United States Patent 7,655,785 (BIOINFORMATICALLY DETECTABLE GROUP OF NOVEL REGULATORY OLIGONUCLEOTIDES AND USES THEREOF) - sequence listing, part 53

SEQ ID NO: 2200203 - RNA, 16 nt, Homo sapiens
aaacuaaccaucugaa

SEQ ID NO: 2200204 - RNA, 15 nt, Homo sapiens
aauaaaucauagcaa

SEQ ID NO: 2200205 - RNA, 16 nt, Homo sapiens
gaugcccuaguuguga

SEQ ID NO: 2200206 - RNA, 18 nt, Homo sapiens
agauaagggugucuuccu

SEQ ID NO: 2200207 - RNA, 17 nt, Homo sapiens
cugagcaaaaugugaac

SEQ ID NO: 2200208 - RNA, 21 nt, Homo sapiens
agugccucuccuggcccugaa

SEQ ID NO: 2200209 - RNA, 13 nt, Homo sapiens
uggguuaauuucu

SEQ ID NO: 2200210 - RNA, 18 nt, Homo sapiens
ugauauuccccauuuccu

SEQ ID NO: 2200211 - RNA, 20 nt, Homo sapiens
gcccacuucccguuuccucu

SEQ ID NO: 2200212 - RNA, 15 nt, Homo sapiens
gcgucaccuccaggc

SEQ ID NO: 2200213 - RNA, 19 nt, Homo sapiens
aacaaggugucuuuuccac

SEQ ID NO: 2200214 - RNA, 21 nt, Homo sapiens
uaccacguuacugcauacuga

SEQ ID NO: 2200215 - RNA, 15 nt, Homo sapiens
guucucucugugcuc

SEQ ID NO: 2200216 - RNA, 21 nt, Homo sapiens
aagccucaggagagagucuaa

SEQ ID NO: 2200217 - RNA, 15 nt, Homo sapiens
aagcaguuaguuccu

SEQ ID NO: 2200218 - RNA, 23 nt, Homo sapiens
agcaugaacuguccuuccauuug

SEQ ID NO: 2200219 - RNA, 19 nt, Homo sapiens
uggacauagcccaagaaca

SEQ ID NO: 2200220 - RNA, 14 nt, Homo sapiens
ccaggcagauccca

SEQ ID NO: 2200221 - RNA, 16 nt, Homo sapiens
uaagaaguuccacuua

SEQ ID NO: 2200222 - RNA, 13 nt, Homo sapiens
uaaguuaggcagu

SEQ ID NO: 2200223 - RNA, 15 nt, Homo sapiens
gcaugaaccuggacc

SEQ ID NO: 2200224 - RNA, 22 nt, Homo sapiens
cccacaauggcugggagggggc

SEQ ID NO: 2200225 - RNA, 13 nt, Homo sapiens
uagucacauauca

SEQ ID NO: 2200226 - RNA, 20 nt, Homo sapiens
auucuggaugggcuuggcca

SEQ ID NO: 2200227 - RNA, 18 nt, Homo sapiens
ucuuccaacccacuggcc

SEQ ID NO: 2200228 - RNA, 20 nt, Homo sapiens
caagaagugggauucaggaa

SEQ ID NO: 2200229 - RNA, 23 nt, Homo sapiens
auuaguaauuuauauagauguca

SEQ ID NO: 2200230 - RNA, 16 nt, Homo sapiens
aggaauucuauaguaa

SEQ ID NO: 2200231 - RNA, 11 nt, Homo sapiens
guguccaugcc

SEQ ID NO: 2200232 - RNA, 20 nt, Homo sapiens
cugaccaauugugcugccau

SEQ ID NO: 2200233 - RNA, 19 nt, Homo sapiens
caaaaagagacccacaaua

SEQ ID NO: 2200234 - RNA, 23 nt, Homo sapiens
caguggggacggaaggcaaagag

SEQ ID NO: 2200235 - RNA, 15 nt, Homo sapiens
acuuguacaccaaug

SEQ ID NO: 2200236 - RNA, 15 nt, Homo sapiens
gagcgccuggugcug

SEQ ID NO: 2200237 - RNA, 16 nt, Homo sapiens
acuugacaagucagga

SEQ ID NO: 2200238 - RNA, 17 nt, Homo sapiens
caaauguuguauuucaa

SEQ ID NO: 2200239 - RNA, 17 nt, Homo sapiens
caagaaggaauugacuu

SEQ ID NO: 2200240 - RNA, 13 nt, Homo sapiens
uccuugcaggcag

SEQ ID NO: 2200241 - RNA, 19 nt, Homo sapiens
gaaaacgguggaggccagg

SEQ ID NO: 2200242 - RNA, 15 nt, Homo sapiens
auucucagcagagug

SEQ ID NO: 2200243 - RNA, 20 nt, Homo sapiens
aagauggauguaaugcacuu

SEQ ID NO: 2200244 - RNA, 15 nt, Homo sapiens
uggacaugagccauu

SEQ ID NO: 2200245 - RNA, 15 nt, Homo sapiens
cuccaagggacaggu

SEQ ID NO: 2200246 - RNA, 22 nt, Homo sapiens
uugggaggcugaggcaggagaa

SEQ ID NO: 2200247 - RNA, 12 nt, Homo sapiens
aaacaggucaau

SEQ ID NO: 2200248 - RNA, 18 nt, Homo sapiens
uuuggggcaagucaugua

SEQ ID NO: 2200249 - RNA, 18 nt, Homo sapiens
auaguaaaaccaaccagc

SEQ ID NO: 2200250 - RNA, 14 nt, Homo sapiens
ccuggauguuauau

SEQ ID NO: 2200251 - RNA, 15 nt, Homo sapiens
cuccccaccacugag

SEQ ID NO: 2200252 - RNA, 17 nt, Homo sapiens
ucaguucuuggugcucu

SEQ ID NO: 2200253 - RNA, 20 nt, Homo sapiens
aauuaaguaaauuacauuaa

SEQ ID NO: 2200254 - RNA, 21 nt, Homo sapiens
uaaauuuucaugaaugugcug

SEQ ID NO: 2200255 - RNA, 22 nt, Homo sapiens
gaugaaggaaggacuaugacaa

SEQ ID NO: 2200256 - RNA, 22 nt, Homo sapiens
acgaacgcucuuagcuuucuca

SEQ ID NO: 2200257 - RNA, 21 nt, Homo sapiens
aguguugcuuuaaauugugcc

SEQ ID NO: 2200258 - RNA, 16 nt, Homo sapiens
guacaaccugugauca

SEQ ID NO: 2200259 - RNA, 13 nt, Homo sapiens
ugagcgacaguga

SEQ ID NO: 2200260 - RNA, 17 nt, Homo sapiens
cuuggugugauugcaca

SEQ ID NO: 2200261 - RNA, 21 nt, Homo sapiens
gaaccugagcuauuuuccucu

SEQ ID NO: 2200262 - RNA, 21 nt, Homo sapiens
aaccugguguuaggugugcaa

SEQ ID NO: 2200263 - RNA, 15 nt, Homo sapiens
guacucguuggaugu

SEQ ID NO: 2200264 - RNA, 22 nt, Homo sapiens
ugccuugaauauuuauucagug

SEQ ID NO: 2200265 - RNA, 21 nt, Homo sapiens
uuauccuguuugaagaaaaag

SEQ ID NO: 2200266 - RNA, 20 nt, Homo sapiens
cauaauucagcacuuaacua

SEQ ID NO: 2200267 - RNA, 19 nt, Homo sapiens
ucgugccacugcacuccag

SEQ ID NO: 2200268 - RNA, 16 nt, Homo sapiens
gaguuguacacccaag

SEQ ID NO: 2200269 - RNA, 18 nt, Homo sapiens
cuccaguuggaugaacau

SEQ ID NO: 2200270 - RNA, 15 nt, Homo sapiens
agccauacuuccagc

SEQ ID NO: 2200271 - RNA, 13 nt, Homo sapiens
uagagaauguguu

SEQ ID NO: 2200272 - RNA, 11 nt, Homo sapiens
cucuacugugg

SEQ ID NO: 2200273 - RNA, 22 nt, Homo sapiens
auagaaugagcacccauuccaa

SEQ ID NO: 2200274 - RNA, 14 nt, Homo sapiens
ccugaaggugccac

SEQ ID NO: 2200275 - RNA, 21 nt, Homo sapiens
gcucccuguguucucuugggg

SEQ ID NO: 2200276 - RNA, 20 nt, Homo sapiens
cucucggccuugggaaggaa

SEQ ID NO: 2200277 - RNA, 12 nt, Homo sapiens
cuaguacuguau

SEQ ID NO: 2200278 - RNA, 17 nt, Homo sapiens
caacaauccuauggaaa

SEQ ID NO: 2200279 - RNA, 12 nt, Homo sapiens
uaugaccaagag

SEQ ID NO: 2200280 - RNA, 12 nt, Homo sapiens
uguaaccaaaaa

SEQ ID NO: 2200281 - RNA, 22 nt, Homo sapiens
cuggcauagcccuccugagcac

SEQ ID NO: 2200282 - RNA, 13 nt, Homo sapiens
uuuucuucaucug

SEQ ID NO: 2200283 - RNA, 23 nt, Homo sapiens
guaacaugaggggacauuuuggu

SEQ ID NO: 2200284 - RNA, 15 nt, Homo sapiens
ccaccaggugucaaa

SEQ ID NO: 2200285 - RNA, 19 nt, Homo sapiens
aagcucuaguucuuaacaa

SEQ ID NO: 2200286 - RNA, 19 nt, Homo sapiens
agacauuucugcacauggu

SEQ ID NO: 2200287 - RNA, 19 nt, Homo sapiens
aagaucuuuuauuuugcca

SEQ ID NO: 2200288 - RNA, 17 nt, Homo sapiens
cacacauggaugagcac

SEQ ID NO: 2200289 - RNA, 19 nt, Homo sapiens
uccccaucuggguccuugc

SEQ ID NO: 2200290 - RNA, 16 nt, Homo sapiens
cgcuggcauguuucac

SEQ ID NO: 2200291 - RNA, 20 nt, Homo sapiens
uuugagugggacaccauucu

SEQ ID NO: 2200292 - RNA, 22 nt, Homo sapiens
aaucacucagugauugcaauuu

SEQ ID NO: 2200293 - RNA, 14 nt, Homo sapiens
gccucaaguuccag

SEQ ID NO: 2200294 - RNA, 21 nt, Homo sapiens
aggugucugcacccaggggug

SEQ ID NO: 2200295 - RNA, 21 nt, Homo sapiens
agucagaaaauuagcaugaaa

SEQ ID NO: 2200296 - RNA, 14 nt, Homo sapiens
ugugucugcaggau

SEQ ID NO: 2200297 - RNA, 14 nt, Homo sapiens
gcaagaaacaguuu

SEQ ID NO: 2200298 - RNA, 19 nt, Homo sapiens
acuggcuccccuucaccuu

SEQ ID NO: 2200299 - RNA, 20 nt, Homo sapiens
aaaaauguauaugcacuuau

SEQ ID NO: 2200300 - RNA, 15 nt, Homo sapiens
cagguuccuccuagg

SEQ ID NO: 2200301 - RNA, 16 nt, Homo sapiens
cuugugaccauuguaa

SEQ ID NO: 2200302 - RNA, 21 nt, Homo sapiens
aaaccugggcaccuaagcaau

SEQ ID NO: 2200303 - RNA, 15 nt, Homo sapiens
gauucugaaucucaa

SEQ ID NO: 2200304 - RNA, 20 nt, Homo sapiens
uaaccuccacaguagcauuu

SEQ ID NO: 2200305 - RNA, 15 nt, Homo sapiens
acagaggagugcagc

SEQ ID NO: 2200306 - RNA, 22 nt, Homo sapiens
aacuuaauacaaaacugugaau

SEQ ID NO: 2200307 - RNA, 22 nt, Homo sapiens
cccuccaagugguccacaagcu

SEQ ID NO: 2200308 - RNA, 21 nt, Homo sapiens
agugagcucgccauucacuga

SEQ ID NO: 2200309 - RNA, 14 nt, Homo sapiens
gaugugaacacauc

SEQ ID NO: 2200310 - RNA, 11 nt, Homo sapiens
uaaagccucaa

SEQ ID NO: 2200311 - RNA, 22 nt, Homo sapiens
cuuuguggauggugucuccuuu

SEQ ID NO: 2200312 - RNA, 23 nt, Homo sapiens
acuguagaccuuucucccuccuu

SEQ ID NO: 2200313 - RNA, 13 nt, Homo sapiens
uauuaaauaugaa

SEQ ID NO: 2200314 - RNA, 20 nt, Homo sapiens
aaucugugccugcacugaga

SEQ ID NO: 2200315 - RNA, 21 nt, Homo sapiens
cgcacuugauggucaggaagu

SEQ ID NO: 2200316 - RNA, 22 nt, Homo sapiens
aucugaggaaggugcuugccug

SEQ ID NO: 2200317 - RNA, 15 nt, Homo sapiens
cuuuguaaacuucca

SEQ ID NO: 2200318 - RNA, 15 nt, Homo sapiens
uuucaguuucuauca

SEQ ID NO: 2200319 - RNA, 22 nt, Homo sapiens
uaccauguuaauacaucauuuu

SEQ ID NO: 2200320 - RNA, 16 nt, Homo sapiens
gcagcuggcccacugc

SEQ ID NO: 2200321 - RNA, 16 nt, Homo sapiens
ccucuggacaagucau

SEQ ID NO: 2200322 - RNA, 16 nt, Homo sapiens
auugacugauggugaa

SEQ ID NO: 2200323 - RNA, 22 nt, Homo sapiens
cagagccucguuucugcuuuca

SEQ ID NO: 2200324 - RNA, 20 nt, Homo sapiens
ucuuaauuuggaaacuaaua

SEQ ID NO: 2200325 - RNA, 15 nt, Homo sapiens
aaucuccaacuuuau

SEQ ID NO: 2200326 - RNA, 22 nt, Homo sapiens
auauguugauuucuuguaacau

SEQ ID NO: 2200327 - RNA, 17 nt, Homo sapiens
ugcuagggaaacuuccc

SEQ ID NO: 2200328 - RNA, 16 nt, Homo sapiens
gccaaguggggugcug

SEQ ID NO: 2200329 - RNA, 14 nt, Homo sapiens
ggaccucaguuuua

SEQ ID NO: 2200330 - RNA, 19 nt, Homo sapiens
ugugccuuaggaaaagcau

SEQ ID NO: 2200331 - RNA, 15 nt, Homo sapiens
cuuggguaauuaaaa

SEQ ID NO: 2200332 - RNA, 22 nt, Homo sapiens
uaagacacacuccccacuucac

SEQ ID NO: 2200333 - RNA, 13 nt, Homo sapiens
gacaagcuguaua

SEQ ID NO: 2200334 - RNA, 13 nt, Homo sapiens
ugcuguaccacaa

SEQ ID NO: 2200335 - RNA, 17 nt, Homo sapiens
uggaaagagguucugca

SEQ ID NO: 2200336 - RNA, 16 nt, Homo sapiens
ccaccugcagccuguu

SEQ ID NO: 2200337 - RNA, 21 nt, Homo sapiens
auauuaaaauaagcacugugc

SEQ ID NO: 2200338 - RNA, 22 nt, Homo sapiens
ggccucugccugggacacugcg

SEQ ID NO: 2200339 - RNA, 21 nt, Homo sapiens
aggucaagcuauuucucugga

SEQ ID NO: 2200340 - RNA, 18 nt, Homo sapiens
ccauauucagcauuugau

SEQ ID NO: 2200341 - RNA, 20 nt, Homo sapiens
aaggcagggcaagaacagaa

SEQ ID NO: 2200342 - RNA, 16 nt, Homo sapiens
acacacggaggcaucc

SEQ ID NO: 2200343 - RNA, 18 nt, Homo sapiens
uccccggcucaagugauc

SEQ ID NO: 2200344 - RNA, 14 nt, Homo sapiens
agccaccguguccu

SEQ ID NO: 2200345 - RNA, 15 nt, Homo sapiens
agcugucgcaucuca

SEQ ID NO: 2200346 - RNA, 21 nt, Homo sapiens
cugaagcugacagcacuacaa

SEQ ID NO: 2200347 - RNA, 15 nt, Homo sapiens
gaagggggcugugug

SEQ ID NO: 2200348 - RNA, 17 nt, Homo sapiens
cgucagccacaccuguc

SEQ ID NO: 2200349 - RNA, 20 nt, Homo sapiens
acccuuccugaaacuucaga

SEQ ID NO: 2200350 - RNA, 17 nt, Homo sapiens
augugugacuccagccu

SEQ ID NO: 2200351 - RNA, 11 nt, Homo sapiens
aacuaccuccu

SEQ ID NO: 2200352 - RNA, 13 nt, Homo sapiens
gugcucuccuaga

SEQ ID NO: 2200353 - RNA, 13 nt, Homo sapiens
guacucuccugga

SEQ ID NO: 2200354 - RNA, 19 nt, Homo sapiens
uguccugugagguuuccca

SEQ ID NO: 2200355 - RNA, 24 nt, Homo sapiens
cggccuguaacauaucuguaaaua

SEQ ID NO: 2200356 - RNA, 21 nt, Homo sapiens
agcaccugauucucacagcaa

SEQ ID NO: 2200357 - RNA, 20 nt, Homo sapiens
aaagugcaugucacaugcca

SEQ ID NO: 2200358 - RNA, 19 nt, Homo sapiens
aaucauuucuagauuauaa

SEQ ID NO: 2200359 - RNA, 19 nt, Homo sapiens
aagaugacggaugccuaga

SEQ ID NO: 2200360 - RNA, 20 nt, Homo sapiens
uagaaacucaggauggucau

SEQ ID NO: 2200361 - RNA, 16 nt, Homo sapiens
agccucugaucugugc

SEQ ID NO: 2200362 - RNA, 14 nt, Homo sapiens
acagccuuugccca

SEQ ID NO: 2200363 - RNA, 18 nt, Homo sapiens
uucacauaaaaccucauu

SEQ ID NO: 2200364 - RNA, 23 nt, Homo sapiens
acaaauuuuguauaacuuuugau

SEQ ID NO: 2200365 - RNA, 13 nt, Homo sapiens
agugccagguggc

SEQ ID NO: 2200366 - RNA, 15 nt, Homo sapiens
gaguucuagaccucu

SEQ ID NO: 2200367 - RNA, 14 nt, Homo sapiens
gcaaugcauucugg

SEQ ID NO: 2200368 - RNA, 15 nt, Homo sapiens
gaacaacaacaaaau

SEQ ID NO: 2200369 - RNA, 15 nt, Homo sapiens
aaugacaaugaugau

SEQ ID NO: 2200370 - RNA, 20 nt, Homo sapiens
gguacuauuuagauauaaca

SEQ ID NO: 2200371 - RNA, 16 nt, Homo sapiens
uguauagcuuaccuga

SEQ ID NO: 2200372 - RNA, 17 nt, Homo sapiens
gagagcaaagugaccug

SEQ ID NO: 2200373 - RNA, 16 nt, Homo sapiens
uaauguuuauuguuca

SEQ ID NO: 2200374 - RNA, 22 nt, Homo sapiens
gggaaggaggccguccaucccg

SEQ ID NO: 2200375 - RNA, 14 nt, Homo sapiens
gcugccccauggcu

SEQ ID NO: 2200376 - RNA, 15 nt, Homo sapiens
aaccuuuuccucacc

SEQ ID NO: 2200377 - RNA, 21 nt, Homo sapiens
accagugauccauguccugaa

SEQ ID NO: 2200378 - RNA, 20 nt, Homo sapiens
gauccccaaaacaggccagg

SEQ ID NO: 2200379 - RNA, 17 nt, Homo sapiens
auuuacaaagcaaaaag

SEQ ID NO: 2200380 - RNA, 14 nt, Homo sapiens
gcucugcaugugug

SEQ ID NO: 2200381 - RNA, 13 nt, Homo sapiens
cugguuucuacca

SEQ ID NO: 2200382 - RNA, 20 nt, Homo sapiens
augguuugugucaaaacugg

SEQ ID NO: 2200383 - RNA, 20 nt, Homo sapiens
ccaaccuguaauaaauauga

SEQ ID NO: 2200384 - RNA, 12 nt, Homo sapiens
gugcacauguac

SEQ ID NO: 2200385 - RNA, 21 nt, Homo sapiens
uguuuugcuuuuguaacuuga

SEQ ID NO: 2200386 - RNA, 22 nt, Homo sapiens
cucagggaucucagaccuagug

SEQ ID NO: 2200387 - RNA, 14 nt, Homo sapiens
cuaaauaacuguau

SEQ ID NO: 2200388 - RNA, 14 nt, Homo sapiens
cagaaaaacaauaa

SEQ ID NO: 2200389 - RNA, 12 nt, Homo sapiens
caagucaggaca

SEQ ID NO: 2200390 - RNA, 14 nt, Homo sapiens
gauggguccucacg

SEQ ID NO: 2200391 - RNA, 16 nt, Homo sapiens
uggaccuggggucccc

SEQ ID NO: 2200392 - RNA, 22 nt, Homo sapiens
aagagauguccuuguaauauuc

SEQ ID NO: 2200393 - RNA, 13 nt, Homo sapiens
acuuagacaguau

SEQ ID NO: 2200394 - RNA, 14 nt, Homo sapiens
gcagccaacccggc

SEQ ID NO: 2200395 - RNA, 16 nt, Homo sapiens
gauggugcugaccucu

SEQ ID NO: 2200396 - RNA, 14 nt, Homo sapiens
aagucaaagacauu

SEQ ID NO: 2200397 - RNA, 22 nt, Homo sapiens
ccuguguccacugagacuuucc

SEQ ID NO: 2200398 - RNA, 15 nt, Homo sapiens
caacuggaagcuuug

SEQ ID NO: 2200399 - RNA, 16 nt, Homo sapiens
auuugauaaacugaau

SEQ ID NO: 2200400 - RNA, 17 nt, Homo sapiens
ccucucaucaguguccu

SEQ ID NO: 2200401 - RNA, 23 nt, Homo sapiens
ggcuucccucucugaaauagccg

SEQ ID NO: 2200402 - RNA, 17 nt, Homo sapiens
ccaucuaucacugcauu

SEQ ID NO: 2200403 - RNA, 15 nt, Homo sapiens
acuuccuuaacagcu

SEQ ID NO: 2200404 - RNA, 14 nt, Homo sapiens
ggauauuuauuuaa

SEQ ID NO: 2200405 - RNA, 13 nt, Homo sapiens
agaucaacuggaa

SEQ ID NO: 2200406 - RNA, 19 nt, Homo sapiens
agccaaccaagagcacauu

SEQ ID NO: 2200407 - RNA, 16 nt, Homo sapiens
aucccagcccacaucu

SEQ ID NO: 2200408 - RNA, 20 nt, Homo sapiens
agcuggagugaagugguaca

SEQ ID NO: 2200409 - RNA, 15 nt, Homo sapiens
aaucccucucacaag

SEQ ID NO: 2200410 - RNA, 19 nt, Homo sapiens
aaaguugccuuuauuugcu

SEQ ID NO: 2200411 - RNA, 14 nt, Homo sapiens
uaucugagauuaca

SEQ ID NO: 2200412 - RNA, 21 nt, Homo sapiens
ggucuccuuggcugucugugg

SEQ ID NO: 2200413 - RNA, 17 nt, Homo sapiens
cagguuauaacaguguu

SEQ ID NO: 2200414 - RNA, 22 nt, Homo sapiens
gcaaauauuuugucacugcugu

SEQ ID NO: 2200415 - RNA, 18 nt, Homo sapiens
uucaggaaaaaugcuuuu

SEQ ID NO: 2200416 - RNA, 20 nt, Homo sapiens
gacagguggcaacaaugccc

SEQ ID NO: 2200417 - RNA, 17 nt, Homo sapiens
caaaugguguccaaaga

SEQ ID NO: 2200418 - RNA, 16 nt, Homo sapiens
uaaauauuauuugaug

SEQ ID NO: 2200419 - RNA, 17 nt, Homo sapiens
uuuagacaagacugucu

SEQ ID NO: 2200420 - RNA, 15 nt, Homo sapiens
cuuccccagguccuu

SEQ ID NO: 2200421 - RNA, 21 nt, Homo sapiens
uaugcuguuauguccagaaau

SEQ ID NO: 2200422 - RNA, 17 nt, Homo sapiens
agcacuuucauugccag

SEQ ID NO: 2200423 - RNA, 14 nt, Homo sapiens
cauuuucagauuca

SEQ ID NO: 2200424 - RNA, 19 nt, Homo sapiens
uaacuuuguaagcuuguau

SEQ ID NO: 2200425 - RNA, 10 nt, Homo sapiens
augacacugu

SEQ ID NO: 2200426 - RNA, 13 nt, Homo sapiens
aucuccccaaaaa

SEQ ID NO: 2200427 - RNA, 21 nt, Homo sapiens
auguaauggaacuuagccauu

SEQ ID NO: 2200428 - RNA, 22 nt, Homo sapiens
cagccacuucggccaggucaca

SEQ ID NO: 2200429 - RNA, 20 nt, Homo sapiens
aguccagaaaucauacugca

SEQ ID NO: 2200430 - RNA, 21 nt, Homo sapiens
gggaacagcagcagugccaua

SEQ ID NO: 2200431 - RNA, 20 nt, Homo sapiens
uauuuccuaguucauuugac

SEQ ID NO: 2200432 - RNA, 18 nt, Homo sapiens
aagaccccagcuucauua

SEQ ID NO: 2200433 - RNA, 13 nt, Homo sapiens
auuugcaaaauca

SEQ ID NO: 2200434 - RNA, 11 nt, Homo sapiens
auccugugucc

SEQ ID NO: 2200435 - RNA, 15 nt, Homo sapiens
uguccuuucuugcag

SEQ ID NO: 2200436 - RNA, 22 nt, Homo sapiens
cuguaucuuugacaauucuggg

SEQ ID NO: 2200437 - RNA, 19 nt, Homo sapiens
augaagauaaguaauuuac

SEQ ID NO: 2200438 - RNA, 20 nt, Homo sapiens
uugcuugccuuccucccuuc

SEQ ID NO: 2200439 - RNA, 12 nt, Homo sapiens
ugucacacaaaa

SEQ ID NO: 2200440 - RNA, 17 nt, Homo sapiens
ugagcagugagcacuga

SEQ ID NO: 2200441 - RNA, 21 nt, Homo sapiens
cuuauuguauuccucauguca

SEQ ID NO: 2200442 - RNA, 22 nt, Homo sapiens
ucugcacaguguucccauggcc

SEQ ID NO: 2200443 - RNA, 20 nt, Homo sapiens
acaaaccuuaaaacagcugu

SEQ ID NO: 2200444 - RNA, 20 nt, Homo sapiens
gaccccucaccuugcaacac

SEQ ID NO: 2200445 - RNA, 18 nt, Homo sapiens
agacaggaacccuugcau

SEQ ID NO: 2200446 - RNA, 15 nt, Homo sapiens
aagaucuauauugua

SEQ ID NO: 2200447 - RNA, 19 nt, Homo sapiens
uuuaucaaagagcacuuga

SEQ ID NO: 2200448 - RNA, 13 nt, Homo sapiens
agcuuaaugucuu

SEQ ID NO: 2200449 - RNA, 15 nt, Homo sapiens
cauagccaauggaca

SEQ ID NO: 2200450 - RNA, 22 nt, Homo sapiens
ugcaaaauaaguuuuucuuuaa

SEQ ID NO: 2200451 - RNA, 16 nt, Homo sapiens
agucucacuguugccc

SEQ ID NO: 2200452 - RNA, 19 nt, Homo sapiens
ugcugccagcuucagguga

SEQ ID NO: 2200453 - RNA, 17 nt, Homo sapiens
cucuaaugugucucuca

SEQ ID NO: 2200454 - RNA, 22 nt, Homo sapiens
uagugccgcaauaaaugcucaa

SEQ ID NO: 2200455 - RNA, 14 nt, Homo sapiens
ugguggccaaagau

SEQ ID NO: 2200456 - RNA, 14 nt, Homo sapiens
ccugccagggugag

SEQ ID NO: 2200457 - RNA, 19 nt, Homo sapiens
guuuugaaaaaauuacuca

SEQ ID NO: 2200458 - RNA, 19 nt, Homo sapiens
accuagagcuagauguguc

SEQ ID NO: 2200459 - RNA, 19 nt, Homo sapiens
ucuauuuuauuaugagcuu

SEQ ID NO: 2200460 - RNA, 20 nt, Homo sapiens
ggacagaugaaugccgugga

SEQ ID NO: 2200461 - RNA, 15 nt, Homo sapiens
aauuucagcuucaua

SEQ ID NO: 2200462 - RNA, 22 nt, Homo sapiens
uggacaaaauggaauacucuua

SEQ ID NO: 2200463 - RNA, 17 nt, Homo sapiens
uuauaaauaugugaaaa

SEQ ID NO: 2200464 - RNA, 17 nt, Homo sapiens
cauggcauauuuuucac

SEQ ID NO: 2200465 - RNA, 17 nt, Homo sapiens
agcucuggaugaaggca

SEQ ID NO: 2200466 - RNA, 22 nt, Homo sapiens
cugggggaggggacauugaaca

SEQ ID NO: 2200467 - RNA, 15 nt, Homo sapiens
aggauuaaacacaca

SEQ ID NO: 2200468 - RNA, 21 nt, Homo sapiens
agauagucucauucugucacc

SEQ ID NO: 2200469 - RNA, 21 nt, Homo sapiens
ugaacagcaggaugcccuguu

SEQ ID NO: 2200470 - RNA, 15 nt, Homo sapiens
uagggaugacuguga

SEQ ID NO: 2200471 - RNA, 21 nt, Homo sapiens
accauucccugccuugcugac

SEQ ID NO: 2200472 - RNA, 21 nt, Homo sapiens
ggccuguuugccgucugugac

SEQ ID NO: 2200473 - RNA, 16 nt, Homo sapiens
caaugccuuguuguau

SEQ ID NO: 2200474 - RNA, 17 nt, Homo sapiens
aaugauaaguacuacau

SEQ ID NO: 2200475 - RNA, 18 nt, Homo sapiens
cauuaagcccucuuccau

SEQ ID NO: 2200476 - RNA, 16 nt, Homo sapiens
cucagaaccugcuccu

SEQ ID NO: 2200477 - RNA, 15 nt, Homo sapiens
uaugcaucugcuacu

SEQ ID NO: 2200478 - RNA, 16 nt, Homo sapiens
aucuauuuccuuucca

SEQ ID NO: 2200479 - RNA, 20 nt, Homo sapiens
aaaacauagaguagaccuga

SEQ ID NO: 2200480 - RNA, 16 nt, Homo sapiens
uacagauuuaagaaua

SEQ ID NO: 2200481 - RNA, 20 nt, Homo sapiens
acaaauggcuuguucaguca

SEQ ID NO: 2200482 - RNA, 12 nt, Homo sapiens
uagccagcauuu

SEQ ID NO: 2200483 - RNA, 14 nt, Homo sapiens
cuuccaaagaaugu

SEQ ID NO: 2200484 - RNA, 16 nt, Homo sapiens
cuuagugacaaaauag

SEQ ID NO: 2200485 - RNA, 24 nt, Homo sapiens
cacgggaaagccgccgaccuguga

SEQ ID NO: 2200486 - RNA, 16 nt, Homo sapiens
acguuugcucauuuaa

SEQ ID NO: 2200487 - RNA, 11 nt, Homo sapiens
gcauccuaguc

SEQ ID NO: 2200488 - RNA, 21 nt, Homo sapiens
aaagacauucuuccaaaaaga

SEQ ID NO: 2200489 - RNA, 18 nt, Homo sapiens
uacugaaaaaaauggagu

SEQ ID NO: 2200490 - RNA, 14 nt, Homo sapiens
gucucuggggaccc

SEQ ID NO: 2200491 - RNA, 18 nt, Homo sapiens
auuuacagccucacuuga

SEQ ID NO: 2200492 - RNA, 17 nt, Homo sapiens
uucaaugccccugaauu

SEQ ID NO: 2200493 - RNA, 19 nt, Homo sapiens
cagucucuuucuguacaag

SEQ ID NO: 2200494 - RNA, 16 nt, Homo sapiens
gcagagugaaauucaa

SEQ ID NO: 2200495 - RNA, 15 nt, Homo sapiens
aauuuuaguauucau

SEQ ID NO: 2200496 - RNA, 17 nt, Homo sapiens
gaaaagggaacugaaca

SEQ ID NO: 2200497 - RNA, 20 nt, Homo sapiens
ggccuagacuuguguguucu

SEQ ID NO: 2200498 - RNA, 19 nt, Homo sapiens
acacugaaaaauauuccaa

SEQ ID NO: 2200499 - RNA, 13 nt, Homo sapiens
aagcagccauaaa

SEQ ID NO: 2200500 - RNA, 18 nt, Homo sapiens
uggucacuucuucugucc

SEQ ID NO: 2200501 - RNA, 16 nt, Homo sapiens
cauguguuugcauaaa

SEQ ID NO: 2200502 - RNA, 14 nt, Homo sapiens
ggucuugagugcau

SEQ ID NO: 2200503 - RNA, 12 nt, Homo sapiens
ggcacaggccag

SEQ ID NO: 2200504 - RNA, 19 nt, Homo sapiens
caggagcagcugugcugca

SEQ ID NO: 2200505 - RNA, 15 nt, Homo sapiens
guuauuuucauucaa

SEQ ID NO: 2200506 - RNA, 16 nt, Homo sapiens
gauucugaaaccacag

SEQ ID NO: 2200507 - RNA, 14 nt, Homo sapiens
acuagugcagggua

SEQ ID NO: 2200508 - RNA, 21 nt, Homo sapiens
accaaggaccccucaccuugc

SEQ ID NO: 2200509 - RNA, 19 nt, Homo sapiens
ugaguagaaaggccuuuaa

SEQ ID NO: 2200510 - RNA, 13 nt, Homo sapiens
cagggcucugcag

SEQ ID NO: 2200511 - RNA, 21 nt, Homo sapiens
uuucucaagaauaagucccuu

SEQ ID NO: 2200512 - RNA, 15 nt, Homo sapiens
gucggaaaacaugcu

SEQ ID NO: 2200513 - RNA, 15 nt, Homo sapiens
uguuaaucacauucc

SEQ ID NO: 2200514 - RNA, 14 nt, Homo sapiens
gauuaaccucugca

SEQ ID NO: 2200515 - RNA, 24 nt, Homo sapiens
caagcucaaugaugcaggcaauaa

SEQ ID NO: 2200516 - RNA, 14 nt, Homo sapiens
cucccuucuugggu

SEQ ID NO: 2200517 - RNA, 13 nt, Homo sapiens
uaggaaacuugaa

SEQ ID NO: 2200518 - RNA, 18 nt, Homo sapiens
ccacagagagaggggaga

SEQ ID NO: 2200519 - RNA, 13 nt, Homo sapiens
uggcauccucaca

SEQ ID NO: 2200520 - RNA, 16 nt, Homo sapiens
acuccugaaaccucuu

SEQ ID NO: 2200521 - RNA, 20 nt, Homo sapiens
cauuaaacuucuacugagca

SEQ ID NO: 2200522 - RNA, 12 nt, Homo sapiens
aaguagcaauuu

SEQ ID NO: 2200523 - RNA, 18 nt, Homo sapiens
uguuccccagcugaucau

SEQ ID NO: 2200524 - RNA, 18 nt, Homo sapiens
cauuauguaucuuaguua

SEQ ID NO: 2200525 - RNA, 17 nt, Homo sapiens
gaugucacaucuuggca

SEQ ID NO: 2200526 - RNA, 18 nt, Homo sapiens
aacucuuggccucugcuu

SEQ ID NO: 2200527 - RNA, 17 nt, Homo sapiens
gcagucagcaugaaucc

SEQ ID NO: 2200528 - RNA, 18 nt, Homo sapiens
caacaacuuaaugugcug

SEQ ID NO: 2200529 - RNA, 22 nt, Homo sapiens
cacucugagcccccugaccuuc

SEQ ID NO: 2200530 - RNA, 13 nt, Homo sapiens
uaguuuuuggacu

SEQ ID NO: 2200531 - RNA, 12 nt, Homo sapiens
ccagaaggggag

SEQ ID NO: 2200532 - RNA, 15 nt, Homo sapiens
acagcaacacucuac

SEQ ID NO: 2200533 - RNA, 21 nt, Homo sapiens
cugugguuucucguacuuuca

SEQ ID NO: 2200534 - RNA, 17 nt, Homo sapiens
cucaaaaacaaagagua

SEQ ID NO: 2200535 - RNA, 22 nt, Homo sapiens
uauuguccccuaaaccaaaaac

SEQ ID NO: 2200536 - RNA, 17 nt, Homo sapiens
uauuuuacugaucucuu

SEQ ID NO: 2200537 - RNA, 17 nt, Homo sapiens
uggaaaaucagcugcuc

SEQ ID NO: 2200538 - RNA, 15 nt, Homo sapiens
cacaugcuuuagcca

SEQ ID NO: 2200539 - RNA, 23 nt, Homo sapiens
aggacucagaagccucuggguca

SEQ ID NO: 2200540 - RNA, 14 nt, Homo sapiens
cagagcaagacugu

SEQ ID NO: 2200541 - RNA, 13 nt, Homo sapiens
gcuccaccccagg

SEQ ID NO: 2200542 - RNA, 14 nt, Homo sapiens
auaccuaaacugua

SEQ ID NO: 2200543 - RNA, 20 nt, Homo sapiens
acuuaaaccugugcuuucau

SEQ ID NO: 2200544 - RNA, 19 nt, Homo sapiens
caaaaaaaaaaauuacauu

SEQ ID NO: 2200545 - RNA, 20 nt, Homo sapiens
cuacuccuuguaaagacugu

SEQ ID NO: 2200546 - RNA, 13 nt, Homo sapiens
cuuaauugugauu

SEQ ID NO: 2200547 - RNA, 17 nt, Homo sapiens
ggauuguuaauguuugc

SEQ ID NO: 2200548 - RNA, 18 nt, Homo sapiens
aguucccuagucuauuca

SEQ ID NO: 2200549 - RNA, 13 nt, Homo sapiens
gaacugacgcugg

SEQ ID NO: 2200550 - RNA, 14 nt, Homo sapiens
uccagguucacuuu

SEQ ID NO: 2200551 - RNA, 19 nt, Homo sapiens
auaaaucguaaccuaugaa

SEQ ID NO: 2200552 - RNA, 11 nt, Homo sapiens
gguucucaggc

SEQ ID NO: 2200553 - RNA, 20 nt, Homo sapiens
gaaccacggaggaugaugcc

SEQ ID NO: 2200554 - RNA, 14 nt, Homo sapiens
ucgucaucuucccu

SEQ ID NO: 2200555 - RNA, 17 nt, Homo sapiens
uucuucacuugcaggca

SEQ ID NO: 2200556 - RNA, 22 nt, Homo sapiens
ugcuuuauuuucccuacuugca

SEQ ID NO: 2200557 - RNA, 13 nt, Homo sapiens
uccuccagggacu

SEQ ID NO: 2200558 - RNA, 16 nt, Homo sapiens
aaugccgcgauggguc

SEQ ID NO: 2200559 - RNA, 21 nt, Homo sapiens
ugguaaauaacugugacugug

SEQ ID NO: 2200560 - RNA, 22 nt, Homo sapiens
caggcucucugguguucagggu

SEQ ID NO: 2200561 - RNA, 17 nt, Homo sapiens
uccagcucucaguuaca

SEQ ID NO: 2200562 - RNA, 12 nt, Homo sapiens
uucuguugccaa

SEQ ID NO: 2200563 - RNA, 20 nt, Homo sapiens
cuccuucacucccugucaua

SEQ ID NO: 2200564 - RNA, 13 nt, Homo sapiens
aauaaccaaacau

SEQ ID NO: 2200565 - RNA, 16 nt, Homo sapiens
uguucuggaagccaua

SEQ ID NO: 2200566 - RNA, 14 nt, Homo sapiens
ucuauaacacauca

SEQ ID NO: 2200567 - RNA, 19 nt, Homo sapiens
cugaauuggcuaugcagua

SEQ ID NO: 2200568 - RNA, 20 nt, Homo sapiens
uaucgucaggaaaccaaaua

SEQ ID NO: 2200569 - RNA, 17 nt, Homo sapiens
guagacugaaaagccau

SEQ ID NO: 2200570 - RNA, 13 nt, Homo sapiens
uccucuauuuccu

SEQ ID NO: 2200571 - RNA, 20 nt, Homo sapiens
agccaggaaauagcggugaa

SEQ ID NO: 2200572 - RNA, 14 nt, Homo sapiens
guuuggccaaaaag

SEQ ID NO: 2200573 - RNA, 16 nt, Homo sapiens
cauuuuauucuuuaag

SEQ ID NO: 2200574 - RNA, 22 nt, Homo sapiens
aaaguuuguucugcagagacuu

SEQ ID NO: 2200575 - RNA, 19 nt, Homo sapiens
gaccuuuaagagaaaugag

SEQ ID NO: 2200576 - RNA, 15 nt, Homo sapiens
ugcaguuucuaagca

SEQ ID NO: 2200577 - RNA, 16 nt, Homo sapiens
ggaucacaagauggaa

SEQ ID NO: 2200578 - RNA, 17 nt, Homo sapiens
auggcuggccacugcac

SEQ ID NO: 2200579 - RNA, 14 nt, Homo sapiens
gcacacacaugcau

SEQ ID NO: 2200580 - RNA, 15 nt, Homo sapiens
auauuauuugcagau

SEQ ID NO: 2200581 - RNA, 14 nt, Homo sapiens
gacaccaccacugu

SEQ ID NO: 2200582 - RNA, 13 nt, Homo sapiens
cagcaacaggaau

SEQ ID NO: 2200583 - RNA, 21 nt, Homo sapiens
ccaccgcauaugcaugccagg

SEQ ID NO: 2200584 - RNA, 20 nt, Homo sapiens
guuuacaggaaagaugcauu

SEQ ID NO: 2200585 - RNA, 18 nt, Homo sapiens
ccagacaccaugugcaau

SEQ ID NO: 2200586 - RNA, 13 nt, Homo sapiens
uguuuucauggac

SEQ ID NO: 2200587 - RNA, 19 nt, Homo sapiens
guguuucuauugacuucaa

SEQ ID NO: 2200588 - RNA, 20 nt, Homo sapiens
ggugggcuucccaguggcug

SEQ ID NO: 2200589 - RNA, 16 nt, Homo sapiens
uuuugacuucagauug

SEQ ID NO: 2200590 - RNA, 15 nt, Homo sapiens
cccuugagaagccaa

SEQ ID NO: 2200591 - RNA, 21 nt, Homo sapiens
gccacugcgcccggcccaaga

SEQ ID NO: 2200592 - RNA, 20 nt, Homo sapiens
gucacaugaaacauuugcaa

SEQ ID NO: 2200593 - RNA, 21 nt, Homo sapiens
cccuccaaaggucugaugucu

SEQ ID NO: 2200594 - RNA, 18 nt, Homo sapiens
ucacaauggaaaaccugg

SEQ ID NO: 2200595 - RNA, 22 nt, Homo sapiens
acaugaauuuuaaauaauguau

SEQ ID NO: 2200596 - RNA, 13 nt, Homo sapiens
aaaaaucacucac

SEQ ID NO: 2200597 - RNA, 13 nt, Homo sapiens
ggaguagugucac

SEQ ID NO: 2200598 - RNA, 11 nt, Homo sapiens
uugugcucagu

SEQ ID NO: 2200599 - RNA, 20 nt, Homo sapiens
cacaccauucauucugguca

SEQ ID NO: 2200600 - RNA, 21 nt, Homo sapiens
auggucacacaccagcacuuu

SEQ ID NO: 2200601 - RNA, 21 nt, Homo sapiens
aaauaaugcauccagcaguac

SEQ ID NO: 2200602 - RNA, 18 nt, Homo sapiens
uggagaaacaggcccaga

SEQ ID NO: 2200603 - RNA, 21 nt, Homo sapiens
uccugaaguuugcauuaauaa

SEQ ID NO: 2200604 - RNA, 18 nt, Homo sapiens
augucucagccuccucag

SEQ ID NO: 2200605 - RNA, 15 nt, Homo sapiens
cugauuuaaacacau

SEQ ID NO: 2200606 - RNA, 15 nt, Homo sapiens
aacaguaucuuugca

SEQ ID NO: 2200607 - RNA, 15 nt, Homo sapiens
uuauaaccuggcaaa

SEQ ID NO: 2200608 - RNA, 18 nt, Homo sapiens
gagugggccgcuguguuu

SEQ ID NO: 2200609 - RNA, 15 nt, Homo sapiens
ugaucuacuugccuc

SEQ ID NO: 2200610 - RNA, 20 nt, Homo sapiens
aauauaaacaggaucucaaa

SEQ ID NO: 2200611 - RNA, 18 nt, Homo sapiens
ccuacagggaacugggaa

SEQ ID NO: 2200612 - RNA, 14 nt, Homo sapiens
ugaccguguacaau

SEQ ID NO: 2200613 - RNA, 14 nt, Homo sapiens
agaaugcuuugcca

SEQ ID NO: 2200614 - RNA, 21 nt, Homo sapiens
ugcccaacugccugccuuagg

SEQ ID NO: 2200615 - RNA, 14 nt, Homo sapiens
gaguuuucaaagau

SEQ ID NO: 2200616 - RNA, 20 nt, Homo sapiens
ggacucauauauuuaagccu

SEQ ID NO: 2200617 - RNA, 18 nt, Homo sapiens
gagggugauggaacaaga

SEQ ID NO: 2200618 - RNA, 19 nt, Homo sapiens
uaauucauuugguucaaau

SEQ ID NO: 2200619 - RNA, 14 nt, Homo sapiens
uucagugcaguuuc

SEQ ID NO: 2200620 - RNA, 16 nt, Homo sapiens
ucacuucuaaaccaaa

SEQ ID NO: 2200621 - RNA, 15 nt, Homo sapiens
ugaaaguuuucuaaa

SEQ ID NO: 2200622 - RNA, 21 nt, Homo sapiens
aacccagcaguucucugccaa

SEQ ID NO: 2200623 - RNA, 20 nt, Homo sapiens
auauccaggcuuaccaaagu

SEQ ID NO: 2200624 - RNA, 20 nt, Homo sapiens
augcuuugagaccagaagaa

SEQ ID NO: 2200625 - RNA, 15 nt, Homo sapiens
uuaaauguauagcug

SEQ ID NO: 2200626 - RNA, 18 nt, Homo sapiens
auggguccacugcaccag

SEQ ID NO: 2200627 - RNA, 16 nt, Homo sapiens
agguggaacucaguca

SEQ ID NO: 2200628 - RNA, 22 nt, Homo sapiens
cucucucuuuucuacacacuca

SEQ ID NO: 2200629 - RNA, 21 nt, Homo sapiens
aacuggcuauccuuggggaag

SEQ ID NO: 2200630 - RNA, 20 nt, Homo sapiens
gaaugaaugucagugugacu

SEQ ID NO: 2200631 - RNA, 17 nt, Homo sapiens
gcuuccuaaacuuucaa

SEQ ID NO: 2200632 - RNA, 15 nt, Homo sapiens
gguugugcagggugu

SEQ ID NO: 2200633 - RNA, 16 nt, Homo sapiens
cucaugugugcucaca

SEQ ID NO: 2200634 - RNA, 19 nt, Homo sapiens
auacaauauaucuugucua

SEQ ID NO: 2200635 - RNA, 16 nt, Homo sapiens
cugucuugugagcuga

SEQ ID NO: 2200636 - RNA, 17 nt, Homo sapiens
cuaaugugaaaaucauc

SEQ ID NO: 2200637 - RNA, 18 nt, Homo sapiens
aagauaguugauucuugc

SEQ ID NO: 2200638 - RNA, 16 nt, Homo sapiens
gugggucccacuuccc

SEQ ID NO: 2200639 - RNA, 16 nt, Homo sapiens
gucuccuggucugugc

SEQ ID NO: 2200640 - RNA, 20 nt, Homo sapiens
acauguuuaaauagccuaaa

SEQ ID NO: 2200641 - RNA, 22 nt, Homo sapiens
ggcggcccuucugacuguuuau

SEQ ID NO: 2200642 - RNA, 21 nt, Homo sapiens
cagacauuuuuuaggggaaua

SEQ ID NO: 2200643 - RNA, 13 nt, Homo sapiens
auguguuccaagg

SEQ ID NO: 2200644 - RNA, 17 nt, Homo sapiens
ugcagaaacaguucacc

SEQ ID NO: 2200645 - RNA, 15 nt, Homo sapiens
aacuggauacuguac

SEQ ID NO: 2200646 - RNA, 15 nt, Homo sapiens
auagcagcuuuagcc

SEQ ID NO: 2200647 - RNA, 17 nt, Homo sapiens
agacaucaccaacuguc

SEQ ID NO: 2200648 - RNA, 20 nt, Homo sapiens
ucucaugccucagccucuca

SEQ ID NO: 2200649 - RNA, 17 nt, Homo sapiens
aauuuaaaauaugcucu

SEQ ID NO: 2200650 - RNA, 16 nt, Homo sapiens
auuagaggauugcacu

SEQ ID NO: 2200651 - RNA, 20 nt, Homo sapiens
auucccccaucuucauccca

SEQ ID NO: 2200652 - RNA, 15 nt, Homo sapiens
cccuacucuguguaa

SEQ ID NO: 2200653 - RNA, 21 nt, Homo sapiens
aagagugagacuccaccucaa

SEQ ID NO: 2200654 - RNA, 12 nt, Homo sapiens
auuuugcacuga

SEQ ID NO: 2200655 - RNA, 20 nt, Homo sapiens
uagcuuguauaguguaaaau

SEQ ID NO: 2200656 - RNA, 24 nt, Homo sapiens
guagugaccaaucgggaguagcaa

SEQ ID NO: 2200657 - RNA, 22 nt, Homo sapiens
cgagucaauccccucauucagg

SEQ ID NO: 2200658 - RNA, 16 nt, Homo sapiens
ggcugugucaccauug

SEQ ID NO: 2200659 - RNA, 16 nt, Homo sapiens
aaucguaaccuaugaa

SEQ ID NO: 2200660 - RNA, 18 nt, Homo sapiens
auuagcauaaagcacuaa

SEQ ID NO: 2200661 - RNA, 14 nt, Homo sapiens
gaccagaaccagag

SEQ ID NO: 2200662 - RNA, 19 nt, Homo sapiens
cacucuacccuauacaacu

SEQ ID NO: 2200663 - RNA, 17 nt, Homo sapiens
agaauucagacaucuga

SEQ ID NO: 2200664 - RNA, 18 nt, Homo sapiens
auuccuuaggaggacuuu

SEQ ID NO: 2200665 - RNA, 17 nt, Homo sapiens
ucuucaguuuuaggcuu

SEQ ID NO: 2200666 - RNA, 14 nt, Homo sapiens
uaaauuugaugcuu

SEQ ID NO: 2200667 - RNA, 18 nt, Homo sapiens
cagagccagaugcaggac

SEQ ID NO: 2200668 - RNA, 23 nt, Homo sapiens
gaaaaguaucccggaagcucaca

SEQ ID NO: 2200669 - RNA, 13 nt, Homo sapiens
cugauauuuacug

SEQ ID NO: 2200670 - RNA, 19 nt, Homo sapiens
agcccgcuucaagcucucu

SEQ ID NO: 2200671 - RNA, 20 nt, Homo sapiens
cauauuggaauguacauguc

SEQ ID NO: 2200672 - RNA, 19 nt, Homo sapiens
uagggcaauauugccaugg

SEQ ID NO: 2200673 - RNA, 12 nt, Homo sapiens
ggacacguggug

SEQ ID NO: 2200674 - RNA, 13 nt, Homo sapiens
gaccuccugacaa

SEQ ID NO: 2200675 - RNA, 18 nt, Homo sapiens
aaauccuaagcucagaga

SEQ ID NO: 2200676 - RNA, 15 nt, Homo sapiens
acgaaaaacauuuca

SEQ ID NO: 2200677 - RNA, 22 nt, Homo sapiens
gauuacccccaguccucccuag

SEQ ID NO: 2200678 - RNA, 23 nt, Homo sapiens
ccuguaauuccagcacuuuggga

SEQ ID NO: 2200679 - RNA, 16 nt, Homo sapiens
auaaacagauaaugcu

SEQ ID NO: 2200680 - RNA, 19 nt, Homo sapiens
caacuucagcaaugaauug

SEQ ID NO: 2200681 - RNA, 13 nt, Homo sapiens
cuaagcagcauuu

SEQ ID NO: 2200682 - RNA, 18 nt, Homo sapiens
ugaagccccuuguccucu

SEQ ID NO: 2200683 - RNA, 14 nt, Homo sapiens
acugugcugagaag

SEQ ID NO: 2200684 - RNA, 17 nt, Homo sapiens
cuguauuucacucuuuc

SEQ ID NO: 2200685 - RNA, 22 nt, Homo sapiens
acacaggggcaaagaacugccc

SEQ ID NO: 2200686 - RNA, 21 nt, Homo sapiens
aaacaccugcugauguggcaa

SEQ ID NO: 2200687 - RNA, 15 nt, Homo sapiens
acccacaauaaacuc

SEQ ID NO: 2200688 - RNA, 18 nt, Homo sapiens
uucauuaucauaugaacu

SEQ ID NO: 2200689 - RNA, 17 nt, Homo sapiens
aguagaggcaugaugau

SEQ ID NO: 2200690 - RNA, 18 nt, Homo sapiens
cuuagcacacucacagau

SEQ ID NO: 2200691 - RNA, 16 nt, Homo sapiens
caacuguggacuccag

SEQ ID NO: 2200692 - RNA, 12 nt, Homo sapiens
cauucuucucac

SEQ ID NO: 2200693 - RNA, 19 nt, Homo sapiens
ucaaugaaccacaaaaaag

SEQ ID NO: 2200694 - RNA, 17 nt, Homo sapiens
uucauuuucaugagccu

SEQ ID NO: 2200695 - RNA, 23 nt, Homo sapiens
agggcuacacagacccugcccac

SEQ ID NO: 2200696 - RNA, 17 nt, Homo sapiens
ucuggauucaaauuuau

SEQ ID NO: 2200697 - RNA, 20 nt, Homo sapiens
gcacuuugcaggaugaccuc

SEQ ID NO: 2200698 - RNA, 15 nt, Homo sapiens
acucuauuguuaccu

SEQ ID NO: 2200699 - RNA, 21 nt, Homo sapiens
cuucugaggcgcugcuuuguc

SEQ ID NO: 2200700 - RNA, 15 nt, Homo sapiens
uacuuaacauuucau

SEQ ID NO: 2200701 - RNA, 23 nt, Homo sapiens
caccugguggauaccugguugag

SEQ ID NO: 2200702 - RNA, 23 nt, Homo sapiens
ccucugccaaaggaugugauaua

SEQ ID NO: 2200703 - RNA, 18 nt, Homo sapiens
guuacaacaguaacacau

SEQ ID NO: 2200704 - RNA, 21 nt, Homo sapiens
acccccaucucuacuaaaaau

SEQ ID NO: 2200705 - RNA, 15 nt, Homo sapiens
aaaaauguuugagua

SEQ ID NO: 2200706 - RNA, 12 nt, Homo sapiens
ccaaaaguuauu

SEQ ID NO: 2200707 - RNA, 16 nt, Homo sapiens
augauuaagugcuuga

SEQ ID NO: 2200708 - RNA, 13 nt, Homo sapiens
guccaagucuucu

SEQ ID NO: 2200709 - RNA, 17 nt, Homo sapiens
gcuggcccugcaggugg

SEQ ID NO: 2200710 - RNA, 19 nt, Homo sapiens
ugcaaagccaccaacagcc

SEQ ID NO: 2200711 - RNA, 10 nt, Homo sapiens
agucuucuca

SEQ ID NO: 2200712 - RNA, 15 nt, Homo sapiens
uaaacuuaacuuuaa

SEQ ID NO: 2200713 - RNA, 21 nt, Homo sapiens
gcaaaggaagcauacuuguga

SEQ ID NO: 2200714 - RNA, 21 nt, Homo sapiens
aggcaacugugaguccgggaa

SEQ ID NO: 2200715 - RNA, 20 nt, Homo sapiens
uauaguugucaguauuauuc

SEQ ID NO: 2200716 - RNA, 19 nt, Homo sapiens
aaacugauggauaucccua

SEQ ID NO: 2200717 - RNA, 20 nt, Homo sapiens
gucuccucucagagugacag

SEQ ID NO: 2200718 - RNA, 19 nt, Homo sapiens
cuuuugcagaaaucacaau

SEQ ID NO: 2200719 - RNA, 20 nt, Homo sapiens
aaugugguuggucaaaucaa

SEQ ID NO: 2200720 - RNA, 16 nt, Homo sapiens
cugaaguuuccgcccc

SEQ ID NO: 2200721 - RNA, 14 nt, Homo sapiens
gaaggacacaguca

SEQ ID NO: 2200722 - RNA, 18 nt, Homo sapiens
cuuugauaaaguaaaaaa

SEQ ID NO: 2200723 - RNA, 23 nt, Homo sapiens
gaaaaggaaggcucuucucccca

SEQ ID NO: 2200724 - RNA, 23 nt, Homo sapiens
aucaugucaggccaucaaggagu

SEQ ID NO: 2200725 - RNA, 21 nt, Homo sapiens
uuagugucuugaauguaagaa

SEQ ID NO: 2200726 - RNA, 21 nt, Homo sapiens
aucagcugguucaguacuguc

SEQ ID NO: 2200727 - RNA, 13 nt, Homo sapiens
ggacacagaccca

SEQ ID NO: 2200728 - RNA, 14 nt, Homo sapiens
acaaauauuucaga

SEQ ID NO: 2200729 - RNA, 18 nt, Homo sapiens
ggcagcuacaagugcagc

SEQ ID NO: 2200730 - RNA, 20 nt, Homo sapiens
gcaggacauuuggcugugau

SEQ ID NO: 2200731 - RNA, 20 nt, Homo sapiens
acauuguuugucugucuuca

SEQ ID NO: 2200732 - RNA, 13 nt, Homo sapiens
cagucagcccagu

SEQ ID NO: 2200733 - RNA, 16 nt, Homo sapiens
uccacgcccaccagcc

SEQ ID NO: 2200734 - RNA, 16 nt, Homo sapiens
ugacacuaaacuccau

SEQ ID NO: 2200735 - RNA, 22 nt, Homo sapiens
cugcuguccaggaacuuuccag

SEQ ID NO: 2200736 - RNA, 24 nt, Homo sapiens
caacaucgugaaaccccaucucua

SEQ ID NO: 2200737 - RNA, 13 nt, Homo sapiens
cggagagagccaa

SEQ ID NO: 2200738 - RNA, 18 nt, Homo sapiens
uuugcagauacucgccaa

SEQ ID NO: 2200739 - RNA, 20 nt, Homo sapiens
ugaaauuuaauuacaaacaa

SEQ ID NO: 2200740 - RNA, 12 nt, Homo sapiens
gucugugcucug

SEQ ID NO: 2200741 - RNA, 20 nt, Homo sapiens
uguuugacuuuagacuguaa

SEQ ID NO: 2200742 - RNA, 20 nt, Homo sapiens
uuccuucuggggcuuugcca

SEQ ID NO: 2200743 - RNA, 16 nt, Homo sapiens
gcuucuggauggauuu

SEQ ID NO: 2200744 - RNA, 20 nt, Homo sapiens
aguggcucuucuaaccucag

SEQ ID NO: 2200745 - RNA, 18 nt, Homo sapiens
uauauuaaagacuaacua

SEQ ID NO: 2200746 - RNA, 19 nt, Homo sapiens
ucacuccacaacccaagaa

SEQ ID NO: 2200747 - RNA, 16 nt, Homo sapiens
cuucucuugacagucu

SEQ ID NO: 2200748 - RNA, 21 nt, Homo sapiens
uuucucuuagaaaaggugaua

SEQ ID NO: 2200749 - RNA, 17 nt, Homo sapiens
cuaauugagaccacagg

SEQ ID NO: 2200750 - RNA, 19 nt, Homo sapiens
auuuuaagucccugucacc

SEQ ID NO: 2200751 - RNA, 20 nt, Homo sapiens
cuuucuuuccaaaacauuuc

SEQ ID NO: 2200752 - RNA, 23 nt, Homo sapiens
ggcccuucccacaggacauuucu

SEQ ID NO: 2200753 - RNA, 20 nt, Homo sapiens
aaguaaagcccagaucucug

SEQ ID NO: 2200754 - RNA, 11 nt, Homo sapiens
acacacacagu

SEQ ID NO: 2200755 - RNA, 16 nt, Homo sapiens
uguuuuucaagccugu

SEQ ID NO: 2200756 - RNA, 19 nt, Homo sapiens
auacccaugcacaguacaa

SEQ ID NO: 2200757 - RNA, 15 nt, Homo sapiens
acacuaaaaggugac

SEQ ID NO: 2200758 - RNA, 15 nt, Homo sapiens
acuuuguuuacuuau

SEQ ID NO: 2200759 - RNA, 23 nt, Homo sapiens
auuuugcccucuccuuagcucuu

SEQ ID NO: 2200760 - RNA, 16 nt, Homo sapiens
gaugagaggaaaucac

SEQ ID NO: 2200761 - RNA, 14 nt, Homo sapiens
ugcuggaaagggag

SEQ ID NO: 2200762 - RNA, 16 nt, Homo sapiens
accacuacacuccagc

SEQ ID NO: 2200763 - RNA, 21 nt, Homo sapiens
ccggaucuacacccaccagag

SEQ ID NO: 2200764 - RNA, 21 nt, Homo sapiens
cuuucaggagggaaaacccac

SEQ ID NO: 2200765 - RNA, 14 nt, Homo sapiens
uccuaaaaguucaa

SEQ ID NO: 2200766 - RNA, 19 nt, Homo sapiens
gaaagaaguuauuuuccag

SEQ ID NO: 2200767 - RNA, 22 nt, Homo sapiens
agcggccuccggcgucuugccc

SEQ ID NO: 2200768 - RNA, 15 nt, Homo sapiens
gcuuugggugccuuu

SEQ ID NO: 2200769 - RNA, 23 nt, Homo sapiens
cuugccauuuucaagaaagcauu

SEQ ID NO: 2200770 - RNA, 19 nt, Homo sapiens
ggcuuuguaugacagugaa

SEQ ID NO: 2200771 - RNA, 21 nt, Homo sapiens
augauguauguugaagccuuu

SEQ ID NO: 2200772 - RNA, 19 nt, Homo sapiens
uuaauagaaauaaauuccu

SEQ ID NO: 2200773 - RNA, 18 nt, Homo sapiens
ugacccugggcuucugua

SEQ ID NO: 2200774 - RNA, 18 nt, Homo sapiens
ccuguaaacacucagcug

SEQ ID NO: 2200775 - RNA, 18 nt, Homo sapiens
ucuguagugcuacagggu

SEQ ID NO: 2200776 - RNA, 12 nt, Homo sapiens
cacauagugaaa

SEQ ID NO: 2200777 - RNA, 16 nt, Homo sapiens
acaugucuccuacuga

SEQ ID NO: 2200778 - RNA, 21 nt, Homo sapiens
caaacaggaaguggacauucu

SEQ ID NO: 2200779 - RNA, 23 nt, Homo sapiens
cuucuagaguaauuaucugugau

SEQ ID NO: 2200780 - RNA, 18 nt, Homo sapiens
ugcaugguauguggguga

SEQ ID NO: 2200781 - RNA, 23 nt, Homo sapiens
ugucguuugugaacgcugugaug

SEQ ID NO: 2200782 - RNA, 15 nt, Homo sapiens
ccagggguguagaug

SEQ ID NO: 2200783 - RNA, 22 nt, Homo sapiens
auaauguaagggucuguuguaa

SEQ ID NO: 2200784 - RNA, 13 nt, Homo sapiens
aaaugcuacucag

SEQ ID NO: 2200785 - RNA, 14 nt, Homo sapiens
guacuauugcagac

SEQ ID NO: 2200786 - RNA, 19 nt, Homo sapiens
ggcuuuuaagaaacacagg

SEQ ID NO: 2200787 - RNA, 18 nt, Homo sapiens
cgucucuguuccaugucu

SEQ ID NO: 2200788 - RNA, 20 nt, Homo sapiens
gaaaaaaaccaaaguacuuu

SEQ ID NO: 2200789 - RNA, 19 nt, Homo sapiens
agaaccugaguucccggga

SEQ ID NO: 2200790 - RNA, 15 nt, Homo sapiens
cacuguguguugaca

SEQ ID NO: 2200791 - RNA, 16 nt, Homo sapiens
uacuaaggaaucuuuc

SEQ ID NO: 2200792 - RNA, 18 nt, Homo sapiens
gaaagugcgaguccucca

SEQ ID NO: 2200793 - RNA, 18 nt, Homo sapiens
aaagaccagccuggucaa

SEQ ID NO: 2200794 - RNA, 18 nt, Homo sapiens
augcaagacacugugcca

SEQ ID NO: 2200795 - RNA, 15 nt, Homo sapiens
acugaaaacuguaaa

SEQ ID NO: 2200796 - RNA, 16 nt, Homo sapiens
uccaagauguucuccu

SEQ ID NO: 2200797 - RNA, 20 nt, Homo sapiens
cucaucugaggcauccagca

SEQ ID NO: 2200798 - RNA, 19 nt, Homo sapiens
uaauacugccggucaccca

SEQ ID NO: 2200799 - RNA, 17 nt, Homo sapiens
aagauguuauacaacca

SEQ ID NO: 2200800 - RNA, 22 nt, Homo sapiens
ugacaggaacccaucacugugu

SEQ ID NO: 2200801 - RNA, 23 nt, Homo sapiens
uuguugguuuggccacucuugac

SEQ ID NO: 2200802 - RNA, 23 nt, Homo sapiens
cuugaaaaauauucauguagauc

SEQ ID NO: 2200803 - RNA, 22 nt, Homo sapiens
uugaauggaaaacacauggugu

SEQ ID NO: 2200804 - RNA, 12 nt, Homo sapiens
uuccuuccagcc

SEQ ID NO: 2200805 - RNA, 17 nt, Homo sapiens
aggucagaggagggcau

SEQ ID NO: 2200806 - RNA, 20 nt, Homo sapiens
cucuucuuuagaacagggaa

SEQ ID NO: 2200807 - RNA, 16 nt, Homo sapiens
acugaaauuuaguaca

SEQ ID NO: 2200808 - RNA, 20 nt, Homo sapiens
uuacaaaccauuaccuguac

SEQ ID NO: 2200809 - RNA, 15 nt, Homo sapiens
ugguggccaagccug

SEQ ID NO: 2200810 - RNA, 18 nt, Homo sapiens
cuaugccugccucaaagg

SEQ ID NO: 2200811 - RNA, 18 nt, Homo sapiens
cauguccuucuuguccac

SEQ ID NO: 2200812 - RNA, 14 nt, Homo sapiens
auggugcuuggcag

SEQ ID NO: 2200813 - RNA, 21 nt, Homo sapiens
aguacgucccagcggccucag

SEQ ID NO: 2200814 - RNA, 21 nt, Homo sapiens
uucugauggccaaaauaccaa

SEQ ID NO: 2200815 - RNA, 12 nt, Homo sapiens
auaacaguauuu

SEQ ID NO: 2200816 - RNA, 21 nt, Homo sapiens
uuaauuaguugauugcuguug

SEQ ID NO: 2200817 - RNA, 21 nt, Homo sapiens
uaguggcgaugcgcccugcau

SEQ ID NO: 2200818 - RNA, 18 nt, Homo sapiens
cccggaagcgccaggcug

SEQ ID NO: 2200819 - RNA, 15 nt, Homo sapiens
gugguguaauaugaa

SEQ ID NO: 2200820 - RNA, 22 nt, Homo sapiens
gccagcugugggacaauuaucu

SEQ ID NO: 2200821 - RNA, 21 nt, Homo sapiens
caguuagagcugagcacuuuu

SEQ ID NO: 2200822 - RNA, 22 nt, Homo sapiens
guggcuggaucugugaggggcu

SEQ ID NO: 2200823 - RNA, 22 nt, Homo sapiens
ucuacuucuggaagucaucuca

SEQ ID NO: 2200824 - RNA, 15 nt, Homo sapiens
ggcucuucugugauu

SEQ ID NO: 2200825 - RNA, 21 nt, Homo sapiens
cucuuaugagcuccauguugc

SEQ ID NO: 2200826 - RNA, 22 nt, Homo sapiens
ggacugugcucacuaccugggu

SEQ ID NO: 2200827 - RNA, 19 nt, Homo sapiens
ccuuaauucacucccacac

SEQ ID NO: 2200828 - RNA, 17 nt, Homo sapiens
cuguagcucaaucugca

SEQ ID NO: 2200829 - RNA, 13 nt, Homo sapiens
cuuguuuguugca

SEQ ID NO: 2200830 - RNA, 23 nt, Homo sapiens
uauuuaaaaaauaaaaaaauaca

SEQ ID NO: 2200831 - RNA, 12 nt, Homo sapiens
uucagccuuaau

SEQ ID NO: 2200832 - RNA, 23 nt, Homo sapiens
uaaaugcuauggaaauacauuua

SEQ ID NO: 2200833 - RNA, 18 nt, Homo sapiens
aaagcucuguugcaauua

SEQ ID NO: 2200834 - RNA, 14 nt, Homo sapiens
cauucugaccauuu

SEQ ID NO: 2200835 - RNA, 22 nt, Homo sapiens
gauacaugagccagugauuauu

SEQ ID NO: 2200836 - RNA, 15 nt, Homo sapiens
ccaaacugucuuugu

SEQ ID NO: 2200837 - RNA, 23 nt, Homo sapiens
uugaaauaccagugaaccaaaga

SEQ ID NO: 2200838 - RNA, 21 nt, Homo sapiens
agaagaugagccuugcagaua

SEQ ID NO: 2200839 - RNA, 14 nt, Homo sapiens
gcuaacucugaccu

SEQ ID NO: 2200840 - RNA, 18 nt, Homo sapiens
ugaaacaugccacuugaa

SEQ ID NO: 2200841 - RNA, 19 nt, Homo sapiens
cuuauggggguguuucuau

SEQ ID NO: 2200842 - RNA, 16 nt, Homo sapiens
cacgguagugccugaa

SEQ ID NO: 2200843 - RNA, 16 nt, Homo sapiens
ugccuuuaauuugcua

SEQ ID NO: 2200844 - RNA, 15 nt, Homo sapiens
agccaccacauuuag

SEQ ID NO: 2200845 - RNA, 21 nt, Homo sapiens
ugaagacuauugguuugagaa

SEQ ID NO: 2200846 - RNA, 18 nt, Homo sapiens
ccaaagcuguugaaguca

SEQ ID NO: 2200847 - RNA, 15 nt, Homo sapiens
auaaaguaugugcau

SEQ ID NO: 2200848 - RNA, 23 nt, Homo sapiens
aaaaauauauuuaaugauaagua

SEQ ID NO: 2200849 - RNA, 16 nt, Homo sapiens
gcaccuccgcuugcca

SEQ ID NO: 2200850 - RNA, 19 nt, Homo sapiens
augaauaaaguugcuguga

SEQ ID NO: 2200851 - RNA, 20 nt, Homo sapiens
ugugaucuguuguaauauca

SEQ ID NO: 2200852 - RNA, 13 nt, Homo sapiens
aagaucuuugccc

SEQ ID NO: 2200853 - RNA, 16 nt, Homo sapiens
aagcaaagugcccaug

SEQ ID NO: 2200854 - RNA, 18 nt, Homo sapiens
cguguguacaugugcacu

SEQ ID NO: 2200855 - RNA, 20 nt, Homo sapiens
cucaguaacacagugcagua

SEQ ID NO: 2200856 - RNA, 14 nt, Homo sapiens
uaugcugcuaugga

SEQ ID NO: 2200857 - RNA, 17 nt, Homo sapiens
agcacguguggccuguu

SEQ ID NO: 2200858 - RNA, 15 nt, Homo sapiens
cuuuucuuuccucag

SEQ ID NO: 2200859 - RNA, 16 nt, Homo sapiens
gauaucacuuacucag

SEQ ID NO: 2200860 - RNA, 14 nt, Homo sapiens
ucuggagaagacua

SEQ ID NO: 2200861 - RNA, 13 nt, Homo sapiens
agucaccaugcaa

SEQ ID NO: 2200862 - RNA, 17 nt, Homo sapiens
guggacacgcgugauug

SEQ ID NO: 2200863 - RNA, 19 nt, Homo sapiens
acgcaccagacacucacag

SEQ ID NO: 2200864 - RNA, 22 nt, Homo sapiens
cauuagaaacugaaaacuguaa

SEQ ID NO: 2200865 - RNA, 17 nt, Homo sapiens
auugcacuucggauaau

SEQ ID NO: 2200866 - RNA, 23 nt, Homo sapiens
acccaugcacagaacaagccaca

SEQ ID NO: 2200867 - RNA, 14 nt, Homo sapiens
augucaguuauaau

SEQ ID NO: 2200868 - RNA, 20 nt, Homo sapiens
auaacaguaguccuuugaua

SEQ ID NO: 2200869 - RNA, 16 nt, Homo sapiens
cauuuuguacaaagau

SEQ ID NO: 2200870 - RNA, 13 nt, Homo sapiens
agucagugucugg

SEQ ID NO: 2200871 - RNA, 14 nt, Homo sapiens
aagaacacaugugc

SEQ ID NO: 2200872 - RNA, 15 nt, Homo sapiens
ugcccagaacuuccc

SEQ ID NO: 2200873 - RNA, 19 nt, Homo sapiens
gacuuuccuagacaauaac

SEQ ID NO: 2200874 - RNA, 17 nt, Homo sapiens
auuauaugcacuagcaa

SEQ ID NO: 2200875 - RNA, 19 nt, Homo sapiens
ugaugauacuccaccagug

SEQ ID NO: 2200876 - RNA, 21 nt, Homo sapiens
gaaguuuagauuuuaaucaaa

SEQ ID NO: 2200877 - RNA, 13 nt, Homo sapiens
ggauucagauuuc

SEQ ID NO: 2200878 - RNA, 20 nt, Homo sapiens
gucagcguugcaugucguga

SEQ ID NO: 2200879 - RNA, 17 nt, Homo sapiens
uggauggggcuuccagc

SEQ ID NO: 2200880 - RNA, 21 nt, Homo sapiens
uguaguuuuucuucaacauca

SEQ ID NO: 2200881 - RNA, 16 nt, Homo sapiens
ugaggagcugcacuga

SEQ ID NO: 2200882 - RNA, 14 nt, Homo sapiens
aagaagacagcaaa

SEQ ID NO: 2200883 - RNA, 20 nt, Homo sapiens
gcauaguucccauguuaaau

SEQ ID NO: 2200884 - RNA, 16 nt, Homo sapiens
aucacuguacuuguag

SEQ ID NO: 2200885 - RNA, 17 nt, Homo sapiens
uguauauauauauacuu

SEQ ID NO: 2200886 - RNA, 20 nt, Homo sapiens
acuuguagaaaucuguaauu

SEQ ID NO: 2200887 - RNA, 22 nt, Homo sapiens
acauuugaacuauauccuuccu

SEQ ID NO: 2200888 - RNA, 17 nt, Homo sapiens
agugagcagugagcacu

SEQ ID NO: 2200889 - RNA, 17 nt, Homo sapiens
ggagccagggccucucc

SEQ ID NO: 2200890 - RNA, 21 nt, Homo sapiens
aguaaaucagugcaguacuca

SEQ ID NO: 2200891 - RNA, 16 nt, Homo sapiens
cuucccuguccuguag

SEQ ID NO: 2200892 - RNA, 16 nt, Homo sapiens
uucaaggcccacuucu

SEQ ID NO: 2200893 - RNA, 12 nt, Homo sapiens
cacuucauaucu

SEQ ID NO: 2200894 - RNA, 12 nt, Homo sapiens
aucaucaucaca

SEQ ID NO: 2200895 - RNA, 23 nt, Homo sapiens
ccucuccccaagaagaugaaaga

SEQ ID NO: 2200896 - RNA, 21 nt, Homo sapiens
guguaugugcgugugugcaag

SEQ ID NO: 2200897 - RNA, 17 nt, Homo sapiens
caggccccgcuugucca

SEQ ID NO: 2200898 - RNA, 15 nt, Homo sapiens
cuuuccaaauugaug

SEQ ID NO: 2200899 - RNA, 13 nt, Homo sapiens
cauucacuacugc

SEQ ID NO: 2200900 - RNA, 13 nt, Homo sapiens
acuuaacucauga

SEQ ID NO: 2200901 - RNA, 14 nt, Homo sapiens
gacugggaagcauu

SEQ ID NO: 2200902 - RNA, 23 nt, Homo sapiens
aaaauuuuuuuagaaagcauuug

SEQ ID NO: 2200903 - RNA, 13 nt, Homo sapiens
augauuuacucau

SEQ ID NO: 2200904 - RNA, 21 nt, Homo sapiens
uauuugguucuguuccugaua

SEQ ID NO: 2200905 - RNA, 18 nt, Homo sapiens
ucucuggucuuccagcga

SEQ ID NO: 2200906 - RNA, 15 nt, Homo sapiens
cuuuggcaauaucau

SEQ ID NO: 2200907 - RNA, 18 nt, Homo sapiens
uaaaauacugcaaaaugu

SEQ ID NO: 2200908 - RNA, 15 nt, Homo sapiens
agcagcccccauuuc

SEQ ID NO: 2200909 - RNA, 16 nt, Homo sapiens
auuucuguugucaaua

SEQ ID NO: 2200910 - RNA, 17 nt, Homo sapiens
cauggcucugaacugca

SEQ ID NO: 2200911 - RNA, 23 nt, Homo sapiens
aaugaggcugcuuuccaaagcca

SEQ ID NO: 2200912 - RNA, 23 nt, Homo sapiens
gacuccucucguacuugaacuca

SEQ ID NO: 2200913 - RNA, 14 nt, Homo sapiens
auuuugucuaccau

SEQ ID NO: 2200914 - RNA, 12 nt, Homo sapiens
accccaacagca

SEQ ID NO: 2200915 - RNA, 15 nt, Homo sapiens
caagcccacuggcca

SEQ ID NO: 2200916 - RNA, 18 nt, Homo sapiens
gcccaggccagagugcag

SEQ ID NO: 2200917 - RNA, 20 nt, Homo sapiens
augguuacuucuucucuuag

SEQ ID NO: 2200918 - RNA, 22 nt, Homo sapiens
gccuaauauugaaaaugucacu

SEQ ID NO: 2200919 - RNA, 13 nt, Homo sapiens
gcaggugccuugu

SEQ ID NO: 2200920 - RNA, 17 nt, Homo sapiens
accacacucauggguca

SEQ ID NO: 2200921 - RNA, 23 nt, Homo sapiens
gauaaucuuauuuuggcauucuu

SEQ ID NO: 2200922 - RNA, 16 nt, Homo sapiens
uccuuggaccguauca

SEQ ID NO: 2200923 - RNA, 14 nt, Homo sapiens
uuuuuaaacuaugu

SEQ ID NO: 2200924 - RNA, 19 nt, Homo sapiens
agagagcgaccagcaggcu

SEQ ID NO: 2200925 - RNA, 18 nt, Homo sapiens
caaauacauugaguuuaa

SEQ ID NO: 2200926 - RNA, 12 nt, Homo sapiens
cucauugaagca

SEQ ID NO: 2200927 - RNA, 15 nt, Homo sapiens
cagaaguggcaggag

SEQ ID NO: 2200928 - RNA, 21 nt, Homo sapiens
ggaaaaaauaaaaacaucagu

SEQ ID NO: 2200929 - RNA, 18 nt, Homo sapiens
uuacauuucauacaacag

SEQ ID NO: 2200930 - RNA, 18 nt, Homo sapiens
cuauuaggaaauucugau

SEQ ID NO: 2200931 - RNA, 18 nt, Homo sapiens
gucaccugcucacaggga

SEQ ID NO: 2200932 - RNA, 22 nt, Homo sapiens
accgccccuugugcucgccuca

SEQ ID NO: 2200933 - RNA, 17 nt, Homo sapiens
ccuagccugcauaucau

SEQ ID NO: 2200934 - RNA, 14 nt, Homo sapiens
ugggaugggcuccc

SEQ ID NO: 2200935 - RNA, 15 nt, Homo sapiens
ggagaggaagcacac

SEQ ID NO: 2200936 - RNA, 22 nt, Homo sapiens
aauauucauguucugaaaauau

SEQ ID NO: 2200937 - RNA, 20 nt, Homo sapiens
auacgcucaggugguugugg

SEQ ID NO: 2200938 - RNA, 17 nt, Homo sapiens
cuuugcuacacugcuga

SEQ ID NO: 2200939 - RNA, 17 nt, Homo sapiens
uuauguuuugugauuca

SEQ ID NO: 2200940 - RNA, 13 nt, Homo sapiens
uaacacagaggac

SEQ ID NO: 2200941 - RNA, 24 nt, Homo sapiens
uugacuucucaaguaacaugacuu

SEQ ID NO: 2200942 - RNA, 13 nt, Homo sapiens
acaguaagggaua

SEQ ID NO: 2200943 - RNA, 19 nt, Homo sapiens
auauagaugucuguguaua

SEQ ID NO: 2200944 - RNA, 16 nt, Homo sapiens
uggggcuggaagcaga

SEQ ID NO: 2200945 - RNA, 17 nt, Homo sapiens
agcugccucccaucuca

SEQ ID NO: 2200946 - RNA, 22 nt, Homo sapiens
uuuggcucauuagcugaauuga

SEQ ID NO: 2200947 - RNA, 18 nt, Homo sapiens
aucaaaucuccugcugau

SEQ ID NO: 2200948 - RNA, 17 nt, Homo sapiens
gacugaugucaucuuga

SEQ ID NO: 2200949 - RNA, 21 nt, Homo sapiens
acagaaguccccucuacuuua

SEQ ID NO: 2200950 - RNA, 22 nt, Homo sapiens
agcagucuccugcccucucccc

SEQ ID NO: 2200951 - RNA, 12 nt, Homo sapiens
ccuucuugugau

SEQ ID NO: 2200952 - RNA, 16 nt, Homo sapiens
cacugucacccuccac

SEQ ID NO: 2200953 - RNA, 14 nt, Homo sapiens
ucugugacugccaa

SEQ ID NO: 2200954 - RNA, 22 nt, Homo sapiens
caggaauuugagaguucacaga

SEQ ID NO: 2200955 - RNA, 17 nt, Homo sapiens
uccugcugccauccuca

SEQ ID NO: 2200956 - RNA, 13 nt, Homo sapiens
gaaauuuucuaca

SEQ ID NO: 2200957 - RNA, 15 nt, Homo sapiens
uauacuuuaguauga

SEQ ID NO: 2200958 - RNA, 21 nt, Homo sapiens
ucccucucaugacuugcaggg

SEQ ID NO: 2200959 - RNA, 17 nt, Homo sapiens
gcucacccguaggcaaa

SEQ ID NO: 2200960 - RNA, 22 nt, Homo sapiens
ccuccauauugcucucauuuca

SEQ ID NO: 2200961 - RNA, 16 nt, Homo sapiens
aguuuugagaaacaaa

SEQ ID NO: 2200962 - RNA, 19 nt, Homo sapiens
uucuuauuuagcccauaau

SEQ ID NO: 2200963 - RNA, 15 nt, Homo sapiens
gaauaauaggccagg

SEQ ID NO: 2200964 - RNA, 15 nt, Homo sapiens
cauccauaacugaac

SEQ ID NO: 2200965 - RNA, 18 nt, Homo sapiens
agaccaccaacguguccu

SEQ ID NO: 2200966 - RNA, 15 nt, Homo sapiens
cucuauguaugcauc

SEQ ID NO: 2200967 - RNA, 20 nt, Homo sapiens
uuguguuccuggcugaugau

SEQ ID NO: 2200968 - RNA, 20 nt, Homo sapiens
acucccacgccuguccuccu

SEQ ID NO: 2200969 - RNA, 17 nt, Homo sapiens
cgaagacaaccaucaca

SEQ ID NO: 2200970 - RNA, 13 nt, Homo sapiens
ccaucagugcucu

SEQ ID NO: 2200971 - RNA, 16 nt, Homo sapiens
agggaauuuucauugg

SEQ ID NO: 2200972 - RNA, 23 nt, Homo sapiens
cuguauuuuuacagcuacuuuaa

SEQ ID NO: 2200973 - RNA, 18 nt, Homo sapiens
cagccacgggggacugac

SEQ ID NO: 2200974 - RNA, 18 nt, Homo sapiens
aauaaacuccuacuaaau

SEQ ID NO: 2200975 - RNA, 13 nt, Homo sapiens
cugccacauucua

SEQ ID NO: 2200976 - RNA, 13 nt, Homo sapiens
guggaguuugaca

SEQ ID NO: 2200977 - RNA, 16 nt, Homo sapiens
uaggauucaagucugc

SEQ ID NO: 2200978 - RNA, 16 nt, Homo sapiens
uugucuuaauggauga

SEQ ID NO: 2200979 - RNA, 24 nt, Homo sapiens
cuagcaggaacuucuagcucauuu

SEQ ID NO: 2200980 - RNA, 14 nt, Homo sapiens
ccaguguucuauga

SEQ ID NO: 2200981 - RNA, 23 nt, Homo sapiens
agagcaaguccucacucuucaag

SEQ ID NO: 2200982 - RNA, 18 nt, Homo sapiens
ggaccccagauaccugug

SEQ ID NO: 2200983 - RNA, 15 nt, Homo sapiens
aacucaccagccucu

SEQ ID NO: 2200984 - RNA, 20 nt, Homo sapiens
aaugaccaugaaagacuucu

SEQ ID NO: 2200985 - RNA, 14 nt, Homo sapiens
ucaucccuugcuua

SEQ ID NO: 2200986 - RNA, 19 nt, Homo sapiens
cccugcaauaaacugcuuu

SEQ ID NO: 2200987 - RNA, 20 nt, Homo sapiens
caaaauagcacauccaccaa

SEQ ID NO: 2200988 - RNA, 18 nt, Homo sapiens
cuuuuuuuuaagucacaa

SEQ ID NO: 2200989 - RNA, 19 nt, Homo sapiens
gguggcugcagccucagga

SEQ ID NO: 2200990 - RNA, 20 nt, Homo sapiens
guaaauauagugaagcaauu

SEQ ID NO: 2200991 - RNA, 13 nt, Homo sapiens
aaguuuaaaaccc

SEQ ID NO: 2200992 - RNA, 19 nt, Homo sapiens
gauacugaggcacacagag

SEQ ID NO: 2200993 - RNA, 12 nt, Homo sapiens
ugaggggucccc

SEQ ID NO: 2200994 - RNA, 18 nt, Homo sapiens
uaugucuuggacacugua

SEQ ID NO: 2200995 - RNA, 21 nt, Homo sapiens
uaggcagaaacaaaaugacug

SEQ ID NO: 2200996 - RNA, 12 nt, Homo sapiens
ccauuugcugcc

SEQ ID NO: 2200997 - RNA, 18 nt, Homo sapiens
aaauguuuuucaaaacaa

SEQ ID NO: 2200998 - RNA, 21 nt, Homo sapiens
aguuaauucucauuaauacuc

SEQ ID NO: 2200999 - RNA, 19 nt, Homo sapiens
gcgggguuagagccaagcu

SEQ ID NO: 2201000 - RNA, 14 nt, Homo sapiens
uccacaaagcaaag

SEQ ID NO: 2201001 - RNA, 13 nt, Homo sapiens
ugugagaagauca

SEQ ID NO: 2201002 - RNA, 19 nt, Homo sapiens
ucauuacaauuuucuguaa

SEQ ID NO: 2201003 - RNA, 19 nt, Homo sapiens
ucagcgacugccacaucau

SEQ ID NO: 2201004 - RNA, 20 nt, Homo sapiens
acaugguucaccaugcagug

SEQ ID NO: 2201005 - RNA, 17 nt, Homo sapiens
cagaaugcuauuucacu

SEQ ID NO: 2201006 - RNA, 23 nt, Homo sapiens
augggauuugaaucaauguauua

SEQ ID NO: 2201007 - RNA, 12 nt, Homo sapiens
caugacauuuac

SEQ ID NO: 2201008 - RNA, 20 nt, Homo sapiens
uaccugggcuuggugcguuu

SEQ ID NO: 2201009 - RNA, 12 nt, Homo sapiens
uuagccucuugc

SEQ ID NO: 2201010 - RNA, 16 nt, Homo sapiens
cagaaauaagugcugu

SEQ ID NO: 2201011 - RNA, 19 nt, Homo sapiens
gaauaaaaggaccacgugc

SEQ ID NO: 2201012 - RNA, 20 nt, Homo sapiens
uuauaucucccccacuccac

SEQ ID NO: 2201013 - RNA, 18 nt, Homo sapiens
guuuucauugacacucuu

SEQ ID NO: 2201014 - RNA, 14 nt, Homo sapiens
cuuaauggguacaa

SEQ ID NO: 2201015 - RNA, 21 nt, Homo sapiens
cugggcagccguuuuccucau

SEQ ID NO: 2201016 - RNA, 19 nt, Homo sapiens
aagggcuuggacucaagca

SEQ ID NO: 2201017 - RNA, 23 nt, Homo sapiens
gaugcaaucgguuuaaacauggc

SEQ ID NO: 2201018 - RNA, 19 nt, Homo sapiens
gggagacaccaguggugcg

SEQ ID NO: 2201019 - RNA, 13 nt, Homo sapiens
aacauccagaucu

SEQ ID NO: 2201020 - RNA, 18 nt, Homo sapiens
cguuuguuuguuucaaua

SEQ ID NO: 2201021 - RNA, 15 nt, Homo sapiens
aaaguaucaugaaag

SEQ ID NO: 2201022 - RNA, 18 nt, Homo sapiens
gaauaggcaaacuuuuau

SEQ ID NO: 2201023 - RNA, 17 nt, Homo sapiens
ucccucaugcuguucca

SEQ ID NO: 2201024 - RNA, 17 nt, Homo sapiens
guguaucugacaaaagg

SEQ ID NO: 2201025 - RNA, 15 nt, Homo sapiens
aaaguuacuacugau

SEQ ID NO: 2201026 - RNA, 13 nt, Homo sapiens
ucucacaugauuc

SEQ ID NO: 2201027 - RNA, 18 nt, Homo sapiens
guaugaaagagcaaguga

SEQ ID NO: 2201028 - RNA, 18 nt, Homo sapiens
agaaguuaauccacaucu

SEQ ID NO: 2201029 - RNA, 20 nt, Homo sapiens
guggcaacccucacuguguu

SEQ ID NO: 2201030 - RNA, 17 nt, Homo sapiens
gcuugaacugcugccaa

SEQ ID NO: 2201031 - RNA, 23 nt, Homo sapiens
ucagaugaguuuuauugacucau

SEQ ID NO: 2201032 - RNA, 15 nt, Homo sapiens
ugcagaaaacauugu

SEQ ID NO: 2201033 - RNA, 15 nt, Homo sapiens
ugcuuguaacaagaa

SEQ ID NO: 2201034 - RNA, 23 nt, Homo sapiens
aggcagcuuuuucucucccacua

SEQ ID NO: 2201035 - RNA, 19 nt, Homo sapiens
ugcuaugaagcguugaugg

SEQ ID NO: 2201036 - RNA, 18 nt, Homo sapiens
gucagaggacgagugcuu

SEQ ID NO: 2201037 - RNA, 21 nt, Homo sapiens
cauugggaggaagcacagauc

SEQ ID NO: 2201038 - RNA, 15 nt, Homo sapiens
cuuuggaaugcaugc

SEQ ID NO: 2201039 - RNA, 15 nt, Homo sapiens
cucaggaauguuugc

SEQ ID NO: 2201040 - RNA, 14 nt, Homo sapiens
caacuacagaauuu

SEQ ID NO: 2201041 - RNA, 17 nt, Homo sapiens
uaccuuagcuucacuca

SEQ ID NO: 2201042 - RNA, 14 nt, Homo sapiens
ccucacucaggaac

SEQ ID NO: 2201043 - RNA, 23 nt, Homo sapiens
ugugugacuuucaggcuacuguu

SEQ ID NO: 2201044 - RNA, 15 nt, Homo sapiens
uguaaguuucauucc

SEQ ID NO: 2201045 - RNA, 21 nt, Homo sapiens
uaacugcauugagaacugcau

SEQ ID NO: 2201046 - RNA, 16 nt, Homo sapiens
cuuagaucaggagaaa

SEQ ID NO: 2201047 - RNA, 17 nt, Homo sapiens
ggugggccucgggucca

SEQ ID NO: 2201048 - RNA, 19 nt, Homo sapiens
cuacuacaaacuucaaaga

SEQ ID NO: 2201049 - RNA, 15 nt, Homo sapiens
cuuuuaaacucugag

SEQ ID NO: 2201050 - RNA, 15 nt, Homo sapiens
aauuuagaaacugaa

SEQ ID NO: 2201051 - RNA, 23 nt, Homo sapiens
ucggacaagacccccagcacuug

SEQ ID NO: 2201052 - RNA, 19 nt, Homo sapiens
cucccugccuccugccuau

SEQ ID NO: 2201053 - RNA, 14 nt, Homo sapiens
aacaauuguggucu

SEQ ID NO: 2201054 - RNA, 15 nt, Homo sapiens
uuaggugaaaauaau

SEQ ID NO: 2201055 - RNA, 20 nt, Homo sapiens
uccguaaacauauaucuuac

SEQ ID NO: 2201056 - RNA, 16 nt, Homo sapiens
ucuugguauuacccuc

SEQ ID NO: 2201057 - RNA, 21 nt, Homo sapiens
ugcuccccagugcuaccucuc

SEQ ID NO: 2201058 - RNA, 12 nt, Homo sapiens
auaagcauuuag

SEQ ID NO: 2201059 - RNA, 19 nt, Homo sapiens
gcgugaccuugcaauguuc

SEQ ID NO: 2201060 - RNA, 12 nt, Homo sapiens
uacauucccugg

SEQ ID NO: 2201061 - RNA, 18 nt, Homo sapiens
aauaaaagaugauuucuc

SEQ ID NO: 2201062 - RNA, 21 nt, Homo sapiens
uacaauucccucuacuguguu

SEQ ID NO: 2201063 - RNA, 17 nt, Homo sapiens
caaaaucaagcaagccu

SEQ ID NO: 2201064 - RNA, 16 nt, Homo sapiens
gacuuucagaguccuu

SEQ ID NO: 2201065 - RNA, 18 nt, Homo sapiens
uaacuuagagacuuuaga

SEQ ID NO: 2201066 - RNA, 18 nt, Homo sapiens
cucuucgccuuucccacc

SEQ ID NO: 2201067 - RNA, 15 nt, Homo sapiens
gcuagcaguacuaau

SEQ ID NO: 2201068 - RNA, 18 nt, Homo sapiens
ggucuucuccauccucac

SEQ ID NO: 2201069 - RNA, 13 nt, Homo sapiens
agagagauacucu

SEQ ID NO: 2201070 - RNA, 16 nt, Homo sapiens
cauggaggcaugccaa

SEQ ID NO: 2201071 - RNA, 13 nt, Homo sapiens
uuaaagagcacug

SEQ ID NO: 2201072 - RNA, 14 nt, Homo sapiens
cucucuucaaucuc

SEQ ID NO: 2201073 - RNA, 20 nt, Homo sapiens
auuauuugucauucauucaa

SEQ ID NO: 2201074 - RNA, 20 nt, Homo sapiens
aauauuuuuuauucaguaaa

SEQ ID NO: 2201075 - RNA, 22 nt, Homo sapiens
agcuuuuugcagauaacaaaca

SEQ ID NO: 2201076 - RNA, 23 nt, Homo sapiens
auaugguuuuguuuucaaugaau

SEQ ID NO: 2201077 - RNA, 14 nt, Homo sapiens
aaaucccacagucu

SEQ ID NO: 2201078 - RNA, 22 nt, Homo sapiens
aaucugacaaagucaugaagcu

SEQ ID NO: 2201079 - RNA, 19 nt, Homo sapiens
uggugauaaguacuuccuc

SEQ ID NO: 2201080 - RNA, 22 nt, Homo sapiens
gcucacuggucaaaaccuacac

SEQ ID NO: 2201081 - RNA, 15 nt, Homo sapiens
gucccagacaauucc

SEQ ID NO: 2201082 - RNA, 14 nt, Homo sapiens
cccugcagcccugg

SEQ ID NO: 2201083 - RNA, 14 nt, Homo sapiens
aagcagguucuuga

SEQ ID NO: 2201084 - RNA, 23 nt, Homo sapiens
uuucaucguaaacauacuucuaa

SEQ ID NO: 2201085 - RNA, 21 nt, Homo sapiens
aacauccucagaaccauucac

SEQ ID NO: 2201086 - RNA, 22 nt, Homo sapiens
caccuuugcaggcaugcaugug

SEQ ID NO: 2201087 - RNA, 20 nt, Homo sapiens
uaguuuuauaaaacucaguu

SEQ ID NO: 2201088 - RNA, 20 nt, Homo sapiens
uaguugauauguaacaguug

SEQ ID NO: 2201089 - RNA, 17 nt, Homo sapiens
auaauaaagaugcucuu

SEQ ID NO: 2201090 - RNA, 14 nt, Homo sapiens
agccccucaugcca

SEQ ID NO: 2201091 - RNA, 15 nt, Homo sapiens
caccagacacccagg

SEQ ID NO: 2201092 - RNA, 13 nt, Homo sapiens
cacguugcccauc

SEQ ID NO: 2201093 - RNA, 21 nt, Homo sapiens
ugccaaaaucaauacaauccu

SEQ ID NO: 2201094 - RNA, 21 nt, Homo sapiens
cagacuggaggggacgcuggu

SEQ ID NO: 2201095 - RNA, 21 nt, Homo sapiens
gcaauuuuucaagagcuccuu

SEQ ID NO: 2201096 - RNA, 17 nt, Homo sapiens
ugcuuguggccaaugca

SEQ ID NO: 2201097 - RNA, 17 nt, Homo sapiens
cagguaagucugguuuu

SEQ ID NO: 2201098 - RNA, 19 nt, Homo sapiens
ccuuuggggagaaagucau

SEQ ID NO: 2201099 - RNA, 21 nt, Homo sapiens
caggguggagaugaggugcuc

SEQ ID NO: 2201100 - RNA, 14 nt, Homo sapiens
cuacaguaagcugg

SEQ ID NO: 2201101 - RNA, 15 nt, Homo sapiens
gcaagaaagauuuca

SEQ ID NO: 2201102 - RNA, 18 nt, Homo sapiens
augugucccuuccaagcu

SEQ ID NO: 2201103 - RNA, 17 nt, Homo sapiens
agccauauguacauaau

SEQ ID NO: 2201104 - RNA, 17 nt, Homo sapiens
acaaauugcuugaaaga

SEQ ID NO: 2201105 - RNA, 17 nt, Homo sapiens
gagggcgucuucuaggg

SEQ ID NO: 2201106 - RNA, 13 nt, Homo sapiens
gagaaucacuuca

SEQ ID NO: 2201107 - RNA, 19 nt, Homo sapiens
ucagaaacuagaaauguga

SEQ ID NO: 2201108 - RNA, 12 nt, Homo sapiens
uguuagugauuu

SEQ ID NO: 2201109 - RNA, 12 nt, Homo sapiens
agaaaguguuaa

SEQ ID NO: 2201110 - RNA, 21 nt, Homo sapiens
uuaacaugcuguguaagcugu

SEQ ID NO: 2201111 - RNA, 22 nt, Homo sapiens
uguuuucagaccuuugucugaa

SEQ ID NO: 2201112 - RNA, 14 nt, Homo sapiens
cuugcucagccaua

SEQ ID NO: 2201113 - RNA, 16 nt, Homo sapiens
ucuucaaccucauuga

SEQ ID NO: 2201114 - RNA, 21 nt, Homo sapiens
agugcugcguugacuacugcu

SEQ ID NO: 2201115 - RNA, 22 nt, Homo sapiens
uguccagccaagggcugagugu

SEQ ID NO: 2201116 - RNA, 16 nt, Homo sapiens
ccccuuuucugcauuu

SEQ ID NO: 2201117 - RNA, 10 nt, Homo sapiens
ccccagagau

SEQ ID NO: 2201118 - RNA, 12 nt, Homo sapiens
uggaggcugcuc

SEQ ID NO: 2201119 - RNA, 18 nt, Homo sapiens
gaaaggucucagcuugua

SEQ ID NO: 2201120 - RNA, 13 nt, Homo sapiens
aaagucuaccggc

SEQ ID NO: 2201121 - RNA, 21 nt, Homo sapiens
uuuuaaucuuccauuccuuca

SEQ ID NO: 2201122 - RNA, 16 nt, Homo sapiens
aaccagugauccaugu

SEQ ID NO: 2201123 - RNA, 17 nt, Homo sapiens
cacacguuugugagcuc

SEQ ID NO: 2201124 - RNA, 18 nt, Homo sapiens
auuagaucaauuacuuau

SEQ ID NO: 2201125 - RNA, 16 nt, Homo sapiens
agaccuaggauuucau

SEQ ID NO: 2201126 - RNA, 17 nt, Homo sapiens
uaugcacacacauggau

SEQ ID NO: 2201127 - RNA, 14 nt, Homo sapiens
uccccuaaaccaaa

SEQ ID NO: 2201128 - RNA, 17 nt, Homo sapiens
aaacauuugucaguaau

SEQ ID NO: 2201129 - RNA, 11 nt, Homo sapiens
agucaguauug

SEQ ID NO: 2201130 - RNA, 17 nt, Homo sapiens
aggugcuugagucucca

SEQ ID NO: 2201131 - RNA, 15 nt, Homo sapiens
cucuauauauacaug

SEQ ID NO: 2201132 - RNA, 14 nt, Homo sapiens
aucauuacugguaa

SEQ ID NO: 2201133 - RNA, 11 nt, Homo sapiens
agcguuugcac

SEQ ID NO: 2201134 - RNA, 14 nt, Homo sapiens
gcuaggaacacucc

SEQ ID NO: 2201135 - RNA, 16 nt, Homo sapiens
auggaagccacaucac

SEQ ID NO: 2201136 - RNA, 14 nt, Homo sapiens
guaaagugauuaaa

SEQ ID NO: 2201137 - RNA, 21 nt, Homo sapiens
acccaccauggaccagcccau

SEQ ID NO: 2201138 - RNA, 14 nt, Homo sapiens
guaccaauucagug

SEQ ID NO: 2201139 - RNA, 16 nt, Homo sapiens
uaaaguauauauuuau

SEQ ID NO: 2201140 - RNA, 18 nt, Homo sapiens
cuaggcaaaagaaaagcu

SEQ ID NO: 2201141 - RNA, 15 nt, Homo sapiens
ugcauugucugcaau

SEQ ID NO: 2201142 - RNA, 18 nt, Homo sapiens
cccaggugauuuccucua

SEQ ID NO: 2201143 - RNA, 20 nt, Homo sapiens
cauuauuacuccuugccauu

SEQ ID NO: 2201144 - RNA, 11 nt, Homo sapiens
uauuucacuua

SEQ ID NO: 2201145 - RNA, 20 nt, Homo sapiens
cuagguggguugaaagccaa

SEQ ID NO: 2201146 - RNA, 20 nt, Homo sapiens
gugaaaaugugugugugcuu

SEQ ID NO: 2201147 - RNA, 18 nt, Homo sapiens
agaagcacgaagcaguua

SEQ ID NO: 2201148 - RNA, 21 nt, Homo sapiens
uaacccaagacaugacauucu

SEQ ID NO: 2201149 - RNA, 21 nt, Homo sapiens
ucuuucaauugcagaugccaa

SEQ ID NO: 2201150 - RNA, 21 nt, Homo sapiens
caaucugcaaaaaaaugugca

SEQ ID NO: 2201151 - RNA, 15 nt, Homo sapiens
cccuaccaugaaucc

SEQ ID NO: 2201152 - RNA, 16 nt, Homo sapiens
ugaaugguuccaugcc

SEQ ID NO: 2201153 - RNA, 12 nt, Homo sapiens
cacauggcuuag

SEQ ID NO: 2201154 - RNA, 20 nt, Homo sapiens
aguagcugggaccacaggug

SEQ ID NO: 2201155 - RNA, 15 nt, Homo sapiens
guagcucguccucac

SEQ ID NO: 2201156 - RNA, 23 nt, Homo sapiens
ugaaauauaaaaaaggugguggu

SEQ ID NO: 2201157 - RNA, 17 nt, Homo sapiens
ugcuacaaacauaucaa

SEQ ID NO: 2201158 - RNA, 23 nt, Homo sapiens
auacuguuucuugcacugaauau

SEQ ID NO: 2201159 - RNA, 19 nt, Homo sapiens
aaagccuccucuggagaau

SEQ ID NO: 2201160 - RNA, 13 nt, Homo sapiens
uucugugacaaaa

SEQ ID NO: 2201161 - RNA, 21 nt, Homo sapiens
ugaauaaguugauucuguccc

SEQ ID NO: 2201162 - RNA, 13 nt, Homo sapiens
cagcguuaugugu

SEQ ID NO: 2201163 - RNA, 12 nt, Homo sapiens
cuaaaguuuuag

SEQ ID NO: 2201164 - RNA, 22 nt, Homo sapiens
aaaggaaaugcuccuccaggga

SEQ ID NO: 2201165 - RNA, 18 nt, Homo sapiens
accucaugggaagcaugu

SEQ ID NO: 2201166 - RNA, 20 nt, Homo sapiens
caaaggucaagaacacagug

SEQ ID NO: 2201167 - RNA, 19 nt, Homo sapiens
agagaucuaugggcauuug

SEQ ID NO: 2201168 - RNA, 18 nt, Homo sapiens
agucagaagcccauuaaa

SEQ ID NO: 2201169 - RNA, 11 nt, Homo sapiens
cucugcugucc

SEQ ID NO: 2201170 - RNA, 12 nt, Homo sapiens
aaaugucccaaa

SEQ ID NO: 2201171 - RNA, 22 nt, Homo sapiens
ugaaaugaauguaaucuaauag

SEQ ID NO: 2201172 - RNA, 12 nt, Homo sapiens
ugcugcgugaca

SEQ ID NO: 2201173 - RNA, 21 nt, Homo sapiens
uaaggucaaacuaauucucac

SEQ ID NO: 2201174 - RNA, 21 nt, Homo sapiens
agcaaagcugaugacaacuuc

SEQ ID NO: 2201175 - RNA, 17 nt, Homo sapiens
aagcccccacuucucuc

SEQ ID NO: 2201176 - RNA, 16 nt, Homo sapiens
uuagugauugcuuuua

SEQ ID NO: 2201177 - RNA, 13 nt, Homo sapiens
gcugccaaggaaa

SEQ ID NO: 2201178 - RNA, 16 nt, Homo sapiens
gcuugcaagggaccau

SEQ ID NO: 2201179 - RNA, 20 nt, Homo sapiens
aauguggauuaaagugccca

SEQ ID NO: 2201180 - RNA, 19 nt, Homo sapiens
ggcccagagcccagcucca

SEQ ID NO: 2201181 - RNA, 20 nt, Homo sapiens
aggcuuaacucgcugaugag

SEQ ID NO: 2201182 - RNA, 23 nt, Homo sapiens
cugcacuguccugaccaucgcac

SEQ ID NO: 2201183 - RNA, 23 nt, Homo sapiens
uuaggaaguuuucuguagucauu

SEQ ID NO: 2201184 - RNA, 14 nt, Homo sapiens
gaacccacccggcc

SEQ ID NO: 2201185 - RNA, 20 nt, Homo sapiens
acaaucguucuguguuugau

SEQ ID NO: 2201186 - RNA, 17 nt, Homo sapiens
gcuagaaaaaacauaaa

SEQ ID NO: 2201187 - RNA, 22 nt, Homo sapiens
ccuccuccuucauggcaggcau

SEQ ID NO: 2201188 - RNA, 18 nt, Homo sapiens
gaaguuacuucuuguaaa

SEQ ID NO: 2201189 - RNA, 13 nt, Homo sapiens
cuucaagagccag

SEQ ID NO: 2201190 - RNA, 21 nt, Homo sapiens
cguuguucccacugaaaugga

SEQ ID NO: 2201191 - RNA, 16 nt, Homo sapiens
caggccuugcugacuc

SEQ ID NO: 2201192 - RNA, 19 nt, Homo sapiens
ccaaucagcuuuuguucua

SEQ ID NO: 2201193 - RNA, 14 nt, Homo sapiens
uccuuaccagagac

SEQ ID NO: 2201194 - RNA, 22 nt, Homo sapiens
agacucugucucaaaacaaaca

SEQ ID NO: 2201195 - RNA, 21 nt, Homo sapiens
cauucuacguaucugcuacuu

SEQ ID NO: 2201196 - RNA, 17 nt, Homo sapiens
gcacaggcaacauuaca

SEQ ID NO: 2201197 - RNA, 22 nt, Homo sapiens
cacaucgcucuaggauaacugg

SEQ ID NO: 2201198 - RNA, 22 nt, Homo sapiens
uugagacggggucuggcugugu

SEQ ID NO: 2201199 - RNA, 22 nt, Homo sapiens
auagcacuuugaaauaccucau

SEQ ID NO: 2201200 - RNA, 14 nt, Homo sapiens
ugacaucucagggg

SEQ ID NO: 2201201 - RNA, 16 nt, Homo sapiens
gccugggcugguugga

SEQ ID NO: 2201202 - RNA, 16 nt, Homo sapiens
acagcauaaagcacau

SEQ ID NO: 2201203 - RNA, 14 nt, Homo sapiens
cagcuauccaguga

SEQ ID NO: 2201204 - RNA, 17 nt, Homo sapiens
uuaaguugauggugaug

SEQ ID NO: 2201205 - RNA, 13 nt, Homo sapiens
auagacacuggac

SEQ ID NO: 2201206 - RNA, 17 nt, Homo sapiens
gacccagggaaugccag

SEQ ID NO: 2201207 - RNA, 13 nt, Homo sapiens
uaaauugauaaca

SEQ ID NO: 2201208 - RNA, 13 nt, Homo sapiens
acccuugaaccaa

SEQ ID NO: 2201209 - RNA, 13 nt, Homo sapiens
acucaugaacuau

SEQ ID NO: 2201210 - RNA, 19 nt, Homo sapiens
uguacaugugcacucccca

SEQ ID NO: 2201211 - RNA, 18 nt, Homo sapiens
agagcugccaucgcugug

SEQ ID NO: 2201212 - RNA, 18 nt, Homo sapiens
acaaaccugcacuuauac

SEQ ID NO: 2201213 - RNA, 21 nt, Homo sapiens
gcuuugcccugcugcccuccc

SEQ ID NO: 2201214 - RNA, 19 nt, Homo sapiens
ucuaugaaacugcacauug

SEQ ID NO: 2201215 - RNA, 16 nt, Homo sapiens
gcaugccuguccuuuc

SEQ ID NO: 2201216 - RNA, 15 nt, Homo sapiens
caguuuauaaagcca

SEQ ID NO: 2201217 - RNA, 15 nt, Homo sapiens
auggcucucuauucc

SEQ ID NO: 2201218 - RNA, 21 nt, Homo sapiens
uccagaaauugugugugcaag

SEQ ID NO: 2201219 - RNA, 18 nt, Homo sapiens
gaaugauuuuucuuuaca

SEQ ID NO: 2201220 - RNA, 17 nt, Homo sapiens
agagucaagggugugug

SEQ ID NO: 2201221 - RNA, 19 nt, Homo sapiens
ucuucauaguuuauuuuca

SEQ ID NO: 2201222 - RNA, 19 nt, Homo sapiens
gauggagucucgcucugcu

SEQ ID NO: 2201223 - RNA, 20 nt, Homo sapiens
acccaagugaagguucccaa

SEQ ID NO: 2201224 - RNA, 20 nt, Homo sapiens
augcugcuggggaagacagu

SEQ ID NO: 2201225 - RNA, 17 nt, Homo sapiens
ucauuuuuuucacugga

SEQ ID NO: 2201226 - RNA, 17 nt, Homo sapiens
ucuguaggaauaagcau

SEQ ID NO: 2201227 - RNA, 19 nt, Homo sapiens
gcuacugaaaaaaauggag

SEQ ID NO: 2201228 - RNA, 16 nt, Homo sapiens
uaguguuggggauccu

SEQ ID NO: 2201229 - RNA, 13 nt, Homo sapiens
ucauuacaguucu

SEQ ID NO: 2201230 - RNA, 23 nt, Homo sapiens
cacacagacccgcuggaccaaag

SEQ ID NO: 2201231 - RNA, 22 nt, Homo sapiens
aguaaaugaauaaaacauuugc

SEQ ID NO: 2201232 - RNA, 18 nt, Homo sapiens
agcuucucagccuuccua

SEQ ID NO: 2201233 - RNA, 16 nt, Homo sapiens
auugaagagaacugca

SEQ ID NO: 2201234 - RNA, 17 nt, Homo sapiens
cacgguccaauccagcc

SEQ ID NO: 2201235 - RNA, 15 nt, Homo sapiens
ucagggccucaggca

SEQ ID NO: 2201236 - RNA, 15 nt, Homo sapiens
ugauguggcaaaagg

SEQ ID NO: 2201237 - RNA, 16 nt, Homo sapiens
cacucauuuauuucca

SEQ ID NO: 2201238 - RNA, 16 nt, Homo sapiens
aaauuagucuuggaaa

SEQ ID NO: 2201239 - RNA, 22 nt, Homo sapiens
cauuagggaaaugcaagucaaa

SEQ ID NO: 2201240 - RNA, 18 nt, Homo sapiens
ucccaagggaggcccaug

SEQ ID NO: 2201241 - RNA, 20 nt, Homo sapiens
ccaagggguuaaugaaacaa

SEQ ID NO: 2201242 - RNA, 16 nt, Homo sapiens
cucccccugcuucuca

SEQ ID NO: 2201243 - RNA, 15 nt, Homo sapiens
gauacaacugagucu

SEQ ID NO: 2201244 - RNA, 16 nt, Homo sapiens
aggcagcuucuagaca

SEQ ID NO: 2201245 - RNA, 17 nt, Homo sapiens
gccgacuggcugugaga

SEQ ID NO: 2201246 - RNA, 16 nt, Homo sapiens
agagcagcuucaguga

SEQ ID NO: 2201247 - RNA, 17 nt, Homo sapiens
ugugacuguggcauuuu

SEQ ID NO: 2201248 - RNA, 21 nt, Homo sapiens
cagcucaggggacacuggccc

SEQ ID NO: 2201249 - RNA, 19 nt, Homo sapiens
auccaucagcaaugcuucu

SEQ ID NO: 2201250 - RNA, 20 nt, Homo sapiens
ggccgcugccccugaguucu

SEQ ID NO: 2201251 - RNA, 23 nt, Homo sapiens
cuggcuuagggugauacuuuugc

SEQ ID NO: 2201252 - RNA, 20 nt, Homo sapiens
uuccuucagacagauuccag

SEQ ID NO: 2201253 - RNA, 18 nt, Homo sapiens
uuuucauguacagcauua

SEQ ID NO: 2201254 - RNA, 12 nt, Homo sapiens
cugcaaagccag

SEQ ID NO: 2201255 - RNA, 15 nt, Homo sapiens
ucccugcacacggca

SEQ ID NO: 2201256 - RNA, 18 nt, Homo sapiens
aacaaugguugaaugaau

SEQ ID NO: 2201257 - RNA, 19 nt, Homo sapiens
acauaguguuuguaacacc

SEQ ID NO: 2201258 - RNA, 19 nt, Homo sapiens
uaacucaccccucagcaaa

SEQ ID NO: 2201259 - RNA, 13 nt, Homo sapiens
uaauuguguuugu

SEQ ID NO: 2201260 - RNA, 17 nt, Homo sapiens
accaaugcugaugaccu

SEQ ID NO: 2201261 - RNA, 14 nt, Homo sapiens
caccacagagccuc

SEQ ID NO: 2201262 - RNA, 14 nt, Homo sapiens
uaacaugauuucaa

SEQ ID NO: 2201263 - RNA, 17 nt, Homo sapiens
accccacaacgugcaac

SEQ ID NO: 2201264 - RNA, 12 nt, Homo sapiens
ucugaaaaccaa

SEQ ID NO: 2201265 - RNA, 18 nt, Homo sapiens
acccucaaugccaagaaa

SEQ ID NO: 2201266 - RNA, 10 nt, Homo sapiens
ucucagcuca

SEQ ID NO: 2201267 - RNA, 12 nt, Homo sapiens
cacuuguaugcu

SEQ ID NO: 2201268 - RNA, 16 nt, Homo sapiens
gcugcuuuccaaagcc

SEQ ID NO: 2201269 - RNA, 18 nt, Homo sapiens
ccacucucuaccagauaa

SEQ ID NO: 2201270 - RNA, 19 nt, Homo sapiens
gaaccuaaauugaacugcc

SEQ ID NO: 2201271 - RNA, 15 nt, Homo sapiens
gugauugacauguag

SEQ ID NO: 2201272 - RNA, 16 nt, Homo sapiens
aucguccagugacuuu

SEQ ID NO: 2201273 - RNA, 23 nt, Homo sapiens
aaguuuuaugagaaaugccagug

SEQ ID NO: 2201274 - RNA, 20 nt, Homo sapiens
cugagucaaauccaguggug

SEQ ID NO: 2201275 - RNA, 15 nt, Homo sapiens
auagccaaggccaaa

SEQ ID NO: 2201276 - RNA, 17 nt, Homo sapiens
uaauguaauaauagaaa

SEQ ID NO: 2201277 - RNA, 20 nt, Homo sapiens
uguaauaauaaaaccaaaga

SEQ ID NO: 2201278 - RNA, 17 nt, Homo sapiens
aagaguccaagaagcca

SEQ ID NO: 2201279 - RNA, 16 nt, Homo sapiens
acacugcagcugucug

SEQ ID NO: 2201280 - RNA, 13 nt, Homo sapiens
aagucuaugcuua

SEQ ID NO: 2201281 - RNA, 21 nt, Homo sapiens
cauaaaaagccugcaauuuca

SEQ ID NO: 2201282 - RNA, 20 nt, Homo sapiens
uuuaacacugucaucuguag

SEQ ID NO: 2201283 - RNA, 18 nt, Homo sapiens
ucagaggacccuuuccag

SEQ ID NO: 2201284 - RNA, 16 nt, Homo sapiens
guaaauagguauuaua

SEQ ID NO: 2201285 - RNA, 18 nt, Homo sapiens
uguauguugaagccuuug

SEQ ID NO: 2201286 - RNA, 16 nt, Homo sapiens
cuagcaggaauauuuc

SEQ ID NO: 2201287 - RNA, 22 nt, Homo sapiens
gccuggagccuacuaaaugcuc

SEQ ID NO: 2201288 - RNA, 16 nt, Homo sapiens
ugcuuccguucaugga

SEQ ID NO: 2201289 - RNA, 22 nt, Homo sapiens
ucuuacacauaaagcacuaccu

SEQ ID NO: 2201290 - RNA, 12 nt, Homo sapiens
gaagaacugacu

SEQ ID NO: 2201291 - RNA, 15 nt, Homo sapiens
aaaccuaacuugcgc

SEQ ID NO: 2201292 - RNA, 16 nt, Homo sapiens
gcuucucccaguguga

SEQ ID NO: 2201293 - RNA, 19 nt, Homo sapiens
aaaucucuacugcuuugga

SEQ ID NO: 2201294 - RNA, 22 nt, Homo sapiens
ugugauaagaaaagccagucaa

SEQ ID NO: 2201295 - RNA, 13 nt, Homo sapiens
cgacgcaggugua

SEQ ID NO: 2201296 - RNA, 13 nt, Homo sapiens
gaagcuggugccc

SEQ ID NO: 2201297 - RNA, 22 nt, Homo sapiens
uauuuuuggaagcauacaauuu

SEQ ID NO: 2201298 - RNA, 14 nt, Homo sapiens
gauaugugccaggc

SEQ ID NO: 2201299 - RNA, 16 nt, Homo sapiens
guucuauaacaacaac

SEQ ID NO: 2201300 - RNA, 18 nt, Homo sapiens
ucacucuuaggcacuuug

SEQ ID NO: 2201301 - RNA, 15 nt, Homo sapiens
gcagcucacuacccu

SEQ ID NO: 2201302 - RNA, 18 nt, Homo sapiens
gacguuggaaggaaaucu

SEQ ID NO: 2201303 - RNA, 17 nt, Homo sapiens
cauguacuacacuucug

SEQ ID NO: 2201304 - RNA, 14 nt, Homo sapiens
ccacugcaaaacac

SEQ ID NO: 2201305 - RNA, 16 nt, Homo sapiens
ggacuauacauacuau

SEQ ID NO: 2201306 - RNA, 12 nt, Homo sapiens
cuuaaauuucca

SEQ ID NO: 2201307 - RNA, 17 nt, Homo sapiens
aaauaucaauggugcug

SEQ ID NO: 2201308 - RNA, 17 nt, Homo sapiens
cagcccagcccgucucc

SEQ ID NO: 2201309 - RNA, 21 nt, Homo sapiens
uuccaggagccuggcaccuuu

SEQ ID NO: 2201310 - RNA, 18 nt, Homo sapiens
aguauugaauacuuacau

SEQ ID NO: 2201311 - RNA, 21 nt, Homo sapiens
acccugcugaacacagugucu

SEQ ID NO: 2201312 - RNA, 10 nt, Homo sapiens
ugccugagau

SEQ ID NO: 2201313 - RNA, 21 nt, Homo sapiens
uuauuuccacuuauaaaggaa

SEQ ID NO: 2201314 - RNA, 17 nt, Homo sapiens
gugugugacacugauga

SEQ ID NO: 2201315 - RNA, 19 nt, Homo sapiens
cucuugggagggaguuacu

SEQ ID NO: 2201316 - RNA, 16 nt, Homo sapiens
aacagcauaugcaaag

SEQ ID NO: 2201317 - RNA, 14 nt, Homo sapiens
agaacuacuuugaa

SEQ ID NO: 2201318 - RNA, 15 nt, Homo sapiens
uccauacaguguacu

SEQ ID NO: 2201319 - RNA, 21 nt, Homo sapiens
cagccacauuucagaccugcu

SEQ ID NO: 2201320 - RNA, 21 nt, Homo sapiens
uucauguuggucugacaucaa

SEQ ID NO: 2201321 - RNA, 17 nt, Homo sapiens
cccuccuuucuuccucc

SEQ ID NO: 2201322 - RNA, 16 nt, Homo sapiens
auuauucaacagagag

SEQ ID NO: 2201323 - RNA, 16 nt, Homo sapiens
guguuauucuggggaa

SEQ ID NO: 2201324 - RNA, 17 nt, Homo sapiens
auuuuaaggcauauuua

SEQ ID NO: 2201325 - RNA, 21 nt, Homo sapiens
ucugguuccuccagccaccuc

SEQ ID NO: 2201326 - RNA, 15 nt, Homo sapiens
ucaaccuuaccaaaa

SEQ ID NO: 2201327 - RNA, 13 nt, Homo sapiens
ccuuaaggcucuu

SEQ ID NO: 2201328 - RNA, 17 nt, Homo sapiens
uggggaagcaaggaaau

SEQ ID NO: 2201329 - RNA, 17 nt, Homo sapiens
cagcacaaagacacaga

SEQ ID NO: 2201330 - RNA, 19 nt, Homo sapiens
uagguuugauucaacacuu

SEQ ID NO: 2201331 - RNA, 16 nt, Homo sapiens
uuccugauaacuuuaa

SEQ ID NO: 2201332 - RNA, 21 nt, Homo sapiens
caccggccccgcccaugagga

SEQ ID NO: 2201333 - RNA, 15 nt, Homo sapiens
aaaggcucagucuca

SEQ ID NO: 2201334 - RNA, 22 nt, Homo sapiens
aguauccaugcaugugcauaua

SEQ ID NO: 2201335 - RNA, 16 nt, Homo sapiens
uuggcuacacagggau

SEQ ID NO: 2201336 - RNA, 22 nt, Homo sapiens
aggucuccaucauggcagugau

SEQ ID NO: 2201337 - RNA, 21 nt, Homo sapiens
ccaacaucgcagacacaugug

SEQ ID NO: 2201338 - RNA, 13 nt, Homo sapiens
acggcggcuccag

SEQ ID NO: 2201339 - RNA, 14 nt, Homo sapiens
acuaucuagguauu

SEQ ID NO: 2201340 - RNA, 13 nt, Homo sapiens
cuuccacuaugag

SEQ ID NO: 2201341 - RNA, 12 nt, Homo sapiens
gaaaucugccaa

SEQ ID NO: 2201342 - RNA, 23 nt, Homo sapiens
aaagcagggacuugaacccauau

SEQ ID NO: 2201343 - RNA, 15 nt, Homo sapiens
uuuucugaauucaua

SEQ ID NO: 2201344 - RNA, 19 nt, Homo sapiens
cauaacauuauacacaaag

SEQ ID NO: 2201345 - RNA, 21 nt, Homo sapiens
cagcaggcccuucccauucug

SEQ ID NO: 2201346 - RNA, 18 nt, Homo sapiens
auaaacgccuucccaaaa

SEQ ID NO: 2201347 - RNA, 16 nt, Homo sapiens
uaugcuuuaucuugaa

SEQ ID NO: 2201348 - RNA, 23 nt, Homo sapiens
uucaccguggcuaccauugucac

SEQ ID NO: 2201349 - RNA, 18 nt, Homo sapiens
ggaggccacgugcagcug

SEQ ID NO: 2201350 - RNA, 22 nt, Homo sapiens
uugacuggguuucucuguauag

SEQ ID NO: 2201351 - RNA, 23 nt, Homo sapiens
uccccgggggcagacaccugugc

SEQ ID NO: 2201352 - RNA, 18 nt, Homo sapiens
aacauuaacaaaagcaau

SEQ ID NO: 2201353 - RNA, 18 nt, Homo sapiens
uaauugugauauuugaca

SEQ ID NO: 2201354 - RNA, 15 nt, Homo sapiens
cagccagugccauuc

SEQ ID NO: 2201355 - RNA, 15 nt, Homo sapiens
caggugucauaugac

SEQ ID NO: 2201356 - RNA, 17 nt, Homo sapiens
ugucaaguauaaaguca

SEQ ID NO: 2201357 - RNA, 22 nt, Homo sapiens
gcuggggcccagcacaacugcu

SEQ ID NO: 2201358 - RNA, 19 nt, Homo sapiens
cguauaauaaaaccaaaga

SEQ ID NO: 2201359 - RNA, 19 nt, Homo sapiens
auucccaucuacuaaaaaa

SEQ ID NO: 2201360 - RNA, 22 nt, Homo sapiens
ucauaaugacuuaagcacacuu

SEQ ID NO: 2201361 - RNA, 12 nt, Homo sapiens
agauuugcaccu

SEQ ID NO: 2201362 - RNA, 13 nt, Homo sapiens
cuucaaaacagaa

SEQ ID NO: 2201363 - RNA, 23 nt, Homo sapiens
uccgcaauguggagcagcagcca

SEQ ID NO: 2201364 - RNA, 22 nt, Homo sapiens
guuuuaaaagagaagcaucauu

SEQ ID NO: 2201365 - RNA, 14 nt, Homo sapiens
gcuaacauggugaa

SEQ ID NO: 2201366 - RNA, 18 nt, Homo sapiens
ucauuuacccuagagguu

SEQ ID NO: 2201367 - RNA, 13 nt, Homo sapiens
uucugauuccauc

SEQ ID NO: 2201368 - RNA, 18 nt, Homo sapiens
uuucauaaugcagaagua

SEQ ID NO: 2201369 - RNA, 20 nt, Homo sapiens
ggauaaugcuguugccucau

SEQ ID NO: 2201370 - RNA, 20 nt, Homo sapiens
accaugccccugagcaaugu

SEQ ID NO: 2201371 - RNA, 16 nt, Homo sapiens
uauuuccccucucaaa

SEQ ID NO: 2201372 - RNA, 22 nt, Homo sapiens
uugaauuuaggugauaccuaaa

SEQ ID NO: 2201373 - RNA, 14 nt, Homo sapiens
ccaagccugcugug

SEQ ID NO: 2201374 - RNA, 20 nt, Homo sapiens
ucauccaaacuguaucuucc

SEQ ID NO: 2201375 - RNA, 22 nt, Homo sapiens
uuacuucaaugggcucuuccaa

SEQ ID NO: 2201376 - RNA, 19 nt, Homo sapiens
agaaccauaggacuguggc

SEQ ID NO: 2201377 - RNA, 14 nt, Homo sapiens
aaaaucaucuuaca

SEQ ID NO: 2201378 - RNA, 21 nt, Homo sapiens
agaaccacuuggcugcucauu

SEQ ID NO: 2201379 - RNA, 18 nt, Homo sapiens
ucaaucagugcagugaua

SEQ ID NO: 2201380 - RNA, 23 nt, Homo sapiens
agaaaggucucuggagggacaaa

SEQ ID NO: 2201381 - RNA, 21 nt, Homo sapiens
ucaggccagccugucccugaa

SEQ ID NO: 2201382 - RNA, 22 nt, Homo sapiens
caugcuguuuucccuuugccac

SEQ ID NO: 2201383 - RNA, 14 nt, Homo sapiens
ugagaagggcucag

SEQ ID NO: 2201384 - RNA, 16 nt, Homo sapiens
acaugcucaaugacuc

SEQ ID NO: 2201385 - RNA, 17 nt, Homo sapiens
uuauuaauuaaaccaga

SEQ ID NO: 2201386 - RNA, 19 nt, Homo sapiens
ugaaaauaaauaaguuaua

SEQ ID NO: 2201387 - RNA, 22 nt, Homo sapiens
aguagcaggacuaggcauguca

SEQ ID NO: 2201388 - RNA, 13 nt, Homo sapiens
cacuaaucugaaa

SEQ ID NO: 2201389 - RNA, 18 nt, Homo sapiens
uccuccccuguucauucu

SEQ ID NO: 2201390 - RNA, 18 nt, Homo sapiens
ccuguaaucacaacucag

SEQ ID NO: 2201391 - RNA, 14 nt, Homo sapiens
gaaaaacaugcuua

SEQ ID NO: 2201392 - RNA, 16 nt, Homo sapiens
augcaggggaaguacu

SEQ ID NO: 2201393 - RNA, 18 nt, Homo sapiens
ugggccaaaaucaugcca

SEQ ID NO: 2201394 - RNA, 17 nt, Homo sapiens
guuuacagcaauuccug

SEQ ID NO: 2201395 - RNA, 17 nt, Homo sapiens
aguggacccuggaccau

SEQ ID NO: 2201396 - RNA, 19 nt, Homo sapiens
uguuucugcagccacuauu

SEQ ID NO: 2201397 - RNA, 14 nt, Homo sapiens
ugugugacuuucag

SEQ ID NO: 2201398 - RNA, 21 nt, Homo sapiens
aucacaccacugcacuccagc

SEQ ID NO: 2201399 - RNA, 13 nt, Homo sapiens
gggcuuuugccac

SEQ ID NO: 2201400 - RNA, 17 nt, Homo sapiens
ugaguuucuguucuccc

SEQ ID NO: 2201401 - RNA, 21 nt, Homo sapiens
caggaaccggagggugaccca

SEQ ID NO: 2201402 - RNA, 15 nt, Homo sapiens
guugacuacugcuau

SEQ ID NO: 2201403 - RNA, 20 nt, Homo sapiens
uggaacucuugacagcuaua

SEQ ID NO: 2201404 - RNA, 20 nt, Homo sapiens
cuacagcauccuggacaaca

SEQ ID NO: 2201405 - RNA, 17 nt, Homo sapiens
auuagccaaguguggua

SEQ ID NO: 2201406 - RNA, 15 nt, Homo sapiens
caguguggacaugag

SEQ ID NO: 2201407 - RNA, 17 nt, Homo sapiens
ccaaucagcacucugua

SEQ ID NO: 2201408 - RNA, 13 nt, Homo sapiens
aagacucugcucu

SEQ ID NO: 2201409 - RNA, 18 nt, Homo sapiens
auaauaucaaaacaagua

SEQ ID NO: 2201410 - RNA, 19 nt, Homo sapiens
aacgauuuuaugaaaugac

SEQ ID NO: 2201411 - RNA, 14 nt, Homo sapiens
gauuauuuaucaca

SEQ ID NO: 2201412 - RNA, 21 nt, Homo sapiens
cuaauaaaauauuuucugugu

SEQ ID NO: 2201413 - RNA, 20 nt, Homo sapiens
uggagccugggcauccucag

SEQ ID NO: 2201414 - RNA, 18 nt, Homo sapiens
caacaccuuccuccugca

SEQ ID NO: 2201415 - RNA, 13 nt, Homo sapiens
acuaagaauauaa

SEQ ID NO: 2201416 - RNA, 22 nt, Homo sapiens
gucagugcugccaguuucccaa

SEQ ID NO: 2201417 - RNA, 22 nt, Homo sapiens
ugggucgcgugaugcgcauguc

SEQ ID NO: 2201418 - RNA, 16 nt, Homo sapiens
ucuucaguuuuucacu

SEQ ID NO: 2201419 - RNA, 18 nt, Homo sapiens
cauuguaaaucugaagaa

SEQ ID NO: 2201420 - RNA, 16 nt, Homo sapiens
gaaguuuuuucuacca

SEQ ID NO: 2201421 - RNA, 12 nt, Homo sapiens
ugaaucuguaca

SEQ ID NO: 2201422 - RNA, 22 nt, Homo sapiens
cuaggauaagcacuagaucucc

SEQ ID NO: 2201423 - RNA, 20 nt, Homo sapiens
auugcuucauuaaaacaaga

SEQ ID NO: 2201424 - RNA, 18 nt, Homo sapiens
caugcauuuuaucagaca

SEQ ID NO: 2201425 - RNA, 21 nt, Homo sapiens
auccuggcuaacacagugaaa

SEQ ID NO: 2201426 - RNA, 20 nt, Homo sapiens
cacugcugcuccagugcagg

SEQ ID NO: 2201427 - RNA, 23 nt, Homo sapiens
ccucuggggcaggaccacuagcu

SEQ ID NO: 2201428 - RNA, 15 nt, Homo sapiens
acccagggugcauua

SEQ ID NO: 2201429 - RNA, 20 nt, Homo sapiens
ugcuccccuaaagccucaaa

SEQ ID NO: 2201430 - RNA, 22 nt, Homo sapiens
auucuuuuuacaucuaucccag

SEQ ID NO: 2201431 - RNA, 17 nt, Homo sapiens
auccaggacucugucaa

SEQ ID NO: 2201432 - RNA, 14 nt, Homo sapiens
agcccagugucccu

SEQ ID NO: 2201433 - RNA, 14 nt, Homo sapiens
agcugagugucugu

SEQ ID NO: 2201434 - RNA, 15 nt, Homo sapiens
uguuuacgauuucac

SEQ ID NO: 2201435 - RNA, 15 nt, Homo sapiens
uuuaaaaaaaguaua

SEQ ID NO: 2201436 - RNA, 19 nt, Homo sapiens
aaaacaacuuggcauuucu

SEQ ID NO: 2201437 - RNA, 14 nt, Homo sapiens
ccaggccaggacuc

SEQ ID NO: 2201438 - RNA, 21 nt, Homo sapiens
aaacuuccacaagagugaauu

SEQ ID NO: 2201439 - RNA, 15 nt, Homo sapiens
agugccauuucagag

SEQ ID NO: 2201440 - RNA, 17 nt, Homo sapiens
aagucuacuucacuaau

SEQ ID NO: 2201441 - RNA, 18 nt, Homo sapiens
aaaacugcacagugcugu

SEQ ID NO: 2201442 - RNA, 20 nt, Homo sapiens
accuuccauucacaccagcu

SEQ ID NO: 2201443 - RNA, 15 nt, Homo sapiens
uugcacagggauucu

SEQ ID NO: 2201444 - RNA, 16 nt, Homo sapiens
acagagcaaguccuca

SEQ ID NO: 2201445 - RNA, 22 nt, Homo sapiens
aaaaauaaaacuucacauuuau

SEQ ID NO: 2201446 - RNA, 12 nt, Homo sapiens
aagcaacagcuu

SEQ ID NO: 2201447 - RNA, 20 nt, Homo sapiens
uauguaggcaauacauguau

SEQ ID NO: 2201448 - RNA, 14 nt, Homo sapiens
ccuaaaaacacaga

SEQ ID NO: 2201449 - RNA, 19 nt, Homo sapiens
uccagauguggcuacugac

SEQ ID NO: 2201450 - RNA, 19 nt, Homo sapiens
gaauacucugaaaccgaag

SEQ ID NO: 2201451 - RNA, 16 nt, Homo sapiens
uaagcaacaugaauua

SEQ ID NO: 2201452 - RNA, 14 nt, Homo sapiens
gcaaagucucucau

SEQ ID NO: 2201453 - RNA, 17 nt, Homo sapiens
gugccacacgcaugggc

SEQ ID NO: 2201454 - RNA, 12 nt, Homo sapiens
ccccaggacaag

SEQ ID NO: 2201455 - RNA, 14 nt, Homo sapiens
aacacuugucaaga

SEQ ID NO: 2201456 - RNA, 12 nt, Homo sapiens
uugccacacuga

SEQ ID NO: 2201457 - RNA, 16 nt, Homo sapiens
cugugauauaagugug

SEQ ID NO: 2201458 - RNA, 20 nt, Homo sapiens
acugaacuuaauaacugugu

SEQ ID NO: 2201459 - RNA, 21 nt, Homo sapiens
uccagaagaagagaagcugcu

SEQ ID NO: 2201460 - RNA, 20 nt, Homo sapiens
gaaacuuguuagaaaugcaa

SEQ ID NO: 2201461 - RNA, 18 nt, Homo sapiens
ugaauugaggacuaugga

SEQ ID NO: 2201462 - RNA, 17 nt, Homo sapiens
cuucuggggcuuugcca

SEQ ID NO: 2201463 - RNA, 21 nt, Homo sapiens
cugaaaucccucuaccuucuc

SEQ ID NO: 2201464 - RNA, 18 nt, Homo sapiens
ucugcaagauuuuaaaag

SEQ ID NO: 2201465 - RNA, 15 nt, Homo sapiens
uccugaugggaacag

SEQ ID NO: 2201466 - RNA, 11 nt, Homo sapiens
ccaugccugug

SEQ ID NO: 2201467 - RNA, 18 nt, Homo sapiens
ugugcuaaccucacugcc

SEQ ID NO: 2201468 - RNA, 11 nt, Homo sapiens
ccgugccugua

SEQ ID NO: 2201469 - RNA, 19 nt, Homo sapiens
uccucaagggccaggacuu

SEQ ID NO: 2201470 - RNA, 21 nt, Homo sapiens
uaaaaucuuucugauaaugca

SEQ ID NO: 2201471 - RNA, 23 nt, Homo sapiens
agccuguugggaucgcauugcau

SEQ ID NO: 2201472 - RNA, 14 nt, Homo sapiens
uacauaugcagaua

SEQ ID NO: 2201473 - RNA, 14 nt, Homo sapiens
cucuuuuguuguuu

SEQ ID NO: 2201474 - RNA, 19 nt, Homo sapiens
aauacuauuuaagauguga

SEQ ID NO: 2201475 - RNA, 13 nt, Homo sapiens
gccuucugaugag

SEQ ID NO: 2201476 - RNA, 18 nt, Homo sapiens
uauuauauguaacuacuu

SEQ ID NO: 2201477 - RNA, 12 nt, Homo sapiens
agaagauuucag

SEQ ID NO: 2201478 - RNA, 19 nt, Homo sapiens
uuuaauaaaaauuccuuaa

SEQ ID NO: 2201479 - RNA, 18 nt, Homo sapiens
ggauuuuaaaugcuguau

SEQ ID NO: 2201480 - RNA, 20 nt, Homo sapiens
agccuguagcuuauauuuga

SEQ ID NO: 2201481 - RNA, 12 nt, Homo sapiens
ggcagugcagua

SEQ ID NO: 2201482 - RNA, 21 nt, Homo sapiens
agucccgggggccugcccugc

SEQ ID NO: 2201483 - RNA, 18 nt, Homo sapiens
caagcagccgcagcgcag

SEQ ID NO: 2201484 - RNA, 17 nt, Homo sapiens
cguuccaccccaagaga

SEQ ID NO: 2201485 - RNA, 21 nt, Homo sapiens
ugccauauucugguucuugaa

SEQ ID NO: 2201486 - RNA, 21 nt, Homo sapiens
aguaaugccacacauugugcu

SEQ ID NO: 2201487 - RNA, 17 nt, Homo sapiens
aacucugggucuuggcc

SEQ ID NO: 2201488 - RNA, 21 nt, Homo sapiens
aauuuuuacacaaaccugaaa

SEQ ID NO: 2201489 - RNA, 19 nt, Homo sapiens
uaauaaauugacauaacca

SEQ ID NO: 2201490 - RNA, 18 nt, Homo sapiens
uccugggagccacuggga

SEQ ID NO: 2201491 - RNA, 15 nt, Homo sapiens
ugaaaugaaagggaa

SEQ ID NO: 2201492 - RNA, 20 nt, Homo sapiens
acagauacauagauggacca

SEQ ID NO: 2201493 - RNA, 17 nt, Homo sapiens
ccaaguuggagugcaau

SEQ ID NO: 2201494 - RNA, 12 nt, Homo sapiens
ugucuuaccaga

SEQ ID NO: 2201495 - RNA, 12 nt, Homo sapiens
uguaagcccuuu

SEQ ID NO: 2201496 - RNA, 21 nt, Homo sapiens
aucccaaaucugucagcaucu

SEQ ID NO: 2201497 - RNA, 16 nt, Homo sapiens
auucauaaugugagau

SEQ ID NO: 2201498 - RNA, 18 nt, Homo sapiens
guuaauaagcaacuguaa

SEQ ID NO: 2201499 - RNA, 16 nt, Homo sapiens
ucagcaggcuagacag

SEQ ID NO: 2201500 - RNA, 19 nt, Homo sapiens
cagggcugggccagugcau

SEQ ID NO: 2201501 - RNA, 15 nt, Homo sapiens
uuaccagauucacuu

SEQ ID NO: 2201502 - RNA, 14 nt, Homo sapiens
augucuguguaugu

SEQ ID NO: 2201503 - RNA, 16 nt, Homo sapiens
caucaauuccaucagc

SEQ ID NO: 2201504 - RNA, 21 nt, Homo sapiens
ccauuccauaauuuguaguau

SEQ ID NO: 2201505 - RNA, 21 nt, Homo sapiens
ccgcugcuuccuggcugggaa

SEQ ID NO: 2201506 - RNA, 17 nt, Homo sapiens
uaaagccucugugcugc

SEQ ID NO: 2201507 - RNA, 16 nt, Homo sapiens
cacuggacucaccucc

SEQ ID NO: 2201508 - RNA, 19 nt, Homo sapiens
acuugauauuuaagcagcu

SEQ ID NO: 2201509 - RNA, 18 nt, Homo sapiens
caaauacuauccaaauaa

SEQ ID NO: 2201510 - RNA, 21 nt, Homo sapiens
aaggugggcggaucacuugag

SEQ ID NO: 2201511 - RNA, 21 nt, Homo sapiens
uacuuucaucuauucuuuccc

SEQ ID NO: 2201512 - RNA, 12 nt, Homo sapiens
gcugauccaguu

SEQ ID NO: 2201513 - RNA, 16 nt, Homo sapiens
aguucuuuuacuguaa

SEQ ID NO: 2201514 - RNA, 18 nt, Homo sapiens
aaaaaucugcaaaagauc

SEQ ID NO: 2201515 - RNA, 22 nt, Homo sapiens
gcuggcagaaagggaacagaaa

SEQ ID NO: 2201516 - RNA, 23 nt, Homo sapiens
acccccguuagcuuccugcagga

SEQ ID NO: 2201517 - RNA, 14 nt, Homo sapiens
ugccaucauaccca

SEQ ID NO: 2201518 - RNA, 17 nt, Homo sapiens
uaugauggucugcauua

SEQ ID NO: 2201519 - RNA, 23 nt, Homo sapiens
auaauaaagacauuuccuaccug

SEQ ID NO: 2201520 - RNA, 23 nt, Homo sapiens
agggcaccccagcugaccuggua

SEQ ID NO: 2201521 - RNA, 18 nt, Homo sapiens
agcgagguccaagcacau

SEQ ID NO: 2201522 - RNA, 17 nt, Homo sapiens
cccuggcccccaucagc

SEQ ID NO: 2201523 - RNA, 17 nt, Homo sapiens
gguggagauugcaguga

SEQ ID NO: 2201524 - RNA, 18 nt, Homo sapiens
ugagcugagaucaugcca

SEQ ID NO: 2201525 - RNA, 15 nt, Homo sapiens
cuuucuaccaucuca

SEQ ID NO: 2201526 - RNA, 13 nt, Homo sapiens
uuuagucugggcu

SEQ ID NO: 2201527 - RNA, 17 nt, Homo sapiens
caggaaucaugaucuga

SEQ ID NO: 2201528 - RNA, 18 nt, Homo sapiens
aaagugacuuccaaacaa

SEQ ID NO: 2201529 - RNA, 15 nt, Homo sapiens
agccuccucucucaa

SEQ ID NO: 2201530 - RNA, 15 nt, Homo sapiens
aagcauaaacaucac

SEQ ID NO: 2201531 - RNA, 14 nt, Homo sapiens
agccggccggcugg

SEQ ID NO: 2201532 - RNA, 15 nt, Homo sapiens
gcgugguagugcaag

SEQ ID NO: 2201533 - RNA, 18 nt, Homo sapiens
uuaaagugguucuggaua

SEQ ID NO: 2201534 - RNA, 17 nt, Homo sapiens
caacgugcgugucucug

SEQ ID NO: 2201535 - RNA, 20 nt, Homo sapiens
caccccuaccucuaguaaau

SEQ ID NO: 2201536 - RNA, 23 nt, Homo sapiens
caaacuggggccuccagaacuca

SEQ ID NO: 2201537 - RNA, 21 nt, Homo sapiens
uuugucagggauuuagcccau

SEQ ID NO: 2201538 - RNA, 20 nt, Homo sapiens
ccaagauggaugcgacccaa

SEQ ID NO: 2201539 - RNA, 15 nt, Homo sapiens
gagacuccaccucaa

SEQ ID NO: 2201540 - RNA, 18 nt, Homo sapiens
uaaguugucgaacaguag

SEQ ID NO: 2201541 - RNA, 22 nt, Homo sapiens
cagugucguuuauauuguagca

SEQ ID NO: 2201542 - RNA, 22 nt, Homo sapiens
uggagagauguuuggaaaccac

SEQ ID NO: 2201543 - RNA, 13 nt, Homo sapiens
gugaacauuccua

SEQ ID NO: 2201544 - RNA, 23 nt, Homo sapiens
uggaaacggcuuuucuuggccaa

SEQ ID NO: 2201545 - RNA, 21 nt, Homo sapiens
ugugacaauaaguuugaaccu

SEQ ID NO: 2201546 - RNA, 19 nt, Homo sapiens
ucuccccucguuaacacau

SEQ ID NO: 2201547 - RNA, 20 nt, Homo sapiens
ccagguggggugaggcagug

SEQ ID NO: 2201548 - RNA, 20 nt, Homo sapiens
uaggccccguggugacauuu

SEQ ID NO: 2201549 - RNA, 15 nt, Homo sapiens
auacacaacuuugca

SEQ ID NO: 2201550 - RNA, 9 nt, Homo sapiens
cacaucucc

SEQ ID NO: 2201551 - RNA, 15 nt, Homo sapiens
uauaaucauauccag

SEQ ID NO: 2201552 - RNA, 15 nt, Homo sapiens
uuuaaucauuuccag

SEQ ID NO: 2201553 - RNA, 21 nt, Homo sapiens
cccaggagagagaaagccagg

SEQ ID NO: 2201554 - RNA, 21 nt, Homo sapiens
accucaguuccacgguugcua

SEQ ID NO: 2201555 - RNA, 21 nt, Homo sapiens
uaagcccugagacucccgccu

SEQ ID NO: 2201556 - RNA, 23 nt, Homo sapiens
uaaggccggcggcucggggcccc

SEQ ID NO: 2201557 - RNA, 23 nt, Homo sapiens
agagucuuugauucaccaaacau

SEQ ID NO: 2201558 - RNA, 12 nt, Homo sapiens
aaagaaaaccac

SEQ ID NO: 2201559 - RNA, 17 nt, Homo sapiens
agggacacuaggaauca

SEQ ID NO: 2201560 - RNA, 22 nt, Homo sapiens
cagucccuaucagcgccuccuu

SEQ ID NO: 2201561 - RNA, 18 nt, Homo sapiens
cagcagaucccagcucac

SEQ ID NO: 2201562 - RNA, 23 nt, Homo sapiens
ccccuuuacuauaagacuauaaa

SEQ ID NO: 2201563 - RNA, 19 nt, Homo sapiens
ccuuugaguuuuguauuca

SEQ ID NO: 2201564 - RNA, 20 nt, Homo sapiens
ugcagauuuccaacuuuuau

SEQ ID NO: 2201565 - RNA, 15 nt, Homo sapiens
ggacuccagaucugc

SEQ ID NO: 2201566 - RNA, 23 nt, Homo sapiens
gaguucucucaucggaggcccau

SEQ ID NO: 2201567 - RNA, 12 nt, Homo sapiens
cuggaccugcug

SEQ ID NO: 2201568 - RNA, 23 nt, Homo sapiens
aauauuuuuuuccuuugcauuca

SEQ ID NO: 2201569 - RNA, 17 nt, Homo sapiens
gugugacaucacagggc

SEQ ID NO: 2201570 - RNA, 20 nt, Homo sapiens
agaaauggauguaagccugg

SEQ ID NO: 2201571 - RNA, 15 nt, Homo sapiens
cccuauuuuugcaau

SEQ ID NO: 2201572 - RNA, 23 nt, Homo sapiens
ccagaggaaagaccaugugguuu

SEQ ID NO: 2201573 - RNA, 12 nt, Homo sapiens
aaccaucucugu

SEQ ID NO: 2201574 - RNA, 16 nt, Homo sapiens
ugcagggcucaggggg

SEQ ID NO: 2201575 - RNA, 22 nt, Homo sapiens
cuguucccaccaggcugcucag

SEQ ID NO: 2201576 - RNA, 22 nt, Homo sapiens
ucaaaaauccuuaugcaugaaa

SEQ ID NO: 2201577 - RNA, 14 nt, Homo sapiens
cagacuucuccaga

SEQ ID NO: 2201578 - RNA, 20 nt, Homo sapiens
aaaguauuuacugacugcuu

SEQ ID NO: 2201579 - RNA, 21 nt, Homo sapiens
auuuaaaaugcucaauuucag

SEQ ID NO: 2201580 - RNA, 19 nt, Homo sapiens
gcuugcagugaaguguucu

SEQ ID NO: 2201581 - RNA, 14 nt, Homo sapiens
caacugaauugcaa

SEQ ID NO: 2201582 - RNA, 20 nt, Homo sapiens
auucaucgguauucauccaa

SEQ ID NO: 2201583 - RNA, 16 nt, Homo sapiens
uugcuauaguugcuaa

SEQ ID NO: 2201584 - RNA, 17 nt, Homo sapiens
ccuggugcacagggcua

SEQ ID NO: 2201585 - RNA, 18 nt, Homo sapiens
ugaucuuuggaaugcaug

SEQ ID NO: 2201586 - RNA, 23 nt, Homo sapiens
cauaacauuguacuguaauggag

SEQ ID NO: 2201587 - RNA, 22 nt, Homo sapiens
ggacgauagcuuggagggaugg

SEQ ID NO: 2201588 - RNA, 14 nt, Homo sapiens
agucugcuuagaaa

SEQ ID NO: 2201589 - RNA, 19 nt, Homo sapiens
acuucuccugaaugcaucc

SEQ ID NO: 2201590 - RNA, 20 nt, Homo sapiens
aauccaguaaucuaaaggaa

SEQ ID NO: 2201591 - RNA, 21 nt, Homo sapiens
acauguugauuuccuauguau

SEQ ID NO: 2201592 - RNA, 19 nt, Homo sapiens
uccagcugcucugucuucu

SEQ ID NO: 2201593 - RNA, 15 nt, Homo sapiens
cuauaaugagcaugu

SEQ ID NO: 2201594 - RNA, 14 nt, Homo sapiens
ugauuucagaagga

SEQ ID NO: 2201595 - RNA, 21 nt, Homo sapiens
accauccuuccauccugagga

SEQ ID NO: 2201596 - RNA, 12 nt, Homo sapiens
guccugaccacc

SEQ ID NO: 2201597 - RNA, 14 nt, Homo sapiens
gugaguuugagcug

SEQ ID NO: 2201598 - RNA, 14 nt, Homo sapiens
gagagucaauguca

SEQ ID NO: 2201599 - RNA, 14 nt, Homo sapiens
aaaagucaguauca

SEQ ID NO: 2201600 - RNA, 14 nt, Homo sapiens
cgcuucauaggcag

SEQ ID NO: 2201601 - RNA, 14 nt, Homo sapiens
ugagcgcuguguua

SEQ ID NO: 2201602 - RNA, 22 nt, Homo sapiens
cagaaguuugcuucuuauggua

SEQ ID NO: 2201603 - RNA, 11 nt, Homo sapiens
cucagugcuuu

SEQ ID NO: 2201604 - RNA, 19 nt, Homo sapiens
aauaaagcaaucugauuca

SEQ ID NO: 2201605 - RNA, 12 nt, Homo sapiens
ucacucugucag

SEQ ID NO: 2201606 - RNA, 12 nt, Homo sapiens
ugcuuguucccu

SEQ ID NO: 2201607 - RNA, 14 nt, Homo sapiens
aguaaaccaaaaag

SEQ ID NO: 2201608 - RNA, 14 nt, Homo sapiens
agugaaccaaagag

SEQ ID NO: 2201609 - RNA, 17 nt, Homo sapiens
cagacuucagacuuuca

SEQ ID NO: 2201610 - RNA, 21 nt, Homo sapiens
cugccaaagaagccuugccau

SEQ ID NO: 2201611 - RNA, 23 nt, Homo sapiens
aguggaggaggggguacaguccu

SEQ ID NO: 2201612 - RNA, 15 nt, Homo sapiens
caggaccaucuuccc

SEQ ID NO: 2201613 - RNA, 21 nt, Homo sapiens
agggcuugucauuaccagacg

SEQ ID NO: 2201614 - RNA, 19 nt, Homo sapiens
ucucugucucaugugugcu

SEQ ID NO: 2201615 - RNA, 19 nt, Homo sapiens
ugcccuagaucaacagauc

SEQ ID NO: 2201616 - RNA, 15 nt, Homo sapiens
gugaguccugauccu

SEQ ID NO: 2201617 - RNA, 21 nt, Homo sapiens
cugguaauaaaugugacucag

SEQ ID NO: 2201618 - RNA, 13 nt, Homo sapiens
acuggaaucagcu

SEQ ID NO: 2201619 - RNA, 22 nt, Homo sapiens
aaauauuuuacccaaauacuca

SEQ ID NO: 2201620 - RNA, 16 nt, Homo sapiens
augcauugucugcaau

SEQ ID NO: 2201621 - RNA, 13 nt, Homo sapiens
guccaugcucaga

SEQ ID NO: 2201622 - RNA, 16 nt, Homo sapiens
ugucauaaaaagacaa

SEQ ID NO: 2201623 - RNA, 15 nt, Homo sapiens
ggaugagaaugugac

SEQ ID NO: 2201624 - RNA, 10 nt, Homo sapiens
cauacuuugg

SEQ ID NO: 2201625 - RNA, 18 nt, Homo sapiens
acgugcgcucugccauuc

SEQ ID NO: 2201626 - RNA, 13 nt, Homo sapiens
ucuguacaaugac

SEQ ID NO: 2201627 - RNA, 18 nt, Homo sapiens
agacaaaguuuugcucuu

SEQ ID NO: 2201628 - RNA, 18 nt, Homo sapiens
uaucagauguuucacuga

SEQ ID NO: 2201629 - RNA, 16 nt, Homo sapiens
cuaaacaaugcugauu

SEQ ID NO: 2201630 - RNA, 16 nt, Homo sapiens
caccuccucauguaca

SEQ ID NO: 2201631 - RNA, 16 nt, Homo sapiens
cagcuuuugcaacuua

SEQ ID NO: 2201632 - RNA, 20 nt, Homo sapiens
cuggagaggggccugggaaa

SEQ ID NO: 2201633 - RNA, 14 nt, Homo sapiens
aaggaacucugcag

SEQ ID NO: 2201634 - RNA, 18 nt, Homo sapiens
uagacaccuucugugcuc

SEQ ID NO: 2201635 - RNA, 18 nt, Homo sapiens
uggcccagugcaaucugu

SEQ ID NO: 2201636 - RNA, 13 nt, Homo sapiens
aaccucuaugcaa

SEQ ID NO: 2201637 - RNA, 16 nt, Homo sapiens
aguggauuacugccau

SEQ ID NO: 2201638 - RNA, 12 nt, Homo sapiens
agcccagcauuu

SEQ ID NO: 2201639 - RNA, 15 nt, Homo sapiens
cauuccuuacuugca

SEQ ID NO: 2201640 - RNA, 15 nt, Homo sapiens
aaauguauccaucuu

SEQ ID NO: 2201641 - RNA, 18 nt, Homo sapiens
uccucuccacugccuucg

SEQ ID NO: 2201642 - RNA, 15 nt, Homo sapiens
ccaagcaggcacucu

SEQ ID NO: 2201643 - RNA, 23 nt, Homo sapiens
uagauguaugcacacacauauau

SEQ ID NO: 2201644 - RNA, 14 nt, Homo sapiens
uugcaggugacauu

SEQ ID NO: 2201645 - RNA, 14 nt, Homo sapiens
ucacaaacugugaa

SEQ ID NO: 2201646 - RNA, 13 nt, Homo sapiens
gccccuccaaacc

SEQ ID NO: 2201647 - RNA, 18 nt, Homo sapiens
uccaucuucauagcccaa

SEQ ID NO: 2201648 - RNA, 12 nt, Homo sapiens
uuugucauauau

SEQ ID NO: 2201649 - RNA, 16 nt, Homo sapiens
ccacagcaaccccagg

SEQ ID NO: 2201650 - RNA, 21 nt, Homo sapiens
acucacugacuccucacuggc

SEQ ID NO: 2201651 - RNA, 16 nt, Homo sapiens
ugugaagcaaacucua

SEQ ID NO: 2201652 - RNA, 20 nt, Homo sapiens
uuuaaucgaacgcgugugug

SEQ ID NO: 2201653 - RNA, 20 nt, Homo sapiens
aaggugauuuuccugugucc

SEQ ID NO: 2201654 - RNA, 15 nt, Homo sapiens
gagacucagugcaga

SEQ ID NO: 2201655 - RNA, 22 nt, Homo sapiens
ucagaaaauguucuguuugcug

SEQ ID NO: 2201656 - RNA, 19 nt, Homo sapiens
acugccuguagagacaaua

SEQ ID NO: 2201657 - RNA, 18 nt, Homo sapiens
uguacuauucaaucuuua

SEQ ID NO: 2201658 - RNA, 14 nt, Homo sapiens
uccucucccaguga

SEQ ID NO: 2201659 - RNA, 11 nt, Homo sapiens
uauaacuaaua

SEQ ID NO: 2201660 - RNA, 15 nt, Homo sapiens
caucagagacaguau

SEQ ID NO: 2201661 - RNA, 19 nt, Homo sapiens
ucacccgagcuagagugca

SEQ ID NO: 2201662 - RNA, 14 nt, Homo sapiens
cuuaaacacacauu

SEQ ID NO: 2201663 - RNA, 23 nt, Homo sapiens
auuuauugucggaagacuugcca

SEQ ID NO: 2201664 - RNA, 21 nt, Homo sapiens
aagugugcuggccucucugac

SEQ ID NO: 2201665 - RNA, 19 nt, Homo sapiens
ugcuagacucuagacaaga

SEQ ID NO: 2201666 - RNA, 13 nt, Homo sapiens
uucagucuugccu

SEQ ID NO: 2201667 - RNA, 23 nt, Homo sapiens
uaaagcccuuuauuuauaauaca

SEQ ID NO: 2201668 - RNA, 18 nt, Homo sapiens
gaaggagugcgugccugc

SEQ ID NO: 2201669 - RNA, 21 nt, Homo sapiens
auaagggaggaauauagaaug

SEQ ID NO: 2201670 - RNA, 13 nt, Homo sapiens
accaaugucuuga

SEQ ID NO: 2201671 - RNA, 16 nt, Homo sapiens
agcuuggaaaaguaac

SEQ ID NO: 2201672 - RNA, 14 nt, Homo sapiens
gaccacgaggcuga

SEQ ID NO: 2201673 - RNA, 13 nt, Homo sapiens
uccccuuguaaaa

SEQ ID NO: 2201674 - RNA, 22 nt, Homo sapiens
acuuuauguaguuuuuauaugu

SEQ ID NO: 2201675 - RNA, 17 nt, Homo sapiens
cccauggaccaugcugu

SEQ ID NO: 2201676 - RNA, 15 nt, Homo sapiens
caggccccaccuccu

SEQ ID NO: 2201677 - RNA, 19 nt, Homo sapiens
uaggcaaagcaaucaagca

SEQ ID NO: 2201678 - RNA, 17 nt, Homo sapiens
uucuuuaguacuuacau

SEQ ID NO: 2201679 - RNA, 12 nt, Homo sapiens
ugacuagccauc

SEQ ID NO: 2201680 - RNA, 19 nt, Homo sapiens
cccagagguaacagaacag

SEQ ID NO: 2201681 - RNA, 20 nt, Homo sapiens
aacacagcuugucucuugcc

SEQ ID NO: 2201682 - RNA, 22 nt, Homo sapiens
cuggcaguugaacagagggaga

SEQ ID NO: 2201683 - RNA, 15 nt, Homo sapiens
aaaaaugcugagcca

SEQ ID NO: 2201684 - RNA, 13 nt, Homo sapiens
auuucuacuguca

SEQ ID NO: 2201685 - RNA, 15 nt, Homo sapiens
uccuuuuccagaaau

SEQ ID NO: 2201686 - RNA, 20 nt, Homo sapiens
uaucacuuuuugaacuaaga

SEQ ID NO: 2201687 - RNA, 20 nt, Homo sapiens
uggugggccucggguccagc

SEQ ID NO: 2201688 - RNA, 19 nt, Homo sapiens
uuaaggggagcaacagagg

SEQ ID NO: 2201689 - RNA, 14 nt, Homo sapiens
uguaacugccaggc

SEQ ID NO: 2201690 - RNA, 16 nt, Homo sapiens
uuaaaacagcugcgac

SEQ ID NO: 2201691 - RNA, 18 nt, Homo sapiens
gcauccuggcacccggcc

SEQ ID NO: 2201692 - RNA, 15 nt, Homo sapiens
aaaucauaguuuaaa

SEQ ID NO: 2201693 - RNA, 22 nt, Homo sapiens
acaaauguuuugcucaauagau

SEQ ID NO: 2201694 - RNA, 15 nt, Homo sapiens
uaaaauuaccagaca

SEQ ID NO: 2201695 - RNA, 16 nt, Homo sapiens
cacuugaggccaguga

SEQ ID NO: 2201696 - RNA, 19 nt, Homo sapiens
caucaucuccugccuuccu

SEQ ID NO: 2201697 - RNA, 13 nt, Homo sapiens
cuaaacuuacauu

SEQ ID NO: 2201698 - RNA, 15 nt, Homo sapiens
gaccuccaaagaaca

SEQ ID NO: 2201699 - RNA, 18 nt, Homo sapiens
cauucagauuuaccauaa

SEQ ID NO: 2201700 - RNA, 11 nt, Homo sapiens
uagcaaagagg

SEQ ID NO: 2201701 - RNA, 22 nt, Homo sapiens
agaaguucaaacccuguaucca

SEQ ID NO: 2201702 - RNA, 16 nt, Homo sapiens
uccccguccacagggc

SEQ ID NO: 2201703 - RNA, 19 nt, Homo sapiens
ucaaaggccacauaccucu

SEQ ID NO: 2201704 - RNA, 11 nt, Homo sapiens
cacuaugacau

SEQ ID NO: 2201705 - RNA, 21 nt, Homo sapiens
uugauauuuauuuuuugccau

SEQ ID NO: 2201706 - RNA, 17 nt, Homo sapiens
cuuggucuguacaaaua

SEQ ID NO: 2201707 - RNA, 22 nt, Homo sapiens
ucuguuauuaacaaacaucacu

SEQ ID NO: 2201708 - RNA, 19 nt, Homo sapiens
gcccccugaugccaccgag

SEQ ID NO: 2201709 - RNA, 13 nt, Homo sapiens
uaaugucagcuua

SEQ ID NO: 2201710 - RNA, 20 nt, Homo sapiens
uaaaaagccugcaauuucau

SEQ ID NO: 2201711 - RNA, 13 nt, Homo sapiens
ggcuccuguggua

SEQ ID NO: 2201712 - RNA, 15 nt, Homo sapiens
uggaacagauuucaa

SEQ ID NO: 2201713 - RNA, 21 nt, Homo sapiens
ccaauacguagauuuuugcuc

SEQ ID NO: 2201714 - RNA, 18 nt, Homo sapiens
gaaaggucauccaaagaa

SEQ ID NO: 2201715 - RNA, 20 nt, Homo sapiens
uacuuaucuugcuccauugu

SEQ ID NO: 2201716 - RNA, 19 nt, Homo sapiens
aaggaaacccccaguguaa

SEQ ID NO: 2201717 - RNA, 20 nt, Homo sapiens
uaccaccaagggaucugcca

SEQ ID NO: 2201718 - RNA, 15 nt, Homo sapiens
gaugauugccaacag

SEQ ID NO: 2201719 - RNA, 22 nt, Homo sapiens
gcacuuuguucuggcucuucca

SEQ ID NO: 2201720 - RNA, 18 nt, Homo sapiens
ucuggcuuuacauuuuau

SEQ ID NO: 2201721 - RNA, 18 nt, Homo sapiens
uaugguuuuccaucuuau

SEQ ID NO: 2201722 - RNA, 12 nt, Homo sapiens
uaaagcugccag

SEQ ID NO: 2201723 - RNA, 15 nt, Homo sapiens
ccugagguuugccag

SEQ ID NO: 2201724 - RNA, 15 nt, Homo sapiens
ccucaggugcugucc

SEQ ID NO: 2201725 - RNA, 15 nt, Homo sapiens
ugugcaucuggugua

SEQ ID NO: 2201726 - RNA, 17 nt, Homo sapiens
ccuugucauagaggaaa

SEQ ID NO: 2201727 - RNA, 13 nt, Homo sapiens
agcuacuaaugau

SEQ ID NO: 2201728 - RNA, 20 nt, Homo sapiens
uacaugaaauaaugcacuga

SEQ ID NO: 2201729 - RNA, 16 nt, Homo sapiens
uccaguuuuggaucuu

SEQ ID NO: 2201730 - RNA, 17 nt, Homo sapiens
agcugcaacaguggugu

SEQ ID NO: 2201731 - RNA, 20 nt, Homo sapiens
aacuugguugguccuugucu

SEQ ID NO: 2201732 - RNA, 17 nt, Homo sapiens
gaacaucccuccuggga

SEQ ID NO: 2201733 - RNA, 22 nt, Homo sapiens
gugaacaguugcuguucuuaca

SEQ ID NO: 2201734 - RNA, 19 nt, Homo sapiens
ggcaaucucagaugcaguu

SEQ ID NO: 2201735 - RNA, 22 nt, Homo sapiens
auuccuuuauuuugcugcuuga

SEQ ID NO: 2201736 - RNA, 16 nt, Homo sapiens
aauacaaaaaccaaaa

SEQ ID NO: 2201737 - RNA, 14 nt, Homo sapiens
acuuucucugcaaa

SEQ ID NO: 2201738 - RNA, 18 nt, Homo sapiens
aacauuuccucuuuccaa

SEQ ID NO: 2201739 - RNA, 23 nt, Homo sapiens
uaaugaaaaugaauaucuauuaa

SEQ ID NO: 2201740 - RNA, 22 nt, Homo sapiens
uuacagacugaugccagacaaa

SEQ ID NO: 2201741 - RNA, 16 nt, Homo sapiens
ucccauagccaggaaa

SEQ ID NO: 2201742 - RNA, 22 nt, Homo sapiens
uauugucugucucuauauugcu

SEQ ID NO: 2201743 - RNA, 14 nt, Homo sapiens
gauauuuuaucuau

SEQ ID NO: 2201744 - RNA, 17 nt, Homo sapiens
cugcagaaggccaagaa

SEQ ID NO: 2201745 - RNA, 16 nt, Homo sapiens
aguagucccugcacag

SEQ ID NO: 2201746 - RNA, 16 nt, Homo sapiens
acuuuuauaccuaucu

SEQ ID NO: 2201747 - RNA, 13 nt, Homo sapiens
agaacuagguuua

SEQ ID NO: 2201748 - RNA, 19 nt, Homo sapiens
guucucauaacucugugau

SEQ ID NO: 2201749 - RNA, 17 nt, Homo sapiens
cucagcucacucugcaa

SEQ ID NO: 2201750 - RNA, 16 nt, Homo sapiens
aggcagggcugggaag

SEQ ID NO: 2201751 - RNA, 20 nt, Homo sapiens
gaucuugcauucccaguggu

SEQ ID NO: 2201752 - RNA, 14 nt, Homo sapiens
aguaucaccaaaaa

SEQ ID NO: 2201753 - RNA, 10 nt, Homo sapiens
ucucccaaag

SEQ ID NO: 2201754 - RNA, 20 nt, Homo sapiens
uaucuuaaguucuaugaaga

SEQ ID NO: 2201755 - RNA, 18 nt, Homo sapiens
gccgaggucacucugggc

SEQ ID NO: 2201756 - RNA, 15 nt, Homo sapiens
caaaaauguuuuuca

SEQ ID NO: 2201757 - RNA, 19 nt, Homo sapiens
gaaaucuauagaacugaau

SEQ ID NO: 2201758 - RNA, 17 nt, Homo sapiens
cagagauugaacuccaa

SEQ ID NO: 2201759 - RNA, 16 nt, Homo sapiens
cacugccucauggcau

SEQ ID NO: 2201760 - RNA, 18 nt, Homo sapiens
cuccuccguguggacugu

SEQ ID NO: 2201761 - RNA, 17 nt, Homo sapiens
acaauuuucugcaggau

SEQ ID NO: 2201762 - RNA, 19 nt, Homo sapiens
agcccauaucuacaguacu

SEQ ID NO: 2201763 - RNA, 19 nt, Homo sapiens
cucaccugucaucucacau

SEQ ID NO: 2201764 - RNA, 14 nt, Homo sapiens
uggggucugugaug

SEQ ID NO: 2201765 - RNA, 20 nt, Homo sapiens
cuucccccaugugccuguca

SEQ ID NO: 2201766 - RNA, 22 nt, Homo sapiens
cagagcaucucggaguucagac

SEQ ID NO: 2201767 - RNA, 20 nt, Homo sapiens
acugcuaggaugaagcccua

SEQ ID NO: 2201768 - RNA, 17 nt, Homo sapiens
caauugugacagcaguu

SEQ ID NO: 2201769 - RNA, 19 nt, Homo sapiens
caaagaagaccacaaauag

SEQ ID NO: 2201770 - RNA, 18 nt, Homo sapiens
uaaagcauuccccaaaga

SEQ ID NO: 2201771 - RNA, 14 nt, Homo sapiens
aggaccaagccaca

SEQ ID NO: 2201772 - RNA, 14 nt, Homo sapiens
gcuuauacaaauuu

SEQ ID NO: 2201773 - RNA, 14 nt, Homo sapiens
uuauauuugucuca

SEQ ID NO: 2201774 - RNA, 20 nt, Homo sapiens
ggaaucuuuuauaacaccuu

SEQ ID NO: 2201775 - RNA, 18 nt, Homo sapiens
auuuucaaauucuacuga

SEQ ID NO: 2201776 - RNA, 17 nt, Homo sapiens
augaggaaagacacaga

SEQ ID NO: 2201777 - RNA, 14 nt, Homo sapiens
ucagcccucagaag

SEQ ID NO: 2201778 - RNA, 14 nt, Homo sapiens
uuacuguggauaaa

SEQ ID NO: 2201779 - RNA, 20 nt, Homo sapiens
gacagucuggccacugucaa

SEQ ID NO: 2201780 - RNA, 14 nt, Homo sapiens
uccucggguaccaa

SEQ ID NO: 2201781 - RNA, 23 nt, Homo sapiens
aacauacuucaaaaauaaugugc

SEQ ID NO: 2201782 - RNA, 21 nt, Homo sapiens
caagcagagugauucaggggc

SEQ ID NO: 2201783 - RNA, 20 nt, Homo sapiens
cgagggcuacucagcaguaa

SEQ ID NO: 2201784 - RNA, 18 nt, Homo sapiens
acgugaggccugcacagc

SEQ ID NO: 2201785 - RNA, 23 nt, Homo sapiens
ucaaauugucuuuugucaugugg

SEQ ID NO: 2201786 - RNA, 15 nt, Homo sapiens
agaccaccacauuga

SEQ ID NO: 2201787 - RNA, 19 nt, Homo sapiens
gccagcugcccccagagcc

SEQ ID NO: 2201788 - RNA, 13 nt, Homo sapiens
ccaggugcaaaag

SEQ ID NO: 2201789 - RNA, 15 nt, Homo sapiens
aggguggggauauca

SEQ ID NO: 2201790 - RNA, 16 nt, Homo sapiens
acgggcacaacuggaa

SEQ ID NO: 2201791 - RNA, 18 nt, Homo sapiens
aauuauaauaaaggucac

SEQ ID NO: 2201792 - RNA, 15 nt, Homo sapiens
cugagcccacucuac

SEQ ID NO: 2201793 - RNA, 10 nt, Homo sapiens
gaaccaaaac

SEQ ID NO: 2201794 - RNA, 14 nt, Homo sapiens
ggccccgucugugg

SEQ ID NO: 2201795 - RNA, 20 nt, Homo sapiens
uccuauggguugucaccaag

SEQ ID NO: 2201796 - RNA, 15 nt, Homo sapiens
aauacuaaacuacau

SEQ ID NO: 2201797 - RNA, 13 nt, Homo sapiens
ugaaugaucuugu

SEQ ID NO: 2201798 - RNA, 17 nt, Homo sapiens
ugcacuguccugaccau

SEQ ID NO: 2201799 - RNA, 13 nt, Homo sapiens
aaauaaugaacug

SEQ ID NO: 2201800 - RNA, 19 nt, Homo sapiens
cucuagacaagauauugua

SEQ ID NO: 2201801 - RNA, 18 nt, Homo sapiens
cagagcacuguagcacuu

SEQ ID NO: 2201802 - RNA, 22 nt, Homo sapiens
caaggagggggccucauugugu

SEQ ID NO: 2201803 - RNA, 23 nt, Homo sapiens
cucaacaaugguugaaugaauaa

SEQ ID NO: 2201804 - RNA, 16 nt, Homo sapiens
caagggcccucacuca

SEQ ID NO: 2201805 - RNA, 16 nt, Homo sapiens
gguuuuucuguucccu

SEQ ID NO: 2201806 - RNA, 15 nt, Homo sapiens
uagcucucccaguga

SEQ ID NO: 2201807 - RNA, 23 nt, Homo sapiens
ccacaauuuccuggguuccacca

SEQ ID NO: 2201808 - RNA, 20 nt, Homo sapiens
uguucugugcauauaguguu

SEQ ID NO: 2201809 - RNA, 15 nt, Homo sapiens
auuuucuuaaaccaa

SEQ ID NO: 2201810 - RNA, 14 nt, Homo sapiens
gacacugugcuaua

SEQ ID NO: 2201811 - RNA, 20 nt, Homo sapiens
aacguuuggaagauccugug

SEQ ID NO: 2201812 - RNA, 15 nt, Homo sapiens
uuggggaaaaaagca

SEQ ID NO: 2201813 - RNA, 12 nt, Homo sapiens
agcucaguuuau

SEQ ID NO: 2201814 - RNA, 19 nt, Homo sapiens
ucuguaaaaauuguuauaa

SEQ ID NO: 2201815 - RNA, 23 nt, Homo sapiens
acagcagcuucaccagagcauuu

SEQ ID NO: 2201816 - RNA, 20 nt, Homo sapiens
aaaguauuguggcaccucaa

SEQ ID NO: 2201817 - RNA, 11 nt, Homo sapiens
ugcgucccaug

SEQ ID NO: 2201818 - RNA, 13 nt, Homo sapiens
auauugugcaaac

SEQ ID NO: 2201819 - RNA, 20 nt, Homo sapiens
acuggaucucuuaagacagc

SEQ ID NO: 2201820 - RNA, 15 nt, Homo sapiens
gcuuuuuguugccuu

SEQ ID NO: 2201821 - RNA, 20 nt, Homo sapiens
caacguuuuuggacacugug

SEQ ID NO: 2201822 - RNA, 15 nt, Homo sapiens
cagccaacuuuugca

SEQ ID NO: 2201823 - RNA, 23 nt, Homo sapiens
aaacugcuuaugaaaaguacuaa

SEQ ID NO: 2201824 - RNA, 22 nt, Homo sapiens
ugggaauggggugggagccaca

SEQ ID NO: 2201825 - RNA, 21 nt, Homo sapiens
gaugaagauucuccugugcua

SEQ ID NO: 2201826 - RNA, 15 nt, Homo sapiens
caauaaagcuccuuu

SEQ ID NO: 2201827 - RNA, 14 nt, Homo sapiens
aauauauacauucu

SEQ ID NO: 2201828 - RNA, 15 nt, Homo sapiens
cacuucagucugugu

SEQ ID NO: 2201829 - RNA, 19 nt, Homo sapiens
caauaguauuaacuauuag

SEQ ID NO: 2201830 - RNA, 22 nt, Homo sapiens
cauggugcaguuuuggugugua

SEQ ID NO: 2201831 - RNA, 19 nt, Homo sapiens
uccugagccccucaauccu

SEQ ID NO: 2201832 - RNA, 17 nt, Homo sapiens
aauuugucaguguauaa

SEQ ID NO: 2201833 - RNA, 21 nt, Homo sapiens
gcaggucccuuuuugucucuc

SEQ ID NO: 2201834 - RNA, 21 nt, Homo sapiens
gaacuuuuuuagaaaugcaaa

SEQ ID NO: 2201835 - RNA, 21 nt, Homo sapiens
ccaucuuuagaaacaucaguu

SEQ ID NO: 2201836 - RNA, 17 nt, Homo sapiens
caaauccuuuauuauua

SEQ ID NO: 2201837 - RNA, 17 nt, Homo sapiens
gcaaauaacugaucuca

SEQ ID NO: 2201838 - RNA, 12 nt, Homo sapiens
ccucuccaagcu

SEQ ID NO: 2201839 - RNA, 19 nt, Homo sapiens
cucuggccuccaaguccac

SEQ ID NO: 2201840 - RNA, 15 nt, Homo sapiens
ucagggagcauuuaa

SEQ ID NO: 2201841 - RNA, 21 nt, Homo sapiens
caacaugaugaaacccuaucu

SEQ ID NO: 2201842 - RNA, 16 nt, Homo sapiens
agcggaaagcagcuca

SEQ ID NO: 2201843 - RNA, 15 nt, Homo sapiens
uugaauuccauggaa

SEQ ID NO: 2201844 - RNA, 15 nt, Homo sapiens
cugucugggggccag

SEQ ID NO: 2201845 - RNA, 17 nt, Homo sapiens
ugcuguaacucagacau

SEQ ID NO: 2201846 - RNA, 14 nt, Homo sapiens
aacgccuggugccc

SEQ ID NO: 2201847 - RNA, 13 nt, Homo sapiens
uggcugccaaaga

SEQ ID NO: 2201848 - RNA, 15 nt, Homo sapiens
acucaguggacacuc

SEQ ID NO: 2201849 - RNA, 21 nt, Homo sapiens
auguuuuauagacccugggaa

SEQ ID NO: 2201850 - RNA, 20 nt, Homo sapiens
augugggugucagucaggga

SEQ ID NO: 2201851 - RNA, 13 nt, Homo sapiens
uacacaaugcauc

SEQ ID NO: 2201852 - RNA, 12 nt, Homo sapiens
uggauuccucac

SEQ ID NO: 2201853 - RNA, 12 nt, Homo sapiens
gccaacuuuguu

SEQ ID NO: 2201854 - RNA, 14 nt, Homo sapiens
cuauacaaccuaac

SEQ ID NO: 2201855 - RNA, 20 nt, Homo sapiens
aggccaaacacccaagcaca

SEQ ID NO: 2201856 - RNA, 14 nt, Homo sapiens
guuuaaaagcaaaa

SEQ ID NO: 2201857 - RNA, 21 nt, Homo sapiens
aaagugcugggauuacaggca

SEQ ID NO: 2201858 - RNA, 18 nt, Homo sapiens
ccuguaauuuuucuggga

SEQ ID NO: 2201859 - RNA, 13 nt, Homo sapiens
ugauuaaucauaa

SEQ ID NO: 2201860 - RNA, 22 nt, Homo sapiens
gugugggaaagcgcggacgugc

SEQ ID NO: 2201861 - RNA, 23 nt, Homo sapiens
uacaguaacaaauaaagugcagu

SEQ ID NO: 2201862 - RNA, 23 nt, Homo sapiens
cagggagcaguugcccucaggcc

SEQ ID NO: 2201863 - RNA, 14 nt, Homo sapiens
ucauaagcuacuga

SEQ ID NO: 2201864 - RNA, 16 nt, Homo sapiens
accguacaucugcaau

SEQ ID NO: 2201865 - RNA, 15 nt, Homo sapiens
ccaguccacugagca

SEQ ID NO: 2201866 - RNA, 13 nt, Homo sapiens
ugaggcucuucac

SEQ ID NO: 2201867 - RNA, 13 nt, Homo sapiens
cagggaccagcuc

SEQ ID NO: 2201868 - RNA, 15 nt, Homo sapiens
ugcugcacaaaagca

SEQ ID NO: 2201869 - RNA, 23 nt, Homo sapiens
auugggaguuuauaccaagagau

SEQ ID NO: 2201870 - RNA, 17 nt, Homo sapiens
gauugguucaugccugg

SEQ ID NO: 2201871 - RNA, 17 nt, Homo sapiens
gagaagcaaguggcuuu

SEQ ID NO: 2201872 - RNA, 21 nt, Homo sapiens
augaccuuggagaagucacuu

SEQ ID NO: 2201873 - RNA, 16 nt, Homo sapiens
uaugucagcaguauug

SEQ ID NO: 2201874 - RNA, 19 nt, Homo sapiens
ccuuucugugguaauucca

SEQ ID NO: 2201875 - RNA, 17 nt, Homo sapiens
cuguuucacuaauacuu

SEQ ID NO: 2201876 - RNA, 14 nt, Homo sapiens
caauaaacccucag

SEQ ID NO: 2201877 - RNA, 19 nt, Homo sapiens
gaaaauccccaacuaugca

SEQ ID NO: 2201878 - RNA, 22 nt, Homo sapiens
acccuaacugagcugccagugg

SEQ ID NO: 2201879 - RNA, 18 nt, Homo sapiens
cucuccacugggaccuga

SEQ ID NO: 2201880 - RNA, 14 nt, Homo sapiens
gaucugcaguuuuu

SEQ ID NO: 2201881 - RNA, 22 nt, Homo sapiens
augucuuuguuaagacugcuga

SEQ ID NO: 2201882 - RNA, 21 nt, Homo sapiens
uacaggcaugaaccacugcac

SEQ ID NO: 2201883 - RNA, 21 nt, Homo sapiens
uaauagacaguagccaaguua

SEQ ID NO: 2201884 - RNA, 15 nt, Homo sapiens
uuuagggaccugcug

SEQ ID NO: 2201885 - RNA, 22 nt, Homo sapiens
ccaaggaaucagcaggaugugu

SEQ ID NO: 2201886 - RNA, 13 nt, Homo sapiens
auaugucuugcaa

SEQ ID NO: 2201887 - RNA, 13 nt, Homo sapiens
aaaggaccuuccc

SEQ ID NO: 2201888 - RNA, 20 nt, Homo sapiens
gacccagguagucaaaggca

SEQ ID NO: 2201889 - RNA, 16 nt, Homo sapiens
agaagcacggcugugg

SEQ ID NO: 2201890 - RNA, 18 nt, Homo sapiens
auuaaaauaacuaagcaa

SEQ ID NO: 2201891 - RNA, 12 nt, Homo sapiens
ccagcuggagaa

SEQ ID NO: 2201892 - RNA, 16 nt, Homo sapiens
uucuuugaccagcaca

SEQ ID NO: 2201893 - RNA, 18 nt, Homo sapiens
uccuuccaagcacccagc

SEQ ID NO: 2201894 - RNA, 18 nt, Homo sapiens
gugauucuuccaccucag

SEQ ID NO: 2201895 - RNA, 12 nt, Homo sapiens
guuugcacuuac

SEQ ID NO: 2201896 - RNA, 19 nt, Homo sapiens
gugucauccaccagugugu

SEQ ID NO: 2201897 - RNA, 16 nt, Homo sapiens
gauuauucuucuuaca

SEQ ID NO: 2201898 - RNA, 18 nt, Homo sapiens
ggaagcagagcacugugu

SEQ ID NO: 2201899 - RNA, 15 nt, Homo sapiens
uuaaagcaucaucug

SEQ ID NO: 2201900 - RNA, 14 nt, Homo sapiens
aagcccaguagcca

SEQ ID NO: 2201901 - RNA, 21 nt, Homo sapiens
auagugucccaguacaaaaag

SEQ ID NO: 2201902 - RNA, 19 nt, Homo sapiens
uaucacuaagaaagaaagg

SEQ ID NO: 2201903 - RNA, 21 nt, Homo sapiens
caguuugauuguuguuuauaa

SEQ ID NO: 2201904 - RNA, 12 nt, Homo sapiens
aaaaauuauuaa

SEQ ID NO: 2201905 - RNA, 19 nt, Homo sapiens
gauccccgacaguggcucu

SEQ ID NO: 2201906 - RNA, 17 nt, Homo sapiens
auucuuccuugagcuaa

SEQ ID NO: 2201907 - RNA, 17 nt, Homo sapiens
aaucugaggaaggugcu

SEQ ID NO: 2201908 - RNA, 17 nt, Homo sapiens
gccaggacaaugaaaua

SEQ ID NO: 2201909 - RNA, 16 nt, Homo sapiens
gagucugagaaagccu

SEQ ID NO: 2201910 - RNA, 14 nt, Homo sapiens
gggugguggcacau

SEQ ID NO: 2201911 - RNA, 17 nt, Homo sapiens
ucucugcccacuaccua

SEQ ID NO: 2201912 - RNA, 14 nt, Homo sapiens
gcuuaaauccaguu

SEQ ID NO: 2201913 - RNA, 19 nt, Homo sapiens
cuuaaaaagaccaugcauu

SEQ ID NO: 2201914 - RNA, 15 nt, Homo sapiens
gcuaauagugaucaa

SEQ ID NO: 2201915 - RNA, 16 nt, Homo sapiens
ccagcauuuaaccaac

SEQ ID NO: 2201916 - RNA, 17 nt, Homo sapiens
aauugcaaaacuagaca

SEQ ID NO: 2201917 - RNA, 18 nt, Homo sapiens
caccugagacaugcugaa

SEQ ID NO: 2201918 - RNA, 21 nt, Homo sapiens
agugguggcaggacaagagaa

SEQ ID NO: 2201919 - RNA, 17 nt, Homo sapiens
cacauguguaagacacu

SEQ ID NO: 2201920 - RNA, 19 nt, Homo sapiens
cuauuuaaaggcacuauua

SEQ ID NO: 2201921 - RNA, 15 nt, Homo sapiens
aucuucguacaugaa

SEQ ID NO: 2201922 - RNA, 18 nt, Homo sapiens
cuccaccuagacuguaaa

SEQ ID NO: 2201923 - RNA, 18 nt, Homo sapiens
caagaguaaauauuguca

SEQ ID NO: 2201924 - RNA, 22 nt, Homo sapiens
cugagacccccaugguaaugua

SEQ ID NO: 2201925 - RNA, 23 nt, Homo sapiens
ccauauucagcauuugauuucca

SEQ ID NO: 2201926 - RNA, 18 nt, Homo sapiens
aaucagcaaccugacuca

SEQ ID NO: 2201927 - RNA, 16 nt, Homo sapiens
cagcauuauucuucag

SEQ ID NO: 2201928 - RNA, 15 nt, Homo sapiens
ugcacuugcuggaag

SEQ ID NO: 2201929 - RNA, 21 nt, Homo sapiens
cguauuuuggggaacuguugu

SEQ ID NO: 2201930 - RNA, 20 nt, Homo sapiens
cauagugcaaaacuguguca

SEQ ID NO: 2201931 - RNA, 17 nt, Homo sapiens
uauguuaugaacaugca

SEQ ID NO: 2201932 - RNA, 22 nt, Homo sapiens
cuaaauguucaagauaucagca

SEQ ID NO: 2201933 - RNA, 16 nt, Homo sapiens
agggugguggcacauu

SEQ ID NO: 2201934 - RNA, 16 nt, Homo sapiens
cacagacccacagaag

SEQ ID NO: 2201935 - RNA, 15 nt, Homo sapiens
ccauggugcacaaaa

SEQ ID NO: 2201936 - RNA, 16 nt, Homo sapiens
aauaagauuuaauuca

SEQ ID NO: 2201937 - RNA, 12 nt, Homo sapiens
ggaucugaggga

SEQ ID NO: 2201938 - RNA, 18 nt, Homo sapiens
aaagauuugugaacugga

SEQ ID NO: 2201939 - RNA, 19 nt, Homo sapiens
gcacagagagcggcuuccc

SEQ ID NO: 2201940 - RNA, 12 nt, Homo sapiens
ggaaagccucau

SEQ ID NO: 2201941 - RNA, 18 nt, Homo sapiens
uucuuuguagaacugccc

SEQ ID NO: 2201942 - RNA, 17 nt, Homo sapiens
cucuaucugaaccaccc

SEQ ID NO: 2201943 - RNA, 14 nt, Homo sapiens
auugaacucuacaa

SEQ ID NO: 2201944 - RNA, 15 nt, Homo sapiens
acauaaaagaacaau

SEQ ID NO: 2201945 - RNA, 17 nt, Homo sapiens
ugacuguuuucuuuaug

SEQ ID NO: 2201946 - RNA, 20 nt, Homo sapiens
aacaugccaggcucaagguc

SEQ ID NO: 2201947 - RNA, 21 nt, Homo sapiens
cauugcuaaacugaugacuua

SEQ ID NO: 2201948 - RNA, 20 nt, Homo sapiens
ggauccacuggcuggacaaa

SEQ ID NO: 2201949 - RNA, 23 nt, Homo sapiens
agauauuaaaaauugaaaacuuu

SEQ ID NO: 2201950 - RNA, 14 nt, Homo sapiens
cauccagggcugcc

SEQ ID NO: 2201951 - RNA, 22 nt, Homo sapiens
ggaccccgagccuggcuccaaa

SEQ ID NO: 2201952 - RNA, 14 nt, Homo sapiens
caagauuaauuuca

SEQ ID NO: 2201953 - RNA, 20 nt, Homo sapiens
cugcugagucgcucucauga

SEQ ID NO: 2201954 - RNA, 20 nt, Homo sapiens
aaaaaacguauugcauuuaa

SEQ ID NO: 2201955 - RNA, 15 nt, Homo sapiens
cuauggagcaaaaca

SEQ ID NO: 2201956 - RNA, 21 nt, Homo sapiens
auuaggcuucuaaaggacaua

SEQ ID NO: 2201957 - RNA, 18 nt, Homo sapiens
aauauuguguugugaaug

SEQ ID NO: 2201958 - RNA, 18 nt, Homo sapiens
ccugcaaaaacagaggug

SEQ ID NO: 2201959 - RNA, 15 nt, Homo sapiens
ucgaguccccagaac

SEQ ID NO: 2201960 - RNA, 12 nt, Homo sapiens
uagucugcauug

SEQ ID NO: 2201961 - RNA, 15 nt, Homo sapiens
acacacagagcucac

SEQ ID NO: 2201962 - RNA, 21 nt, Homo sapiens
cuagguauucgaaaccuguga

SEQ ID NO: 2201963 - RNA, 23 nt, Homo sapiens
aggaagaagucuaagagugaagu

SEQ ID NO: 2201964 - RNA, 17 nt, Homo sapiens
auuuaagaugugaaaau

SEQ ID NO: 2201965 - RNA, 21 nt, Homo sapiens
aaucaaaaacuuuucauuuca

SEQ ID NO: 2201966 - RNA, 11 nt, Homo sapiens
uccagugcagg

SEQ ID NO: 2201967 - RNA, 23 nt, Homo sapiens
guaaugaaacaccuucucuggag

SEQ ID NO: 2201968 - RNA, 16 nt, Homo sapiens
gaaagcugcuugccau

SEQ ID NO: 2201969 - RNA, 23 nt, Homo sapiens
cuucaggccugcuagucacugga

SEQ ID NO: 2201970 - RNA, 18 nt, Homo sapiens
uaaacaauucaugccuuu

SEQ ID NO: 2201971 - RNA, 22 nt, Homo sapiens
ccuacuaauccucucugcaagu

SEQ ID NO: 2201972 - RNA, 18 nt, Homo sapiens
agugggaagggagcauug

SEQ ID NO: 2201973 - RNA, 11 nt, Homo sapiens
augguguuucu

SEQ ID NO: 2201974 - RNA, 22 nt, Homo sapiens
gggaccaacugggcccaagaca

SEQ ID NO: 2201975 - RNA, 18 nt, Homo sapiens
cuuguaucccuagugcuc

SEQ ID NO: 2201976 - RNA, 20 nt, Homo sapiens
acuuucuuauccuagcacau

SEQ ID NO: 2201977 - RNA, 14 nt, Homo sapiens
gccagggcucagau

SEQ ID NO: 2201978 - RNA, 16 nt, Homo sapiens
agcuucuagacacucc

SEQ ID NO: 2201979 - RNA, 16 nt, Homo sapiens
ccugugccagaccuca

SEQ ID NO: 2201980 - RNA, 14 nt, Homo sapiens
uuguagaugcuauu

SEQ ID NO: 2201981 - RNA, 20 nt, Homo sapiens
aauuccaucagcacaaagac

SEQ ID NO: 2201982 - RNA, 21 nt, Homo sapiens
cugcugcccagugcaaaccac

SEQ ID NO: 2201983 - RNA, 18 nt, Homo sapiens
gaucuucagaacugcccu

SEQ ID NO: 2201984 - RNA, 13 nt, Homo sapiens
gaacagaagugag

SEQ ID NO: 2201985 - RNA, 22 nt, Homo sapiens
cauccauuuguuuucacacuga

SEQ ID NO: 2201986 - RNA, 19 nt, Homo sapiens
ugcuccacuggguuacaga

SEQ ID NO: 2201987 - RNA, 16 nt, Homo sapiens
ugaaagggaaacuggg

SEQ ID NO: 2201988 - RNA, 16 nt, Homo sapiens
ugccauaaaacauuaa

SEQ ID NO: 2201989 - RNA, 14 nt, Homo sapiens
augaaaccacugga

SEQ ID NO: 2201990 - RNA, 14 nt, Homo sapiens
cugagcccccugac

SEQ ID NO: 2201991 - RNA, 17 nt, Homo sapiens
agaguucugaucuguac

SEQ ID NO: 2201992 - RNA, 15 nt, Homo sapiens
cagggccaguccucc

SEQ ID NO: 2201993 - RNA, 18 nt, Homo sapiens
uacaauuuaaugcacuaa

SEQ ID NO: 2201994 - RNA, 18 nt, Homo sapiens
uugaugcuguuucuacau

SEQ ID NO: 2201995 - RNA, 22 nt, Homo sapiens
gccacgaccuggggugggcaca

SEQ ID NO: 2201996 - RNA, 14 nt, Homo sapiens
acaugauccugcaa

SEQ ID NO: 2201997 - RNA, 15 nt, Homo sapiens
cugucauuuccucua

SEQ ID NO: 2201998 - RNA, 12 nt, Homo sapiens
ccaaacagugac

SEQ ID NO: 2201999 - RNA, 18 nt, Homo sapiens
uaaaaaaaaaaaaaagcu

SEQ ID NO: 2202000 - RNA, 16 nt, Homo sapiens
acacucaaaagcuggg

SEQ ID NO: 2202001 - RNA, 15 nt, Homo sapiens
aauauagcucaggua

SEQ ID NO: 2202002 - RNA, 22 nt, Homo sapiens
gaaauaguuauuuuaauaccuu

SEQ ID NO: 2202003 - RNA, 22 nt, Homo sapiens
caaagaauuaugcaucugcuac

SEQ ID NO: 2202004 - RNA, 17 nt, Homo sapiens
aagaauugaacccagga

SEQ ID NO: 2202005 - RNA, 20 nt, Homo sapiens
cacagccgccugaaagccac

SEQ ID NO: 2202006 - RNA, 18 nt, Homo sapiens
uccugguauuauuuacaa

SEQ ID NO: 2202007 - RNA, 21 nt, Homo sapiens
caaaugcuggggucauauaaa

SEQ ID NO: 2202008 - RNA, 23 nt, Homo sapiens
aaugugugguuuuuaugauuuau

SEQ ID NO: 2202009 - RNA, 18 nt, Homo sapiens
ggccgugacgucugggug

SEQ ID NO: 2202010 - RNA, 21 nt, Homo sapiens
ugucuggacucacggagcuca

SEQ ID NO: 2202011 - RNA, 16 nt, Homo sapiens
cucagaggcgcacugu

SEQ ID NO: 2202012 - RNA, 19 nt, Homo sapiens
ccuuccagggcucuuccag

SEQ ID NO: 2202013 - RNA, 18 nt, Homo sapiens
gaaggauugcaaugcccg

SEQ ID NO: 2202014 - RNA, 22 nt, Homo sapiens
auuacaagcuguagaccaccua

SEQ ID NO: 2202015 - RNA, 17 nt, Homo sapiens
aauguacucuugaacuu

SEQ ID NO: 2202016 - RNA, 14 nt, Homo sapiens
cuggaccaaagcug

SEQ ID NO: 2202017 - RNA, 16 nt, Homo sapiens
gcaggcccacucccca

SEQ ID NO: 2202018 - RNA, 14 nt, Homo sapiens
aacaaaaaacugcc

SEQ ID NO: 2202019 - RNA, 22 nt, Homo sapiens
guuccuccuccccucuccuagc

SEQ ID NO: 2202020 - RNA, 13 nt, Homo sapiens
uauuuuuguggac

SEQ ID NO: 2202021 - RNA, 21 nt, Homo sapiens
uggcuucaccaucaauccuga

SEQ ID NO: 2202022 - RNA, 22 nt, Homo sapiens
caggauaugaguacauacucaa

SEQ ID NO: 2202023 - RNA, 22 nt, Homo sapiens
aagcuucucagacuucucuuau

SEQ ID NO: 2202024 - RNA, 16 nt, Homo sapiens
uucugacggcccugca

SEQ ID NO: 2202025 - RNA, 12 nt, Homo sapiens
ugacuucagugu

SEQ ID NO: 2202026 - RNA, 14 nt, Homo sapiens
accccauuagucua

SEQ ID NO: 2202027 - RNA, 13 nt, Homo sapiens
aguuuccaugugg

SEQ ID NO: 2202028 - RNA, 13 nt, Homo sapiens
uuugcacuuucag

SEQ ID NO: 2202029 - RNA, 16 nt, Homo sapiens
cuucuuguacuacaca

SEQ ID NO: 2202030 - RNA, 14 nt, Homo sapiens
aucuauaccaccuu

SEQ ID NO: 2202031 - RNA, 12 nt, Homo sapiens
cccacagcacua

SEQ ID NO: 2202032 - RNA, 18 nt, Homo sapiens
gcucaugccuuaauccca

SEQ ID NO: 2202033 - RNA, 20 nt, Homo sapiens
ugcaagguucaacuuauuaa

SEQ ID NO: 2202034 - RNA, 21 nt, Homo sapiens
agugacauguacauacuguau

SEQ ID NO: 2202035 - RNA, 13 nt, Homo sapiens
aaauuacauuaaa

SEQ ID NO: 2202036 - RNA, 17 nt, Homo sapiens
acaauauguaaucaaac

SEQ ID NO: 2202037 - RNA, 13 nt, Homo sapiens
uugauacaaagua

SEQ ID NO: 2202038 - RNA, 18 nt, Homo sapiens
uaaaaccuuccaugucaa

SEQ ID NO: 2202039 - RNA, 18 nt, Homo sapiens
uauucauggauggcucaa

SEQ ID NO: 2202040 - RNA, 16 nt, Homo sapiens
gaaggcaaaagaaaga

SEQ ID NO: 2202041 - RNA, 14 nt, Homo sapiens
cuucuauguauuag

SEQ ID NO: 2202042 - RNA, 23 nt, Homo sapiens
uaaaauauuuuuaugugcaauaa

SEQ ID NO: 2202043 - RNA, 19 nt, Homo sapiens
aaauguuuauacguggaaa

SEQ ID NO: 2202044 - RNA, 23 nt, Homo sapiens
uacaguuucuucaugcauuacuu

SEQ ID NO: 2202045 - RNA, 20 nt, Homo sapiens
ucuaaagggaucugcuuaaa

SEQ ID NO: 2202046 - RNA, 13 nt, Homo sapiens
aaagaaauccaaa

SEQ ID NO: 2202047 - RNA, 14 nt, Homo sapiens
cccucucucugggc

SEQ ID NO: 2202048 - RNA, 18 nt, Homo sapiens
caaugagcagagauggca

SEQ ID NO: 2202049 - RNA, 16 nt, Homo sapiens
auucccagcuacucau

SEQ ID NO: 2202050 - RNA, 17 nt, Homo sapiens
gugggagcaccugccag

SEQ ID NO: 2202051 - RNA, 14 nt, Homo sapiens
aaguuucccuuccu

SEQ ID NO: 2202052 - RNA, 19 nt, Homo sapiens
gaacuggaggcagggaaca

SEQ ID NO: 2202053 - RNA, 20 nt, Homo sapiens
gaguuccggccugggcacca

SEQ ID NO: 2202054 - RNA, 16 nt, Homo sapiens
uauguacugccuuagu

SEQ ID NO: 2202055 - RNA, 15 nt, Homo sapiens
acuuuaaugaacuaa

SEQ ID NO: 2202056 - RNA, 14 nt, Homo sapiens
gguauguuuuacca

SEQ ID NO: 2202057 - RNA, 22 nt, Homo sapiens
cuggccuaaugagauaauacuc

SEQ ID NO: 2202058 - RNA, 21 nt, Homo sapiens
agaugucugcagcccucagca

SEQ ID NO: 2202059 - RNA, 22 nt, Homo sapiens
guuaggccauucuugcauugau

SEQ ID NO: 2202060 - RNA, 15 nt, Homo sapiens
gacuacucagcacug

SEQ ID NO: 2202061 - RNA, 23 nt, Homo sapiens
aacugagucacucacauugagag

SEQ ID NO: 2202062 - RNA, 16 nt, Homo sapiens
cuaaacccuguuccug

SEQ ID NO: 2202063 - RNA, 18 nt, Homo sapiens
auaaugguugacuggguu

SEQ ID NO: 2202064 - RNA, 20 nt, Homo sapiens
gcccugcucccagacauaaa

SEQ ID NO: 2202065 - RNA, 22 nt, Homo sapiens
cagugcuccccaauuauaucuc

SEQ ID NO: 2202066 - RNA, 22 nt, Homo sapiens
agggggcaucuuuaagcaaggu

SEQ ID NO: 2202067 - RNA, 19 nt, Homo sapiens
cuugugacuuugagacuau

SEQ ID NO: 2202068 - RNA, 14 nt, Homo sapiens
uccuuuugaccaaa

SEQ ID NO: 2202069 - RNA, 16 nt, Homo sapiens
gcaaauguuaugcaua

SEQ ID NO: 2202070 - RNA, 18 nt, Homo sapiens
ugccucuaagcugcucua

SEQ ID NO: 2202071 - RNA, 15 nt, Homo sapiens
ccuggcacacaucag

SEQ ID NO: 2202072 - RNA, 19 nt, Homo sapiens
aggcaacgauggaguacac

SEQ ID NO: 2202073 - RNA, 22 nt, Homo sapiens
acucacaccuguaaucccagca

SEQ ID NO: 2202074 - RNA, 23 nt, Homo sapiens
ugccugguggggaucagacagag

SEQ ID NO: 2202075 - RNA, 18 nt, Homo sapiens
auaggcaggaacauacag

SEQ ID NO: 2202076 - RNA, 21 nt, Homo sapiens
ccauuggagucccugaaggac

SEQ ID NO: 2202077 - RNA, 19 nt, Homo sapiens
aggcuucuacagacuguag

SEQ ID NO: 2202078 - RNA, 21 nt, Homo sapiens
gaagccucacugcaagcacug

SEQ ID NO: 2202079 - RNA, 13 nt, Homo sapiens
aauauuauaguuu

SEQ ID NO: 2202080 - RNA, 16 nt, Homo sapiens
ccuugugcuuagcuuu

SEQ ID NO: 2202081 - RNA, 21 nt, Homo sapiens
uguagccaccuccuuggcacc

SEQ ID NO: 2202082 - RNA, 11 nt, Homo sapiens
cucaacagaga

SEQ ID NO: 2202083 - RNA, 16 nt, Homo sapiens
ucagcccagugcaaac

SEQ ID NO: 2202084 - RNA, 12 nt, Homo sapiens
guccauuaucua

SEQ ID NO: 2202085 - RNA, 23 nt, Homo sapiens
auguguaucagauguuucacuga

SEQ ID NO: 2202086 - RNA, 18 nt, Homo sapiens
uauaucucaaauuguaau

SEQ ID NO: 2202087 - RNA, 19 nt, Homo sapiens
gaacacuggagucuugcaa

SEQ ID NO: 2202088 - RNA, 18 nt, Homo sapiens
gaccuuaugagaaacugc

SEQ ID NO: 2202089 - RNA, 21 nt, Homo sapiens
acugccccacaugcaugucug

SEQ ID NO: 2202090 - RNA, 20 nt, Homo sapiens
auuaaggucauuacucucaa

SEQ ID NO: 2202091 - RNA, 16 nt, Homo sapiens
aauguugacaggcaaa

SEQ ID NO: 2202092 - RNA, 20 nt, Homo sapiens
gcaagacagcccaacagcug

SEQ ID NO: 2202093 - RNA, 14 nt, Homo sapiens
auaagaauuugcau

SEQ ID NO: 2202094 - RNA, 16 nt, Homo sapiens
cacugaguagucauuu

SEQ ID NO: 2202095 - RNA, 22 nt, Homo sapiens
caccuauucuguaguugcagcu

SEQ ID NO: 2202096 - RNA, 22 nt, Homo sapiens
uggugccgaauugucuuuggug

SEQ ID NO: 2202097 - RNA, 22 nt, Homo sapiens
uccuaauaugcuuuacaaucug

SEQ ID NO: 2202098 - RNA, 15 nt, Homo sapiens
ucuaaugaagaauuc

SEQ ID NO: 2202099 - RNA, 23 nt, Homo sapiens
agcuauucucuuaaaaugacaaa

SEQ ID NO: 2202100 - RNA, 22 nt, Homo sapiens
cacccgaagcgcuucugcacca

SEQ ID NO: 2202101 - RNA, 23 nt, Homo sapiens
auaugcugcuugugaccuugacu

SEQ ID NO: 2202102 - RNA, 17 nt, Homo sapiens
ugccuuucaaacauuga

SEQ ID NO: 2202103 - RNA, 22 nt, Homo sapiens
ucuuaagauccacaaaugaagg

SEQ ID NO: 2202104 - RNA, 21 nt, Homo sapiens
acauagaaagccaugugcuaa

SEQ ID NO: 2202105 - RNA, 21 nt, Homo sapiens
cacacuugaauuugggcagcu

SEQ ID NO: 2202106 - RNA, 22 nt, Homo sapiens
guagcccaggccagagugcagu

SEQ ID NO: 2202107 - RNA, 17 nt, Homo sapiens
aaugcuucugccucagc

SEQ ID NO: 2202108 - RNA, 14 nt, Homo sapiens
gccuagugugccaa

SEQ ID NO: 2202109 - RNA, 22 nt, Homo sapiens
cugauugucaacacaaacuggc

SEQ ID NO: 2202110 - RNA, 15 nt, Homo sapiens
gagcuuuccaguuag

SEQ ID NO: 2202111 - RNA, 21 nt, Homo sapiens
aaggucauggccacacuguga

SEQ ID NO: 2202112 - RNA, 21 nt, Homo sapiens
cagagaaguucuggcugaaca

SEQ ID NO: 2202113 - RNA, 17 nt, Homo sapiens
aaacuguaugugcaguu

SEQ ID NO: 2202114 - RNA, 18 nt, Homo sapiens
gcuggcagccacccccuc

SEQ ID NO: 2202115 - RNA, 20 nt, Homo sapiens
gauguaguucuuuucaugca

SEQ ID NO: 2202116 - RNA, 19 nt, Homo sapiens
uaaacaugaagcacaaaaa

SEQ ID NO: 2202117 - RNA, 16 nt, Homo sapiens
gccuuggaaccagccc

SEQ ID NO: 2202118 - RNA, 23 nt, Homo sapiens
aagcauuuuaaaugucaguuaca

SEQ ID NO: 2202119 - RNA, 23 nt, Homo sapiens
ccaagccguaggacccaguuucc

SEQ ID NO: 2202120 - RNA, 16 nt, Homo sapiens
aagcaugaucacagcu

SEQ ID NO: 2202121 - RNA, 12 nt, Homo sapiens
aucuaaacuaga

SEQ ID NO: 2202122 - RNA, 22 nt, Homo sapiens
cuguucucagagcuccacagaa

SEQ ID NO: 2202123 - RNA, 14 nt, Homo sapiens
caguacagaaggca

SEQ ID NO: 2202124 - RNA, 16 nt, Homo sapiens
uuuaagauaaacagaa

SEQ ID NO: 2202125 - RNA, 12 nt, Homo sapiens
caaauauguaug

SEQ ID NO: 2202126 - RNA, 23 nt, Homo sapiens
acuugcuccacucgcacuuauca

SEQ ID NO: 2202127 - RNA, 12 nt, Homo sapiens
cagaagccucac

SEQ ID NO: 2202128 - RNA, 16 nt, Homo sapiens
uggcaggccagugucu

SEQ ID NO: 2202129 - RNA, 23 nt, Homo sapiens
ucuccacuggacccuugauucau

SEQ ID NO: 2202130 - RNA, 20 nt, Homo sapiens
ugagaauguggaauaccuaa

SEQ ID NO: 2202131 - RNA, 16 nt, Homo sapiens
ucagagggcccagugg

SEQ ID NO: 2202132 - RNA, 19 nt, Homo sapiens
gcaguaucaugaagccuaa

SEQ ID NO: 2202133 - RNA, 12 nt, Homo sapiens
ucagagugcaag

SEQ ID NO: 2202134 - RNA, 16 nt, Homo sapiens
cuuuugugaaacuuga

SEQ ID NO: 2202135 - RNA, 22 nt, Homo sapiens
aguagaggguccagucuucuag

SEQ ID NO: 2202136 - RNA, 18 nt, Homo sapiens
acagaacauauguugcaa

SEQ ID NO: 2202137 - RNA, 14 nt, Homo sapiens
aagaaggcaaccca

SEQ ID NO: 2202138 - RNA, 16 nt, Homo sapiens
auucuaacuaaugaca

SEQ ID NO: 2202139 - RNA, 17 nt, Homo sapiens
ugaagguugacacagga

SEQ ID NO: 2202140 - RNA, 15 nt, Homo sapiens
gcuuuuucaguugaa

SEQ ID NO: 2202141 - RNA, 23 nt, Homo sapiens
aaacucaagcuucuucacucaca

SEQ ID NO: 2202142 - RNA, 19 nt, Homo sapiens
acccaugaccguucucuga

SEQ ID NO: 2202143 - RNA, 23 nt, Homo sapiens
agacuuuuaaagacuugcacaaa

SEQ ID NO: 2202144 - RNA, 16 nt, Homo sapiens
uccaauuaugugacaa

SEQ ID NO: 2202145 - RNA, 15 nt, Homo sapiens
guacuauuacuauua

SEQ ID NO: 2202146 - RNA, 15 nt, Homo sapiens
auucuggauaucuca

SEQ ID NO: 2202147 - RNA, 20 nt, Homo sapiens
ucaguaacugucaggcugaa

SEQ ID NO: 2202148 - RNA, 14 nt, Homo sapiens
gggaccagagggau

SEQ ID NO: 2202149 - RNA, 15 nt, Homo sapiens
ccagagcaaacagaa

SEQ ID NO: 2202150 - RNA, 13 nt, Homo sapiens
caaaaaaccucac

SEQ ID NO: 2202151 - RNA, 20 nt, Homo sapiens
gacucaaagagggagugcau

SEQ ID NO: 2202152 - RNA, 22 nt, Homo sapiens
auacagacccacagagugccau

SEQ ID NO: 2202153 - RNA, 18 nt, Homo sapiens
ugcccaccguuaggauuc

SEQ ID NO: 2202154 - RNA, 12 nt, Homo sapiens
acaaaagucugu

SEQ ID NO: 2202155 - RNA, 22 nt, Homo sapiens
uggugcuaccuggcucuccugu

SEQ ID NO: 2202156 - RNA, 17 nt, Homo sapiens
auaucuaucagaguauc

SEQ ID NO: 2202157 - RNA, 19 nt, Homo sapiens
cuauuucuuuaaaugcuuu

SEQ ID NO: 2202158 - RNA, 16 nt, Homo sapiens
uaggaagagaaaccag

SEQ ID NO: 2202159 - RNA, 21 nt, Homo sapiens
uugacaugagucuccagauag

SEQ ID NO: 2202160 - RNA, 13 nt, Homo sapiens
agaucaaugguuu

SEQ ID NO: 2202161 - RNA, 19 nt, Homo sapiens
gucucacuguucugcaaag

SEQ ID NO: 2202162 - RNA, 18 nt, Homo sapiens
ucuaugacugaaguacug

SEQ ID NO: 2202163 - RNA, 12 nt, Homo sapiens
cacagucacugc

SEQ ID NO: 2202164 - RNA, 23 nt, Homo sapiens
agggaugaagaaagacucugaga

SEQ ID NO: 2202165 - RNA, 13 nt, Homo sapiens
auaacagugugcu

SEQ ID NO: 2202166 - RNA, 14 nt, Homo sapiens
ugcuccacaguguu

SEQ ID NO: 2202167 - RNA, 22 nt, Homo sapiens
cauuucugaggugcacugggag

SEQ ID NO: 2202168 - RNA, 23 nt, Homo sapiens
ggaaggagguucucccagcccau

SEQ ID NO: 2202169 - RNA, 19 nt, Homo sapiens
augaucaaaaauaaugcau

SEQ ID NO: 2202170 - RNA, 18 nt, Homo sapiens
uccaucuuugaacuucug

SEQ ID NO: 2202171 - RNA, 16 nt, Homo sapiens
uauauucauaccuguu

SEQ ID NO: 2202172 - RNA, 23 nt, Homo sapiens
agcccaggaagucucaucugggg

SEQ ID NO: 2202173 - RNA, 18 nt, Homo sapiens
cuguuggaaguucacugg

SEQ ID NO: 2202174 - RNA, 13 nt, Homo sapiens
ucuguucaaggaa

SEQ ID NO: 2202175 - RNA, 20 nt, Homo sapiens
cuucuuaacucucuguuaca

SEQ ID NO: 2202176 - RNA, 19 nt, Homo sapiens
uaugugucacacuuugcca

SEQ ID NO: 2202177 - RNA, 14 nt, Homo sapiens
ggcccaacacuggc

SEQ ID NO: 2202178 - RNA, 11 nt, Homo sapiens
ucuugcauucu

SEQ ID NO: 2202179 - RNA, 11 nt, Homo sapiens
auaugcauaua

SEQ ID NO: 2202180 - RNA, 18 nt, Homo sapiens
auaaaggaagucaccaaa

SEQ ID NO: 2202181 - RNA, 18 nt, Homo sapiens
ccucagccuaagaaacac

SEQ ID NO: 2202182 - RNA, 23 nt, Homo sapiens
uccagagacucgaguccccauga

SEQ ID NO: 2202183 - RNA, 19 nt, Homo sapiens
cuggcugcugcugugcagu

SEQ ID NO: 2202184 - RNA, 21 nt, Homo sapiens
ugcauaaacaauccaaaugca

SEQ ID NO: 2202185 - RNA, 21 nt, Homo sapiens
uucaaugcuagaacaacgccu

SEQ ID NO: 2202186 - RNA, 18 nt, Homo sapiens
gaguccaaaccuucuacc

SEQ ID NO: 2202187 - RNA, 21 nt, Homo sapiens
ucagacggccuagugugccaa

SEQ ID NO: 2202188 - RNA, 20 nt, Homo sapiens
ccacugagcuggcugacuaa

SEQ ID NO: 2202189 - RNA, 22 nt, Homo sapiens
aauaagauguaguaacacugug

SEQ ID NO: 2202190 - RNA, 18 nt, Homo sapiens
caugaaggacacucugca

SEQ ID NO: 2202191 - RNA, 13 nt, Homo sapiens
agguaugagccag

SEQ ID NO: 2202192 - RNA, 23 nt, Homo sapiens
ggcuccuccugcccuccaucuca

SEQ ID NO: 2202193 - RNA, 15 nt, Homo sapiens
uaguaaaagugcuuu

SEQ ID NO: 2202194 - RNA, 19 nt, Homo sapiens
cuuccugguagacuagguu

SEQ ID NO: 2202195 - RNA, 17 nt, Homo sapiens
uagagggacccuuccaa

SEQ ID NO: 2202196 - RNA, 14 nt, Homo sapiens
cagcugccagagaa

SEQ ID NO: 2202197 - RNA, 21 nt, Homo sapiens
uuaagcccucgugcacacaca

SEQ ID NO: 2202198 - RNA, 19 nt, Homo sapiens
uguguggucaacauuucuc

SEQ ID NO: 2202199 - RNA, 19 nt, Homo sapiens
aauuccuugccccacaguu

SEQ ID NO: 2202200 - RNA, 20 nt, Homo sapiens
ucugagcaagagcuggcaaa

SEQ ID NO: 2202201 - RNA, 19 nt, Homo sapiens
guuugugcucuacuguuac

SEQ ID NO: 2202202 - RNA, 21 nt, Homo sapiens
ucuucuggacugcacacuucc

SEQ ID NO: 2202203 - RNA, 21 nt, Homo sapiens
auaaaaccucagggacaacau

SEQ ID NO: 2202204 - RNA, 17 nt, Homo sapiens
aacucugggcugccaug

SEQ ID NO: 2202205 - RNA, 18 nt, Homo sapiens
uccugaacugcuuuccau

SEQ ID NO: 2202206 - RNA, 14 nt, Homo sapiens
acuuuaucaaagau

SEQ ID NO: 2202207 - RNA, 17 nt, Homo sapiens
aucaaaggacaccauuu

SEQ ID NO: 2202208 - RNA, 22 nt, Homo sapiens
aggauaucccuuccuacaguaa

SEQ ID NO: 2202209 - RNA, 21 nt, Homo sapiens
cagccugguuucugggugcua

SEQ ID NO: 2202210 - RNA, 19 nt, Homo sapiens
ugcagagguaaaaguguga

SEQ ID NO: 2202211 - RNA, 21 nt, Homo sapiens
uagcuaggugcacauauacau

SEQ ID NO: 2202212 - RNA, 15 nt, Homo sapiens
uuccccuuagagugc

SEQ ID NO: 2202213 - RNA, 13 nt, Homo sapiens
cauacaacagaaa

SEQ ID NO: 2202214 - RNA, 17 nt, Homo sapiens
cugcugcuugaaacuuc

SEQ ID NO: 2202215 - RNA, 17 nt, Homo sapiens
ucuaugaaagcuaugaa

SEQ ID NO: 2202216 - RNA, 18 nt, Homo sapiens
ccuugcugggccagggaa

SEQ ID NO: 2202217 - RNA, 17 nt, Homo sapiens
auuuucuuuacagguau

SEQ ID NO: 2202218 - RNA, 19 nt, Homo sapiens
gcauucauuuuuauagcaa

SEQ ID NO: 2202219 - RNA, 22 nt, Homo sapiens
ggaaguacugcacccagcagug

SEQ ID NO: 2202220 - RNA, 20 nt, Homo sapiens
gaucaaaaccugcuaccucc

SEQ ID NO: 2202221 - RNA, 15 nt, Homo sapiens
ccgaugguacuauuu

SEQ ID NO: 2202222 - RNA, 18 nt, Homo sapiens
cggcccccucaccccagc

SEQ ID NO: 2202223 - RNA, 16 nt, Homo sapiens
ugucaccucagcacug

SEQ ID NO: 2202224 - RNA, 19 nt, Homo sapiens
caugaucuuguuacuguga

SEQ ID NO: 2202225 - RNA, 19 nt, Homo sapiens
agcccuuugcuaaaauaua

SEQ ID NO: 2202226 - RNA, 16 nt, Homo sapiens
cucuucugccuucuca

SEQ ID NO: 2202227 - RNA, 17 nt, Homo sapiens
gagagcagcaggugcug

SEQ ID NO: 2202228 - RNA, 13 nt, Homo sapiens
accagggugcaug

SEQ ID NO: 2202229 - RNA, 19 nt, Homo sapiens
uaugcaaacaguucuugga

SEQ ID NO: 2202230 - RNA, 20 nt, Homo sapiens
aaacaauuggcaaacuuugu

SEQ ID NO: 2202231 - RNA, 13 nt, Homo sapiens
gagccaccuuuac

SEQ ID NO: 2202232 - RNA, 20 nt, Homo sapiens
cuugugccaacacucaagaa

SEQ ID NO: 2202233 - RNA, 19 nt, Homo sapiens
agucggccccaucucucau

SEQ ID NO: 2202234 - RNA, 17 nt, Homo sapiens
ccagaauaacuagcacc

SEQ ID NO: 2202235 - RNA, 17 nt, Homo sapiens
aauugauuucuucucau

SEQ ID NO: 2202236 - RNA, 15 nt, Homo sapiens
cagagcgcaccucaa

SEQ ID NO: 2202237 - RNA, 12 nt, Homo sapiens
cacuguccagua

SEQ ID NO: 2202238 - RNA, 14 nt, Homo sapiens
cuuuguucucucuc

SEQ ID NO: 2202239 - RNA, 12 nt, Homo sapiens
uuauaaucuuuu

SEQ ID NO: 2202240 - RNA, 21 nt, Homo sapiens
cagugaccacgcauugucaca

SEQ ID NO: 2202241 - RNA, 20 nt, Homo sapiens
ccagacuuucuuuuucuaca

SEQ ID NO: 2202242 - RNA, 15 nt, Homo sapiens
uaaaugggacuggag

SEQ ID NO: 2202243 - RNA, 18 nt, Homo sapiens
guggucagcccuaggaua

SEQ ID NO: 2202244 - RNA, 18 nt, Homo sapiens
acagugaaucagucccau

SEQ ID NO: 2202245 - RNA, 15 nt, Homo sapiens
uauaagguaauguag

SEQ ID NO: 2202246 - RNA, 19 nt, Homo sapiens
accacagaugugucuggga

SEQ ID NO: 2202247 - RNA, 18 nt, Homo sapiens
ccuacugccucuccagca

SEQ ID NO: 2202248 - RNA, 22 nt, Homo sapiens
ucuaaacaaaaaaaggcgguga

SEQ ID NO: 2202249 - RNA, 18 nt, Homo sapiens
agcuauacuuacacugua

SEQ ID NO: 2202250 - RNA, 23 nt, Homo sapiens
agcccaagagauuguugcuuugu

SEQ ID NO: 2202251 - RNA, 13 nt, Homo sapiens
guuuaaagucuca

SEQ ID NO: 2202252 - RNA, 18 nt, Homo sapiens
ugagcaagucccaucuca

SEQ ID NO: 2202253 - RNA, 18 nt, Homo sapiens
agagcaagacccaucuca

SEQ ID NO: 2202254 - RNA, 15 nt, Homo sapiens
uuggaacugcaauga

SEQ ID NO: 2202255 - RNA, 22 nt, Homo sapiens
aaggacucccggagccugugca

SEQ ID NO: 2202256 - RNA, 12 nt, Homo sapiens
aauagcucagaa

SEQ ID NO: 2202257 - RNA, 16 nt, Homo sapiens
cuuacaaauacuaaaa

SEQ ID NO: 2202258 - RNA, 17 nt, Homo sapiens
ugaacaccuauugcacu

SEQ ID NO: 2202259 - RNA, 16 nt, Homo sapiens
aggucaaaaaggccaa

SEQ ID NO: 2202260 - RNA, 22 nt, Homo sapiens
auauuaggcuauaaauguccua

SEQ ID NO: 2202261 - RNA, 14 nt, Homo sapiens
ccaaagagugcuaa

SEQ ID NO: 2202262 - RNA, 20 nt, Homo sapiens
aauaaagcugauagcauaua

SEQ ID NO: 2202263 - RNA, 20 nt, Homo sapiens
uaccucugaucaaagcaccu

SEQ ID NO: 2202264 - RNA, 22 nt, Homo sapiens
caguuuuuucaccuccauguca

SEQ ID NO: 2202265 - RNA, 21 nt, Homo sapiens
gcagcucuucuggcuguguug

SEQ ID NO: 2202266 - RNA, 22 nt, Homo sapiens
acacauuaaaggaaaaauagca

SEQ ID NO: 2202267 - RNA, 22 nt, Homo sapiens
gugcauuaacuuaaaagauuca

SEQ ID NO: 2202268 - RNA, 19 nt, Homo sapiens
gcuacucaaguagcauuua

SEQ ID NO: 2202269 - RNA, 20 nt, Homo sapiens
uggaaaugguggugcuuuaa

SEQ ID NO: 2202270 - RNA, 23 nt, Homo sapiens
aaguauuuuuuucuuuuuucuca

SEQ ID NO: 2202271 - RNA, 17 nt, Homo sapiens
acaacaaccuaugcacc

SEQ ID NO: 2202272 - RNA, 21 nt, Homo sapiens
uugauggcuccgaacacccuc

SEQ ID NO: 2202273 - RNA, 15 nt, Homo sapiens
cuuuuccugauguuc

SEQ ID NO: 2202274 - RNA, 22 nt, Homo sapiens
ucucaucugcacccuucuuuuc

SEQ ID NO: 2202275 - RNA, 19 nt, Homo sapiens
ucucaaaggcccucaguga

SEQ ID NO: 2202276 - RNA, 23 nt, Homo sapiens
acauuuguuugguuauagugcaa

SEQ ID NO: 2202277 - RNA, 21 nt, Homo sapiens
ucaacauuuaaucaaucuuug

SEQ ID NO: 2202278 - RNA, 19 nt, Homo sapiens
gcauuuaaacucauuugag

SEQ ID NO: 2202279 - RNA, 20 nt, Homo sapiens
augcacuuccuuaccuagug

SEQ ID NO: 2202280 - RNA, 15 nt, Homo sapiens
accaggacugcagcu

SEQ ID NO: 2202281 - RNA, 13 nt, Homo sapiens
cuccagugccagc

SEQ ID NO: 2202282 - RNA, 20 nt, Homo sapiens
agguucacuuuggauaugau

SEQ ID NO: 2202283 - RNA, 15 nt, Homo sapiens
uuuacaaggugacaa

SEQ ID NO: 2202284 - RNA, 22 nt, Homo sapiens
agcaguuggggcccucuugcca

SEQ ID NO: 2202285 - RNA, 16 nt, Homo sapiens
guacuagcaguguuuc

SEQ ID NO: 2202286 - RNA, 23 nt, Homo sapiens
uuuaaccaauaacuagcuucuua

SEQ ID NO: 2202287 - RNA, 20 nt, Homo sapiens
ccauagugcacuagcauuuu

SEQ ID NO: 2202288 - RNA, 18 nt, Homo sapiens
uccccaaccccucagauu

SEQ ID NO: 2202289 - RNA, 20 nt, Homo sapiens
gaacacuggcagacugugua

SEQ ID NO: 2202290 - RNA, 14 nt, Homo sapiens
ggccauggugcaca

SEQ ID NO: 2202291 - RNA, 17 nt, Homo sapiens
ccugcguugugagcucu

SEQ ID NO: 2202292 - RNA, 22 nt, Homo sapiens
ugucccugccccgccccccaga

SEQ ID NO: 2202293 - RNA, 13 nt, Homo sapiens
caacuuuccagac

SEQ ID NO: 2202294 - RNA, 15 nt, Homo sapiens
uaaaaaugcaugaua

SEQ ID NO: 2202295 - RNA, 12 nt, Homo sapiens
cuugaugaagcc

SEQ ID NO: 2202296 - RNA, 22 nt, Homo sapiens
aagagauauaauguucacuaau

SEQ ID NO: 2202297 - RNA, 21 nt, Homo sapiens
agcuuuaaacucagggacaga

SEQ ID NO: 2202298 - RNA, 19 nt, Homo sapiens
acugaaguagugugcaguu

SEQ ID NO: 2202299 - RNA, 18 nt, Homo sapiens
cacaccucccaccugcau

SEQ ID NO: 2202300 - RNA, 17 nt, Homo sapiens
agugauggggaauuuau

SEQ ID NO: 2202301 - RNA, 16 nt, Homo sapiens
auaguaaacacaggga

SEQ ID NO: 2202302 - RNA, 23 nt, Homo sapiens
cauuugcuuacuuugcauuugug

SEQ ID NO: 2202303 - RNA, 20 nt, Homo sapiens
gcaugacucagacugcauga

SEQ ID NO: 2202304 - RNA, 19 nt, Homo sapiens
auauaaaaauaaagcacuu

SEQ ID NO: 2202305 - RNA, 14 nt, Homo sapiens
caagcaagugcaca

SEQ ID NO: 2202306 - RNA, 20 nt, Homo sapiens
uccuccccccuccucugaaa

SEQ ID NO: 2202307 - RNA, 16 nt, Homo sapiens
guacuagcauuuucca

SEQ ID NO: 2202308 - RNA, 17 nt, Homo sapiens
cuuugcagucaguucau

SEQ ID NO: 2202309 - RNA, 20 nt, Homo sapiens
uauuuuaagaaguugcugca

SEQ ID NO: 2202310 - RNA, 19 nt, Homo sapiens
uugccauuacucaauugau

SEQ ID NO: 2202311 - RNA, 20 nt, Homo sapiens
ucucacauaagcccaguuca

SEQ ID NO: 2202312 - RNA, 20 nt, Homo sapiens
auaaacacugguuguaguca

SEQ ID NO: 2202313 - RNA, 13 nt, Homo sapiens
cuucaagaccaaa

SEQ ID NO: 2202314 - RNA, 19 nt, Homo sapiens
aucuacaacauaaugauac

SEQ ID NO: 2202315 - RNA, 16 nt, Homo sapiens
cuuaaauacaaucaca

SEQ ID NO: 2202316 - RNA, 13 nt, Homo sapiens
uuccgacaccucu

SEQ ID NO: 2202317 - RNA, 22 nt, Homo sapiens
ccgcccaccagaccuguucuga

SEQ ID NO: 2202318 - RNA, 22 nt, Homo sapiens
ccugccgucuucacuuccccac

SEQ ID NO: 2202319 - RNA, 16 nt, Homo sapiens
ccagagcuccaugcau

SEQ ID NO: 2202320 - RNA, 14 nt, Homo sapiens
acuaaccaucugaa

SEQ ID NO: 2202321 - RNA, 20 nt, Homo sapiens
aagcaguggccuuauugcau

SEQ ID NO: 2202322 - RNA, 13 nt, Homo sapiens
gagaacuuuccau

SEQ ID NO: 2202323 - RNA, 14 nt, Homo sapiens
aauucuuacuguuc

SEQ ID NO: 2202324 - RNA, 17 nt, Homo sapiens
ugcuccaggaucuuuga

SEQ ID NO: 2202325 - RNA, 13 nt, Homo sapiens
cugcacccaggua

SEQ ID NO: 2202326 - RNA, 12 nt, Homo sapiens
aagcccuguggg

SEQ ID NO: 2202327 - RNA, 18 nt, Homo sapiens
ccgcauuuggauuggaug

SEQ ID NO: 2202328 - RNA, 12 nt, Homo sapiens
cauugucccuga

SEQ ID NO: 2202329 - RNA, 20 nt, Homo sapiens
agucugaauagucuucagag

SEQ ID NO: 2202330 - RNA, 20 nt, Homo sapiens
cugaauaaagcacgugcaag

SEQ ID NO: 2202331 - RNA, 18 nt, Homo sapiens
acaacauccauguccuau

SEQ ID NO: 2202332 - RNA, 18 nt, Homo sapiens
ccugcauuguuagcacua

SEQ ID NO: 2202333 - RNA, 16 nt, Homo sapiens
caaccagagcacugua

SEQ ID NO: 2202334 - RNA, 14 nt, Homo sapiens
caaacuuacuauuu

SEQ ID NO: 2202335 - RNA, 11 nt, Homo sapiens
acuuuuccaca

SEQ ID NO: 2202336 - RNA, 20 nt, Homo sapiens
uauagcuugcauagucaaua

SEQ ID NO: 2202337 - RNA, 18 nt, Homo sapiens
aguucaauugugucugug

SEQ ID NO: 2202338 - RNA, 16 nt, Homo sapiens
agugaaggucaccugg

SEQ ID NO: 2202339 - RNA, 21 nt, Homo sapiens
ucuccagggaggguauuuauu

SEQ ID NO: 2202340 - RNA, 20 nt, Homo sapiens
aagauuggggacacucauau

SEQ ID NO: 2202341 - RNA, 18 nt, Homo sapiens
ucucucagacuuacuuua

SEQ ID NO: 2202342 - RNA, 18 nt, Homo sapiens
ucuugauguucagacauu

SEQ ID NO: 2202343 - RNA, 21 nt, Homo sapiens
uugaccucuauaaacuucaga

SEQ ID NO: 2202344 - RNA, 15 nt, Homo sapiens
uauaugcagaauuac

SEQ ID NO: 2202345 - RNA, 21 nt, Homo sapiens
cagaacagagugcaacccagu

SEQ ID NO: 2202346 - RNA, 13 nt, Homo sapiens
gaccucacugucc

SEQ ID NO: 2202347 - RNA, 14 nt, Homo sapiens
ugcagcaguaccau

SEQ ID NO: 2202348 - RNA, 20 nt, Homo sapiens
ccaggaucaugguguaauaa

SEQ ID NO: 2202349 - RNA, 15 nt, Homo sapiens
ugcauaacguauaaa

SEQ ID NO: 2202350 - RNA, 13 nt, Homo sapiens
cuugcauucauuu

SEQ ID NO: 2202351 - RNA, 13 nt, Homo sapiens
ucuacauuacaaa

SEQ ID NO: 2202352 - RNA, 14 nt, Homo sapiens
uggaugcagaucca

SEQ ID NO: 2202353 - RNA, 13 nt, Homo sapiens
agaucacugaaga

SEQ ID NO: 2202354 - RNA, 22 nt, Homo sapiens
uacaaacuuggacaacacggag

SEQ ID NO: 2202355 - RNA, 19 nt, Homo sapiens
aaugaguccaaacuggaau

SEQ ID NO: 2202356 - RNA, 22 nt, Homo sapiens
augaaaggacaguuaaguauuu

SEQ ID NO: 2202357 - RNA, 17 nt, Homo sapiens
uccuuugaucccagaaa

SEQ ID NO: 2202358 - RNA, 19 nt, Homo sapiens
ugggagcacggacugucag

SEQ ID NO: 2202359 - RNA, 18 nt, Homo sapiens
cccugugguccugaauuc

SEQ ID NO: 2202360 - RNA, 20 nt, Homo sapiens
uccaugcuuucaccuacaca

SEQ ID NO: 2202361 - RNA, 12 nt, Homo sapiens
gcugacaucucc

SEQ ID NO: 2202362 - RNA, 23 nt, Homo sapiens
cugucaagcaccugcaugugcug

SEQ ID NO: 2202363 - RNA, 16 nt, Homo sapiens
cugggggccucugccu

SEQ ID NO: 2202364 - RNA, 19 nt, Homo sapiens
ccaaagaguuuucugugca

SEQ ID NO: 2202365 - RNA, 13 nt, Homo sapiens
gugcagauaucac

SEQ ID NO: 2202366 - RNA, 18 nt, Homo sapiens
ugucacaugaaacauuug

SEQ ID NO: 2202367 - RNA, 14 nt, Homo sapiens
uggaauugcucaag

SEQ ID NO: 2202368 - RNA, 18 nt, Homo sapiens
cuuaaacaauucuuguaa

SEQ ID NO: 2202369 - RNA, 15 nt, Homo sapiens
aaagaccauuuuucc

SEQ ID NO: 2202370 - RNA, 15 nt, Homo sapiens
uuauuguaaaugagu

SEQ ID NO: 2202371 - RNA, 14 nt, Homo sapiens
caugugcaccugcc

SEQ ID NO: 2202372 - RNA, 17 nt, Homo sapiens
agagaggccaggugcag

SEQ ID NO: 2202373 - RNA, 23 nt, Homo sapiens
aacauugaucuguuuuacaggaa

SEQ ID NO: 2202374 - RNA, 19 nt, Homo sapiens
aguaaaaggaaaugcaagu

SEQ ID NO: 2202375 - RNA, 12 nt, Homo sapiens
guguauguauaa

SEQ ID NO: 2202376 - RNA, 12 nt, Homo sapiens
guaaaauggagg

SEQ ID NO: 2202377 - RNA, 22 nt, Homo sapiens
aggaaauguuucucuaacccuu

SEQ ID NO: 2202378 - RNA, 21 nt, Homo sapiens
aacauuccuaucaauccaaau

SEQ ID NO: 2202379 - RNA, 16 nt, Homo sapiens
gccccagacacagugc

SEQ ID NO: 2202380 - RNA, 14 nt, Homo sapiens
gcaguuaggugcug

SEQ ID NO: 2202381 - RNA, 18 nt, Homo sapiens
ugcuuuaugaaguuugag

SEQ ID NO: 2202382 - RNA, 24 nt, Homo sapiens
cccagguugcugugggugcagcug

SEQ ID NO: 2202383 - RNA, 22 nt, Homo sapiens
ugaggaauaaagcuucucucug

SEQ ID NO: 2202384 - RNA, 16 nt, Homo sapiens
gagggcagacuggggc

SEQ ID NO: 2202385 - RNA, 13 nt, Homo sapiens
agauuuuuagucu

SEQ ID NO: 2202386 - RNA, 23 nt, Homo sapiens
uauggaucuguugggaaccagag

SEQ ID NO: 2202387 - RNA, 20 nt, Homo sapiens
aaccacaaaggccaaacugc

SEQ ID NO: 2202388 - RNA, 15 nt, Homo sapiens
caggcaaaauugaua

SEQ ID NO: 2202389 - RNA, 22 nt, Homo sapiens
ugguucugaaauaaacuucacu

SEQ ID NO: 2202390 - RNA, 14 nt, Homo sapiens
auaaaacagauauu

SEQ ID NO: 2202391 - RNA, 18 nt, Homo sapiens
auguaauaaaaagccucu

SEQ ID NO: 2202392 - RNA, 13 nt, Homo sapiens
aagaucugcuucc

SEQ ID NO: 2202393 - RNA, 15 nt, Homo sapiens
cuuuuaaugaauuua

SEQ ID NO: 2202394 - RNA, 15 nt, Homo sapiens
gaagauaucuugaaa

SEQ ID NO: 2202395 - RNA, 23 nt, Homo sapiens
aguauugaaauguuugcauaaag

SEQ ID NO: 2202396 - RNA, 24 nt, Homo sapiens
auaaauucucuccuaaugaugacu

SEQ ID NO: 2202397 - RNA, 13 nt, Homo sapiens
caaauucauggca

SEQ ID NO: 2202398 - RNA, 16 nt, Homo sapiens
aaaagacgcaccagcc

SEQ ID NO: 2202399 - RNA, 14 nt, Homo sapiens
accuuuacuuuaga

SEQ ID NO: 2202400 - RNA, 22 nt, Homo sapiens
caauaaauuauuagagauuuuc

SEQ ID NO: 2202401 - RNA, 24 nt, Homo sapiens
acauucguuacuguugugaaaauc

SEQ ID NO: 2202402 - RNA, 20 nt, Homo sapiens
cgcuuaugguuuuaaugcaa

SEQ ID NO: 2202403 - RNA, 22 nt, Homo sapiens
uuauaauuuugguccaaauucu

SEQ ID NO: 2202404 - RNA, 15 nt, Homo sapiens
uaagagaacaaugug

SEQ ID NO: 2202405 - RNA, 22 nt, Homo sapiens
gcucgccccagcaggugcugac

SEQ ID NO: 2202406 - RNA, 17 nt, Homo sapiens
gagacaggguuucaccg

SEQ ID NO: 2202407 - RNA, 11 nt, Homo sapiens
auggacugggg

SEQ ID NO: 2202408 - RNA, 17 nt, Homo sapiens
agccagggcaacacagu

SEQ ID NO: 2202409 - RNA, 14 nt, Homo sapiens
uaugguaaucuuua

SEQ ID NO: 2202410 - RNA, 17 nt, Homo sapiens
cccuuccuugccaguga

SEQ ID NO: 2202411 - RNA, 20 nt, Homo sapiens
caagaggaaaaacagggaaa

SEQ ID NO: 2202412 - RNA, 16 nt, Homo sapiens
caguagagcucuacug

SEQ ID NO: 2202413 - RNA, 18 nt, Homo sapiens
uaucaucuuuugaucuuu

SEQ ID NO: 2202414 - RNA, 15 nt, Homo sapiens
cacuuaaagaaauaa

SEQ ID NO: 2202415 - RNA, 15 nt, Homo sapiens
acucccaacccuggc

SEQ ID NO: 2202416 - RNA, 20 nt, Homo sapiens
uggggaggugagagugcaga

SEQ ID NO: 2202417 - RNA, 20 nt, Homo sapiens
cccucccuggaugacauuaa

SEQ ID NO: 2202418 - RNA, 13 nt, Homo sapiens
aaagcguccucuc

SEQ ID NO: 2202419 - RNA, 15 nt, Homo sapiens
guucauggauuuucc

SEQ ID NO: 2202420 - RNA, 19 nt, Homo sapiens
uuaaugucagucuacaggc

SEQ ID NO: 2202421 - RNA, 19 nt, Homo sapiens
ugugucgcuuaugucuaua

SEQ ID NO: 2202422 - RNA, 13 nt, Homo sapiens
auuccugugacuu

SEQ ID NO: 2202423 - RNA, 21 nt, Homo sapiens
acuguuuuauaaacugcugua

SEQ ID NO: 2202424 - RNA, 21 nt, Homo sapiens
uuuauaacuauuauauuauca

SEQ ID NO: 2202425 - RNA, 19 nt, Homo sapiens
uaacacagagagacagacu

SEQ ID NO: 2202426 - RNA, 22 nt, Homo sapiens
gugagacagugggggugccugg

SEQ ID NO: 2202427 - RNA, 21 nt, Homo sapiens
ucuacuggaaauguagcacuu

SEQ ID NO: 2202428 - RNA, 20 nt, Homo sapiens
uugucaaggcugacuacuca

SEQ ID NO: 2202429 - RNA, 17 nt, Homo sapiens
acagacacacacuggcu

SEQ ID NO: 2202430 - RNA, 22 nt, Homo sapiens
uuaagaaugucgauuaaaauca

SEQ ID NO: 2202431 - RNA, 16 nt, Homo sapiens
agugccaacuccucac

SEQ ID NO: 2202432 - RNA, 12 nt, Homo sapiens
auuuaacugcau

SEQ ID NO: 2202433 - RNA, 12 nt, Homo sapiens
guaucauuacau

SEQ ID NO: 2202434 - RNA, 15 nt, Homo sapiens
cacugccugccaagc

SEQ ID NO: 2202435 - RNA, 18 nt, Homo sapiens
uaacccagagcuguauuu

SEQ ID NO: 2202436 - RNA, 13 nt, Homo sapiens
agacagaccacuu

SEQ ID NO: 2202437 - RNA, 22 nt, Homo sapiens
ucccagagaccuucugaucucc

SEQ ID NO: 2202438 - RNA, 13 nt, Homo sapiens
aaguucaugggca

SEQ ID NO: 2202439 - RNA, 19 nt, Homo sapiens
agaaacuaucuauuugcac

SEQ ID NO: 2202440 - RNA, 21 nt, Homo sapiens
uugcugcaucuccccucagau

SEQ ID NO: 2202441 - RNA, 14 nt, Homo sapiens
aguaugaucucagu

SEQ ID NO: 2202442 - RNA, 21 nt, Homo sapiens
uccccaucauuacugguaaag

SEQ ID NO: 2202443 - RNA, 16 nt, Homo sapiens
augaaaugggcuuuaa

SEQ ID NO: 2202444 - RNA, 15 nt, Homo sapiens
caacccaugaaggcu

SEQ ID NO: 2202445 - RNA, 17 nt, Homo sapiens
uguggugauuggccaca

SEQ ID NO: 2202446 - RNA, 12 nt, Homo sapiens
ugucucugugag

SEQ ID NO: 2202447 - RNA, 14 nt, Homo sapiens
ccuaaaugaccuca

SEQ ID NO: 2202448 - RNA, 20 nt, Homo sapiens
ucuggauuagaaugccgguu

SEQ ID NO: 2202449 - RNA, 16 nt, Homo sapiens
cccauacaauguaugu

SEQ ID NO: 2202450 - RNA, 17 nt, Homo sapiens
uccaauauuuucuuuaa

SEQ ID NO: 2202451 - RNA, 17 nt, Homo sapiens
aucauguaccucagauc

SEQ ID NO: 2202452 - RNA, 21 nt, Homo sapiens
ugcccccaggcagccaccagu

SEQ ID NO: 2202453 - RNA, 18 nt, Homo sapiens
acauuaacaaaagcaauu

SEQ ID NO: 2202454 - RNA, 20 nt, Homo sapiens
aaaucacccuaagugacaca

SEQ ID NO: 2202455 - RNA, 23 nt, Homo sapiens
agaaccuggcagguuagaaccua

SEQ ID NO: 2202456 - RNA, 14 nt, Homo sapiens
aaaauaagcauuug

SEQ ID NO: 2202457 - RNA, 12 nt, Homo sapiens
cugaaaauugca

SEQ ID NO: 2202458 - RNA, 21 nt, Homo sapiens
aucaccuugauaaugggauga

SEQ ID NO: 2202459 - RNA, 14 nt, Homo sapiens
acagccaagcccua

SEQ ID NO: 2202460 - RNA, 15 nt, Homo sapiens
auaaggagugccuga

SEQ ID NO: 2202461 - RNA, 14 nt, Homo sapiens
agacccuuauuuaa

SEQ ID NO: 2202462 - RNA, 21 nt, Homo sapiens
uccauguagaacuugaacuaa

SEQ ID NO: 2202463 - RNA, 22 nt, Homo sapiens
uuugaugccaagaaaguauuug

SEQ ID NO: 2202464 - RNA, 17 nt, Homo sapiens
ugauuacagauguacaa

SEQ ID NO: 2202465 - RNA, 18 nt, Homo sapiens
ugugggccagagauccuc

SEQ ID NO: 2202466 - RNA, 16 nt, Homo sapiens
ugggggcuucucugcu

SEQ ID NO: 2202467 - RNA, 21 nt, Homo sapiens
cuguccccuucucucaucucu

SEQ ID NO: 2202468 - RNA, 22 nt, Homo sapiens
agauaacagugugcucauagaa

SEQ ID NO: 2202469 - RNA, 16 nt, Homo sapiens
ugaaauaaacagucua

SEQ ID NO: 2202470 - RNA, 18 nt, Homo sapiens
guggaacucagucauuag

SEQ ID NO: 2202471 - RNA, 17 nt, Homo sapiens
agcuccacacauuccag

SEQ ID NO: 2202472 - RNA, 21 nt, Homo sapiens
gacaaaggaguaguagcugaa

SEQ ID NO: 2202473 - RNA, 19 nt, Homo sapiens
guggguuugggguggggaa

SEQ ID NO: 2202474 - RNA, 12 nt, Homo sapiens
cuccaccugcag

SEQ ID NO: 2202475 - RNA, 13 nt, Homo sapiens
ucccuagccagag

SEQ ID NO: 2202476 - RNA, 18 nt, Homo sapiens
aucucugcuuaguucuau

SEQ ID NO: 2202477 - RNA, 17 nt, Homo sapiens
cuccucaaucauagcca

SEQ ID NO: 2202478 - RNA, 22 nt, Homo sapiens
gcaacugaggcagacagcagcu

SEQ ID NO: 2202479 - RNA, 21 nt, Homo sapiens
aagccgaccuucccuccgccu

SEQ ID NO: 2202480 - RNA, 18 nt, Homo sapiens
acccccuguccugacucu

SEQ ID NO: 2202481 - RNA, 18 nt, Homo sapiens
uagcaaaaauguuuucca

SEQ ID NO: 2202482 - RNA, 17 nt, Homo sapiens
aacagcccucaggucag

SEQ ID NO: 2202483 - RNA, 14 nt, Homo sapiens
guauugcagccaaa

SEQ ID NO: 2202484 - RNA, 20 nt, Homo sapiens
gucugaacaauauauacuua

SEQ ID NO: 2202485 - RNA, 15 nt, Homo sapiens
uaauccuagcacuuu

SEQ ID NO: 2202486 - RNA, 21 nt, Homo sapiens
gcacuuucccuagaaagccau

SEQ ID NO: 2202487 - RNA, 12 nt, Homo sapiens
gaaaacacuguc

SEQ ID NO: 2202488 - RNA, 15 nt, Homo sapiens
uguccaugccuucca

SEQ ID NO: 2202489 - RNA, 22 nt, Homo sapiens
cugagucagcaccccuccuagc

SEQ ID NO: 2202490 - RNA, 18 nt, Homo sapiens
cucugugcaggugcugcc

SEQ ID NO: 2202491 - RNA, 22 nt, Homo sapiens
uucccacuggaggucacauuca

SEQ ID NO: 2202492 - RNA, 21 nt, Homo sapiens
ggcuuccugaugauggucauu

SEQ ID NO: 2202493 - RNA, 20 nt, Homo sapiens
aaacucaucuggaguucuca

SEQ ID NO: 2202494 - RNA, 16 nt, Homo sapiens
cacuuuucauaucauu

SEQ ID NO: 2202495 - RNA, 17 nt, Homo sapiens
uauguaugaguaucugu

SEQ ID NO: 2202496 - RNA, 17 nt, Homo sapiens
caggcugcagugcaaug

SEQ ID NO: 2202497 - RNA, 18 nt, Homo sapiens
uccagaaugugcugccuu

SEQ ID NO: 2202498 - RNA, 14 nt, Homo sapiens
ccaccacaagagcu

SEQ ID NO: 2202499 - RNA, 19 nt, Homo sapiens
auaccagugaaccaaagag

SEQ ID NO: 2202500 - RNA, 13 nt, Homo sapiens
uucuaccaagcaa

SEQ ID NO: 2202501 - RNA, 15 nt, Homo sapiens
auacaacaaucccag

SEQ ID NO: 2202502 - RNA, 17 nt, Homo sapiens
gccaugugcagccacca

SEQ ID NO: 2202503 - RNA, 22 nt, Homo sapiens
agccaucaauuuuaacauuuga

SEQ ID NO: 2202504 - RNA, 21 nt, Homo sapiens
aggugacaugugaaaccuuuu

SEQ ID NO: 2202505 - RNA, 18 nt, Homo sapiens
aagucagucuuauagcaa

SEQ ID NO: 2202506 - RNA, 17 nt, Homo sapiens
uucauggccucaggaga

SEQ ID NO: 2202507 - RNA, 15 nt, Homo sapiens
guccuaggacuuaaa

SEQ ID NO: 2202508 - RNA, 14 nt, Homo sapiens
aaacccuaaaaaga

SEQ ID NO: 2202509 - RNA, 22 nt, Homo sapiens
auguacuguaaacaguucugca

SEQ ID NO: 2202510 - RNA, 18 nt, Homo sapiens
uucagggaauuucaggaa

SEQ ID NO: 2202511 - RNA, 21 nt, Homo sapiens
aacccagugagacagaccgcc

SEQ ID NO: 2202512 - RNA, 23 nt, Homo sapiens
ccuucaauuuucuucacacuauc

SEQ ID NO: 2202513 - RNA, 18 nt, Homo sapiens
uccuaucuuuacaucuau

SEQ ID NO: 2202514 - RNA, 21 nt, Homo sapiens
gacuguuuucaauaacaaagc

SEQ ID NO: 2202515 - RNA, 12 nt, Homo sapiens
uaauggcauuuu

SEQ ID NO: 2202516 - RNA, 20 nt, Homo sapiens
uuagaccaaaagcaacauuc

SEQ ID NO: 2202517 - RNA, 15 nt, Homo sapiens
acugcccaaagccau

SEQ ID NO: 2202518 - RNA, 14 nt, Homo sapiens
agucaauauuguau

SEQ ID NO: 2202519 - RNA, 23 nt, Homo sapiens
uacaaucaggagugguggaaccu

SEQ ID NO: 2202520 - RNA, 13 nt, Homo sapiens
gauguacaauuaa

SEQ ID NO: 2202521 - RNA, 15 nt, Homo sapiens
uugggaacugcaaua

SEQ ID NO: 2202522 - RNA, 15 nt, Homo sapiens
aaguuagaaaauuca

SEQ ID NO: 2202523 - RNA, 15 nt, Homo sapiens
acagagguggcugcu

SEQ ID NO: 2202524 - RNA, 20 nt, Homo sapiens
auuucuuucccuaaagaaca

SEQ ID NO: 2202525 - RNA, 18 nt, Homo sapiens
aagcugauuuucaugaaa

SEQ ID NO: 2202526 - RNA, 13 nt, Homo sapiens
cauguaugaaauu

SEQ ID NO: 2202527 - RNA, 20 nt, Homo sapiens
caaaaaucuguguaacugua

SEQ ID NO: 2202528 - RNA, 14 nt, Homo sapiens
gagccuuccagggg

SEQ ID NO: 2202529 - RNA, 18 nt, Homo sapiens
cuuauauaguauucauuu

SEQ ID NO: 2202530 - RNA, 16 nt, Homo sapiens
uugucauagacuccuu

SEQ ID NO: 2202531 - RNA, 15 nt, Homo sapiens
guuaaugucagugac

SEQ ID NO: 2202532 - RNA, 20 nt, Homo sapiens
agcuaugaucgcgccacuac

SEQ ID NO: 2202533 - RNA, 12 nt, Homo sapiens
aagugcaucuac

SEQ ID NO: 2202534 - RNA, 21 nt, Homo sapiens
aaccccuucucugugacccac

SEQ ID NO: 2202535 - RNA, 22 nt, Homo sapiens
auuucugcuuucuucuuuagca

SEQ ID NO: 2202536 - RNA, 17 nt, Homo sapiens
gccuugcagaacugcca

SEQ ID NO: 2202537 - RNA, 13 nt, Homo sapiens
uuccugaguaccu

SEQ ID NO: 2202538 - RNA, 21 nt, Homo sapiens
uaguccagaaaucuauuacac

SEQ ID NO: 2202539 - RNA, 19 nt, Homo sapiens
ccuuccaaaccucaauaaa

SEQ ID NO: 2202540 - RNA, 12 nt, Homo sapiens
ccacaugguguc

SEQ ID NO: 2202541 - RNA, 18 nt, Homo sapiens
uaaccuuauacuacuaaa

SEQ ID NO: 2202542 - RNA, 22 nt, Homo sapiens
caggaaauauaucuuaaugcag

SEQ ID NO: 2202543 - RNA, 16 nt, Homo sapiens
uggacaugcuuuggca

SEQ ID NO: 2202544 - RNA, 22 nt, Homo sapiens
uagcagcuauguaaaugaccua

SEQ ID NO: 2202545 - RNA, 17 nt, Homo sapiens
uugcucuguuucuuccu

SEQ ID NO: 2202546 - RNA, 18 nt, Homo sapiens
acuaugggcagcccagug

SEQ ID NO: 2202547 - RNA, 16 nt, Homo sapiens
uggugucugugacauu

SEQ ID NO: 2202548 - RNA, 21 nt, Homo sapiens
ugcagacagaagucuccucaa

SEQ ID NO: 2202549 - RNA, 17 nt, Homo sapiens
ccaggaccuugcuuccu

SEQ ID NO: 2202550 - RNA, 22 nt, Homo sapiens
cugcugccggaagucaucccag

SEQ ID NO: 2202551 - RNA, 18 nt, Homo sapiens
gcugaaugccuguuagca

SEQ ID NO: 2202552 - RNA, 13 nt, Homo sapiens
agccugagccaca

SEQ ID NO: 2202553 - RNA, 15 nt, Homo sapiens
cagccuucagucaca

SEQ ID NO: 2202554 - RNA, 17 nt, Homo sapiens
gaggccauucuuuccca

SEQ ID NO: 2202555 - RNA, 19 nt, Homo sapiens
agcagaggcuuugcugcug

SEQ ID NO: 2202556 - RNA, 19 nt, Homo sapiens
cagaaccuuguuauuucuc

SEQ ID NO: 2202557 - RNA, 22 nt, Homo sapiens
acuggaucuucuaucauuccaa

SEQ ID NO: 2202558 - RNA, 13 nt, Homo sapiens
agugggugucucu

SEQ ID NO: 2202559 - RNA, 18 nt, Homo sapiens
cagucuucugacugucac

SEQ ID NO: 2202560 - RNA, 18 nt, Homo sapiens
uggacauuuauguacaaa

SEQ ID NO: 2202561 - RNA, 13 nt, Homo sapiens
augucacugccaa

SEQ ID NO: 2202562 - RNA, 23 nt, Homo sapiens
acauugcaggaagagaugcucua

SEQ ID NO: 2202563 - RNA, 13 nt, Homo sapiens
aaggaaauaucau

SEQ ID NO: 2202564 - RNA, 16 nt, Homo sapiens
cuucacaacccaucua

SEQ ID NO: 2202565 - RNA, 12 nt, Homo sapiens
ccccaccugcuc

SEQ ID NO: 2202566 - RNA, 15 nt, Homo sapiens
ccuuaaaucacacau

SEQ ID NO: 2202567 - RNA, 20 nt, Homo sapiens
uuaaugaacaugugaaguua

SEQ ID NO: 2202568 - RNA, 20 nt, Homo sapiens
uaaaaauagaagaauacaaa

SEQ ID NO: 2202569 - RNA, 16 nt, Homo sapiens
cagcagagaagcugua

SEQ ID NO: 2202570 - RNA, 20 nt, Homo sapiens
acauuauugaggaaaauuaa

SEQ ID NO: 2202571 - RNA, 23 nt, Homo sapiens
aaugcuauggacugcacaaaagu

SEQ ID NO: 2202572 - RNA, 13 nt, Homo sapiens
gagugggaccaac

SEQ ID NO: 2202573 - RNA, 17 nt, Homo sapiens
uucccauuggaugcauu

SEQ ID NO: 2202574 - RNA, 20 nt, Homo sapiens
augcacagauuaaacuucac

SEQ ID NO: 2202575 - RNA, 14 nt, Homo sapiens
cuucauuaaaacaa

SEQ ID NO: 2202576 - RNA, 18 nt, Homo sapiens
ccuggccuggcacacauc

SEQ ID NO: 2202577 - RNA, 20 nt, Homo sapiens
aucaacgccucacugaaaca

SEQ ID NO: 2202578 - RNA, 19 nt, Homo sapiens
uuuaaagaauucucuugcu

SEQ ID NO: 2202579 - RNA, 15 nt, Homo sapiens
ugucauuguaaacaa

SEQ ID NO: 2202580 - RNA, 17 nt, Homo sapiens
gggcaggccagggcagu

SEQ ID NO: 2202581 - RNA, 16 nt, Homo sapiens
gaggugacacccauug

SEQ ID NO: 2202582 - RNA, 22 nt, Homo sapiens
aacucuccuguggccugcucau

SEQ ID NO: 2202583 - RNA, 23 nt, Homo sapiens
cauuuuuagaacuccaguuuuca

SEQ ID NO: 2202584 - RNA, 16 nt, Homo sapiens
gaauuauuagcaccag

SEQ ID NO: 2202585 - RNA, 20 nt, Homo sapiens
acucuaggguccaguggaug

SEQ ID NO: 2202586 - RNA, 14 nt, Homo sapiens
uccgaggugguuuu

SEQ ID NO: 2202587 - RNA, 22 nt, Homo sapiens
ucuccaggggccacaagaccau

SEQ ID NO: 2202588 - RNA, 20 nt, Homo sapiens
uccgucaguccaagucuucu

SEQ ID NO: 2202589 - RNA, 15 nt, Homo sapiens
ccucuaccagcacau

SEQ ID NO: 2202590 - RNA, 23 nt, Homo sapiens
ucccacggcucugugcccggugc

SEQ ID NO: 2202591 - RNA, 19 nt, Homo sapiens
uaccccugcucccauuccu

SEQ ID NO: 2202592 - RNA, 17 nt, Homo sapiens
uaauauuuuaaauugcu

SEQ ID NO: 2202593 - RNA, 19 nt, Homo sapiens
gggcuguugagaugccugu

SEQ ID NO: 2202594 - RNA, 17 nt, Homo sapiens
uuugaauaugccaaaca

SEQ ID NO: 2202595 - RNA, 21 nt, Homo sapiens
agaagagucuuugauucacca

SEQ ID NO: 2202596 - RNA, 17 nt, Homo sapiens
uccuuaggagaugucau

SEQ ID NO: 2202597 - RNA, 14 nt, Homo sapiens
aacaaaaucaugga

SEQ ID NO: 2202598 - RNA, 17 nt, Homo sapiens
cauggccuaugcacaua

SEQ ID NO: 2202599 - RNA, 22 nt, Homo sapiens
guguuaaugucccauuucacga

SEQ ID NO: 2202600 - RNA, 23 nt, Homo sapiens
auuagcauggccccaguccaugc

SEQ ID NO: 2202601 - RNA, 12 nt, Homo sapiens
accaaaaacuga

SEQ ID NO: 2202602 - RNA, 22 nt, Homo sapiens
augaauguaauuuugaacuguu

SEQ ID NO: 2202603 - RNA, 16 nt, Homo sapiens
gugaaauacaguauac

SEQ ID NO: 2202604 - RNA, 22 nt, Homo sapiens
uuugcagcuuucucuaguucaa

SEQ ID NO: 2202605 - RNA, 15 nt, Homo sapiens
cagucuguucucaca

SEQ ID NO: 2202606 - RNA, 20 nt, Homo sapiens
augaaaaagacaagauuuau

SEQ ID NO: 2202607 - RNA, 22 nt, Homo sapiens
cggugucuggaaaagcacuuua

SEQ ID NO: 2202608 - RNA, 12 nt, Homo sapiens
ugggaguacuga

SEQ ID NO: 2202609 - RNA, 18 nt, Homo sapiens
caaccuucacaucuguca

SEQ ID NO: 2202610 - RNA, 23 nt, Homo sapiens
aucaaaucugguauugaacugca

SEQ ID NO: 2202611 - RNA, 20 nt, Homo sapiens
gcuggcuccuccaggcacgu

SEQ ID NO: 2202612 - RNA, 12 nt, Homo sapiens
ucaccagugugu

SEQ ID NO: 2202613 - RNA, 23 nt, Homo sapiens
aauugauggagccauugaugcaa

SEQ ID NO: 2202614 - RNA, 20 nt, Homo sapiens
aguucaaauuuugcauugug

SEQ ID NO: 2202615 - RNA, 20 nt, Homo sapiens
aagauaguugauuaugaaua

SEQ ID NO: 2202616 - RNA, 15 nt, Homo sapiens
aaaguuguuugugcc

SEQ ID NO: 2202617 - RNA, 17 nt, Homo sapiens
ugauuaaaauucaggaa

SEQ ID NO: 2202618 - RNA, 22 nt, Homo sapiens
ccucaugugaucacaauuugca

SEQ ID NO: 2202619 - RNA, 22 nt, Homo sapiens
acuggaaccccagcuucccucc

SEQ ID NO: 2202620 - RNA, 18 nt, Homo sapiens
ucagacuuaaaauuccac

SEQ ID NO: 2202621 - RNA, 16 nt, Homo sapiens
agggucagugccaagu

SEQ ID NO: 2202622 - RNA, 15 nt, Homo sapiens
uguguggcaguucuc

SEQ ID NO: 2202623 - RNA, 15 nt, Homo sapiens
uguucuguuacaaaa

SEQ ID NO: 2202624 - RNA, 12 nt, Homo sapiens
cauaauguauua

SEQ ID NO: 2202625 - RNA, 21 nt, Homo sapiens
acucucuguggucccuuccaa

SEQ ID NO: 2202626 - RNA, 17 nt, Homo sapiens
gccaaccugaugccccu

SEQ ID NO: 2202627 - RNA, 19 nt, Homo sapiens
agugaccccagcuccaggc

SEQ ID NO: 2202628 - RNA, 19 nt, Homo sapiens
uccauuuugugaauuguga

SEQ ID NO: 2202629 - RNA, 13 nt, Homo sapiens
gucuggacugcua

SEQ ID NO: 2202630 - RNA, 14 nt, Homo sapiens
uagcccaaaaccaa

SEQ ID NO: 2202631 - RNA, 14 nt, Homo sapiens
aucauugcaaacaa

SEQ ID NO: 2202632 - RNA, 21 nt, Homo sapiens
guuuguuccccaagacauucu

SEQ ID NO: 2202633 - RNA, 22 nt, Homo sapiens
uacaggaucauguaaaugcuca

SEQ ID NO: 2202634 - RNA, 19 nt, Homo sapiens
agcugccugugccaugccc

SEQ ID NO: 2202635 - RNA, 16 nt, Homo sapiens
acauggugacuuuuga

SEQ ID NO: 2202636 - RNA, 20 nt, Homo sapiens
acuucccagagcaucuugca

SEQ ID NO: 2202637 - RNA, 22 nt, Homo sapiens
uaacuagacaccaaaguucuaa

SEQ ID NO: 2202638 - RNA, 21 nt, Homo sapiens
uguguuuuuuccccauuguau

SEQ ID NO: 2202639 - RNA, 12 nt, Homo sapiens
aaauaaaagccu

SEQ ID NO: 2202640 - RNA, 22 nt, Homo sapiens
accauggguuauuuaugcuugu

SEQ ID NO: 2202641 - RNA, 23 nt, Homo sapiens
guuuuggccaccccuugcucucu

SEQ ID NO: 2202642 - RNA, 15 nt, Homo sapiens
ugccaaaauaccuuc

SEQ ID NO: 2202643 - RNA, 16 nt, Homo sapiens
uuuguaaugcugcaca

SEQ ID NO: 2202644 - RNA, 12 nt, Homo sapiens
guagaaaggcca

SEQ ID NO: 2202645 - RNA, 19 nt, Homo sapiens
aguuguugcuuauacuguu

SEQ ID NO: 2202646 - RNA, 22 nt, Homo sapiens
gugcccauguguacauucugcc

SEQ ID NO: 2202647 - RNA, 17 nt, Homo sapiens
uaccacaggaugcauau

SEQ ID NO: 2202648 - RNA, 16 nt, Homo sapiens
cugcugccugcugaga

SEQ ID NO: 2202649 - RNA, 18 nt, Homo sapiens
caaaaccccccagauauc

SEQ ID NO: 2202650 - RNA, 19 nt, Homo sapiens
ccaggacaccuuucucugc

SEQ ID NO: 2202651 - RNA, 12 nt, Homo sapiens
gccugacauuca

SEQ ID NO: 2202652 - RNA, 12 nt, Homo sapiens
cauguauacuua

SEQ ID NO: 2202653 - RNA, 17 nt, Homo sapiens
auucagggagugggcua

SEQ ID NO: 2202654 - RNA, 13 nt, Homo sapiens
gcagaagcagcug

SEQ ID NO: 2202655 - RNA, 23 nt, Homo sapiens
guaaggacuugugccucuuggga

SEQ ID NO: 2202656 - RNA, 17 nt, Homo sapiens
accuagcgucaguauuu

SEQ ID NO: 2202657 - RNA, 20 nt, Homo sapiens
aucucuauuaaaauacaaaa

SEQ ID NO: 2202658 - RNA, 17 nt, Homo sapiens
caagaagucccaagacc

SEQ ID NO: 2202659 - RNA, 21 nt, Homo sapiens
auacuucuuuauucacaguau

SEQ ID NO: 2202660 - RNA, 14 nt, Homo sapiens
uacuguccaaagac

SEQ ID NO: 2202661 - RNA, 18 nt, Homo sapiens
ugagaaaccuguaucuuu

SEQ ID NO: 2202662 - RNA, 12 nt, Homo sapiens
acacaugugcac

SEQ ID NO: 2202663 - RNA, 22 nt, Homo sapiens
uaccagacuguguauucauuga

SEQ ID NO: 2202664 - RNA, 12 nt, Homo sapiens
agaccuuggcau

SEQ ID NO: 2202665 - RNA, 12 nt, Homo sapiens
auccaagaccug

SEQ ID NO: 2202666 - RNA, 18 nt, Homo sapiens
gcucaagugaucuuccca

SEQ ID NO: 2202667 - RNA, 12 nt, Homo sapiens
aaugaccuguau

SEQ ID NO: 2202668 - RNA, 20 nt, Homo sapiens
acaagguucccucugagaau

SEQ ID NO: 2202669 - RNA, 19 nt, Homo sapiens
cuuucauaaagucuugccu

SEQ ID NO: 2202670 - RNA, 22 nt, Homo sapiens
uaucacuguaucaucuuggucu

SEQ ID NO: 2202671 - RNA, 14 nt, Homo sapiens
gcuggacacccccu

SEQ ID NO: 2202672 - RNA, 18 nt, Homo sapiens
uaggugaggcugggcccu

SEQ ID NO: 2202673 - RNA, 12 nt, Homo sapiens
caguccaaggaa

SEQ ID NO: 2202674 - RNA, 14 nt, Homo sapiens
ccauucugcauuua

SEQ ID NO: 2202675 - RNA, 19 nt, Homo sapiens
ccggaugacacaaauacca

SEQ ID NO: 2202676 - RNA, 15 nt, Homo sapiens
guuuucuucugugau

SEQ ID NO: 2202677 - RNA, 17 nt, Homo sapiens
uccacacccucacugcu

SEQ ID NO: 2202678 - RNA, 20 nt, Homo sapiens
accaguuaugauaaccaaga

SEQ ID NO: 2202679 - RNA, 19 nt, Homo sapiens
uuacuccuuuggcuucaaa

SEQ ID NO: 2202680 - RNA, 19 nt, Homo sapiens
uuuuaaaaaggaacugcag

SEQ ID NO: 2202681 - RNA, 22 nt, Homo sapiens
augcccucauaaaccaaugugg

SEQ ID NO: 2202682 - RNA, 21 nt, Homo sapiens
uuaugcuguggucacaggggu

SEQ ID NO: 2202683 - RNA, 14 nt, Homo sapiens
auuggcugccuuau

SEQ ID NO: 2202684 - RNA, 12 nt, Homo sapiens
guacaaugacuu

SEQ ID NO: 2202685 - RNA, 17 nt, Homo sapiens
acuguugcauaacuauu

SEQ ID NO: 2202686 - RNA, 19 nt, Homo sapiens
acuguuaauaguacuauua

SEQ ID NO: 2202687 - RNA, 12 nt, Homo sapiens
ugccauugcacu

SEQ ID NO: 2202688 - RNA, 22 nt, Homo sapiens
uuauuugcacagggagaauuga

SEQ ID NO: 2202689 - RNA, 17 nt, Homo sapiens
ugagaucaucagugaua

SEQ ID NO: 2202690 - RNA, 19 nt, Homo sapiens
guuuccaucagguuccauc

SEQ ID NO: 2202691 - RNA, 11 nt, Homo sapiens
aauuucuacua

SEQ ID NO: 2202692 - RNA, 23 nt, Homo sapiens
ucaccgcgaggccuauuguugaa

SEQ ID NO: 2202693 - RNA, 23 nt, Homo sapiens
guuacgaguuuucccucagugaa

SEQ ID NO: 2202694 - RNA, 18 nt, Homo sapiens
uagagaauaccaguguua

SEQ ID NO: 2202695 - RNA, 19 nt, Homo sapiens
gcuacaguuuggagcccac

SEQ ID NO: 2202696 - RNA, 14 nt, Homo sapiens
cucucccacaccac

SEQ ID NO: 2202697 - RNA, 17 nt, Homo sapiens
aaagcauuguaacuuau

SEQ ID NO: 2202698 - RNA, 16 nt, Homo sapiens
uuuucuauauucucau

SEQ ID NO: 2202699 - RNA, 16 nt, Homo sapiens
aauuccauuaucuuau

SEQ ID NO: 2202700 - RNA, 23 nt, Homo sapiens
acagaaauccuuucauaaagcac

SEQ ID NO: 2202701 - RNA, 15 nt, Homo sapiens
ccuucacaaauguca

SEQ ID NO: 2202702 - RNA, 23 nt, Homo sapiens
cuggggaggcaggcauuccugaa

SEQ ID NO: 2202703 - RNA, 15 nt, Homo sapiens
ugaccucgugaucua

SEQ ID NO: 2202704 - RNA, 21 nt, Homo sapiens
acacaggcccagaugacaucc

SEQ ID NO: 2202705 - RNA, 14 nt, Homo sapiens
ucaauuaauugauu

SEQ ID NO: 2202706 - RNA, 11 nt, Homo sapiens
gauacacugug

SEQ ID NO: 2202707 - RNA, 21 nt, Homo sapiens
ucacagccuuucugaggacac

SEQ ID NO: 2202708 - RNA, 12 nt, Homo sapiens
uucagagcugcc

SEQ ID NO: 2202709 - RNA, 12 nt, Homo sapiens
guguacaggugu

SEQ ID NO: 2202710 - RNA, 23 nt, Homo sapiens
uuuaaauacagucuuccauuugc

SEQ ID NO: 2202711 - RNA, 19 nt, Homo sapiens
aggggccagagagcagggg

SEQ ID NO: 2202712 - RNA, 21 nt, Homo sapiens
gcuuuugguggcuaccaugca

SEQ ID NO: 2202713 - RNA, 17 nt, Homo sapiens
gccaggacaaaaugcag

SEQ ID NO: 2202714 - RNA, 14 nt, Homo sapiens
caggcuagauguau

SEQ ID NO: 2202715 - RNA, 16 nt, Homo sapiens
uacgugagggggagcu

SEQ ID NO: 2202716 - RNA, 18 nt, Homo sapiens
cuguguaaccagcaguca

SEQ ID NO: 2202717 - RNA, 16 nt, Homo sapiens
guguaggcaccaccuc

SEQ ID NO: 2202718 - RNA, 14 nt, Homo sapiens
aagugagagagcaa

SEQ ID NO: 2202719 - RNA, 21 nt, Homo sapiens
aucaaggauguaguaucucau

SEQ ID NO: 2202720 - RNA, 12 nt, Homo sapiens
accaaaggugaa

SEQ ID NO: 2202721 - RNA, 22 nt, Homo sapiens
uauacugaaggaaaaacacaag

SEQ ID NO: 2202722 - RNA, 18 nt, Homo sapiens
gagccugagccacaaaaa

SEQ ID NO: 2202723 - RNA, 16 nt, Homo sapiens
uccuuccagcuaguga

SEQ ID NO: 2202724 - RNA, 20 nt, Homo sapiens
uaaagugcugcagccaaaga

SEQ ID NO: 2202725 - RNA, 17 nt, Homo sapiens
auccuaguaauugccua

SEQ ID NO: 2202726 - RNA, 20 nt, Homo sapiens
uuucacgcaugugugcugca

SEQ ID NO: 2202727 - RNA, 16 nt, Homo sapiens
ucucuaaaucaaguau

SEQ ID NO: 2202728 - RNA, 22 nt, Homo sapiens
aaaaagucagagacagauaccu

SEQ ID NO: 2202729 - RNA, 12 nt, Homo sapiens
uguggucauccu

SEQ ID NO: 2202730 - RNA, 21 nt, Homo sapiens
uagaggacuucuggcagggaa

SEQ ID NO: 2202731 - RNA, 13 nt, Homo sapiens
uuaaacauuucaa

SEQ ID NO: 2202732 - RNA, 19 nt, Homo sapiens
uauaaauguguggugcuaa

SEQ ID NO: 2202733 - RNA, 21 nt, Homo sapiens
agaaugugcagugucuuguaa

SEQ ID NO: 2202734 - RNA, 13 nt, Homo sapiens
accugauccugga

SEQ ID NO: 2202735 - RNA, 14 nt, Homo sapiens
agcaucgugcuguu

SEQ ID NO: 2202736 - RNA, 19 nt, Homo sapiens
augaaaaaaaaaacuauca

SEQ ID NO: 2202737 - RNA, 19 nt, Homo sapiens
aaauuauuuuguucauaca

SEQ ID NO: 2202738 - RNA, 22 nt, Homo sapiens
gguugcagugcugagcuguggg

SEQ ID NO: 2202739 - RNA, 22 nt, Homo sapiens
aucauauuggugcugagugcua

SEQ ID NO: 2202740 - RNA, 14 nt, Homo sapiens
ucagaacaaaguga

SEQ ID NO: 2202741 - RNA, 17 nt, Homo sapiens
ccuagaccuggugcuga

SEQ ID NO: 2202742 - RNA, 14 nt, Homo sapiens
augcuuaaaugauc

SEQ ID NO: 2202743 - RNA, 15 nt, Homo sapiens
uaggauuacuuagau

SEQ ID NO: 2202744 - RNA, 20 nt, Homo sapiens
uacaaguuucuagcucucac

SEQ ID NO: 2202745 - RNA, 22 nt, Homo sapiens
acggcuguguauuucuguagaa

SEQ ID NO: 2202746 - RNA, 19 nt, Homo sapiens
ugucuggcaaugccacagc

SEQ ID NO: 2202747 - RNA, 14 nt, Homo sapiens
ggcccaucaggggc

SEQ ID NO: 2202748 - RNA, 21 nt, Homo sapiens
ugguguuauguuuauguaaca

SEQ ID NO: 2202749 - RNA, 22 nt, Homo sapiens
auuacaguccguccaccaccuc

SEQ ID NO: 2202750 - RNA, 17 nt, Homo sapiens
gaaaagggagucaugca

SEQ ID NO: 2202751 - RNA, 23 nt, Homo sapiens
ccuuaacacacacaccucuagga

SEQ ID NO: 2202752 - RNA, 17 nt, Homo sapiens
accagcugggguccugu

SEQ ID NO: 2202753 - RNA, 14 nt, Homo sapiens
acuaggucaaucag

SEQ ID NO: 2202754 - RNA, 12 nt, Homo sapiens
cucucucacuga

SEQ ID NO: 2202755 - RNA, 21 nt, Homo sapiens
cagagauggcaguugcuuccu

SEQ ID NO: 2202756 - RNA, 16 nt, Homo sapiens
gugaggugacuugccu

SEQ ID NO: 2202757 - RNA, 20 nt, Homo sapiens
ugaccaaauaaaguaccauu

SEQ ID NO: 2202758 - RNA, 14 nt, Homo sapiens
gcuuccugugacag

SEQ ID NO: 2202759 - RNA, 16 nt, Homo sapiens
ugcauaacgucugccu

SEQ ID NO: 2202760 - RNA, 14 nt, Homo sapiens
cugaguugcccuga

SEQ ID NO: 2202761 - RNA, 16 nt, Homo sapiens
cauguaagccaaguca

SEQ ID NO: 2202762 - RNA, 18 nt, Homo sapiens
ggauaacccuacacccag

SEQ ID NO: 2202763 - RNA, 12 nt, Homo sapiens
ucauucaaguca

SEQ ID NO: 2202764 - RNA, 14 nt, Homo sapiens
ugcguccucugucc

SEQ ID NO: 2202765 - RNA, 14 nt, Homo sapiens
gcaguaauguuccu

SEQ ID NO: 2202766 - RNA, 17 nt, Homo sapiens
uaacucaauauuuucca

SEQ ID NO: 2202767 - RNA, 20 nt, Homo sapiens
acccagugccuacagggcug

SEQ ID NO: 2202768 - RNA, 19 nt, Homo sapiens
cccuguguugugcucagga

SEQ ID NO: 2202769 - RNA, 17 nt, Homo sapiens
ccaggagaaagaaggcu

SEQ ID NO: 2202770 - RNA, 18 nt, Homo sapiens
cuuguuaauuuuauucaa

SEQ ID NO: 2202771 - RNA, 12 nt, Homo sapiens
uggagugcugca

SEQ ID NO: 2202772 - RNA, 15 nt, Homo sapiens
ggaguguucuguggg

SEQ ID NO: 2202773 - RNA, 22 nt, Homo sapiens
aaggaaacuugaaucaaagcag

SEQ ID NO: 2202774 - RNA, 16 nt, Homo sapiens
aaugcuaaaacaugau

SEQ ID NO: 2202775 - RNA, 17 nt, Homo sapiens
agagaaucaacuaggua

SEQ ID NO: 2202776 - RNA, 22 nt, Homo sapiens
ugcugugaggcuguccuguaca

SEQ ID NO: 2202777 - RNA, 17 nt, Homo sapiens
aggaggaggaggacaga

SEQ ID NO: 2202778 - RNA, 11 nt, Homo sapiens
cauaacuguag

SEQ ID NO: 2202779 - RNA, 15 nt, Homo sapiens
aacauuaacauugau

SEQ ID NO: 2202780 - RNA, 21 nt, Homo sapiens
caauuguagaugaacaucucu

SEQ ID NO: 2202781 - RNA, 13 nt, Homo sapiens
cuaguuugcacua

SEQ ID NO: 2202782 - RNA, 23 nt, Homo sapiens
aaccgaggcccucaauccaccuu

SEQ ID NO: 2202783 - RNA, 21 nt, Homo sapiens
acuggagcaucugacucacaa

SEQ ID NO: 2202784 - RNA, 13 nt, Homo sapiens
agcucaaguuuca

SEQ ID NO: 2202785 - RNA, 16 nt, Homo sapiens
acacagugagacugua

SEQ ID NO: 2202786 - RNA, 16 nt, Homo sapiens
aaggaagaucaggcca

SEQ ID NO: 2202787 - RNA, 21 nt, Homo sapiens
augucccuuucuuggccaguu

SEQ ID NO: 2202788 - RNA, 21 nt, Homo sapiens
ucucaaggcaguuaauucuca

SEQ ID NO: 2202789 - RNA, 20 nt, Homo sapiens
auauggaaaaaaugaacuuu

SEQ ID NO: 2202790 - RNA, 16 nt, Homo sapiens
gcucuuuugugaugaa

SEQ ID NO: 2202791 - RNA, 13 nt, Homo sapiens
uauuaccacugaa

SEQ ID NO: 2202792 - RNA, 22 nt, Homo sapiens
ugcacuguccugaccaucgcac

SEQ ID NO: 2202793 - RNA, 20 nt, Homo sapiens
acaacgaacauggcauguga

SEQ ID NO: 2202794 - RNA, 16 nt, Homo sapiens
ggcugcaugagcugca

SEQ ID NO: 2202795 - RNA, 12 nt, Homo sapiens
uccaggggucuu

SEQ ID NO: 2202796 - RNA, 15 nt, Homo sapiens
uaauaccuguccaca

SEQ ID NO: 2202797 - RNA, 22 nt, Homo sapiens
ccacccaggcuggagugcagug

SEQ ID NO: 2202798 - RNA, 23 nt, Homo sapiens
uuccuuuaacaacauguuuccag

SEQ ID NO: 2202799 - RNA, 17 nt, Homo sapiens
ucauugguguacugugu

SEQ ID NO: 2202800 - RNA, 19 nt, Homo sapiens
gcagcugggauuacaggug

SEQ ID NO: 2202801 - RNA, 18 nt, Homo sapiens
aauguauucuuaaauuca

SEQ ID NO: 2202802 - RNA, 15 nt, Homo sapiens
cagggcuggggccaa

SEQ ID NO: 2202803 - RNA, 20 nt, Homo sapiens
ggacacccacagcugcagca

SEQ ID NO: 2202804 - RNA, 14 nt, Homo sapiens
auaauuugcacuga

SEQ ID NO: 2202805 - RNA, 19 nt, Homo sapiens
gagugagacuccgucucaa

SEQ ID NO: 2202806 - RNA, 20 nt, Homo sapiens
agccccucccccaucuccca

SEQ ID NO: 2202807 - RNA, 18 nt, Homo sapiens
gaauacuguuauaucuaa

SEQ ID NO: 2202808 - RNA, 13 nt, Homo sapiens
uggaugauucaga

SEQ ID NO: 2202809 - RNA, 19 nt, Homo sapiens
uuguaauuuuacacaaaua

SEQ ID NO: 2202810 - RNA, 18 nt, Homo sapiens
uccuugaccacuggcccu

SEQ ID NO: 2202811 - RNA, 14 nt, Homo sapiens
uuacagagccuuga

SEQ ID NO: 2202812 - RNA, 14 nt, Homo sapiens
aaaauaucuugcaa

SEQ ID NO: 2202813 - RNA, 15 nt, Homo sapiens
cagguucucaccuca

SEQ ID NO: 2202814 - RNA, 18 nt, Homo sapiens
ucacuugguccuaccuau

SEQ ID NO: 2202815 - RNA, 16 nt, Homo sapiens
uuuaggcacuguucaa

SEQ ID NO: 2202816 - RNA, 22 nt, Homo sapiens
uauuuuaagaauuucacaagcu

SEQ ID NO: 2202817 - RNA, 21 nt, Homo sapiens
aguaccuagcuggcucuguga

SEQ ID NO: 2202818 - RNA, 16 nt, Homo sapiens
uguuauauauuuacuc

SEQ ID NO: 2202819 - RNA, 12 nt, Homo sapiens
agauuugucaca

SEQ ID NO: 2202820 - RNA, 15 nt, Homo sapiens
caccucaagugcaag

SEQ ID NO: 2202821 - RNA, 18 nt, Homo sapiens
aggccuacugaccaaauu

SEQ ID NO: 2202822 - RNA, 19 nt, Homo sapiens
agaagccaaacagcaagaa

SEQ ID NO: 2202823 - RNA, 16 nt, Homo sapiens
uauguuuucacuguau

SEQ ID NO: 2202824 - RNA, 21 nt, Homo sapiens
cugaggaagugggcgugagug

SEQ ID NO: 2202825 - RNA, 18 nt, Homo sapiens
auuuuauaacagaauuaa

SEQ ID NO: 2202826 - RNA, 15 nt, Homo sapiens
cucugguaauauuga

SEQ ID NO: 2202827 - RNA, 20 nt, Homo sapiens
uaaaaucugcugaucucugu

SEQ ID NO: 2202828 - RNA, 22 nt, Homo sapiens
guacagcacuuucuucuuccca

SEQ ID NO: 2202829 - RNA, 18 nt, Homo sapiens
ucagucccuuccccaugc

SEQ ID NO: 2202830 - RNA, 20 nt, Homo sapiens
uauaauucuuucaauacaga

SEQ ID NO: 2202831 - RNA, 19 nt, Homo sapiens
ccuauuccugaacuauaac

SEQ ID NO: 2202832 - RNA, 14 nt, Homo sapiens
guaagaauauagua

SEQ ID NO: 2202833 - RNA, 19 nt, Homo sapiens
agacaccugccuuaacaca

SEQ ID NO: 2202834 - RNA, 19 nt, Homo sapiens
cggaucuuuggacagaagc

SEQ ID NO: 2202835 - RNA, 12 nt, Homo sapiens
ugccuucauuga

SEQ ID NO: 2202836 - RNA, 16 nt, Homo sapiens
ugcacagggcaauuga

SEQ ID NO: 2202837 - RNA, 22 nt, Homo sapiens
caugacuuguagcauauucuuu

SEQ ID NO: 2202838 - RNA, 13 nt, Homo sapiens
ggcugcuuuccaa

SEQ ID NO: 2202839 - RNA, 20 nt, Homo sapiens
ugcuuuaccacaaugagcaa

SEQ ID NO: 2202840 - RNA, 15 nt, Homo sapiens
ucaaauaccacauga

SEQ ID NO: 2202841 - RNA, 17 nt, Homo sapiens
auuuuguuuuguucagu

SEQ ID NO: 2202842 - RNA, 18 nt, Homo sapiens
cuauaugcauuuaauucu

SEQ ID NO: 2202843 - RNA, 15 nt, Homo sapiens
aauagauuucucaag

SEQ ID NO: 2202844 - RNA, 21 nt, Homo sapiens
cauuggcccauagguacauug

SEQ ID NO: 2202845 - RNA, 17 nt, Homo sapiens
guauucauauguuuaug

SEQ ID NO: 2202846 - RNA, 14 nt, Homo sapiens
uugucccccaacuu

SEQ ID NO: 2202847 - RNA, 15 nt, Homo sapiens
ugugaaccaccacac

SEQ ID NO: 2202848 - RNA, 15 nt, Homo sapiens
acugaagcugcacag

SEQ ID NO: 2202849 - RNA, 22 nt, Homo sapiens
gagcucccaccucccuucccac

SEQ ID NO: 2202850 - RNA, 19 nt, Homo sapiens
cacacgaggagcaugcagc

SEQ ID NO: 2202851 - RNA, 13 nt, Homo sapiens
aacaaggaugaau

SEQ ID NO: 2202852 - RNA, 16 nt, Homo sapiens
ugcauugaaagaauua

SEQ ID NO: 2202853 - RNA, 23 nt, Homo sapiens
caguacucaguaacagugcagua

SEQ ID NO: 2202854 - RNA, 21 nt, Homo sapiens
cuuuaacacaacucuuuguuc

SEQ ID NO: 2202855 - RNA, 16 nt, Homo sapiens
aauguucaucaaugaa

SEQ ID NO: 2202856 - RNA, 18 nt, Homo sapiens
uaaacuucuggugugaua

SEQ ID NO: 2202857 - RNA, 21 nt, Homo sapiens
ggaaccucagccuggccagac

SEQ ID NO: 2202858 - RNA, 14 nt, Homo sapiens
uuuaguauguguca

SEQ ID NO: 2202859 - RNA, 22 nt, Homo sapiens
uuagaaagcugacauugccaaa

SEQ ID NO: 2202860 - RNA, 22 nt, Homo sapiens
guuuguaaguggauucaguuca

SEQ ID NO: 2202861 - RNA, 22 nt, Homo sapiens
ucuaaacuacaacgaacacaag

SEQ ID NO: 2202862 - RNA, 14 nt, Homo sapiens
caauuggguuguga

SEQ ID NO: 2202863 - RNA, 15 nt, Homo sapiens
ucacucuuaugaaau

SEQ ID NO: 2202864 - RNA, 13 nt, Homo sapiens
agacugagcaccu

SEQ ID NO: 2202865 - RNA, 18 nt, Homo sapiens
ucacgaggugucucucac

SEQ ID NO: 2202866 - RNA, 17 nt, Homo sapiens
ggcagauggggcacuga

SEQ ID NO: 2202867 - RNA, 22 nt, Homo sapiens
uauguaauuuuauuuacauucu

SEQ ID NO: 2202868 - RNA, 17 nt, Homo sapiens
gccacuauuaacauuuc

SEQ ID NO: 2202869 - RNA, 17 nt, Homo sapiens
ugagcaaggacauugcc

SEQ ID NO: 2202870 - RNA, 18 nt, Homo sapiens
gcagauccccacuguccu

SEQ ID NO: 2202871 - RNA, 15 nt, Homo sapiens
cauauagaggcaaga

SEQ ID NO: 2202872 - RNA, 22 nt, Homo sapiens
ccuugccuguuuuucaaucuca

SEQ ID NO: 2202873 - RNA, 15 nt, Homo sapiens
agugcuccauccaaa

SEQ ID NO: 2202874 - RNA, 19 nt, Homo sapiens
uucccccacuacugcagca

SEQ ID NO: 2202875 - RNA, 16 nt, Homo sapiens
agugggcagugcaugu

SEQ ID NO: 2202876 - RNA, 20 nt, Homo sapiens
gaaagagaaaaugcuuucuc

SEQ ID NO: 2202877 - RNA, 14 nt, Homo sapiens
auccuagcacuuug

SEQ ID NO: 2202878 - RNA, 16 nt, Homo sapiens
gguucaagcuugucca

SEQ ID NO: 2202879 - RNA, 21 nt, Homo sapiens
cgagauagcaccauugcacuc

SEQ ID NO: 2202880 - RNA, 16 nt, Homo sapiens
cuugauauuuucuaua

SEQ ID NO: 2202881 - RNA, 13 nt, Homo sapiens
uaaaugcagguau

SEQ ID NO: 2202882 - RNA, 23 nt, Homo sapiens
ugcagaacuuaaucuggacacac

SEQ ID NO: 2202883 - RNA, 18 nt, Homo sapiens
aaauauggaauaggagac

SEQ ID NO: 2202884 - RNA, 23 nt, Homo sapiens
ccauuuccaaauguggccuccau

SEQ ID NO: 2202885 - RNA, 18 nt, Homo sapiens
uccuguaagaccuucggg

SEQ ID NO: 2202886 - RNA, 18 nt, Homo sapiens
aaggcccacuguccagca

SEQ ID NO: 2202887 - RNA, 19 nt, Homo sapiens
cccagaaccacagaugugu

SEQ ID NO: 2202888 - RNA, 20 nt, Homo sapiens
gacgugcacuuggugcugcg

SEQ ID NO: 2202889 - RNA, 12 nt, Homo sapiens
acauaucuuaca

SEQ ID NO: 2202890 - RNA, 22 nt, Homo sapiens
gaaugauuaugaauuacauuug

SEQ ID NO: 2202891 - RNA, 21 nt, Homo sapiens
acgaagugccagaacccaaau

SEQ ID NO: 2202892 - RNA, 19 nt, Homo sapiens
ucuggucaaccccacaagc

SEQ ID NO: 2202893 - RNA, 22 nt, Homo sapiens
gggcugccgagugcugugcacg

SEQ ID NO: 2202894 - RNA, 13 nt, Homo sapiens
ugcagaguacugg

SEQ ID NO: 2202895 - RNA, 13 nt, Homo sapiens
guacaugugcaca

SEQ ID NO: 2202896 - RNA, 13 nt, Homo sapiens
cccauugucucau

SEQ ID NO: 2202897 - RNA, 15 nt, Homo sapiens
cauaaaagucuguga

SEQ ID NO: 2202898 - RNA, 23 nt, Homo sapiens
gcugcccugucuggaacauggac

SEQ ID NO: 2202899 - RNA, 20 nt, Homo sapiens
agucacgcaccaagcaggca

SEQ ID NO: 2202900 - RNA, 20 nt, Homo sapiens
acucaggcgggcaccaaggc

SEQ ID NO: 2202901 - RNA, 23 nt, Homo sapiens
aacugucgucuuuuuccaaacaa

SEQ ID NO: 2202902 - RNA, 20 nt, Homo sapiens
ugggacuguguggaccaagg

SEQ ID NO: 2202903 - RNA, 18 nt, Homo sapiens
caggaugauggcacugag

SEQ ID NO: 2202904 - RNA, 17 nt, Homo sapiens
aauaugcuuauaaccua

SEQ ID NO: 2202905 - RNA, 22 nt, Homo sapiens
aagcgacccauucagagacugu

SEQ ID NO: 2202906 - RNA, 13 nt, Homo sapiens
auucuccaguauu

SEQ ID NO: 2202907 - RNA, 17 nt, Homo sapiens
cacagagccugccucag

SEQ ID NO: 2202908 - RNA, 14 nt, Homo sapiens
ugcaccagagcaac

SEQ ID NO: 2202909 - RNA, 20 nt, Homo sapiens
cugcugaucaaucugcaguu

SEQ ID NO: 2202910 - RNA, 16 nt, Homo sapiens
uccccugcacuguaaa

SEQ ID NO: 2202911 - RNA, 15 nt, Homo sapiens
auccuccuaccucca

SEQ ID NO: 2202912 - RNA, 14 nt, Homo sapiens
uguauggauauaau

SEQ ID NO: 2202913 - RNA, 17 nt, Homo sapiens
uggacuuucuugcauga

SEQ ID NO: 2202914 - RNA, 16 nt, Homo sapiens
cacuugccaugcagga

SEQ ID NO: 2202915 - RNA, 23 nt, Homo sapiens
uaccagagccuucaagugccaaa

SEQ ID NO: 2202916 - RNA, 18 nt, Homo sapiens
ugaggaaaaguccacaag

SEQ ID NO: 2202917 - RNA, 22 nt, Homo sapiens
ucagcccugcaccaugcugcug

SEQ ID NO: 2202918 - RNA, 17 nt, Homo sapiens
uauagccuauacugcau

SEQ ID NO: 2202919 - RNA, 17 nt, Homo sapiens
ugcccagacuacagggc

SEQ ID NO: 2202920 - RNA, 15 nt, Homo sapiens
ucagccccacugaca

SEQ ID NO: 2202921 - RNA, 13 nt, Homo sapiens
cauuccaagacag

SEQ ID NO: 2202922 - RNA, 23 nt, Homo sapiens
caugauuuuauacauagucacaa

SEQ ID NO: 2202923 - RNA, 19 nt, Homo sapiens
ccacagucauuagugaauu

SEQ ID NO: 2202924 - RNA, 16 nt, Homo sapiens
cauccucaaacacugc

SEQ ID NO: 2202925 - RNA, 20 nt, Homo sapiens
cgcacaggcuggagugcagu

SEQ ID NO: 2202926 - RNA, 21 nt, Homo sapiens
aggggagacuuaggccagagg

SEQ ID NO: 2202927 - RNA, 20 nt, Homo sapiens
uucaggcugccuaagacaug

SEQ ID NO: 2202928 - RNA, 20 nt, Homo sapiens
cugaguagucuguagcuuga

SEQ ID NO: 2202929 - RNA, 21 nt, Homo sapiens
agcuuccaacccgaggcaaua

SEQ ID NO: 2202930 - RNA, 23 nt, Homo sapiens
uggucaucgugacagcagcagcu

SEQ ID NO: 2202931 - RNA, 17 nt, Homo sapiens
agaaucacuugacuuug

SEQ ID NO: 2202932 - RNA, 20 nt, Homo sapiens
uaguaucugcuuaggugcca

SEQ ID NO: 2202933 - RNA, 13 nt, Homo sapiens
aagcucacacuug

SEQ ID NO: 2202934 - RNA, 12 nt, Homo sapiens
aauaguaaucug

SEQ ID NO: 2202935 - RNA, 23 nt, Homo sapiens
agcuccucagcggcuccagcuca

SEQ ID NO: 2202936 - RNA, 22 nt, Homo sapiens
uggcucccucacucucaggaaa

SEQ ID NO: 2202937 - RNA, 17 nt, Homo sapiens
cagaggugcuccaugga

SEQ ID NO: 2202938 - RNA, 20 nt, Homo sapiens
ucgggaagagaggaguucaa

SEQ ID NO: 2202939 - RNA, 15 nt, Homo sapiens
gaaaacuaagucaga

SEQ ID NO: 2202940 - RNA, 11 nt, Homo sapiens
ugccacaaaga

SEQ ID NO: 2202941 - RNA, 19 nt, Homo sapiens
aggagcugauuuccaggcc

SEQ ID NO: 2202942 - RNA, 14 nt, Homo sapiens
ugcaguuugaucaa

SEQ ID NO: 2202943 - RNA, 19 nt, Homo sapiens
auguucuuggaacauggaa

SEQ ID NO: 2202944 - RNA, 23 nt, Homo sapiens
guucuaaggauggaaaggugaca

SEQ ID NO: 2202945 - RNA, 20 nt, Homo sapiens
gaaaguuuuaauaccuaagu

SEQ ID NO: 2202946 - RNA, 13 nt, Homo sapiens
uagacacuggaca

SEQ ID NO: 2202947 - RNA, 15 nt, Homo sapiens
aaaaauccuacaagg

SEQ ID NO: 2202948 - RNA, 19 nt, Homo sapiens
aaaaugugaacauggaaac

SEQ ID NO: 2202949 - RNA, 18 nt, Homo sapiens
uggaagcauccugugcug

SEQ ID NO: 2202950 - RNA, 16 nt, Homo sapiens
gcgggacccgaccccc

SEQ ID NO: 2202951 - RNA, 17 nt, Homo sapiens
agugcccaacuguuaua

SEQ ID NO: 2202952 - RNA, 18 nt, Homo sapiens
cuucaagcgcuccagggc

SEQ ID NO: 2202953 - RNA, 15 nt, Homo sapiens
gcuaauaagugcuuu

SEQ ID NO: 2202954 - RNA, 22 nt, Homo sapiens
gauuuuuuuuucauacacuuau

SEQ ID NO: 2202955 - RNA, 13 nt, Homo sapiens
gauacauacagaa

SEQ ID NO: 2202956 - RNA, 22 nt, Homo sapiens
cccaugggcuaucaacuuaaua

SEQ ID NO: 2202957 - RNA, 19 nt, Homo sapiens
cauaucuuagguauauaau

SEQ ID NO: 2202958 - RNA, 22 nt, Homo sapiens
guccugggcauggguccagggc

SEQ ID NO: 2202959 - RNA, 15 nt, Homo sapiens
agugcuguccaugcu

SEQ ID NO: 2202960 - RNA, 14 nt, Homo sapiens
agaucauauccuca

SEQ ID NO: 2202961 - RNA, 21 nt, Homo sapiens
gcuacucaugacugaagggaa

SEQ ID NO: 2202962 - RNA, 17 nt, Homo sapiens
uaggacucugcacugaa

SEQ ID NO: 2202963 - RNA, 15 nt, Homo sapiens
gguuugucaguucuu

SEQ ID NO: 2202964 - RNA, 19 nt, Homo sapiens
aaugaacuuguuacuugca

SEQ ID NO: 2202965 - RNA, 16 nt, Homo sapiens
ugagugaaacucccac

SEQ ID NO: 2202966 - RNA, 16 nt, Homo sapiens
uauaacaaaugcuuua

SEQ ID NO: 2202967 - RNA, 20 nt, Homo sapiens
uugcugaagugguugcauuc

SEQ ID NO: 2202968 - RNA, 11 nt, Homo sapiens
cucuccaggga

SEQ ID NO: 2202969 - RNA, 22 nt, Homo sapiens
cccagcacuuugggagaccaag

SEQ ID NO: 2202970 - RNA, 22 nt, Homo sapiens
cugcccauggacaggcuggcuc

SEQ ID NO: 2202971 - RNA, 18 nt, Homo sapiens
guugauuacagugcagug

SEQ ID NO: 2202972 - RNA, 16 nt, Homo sapiens
ccucuuacaacuuuca

SEQ ID NO: 2202973 - RNA, 18 nt, Homo sapiens
agcuaggccuggccagau

SEQ ID NO: 2202974 - RNA, 19 nt, Homo sapiens
caugucucacgucucccua

SEQ ID NO: 2202975 - RNA, 21 nt, Homo sapiens
ccuuuaccuuuuaugcaaaag

SEQ ID NO: 2202976 - RNA, 20 nt, Homo sapiens
uuaugcauuuuuuaccacaa

SEQ ID NO: 2202977 - RNA, 16 nt, Homo sapiens
cccugaggcucaggga

SEQ ID NO: 2202978 - RNA, 16 nt, Homo sapiens
uuaauaagucauugaa

SEQ ID NO: 2202979 - RNA, 16 nt, Homo sapiens
uuaaaugccuuguaua

SEQ ID NO: 2202980 - RNA, 15 nt, Homo sapiens
ugugcaucaguggga

SEQ ID NO: 2202981 - RNA, 20 nt, Homo sapiens
agcccauuccucccauucaa

SEQ ID NO: 2202982 - RNA, 14 nt, Homo sapiens
cauugcacuggaau

SEQ ID NO: 2202983 - RNA, 14 nt, Homo sapiens
auaaauauacucaa

SEQ ID NO: 2202984 - RNA, 23 nt, Homo sapiens
uugcucaagaggaaaauccaaaa

SEQ ID NO: 2202985 - RNA, 20 nt, Homo sapiens
ccaauagucucucugcaaga

SEQ ID NO: 2202986 - RNA, 19 nt, Homo sapiens
uaggcagcuguccugugau

SEQ ID NO: 2202987 - RNA, 16 nt, Homo sapiens
auuuaacaagauuucu

SEQ ID NO: 2202988 - RNA, 23 nt, Homo sapiens
acaaagcauucuaaaugaacuca

SEQ ID NO: 2202989 - RNA, 20 nt, Homo sapiens
ugcauuuugugugaugcaug

SEQ ID NO: 2202990 - RNA, 16 nt, Homo sapiens
acuuccuauuagugac

SEQ ID NO: 2202991 - RNA, 23 nt, Homo sapiens
gcuucucuuuuuagauguagcac

SEQ ID NO: 2202992 - RNA, 16 nt, Homo sapiens
ccuguccuaagcacuu

SEQ ID NO: 2202993 - RNA, 15 nt, Homo sapiens
aucuaucaacuauaa

SEQ ID NO: 2202994 - RNA, 14 nt, Homo sapiens
aaagguaugcauuu

SEQ ID NO: 2202995 - RNA, 17 nt, Homo sapiens
cacucauauugcccuaa

SEQ ID NO: 2202996 - RNA, 20 nt, Homo sapiens
auucuuaacagugguucaaa

SEQ ID NO: 2202997 - RNA, 19 nt, Homo sapiens
aucacugccacacucucca

SEQ ID NO: 2202998 - RNA, 18 nt, Homo sapiens
uuggaaaccacagucagu

SEQ ID NO: 2202999 - RNA, 14 nt, Homo sapiens
agcugauacuuuga

SEQ ID NO: 2203000 - RNA, 14 nt, Homo sapiens
uaaugaacuaccau

SEQ ID NO: 2203001 - RNA, 23 nt, Homo sapiens
acaccuggcacugcugugcugug

SEQ ID NO: 2203002 - RNA, 12 nt, Homo sapiens
uugguuuuggac

SEQ ID NO: 2203003 - RNA, 22 nt, Homo sapiens
cacguagccacgcacagccaga

SEQ ID NO: 2203004 - RNA, 13 nt, Homo sapiens
ugauaaguucaua

SEQ ID NO: 2203005 - RNA, 13 nt, Homo sapiens
uccaacaguuuaa

SEQ ID NO: 2203006 - RNA, 21 nt, Homo sapiens
ugacccagcccugaacaaagc

SEQ ID NO: 2203007 - RNA, 16 nt, Homo sapiens
auccauuguguucucu

SEQ ID NO: 2203008 - RNA, 18 nt, Homo sapiens
augcuauaacuauguuga

SEQ ID NO: 2203009 - RNA, 13 nt, Homo sapiens
cagcagccugcca

SEQ ID NO: 2203010 - RNA, 23 nt, Homo sapiens
uggagccaccugucccaccucaa

SEQ ID NO: 2203011 - RNA, 14 nt, Homo sapiens
acucugaaagaccu

SEQ ID NO: 2203012 - RNA, 13 nt, Homo sapiens
cagccaagcccua

SEQ ID NO: 2203013 - RNA, 18 nt, Homo sapiens
uuaaucugagaggccaca

SEQ ID NO: 2203014 - RNA, 19 nt, Homo sapiens
aaauucacuaaucuugaau

SEQ ID NO: 2203015 - RNA, 19 nt, Homo sapiens
caugggucgggagagggga

SEQ ID NO: 2203016 - RNA, 20 nt, Homo sapiens
ggcaguacuccucccugggg

SEQ ID NO: 2203017 - RNA, 20 nt, Homo sapiens
gccggacgcaggugcugcgg

SEQ ID NO: 2203018 - RNA, 14 nt, Homo sapiens
cucacuguguugcc

SEQ ID NO: 2203019 - RNA, 13 nt, Homo sapiens
gauggcaaaaaca

SEQ ID NO: 2203020 - RNA, 13 nt, Homo sapiens
auacggugggggu

SEQ ID NO: 2203021 - RNA, 21 nt, Homo sapiens
cuagcugggaaggugaccaca

SEQ ID NO: 2203022 - RNA, 21 nt, Homo sapiens
aauauucccugacgacacuga

SEQ ID NO: 2203023 - RNA, 23 nt, Homo sapiens
uugccaagcagugcacauuucau

SEQ ID NO: 2203024 - RNA, 19 nt, Homo sapiens
ugaacccaggacaagcaug

SEQ ID NO: 2203025 - RNA, 14 nt, Homo sapiens
auggccugugcugg

SEQ ID NO: 2203026 - RNA, 17 nt, Homo sapiens
aacgcaguaaacagcuu

SEQ ID NO: 2203027 - RNA, 13 nt, Homo sapiens
cacuuggaugcag

SEQ ID NO: 2203028 - RNA, 23 nt, Homo sapiens
auugugaauugccugccauggcu

SEQ ID NO: 2203029 - RNA, 17 nt, Homo sapiens
uaguuacuaaacaugua

SEQ ID NO: 2203030 - RNA, 16 nt, Homo sapiens
uuugauaugauuguaa

SEQ ID NO: 2203031 - RNA, 22 nt, Homo sapiens
gcacugcugggggugaggacac

SEQ ID NO: 2203032 - RNA, 24 nt, Homo sapiens
cucauguguguagcuaagcuaccu

SEQ ID NO: 2203033 - RNA, 19 nt, Homo sapiens
ugaaaguuuuuaauucaua

SEQ ID NO: 2203034 - RNA, 16 nt, Homo sapiens
ugcuuuuaacucuaga

SEQ ID NO: 2203035 - RNA, 18 nt, Homo sapiens
uggggggcacagccagaa

SEQ ID NO: 2203036 - RNA, 20 nt, Homo sapiens
uaaagcacugauaggacuua

SEQ ID NO: 2203037 - RNA, 15 nt, Homo sapiens
gauccacuucucuca

SEQ ID NO: 2203038 - RNA, 22 nt, Homo sapiens
cuucacuguccuccaagccagc

SEQ ID NO: 2203039 - RNA, 18 nt, Homo sapiens
cauaagauauucuuuaca

SEQ ID NO: 2203040 - RNA, 22 nt, Homo sapiens
aacaaaagcuugaagcugugga

SEQ ID NO: 2203041 - RNA, 13 nt, Homo sapiens
uacuagauugauc

SEQ ID NO: 2203042 - RNA, 23 nt, Homo sapiens
gauggaggggugguccugacuca

SEQ ID NO: 2203043 - RNA, 16 nt, Homo sapiens
caaggcaaggaagggu

SEQ ID NO: 2203044 - RNA, 14 nt, Homo sapiens
cuucugagcacugu

SEQ ID NO: 2203045 - RNA, 12 nt, Homo sapiens
ugacagccagag

SEQ ID NO: 2203046 - RNA, 18 nt, Homo sapiens
gagcaauguggauaugac

SEQ ID NO: 2203047 - RNA, 13 nt, Homo sapiens
acuguaaagacaa

SEQ ID NO: 2203048 - RNA, 20 nt, Homo sapiens
caccagaagugccaugcuca

SEQ ID NO: 2203049 - RNA, 13 nt, Homo sapiens
agaaaauaugcau

SEQ ID NO: 2203050 - RNA, 21 nt, Homo sapiens
aaccuccuuucucuucucugu

SEQ ID NO: 2203051 - RNA, 22 nt, Homo sapiens
gccagguaugacacccacucuc

SEQ ID NO: 2203052 - RNA, 23 nt, Homo sapiens
ccagcugugguuuucuuuugcca

SEQ ID NO: 2203053 - RNA, 17 nt, Homo sapiens
uggcucaugucuauaau

SEQ ID NO: 2203054 - RNA, 17 nt, Homo sapiens
agccuucaauguaccug

SEQ ID NO: 2203055 - RNA, 19 nt, Homo sapiens
ggauauaaaaauaauguca

SEQ ID NO: 2203056 - RNA, 19 nt, Homo sapiens
ccacgaacuugcugggugg

SEQ ID NO: 2203057 - RNA, 14 nt, Homo sapiens
aauuaaccuuucag

SEQ ID NO: 2203058 - RNA, 22 nt, Homo sapiens
acaagacccaaguagcugcuac

SEQ ID NO: 2203059 - RNA, 19 nt, Homo sapiens
aagaaguccauauuguucc

SEQ ID NO: 2203060 - RNA, 17 nt, Homo sapiens
ucauucauuucauugug

SEQ ID NO: 2203061 - RNA, 19 nt, Homo sapiens
caucauccuccauugcucc

SEQ ID NO: 2203062 - RNA, 14 nt, Homo sapiens
ugaauuucucuaca

SEQ ID NO: 2203063 - RNA, 15 nt, Homo sapiens
cucagaggguguccu

SEQ ID NO: 2203064 - RNA, 19 nt, Homo sapiens
caccuggauguacuaucca

SEQ ID NO: 2203065 - RNA, 20 nt, Homo sapiens
agcccucucagaucacccca

SEQ ID NO: 2203066 - RNA, 23 nt, Homo sapiens
aagcacucuggaugauggauucc

SEQ ID NO: 2203067 - RNA, 17 nt, Homo sapiens
aauuaaaugccuuguau

SEQ ID NO: 2203068 - RNA, 20 nt, Homo sapiens
ucuauaaauucaacacuuau

SEQ ID NO: 2203069 - RNA, 13 nt, Homo sapiens
gaggaacccaaga

SEQ ID NO: 2203070 - RNA, 18 nt, Homo sapiens
guagugaauuggcuuccu

SEQ ID NO: 2203071 - RNA, 19 nt, Homo sapiens
uagaauuauaagucacaaa

SEQ ID NO: 2203072 - RNA, 14 nt, Homo sapiens
agugucuguaccuc

SEQ ID NO: 2203073 - RNA, 20 nt, Homo sapiens
acuaucugcauuaucuaugc

SEQ ID NO: 2203074 - RNA, 16 nt, Homo sapiens
cugauggaaacaaagu

SEQ ID NO: 2203075 - RNA, 23 nt, Homo sapiens
acacuuauuuucuaaccaaauac

SEQ ID NO: 2203076 - RNA, 16 nt, Homo sapiens
ucuccgacuuccccug

SEQ ID NO: 2203077 - RNA, 20 nt, Homo sapiens
caguuuuaccucuucucucu

SEQ ID NO: 2203078 - RNA, 23 nt, Homo sapiens
agagguugcagugagcugagauc

SEQ ID NO: 2203079 - RNA, 14 nt, Homo sapiens
uguggaaaguguaa

SEQ ID NO: 2203080 - RNA, 22 nt, Homo sapiens
agccagggggaugccacuccuc

SEQ ID NO: 2203081 - RNA, 13 nt, Homo sapiens
ucaaacuguaaaa

SEQ ID NO: 2203082 - RNA, 22 nt, Homo sapiens
ggaaggucucaggagaagggau

SEQ ID NO: 2203083 - RNA, 13 nt, Homo sapiens
gaagcucacccaa

SEQ ID NO: 2203084 - RNA, 21 nt, Homo sapiens
gaagcaauaaagcucuucccu

SEQ ID NO: 2203085 - RNA, 15 nt, Homo sapiens
uuuguaaugcaaaag

SEQ ID NO: 2203086 - RNA, 15 nt, Homo sapiens
auccacacugcacac

SEQ ID NO: 2203087 - RNA, 21 nt, Homo sapiens
guuucuucaguaaugaguuaa

SEQ ID NO: 2203088 - RNA, 22 nt, Homo sapiens
caacagaugagcgaaaauguau

SEQ ID NO: 2203089 - RNA, 22 nt, Homo sapiens
acccaggcaguaccauucagga

SEQ ID NO: 2203090 - RNA, 19 nt, Homo sapiens
gaacauagggaugaaguaa

SEQ ID NO: 2203091 - RNA, 18 nt, Homo sapiens
caaaggcugagaacacug

SEQ ID NO: 2203092 - RNA, 20 nt, Homo sapiens
ccucagaaaagugacagugg

SEQ ID NO: 2203093 - RNA, 19 nt, Homo sapiens
uugugcucaauacacagaa

SEQ ID NO: 2203094 - RNA, 20 nt, Homo sapiens
uuuucauuagcaaaaaaagu

SEQ ID NO: 2203095 - RNA, 15 nt, Homo sapiens
cucagcugcacauuc

SEQ ID NO: 2203096 - RNA, 17 nt, Homo sapiens
ccaaugccugugaagca

SEQ ID NO: 2203097 - RNA, 18 nt, Homo sapiens
uggucucuacuguggcaa

SEQ ID NO: 2203098 - RNA, 11 nt, Homo sapiens
acaaggccagg

SEQ ID NO: 2203099 - RNA, 16 nt, Homo sapiens
gcuggaccugcugaca

SEQ ID NO: 2203100 - RNA, 15 nt, Homo sapiens
gggucucaguguccu

SEQ ID NO: 2203101 - RNA, 21 nt, Homo sapiens
gucuguauuccugauaugccu

SEQ ID NO: 2203102 - RNA, 21 nt, Homo sapiens
ggccacagaaggugaacuuug

SEQ ID NO: 2203103 - RNA, 20 nt, Homo sapiens
ggagcuucucugcugcuuaa

SEQ ID NO: 2203104 - RNA, 15 nt, Homo sapiens
uggcugaaaaugcaa

SEQ ID NO: 2203105 - RNA, 18 nt, Homo sapiens
aacugccaucauuuacuu

SEQ ID NO: 2203106 - RNA, 19 nt, Homo sapiens
uauuuucccucucuugccu

SEQ ID NO: 2203107 - RNA, 14 nt, Homo sapiens
aggccaaucagaag

SEQ ID NO: 2203108 - RNA, 19 nt, Homo sapiens
uuuacauuuucaguaccaa

SEQ ID NO: 2203109 - RNA, 14 nt, Homo sapiens
aaagcaguugagac

SEQ ID NO: 2203110 - RNA, 21 nt, Homo sapiens
uucuucucaaaaaauaauuag

SEQ ID NO: 2203111 - RNA, 15 nt, Homo sapiens
acucugucuaccugg

SEQ ID NO: 2203112 - RNA, 18 nt, Homo sapiens
auugauuucaagucuucu

SEQ ID NO: 2203113 - RNA, 23 nt, Homo sapiens
auuaucucaaaacugcacuguca

SEQ ID NO: 2203114 - RNA, 14 nt, Homo sapiens
aaugcuauggacug

SEQ ID NO: 2203115 - RNA, 21 nt, Homo sapiens
augcugucuguccaacugccu

SEQ ID NO: 2203116 - RNA, 20 nt, Homo sapiens
aagccucugguggaaccugc

SEQ ID NO: 2203117 - RNA, 14 nt, Homo sapiens
auauauuauucucg

SEQ ID NO: 2203118 - RNA, 22 nt, Homo sapiens
caagugugugcaugugugcgag

SEQ ID NO: 2203119 - RNA, 20 nt, Homo sapiens
acgaccuugguucacuuuuc

SEQ ID NO: 2203120 - RNA, 21 nt, Homo sapiens
caaugagcuuucugaacagcu

SEQ ID NO: 2203121 - RNA, 21 nt, Homo sapiens
gguaucaggacugugaccaaa

SEQ ID NO: 2203122 - RNA, 18 nt, Homo sapiens
gaagucucuaacaaugua

SEQ ID NO: 2203123 - RNA, 17 nt, Homo sapiens
guggaacagagucauau

SEQ ID NO: 2203124 - RNA, 17 nt, Homo sapiens
uauuaauauuugcacau

SEQ ID NO: 2203125 - RNA, 18 nt, Homo sapiens
ggcgcuggacaccuacag

SEQ ID NO: 2203126 - RNA, 16 nt, Homo sapiens
gcauccugugcuucua

SEQ ID NO: 2203127 - RNA, 13 nt, Homo sapiens
cgugccugcuacg

SEQ ID NO: 2203128 - RNA, 16 nt, Homo sapiens
agcccagggcacuuca

SEQ ID NO: 2203129 - RNA, 16 nt, Homo sapiens
acaaauaaguuacauc

SEQ ID NO: 2203130 - RNA, 15 nt, Homo sapiens
caagagccugaguga

SEQ ID NO: 2203131 - RNA, 19 nt, Homo sapiens
ugaaaucccaucugcauuu

SEQ ID NO: 2203132 - RNA, 18 nt, Homo sapiens
uggcaacaucuugcaaaa

SEQ ID NO: 2203133 - RNA, 20 nt, Homo sapiens
cuucccaggacccaggucug

SEQ ID NO: 2203134 - RNA, 22 nt, Homo sapiens
uuuggguucacagaagcacagc

SEQ ID NO: 2203135 - RNA, 14 nt, Homo sapiens
auggguuaaaucaa

SEQ ID NO: 2203136 - RNA, 15 nt, Homo sapiens
augguuccccaggag

SEQ ID NO: 2203137 - RNA, 19 nt, Homo sapiens
cuagaaccaagaagggcua

SEQ ID NO: 2203138 - RNA, 19 nt, Homo sapiens
gaacuaugaacacugucau

SEQ ID NO: 2203139 - RNA, 23 nt, Homo sapiens
agacucuuuuuuugagugacagc

SEQ ID NO: 2203140 - RNA, 13 nt, Homo sapiens
uggcaagucucac

SEQ ID NO: 2203141 - RNA, 23 nt, Homo sapiens
ggccagccccacccccagccagg

SEQ ID NO: 2203142 - RNA, 21 nt, Homo sapiens
ucuuuauauaaggucauagau

SEQ ID NO: 2203143 - RNA, 23 nt, Homo sapiens
gauucuucucuuaauuucauaga

SEQ ID NO: 2203144 - RNA, 12 nt, Homo sapiens
caaggcugaggu

SEQ ID NO: 2203145 - RNA, 20 nt, Homo sapiens
gucaucacuccucugucaua

SEQ ID NO: 2203146 - RNA, 18 nt, Homo sapiens
ugcuuuaauucagcuuua

SEQ ID NO: 2203147 - RNA, 20 nt, Homo sapiens
aauuaauaucacagcauaac

SEQ ID NO: 2203148 - RNA, 22 nt, Homo sapiens
auggcuggaagggguccagccu

SEQ ID NO: 2203149 - RNA, 21 nt, Homo sapiens
uaagaauucuguacuuccaau

SEQ ID NO: 2203150 - RNA, 16 nt, Homo sapiens
uuuggaugauugucau

SEQ ID NO: 2203151 - RNA, 10 nt, Homo sapiens
ugaugcaaau

SEQ ID NO: 2203152 - RNA, 16 nt, Homo sapiens
uaaaaaaauuacugug

SEQ ID NO: 2203153 - RNA, 17 nt, Homo sapiens
cuauuuuugugugcugu

SEQ ID NO: 2203154 - RNA, 23 nt, Homo sapiens
ugagcgugaaucuguaucuugcc

SEQ ID NO: 2203155 - RNA, 18 nt, Homo sapiens
cugggauuacaagcguga

SEQ ID NO: 2203156 - RNA, 20 nt, Homo sapiens
aguaagaauuauuuacugaa

SEQ ID NO: 2203157 - RNA, 17 nt, Homo sapiens
uguagauaaagcacugu

SEQ ID NO: 2203158 - RNA, 20 nt, Homo sapiens
ggugggcacccacccuggga

SEQ ID NO: 2203159 - RNA, 22 nt, Homo sapiens
acaacccagaauggucauuuca

SEQ ID NO: 2203160 - RNA, 18 nt, Homo sapiens
ucuaugacgcaaagauca

SEQ ID NO: 2203161 - RNA, 22 nt, Homo sapiens
aacagaagauuacaaaagcaau

SEQ ID NO: 2203162 - RNA, 15 nt, Homo sapiens
uucuccaaacgauua

SEQ ID NO: 2203163 - RNA, 17 nt, Homo sapiens
gaugcuguuaaccaaag

SEQ ID NO: 2203164 - RNA, 20 nt, Homo sapiens
ccccggccacucccugccaa

SEQ ID NO: 2203165 - RNA, 14 nt, Homo sapiens
gcaaaucacuucaa

SEQ ID NO: 2203166 - RNA, 12 nt, Homo sapiens
ugcaaagacuga

SEQ ID NO: 2203167 - RNA, 23 nt, Homo sapiens
uccuugagaagugggagcacccu

SEQ ID NO: 2203168 - RNA, 12 nt, Homo sapiens
gccugguuuguu

SEQ ID NO: 2203169 - RNA, 21 nt, Homo sapiens
ucagcggucauucuacacuga

SEQ ID NO: 2203170 - RNA, 20 nt, Homo sapiens
cagaugcaccccaacauuga

SEQ ID NO: 2203171 - RNA, 17 nt, Homo sapiens
cagaaagcuuuauaugu

SEQ ID NO: 2203172 - RNA, 15 nt, Homo sapiens
uaacuggcauaggaa

SEQ ID NO: 2203173 - RNA, 23 nt, Homo sapiens
ccagccuucuccaggacaaccug

SEQ ID NO: 2203174 - RNA, 22 nt, Homo sapiens
uacaauuauuuuuacaguucuc

SEQ ID NO: 2203175 - RNA, 13 nt, Homo sapiens
aagacaauucuuu

SEQ ID NO: 2203176 - RNA, 20 nt, Homo sapiens
caggcuccaccucgaauacu

SEQ ID NO: 2203177 - RNA, 13 nt, Homo sapiens
auaagaagcaaau

SEQ ID NO: 2203178 - RNA, 13 nt, Homo sapiens
aauuuauuacaaa

SEQ ID NO: 2203179 - RNA, 18 nt, Homo sapiens
ccugucuuucagcauuca

SEQ ID NO: 2203180 - RNA, 23 nt, Homo sapiens
cuucagagacuaucugauuuccu

SEQ ID NO: 2203181 - RNA, 16 nt, Homo sapiens
cauuccauucuggaag

SEQ ID NO: 2203182 - RNA, 12 nt, Homo sapiens
ugccgcucucuc

SEQ ID NO: 2203183 - RNA, 12 nt, Homo sapiens
ugcagcucucua

SEQ ID NO: 2203184 - RNA, 13 nt, Homo sapiens
acaauaucugcag

SEQ ID NO: 2203185 - RNA, 15 nt, Homo sapiens
gcuguggcccuggag

SEQ ID NO: 2203186 - RNA, 17 nt, Homo sapiens
gaaaaaaaaauguucau

SEQ ID NO: 2203187 - RNA, 17 nt, Homo sapiens
ucagaacagacaaucac

SEQ ID NO: 2203188 - RNA, 19 nt, Homo sapiens
gagggggucugggccagug

SEQ ID NO: 2203189 - RNA, 21 nt, Homo sapiens
uuaagguuuuacuuuucugaa

SEQ ID NO: 2203190 - RNA, 22 nt, Homo sapiens
caucucccacccuguaccucau

SEQ ID NO: 2203191 - RNA, 17 nt, Homo sapiens
aaccuaaaaaucaauca

SEQ ID NO: 2203192 - RNA, 17 nt, Homo sapiens
ggguccugccgguggga

SEQ ID NO: 2203193 - RNA, 14 nt, Homo sapiens
agauucacacuguc

SEQ ID NO: 2203194 - RNA, 15 nt, Homo sapiens
uccggcagccuggau

SEQ ID NO: 2203195 - RNA, 17 nt, Homo sapiens
gccauucccacuaagcu

SEQ ID NO: 2203196 - RNA, 14 nt, Homo sapiens
uacugacugagaua

SEQ ID NO: 2203197 - RNA, 17 nt, Homo sapiens
uauauuuugaugagcuu

SEQ ID NO: 2203198 - RNA, 22 nt, Homo sapiens
ccggaagcucacagugacauua

SEQ ID NO: 2203199 - RNA, 19 nt, Homo sapiens
aaauuuggggacagauuca

SEQ ID NO: 2203200 - RNA, 17 nt, Homo sapiens
cugaucccccagaugca

SEQ ID NO: 2203201 - RNA, 17 nt, Homo sapiens
gcuuuacaacuugaaug

SEQ ID NO: 2203202 - RNA, 20 nt, Homo sapiens
ucagaacucguuaaagcaaa

SEQ ID NO: 2203203 - RNA, 13 nt, Homo sapiens
uuuuguuaccuuu

SEQ ID NO: 2203204 - RNA, 17 nt, Homo sapiens
ccagaugcugauguuca

SEQ ID NO: 2203205 - RNA, 19 nt, Homo sapiens
uggagaagacuucuuugca

SEQ ID NO: 2203206 - RNA, 23 nt, Homo sapiens
aauccucuaggaggcuccuccuc

SEQ ID NO: 2203207 - RNA, 22 nt, Homo sapiens
acuaauaguauccagcacagau

SEQ ID NO: 2203208 - RNA, 14 nt, Homo sapiens
ccugcuacccagua

SEQ ID NO: 2203209 - RNA, 14 nt, Homo sapiens
uuuuuaacuuaucu

SEQ ID NO: 2203210 - RNA, 19 nt, Homo sapiens
aaagcaccugaacaguuua

SEQ ID NO: 2203211 - RNA, 21 nt, Homo sapiens
cccucguugcccagcacuguc

SEQ ID NO: 2203212 - RNA, 17 nt, Homo sapiens
cacagcucagcugccca

SEQ ID NO: 2203213 - RNA, 21 nt, Homo sapiens
auaaauauuucucaacugagg

SEQ ID NO: 2203214 - RNA, 15 nt, Homo sapiens
aaagaagauuuugcc

SEQ ID NO: 2203215 - RNA, 21 nt, Homo sapiens
cugaucuuugaaaacacuaca

SEQ ID NO: 2203216 - RNA, 13 nt, Homo sapiens
aaaagcauguaca

SEQ ID NO: 2203217 - RNA, 13 nt, Homo sapiens
auauuucagcaaa

SEQ ID NO: 2203218 - RNA, 12 nt, Homo sapiens
gggaagucucag

SEQ ID NO: 2203219 - RNA, 14 nt, Homo sapiens
gggcugcuccccaa

SEQ ID NO: 2203220 - RNA, 15 nt, Homo sapiens
acacacagaugucuu

SEQ ID NO: 2203221 - RNA, 15 nt, Homo sapiens
gaucaguauuucacu

SEQ ID NO: 2203222 - RNA, 15 nt, Homo sapiens
uucuagaagacuaca

SEQ ID NO: 2203223 - RNA, 21 nt, Homo sapiens
ucuacacagauggaaucucuu

SEQ ID NO: 2203224 - RNA, 13 nt, Homo sapiens
ucaugaacuggcu

SEQ ID NO: 2203225 - RNA, 21 nt, Homo sapiens
ggccagccuuucccccuguga

SEQ ID NO: 2203226 - RNA, 14 nt, Homo sapiens
ucuguguucaggau

SEQ ID NO: 2203227 - RNA, 14 nt, Homo sapiens
ugcacauaaacucc

SEQ ID NO: 2203228 - RNA, 21 nt, Homo sapiens
aacaccuuuguuuugcacuga

SEQ ID NO: 2203229 - RNA, 16 nt, Homo sapiens
cagagaggacuguuga

SEQ ID NO: 2203230 - RNA, 22 nt, Homo sapiens
caaccaggaagaguucuauccc

SEQ ID NO: 2203231 - RNA, 15 nt, Homo sapiens
uucagcuccuuccac

SEQ ID NO: 2203232 - RNA, 18 nt, Homo sapiens
uaaauauacaucugugua

SEQ ID NO: 2203233 - RNA, 15 nt, Homo sapiens
cugggugcugucaug

SEQ ID NO: 2203234 - RNA, 11 nt, Homo sapiens
cuaaguacugu

SEQ ID NO: 2203235 - RNA, 23 nt, Homo sapiens
ggauggaaauaacggguggcauu

SEQ ID NO: 2203236 - RNA, 20 nt, Homo sapiens
gagaggaggaggaugacuaa

SEQ ID NO: 2203237 - RNA, 13 nt, Homo sapiens
agaugccaaugac

SEQ ID NO: 2203238 - RNA, 18 nt, Homo sapiens
ccuaguuucccccuauga

SEQ ID NO: 2203239 - RNA, 20 nt, Homo sapiens
uuagcaaaagcguccagaaa

SEQ ID NO: 2203240 - RNA, 22 nt, Homo sapiens
ucagugcucacccguaggcaaa

SEQ ID NO: 2203241 - RNA, 14 nt, Homo sapiens
aaagaaauagccaa

SEQ ID NO: 2203242 - RNA, 17 nt, Homo sapiens
ugacaaugacuaagcca

SEQ ID NO: 2203243 - RNA, 15 nt, Homo sapiens
uacaacagugagaaa

SEQ ID NO: 2203244 - RNA, 21 nt, Homo sapiens
ccauguccaaagaggcugccc

SEQ ID NO: 2203245 - RNA, 13 nt, Homo sapiens
accacgugcagua

SEQ ID NO: 2203246 - RNA, 16 nt, Homo sapiens
ugggcaggaagugaag

SEQ ID NO: 2203247 - RNA, 18 nt, Homo sapiens
uaacaggauacaggugac

SEQ ID NO: 2203248 - RNA, 20 nt, Homo sapiens
auacccuggagcaagaccug

SEQ ID NO: 2203249 - RNA, 14 nt, Homo sapiens
aacaagaguuuuaa

SEQ ID NO: 2203250 - RNA, 15 nt, Homo sapiens
cauaagcugauuuga

SEQ ID NO: 2203251 - RNA, 13 nt, Homo sapiens
uuaauccaaagaa

SEQ ID NO: 2203252 - RNA, 18 nt, Homo sapiens
augagccaccaugcccag

SEQ ID NO: 2203253 - RNA, 19 nt, Homo sapiens
ccucuggcaaguagcuuuc

SEQ ID NO: 2203254 - RNA, 16 nt, Homo sapiens
uaaacuuguaaagaca

SEQ ID NO: 2203255 - RNA, 20 nt, Homo sapiens
acaucaguuguuuguuugau

SEQ ID NO: 2203256 - RNA, 20 nt, Homo sapiens
agauagaauucaauuugaac

SEQ ID NO: 2203257 - RNA, 14 nt, Homo sapiens
aaucgaacuaugaa

SEQ ID NO: 2203258 - RNA, 15 nt, Homo sapiens
ccaucucgggcacag

SEQ ID NO: 2203259 - RNA, 18 nt, Homo sapiens
gacaggcuccucugggga

SEQ ID NO: 2203260 - RNA, 20 nt, Homo sapiens
ccuggaacaccugaugguga

SEQ ID NO: 2203261 - RNA, 14 nt, Homo sapiens
uuauucuacuauac

SEQ ID NO: 2203262 - RNA, 16 nt, Homo sapiens
gaggugagaccaccuc

SEQ ID NO: 2203263 - RNA, 20 nt, Homo sapiens
gugcuggccucaaacagcca

SEQ ID NO: 2203264 - RNA, 15 nt, Homo sapiens
aaaggaacuaugaaa

SEQ ID NO: 2203265 - RNA, 18 nt, Homo sapiens
ucccuucuggacacugag

SEQ ID NO: 2203266 - RNA, 22 nt, Homo sapiens
accuauucugaaaaagacauaa

SEQ ID NO: 2203267 - RNA, 19 nt, Homo sapiens
agcaugacgggaaaaccaa

SEQ ID NO: 2203268 - RNA, 20 nt, Homo sapiens
aucuaauguugaguuauuaa

SEQ ID NO: 2203269 - RNA, 15 nt, Homo sapiens
ucaaagcacacguca

SEQ ID NO: 2203270 - RNA, 16 nt, Homo sapiens
gaguaauaguaaacac

SEQ ID NO: 2203271 - RNA, 17 nt, Homo sapiens
guuccaugaagacaaau

SEQ ID NO: 2203272 - RNA, 21 nt, Homo sapiens
aaauaaccacaagguccacuc

SEQ ID NO: 2203273 - RNA, 16 nt, Homo sapiens
gcuguuucaccuuucu

SEQ ID NO: 2203274 - RNA, 21 nt, Homo sapiens
cucaguuggaaucauugcuaa

SEQ ID NO: 2203275 - RNA, 17 nt, Homo sapiens
agugccucuuucaucca

SEQ ID NO: 2203276 - RNA, 22 nt, Homo sapiens
gcacaagcugcggaagcugaac

SEQ ID NO: 2203277 - RNA, 22 nt, Homo sapiens
ccuuaggagacgcugcacuuga

SEQ ID NO: 2203278 - RNA, 21 nt, Homo sapiens
aaucuacucuuaaauauacaa

SEQ ID NO: 2203279 - RNA, 16 nt, Homo sapiens
uauuuuugaaaaggga

SEQ ID NO: 2203280 - RNA, 19 nt, Homo sapiens
caggcuggagugcaauggu

SEQ ID NO: 2203281 - RNA, 19 nt, Homo sapiens
cuauaacuaugaccaugcu

SEQ ID NO: 2203282 - RNA, 14 nt, Homo sapiens
agauuacacuccag

SEQ ID NO: 2203283 - RNA, 22 nt, Homo sapiens
ucuuaagcuaagacugauguca

SEQ ID NO: 2203284 - RNA, 14 nt, Homo sapiens
acauugcauguauu

SEQ ID NO: 2203285 - RNA, 21 nt, Homo sapiens
agcccuaaauguacucuugaa

SEQ ID NO: 2203286 - RNA, 21 nt, Homo sapiens
augaauaaauauuacaaauuc

SEQ ID NO: 2203287 - RNA, 19 nt, Homo sapiens
ugcaaauucauuucauggu

SEQ ID NO: 2203288 - RNA, 21 nt, Homo sapiens
auacauuuguugguaacuaau

SEQ ID NO: 2203289 - RNA, 15 nt, Homo sapiens
cucugcaggccacuu

SEQ ID NO: 2203290 - RNA, 19 nt, Homo sapiens
cgcuggaauccagaaggaa

SEQ ID NO: 2203291 - RNA, 19 nt, Homo sapiens
aaguugaggggagcaugcu

SEQ ID NO: 2203292 - RNA, 15 nt, Homo sapiens
uuauauuacucucau

SEQ ID NO: 2203293 - RNA, 21 nt, Homo sapiens
uguguccguggaaccaguccu

SEQ ID NO: 2203294 - RNA, 13 nt, Homo sapiens
cacuguuagcaca

SEQ ID NO: 2203295 - RNA, 21 nt, Homo sapiens
uaacaacugcccaguuuccag

SEQ ID NO: 2203296 - RNA, 18 nt, Homo sapiens
cucuuuaaaaugcaaaau

SEQ ID NO: 2203297 - RNA, 23 nt, Homo sapiens
ggugacagugacgugacucagag

SEQ ID NO: 2203298 - RNA, 15 nt, Homo sapiens
uacuauuaacucugc

SEQ ID NO: 2203299 - RNA, 19 nt, Homo sapiens
cuaggccauuagcccuuca

SEQ ID NO: 2203300 - RNA, 21 nt, Homo sapiens
ccacuugggacuagaucacaa

SEQ ID NO: 2203301 - RNA, 16 nt, Homo sapiens
cacagcccaggccaca

SEQ ID NO: 2203302 - RNA, 16 nt, Homo sapiens
guaauuuuaugagcug

SEQ ID NO: 2203303 - RNA, 15 nt, Homo sapiens
agcaucuaaggacaa

SEQ ID NO: 2203304 - RNA, 22 nt, Homo sapiens
ugaagaucuaaacuuuugagaa

SEQ ID NO: 2203305 - RNA, 16 nt, Homo sapiens
ccucaccucucaccuc

SEQ ID NO: 2203306 - RNA, 15 nt, Homo sapiens
uagcauaaugaaaau

SEQ ID NO: 2203307 - RNA, 16 nt, Homo sapiens
guuuuuucugcaauga

SEQ ID NO: 2203308 - RNA, 18 nt, Homo sapiens
aacagugagccaaauaaa

SEQ ID NO: 2203309 - RNA, 11 nt, Homo sapiens
uggaugcacac

SEQ ID NO: 2203310 - RNA, 11 nt, Homo sapiens
ugcaugcacag

SEQ ID NO: 2203311 - RNA, 14 nt, Homo sapiens
ggcaaacaggcagu

SEQ ID NO: 2203312 - RNA, 18 nt, Homo sapiens
caagcagaucucaucuca

SEQ ID NO: 2203313 - RNA, 15 nt, Homo sapiens
uggaggaaaccacaa

SEQ ID NO: 2203314 - RNA, 16 nt, Homo sapiens
gccagucuugccuagg

SEQ ID NO: 2203315 - RNA, 20 nt, Homo sapiens
ugauuauauaaaauacauaa

SEQ ID NO: 2203316 - RNA, 13 nt, Homo sapiens
guaauugcauguu

SEQ ID NO: 2203317 - RNA, 15 nt, Homo sapiens
aguuuuuauucugaa

SEQ ID NO: 2203318 - RNA, 21 nt, Homo sapiens
gugcuguggagagaagcugau

SEQ ID NO: 2203319 - RNA, 20 nt, Homo sapiens
gguagaggcugggggcucca

SEQ ID NO: 2203320 - RNA, 15 nt, Homo sapiens
ugccuuagcauguga

SEQ ID NO: 2203321 - RNA, 16 nt, Homo sapiens
cagaguguagaccgag

SEQ ID NO: 2203322 - RNA, 21 nt, Homo sapiens
ucuagccugaauucuuuucaa

SEQ ID NO: 2203323 - RNA, 20 nt, Homo sapiens
cacuauccuuccucucugug

SEQ ID NO: 2203324 - RNA, 15 nt, Homo sapiens
ucagcacagccucac

SEQ ID NO: 2203325 - RNA, 15 nt, Homo sapiens
cuuaacucauugcaa

SEQ ID NO: 2203326 - RNA, 14 nt, Homo sapiens
aaggucaguuugau

SEQ ID NO: 2203327 - RNA, 17 nt, Homo sapiens
aacaagacuggcucuuu

SEQ ID NO: 2203328 - RNA, 14 nt, Homo sapiens
aagcuggugcuacu

SEQ ID NO: 2203329 - RNA, 13 nt, Homo sapiens
ugcccacucccua

SEQ ID NO: 2203330 - RNA, 17 nt, Homo sapiens
uaaaacaugcuggugaa

SEQ ID NO: 2203331 - RNA, 15 nt, Homo sapiens
cauuuauauauugaa

SEQ ID NO: 2203332 - RNA, 13 nt, Homo sapiens
guaaugaugcuga

SEQ ID NO: 2203333 - RNA, 12 nt, Homo sapiens
cuuaaguguaaa

SEQ ID NO: 2203334 - RNA, 13 nt, Homo sapiens
aucaagaagggcu

SEQ ID NO: 2203335 - RNA, 24 nt, Homo sapiens
guuccauaugugggugucagucag

SEQ ID NO: 2203336 - RNA, 23 nt, Homo sapiens
ugaaucaguccuagaauguuuca

SEQ ID NO: 2203337 - RNA, 13 nt, Homo sapiens
cauuccugaauaa

SEQ ID NO: 2203338 - RNA, 15 nt, Homo sapiens
ccuuccuacuuugcu

SEQ ID NO: 2203339 - RNA, 16 nt, Homo sapiens
gcugcaccccaugugg

SEQ ID NO: 2203340 - RNA, 22 nt, Homo sapiens
cuuuccugggggaugugcacgg

SEQ ID NO: 2203341 - RNA, 24 nt, Homo sapiens
uuucuuguuucaucguaaacauac

SEQ ID NO: 2203342 - RNA, 12 nt, Homo sapiens
cuacugccccag

SEQ ID NO: 2203343 - RNA, 16 nt, Homo sapiens
guuaguuuacaauauu

SEQ ID NO: 2203344 - RNA, 18 nt, Homo sapiens
gagcugcacaaagucagc

SEQ ID NO: 2203345 - RNA, 23 nt, Homo sapiens
gucugcccccgucuucucuccau

SEQ ID NO: 2203346 - RNA, 13 nt, Homo sapiens
cucuguagcugcu

SEQ ID NO: 2203347 - RNA, 18 nt, Homo sapiens
cucccuccagacaaugcc

SEQ ID NO: 2203348 - RNA, 14 nt, Homo sapiens
ccaguugccuuuua

SEQ ID NO: 2203349 - RNA, 14 nt, Homo sapiens
ccuaucuuugccac

SEQ ID NO: 2203350 - RNA, 14 nt, Homo sapiens
uauaacagaauuaa

SEQ ID NO: 2203351 - RNA, 22 nt, Homo sapiens
uccaucagagaugggaaaacca

SEQ ID NO: 2203352 - RNA, 22 nt, Homo sapiens
uaaauuacuguuuugccaagaa

SEQ ID NO: 2203353 - RNA, 23 nt, Homo sapiens
agcuguuuuggaugaaugcagua

SEQ ID NO: 2203354 - RNA, 18 nt, Homo sapiens
acaaaggacagaguauga

SEQ ID NO: 2203355 - RNA, 12 nt, Homo sapiens
uggcugauuuca

SEQ ID NO: 2203356 - RNA, 16 nt, Homo sapiens
uaaagcaaaauaguau

SEQ ID NO: 2203357 - RNA, 14 nt, Homo sapiens
gauagcugacucau

SEQ ID NO: 2203358 - RNA, 22 nt, Homo sapiens
cuuguggcuccacacacacaaa

SEQ ID NO: 2203359 - RNA, 14 nt, Homo sapiens
acaggcugagcuuu

SEQ ID NO: 2203360 - RNA, 15 nt, Homo sapiens
aggaauccacaucau

SEQ ID NO: 2203361 - RNA, 15 nt, Homo sapiens
gcuaccucaaccaau

SEQ ID NO: 2203362 - RNA, 15 nt, Homo sapiens
gugacuguugagggc

SEQ ID NO: 2203363 - RNA, 18 nt, Homo sapiens
cacuguggguagacacac

SEQ ID NO: 2203364 - RNA, 16 nt, Homo sapiens
uguacauaaacuguca

SEQ ID NO: 2203365 - RNA, 17 nt, Homo sapiens
aagcuugaagcugugga

SEQ ID NO: 2203366 - RNA, 15 nt, Homo sapiens
aaggguaucugguga

SEQ ID NO: 2203367 - RNA, 14 nt, Homo sapiens
cuuuuccuugcuga

SEQ ID NO: 2203368 - RNA, 20 nt, Homo sapiens
gauaauaugaaaaucuccau

SEQ ID NO: 2203369 - RNA, 20 nt, Homo sapiens
aagacaauuuuaauguuuac

SEQ ID NO: 2203370 - RNA, 12 nt, Homo sapiens
auuuuguuacaa

SEQ ID NO: 2203371 - RNA, 15 nt, Homo sapiens
auguccccauggcug

SEQ ID NO: 2203372 - RNA, 17 nt, Homo sapiens
uucuggaccaaggugaa

SEQ ID NO: 2203373 - RNA, 16 nt, Homo sapiens
caaugugacaccuaac

SEQ ID NO: 2203374 - RNA, 20 nt, Homo sapiens
auaugcccucaucaucccag

SEQ ID NO: 2203375 - RNA, 13 nt, Homo sapiens
aggacgcaugcag

SEQ ID NO: 2203376 - RNA, 13 nt, Homo sapiens
agaugacuacuug

SEQ ID NO: 2203377 - RNA, 19 nt, Homo sapiens
agagaaugagaagacaugg

SEQ ID NO: 2203378 - RNA, 17 nt, Homo sapiens
acaucuaguuaaucaua

SEQ ID NO: 2203379 - RNA, 14 nt, Homo sapiens
ugcuaugugccuua

SEQ ID NO: 2203380 - RNA, 18 nt, Homo sapiens
aaaauaguuuuacauuaa

SEQ ID NO: 2203381 - RNA, 16 nt, Homo sapiens
ccuuguaaagacugua

SEQ ID NO: 2203382 - RNA, 23 nt, Homo sapiens
uccccauuugggacaucaagccu

SEQ ID NO: 2203383 - RNA, 23 nt, Homo sapiens
uuacuguacauacaaauucuacu

SEQ ID NO: 2203384 - RNA, 12 nt, Homo sapiens
aaguucauaucu

SEQ ID NO: 2203385 - RNA, 22 nt, Homo sapiens
cuaugugauucuggaagcaaau

SEQ ID NO: 2203386 - RNA, 20 nt, Homo sapiens
gccaggugccuccugacaca

SEQ ID NO: 2203387 - RNA, 19 nt, Homo sapiens
cucauaugauguacaugua

SEQ ID NO: 2203388 - RNA, 22 nt, Homo sapiens
cauguaaccaagaguauuccau

SEQ ID NO: 2203389 - RNA, 21 nt, Homo sapiens
agugccugcugggugccaggu

SEQ ID NO: 2203390 - RNA, 11 nt, Homo sapiens
ugggcacaaac

SEQ ID NO: 2203391 - RNA, 19 nt, Homo sapiens
cgcccccuccgcccugcca

SEQ ID NO: 2203392 - RNA, 20 nt, Homo sapiens
aguguuuccuaggaggaaaa

SEQ ID NO: 2203393 - RNA, 19 nt, Homo sapiens
cagccuugaccucugggag

SEQ ID NO: 2203394 - RNA, 16 nt, Homo sapiens
gaaccaauucacuuua

SEQ ID NO: 2203395 - RNA, 14 nt, Homo sapiens
aggugaugccauua

SEQ ID NO: 2203396 - RNA, 23 nt, Homo sapiens
ccaauacauuauuggacuuccau

SEQ ID NO: 2203397 - RNA, 18 nt, Homo sapiens
agacuggaauaguggcau

SEQ ID NO: 2203398 - RNA, 18 nt, Homo sapiens
guccuauccaaaggaauc

SEQ ID NO: 2203399 - RNA, 15 nt, Homo sapiens
ugguaauaacaaacg

SEQ ID NO: 2203400 - RNA, 15 nt, Homo sapiens
cuccugcugcuccug

SEQ ID NO: 2203401 - RNA, 18 nt, Homo sapiens
cagcugcuggcugugaca

SEQ ID NO: 2203402 - RNA, 13 nt, Homo sapiens
agucggucaccaa

SEQ ID NO: 2203403 - RNA, 13 nt, Homo sapiens
aagaaaugcugcc

SEQ ID NO: 2203404 - RNA, 15 nt, Homo sapiens
agccacuugugagua

SEQ ID NO: 2203405 - RNA, 16 nt, Homo sapiens
aauucuagucucugau

SEQ ID NO: 2203406 - RNA, 14 nt, Homo sapiens
accccugcacaguu

SEQ ID NO: 2203407 - RNA, 17 nt, Homo sapiens
aggggaggagagagggu

SEQ ID NO: 2203408 - RNA, 21 nt, Homo sapiens
gguucuacugacccaacuggg

SEQ ID NO: 2203409 - RNA, 20 nt, Homo sapiens
ugagguagauuucauugaag

SEQ ID NO: 2203410 - RNA, 23 nt, Homo sapiens
uucaggccauucuccugccucag

SEQ ID NO: 2203411 - RNA, 16 nt, Homo sapiens
ccaaggguaugggaag

SEQ ID NO: 2203412 - RNA, 12 nt, Homo sapiens
cugccauggaag

SEQ ID NO: 2203413 - RNA, 16 nt, Homo sapiens
cuauaaggcugagggc

SEQ ID NO: 2203414 - RNA, 18 nt, Homo sapiens
uacaucgaggcucuugcu

SEQ ID NO: 2203415 - RNA, 13 nt, Homo sapiens
accaguccaugag

SEQ ID NO: 2203416 - RNA, 13 nt, Homo sapiens
uuguuuccuccuu

SEQ ID NO: 2203417 - RNA, 14 nt, Homo sapiens
cacuguuugucuca

SEQ ID NO: 2203418 - RNA, 14 nt, Homo sapiens
gcacaggugacaag

SEQ ID NO: 2203419 - RNA, 18 nt, Homo sapiens
augcugugcaaacagugu

SEQ ID NO: 2203420 - RNA, 20 nt, Homo sapiens
gugggauggggacauuugaa

SEQ ID NO: 2203421 - RNA, 23 nt, Homo sapiens
gcucuguguuucuggggacacca

SEQ ID NO: 2203422 - RNA, 23 nt, Homo sapiens
ugccucauuaucuugcagcugua

SEQ ID NO: 2203423 - RNA, 13 nt, Homo sapiens
aauugcuacauag

SEQ ID NO: 2203424 - RNA, 13 nt, Homo sapiens
accagcuacccug

SEQ ID NO: 2203425 - RNA, 15 nt, Homo sapiens
gcuagucacauauca

SEQ ID NO: 2203426 - RNA, 17 nt, Homo sapiens
uaccucaucccaugaga

SEQ ID NO: 2203427 - RNA, 16 nt, Homo sapiens
gucguugacuuuaggg

SEQ ID NO: 2203428 - RNA, 17 nt, Homo sapiens
acuggggacuuggccuc

SEQ ID NO: 2203429 - RNA, 15 nt, Homo sapiens
gcuggaggcacccau

SEQ ID NO: 2203430 - RNA, 17 nt, Homo sapiens
auauacuuuugugaaca

SEQ ID NO: 2203431 - RNA, 20 nt, Homo sapiens
caccucacugucaucugcca

SEQ ID NO: 2203432 - RNA, 16 nt, Homo sapiens
agggcaccaccaagaa

SEQ ID NO: 2203433 - RNA, 19 nt, Homo sapiens
acuuugggcuuaguauuuc

SEQ ID NO: 2203434 - RNA, 20 nt, Homo sapiens
uuccccuaacccuacaugca

SEQ ID NO: 2203435 - RNA, 19 nt, Homo sapiens
accucuucucuuccuguaa

SEQ ID NO: 2203436 - RNA, 18 nt, Homo sapiens
cacccagguuggagugca

SEQ ID NO: 2203437 - RNA, 23 nt, Homo sapiens
ugccucugaggccagccuggccu

SEQ ID NO: 2203438 - RNA, 19 nt, Homo sapiens
aacuguacccuauguucac

SEQ ID NO: 2203439 - RNA, 17 nt, Homo sapiens
acuuguagggaugccuu

SEQ ID NO: 2203440 - RNA, 22 nt, Homo sapiens
cacccuggcaggcuuccauccc

SEQ ID NO: 2203441 - RNA, 15 nt, Homo sapiens
ucuagcaccaggacu

SEQ ID NO: 2203442 - RNA, 14 nt, Homo sapiens
gcuaggaagcaaga

SEQ ID NO: 2203443 - RNA, 17 nt, Homo sapiens
uuacgcccaucucagga

SEQ ID NO: 2203444 - RNA, 16 nt, Homo sapiens
aucgggagcagugucu

SEQ ID NO: 2203445 - RNA, 10 nt, Homo sapiens
gcaccaaaga

SEQ ID NO: 2203446 - RNA, 13 nt, Homo sapiens
ggaucuaacuguu

SEQ ID NO: 2203447 - RNA, 15 nt, Homo sapiens
ggccccggcucccac

SEQ ID NO: 2203448 - RNA, 20 nt, Homo sapiens
gcacccuggagagugcacau

SEQ ID NO: 2203449 - RNA, 11 nt, Homo sapiens
ugccuguucuc

SEQ ID NO: 2203450 - RNA, 16 nt, Homo sapiens
gccugcuccaucucau

SEQ ID NO: 2203451 - RNA, 16 nt, Homo sapiens
aguugcacauuaggaa

SEQ ID NO: 2203452 - RNA, 19 nt, Homo sapiens
uuuucucuaugaaaagcaa

SEQ ID NO: 2203453 - RNA, 16 nt, Homo sapiens
gggggccuucacagug

SEQ ID NO: 2203454 - RNA, 23 nt, Homo sapiens
aauaagacuuagauugugcuccu

SEQ ID NO: 2203455 - RNA, 23 nt, Homo sapiens
ugguguacagaccaccuuucaca

SEQ ID NO: 2203456 - RNA, 20 nt, Homo sapiens
cucaugcaagacuucacugc

SEQ ID NO: 2203457 - RNA, 18 nt, Homo sapiens
gucuuucacucacaacac

SEQ ID NO: 2203458 - RNA, 17 nt, Homo sapiens
cagccacggggacucag

SEQ ID NO: 2203459 - RNA, 21 nt, Homo sapiens
gcuaaucugccugguuuuauu

SEQ ID NO: 2203460 - RNA, 21 nt, Homo sapiens
cacucauuaccgucugugauu

SEQ ID NO: 2203461 - RNA, 14 nt, Homo sapiens
cacaacccaagaau

SEQ ID NO: 2203462 - RNA, 15 nt, Homo sapiens
uacaaaauccagcua

SEQ ID NO: 2203463 - RNA, 23 nt, Homo sapiens
caccuugcggggauaaagagaga

SEQ ID NO: 2203464 - RNA, 23 nt, Homo sapiens
auugcccccagggcacuucacag

SEQ ID NO: 2203465 - RNA, 14 nt, Homo sapiens
gaucuugguucacu

SEQ ID NO: 2203466 - RNA, 12 nt, Homo sapiens
cucaaaccacuu

SEQ ID NO: 2203467 - RNA, 20 nt, Homo sapiens
ggcccgccacccuugcccac

SEQ ID NO: 2203468 - RNA, 13 nt, Homo sapiens
cuaaaauucuguc

SEQ ID NO: 2203469 - RNA, 11 nt, Homo sapiens
uugacugcugc

SEQ ID NO: 2203470 - RNA, 21 nt, Homo sapiens
uggcagugggagcugccuguu

SEQ ID NO: 2203471 - RNA, 18 nt, Homo sapiens
cucuuugacaauuccuag

SEQ ID NO: 2203472 - RNA, 22 nt, Homo sapiens
gccagauuuuuuaaaauuuaua

SEQ ID NO: 2203473 - RNA, 12 nt, Homo sapiens
cuuacucugaaa

SEQ ID NO: 2203474 - RNA, 21 nt, Homo sapiens
gaauucuaaauaaauuuccca

SEQ ID NO: 2203475 - RNA, 20 nt, Homo sapiens
aacacccgacuccucaaaag

SEQ ID NO: 2203476 - RNA, 21 nt, Homo sapiens
ccagccugggcaacauaguga

SEQ ID NO: 2203477 - RNA, 20 nt, Homo sapiens
gagaaucgaccucacuguca

SEQ ID NO: 2203478 - RNA, 16 nt, Homo sapiens
aguugccaacuauucu

SEQ ID NO: 2203479 - RNA, 15 nt, Homo sapiens
uuacauuuccaaaug

SEQ ID NO: 2203480 - RNA, 15 nt, Homo sapiens
uccacagucucccau

SEQ ID NO: 2203481 - RNA, 15 nt, Homo sapiens
cuccuguuuccaugg

SEQ ID NO: 2203482 - RNA, 21 nt, Homo sapiens
uuggcacuguuugccauucuc

SEQ ID NO: 2203483 - RNA, 12 nt, Homo sapiens
cuucagcccacc

SEQ ID NO: 2203484 - RNA, 22 nt, Homo sapiens
aauggcacaugucauugcccac

SEQ ID NO: 2203485 - RNA, 23 nt, Homo sapiens
gauuugcuguuaccaaaucucag

SEQ ID NO: 2203486 - RNA, 15 nt, Homo sapiens
aaugauucaauguga

SEQ ID NO: 2203487 - RNA, 15 nt, Homo sapiens
ugaauuucugaaaga

SEQ ID NO: 2203488 - RNA, 14 nt, Homo sapiens
auccugaacaagaa

SEQ ID NO: 2203489 - RNA, 20 nt, Homo sapiens
agcccaggggccggccagug

SEQ ID NO: 2203490 - RNA, 16 nt, Homo sapiens
uccuauaacacuguga

SEQ ID NO: 2203491 - RNA, 14 nt, Homo sapiens
uaaaucuaguauac

SEQ ID NO: 2203492 - RNA, 14 nt, Homo sapiens
aacucuauacucaa

SEQ ID NO: 2203493 - RNA, 14 nt, Homo sapiens
augauguauguuga

SEQ ID NO: 2203494 - RNA, 22 nt, Homo sapiens
ccugaagucuuuguacagacaa

SEQ ID NO: 2203495 - RNA, 13 nt, Homo sapiens
cuuagcauguccc

SEQ ID NO: 2203496 - RNA, 17 nt, Homo sapiens
ucgcugaacaauuaccu

SEQ ID NO: 2203497 - RNA, 20 nt, Homo sapiens
cuaugaguuggacuucaguc

SEQ ID NO: 2203498 - RNA, 19 nt, Homo sapiens
aagacucaguaugcuuucc

SEQ ID NO: 2203499 - RNA, 15 nt, Homo sapiens
aaggaaacgaugaaa

SEQ ID NO: 2203500 - RNA, 21 nt, Homo sapiens
gaaaauaguggcaggacuguc

SEQ ID NO: 2203501 - RNA, 16 nt, Homo sapiens
aaagauugaguuugca

SEQ ID NO: 2203502 - RNA, 17 nt, Homo sapiens
gaguuccggccugggca

SEQ ID NO: 2203503 - RNA, 16 nt, Homo sapiens
acccuguaaaauggag

SEQ ID NO: 2203504 - RNA, 16 nt, Homo sapiens
cccucaaauacaguau

SEQ ID NO: 2203505 - RNA, 22 nt, Homo sapiens
gcugaaauuuuagaaauauuca

SEQ ID NO: 2203506 - RNA, 23 nt, Homo sapiens
ucaggcugggcagccccagagag

SEQ ID NO: 2203507 - RNA, 19 nt, Homo sapiens
ccuaggaggaaaauuccau

SEQ ID NO: 2203508 - RNA, 21 nt, Homo sapiens
cagagguucauuucaaauaca

SEQ ID NO: 2203509 - RNA, 19 nt, Homo sapiens
cacaguuuauugauuucaa

SEQ ID NO: 2203510 - RNA, 14 nt, Homo sapiens
ucagaaaaccaaag

SEQ ID NO: 2203511 - RNA, 15 nt, Homo sapiens
aagggaggaggugaa

SEQ ID NO: 2203512 - RNA, 17 nt, Homo sapiens
agaaauaaauucacauc

SEQ ID NO: 2203513 - RNA, 16 nt, Homo sapiens
uaacuuugacuuucuu

SEQ ID NO: 2203514 - RNA, 21 nt, Homo sapiens
ggucuggcauuauaaagaaca

SEQ ID NO: 2203515 - RNA, 17 nt, Homo sapiens
acauccauugacugacc

SEQ ID NO: 2203516 - RNA, 12 nt, Homo sapiens
gaggaugcucuu

SEQ ID NO: 2203517 - RNA, 12 nt, Homo sapiens
auauguaugggu

SEQ ID NO: 2203518 - RNA, 12 nt, Homo sapiens
agauguaugugu

SEQ ID NO: 2203519 - RNA, 19 nt, Homo sapiens
gccaaggcuggagugcagu

SEQ ID NO: 2203520 - RNA, 18 nt, Homo sapiens
ccuaguuuacaagucaga

SEQ ID NO: 2203521 - RNA, 15 nt, Homo sapiens
ggagaagacugugcg

SEQ ID NO: 2203522 - RNA, 17 nt, Homo sapiens
cacaccugcggcccaau

SEQ ID NO: 2203523 - RNA, 18 nt, Homo sapiens
aauuguuucauucauccu

SEQ ID NO: 2203524 - RNA, 13 nt, Homo sapiens
uaauuuucacuuu

SEQ ID NO: 2203525 - RNA, 13 nt, Homo sapiens
uauguuucacagu

SEQ ID NO: 2203526 - RNA, 13 nt, Homo sapiens
cuggaccauuccu

SEQ ID NO: 2203527 - RNA, 21 nt, Homo sapiens
agacuuuuaaaagacuuguua

SEQ ID NO: 2203528 - RNA, 17 nt, Homo sapiens
ccaugaaaaacagcaga

SEQ ID NO: 2203529 - RNA, 19 nt, Homo sapiens
aggaaaaaugaggaaucca

SEQ ID NO: 2203530 - RNA, 20 nt, Homo sapiens
aggcagcagugagcuaugau

SEQ ID NO: 2203531 - RNA, 21 nt, Homo sapiens
caccauuuuguuuagacaauu

SEQ ID NO: 2203532 - RNA, 19 nt, Homo sapiens
gaaauguuuguccuugcac

SEQ ID NO: 2203533 - RNA, 11 nt, Homo sapiens
uuugguuuugu

SEQ ID NO: 2203534 - RNA, 15 nt, Homo sapiens
caggccauccauuca

SEQ ID NO: 2203535 - RNA, 11 nt, Homo sapiens
augaacacuug

SEQ ID NO: 2203536 - RNA, 20 nt, Homo sapiens
caauuuucacacacgugaga

SEQ ID NO: 2203537 - RNA, 11 nt, Homo sapiens
ucugucuucaa

SEQ ID NO: 2203538 - RNA, 15 nt, Homo sapiens
aagacuugcauuuaa

SEQ ID NO: 2203539 - RNA, 13 nt, Homo sapiens
ggacuacaggugu

SEQ ID NO: 2203540 - RNA, 23 nt, Homo sapiens
guauaaguguguacaagcauuca

SEQ ID NO: 2203541 - RNA, 23 nt, Homo sapiens
guuucuuuagcaguuuugugaua

SEQ ID NO: 2203542 - RNA, 16 nt, Homo sapiens
uccaaagcuguuccau

SEQ ID NO: 2203543 - RNA, 19 nt, Homo sapiens
gugaacaaagcagccacga

SEQ ID NO: 2203544 - RNA, 19 nt, Homo sapiens
cauucccauguugucaaua

SEQ ID NO: 2203545 - RNA, 20 nt, Homo sapiens
augggugaacuuacuugcau

SEQ ID NO: 2203546 - RNA, 12 nt, Homo sapiens
uccuguucaaga

SEQ ID NO: 2203547 - RNA, 17 nt, Homo sapiens
auacugccggucaccca

SEQ ID NO: 2203548 - RNA, 17 nt, Homo sapiens
cagaugaugcuuuggaa

SEQ ID NO: 2203549 - RNA, 22 nt, Homo sapiens
cagaaaauauuauguguuucca

SEQ ID NO: 2203550 - RNA, 19 nt, Homo sapiens
guaaaauguuuucauuuua

SEQ ID NO: 2203551 - RNA, 19 nt, Homo sapiens
gccucaagaugaaggcaaa

SEQ ID NO: 2203552 - RNA, 20 nt, Homo sapiens
aaugacuuaagcacacuuga

SEQ ID NO: 2203553 - RNA, 19 nt, Homo sapiens
aaauucuacuguauggaau

SEQ ID NO: 2203554 - RNA, 14 nt, Homo sapiens
agugcauucauuca

SEQ ID NO: 2203555 - RNA, 15 nt, Homo sapiens
accuuccaagacuga

SEQ ID NO: 2203556 - RNA, 22 nt, Homo sapiens
agcuugaaauagugucugauga

SEQ ID NO: 2203557 - RNA, 16 nt, Homo sapiens
cgggcccugcugagga

SEQ ID NO: 2203558 - RNA, 20 nt, Homo sapiens
acccaguuggugacugggaa

SEQ ID NO: 2203559 - RNA, 13 nt, Homo sapiens
aucugacauauua

SEQ ID NO: 2203560 - RNA, 13 nt, Homo sapiens
gccaacuccucac

SEQ ID NO: 2203561 - RNA, 20 nt, Homo sapiens
caaggauuacacauuucacu

SEQ ID NO: 2203562 - RNA, 15 nt, Homo sapiens
ugucauucauuuaau

SEQ ID NO: 2203563 - RNA, 20 nt, Homo sapiens
ugaaggaaggacuaugacaa

SEQ ID NO: 2203564 - RNA, 15 nt, Homo sapiens
auucuccaacccaaa

SEQ ID NO: 2203565 - RNA, 22 nt, Homo sapiens
augucaagaacaggacauagca

SEQ ID NO: 2203566 - RNA, 16 nt, Homo sapiens
agccagagaugcaaua

SEQ ID NO: 2203567 - RNA, 22 nt, Homo sapiens
cggccacaugccgcgucccugc

SEQ ID NO: 2203568 - RNA, 14 nt, Homo sapiens
uucuguaaauacca

SEQ ID NO: 2203569 - RNA, 14 nt, Homo sapiens
uaauguaaaaccca

SEQ ID NO: 2203570 - RNA, 15 nt, Homo sapiens
gauuuuaaaugcugu

SEQ ID NO: 2203571 - RNA, 12 nt, Homo sapiens
acugagggccac

SEQ ID NO: 2203572 - RNA, 19 nt, Homo sapiens
cauguagguaggaagcacu

SEQ ID NO: 2203573 - RNA, 18 nt, Homo sapiens
caaugucauuacauagaa

SEQ ID NO: 2203574 - RNA, 23 nt, Homo sapiens
ccugugcagguuuauauugggaa

SEQ ID NO: 2203575 - RNA, 12 nt, Homo sapiens
uuaagcucaaaa

SEQ ID NO: 2203576 - RNA, 16 nt, Homo sapiens
uccacaggcuccccau

SEQ ID NO: 2203577 - RNA, 18 nt, Homo sapiens
ggacuuccuugcucuccc

SEQ ID NO: 2203578 - RNA, 15 nt, Homo sapiens
aaguaaauacaguag

SEQ ID NO: 2203579 - RNA, 21 nt, Homo sapiens
cuuacaggguaacugugcuga

SEQ ID NO: 2203580 - RNA, 24 nt, Homo sapiens
gcaaacuuucuuaaaacauuauga

SEQ ID NO: 2203581 - RNA, 12 nt, Homo sapiens
auucccuuguau

SEQ ID NO: 2203582 - RNA, 21 nt, Homo sapiens
uagugacuugugucccaugau

SEQ ID NO: 2203583 - RNA, 15 nt, Homo sapiens
acagacuggagacaa

SEQ ID NO: 2203584 - RNA, 15 nt, Homo sapiens
ugcgccauugcacuc

SEQ ID NO: 2203585 - RNA, 21 nt, Homo sapiens
cuggcucugccccucaggggg

SEQ ID NO: 2203586 - RNA, 17 nt, Homo sapiens
uaacccugucuccucuc

SEQ ID NO: 2203587 - RNA, 14 nt, Homo sapiens
uuauggagugugcc

SEQ ID NO: 2203588 - RNA, 17 nt, Homo sapiens
uguuuugcauggaguau

SEQ ID NO: 2203589 - RNA, 17 nt, Homo sapiens
ccuuccuauuuugcaua

SEQ ID NO: 2203590 - RNA, 12 nt, Homo sapiens
ccaugagcucac

SEQ ID NO: 2203591 - RNA, 12 nt, Homo sapiens
ucacgagcccau

SEQ ID NO: 2203592 - RNA, 17 nt, Homo sapiens
ugcacacauuaggcauu

SEQ ID NO: 2203593 - RNA, 20 nt, Homo sapiens
uguuauuuuauugccuuuag

SEQ ID NO: 2203594 - RNA, 12 nt, Homo sapiens
acagaacuacuu

SEQ ID NO: 2203595 - RNA, 13 nt, Homo sapiens
aaccuuccaucuc

SEQ ID NO: 2203596 - RNA, 16 nt, Homo sapiens
aucuuccaugcuacau

SEQ ID NO: 2203597 - RNA, 15 nt, Homo sapiens
gcagaugaaguaacu

SEQ ID NO: 2203598 - RNA, 16 nt, Homo sapiens
uacuuuagacuaaaga

SEQ ID NO: 2203599 - RNA, 15 nt, Homo sapiens
uuugcuaacuggguu

SEQ ID NO: 2203600 - RNA, 20 nt, Homo sapiens
ugcagcuucgaggacaggaa

SEQ ID NO: 2203601 - RNA, 21 nt, Homo sapiens
aaaaaaauuuuauagugucuu

SEQ ID NO: 2203602 - RNA, 18 nt, Homo sapiens
ucgccuuagcauguuugc

SEQ ID NO: 2203603 - RNA, 19 nt, Homo sapiens
cacauuugaauucuugauc

SEQ ID NO: 2203604 - RNA, 14 nt, Homo sapiens
uaugcuaacuguag

SEQ ID NO: 2203605 - RNA, 13 nt, Homo sapiens
cuguagccugaag

SEQ ID NO: 2203606 - RNA, 18 nt, Homo sapiens
aagacugcagcugcugaa

SEQ ID NO: 2203607 - RNA, 23 nt, Homo sapiens
cccucccuggaugacauuaaaga

SEQ ID NO: 2203608 - RNA, 10 nt, Homo sapiens
cuacauauau

SEQ ID NO: 2203609 - RNA, 19 nt, Homo sapiens
uggcaaagagagguccaga

SEQ ID NO: 2203610 - RNA, 18 nt, Homo sapiens
ccacucucugggacucuc

SEQ ID NO: 2203611 - RNA, 16 nt, Homo sapiens
uccaacacaucucccu

SEQ ID NO: 2203612 - RNA, 21 nt, Homo sapiens
uccaaguacgauaauuccuca

SEQ ID NO: 2203613 - RNA, 18 nt, Homo sapiens
gcaucaucucuuccucac

SEQ ID NO: 2203614 - RNA, 16 nt, Homo sapiens
uaugguugauguggaa

SEQ ID NO: 2203615 - RNA, 18 nt, Homo sapiens
ggucugauauuaaucaaa

SEQ ID NO: 2203616 - RNA, 14 nt, Homo sapiens
ggagcguguggcug

SEQ ID NO: 2203617 - RNA, 13 nt, Homo sapiens
gcagcucuacucu

SEQ ID NO: 2203618 - RNA, 18 nt, Homo sapiens
uaaggaagacacagccca

SEQ ID NO: 2203619 - RNA, 20 nt, Homo sapiens
cccaucacgccugugcagug

SEQ ID NO: 2203620 - RNA, 13 nt, Homo sapiens
cuucuuguucccc

SEQ ID NO: 2203621 - RNA, 19 nt, Homo sapiens
gcuaagcuaccuugucaua

SEQ ID NO: 2203622 - RNA, 17 nt, Homo sapiens
auaaaugucacugccaa

SEQ ID NO: 2203623 - RNA, 16 nt, Homo sapiens
aaagagguagcacuac

SEQ ID NO: 2203624 - RNA, 13 nt, Homo sapiens
aagauaauguugc

SEQ ID NO: 2203625 - RNA, 16 nt, Homo sapiens
agaauguacuugauau

SEQ ID NO: 2203626 - RNA, 15 nt, Homo sapiens
ccuauaguaucuuuu

SEQ ID NO: 2203627 - RNA, 15 nt, Homo sapiens
cauugagaaacugaa

SEQ ID NO: 2203628 - RNA, 22 nt, Homo sapiens
accaugcagccgcaccagagag

SEQ ID NO: 2203629 - RNA, 17 nt, Homo sapiens
acucuuagaagugacau

SEQ ID NO: 2203630 - RNA, 12 nt, Homo sapiens
ugucaguucucu

SEQ ID NO: 2203631 - RNA, 13 nt, Homo sapiens
gugccuacaggug

SEQ ID NO: 2203632 - RNA, 20 nt, Homo sapiens
uuuaauucuaguuucucuca

SEQ ID NO: 2203633 - RNA, 17 nt, Homo sapiens
aaauuuugccugcaaca

SEQ ID NO: 2203634 - RNA, 22 nt, Homo sapiens
uaccagguggcaaaguacuugu

SEQ ID NO: 2203635 - RNA, 13 nt, Homo sapiens
aauuugaaaucca

SEQ ID NO: 2203636 - RNA, 22 nt, Homo sapiens
uguggagaugcccaggauuuga

SEQ ID NO: 2203637 - RNA, 20 nt, Homo sapiens
acauuugggagacaugugac

SEQ ID NO: 2203638 - RNA, 17 nt, Homo sapiens
cauuguaaaguauguga

SEQ ID NO: 2203639 - RNA, 20 nt, Homo sapiens
cuuggagacagggcccuguc

SEQ ID NO: 2203640 - RNA, 13 nt, Homo sapiens
agacauaccucuc

SEQ ID NO: 2203641 - RNA, 19 nt, Homo sapiens
cucccaaauugcugggauu

SEQ ID NO: 2203642 - RNA, 19 nt, Homo sapiens
cugagacuauuuuaacugg

SEQ ID NO: 2203643 - RNA, 13 nt, Homo sapiens
gaccaggaccucc

SEQ ID NO: 2203644 - RNA, 16 nt, Homo sapiens
uggaauucaaagcucu

SEQ ID NO: 2203645 - RNA, 14 nt, Homo sapiens
auuggcacugugga

SEQ ID NO: 2203646 - RNA, 14 nt, Homo sapiens
aguaacacuuuaaa

SEQ ID NO: 2203647 - RNA, 21 nt, Homo sapiens
gccccagcuccucuuccugcc

SEQ ID NO: 2203648 - RNA, 21 nt, Homo sapiens
guuggugggggucagucacuu

SEQ ID NO: 2203649 - RNA, 14 nt, Homo sapiens
cugcuuaguaucuc

SEQ ID NO: 2203650 - RNA, 20 nt, Homo sapiens
uccguuugccaaucauugca

SEQ ID NO: 2203651 - RNA, 12 nt, Homo sapiens
cuagaaacacac

SEQ ID NO: 2203652 - RNA, 12 nt, Homo sapiens
caucuuaaacua

SEQ ID NO: 2203653 - RNA, 18 nt, Homo sapiens
uaaagcaaaccagccuca

SEQ ID NO: 2203654 - RNA, 18 nt, Homo sapiens
agugggagguugugcaug

SEQ ID NO: 2203655 - RNA, 15 nt, Homo sapiens
cuuagccaugaucug

SEQ ID NO: 2203656 - RNA, 16 nt, Homo sapiens
gaauauaauacuguau

SEQ ID NO: 2203657 - RNA, 19 nt, Homo sapiens
ccagacauugauggggaca

SEQ ID NO: 2203658 - RNA, 13 nt, Homo sapiens
uaacgauacaaau

SEQ ID NO: 2203659 - RNA, 13 nt, Homo sapiens
caggacuaggcau

SEQ ID NO: 2203660 - RNA, 18 nt, Homo sapiens
aauuuauggaaucuacca

SEQ ID NO: 2203661 - RNA, 16 nt, Homo sapiens
uggggcaggcagugau

SEQ ID NO: 2203662 - RNA, 21 nt, Homo sapiens
acagccuuucaauucauauac

SEQ ID NO: 2203663 - RNA, 22 nt, Homo sapiens
caucuuuacaaaacuacaugag

SEQ ID NO: 2203664 - RNA, 15 nt, Homo sapiens
gugcaugugcacuug

SEQ ID NO: 2203665 - RNA, 15 nt, Homo sapiens
auguauauacauuua

SEQ ID NO: 2203666 - RNA, 17 nt, Homo sapiens
uugaaaagauagggaag

SEQ ID NO: 2203667 - RNA, 18 nt, Homo sapiens
cugcauugggagcaucca

SEQ ID NO: 2203668 - RNA, 17 nt, Homo sapiens
ugucccucuuccauccc

SEQ ID NO: 2203669 - RNA, 15 nt, Homo sapiens
ccugacuaacuuuuu

SEQ ID NO: 2203670 - RNA, 19 nt, Homo sapiens
aucaauuggcagugacuuu

SEQ ID NO: 2203671 - RNA, 21 nt, Homo sapiens
ucacaauaaauggccagugcu

SEQ ID NO: 2203672 - RNA, 13 nt, Homo sapiens
ucaaaaaguaauu

SEQ ID NO: 2203673 - RNA, 14 nt, Homo sapiens
aagaagugccaguu

SEQ ID NO: 2203674 - RNA, 15 nt, Homo sapiens
caguucugggcaaag

SEQ ID NO: 2203675 - RNA, 11 nt, Homo sapiens
agccaccacuc

SEQ ID NO: 2203676 - RNA, 21 nt, Homo sapiens
gagcugaggauuuccuggagu

SEQ ID NO: 2203677 - RNA, 21 nt, Homo sapiens
ccuuacuccugguucagugcc

SEQ ID NO: 2203678 - RNA, 16 nt, Homo sapiens
caauguauacaaugca

SEQ ID NO: 2203679 - RNA, 13 nt, Homo sapiens
uucauuucagcau

SEQ ID NO: 2203680 - RNA, 15 nt, Homo sapiens
cugaaaaaugcucaa

SEQ ID NO: 2203681 - RNA, 16 nt, Homo sapiens
ugacggguugugagac

SEQ ID NO: 2203682 - RNA, 15 nt, Homo sapiens
auuucuaguccaaaa

SEQ ID NO: 2203683 - RNA, 16 nt, Homo sapiens
aggaggauaagcuuuu

SEQ ID NO: 2203684 - RNA, 15 nt, Homo sapiens
agagugacagucaua

SEQ ID NO: 2203685 - RNA, 15 nt, Homo sapiens
cauguaaagcuguua

SEQ ID NO: 2203686 - RNA, 18 nt, Homo sapiens
aggcagcagacacaugcc

SEQ ID NO: 2203687 - RNA, 21 nt, Homo sapiens
ggaagacgugcgcgaugugac

SEQ ID NO: 2203688 - RNA, 17 nt, Homo sapiens
gagagcuagagggacaa

SEQ ID NO: 2203689 - RNA, 23 nt, Homo sapiens
ugagcccuggacucaucuuggga

SEQ ID NO: 2203690 - RNA, 14 nt, Homo sapiens
acccaaaagcucag

SEQ ID NO: 2203691 - RNA, 18 nt, Homo sapiens
agaauugaaaaaccauuu

SEQ ID NO: 2203692 - RNA, 17 nt, Homo sapiens
uaaaggacaaacaguga

SEQ ID NO: 2203693 - RNA, 14 nt, Homo sapiens
gaacaacauaucuc

SEQ ID NO: 2203694 - RNA, 19 nt, Homo sapiens
ucauacauuagugccauag

SEQ ID NO: 2203695 - RNA, 19 nt, Homo sapiens
ccuugacgucguuuuacaa

SEQ ID NO: 2203696 - RNA, 15 nt, Homo sapiens
cuccucugcuugcca

SEQ ID NO: 2203697 - RNA, 18 nt, Homo sapiens
aggucgagacauuccugc

SEQ ID NO: 2203698 - RNA, 15 nt, Homo sapiens
cugccaagccuauug

SEQ ID NO: 2203699 - RNA, 17 nt, Homo sapiens
aagcaacugaucauauu

SEQ ID NO: 2203700 - RNA, 19 nt, Homo sapiens
aaugcagcgugaagggauu

SEQ ID NO: 2203701 - RNA, 21 nt, Homo sapiens
ugauuaggaaucuaaaugaag

SEQ ID NO: 2203702 - RNA, 18 nt, Homo sapiens
ccaaacccuuaacugaca

SEQ ID NO: 2203703 - RNA, 16 nt, Homo sapiens
cagaccacucccuucc

SEQ ID NO: 2203704 - RNA, 17 nt, Homo sapiens
gucuagacugccaggga

SEQ ID NO: 2203705 - RNA, 15 nt, Homo sapiens
caggaaccacaccac

SEQ ID NO: 2203706 - RNA, 12 nt, Homo sapiens
aaagcagcaucu

SEQ ID NO: 2203707 - RNA, 18 nt, Homo sapiens
auacugacuucaguggga

SEQ ID NO: 2203708 - RNA, 13 nt, Homo sapiens
ccucuaagguugg

SEQ ID NO: 2203709 - RNA, 21 nt, Homo sapiens
cugggggcccauucugcaugc

SEQ ID NO: 2203710 - RNA, 23 nt, Homo sapiens
acuguacagacagaaaaaacuga

SEQ ID NO: 2203711 - RNA, 12 nt, Homo sapiens
aaggacacucac

SEQ ID NO: 2203712 - RNA, 17 nt, Homo sapiens
cugagccuucagcacua

SEQ ID NO: 2203713 - RNA, 20 nt, Homo sapiens
cuagccuuguguuauagaau

SEQ ID NO: 2203714 - RNA, 22 nt, Homo sapiens
aaaaaucauguguugcagcuuu

SEQ ID NO: 2203715 - RNA, 21 nt, Homo sapiens
guagguaggaagcacugaaaa

SEQ ID NO: 2203716 - RNA, 18 nt, Homo sapiens
agaacuucccuccaucca

SEQ ID NO: 2203717 - RNA, 16 nt, Homo sapiens
aaaggaagacuugaag

SEQ ID NO: 2203718 - RNA, 19 nt, Homo sapiens
cacggcagcuguagcuccc

SEQ ID NO: 2203719 - RNA, 15 nt, Homo sapiens
auuuaucuacaugca

SEQ ID NO: 2203720 - RNA, 14 nt, Homo sapiens
aguugauacuugaa

SEQ ID NO: 2203721 - RNA, 15 nt, Homo sapiens
caccuaucuuuggua

SEQ ID NO: 2203722 - RNA, 22 nt, Homo sapiens
ccuaauaaacauccuucaagaa

SEQ ID NO: 2203723 - RNA, 12 nt, Homo sapiens
ucuuaaucuuuu

SEQ ID NO: 2203724 - RNA, 15 nt, Homo sapiens
uuuggguagugccau

SEQ ID NO: 2203725 - RNA, 14 nt, Homo sapiens
augauuaacuaauu

SEQ ID NO: 2203726 - RNA, 13 nt, Homo sapiens
ggagucugcacau

SEQ ID NO: 2203727 - RNA, 17 nt, Homo sapiens
uuugggaagucucagca

SEQ ID NO: 2203728 - RNA, 20 nt, Homo sapiens
gaaugugcugaucauuugag

SEQ ID NO: 2203729 - RNA, 22 nt, Homo sapiens
aaacuuacacuguuucaucuca

SEQ ID NO: 2203730 - RNA, 23 nt, Homo sapiens
aucagccuuccgcaauucaugua

SEQ ID NO: 2203731 - RNA, 12 nt, Homo sapiens
ccagagcacugu

SEQ ID NO: 2203732 - RNA, 12 nt, Homo sapiens
ccauagcacugg

SEQ ID NO: 2203733 - RNA, 23 nt, Homo sapiens
gaaaggagccaaguggggcccuc

SEQ ID NO: 2203734 - RNA, 13 nt, Homo sapiens
cccgggagcuuug

SEQ ID NO: 2203735 - RNA, 23 nt, Homo sapiens
cggugcauacacccccaccuccu

SEQ ID NO: 2203736 - RNA, 20 nt, Homo sapiens
guccuagccccucacuucca

SEQ ID NO: 2203737 - RNA, 18 nt, Homo sapiens
gcuauuuuuauacaguga

SEQ ID NO: 2203738 - RNA, 18 nt, Homo sapiens
acaguugcacagcaucuc

SEQ ID NO: 2203739 - RNA, 22 nt, Homo sapiens
ucccuuggaauaaaaacauuuc

SEQ ID NO: 2203740 - RNA, 23 nt, Homo sapiens
caccuggguuggaggaagggcac

SEQ ID NO: 2203741 - RNA, 22 nt, Homo sapiens
uucucuauguacagaugaugua

SEQ ID NO: 2203742 - RNA, 14 nt, Homo sapiens
aggagggcuuugug

SEQ ID NO: 2203743 - RNA, 20 nt, Homo sapiens
agcugugaccugcugagcuc

SEQ ID NO: 2203744 - RNA, 16 nt, Homo sapiens
aagguuccaacuguau

SEQ ID NO: 2203745 - RNA, 18 nt, Homo sapiens
uggaaacuguugccagag

SEQ ID NO: 2203746 - RNA, 21 nt, Homo sapiens
ggagucugccaaaacaaggga

SEQ ID NO: 2203747 - RNA, 12 nt, Homo sapiens
uauaagugcuca

SEQ ID NO: 2203748 - RNA, 19 nt, Homo sapiens
agcaagaugugaaagaaga

SEQ ID NO: 2203749 - RNA, 17 nt, Homo sapiens
ugcuuccacuucuaugc

SEQ ID NO: 2203750 - RNA, 12 nt, Homo sapiens
uaucugcaauua

SEQ ID NO: 2203751 - RNA, 19 nt, Homo sapiens
agacccagcugauugcacu

SEQ ID NO: 2203752 - RNA, 16 nt, Homo sapiens
gcugcuggagugcagu

SEQ ID NO: 2203753 - RNA, 15 nt, Homo sapiens
uaaauaccauugugu

SEQ ID NO: 2203754 - RNA, 21 nt, Homo sapiens
auauacuauuuucauucucuu

SEQ ID NO: 2203755 - RNA, 21 nt, Homo sapiens
uuacaagacuguaaauuccaa

SEQ ID NO: 2203756 - RNA, 21 nt, Homo sapiens
guccacccucauuucugccag

SEQ ID NO: 2203757 - RNA, 14 nt, Homo sapiens
aauguugcuuuaac

SEQ ID NO: 2203758 - RNA, 13 nt, Homo sapiens
cacuccagugcca

SEQ ID NO: 2203759 - RNA, 22 nt, Homo sapiens
caguaucggcacuguacaaaaa

SEQ ID NO: 2203760 - RNA, 16 nt, Homo sapiens
gccucaaguuauuuca

SEQ ID NO: 2203761 - RNA, 15 nt, Homo sapiens
ucugaggaguccaaa

SEQ ID NO: 2203762 - RNA, 13 nt, Homo sapiens
acaaucaugccua

SEQ ID NO: 2203763 - RNA, 16 nt, Homo sapiens
gaggugcaugccuaau

SEQ ID NO: 2203764 - RNA, 16 nt, Homo sapiens
caguauccacacauaa

SEQ ID NO: 2203765 - RNA, 23 nt, Homo sapiens
gucaauguccuacugagacagca

SEQ ID NO: 2203766 - RNA, 22 nt, Homo sapiens
aaggcagagccuuuuuaccugg

SEQ ID NO: 2203767 - RNA, 19 nt, Homo sapiens
agccaagagucaugucaaa

SEQ ID NO: 2203768 - RNA, 20 nt, Homo sapiens
agauaucacuuacucaguua

SEQ ID NO: 2203769 - RNA, 15 nt, Homo sapiens
guucucucucucugu

SEQ ID NO: 2203770 - RNA, 17 nt, Homo sapiens
aggcugggagcauagca

SEQ ID NO: 2203771 - RNA, 18 nt, Homo sapiens
cuuagccuccugaccuga

SEQ ID NO: 2203772 - RNA, 12 nt, Homo sapiens
auugccaagugc

SEQ ID NO: 2203773 - RNA, 13 nt, Homo sapiens
ucaaaugcucaag

SEQ ID NO: 2203774 - RNA, 16 nt, Homo sapiens
ugccagccacugugau

SEQ ID NO: 2203775 - RNA, 18 nt, Homo sapiens
gugccagcugcuucugcc

SEQ ID NO: 2203776 - RNA, 22 nt, Homo sapiens
auugacaacugcacaugaaagu

SEQ ID NO: 2203777 - RNA, 23 nt, Homo sapiens
aaaauacuaugugggacaccuca

SEQ ID NO: 2203778 - RNA, 13 nt, Homo sapiens
uuugaggccaaaa

SEQ ID NO: 2203779 - RNA, 16 nt, Homo sapiens
cagcagcuuggagcag

SEQ ID NO: 2203780 - RNA, 23 nt, Homo sapiens
aaggagcaaaacgccucuuuucc

SEQ ID NO: 2203781 - RNA, 20 nt, Homo sapiens
agguuucaccugaucauaua

SEQ ID NO: 2203782 - RNA, 13 nt, Homo sapiens
augugcccugccu

SEQ ID NO: 2203783 - RNA, 15 nt, Homo sapiens
auucacccuguccaa

SEQ ID NO: 2203784 - RNA, 18 nt, Homo sapiens
aggaguuugagaccaacc

SEQ ID NO: 2203785 - RNA, 19 nt, Homo sapiens
uaugacaacucuuauuuga

SEQ ID NO: 2203786 - RNA, 20 nt, Homo sapiens
cauggaauuucuaguaugag

SEQ ID NO: 2203787 - RNA, 23 nt, Homo sapiens
caaaugacagauucugacauuua

SEQ ID NO: 2203788 - RNA, 12 nt, Homo sapiens
acugaagcacag

SEQ ID NO: 2203789 - RNA, 21 nt, Homo sapiens
ugcugggcaggaaaccccagc

SEQ ID NO: 2203790 - RNA, 20 nt, Homo sapiens
ccccacuuuuuguuguucau

SEQ ID NO: 2203791 - RNA, 17 nt, Homo sapiens
ucauaaacuucagggau

SEQ ID NO: 2203792 - RNA, 22 nt, Homo sapiens
acagucacugauguacaauuaa

SEQ ID NO: 2203793 - RNA, 14 nt, Homo sapiens
gaaucaacauuucu

SEQ ID NO: 2203794 - RNA, 16 nt, Homo sapiens
uuuccagucauuucaa

SEQ ID NO: 2203795 - RNA, 23 nt, Homo sapiens
uuuaauccauuucaggacucucu

SEQ ID NO: 2203796 - RNA, 20 nt, Homo sapiens
ugggaaaagcccacaggccu

SEQ ID NO: 2203797 - RNA, 18 nt, Homo sapiens
auuuccuaguagaacuca

SEQ ID NO: 2203798 - RNA, 16 nt, Homo sapiens
guaggcuuaguuugug

SEQ ID NO: 2203799 - RNA, 12 nt, Homo sapiens
augacacugagc

SEQ ID NO: 2203800 - RNA, 23 nt, Homo sapiens
auuuccuaucauuuuauuaucac

SEQ ID NO: 2203801 - RNA, 18 nt, Homo sapiens
cuugauucagucacaugg

SEQ ID NO: 2203802 - RNA, 14 nt, Homo sapiens
ucaauuaguacagu

SEQ ID NO: 2203803 - RNA, 18 nt, Homo sapiens
guuugccaucccaaaaau

SEQ ID NO: 2203804 - RNA, 13 nt, Homo sapiens
acugaaggcauau

SEQ ID NO: 2203805 - RNA, 14 nt, Homo sapiens
cugcaaaugugcag

SEQ ID NO: 2203806 - RNA, 18 nt, Homo sapiens
uucuaaaguuuugcaaca

SEQ ID NO: 2203807 - RNA, 23 nt, Homo sapiens
acugugaaggaacucugcaguua

SEQ ID NO: 2203808 - RNA, 13 nt, Homo sapiens
cugagguggugga

SEQ ID NO: 2203809 - RNA, 19 nt, Homo sapiens
gcaauucuacccagagccu

SEQ ID NO: 2203810 - RNA, 18 nt, Homo sapiens
acucuagaagaccaaaug

SEQ ID NO: 2203811 - RNA, 17 nt, Homo sapiens
accaucuccaugugacc

SEQ ID NO: 2203812 - RNA, 16 nt, Homo sapiens
agcgccucuccugggg

SEQ ID NO: 2203813 - RNA, 17 nt, Homo sapiens
uuaaguggacucucuga

SEQ ID NO: 2203814 - RNA, 18 nt, Homo sapiens
aucuuaucccuugacaaa

SEQ ID NO: 2203815 - RNA, 16 nt, Homo sapiens
ugccuugcugugaaau

SEQ ID NO: 2203816 - RNA, 19 nt, Homo sapiens
gccagggaauccugaccug

SEQ ID NO: 2203817 - RNA, 14 nt, Homo sapiens
ugcucugugcccac

SEQ ID NO: 2203818 - RNA, 18 nt, Homo sapiens
ucccaggcuggauacuaa

SEQ ID NO: 2203819 - RNA, 19 nt, Homo sapiens
aaauaagguaauacauaua

SEQ ID NO: 2203820 - RNA, 20 nt, Homo sapiens
guauccaauaggcauuugau

SEQ ID NO: 2203821 - RNA, 14 nt, Homo sapiens
aaccucacuugaag

SEQ ID NO: 2203822 - RNA, 17 nt, Homo sapiens
aaugacagauucugaca

SEQ ID NO: 2203823 - RNA, 17 nt, Homo sapiens
uccagauagcagggcau

SEQ ID NO: 2203824 - RNA, 18 nt, Homo sapiens
uacggcuggugugucaua

SEQ ID NO: 2203825 - RNA, 21 nt, Homo sapiens
ccaauuucucucagauuucca

SEQ ID NO: 2203826 - RNA, 16 nt, Homo sapiens
ugggaaaacauuugcu

SEQ ID NO: 2203827 - RNA, 15 nt, Homo sapiens
agagcaaagugaccu

SEQ ID NO: 2203828 - RNA, 17 nt, Homo sapiens
cacacuugggagcaaaa

SEQ ID NO: 2203829 - RNA, 21 nt, Homo sapiens
acuaagcaucuuuauaugcuu

SEQ ID NO: 2203830 - RNA, 18 nt, Homo sapiens
gagauggagucucacucu

SEQ ID NO: 2203831 - RNA, 15 nt, Homo sapiens
cacaaagaugugcaa

SEQ ID NO: 2203832 - RNA, 20 nt, Homo sapiens
acccuggggauaguccuucc

SEQ ID NO: 2203833 - RNA, 20 nt, Homo sapiens
aagagauuuaucuuuauaca

SEQ ID NO: 2203834 - RNA, 21 nt, Homo sapiens
gcagggucaguggaagcccca

SEQ ID NO: 2203835 - RNA, 14 nt, Homo sapiens
ucuuccagaaacua

SEQ ID NO: 2203836 - RNA, 13 nt, Homo sapiens
caauagcauccaa

SEQ ID NO: 2203837 - RNA, 20 nt, Homo sapiens
cuacuuuuucuagcuacaau

SEQ ID NO: 2203838 - RNA, 18 nt, Homo sapiens
cucucagcagaaacacac

SEQ ID NO: 2203839 - RNA, 20 nt, Homo sapiens
ugaaggugacaucaggauua

SEQ ID NO: 2203840 - RNA, 20 nt, Homo sapiens
gcauggccugcagucuggca

SEQ ID NO: 2203841 - RNA, 17 nt, Homo sapiens
auuuaauucauguugcc

SEQ ID NO: 2203842 - RNA, 20 nt, Homo sapiens
uuguugcaauaucuacauuc

SEQ ID NO: 2203843 - RNA, 17 nt, Homo sapiens
gaugaacauucaagaga

SEQ ID NO: 2203844 - RNA, 17 nt, Homo sapiens
cacugugaacuaaugac

SEQ ID NO: 2203845 - RNA, 16 nt, Homo sapiens
cuaagagaacaaugug

SEQ ID NO: 2203846 - RNA, 18 nt, Homo sapiens
caggagcugauggcagcu

SEQ ID NO: 2203847 - RNA, 14 nt, Homo sapiens
ugguccucagggga

SEQ ID NO: 2203848 - RNA, 17 nt, Homo sapiens
gaaauggcgaaugucau

SEQ ID NO: 2203849 - RNA, 18 nt, Homo sapiens
cccacugccagacaugcc

SEQ ID NO: 2203850 - RNA, 17 nt, Homo sapiens
gcuuugcugcuaugaaa

SEQ ID NO: 2203851 - RNA, 19 nt, Homo sapiens
uuaccugucauuuugcacu

SEQ ID NO: 2203852 - RNA, 21 nt, Homo sapiens
aaaguaccuauugaacaugug

SEQ ID NO: 2203853 - RNA, 23 nt, Homo sapiens
uagucaagagaaguacagaaugu

SEQ ID NO: 2203854 - RNA, 21 nt, Homo sapiens
cuucugaccacagcaucauuu

SEQ ID NO: 2203855 - RNA, 20 nt, Homo sapiens
acuucuugcuggucuaguca

SEQ ID NO: 2203856 - RNA, 21 nt, Homo sapiens
uaagugcuacuuugccauuaa

SEQ ID NO: 2203857 - RNA, 18 nt, Homo sapiens
gccaggaccaugcaggga

SEQ ID NO: 2203858 - RNA, 21 nt, Homo sapiens
auucauauuaagacaguguac

SEQ ID NO: 2203859 - RNA, 20 nt, Homo sapiens
uaaaauaaguggauuuugua

SEQ ID NO: 2203860 - RNA, 14 nt, Homo sapiens
cuggucuucacugc

SEQ ID NO: 2203861 - RNA, 13 nt, Homo sapiens
aguuuagcauuaa

SEQ ID NO: 2203862 - RNA, 20 nt, Homo sapiens
ucccaagcaccugggauuac

SEQ ID NO: 2203863 - RNA, 19 nt, Homo sapiens
agccaggagaagcucagcu

SEQ ID NO: 2203864 - RNA, 14 nt, Homo sapiens
uacauuuauaaucu

SEQ ID NO: 2203865 - RNA, 21 nt, Homo sapiens
cacauguaucacccccaaaaa

SEQ ID NO: 2203866 - RNA, 17 nt, Homo sapiens
ccuuguggccuaugaaa

SEQ ID NO: 2203867 - RNA, 23 nt, Homo sapiens
aggacugccccgugcagacugga

SEQ ID NO: 2203868 - RNA, 17 nt, Homo sapiens
gacgugauuuugcugua

SEQ ID NO: 2203869 - RNA, 20 nt, Homo sapiens
agacauuccugcgcauggug

SEQ ID NO: 2203870 - RNA, 17 nt, Homo sapiens
cuuuuccauccuaguga

SEQ ID NO: 2203871 - RNA, 14 nt, Homo sapiens
uaagaagugccaag

SEQ ID NO: 2203872 - RNA, 15 nt, Homo sapiens
ucacauccuugacuu

SEQ ID NO: 2203873 - RNA, 17 nt, Homo sapiens
gaguucagcaaagagug

SEQ ID NO: 2203874 - RNA, 16 nt, Homo sapiens
acuaucccugcacaua

SEQ ID NO: 2203875 - RNA, 14 nt, Homo sapiens
auuaagcaucacaa

SEQ ID NO: 2203876 - RNA, 13 nt, Homo sapiens
ucuaugcauguau

SEQ ID NO: 2203877 - RNA, 18 nt, Homo sapiens
gucugugggaaggcaaau

SEQ ID NO: 2203878 - RNA, 17 nt, Homo sapiens
uguagagaaaacaugca

SEQ ID NO: 2203879 - RNA, 14 nt, Homo sapiens
uuucuguugcccca

SEQ ID NO: 2203880 - RNA, 22 nt, Homo sapiens
aacagaaauguuuuuuggcauu

SEQ ID NO: 2203881 - RNA, 13 nt, Homo sapiens
aggaaaaccucaa

SEQ ID NO: 2203882 - RNA, 19 nt, Homo sapiens
ugccuccugggaccaugga

SEQ ID NO: 2203883 - RNA, 23 nt, Homo sapiens
aaccuaacugcaauguggauguu

SEQ ID NO: 2203884 - RNA, 19 nt, Homo sapiens
uuccuauacgugugucuuu

SEQ ID NO: 2203885 - RNA, 18 nt, Homo sapiens
gcacaacaugcacauuca

SEQ ID NO: 2203886 - RNA, 20 nt, Homo sapiens
guuccucccaggaagcccag

SEQ ID NO: 2203887 - RNA, 23 nt, Homo sapiens
uuagauguucuaagucuuuccau

SEQ ID NO: 2203888 - RNA, 18 nt, Homo sapiens
aguccgcagucuggccug

SEQ ID NO: 2203889 - RNA, 14 nt, Homo sapiens
cugccauacgcggg

SEQ ID NO: 2203890 - RNA, 21 nt, Homo sapiens
uuuuaacugcuucaaguguua

SEQ ID NO: 2203891 - RNA, 17 nt, Homo sapiens
ugauuucagacugcaga

SEQ ID NO: 2203892 - RNA, 12 nt, Homo sapiens
aagcuaaaucau

SEQ ID NO: 2203893 - RNA, 20 nt, Homo sapiens
cuugugccucagccucccaa

SEQ ID NO: 2203894 - RNA, 16 nt, Homo sapiens
aauuuuaaacauaucc

SEQ ID NO: 2203895 - RNA, 14 nt, Homo sapiens
uuguucacugugag

SEQ ID NO: 2203896 - RNA, 14 nt, Homo sapiens
uucucggguucucu

SEQ ID NO: 2203897 - RNA, 20 nt, Homo sapiens
caauacuucauuaauuucaa

SEQ ID NO: 2203898 - RNA, 23 nt, Homo sapiens
cccacuuuucucucuauuuguau

SEQ ID NO: 2203899 - RNA, 21 nt, Homo sapiens
aacuaaauaaaguguugaaca

SEQ ID NO: 2203900 - RNA, 16 nt, Homo sapiens
gucucacuuuguugcc

SEQ ID NO: 2203901 - RNA, 20 nt, Homo sapiens
uccagcaccuucccucucac

SEQ ID NO: 2203902 - RNA, 23 nt, Homo sapiens
aacuucagagcaugaaaaucaca

SEQ ID NO: 2203903 - RNA, 16 nt, Homo sapiens
aaaugaauaaugccuu

SEQ ID NO: 2203904 - RNA, 21 nt, Homo sapiens
ucaguauugagacacugucaa

SEQ ID NO: 2203905 - RNA, 12 nt, Homo sapiens
ggagaagccauu

SEQ ID NO: 2203906 - RNA, 17 nt, Homo sapiens
auauauuauauggaaau

SEQ ID NO: 2203907 - RNA, 19 nt, Homo sapiens
ggaacuuuuauuacugggg

SEQ ID NO: 2203908 - RNA, 22 nt, Homo sapiens
accccgaccaccugcccaaccu

SEQ ID NO: 2203909 - RNA, 11 nt, Homo sapiens
ucucuagcuca

SEQ ID NO: 2203910 - RNA, 16 nt, Homo sapiens
aacccugugucacuua

SEQ ID NO: 2203911 - RNA, 21 nt, Homo sapiens
aaaauaguauuuuauuucuca

SEQ ID NO: 2203912 - RNA, 16 nt, Homo sapiens
cccaacgcacaggaaa

SEQ ID NO: 2203913 - RNA, 16 nt, Homo sapiens
gggcuaaacaugugag

SEQ ID NO: 2203914 - RNA, 17 nt, Homo sapiens
aggagcacaggucccac

SEQ ID NO: 2203915 - RNA, 13 nt, Homo sapiens
uguuauuuacacu

SEQ ID NO: 2203916 - RNA, 18 nt, Homo sapiens
aauuauuuugugaugcaa

SEQ ID NO: 2203917 - RNA, 18 nt, Homo sapiens
gcagaugaacuaauuuca

SEQ ID NO: 2203918 - RNA, 17 nt, Homo sapiens
auggaucaucaagguga

SEQ ID NO: 2203919 - RNA, 12 nt, Homo sapiens
ugguacucagua

SEQ ID NO: 2203920 - RNA, 16 nt, Homo sapiens
accaaggggguaaaaa

SEQ ID NO: 2203921 - RNA, 18 nt, Homo sapiens
uucugagcagugccucuu

SEQ ID NO: 2203922 - RNA, 16 nt, Homo sapiens
agccaaggucaugcca

SEQ ID NO: 2203923 - RNA, 15 nt, Homo sapiens
auacggaacacuguc

SEQ ID NO: 2203924 - RNA, 15 nt, Homo sapiens
uaauuuguaugcuaa

SEQ ID NO: 2203925 - RNA, 15 nt, Homo sapiens
cugcaauuggcaccg

SEQ ID NO: 2203926 - RNA, 22 nt, Homo sapiens
uucccuucaucuggaaccauca

SEQ ID NO: 2203927 - RNA, 15 nt, Homo sapiens
ucggagccaacaaga

SEQ ID NO: 2203928 - RNA, 20 nt, Homo sapiens
uggcucaacguuuuuggaca

SEQ ID NO: 2203929 - RNA, 22 nt, Homo sapiens
ggauccguuugaccaauuugca

SEQ ID NO: 2203930 - RNA, 16 nt, Homo sapiens
uugugguaaacaaaga

SEQ ID NO: 2203931 - RNA, 17 nt, Homo sapiens
auuaaaaucacaaacuc

SEQ ID NO: 2203932 - RNA, 19 nt, Homo sapiens
cugucuucagcacauucca

SEQ ID NO: 2203933 - RNA, 16 nt, Homo sapiens
auauuugguaccaugg

SEQ ID NO: 2203934 - RNA, 18 nt, Homo sapiens
cagcucaccaacuacaga

SEQ ID NO: 2203935 - RNA, 16 nt, Homo sapiens
uuaauaguauaucuaa

SEQ ID NO: 2203936 - RNA, 22 nt, Homo sapiens
uagaagauccacauccucuaca

SEQ ID NO: 2203937 - RNA, 22 nt, Homo sapiens
cugcagucccuuucgacuugca

SEQ ID NO: 2203938 - RNA, 19 nt, Homo sapiens
ucuaguaagaugcacugaa

SEQ ID NO: 2203939 - RNA, 21 nt, Homo sapiens
gucuaaagcagggaagugaca

SEQ ID NO: 2203940 - RNA, 18 nt, Homo sapiens
agucaccuaaguacuuaa

SEQ ID NO: 2203941 - RNA, 19 nt, Homo sapiens
uguggaaaguuaaugucaa

SEQ ID NO: 2203942 - RNA, 15 nt, Homo sapiens
ucuucucccuuugaa

SEQ ID NO: 2203943 - RNA, 21 nt, Homo sapiens
ccuaccuuagaaaacaaguau

SEQ ID NO: 2203944 - RNA, 13 nt, Homo sapiens
uuugaaauaccuu

SEQ ID NO: 2203945 - RNA, 18 nt, Homo sapiens
acaugccucucucaggcc

SEQ ID NO: 2203946 - RNA, 11 nt, Homo sapiens
uggaucugcca

SEQ ID NO: 2203947 - RNA, 19 nt, Homo sapiens
auuuucuaauguugacuuu

SEQ ID NO: 2203948 - RNA, 16 nt, Homo sapiens
cugugagcauuaaaua

SEQ ID NO: 2203949 - RNA, 15 nt, Homo sapiens
agaagguuguauuac

SEQ ID NO: 2203950 - RNA, 21 nt, Homo sapiens
uguuuacagggagccuccugc

SEQ ID NO: 2203951 - RNA, 16 nt, Homo sapiens
acaggaaaggccccaa

SEQ ID NO: 2203952 - RNA, 15 nt, Homo sapiens
agugcuuguuuuaca

SEQ ID NO: 2203953 - RNA, 17 nt, Homo sapiens
gaugcuugagccuuuga

SEQ ID NO: 2203954 - RNA, 15 nt, Homo sapiens
aagauacagacauuc

SEQ ID NO: 2203955 - RNA, 16 nt, Homo sapiens
gggcauccaacugaga

SEQ ID NO: 2203956 - RNA, 19 nt, Homo sapiens
ucccuuaauuuaagucauu

SEQ ID NO: 2203957 - RNA, 17 nt, Homo sapiens
cccaggggcagccacac

SEQ ID NO: 2203958 - RNA, 20 nt, Homo sapiens
agucgccagucacugcugca

SEQ ID NO: 2203959 - RNA, 22 nt, Homo sapiens
auacucccuuucagggccaggg

SEQ ID NO: 2203960 - RNA, 12 nt, Homo sapiens
uuuaguccucac

SEQ ID NO: 2203961 - RNA, 13 nt, Homo sapiens
agauggaggccuc

SEQ ID NO: 2203962 - RNA, 22 nt, Homo sapiens
gucaggccuggccucaucucag

SEQ ID NO: 2203963 - RNA, 15 nt, Homo sapiens
cuggucucaaacucc

SEQ ID NO: 2203964 - RNA, 15 nt, Homo sapiens
agccaggugagcucu

SEQ ID NO: 2203965 - RNA, 19 nt, Homo sapiens
uggcccuugccggggccug

SEQ ID NO: 2203966 - RNA, 12 nt, Homo sapiens
aguaauuuaaca

SEQ ID NO: 2203967 - RNA, 15 nt, Homo sapiens
ucaugcauuguccuc

SEQ ID NO: 2203968 - RNA, 21 nt, Homo sapiens
ccacacuuccuguccagagag

SEQ ID NO: 2203969 - RNA, 18 nt, Homo sapiens
uccucaggaacagaacac

SEQ ID NO: 2203970 - RNA, 13 nt, Homo sapiens
augcuggaaccag

SEQ ID NO: 2203971 - RNA, 13 nt, Homo sapiens
aaacgaaucauug

SEQ ID NO: 2203972 - RNA, 22 nt, Homo sapiens
cugaggaagcacagcagcaucu

SEQ ID NO: 2203973 - RNA, 13 nt, Homo sapiens
aggaaaagccaac

SEQ ID NO: 2203974 - RNA, 13 nt, Homo sapiens
agggaaagccagc

SEQ ID NO: 2203975 - RNA, 19 nt, Homo sapiens
gccucucauagaaauugcc

SEQ ID NO: 2203976 - RNA, 17 nt, Homo sapiens
aauggaauaacuaucuc

SEQ ID NO: 2203977 - RNA, 12 nt, Homo sapiens
uuccgucucccc

SEQ ID NO: 2203978 - RNA, 17 nt, Homo sapiens
ugagaagugcacuuuaa

SEQ ID NO: 2203979 - RNA, 20 nt, Homo sapiens
agucacuaucauagggauaa

SEQ ID NO: 2203980 - RNA, 11 nt, Homo sapiens
uggcaaagaca

SEQ ID NO: 2203981 - RNA, 14 nt, Homo sapiens
gaaaugacuuuuug

SEQ ID NO: 2203982 - RNA, 14 nt, Homo sapiens
agcuugcugucacu

SEQ ID NO: 2203983 - RNA, 20 nt, Homo sapiens
aagaaguugcugcagauucc

SEQ ID NO: 2203984 - RNA, 15 nt, Homo sapiens
uaaaaaccuuccaaa

SEQ ID NO: 2203985 - RNA, 20 nt, Homo sapiens
ugugaguuugccguuugucc

SEQ ID NO: 2203986 - RNA, 15 nt, Homo sapiens
caguuacaugcauac

SEQ ID NO: 2203987 - RNA, 17 nt, Homo sapiens
ccuaaacauaugaauua

SEQ ID NO: 2203988 - RNA, 19 nt, Homo sapiens
gacagucuggaggucccag

SEQ ID NO: 2203989 - RNA, 19 nt, Homo sapiens
ugagauugaauuucacugu

SEQ ID NO: 2203990 - RNA, 13 nt, Homo sapiens
uauauacuacaug

SEQ ID NO: 2203991 - RNA, 13 nt, Homo sapiens
uaauuacuacuag

SEQ ID NO: 2203992 - RNA, 15 nt, Homo sapiens
agauauuugguacca

SEQ ID NO: 2203993 - RNA, 14 nt, Homo sapiens
aagauuaauuucau

SEQ ID NO: 2203994 - RNA, 15 nt, Homo sapiens
guugcuggacuguca

SEQ ID NO: 2203995 - RNA, 15 nt, Homo sapiens
ucuucuacaaccaga

SEQ ID NO: 2203996 - RNA, 18 nt, Homo sapiens
agcugagaauguggaaua

SEQ ID NO: 2203997 - RNA, 16 nt, Homo sapiens
ucaaaucugagccuua

SEQ ID NO: 2203998 - RNA, 12 nt, Homo sapiens
auuuucuuccaa

SEQ ID NO: 2203999 - RNA, 13 nt, Homo sapiens
guucuugugacag

SEQ ID NO: 2204000 - RNA, 22 nt, Homo sapiens
gugucacccugugggugucucc

SEQ ID NO: 2204001 - RNA, 17 nt, Homo sapiens
auaauauauuugcagau

SEQ ID NO: 2204002 - RNA, 14 nt, Homo sapiens
ggcguugugggcag

SEQ ID NO: 2204003 - RNA, 19 nt, Homo sapiens
cccagggcaaagaacacaa

SEQ ID NO: 2204004 - RNA, 15 nt, Homo sapiens
uaaagacaaucacug

SEQ ID NO: 2204005 - RNA, 17 nt, Homo sapiens
cagugugaaacuuacca

SEQ ID NO: 2204006 - RNA, 18 nt, Homo sapiens
aacgauucccccagucau

SEQ ID NO: 2204007 - RNA, 15 nt, Homo sapiens
agacacuauuuaucu

SEQ ID NO: 2204008 - RNA, 12 nt, Homo sapiens
cagcaaacuguc

SEQ ID NO: 2204009 - RNA, 23 nt, Homo sapiens
ggggcaaauagagagucuccaag

SEQ ID NO: 2204010 - RNA, 12 nt, Homo sapiens
ugggaaaccaug

SEQ ID NO: 2204011 - RNA, 16 nt, Homo sapiens
acuuccacugccaucc

SEQ ID NO: 2204012 - RNA, 20 nt, Homo sapiens
ugcccuagaucaacagauca

SEQ ID NO: 2204013 - RNA, 19 nt, Homo sapiens
uuaguucuguauacaguac

SEQ ID NO: 2204014 - RNA, 18 nt, Homo sapiens
uguuaaggcaacauuccu

SEQ ID NO: 2204015 - RNA, 17 nt, Homo sapiens
ugucugccuaugcacug

SEQ ID NO: 2204016 - RNA, 22 nt, Homo sapiens
gaccuaaauuauuuacugcaaa

SEQ ID NO: 2204017 - RNA, 15 nt, Homo sapiens
ccagccacugcagca

SEQ ID NO: 2204018 - RNA, 20 nt, Homo sapiens
cggacuuacaaccuugucag

SEQ ID NO: 2204019 - RNA, 17 nt, Homo sapiens
cagugacuaauuuugcc

SEQ ID NO: 2204020 - RNA, 20 nt, Homo sapiens
aggcugcuagaggugcucau

SEQ ID NO: 2204021 - RNA, 17 nt, Homo sapiens
ucacuuuuuuuuuccaa

SEQ ID NO: 2204022 - RNA, 23 nt, Homo sapiens
auucagagcuauggugcuugcug

SEQ ID NO: 2204023 - RNA, 20 nt, Homo sapiens
gcaaauuaguugguuugugu

SEQ ID NO: 2204024 - RNA, 20 nt, Homo sapiens
ucaaacugcggacacacgca

SEQ ID NO: 2204025 - RNA, 19 nt, Homo sapiens
gacccugggcccaucucuc

SEQ ID NO: 2204026 - RNA, 18 nt, Homo sapiens
cucauaccuggcuugcag

SEQ ID NO: 2204027 - RNA, 16 nt, Homo sapiens
uggauggcacccugga

SEQ ID NO: 2204028 - RNA, 23 nt, Homo sapiens
aucauauaauaaauguacauuaa

SEQ ID NO: 2204029 - RNA, 19 nt, Homo sapiens
aacaacaccagaacugugu

SEQ ID NO: 2204030 - RNA, 12 nt, Homo sapiens
ugcgucuaccca

SEQ ID NO: 2204031 - RNA, 15 nt, Homo sapiens
agauacuugugaaca

SEQ ID NO: 2204032 - RNA, 17 nt, Homo sapiens
augcagauuacacugau

SEQ ID NO: 2204033 - RNA, 22 nt, Homo sapiens
gaaagaauuccugcagcaguua

SEQ ID NO: 2204034 - RNA, 14 nt, Homo sapiens
ggcacuguccaggg

SEQ ID NO: 2204035 - RNA, 13 nt, Homo sapiens
gugacuccaggag

SEQ ID NO: 2204036 - RNA, 14 nt, Homo sapiens
ggaccgaaggugac

SEQ ID NO: 2204037 - RNA, 21 nt, Homo sapiens
aagacaggucuagacuuucuc

SEQ ID NO: 2204038 - RNA, 14 nt, Homo sapiens
uucuugcaugguuu

SEQ ID NO: 2204039 - RNA, 17 nt, Homo sapiens
aaauauuugugauuuac

SEQ ID NO: 2204040 - RNA, 19 nt, Homo sapiens
cuauuguaguaaacuugga

SEQ ID NO: 2204041 - RNA, 22 nt, Homo sapiens
gcuuuaaacucagggacagagc

SEQ ID NO: 2204042 - RNA, 22 nt, Homo sapiens
gcaggugcuccucgagagugag

SEQ ID NO: 2204043 - RNA, 13 nt, Homo sapiens
uacagcacuuuga

SEQ ID NO: 2204044 - RNA, 20 nt, Homo sapiens
cuucuagggagacaacagcc

SEQ ID NO: 2204045 - RNA, 17 nt, Homo sapiens
aaucugauaccaaagag

SEQ ID NO: 2204046 - RNA, 13 nt, Homo sapiens
cuccgccauucca

SEQ ID NO: 2204047 - RNA, 17 nt, Homo sapiens
cgcacaugacauagcac

SEQ ID NO: 2204048 - RNA, 14 nt, Homo sapiens
cucagcucaccuca

SEQ ID NO: 2204049 - RNA, 16 nt, Homo sapiens
cagagcaagacccauc

SEQ ID NO: 2204050 - RNA, 23 nt, Homo sapiens
cacagcuaacauggaaguacuau

SEQ ID NO: 2204051 - RNA, 19 nt, Homo sapiens
ccauaucccuuccucucag

SEQ ID NO: 2204052 - RNA, 15 nt, Homo sapiens
gaugaaugucaguug

SEQ ID NO: 2204053 - RNA, 15 nt, Homo sapiens
cccauuucacccaug

SEQ ID NO: 2204054 - RNA, 14 nt, Homo sapiens
ucagaucugucuga

SEQ ID NO: 2204055 - RNA, 18 nt, Homo sapiens
aaauuauaguagcuuaua

SEQ ID NO: 2204056 - RNA, 15 nt, Homo sapiens
ucccuuugcugcuga

SEQ ID NO: 2204057 - RNA, 16 nt, Homo sapiens
agugcugaacuggcug

SEQ ID NO: 2204058 - RNA, 21 nt, Homo sapiens
uauugcuugggucucucucca

SEQ ID NO: 2204059 - RNA, 22 nt, Homo sapiens
uggccaagaagcaguggccuua

SEQ ID NO: 2204060 - RNA, 21 nt, Homo sapiens
aaaugggaauuuaauugucau

SEQ ID NO: 2204061 - RNA, 17 nt, Homo sapiens
ucaaguuccagugcaga

SEQ ID NO: 2204062 - RNA, 23 nt, Homo sapiens
aggaugguagaaguuuggcugcu

SEQ ID NO: 2204063 - RNA, 15 nt, Homo sapiens
uagaggaaagaaaga

SEQ ID NO: 2204064 - RNA, 21 nt, Homo sapiens
uacacagaaaagggagcuaaa

SEQ ID NO: 2204065 - RNA, 19 nt, Homo sapiens
gggccagaggaacugucca

SEQ ID NO: 2204066 - RNA, 14 nt, Homo sapiens
aaugcacauuuuau

SEQ ID NO: 2204067 - RNA, 14 nt, Homo sapiens
aaaguguacaugaa

SEQ ID NO: 2204068 - RNA, 22 nt, Homo sapiens
acuaguguguguguguauauau

SEQ ID NO: 2204069 - RNA, 23 nt, Homo sapiens
gugcaaaagcagaaaauacagcu

SEQ ID NO: 2204070 - RNA, 18 nt, Homo sapiens
caccuggucgccaaucca

SEQ ID NO: 2204071 - RNA, 21 nt, Homo sapiens
gcacaagcaccucuccuguga

SEQ ID NO: 2204072 - RNA, 17 nt, Homo sapiens
uguuacagaagcugaaa

SEQ ID NO: 2204073 - RNA, 19 nt, Homo sapiens
ugaagggggauaugaaugg

SEQ ID NO: 2204074 - RNA, 18 nt, Homo sapiens
cuuuucauaaccuagccu

SEQ ID NO: 2204075 - RNA, 12 nt, Homo sapiens
aacacauuguga

SEQ ID NO: 2204076 - RNA, 17 nt, Homo sapiens
aguuccacgaaacacug

SEQ ID NO: 2204077 - RNA, 13 nt, Homo sapiens
ggaacagacucga

SEQ ID NO: 2204078 - RNA, 13 nt, Homo sapiens
uauguuugcacuu

SEQ ID NO: 2204079 - RNA, 16 nt, Homo sapiens
gccagaauucuacccu

SEQ ID NO: 2204080 - RNA, 16 nt, Homo sapiens
gugauuagaagcuaaa

SEQ ID NO: 2204081 - RNA, 23 nt, Homo sapiens
ucugcuuacugacuuaggcaaua

SEQ ID NO: 2204082 - RNA, 21 nt, Homo sapiens
agagacaauaaaacauuccug

SEQ ID NO: 2204083 - RNA, 18 nt, Homo sapiens
uuaucaauuaaugacaau

SEQ ID NO: 2204084 - RNA, 22 nt, Homo sapiens
agccccucucuuauaauuccag

SEQ ID NO: 2204085 - RNA, 13 nt, Homo sapiens
acauggugugagu

SEQ ID NO: 2204086 - RNA, 15 nt, Homo sapiens
gacuuaaaaucuaau

SEQ ID NO: 2204087 - RNA, 16 nt, Homo sapiens
caauuaauauuacuca

SEQ ID NO: 2204088 - RNA, 14 nt, Homo sapiens
guuuaugcuaccua

SEQ ID NO: 2204089 - RNA, 19 nt, Homo sapiens
ugagcagcauccaccccac

SEQ ID NO: 2204090 - RNA, 16 nt, Homo sapiens
cacccagugcugccau

SEQ ID NO: 2204091 - RNA, 16 nt, Homo sapiens
cacaagacugcacauc

SEQ ID NO: 2204092 - RNA, 16 nt, Homo sapiens
uuuggauugggguccc

SEQ ID NO: 2204093 - RNA, 12 nt, Homo sapiens
ugcuacccagua

SEQ ID NO: 2204094 - RNA, 20 nt, Homo sapiens
guaaucccagcuacauggga

SEQ ID NO: 2204095 - RNA, 22 nt, Homo sapiens
cauguggcuaaaugccuaauaa

SEQ ID NO: 2204096 - RNA, 22 nt, Homo sapiens
auucuggcaucuuagaccucca

SEQ ID NO: 2204097 - RNA, 17 nt, Homo sapiens
caacacgccuaaaacuc

SEQ ID NO: 2204098 - RNA, 13 nt, Homo sapiens
agcuaacagugaa

SEQ ID NO: 2204099 - RNA, 13 nt, Homo sapiens
aggauacagucuu

SEQ ID NO: 2204100 - RNA, 13 nt, Homo sapiens
ggaugucugccac

SEQ ID NO: 2204101 - RNA, 13 nt, Homo sapiens
uaaagcacauggu

SEQ ID NO: 2204102 - RNA, 16 nt, Homo sapiens
aaacacacucaaaaga

SEQ ID NO: 2204103 - RNA, 15 nt, Homo sapiens
ucgaggagugccgug

SEQ ID NO: 2204104 - RNA, 14 nt, Homo sapiens
auccuccugcaaga

SEQ ID NO: 2204105 - RNA, 14 nt, Homo sapiens
gugaacguguucaa

SEQ ID NO: 2204106 - RNA, 16 nt, Homo sapiens
ggagaaaauaacaaga

SEQ ID NO: 2204107 - RNA, 16 nt, Homo sapiens
auugaguuuaacaaua

SEQ ID NO: 2204108 - RNA, 18 nt, Homo sapiens
agggcaagggaggggugg

SEQ ID NO: 2204109 - RNA, 15 nt, Homo sapiens
gccgccuuaagcuga

SEQ ID NO: 2204110 - RNA, 20 nt, Homo sapiens
aaauuaacaugauaaaagac

SEQ ID NO: 2204111 - RNA, 16 nt, Homo sapiens
uuauauauucuuacaa

SEQ ID NO: 2204112 - RNA, 15 nt, Homo sapiens
aacauguccuaauuc

SEQ ID NO: 2204113 - RNA, 11 nt, Homo sapiens
uugaagccuuu

SEQ ID NO: 2204114 - RNA, 20 nt, Homo sapiens
gacuggcuacagaguaacaa

SEQ ID NO: 2204115 - RNA, 19 nt, Homo sapiens
gccucacuugauucaucuc

SEQ ID NO: 2204116 - RNA, 22 nt, Homo sapiens
uucugaacacaauaaacuauuu

SEQ ID NO: 2204117 - RNA, 22 nt, Homo sapiens
acaguaacugccauuuuuuguc

SEQ ID NO: 2204118 - RNA, 17 nt, Homo sapiens
aggcgagagggcugugg

SEQ ID NO: 2204119 - RNA, 17 nt, Homo sapiens
aagaugcccucaacuca

SEQ ID NO: 2204120 - RNA, 17 nt, Homo sapiens
auuuugggaaguugcau

SEQ ID NO: 2204121 - RNA, 23 nt, Homo sapiens
aaaauuuaacuccauauguguuc

SEQ ID NO: 2204122 - RNA, 17 nt, Homo sapiens
uucauucacaguuugau

SEQ ID NO: 2204123 - RNA, 22 nt, Homo sapiens
uauauaugcuuggcuaacuaua

SEQ ID NO: 2204124 - RNA, 12 nt, Homo sapiens
cgcuaugugcac

SEQ ID NO: 2204125 - RNA, 17 nt, Homo sapiens
aucuccugcgcccuuca

SEQ ID NO: 2204126 - RNA, 18 nt, Homo sapiens
acuuccaucugugccaua

SEQ ID NO: 2204127 - RNA, 16 nt, Homo sapiens
uaaaauauaggcuuua

SEQ ID NO: 2204128 - RNA, 17 nt, Homo sapiens
gucucuacccaguagau

SEQ ID NO: 2204129 - RNA, 21 nt, Homo sapiens
ccggcgggacccccauguccu

SEQ ID NO: 2204130 - RNA, 17 nt, Homo sapiens
aaugauucauguuauau

SEQ ID NO: 2204131 - RNA, 23 nt, Homo sapiens
ccugacaacacucauugaccuga

SEQ ID NO: 2204132 - RNA, 16 nt, Homo sapiens
agcagaugguccucca

SEQ ID NO: 2204133 - RNA, 22 nt, Homo sapiens
uugucucucuaaacccaaauaa

SEQ ID NO: 2204134 - RNA, 19 nt, Homo sapiens
acuuccuauaugcacuuau

SEQ ID NO: 2204135 - RNA, 16 nt, Homo sapiens
agugccuuuuuccuua

SEQ ID NO: 2204136 - RNA, 18 nt, Homo sapiens
uauauuugggccugcucc

SEQ ID NO: 2204137 - RNA, 14 nt, Homo sapiens
ccucacuaccagaa

SEQ ID NO: 2204138 - RNA, 20 nt, Homo sapiens
agcucagggcccugugccag

SEQ ID NO: 2204139 - RNA, 19 nt, Homo sapiens
gcuuucagugccugcuguu

SEQ ID NO: 2204140 - RNA, 15 nt, Homo sapiens
aaacaaccaugucau

SEQ ID NO: 2204141 - RNA, 19 nt, Homo sapiens
cuggccccuguggggaaca

SEQ ID NO: 2204142 - RNA, 16 nt, Homo sapiens
acugggcaacacugca

SEQ ID NO: 2204143 - RNA, 17 nt, Homo sapiens
gcgcccagcuauacugu

SEQ ID NO: 2204144 - RNA, 15 nt, Homo sapiens
gagcaguaucagcau

SEQ ID NO: 2204145 - RNA, 20 nt, Homo sapiens
ccuacacgagauacagaauu

SEQ ID NO: 2204146 - RNA, 22 nt, Homo sapiens
aaugaguguguuggcuugugau

SEQ ID NO: 2204147 - RNA, 19 nt, Homo sapiens
agaaagaaugcauuccaga

SEQ ID NO: 2204148 - RNA, 16 nt, Homo sapiens
acggcaucaaggugcu

SEQ ID NO: 2204149 - RNA, 17 nt, Homo sapiens
uacacucuagugccaua

SEQ ID NO: 2204150 - RNA, 16 nt, Homo sapiens
uaccagcaacuugaac

SEQ ID NO: 2204151 - RNA, 14 nt, Homo sapiens
ccaaaaggcccuuu

SEQ ID NO: 2204152 - RNA, 19 nt, Homo sapiens
ucuccuaaugaugacuuga

SEQ ID NO: 2204153 - RNA, 22 nt, Homo sapiens
uccauaaagacaaucacugcca

SEQ ID NO: 2204154 - RNA, 19 nt, Homo sapiens
acccagaaacaacacaauc

SEQ ID NO: 2204155 - RNA, 17 nt, Homo sapiens
cuauuugaacaugugcc

SEQ ID NO: 2204156 - RNA, 14 nt, Homo sapiens
gagacaacagguaa

SEQ ID NO: 2204157 - RNA, 23 nt, Homo sapiens
caguagagcaaaucuaugagauu

SEQ ID NO: 2204158 - RNA, 21 nt, Homo sapiens
cuucucacccuaugugggugg

SEQ ID NO: 2204159 - RNA, 16 nt, Homo sapiens
ugcauccucacugugg

SEQ ID NO: 2204160 - RNA, 15 nt, Homo sapiens
auggacucaguuuuc

SEQ ID NO: 2204161 - RNA, 20 nt, Homo sapiens
cuggauuuguuucugugauc

SEQ ID NO: 2204162 - RNA, 20 nt, Homo sapiens
agccacaucuugcucugcau

SEQ ID NO: 2204163 - RNA, 11 nt, Homo sapiens
gaacuugccug

SEQ ID NO: 2204164 - RNA, 13 nt, Homo sapiens
uucuguguacuuu

SEQ ID NO: 2204165 - RNA, 15 nt, Homo sapiens
uguagucaggugcuc

SEQ ID NO: 2204166 - RNA, 14 nt, Homo sapiens
ucugucuuguaaua

SEQ ID NO: 2204167 - RNA, 22 nt, Homo sapiens
uaccucaguucccucuugcuca

SEQ ID NO: 2204168 - RNA, 22 nt, Homo sapiens
aauguuucuguccuuucuguga

SEQ ID NO: 2204169 - RNA, 22 nt, Homo sapiens
cgucugugacuuaucuaccauu

SEQ ID NO: 2204170 - RNA, 19 nt, Homo sapiens
cuacagggacacuaucacu

SEQ ID NO: 2204171 - RNA, 16 nt, Homo sapiens
uguucucugaggacac

SEQ ID NO: 2204172 - RNA, 18 nt, Homo sapiens
uuaagcuccagacauaca

SEQ ID NO: 2204173 - RNA, 13 nt, Homo sapiens
cguggauugugaa

SEQ ID NO: 2204174 - RNA, 21 nt, Homo sapiens
ucucuaggccuucaggacucu

SEQ ID NO: 2204175 - RNA, 15 nt, Homo sapiens
cauguuucacuccug

SEQ ID NO: 2204176 - RNA, 13 nt, Homo sapiens
ucaguuauuugca

SEQ ID NO: 2204177 - RNA, 22 nt, Homo sapiens
acagagggaaacacagcagcuu

SEQ ID NO: 2204178 - RNA, 13 nt, Homo sapiens
uguccacucagua

SEQ ID NO: 2204179 - RNA, 20 nt, Homo sapiens
auuuagcuccaaaccuucac

SEQ ID NO: 2204180 - RNA, 12 nt, Homo sapiens
caaaacauacaa

SEQ ID NO: 2204181 - RNA, 14 nt, Homo sapiens
auaagaaacacaaa

SEQ ID NO: 2204182 - RNA, 14 nt, Homo sapiens
aaggugauuuuccu

SEQ ID NO: 2204183 - RNA, 17 nt, Homo sapiens
cauuuuauuaagcuuuu

SEQ ID NO: 2204184 - RNA, 14 nt, Homo sapiens
cccguuagucucug

SEQ ID NO: 2204185 - RNA, 16 nt, Homo sapiens
ucguacauagucuguu

SEQ ID NO: 2204186 - RNA, 17 nt, Homo sapiens
augaguaaaaacuagaa

SEQ ID NO: 2204187 - RNA, 17 nt, Homo sapiens
agccagcaguuguaaaa

SEQ ID NO: 2204188 - RNA, 16 nt, Homo sapiens
ugugguguuacuguag

SEQ ID NO: 2204189 - RNA, 10 nt, Homo sapiens
aguacagggg

SEQ ID NO: 2204190 - RNA, 23 nt, Homo sapiens
gcacaaaagucucaauguuccau

SEQ ID NO: 2204191 - RNA, 19 nt, Homo sapiens
guaccaucuacaucuccuu

SEQ ID NO: 2204192 - RNA, 22 nt, Homo sapiens
gccugacuuggggagauggagu

SEQ ID NO: 2204193 - RNA, 18 nt, Homo sapiens
agccauguauuucaggga

SEQ ID NO: 2204194 - RNA, 14 nt, Homo sapiens
gaugccugcagugc

SEQ ID NO: 2204195 - RNA, 18 nt, Homo sapiens
ucauagauaauaguacau

SEQ ID NO: 2204196 - RNA, 16 nt, Homo sapiens
acacuuuauacuugcc

SEQ ID NO: 2204197 - RNA, 17 nt, Homo sapiens
uuguaaauagcucaggu

SEQ ID NO: 2204198 - RNA, 21 nt, Homo sapiens
gcuuuuugggaccaucacuga

SEQ ID NO: 2204199 - RNA, 13 nt, Homo sapiens
acaaauaauagca

SEQ ID NO: 2204200 - RNA, 15 nt, Homo sapiens
agaaucgcuuuccuu

SEQ ID NO: 2204201 - RNA, 15 nt, Homo sapiens
cucucgggagcccua

SEQ ID NO: 2204202 - RNA, 17 nt, Homo sapiens
uggucuucgcagccuag

SEQ ID NO: 2204203 - RNA, 19 nt, Homo sapiens
ugaaugcaccauggucaaa

SEQ ID NO: 2204204 - RNA, 17 nt, Homo sapiens
agcaggcuugugcuuua

SEQ ID NO: 2204205 - RNA, 14 nt, Homo sapiens
gacuaguuuacaaa

SEQ ID NO: 2204206 - RNA, 14 nt, Homo sapiens
ucauaguugcaaaa

SEQ ID NO: 2204207 - RNA, 14 nt, Homo sapiens
acacaccugaauaa

SEQ ID NO: 2204208 - RNA, 21 nt, Homo sapiens
cuugaauaaauuugcccaaaa

SEQ ID NO: 2204209 - RNA, 16 nt, Homo sapiens
agccauagagccugaa

SEQ ID NO: 2204210 - RNA, 16 nt, Homo sapiens
ugggugggugggauga

SEQ ID NO: 2204211 - RNA, 14 nt, Homo sapiens
agccaaccuggacu

SEQ ID NO: 2204212 - RNA, 19 nt, Homo sapiens
gucugugucagcgggugca

SEQ ID NO: 2204213 - RNA, 18 nt, Homo sapiens
cagaaguauuuucuaguu

SEQ ID NO: 2204214 - RNA, 18 nt, Homo sapiens
gagucugucucugucaug

SEQ ID NO: 2204215 - RNA, 23 nt, Homo sapiens
agauauugcgccugugugcgugu

SEQ ID NO: 2204216 - RNA, 14 nt, Homo sapiens
ucagugcuccugua

SEQ ID NO: 2204217 - RNA, 14 nt, Homo sapiens
guauugacaacagu

SEQ ID NO: 2204218 - RNA, 19 nt, Homo sapiens
cuuggcccgcggccugcac

SEQ ID NO: 2204219 - RNA, 19 nt, Homo sapiens
ugugaguaagagcuggugu

SEQ ID NO: 2204220 - RNA, 23 nt, Homo sapiens
ugcaugaauuccacuccuuccag

SEQ ID NO: 2204221 - RNA, 15 nt, Homo sapiens
gaguggacgucagaa

SEQ ID NO: 2204222 - RNA, 20 nt, Homo sapiens
uaaaaaagaguuuagucguc

SEQ ID NO: 2204223 - RNA, 13 nt, Homo sapiens
aauuaaagcacac

SEQ ID NO: 2204224 - RNA, 18 nt, Homo sapiens
gcuuggggcaacagauug

SEQ ID NO: 2204225 - RNA, 12 nt, Homo sapiens
gccucacauucc

SEQ ID NO: 2204226 - RNA, 16 nt, Homo sapiens
ggaguagccauucuau

SEQ ID NO: 2204227 - RNA, 20 nt, Homo sapiens
aguguuccccuuccacugag

SEQ ID NO: 2204228 - RNA, 23 nt, Homo sapiens
gcuucuauaagugugaccaguuu

SEQ ID NO: 2204229 - RNA, 21 nt, Homo sapiens
gugcagggcucagggggcccg

SEQ ID NO: 2204230 - RNA, 18 nt, Homo sapiens
auuguagaaacucagcag

SEQ ID NO: 2204231 - RNA, 20 nt, Homo sapiens
aucuccccuggggagccuga

SEQ ID NO: 2204232 - RNA, 14 nt, Homo sapiens
cauuaagagugaau

SEQ ID NO: 2204233 - RNA, 18 nt, Homo sapiens
aaaauguguccuaucuau

SEQ ID NO: 2204234 - RNA, 17 nt, Homo sapiens
aguuccccugucugucc

SEQ ID NO: 2204235 - RNA, 23 nt, Homo sapiens
ccagcucaggacagaugccacac

SEQ ID NO: 2204236 - RNA, 16 nt, Homo sapiens
agagucgcugugccac

SEQ ID NO: 2204237 - RNA, 16 nt, Homo sapiens
acuaucaacacugcag

SEQ ID NO: 2204238 - RNA, 23 nt, Homo sapiens
ccugauggaaguuaacccggagc

SEQ ID NO: 2204239 - RNA, 18 nt, Homo sapiens
uuucuauuguuaaacaaa

SEQ ID NO: 2204240 - RNA, 10 nt, Homo sapiens
cuccaucucu

SEQ ID NO: 2204241 - RNA, 17 nt, Homo sapiens
ugcgccccgccugaccu

SEQ ID NO: 2204242 - RNA, 13 nt, Homo sapiens
uggcugucccugu

SEQ ID NO: 2204243 - RNA, 14 nt, Homo sapiens
gccaagcuguguuc

SEQ ID NO: 2204244 - RNA, 21 nt, Homo sapiens
auccuggcuggagaaugugga

SEQ ID NO: 2204245 - RNA, 18 nt, Homo sapiens
cacaguaauuauguucua

SEQ ID NO: 2204246 - RNA, 15 nt, Homo sapiens
cgcccuguguccaca

SEQ ID NO: 2204247 - RNA, 23 nt, Homo sapiens
gaaacucuauggguaucaaacag

SEQ ID NO: 2204248 - RNA, 19 nt, Homo sapiens
uacuucuacauccaaugua

SEQ ID NO: 2204249 - RNA, 16 nt, Homo sapiens
auucaaauugcugcuu

SEQ ID NO: 2204250 - RNA, 16 nt, Homo sapiens
cauauuucauauucau

SEQ ID NO: 2204251 - RNA, 16 nt, Homo sapiens
cuuagagcucucauga

SEQ ID NO: 2204252 - RNA, 22 nt, Homo sapiens
caguuuaagaaguggugacauu

SEQ ID NO: 2204253 - RNA, 14 nt, Homo sapiens
cuagaaguggcaga

SEQ ID NO: 2204254 - RNA, 20 nt, Homo sapiens
caagucuuuacagaaucaaa

SEQ ID NO: 2204255 - RNA, 13 nt, Homo sapiens
uauuucccuugcc

SEQ ID NO: 2204256 - RNA, 11 nt, Homo sapiens
ggcuucacagc

SEQ ID NO: 2204257 - RNA, 18 nt, Homo sapiens
uaccuuguuuugccaugu

SEQ ID NO: 2204258 - RNA, 15 nt, Homo sapiens
acugaacaugcucau

SEQ ID NO: 2204259 - RNA, 20 nt, Homo sapiens
acuuuuuuugguauaauguu

SEQ ID NO: 2204260 - RNA, 21 nt, Homo sapiens
aguguucauuuuagugacugu

SEQ ID NO: 2204261 - RNA, 22 nt, Homo sapiens
aauuguaaguaccccugauaag

SEQ ID NO: 2204262 - RNA, 12 nt, Homo sapiens
cauuuacugugg

SEQ ID NO: 2204263 - RNA, 14 nt, Homo sapiens
aguuuuaguucugu

SEQ ID NO: 2204264 - RNA, 16 nt, Homo sapiens
accagaucauugugaa

SEQ ID NO: 2204265 - RNA, 18 nt, Homo sapiens
agagaaauaaaacuccuu

SEQ ID NO: 2204266 - RNA, 16 nt, Homo sapiens
caggagcugcucacua

SEQ ID NO: 2204267 - RNA, 20 nt, Homo sapiens
cuaaagcaguguuugcucca

SEQ ID NO: 2204268 - RNA, 21 nt, Homo sapiens
caugaugcgggccagugcucc

SEQ ID NO: 2204269 - RNA, 20 nt, Homo sapiens
guacaaauaauauugccuug

SEQ ID NO: 2204270 - RNA, 13 nt, Homo sapiens
gugggguggcacc

SEQ ID NO: 2204271 - RNA, 21 nt, Homo sapiens
cccaguaaaaucaaaugugca

SEQ ID NO: 2204272 - RNA, 16 nt, Homo sapiens
ucacauaaaugcagcc

SEQ ID NO: 2204273 - RNA, 22 nt, Homo sapiens
caggguggaggaaggugacugu

SEQ ID NO: 2204274 - RNA, 21 nt, Homo sapiens
gaaucauacuuaacauuucau

SEQ ID NO: 2204275 - RNA, 18 nt, Homo sapiens
gccuuuucugugccagac

SEQ ID NO: 2204276 - RNA, 16 nt, Homo sapiens
uaguucagugaccugu

SEQ ID NO: 2204277 - RNA, 17 nt, Homo sapiens
cagcccuuggccagaag

SEQ ID NO: 2204278 - RNA, 11 nt, Homo sapiens
uggacugggag

SEQ ID NO: 2204279 - RNA, 14 nt, Homo sapiens
agagagcacaguga

SEQ ID NO: 2204280 - RNA, 16 nt, Homo sapiens
uggagcccgugcagua

SEQ ID NO: 2204281 - RNA, 18 nt, Homo sapiens
auccaaucuuguuuccaa

SEQ ID NO: 2204282 - RNA, 22 nt, Homo sapiens
aucaaauugcuacauaguccaa

SEQ ID NO: 2204283 - RNA, 23 nt, Homo sapiens
gucucgugguaggacuguagaaa

SEQ ID NO: 2204284 - RNA, 18 nt, Homo sapiens
aagcuuuggaagcagcaa

SEQ ID NO: 2204285 - RNA, 19 nt, Homo sapiens
gaguucgaggcugcaguca

SEQ ID NO: 2204286 - RNA, 20 nt, Homo sapiens
agggggguugugaggccugg

SEQ ID NO: 2204287 - RNA, 17 nt, Homo sapiens
cagggcugcgucugcaa

SEQ ID NO: 2204288 - RNA, 17 nt, Homo sapiens
ugggggaacaaugagca

SEQ ID NO: 2204289 - RNA, 13 nt, Homo sapiens
gaauaauccagaa

SEQ ID NO: 2204290 - RNA, 23 nt, Homo sapiens
cuuguucuuagagcagauucuag

SEQ ID NO: 2204291 - RNA, 12 nt, Homo sapiens
gcuuccuaacug

SEQ ID NO: 2204292 - RNA, 16 nt, Homo sapiens
agaauuagauuucuau

SEQ ID NO: 2204293 - RNA, 19 nt, Homo sapiens
ggggaaguaaaacagucau

SEQ ID NO: 2204294 - RNA, 20 nt, Homo sapiens
agcuaaaauaagcucaguga

SEQ ID NO: 2204295 - RNA, 21 nt, Homo sapiens
aaugcuauggaaauacauuua

SEQ ID NO: 2204296 - RNA, 16 nt, Homo sapiens
agcuuccccaguagcu

SEQ ID NO: 2204297 - RNA, 16 nt, Homo sapiens
ccaguguuagugggaa

SEQ ID NO: 2204298 - RNA, 18 nt, Homo sapiens
aggccaguaccacacuca

SEQ ID NO: 2204299 - RNA, 18 nt, Homo sapiens
caucaugccaacuuguga

SEQ ID NO: 2204300 - RNA, 22 nt, Homo sapiens
ucagccuuucuaaaaguugcau

SEQ ID NO: 2204301 - RNA, 14 nt, Homo sapiens
ccccugcaaaaaga

SEQ ID NO: 2204302 - RNA, 13 nt, Homo sapiens
acauuaguguucu

SEQ ID NO: 2204303 - RNA, 18 nt, Homo sapiens
aagacaugcuuacuuuuu

SEQ ID NO: 2204304 - RNA, 18 nt, Homo sapiens
aagaaucuaaaccuuaca

SEQ ID NO: 2204305 - RNA, 19 nt, Homo sapiens
uuacugugcugaaagucag

SEQ ID NO: 2204306 - RNA, 17 nt, Homo sapiens
gugcauuucagcuugaa

SEQ ID NO: 2204307 - RNA, 14 nt, Homo sapiens
aaauacuugcucca

SEQ ID NO: 2204308 - RNA, 18 nt, Homo sapiens
aaaugugguugcuuaauu

SEQ ID NO: 2204309 - RNA, 11 nt, Homo sapiens
aggcauucucu

SEQ ID NO: 2204310 - RNA, 21 nt, Homo sapiens
ugaauuccacuccuuccagaa

SEQ ID NO: 2204311 - RNA, 20 nt, Homo sapiens
uucgaugccugcaugcugaa

SEQ ID NO: 2204312 - RNA, 15 nt, Homo sapiens
auguacuauguguua

SEQ ID NO: 2204313 - RNA, 17 nt, Homo sapiens
uagcugggacuacaggc

SEQ ID NO: 2204314 - RNA, 13 nt, Homo sapiens
acaucaacugcau

SEQ ID NO: 2204315 - RNA, 20 nt, Homo sapiens
uuaaauagaugacauugacu

SEQ ID NO: 2204316 - RNA, 15 nt, Homo sapiens
agccugcuucuuccc

SEQ ID NO: 2204317 - RNA, 16 nt, Homo sapiens
accuuucuagccuuag

SEQ ID NO: 2204318 - RNA, 16 nt, Homo sapiens
guuuggaugaaaaaag

SEQ ID NO: 2204319 - RNA, 23 nt, Homo sapiens
caaacucaguucgaccaaacuca

SEQ ID NO: 2204320 - RNA, 17 nt, Homo sapiens
caaccaagcgcauccaa

SEQ ID NO: 2204321 - RNA, 22 nt, Homo sapiens
uuuguccaucagauucugugag

SEQ ID NO: 2204322 - RNA, 12 nt, Homo sapiens
agagcagcagca

SEQ ID NO: 2204323 - RNA, 21 nt, Homo sapiens
cauacagcuguccacacugaa

SEQ ID NO: 2204324 - RNA, 15 nt, Homo sapiens
agugcuuuccaauuc

SEQ ID NO: 2204325 - RNA, 23 nt, Homo sapiens
ucaugcccugccuugucccucuc

SEQ ID NO: 2204326 - RNA, 16 nt, Homo sapiens
cugauuggugauucaa

SEQ ID NO: 2204327 - RNA, 15 nt, Homo sapiens
gcuggggugucaaua

SEQ ID NO: 2204328 - RNA, 18 nt, Homo sapiens
auuaaaccucuuucccca

SEQ ID NO: 2204329 - RNA, 20 nt, Homo sapiens
ugcucugaauguccugacac

SEQ ID NO: 2204330 - RNA, 17 nt, Homo sapiens
uaacugccuuguguaca

SEQ ID NO: 2204331 - RNA, 17 nt, Homo sapiens
acaggacauuugacaug

SEQ ID NO: 2204332 - RNA, 14 nt, Homo sapiens
aacucugacaaggg

SEQ ID NO: 2204333 - RNA, 22 nt, Homo sapiens
aucagccauaagaaagcacuau

SEQ ID NO: 2204334 - RNA, 13 nt, Homo sapiens
uucugaguagcau

SEQ ID NO: 2204335 - RNA, 13 nt, Homo sapiens
aucugaguugcau

SEQ ID NO: 2204336 - RNA, 17 nt, Homo sapiens
auuguauuuaagacaua

SEQ ID NO: 2204337 - RNA, 18 nt, Homo sapiens
aagaaugagccuguccaa

SEQ ID NO: 2204338 - RNA, 13 nt, Homo sapiens
agaaucuaaugaa

SEQ ID NO: 2204339 - RNA, 17 nt, Homo sapiens
auuuacaguuacugccu

SEQ ID NO: 2204340 - RNA, 20 nt, Homo sapiens
aaagaugcauuuucacugca

SEQ ID NO: 2204341 - RNA, 15 nt, Homo sapiens
ucuacuacuuggaag

SEQ ID NO: 2204342 - RNA, 20 nt, Homo sapiens
ugggugaauaauacaguauc

SEQ ID NO: 2204343 - RNA, 16 nt, Homo sapiens
gcuuccagaaaacccc

SEQ ID NO: 2204344 - RNA, 16 nt, Homo sapiens
ggcuccaaaucugccu

SEQ ID NO: 2204345 - RNA, 22 nt, Homo sapiens
uucuaggcaaaauugugaagcu

SEQ ID NO: 2204346 - RNA, 12 nt, Homo sapiens
ccaccaugcccu

SEQ ID NO: 2204347 - RNA, 18 nt, Homo sapiens
ugccuuucucucuuucuc

SEQ ID NO: 2204348 - RNA, 21 nt, Homo sapiens
gcuuguucuuccucuuaccug

SEQ ID NO: 2204349 - RNA, 22 nt, Homo sapiens
cucacacaaauuaaaauacagc

SEQ ID NO: 2204350 - RNA, 15 nt, Homo sapiens
aguccucacaugccc

SEQ ID NO: 2204351 - RNA, 19 nt, Homo sapiens
guaaauccugccauuuaaa

SEQ ID NO: 2204352 - RNA, 19 nt, Homo sapiens
uuaauccuuuguauuacaa

SEQ ID NO: 2204353 - RNA, 14 nt, Homo sapiens
gcacagccuggcag

SEQ ID NO: 2204354 - RNA, 18 nt, Homo sapiens
agccucauggaacaggau

SEQ ID NO: 2204355 - RNA, 15 nt, Homo sapiens
uaggaguugcuccua

SEQ ID NO: 2204356 - RNA, 12 nt, Homo sapiens
ucauccaggcau

SEQ ID NO: 2204357 - RNA, 15 nt, Homo sapiens
gcaguggagccugaa

SEQ ID NO: 2204358 - RNA, 15 nt, Homo sapiens
ccuaaaauacaaaca

SEQ ID NO: 2204359 - RNA, 17 nt, Homo sapiens
aagucaguucugugauc

SEQ ID NO: 2204360 - RNA, 16 nt, Homo sapiens
gaugaaggcuugucag

SEQ ID NO: 2204361 - RNA, 15 nt, Homo sapiens
ugaaggaacauuccu

SEQ ID NO: 2204362 - RNA, 18 nt, Homo sapiens
ggccgccagacucgagag

SEQ ID NO: 2204363 - RNA, 18 nt, Homo sapiens
ccuacaucccaucauggc

SEQ ID NO: 2204364 - RNA, 21 nt, Homo sapiens
cuuggcauacaaaauauuuaa

SEQ ID NO: 2204365 - RNA, 19 nt, Homo sapiens
caauaccccuguuaagcaa

SEQ ID NO: 2204366 - RNA, 15 nt, Homo sapiens
ccauaugaauaacau

SEQ ID NO: 2204367 - RNA, 20 nt, Homo sapiens
aagcagaugggaacugaauu

SEQ ID NO: 2204368 - RNA, 17 nt, Homo sapiens
gcauuugaaugcauuuu

SEQ ID NO: 2204369 - RNA, 18 nt, Homo sapiens
ggccucacuaccagaaga

SEQ ID NO: 2204370 - RNA, 16 nt, Homo sapiens
gucaugcuucaucauu

SEQ ID NO: 2204371 - RNA, 13 nt, Homo sapiens
agagaaaacuguu

SEQ ID NO: 2204372 - RNA, 13 nt, Homo sapiens
auaaaagugcuac

SEQ ID NO: 2204373 - RNA, 14 nt, Homo sapiens
aaagauacagggga

SEQ ID NO: 2204374 - RNA, 16 nt, Homo sapiens
aauggagaaaaccaga

SEQ ID NO: 2204375 - RNA, 16 nt, Homo sapiens
ugcuugggagccugug

SEQ ID NO: 2204376 - RNA, 16 nt, Homo sapiens
aguuuggaugucugua

SEQ ID NO: 2204377 - RNA, 15 nt, Homo sapiens
gggcagaucauuuga

SEQ ID NO: 2204378 - RNA, 19 nt, Homo sapiens
uuugcccugaggcucaguc

SEQ ID NO: 2204379 - RNA, 20 nt, Homo sapiens
ugauuucuugugauguauuc

SEQ ID NO: 2204380 - RNA, 19 nt, Homo sapiens
cuacugggugucauuucau

SEQ ID NO: 2204381 - RNA, 22 nt, Homo sapiens
ucccaauauguagccuuuuauc

SEQ ID NO: 2204382 - RNA, 24 nt, Homo sapiens
ggaagagugguuaagacuacugaa

SEQ ID NO: 2204383 - RNA, 16 nt, Homo sapiens
acauuccaauuugcac

SEQ ID NO: 2204384 - RNA, 14 nt, Homo sapiens
uucccgccuuccaa

SEQ ID NO: 2204385 - RNA, 21 nt, Homo sapiens
cagugacuguacaguuaucau

SEQ ID NO: 2204386 - RNA, 13 nt, Homo sapiens
ccaggacagcauu

SEQ ID NO: 2204387 - RNA, 17 nt, Homo sapiens
gguuuggucaguuacaa

SEQ ID NO: 2204388 - RNA, 19 nt, Homo sapiens
accacuggccaccaggcug

SEQ ID NO: 2204389 - RNA, 22 nt, Homo sapiens
uaguuuguaugccaagugagaa

SEQ ID NO: 2204390 - RNA, 19 nt, Homo sapiens
accuguauaacccuguuac

SEQ ID NO: 2204391 - RNA, 21 nt, Homo sapiens
cugccuggaggcaaaggccug

SEQ ID NO: 2204392 - RNA, 18 nt, Homo sapiens
accagcccugaccccagu

SEQ ID NO: 2204393 - RNA, 15 nt, Homo sapiens
acucauccauccagg

SEQ ID NO: 2204394 - RNA, 20 nt, Homo sapiens
guuacaagaaacagccacug

SEQ ID NO: 2204395 - RNA, 21 nt, Homo sapiens
aacaccugauuaacugaggca

SEQ ID NO: 2204396 - RNA, 14 nt, Homo sapiens
cucccggggccccu

SEQ ID NO: 2204397 - RNA, 14 nt, Homo sapiens
cugggugggcgggg

SEQ ID NO: 2204398 - RNA, 13 nt, Homo sapiens
uccccacccaaga

SEQ ID NO: 2204399 - RNA, 20 nt, Homo sapiens
acucaugaaugaaaauacau

SEQ ID NO: 2204400 - RNA, 21 nt, Homo sapiens
uggcccuuggcuuuagccaua

SEQ ID NO: 2204401 - RNA, 18 nt, Homo sapiens
gcccaagguaaacaguuu

SEQ ID NO: 2204402 - RNA, 19 nt, Homo sapiens
cuguaaauauuuuucacau

SEQ ID NO: 2204403 - RNA, 18 nt, Homo sapiens
uaagagaagcuacuuugu

SEQ ID NO: 2204404 - RNA, 14 nt, Homo sapiens
aacauuccuaucaa

SEQ ID NO: 2204405 - RNA, 16 nt, Homo sapiens
agcaaauuuucagcau

SEQ ID NO: 2204406 - RNA, 22 nt, Homo sapiens
auaaggagugccugaauagcuu

SEQ ID NO: 2204407 - RNA, 12 nt, Homo sapiens
aucucagaagau

SEQ ID NO: 2204408 - RNA, 23 nt, Homo sapiens
caaaaccaauucaugaagugaau

SEQ ID NO: 2204409 - RNA, 19 nt, Homo sapiens
aggagaacguuugguacaa

SEQ ID NO: 2204410 - RNA, 23 nt, Homo sapiens
ugaaagggaaggagacacauuca

SEQ ID NO: 2204411 - RNA, 20 nt, Homo sapiens
gaaagaauagaacacaguuu

SEQ ID NO: 2204412 - RNA, 16 nt, Homo sapiens
aggcccaagcugccug

SEQ ID NO: 2204413 - RNA, 12 nt, Homo sapiens
ccccuaaacaaa

SEQ ID NO: 2204414 - RNA, 21 nt, Homo sapiens
aucaaugcaagagugauugca

SEQ ID NO: 2204415 - RNA, 14 nt, Homo sapiens
gccuuccacaguga

SEQ ID NO: 2204416 - RNA, 20 nt, Homo sapiens
acggagggcagucccgggug

SEQ ID NO: 2204417 - RNA, 20 nt, Homo sapiens
uuucuacaaugugaacuuua

SEQ ID NO: 2204418 - RNA, 15 nt, Homo sapiens
aaaagcugcauuuaa

SEQ ID NO: 2204419 - RNA, 20 nt, Homo sapiens
ucucaaagauuugacaugcu

SEQ ID NO: 2204420 - RNA, 15 nt, Homo sapiens
ugacgagcaugagcu

SEQ ID NO: 2204421 - RNA, 14 nt, Homo sapiens
uacaagacacagug

SEQ ID NO: 2204422 - RNA, 12 nt, Homo sapiens
cucuguacgagg

SEQ ID NO: 2204423 - RNA, 17 nt, Homo sapiens
cugggagaaccaaaaag

SEQ ID NO: 2204424 - RNA, 14 nt, Homo sapiens
uggugucaguaucc

SEQ ID NO: 2204425 - RNA, 15 nt, Homo sapiens
cagacuuaacagccc

SEQ ID NO: 2204426 - RNA, 18 nt, Homo sapiens
gcccacccccaccaugca

SEQ ID NO: 2204427 - RNA, 23 nt, Homo sapiens
auuuuugaaaaaaguacauauuu

SEQ ID NO: 2204428 - RNA, 18 nt, Homo sapiens
ugccaacuccaugaccag

SEQ ID NO: 2204429 - RNA, 19 nt, Homo sapiens
caugugaaacucaucucau

SEQ ID NO: 2204430 - RNA, 21 nt, Homo sapiens
aucuucuucauccaacuucca

SEQ ID NO: 2204431 - RNA, 15 nt, Homo sapiens
agacaucaaugaaac

SEQ ID NO: 2204432 - RNA, 15 nt, Homo sapiens
caaguucucaccucu

SEQ ID NO: 2204433 - RNA, 14 nt, Homo sapiens
gagacuuacugggu

SEQ ID NO: 2204434 - RNA, 23 nt, Homo sapiens
auaaaaccuguucucuuuaauca

SEQ ID NO: 2204435 - RNA, 13 nt, Homo sapiens
agacugacugcaa

SEQ ID NO: 2204436 - RNA, 19 nt, Homo sapiens
acucugguuggaaaugcca

SEQ ID NO: 2204437 - RNA, 22 nt, Homo sapiens
ugggaauaauagacacugggga

SEQ ID NO: 2204438 - RNA, 20 nt, Homo sapiens
agcggcuucaagagccagag

SEQ ID NO: 2204439 - RNA, 13 nt, Homo sapiens
auuuuucuaucaa

SEQ ID NO: 2204440 - RNA, 14 nt, Homo sapiens
ugucaugugccuug

SEQ ID NO: 2204441 - RNA, 19 nt, Homo sapiens
gcugcuuuaggaauucugc

SEQ ID NO: 2204442 - RNA, 17 nt, Homo sapiens
caggggcugcauccuca

SEQ ID NO: 2204443 - RNA, 15 nt, Homo sapiens
acucuuaucugggug

SEQ ID NO: 2204444 - RNA, 22 nt, Homo sapiens
ccuggacuagagggaccucucc

SEQ ID NO: 2204445 - RNA, 22 nt, Homo sapiens
ugcagggguuauguggaagugu

SEQ ID NO: 2204446 - RNA, 23 nt, Homo sapiens
aagaagagggucugcauuuuccu

SEQ ID NO: 2204447 - RNA, 19 nt, Homo sapiens
acccaagugccucaccucg

SEQ ID NO: 2204448 - RNA, 14 nt, Homo sapiens
uaugcaaaauggaa

SEQ ID NO: 2204449 - RNA, 12 nt, Homo sapiens
cucuuccaucau

SEQ ID NO: 2204450 - RNA, 17 nt, Homo sapiens
agaccaguacugggaag

SEQ ID NO: 2204451 - RNA, 17 nt, Homo sapiens
augugucaucaggagaa

SEQ ID NO: 2204452 - RNA, 16 nt, Homo sapiens
caucacgucagugcuc

SEQ ID NO: 2204453 - RNA, 19 nt, Homo sapiens
agcaaaggauguguuuuca

SEQ ID NO: 2204454 - RNA, 16 nt, Homo sapiens
caauguuaucaaccaa

SEQ ID NO: 2204455 - RNA, 16 nt, Homo sapiens
cccucaacuauucugu

SEQ ID NO: 2204456 - RNA, 16 nt, Homo sapiens
cccagagccacacaug

SEQ ID NO: 2204457 - RNA, 13 nt, Homo sapiens
acuugacuuugcc

SEQ ID NO: 2204458 - RNA, 20 nt, Homo sapiens
ucaaugugcuuuuaauguac

SEQ ID NO: 2204459 - RNA, 15 nt, Homo sapiens
uuguuguaauugcau

SEQ ID NO: 2204460 - RNA, 13 nt, Homo sapiens
gagccugguccca

SEQ ID NO: 2204461 - RNA, 20 nt, Homo sapiens
auuccugauaauaauugauc

SEQ ID NO: 2204462 - RNA, 14 nt, Homo sapiens
acauuuuaacaaga

SEQ ID NO: 2204463 - RNA, 15 nt, Homo sapiens
aaccaacccauguau

SEQ ID NO: 2204464 - RNA, 14 nt, Homo sapiens
augauaugaccaaa

SEQ ID NO: 2204465 - RNA, 20 nt, Homo sapiens
ggcugucagucguguugcuu

SEQ ID NO: 2204466 - RNA, 19 nt, Homo sapiens
guggacugugcuggugcau

SEQ ID NO: 2204467 - RNA, 19 nt, Homo sapiens
cauggcugaaguuggccac

SEQ ID NO: 2204468 - RNA, 16 nt, Homo sapiens
cuguuagacaaaagug

SEQ ID NO: 2204469 - RNA, 18 nt, Homo sapiens
ccugacucuugcaggggu

SEQ ID NO: 2204470 - RNA, 18 nt, Homo sapiens
augucccugaagugccag

SEQ ID NO: 2204471 - RNA, 18 nt, Homo sapiens
cauguuacugaccagcaa

SEQ ID NO: 2204472 - RNA, 20 nt, Homo sapiens
ccuccucugccuacagccag

SEQ ID NO: 2204473 - RNA, 16 nt, Homo sapiens
ggaauuacaagcccug

SEQ ID NO: 2204474 - RNA, 12 nt, Homo sapiens
auaaagguucau

SEQ ID NO: 2204475 - RNA, 11 nt, Homo sapiens
acacacaaaaa

SEQ ID NO: 2204476 - RNA, 16 nt, Homo sapiens
uggccucaggcauuug

SEQ ID NO: 2204477 - RNA, 15 nt, Homo sapiens
gugucaugccaguga

SEQ ID NO: 2204478 - RNA, 23 nt, Homo sapiens
ccaacugcuguucauguuacuca

SEQ ID NO: 2204479 - RNA, 22 nt, Homo sapiens
auaaagagagcccugguccuag

SEQ ID NO: 2204480 - RNA, 16 nt, Homo sapiens
uguaaaugaaacuuaa

SEQ ID NO: 2204481 - RNA, 18 nt, Homo sapiens
uaugucagagcuguuaua

SEQ ID NO: 2204482 - RNA, 13 nt, Homo sapiens
augaagcaugcua

SEQ ID NO: 2204483 - RNA, 17 nt, Homo sapiens
uggccuugaaaccaccu

SEQ ID NO: 2204484 - RNA, 17 nt, Homo sapiens
agaccaccaagccuuga

SEQ ID NO: 2204485 - RNA, 14 nt, Homo sapiens
aagucgcauuccau

SEQ ID NO: 2204486 - RNA, 12 nt, Homo sapiens
uggugaaugaca

SEQ ID NO: 2204487 - RNA, 14 nt, Homo sapiens
agagaguggaagaa

SEQ ID NO: 2204488 - RNA, 15 nt, Homo sapiens
gacucagacugcaug

SEQ ID NO: 2204489 - RNA, 21 nt, Homo sapiens
uucaaggaacagccacaaaau

SEQ ID NO: 2204490 - RNA, 16 nt, Homo sapiens
gcauuugauuuugccc

SEQ ID NO: 2204491 - RNA, 23 nt, Homo sapiens
auuccuucucccaucucuuccuu

SEQ ID NO: 2204492 - RNA, 20 nt, Homo sapiens
gacacaggaugaaggcaaug

SEQ ID NO: 2204493 - RNA, 13 nt, Homo sapiens
gaaggaaacugaa

SEQ ID NO: 2204494 - RNA, 17 nt, Homo sapiens
uauccaauugcucuuuc

SEQ ID NO: 2204495 - RNA, 17 nt, Homo sapiens
uugucaccucugugacc

SEQ ID NO: 2204496 - RNA, 13 nt, Homo sapiens
auggaacauaaaa

SEQ ID NO: 2204497 - RNA, 17 nt, Homo sapiens
uggcuuccuuguuuaug

SEQ ID NO: 2204498 - RNA, 15 nt, Homo sapiens
aggugacaagcguca

SEQ ID NO: 2204499 - RNA, 18 nt, Homo sapiens
gaggccgaggcgggugga

SEQ ID NO: 2204500 - RNA, 22 nt, Homo sapiens
gaguguuccccuuccacugagg

SEQ ID NO: 2204501 - RNA, 14 nt, Homo sapiens
uccgugcuaugaca

SEQ ID NO: 2204502 - RNA, 17 nt, Homo sapiens
auucgcugugucagcau

SEQ ID NO: 2204503 - RNA, 13 nt, Homo sapiens
gacaacugugacu

SEQ ID NO: 2204504 - RNA, 13 nt, Homo sapiens
uaccucugggaaa

SEQ ID NO: 2204505 - RNA, 14 nt, Homo sapiens
accaaggcgaguuu

SEQ ID NO: 2204506 - RNA, 14 nt, Homo sapiens
ccccagcucuggau

SEQ ID NO: 2204507 - RNA, 21 nt, Homo sapiens
gaaacauuuuguggucauuaa

SEQ ID NO: 2204508 - RNA, 21 nt, Homo sapiens
uucuaacuuuaugaacucccu

SEQ ID NO: 2204509 - RNA, 21 nt, Homo sapiens
auucacauaacuucucugagu

SEQ ID NO: 2204510 - RNA, 16 nt, Homo sapiens
cacauuaggaugguga

SEQ ID NO: 2204511 - RNA, 21 nt, Homo sapiens
cugauccuccaacagcuguca

SEQ ID NO: 2204512 - RNA, 17 nt, Homo sapiens
uguacauauaagugauu

SEQ ID NO: 2204513 - RNA, 17 nt, Homo sapiens
aacuuuagaauucccaa

SEQ ID NO: 2204514 - RNA, 23 nt, Homo sapiens
gacuucacagauuuguccaggcu

SEQ ID NO: 2204515 - RNA, 15 nt, Homo sapiens
cuccagagacaggaa

SEQ ID NO: 2204516 - RNA, 19 nt, Homo sapiens
aacacacauggaugcacac

SEQ ID NO: 2204517 - RNA, 17 nt, Homo sapiens
uggaagcucuucuuccc

SEQ ID NO: 2204518 - RNA, 14 nt, Homo sapiens
gcuucaaucacugu

SEQ ID NO: 2204519 - RNA, 13 nt, Homo sapiens
guaaaugccacac

SEQ ID NO: 2204520 - RNA, 13 nt, Homo sapiens
acugccaaccucg

SEQ ID NO: 2204521 - RNA, 20 nt, Homo sapiens
guggucauuuccuaugcaaa

SEQ ID NO: 2204522 - RNA, 20 nt, Homo sapiens
cagaaaaauugaacuacagc

SEQ ID NO: 2204523 - RNA, 22 nt, Homo sapiens
uuaucacuguuuaaagcuuuga

SEQ ID NO: 2204524 - RNA, 14 nt, Homo sapiens
aaugcauugcuaaa

SEQ ID NO: 2204525 - RNA, 15 nt, Homo sapiens
uauuauuaaucucau

SEQ ID NO: 2204526 - RNA, 18 nt, Homo sapiens
ggucgggcugccagccca

SEQ ID NO: 2204527 - RNA, 15 nt, Homo sapiens
aaaugucuucuccca

SEQ ID NO: 2204528 - RNA, 20 nt, Homo sapiens
auugaauuaauaauaaagcu

SEQ ID NO: 2204529 - RNA, 21 nt, Homo sapiens
cauuuccgugguuucucauga

SEQ ID NO: 2204530 - RNA, 18 nt, Homo sapiens
ggagccccgccacagccu

SEQ ID NO: 2204531 - RNA, 14 nt, Homo sapiens
caauucgaacuuuu

SEQ ID NO: 2204532 - RNA, 20 nt, Homo sapiens
cuggaugggcugcagcagag

SEQ ID NO: 2204533 - RNA, 19 nt, Homo sapiens
ucaucuuggucacauacaa

SEQ ID NO: 2204534 - RNA, 16 nt, Homo sapiens
aagggacguccuccaa

SEQ ID NO: 2204535 - RNA, 14 nt, Homo sapiens
gauguaaaugccac

SEQ ID NO: 2204536 - RNA, 14 nt, Homo sapiens
accacuuaccucaa

SEQ ID NO: 2204537 - RNA, 17 nt, Homo sapiens
acaauuaacugagcaua

SEQ ID NO: 2204538 - RNA, 17 nt, Homo sapiens
caggaguuccagugcug

SEQ ID NO: 2204539 - RNA, 18 nt, Homo sapiens
caaggguuggaggcaaug

SEQ ID NO: 2204540 - RNA, 16 nt, Homo sapiens
uccuucacacaguuca

SEQ ID NO: 2204541 - RNA, 18 nt, Homo sapiens
gcuuauccaugccuggga

SEQ ID NO: 2204542 - RNA, 22 nt, Homo sapiens
acggucacuuuacuguccccau

SEQ ID NO: 2204543 - RNA, 18 nt, Homo sapiens
cuuuuguucccauccucu

SEQ ID NO: 2204544 - RNA, 23 nt, Homo sapiens
acauagauagaaugaaccaauau

SEQ ID NO: 2204545 - RNA, 18 nt, Homo sapiens
agauaccuccaacccugc

SEQ ID NO: 2204546 - RNA, 21 nt, Homo sapiens
ugcauuuuuauuaaagcauuu

SEQ ID NO: 2204547 - RNA, 21 nt, Homo sapiens
ggaacaaaacuccagacucuu

SEQ ID NO: 2204548 - RNA, 17 nt, Homo sapiens
aaacuuacaaacuuugu

SEQ ID NO: 2204549 - RNA, 20 nt, Homo sapiens
ccuagccaggcuaucuggcc

SEQ ID NO: 2204550 - RNA, 17 nt, Homo sapiens
aacagauuuacauccca

SEQ ID NO: 2204551 - RNA, 17 nt, Homo sapiens
gggucaaaggagaacaa

SEQ ID NO: 2204552 - RNA, 17 nt, Homo sapiens
acacugaaucauuaaca

SEQ ID NO: 2204553 - RNA, 15 nt, Homo sapiens
gauaccacugcacug

SEQ ID NO: 2204554 - RNA, 19 nt, Homo sapiens
aaaugggccugccugccuc

SEQ ID NO: 2204555 - RNA, 18 nt, Homo sapiens
uucccgcacaaauuccac

SEQ ID NO: 2204556 - RNA, 15 nt, Homo sapiens
cauccauaauuguga

SEQ ID NO: 2204557 - RNA, 22 nt, Homo sapiens
uuauuaacaguauaauuguguu

SEQ ID NO: 2204558 - RNA, 23 nt, Homo sapiens
uuguaaaacugugacauuccaca

SEQ ID NO: 2204559 - RNA, 16 nt, Homo sapiens
auuuuuuaaugugcuc

SEQ ID NO: 2204560 - RNA, 14 nt, Homo sapiens
ccuaggauguucug

SEQ ID NO: 2204561 - RNA, 15 nt, Homo sapiens
gcauacaguuugcac

SEQ ID NO: 2204562 - RNA, 16 nt, Homo sapiens
ugaggcccacucuguu

SEQ ID NO: 2204563 - RNA, 19 nt, Homo sapiens
gcuggaauucuaacaaguc

SEQ ID NO: 2204564 - RNA, 20 nt, Homo sapiens
augagguacucuccuggaaa

SEQ ID NO: 2204565 - RNA, 16 nt, Homo sapiens
cagguggcagagugaa

SEQ ID NO: 2204566 - RNA, 11 nt, Homo sapiens
ggccagggugg

SEQ ID NO: 2204567 - RNA, 13 nt, Homo sapiens
gucacuucaccau

SEQ ID NO: 2204568 - RNA, 18 nt, Homo sapiens
gagaaaggcauuggccau

SEQ ID NO: 2204569 - RNA, 16 nt, Homo sapiens
ucaaaucuuacaaaau

SEQ ID NO: 2204570 - RNA, 16 nt, Homo sapiens
ucuuuccuuccucuca

SEQ ID NO: 2204571 - RNA, 18 nt, Homo sapiens
auaaaguauauguucuga

SEQ ID NO: 2204572 - RNA, 14 nt, Homo sapiens
cucaggcacacagc

SEQ ID NO: 2204573 - RNA, 14 nt, Homo sapiens
cuaaaccacaaaag

SEQ ID NO: 2204574 - RNA, 18 nt, Homo sapiens
cauauggauccacuggcu

SEQ ID NO: 2204575 - RNA, 18 nt, Homo sapiens
ugaaagaaaaaguacaag

SEQ ID NO: 2204576 - RNA, 18 nt, Homo sapiens
cagagacccccgugccaa

SEQ ID NO: 2204577 - RNA, 16 nt, Homo sapiens
uaucuguuuacaucca

SEQ ID NO: 2204578 - RNA, 14 nt, Homo sapiens
cagauggcauaaau

SEQ ID NO: 2204579 - RNA, 15 nt, Homo sapiens
cgugggauccagaga

SEQ ID NO: 2204580 - RNA, 16 nt, Homo sapiens
cagggacauguggaaa

SEQ ID NO: 2204581 - RNA, 23 nt, Homo sapiens
gcaccugccuccucguuccuuuc

SEQ ID NO: 2204582 - RNA, 15 nt, Homo sapiens
cugcacacaggacag

SEQ ID NO: 2204583 - RNA, 20 nt, Homo sapiens
gucacagaucacagugucuu

SEQ ID NO: 2204584 - RNA, 15 nt, Homo sapiens
cuggaggugagacac

SEQ ID NO: 2204585 - RNA, 19 nt, Homo sapiens
ucaggaaaaaugaggaauc

SEQ ID NO: 2204586 - RNA, 20 nt, Homo sapiens
acugaagcaaauaccaaagc

SEQ ID NO: 2204587 - RNA, 12 nt, Homo sapiens
uaaagacuguag

SEQ ID NO: 2204588 - RNA, 18 nt, Homo sapiens
aucuaaauuuaauuaccu

SEQ ID NO: 2204589 - RNA, 22 nt, Homo sapiens
aaucauuuuaugucaagggcag

SEQ ID NO: 2204590 - RNA, 12 nt, Homo sapiens
ugguaacugcac

SEQ ID NO: 2204591 - RNA, 14 nt, Homo sapiens
agccuggaggacaa

SEQ ID NO: 2204592 - RNA, 18 nt, Homo sapiens
aaaugugaccugugucac

SEQ ID NO: 2204593 - RNA, 21 nt, Homo sapiens
ugggguacccacugcucuggu

SEQ ID NO: 2204594 - RNA, 15 nt, Homo sapiens
cagaucaacugaguu

SEQ ID NO: 2204595 - RNA, 18 nt, Homo sapiens
cacaugcaccuacccaua

SEQ ID NO: 2204596 - RNA, 18 nt, Homo sapiens
acuuccccuucuugccau

SEQ ID NO: 2204597 - RNA, 20 nt, Homo sapiens
gcgugcuugcaugugcugca

SEQ ID NO: 2204598 - RNA, 15 nt, Homo sapiens
gugaacaugaguucc

SEQ ID NO: 2204599 - RNA, 20 nt, Homo sapiens
aagcauuuuauaaaugauau

SEQ ID NO: 2204600 - RNA, 22 nt, Homo sapiens
auuucaugaaaaugacauuaaa

SEQ ID NO: 2204601 - RNA, 21 nt, Homo sapiens
aaaugcccaaaagagguguca

SEQ ID NO: 2204602 - RNA, 20 nt, Homo sapiens
uucucauuucuguagccuga

SEQ ID NO: 2204603 - RNA, 21 nt, Homo sapiens
acaguaauuuccuggucacau

SEQ ID NO: 2204604 - RNA, 21 nt, Homo sapiens
cagauuucagggaagcccuga

SEQ ID NO: 2204605 - RNA, 23 nt, Homo sapiens
cagaauauuaauaaaacuuuaug

SEQ ID NO: 2204606 - RNA, 18 nt, Homo sapiens
cagggagaggcugugucc

SEQ ID NO: 2204607 - RNA, 15 nt, Homo sapiens
cuucccuuaacucca

SEQ ID NO: 2204608 - RNA, 20 nt, Homo sapiens
agcaaauaucauacuguuca

SEQ ID NO: 2204609 - RNA, 12 nt, Homo sapiens
aucaauguuucu

SEQ ID NO: 2204610 - RNA, 17 nt, Homo sapiens
ggugugcaccuguaauc

SEQ ID NO: 2204611 - RNA, 12 nt, Homo sapiens
auugcuugcaca

SEQ ID NO: 2204612 - RNA, 23 nt, Homo sapiens
acaggcacuuggcagccuuguga

SEQ ID NO: 2204613 - RNA, 14 nt, Homo sapiens
uuacuaagcacugu

SEQ ID NO: 2204614 - RNA, 19 nt, Homo sapiens
aaaauuucaaaagugaucu

SEQ ID NO: 2204615 - RNA, 14 nt, Homo sapiens
ggcgaccaccaaag

SEQ ID NO: 2204616 - RNA, 16 nt, Homo sapiens
uaucuccagugcauua

SEQ ID NO: 2204617 - RNA, 16 nt, Homo sapiens
ggccugucgugccagu

SEQ ID NO: 2204618 - RNA, 18 nt, Homo sapiens
uauuuuaaauguggaaug

SEQ ID NO: 2204619 - RNA, 14 nt, Homo sapiens
gcauggugcaguug

SEQ ID NO: 2204620 - RNA, 16 nt, Homo sapiens
uugcacuauuuccaca

SEQ ID NO: 2204621 - RNA, 17 nt, Homo sapiens
gagcaggguuagcucac

SEQ ID NO: 2204622 - RNA, 13 nt, Homo sapiens
ugugaacaaucag

SEQ ID NO: 2204623 - RNA, 11 nt, Homo sapiens
ucaggucccau

SEQ ID NO: 2204624 - RNA, 18 nt, Homo sapiens
ggugagagucugggucca

SEQ ID NO: 2204625 - RNA, 21 nt, Homo sapiens
aggagacugguuaggacaaaa

SEQ ID NO: 2204626 - RNA, 18 nt, Homo sapiens
gcuucagagccuagccac

SEQ ID NO: 2204627 - RNA, 21 nt, Homo sapiens
cuauuuuuguuaagcgugucu

SEQ ID NO: 2204628 - RNA, 11 nt, Homo sapiens
cucuccugucc

SEQ ID NO: 2204629 - RNA, 11 nt, Homo sapiens
uccuccugcuc

SEQ ID NO: 2204630 - RNA, 13 nt, Homo sapiens
gucauuugcuaau

SEQ ID NO: 2204631 - RNA, 22 nt, Homo sapiens
cucagcccgccuucaggcugcc

SEQ ID NO: 2204632 - RNA, 19 nt, Homo sapiens
caaaacagcauaguacugg

SEQ ID NO: 2204633 - RNA, 16 nt, Homo sapiens
uugcauaggaauugca

SEQ ID NO: 2204634 - RNA, 20 nt, Homo sapiens
uuuauagucgaacaauucau

SEQ ID NO: 2204635 - RNA, 21 nt, Homo sapiens
gcaucaaaauauuucagugaa

SEQ ID NO: 2204636 - RNA, 21 nt, Homo sapiens
uuacccaaauauaaccauuua

SEQ ID NO: 2204637 - RNA, 14 nt, Homo sapiens
ugcaaucacaaaag

SEQ ID NO: 2204638 - RNA, 14 nt, Homo sapiens
cuacaugcugaaaa

SEQ ID NO: 2204639 - RNA, 14 nt, Homo sapiens
cuccaugcugcaaa

SEQ ID NO: 2204640 - RNA, 17 nt, Homo sapiens
agugagugacaaagccu

SEQ ID NO: 2204641 - RNA, 16 nt, Homo sapiens
agcugggggacacuuu

SEQ ID NO: 2204642 - RNA, 13 nt, Homo sapiens
aauaagcaaucaa

SEQ ID NO: 2204643 - RNA, 14 nt, Homo sapiens
cuggcuguggacca

SEQ ID NO: 2204644 - RNA, 20 nt, Homo sapiens
uuaguuccauuuggucuucu

SEQ ID NO: 2204645 - RNA, 15 nt, Homo sapiens
cuugggccucccacu

SEQ ID NO: 2204646 - RNA, 15 nt, Homo sapiens
cagaacccuggugag

SEQ ID NO: 2204647 - RNA, 16 nt, Homo sapiens
augguaagagucacaa

SEQ ID NO: 2204648 - RNA, 15 nt, Homo sapiens
agggaucuguuugaa

SEQ ID NO: 2204649 - RNA, 13 nt, Homo sapiens
aaggcauuccagg

SEQ ID NO: 2204650 - RNA, 23 nt, Homo sapiens
cauucucuugaaggugcugccac

SEQ ID NO: 2204651 - RNA, 15 nt, Homo sapiens
uauuaguuaggugug

SEQ ID NO: 2204652 - RNA, 18 nt, Homo sapiens
aggaugagaugacagaua

SEQ ID NO: 2204653 - RNA, 14 nt, Homo sapiens
gcaaagaucucagc

SEQ ID NO: 2204654 - RNA, 19 nt, Homo sapiens
cugagauucgaauccucaa

SEQ ID NO: 2204655 - RNA, 13 nt, Homo sapiens
agucccuccccaa

SEQ ID NO: 2204656 - RNA, 13 nt, Homo sapiens
ccauggcacugag

SEQ ID NO: 2204657 - RNA, 21 nt, Homo sapiens
auauuagauaaccauauucac

SEQ ID NO: 2204658 - RNA, 14 nt, Homo sapiens
aagaaaaucaucuu

SEQ ID NO: 2204659 - RNA, 17 nt, Homo sapiens
guuuugucucugcaucu

SEQ ID NO: 2204660 - RNA, 19 nt, Homo sapiens
uucaaaacagaacggguuc

SEQ ID NO: 2204661 - RNA, 16 nt, Homo sapiens
ugaccaaagcauuucu

SEQ ID NO: 2204662 - RNA, 20 nt, Homo sapiens
ccauggcuguguuggugugg

SEQ ID NO: 2204663 - RNA, 19 nt, Homo sapiens
agggcaguacaguggcuuc

SEQ ID NO: 2204664 - RNA, 21 nt, Homo sapiens
aaucauucuuuccccucagag

SEQ ID NO: 2204665 - RNA, 18 nt, Homo sapiens
agaugauucggauuugac

SEQ ID NO: 2204666 - RNA, 21 nt, Homo sapiens
ucuaaaaaucaaauaagcuaa

SEQ ID NO: 2204667 - RNA, 11 nt, Homo sapiens
cucagcacuuu

SEQ ID NO: 2204668 - RNA, 13 nt, Homo sapiens
cgccugacagcau

SEQ ID NO: 2204669 - RNA, 23 nt, Homo sapiens
caauggugacugauuucaaauca

SEQ ID NO: 2204670 - RNA, 13 nt, Homo sapiens
aguguucccugac

SEQ ID NO: 2204671 - RNA, 13 nt, Homo sapiens
agcccuucuaccc

SEQ ID NO: 2204672 - RNA, 16 nt, Homo sapiens
augguaaucaguuuug

SEQ ID NO: 2204673 - RNA, 15 nt, Homo sapiens
uagguugagcaauuu

SEQ ID NO: 2204674 - RNA, 18 nt, Homo sapiens
gacaguuuacuuugccaa

SEQ ID NO: 2204675 - RNA, 18 nt, Homo sapiens
uauuugguauaaaggguu

SEQ ID NO: 2204676 - RNA, 16 nt, Homo sapiens
ccaaguauuuugccac

SEQ ID NO: 2204677 - RNA, 16 nt, Homo sapiens
cacuggggcagacaau

SEQ ID NO: 2204678 - RNA, 15 nt, Homo sapiens
aaauuuugcacugcu

SEQ ID NO: 2204679 - RNA, 20 nt, Homo sapiens
ccauccaauggauugugcaa

SEQ ID NO: 2204680 - RNA, 21 nt, Homo sapiens
gaauuagcuuggggccaggga

SEQ ID NO: 2204681 - RNA, 15 nt, Homo sapiens
uuuaggauccaugca

SEQ ID NO: 2204682 - RNA, 15 nt, Homo sapiens
cuuaacauucauaga

SEQ ID NO: 2204683 - RNA, 15 nt, Homo sapiens
aagugagcacugagg

SEQ ID NO: 2204684 - RNA, 16 nt, Homo sapiens
auucauuuaacagagc

SEQ ID NO: 2204685 - RNA, 15 nt, Homo sapiens
cugacuuaacaacug

SEQ ID NO: 2204686 - RNA, 18 nt, Homo sapiens
ucugcagucgcuugccaa

SEQ ID NO: 2204687 - RNA, 21 nt, Homo sapiens
caagaugcgcacugcauucca

SEQ ID NO: 2204688 - RNA, 19 nt, Homo sapiens
uuugaauggaaaacacaug

SEQ ID NO: 2204689 - RNA, 17 nt, Homo sapiens
cauggaaaacagaguau

SEQ ID NO: 2204690 - RNA, 18 nt, Homo sapiens
uucuaaggaauaugagcu

SEQ ID NO: 2204691 - RNA, 16 nt, Homo sapiens
ggcaaguugcaucaga

SEQ ID NO: 2204692 - RNA, 17 nt, Homo sapiens
ucuaggaaacccaagga

SEQ ID NO: 2204693 - RNA, 13 nt, Homo sapiens
uagauagugauau

SEQ ID NO: 2204694 - RNA, 16 nt, Homo sapiens
gcccuccccagacucc

SEQ ID NO: 2204695 - RNA, 20 nt, Homo sapiens
caauaauggggcagacacaa

SEQ ID NO: 2204696 - RNA, 19 nt, Homo sapiens
uaauacuucuuguguguau

SEQ ID NO: 2204697 - RNA, 15 nt, Homo sapiens
aaauaaacacuuccu

SEQ ID NO: 2204698 - RNA, 13 nt, Homo sapiens
cagcugcagccaa

SEQ ID NO: 2204699 - RNA, 23 nt, Homo sapiens
ccaugcacccucauacacagaaa

SEQ ID NO: 2204700 - RNA, 19 nt, Homo sapiens
uccccacccagucucaugu

SEQ ID NO: 2204701 - RNA, 13 nt, Homo sapiens
ccuuguuaaucca

SEQ ID NO: 2204702 - RNA, 17 nt, Homo sapiens
gaccacuuuggagcacu

SEQ ID NO: 2204703 - RNA, 18 nt, Homo sapiens
ucugccuugguauagcau

SEQ ID NO: 2204704 - RNA, 22 nt, Homo sapiens
ugagagagagugagagcacaaa

SEQ ID NO: 2204705 - RNA, 19 nt, Homo sapiens
acagauuuccauccuaguc

SEQ ID NO: 2204706 - RNA, 12 nt, Homo sapiens
aggucacugggu

SEQ ID NO: 2204707 - RNA, 19 nt, Homo sapiens
aauucgugauuuucaagca

SEQ ID NO: 2204708 - RNA, 13 nt, Homo sapiens
ggggccuccagaa

SEQ ID NO: 2204709 - RNA, 19 nt, Homo sapiens
ggguagauuucagggagac

SEQ ID NO: 2204710 - RNA, 20 nt, Homo sapiens
aaggggcugucucccaauga

SEQ ID NO: 2204711 - RNA, 14 nt, Homo sapiens
acaugaugugagau

SEQ ID NO: 2204712 - RNA, 18 nt, Homo sapiens
ugaacugaaggcucagau

SEQ ID NO: 2204713 - RNA, 22 nt, Homo sapiens
cucugcauccagagauucauuu

SEQ ID NO: 2204714 - RNA, 16 nt, Homo sapiens
uacuugcacuguuacu

SEQ ID NO: 2204715 - RNA, 16 nt, Homo sapiens
uggcaagagacuacuc

SEQ ID NO: 2204716 - RNA, 20 nt, Homo sapiens
uguccuucgcccugugcacc

SEQ ID NO: 2204717 - RNA, 19 nt, Homo sapiens
ugcagaggauaaggaggca

SEQ ID NO: 2204718 - RNA, 16 nt, Homo sapiens
auuacugaugugugca

SEQ ID NO: 2204719 - RNA, 15 nt, Homo sapiens
cuguuccugccacau

SEQ ID NO: 2204720 - RNA, 18 nt, Homo sapiens
uguuucuaaaacuauggu

SEQ ID NO: 2204721 - RNA, 18 nt, Homo sapiens
ucacaugccccucuuaga

SEQ ID NO: 2204722 - RNA, 18 nt, Homo sapiens
ccacugugacuuugccca

SEQ ID NO: 2204723 - RNA, 15 nt, Homo sapiens
auggaauaaaccauu

SEQ ID NO: 2204724 - RNA, 17 nt, Homo sapiens
cuuuuaugauacuugaa

SEQ ID NO: 2204725 - RNA, 18 nt, Homo sapiens
ggaugaaacuaaagcaau

SEQ ID NO: 2204726 - RNA, 23 nt, Homo sapiens
uucuccuugauuuuaaaauuccu

SEQ ID NO: 2204727 - RNA, 18 nt, Homo sapiens
acaaaaugacuggcuccu

SEQ ID NO: 2204728 - RNA, 18 nt, Homo sapiens
caugucucuuugccaagg

SEQ ID NO: 2204729 - RNA, 15 nt, Homo sapiens
cauuauuacugguau

SEQ ID NO: 2204730 - RNA, 17 nt, Homo sapiens
ggugugcccuguacaca

SEQ ID NO: 2204731 - RNA, 20 nt, Homo sapiens
cuggaagccucuauugccau

SEQ ID NO: 2204732 - RNA, 12 nt, Homo sapiens
guuuucuugaua

SEQ ID NO: 2204733 - RNA, 13 nt, Homo sapiens
aucuauuuauuaa

SEQ ID NO: 2204734 - RNA, 12 nt, Homo sapiens
gcgcaacauuuc

SEQ ID NO: 2204735 - RNA, 13 nt, Homo sapiens
ccuuuuuucccau

SEQ ID NO: 2204736 - RNA, 19 nt, Homo sapiens
augaucagaagaacaugau

SEQ ID NO: 2204737 - RNA, 13 nt, Homo sapiens
ugcaagcacaaau

SEQ ID NO: 2204738 - RNA, 15 nt, Homo sapiens
ucugucaaaaaucaa

SEQ ID NO: 2204739 - RNA, 16 nt, Homo sapiens
agcacccacucagcca

SEQ ID NO: 2204740 - RNA, 17 nt, Homo sapiens
aaacucuuaaguccuaa

SEQ ID NO: 2204741 - RNA, 17 nt, Homo sapiens
ucagggccaguccuccu

SEQ ID NO: 2204742 - RNA, 14 nt, Homo sapiens
uuaagaacuaugac

SEQ ID NO: 2204743 - RNA, 22 nt, Homo sapiens
gcccuccucgggccgaggccca

SEQ ID NO: 2204744 - RNA, 20 nt, Homo sapiens
cauugucaccccaagccaua

SEQ ID NO: 2204745 - RNA, 18 nt, Homo sapiens
ucuguugcuuauugggag

SEQ ID NO: 2204746 - RNA, 24 nt, Homo sapiens
aaaaggacuggaaaaaugaacugu

SEQ ID NO: 2204747 - RNA, 20 nt, Homo sapiens
cuucagaggauaaauaucaa

SEQ ID NO: 2204748 - RNA, 13 nt, Homo sapiens
auuuuaauuugua

SEQ ID NO: 2204749 - RNA, 21 nt, Homo sapiens
ccaggcuggacgugguggcuc

SEQ ID NO: 2204750 - RNA, 20 nt, Homo sapiens
aaagagagcaggacucacag

SEQ ID NO: 2204751 - RNA, 23 nt, Homo sapiens
agggcagauuacagucauuuccu

SEQ ID NO: 2204752 - RNA, 18 nt, Homo sapiens
cuugauuacuuccacuga

SEQ ID NO: 2204753 - RNA, 16 nt, Homo sapiens
uaugagucuucuguaa

SEQ ID NO: 2204754 - RNA, 20 nt, Homo sapiens
cucaggacccccuguccuga

SEQ ID NO: 2204755 - RNA, 18 nt, Homo sapiens
cuugaaugccauagucaa

SEQ ID NO: 2204756 - RNA, 15 nt, Homo sapiens
uauuggucuugcccu

SEQ ID NO: 2204757 - RNA, 19 nt, Homo sapiens
uccaauggaauacugaaaa

SEQ ID NO: 2204758 - RNA, 17 nt, Homo sapiens
acauaauguaucaugaa

SEQ ID NO: 2204759 - RNA, 18 nt, Homo sapiens
ucaauuuguaauugcuua

SEQ ID NO: 2204760 - RNA, 18 nt, Homo sapiens
auguacuagcauuuucca

SEQ ID NO: 2204761 - RNA, 17 nt, Homo sapiens
cugagcacagcaaggga

SEQ ID NO: 2204762 - RNA, 15 nt, Homo sapiens
aaugacaacauugca

SEQ ID NO: 2204763 - RNA, 18 nt, Homo sapiens
ucccaaguagaaucucag

SEQ ID NO: 2204764 - RNA, 16 nt, Homo sapiens
gcuggaggcagacucg

SEQ ID NO: 2204765 - RNA, 14 nt, Homo sapiens
aagauuucucuuaa

SEQ ID NO: 2204766 - RNA, 21 nt, Homo sapiens
auuagaaauguaacauacuca

SEQ ID NO: 2204767 - RNA, 15 nt, Homo sapiens
ucauugccuuuccag

SEQ ID NO: 2204768 - RNA, 20 nt, Homo sapiens
cucaggggccaacuaggcag

SEQ ID NO: 2204769 - RNA, 18 nt, Homo sapiens
cuaauuuuuuauccuuuu

SEQ ID NO: 2204770 - RNA, 22 nt, Homo sapiens
agaagccggcucuucaaagaca

SEQ ID NO: 2204771 - RNA, 21 nt, Homo sapiens
cauaugauguacauguacuga

SEQ ID NO: 2204772 - RNA, 14 nt, Homo sapiens
aacagaguccaauu

SEQ ID NO: 2204773 - RNA, 14 nt, Homo sapiens
uuggcucccugugu

SEQ ID NO: 2204774 - RNA, 14 nt, Homo sapiens
ugcauuauugacga

SEQ ID NO: 2204775 - RNA, 12 nt, Homo sapiens
ccccaccacaaa

SEQ ID NO: 2204776 - RNA, 23 nt, Homo sapiens
uaucuuugagcgcccacuagacc

SEQ ID NO: 2204777 - RNA, 23 nt, Homo sapiens
uaauugcaucaguucauugaccu

SEQ ID NO: 2204778 - RNA, 18 nt, Homo sapiens
agcucaacuguugccagg

SEQ ID NO: 2204779 - RNA, 14 nt, Homo sapiens
gaggagccucagaa

SEQ ID NO: 2204780 - RNA, 15 nt, Homo sapiens
guaaaacaaucuguu

SEQ ID NO: 2204781 - RNA, 19 nt, Homo sapiens
ucaggaaugcagcacagua

SEQ ID NO: 2204782 - RNA, 15 nt, Homo sapiens
cauuaaacacuguaa

SEQ ID NO: 2204783 - RNA, 15 nt, Homo sapiens
gaacaguccuguuca

SEQ ID NO: 2204784 - RNA, 17 nt, Homo sapiens
aagaauauuuacaauaa

SEQ ID NO: 2204785 - RNA, 11 nt, Homo sapiens
cagaugucuua

SEQ ID NO: 2204786 - RNA, 21 nt, Homo sapiens
uugggaaaauacguugaggga

SEQ ID NO: 2204787 - RNA, 18 nt, Homo sapiens
auuggagaaaagcacuua

SEQ ID NO: 2204788 - RNA, 16 nt, Homo sapiens
auuaauauaaccauaa

SEQ ID NO: 2204789 - RNA, 22 nt, Homo sapiens
aaguaauguaaaauccauccaa

SEQ ID NO: 2204790 - RNA, 18 nt, Homo sapiens
acagacauccucuaugcc

SEQ ID NO: 2204791 - RNA, 21 nt, Homo sapiens
gcaucaggcagggugagcucc

SEQ ID NO: 2204792 - RNA, 23 nt, Homo sapiens
gcuuuguuaucuuccacuggaaa

SEQ ID NO: 2204793 - RNA, 12 nt, Homo sapiens
uucauaccuaag

SEQ ID NO: 2204794 - RNA, 19 nt, Homo sapiens
caguccugggauguggcug

SEQ ID NO: 2204795 - RNA, 16 nt, Homo sapiens
ucacaaaguccacuuu

SEQ ID NO: 2204796 - RNA, 12 nt, Homo sapiens
ugaacacuggag

SEQ ID NO: 2204797 - RNA, 23 nt, Homo sapiens
uuggggugauuucucacccucug

SEQ ID NO: 2204798 - RNA, 14 nt, Homo sapiens
ccucacguccauca

SEQ ID NO: 2204799 - RNA, 24 nt, Homo sapiens
guaucacagacuggcaacaagaag

SEQ ID NO: 2204800 - RNA, 17 nt, Homo sapiens
cagugacuuugagcuga

SEQ ID NO: 2204801 - RNA, 16 nt, Homo sapiens
gucuggcaucucccac

SEQ ID NO: 2204802 - RNA, 18 nt, Homo sapiens
uuaaaagaacucauucau

SEQ ID NO: 2204803 - RNA, 15 nt, Homo sapiens
ucuauuaaagauauu

SEQ ID NO: 2204804 - RNA, 13 nt, Homo sapiens
agaggacugagac

SEQ ID NO: 2204805 - RNA, 11 nt, Homo sapiens
agcacaguaaa

SEQ ID NO: 2204806 - RNA, 13 nt, Homo sapiens
uuuguuacuguuc

SEQ ID NO: 2204807 - RNA, 22 nt, Homo sapiens
cauuuggccucuuguagucuug

SEQ ID NO: 2204808 - RNA, 17 nt, Homo sapiens
ucuauaaguguucagug

SEQ ID NO: 2204809 - RNA, 12 nt, Homo sapiens
gagggugacugu

SEQ ID NO: 2204810 - RNA, 14 nt, Homo sapiens
auacaugcauacac

SEQ ID NO: 2204811 - RNA, 12 nt, Homo sapiens
acgaacuggacu

SEQ ID NO: 2204812 - RNA, 23 nt, Homo sapiens
accugcacguugugcacauguac

SEQ ID NO: 2204813 - RNA, 21 nt, Homo sapiens
aggaaugugggcugggggaag

SEQ ID NO: 2204814 - RNA, 19 nt, Homo sapiens
cuauuaaaucuugcaacug

SEQ ID NO: 2204815 - RNA, 15 nt, Homo sapiens
gacucauucccagua

SEQ ID NO: 2204816 - RNA, 16 nt, Homo sapiens
cacuaucaacacugca

SEQ ID NO: 2204817 - RNA, 17 nt, Homo sapiens
aaagacacuugauacuu

SEQ ID NO: 2204818 - RNA, 23 nt, Homo sapiens
ucaaaucaguccuuugauuccau

SEQ ID NO: 2204819 - RNA, 19 nt, Homo sapiens
aaaauggauccccagugaa

SEQ ID NO: 2204820 - RNA, 15 nt, Homo sapiens
cauguccuaauucuu

SEQ ID NO: 2204821 - RNA, 22 nt, Homo sapiens
ucauggugaaaagcuccaucaa

SEQ ID NO: 2204822 - RNA, 16 nt, Homo sapiens
gaaauuccucuguaga

SEQ ID NO: 2204823 - RNA, 15 nt, Homo sapiens
aauucuaaaugcugg

SEQ ID NO: 2204824 - RNA, 13 nt, Homo sapiens
cauguaaccaaga

SEQ ID NO: 2204825 - RNA, 14 nt, Homo sapiens
caggcuggucuuga

SEQ ID NO: 2204826 - RNA, 19 nt, Homo sapiens
cuccaaaaggcccuuuuca

SEQ ID NO: 2204827 - RNA, 20 nt, Homo sapiens
ccuccacuccagcucugaga

SEQ ID NO: 2204828 - RNA, 17 nt, Homo sapiens
cagcuaggaacaaaucu

SEQ ID NO: 2204829 - RNA, 16 nt, Homo sapiens
acugagggguggcacg

SEQ ID NO: 2204830 - RNA, 15 nt, Homo sapiens
gacaacagguuuuca

SEQ ID NO: 2204831 - RNA, 14 nt, Homo sapiens
auccuaugugauuu

SEQ ID NO: 2204832 - RNA, 17 nt, Homo sapiens
uguauauauaaucuaua

SEQ ID NO: 2204833 - RNA, 14 nt, Homo sapiens
aauggagucugcag

SEQ ID NO: 2204834 - RNA, 22 nt, Homo sapiens
aaucuugaggaauaaaugccuu

SEQ ID NO: 2204835 - RNA, 22 nt, Homo sapiens
cccuccaucccuuccccagaga

SEQ ID NO: 2204836 - RNA, 22 nt, Homo sapiens
caggagccuacuucuagcugua

SEQ ID NO: 2204837 - RNA, 15 nt, Homo sapiens
ucgggggcuguggau

SEQ ID NO: 2204838 - RNA, 19 nt, Homo sapiens
auuuauuuuuucaucucau

SEQ ID NO: 2204839 - RNA, 23 nt, Homo sapiens
gaaagagcuggcaaacugugaau

SEQ ID NO: 2204840 - RNA, 23 nt, Homo sapiens
ccucauggcucuggcacagugua

SEQ ID NO: 2204841 - RNA, 17 nt, Homo sapiens
gagaagcaucauuuccc

SEQ ID NO: 2204842 - RNA, 13 nt, Homo sapiens
ugaugaucuuugc

SEQ ID NO: 2204843 - RNA, 20 nt, Homo sapiens
auaacuuggccauguucucc

SEQ ID NO: 2204844 - RNA, 13 nt, Homo sapiens
aaugaacagaauu

SEQ ID NO: 2204845 - RNA, 16 nt, Homo sapiens
cacuucuaaaccaaaa

SEQ ID NO: 2204846 - RNA, 22 nt, Homo sapiens
auggauucuccacucaguugca

SEQ ID NO: 2204847 - RNA, 23 nt, Homo sapiens
aaacccacgauuuucuccagcuc

SEQ ID NO: 2204848 - RNA, 15 nt, Homo sapiens
auggcagacaaagca

SEQ ID NO: 2204849 - RNA, 14 nt, Homo sapiens
aauggaaagguccu

SEQ ID NO: 2204850 - RNA, 15 nt, Homo sapiens
aggacccugcuucug

SEQ ID NO: 2204851 - RNA, 22 nt, Homo sapiens
caggguguuaaggcagugacuu

SEQ ID NO: 2204852 - RNA, 20 nt, Homo sapiens
aucaaggcucuuccguucca

SEQ ID NO: 2204853 - RNA, 14 nt, Homo sapiens
uauuuacaagggaa

SEQ ID NO: 2204854 - RNA, 21 nt, Homo sapiens
ccagauaaagguucaugcaaa

SEQ ID NO: 2204855 - RNA, 16 nt, Homo sapiens
gacaacagccugagaa

SEQ ID NO: 2204856 - RNA, 14 nt, Homo sapiens
gcaaaaccaaagaa

SEQ ID NO: 2204857 - RNA, 13 nt, Homo sapiens
guuagcaauaugu

SEQ ID NO: 2204858 - RNA, 16 nt, Homo sapiens
acccccauguccuccg

SEQ ID NO: 2204859 - RNA, 14 nt, Homo sapiens
cagagcacuguaua

SEQ ID NO: 2204860 - RNA, 21 nt, Homo sapiens
ggacuuccccggagggcugcg

SEQ ID NO: 2204861 - RNA, 19 nt, Homo sapiens
uaacuuaguaagugcuuuu

SEQ ID NO: 2204862 - RNA, 15 nt, Homo sapiens
cucagccccacugac

SEQ ID NO: 2204863 - RNA, 16 nt, Homo sapiens
aucugccagaccuuaa

SEQ ID NO: 2204864 - RNA, 20 nt, Homo sapiens
cuacugacggaguccugugu

SEQ ID NO: 2204865 - RNA, 17 nt, Homo sapiens
ccuucauccuugacucc

SEQ ID NO: 2204866 - RNA, 13 nt, Homo sapiens
uccccagccuggg

SEQ ID NO: 2204867 - RNA, 15 nt, Homo sapiens
caguggugugaaaca

SEQ ID NO: 2204868 - RNA, 18 nt, Homo sapiens
cucugcucccaacuucgc

SEQ ID NO: 2204869 - RNA, 20 nt, Homo sapiens
cacucaaggaaaagaugugc

SEQ ID NO: 2204870 - RNA, 15 nt, Homo sapiens
acuuuguaaauaagu

SEQ ID NO: 2204871 - RNA, 14 nt, Homo sapiens
aauuaaacccugcc

SEQ ID NO: 2204872 - RNA, 13 nt, Homo sapiens
uaauucuuguaga

SEQ ID NO: 2204873 - RNA, 13 nt, Homo sapiens
uuguagcacugag

SEQ ID NO: 2204874 - RNA, 15 nt, Homo sapiens
caacccuguuuccug

SEQ ID NO: 2204875 - RNA, 20 nt, Homo sapiens
uagacaucccccuccuugcc

SEQ ID NO: 2204876 - RNA, 18 nt, Homo sapiens
cugacccaggaccauccu

SEQ ID NO: 2204877 - RNA, 18 nt, Homo sapiens
gcagaggucccucagcug

SEQ ID NO: 2204878 - RNA, 15 nt, Homo sapiens
aaggaauaaaaccau

SEQ ID NO: 2204879 - RNA, 18 nt, Homo sapiens
aaaaugagauaugcaaua

SEQ ID NO: 2204880 - RNA, 16 nt, Homo sapiens
aaaccauuucagccaa

SEQ ID NO: 2204881 - RNA, 19 nt, Homo sapiens
aaaaacacuauuucuggaa

SEQ ID NO: 2204882 - RNA, 15 nt, Homo sapiens
aaaauagacuaaccu

SEQ ID NO: 2204883 - RNA, 21 nt, Homo sapiens
ugcaguaucuguugcuugucu

SEQ ID NO: 2204884 - RNA, 20 nt, Homo sapiens
guccugaugcugugcucaau

SEQ ID NO: 2204885 - RNA, 14 nt, Homo sapiens
caguagaaagagug

SEQ ID NO: 2204886 - RNA, 15 nt, Homo sapiens
uuucugugcagagau

SEQ ID NO: 2204887 - RNA, 20 nt, Homo sapiens
aaggccagucugaaccugag

SEQ ID NO: 2204888 - RNA, 19 nt, Homo sapiens
aguacucucugcucuagcc

SEQ ID NO: 2204889 - RNA, 17 nt, Homo sapiens
augcuuucucuccucuu

SEQ ID NO: 2204890 - RNA, 19 nt, Homo sapiens
aggcuaccucuaccuucaa

SEQ ID NO: 2204891 - RNA, 20 nt, Homo sapiens
cucccuaaggaaucugaaag

SEQ ID NO: 2204892 - RNA, 21 nt, Homo sapiens
augaagaccuaaaugaccuca

SEQ ID NO: 2204893 - RNA, 22 nt, Homo sapiens
aaagcugauuacugucaauaaa

SEQ ID NO: 2204894 - RNA, 20 nt, Homo sapiens
aaguuauugaugagagggaa

SEQ ID NO: 2204895 - RNA, 12 nt, Homo sapiens
guuugugauauu

SEQ ID NO: 2204896 - RNA, 14 nt, Homo sapiens
acuggcaugagcca

SEQ ID NO: 2204897 - RNA, 15 nt, Homo sapiens
gcuuauggauucaua

SEQ ID NO: 2204898 - RNA, 17 nt, Homo sapiens
uucaggcagcacaucaa

SEQ ID NO: 2204899 - RNA, 21 nt, Homo sapiens
uuaggucauuacuaaccauag

SEQ ID NO: 2204900 - RNA, 12 nt, Homo sapiens
ggggcugugcau

SEQ ID NO: 2204901 - RNA, 23 nt, Homo sapiens
ucuguaaaaagaucccugagauu

SEQ ID NO: 2204902 - RNA, 21 nt, Homo sapiens
ucuauuugccuccagugcagu

SEQ ID NO: 2204903 - RNA, 21 nt, Homo sapiens
uuuaagcuaucuauaccuuac

SEQ ID NO: 2204904 - RNA, 16 nt, Homo sapiens
ucacguucuagugaaa

SEQ ID NO: 2204905 - RNA, 18 nt, Homo sapiens
aacuuuuuccaaucuuag

SEQ ID NO: 2204906 - RNA, 11 nt, Homo sapiens
aauugagauga

SEQ ID NO: 2204907 - RNA, 21 nt, Homo sapiens
uccucucaugucuuugcugca

SEQ ID NO: 2204908 - RNA, 17 nt, Homo sapiens
auuauuggacagucuca

SEQ ID NO: 2204909 - RNA, 18 nt, Homo sapiens
ccaucagaaacacccuca

SEQ ID NO: 2204910 - RNA, 20 nt, Homo sapiens
gauuaugaugaaaaccuaca

SEQ ID NO: 2204911 - RNA, 20 nt, Homo sapiens
uccaccccaucccagacucc

SEQ ID NO: 2204912 - RNA, 20 nt, Homo sapiens
ucuuccagaaggcaaaaaga

SEQ ID NO: 2204913 - RNA, 15 nt, Homo sapiens
cccugggccaggcag

SEQ ID NO: 2204914 - RNA, 17 nt, Homo sapiens
ucccucagagacaccaa

SEQ ID NO: 2204915 - RNA, 18 nt, Homo sapiens
aucugauuagaaguauaa

SEQ ID NO: 2204916 - RNA, 23 nt, Homo sapiens
ucacggaccccauguuggaucuu

SEQ ID NO: 2204917 - RNA, 20 nt, Homo sapiens
gucauucagcgggagcacug

SEQ ID NO: 2204918 - RNA, 23 nt, Homo sapiens
gcaaggacacagaugaaacacaa

SEQ ID NO: 2204919 - RNA, 13 nt, Homo sapiens
gcagugugcauaa

SEQ ID NO: 2204920 - RNA, 16 nt, Homo sapiens
cucuccuccacucuga

SEQ ID NO: 2204921 - RNA, 16 nt, Homo sapiens
uaaaucuccaguacuu

SEQ ID NO: 2204922 - RNA, 21 nt, Homo sapiens
caacaaccaccaccacaauga

SEQ ID NO: 2204923 - RNA, 19 nt, Homo sapiens
guucuccuaaugcucugaa

SEQ ID NO: 2204924 - RNA, 19 nt, Homo sapiens
cccagccagggcucaaucu

SEQ ID NO: 2204925 - RNA, 11 nt, Homo sapiens
ggcugacauug

SEQ ID NO: 2204926 - RNA, 19 nt, Homo sapiens
uuggccucccaaagugcua

SEQ ID NO: 2204927 - RNA, 14 nt, Homo sapiens
ugcuguugaagauu

SEQ ID NO: 2204928 - RNA, 18 nt, Homo sapiens
uugcuuccaagaccauuu

SEQ ID NO: 2204929 - RNA, 17 nt, Homo sapiens
uaaauagaagaguuuaa

SEQ ID NO: 2204930 - RNA, 13 nt, Homo sapiens
ucccuuugccagu

SEQ ID NO: 2204931 - RNA, 14 nt, Homo sapiens
cucaccagucccau

SEQ ID NO: 2204932 - RNA, 22 nt, Homo sapiens
aagcccugacuauuuacaguag

SEQ ID NO: 2204933 - RNA, 14 nt, Homo sapiens
gccaggggaacucg

SEQ ID NO: 2204934 - RNA, 14 nt, Homo sapiens
gacugaggaccaca

SEQ ID NO: 2204935 - RNA, 19 nt, Homo sapiens
aaugucuugcuguugacau

SEQ ID NO: 2204936 - RNA, 22 nt, Homo sapiens
gaaaagcuaccaucacuuccuc

SEQ ID NO: 2204937 - RNA, 15 nt, Homo sapiens
aguauauuuccauuc

SEQ ID NO: 2204938 - RNA, 16 nt, Homo sapiens
gcucagugccuggaca

SEQ ID NO: 2204939 - RNA, 15 nt, Homo sapiens
uguuacaaauaugca

SEQ ID NO: 2204940 - RNA, 21 nt, Homo sapiens
ucagauuccccccaucuccau

SEQ ID NO: 2204941 - RNA, 20 nt, Homo sapiens
aauguagacuuuugcuuuau

SEQ ID NO: 2204942 - RNA, 16 nt, Homo sapiens
ucccccacgucucucu

SEQ ID NO: 2204943 - RNA, 14 nt, Homo sapiens
cugcuaaauacugu

SEQ ID NO: 2204944 - RNA, 12 nt, Homo sapiens
ccucugugcaga

SEQ ID NO: 2204945 - RNA, 14 nt, Homo sapiens
ucucucccugcuuu

SEQ ID NO: 2204946 - RNA, 13 nt, Homo sapiens
ccuaguccaacau

SEQ ID NO: 2204947 - RNA, 19 nt, Homo sapiens
agcgguaucucuggcacca

SEQ ID NO: 2204948 - RNA, 17 nt, Homo sapiens
auuuuccucacacccac

SEQ ID NO: 2204949 - RNA, 14 nt, Homo sapiens
uaccauacacgcaa

SEQ ID NO: 2204950 - RNA, 17 nt, Homo sapiens
ggaaugugcaacauucu

SEQ ID NO: 2204951 - RNA, 18 nt, Homo sapiens
agacuguuacuuuggcaa

SEQ ID NO: 2204952 - RNA, 17 nt, Homo sapiens
aaaggaagucaccaaaa

SEQ ID NO: 2204953 - RNA, 20 nt, Homo sapiens
guuacucuguaaaugaaaaa

SEQ ID NO: 2204954 - RNA, 21 nt, Homo sapiens
uuuaucucuuuaguuagugau

SEQ ID NO: 2204955 - RNA, 23 nt, Homo sapiens
ucucaauaaauuuuuauuacuua

SEQ ID NO: 2204956 - RNA, 22 nt, Homo sapiens
aagggaacaaguugagcuauga

SEQ ID NO: 2204957 - RNA, 14 nt, Homo sapiens
uuaauuuucacuuu

SEQ ID NO: 2204958 - RNA, 12 nt, Homo sapiens
aggguacaugug

SEQ ID NO: 2204959 - RNA, 18 nt, Homo sapiens
uagaccagggcugcucuu

SEQ ID NO: 2204960 - RNA, 14 nt, Homo sapiens
aaaagggagauuca

SEQ ID NO: 2204961 - RNA, 18 nt, Homo sapiens
guaucucuucagucucua

SEQ ID NO: 2204962 - RNA, 23 nt, Homo sapiens
aagcuaccuugucauauguguug

SEQ ID NO: 2204963 - RNA, 21 nt, Homo sapiens
cacgugauggaccaaagccac

SEQ ID NO: 2204964 - RNA, 23 nt, Homo sapiens
aacuucauuuuucuaauaaucau

SEQ ID NO: 2204965 - RNA, 22 nt, Homo sapiens
ucaaaguuuugaaaagcuauua

SEQ ID NO: 2204966 - RNA, 14 nt, Homo sapiens
uguugaaugcugcu

SEQ ID NO: 2204967 - RNA, 21 nt, Homo sapiens
uuccugacgagauaagcaguu

SEQ ID NO: 2204968 - RNA, 17 nt, Homo sapiens
ugaaaagcacagccuca

SEQ ID NO: 2204969 - RNA, 22 nt, Homo sapiens
gacaguuuugcuuuaguacaau

SEQ ID NO: 2204970 - RNA, 13 nt, Homo sapiens
ccaaccuguaaua

SEQ ID NO: 2204971 - RNA, 13 nt, Homo sapiens
caaaacugucauc

SEQ ID NO: 2204972 - RNA, 22 nt, Homo sapiens
gcuaacuuuuauuaucuucuau

SEQ ID NO: 2204973 - RNA, 13 nt, Homo sapiens
caauaauaauuaa

SEQ ID NO: 2204974 - RNA, 16 nt, Homo sapiens
ucuaagcacauuccaa

SEQ ID NO: 2204975 - RNA, 15 nt, Homo sapiens
cauggaaaacaccag

SEQ ID NO: 2204976 - RNA, 16 nt, Homo sapiens
ccagcacucagccuca

SEQ ID NO: 2204977 - RNA, 17 nt, Homo sapiens
augugccuuguccagga

SEQ ID NO: 2204978 - RNA, 15 nt, Homo sapiens
caguuugacuguggc

SEQ ID NO: 2204979 - RNA, 23 nt, Homo sapiens
agacacccuaacucuugcucacu

SEQ ID NO: 2204980 - RNA, 16 nt, Homo sapiens
guauuaauaaacacau

SEQ ID NO: 2204981 - RNA, 15 nt, Homo sapiens
augugggcguuugua

SEQ ID NO: 2204982 - RNA, 12 nt, Homo sapiens
cugauaagcaag

SEQ ID NO: 2204983 - RNA, 21 nt, Homo sapiens
uugacauguagguacccugcc

SEQ ID NO: 2204984 - RNA, 19 nt, Homo sapiens
gaacuuugcacacuucaaa

SEQ ID NO: 2204985 - RNA, 16 nt, Homo sapiens
ugaagcaacugaaucu

SEQ ID NO: 2204986 - RNA, 23 nt, Homo sapiens
uccaaugcuucuguugaucucag

SEQ ID NO: 2204987 - RNA, 17 nt, Homo sapiens
accacugauaaaaccau

SEQ ID NO: 2204988 - RNA, 15 nt, Homo sapiens
ugucuccuuccacaa

SEQ ID NO: 2204989 - RNA, 17 nt, Homo sapiens
uuccucucccauucacc

SEQ ID NO: 2204990 - RNA, 21 nt, Homo sapiens
cauuuuuagauugguucuguu

SEQ ID NO: 2204991 - RNA, 20 nt, Homo sapiens
uacaaaugugugacugcuca

SEQ ID NO: 2204992 - RNA, 18 nt, Homo sapiens
cagagcccucaacuauuc

SEQ ID NO: 2204993 - RNA, 22 nt, Homo sapiens
auauuuaacuggugcacuuugu

SEQ ID NO: 2204994 - RNA, 18 nt, Homo sapiens
acauaaagaaacacuuuc

SEQ ID NO: 2204995 - RNA, 15 nt, Homo sapiens
caaagcccaucauaa

SEQ ID NO: 2204996 - RNA, 19 nt, Homo sapiens
ugcuaggaugaagcccuaa

SEQ ID NO: 2204997 - RNA, 15 nt, Homo sapiens
uguacagaauuucca

SEQ ID NO: 2204998 - RNA, 19 nt, Homo sapiens
cugagacuacaggugagug

SEQ ID NO: 2204999 - RNA, 17 nt, Homo sapiens
uugaggcagcagaauug

SEQ ID NO: 2205000 - RNA, 20 nt, Homo sapiens
ggaagaucuugagagcugcu

SEQ ID NO: 2205001 - RNA, 19 nt, Homo sapiens
uggagaacucacugugggc

SEQ ID NO: 2205002 - RNA, 16 nt, Homo sapiens
ucaauaaaguacaaga

SEQ ID NO: 2205003 - RNA, 18 nt, Homo sapiens
gguucucagguucacuca

SEQ ID NO: 2205004 - RNA, 14 nt, Homo sapiens
uaggauuugaacac

SEQ ID NO: 2205005 - RNA, 18 nt, Homo sapiens
cuuuugagaguaauuugg

SEQ ID NO: 2205006 - RNA, 13 nt, Homo sapiens
cacaagaagacca

SEQ ID NO: 2205007 - RNA, 13 nt, Homo sapiens
gcugcucugccau

SEQ ID NO: 2205008 - RNA, 14 nt, Homo sapiens
cugcaaugagccau

SEQ ID NO: 2205009 - RNA, 14 nt, Homo sapiens
agcccuugcugcca

SEQ ID NO: 2205010 - RNA, 22 nt, Homo sapiens
accugggagcaggggcaaugac

SEQ ID NO: 2205011 - RNA, 16 nt, Homo sapiens
acuuucuuuacuccau

SEQ ID NO: 2205012 - RNA, 15 nt, Homo sapiens
ccagaccucagggac

SEQ ID NO: 2205013 - RNA, 14 nt, Homo sapiens
ccaaaggaagcaca

SEQ ID NO: 2205014 - RNA, 21 nt, Homo sapiens
guuguaaaaagaaaaaccacu

SEQ ID NO: 2205015 - RNA, 15 nt, Homo sapiens
ugugagagauucugu

SEQ ID NO: 2205016 - RNA, 20 nt, Homo sapiens
ugaccaacgcacaacaggaa

SEQ ID NO: 2205017 - RNA, 13 nt, Homo sapiens
aacaacacaaaag

SEQ ID NO: 2205018 - RNA, 20 nt, Homo sapiens
auggacucaggauccaguga

SEQ ID NO: 2205019 - RNA, 17 nt, Homo sapiens
cugauuacccaaugcac

SEQ ID NO: 2205020 - RNA, 21 nt, Homo sapiens
uuaauaaagaauuaacagaga

SEQ ID NO: 2205021 - RNA, 21 nt, Homo sapiens
acugauguuacaucacagugu

SEQ ID NO: 2205022 - RNA, 14 nt, Homo sapiens
acauggagcuguca

SEQ ID NO: 2205023 - RNA, 23 nt, Homo sapiens
ucccauaacauaaaagugcuacu

SEQ ID NO: 2205024 - RNA, 14 nt, Homo sapiens
cuuauuuauaccuc

SEQ ID NO: 2205025 - RNA, 17 nt, Homo sapiens
cucgggggccuguggug

SEQ ID NO: 2205026 - RNA, 11 nt, Homo sapiens
gagcucaaggu

SEQ ID NO: 2205027 - RNA, 11 nt, Homo sapiens
cugacugcaac

SEQ ID NO: 2205028 - RNA, 15 nt, Homo sapiens
ucucugauauuugga

SEQ ID NO: 2205029 - RNA, 16 nt, Homo sapiens
uucuaaaucaccagaa

SEQ ID NO: 2205030 - RNA, 14 nt, Homo sapiens
uuacagauaaccua

SEQ ID NO: 2205031 - RNA, 23 nt, Homo sapiens
aucgcucguguguucuauccaaa

SEQ ID NO: 2205032 - RNA, 16 nt, Homo sapiens
cuggaggacguggacu

SEQ ID NO: 2205033 - RNA, 21 nt, Homo sapiens
gagccauauguacauaaucua

SEQ ID NO: 2205034 - RNA, 17 nt, Homo sapiens
uaaaucauuuucauuaa

SEQ ID NO: 2205035 - RNA, 11 nt, Homo sapiens
auuguaaaaaa

SEQ ID NO: 2205036 - RNA, 17 nt, Homo sapiens
aauaguuuaucauuuac

SEQ ID NO: 2205037 - RNA, 17 nt, Homo sapiens
cuuuguuacuuccuuau

SEQ ID NO: 2205038 - RNA, 18 nt, Homo sapiens
auuuauaacguucucagu

SEQ ID NO: 2205039 - RNA, 23 nt, Homo sapiens
uucauccauauuguugaauguuu

SEQ ID NO: 2205040 - RNA, 17 nt, Homo sapiens
uagauuaugucuuucca

SEQ ID NO: 2205041 - RNA, 23 nt, Homo sapiens
cagaaauuagccggucauggugg

SEQ ID NO: 2205042 - RNA, 19 nt, Homo sapiens
aauauucaaugaacuucca

SEQ ID NO: 2205043 - RNA, 15 nt, Homo sapiens
acaauaacacugucu

SEQ ID NO: 2205044 - RNA, 19 nt, Homo sapiens
uuguaagcuauaacauauu

SEQ ID NO: 2205045 - RNA, 23 nt, Homo sapiens
ccugcagcggaagggacucuggg

SEQ ID NO: 2205046 - RNA, 13 nt, Homo sapiens
ugcauauauacau

SEQ ID NO: 2205047 - RNA, 13 nt, Homo sapiens
uaaaaauaugaaa

SEQ ID NO: 2205048 - RNA, 20 nt, Homo sapiens
cuaaaaauggcuaacugaug

SEQ ID NO: 2205049 - RNA, 20 nt, Homo sapiens
auaauuauaauguugcccag

SEQ ID NO: 2205050 - RNA, 16 nt, Homo sapiens
aaagauggaguuucua

SEQ ID NO: 2205051 - RNA, 13 nt, Homo sapiens
ccagcguggcgca

SEQ ID NO: 2205052 - RNA, 18 nt, Homo sapiens
gcaucccugugagcaaaa

SEQ ID NO: 2205053 - RNA, 13 nt, Homo sapiens
gaggccaccuccu

SEQ ID NO: 2205054 - RNA, 12 nt, Homo sapiens
aggcaguggcuu

SEQ ID NO: 2205055 - RNA, 13 nt, Homo sapiens
caagaaccucucc

SEQ ID NO: 2205056 - RNA, 15 nt, Homo sapiens
cugcccauggcaugu

SEQ ID NO: 2205057 - RNA, 19 nt, Homo sapiens
caucccagcccacaucuca

SEQ ID NO: 2205058 - RNA, 12 nt, Homo sapiens
cauguauggcca

SEQ ID NO: 2205059 - RNA, 18 nt, Homo sapiens
uuccccucauugcauuua

SEQ ID NO: 2205060 - RNA, 23 nt, Homo sapiens
gagggguugaugccagacaucac

SEQ ID NO: 2205061 - RNA, 14 nt, Homo sapiens
aaaaccgaguugcc

SEQ ID NO: 2205062 - RNA, 15 nt, Homo sapiens
uauugauuccucaca

SEQ ID NO: 2205063 - RNA, 19 nt, Homo sapiens
cgucuucaagaacuucucg

SEQ ID NO: 2205064 - RNA, 23 nt, Homo sapiens
ggcccccaccgccgggguccugg

SEQ ID NO: 2205065 - RNA, 24 nt, Homo sapiens
guuaaagggcauuuuacuaaggca

SEQ ID NO: 2205066 - RNA, 13 nt, Homo sapiens
ggcgcaugugcca

SEQ ID NO: 2205067 - RNA, 20 nt, Homo sapiens
agcaccuccccgcugggaag

SEQ ID NO: 2205068 - RNA, 21 nt, Homo sapiens
gcugcagcucuccaccagcug

SEQ ID NO: 2205069 - RNA, 22 nt, Homo sapiens
acugugacuaggcauacacugu

SEQ ID NO: 2205070 - RNA, 12 nt, Homo sapiens
caggcuugaauc

SEQ ID NO: 2205071 - RNA, 20 nt, Homo sapiens
cugucugaccuuccaaagac

SEQ ID NO: 2205072 - RNA, 21 nt, Homo sapiens
uccucgagggcagggacuuug

SEQ ID NO: 2205073 - RNA, 17 nt, Homo sapiens
cccagacaaccaaaaca

SEQ ID NO: 2205074 - RNA, 21 nt, Homo sapiens
cuuuccggcacacugccaaau

SEQ ID NO: 2205075 - RNA, 22 nt, Homo sapiens
uuccucucaugucuuugcugca

SEQ ID NO: 2205076 - RNA, 23 nt, Homo sapiens
agucccccaacucugagcccaug

SEQ ID NO: 2205077 - RNA, 17 nt, Homo sapiens
aauaauauaaaugaaug

SEQ ID NO: 2205078 - RNA, 22 nt, Homo sapiens
ugacuggcccacacgugcauag

SEQ ID NO: 2205079 - RNA, 17 nt, Homo sapiens
cacugacugaacuguaa

SEQ ID NO: 2205080 - RNA, 14 nt, Homo sapiens
cagauuucagucuu

SEQ ID NO: 2205081 - RNA, 20 nt, Homo sapiens
auuaaagaugaccuacagug

SEQ ID NO: 2205082 - RNA, 15 nt, Homo sapiens
caucauguugaauaa

SEQ ID NO: 2205083 - RNA, 21 nt, Homo sapiens
agggaauacuauacagccaua

SEQ ID NO: 2205084 - RNA, 14 nt, Homo sapiens
caaucagguagcuu

SEQ ID NO: 2205085 - RNA, 15 nt, Homo sapiens
cucucugucucucuc

SEQ ID NO: 2205086 - RNA, 16 nt, Homo sapiens
uacaggugugagucac

SEQ ID NO: 2205087 - RNA, 20 nt, Homo sapiens
agacaaugcaccuagcugug

SEQ ID NO: 2205088 - RNA, 16 nt, Homo sapiens
gcccaaucauuugcaa

SEQ ID NO: 2205089 - RNA, 18 nt, Homo sapiens
cuaucauaugaagauaac

SEQ ID NO: 2205090 - RNA, 20 nt, Homo sapiens
acuccaaacaauucugauga

SEQ ID NO: 2205091 - RNA, 20 nt, Homo sapiens
ccuuuauuaaaaacugagug

SEQ ID NO: 2205092 - RNA, 13 nt, Homo sapiens
ugaaaagccaugu

SEQ ID NO: 2205093 - RNA, 21 nt, Homo sapiens
aaacaucuaauaaguauauaa

SEQ ID NO: 2205094 - RNA, 23 nt, Homo sapiens
aaagcuacuauguacugccuuag

SEQ ID NO: 2205095 - RNA, 13 nt, Homo sapiens
gcaggacugcaca

SEQ ID NO: 2205096 - RNA, 20 nt, Homo sapiens
uggcuuuggugaacuguugg

SEQ ID NO: 2205097 - RNA, 15 nt, Homo sapiens
augagugauccugcc

SEQ ID NO: 2205098 - RNA, 18 nt, Homo sapiens
uacaauauggacauguaa

SEQ ID NO: 2205099 - RNA, 18 nt, Homo sapiens
aaaagcugaccccaaaga

SEQ ID NO: 2205100 - RNA, 19 nt, Homo sapiens
agaaacuuugaguacagau

SEQ ID NO: 2205101 - RNA, 16 nt, Homo sapiens
ugaugcuauuuaugca

SEQ ID NO: 2205102 - RNA, 14 nt, Homo sapiens
acagcucugagauc

SEQ ID NO: 2205103 - RNA, 20 nt, Homo sapiens
agacugaacuuacacuguau

SEQ ID NO: 2205104 - RNA, 22 nt, Homo sapiens
ugcauucauuuuuauagcaaca

SEQ ID NO: 2205105 - RNA, 19 nt, Homo sapiens
uccucucucuacuugaaua

SEQ ID NO: 2205106 - RNA, 22 nt, Homo sapiens
aggaugggggguguccccucag

SEQ ID NO: 2205107 - RNA, 18 nt, Homo sapiens
uacuggccuuuucacuga

SEQ ID NO: 2205108 - RNA, 23 nt, Homo sapiens
aaaaaccaaacccagacaaccaa

SEQ ID NO: 2205109 - RNA, 21 nt, Homo sapiens
ccaaggcacugagaccuccac

SEQ ID NO: 2205110 - RNA, 16 nt, Homo sapiens
aaaaccuuccuucccu

SEQ ID NO: 2205111 - RNA, 15 nt, Homo sapiens
auucuggacacuguc

SEQ ID NO: 2205112 - RNA, 16 nt, Homo sapiens
agcagguggcaucucu

SEQ ID NO: 2205113 - RNA, 16 nt, Homo sapiens
ugcccacaacuugcca

SEQ ID NO: 2205114 - RNA, 14 nt, Homo sapiens
uaucaccgggggca

SEQ ID NO: 2205115 - RNA, 19 nt, Homo sapiens
guggaaagucacaggucac

SEQ ID NO: 2205116 - RNA, 15 nt, Homo sapiens
cucacagcacuuguu

SEQ ID NO: 2205117 - RNA, 20 nt, Homo sapiens
aaacauuccccuccccacuc

SEQ ID NO: 2205118 - RNA, 21 nt, Homo sapiens
gcugcagguuuguaaugcaaa

SEQ ID NO: 2205119 - RNA, 16 nt, Homo sapiens
aacguguuugugguca

SEQ ID NO: 2205120 - RNA, 16 nt, Homo sapiens
aguagguuuacauuca

SEQ ID NO: 2205121 - RNA, 17 nt, Homo sapiens
ucccuagggccuucaga

SEQ ID NO: 2205122 - RNA, 14 nt, Homo sapiens
aacauuuaaauucc

SEQ ID NO: 2205123 - RNA, 18 nt, Homo sapiens
acugaguucuauauucug

SEQ ID NO: 2205124 - RNA, 20 nt, Homo sapiens
agugacaucucuuugauguc

SEQ ID NO: 2205125 - RNA, 21 nt, Homo sapiens
cuuugguaaucucugugaaau

SEQ ID NO: 2205126 - RNA, 15 nt, Homo sapiens
uccgcugucacccag

SEQ ID NO: 2205127 - RNA, 15 nt, Homo sapiens
ucaggagucaacgug

SEQ ID NO: 2205128 - RNA, 16 nt, Homo sapiens
caccccagaggccacc

SEQ ID NO: 2205129 - RNA, 19 nt, Homo sapiens
cacauagaagcuguccuug

SEQ ID NO: 2205130 - RNA, 15 nt, Homo sapiens
aggacaacaucagcu

SEQ ID NO: 2205131 - RNA, 19 nt, Homo sapiens
gaaguguucugagcuguau

SEQ ID NO: 2205132 - RNA, 18 nt, Homo sapiens
gaggugggcagcagcuca

SEQ ID NO: 2205133 - RNA, 13 nt, Homo sapiens
ucagcaagcauuu

SEQ ID NO: 2205134 - RNA, 22 nt, Homo sapiens
ugcuggcagaaagcaaauguga

SEQ ID NO: 2205135 - RNA, 16 nt, Homo sapiens
agcccaucaccucuaa

SEQ ID NO: 2205136 - RNA, 15 nt, Homo sapiens
aaagccaucauguaa

SEQ ID NO: 2205137 - RNA, 18 nt, Homo sapiens
ugugcagaaaacauuguu

SEQ ID NO: 2205138 - RNA, 17 nt, Homo sapiens
cauuuggacaaucugca

SEQ ID NO: 2205139 - RNA, 22 nt, Homo sapiens
ccaugauggugcugaccucugg

SEQ ID NO: 2205140 - RNA, 21 nt, Homo sapiens
uggcugaucauugcaguauca

SEQ ID NO: 2205141 - RNA, 16 nt, Homo sapiens
acauaaacccaucugu

SEQ ID NO: 2205142 - RNA, 20 nt, Homo sapiens
cgccuuugugagcugugagu

SEQ ID NO: 2205143 - RNA, 23 nt, Homo sapiens
ggcuauuauuugacuuguugcug

SEQ ID NO: 2205144 - RNA, 13 nt, Homo sapiens
acagagaguccca

SEQ ID NO: 2205145 - RNA, 14 nt, Homo sapiens
aaagaguaagggua

SEQ ID NO: 2205146 - RNA, 16 nt, Homo sapiens
ccuccgaccacuucca

SEQ ID NO: 2205147 - RNA, 21 nt, Homo sapiens
ugaacaguuuaugcagugcug

SEQ ID NO: 2205148 - RNA, 16 nt, Homo sapiens
ccucgcaugacuguua

SEQ ID NO: 2205149 - RNA, 15 nt, Homo sapiens
caucccccacuccuu

SEQ ID NO: 2205150 - RNA, 14 nt, Homo sapiens
aaagucaccugccc

SEQ ID NO: 2205151 - RNA, 14 nt, Homo sapiens
ugugacauuguagu

SEQ ID NO: 2205152 - RNA, 14 nt, Homo sapiens
ucuucagugucucu

SEQ ID NO: 2205153 - RNA, 18 nt, Homo sapiens
cuuuaaagccgugcucuu

SEQ ID NO: 2205154 - RNA, 18 nt, Homo sapiens
ccacugcagaagacagua

SEQ ID NO: 2205155 - RNA, 19 nt, Homo sapiens
uaacauguuuuacucacaa

SEQ ID NO: 2205156 - RNA, 17 nt, Homo sapiens
aagcccccacacagacc

SEQ ID NO: 2205157 - RNA, 23 nt, Homo sapiens
ccauuuuuuucauuguguucucu

SEQ ID NO: 2205158 - RNA, 13 nt, Homo sapiens
ccucccuuugcca

SEQ ID NO: 2205159 - RNA, 21 nt, Homo sapiens
gccuuacaaacucacuaugaa

SEQ ID NO: 2205160 - RNA, 16 nt, Homo sapiens
aguuucaaaauguuaa

SEQ ID NO: 2205161 - RNA, 22 nt, Homo sapiens
ugcacacacacagagauaugca

SEQ ID NO: 2205162 - RNA, 20 nt, Homo sapiens
uccagcaggguauggccagc

SEQ ID NO: 2205163 - RNA, 21 nt, Homo sapiens
cuaucacauacaauuugcacu

SEQ ID NO: 2205164 - RNA, 16 nt, Homo sapiens
aaaacacccuuuccaa

SEQ ID NO: 2205165 - RNA, 21 nt, Homo sapiens
cauaaaagacaagcacuuugg

SEQ ID NO: 2205166 - RNA, 20 nt, Homo sapiens
agaacauuaauuauauguau

SEQ ID NO: 2205167 - RNA, 23 nt, Homo sapiens
agaucugcuucuucaucuugaca

SEQ ID NO: 2205168 - RNA, 14 nt, Homo sapiens
cugccuugcuguga

SEQ ID NO: 2205169 - RNA, 17 nt, Homo sapiens
cgauaaaagacagugaa

SEQ ID NO: 2205170 - RNA, 16 nt, Homo sapiens
aguuaugugaccucac

SEQ ID NO: 2205171 - RNA, 19 nt, Homo sapiens
gcagcaagggaccugcuca

SEQ ID NO: 2205172 - RNA, 23 nt, Homo sapiens
uguugcugauuuugaccuuguau

SEQ ID NO: 2205173 - RNA, 21 nt, Homo sapiens
gccugcacagauaccucauca

SEQ ID NO: 2205174 - RNA, 16 nt, Homo sapiens
augauugugugacuau

SEQ ID NO: 2205175 - RNA, 15 nt, Homo sapiens
cagguggcaccugca

SEQ ID NO: 2205176 - RNA, 18 nt, Homo sapiens
ucaagcaauccagccuca

SEQ ID NO: 2205177 - RNA, 13 nt, Homo sapiens
uucaaaccaggau

SEQ ID NO: 2205178 - RNA, 15 nt, Homo sapiens
gacgcugcugccgug

SEQ ID NO: 2205179 - RNA, 21 nt, Homo sapiens
gauguaaaaaugaaaagccaa

SEQ ID NO: 2205180 - RNA, 21 nt, Homo sapiens
uggcaguguggcagugaccau

SEQ ID NO: 2205181 - RNA, 21 nt, Homo sapiens
aaggaagugagguagugccaa

SEQ ID NO: 2205182 - RNA, 22 nt, Homo sapiens
caacugaccugaccccauuccu

SEQ ID NO: 2205183 - RNA, 16 nt, Homo sapiens
cgcuagaguucuccag

SEQ ID NO: 2205184 - RNA, 15 nt, Homo sapiens
uaaaagccacauaga

SEQ ID NO: 2205185 - RNA, 16 nt, Homo sapiens
uguuauacugaaccag

SEQ ID NO: 2205186 - RNA, 18 nt, Homo sapiens
caguggcauucacaucuc

SEQ ID NO: 2205187 - RNA, 14 nt, Homo sapiens
cuuaaacaauguau

SEQ ID NO: 2205188 - RNA, 16 nt, Homo sapiens
auucaaaagcacaaac

SEQ ID NO: 2205189 - RNA, 13 nt, Homo sapiens
auagucuguccaa

SEQ ID NO: 2205190 - RNA, 18 nt, Homo sapiens
cacacgcugcccaggcuc

SEQ ID NO: 2205191 - RNA, 13 nt, Homo sapiens
ucaugagaauuga

SEQ ID NO: 2205192 - RNA, 19 nt, Homo sapiens
auacagaaagugacaaggg

SEQ ID NO: 2205193 - RNA, 16 nt, Homo sapiens
cuaguggaaaugagcg

SEQ ID NO: 2205194 - RNA, 16 nt, Homo sapiens
cugcacagcaaaagaa

SEQ ID NO: 2205195 - RNA, 18 nt, Homo sapiens
cccuggguguccccgcug

SEQ ID NO: 2205196 - RNA, 22 nt, Homo sapiens
accauggcaugguuauugauga

SEQ ID NO: 2205197 - RNA, 14 nt, Homo sapiens
ggcggcuccagguc

SEQ ID NO: 2205198 - RNA, 20 nt, Homo sapiens
acgguggccagagaugccag

SEQ ID NO: 2205199 - RNA, 20 nt, Homo sapiens
gccuuccugggcagccuuuc

SEQ ID NO: 2205200 - RNA, 18 nt, Homo sapiens
gcuauaauaaagaagugu

SEQ ID NO: 2205201 - RNA, 16 nt, Homo sapiens
uugccucaaguuccau

SEQ ID NO: 2205202 - RNA, 14 nt, Homo sapiens
agcuucucaauuuc

SEQ ID NO: 2205203 - RNA, 16 nt, Homo sapiens
guggcccugugccugg

SEQ ID NO: 2205204 - RNA, 13 nt, Homo sapiens
guugcaguaguau

SEQ ID NO: 2205205 - RNA, 20 nt, Homo sapiens
guguccgugaaaguugugau

SEQ ID NO: 2205206 - RNA, 19 nt, Homo sapiens
cagaaagccaacauguggc

SEQ ID NO: 2205207 - RNA, 23 nt, Homo sapiens
caagacacccaguggaaccaaaa

SEQ ID NO: 2205208 - RNA, 14 nt, Homo sapiens
auguuugacacaau

SEQ ID NO: 2205209 - RNA, 13 nt, Homo sapiens
acaauacuguucu

SEQ ID NO: 2205210 - RNA, 12 nt, Homo sapiens
ugcuaaagacau

SEQ ID NO: 2205211 - RNA, 16 nt, Homo sapiens
cagagggaaacacagc

SEQ ID NO: 2205212 - RNA, 15 nt, Homo sapiens
auuucccuacccuaa

SEQ ID NO: 2205213 - RNA, 14 nt, Homo sapiens
cuccugccaaaaga

SEQ ID NO: 2205214 - RNA, 20 nt, Homo sapiens
auaugucagggcacauguga

SEQ ID NO: 2205215 - RNA, 17 nt, Homo sapiens
ccagcucccuagacugc

SEQ ID NO: 2205216 - RNA, 23 nt, Homo sapiens
agugcccucuggacagcuugacu

SEQ ID NO: 2205217 - RNA, 17 nt, Homo sapiens
ccacguggccgcugccc

SEQ ID NO: 2205218 - RNA, 15 nt, Homo sapiens
cauguggugggacuu

SEQ ID NO: 2205219 - RNA, 15 nt, Homo sapiens
uuuggauuacuuaaa

SEQ ID NO: 2205220 - RNA, 20 nt, Homo sapiens
aucuuguuuauagcaaaaau

SEQ ID NO: 2205221 - RNA, 16 nt, Homo sapiens
cacauaaacuuuauaa

SEQ ID NO: 2205222 - RNA, 14 nt, Homo sapiens
ucauuccccggggc

SEQ ID NO: 2205223 - RNA, 19 nt, Homo sapiens
uaaucucucugcagcugcc

SEQ ID NO: 2205224 - RNA, 21 nt, Homo sapiens
aguacaaauguuuuucaucca

SEQ ID NO: 2205225 - RNA, 21 nt, Homo sapiens
aagcaccuaaaacccaaaggu

SEQ ID NO: 2205226 - RNA, 20 nt, Homo sapiens
cgucagagaccugggagcag

SEQ ID NO: 2205227 - RNA, 18 nt, Homo sapiens
uguuuccugcaccugcug

SEQ ID NO: 2205228 - RNA, 15 nt, Homo sapiens
uggauaacauugcua

SEQ ID NO: 2205229 - RNA, 19 nt, Homo sapiens
acauuaggaguaacuuuca

SEQ ID NO: 2205230 - RNA, 15 nt, Homo sapiens
gcuucuucacaggca

SEQ ID NO: 2205231 - RNA, 19 nt, Homo sapiens
gcugcaccacuuccagggu

SEQ ID NO: 2205232 - RNA, 17 nt, Homo sapiens
agaguuaacaaugauau

SEQ ID NO: 2205233 - RNA, 14 nt, Homo sapiens
ugugcuuucauguu

SEQ ID NO: 2205234 - RNA, 12 nt, Homo sapiens
acaguaaaucac

SEQ ID NO: 2205235 - RNA, 15 nt, Homo sapiens
ugcccacaccaacga

SEQ ID NO: 2205236 - RNA, 12 nt, Homo sapiens
uggggaaagugc

SEQ ID NO: 2205237 - RNA, 15 nt, Homo sapiens
gucuugcuaccucag

SEQ ID NO: 2205238 - RNA, 20 nt, Homo sapiens
uucacaguugagugcauccc

SEQ ID NO: 2205239 - RNA, 12 nt, Homo sapiens
ccuugugaucca

SEQ ID NO: 2205240 - RNA, 16 nt, Homo sapiens
auuuccaaauucacaa

SEQ ID NO: 2205241 - RNA, 21 nt, Homo sapiens
cuuggauuuuccugaaagugu

SEQ ID NO: 2205242 - RNA, 18 nt, Homo sapiens
ucuuuagccagaaucuca

SEQ ID NO: 2205243 - RNA, 20 nt, Homo sapiens
aagaacaguaacugccauca

SEQ ID NO: 2205244 - RNA, 15 nt, Homo sapiens
agcuccugacacugc

SEQ ID NO: 2205245 - RNA, 17 nt, Homo sapiens
ucugagagccaggguuu

SEQ ID NO: 2205246 - RNA, 21 nt, Homo sapiens
ugccauggcuggggggucuca

SEQ ID NO: 2205247 - RNA, 18 nt, Homo sapiens
cugugaggccccuggaca

SEQ ID NO: 2205248 - RNA, 14 nt, Homo sapiens
uauucaucagggag

SEQ ID NO: 2205249 - RNA, 16 nt, Homo sapiens
cugccuuuaugagauu

SEQ ID NO: 2205250 - RNA, 12 nt, Homo sapiens
uuuuauuugacu

SEQ ID NO: 2205251 - RNA, 20 nt, Homo sapiens
auaucuuugagggcugacaa

SEQ ID NO: 2205252 - RNA, 18 nt, Homo sapiens
guuacuggggucacccaa

SEQ ID NO: 2205253 - RNA, 19 nt, Homo sapiens
auucaagaaacagaaguag

SEQ ID NO: 2205254 - RNA, 22 nt, Homo sapiens
ggcacuccucucgcauggugug

SEQ ID NO: 2205255 - RNA, 23 nt, Homo sapiens
agcuuaaauaaauucaaaccauu

SEQ ID NO: 2205256 - RNA, 16 nt, Homo sapiens
cauguauugugucuuu

SEQ ID NO: 2205257 - RNA, 15 nt, Homo sapiens
caaauugcuuuacag

SEQ ID NO: 2205258 - RNA, 17 nt, Homo sapiens
cugcuuccagugaggcu

SEQ ID NO: 2205259 - RNA, 18 nt, Homo sapiens
cucugaggagcccacggg

SEQ ID NO: 2205260 - RNA, 20 nt, Homo sapiens
cuggcaucuuucaacaauga

SEQ ID NO: 2205261 - RNA, 16 nt, Homo sapiens
gcaaccagagcacugu

SEQ ID NO: 2205262 - RNA, 14 nt, Homo sapiens
guguucaacuguga

SEQ ID NO: 2205263 - RNA, 15 nt, Homo sapiens
gauuugagggagaag

SEQ ID NO: 2205264 - RNA, 14 nt, Homo sapiens
aauggucucagccu

SEQ ID NO: 2205265 - RNA, 15 nt, Homo sapiens
ugaaaucucaggaau

SEQ ID NO: 2205266 - RNA, 15 nt, Homo sapiens
cagggacuugaaguu

SEQ ID NO: 2205267 - RNA, 15 nt, Homo sapiens
ccggauauauacaua

SEQ ID NO: 2205268 - RNA, 18 nt, Homo sapiens
agaaaugacugcauuuga

SEQ ID NO: 2205269 - RNA, 19 nt, Homo sapiens
aggcuucaggggacuguuc

SEQ ID NO: 2205270 - RNA, 18 nt, Homo sapiens
ugcgucaggcagugugag

SEQ ID NO: 2205271 - RNA, 15 nt, Homo sapiens
ugaaaaugaccaaaa

SEQ ID NO: 2205272 - RNA, 15 nt, Homo sapiens
aauggaaacauuuac

SEQ ID NO: 2205273 - RNA, 14 nt, Homo sapiens
ggcauuugaucaga

SEQ ID NO: 2205274 - RNA, 17 nt, Homo sapiens
uucugguuuaacuaaua

SEQ ID NO: 2205275 - RNA, 17 nt, Homo sapiens
auaacugagcacuuuga

SEQ ID NO: 2205276 - RNA, 13 nt, Homo sapiens
cggaguugugcac

SEQ ID NO: 2205277 - RNA, 18 nt, Homo sapiens
gagauggggacaggugaa

SEQ ID NO: 2205278 - RNA, 14 nt, Homo sapiens
ugaaaccccaucuc

SEQ ID NO: 2205279 - RNA, 13 nt, Homo sapiens
gaucuuccucaca

SEQ ID NO: 2205280 - RNA, 14 nt, Homo sapiens
ugcuacuaacagau

SEQ ID NO: 2205281 - RNA, 11 nt, Homo sapiens
ggccccugaca

SEQ ID NO: 2205282 - RNA, 18 nt, Homo sapiens
gugguaggccauggccac

SEQ ID NO: 2205283 - RNA, 20 nt, Homo sapiens
cucgggaaacacacaagcaa

SEQ ID NO: 2205284 - RNA, 16 nt, Homo sapiens
ucagaagccuagggga

SEQ ID NO: 2205285 - RNA, 21 nt, Homo sapiens
uauaacaaacuacauguaauc

SEQ ID NO: 2205286 - RNA, 19 nt, Homo sapiens
uugaaggcccugcugaguc

SEQ ID NO: 2205287 - RNA, 19 nt, Homo sapiens
auacuuagagaaccuauag

SEQ ID NO: 2205288 - RNA, 22 nt, Homo sapiens
caugaacccugccccacuccug

SEQ ID NO: 2205289 - RNA, 14 nt, Homo sapiens
cugcaaaaggaggu

SEQ ID NO: 2205290 - RNA, 18 nt, Homo sapiens
uccaccgcagaaggaagg

SEQ ID NO: 2205291 - RNA, 15 nt, Homo sapiens
cagucucuacuguua

SEQ ID NO: 2205292 - RNA, 18 nt, Homo sapiens
gguucacugcacuguuca

SEQ ID NO: 2205293 - RNA, 12 nt, Homo sapiens
gacaaaugccaa

SEQ ID NO: 2205294 - RNA, 18 nt, Homo sapiens
ugaagaccccacugccac

SEQ ID NO: 2205295 - RNA, 13 nt, Homo sapiens
cuccaaaauauua

SEQ ID NO: 2205296 - RNA, 15 nt, Homo sapiens
cucugcuccaccuug

SEQ ID NO: 2205297 - RNA, 19 nt, Homo sapiens
ggccaagccuaucaaagga

SEQ ID NO: 2205298 - RNA, 15 nt, Homo sapiens
ucagauuucauguca

SEQ ID NO: 2205299 - RNA, 19 nt, Homo sapiens
uguuguucauagucaauca

SEQ ID NO: 2205300 - RNA, 16 nt, Homo sapiens
uucaagauuaaacuga

SEQ ID NO: 2205301 - RNA, 20 nt, Homo sapiens
agggcagucaguaguauucu

SEQ ID NO: 2205302 - RNA, 17 nt, Homo sapiens
acucaauggaguauguc

SEQ ID NO: 2205303 - RNA, 15 nt, Homo sapiens
aaucaccuccugugu

SEQ ID NO: 2205304 - RNA, 15 nt, Homo sapiens
uaucaauuacagucc

SEQ ID NO: 2205305 - RNA, 13 nt, Homo sapiens
cacucagcacuuu

SEQ ID NO: 2205306 - RNA, 15 nt, Homo sapiens
guaaagaaguuugau

SEQ ID NO: 2205307 - RNA, 13 nt, Homo sapiens
ugggggucagggg

SEQ ID NO: 2205308 - RNA, 19 nt, Homo sapiens
ccagaagcaguaauaauca

SEQ ID NO: 2205309 - RNA, 14 nt, Homo sapiens
accuccucccucau

SEQ ID NO: 2205310 - RNA, 14 nt, Homo sapiens
ucgagacacaguga

SEQ ID NO: 2205311 - RNA, 19 nt, Homo sapiens
guacagaccaccuuucaca

SEQ ID NO: 2205312 - RNA, 12 nt, Homo sapiens
gcaucuguguaa

SEQ ID NO: 2205313 - RNA, 16 nt, Homo sapiens
aaugcuccuccuccau

SEQ ID NO: 2205314 - RNA, 15 nt, Homo sapiens
uauaaauacugcaaa

SEQ ID NO: 2205315 - RNA, 14 nt, Homo sapiens
uugacaucagcauu

SEQ ID NO: 2205316 - RNA, 20 nt, Homo sapiens
cuauuaaugaggucuuuaaa

SEQ ID NO: 2205317 - RNA, 20 nt, Homo sapiens
uguacauuuaauaauaucaa

SEQ ID NO: 2205318 - RNA, 17 nt, Homo sapiens
uuagagcaaccucugua

SEQ ID NO: 2205319 - RNA, 20 nt, Homo sapiens
guuauacaaccaucaaagug

SEQ ID NO: 2205320 - RNA, 21 nt, Homo sapiens
ggacuauggcucuacuuucag

SEQ ID NO: 2205321 - RNA, 13 nt, Homo sapiens
uuuccuugcaaau

SEQ ID NO: 2205322 - RNA, 19 nt, Homo sapiens
guguagggguguguguaug

SEQ ID NO: 2205323 - RNA, 21 nt, Homo sapiens
uaaagaccuugaaaagcagua

SEQ ID NO: 2205324 - RNA, 14 nt, Homo sapiens
caucaaaguguuua

SEQ ID NO: 2205325 - RNA, 16 nt, Homo sapiens
gcaccuagcugugcaa

SEQ ID NO: 2205326 - RNA, 19 nt, Homo sapiens
uaggucuccaagaccaccc

SEQ ID NO: 2205327 - RNA, 22 nt, Homo sapiens
gcagcgguagcaucugagcucc

SEQ ID NO: 2205328 - RNA, 13 nt, Homo sapiens
cuuauaugugaca

SEQ ID NO: 2205329 - RNA, 21 nt, Homo sapiens
ucuaaucaaaagggaaaagaa

SEQ ID NO: 2205330 - RNA, 11 nt, Homo sapiens
ggagcaguuga

SEQ ID NO: 2205331 - RNA, 18 nt, Homo sapiens
ccaaggcccagcuauggc

SEQ ID NO: 2205332 - RNA, 22 nt, Homo sapiens
uuuuguagagacagggucucac

SEQ ID NO: 2205333 - RNA, 22 nt, Homo sapiens
ucaccacuguaguucucucauu

SEQ ID NO: 2205334 - RNA, 16 nt, Homo sapiens
caucuuccucugcaga

SEQ ID NO: 2205335 - RNA, 21 nt, Homo sapiens
gcuuggugguuaugucccaug

SEQ ID NO: 2205336 - RNA, 15 nt, Homo sapiens
gacaggggcucagga

SEQ ID NO: 2205337 - RNA, 15 nt, Homo sapiens
guggugggcagguga

SEQ ID NO: 2205338 - RNA, 15 nt, Homo sapiens
caggccggguggcca

SEQ ID NO: 2205339 - RNA, 18 nt, Homo sapiens
uguugccuugagcucuuc

SEQ ID NO: 2205340 - RNA, 16 nt, Homo sapiens
gaaagaagccacagcu

SEQ ID NO: 2205341 - RNA, 15 nt, Homo sapiens
gaaaaauuauuugug

SEQ ID NO: 2205342 - RNA, 22 nt, Homo sapiens
cgucaagagugaauucccucac

SEQ ID NO: 2205343 - RNA, 18 nt, Homo sapiens
gauccugucuugcugagg

SEQ ID NO: 2205344 - RNA, 18 nt, Homo sapiens
uauaugaauauuuugcaa

SEQ ID NO: 2205345 - RNA, 21 nt, Homo sapiens
ugagggaggggagcuaugcua

SEQ ID NO: 2205346 - RNA, 13 nt, Homo sapiens
gacaugaauggag

SEQ ID NO: 2205347 - RNA, 22 nt, Homo sapiens
aucugcuuuugguuauaaugug

SEQ ID NO: 2205348 - RNA, 13 nt, Homo sapiens
uuacaaauauugu

SEQ ID NO: 2205349 - RNA, 23 nt, Homo sapiens
cuggcuuggggucaagaaacagc

SEQ ID NO: 2205350 - RNA, 16 nt, Homo sapiens
cuuugccacacugugg

SEQ ID NO: 2205351 - RNA, 16 nt, Homo sapiens
gaaccugagacucaga

SEQ ID NO: 2205352 - RNA, 16 nt, Homo sapiens
uuugagaagcucugau

SEQ ID NO: 2205353 - RNA, 16 nt, Homo sapiens
uguucauucugugacc

SEQ ID NO: 2205354 - RNA, 17 nt, Homo sapiens
acuccuggcuucaugug

SEQ ID NO: 2205355 - RNA, 18 nt, Homo sapiens
gugagaugggacauucca

SEQ ID NO: 2205356 - RNA, 14 nt, Homo sapiens
ugcuugcugcucau

SEQ ID NO: 2205357 - RNA, 15 nt, Homo sapiens
gaugcuguugggaaa

SEQ ID NO: 2205358 - RNA, 18 nt, Homo sapiens
agaaaaccauucuggaca

SEQ ID NO: 2205359 - RNA, 23 nt, Homo sapiens
acccuuauaaaauccugugcaau

SEQ ID NO: 2205360 - RNA, 18 nt, Homo sapiens
aauuagggcuacauugua

SEQ ID NO: 2205361 - RNA, 18 nt, Homo sapiens
auaaaauguuuucacugu

SEQ ID NO: 2205362 - RNA, 20 nt, Homo sapiens
cuugagucuguguugugucc

SEQ ID NO: 2205363 - RNA, 13 nt, Homo sapiens
caacgaaaagcac

SEQ ID NO: 2205364 - RNA, 21 nt, Homo sapiens
gccaccaccuacagcccagug

SEQ ID NO: 2205365 - RNA, 20 nt, Homo sapiens
agcaaauaaacuuacagauc

SEQ ID NO: 2205366 - RNA, 20 nt, Homo sapiens
aacucaaauacacauuugcu

SEQ ID NO: 2205367 - RNA, 14 nt, Homo sapiens
cucaggacagaaca

SEQ ID NO: 2205368 - RNA, 15 nt, Homo sapiens
gaagcugaaaugcag

SEQ ID NO: 2205369 - RNA, 15 nt, Homo sapiens
gcucaagaacacaug

SEQ ID NO: 2205370 - RNA, 20 nt, Homo sapiens
cacgaggugguagcucugag

SEQ ID NO: 2205371 - RNA, 14 nt, Homo sapiens
gaccccgagccugg

SEQ ID NO: 2205372 - RNA, 15 nt, Homo sapiens
ccuuguaaaagccua

SEQ ID NO: 2205373 - RNA, 12 nt, Homo sapiens
uacaagaacaau

SEQ ID NO: 2205374 - RNA, 14 nt, Homo sapiens
uauuuuuaccuaaa

SEQ ID NO: 2205375 - RNA, 21 nt, Homo sapiens
uauucaaguauuccuaugcca

SEQ ID NO: 2205376 - RNA, 19 nt, Homo sapiens
aggaugggugaaaccacau

SEQ ID NO: 2205377 - RNA, 15 nt, Homo sapiens
uuaucuuacaaagug

SEQ ID NO: 2205378 - RNA, 20 nt, Homo sapiens
cuggcagaucaugaagccca

SEQ ID NO: 2205379 - RNA, 14 nt, Homo sapiens
aaggggccuggaag

SEQ ID NO: 2205380 - RNA, 17 nt, Homo sapiens
auaguaagccccuguga

SEQ ID NO: 2205381 - RNA, 15 nt, Homo sapiens
uaaguaagacuuuua

SEQ ID NO: 2205382 - RNA, 19 nt, Homo sapiens
ugcuugccgaaacuggaag

SEQ ID NO: 2205383 - RNA, 17 nt, Homo sapiens
cagauggccacugcucu

SEQ ID NO: 2205384 - RNA, 17 nt, Homo sapiens
gaauccuccuccagggu

SEQ ID NO: 2205385 - RNA, 13 nt, Homo sapiens
gaaguuaccaaau

SEQ ID NO: 2205386 - RNA, 19 nt, Homo sapiens
ucagaaauucucugcgauu

SEQ ID NO: 2205387 - RNA, 11 nt, Homo sapiens
uuacaguucug

SEQ ID NO: 2205388 - RNA, 22 nt, Homo sapiens
guucuuguuuuauauaccuggc

SEQ ID NO: 2205389 - RNA, 18 nt, Homo sapiens
gcuuggauuaaauacaua

SEQ ID NO: 2205390 - RNA, 19 nt, Homo sapiens
ccuauugccuccauucucc

SEQ ID NO: 2205391 - RNA, 20 nt, Homo sapiens
uuuaccucacacccaaagca

SEQ ID NO: 2205392 - RNA, 16 nt, Homo sapiens
aggauuuuaccaaagc

SEQ ID NO: 2205393 - RNA, 16 nt, Homo sapiens
ucaagaggaccaaaug

SEQ ID NO: 2205394 - RNA, 17 nt, Homo sapiens
caagaaugugcacucuc

SEQ ID NO: 2205395 - RNA, 22 nt, Homo sapiens
uguaaaccaucgcgugcaauga

SEQ ID NO: 2205396 - RNA, 16 nt, Homo sapiens
caucaggcagcccaaa

SEQ ID NO: 2205397 - RNA, 20 nt, Homo sapiens
uugauacaucaucgggaaaa

SEQ ID NO: 2205398 - RNA, 20 nt, Homo sapiens
agcgugaggagcgaucucag

SEQ ID NO: 2205399 - RNA, 16 nt, Homo sapiens
gcuucuuauccuuaca

SEQ ID NO: 2205400 - RNA, 13 nt, Homo sapiens
gcagggcugugau

SEQ ID NO: 2205401 - RNA, 19 nt, Homo sapiens
gcucccaugugagucccug

SEQ ID NO: 2205402 - RNA, 23 nt, Homo sapiens
uuauggggccuaaccugccacuu

SEQ ID NO: 2205403 - RNA, 12 nt, Homo sapiens
ccuagugccuuc

SEQ ID NO: 2205404 - RNA, 21 nt, Homo sapiens
uuuugcccacacacuuuccau

SEQ ID NO: 2205405 - RNA, 18 nt, Homo sapiens
gagugggguggggagcau

SEQ ID NO: 2205406 - RNA, 18 nt, Homo sapiens
agcuagagcuuuaccuga

SEQ ID NO: 2205407 - RNA, 14 nt, Homo sapiens
guguugaucccaag

SEQ ID NO: 2205408 - RNA, 17 nt, Homo sapiens
uugaguuacugaucuuc

SEQ ID NO: 2205409 - RNA, 22 nt, Homo sapiens
aucuagcuggcuucccugucua

SEQ ID NO: 2205410 - RNA, 17 nt, Homo sapiens
uuuguucucccaaaaca

SEQ ID NO: 2205411 - RNA, 15 nt, Homo sapiens
cugccuuacagacag

SEQ ID NO: 2205412 - RNA, 14 nt, Homo sapiens
gcaacuagggcuag

SEQ ID NO: 2205413 - RNA, 15 nt, Homo sapiens
uccugcaccgagaga

SEQ ID NO: 2205414 - RNA, 15 nt, Homo sapiens
ugccugguaccagag

SEQ ID NO: 2205415 - RNA, 15 nt, Homo sapiens
gcccuggugcugcca

SEQ ID NO: 2205416 - RNA, 20 nt, Homo sapiens
ccuauuagaguauuuuccac

SEQ ID NO: 2205417 - RNA, 17 nt, Homo sapiens
auucaaccaaccaagga

SEQ ID NO: 2205418 - RNA, 18 nt, Homo sapiens
auguuagccacaguguau

SEQ ID NO: 2205419 - RNA, 14 nt, Homo sapiens
cucaucacuggacu

SEQ ID NO: 2205420 - RNA, 15 nt, Homo sapiens
auaaauuaagacuuu

SEQ ID NO: 2205421 - RNA, 15 nt, Homo sapiens
gagagagacaggcag

SEQ ID NO: 2205422 - RNA, 13 nt, Homo sapiens
ucccaggacccug

SEQ ID NO: 2205423 - RNA, 18 nt, Homo sapiens
ggcuggucuuggugaaca

SEQ ID NO: 2205424 - RNA, 19 nt, Homo sapiens
gcgucugccccacccucaa

SEQ ID NO: 2205425 - RNA, 17 nt, Homo sapiens
gaaggcccacuguccag

SEQ ID NO: 2205426 - RNA, 18 nt, Homo sapiens
ccucugcuguagcuuaug

SEQ ID NO: 2205427 - RNA, 23 nt, Homo sapiens
ugcugauuuuuuuucugauaaau

SEQ ID NO: 2205428 - RNA, 22 nt, Homo sapiens
gucacuacgugacuguggcaca

SEQ ID NO: 2205429 - RNA, 16 nt, Homo sapiens
cucuggcuggucuuca

SEQ ID NO: 2205430 - RNA, 15 nt, Homo sapiens
caggcagggucuguu

SEQ ID NO: 2205431 - RNA, 19 nt, Homo sapiens
uugauaaauccaucacuau

SEQ ID NO: 2205432 - RNA, 18 nt, Homo sapiens
cugacuuguuugucuucc

SEQ ID NO: 2205433 - RNA, 9 nt, Homo sapiens
gauggagcu

SEQ ID NO: 2205434 - RNA, 22 nt, Homo sapiens
cauaauagucaauuucuacuuc

SEQ ID NO: 2205435 - RNA, 19 nt, Homo sapiens
gccaagcagugccugccua

SEQ ID NO: 2205436 - RNA, 13 nt, Homo sapiens
agggcagaguaug

SEQ ID NO: 2205437 - RNA, 18 nt, Homo sapiens
aacagccccagugcacug

SEQ ID NO: 2205438 - RNA, 16 nt, Homo sapiens
gcccagggaugcaaag

SEQ ID NO: 2205439 - RNA, 20 nt, Homo sapiens
ugcagccaggagaaggucag

SEQ ID NO: 2205440 - RNA, 19 nt, Homo sapiens
auguaaacaaaaacaacug

SEQ ID NO: 2205441 - RNA, 17 nt, Homo sapiens
ucuauucuuugccuuag

SEQ ID NO: 2205442 - RNA, 22 nt, Homo sapiens
acuuaucccaagagaaugaaau

SEQ ID NO: 2205443 - RNA, 19 nt, Homo sapiens
aaauuagcugggcauggug

SEQ ID NO: 2205444 - RNA, 20 nt, Homo sapiens
aaaaggacucucaggaccaa

SEQ ID NO: 2205445 - RNA, 16 nt, Homo sapiens
uccgacugcuagggag

SEQ ID NO: 2205446 - RNA, 16 nt, Homo sapiens
aaagcccauugccauu

SEQ ID NO: 2205447 - RNA, 12 nt, Homo sapiens
accauuagcaua

SEQ ID NO: 2205448 - RNA, 19 nt, Homo sapiens
acuggaaaaaugaacugua

SEQ ID NO: 2205449 - RNA, 19 nt, Homo sapiens
uccacuuggucugugagau

SEQ ID NO: 2205450 - RNA, 14 nt, Homo sapiens
ggagccucaguuuc

SEQ ID NO: 2205451 - RNA, 19 nt, Homo sapiens
ccaggcuggagugcaguga

SEQ ID NO: 2205452 - RNA, 14 nt, Homo sapiens
aggaccuaucccaa

SEQ ID NO: 2205453 - RNA, 15 nt, Homo sapiens
gucacgcuucuucuu

SEQ ID NO: 2205454 - RNA, 13 nt, Homo sapiens
uuauugugauuac

SEQ ID NO: 2205455 - RNA, 22 nt, Homo sapiens
ccaaccgaacaugaccaaaaac

SEQ ID NO: 2205456 - RNA, 13 nt, Homo sapiens
aaaauaccuucua

SEQ ID NO: 2205457 - RNA, 11 nt, Homo sapiens
uaaugugaagg

SEQ ID NO: 2205458 - RNA, 14 nt, Homo sapiens
cuggcuuggaacac

SEQ ID NO: 2205459 - RNA, 12 nt, Homo sapiens
gagcagugcagc

SEQ ID NO: 2205460 - RNA, 16 nt, Homo sapiens
aacccuaagccaagac

SEQ ID NO: 2205461 - RNA, 18 nt, Homo sapiens
auguuucagaagcauuca

SEQ ID NO: 2205462 - RNA, 19 nt, Homo sapiens
cuuuguuuacaugaguuca

SEQ ID NO: 2205463 - RNA, 13 nt, Homo sapiens
aaccagucugaag

SEQ ID NO: 2205464 - RNA, 15 nt, Homo sapiens
cuccuucuugcccug

SEQ ID NO: 2205465 - RNA, 16 nt, Homo sapiens
cauccugaacugcuuc

SEQ ID NO: 2205466 - RNA, 12 nt, Homo sapiens
agugggugguga

SEQ ID NO: 2205467 - RNA, 15 nt, Homo sapiens
auggcucugugaaau

SEQ ID NO: 2205468 - RNA, 17 nt, Homo sapiens
aauuacuaaauuacaaa

SEQ ID NO: 2205469 - RNA, 21 nt, Homo sapiens
ugaaaacauagcaucucagga

SEQ ID NO: 2205470 - RNA, 17 nt, Homo sapiens
gagaauccuuguggcuu

SEQ ID NO: 2205471 - RNA, 17 nt, Homo sapiens
aaugccacaagacauaa

SEQ ID NO: 2205472 - RNA, 13 nt, Homo sapiens
uuccaaaguuuug

SEQ ID NO: 2205473 - RNA, 23 nt, Homo sapiens
accccaaucccugccacugggcu

SEQ ID NO: 2205474 - RNA, 13 nt, Homo sapiens
aagagaugaauug

SEQ ID NO: 2205475 - RNA, 22 nt, Homo sapiens
uguaacauuguaaaguauguga

SEQ ID NO: 2205476 - RNA, 22 nt, Homo sapiens
aggauccugagccagauuucac

SEQ ID NO: 2205477 - RNA, 15 nt, Homo sapiens
uucuagaaacaaaca

SEQ ID NO: 2205478 - RNA, 13 nt, Homo sapiens
caacugaccagcc

SEQ ID NO: 2205479 - RNA, 16 nt, Homo sapiens
ugcauacacacacaca

SEQ ID NO: 2205480 - RNA, 14 nt, Homo sapiens
ucccgggacuaccu

SEQ ID NO: 2205481 - RNA, 21 nt, Homo sapiens
caggucuccaccugcacauug

SEQ ID NO: 2205482 - RNA, 18 nt, Homo sapiens
cuugugguugaaaaccac

SEQ ID NO: 2205483 - RNA, 15 nt, Homo sapiens
ccgauaaugcaugaa

SEQ ID NO: 2205484 - RNA, 15 nt, Homo sapiens
cugaucauguaugca

SEQ ID NO: 2205485 - RNA, 19 nt, Homo sapiens
cuccaaaaguagcuuccuc

SEQ ID NO: 2205486 - RNA, 16 nt, Homo sapiens
cagcugaugaacugug

SEQ ID NO: 2205487 - RNA, 16 nt, Homo sapiens
uguaaugacagugcua

SEQ ID NO: 2205488 - RNA, 17 nt, Homo sapiens
uaaagcauaaguauaca

SEQ ID NO: 2205489 - RNA, 14 nt, Homo sapiens
caaaguguaugcag

SEQ ID NO: 2205490 - RNA, 23 nt, Homo sapiens
agggcuggaaacaagugacccca

SEQ ID NO: 2205491 - RNA, 18 nt, Homo sapiens
gauaugauuguaacauau

SEQ ID NO: 2205492 - RNA, 17 nt, Homo sapiens
ucugaguagcauauaua

SEQ ID NO: 2205493 - RNA, 23 nt, Homo sapiens
cucaugcaagacuucacugcagc

SEQ ID NO: 2205494 - RNA, 14 nt, Homo sapiens
ccugccuacuggau

SEQ ID NO: 2205495 - RNA, 15 nt, Homo sapiens
auaaagcagccucau

SEQ ID NO: 2205496 - RNA, 19 nt, Homo sapiens
gaagggugaauaguuuccu

SEQ ID NO: 2205497 - RNA, 19 nt, Homo sapiens
caguaaucccagcuacuca

SEQ ID NO: 2205498 - RNA, 20 nt, Homo sapiens
gcagggcagccugugggaga

SEQ ID NO: 2205499 - RNA, 20 nt, Homo sapiens
caaacauccuacaagacaca

SEQ ID NO: 2205500 - RNA, 16 nt, Homo sapiens
uuuguaugaaguacuu

SEQ ID NO: 2205501 - RNA, 20 nt, Homo sapiens
gacaccucaagguguucucu

SEQ ID NO: 2205502 - RNA, 15 nt, Homo sapiens
aagagaucuacacau

SEQ ID NO: 2205503 - RNA, 21 nt, Homo sapiens
auucuuuggagauggaguaua

SEQ ID NO: 2205504 - RNA, 16 nt, Homo sapiens
uaaagcauaaaaaggu

SEQ ID NO: 2205505 - RNA, 13 nt, Homo sapiens
cuuggugcucugu

SEQ ID NO: 2205506 - RNA, 20 nt, Homo sapiens
auuuucuccuugguuugcua

SEQ ID NO: 2205507 - RNA, 17 nt, Homo sapiens
gcaauuuugcauuugaa

SEQ ID NO: 2205508 - RNA, 17 nt, Homo sapiens
aaauuggaacaccuccu

SEQ ID NO: 2205509 - RNA, 14 nt, Homo sapiens
cagaguucagggag

SEQ ID NO: 2205510 - RNA, 15 nt, Homo sapiens
gaggcucuaauucuc

SEQ ID NO: 2205511 - RNA, 18 nt, Homo sapiens
uuacaaauaauuaucaca

SEQ ID NO: 2205512 - RNA, 15 nt, Homo sapiens
ugauggagcagagca

SEQ ID NO: 2205513 - RNA, 15 nt, Homo sapiens
cagugcagugaagga

SEQ ID NO: 2205514 - RNA, 13 nt, Homo sapiens
cugacccacagcc

SEQ ID NO: 2205515 - RNA, 21 nt, Homo sapiens
guacaguauguuuuacaugua

SEQ ID NO: 2205516 - RNA, 17 nt, Homo sapiens
uggcauaaccugucuca

SEQ ID NO: 2205517 - RNA, 14 nt, Homo sapiens
uccaggccccaaaa

SEQ ID NO: 2205518 - RNA, 18 nt, Homo sapiens
aauucagggagugggcua

SEQ ID NO: 2205519 - RNA, 15 nt, Homo sapiens
auugugugugcaaga

SEQ ID NO: 2205520 - RNA, 18 nt, Homo sapiens
agaccaucuacauacaca

SEQ ID NO: 2205521 - RNA, 13 nt, Homo sapiens
aagacaaaugggc

SEQ ID NO: 2205522 - RNA, 13 nt, Homo sapiens
aaaaaaaaugaga

SEQ ID NO: 2205523 - RNA, 13 nt, Homo sapiens
ugauagccuuccg

SEQ ID NO: 2205524 - RNA, 12 nt, Homo sapiens
cuuuauuucucu

SEQ ID NO: 2205525 - RNA, 19 nt, Homo sapiens
uuaagccuaaaugccuuag

SEQ ID NO: 2205526 - RNA, 10 nt, Homo sapiens
gcucuugucc

SEQ ID NO: 2205527 - RNA, 13 nt, Homo sapiens
uggccagugagau

SEQ ID NO: 2205528 - RNA, 22 nt, Homo sapiens
aacuuagaggaaaagggcacag

SEQ ID NO: 2205529 - RNA, 22 nt, Homo sapiens
ucuuuuacuguggagguggcug

SEQ ID NO: 2205530 - RNA, 21 nt, Homo sapiens
uuccuuuaugaugacugcuua

SEQ ID NO: 2205531 - RNA, 22 nt, Homo sapiens
uaacaguugcuuuggauucucu

SEQ ID NO: 2205532 - RNA, 14 nt, Homo sapiens
cacugcagggccag

SEQ ID NO: 2205533 - RNA, 16 nt, Homo sapiens
cuagguucgaauccag

SEQ ID NO: 2205534 - RNA, 16 nt, Homo sapiens
uguaaauuuguacuau

SEQ ID NO: 2205535 - RNA, 12 nt, Homo sapiens
uuggaaaucaca

SEQ ID NO: 2205536 - RNA, 16 nt, Homo sapiens
ugaauucaaagcuugu

SEQ ID NO: 2205537 - RNA, 20 nt, Homo sapiens
uaugaugcuggaaauaugaa

SEQ ID NO: 2205538 - RNA, 21 nt, Homo sapiens
auaggccugucccuugccucu

SEQ ID NO: 2205539 - RNA, 14 nt, Homo sapiens
ugagggacugccuc

SEQ ID NO: 2205540 - RNA, 23 nt, Homo sapiens
ugccuguagagacaauacaguaa

SEQ ID NO: 2205541 - RNA, 18 nt, Homo sapiens
cuccagugccagcaauga

SEQ ID NO: 2205542 - RNA, 18 nt, Homo sapiens
uuguacuaaucugagauu

SEQ ID NO: 2205543 - RNA, 17 nt, Homo sapiens
acauuuuacugauuaac

SEQ ID NO: 2205544 - RNA, 19 nt, Homo sapiens
cucuauugauguacagucu

SEQ ID NO: 2205545 - RNA, 18 nt, Homo sapiens
ggaaugaccccuaggcaa

SEQ ID NO: 2205546 - RNA, 13 nt, Homo sapiens
uggagcagccacc

SEQ ID NO: 2205547 - RNA, 17 nt, Homo sapiens
agcuggagaaauggcau

SEQ ID NO: 2205548 - RNA, 17 nt, Homo sapiens
agugaaaaaggaaugau

SEQ ID NO: 2205549 - RNA, 14 nt, Homo sapiens
aaccagugagcacu

SEQ ID NO: 2205550 - RNA, 14 nt, Homo sapiens
ccaaauacauucca

SEQ ID NO: 2205551 - RNA, 19 nt, Homo sapiens
aaauuuggggggucuugca

SEQ ID NO: 2205552 - RNA, 20 nt, Homo sapiens
gcccagacaccaugugcaau

SEQ ID NO: 2205553 - RNA, 20 nt, Homo sapiens
accaucaacuuaaagugaau

SEQ ID NO: 2205554 - RNA, 16 nt, Homo sapiens
gccgggcugcacagac

SEQ ID NO: 2205555 - RNA, 23 nt, Homo sapiens
uuucuucaaauguuuaaaccacu

SEQ ID NO: 2205556 - RNA, 18 nt, Homo sapiens
ucaaagauccagugcagu

SEQ ID NO: 2205557 - RNA, 14 nt, Homo sapiens
uucccccugcugau

SEQ ID NO: 2205558 - RNA, 16 nt, Homo sapiens
uuggaaucugcuccaa

SEQ ID NO: 2205559 - RNA, 15 nt, Homo sapiens
ccuucguguggcucc

SEQ ID NO: 2205560 - RNA, 20 nt, Homo sapiens
cuugauucucuccuacuguu

SEQ ID NO: 2205561 - RNA, 21 nt, Homo sapiens
uggcuggguuugggcagugga

SEQ ID NO: 2205562 - RNA, 22 nt, Homo sapiens
ugcaagguacucuggugaguca

SEQ ID NO: 2205563 - RNA, 15 nt, Homo sapiens
ggcaaucuugccuuc

SEQ ID NO: 2205564 - RNA, 15 nt, Homo sapiens
ugccuaauggcaaaa

SEQ ID NO: 2205565 - RNA, 22 nt, Homo sapiens
gcacuuuaacccucucuucccu

SEQ ID NO: 2205566 - RNA, 18 nt, Homo sapiens
ucaacccaagaaccuguu

SEQ ID NO: 2205567 - RNA, 15 nt, Homo sapiens
ucauaguaagauuga

SEQ ID NO: 2205568 - RNA, 12 nt, Homo sapiens
uuacuguuuaca

SEQ ID NO: 2205569 - RNA, 12 nt, Homo sapiens
caacacccaaag

SEQ ID NO: 2205570 - RNA, 17 nt, Homo sapiens
uggaagaaaugggagaa

SEQ ID NO: 2205571 - RNA, 16 nt, Homo sapiens
agagacuauguagcaa

SEQ ID NO: 2205572 - RNA, 11 nt, Homo sapiens
uaaacaugaag

SEQ ID NO: 2205573 - RNA, 17 nt, Homo sapiens
uccaguauucuugucaa

SEQ ID NO: 2205574 - RNA, 23 nt, Homo sapiens
acuguggcuucuuaaucuuuuca

SEQ ID NO: 2205575 - RNA, 18 nt, Homo sapiens
cccuccuggagcauccca

SEQ ID NO: 2205576 - RNA, 20 nt, Homo sapiens
accugaacugaaaggacugu

SEQ ID NO: 2205577 - RNA, 17 nt, Homo sapiens
cagauaacagugugcuc

SEQ ID NO: 2205578 - RNA, 13 nt, Homo sapiens
aaaacuggcucug

SEQ ID NO: 2205579 - RNA, 15 nt, Homo sapiens
ugggacucaguucuu

SEQ ID NO: 2205580 - RNA, 15 nt, Homo sapiens
aauugugaacaugau

SEQ ID NO: 2205581 - RNA, 13 nt, Homo sapiens
ugcuggaagaauu

SEQ ID NO: 2205582 - RNA, 15 nt, Homo sapiens
caucauccucacgug

SEQ ID NO: 2205583 - RNA, 18 nt, Homo sapiens
cauuguuuauuguauacu

SEQ ID NO: 2205584 - RNA, 21 nt, Homo sapiens
auuuuuacuaucacacaugaa

SEQ ID NO: 2205585 - RNA, 14 nt, Homo sapiens
acaauaaagcaaug

SEQ ID NO: 2205586 - RNA, 23 nt, Homo sapiens
uggauuaaaaaaaugugguacau

SEQ ID NO: 2205587 - RNA, 15 nt, Homo sapiens
aaagaaaacuaacaa

SEQ ID NO: 2205588 - RNA, 14 nt, Homo sapiens
uguaaauauuucaa

SEQ ID NO: 2205589 - RNA, 21 nt, Homo sapiens
ggccuauagauugauuuaccu

SEQ ID NO: 2205590 - RNA, 16 nt, Homo sapiens
gaccccugcccaccuc

SEQ ID NO: 2205591 - RNA, 17 nt, Homo sapiens
guguucugauuagaaau

SEQ ID NO: 2205592 - RNA, 20 nt, Homo sapiens
agccucagaagaaaacaaag

SEQ ID NO: 2205593 - RNA, 18 nt, Homo sapiens
cagcacuuagguuuuccu

SEQ ID NO: 2205594 - RNA, 14 nt, Homo sapiens
gccuguccuggauc

SEQ ID NO: 2205595 - RNA, 16 nt, Homo sapiens
cauguacuguucucuu

SEQ ID NO: 2205596 - RNA, 14 nt, Homo sapiens
gucucauucuucca

SEQ ID NO: 2205597 - RNA, 16 nt, Homo sapiens
cuguauuacauaaaua

SEQ ID NO: 2205598 - RNA, 13 nt, Homo sapiens
aacaaacauuuga

SEQ ID NO: 2205599 - RNA, 17 nt, Homo sapiens
aaagcaugggaucucau

SEQ ID NO: 2205600 - RNA, 22 nt, Homo sapiens
aagucaucucauuccacuguug

SEQ ID NO: 2205601 - RNA, 18 nt, Homo sapiens
uucacuggcuucccaaau

SEQ ID NO: 2205602 - RNA, 21 nt, Homo sapiens
uucagagacuccugcaggcag

SEQ ID NO: 2205603 - RNA, 16 nt, Homo sapiens
uaguagaaaugccaga

SEQ ID NO: 2205604 - RNA, 16 nt, Homo sapiens
cggugugcaccaacau

SEQ ID NO: 2205605 - RNA, 17 nt, Homo sapiens
caagccugucuucagag

SEQ ID NO: 2205606 - RNA, 23 nt, Homo sapiens
uaauucaugguuguuccaaagau

SEQ ID NO: 2205607 - RNA, 13 nt, Homo sapiens
uaauuguguacaa

SEQ ID NO: 2205608 - RNA, 15 nt, Homo sapiens
gauucucaugccuca

SEQ ID NO: 2205609 - RNA, 16 nt, Homo sapiens
uuuggagucacuguag

SEQ ID NO: 2205610 - RNA, 12 nt, Homo sapiens
agaaacucccau

SEQ ID NO: 2205611 - RNA, 15 nt, Homo sapiens
ucccccaaacauguu

SEQ ID NO: 2205612 - RNA, 12 nt, Homo sapiens
ugacagagccag

SEQ ID NO: 2205613 - RNA, 13 nt, Homo sapiens
ugagaccuggcag

SEQ ID NO: 2205614 - RNA, 12 nt, Homo sapiens
ggaugguggugc

SEQ ID NO: 2205615 - RNA, 22 nt, Homo sapiens
cuugaugagcugugcacaaagu

SEQ ID NO: 2205616 - RNA, 22 nt, Homo sapiens
ugcggcaaaaggaaagcugugu

SEQ ID NO: 2205617 - RNA, 17 nt, Homo sapiens
ucuuucaauacagauau

SEQ ID NO: 2205618 - RNA, 15 nt, Homo sapiens
cucaaaccacuugcc

SEQ ID NO: 2205619 - RNA, 14 nt, Homo sapiens
uggugcugacaaag

SEQ ID NO: 2205620 - RNA, 17 nt, Homo sapiens
ugaggggcuggcacuga

SEQ ID NO: 2205621 - RNA, 17 nt, Homo sapiens
caguaaaucagugcagu

SEQ ID NO: 2205622 - RNA, 16 nt, Homo sapiens
ccagcaugucacuccc

SEQ ID NO: 2205623 - RNA, 14 nt, Homo sapiens
caggugauucuguu

SEQ ID NO: 2205624 - RNA, 19 nt, Homo sapiens
cgcggggccgcuguccagg

SEQ ID NO: 2205625 - RNA, 14 nt, Homo sapiens
cacauguggacuuu

SEQ ID NO: 2205626 - RNA, 13 nt, Homo sapiens
aaacacuugcaac

SEQ ID NO: 2205627 - RNA, 20 nt, Homo sapiens
aagcgauucuucugccucag

SEQ ID NO: 2205628 - RNA, 22 nt, Homo sapiens
gagccggacacuucucaggaaa

SEQ ID NO: 2205629 - RNA, 20 nt, Homo sapiens
aacauacugcauuucacucu

SEQ ID NO: 2205630 - RNA, 21 nt, Homo sapiens
caaaaaaaaaauuugccaaga

SEQ ID NO: 2205631 - RNA, 14 nt, Homo sapiens
gccucccccaaagc

SEQ ID NO: 2205632 - RNA, 22 nt, Homo sapiens
gaggugagggggguucuccuuu

SEQ ID NO: 2205633 - RNA, 15 nt, Homo sapiens
caauguuagccucaa

SEQ ID NO: 2205634 - RNA, 18 nt, Homo sapiens
ugcuuuuugcguacacag

SEQ ID NO: 2205635 - RNA, 14 nt, Homo sapiens
agaaaaacaacuuu

SEQ ID NO: 2205636 - RNA, 14 nt, Homo sapiens
gaaauauugacuca

SEQ ID NO: 2205637 - RNA, 17 nt, Homo sapiens
acagccuucacuggaga

SEQ ID NO: 2205638 - RNA, 15 nt, Homo sapiens
gguagucagauuuca

SEQ ID NO: 2205639 - RNA, 23 nt, Homo sapiens
acaaggcauucaaguguacagug

SEQ ID NO: 2205640 - RNA, 19 nt, Homo sapiens
auuucaguuuuaacaaaug

SEQ ID NO: 2205641 - RNA, 18 nt, Homo sapiens
aacuguguauguacauau

SEQ ID NO: 2205642 - RNA, 16 nt, Homo sapiens
cuggagcccacaaccu

SEQ ID NO: 2205643 - RNA, 18 nt, Homo sapiens
uaaacucgagauacagcu

SEQ ID NO: 2205644 - RNA, 12 nt, Homo sapiens
uccugccagcuc

SEQ ID NO: 2205645 - RNA, 16 nt, Homo sapiens
uaauaaucauuuuaga

SEQ ID NO: 2205646 - RNA, 15 nt, Homo sapiens
uguauuaauaaagca

SEQ ID NO: 2205647 - RNA, 18 nt, Homo sapiens
cagaaacuacaugauuaa

SEQ ID NO: 2205648 - RNA, 14 nt, Homo sapiens
aaaaggaacacugg

SEQ ID NO: 2205649 - RNA, 14 nt, Homo sapiens
ugcagaagacagua

SEQ ID NO: 2205650 - RNA, 18 nt, Homo sapiens
ccuugagcuccccaaaaa

SEQ ID NO: 2205651 - RNA, 18 nt, Homo sapiens
uucucugcaauuuuacug

SEQ ID NO: 2205652 - RNA, 16 nt, Homo sapiens
cucugacuccaagagg

SEQ ID NO: 2205653 - RNA, 19 nt, Homo sapiens
caagccaggcucacucaca

SEQ ID NO: 2205654 - RNA, 17 nt, Homo sapiens
cuggccaaauaugcacu

SEQ ID NO: 2205655 - RNA, 14 nt, Homo sapiens
ggucucuuccuucg

SEQ ID NO: 2205656 - RNA, 13 nt, Homo sapiens
uuaacgcacuugg

SEQ ID NO: 2205657 - RNA, 11 nt, Homo sapiens
ugauaugcaca

SEQ ID NO: 2205658 - RNA, 13 nt, Homo sapiens
cugugaguguaag

SEQ ID NO: 2205659 - RNA, 22 nt, Homo sapiens
guuaucaguaaugcuaaaugug

SEQ ID NO: 2205660 - RNA, 13 nt, Homo sapiens
uuacccagugccg

SEQ ID NO: 2205661 - RNA, 15 nt, Homo sapiens
gaaacacuaaagcau

SEQ ID NO: 2205662 - RNA, 22 nt, Homo sapiens
cucaccaccacacuacacagca

SEQ ID NO: 2205663 - RNA, 16 nt, Homo sapiens
cuaagaagugguguuc

SEQ ID NO: 2205664 - RNA, 12 nt, Homo sapiens
agcucuggccac

SEQ ID NO: 2205665 - RNA, 16 nt, Homo sapiens
cauugcucuccaguca

SEQ ID NO: 2205666 - RNA, 20 nt, Homo sapiens
cagcaccugccccggcagug

SEQ ID NO: 2205667 - RNA, 15 nt, Homo sapiens
uuacguuuacauucu

SEQ ID NO: 2205668 - RNA, 21 nt, Homo sapiens
cccugggacuaaagccaggaa

SEQ ID NO: 2205669 - RNA, 23 nt, Homo sapiens
caaucuauuuaaaaaacuguaua

SEQ ID NO: 2205670 - RNA, 15 nt, Homo sapiens
ccucggccucccaca

SEQ ID NO: 2205671 - RNA, 18 nt, Homo sapiens
uguggcuuauguggaguu

SEQ ID NO: 2205672 - RNA, 22 nt, Homo sapiens
agagaaccucagaucaggugca

SEQ ID NO: 2205673 - RNA, 19 nt, Homo sapiens
agauuacuuuuucuuuaug

SEQ ID NO: 2205674 - RNA, 16 nt, Homo sapiens
ucuguauaugauucuc

SEQ ID NO: 2205675 - RNA, 20 nt, Homo sapiens
aauggcaaguuuugauauga

SEQ ID NO: 2205676 - RNA, 17 nt, Homo sapiens
uccugcuagcaccuccc

SEQ ID NO: 2205677 - RNA, 15 nt, Homo sapiens
ucaccagcugcaaag

SEQ ID NO: 2205678 - RNA, 20 nt, Homo sapiens
acaagaacuuuaaauugugu

SEQ ID NO: 2205679 - RNA, 12 nt, Homo sapiens
aggaaagccaaa

SEQ ID NO: 2205680 - RNA, 12 nt, Homo sapiens
agaaaagccaga

SEQ ID NO: 2205681 - RNA, 19 nt, Homo sapiens
acgcugccucaacacugaa

SEQ ID NO: 2205682 - RNA, 22 nt, Homo sapiens
ugauuucagcaccuacagugua

SEQ ID NO: 2205683 - RNA, 15 nt, Homo sapiens
aauguauuaugagcc

SEQ ID NO: 2205684 - RNA, 20 nt, Homo sapiens
caaggaagaauaaaguugaa

SEQ ID NO: 2205685 - RNA, 21 nt, Homo sapiens
uggagagaaguugcccuccag

SEQ ID NO: 2205686 - RNA, 13 nt, Homo sapiens
uuaucacacuuug

SEQ ID NO: 2205687 - RNA, 19 nt, Homo sapiens
uguugugcaaguugacaaa

SEQ ID NO: 2205688 - RNA, 16 nt, Homo sapiens
agauuucucugagauc

SEQ ID NO: 2205689 - RNA, 16 nt, Homo sapiens
acccccagugcucaca

SEQ ID NO: 2205690 - RNA, 13 nt, Homo sapiens
uaagcaagagcca

SEQ ID NO: 2205691 - RNA, 15 nt, Homo sapiens
uucuuggcuuccuuu

SEQ ID NO: 2205692 - RNA, 19 nt, Homo sapiens
aacuggaauaaguguuuau

SEQ ID NO: 2205693 - RNA, 21 nt, Homo sapiens
ccuuugcaguuggacucucag

SEQ ID NO: 2205694 - RNA, 10 nt, Homo sapiens
cacacccacu

SEQ ID NO: 2205695 - RNA, 17 nt, Homo sapiens
acacacgaugcauuuaa

SEQ ID NO: 2205696 - RNA, 20 nt, Homo sapiens
cccuuucaacagaauucacu

SEQ ID NO: 2205697 - RNA, 15 nt, Homo sapiens
ugacacauaugcacc

SEQ ID NO: 2205698 - RNA, 20 nt, Homo sapiens
aaagcuggagucugucaaug

SEQ ID NO: 2205699 - RNA, 23 nt, Homo sapiens
uguagcccaggccagagugcagu

SEQ ID NO: 2205700 - RNA, 17 nt, Homo sapiens
caaauucaguggacauu

SEQ ID NO: 2205701 - RNA, 17 nt, Homo sapiens
auauauuaaagcaucag

SEQ ID NO: 2205702 - RNA, 21 nt, Homo sapiens
gacaaaugacccccaucccau

SEQ ID NO: 2205703 - RNA, 18 nt, Homo sapiens
gugaauuaaagaugcuga

SEQ ID NO: 2205704 - RNA, 22 nt, Homo sapiens
caugaaggagagcccagucucc

SEQ ID NO: 2205705 - RNA, 13 nt, Homo sapiens
cuuaagcugggau

SEQ ID NO: 2205706 - RNA, 15 nt, Homo sapiens
uuaaaaucagcuauu

SEQ ID NO: 2205707 - RNA, 14 nt, Homo sapiens
gacaucaagcucaa

SEQ ID NO: 2205708 - RNA, 21 nt, Homo sapiens
cacccaaaaauaucuccucca

SEQ ID NO: 2205709 - RNA, 14 nt, Homo sapiens
cccaagugccaucc

SEQ ID NO: 2205710 - RNA, 21 nt, Homo sapiens
aggucucgcugaugcugggcu

SEQ ID NO: 2205711 - RNA, 18 nt, Homo sapiens
auauaaguuugaaggaaa

SEQ ID NO: 2205712 - RNA, 18 nt, Homo sapiens
agaaguaagaagaggagc

SEQ ID NO: 2205713 - RNA, 18 nt, Homo sapiens
cuguaccggccacugcaa

SEQ ID NO: 2205714 - RNA, 14 nt, Homo sapiens
ggcucccaggacac

SEQ ID NO: 2205715 - RNA, 19 nt, Homo sapiens
gccucuuauuccaggagaa

SEQ ID NO: 2205716 - RNA, 14 nt, Homo sapiens
uccucuuugugaua

SEQ ID NO: 2205717 - RNA, 15 nt, Homo sapiens
gaagaauauucccaa

SEQ ID NO: 2205718 - RNA, 19 nt, Homo sapiens
aguguccuggaaauucugc

SEQ ID NO: 2205719 - RNA, 21 nt, Homo sapiens
uauccccggacgcaugcaggg

SEQ ID NO: 2205720 - RNA, 14 nt, Homo sapiens
gcccaggcagucuu

SEQ ID NO: 2205721 - RNA, 15 nt, Homo sapiens
ugacgacagugcauu

SEQ ID NO: 2205722 - RNA, 15 nt, Homo sapiens
auuagcuuuuucuca

SEQ ID NO: 2205723 - RNA, 22 nt, Homo sapiens
ucaguggggacaggaaggacca

SEQ ID NO: 2205724 - RNA, 21 nt, Homo sapiens
uaguucagaggaagcacauaa

SEQ ID NO: 2205725 - RNA, 15 nt, Homo sapiens
auucagccagcuuaa

SEQ ID NO: 2205726 - RNA, 18 nt, Homo sapiens
agauuacagucauuuccu

SEQ ID NO: 2205727 - RNA, 20 nt, Homo sapiens
gguuuacauccuucacugcu

SEQ ID NO: 2205728 - RNA, 14 nt, Homo sapiens
uccuuucugccgac

SEQ ID NO: 2205729 - RNA, 22 nt, Homo sapiens
agaugagguucugagaccagug

SEQ ID NO: 2205730 - RNA, 21 nt, Homo sapiens
guaauacuggaauaauuugua

SEQ ID NO: 2205731 - RNA, 11 nt, Homo sapiens
uuugaggacau

SEQ ID NO: 2205732 - RNA, 18 nt, Homo sapiens
cccaacuccuuccagcua

SEQ ID NO: 2205733 - RNA, 23 nt, Homo sapiens
ucacaggaaguagaggaggccac

SEQ ID NO: 2205734 - RNA, 20 nt, Homo sapiens
gacaaaggccuuaacaaacg

SEQ ID NO: 2205735 - RNA, 21 nt, Homo sapiens
uguauauuuuauaucaauuua

SEQ ID NO: 2205736 - RNA, 15 nt, Homo sapiens
agagacuccuugaga

SEQ ID NO: 2205737 - RNA, 17 nt, Homo sapiens
ugcaaugcaagcccuuu

SEQ ID NO: 2205738 - RNA, 18 nt, Homo sapiens
uuucuauuuuauuaugaa

SEQ ID NO: 2205739 - RNA, 13 nt, Homo sapiens
uccagaucugcac

SEQ ID NO: 2205740 - RNA, 13 nt, Homo sapiens
auccagcacuggu

SEQ ID NO: 2205741 - RNA, 14 nt, Homo sapiens
gaaaaauaugugaa

SEQ ID NO: 2205742 - RNA, 19 nt, Homo sapiens
agccuaacaugauuauuug

SEQ ID NO: 2205743 - RNA, 14 nt, Homo sapiens
uguguauauguaga

SEQ ID NO: 2205744 - RNA, 15 nt, Homo sapiens
aguacagaaaaauac

SEQ ID NO: 2205745 - RNA, 14 nt, Homo sapiens
caaagugccaaaga

SEQ ID NO: 2205746 - RNA, 14 nt, Homo sapiens
cuuugugccuuuga

SEQ ID NO: 2205747 - RNA, 16 nt, Homo sapiens
agcaguguuugcucca

SEQ ID NO: 2205748 - RNA, 18 nt, Homo sapiens
gagguugagaaaaccuga

SEQ ID NO: 2205749 - RNA, 22 nt, Homo sapiens
aucauaaagagcacguuuucca

SEQ ID NO: 2205750 - RNA, 21 nt, Homo sapiens
ucauuuccuccgucaccucag

SEQ ID NO: 2205751 - RNA, 19 nt, Homo sapiens
gaaaggcaucuaagacauu

SEQ ID NO: 2205752 - RNA, 15 nt, Homo sapiens
guccacuguggcacu

SEQ ID NO: 2205753 - RNA, 15 nt, Homo sapiens
gugcuccgugccucc

SEQ ID NO: 2205754 - RNA, 12 nt, Homo sapiens
uuggagcacucu

SEQ ID NO: 2205755 - RNA, 12 nt, Homo sapiens
agaacucaaggc

SEQ ID NO: 2205756 - RNA, 12 nt, Homo sapiens
aggccucaagaa

SEQ ID NO: 2205757 - RNA, 19 nt, Homo sapiens
gauaagccaauccucacuc

SEQ ID NO: 2205758 - RNA, 14 nt, Homo sapiens
cuaauuuauucaaa

SEQ ID NO: 2205759 - RNA, 10 nt, Homo sapiens
gaauucugua

SEQ ID NO: 2205760 - RNA, 21 nt, Homo sapiens
cagguucuucagggccagucc

SEQ ID NO: 2205761 - RNA, 17 nt, Homo sapiens
ggcaggcugaggugaga

SEQ ID NO: 2205762 - RNA, 20 nt, Homo sapiens
cagugagccaagauugcgcc

SEQ ID NO: 2205763 - RNA, 19 nt, Homo sapiens
cucaacgagagcacuugaa

SEQ ID NO: 2205764 - RNA, 22 nt, Homo sapiens
augucccuuuuuuccuaugcaa

SEQ ID NO: 2205765 - RNA, 19 nt, Homo sapiens
uucuuuuuccccaauaaau

SEQ ID NO: 2205766 - RNA, 13 nt, Homo sapiens
auacuuuugcccu

SEQ ID NO: 2205767 - RNA, 16 nt, Homo sapiens
gugguuugauaguguu

SEQ ID NO: 2205768 - RNA, 13 nt, Homo sapiens
caccugagcagga

SEQ ID NO: 2205769 - RNA, 14 nt, Homo sapiens
cgcaaguucaggga

SEQ ID NO: 2205770 - RNA, 18 nt, Homo sapiens
cucagaggguguccugca

SEQ ID NO: 2205771 - RNA, 22 nt, Homo sapiens
acauagagauaugcacacacag

SEQ ID NO: 2205772 - RNA, 22 nt, Homo sapiens
gcuggauugccuuguaugcaaa

SEQ ID NO: 2205773 - RNA, 15 nt, Homo sapiens
auguaugacuuaaua

SEQ ID NO: 2205774 - RNA, 15 nt, Homo sapiens
acuauuucagaauau

SEQ ID NO: 2205775 - RNA, 17 nt, Homo sapiens
uuauucaaaaugaugua

SEQ ID NO: 2205776 - RNA, 23 nt, Homo sapiens
cugggauggggcuucacugcugu

SEQ ID NO: 2205777 - RNA, 15 nt, Homo sapiens
augugauguucuaag

SEQ ID NO: 2205778 - RNA, 15 nt, Homo sapiens
gcgcaaaaugcagcu

SEQ ID NO: 2205779 - RNA, 19 nt, Homo sapiens
auuaauuguuuugcacuuu

SEQ ID NO: 2205780 - RNA, 24 nt, Homo sapiens
uauuuucauuuauccagaugacca

SEQ ID NO: 2205781 - RNA, 16 nt, Homo sapiens
augugaucauagcuca

SEQ ID NO: 2205782 - RNA, 20 nt, Homo sapiens
cgaggugguagcucugagcc

SEQ ID NO: 2205783 - RNA, 13 nt, Homo sapiens
cucucacuauuau

SEQ ID NO: 2205784 - RNA, 17 nt, Homo sapiens
caccuaugugguccaga

SEQ ID NO: 2205785 - RNA, 21 nt, Homo sapiens
ggucccugaggaugggucaga

SEQ ID NO: 2205786 - RNA, 14 nt, Homo sapiens
ccaucagugaaaaa

SEQ ID NO: 2205787 - RNA, 22 nt, Homo sapiens
gcccucccuggcugugagcagc

SEQ ID NO: 2205788 - RNA, 20 nt, Homo sapiens
cagguggcacuuccaccucc

SEQ ID NO: 2205789 - RNA, 23 nt, Homo sapiens
uuucuaaagcucugaacaaaagc

SEQ ID NO: 2205790 - RNA, 15 nt, Homo sapiens
cugcccaggggagcc

SEQ ID NO: 2205791 - RNA, 16 nt, Homo sapiens
aagcuacuauguacug

SEQ ID NO: 2205792 - RNA, 17 nt, Homo sapiens
gaucuuucuauuccaaa

SEQ ID NO: 2205793 - RNA, 22 nt, Homo sapiens
ggcagaagaauugaacccagga

SEQ ID NO: 2205794 - RNA, 16 nt, Homo sapiens
uuuuguucuuguugua

SEQ ID NO: 2205795 - RNA, 14 nt, Homo sapiens
uuacauacagugau

SEQ ID NO: 2205796 - RNA, 18 nt, Homo sapiens
cccaccagcccacaucca

SEQ ID NO: 2205797 - RNA, 19 nt, Homo sapiens
auccaauccacuaacacuu

SEQ ID NO: 2205798 - RNA, 13 nt, Homo sapiens
cuguggucugugu

SEQ ID NO: 2205799 - RNA, 18 nt, Homo sapiens
cgaauuucucacucccuu

SEQ ID NO: 2205800 - RNA, 20 nt, Homo sapiens
acacagagcuaaggccaaug

SEQ ID NO: 2205801 - RNA, 11 nt, Homo sapiens
uuccaaagcaa

SEQ ID NO: 2205802 - RNA, 13 nt, Homo sapiens
ggagucaucucaa

SEQ ID NO: 2205803 - RNA, 15 nt, Homo sapiens
aaaaguaaaccacaa

SEQ ID NO: 2205804 - RNA, 23 nt, Homo sapiens
cuccuccaggguggcagcaacaa

SEQ ID NO: 2205805 - RNA, 14 nt, Homo sapiens
aacagaaaacaauu

SEQ ID NO: 2205806 - RNA, 17 nt, Homo sapiens
agaauaaagcauuucac

SEQ ID NO: 2205807 - RNA, 13 nt, Homo sapiens
guuagcagcacgu

SEQ ID NO: 2205808 - RNA, 23 nt, Homo sapiens
caucaggacccuucgugacaaug

SEQ ID NO: 2205809 - RNA, 13 nt, Homo sapiens
cuccuuuugacca

SEQ ID NO: 2205810 - RNA, 21 nt, Homo sapiens
caggacuuugaugcauuucca

SEQ ID NO: 2205811 - RNA, 13 nt, Homo sapiens
cuuaaaaguauuc

SEQ ID NO: 2205812 - RNA, 21 nt, Homo sapiens
uuuacaacucaaaaaacauug

SEQ ID NO: 2205813 - RNA, 22 nt, Homo sapiens
cgaggucaggagauggagacca

SEQ ID NO: 2205814 - RNA, 22 nt, Homo sapiens
cccagcacuuugggaagcugag

SEQ ID NO: 2205815 - RNA, 15 nt, Homo sapiens
caaucaucuuaacuu

SEQ ID NO: 2205816 - RNA, 18 nt, Homo sapiens
guaaucccaagaucugug

SEQ ID NO: 2205817 - RNA, 15 nt, Homo sapiens
agauuuucuuuugcc

SEQ ID NO: 2205818 - RNA, 23 nt, Homo sapiens
cauucacagauaccucucuugua

SEQ ID NO: 2205819 - RNA, 22 nt, Homo sapiens
aacagcuguucaguugcacuuc

SEQ ID NO: 2205820 - RNA, 17 nt, Homo sapiens
uggaacaagcacagaug

SEQ ID NO: 2205821 - RNA, 15 nt, Homo sapiens
cagggccuccagggc

SEQ ID NO: 2205822 - RNA, 21 nt, Homo sapiens
gaaaagguagcuuaccugaca

SEQ ID NO: 2205823 - RNA, 19 nt, Homo sapiens
cugcauuugccugcuucuu

SEQ ID NO: 2205824 - RNA, 20 nt, Homo sapiens
cugaggggaggcaccuccag

SEQ ID NO: 2205825 - RNA, 14 nt, Homo sapiens
ucggggacccugcg

SEQ ID NO: 2205826 - RNA, 19 nt, Homo sapiens
ggcuagagugcaauggcgc

SEQ ID NO: 2205827 - RNA, 16 nt, Homo sapiens
auaauaaaguaauuga

SEQ ID NO: 2205828 - RNA, 21 nt, Homo sapiens
auacauugauucaugucucac

SEQ ID NO: 2205829 - RNA, 16 nt, Homo sapiens
uccuuuggccauucca

SEQ ID NO: 2205830 - RNA, 13 nt, Homo sapiens
aaaugcauguccu

SEQ ID NO: 2205831 - RNA, 14 nt, Homo sapiens
uuaagaaacauucu

SEQ ID NO: 2205832 - RNA, 11 nt, Homo sapiens
uguuuugccau

SEQ ID NO: 2205833 - RNA, 14 nt, Homo sapiens
caguuuuccaugaa

SEQ ID NO: 2205834 - RNA, 13 nt, Homo sapiens
uuuccucuaucua

SEQ ID NO: 2205835 - RNA, 23 nt, Homo sapiens
gcuguauagcugcuuccagugua

SEQ ID NO: 2205836 - RNA, 14 nt, Homo sapiens
cuauugaacuguau

SEQ ID NO: 2205837 - RNA, 21 nt, Homo sapiens
gcagaucucaucucaugacag

SEQ ID NO: 2205838 - RNA, 22 nt, Homo sapiens
acuugggaauaaaucauagcaa

SEQ ID NO: 2205839 - RNA, 15 nt, Homo sapiens
gccccuuucuucccc

SEQ ID NO: 2205840 - RNA, 21 nt, Homo sapiens
gugcuaauuuguuuuggauau

SEQ ID NO: 2205841 - RNA, 16 nt, Homo sapiens
augugauuagugucuc

SEQ ID NO: 2205842 - RNA, 11 nt, Homo sapiens
uugaauuccau

SEQ ID NO: 2205843 - RNA, 18 nt, Homo sapiens
agcauuuaauguagccau

SEQ ID NO: 2205844 - RNA, 12 nt, Homo sapiens
ucccuugaggga

SEQ ID NO: 2205845 - RNA, 15 nt, Homo sapiens
uggauuuagcuuguu

SEQ ID NO: 2205846 - RNA, 15 nt, Homo sapiens
agaagccccgucucu

SEQ ID NO: 2205847 - RNA, 22 nt, Homo sapiens
cuucuggccucccacagacuca

SEQ ID NO: 2205848 - RNA, 22 nt, Homo sapiens
uugcuuuuguuuuccugcuggu

SEQ ID NO: 2205849 - RNA, 19 nt, Homo sapiens
acuuguggaccucaccaga

SEQ ID NO: 2205850 - RNA, 22 nt, Homo sapiens
augcucuauguuuguauuugga

SEQ ID NO: 2205851 - RNA, 22 nt, Homo sapiens
aaaucaaucuggugcuaauggu

SEQ ID NO: 2205852 - RNA, 17 nt, Homo sapiens
aggcucguugacuggcu

SEQ ID NO: 2205853 - RNA, 14 nt, Homo sapiens
accaucaguuacug

SEQ ID NO: 2205854 - RNA, 12 nt, Homo sapiens
aagggagacuga

SEQ ID NO: 2205855 - RNA, 14 nt, Homo sapiens
auucugaccaugga

SEQ ID NO: 2205856 - RNA, 19 nt, Homo sapiens
uacaccccaacagcacccu

SEQ ID NO: 2205857 - RNA, 16 nt, Homo sapiens
ugauaaaauguuuuca

SEQ ID NO: 2205858 - RNA, 23 nt, Homo sapiens
gaacuaaccuaccccaacucugc

SEQ ID NO: 2205859 - RNA, 14 nt, Homo sapiens
aguaugaagacacu

SEQ ID NO: 2205860 - RNA, 18 nt, Homo sapiens
cguaguuacucucaggca

SEQ ID NO: 2205861 - RNA, 12 nt, Homo sapiens
cucccacuuccu

SEQ ID NO: 2205862 - RNA, 21 nt, Homo sapiens
auuguuuggcaaugcacugaa

SEQ ID NO: 2205863 - RNA, 20 nt, Homo sapiens
cauauuuuguauuguucuaa

SEQ ID NO: 2205864 - RNA, 19 nt, Homo sapiens
ucuuauuuguaaagcucac

SEQ ID NO: 2205865 - RNA, 17 nt, Homo sapiens
acuauuaaacagucugu

SEQ ID NO: 2205866 - RNA, 16 nt, Homo sapiens
ugucagcuacuaauga

SEQ ID NO: 2205867 - RNA, 20 nt, Homo sapiens
ucuggguuaggccuugccua

SEQ ID NO: 2205868 - RNA, 15 nt, Homo sapiens
aagagugcugagaac

SEQ ID NO: 2205869 - RNA, 19 nt, Homo sapiens
uugauugucagcuacuaau

SEQ ID NO: 2205870 - RNA, 18 nt, Homo sapiens
aagguuggcgacugucau

SEQ ID NO: 2205871 - RNA, 20 nt, Homo sapiens
uugacuauuauagaauggaa

SEQ ID NO: 2205872 - RNA, 12 nt, Homo sapiens
aacaguauuuca

SEQ ID NO: 2205873 - RNA, 13 nt, Homo sapiens
gccucucucugcu

SEQ ID NO: 2205874 - RNA, 22 nt, Homo sapiens
uggaaacgaagcaccaucauuc

SEQ ID NO: 2205875 - RNA, 22 nt, Homo sapiens
caaggccaggccuuggggacaa

SEQ ID NO: 2205876 - RNA, 23 nt, Homo sapiens
aguggccagggcuuguggacucu

SEQ ID NO: 2205877 - RNA, 15 nt, Homo sapiens
agcagccaacaagca

SEQ ID NO: 2205878 - RNA, 23 nt, Homo sapiens
acccucagaauauuaagcacauu

SEQ ID NO: 2205879 - RNA, 16 nt, Homo sapiens
uaucucaaacuacugg

SEQ ID NO: 2205880 - RNA, 21 nt, Homo sapiens
caaagaaaauucucaagugau

SEQ ID NO: 2205881 - RNA, 11 nt, Homo sapiens
gaguuaccuac

SEQ ID NO: 2205882 - RNA, 21 nt, Homo sapiens
aaaauauucgugguaucugug

SEQ ID NO: 2205883 - RNA, 16 nt, Homo sapiens
ggaagcccucaaagaa

SEQ ID NO: 2205884 - RNA, 20 nt, Homo sapiens
aaucaaaggcgcuuugaaac

SEQ ID NO: 2205885 - RNA, 18 nt, Homo sapiens
caggccagagugcugcca

SEQ ID NO: 2205886 - RNA, 20 nt, Homo sapiens
cuuuauagguuuauuacaag

SEQ ID NO: 2205887 - RNA, 17 nt, Homo sapiens
ugcagauagugccucug

SEQ ID NO: 2205888 - RNA, 18 nt, Homo sapiens
aguuuccuucccuaccca

SEQ ID NO: 2205889 - RNA, 21 nt, Homo sapiens
acuuaacgaaaauaguauuuc

SEQ ID NO: 2205890 - RNA, 13 nt, Homo sapiens
gguucacugagcu

SEQ ID NO: 2205891 - RNA, 21 nt, Homo sapiens
gcaauugucuuguaccuugag

SEQ ID NO: 2205892 - RNA, 20 nt, Homo sapiens
uccacugcugaggacacuca

SEQ ID NO: 2205893 - RNA, 23 nt, Homo sapiens
gucccagcggugggaccuaggga

SEQ ID NO: 2205894 - RNA, 19 nt, Homo sapiens
guuucuggggaugucccag

SEQ ID NO: 2205895 - RNA, 16 nt, Homo sapiens
cacacuuuguccaaug

SEQ ID NO: 2205896 - RNA, 17 nt, Homo sapiens
aaagcagggacuugaac

SEQ ID NO: 2205897 - RNA, 13 nt, Homo sapiens
uucuugcacugua

SEQ ID NO: 2205898 - RNA, 16 nt, Homo sapiens
agguggugccuucuca

SEQ ID NO: 2205899 - RNA, 13 nt, Homo sapiens
cuuuuauauucua

SEQ ID NO: 2205900 - RNA, 16 nt, Homo sapiens
uacugauucacugcau

SEQ ID NO: 2205901 - RNA, 16 nt, Homo sapiens
acugcuaugccauuuc

SEQ ID NO: 2205902 - RNA, 11 nt, Homo sapiens
cagagcuucuu

SEQ ID NO: 2205903 - RNA, 21 nt, Homo sapiens
aacugccccccuccuuuccaa

SEQ ID NO: 2205904 - RNA, 16 nt, Homo sapiens
uagccugggguggggu

SEQ ID NO: 2205905 - RNA, 13 nt, Homo sapiens
cacucuuaugaaa

SEQ ID NO: 2205906 - RNA, 20 nt, Homo sapiens
caauuuuuuuauacuaccaa

SEQ ID NO: 2205907 - RNA, 17 nt, Homo sapiens
gagggucaccagguugg

SEQ ID NO: 2205908 - RNA, 21 nt, Homo sapiens
agacaaauagucggauuagaa

SEQ ID NO: 2205909 - RNA, 19 nt, Homo sapiens
ugcacagccaacgagacac

SEQ ID NO: 2205910 - RNA, 22 nt, Homo sapiens
caugaaauggacaaacagugca

SEQ ID NO: 2205911 - RNA, 21 nt, Homo sapiens
aacccugagaggcagguggua

SEQ ID NO: 2205912 - RNA, 18 nt, Homo sapiens
aaaagcacaaaguucuca

SEQ ID NO: 2205913 - RNA, 18 nt, Homo sapiens
aacuucuugcuucuuucu

SEQ ID NO: 2205914 - RNA, 20 nt, Homo sapiens
cugucccuccuggugucacc

SEQ ID NO: 2205915 - RNA, 18 nt, Homo sapiens
uuccaaguuuccaaacaa

SEQ ID NO: 2205916 - RNA, 14 nt, Homo sapiens
aaucuuuacacaau

SEQ ID NO: 2205917 - RNA, 16 nt, Homo sapiens
guucagaaaagcaccu

SEQ ID NO: 2205918 - RNA, 14 nt, Homo sapiens
uauacuguuuacug

SEQ ID NO: 2205919 - RNA, 18 nt, Homo sapiens
gccguguuacuguugcac

SEQ ID NO: 2205920 - RNA, 20 nt, Homo sapiens
cuggagugcugugcuguguu

SEQ ID NO: 2205921 - RNA, 23 nt, Homo sapiens
uagauauggaaaauagugaugaa

SEQ ID NO: 2205922 - RNA, 23 nt, Homo sapiens
acaagaaaaguugaagaagauau

SEQ ID NO: 2205923 - RNA, 15 nt, Homo sapiens
agucacuuccagugu

SEQ ID NO: 2205924 - RNA, 21 nt, Homo sapiens
acagacaauauggucccaaau

SEQ ID NO: 2205925 - RNA, 13 nt, Homo sapiens
ucuucauuuuggu

SEQ ID NO: 2205926 - RNA, 23 nt, Homo sapiens
ccacucugagugaauacuuugau

SEQ ID NO: 2205927 - RNA, 17 nt, Homo sapiens
agaugacgaguaacucc

SEQ ID NO: 2205928 - RNA, 18 nt, Homo sapiens
ucacacugugcucagauu

SEQ ID NO: 2205929 - RNA, 18 nt, Homo sapiens
cauaucauuaaacaaaua

SEQ ID NO: 2205930 - RNA, 22 nt, Homo sapiens
ccugucaccaugauucugucca

SEQ ID NO: 2205931 - RNA, 15 nt, Homo sapiens
ccuuuuuuucccaaa

SEQ ID NO: 2205932 - RNA, 23 nt, Homo sapiens
aacaguagcuuagcaucagaggu

SEQ ID NO: 2205933 - RNA, 16 nt, Homo sapiens
caugauuagugcaaua

SEQ ID NO: 2205934 - RNA, 14 nt, Homo sapiens
ggauaucacuucau

SEQ ID NO: 2205935 - RNA, 15 nt, Homo sapiens
uuacucugagcucau

SEQ ID NO: 2205936 - RNA, 24 nt, Homo sapiens
gaccacugggcaaugauggcaauu

SEQ ID NO: 2205937 - RNA, 19 nt, Homo sapiens
aauuccacuccuuccagaa

SEQ ID NO: 2205938 - RNA, 22 nt, Homo sapiens
aacaauguuuuuuauacuucaa

SEQ ID NO: 2205939 - RNA, 14 nt, Homo sapiens
uaaccaguucuguc

SEQ ID NO: 2205940 - RNA, 19 nt, Homo sapiens
uggcuuagagaggcuugaa

SEQ ID NO: 2205941 - RNA, 15 nt, Homo sapiens
accuccgccaaugca

SEQ ID NO: 2205942 - RNA, 20 nt, Homo sapiens
auauucagauauaaaacagu

SEQ ID NO: 2205943 - RNA, 18 nt, Homo sapiens
acauauucuuuaaauuuc

SEQ ID NO: 2205944 - RNA, 11 nt, Homo sapiens
uaaucauucca

SEQ ID NO: 2205945 - RNA, 14 nt, Homo sapiens
uacucaaccaaauu

SEQ ID NO: 2205946 - RNA, 20 nt, Homo sapiens
uucaccuccuucaauuccau

SEQ ID NO: 2205947 - RNA, 12 nt, Homo sapiens
aggggcaaagaa

SEQ ID NO: 2205948 - RNA, 18 nt, Homo sapiens
uugaaucugaaucagcca

SEQ ID NO: 2205949 - RNA, 11 nt, Homo sapiens
guaccaguuaa

SEQ ID NO: 2205950 - RNA, 16 nt, Homo sapiens
ucccccugcccugugc

SEQ ID NO: 2205951 - RNA, 21 nt, Homo sapiens
gccccagccuucuuugcuugc

SEQ ID NO: 2205952 - RNA, 17 nt, Homo sapiens
acaggacugguacucaa

SEQ ID NO: 2205953 - RNA, 16 nt, Homo sapiens
guaugcuuaagagaaa

SEQ ID NO: 2205954 - RNA, 16 nt, Homo sapiens
ugaucagaaacagggu

SEQ ID NO: 2205955 - RNA, 15 nt, Homo sapiens
uuguaaaugugacac

SEQ ID NO: 2205956 - RNA, 14 nt, Homo sapiens
cuugccaugugcug

SEQ ID NO: 2205957 - RNA, 18 nt, Homo sapiens
gaagcucaucaaagccca

SEQ ID NO: 2205958 - RNA, 22 nt, Homo sapiens
gacauuuaauuuagugaucuua

SEQ ID NO: 2205959 - RNA, 14 nt, Homo sapiens
guagugggugaaug

SEQ ID NO: 2205960 - RNA, 16 nt, Homo sapiens
cagaugauacuuccaa

SEQ ID NO: 2205961 - RNA, 22 nt, Homo sapiens
ugauaaaagauuuuccuauucc

SEQ ID NO: 2205962 - RNA, 21 nt, Homo sapiens
gccucaagcaauccaccugcc

SEQ ID NO: 2205963 - RNA, 19 nt, Homo sapiens
auugguauauuuccauuca

SEQ ID NO: 2205964 - RNA, 19 nt, Homo sapiens
ucuuccuuuuugguuuuua

SEQ ID NO: 2205965 - RNA, 17 nt, Homo sapiens
ugccugcuccaucucau

SEQ ID NO: 2205966 - RNA, 15 nt, Homo sapiens
agaggaccagugagu

SEQ ID NO: 2205967 - RNA, 13 nt, Homo sapiens
uaggauacuuaac

SEQ ID NO: 2205968 - RNA, 17 nt, Homo sapiens
ucucagcucccauuucu

SEQ ID NO: 2205969 - RNA, 19 nt, Homo sapiens
uucagguuuguaugaugua

SEQ ID NO: 2205970 - RNA, 18 nt, Homo sapiens
gaaauaaagucaaaucaa

SEQ ID NO: 2205971 - RNA, 18 nt, Homo sapiens
cucaguugaaaaugcaac

SEQ ID NO: 2205972 - RNA, 10 nt, Homo sapiens
ugucucucau

SEQ ID NO: 2205973 - RNA, 19 nt, Homo sapiens
gcauuguaucgauguuaug

SEQ ID NO: 2205974 - RNA, 19 nt, Homo sapiens
aaauaugugaaaaugauua

SEQ ID NO: 2205975 - RNA, 21 nt, Homo sapiens
uacauagaaagccaugugcua

SEQ ID NO: 2205976 - RNA, 15 nt, Homo sapiens
aguuauaaaguccuu

SEQ ID NO: 2205977 - RNA, 15 nt, Homo sapiens
caucacaacauuccu

SEQ ID NO: 2205978 - RNA, 11 nt, Homo sapiens
gggagcacaga

SEQ ID NO: 2205979 - RNA, 11 nt, Homo sapiens
gaaagcacaag

SEQ ID NO: 2205980 - RNA, 19 nt, Homo sapiens
uaagccaaagaaaugaaca

SEQ ID NO: 2205981 - RNA, 11 nt, Homo sapiens
agguggcccag

SEQ ID NO: 2205982 - RNA, 22 nt, Homo sapiens
gaagcuccugggggaugcucua

SEQ ID NO: 2205983 - RNA, 17 nt, Homo sapiens
ggaccugcccugggcca

SEQ ID NO: 2205984 - RNA, 15 nt, Homo sapiens
cuuuauuuugagaug

SEQ ID NO: 2205985 - RNA, 18 nt, Homo sapiens
ugcaaugacacagucuug

SEQ ID NO: 2205986 - RNA, 21 nt, Homo sapiens
aaucguccagcgaccuuccuc

SEQ ID NO: 2205987 - RNA, 14 nt, Homo sapiens
aguaguuagcuuuc

SEQ ID NO: 2205988 - RNA, 19 nt, Homo sapiens
cuaaaaguuuuaaccucag

SEQ ID NO: 2205989 - RNA, 21 nt, Homo sapiens
aaggaggcuuaggacuuucca

SEQ ID NO: 2205990 - RNA, 14 nt, Homo sapiens
uggggagucaggga

SEQ ID NO: 2205991 - RNA, 15 nt, Homo sapiens
ugauucucuaugaca

SEQ ID NO: 2205992 - RNA, 22 nt, Homo sapiens
aaggcuccugagacacaugggu

SEQ ID NO: 2205993 - RNA, 14 nt, Homo sapiens
ugagccaaaaacaa

SEQ ID NO: 2205994 - RNA, 18 nt, Homo sapiens
gaugucuuaacgaauaaa

SEQ ID NO: 2205995 - RNA, 18 nt, Homo sapiens
ccacauucuauagccaua

SEQ ID NO: 2205996 - RNA, 17 nt, Homo sapiens
aaauuucagaccaguuc

SEQ ID NO: 2205997 - RNA, 20 nt, Homo sapiens
auggaagacaggaaaguuca

SEQ ID NO: 2205998 - RNA, 13 nt, Homo sapiens
cucuguauguacu

SEQ ID NO: 2205999 - RNA, 14 nt, Homo sapiens
gcccagcuacauuc

SEQ ID NO: 2206000 - RNA, 19 nt, Homo sapiens
gcuuugguuaauacaucuu

SEQ ID NO: 2206001 - RNA, 11 nt, Homo sapiens
uauucuggaaa

SEQ ID NO: 2206002 - RNA, 15 nt, Homo sapiens
cccugauugaccugc

SEQ ID NO: 2206003 - RNA, 16 nt, Homo sapiens
ugaggagugaggaaua

SEQ ID NO: 2206004 - RNA, 13 nt, Homo sapiens
uuguagagcagau

SEQ ID NO: 2206005 - RNA, 15 nt, Homo sapiens
auagaggaacuugaa

SEQ ID NO: 2206006 - RNA, 16 nt, Homo sapiens
acacuaaguuccugau

SEQ ID NO: 2206007 - RNA, 13 nt, Homo sapiens
cuggucuuugguu

SEQ ID NO: 2206008 - RNA, 18 nt, Homo sapiens
guguuuacauuuacugaa

SEQ ID NO: 2206009 - RNA, 16 nt, Homo sapiens
uggcaucuccauguag

SEQ ID NO: 2206010 - RNA, 21 nt, Homo sapiens
caaagauuuuuggcacuuugu

SEQ ID NO: 2206011 - RNA, 15 nt, Homo sapiens
cagcuuagauuucau

SEQ ID NO: 2206012 - RNA, 19 nt, Homo sapiens
uauaaugggauauaguuua

SEQ ID NO: 2206013 - RNA, 16 nt, Homo sapiens
cauuucugauucugau

SEQ ID NO: 2206014 - RNA, 12 nt, Homo sapiens
caugauagacuu

SEQ ID NO: 2206015 - RNA, 21 nt, Homo sapiens
uuagucuuggaaaaaaaccac

SEQ ID NO: 2206016 - RNA, 13 nt, Homo sapiens
gcgaggcucuaac

SEQ ID NO: 2206017 - RNA, 14 nt, Homo sapiens
agcaauaacuucua

SEQ ID NO: 2206018 - RNA, 19 nt, Homo sapiens
gaauguguucaccauccca

SEQ ID NO: 2206019 - RNA, 18 nt, Homo sapiens
uuaacagguaugaaccac

SEQ ID NO: 2206020 - RNA, 22 nt, Homo sapiens
acaaugauaugcaagugcaaaa

SEQ ID NO: 2206021 - RNA, 21 nt, Homo sapiens
agaaaauccauucauucaauc

SEQ ID NO: 2206022 - RNA, 12 nt, Homo sapiens
cacagccaauac

SEQ ID NO: 2206023 - RNA, 17 nt, Homo sapiens
gauagaugucguggacu

SEQ ID NO: 2206024 - RNA, 20 nt, Homo sapiens
cccuggcugaaggacuguga

SEQ ID NO: 2206025 - RNA, 12 nt, Homo sapiens
agucagcacaga

SEQ ID NO: 2206026 - RNA, 12 nt, Homo sapiens
uuaaaagaauuu

SEQ ID NO: 2206027 - RNA, 22 nt, Homo sapiens
auguuugcuauugacaagucau

SEQ ID NO: 2206028 - RNA, 22 nt, Homo sapiens
gcacugacugauagcuuacacu

SEQ ID NO: 2206029 - RNA, 18 nt, Homo sapiens
ugacuuaagaaagcaaaa

SEQ ID NO: 2206030 - RNA, 20 nt, Homo sapiens
agacccucauuccuucccag

SEQ ID NO: 2206031 - RNA, 22 nt, Homo sapiens
auaacaaggaaaacaguaacua

SEQ ID NO: 2206032 - RNA, 10 nt, Homo sapiens
ccacucugga

SEQ ID NO: 2206033 - RNA, 19 nt, Homo sapiens
auuguuaggagaugucauc

SEQ ID NO: 2206034 - RNA, 21 nt, Homo sapiens
uagcauccaaggggccuggaa

SEQ ID NO: 2206035 - RNA, 20 nt, Homo sapiens
auuuaagaaugaaacuauaa

SEQ ID NO: 2206036 - RNA, 19 nt, Homo sapiens
caaucuacaacuggaagau

SEQ ID NO: 2206037 - RNA, 20 nt, Homo sapiens
aguaucucuucagucucuau

SEQ ID NO: 2206038 - RNA, 15 nt, Homo sapiens
aucagaaagcuuuau

SEQ ID NO: 2206039 - RNA, 15 nt, Homo sapiens
cucccuggagcugcu

SEQ ID NO: 2206040 - RNA, 19 nt, Homo sapiens
agaaugaaagcuccucgag

SEQ ID NO: 2206041 - RNA, 17 nt, Homo sapiens
acuuauugccaugugga

SEQ ID NO: 2206042 - RNA, 17 nt, Homo sapiens
ucucuccagccucacag

SEQ ID NO: 2206043 - RNA, 20 nt, Homo sapiens
aaaaccaaaagugcauucaa

SEQ ID NO: 2206044 - RNA, 19 nt, Homo sapiens
agugcaaaagauuaagauu

SEQ ID NO: 2206045 - RNA, 18 nt, Homo sapiens
cugugcagcgggugcugc

SEQ ID NO: 2206046 - RNA, 15 nt, Homo sapiens
uaguuauaaucugau

SEQ ID NO: 2206047 - RNA, 17 nt, Homo sapiens
aagaaggugucuccuag

SEQ ID NO: 2206048 - RNA, 15 nt, Homo sapiens
gcauuuaugaugcag

SEQ ID NO: 2206049 - RNA, 13 nt, Homo sapiens
ccggaaaaaucua

SEQ ID NO: 2206050 - RNA, 20 nt, Homo sapiens
gagaaggaacuuugucacau

SEQ ID NO: 2206051 - RNA, 21 nt, Homo sapiens
ccauuuuacuuccaugauacu

SEQ ID NO: 2206052 - RNA, 22 nt, Homo sapiens
gaacacgcaugccucagccagc

SEQ ID NO: 2206053 - RNA, 12 nt, Homo sapiens
acccuguuacaa

SEQ ID NO: 2206054 - RNA, 16 nt, Homo sapiens
cuacaccacacuaaaa

SEQ ID NO: 2206055 - RNA, 17 nt, Homo sapiens
uaacucugcacuacucc

SEQ ID NO: 2206056 - RNA, 15 nt, Homo sapiens
gcaaaaaccagagaa

SEQ ID NO: 2206057 - RNA, 19 nt, Homo sapiens
aaggggaaauaacugccuu

SEQ ID NO: 2206058 - RNA, 12 nt, Homo sapiens
auuuuucugcac

SEQ ID NO: 2206059 - RNA, 20 nt, Homo sapiens
cuguuagcacuguugaugua

SEQ ID NO: 2206060 - RNA, 20 nt, Homo sapiens
aggggacucagcccugaggu

SEQ ID NO: 2206061 - RNA, 21 nt, Homo sapiens
auccagaagguuugcaccccu

SEQ ID NO: 2206062 - RNA, 17 nt, Homo sapiens
gaacuaugaacacuguc

SEQ ID NO: 2206063 - RNA, 14 nt, Homo sapiens
agacuguugugcuc

SEQ ID NO: 2206064 - RNA, 14 nt, Homo sapiens
cugucaccagaccc

SEQ ID NO: 2206065 - RNA, 21 nt, Homo sapiens
ucgguggcugccuuugaucac

SEQ ID NO: 2206066 - RNA, 19 nt, Homo sapiens
ucacucucaaacuucacua

SEQ ID NO: 2206067 - RNA, 15 nt, Homo sapiens
uuuaugauacuugaa

SEQ ID NO: 2206068 - RNA, 18 nt, Homo sapiens
agaggaaacucugucacu

SEQ ID NO: 2206069 - RNA, 23 nt, Homo sapiens
uuggaaagauuuaagguuucaca

SEQ ID NO: 2206070 - RNA, 19 nt, Homo sapiens
cuggaauuaaaacaaaaca

SEQ ID NO: 2206071 - RNA, 22 nt, Homo sapiens
acuacagcgccaacgagcagug

SEQ ID NO: 2206072 - RNA, 20 nt, Homo sapiens
gaccaggauugcacugacau

SEQ ID NO: 2206073 - RNA, 15 nt, Homo sapiens
ccuucacauaguuuu

SEQ ID NO: 2206074 - RNA, 15 nt, Homo sapiens
ugagcuaccaggaag

SEQ ID NO: 2206075 - RNA, 24 nt, Homo sapiens
caccuauucuguaguugcagcuga

SEQ ID NO: 2206076 - RNA, 17 nt, Homo sapiens
aaagguugauguauuua

SEQ ID NO: 2206077 - RNA, 19 nt, Homo sapiens
aacuguaacauauaugaaa

SEQ ID NO: 2206078 - RNA, 17 nt, Homo sapiens
uggccaagagaccagcc

SEQ ID NO: 2206079 - RNA, 16 nt, Homo sapiens
uccagggagucucagc

SEQ ID NO: 2206080 - RNA, 19 nt, Homo sapiens
cugauggaaacaaagugga

SEQ ID NO: 2206081 - RNA, 20 nt, Homo sapiens
ggccagcugccccucauuua

SEQ ID NO: 2206082 - RNA, 14 nt, Homo sapiens
auacuuauguuuca

SEQ ID NO: 2206083 - RNA, 13 nt, Homo sapiens
ccauacuucucuc

SEQ ID NO: 2206084 - RNA, 21 nt, Homo sapiens
auaaggaugacuuuagaauaa

SEQ ID NO: 2206085 - RNA, 17 nt, Homo sapiens
ccauaguaugcucugag

SEQ ID NO: 2206086 - RNA, 17 nt, Homo sapiens
gguguaccacccauccc

SEQ ID NO: 2206087 - RNA, 13 nt, Homo sapiens
caaaacuguaaaa

SEQ ID NO: 2206088 - RNA, 23 nt, Homo sapiens
cuuguaaaaacuuuuaagccauu

SEQ ID NO: 2206089 - RNA, 20 nt, Homo sapiens
ugcaaccccaucauccucag

SEQ ID NO: 2206090 - RNA, 16 nt, Homo sapiens
aguccaucuucuuuau

SEQ ID NO: 2206091 - RNA, 21 nt, Homo sapiens
ccaggcccugcucuuccucag

SEQ ID NO: 2206092 - RNA, 18 nt, Homo sapiens
cugugcagagaugacugu

SEQ ID NO: 2206093 - RNA, 18 nt, Homo sapiens
gacacagcucuucauucc

SEQ ID NO: 2206094 - RNA, 14 nt, Homo sapiens
augugauacaaauu

SEQ ID NO: 2206095 - RNA, 17 nt, Homo sapiens
augugaacacaucagcu

SEQ ID NO: 2206096 - RNA, 17 nt, Homo sapiens
acaccaccaugcucaac

SEQ ID NO: 2206097 - RNA, 19 nt, Homo sapiens
gccaugauggugcugaccu

SEQ ID NO: 2206098 - RNA, 15 nt, Homo sapiens
gauuauuuccagugu

SEQ ID NO: 2206099 - RNA, 19 nt, Homo sapiens
caucugcagccacuuucug

SEQ ID NO: 2206100 - RNA, 18 nt, Homo sapiens
agcuguguccucaugagg

SEQ ID NO: 2206101 - RNA, 16 nt, Homo sapiens
caaaagcauccaagaa

SEQ ID NO: 2206102 - RNA, 13 nt, Homo sapiens
gccccugcacucc

SEQ ID NO: 2206103 - RNA, 17 nt, Homo sapiens
augcgaaugguagucua

SEQ ID NO: 2206104 - RNA, 20 nt, Homo sapiens
cagagguugcaaugagccaa

SEQ ID NO: 2206105 - RNA, 16 nt, Homo sapiens
cucacaucuguccaga

SEQ ID NO: 2206106 - RNA, 22 nt, Homo sapiens
aaccccuuuuuguaccauuaau

SEQ ID NO: 2206107 - RNA, 20 nt, Homo sapiens
uaucuguguuuguacugugc

SEQ ID NO: 2206108 - RNA, 21 nt, Homo sapiens
uuuugucuugcgggucuguca

SEQ ID NO: 2206109 - RNA, 23 nt, Homo sapiens
cugaggugggaaaaucacuugaa

SEQ ID NO: 2206110 - RNA, 20 nt, Homo sapiens
gaguaccuguccaagacagg

SEQ ID NO: 2206111 - RNA, 16 nt, Homo sapiens
ccuccaaaagcacuua

SEQ ID NO: 2206112 - RNA, 15 nt, Homo sapiens
uuaauuccacuuuaa

SEQ ID NO: 2206113 - RNA, 15 nt, Homo sapiens
cuguucaaaauucca

SEQ ID NO: 2206114 - RNA, 19 nt, Homo sapiens
ccaacacucuuggggacca

SEQ ID NO: 2206115 - RNA, 21 nt, Homo sapiens
ccuguucaagaaacaaccuuu

SEQ ID NO: 2206116 - RNA, 16 nt, Homo sapiens
uaccauauugcucuua

SEQ ID NO: 2206117 - RNA, 15 nt, Homo sapiens
aaccuuuacauccag

SEQ ID NO: 2206118 - RNA, 20 nt, Homo sapiens
agauaacaaucuguauauaa

SEQ ID NO: 2206119 - RNA, 12 nt, Homo sapiens
uucagcacacac

SEQ ID NO: 2206120 - RNA, 20 nt, Homo sapiens
aagcggaugcuccauuucaa

SEQ ID NO: 2206121 - RNA, 21 nt, Homo sapiens
aggaugccucagugcuuaugu

SEQ ID NO: 2206122 - RNA, 22 nt, Homo sapiens
uuaugcuuuuagaguugcaacu

SEQ ID NO: 2206123 - RNA, 11 nt, Homo sapiens
auuuucauucu

SEQ ID NO: 2206124 - RNA, 21 nt, Homo sapiens
caaauguuuuucauccauucc

SEQ ID NO: 2206125 - RNA, 21 nt, Homo sapiens
caugcauggauggguccucac

SEQ ID NO: 2206126 - RNA, 17 nt, Homo sapiens
cuucugaaaaaguaucc

SEQ ID NO: 2206127 - RNA, 14 nt, Homo sapiens
cagguucacuuugg

SEQ ID NO: 2206128 - RNA, 23 nt, Homo sapiens
guccuuugucuaaguagggccag

SEQ ID NO: 2206129 - RNA, 14 nt, Homo sapiens
agccacugccuuca

SEQ ID NO: 2206130 - RNA, 19 nt, Homo sapiens
acccacgaggaggaaccag

SEQ ID NO: 2206131 - RNA, 13 nt, Homo sapiens
aaucuuuucacaa

SEQ ID NO: 2206132 - RNA, 19 nt, Homo sapiens
uaaaguucacacaguauua

SEQ ID NO: 2206133 - RNA, 15 nt, Homo sapiens
guacacauauuuuga

SEQ ID NO: 2206134 - RNA, 15 nt, Homo sapiens
auaaugcucacuugg

SEQ ID NO: 2206135 - RNA, 14 nt, Homo sapiens
uuucugacuccagu

SEQ ID NO: 2206136 - RNA, 16 nt, Homo sapiens
aaaaaugggagacaau

SEQ ID NO: 2206137 - RNA, 21 nt, Homo sapiens
ucaauggagcaugugugcaaa

SEQ ID NO: 2206138 - RNA, 17 nt, Homo sapiens
aucuuaagccaagaagu

SEQ ID NO: 2206139 - RNA, 14 nt, Homo sapiens
uguggaggggagcu

SEQ ID NO: 2206140 - RNA, 20 nt, Homo sapiens
acuaggugaacagcaggaug

SEQ ID NO: 2206141 - RNA, 13 nt, Homo sapiens
aaaugcugcagga

SEQ ID NO: 2206142 - RNA, 16 nt, Homo sapiens
ccgccagaguguccug

SEQ ID NO: 2206143 - RNA, 22 nt, Homo sapiens
aaccauauccauguugcugacu

SEQ ID NO: 2206144 - RNA, 16 nt, Homo sapiens
acauuuauuuuucuca

SEQ ID NO: 2206145 - RNA, 19 nt, Homo sapiens
aaacugagccucuuuucaa

SEQ ID NO: 2206146 - RNA, 13 nt, Homo sapiens
uucuuuucccuca

SEQ ID NO: 2206147 - RNA, 15 nt, Homo sapiens
cuagaugagcccagc

SEQ ID NO: 2206148 - RNA, 23 nt, Homo sapiens
ccuccagcuguacuagugccauu

SEQ ID NO: 2206149 - RNA, 18 nt, Homo sapiens
uguucaacauuaacauug

SEQ ID NO: 2206150 - RNA, 14 nt, Homo sapiens
gcuuauuuaaucug

SEQ ID NO: 2206151 - RNA, 17 nt, Homo sapiens
gacugugcucacuaccu

SEQ ID NO: 2206152 - RNA, 11 nt, Homo sapiens
cagagcacuug

SEQ ID NO: 2206153 - RNA, 23 nt, Homo sapiens
cuagaagaauuaagcugugcaau

SEQ ID NO: 2206154 - RNA, 21 nt, Homo sapiens
uugauugaggagcugcacuga

SEQ ID NO: 2206155 - RNA, 14 nt, Homo sapiens
ucaaacugccuugg

SEQ ID NO: 2206156 - RNA, 17 nt, Homo sapiens
agcuccccucacucugu

SEQ ID NO: 2206157 - RNA, 15 nt, Homo sapiens
auucauaaugugaga

SEQ ID NO: 2206158 - RNA, 18 nt, Homo sapiens
caaaaugugauucuaugu

SEQ ID NO: 2206159 - RNA, 18 nt, Homo sapiens
uggaccacuccugaauga

SEQ ID NO: 2206160 - RNA, 13 nt, Homo sapiens
caaagaaauuucc

SEQ ID NO: 2206161 - RNA, 17 nt, Homo sapiens
cuuggggagcacuuguc

SEQ ID NO: 2206162 - RNA, 20 nt, Homo sapiens
caucacaguuguucugcaaa

SEQ ID NO: 2206163 - RNA, 15 nt, Homo sapiens
ggcccugagcucggu

SEQ ID NO: 2206164 - RNA, 22 nt, Homo sapiens
cauccuugauuacuuccacuga

SEQ ID NO: 2206165 - RNA, 22 nt, Homo sapiens
caauaauuuaaaaaacaugaau

SEQ ID NO: 2206166 - RNA, 15 nt, Homo sapiens
ugucuuucacuggaa

SEQ ID NO: 2206167 - RNA, 16 nt, Homo sapiens
ccugcugcacuuccug

SEQ ID NO: 2206168 - RNA, 22 nt, Homo sapiens
uguccugcccccaaggaggcag

SEQ ID NO: 2206169 - RNA, 18 nt, Homo sapiens
ccacauuucuaagccuuu

SEQ ID NO: 2206170 - RNA, 14 nt, Homo sapiens
acuuagacaguaug

SEQ ID NO: 2206171 - RNA, 14 nt, Homo sapiens
ucuuuuacuguaau

SEQ ID NO: 2206172 - RNA, 16 nt, Homo sapiens
ugauagcuaagugagu

SEQ ID NO: 2206173 - RNA, 19 nt, Homo sapiens
agguggggauccugccuaa

SEQ ID NO: 2206174 - RNA, 13 nt, Homo sapiens
aagcagguuuguu

SEQ ID NO: 2206175 - RNA, 15 nt, Homo sapiens
cuggcucaaagacaa

SEQ ID NO: 2206176 - RNA, 20 nt, Homo sapiens
cuuacucuaggucaguauua

SEQ ID NO: 2206177 - RNA, 23 nt, Homo sapiens
acuugcaauccaggcuguucuca

SEQ ID NO: 2206178 - RNA, 23 nt, Homo sapiens
ugugaaagaugcacaacacuccu

SEQ ID NO: 2206179 - RNA, 13 nt, Homo sapiens
auuuauccaugcu

SEQ ID NO: 2206180 - RNA, 18 nt, Homo sapiens
aaccacuaaaauguuaga

SEQ ID NO: 2206181 - RNA, 21 nt, Homo sapiens
uagauacacuaaaaaucugag

SEQ ID NO: 2206182 - RNA, 12 nt, Homo sapiens
gacucugugcuc

SEQ ID NO: 2206183 - RNA, 14 nt, Homo sapiens
ucaucauccaggag

SEQ ID NO: 2206184 - RNA, 21 nt, Homo sapiens
ugaggccugggagucucuuga

SEQ ID NO: 2206185 - RNA, 21 nt, Homo sapiens
accucuccccuggaacugucu

SEQ ID NO: 2206186 - RNA, 20 nt, Homo sapiens
aaagaaugcuggguguugca

SEQ ID NO: 2206187 - RNA, 21 nt, Homo sapiens
caugcacgccgggauuccucu

SEQ ID NO: 2206188 - RNA, 20 nt, Homo sapiens
ucccagcagcgguaccccag

SEQ ID NO: 2206189 - RNA, 20 nt, Homo sapiens
gccagggauugaaguuuauu

SEQ ID NO: 2206190 - RNA, 17 nt, Homo sapiens
uuggagcucauucuguc

SEQ ID NO: 2206191 - RNA, 22 nt, Homo sapiens
acaaaauugcugaggagcucag

SEQ ID NO: 2206192 - RNA, 18 nt, Homo sapiens
uacugaggauauggacac

SEQ ID NO: 2206193 - RNA, 14 nt, Homo sapiens
uagauauucauuaa

SEQ ID NO: 2206194 - RNA, 20 nt, Homo sapiens
uuaaagauggggaaacugag

SEQ ID NO: 2206195 - RNA, 19 nt, Homo sapiens
uugcuccuggaaccuggca

SEQ ID NO: 2206196 - RNA, 23 nt, Homo sapiens
uggcuuaccugaccucuugcugu

SEQ ID NO: 2206197 - RNA, 17 nt, Homo sapiens
agcaugaaccacccaga

SEQ ID NO: 2206198 - RNA, 14 nt, Homo sapiens
ccauugaccagcuc

SEQ ID NO: 2206199 - RNA, 19 nt, Homo sapiens
gauaguguuuuguacuugu

SEQ ID NO: 2206200 - RNA, 15 nt, Homo sapiens
uguaauacuuuacaa

SEQ ID NO: 2206201 - RNA, 18 nt, Homo sapiens
ugagaggagcguguccua

SEQ ID NO: 2206202 - RNA, 16 nt, Homo sapiens
gaggaaguuuugucua

SEQ ID NO: 2206203 - RNA, 15 nt, Homo sapiens
agucguucccagugu

SEQ ID NO: 2206204 - RNA, 23 nt, Homo sapiens
guuucuuuccuaaaccauucacc

SEQ ID NO: 2206205 - RNA, 22 nt, Homo sapiens
cagggcgccccugggagacaac

SEQ ID NO: 2206206 - RNA, 15 nt, Homo sapiens
agucaucaucuccaa

SEQ ID NO: 2206207 - RNA, 22 nt, Homo sapiens
cccccaggaaggccacagugcu

SEQ ID NO: 2206208 - RNA, 16 nt, Homo sapiens
uacuguuccaaaaaga

SEQ ID NO: 2206209 - RNA, 17 nt, Homo sapiens
ggagaaaccuacagaau

SEQ ID NO: 2206210 - RNA, 13 nt, Homo sapiens
caaaaugucucuu

SEQ ID NO: 2206211 - RNA, 18 nt, Homo sapiens
augucugccuaugcacug

SEQ ID NO: 2206212 - RNA, 20 nt, Homo sapiens
aagcuuccaugaugcacagu

SEQ ID NO: 2206213 - RNA, 22 nt, Homo sapiens
uucagaauggacuguuuguacg

SEQ ID NO: 2206214 - RNA, 16 nt, Homo sapiens
uggcaugguuguugca

SEQ ID NO: 2206215 - RNA, 12 nt, Homo sapiens
ccaguuacauaa

SEQ ID NO: 2206216 - RNA, 18 nt, Homo sapiens
agauccucugauauacaa

SEQ ID NO: 2206217 - RNA, 16 nt, Homo sapiens
aacaaaguuuucaugu

SEQ ID NO: 2206218 - RNA, 17 nt, Homo sapiens
agcucaggcgcagcccu

SEQ ID NO: 2206219 - RNA, 15 nt, Homo sapiens
gaucugguuugacuc

SEQ ID NO: 2206220 - RNA, 19 nt, Homo sapiens
aaaccuuacucugagcuca

SEQ ID NO: 2206221 - RNA, 21 nt, Homo sapiens
uggaaagaaguuggggacaca

SEQ ID NO: 2206222 - RNA, 15 nt, Homo sapiens
acuccugucuguccu

SEQ ID NO: 2206223 - RNA, 17 nt, Homo sapiens
caggaugaacuagccau

SEQ ID NO: 2206224 - RNA, 17 nt, Homo sapiens
ggacaguugauuuccaa

SEQ ID NO: 2206225 - RNA, 18 nt, Homo sapiens
caccuucaccuucaucca

SEQ ID NO: 2206226 - RNA, 21 nt, Homo sapiens
accaacuacggauugcugcaa

SEQ ID NO: 2206227 - RNA, 13 nt, Homo sapiens
uuuaggaugcuuu

SEQ ID NO: 2206228 - RNA, 12 nt, Homo sapiens
uuuaaaugaagu

SEQ ID NO: 2206229 - RNA, 16 nt, Homo sapiens
ccaguucuugcaauaa

SEQ ID NO: 2206230 - RNA, 19 nt, Homo sapiens
agaauacccuaaaguauaa

SEQ ID NO: 2206231 - RNA, 20 nt, Homo sapiens
uguuuccagauuacacucca

SEQ ID NO: 2206232 - RNA, 22 nt, Homo sapiens
uacaguacucaggcagugcagu

SEQ ID NO: 2206233 - RNA, 21 nt, Homo sapiens
aagucuucuuaucuaaaccca

SEQ ID NO: 2206234 - RNA, 19 nt, Homo sapiens
cagguuccuuaucugucac

SEQ ID NO: 2206235 - RNA, 19 nt, Homo sapiens
ccccaggcacuuugcauca

SEQ ID NO: 2206236 - RNA, 12 nt, Homo sapiens
uguugcauuccc

SEQ ID NO: 2206237 - RNA, 21 nt, Homo sapiens
gacauuuauuuuucucaugaa

SEQ ID NO: 2206238 - RNA, 14 nt, Homo sapiens
aaacauuauuccaa

SEQ ID NO: 2206239 - RNA, 17 nt, Homo sapiens
auguagacugugccaga

SEQ ID NO: 2206240 - RNA, 16 nt, Homo sapiens
ccaccacuugaugucu

SEQ ID NO: 2206241 - RNA, 14 nt, Homo sapiens
uaugcuaauaguga

SEQ ID NO: 2206242 - RNA, 21 nt, Homo sapiens
cugggaucaagaaggggacag

SEQ ID NO: 2206243 - RNA, 17 nt, Homo sapiens
cagcaagcaaacagggu

SEQ ID NO: 2206244 - RNA, 17 nt, Homo sapiens
aaauuuaucaacuguca

SEQ ID NO: 2206245 - RNA, 21 nt, Homo sapiens
uccacccagcaggcagagugg

SEQ ID NO: 2206246 - RNA, 14 nt, Homo sapiens
ggacagcuuugaua

SEQ ID NO: 2206247 - RNA, 16 nt, Homo sapiens
agauuuaucacuuuuu

SEQ ID NO: 2206248 - RNA, 18 nt, Homo sapiens
cccaauuugaauucaauu

SEQ ID NO: 2206249 - RNA, 14 nt, Homo sapiens
uccuuuauugucca

SEQ ID NO: 2206250 - RNA, 18 nt, Homo sapiens
accccuugguacugaaaa

SEQ ID NO: 2206251 - RNA, 19 nt, Homo sapiens
ggauuuccagccagggcug

SEQ ID NO: 2206252 - RNA, 13 nt, Homo sapiens
gcagaccaccagc

SEQ ID NO: 2206253 - RNA, 18 nt, Homo sapiens
aaaacagacaaaacaauc

SEQ ID NO: 2206254 - RNA, 15 nt, Homo sapiens
caggggccaaagcca

SEQ ID NO: 2206255 - RNA, 17 nt, Homo sapiens
cuaucucuugucauaua

SEQ ID NO: 2206256 - RNA, 14 nt, Homo sapiens
ucucagcuuugaga

SEQ ID NO: 2206257 - RNA, 21 nt, Homo sapiens
cauaaacaaguucgagucaaa

SEQ ID NO: 2206258 - RNA, 15 nt, Homo sapiens
cucccccagcuccuu

SEQ ID NO: 2206259 - RNA, 15 nt, Homo sapiens
cuuucccagccucuu

SEQ ID NO: 2206260 - RNA, 14 nt, Homo sapiens
cagggugucuguca

SEQ ID NO: 2206261 - RNA, 15 nt, Homo sapiens
auuuugaagucagag

SEQ ID NO: 2206262 - RNA, 17 nt, Homo sapiens
caucaaagugguaaaua

SEQ ID NO: 2206263 - RNA, 15 nt, Homo sapiens
caagcaaauguuuaa

SEQ ID NO: 2206264 - RNA, 24 nt, Homo sapiens
auuucacauccuguaagugcuuaa

SEQ ID NO: 2206265 - RNA, 15 nt, Homo sapiens
auuucuuuccuccag

SEQ ID NO: 2206266 - RNA, 21 nt, Homo sapiens
gguuuugucucugcaucucau

SEQ ID NO: 2206267 - RNA, 20 nt, Homo sapiens
gaucgcgccacugcacucca

SEQ ID NO: 2206268 - RNA, 14 nt, Homo sapiens
cucuacaaaaagca

SEQ ID NO: 2206269 - RNA, 17 nt, Homo sapiens
aaaaauaaaacaguauc

SEQ ID NO: 2206270 - RNA, 13 nt, Homo sapiens
ugcccccuuucag

SEQ ID NO: 2206271 - RNA, 16 nt, Homo sapiens
agggauuccccuaacc

SEQ ID NO: 2206272 - RNA, 13 nt, Homo sapiens
uacucacagccag

SEQ ID NO: 2206273 - RNA, 16 nt, Homo sapiens
ucaaauacaucuccag

SEQ ID NO: 2206274 - RNA, 23 nt, Homo sapiens
cauccaccguccccucccaggga

SEQ ID NO: 2206275 - RNA, 17 nt, Homo sapiens
cccgugcagcuuccaaa

SEQ ID NO: 2206276 - RNA, 21 nt, Homo sapiens
aaaggaucucuauaacagauc

SEQ ID NO: 2206277 - RNA, 17 nt, Homo sapiens
ucagcugauuugcagaa

SEQ ID NO: 2206278 - RNA, 16 nt, Homo sapiens
ccccaggccuccagaa

SEQ ID NO: 2206279 - RNA, 17 nt, Homo sapiens
aaucccucuaaccccuu

SEQ ID NO: 2206280 - RNA, 15 nt, Homo sapiens
uuuuaaaucauuuca

SEQ ID NO: 2206281 - RNA, 22 nt, Homo sapiens
uccagagaggaccuaucccaaa

SEQ ID NO: 2206282 - RNA, 13 nt, Homo sapiens
gugaagauacuuu

SEQ ID NO: 2206283 - RNA, 17 nt, Homo sapiens
cucaggagucugaggca

SEQ ID NO: 2206284 - RNA, 19 nt, Homo sapiens
aggaacucgcaccugugcu

SEQ ID NO: 2206285 - RNA, 22 nt, Homo sapiens
guauauuuaugaccagagcaaa

SEQ ID NO: 2206286 - RNA, 17 nt, Homo sapiens
accccuggccugacucc

SEQ ID NO: 2206287 - RNA, 16 nt, Homo sapiens
uguucgacuaccuuuu

SEQ ID NO: 2206288 - RNA, 19 nt, Homo sapiens
agcucuggcuuagacacca

SEQ ID NO: 2206289 - RNA, 19 nt, Homo sapiens
aaagggacccaccugcuag

SEQ ID NO: 2206290 - RNA, 15 nt, Homo sapiens
auaguccucugcuaa

SEQ ID NO: 2206291 - RNA, 14 nt, Homo sapiens
cuccccuacaucaa

SEQ ID NO: 2206292 - RNA, 21 nt, Homo sapiens
uguugguguucggagcucuuc

SEQ ID NO: 2206293 - RNA, 23 nt, Homo sapiens
ucauuggaugauauguugaucag

SEQ ID NO: 2206294 - RNA, 18 nt, Homo sapiens
gaaggcuuugccaugggc

SEQ ID NO: 2206295 - RNA, 18 nt, Homo sapiens
gaagacagauacuccucc

SEQ ID NO: 2206296 - RNA, 22 nt, Homo sapiens
uggaaacaagucagucauucag

SEQ ID NO: 2206297 - RNA, 17 nt, Homo sapiens
uauagaugcaaaguauu

SEQ ID NO: 2206298 - RNA, 19 nt, Homo sapiens
ucuguagaauuagucaucu

SEQ ID NO: 2206299 - RNA, 21 nt, Homo sapiens
ccagacaaaaauaucaauggu

SEQ ID NO: 2206300 - RNA, 18 nt, Homo sapiens
ugcugagccuccuugucu

SEQ ID NO: 2206301 - RNA, 21 nt, Homo sapiens
accagaauugcuugaacccag

SEQ ID NO: 2206302 - RNA, 22 nt, Homo sapiens
ccuggcaaagaacucauuugaa

SEQ ID NO: 2206303 - RNA, 16 nt, Homo sapiens
cuucagcauguucuca

SEQ ID NO: 2206304 - RNA, 22 nt, Homo sapiens
gaaucuaaaccuuacaugugua

SEQ ID NO: 2206305 - RNA, 17 nt, Homo sapiens
gccugacuaauuuugua

SEQ ID NO: 2206306 - RNA, 13 nt, Homo sapiens
uaauaaaucacac

SEQ ID NO: 2206307 - RNA, 21 nt, Homo sapiens
ccaccaccugaagcugaccaa

SEQ ID NO: 2206308 - RNA, 17 nt, Homo sapiens
ugaugaugcaguuuuca

SEQ ID NO: 2206309 - RNA, 19 nt, Homo sapiens
ucccuuguagaaagugagg

SEQ ID NO: 2206310 - RNA, 15 nt, Homo sapiens
aaauuuaucaaagca

SEQ ID NO: 2206311 - RNA, 11 nt, Homo sapiens
uauuugcacag

SEQ ID NO: 2206312 - RNA, 20 nt, Homo sapiens
uuauuugcacacugcacugu

SEQ ID NO: 2206313 - RNA, 22 nt, Homo sapiens
aauuuugagauuaagaaugcca

SEQ ID NO: 2206314 - RNA, 21 nt, Homo sapiens
augcuugguacuguaauguua

SEQ ID NO: 2206315 - RNA, 19 nt, Homo sapiens
ccugaccuccauaugcugu

SEQ ID NO: 2206316 - RNA, 23 nt, Homo sapiens
aucccaaggcuccugaccuaccu

SEQ ID NO: 2206317 - RNA, 19 nt, Homo sapiens
cucaguucucuugcuuuca

SEQ ID NO: 2206318 - RNA, 13 nt, Homo sapiens
cgguggaccaaag

SEQ ID NO: 2206319 - RNA, 18 nt, Homo sapiens
cagaaacacucaaguuga

SEQ ID NO: 2206320 - RNA, 14 nt, Homo sapiens
aaggaccagugaga

SEQ ID NO: 2206321 - RNA, 19 nt, Homo sapiens
aacacuuauacugacuuuc

SEQ ID NO: 2206322 - RNA, 13 nt, Homo sapiens
guugccagugaua

SEQ ID NO: 2206323 - RNA, 24 nt, Homo sapiens
gcauuuuguagucuuaacuucucc

SEQ ID NO: 2206324 - RNA, 17 nt, Homo sapiens
augguccaaaaauaguc

SEQ ID NO: 2206325 - RNA, 19 nt, Homo sapiens
caucuuauaugggaaacca

SEQ ID NO: 2206326 - RNA, 22 nt, Homo sapiens
gaccagugaaacuaugauccca

SEQ ID NO: 2206327 - RNA, 20 nt, Homo sapiens
ugccuuuuauaacugaaaua

SEQ ID NO: 2206328 - RNA, 14 nt, Homo sapiens
caaucaaagcacuu

SEQ ID NO: 2206329 - RNA, 21 nt, Homo sapiens
acccuuuuccuccagacagau

SEQ ID NO: 2206330 - RNA, 15 nt, Homo sapiens
cuccagcaccauaga

SEQ ID NO: 2206331 - RNA, 15 nt, Homo sapiens
uguacuugccuuauu

SEQ ID NO: 2206332 - RNA, 19 nt, Homo sapiens
aauaaugcccuuaauguga

SEQ ID NO: 2206333 - RNA, 15 nt, Homo sapiens
cccuggccaucucaa

SEQ ID NO: 2206334 - RNA, 15 nt, Homo sapiens
agcacuuuggacaug

SEQ ID NO: 2206335 - RNA, 13 nt, Homo sapiens
auaaauaccucuu

SEQ ID NO: 2206336 - RNA, 20 nt, Homo sapiens
aucuguuuuguuucuugacu

SEQ ID NO: 2206337 - RNA, 17 nt, Homo sapiens
caguacauaauacacuu

SEQ ID NO: 2206338 - RNA, 20 nt, Homo sapiens
uuguggguuuuuucacauaa

SEQ ID NO: 2206339 - RNA, 16 nt, Homo sapiens
uaccacaguguuuuau

SEQ ID NO: 2206340 - RNA, 13 nt, Homo sapiens
ccaguauggugaa

SEQ ID NO: 2206341 - RNA, 14 nt, Homo sapiens
aucugacaauauac

SEQ ID NO: 2206342 - RNA, 16 nt, Homo sapiens
uggaccugggcaugac

SEQ ID NO: 2206343 - RNA, 22 nt, Homo sapiens
gcaggaucugucugugcacaug

SEQ ID NO: 2206344 - RNA, 14 nt, Homo sapiens
ccucugaaacagcu

SEQ ID NO: 2206345 - RNA, 22 nt, Homo sapiens
uaaaaacaaauaauaucucuaa

SEQ ID NO: 2206346 - RNA, 23 nt, Homo sapiens
cuuauucgcaauagacaaaguga

SEQ ID NO: 2206347 - RNA, 20 nt, Homo sapiens
ucagggcaucggcagcugaa

SEQ ID NO: 2206348 - RNA, 23 nt, Homo sapiens
uggauugugccuaauguguuuga

SEQ ID NO: 2206349 - RNA, 11 nt, Homo sapiens
cuucucuccau

SEQ ID NO: 2206350 - RNA, 20 nt, Homo sapiens
acagcagcugaacagccaaa

SEQ ID NO: 2206351 - RNA, 20 nt, Homo sapiens
caaacuguagaaaugaugau

SEQ ID NO: 2206352 - RNA, 17 nt, Homo sapiens
cgaggggcucaguucug

SEQ ID NO: 2206353 - RNA, 15 nt, Homo sapiens
gcuguuuguagugaa

SEQ ID NO: 2206354 - RNA, 14 nt, Homo sapiens
acugugcugauuca

SEQ ID NO: 2206355 - RNA, 19 nt, Homo sapiens
gagugcaguuuccaauccc

SEQ ID NO: 2206356 - RNA, 17 nt, Homo sapiens
ccacuuggcaucauuca

SEQ ID NO: 2206357 - RNA, 21 nt, Homo sapiens
uugaggcugcagugagccauc

SEQ ID NO: 2206358 - RNA, 21 nt, Homo sapiens
aauaaauuuuagugugccuuc

SEQ ID NO: 2206359 - RNA, 22 nt, Homo sapiens
cuuacauuauuaaucauuccau

SEQ ID NO: 2206360 - RNA, 19 nt, Homo sapiens
cccauccccuuuacuauca

SEQ ID NO: 2206361 - RNA, 16 nt, Homo sapiens
ccuuaauaugaucugu

SEQ ID NO: 2206362 - RNA, 19 nt, Homo sapiens
aagagugcuaagcauuagc

SEQ ID NO: 2206363 - RNA, 15 nt, Homo sapiens
ccaggaaguagcaca

SEQ ID NO: 2206364 - RNA, 16 nt, Homo sapiens
auugucuuaaaaccag

SEQ ID NO: 2206365 - RNA, 20 nt, Homo sapiens
uacuaauaugccuagcacaa

SEQ ID NO: 2206366 - RNA, 21 nt, Homo sapiens
gcggcucuuccuggacaguga

SEQ ID NO: 2206367 - RNA, 14 nt, Homo sapiens
cuacccuguugcuu

SEQ ID NO: 2206368 - RNA, 21 nt, Homo sapiens
augcacauauggacucugcac

SEQ ID NO: 2206369 - RNA, 14 nt, Homo sapiens
gacaggcaugcacc

SEQ ID NO: 2206370 - RNA, 19 nt, Homo sapiens
augugcggcugaacugaga

SEQ ID NO: 2206371 - RNA, 22 nt, Homo sapiens
caagaauuauaacagcaaggaa

SEQ ID NO: 2206372 - RNA, 18 nt, Homo sapiens
gagggaccucucccaggg

SEQ ID NO: 2206373 - RNA, 15 nt, Homo sapiens
gaaagucccuaauaa

SEQ ID NO: 2206374 - RNA, 22 nt, Homo sapiens
auuauucaaaugcuucuuccca

SEQ ID NO: 2206375 - RNA, 20 nt, Homo sapiens
aaaauugaauuuaacaaugc

SEQ ID NO: 2206376 - RNA, 15 nt, Homo sapiens
uguuuuucuaaagga

SEQ ID NO: 2206377 - RNA, 15 nt, Homo sapiens
uccacaggauauuaa

SEQ ID NO: 2206378 - RNA, 17 nt, Homo sapiens
auuguccgggcucagaa

SEQ ID NO: 2206379 - RNA, 16 nt, Homo sapiens
gcuuuuaaacugauua

SEQ ID NO: 2206380 - RNA, 14 nt, Homo sapiens
cgcugggugccugc

SEQ ID NO: 2206381 - RNA, 20 nt, Homo sapiens
gcagaagcagcugcagcagc

SEQ ID NO: 2206382 - RNA, 14 nt, Homo sapiens
acucuucacagauu

SEQ ID NO: 2206383 - RNA, 13 nt, Homo sapiens
aaccuuaucucca

SEQ ID NO: 2206384 - RNA, 15 nt, Homo sapiens
gccauggcuggaaug

SEQ ID NO: 2206385 - RNA, 15 nt, Homo sapiens
accucuucuaugcaa

SEQ ID NO: 2206386 - RNA, 22 nt, Homo sapiens
ucccaaggacagucagcauuuc

SEQ ID NO: 2206387 - RNA, 17 nt, Homo sapiens
gaauuccaucuuguaaa

SEQ ID NO: 2206388 - RNA, 19 nt, Homo sapiens
cccagcuugggcccagcug

SEQ ID NO: 2206389 - RNA, 18 nt, Homo sapiens
aagauggcugacuuugcu

SEQ ID NO: 2206390 - RNA, 21 nt, Homo sapiens
uggucauuugguggcucuaac

SEQ ID NO: 2206391 - RNA, 21 nt, Homo sapiens
gcucuccccaaacuugcuuua

SEQ ID NO: 2206392 - RNA, 18 nt, Homo sapiens
uaguuuuuauuaaacuca

SEQ ID NO: 2206393 - RNA, 19 nt, Homo sapiens
accuuccauucacaccagc

SEQ ID NO: 2206394 - RNA, 16 nt, Homo sapiens
gccugccuucucaggg

SEQ ID NO: 2206395 - RNA, 12 nt, Homo sapiens
uuagcaaagcau

SEQ ID NO: 2206396 - RNA, 19 nt, Homo sapiens
aacauaugaggaaucugca

SEQ ID NO: 2206397 - RNA, 21 nt, Homo sapiens
uuaacacuuuggacuucucug

SEQ ID NO: 2206398 - RNA, 14 nt, Homo sapiens
ucccucauccauag

SEQ ID NO: 2206399 - RNA, 17 nt, Homo sapiens
auaaaguuggugacaga

SEQ ID NO: 2206400 - RNA, 18 nt, Homo sapiens
ucuccguugucauugacu

SEQ ID NO: 2206401 - RNA, 20 nt, Homo sapiens
acuuuuuuagaaaugcaaaa

SEQ ID NO: 2206402 - RNA, 17 nt, Homo sapiens
gaggcuggaccaacugc

SEQ ID NO: 2206403 - RNA, 13 nt, Homo sapiens
aagcaucugugua

SEQ ID NO: 2206404 - RNA, 13 nt, Homo sapiens
acucauuccagau

SEQ ID NO: 2206405 - RNA, 18 nt, Homo sapiens
ugacaggaacccaucacu

SEQ ID NO: 2206406 - RNA, 18 nt, Homo sapiens
cugaaacccuugagcuca

SEQ ID NO: 2206407 - RNA, 17 nt, Homo sapiens
cauuauuugaguuugac

SEQ ID NO: 2206408 - RNA, 21 nt, Homo sapiens
uugggaaauuuuucuuucuaa

SEQ ID NO: 2206409 - RNA, 15 nt, Homo sapiens
cccuuucugugguaa

SEQ ID NO: 2206410 - RNA, 22 nt, Homo sapiens
uaaaccuguuccugacuguucu

SEQ ID NO: 2206411 - RNA, 13 nt, Homo sapiens
auuguccuuggag

SEQ ID NO: 2206412 - RNA, 12 nt, Homo sapiens
uuacuaaagaca

SEQ ID NO: 2206413 - RNA, 10 nt, Homo sapiens
uggaggaccc

SEQ ID NO: 2206414 - RNA, 14 nt, Homo sapiens
caaaaugugaugcu

SEQ ID NO: 2206415 - RNA, 23 nt, Homo sapiens
uucauauagggaagaguucugau

SEQ ID NO: 2206416 - RNA, 13 nt, Homo sapiens
augacauucaugc

SEQ ID NO: 2206417 - RNA, 16 nt, Homo sapiens
uuuucuggaugguucc

SEQ ID NO: 2206418 - RNA, 16 nt, Homo sapiens
uuguccaugauguccu

SEQ ID NO: 2206419 - RNA, 14 nt, Homo sapiens
aggcuguagcaucu

SEQ ID NO: 2206420 - RNA, 13 nt, Homo sapiens
caauuuagacaaa

SEQ ID NO: 2206421 - RNA, 20 nt, Homo sapiens
auaaacauuaaaugucuuau

SEQ ID NO: 2206422 - RNA, 13 nt, Homo sapiens
aacuugaguauaa

SEQ ID NO: 2206423 - RNA, 13 nt, Homo sapiens
agugaaaccagcu

SEQ ID NO: 2206424 - RNA, 21 nt, Homo sapiens
aaccccuuagcaauaagcacu

SEQ ID NO: 2206425 - RNA, 18 nt, Homo sapiens
caucccugaugucugucu

SEQ ID NO: 2206426 - RNA, 23 nt, Homo sapiens
agggagaugauccagagacaugu

SEQ ID NO: 2206427 - RNA, 20 nt, Homo sapiens
ucuuuaauuuguuaucucaa

SEQ ID NO: 2206428 - RNA, 14 nt, Homo sapiens
uuucagccacuucu

SEQ ID NO: 2206429 - RNA, 22 nt, Homo sapiens
uaauuccccaagaggucccaag

SEQ ID NO: 2206430 - RNA, 14 nt, Homo sapiens
caggaguccaaacc

SEQ ID NO: 2206431 - RNA, 14 nt, Homo sapiens
acaucugagcagug

SEQ ID NO: 2206432 - RNA, 20 nt, Homo sapiens
aggauuccgucuucucucau

SEQ ID NO: 2206433 - RNA, 21 nt, Homo sapiens
ccaccuugccacccauucuuc

SEQ ID NO: 2206434 - RNA, 21 nt, Homo sapiens
agagcaaucuugcugugaaac

SEQ ID NO: 2206435 - RNA, 16 nt, Homo sapiens
gagacgggguuucacc

SEQ ID NO: 2206436 - RNA, 13 nt, Homo sapiens
auauugcagucaa

SEQ ID NO: 2206437 - RNA, 13 nt, Homo sapiens
uuggccucccaag

SEQ ID NO: 2206438 - RNA, 14 nt, Homo sapiens
gggaguggguggca

SEQ ID NO: 2206439 - RNA, 15 nt, Homo sapiens
gggccuuacuuccca

SEQ ID NO: 2206440 - RNA, 12 nt, Homo sapiens
acauuguaagag

SEQ ID NO: 2206441 - RNA, 12 nt, Homo sapiens
agagacuguuau

SEQ ID NO: 2206442 - RNA, 19 nt, Homo sapiens
aauucuagaugacuuuaau

SEQ ID NO: 2206443 - RNA, 18 nt, Homo sapiens
cagccccuccucccucag

SEQ ID NO: 2206444 - RNA, 15 nt, Homo sapiens
gauuguaauugccau

SEQ ID NO: 2206445 - RNA, 18 nt, Homo sapiens
cuuuuuuauacucaauca

SEQ ID NO: 2206446 - RNA, 19 nt, Homo sapiens
cucacuguucaaucauuga

SEQ ID NO: 2206447 - RNA, 19 nt, Homo sapiens
gugaaauacuguacagggg

SEQ ID NO: 2206448 - RNA, 12 nt, Homo sapiens
aauucauguuuc

SEQ ID NO: 2206449 - RNA, 16 nt, Homo sapiens
accucucucacugacu

SEQ ID NO: 2206450 - RNA, 15 nt, Homo sapiens
acgggggcagcugau

SEQ ID NO: 2206451 - RNA, 18 nt, Homo sapiens
uccccacagaacugcuua

SEQ ID NO: 2206452 - RNA, 14 nt, Homo sapiens
ugcuaagcuaaaga

SEQ ID NO: 2206453 - RNA, 16 nt, Homo sapiens
auagaggggcauucac

SEQ ID NO: 2206454 - RNA, 20 nt, Homo sapiens
caaaucuaagggaaaaagcc

SEQ ID NO: 2206455 - RNA, 18 nt, Homo sapiens
agaauuuccuaaugagau

SEQ ID NO: 2206456 - RNA, 19 nt, Homo sapiens
ugaacgacuguauauugcu

SEQ ID NO: 2206457 - RNA, 22 nt, Homo sapiens
aauaggcuuucuguguauauaa

SEQ ID NO: 2206458 - RNA, 16 nt, Homo sapiens
aggauugcacugacau

SEQ ID NO: 2206459 - RNA, 21 nt, Homo sapiens
ggccaaugcuggaaacauuca

SEQ ID NO: 2206460 - RNA, 18 nt, Homo sapiens
ugagaauauaauacugua

SEQ ID NO: 2206461 - RNA, 23 nt, Homo sapiens
uaguuucuuucuguuauugcacu

SEQ ID NO: 2206462 - RNA, 15 nt, Homo sapiens
uagaaacauuguaaa

SEQ ID NO: 2206463 - RNA, 22 nt, Homo sapiens
ucuaaaaaaggaauccucugug

SEQ ID NO: 2206464 - RNA, 17 nt, Homo sapiens
ucccauuucuacucuua

SEQ ID NO: 2206465 - RNA, 12 nt, Homo sapiens
cacauacuccuu

SEQ ID NO: 2206466 - RNA, 16 nt, Homo sapiens
cccaggagacucuggg

SEQ ID NO: 2206467 - RNA, 11 nt, Homo sapiens
acaaacaguga

SEQ ID NO: 2206468 - RNA, 17 nt, Homo sapiens
gaaagaagcaguucuca

SEQ ID NO: 2206469 - RNA, 17 nt, Homo sapiens
agagagguuaacagauu

SEQ ID NO: 2206470 - RNA, 15 nt, Homo sapiens
acagaccccuaggga

SEQ ID NO: 2206471 - RNA, 12 nt, Homo sapiens
cuacuccaaaau

SEQ ID NO: 2206472 - RNA, 12 nt, Homo sapiens
aacuuccacucc

SEQ ID NO: 2206473 - RNA, 12 nt, Homo sapiens
cugcuccaaagu

SEQ ID NO: 2206474 - RNA, 12 nt, Homo sapiens
aagcuccacugu

SEQ ID NO: 2206475 - RNA, 21 nt, Homo sapiens
uggggauccccgccuggccag

SEQ ID NO: 2206476 - RNA, 19 nt, Homo sapiens
uggagggucgccacacccg

SEQ ID NO: 2206477 - RNA, 18 nt, Homo sapiens
acaucacugcacuccagc

SEQ ID NO: 2206478 - RNA, 20 nt, Homo sapiens
uaaagacagagugaauuuca

SEQ ID NO: 2206479 - RNA, 21 nt, Homo sapiens
gagcccagaucaccaccugaa

SEQ ID NO: 2206480 - RNA, 13 nt, Homo sapiens
cugaguccagagc

SEQ ID NO: 2206481 - RNA, 14 nt, Homo sapiens
acaugaaguauuuu

SEQ ID NO: 2206482 - RNA, 19 nt, Homo sapiens
uagaauugguggugagaua

SEQ ID NO: 2206483 - RNA, 23 nt, Homo sapiens
agaaccuggagagcuagaaccua

SEQ ID NO: 2206484 - RNA, 23 nt, Homo sapiens
aaauguuagaaaaauagcuguga

SEQ ID NO: 2206485 - RNA, 22 nt, Homo sapiens
acuuaggacuacauuuugcucu

SEQ ID NO: 2206486 - RNA, 18 nt, Homo sapiens
ucaucuuggucacauaca

SEQ ID NO: 2206487 - RNA, 16 nt, Homo sapiens
ugcugcugugucuuua

SEQ ID NO: 2206488 - RNA, 23 nt, Homo sapiens
cuuaaauuuugugauauggagcc

SEQ ID NO: 2206489 - RNA, 14 nt, Homo sapiens
gauauucuuuacaa

SEQ ID NO: 2206490 - RNA, 22 nt, Homo sapiens
auggugccccaggaccagcuca

SEQ ID NO: 2206491 - RNA, 15 nt, Homo sapiens
cagguucccccagca

SEQ ID NO: 2206492 - RNA, 22 nt, Homo sapiens
gaguuguuuuggugccugccuc

SEQ ID NO: 2206493 - RNA, 21 nt, Homo sapiens
gccaaaacacuuaggaagaaa

SEQ ID NO: 2206494 - RNA, 15 nt, Homo sapiens
uggaugugggguccc

SEQ ID NO: 2206495 - RNA, 21 nt, Homo sapiens
caaguuuuucagaaagcauua

SEQ ID NO: 2206496 - RNA, 22 nt, Homo sapiens
gcaaagaccgauugcauaggaa

SEQ ID NO: 2206497 - RNA, 18 nt, Homo sapiens
ugggaaaaaaacuuggca

SEQ ID NO: 2206498 - RNA, 16 nt, Homo sapiens
auacuuugcaauccaa

SEQ ID NO: 2206499 - RNA, 20 nt, Homo sapiens
uggaaauucugcugcuucuc

SEQ ID NO: 2206500 - RNA, 12 nt, Homo sapiens
gaagaagcuaaa

SEQ ID NO: 2206501 - RNA, 17 nt, Homo sapiens
uguaaucccagcuacau

SEQ ID NO: 2206502 - RNA, 18 nt, Homo sapiens
cgcacucucauaugccac

SEQ ID NO: 2206503 - RNA, 11 nt, Homo sapiens
cucucucucag

SEQ ID NO: 2206504 - RNA, 20 nt, Homo sapiens
acagaggggagucaccagcc

SEQ ID NO: 2206505 - RNA, 18 nt, Homo sapiens
ccucuccaguaucuucac

SEQ ID NO: 2206506 - RNA, 12 nt, Homo sapiens
uccugaccucag

SEQ ID NO: 2206507 - RNA, 18 nt, Homo sapiens
cccuaaugagaagucaac

SEQ ID NO: 2206508 - RNA, 21 nt, Homo sapiens
gugcgugaagaccaacaaagu

SEQ ID NO: 2206509 - RNA, 21 nt, Homo sapiens
uucgccccauuuucuuuacag

SEQ ID NO: 2206510 - RNA, 20 nt, Homo sapiens
ucuuauuuuagacaaccaua

SEQ ID NO: 2206511 - RNA, 21 nt, Homo sapiens
ccuucugcuaugacaaaaccu

SEQ ID NO: 2206512 - RNA, 15 nt, Homo sapiens
gcccagccacauuuc

SEQ ID NO: 2206513 - RNA, 18 nt, Homo sapiens
aaucuauuccugccacca

SEQ ID NO: 2206514 - RNA, 14 nt, Homo sapiens
ccugucuccagggc

SEQ ID NO: 2206515 - RNA, 14 nt, Homo sapiens
ccuguuuccagggu

SEQ ID NO: 2206516 - RNA, 20 nt, Homo sapiens
uugcuuuggauacacacaua

SEQ ID NO: 2206517 - RNA, 21 nt, Homo sapiens
cuguugccagugcuuugcaca

SEQ ID NO: 2206518 - RNA, 17 nt, Homo sapiens
gcagugcaagagacucu

SEQ ID NO: 2206519 - RNA, 20 nt, Homo sapiens
ugaggugacugcagucugau

SEQ ID NO: 2206520 - RNA, 16 nt, Homo sapiens
aagcaaaugucuuccu

SEQ ID NO: 2206521 - RNA, 19 nt, Homo sapiens
cagccuggggaacagagca

SEQ ID NO: 2206522 - RNA, 20 nt, Homo sapiens
ggaugggacacccaacacuu

SEQ ID NO: 2206523 - RNA, 13 nt, Homo sapiens
uccuguugggaga

SEQ ID NO: 2206524 - RNA, 14 nt, Homo sapiens
ccucugagacauga

SEQ ID NO: 2206525 - RNA, 19 nt, Homo sapiens
ugaccaaauaaaguaccau

SEQ ID NO: 2206526 - RNA, 22 nt, Homo sapiens
cuguugacuggcugugugaccu

SEQ ID NO: 2206527 - RNA, 19 nt, Homo sapiens
aauuccauuuacuugauca

SEQ ID NO: 2206528 - RNA, 20 nt, Homo sapiens
aacaggauuacaguguagcu

SEQ ID NO: 2206529 - RNA, 15 nt, Homo sapiens
uggacaugaaggaaa

SEQ ID NO: 2206530 - RNA, 14 nt, Homo sapiens
cagagaugacuguc

SEQ ID NO: 2206531 - RNA, 15 nt, Homo sapiens
ugaagacacugucaa

SEQ ID NO: 2206532 - RNA, 14 nt, Homo sapiens
gugaauaaaaccuu

SEQ ID NO: 2206533 - RNA, 18 nt, Homo sapiens
aaaagcaccacuguucug

SEQ ID NO: 2206534 - RNA, 16 nt, Homo sapiens
gcccucauccauuuau

SEQ ID NO: 2206535 - RNA, 18 nt, Homo sapiens
uaauguuuauuguucaau

SEQ ID NO: 2206536 - RNA, 19 nt, Homo sapiens
gaauucuugaaaaacuuac

SEQ ID NO: 2206537 - RNA, 14 nt, Homo sapiens
guccuggggaccau

SEQ ID NO: 2206538 - RNA, 14 nt, Homo sapiens
uacauggguucaau

SEQ ID NO: 2206539 - RNA, 19 nt, Homo sapiens
aguuacuuuuuuacacuga

SEQ ID NO: 2206540 - RNA, 14 nt, Homo sapiens
aagucaacauaugc

SEQ ID NO: 2206541 - RNA, 20 nt, Homo sapiens
auggcuccggccucugccuu

SEQ ID NO: 2206542 - RNA, 19 nt, Homo sapiens
aaauuccaaugaagccaua

SEQ ID NO: 2206543 - RNA, 15 nt, Homo sapiens
gaggaaucagcucaa

SEQ ID NO: 2206544 - RNA, 21 nt, Homo sapiens
caguauauucuuugguuguga

SEQ ID NO: 2206545 - RNA, 16 nt, Homo sapiens
gugaauacauuuugca

SEQ ID NO: 2206546 - RNA, 17 nt, Homo sapiens
aagacccaaaacagcuu

SEQ ID NO: 2206547 - RNA, 21 nt, Homo sapiens
aagauaaauagaguuccaaau

SEQ ID NO: 2206548 - RNA, 11 nt, Homo sapiens
aauuccaaagc

SEQ ID NO: 2206549 - RNA, 14 nt, Homo sapiens
agauuucaguagaa

SEQ ID NO: 2206550 - RNA, 15 nt, Homo sapiens
cuggcggcugugcau

SEQ ID NO: 2206551 - RNA, 14 nt, Homo sapiens
aauacaaaggugcu

SEQ ID NO: 2206552 - RNA, 17 nt, Homo sapiens
caugacagccagagccu

SEQ ID NO: 2206553 - RNA, 18 nt, Homo sapiens
gcagaauugagagugauu

SEQ ID NO: 2206554 - RNA, 16 nt, Homo sapiens
aaucauauugaugaaa

SEQ ID NO: 2206555 - RNA, 17 nt, Homo sapiens
ugccccacaggccacac

SEQ ID NO: 2206556 - RNA, 15 nt, Homo sapiens
ggccggggacugccu

SEQ ID NO: 2206557 - RNA, 15 nt, Homo sapiens
ccucagaaagggauu

SEQ ID NO: 2206558 - RNA, 18 nt, Homo sapiens
ccccucgugcgcaucuca

SEQ ID NO: 2206559 - RNA, 15 nt, Homo sapiens
cucaccuugucucau

SEQ ID NO: 2206560 - RNA, 19 nt, Homo sapiens
auuaagggaauaagccaug

SEQ ID NO: 2206561 - RNA, 18 nt, Homo sapiens
cagggggaagcaccagcc

SEQ ID NO: 2206562 - RNA, 17 nt, Homo sapiens
cagucgcauagacuuau

SEQ ID NO: 2206563 - RNA, 15 nt, Homo sapiens
uaagcugugugcagg

SEQ ID NO: 2206564 - RNA, 20 nt, Homo sapiens
cuaucuguguggugaugaau

SEQ ID NO: 2206565 - RNA, 13 nt, Homo sapiens
gucugugaugcuc

SEQ ID NO: 2206566 - RNA, 11 nt, Homo sapiens
uuucaggagac

SEQ ID NO: 2206567 - RNA, 19 nt, Homo sapiens
cuagaacucuccaucuuau

SEQ ID NO: 2206568 - RNA, 22 nt, Homo sapiens
cagagacacagcccccacggac

SEQ ID NO: 2206569 - RNA, 18 nt, Homo sapiens
uaauggcuaguacuguau

SEQ ID NO: 2206570 - RNA, 13 nt, Homo sapiens
uggacuuuggaca

SEQ ID NO: 2206571 - RNA, 18 nt, Homo sapiens
aucaccucuaaaaaccaa

SEQ ID NO: 2206572 - RNA, 18 nt, Homo sapiens
ucaaaagagguuacuuua

SEQ ID NO: 2206573 - RNA, 23 nt, Homo sapiens
accaaauggcacuuuugaugaaa

SEQ ID NO: 2206574 - RNA, 16 nt, Homo sapiens
auuuuccuccaggcaa

SEQ ID NO: 2206575 - RNA, 15 nt, Homo sapiens
cugagaagcaguaua

SEQ ID NO: 2206576 - RNA, 15 nt, Homo sapiens
acuuuucugccaaaa

SEQ ID NO: 2206577 - RNA, 16 nt, Homo sapiens
uuccgcauccuagucu

SEQ ID NO: 2206578 - RNA, 19 nt, Homo sapiens
ccucugugccauggaugau

SEQ ID NO: 2206579 - RNA, 16 nt, Homo sapiens
gugacauuuccaugca

SEQ ID NO: 2206580 - RNA, 17 nt, Homo sapiens
ccuuaaacuuucaauau

SEQ ID NO: 2206581 - RNA, 20 nt, Homo sapiens
uaauguuguaauucaugcca

SEQ ID NO: 2206582 - RNA, 16 nt, Homo sapiens
uguugauggcaaaaaa

SEQ ID NO: 2206583 - RNA, 21 nt, Homo sapiens
ugaacuaaugauaaaguaaug

SEQ ID NO: 2206584 - RNA, 12 nt, Homo sapiens
aauaaugaagua

SEQ ID NO: 2206585 - RNA, 14 nt, Homo sapiens
cuagccuugcacuu

SEQ ID NO: 2206586 - RNA, 15 nt, Homo sapiens
uguggcuuaguaaua

SEQ ID NO: 2206587 - RNA, 15 nt, Homo sapiens
ggcuggaucucucga

SEQ ID NO: 2206588 - RNA, 21 nt, Homo sapiens
cucuuuaguauaauugaccua

SEQ ID NO: 2206589 - RNA, 21 nt, Homo sapiens
ucuuaaaaaauuuauacuuaa

SEQ ID NO: 2206590 - RNA, 12 nt, Homo sapiens
ugucggagcaag

SEQ ID NO: 2206591 - RNA, 12 nt, Homo sapiens
uugugcauuugg

SEQ ID NO: 2206592 - RNA, 19 nt, Homo sapiens
aacauuuugagaacaaaga

SEQ ID NO: 2206593 - RNA, 21 nt, Homo sapiens
agggccaccccacucuaccuc

SEQ ID NO: 2206594 - RNA, 16 nt, Homo sapiens
ugugggcaggaaguga

SEQ ID NO: 2206595 - RNA, 14 nt, Homo sapiens
cggucguguuguga

SEQ ID NO: 2206596 - RNA, 21 nt, Homo sapiens
cucugacaguauuaacaucaa

SEQ ID NO: 2206597 - RNA, 14 nt, Homo sapiens
augguggguacaaa

SEQ ID NO: 2206598 - RNA, 11 nt, Homo sapiens
ccucacacugu

SEQ ID NO: 2206599 - RNA, 11 nt, Homo sapiens
ccccacacugc

SEQ ID NO: 2206600 - RNA, 16 nt, Homo sapiens
uaaagcaaacuggggc

SEQ ID NO: 2206601 - RNA, 17 nt, Homo sapiens
auagacuuauugccaaa

SEQ ID NO: 2206602 - RNA, 13 nt, Homo sapiens
acacugcacuguu

SEQ ID NO: 2206603 - RNA, 17 nt, Homo sapiens
acuguuaacuaugacag

SEQ ID NO: 2206604 - RNA, 16 nt, Homo sapiens
caagucccccaagacc

SEQ ID NO: 2206605 - RNA, 23 nt, Homo sapiens
uguuuggaccaaaaaccaguauu

SEQ ID NO: 2206606 - RNA, 17 nt, Homo sapiens
cuggucacauugccuua

SEQ ID NO: 2206607 - RNA, 18 nt, Homo sapiens
uauggugucauaggcucu

SEQ ID NO: 2206608 - RNA, 13 nt, Homo sapiens
cauuggcacaaug

SEQ ID NO: 2206609 - RNA, 13 nt, Homo sapiens
ugagagcauguga

SEQ ID NO: 2206610 - RNA, 13 nt, Homo sapiens
guuuagcaguaua

SEQ ID NO: 2206611 - RNA, 22 nt, Homo sapiens
acaauaaaaccugggugucaga

SEQ ID NO: 2206612 - RNA, 22 nt, Homo sapiens
aauauugccaaugcuacaguaa

SEQ ID NO: 2206613 - RNA, 21 nt, Homo sapiens
cggugagacccauggcugugu

SEQ ID NO: 2206614 - RNA, 12 nt, Homo sapiens
uauaucagggaa

SEQ ID NO: 2206615 - RNA, 22 nt, Homo sapiens
uccaaaugggaaggacaguuga

SEQ ID NO: 2206616 - RNA, 22 nt, Homo sapiens
gccauugagaaugugcuuugua

SEQ ID NO: 2206617 - RNA, 19 nt, Homo sapiens
gacagaucaagcugugaga

SEQ ID NO: 2206618 - RNA, 14 nt, Homo sapiens
agaugcaucaucuc

SEQ ID NO: 2206619 - RNA, 14 nt, Homo sapiens
uuuacagacuguga

SEQ ID NO: 2206620 - RNA, 20 nt, Homo sapiens
guggggggugacagugccuu

SEQ ID NO: 2206621 - RNA, 18 nt, Homo sapiens
uggcuaaggaaauucuaa

SEQ ID NO: 2206622 - RNA, 18 nt, Homo sapiens
cucuacuaaaacauacaa

SEQ ID NO: 2206623 - RNA, 20 nt, Homo sapiens
agccucugguaaccucuuac

SEQ ID NO: 2206624 - RNA, 18 nt, Homo sapiens
aaccauagcuaaguagca

SEQ ID NO: 2206625 - RNA, 14 nt, Homo sapiens
ucagaaagugcagc

SEQ ID NO: 2206626 - RNA, 22 nt, Homo sapiens
ugcaauccaaauccagccuuug

SEQ ID NO: 2206627 - RNA, 17 nt, Homo sapiens
uuagaaguagaauuugc

SEQ ID NO: 2206628 - RNA, 13 nt, Homo sapiens
uccagauguuaau

SEQ ID NO: 2206629 - RNA, 14 nt, Homo sapiens
agaaaagaccuuuu

SEQ ID NO: 2206630 - RNA, 19 nt, Homo sapiens
gaguucaguggcacucaac

SEQ ID NO: 2206631 - RNA, 18 nt, Homo sapiens
cacuggucaggugcuucu

SEQ ID NO: 2206632 - RNA, 22 nt, Homo sapiens
acguggugcuucucacacugga

SEQ ID NO: 2206633 - RNA, 12 nt, Homo sapiens
aaacuuucugua

SEQ ID NO: 2206634 - RNA, 16 nt, Homo sapiens
aggugauuccagugaa

SEQ ID NO: 2206635 - RNA, 16 nt, Homo sapiens
uggggaugucucucau

SEQ ID NO: 2206636 - RNA, 15 nt, Homo sapiens
augaaugggcaaaac

SEQ ID NO: 2206637 - RNA, 18 nt, Homo sapiens
acaguacccaaacugcuu

SEQ ID NO: 2206638 - RNA, 19 nt, Homo sapiens
gacaaggucgagacauucc

SEQ ID NO: 2206639 - RNA, 20 nt, Homo sapiens
aaagauuucuugaguuuugu

SEQ ID NO: 2206640 - RNA, 13 nt, Homo sapiens
auuuugcuuccuu

SEQ ID NO: 2206641 - RNA, 22 nt, Homo sapiens
augcauugccuguaacaaugua

SEQ ID NO: 2206642 - RNA, 22 nt, Homo sapiens
cuaucuaauuuuacacucugua

SEQ ID NO: 2206643 - RNA, 21 nt, Homo sapiens
ugugcagggugaagcagcuca

SEQ ID NO: 2206644 - RNA, 12 nt, Homo sapiens
cagaaacaucuc

SEQ ID NO: 2206645 - RNA, 21 nt, Homo sapiens
uugacguauauauaaacagaa

SEQ ID NO: 2206646 - RNA, 19 nt, Homo sapiens
acuggcccacacgugcaua

SEQ ID NO: 2206647 - RNA, 16 nt, Homo sapiens
ugggaggaugaaggag

SEQ ID NO: 2206648 - RNA, 23 nt, Homo sapiens
agagacccuuugucucugagaag

SEQ ID NO: 2206649 - RNA, 15 nt, Homo sapiens
ugccaggcaccaucu

SEQ ID NO: 2206650 - RNA, 18 nt, Homo sapiens
caaugaguggacaaguca

SEQ ID NO: 2206651 - RNA, 18 nt, Homo sapiens
gcacacacagaugcacac

SEQ ID NO: 2206652 - RNA, 16 nt, Homo sapiens
uugaauucuugauaaa

SEQ ID NO: 2206653 - RNA, 16 nt, Homo sapiens
agaauuuccuguaaua

SEQ ID NO: 2206654 - RNA, 15 nt, Homo sapiens
acacaugugcaguca

SEQ ID NO: 2206655 - RNA, 18 nt, Homo sapiens
ucaggcccucagcugucg

SEQ ID NO: 2206656 - RNA, 17 nt, Homo sapiens
aguuugugcaagacacc

SEQ ID NO: 2206657 - RNA, 20 nt, Homo sapiens
agggaagaaugaacacuccc

SEQ ID NO: 2206658 - RNA, 16 nt, Homo sapiens
caugaccacucuuggc

SEQ ID NO: 2206659 - RNA, 15 nt, Homo sapiens
augaauaguuuccaa

SEQ ID NO: 2206660 - RNA, 16 nt, Homo sapiens
auucaaaauaguucua

SEQ ID NO: 2206661 - RNA, 14 nt, Homo sapiens
uuuaaaagcaugau

SEQ ID NO: 2206662 - RNA, 20 nt, Homo sapiens
uguucuuaugcaaaauggaa

SEQ ID NO: 2206663 - RNA, 23 nt, Homo sapiens
acauauucacagugaacauaacu

SEQ ID NO: 2206664 - RNA, 14 nt, Homo sapiens
uggggcaacugaga

SEQ ID NO: 2206665 - RNA, 19 nt, Homo sapiens
gcggcaggaagggggccga

SEQ ID NO: 2206666 - RNA, 16 nt, Homo sapiens
uccacgcucaaucuca

SEQ ID NO: 2206667 - RNA, 16 nt, Homo sapiens
cuucucuacagacucc

SEQ ID NO: 2206668 - RNA, 17 nt, Homo sapiens
ugauuaaaaaacugaca

SEQ ID NO: 2206669 - RNA, 15 nt, Homo sapiens
ucugccacacucuga

SEQ ID NO: 2206670 - RNA, 14 nt, Homo sapiens
cagcccaacccggc

SEQ ID NO: 2206671 - RNA, 15 nt, Homo sapiens
guaagguaugggaga

SEQ ID NO: 2206672 - RNA, 17 nt, Homo sapiens
uccuuuaaauucuuucc

SEQ ID NO: 2206673 - RNA, 19 nt, Homo sapiens
ugacauacccccuccccca

SEQ ID NO: 2206674 - RNA, 20 nt, Homo sapiens
ugaucuucccacaccagccu

SEQ ID NO: 2206675 - RNA, 21 nt, Homo sapiens
ccagcaagaugaaacagggca

SEQ ID NO: 2206676 - RNA, 20 nt, Homo sapiens
ccuuccaggcguagggccag

SEQ ID NO: 2206677 - RNA, 22 nt, Homo sapiens
aggaacagugugguuugggaaa

SEQ ID NO: 2206678 - RNA, 18 nt, Homo sapiens
gaacuucagaagugccau

SEQ ID NO: 2206679 - RNA, 16 nt, Homo sapiens
cuuuaaaagucauuca

SEQ ID NO: 2206680 - RNA, 22 nt, Homo sapiens
uucucuagggaaggccaccugc

SEQ ID NO: 2206681 - RNA, 17 nt, Homo sapiens
gaggucaucacuuugac

SEQ ID NO: 2206682 - RNA, 19 nt, Homo sapiens
ucaagcgauugucugagga

SEQ ID NO: 2206683 - RNA, 13 nt, Homo sapiens
gccccccccaugu

SEQ ID NO: 2206684 - RNA, 18 nt, Homo sapiens
auaguuuuauuuacuucu

SEQ ID NO: 2206685 - RNA, 14 nt, Homo sapiens
cuugcuuguuacau

SEQ ID NO: 2206686 - RNA, 22 nt, Homo sapiens
uuccuuagcuuagaccucagcc

SEQ ID NO: 2206687 - RNA, 13 nt, Homo sapiens
ccugacaccugcu

SEQ ID NO: 2206688 - RNA, 13 nt, Homo sapiens
cuggacacccucu

SEQ ID NO: 2206689 - RNA, 15 nt, Homo sapiens
auggcugccaucuca

SEQ ID NO: 2206690 - RNA, 19 nt, Homo sapiens
ugcuuuucugccacuccau

SEQ ID NO: 2206691 - RNA, 14 nt, Homo sapiens
uggggggacugccu

SEQ ID NO: 2206692 - RNA, 15 nt, Homo sapiens
cuauguggcugcugc

SEQ ID NO: 2206693 - RNA, 22 nt, Homo sapiens
uaaacuuaagggaaaaguucuc

SEQ ID NO: 2206694 - RNA, 16 nt, Homo sapiens
ggucuuuugguuauga

SEQ ID NO: 2206695 - RNA, 21 nt, Homo sapiens
accuucugugcuucagcucuu

SEQ ID NO: 2206696 - RNA, 17 nt, Homo sapiens
acauggccaauagucau

SEQ ID NO: 2206697 - RNA, 13 nt, Homo sapiens
cagagaugggaaa

SEQ ID NO: 2206698 - RNA, 21 nt, Homo sapiens
ccagggccugggggcagugac

SEQ ID NO: 2206699 - RNA, 10 nt, Homo sapiens
ccugcccuug

SEQ ID NO: 2206700 - RNA, 21 nt, Homo sapiens
gcuucugguuaggugugucag

SEQ ID NO: 2206701 - RNA, 22 nt, Homo sapiens
ggagguugcagugagcuaagau

SEQ ID NO: 2206702 - RNA, 13 nt, Homo sapiens
uacaaaaagaaga

SEQ ID NO: 2206703 - RNA, 15 nt, Homo sapiens
cguguguccaugugu

SEQ ID NO: 2206704 - RNA, 13 nt, Homo sapiens
auaagagacuuau

SEQ ID NO: 2206705 - RNA, 14 nt, Homo sapiens
accccaucugccca

SEQ ID NO: 2206706 - RNA, 13 nt, Homo sapiens
ucucuaugaucuu

SEQ ID NO: 2206707 - RNA, 20 nt, Homo sapiens
uauaaaccccaccccaaaau

SEQ ID NO: 2206708 - RNA, 20 nt, Homo sapiens
ucugccacaccucuccaaag

SEQ ID NO: 2206709 - RNA, 23 nt, Homo sapiens
uaccugucauuuugcacuguaaa

SEQ ID NO: 2206710 - RNA, 16 nt, Homo sapiens
uuucaaaaugcuucaa

SEQ ID NO: 2206711 - RNA, 14 nt, Homo sapiens
gaauauuuagcaua

SEQ ID NO: 2206712 - RNA, 21 nt, Homo sapiens
agaaauuuuucuaguauauaa

SEQ ID NO: 2206713 - RNA, 16 nt, Homo sapiens
aaccuaguucaaugug

SEQ ID NO: 2206714 - RNA, 20 nt, Homo sapiens
ccaagauacuugaacacugu

SEQ ID NO: 2206715 - RNA, 20 nt, Homo sapiens
caagcaaaucuccugccuca

SEQ ID NO: 2206716 - RNA, 13 nt, Homo sapiens
uccuaucaaaaag

SEQ ID NO: 2206717 - RNA, 17 nt, Homo sapiens
ccauucacccuguguaa

SEQ ID NO: 2206718 - RNA, 21 nt, Homo sapiens
agauguuguuaaaaacaugug

SEQ ID NO: 2206719 - RNA, 21 nt, Homo sapiens
caauccaaaaauguuuuucaa

SEQ ID NO: 2206720 - RNA, 19 nt, Homo sapiens
agaucugcagucacuucgu

SEQ ID NO: 2206721 - RNA, 13 nt, Homo sapiens
caauauugccaug

SEQ ID NO: 2206722 - RNA, 13 nt, Homo sapiens
uucgaaagcaaug

SEQ ID NO: 2206723 - RNA, 17 nt, Homo sapiens
cuuuacuuuguacaaau

SEQ ID NO: 2206724 - RNA, 16 nt, Homo sapiens
cugggggccucagugc

SEQ ID NO: 2206725 - RNA, 21 nt, Homo sapiens
gugugacuuugggcaagccaa

SEQ ID NO: 2206726 - RNA, 16 nt, Homo sapiens
auuuggauuuuccacc

SEQ ID NO: 2206727 - RNA, 14 nt, Homo sapiens
ugaagccauuugcc

SEQ ID NO: 2206728 - RNA, 15 nt, Homo sapiens
cacaaagcuauuuaa

SEQ ID NO: 2206729 - RNA, 13 nt, Homo sapiens
gauauaagccaua

SEQ ID NO: 2206730 - RNA, 16 nt, Homo sapiens
uuacgaucuguuucca

SEQ ID NO: 2206731 - RNA, 20 nt, Homo sapiens
gaagcagguucuugauguca

SEQ ID NO: 2206732 - RNA, 19 nt, Homo sapiens
cagacccuggaacuggaga

SEQ ID NO: 2206733 - RNA, 17 nt, Homo sapiens
uccacccagugauccca

SEQ ID NO: 2206734 - RNA, 20 nt, Homo sapiens
gcuuuggacgcacacagcuu

SEQ ID NO: 2206735 - RNA, 19 nt, Homo sapiens
acacagugaccauacuaau

SEQ ID NO: 2206736 - RNA, 16 nt, Homo sapiens
aaaugagagaagggac

SEQ ID NO: 2206737 - RNA, 15 nt, Homo sapiens
uuagaauacuacagc

SEQ ID NO: 2206738 - RNA, 21 nt, Homo sapiens
agaaguuuggcugcugucaua

SEQ ID NO: 2206739 - RNA, 21 nt, Homo sapiens
cuuaaauuaagauuaugugag

SEQ ID NO: 2206740 - RNA, 17 nt, Homo sapiens
ggcucacgccuguaauu

SEQ ID NO: 2206741 - RNA, 14 nt, Homo sapiens
uaauccuaccucaa

SEQ ID NO: 2206742 - RNA, 22 nt, Homo sapiens
accacaaccaccuucaccugga

SEQ ID NO: 2206743 - RNA, 16 nt, Homo sapiens
uuaaaacagacacugg

SEQ ID NO: 2206744 - RNA, 15 nt, Homo sapiens
gggaggcagggcagc

SEQ ID NO: 2206745 - RNA, 16 nt, Homo sapiens
gugagacccuguucua

SEQ ID NO: 2206746 - RNA, 13 nt, Homo sapiens
aggaauucagugc

SEQ ID NO: 2206747 - RNA, 20 nt, Homo sapiens
cucuuggccggauguccuca

SEQ ID NO: 2206748 - RNA, 17 nt, Homo sapiens
caugagaaguugauaua

SEQ ID NO: 2206749 - RNA, 21 nt, Homo sapiens
acagacuggcuccaacacugc

SEQ ID NO: 2206750 - RNA, 12 nt, Homo sapiens
caucagcacucu

SEQ ID NO: 2206751 - RNA, 14 nt, Homo sapiens
aauaaauugcuccu

SEQ ID NO: 2206752 - RNA, 18 nt, Homo sapiens
gguucuggaaacauucag

SEQ ID NO: 2206753 - RNA, 18 nt, Homo sapiens
uguauaaaaugcuacuua

SEQ ID NO: 2206754 - RNA, 14 nt, Homo sapiens
uaagagcaauguuu

SEQ ID NO: 2206755 - RNA, 21 nt, Homo sapiens
auaaacaacuuaauguucuga

SEQ ID NO: 2206756 - RNA, 18 nt, Homo sapiens
auggagugcaguggcuca

SEQ ID NO: 2206757 - RNA, 18 nt, Homo sapiens
gaauauucccaagcccau

SEQ ID NO: 2206758 - RNA, 17 nt, Homo sapiens
auugucuguauuugccg

SEQ ID NO: 2206759 - RNA, 14 nt, Homo sapiens
ucuugauaaaugac

SEQ ID NO: 2206760 - RNA, 20 nt, Homo sapiens
uguguaagacacugugcaaa

SEQ ID NO: 2206761 - RNA, 21 nt, Homo sapiens
ugcagggccuguaaucccagc

SEQ ID NO: 2206762 - RNA, 21 nt, Homo sapiens
gauggauaucccuaccuugaa

SEQ ID NO: 2206763 - RNA, 12 nt, Homo sapiens
gcucccaggugc

SEQ ID NO: 2206764 - RNA, 12 nt, Homo sapiens
cuguccagccuu

SEQ ID NO: 2206765 - RNA, 12 nt, Homo sapiens
ccucccagcugc

SEQ ID NO: 2206766 - RNA, 14 nt, Homo sapiens
ucucucuccagggu

SEQ ID NO: 2206767 - RNA, 18 nt, Homo sapiens
acagcgagacuccgucuc

SEQ ID NO: 2206768 - RNA, 14 nt, Homo sapiens
ggagucagugucug

SEQ ID NO: 2206769 - RNA, 20 nt, Homo sapiens
cuucauuaguugaaagggau

SEQ ID NO: 2206770 - RNA, 22 nt, Homo sapiens
agggcuacccaaaacaguucua

SEQ ID NO: 2206771 - RNA, 21 nt, Homo sapiens
auguuaguagaaauuuuacaa

SEQ ID NO: 2206772 - RNA, 13 nt, Homo sapiens
cuacacugugaag

SEQ ID NO: 2206773 - RNA, 16 nt, Homo sapiens
auccuguuaggggaaa

SEQ ID NO: 2206774 - RNA, 19 nt, Homo sapiens
gcagggguccuugguguga

SEQ ID NO: 2206775 - RNA, 15 nt, Homo sapiens
aaagaauacuuucau

SEQ ID NO: 2206776 - RNA, 23 nt, Homo sapiens
ccuuggccucucuguacacugcc

SEQ ID NO: 2206777 - RNA, 15 nt, Homo sapiens
aguggagaagcacac

SEQ ID NO: 2206778 - RNA, 20 nt, Homo sapiens
uuguguguuccaaguuucca

SEQ ID NO: 2206779 - RNA, 19 nt, Homo sapiens
guauucaacuaauacaugg

SEQ ID NO: 2206780 - RNA, 14 nt, Homo sapiens
aacccaucuacccc

SEQ ID NO: 2206781 - RNA, 17 nt, Homo sapiens
ucuuuggaggcuuuuaa

SEQ ID NO: 2206782 - RNA, 22 nt, Homo sapiens
ugccagaaugcuuuaggaugua

SEQ ID NO: 2206783 - RNA, 14 nt, Homo sapiens
auuuaaagcaucau

SEQ ID NO: 2206784 - RNA, 18 nt, Homo sapiens
uugagaugguaacagauu

SEQ ID NO: 2206785 - RNA, 20 nt, Homo sapiens
ggcgacagagggagacucca

SEQ ID NO: 2206786 - RNA, 15 nt, Homo sapiens
cugggcagagccugu

SEQ ID NO: 2206787 - RNA, 13 nt, Homo sapiens
uaaauaguuugac

SEQ ID NO: 2206788 - RNA, 13 nt, Homo sapiens
gaaucaguguguu

SEQ ID NO: 2206789 - RNA, 14 nt, Homo sapiens
uggaugaagcucug

SEQ ID NO: 2206790 - RNA, 16 nt, Homo sapiens
agcagggguuggucaa

SEQ ID NO: 2206791 - RNA, 21 nt, Homo sapiens
cuacugauuuuuuaguuaaau

SEQ ID NO: 2206792 - RNA, 20 nt, Homo sapiens
gugcugacaacuuagcucag

SEQ ID NO: 2206793 - RNA, 23 nt, Homo sapiens
agccaguguggucaguauuccaa

SEQ ID NO: 2206794 - RNA, 12 nt, Homo sapiens
cugaaacuucaa

SEQ ID NO: 2206795 - RNA, 15 nt, Homo sapiens
aagucaggaguccaa

SEQ ID NO: 2206796 - RNA, 23 nt, Homo sapiens
uuuacuuuugcucccuaccugac

SEQ ID NO: 2206797 - RNA, 22 nt, Homo sapiens
ggucuccaccccucaagccagg

SEQ ID NO: 2206798 - RNA, 16 nt, Homo sapiens
uacgugaaaugcucaa

SEQ ID NO: 2206799 - RNA, 14 nt, Homo sapiens
cucaguaguauaug

SEQ ID NO: 2206800 - RNA, 16 nt, Homo sapiens
uaauugugugucacaa

SEQ ID NO: 2206801 - RNA, 22 nt, Homo sapiens
uggcaauuuuuuuauacuacca

SEQ ID NO: 2206802 - RNA, 19 nt, Homo sapiens
ggccugaaaugacauuuca

SEQ ID NO: 2206803 - RNA, 22 nt, Homo sapiens
uccccuuaaaucaggaaauaca

SEQ ID NO: 2206804 - RNA, 21 nt, Homo sapiens
cacuagguuucaccucccaaa

SEQ ID NO: 2206805 - RNA, 20 nt, Homo sapiens
cagcaggaccugugcuuuga

SEQ ID NO: 2206806 - RNA, 14 nt, Homo sapiens
guuaggcucacagu

SEQ ID NO: 2206807 - RNA, 13 nt, Homo sapiens
ugcaaaaauaacc

SEQ ID NO: 2206808 - RNA, 18 nt, Homo sapiens
uucugauguuacugagau

SEQ ID NO: 2206809 - RNA, 19 nt, Homo sapiens
aagaauauuccauuuuccu

SEQ ID NO: 2206810 - RNA, 22 nt, Homo sapiens
agcucugcuugccgaaacugga

SEQ ID NO: 2206811 - RNA, 23 nt, Homo sapiens
agaauaugcgggacaugaugcua

SEQ ID NO: 2206812 - RNA, 20 nt, Homo sapiens
aucucugguuuugcuuuguu

SEQ ID NO: 2206813 - RNA, 21 nt, Homo sapiens
acucagauuuaagccuuacaa

SEQ ID NO: 2206814 - RNA, 19 nt, Homo sapiens
gaauguuguccugugucau

SEQ ID NO: 2206815 - RNA, 18 nt, Homo sapiens
gagucuucacuaaccuuu

SEQ ID NO: 2206816 - RNA, 15 nt, Homo sapiens
cauauccgggugcuc

SEQ ID NO: 2206817 - RNA, 14 nt, Homo sapiens
cuaggucugaccaa

SEQ ID NO: 2206818 - RNA, 21 nt, Homo sapiens
ggcgaagcugagcgggucuag

SEQ ID NO: 2206819 - RNA, 15 nt, Homo sapiens
cuauauccugugacu

SEQ ID NO: 2206820 - RNA, 20 nt, Homo sapiens
ucccuuuuugucucucaugg

SEQ ID NO: 2206821 - RNA, 18 nt, Homo sapiens
auccccacguggacaaga

SEQ ID NO: 2206822 - RNA, 16 nt, Homo sapiens
agaaaaaaaaacuggg

SEQ ID NO: 2206823 - RNA, 13 nt, Homo sapiens
ucugcaaccucug

SEQ ID NO: 2206824 - RNA, 15 nt, Homo sapiens
uauuacuaguguuua

SEQ ID NO: 2206825 - RNA, 14 nt, Homo sapiens
ucugcccucauaga

SEQ ID NO: 2206826 - RNA, 12 nt, Homo sapiens
auccuaccacaa

SEQ ID NO: 2206827 - RNA, 14 nt, Homo sapiens
ucaagcaguucucc

SEQ ID NO: 2206828 - RNA, 12 nt, Homo sapiens
ucccaaagugaa

SEQ ID NO: 2206829 - RNA, 23 nt, Homo sapiens
ucccaggcugcuggagugcagug

SEQ ID NO: 2206830 - RNA, 21 nt, Homo sapiens
uaucagagacccuggugcugc

SEQ ID NO: 2206831 - RNA, 21 nt, Homo sapiens
auuucugaaaaagaacuguau

SEQ ID NO: 2206832 - RNA, 19 nt, Homo sapiens
acaggccacacgcugccca

SEQ ID NO: 2206833 - RNA, 15 nt, Homo sapiens
ccaauuacacacagc

SEQ ID NO: 2206834 - RNA, 15 nt, Homo sapiens
cauccuccauugcuc

SEQ ID NO: 2206835 - RNA, 15 nt, Homo sapiens
caacaaacauagaaa

SEQ ID NO: 2206836 - RNA, 22 nt, Homo sapiens
gaagaaccacgaugaccacaga

SEQ ID NO: 2206837 - RNA, 13 nt, Homo sapiens
uguagccaugacc

SEQ ID NO: 2206838 - RNA, 21 nt, Homo sapiens
augaucuuuccauuggaaaua

SEQ ID NO: 2206839 - RNA, 14 nt, Homo sapiens
ucaauaauuacugu

SEQ ID NO: 2206840 - RNA, 23 nt, Homo sapiens
cucauccagggcucugaccaguu

SEQ ID NO: 2206841 - RNA, 21 nt, Homo sapiens
ugggaccacacagacaggguu

SEQ ID NO: 2206842 - RNA, 19 nt, Homo sapiens
gucucaagagggcacuggu

SEQ ID NO: 2206843 - RNA, 15 nt, Homo sapiens
acaguuuccagucau

SEQ ID NO: 2206844 - RNA, 14 nt, Homo sapiens
cccuccaaaagcac

SEQ ID NO: 2206845 - RNA, 19 nt, Homo sapiens
cuugaaguauccacagaaa

SEQ ID NO: 2206846 - RNA, 21 nt, Homo sapiens
uccauuuucuucucugugaag

SEQ ID NO: 2206847 - RNA, 15 nt, Homo sapiens
cgcggcgguggagcc

SEQ ID NO: 2206848 - RNA, 21 nt, Homo sapiens
uuaacacccuuuagaaccuua

SEQ ID NO: 2206849 - RNA, 22 nt, Homo sapiens
caaagauaagguuauaguaaca

SEQ ID NO: 2206850 - RNA, 23 nt, Homo sapiens
ucaaaaauaccauuuuaguauga

SEQ ID NO: 2206851 - RNA, 16 nt, Homo sapiens
gaccacagagcuccug

SEQ ID NO: 2206852 - RNA, 16 nt, Homo sapiens
gucuguuuugccuuca

SEQ ID NO: 2206853 - RNA, 17 nt, Homo sapiens
caauauugguguacugu

SEQ ID NO: 2206854 - RNA, 19 nt, Homo sapiens
acagaaauacugcucugaa

SEQ ID NO: 2206855 - RNA, 22 nt, Homo sapiens
cggcugccuagcccucccccca

SEQ ID NO: 2206856 - RNA, 22 nt, Homo sapiens
cucucugaacacacauugcuau

SEQ ID NO: 2206857 - RNA, 18 nt, Homo sapiens
uucagaagccuaauucca

SEQ ID NO: 2206858 - RNA, 20 nt, Homo sapiens
gccugagaggcaggcauaga

SEQ ID NO: 2206859 - RNA, 20 nt, Homo sapiens
agaacaauuaaacagccaaa

SEQ ID NO: 2206860 - RNA, 16 nt, Homo sapiens
aggaagagccuuccac

SEQ ID NO: 2206861 - RNA, 22 nt, Homo sapiens
gauaucugcagggacagagcau

SEQ ID NO: 2206862 - RNA, 14 nt, Homo sapiens
cucccaaccucaau

SEQ ID NO: 2206863 - RNA, 14 nt, Homo sapiens
agguucuucagggc

SEQ ID NO: 2206864 - RNA, 21 nt, Homo sapiens
aauaguuguuauucuguaguu

SEQ ID NO: 2206865 - RNA, 19 nt, Homo sapiens
ucacuguauauaaacauau

SEQ ID NO: 2206866 - RNA, 19 nt, Homo sapiens
gcaauacuguccaguuuuc

SEQ ID NO: 2206867 - RNA, 17 nt, Homo sapiens
gaaacaguuaauaccau

SEQ ID NO: 2206868 - RNA, 11 nt, Homo sapiens
auaaagugaug

SEQ ID NO: 2206869 - RNA, 19 nt, Homo sapiens
gugauggaagaugcagucu

SEQ ID NO: 2206870 - RNA, 22 nt, Homo sapiens
aaauuuccuuucauaccuugaa

SEQ ID NO: 2206871 - RNA, 21 nt, Homo sapiens
ccucagagggccauugaacuc

SEQ ID NO: 2206872 - RNA, 21 nt, Homo sapiens
ugcuacucauggcaagauuag

SEQ ID NO: 2206873 - RNA, 22 nt, Homo sapiens
auucaucugggaggcagaacag

SEQ ID NO: 2206874 - RNA, 14 nt, Homo sapiens
auaaucucuuucca

SEQ ID NO: 2206875 - RNA, 13 nt, Homo sapiens
uuccuccauaaau

SEQ ID NO: 2206876 - RNA, 23 nt, Homo sapiens
ugucccucaaaugacccaaagac

SEQ ID NO: 2206877 - RNA, 13 nt, Homo sapiens
auucuucugcuuc

SEQ ID NO: 2206878 - RNA, 17 nt, Homo sapiens
guuuuuacuaaguaaaa

SEQ ID NO: 2206879 - RNA, 19 nt, Homo sapiens
gugaagaguuucacaaauc

SEQ ID NO: 2206880 - RNA, 21 nt, Homo sapiens
auuguguugggaccugugauc

SEQ ID NO: 2206881 - RNA, 23 nt, Homo sapiens
ccaaguuccaaaauaaagcauaa

SEQ ID NO: 2206882 - RNA, 15 nt, Homo sapiens
ggaaauaacauugca

SEQ ID NO: 2206883 - RNA, 19 nt, Homo sapiens
cuguuggcaaauuugugaa

SEQ ID NO: 2206884 - RNA, 21 nt, Homo sapiens
agagggaccaaauugcuucua

SEQ ID NO: 2206885 - RNA, 18 nt, Homo sapiens
cagacucuuccaccagag

SEQ ID NO: 2206886 - RNA, 16 nt, Homo sapiens
cccagugacaaccaaa

SEQ ID NO: 2206887 - RNA, 20 nt, Homo sapiens
uauacuuugccacugcugua

SEQ ID NO: 2206888 - RNA, 19 nt, Homo sapiens
caaaaaacaacacagucua

SEQ ID NO: 2206889 - RNA, 21 nt, Homo sapiens
caagcaccacgcccuccaggg

SEQ ID NO: 2206890 - RNA, 20 nt, Homo sapiens
gaaaacuugacauguagcuu

SEQ ID NO: 2206891 - RNA, 10 nt, Homo sapiens
cuuuugccau

SEQ ID NO: 2206892 - RNA, 19 nt, Homo sapiens
agccuuuaucuaugggaga

SEQ ID NO: 2206893 - RNA, 16 nt, Homo sapiens
ucaggcuacaagguag

SEQ ID NO: 2206894 - RNA, 19 nt, Homo sapiens
accuaguccccagccugcu

SEQ ID NO: 2206895 - RNA, 13 nt, Homo sapiens
gagacaaggucac

SEQ ID NO: 2206896 - RNA, 19 nt, Homo sapiens
ccauauauuuaauauguca

SEQ ID NO: 2206897 - RNA, 14 nt, Homo sapiens
cagcucagcacugc

SEQ ID NO: 2206898 - RNA, 16 nt, Homo sapiens
ccgauguccgugggca

SEQ ID NO: 2206899 - RNA, 16 nt, Homo sapiens
ccuguggcagcugccc

SEQ ID NO: 2206900 - RNA, 13 nt, Homo sapiens
cuauaauaccagc

SEQ ID NO: 2206901 - RNA, 14 nt, Homo sapiens
ggaaacacacuguu

SEQ ID NO: 2206902 - RNA, 19 nt, Homo sapiens
caaugaucaccgacugaaa

SEQ ID NO: 2206903 - RNA, 16 nt, Homo sapiens
gaggccggaaucucag

SEQ ID NO: 2206904 - RNA, 15 nt, Homo sapiens
caaaaugacuuauua

SEQ ID NO: 2206905 - RNA, 16 nt, Homo sapiens
ugauugacacacagca

SEQ ID NO: 2206906 - RNA, 11 nt, Homo sapiens
guaccaaaaca

SEQ ID NO: 2206907 - RNA, 22 nt, Homo sapiens
cugaaaagauacugaugcauug

SEQ ID NO: 2206908 - RNA, 17 nt, Homo sapiens
acuccccuuucuuccaa

SEQ ID NO: 2206909 - RNA, 20 nt, Homo sapiens
auacaagucccguucuguag

SEQ ID NO: 2206910 - RNA, 21 nt, Homo sapiens
gcuucaaagccauauggacac

SEQ ID NO: 2206911 - RNA, 20 nt, Homo sapiens
ccacaccaaugcaacauuug

SEQ ID NO: 2206912 - RNA, 21 nt, Homo sapiens
aggcagcuaucugcacucuaa

SEQ ID NO: 2206913 - RNA, 23 nt, Homo sapiens
uggcacaugacaacuuugccagc

SEQ ID NO: 2206914 - RNA, 13 nt, Homo sapiens
auucguagggaug

SEQ ID NO: 2206915 - RNA, 13 nt, Homo sapiens
uucaaaccauuuu

SEQ ID NO: 2206916 - RNA, 22 nt, Homo sapiens
cagucacccagggcgucccuga

SEQ ID NO: 2206917 - RNA, 22 nt, Homo sapiens
acuuucuucuagugcuuuucag

SEQ ID NO: 2206918 - RNA, 19 nt, Homo sapiens
uggaagguggggacaggga

SEQ ID NO: 2206919 - RNA, 22 nt, Homo sapiens
gaaucaauccagcgguucucaa

SEQ ID NO: 2206920 - RNA, 17 nt, Homo sapiens
augggagcuuaacuuua

SEQ ID NO: 2206921 - RNA, 22 nt, Homo sapiens
acuguucuugacaaucaucucc

SEQ ID NO: 2206922 - RNA, 15 nt, Homo sapiens
agcaggacugcacag

SEQ ID NO: 2206923 - RNA, 14 nt, Homo sapiens
auccuccuaccuca

SEQ ID NO: 2206924 - RNA, 19 nt, Homo sapiens
caagaacagagucucagga

SEQ ID NO: 2206925 - RNA, 19 nt, Homo sapiens
uuuguauuuuuaguagaga

SEQ ID NO: 2206926 - RNA, 12 nt, Homo sapiens
uuagcuauuacu

SEQ ID NO: 2206927 - RNA, 20 nt, Homo sapiens
ucuccaccccucaagccagg

SEQ ID NO: 2206928 - RNA, 14 nt, Homo sapiens
gcuagacuggugac

SEQ ID NO: 2206929 - RNA, 19 nt, Homo sapiens
auguucugugacugaagaa

SEQ ID NO: 2206930 - RNA, 20 nt, Homo sapiens
acaucucaaggagggagaac

SEQ ID NO: 2206931 - RNA, 17 nt, Homo sapiens
cuuggaguuugcauucu

SEQ ID NO: 2206932 - RNA, 20 nt, Homo sapiens
ccccucauucagagacugcc

SEQ ID NO: 2206933 - RNA, 20 nt, Homo sapiens
acaauccgagcuacaaagca

SEQ ID NO: 2206934 - RNA, 20 nt, Homo sapiens
uggccucucuguacacugcc

SEQ ID NO: 2206935 - RNA, 21 nt, Homo sapiens
ggagggcugucaucugugcac

SEQ ID NO: 2206936 - RNA, 20 nt, Homo sapiens
augcacacacagaugcacac

SEQ ID NO: 2206937 - RNA, 22 nt, Homo sapiens
accccagaagauuagcauccca

SEQ ID NO: 2206938 - RNA, 14 nt, Homo sapiens
uuaucaguaagaaa

SEQ ID NO: 2206939 - RNA, 16 nt, Homo sapiens
agccuggggcaaagcu

SEQ ID NO: 2206940 - RNA, 15 nt, Homo sapiens
cugauuggggccuca

SEQ ID NO: 2206941 - RNA, 20 nt, Homo sapiens
aaugucaucaaauauuacca

SEQ ID NO: 2206942 - RNA, 14 nt, Homo sapiens
aaugccgccuguca

SEQ ID NO: 2206943 - RNA, 18 nt, Homo sapiens
ucugggcccccacuuuca

SEQ ID NO: 2206944 - RNA, 21 nt, Homo sapiens
cucaaggcugcagugagccaa

SEQ ID NO: 2206945 - RNA, 18 nt, Homo sapiens
aucuuuguggccaaggag

SEQ ID NO: 2206946 - RNA, 14 nt, Homo sapiens
auacguccaccaug

SEQ ID NO: 2206947 - RNA, 22 nt, Homo sapiens
ucaauuucuggaaaacugccuu

SEQ ID NO: 2206948 - RNA, 16 nt, Homo sapiens
ggguucacaccauucu

SEQ ID NO: 2206949 - RNA, 20 nt, Homo sapiens
cugauccccuuugguuuuac

SEQ ID NO: 2206950 - RNA, 16 nt, Homo sapiens
cagcccugacuggugc

SEQ ID NO: 2206951 - RNA, 21 nt, Homo sapiens
cuuucaaauuuacugucuuaa

SEQ ID NO: 2206952 - RNA, 14 nt, Homo sapiens
auuuauaagcauuu

SEQ ID NO: 2206953 - RNA, 17 nt, Homo sapiens
caaaauguucuauuuaa

SEQ ID NO: 2206954 - RNA, 15 nt, Homo sapiens
uauaugugugccuau

SEQ ID NO: 2206955 - RNA, 15 nt, Homo sapiens
aagcuuccauuccac

SEQ ID NO: 2206956 - RNA, 13 nt, Homo sapiens
ugaaauugccaaa

SEQ ID NO: 2206957 - RNA, 13 nt, Homo sapiens
cccucuugugcuc

SEQ ID NO: 2206958 - RNA, 16 nt, Homo sapiens
aacuagaaaucugcca

SEQ ID NO: 2206959 - RNA, 10 nt, Homo sapiens
uauucauugg

SEQ ID NO: 2206960 - RNA, 16 nt, Homo sapiens
uaucaauggauuuauc

SEQ ID NO: 2206961 - RNA, 20 nt, Homo sapiens
ccaaaucuaaauagauacuu

SEQ ID NO: 2206962 - RNA, 16 nt, Homo sapiens
agauauuuccauuucu

SEQ ID NO: 2206963 - RNA, 14 nt, Homo sapiens
ugaggugaauuuca

SEQ ID NO: 2206964 - RNA, 21 nt, Homo sapiens
gcagagcccucaugugacaug

SEQ ID NO: 2206965 - RNA, 16 nt, Homo sapiens
gggcaaggaagcuuug

SEQ ID NO: 2206966 - RNA, 21 nt, Homo sapiens
ccuucaguaaaugugauucac

SEQ ID NO: 2206967 - RNA, 16 nt, Homo sapiens
uggccuggccagacca

SEQ ID NO: 2206968 - RNA, 17 nt, Homo sapiens
cuaccuuuugcuacuua

SEQ ID NO: 2206969 - RNA, 18 nt, Homo sapiens
cuuccguccauccauuca

SEQ ID NO: 2206970 - RNA, 18 nt, Homo sapiens
acaguauuacaguguccu

SEQ ID NO: 2206971 - RNA, 16 nt, Homo sapiens
ugugucuguacacgug

SEQ ID NO: 2206972 - RNA, 19 nt, Homo sapiens
acuaggaaaagaccaucug

SEQ ID NO: 2206973 - RNA, 14 nt, Homo sapiens
augcccccucagug

SEQ ID NO: 2206974 - RNA, 19 nt, Homo sapiens
cauucagcagcaggugcuu

SEQ ID NO: 2206975 - RNA, 19 nt, Homo sapiens
uuucucugagaucaugagu

SEQ ID NO: 2206976 - RNA, 15 nt, Homo sapiens
aggcaggaacauaca

SEQ ID NO: 2206977 - RNA, 17 nt, Homo sapiens
uguaaucacauuccuua

SEQ ID NO: 2206978 - RNA, 20 nt, Homo sapiens
ccuguggccccaccgagcug

SEQ ID NO: 2206979 - RNA, 17 nt, Homo sapiens
caguuguguuccugaca

SEQ ID NO: 2206980 - RNA, 20 nt, Homo sapiens
ucauuugggcuuucuguuga

SEQ ID NO: 2206981 - RNA, 19 nt, Homo sapiens
agugcaauggcacaaucuu

SEQ ID NO: 2206982 - RNA, 18 nt, Homo sapiens
cugccugggacagccacu

SEQ ID NO: 2206983 - RNA, 19 nt, Homo sapiens
ccugaaauuaacucagaca

SEQ ID NO: 2206984 - RNA, 23 nt, Homo sapiens
ucaucaggugcauagcaagugaa

SEQ ID NO: 2206985 - RNA, 15 nt, Homo sapiens
ggcuccuaccugggg

SEQ ID NO: 2206986 - RNA, 19 nt, Homo sapiens
aauaagcauaccauugaaa

SEQ ID NO: 2206987 - RNA, 22 nt, Homo sapiens
uagcuuuccacauuugucacag

SEQ ID NO: 2206988 - RNA, 22 nt, Homo sapiens
ugacauuuauuuuucucaugaa

SEQ ID NO: 2206989 - RNA, 21 nt, Homo sapiens
uuuucaaagugggauagcuau

SEQ ID NO: 2206990 - RNA, 13 nt, Homo sapiens
ugcaugugugaag

SEQ ID NO: 2206991 - RNA, 20 nt, Homo sapiens
uaacuccuuuuccacuuuaa

SEQ ID NO: 2206992 - RNA, 21 nt, Homo sapiens
cagugaugugaucauagcuca

SEQ ID NO: 2206993 - RNA, 20 nt, Homo sapiens
aagagacaggagacaugagu

SEQ ID NO: 2206994 - RNA, 14 nt, Homo sapiens
ucagccauucacug

SEQ ID NO: 2206995 - RNA, 22 nt, Homo sapiens
uccaguuagagucuucaucugu

SEQ ID NO: 2206996 - RNA, 20 nt, Homo sapiens
acugauccaguauaagacua

SEQ ID NO: 2206997 - RNA, 18 nt, Homo sapiens
cccagugcccuuugcauc

SEQ ID NO: 2206998 - RNA, 19 nt, Homo sapiens
cagccucauugaugucaaa

SEQ ID NO: 2206999 - RNA, 23 nt, Homo sapiens
uugcauaacagcaggguaccuga

SEQ ID NO: 2207000 - RNA, 22 nt, Homo sapiens
uucccuguucuucguugcugca

SEQ ID NO: 2207001 - RNA, 23 nt, Homo sapiens
acaguugcacagcaucucagcuc

SEQ ID NO: 2207002 - RNA, 16 nt, Homo sapiens
guaagaccaccuuccc

SEQ ID NO: 2207003 - RNA, 16 nt, Homo sapiens
uuuguuuugcacugac

SEQ ID NO: 2207004 - RNA, 16 nt, Homo sapiens
guauauaaacauauca

SEQ ID NO: 2207005 - RNA, 22 nt, Homo sapiens
ucccaagcugauuuuauucaau

SEQ ID NO: 2207006 - RNA, 19 nt, Homo sapiens
uucaaacauuauucucaac

SEQ ID NO: 2207007 - RNA, 23 nt, Homo sapiens
cgaggacagccugccucugccac

SEQ ID NO: 2207008 - RNA, 20 nt, Homo sapiens
aaccuagauugcaccauugc

SEQ ID NO: 2207009 - RNA, 21 nt, Homo sapiens
gcuggcauuugcugcauuuca

SEQ ID NO: 2207010 - RNA, 19 nt, Homo sapiens
gcugccccuggugcacugg

SEQ ID NO: 2207011 - RNA, 19 nt, Homo sapiens
agcugccugcugccauagc

SEQ ID NO: 2207012 - RNA, 19 nt, Homo sapiens
gagauguggaaaagccaag

SEQ ID NO: 2207013 - RNA, 21 nt, Homo sapiens
augcccaacuuacugucuucu

SEQ ID NO: 2207014 - RNA, 14 nt, Homo sapiens
ugacacggccauga

SEQ ID NO: 2207015 - RNA, 21 nt, Homo sapiens
ccucuuagaugcaguucugaa

SEQ ID NO: 2207016 - RNA, 16 nt, Homo sapiens
cuggccaggacacacu

SEQ ID NO: 2207017 - RNA, 13 nt, Homo sapiens
gaaaauacaucuu

SEQ ID NO: 2207018 - RNA, 15 nt, Homo sapiens
uacagacaucuaaug

SEQ ID NO: 2207019 - RNA, 15 nt, Homo sapiens
aauaaagaaccaguc

SEQ ID NO: 2207020 - RNA, 18 nt, Homo sapiens
ucaccggccgauggagac

SEQ ID NO: 2207021 - RNA, 16 nt, Homo sapiens
ggaccaguuucuugaa

SEQ ID NO: 2207022 - RNA, 13 nt, Homo sapiens
uauuuaaagcauu

SEQ ID NO: 2207023 - RNA, 15 nt, Homo sapiens
ugaacugcaacacug

SEQ ID NO: 2207024 - RNA, 19 nt, Homo sapiens
gcagccccuaagugcaaac

SEQ ID NO: 2207025 - RNA, 12 nt, Homo sapiens
ggaggacaagca

SEQ ID NO: 2207026 - RNA, 20 nt, Homo sapiens
auuaaacuuuucauuacacu

SEQ ID NO: 2207027 - RNA, 17 nt, Homo sapiens
gggugcuggauggacag

SEQ ID NO: 2207028 - RNA, 20 nt, Homo sapiens
cugagcaaaucaccacaaac

SEQ ID NO: 2207029 - RNA, 15 nt, Homo sapiens
caucccggcacuguu

SEQ ID NO: 2207030 - RNA, 16 nt, Homo sapiens
agggaggccugagggg

SEQ ID NO: 2207031 - RNA, 22 nt, Homo sapiens
uccccagacuucucuuucuuau

SEQ ID NO: 2207032 - RNA, 24 nt, Homo sapiens
uuucaccaggaucucuuggccuca

SEQ ID NO: 2207033 - RNA, 22 nt, Homo sapiens
cgcaggggcugccgagugcugu

SEQ ID NO: 2207034 - RNA, 12 nt, Homo sapiens
uggcucuucacc

SEQ ID NO: 2207035 - RNA, 13 nt, Homo sapiens
ccagugacacuuc

SEQ ID NO: 2207036 - RNA, 21 nt, Homo sapiens
auucugccuuugccaggugac

SEQ ID NO: 2207037 - RNA, 20 nt, Homo sapiens
gcaaccucggggagugccac

SEQ ID NO: 2207038 - RNA, 20 nt, Homo sapiens
gucccuucccagcgcugcug

SEQ ID NO: 2207039 - RNA, 10 nt, Homo sapiens
cgccccagag

SEQ ID NO: 2207040 - RNA, 13 nt, Homo sapiens
ccaauuccugaca

SEQ ID NO: 2207041 - RNA, 21 nt, Homo sapiens
aaggcuaucggagcaguucaa

SEQ ID NO: 2207042 - RNA, 15 nt, Homo sapiens
guauauagaagucua

SEQ ID NO: 2207043 - RNA, 16 nt, Homo sapiens
auggaagcaaagacaa

SEQ ID NO: 2207044 - RNA, 13 nt, Homo sapiens
uugugcucuuucc

SEQ ID NO: 2207045 - RNA, 17 nt, Homo sapiens
uuauaccuguacacaca

SEQ ID NO: 2207046 - RNA, 22 nt, Homo sapiens
gugaaaaaggcaagccacagaa

SEQ ID NO: 2207047 - RNA, 19 nt, Homo sapiens
ucaaguaccucaucugcac

SEQ ID NO: 2207048 - RNA, 21 nt, Homo sapiens
ugaaugaaacccccacacaca

SEQ ID NO: 2207049 - RNA, 18 nt, Homo sapiens
uuucaguaucaucuccau

SEQ ID NO: 2207050 - RNA, 19 nt, Homo sapiens
ucaaaggcauaagucauuc

SEQ ID NO: 2207051 - RNA, 16 nt, Homo sapiens
ccauuuguuugugcuu

SEQ ID NO: 2207052 - RNA, 20 nt, Homo sapiens
aagcuaucagcaauacucau

SEQ ID NO: 2207053 - RNA, 21 nt, Homo sapiens
agacugggucucgcuuuguug

SEQ ID NO: 2207054 - RNA, 16 nt, Homo sapiens
aaagaauucucuugcu

SEQ ID NO: 2207055 - RNA, 13 nt, Homo sapiens
agaggaugucaca

SEQ ID NO: 2207056 - RNA, 17 nt, Homo sapiens
uacuuuugcacuuugaa

SEQ ID NO: 2207057 - RNA, 15 nt, Homo sapiens
auaagaucagacucu

SEQ ID NO: 2207058 - RNA, 20 nt, Homo sapiens
auagagcagauucaguguua

SEQ ID NO: 2207059 - RNA, 16 nt, Homo sapiens
gcaacugcccuuccag

SEQ ID NO: 2207060 - RNA, 23 nt, Homo sapiens
cuccuuccuggagcccagaggag

SEQ ID NO: 2207061 - RNA, 14 nt, Homo sapiens
uugaagccaaagaa

SEQ ID NO: 2207062 - RNA, 23 nt, Homo sapiens
aaaacaaagcaacaaauuaacua

SEQ ID NO: 2207063 - RNA, 14 nt, Homo sapiens
ugaaucuacauuca

SEQ ID NO: 2207064 - RNA, 16 nt, Homo sapiens
ccacccagaggucucc

SEQ ID NO: 2207065 - RNA, 17 nt, Homo sapiens
caggcaaacguccacaa

SEQ ID NO: 2207066 - RNA, 19 nt, Homo sapiens
agaggugguagaaccacuu

SEQ ID NO: 2207067 - RNA, 22 nt, Homo sapiens
uggguauaccucuaacugugca

SEQ ID NO: 2207068 - RNA, 15 nt, Homo sapiens
agcagugaucucagg

SEQ ID NO: 2207069 - RNA, 19 nt, Homo sapiens
caugaugugugaguguaau

SEQ ID NO: 2207070 - RNA, 22 nt, Homo sapiens
augggucuggcugagcugaacc

SEQ ID NO: 2207071 - RNA, 16 nt, Homo sapiens
uguuaggauuacaggc

SEQ ID NO: 2207072 - RNA, 15 nt, Homo sapiens
augccucagagggua

SEQ ID NO: 2207073 - RNA, 19 nt, Homo sapiens
agaagcuuugguucugcca

SEQ ID NO: 2207074 - RNA, 19 nt, Homo sapiens
gccauguaccaguguacug

SEQ ID NO: 2207075 - RNA, 21 nt, Homo sapiens
gcacaauuaauuaaaagugaa

SEQ ID NO: 2207076 - RNA, 17 nt, Homo sapiens
acauacgcacugggcau

SEQ ID NO: 2207077 - RNA, 17 nt, Homo sapiens
ugcagauucagugcaau

SEQ ID NO: 2207078 - RNA, 15 nt, Homo sapiens
cuggaccccacuggc

SEQ ID NO: 2207079 - RNA, 12 nt, Homo sapiens
uucucuauucca

SEQ ID NO: 2207080 - RNA, 23 nt, Homo sapiens
gcucaugccucagcccgccuuca

SEQ ID NO: 2207081 - RNA, 12 nt, Homo sapiens
cauuccuaacac

SEQ ID NO: 2207082 - RNA, 15 nt, Homo sapiens
acagcuucugagaau

SEQ ID NO: 2207083 - RNA, 23 nt, Homo sapiens
ucuauugggaguuuauaccaaga

SEQ ID NO: 2207084 - RNA, 18 nt, Homo sapiens
uacagucugucaugaaca

SEQ ID NO: 2207085 - RNA, 20 nt, Homo sapiens
ucaagaugagccugggcuca

SEQ ID NO: 2207086 - RNA, 16 nt, Homo sapiens
ugccuggacacuguac

SEQ ID NO: 2207087 - RNA, 23 nt, Homo sapiens
agaauuaccauuuguuaauauca

SEQ ID NO: 2207088 - RNA, 16 nt, Homo sapiens
ccaaccugaagacacc

SEQ ID NO: 2207089 - RNA, 20 nt, Homo sapiens
caccauaaugagaugugagc

SEQ ID NO: 2207090 - RNA, 20 nt, Homo sapiens
aucacauguaauccaaagac

SEQ ID NO: 2207091 - RNA, 14 nt, Homo sapiens
caaaccucaaauau

SEQ ID NO: 2207092 - RNA, 14 nt, Homo sapiens
auuaucuugcucau

SEQ ID NO: 2207093 - RNA, 16 nt, Homo sapiens
guuuaagaaaugagaa

SEQ ID NO: 2207094 - RNA, 21 nt, Homo sapiens
auccaugcagauaacagcugg

SEQ ID NO: 2207095 - RNA, 14 nt, Homo sapiens
uccaucaugcaaaa

SEQ ID NO: 2207096 - RNA, 16 nt, Homo sapiens
aaauguaccuucacac

SEQ ID NO: 2207097 - RNA, 22 nt, Homo sapiens
guuguaguuuauaaaagacugu

SEQ ID NO: 2207098 - RNA, 19 nt, Homo sapiens
aauuaauaauagauuguga

SEQ ID NO: 2207099 - RNA, 17 nt, Homo sapiens
ugggugcaugaucuuga

SEQ ID NO: 2207100 - RNA, 20 nt, Homo sapiens
caggccaucaaggaguauau

SEQ ID NO: 2207101 - RNA, 19 nt, Homo sapiens
guuaaaaaagaaaucuguu

SEQ ID NO: 2207102 - RNA, 17 nt, Homo sapiens
cagccuuuccagccucc

SEQ ID NO: 2207103 - RNA, 17 nt, Homo sapiens
aauauuuuuuucuagcu

SEQ ID NO: 2207104 - RNA, 19 nt, Homo sapiens
aguuuggcaaacucuccac

SEQ ID NO: 2207105 - RNA, 14 nt, Homo sapiens
cagaauaauucuua

SEQ ID NO: 2207106 - RNA, 20 nt, Homo sapiens
cacauuucaccccaggcuca

SEQ ID NO: 2207107 - RNA, 17 nt, Homo sapiens
acagagccaacucacuc

SEQ ID NO: 2207108 - RNA, 22 nt, Homo sapiens
uccuggaagaacaaaucuacca

SEQ ID NO: 2207109 - RNA, 17 nt, Homo sapiens
ucccagccagcaguuca

SEQ ID NO: 2207110 - RNA, 22 nt, Homo sapiens
cucauuggaaauuuagcauugu

SEQ ID NO: 2207111 - RNA, 20 nt, Homo sapiens
uuagcaauaaauaacacuug

SEQ ID NO: 2207112 - RNA, 18 nt, Homo sapiens
guucaggcagcacaucaa

SEQ ID NO: 2207113 - RNA, 15 nt, Homo sapiens
auaauaucugugagg

SEQ ID NO: 2207114 - RNA, 15 nt, Homo sapiens
aaaucagccagacau

SEQ ID NO: 2207115 - RNA, 20 nt, Homo sapiens
gaagccaccgggagauuucu

SEQ ID NO: 2207116 - RNA, 23 nt, Homo sapiens
cugaaggacgcgccaggggaguu

SEQ ID NO: 2207117 - RNA, 22 nt, Homo sapiens
ucuucccugguccccccaaauc

SEQ ID NO: 2207118 - RNA, 13 nt, Homo sapiens
gacuguagaagaa

SEQ ID NO: 2207119 - RNA, 11 nt, Homo sapiens
cacuguagcua

SEQ ID NO: 2207120 - RNA, 15 nt, Homo sapiens
ucccaguauaccuca

SEQ ID NO: 2207121 - RNA, 14 nt, Homo sapiens
acacgccacaacuc

SEQ ID NO: 2207122 - RNA, 17 nt, Homo sapiens
cgauuugggaaccaagc

SEQ ID NO: 2207123 - RNA, 13 nt, Homo sapiens
aggcccaaugagg

SEQ ID NO: 2207124 - RNA, 18 nt, Homo sapiens
gucuuguguacacugcuc

SEQ ID NO: 2207125 - RNA, 20 nt, Homo sapiens
accccccccacacacaccau

SEQ ID NO: 2207126 - RNA, 14 nt, Homo sapiens
caaucguucucugu

SEQ ID NO: 2207127 - RNA, 12 nt, Homo sapiens
caguaaaccuua

SEQ ID NO: 2207128 - RNA, 12 nt, Homo sapiens
aagaaaacauuu

SEQ ID NO: 2207129 - RNA, 17 nt, Homo sapiens
gcagcugggauuugaac

SEQ ID NO: 2207130 - RNA, 17 nt, Homo sapiens
cgaaaaccacaaaaaga

SEQ ID NO: 2207131 - RNA, 20 nt, Homo sapiens
agggcuuuaaacaugauuau

SEQ ID NO: 2207132 - RNA, 19 nt, Homo sapiens
ugaccuaguaaacuuugua

SEQ ID NO: 2207133 - RNA, 11 nt, Homo sapiens
cacagccauag

SEQ ID NO: 2207134 - RNA, 15 nt, Homo sapiens
ccacugucucuucca

SEQ ID NO: 2207135 - RNA, 19 nt, Homo sapiens
accauccagagaccaaaua

SEQ ID NO: 2207136 - RNA, 13 nt, Homo sapiens
uuaagaucccagu

SEQ ID NO: 2207137 - RNA, 16 nt, Homo sapiens
ugguucagacacagcu

SEQ ID NO: 2207138 - RNA, 18 nt, Homo sapiens
agauaugcuuaaugauag

SEQ ID NO: 2207139 - RNA, 23 nt, Homo sapiens
caaauucucaagccgcaucccag

SEQ ID NO: 2207140 - RNA, 16 nt, Homo sapiens
guuaucuaauacaaaa

SEQ ID NO: 2207141 - RNA, 12 nt, Homo sapiens
aucccaucucuc

SEQ ID NO: 2207142 - RNA, 11 nt, Homo sapiens
aaaauguuggc

SEQ ID NO: 2207143 - RNA, 14 nt, Homo sapiens
ucaaaucucuacaa

SEQ ID NO: 2207144 - RNA, 15 nt, Homo sapiens
gugcccacauuugau

SEQ ID NO: 2207145 - RNA, 16 nt, Homo sapiens
ggugccagcaacugaa

SEQ ID NO: 2207146 - RNA, 13 nt, Homo sapiens
acuguauggaauc

SEQ ID NO: 2207147 - RNA, 22 nt, Homo sapiens
aaggaaaaccaucucugugauu

SEQ ID NO: 2207148 - RNA, 15 nt, Homo sapiens
cagauuauuauugaa

SEQ ID NO: 2207149 - RNA, 13 nt, Homo sapiens
guuaaugaaauaa

SEQ ID NO: 2207150 - RNA, 16 nt, Homo sapiens
acauauacaucuagca

SEQ ID NO: 2207151 - RNA, 18 nt, Homo sapiens
caaaaugauacuuacuga

SEQ ID NO: 2207152 - RNA, 20 nt, Homo sapiens
ugugauuuuaaaauuuugcu

SEQ ID NO: 2207153 - RNA, 20 nt, Homo sapiens
acacauuucuuugaauuuag

SEQ ID NO: 2207154 - RNA, 18 nt, Homo sapiens
cucaaauuguaauuaaua

SEQ ID NO: 2207155 - RNA, 16 nt, Homo sapiens
ucaaguaauugugaaa

SEQ ID NO: 2207156 - RNA, 22 nt, Homo sapiens
agaucacaccacugcacuccag

SEQ ID NO: 2207157 - RNA, 16 nt, Homo sapiens
auuaccagauucacuu

SEQ ID NO: 2207158 - RNA, 19 nt, Homo sapiens
uaucugccuuagacaaagg

SEQ ID NO: 2207159 - RNA, 21 nt, Homo sapiens
auacaagaggcucccucuuga

SEQ ID NO: 2207160 - RNA, 18 nt, Homo sapiens
ugucagauucacacaugc

SEQ ID NO: 2207161 - RNA, 17 nt, Homo sapiens
ucuggggccccaucagc

SEQ ID NO: 2207162 - RNA, 20 nt, Homo sapiens
uccucaccucuggacuggcu

SEQ ID NO: 2207163 - RNA, 15 nt, Homo sapiens
agccuggcuggcaca

SEQ ID NO: 2207164 - RNA, 18 nt, Homo sapiens
cuguuacacuuuuuggaa

SEQ ID NO: 2207165 - RNA, 17 nt, Homo sapiens
ucuugcugggcauacuu

SEQ ID NO: 2207166 - RNA, 21 nt, Homo sapiens
gaauuauuuugaaugucacaa

SEQ ID NO: 2207167 - RNA, 15 nt, Homo sapiens
ucaaugugcuuuuaa

SEQ ID NO: 2207168 - RNA, 13 nt, Homo sapiens
aggacuucuggca

SEQ ID NO: 2207169 - RNA, 16 nt, Homo sapiens
gccugcacuaauuuga

SEQ ID NO: 2207170 - RNA, 20 nt, Homo sapiens
aucuaagaauacagcuuucu

SEQ ID NO: 2207171 - RNA, 17 nt, Homo sapiens
aaacccucuccaucucc

SEQ ID NO: 2207172 - RNA, 20 nt, Homo sapiens
uggcuacuucccuuccuccc

SEQ ID NO: 2207173 - RNA, 10 nt, Homo sapiens
cagugccugu

SEQ ID NO: 2207174 - RNA, 10 nt, Homo sapiens
cugugccuga

SEQ ID NO: 2207175 - RNA, 24 nt, Homo sapiens
aggucacuuuguuuuacugucuua

SEQ ID NO: 2207176 - RNA, 14 nt, Homo sapiens
acccaccucagccu

SEQ ID NO: 2207177 - RNA, 17 nt, Homo sapiens
uguguucuuguuuucag

SEQ ID NO: 2207178 - RNA, 13 nt, Homo sapiens
ugaaacacuuuca

SEQ ID NO: 2207179 - RNA, 17 nt, Homo sapiens
aagagcuguuaugcugu

SEQ ID NO: 2207180 - RNA, 17 nt, Homo sapiens
auguuaacuaaauaacu

SEQ ID NO: 2207181 - RNA, 17 nt, Homo sapiens
caaucauacugacauaa

SEQ ID NO: 2207182 - RNA, 19 nt, Homo sapiens
ucaccucuccaggugcuca

SEQ ID NO: 2207183 - RNA, 20 nt, Homo sapiens
auuucugaggugcacuggga

SEQ ID NO: 2207184 - RNA, 10 nt, Homo sapiens
gacucuggac

SEQ ID NO: 2207185 - RNA, 15 nt, Homo sapiens
uaaucugagcagucu

SEQ ID NO: 2207186 - RNA, 18 nt, Homo sapiens
uuuccucagguccuuuag

SEQ ID NO: 2207187 - RNA, 19 nt, Homo sapiens
uagcacuugcagaccugcc

SEQ ID NO: 2207188 - RNA, 16 nt, Homo sapiens
agugccuagacuguua

SEQ ID NO: 2207189 - RNA, 17 nt, Homo sapiens
cacacauggaugcacac

SEQ ID NO: 2207190 - RNA, 22 nt, Homo sapiens
ggauaaauuuuugguggugaua

SEQ ID NO: 2207191 - RNA, 22 nt, Homo sapiens
ugcgaauaagcuuuuaaugcuc

SEQ ID NO: 2207192 - RNA, 15 nt, Homo sapiens
uucuucuucuaaaau

SEQ ID NO: 2207193 - RNA, 22 nt, Homo sapiens
ugccuuaucucuucucacuuuc

SEQ ID NO: 2207194 - RNA, 16 nt, Homo sapiens
acuaaugauguuuucc

SEQ ID NO: 2207195 - RNA, 18 nt, Homo sapiens
ucugaagaaacuucccaa

SEQ ID NO: 2207196 - RNA, 16 nt, Homo sapiens
cugagcaaagcauuga

SEQ ID NO: 2207197 - RNA, 16 nt, Homo sapiens
agggcuuccuaaaaau

SEQ ID NO: 2207198 - RNA, 17 nt, Homo sapiens
ucaacaauaaagacuga

SEQ ID NO: 2207199 - RNA, 15 nt, Homo sapiens
ccuuugcaccuccau

SEQ ID NO: 2207200 - RNA, 12 nt, Homo sapiens
ucacuguaaaau

SEQ ID NO: 2207201 - RNA, 17 nt, Homo sapiens
gaaaccauccucucccu

SEQ ID NO: 2207202 - RNA, 17 nt, Homo sapiens
uacauuaacggugcuaa

SEQ ID NO: 2207203 - RNA, 15 nt, Homo sapiens
ugaauaucaguuauu

SEQ ID NO: 2207204 - RNA, 16 nt, Homo sapiens
ucuauaggaacauaug

SEQ ID NO: 2207205 - RNA, 19 nt, Homo sapiens
uauauaccaaugacuucca

SEQ ID NO: 2207206 - RNA, 18 nt, Homo sapiens
gaauacuauacagccaua

SEQ ID NO: 2207207 - RNA, 18 nt, Homo sapiens
cuuucugugcugguaaca

SEQ ID NO: 2207208 - RNA, 20 nt, Homo sapiens
guuaggggaauggagggaau

SEQ ID NO: 2207209 - RNA, 16 nt, Homo sapiens
gauuauuccuauaauu

SEQ ID NO: 2207210 - RNA, 16 nt, Homo sapiens
uaggcaugguggacuc

SEQ ID NO: 2207211 - RNA, 19 nt, Homo sapiens
gaaaugggcaguucuccca

SEQ ID NO: 2207212 - RNA, 20 nt, Homo sapiens
auucaacuuaacuaucaucu

SEQ ID NO: 2207213 - RNA, 16 nt, Homo sapiens
guacauaguaaaguau

SEQ ID NO: 2207214 - RNA, 22 nt, Homo sapiens
ggaagagccaaagaauauucca

SEQ ID NO: 2207215 - RNA, 21 nt, Homo sapiens
cucggagaagagcuguucaca

SEQ ID NO: 2207216 - RNA, 13 nt, Homo sapiens
uguuuugagccag

SEQ ID NO: 2207217 - RNA, 15 nt, Homo sapiens
auguuacugugugaa

SEQ ID NO: 2207218 - RNA, 18 nt, Homo sapiens
uuucacuggggaagccag

SEQ ID NO: 2207219 - RNA, 16 nt, Homo sapiens
caauugaaaugcauug

SEQ ID NO: 2207220 - RNA, 19 nt, Homo sapiens
aucccggaguucuccugcu

SEQ ID NO: 2207221 - RNA, 14 nt, Homo sapiens
gggccuaggcugca

SEQ ID NO: 2207222 - RNA, 16 nt, Homo sapiens
gcauaauaugcauaua

SEQ ID NO: 2207223 - RNA, 17 nt, Homo sapiens
auggcaucuaccgaccu

SEQ ID NO: 2207224 - RNA, 15 nt, Homo sapiens
cuucccuucuuugca

SEQ ID NO: 2207225 - RNA, 18 nt, Homo sapiens
ugaaugcacuuuugcuca

SEQ ID NO: 2207226 - RNA, 17 nt, Homo sapiens
uuugucucugcaucuca

SEQ ID NO: 2207227 - RNA, 22 nt, Homo sapiens
agacaaaugggacugaugucau

SEQ ID NO: 2207228 - RNA, 20 nt, Homo sapiens
cuaggguuuggcaagucugc

SEQ ID NO: 2207229 - RNA, 23 nt, Homo sapiens
aaacuuucucauaagcaccuaaa

SEQ ID NO: 2207230 - RNA, 15 nt, Homo sapiens
uuugagagugauucu

SEQ ID NO: 2207231 - RNA, 20 nt, Homo sapiens
caaaguaagccucaccuuug

SEQ ID NO: 2207232 - RNA, 14 nt, Homo sapiens
uguggugucuagca

SEQ ID NO: 2207233 - RNA, 16 nt, Homo sapiens
auaaacauuucauuuc

SEQ ID NO: 2207234 - RNA, 14 nt, Homo sapiens
uuuaaacacaucaa

SEQ ID NO: 2207235 - RNA, 14 nt, Homo sapiens
uaacuacacuaaua

SEQ ID NO: 2207236 - RNA, 14 nt, Homo sapiens
uagaaacacugcaa

SEQ ID NO: 2207237 - RNA, 16 nt, Homo sapiens
cagggcccccaucuca

SEQ ID NO: 2207238 - RNA, 16 nt, Homo sapiens
ggagaggggaggucac

SEQ ID NO: 2207239 - RNA, 17 nt, Homo sapiens
cuuugaauuucccaguc

SEQ ID NO: 2207240 - RNA, 19 nt, Homo sapiens
cugucuuacuauuauagca

SEQ ID NO: 2207241 - RNA, 22 nt, Homo sapiens
gcaggcuguuuauauguucaca

SEQ ID NO: 2207242 - RNA, 21 nt, Homo sapiens
ggaccugccccccacucugca

SEQ ID NO: 2207243 - RNA, 12 nt, Homo sapiens
acauaagacaga

SEQ ID NO: 2207244 - RNA, 15 nt, Homo sapiens
ugaccaauacauuug

SEQ ID NO: 2207245 - RNA, 12 nt, Homo sapiens
ucuagcauccuc

SEQ ID NO: 2207246 - RNA, 21 nt, Homo sapiens
uccccauuacccucaggacaa

SEQ ID NO: 2207247 - RNA, 21 nt, Homo sapiens
agacguggugugagagggacg

SEQ ID NO: 2207248 - RNA, 14 nt, Homo sapiens
ugcucucuggucuu

SEQ ID NO: 2207249 - RNA, 21 nt, Homo sapiens
aaaugguuaaauuuuacauga

SEQ ID NO: 2207250 - RNA, 14 nt, Homo sapiens
cuaauucaguucug

SEQ ID NO: 2207251 - RNA, 14 nt, Homo sapiens
ccaccgcagcuacu

SEQ ID NO: 2207252 - RNA, 15 nt, Homo sapiens
cuuacucuacugcug

SEQ ID NO: 2207253 - RNA, 11 nt, Homo sapiens
aaauaucucac

SEQ ID NO: 2207254 - RNA, 19 nt, Homo sapiens
gaccacagcacagccaaca

SEQ ID NO: 2207255 - RNA, 16 nt, Homo sapiens
gaugaccagugccuug

SEQ ID NO: 2207256 - RNA, 23 nt, Homo sapiens
ucaggcagagcccgguacagggc

SEQ ID NO: 2207257 - RNA, 22 nt, Homo sapiens
cugucaagaagaggaaagggag

SEQ ID NO: 2207258 - RNA, 21 nt, Homo sapiens
aauugagacagugcacaugaa

SEQ ID NO: 2207259 - RNA, 18 nt, Homo sapiens
uuguuuuaacagaugcca

SEQ ID NO: 2207260 - RNA, 14 nt, Homo sapiens
acuuuaagauguuu

SEQ ID NO: 2207261 - RNA, 13 nt, Homo sapiens
auaaacagaacuc

SEQ ID NO: 2207262 - RNA, 14 nt, Homo sapiens
aaucucaauuccau

SEQ ID NO: 2207263 - RNA, 19 nt, Homo sapiens
auaaacuuuuuuucaaugu

SEQ ID NO: 2207264 - RNA, 18 nt, Homo sapiens
aaacaaaggaaguucucc

SEQ ID NO: 2207265 - RNA, 23 nt, Homo sapiens
caggaacuugcacaaaaucacac

SEQ ID NO: 2207266 - RNA, 20 nt, Homo sapiens
agacuuuacauggaugccaa

SEQ ID NO: 2207267 - RNA, 23 nt, Homo sapiens
uuauaacuauauaaaugacauua

SEQ ID NO: 2207268 - RNA, 16 nt, Homo sapiens
ugcuaauguacuuuca

SEQ ID NO: 2207269 - RNA, 18 nt, Homo sapiens
accuauaguaagugcuua

SEQ ID NO: 2207270 - RNA, 22 nt, Homo sapiens
agccauaguggagagaacugaa

SEQ ID NO: 2207271 - RNA, 20 nt, Homo sapiens
auuggcaaaauuacaguuca

SEQ ID NO: 2207272 - RNA, 17 nt, Homo sapiens
cuaauuuuuuuuguaca

SEQ ID NO: 2207273 - RNA, 14 nt, Homo sapiens
uaguucagcugccc

SEQ ID NO: 2207274 - RNA, 14 nt, Homo sapiens
uagcuuagcugucu

SEQ ID NO: 2207275 - RNA, 12 nt, Homo sapiens
cacauuuuuaca

SEQ ID NO: 2207276 - RNA, 17 nt, Homo sapiens
ugccagcagaacaugug

SEQ ID NO: 2207277 - RNA, 18 nt, Homo sapiens
cuagacugcuccugggca

SEQ ID NO: 2207278 - RNA, 15 nt, Homo sapiens
auggugguauuguga

SEQ ID NO: 2207279 - RNA, 15 nt, Homo sapiens
augucaguauuucaa

SEQ ID NO: 2207280 - RNA, 22 nt, Homo sapiens
acaaguauauaauaugucaccu

SEQ ID NO: 2207281 - RNA, 14 nt, Homo sapiens
uaaaaucacuguca

SEQ ID NO: 2207282 - RNA, 23 nt, Homo sapiens
ugugccaucacugagcauacuca

SEQ ID NO: 2207283 - RNA, 21 nt, Homo sapiens
caggaaagucguacuguucac

SEQ ID NO: 2207284 - RNA, 15 nt, Homo sapiens
cugaugauacaugca

SEQ ID NO: 2207285 - RNA, 13 nt, Homo sapiens
gaggaacagguuc

SEQ ID NO: 2207286 - RNA, 13 nt, Homo sapiens
cugccucagucuc

SEQ ID NO: 2207287 - RNA, 13 nt, Homo sapiens
uggccccugagau

SEQ ID NO: 2207288 - RNA, 16 nt, Homo sapiens
accacuugacagacug

SEQ ID NO: 2207289 - RNA, 23 nt, Homo sapiens
gaccuaacauucgaucucauuca

SEQ ID NO: 2207290 - RNA, 21 nt, Homo sapiens
ggcaggugccaugucugggaa

SEQ ID NO: 2207291 - RNA, 19 nt, Homo sapiens
uuuaaaauaccacuguaau

SEQ ID NO: 2207292 - RNA, 13 nt, Homo sapiens
cuagcauugcacu

SEQ ID NO: 2207293 - RNA, 15 nt, Homo sapiens
aaauggguuacuuga

SEQ ID NO: 2207294 - RNA, 19 nt, Homo sapiens
augccugugaagcagucag

SEQ ID NO: 2207295 - RNA, 19 nt, Homo sapiens
uagauuuucaccuauccag

SEQ ID NO: 2207296 - RNA, 14 nt, Homo sapiens
uagaacagccagac

SEQ ID NO: 2207297 - RNA, 14 nt, Homo sapiens
acugcagucagcau

SEQ ID NO: 2207298 - RNA, 13 nt, Homo sapiens
uucccugagucac

SEQ ID NO: 2207299 - RNA, 19 nt, Homo sapiens
gcaucccugaaacaucuca

SEQ ID NO: 2207300 - RNA, 18 nt, Homo sapiens
acuguaauuuucaugaua

SEQ ID NO: 2207301 - RNA, 16 nt, Homo sapiens
cuccagcauccugcuu

SEQ ID NO: 2207302 - RNA, 15 nt, Homo sapiens
cuguaaucaggcaag

SEQ ID NO: 2207303 - RNA, 14 nt, Homo sapiens
gucuggccagggag

SEQ ID NO: 2207304 - RNA, 22 nt, Homo sapiens
uucaaacugcugcauacuuuga

SEQ ID NO: 2207305 - RNA, 14 nt, Homo sapiens
auuguuuugccagu

SEQ ID NO: 2207306 - RNA, 17 nt, Homo sapiens
ggagacuuuuaucuacu

SEQ ID NO: 2207307 - RNA, 15 nt, Homo sapiens
ugggaagggcuccca

SEQ ID NO: 2207308 - RNA, 20 nt, Homo sapiens
aucucccacccuguaccuca

SEQ ID NO: 2207309 - RNA, 22 nt, Homo sapiens
aaaggaaauguaaaagcacaug

SEQ ID NO: 2207310 - RNA, 12 nt, Homo sapiens
aggcuccugggg

SEQ ID NO: 2207311 - RNA, 12 nt, Homo sapiens
acuguccugcuc

SEQ ID NO: 2207312 - RNA, 16 nt, Homo sapiens
ccagcuccccaagaaa

SEQ ID NO: 2207313 - RNA, 22 nt, Homo sapiens
agcugacacagaaaaaggaugu

SEQ ID NO: 2207314 - RNA, 23 nt, Homo sapiens
agcugugcugggugagcucuucc

SEQ ID NO: 2207315 - RNA, 17 nt, Homo sapiens
aauugugaagauuucau

SEQ ID NO: 2207316 - RNA, 16 nt, Homo sapiens
uaccuggugagcucag

SEQ ID NO: 2207317 - RNA, 15 nt, Homo sapiens
uaaacuacagaauau

SEQ ID NO: 2207318 - RNA, 12 nt, Homo sapiens
auuacucugaaa

SEQ ID NO: 2207319 - RNA, 14 nt, Homo sapiens
aaaauaugucauca

SEQ ID NO: 2207320 - RNA, 16 nt, Homo sapiens
gagagguuugcaucca

SEQ ID NO: 2207321 - RNA, 18 nt, Homo sapiens
auuuccuuuuugacacug

SEQ ID NO: 2207322 - RNA, 10 nt, Homo sapiens
aaucuugccc

SEQ ID NO: 2207323 - RNA, 12 nt, Homo sapiens
gacuuggcagua

SEQ ID NO: 2207324 - RNA, 18 nt, Homo sapiens
aaaucuccuggcuuuaca

SEQ ID NO: 2207325 - RNA, 15 nt, Homo sapiens
ccugucuacucaucc

SEQ ID NO: 2207326 - RNA, 15 nt, Homo sapiens
cuguuuuugcaacua

SEQ ID NO: 2207327 - RNA, 20 nt, Homo sapiens
ugauaauagagggcuggaau

SEQ ID NO: 2207328 - RNA, 22 nt, Homo sapiens
gccacccucacacacacagcug

SEQ ID NO: 2207329 - RNA, 20 nt, Homo sapiens
aaauguaccugagacauauu

SEQ ID NO: 2207330 - RNA, 13 nt, Homo sapiens
agucugaagcugg

SEQ ID NO: 2207331 - RNA, 14 nt, Homo sapiens
gcucuguuccacau

SEQ ID NO: 2207332 - RNA, 20 nt, Homo sapiens
gaaaggucauuaaaccagau

SEQ ID NO: 2207333 - RNA, 14 nt, Homo sapiens
cucaggucagcuca

SEQ ID NO: 2207334 - RNA, 14 nt, Homo sapiens
ucucucuucuuuuc

SEQ ID NO: 2207335 - RNA, 15 nt, Homo sapiens
ccugaaacacuggac

SEQ ID NO: 2207336 - RNA, 22 nt, Homo sapiens
gggugcucccuaccaccucccc

SEQ ID NO: 2207337 - RNA, 17 nt, Homo sapiens
acucguucuucugggaa

SEQ ID NO: 2207338 - RNA, 17 nt, Homo sapiens
aauaggauuuaauuugu

SEQ ID NO: 2207339 - RNA, 16 nt, Homo sapiens
ucuugggggugguuuu

SEQ ID NO: 2207340 - RNA, 22 nt, Homo sapiens
cagugcaugggggauguuucuu

SEQ ID NO: 2207341 - RNA, 22 nt, Homo sapiens
uagcauuguuccacacauuuaa

SEQ ID NO: 2207342 - RNA, 16 nt, Homo sapiens
ccugcaauaagggagg

SEQ ID NO: 2207343 - RNA, 22 nt, Homo sapiens
acugaguagcucuccugacuuu

SEQ ID NO: 2207344 - RNA, 19 nt, Homo sapiens
accccaggcccacucaggg

SEQ ID NO: 2207345 - RNA, 16 nt, Homo sapiens
uaaagauuugcuucca

SEQ ID NO: 2207346 - RNA, 15 nt, Homo sapiens
cgcugcauacagggg

SEQ ID NO: 2207347 - RNA, 21 nt, Homo sapiens
agagacucagcgcuccuccug

SEQ ID NO: 2207348 - RNA, 23 nt, Homo sapiens
ucaaagacuucauuuaacacuga

SEQ ID NO: 2207349 - RNA, 18 nt, Homo sapiens
ggaacaagacccccagga

SEQ ID NO: 2207350 - RNA, 19 nt, Homo sapiens
gcucccacacccaccucug

SEQ ID NO: 2207351 - RNA, 17 nt, Homo sapiens
acauauagcuuugcaac

SEQ ID NO: 2207352 - RNA, 22 nt, Homo sapiens
ccucaguuuccucaucugcaaa

SEQ ID NO: 2207353 - RNA, 19 nt, Homo sapiens
gagaagggaagccucuuca

SEQ ID NO: 2207354 - RNA, 15 nt, Homo sapiens
gugucuaaugcauua

SEQ ID NO: 2207355 - RNA, 17 nt, Homo sapiens
uccccuucuucccgccc

SEQ ID NO: 2207356 - RNA, 19 nt, Homo sapiens
ccauagucagcagcagcuc

SEQ ID NO: 2207357 - RNA, 22 nt, Homo sapiens
guccaccucccauuacuuugau

SEQ ID NO: 2207358 - RNA, 21 nt, Homo sapiens
ucaauacuuaaaaauagucuu

SEQ ID NO: 2207359 - RNA, 16 nt, Homo sapiens
gcucagaauugcacau

SEQ ID NO: 2207360 - RNA, 21 nt, Homo sapiens
uggaagccaccucaccaagga

SEQ ID NO: 2207361 - RNA, 21 nt, Homo sapiens
ccaugccaggaaccuguccua

SEQ ID NO: 2207362 - RNA, 16 nt, Homo sapiens
ugccaaauaucuugau

SEQ ID NO: 2207363 - RNA, 22 nt, Homo sapiens
accugccacuuccaggagccca

SEQ ID NO: 2207364 - RNA, 16 nt, Homo sapiens
aaaagacaaauaugua

SEQ ID NO: 2207365 - RNA, 14 nt, Homo sapiens
ggcagcccagugga

SEQ ID NO: 2207366 - RNA, 20 nt, Homo sapiens
caaacagccucacuccucag

SEQ ID NO: 2207367 - RNA, 22 nt, Homo sapiens
uucucuccugugugcuugucag

SEQ ID NO: 2207368 - RNA, 13 nt, Homo sapiens
acacaccucugcc

SEQ ID NO: 2207369 - RNA, 22 nt, Homo sapiens
uguucauuaaauuuucuaugcu

SEQ ID NO: 2207370 - RNA, 12 nt, Homo sapiens
gauguacacaca

SEQ ID NO: 2207371 - RNA, 23 nt, Homo sapiens
aagauucuuuaaacuacugaacu

SEQ ID NO: 2207372 - RNA, 21 nt, Homo sapiens
cuaugggagauuaaaaccaga

SEQ ID NO: 2207373 - RNA, 19 nt, Homo sapiens
agccacagcuucuucaucu

SEQ ID NO: 2207374 - RNA, 13 nt, Homo sapiens
ugcauguaugugc

SEQ ID NO: 2207375 - RNA, 16 nt, Homo sapiens
ucucacgauaugcaag

SEQ ID NO: 2207376 - RNA, 20 nt, Homo sapiens
gaacaauuaaacagccaaau

SEQ ID NO: 2207377 - RNA, 14 nt, Homo sapiens
uuaauuacauacag

SEQ ID NO: 2207378 - RNA, 17 nt, Homo sapiens
ggcucuguuugugggac

SEQ ID NO: 2207379 - RNA, 18 nt, Homo sapiens
aauuuggccugcacuaau

SEQ ID NO: 2207380 - RNA, 20 nt, Homo sapiens
uggccucccuuugugugcau

SEQ ID NO: 2207381 - RNA, 20 nt, Homo sapiens
aaaauuuuuugugauuucaa

SEQ ID NO: 2207382 - RNA, 15 nt, Homo sapiens
cagauaccugugagg

SEQ ID NO: 2207383 - RNA, 20 nt, Homo sapiens
uauagccuauggcagaaaaa

SEQ ID NO: 2207384 - RNA, 14 nt, Homo sapiens
uuugcagcuaaaau

SEQ ID NO: 2207385 - RNA, 22 nt, Homo sapiens
cuggauuugcauacauucuuca

SEQ ID NO: 2207386 - RNA, 16 nt, Homo sapiens
gacauuaaaagcuauc

SEQ ID NO: 2207387 - RNA, 22 nt, Homo sapiens
ccuguuuguggauguguguuug

SEQ ID NO: 2207388 - RNA, 14 nt, Homo sapiens
cuccccaaggccac

SEQ ID NO: 2207389 - RNA, 17 nt, Homo sapiens
uuucacauaaacacaua

SEQ ID NO: 2207390 - RNA, 15 nt, Homo sapiens
gcacacacacagaga

SEQ ID NO: 2207391 - RNA, 18 nt, Homo sapiens
ucacuacuuuaauaaaga

SEQ ID NO: 2207392 - RNA, 16 nt, Homo sapiens
caauacccugucuuua

SEQ ID NO: 2207393 - RNA, 13 nt, Homo sapiens
cauguugauuaaa

SEQ ID NO: 2207394 - RNA, 12 nt, Homo sapiens
guaaauugcaca

SEQ ID NO: 2207395 - RNA, 14 nt, Homo sapiens
uccuuccugcccug

SEQ ID NO: 2207396 - RNA, 22 nt, Homo sapiens
auaaauccucagguaguacugg

SEQ ID NO: 2207397 - RNA, 13 nt, Homo sapiens
auuucaauaucaa

SEQ ID NO: 2207398 - RNA, 13 nt, Homo sapiens
cucaaaaucuuuc

SEQ ID NO: 2207399 - RNA, 21 nt, Homo sapiens
guguaaaaaacaaacauuuga

SEQ ID NO: 2207400 - RNA, 13 nt, Homo sapiens
aacuaaaauguuc

SEQ ID NO: 2207401 - RNA, 13 nt, Homo sapiens
uaaguacuguaau

SEQ ID NO: 2207402 - RNA, 21 nt, Homo sapiens
ucuucaagccuggcccaguga

SEQ ID NO: 2207403 - RNA, 17 nt, Homo sapiens
gacuggaugcucgccau

SEQ ID NO: 2207404 - RNA, 21 nt, Homo sapiens
ucaugaaacuguccaccaaga

SEQ ID NO: 2207405 - RNA, 20 nt, Homo sapiens
acagaaugcggccucugaga

SEQ ID NO: 2207406 - RNA, 15 nt, Homo sapiens
uagccuaaacuccaa

SEQ ID NO: 2207407 - RNA, 21 nt, Homo sapiens
ucaucauuuuuauacaggaca

SEQ ID NO: 2207408 - RNA, 12 nt, Homo sapiens
gaaaaccagcuu

SEQ ID NO: 2207409 - RNA, 18 nt, Homo sapiens
cuaucccuuuccaaaggc

SEQ ID NO: 2207410 - RNA, 16 nt, Homo sapiens
gacaguguuaucccaa

SEQ ID NO: 2207411 - RNA, 23 nt, Homo sapiens
aauguccauauuuauuuuuaugu

SEQ ID NO: 2207412 - RNA, 15 nt, Homo sapiens
acuggcugugugacu

SEQ ID NO: 2207413 - RNA, 20 nt, Homo sapiens
uccuucugcccuuccuccag

SEQ ID NO: 2207414 - RNA, 18 nt, Homo sapiens
agaugcagggcagucauu

SEQ ID NO: 2207415 - RNA, 17 nt, Homo sapiens
gacuugauacugcaaua

SEQ ID NO: 2207416 - RNA, 21 nt, Homo sapiens
cucagccacacccaggcacuu

SEQ ID NO: 2207417 - RNA, 17 nt, Homo sapiens
uguucauggacuauucc

SEQ ID NO: 2207418 - RNA, 13 nt, Homo sapiens
accccaccugcuc

SEQ ID NO: 2207419 - RNA, 14 nt, Homo sapiens
uuaccuggggaucc

SEQ ID NO: 2207420 - RNA, 14 nt, Homo sapiens
uggggacaccugcc

SEQ ID NO: 2207421 - RNA, 22 nt, Homo sapiens
gacacagcugaacaguguuaau

SEQ ID NO: 2207422 - RNA, 14 nt, Homo sapiens
gcaaccucugucuc

SEQ ID NO: 2207423 - RNA, 16 nt, Homo sapiens
uguuucuaaacuagga

SEQ ID NO: 2207424 - RNA, 13 nt, Homo sapiens
gccugccaagcuc

SEQ ID NO: 2207425 - RNA, 10 nt, Homo sapiens
ccccagagag

SEQ ID NO: 2207426 - RNA, 16 nt, Homo sapiens
acauucaguacuuuau

SEQ ID NO: 2207427 - RNA, 16 nt, Homo sapiens
uauuuaagcagcuuga

SEQ ID NO: 2207428 - RNA, 14 nt, Homo sapiens
uuccaaugacauuu

SEQ ID NO: 2207429 - RNA, 22 nt, Homo sapiens
caugugcuucaucugugggaug

SEQ ID NO: 2207430 - RNA, 13 nt, Homo sapiens
acuaauacauuaa

SEQ ID NO: 2207431 - RNA, 13 nt, Homo sapiens
uucuuuacuccuu

SEQ ID NO: 2207432 - RNA, 23 nt, Homo sapiens
ugccccacaaaacuucagugugg

SEQ ID NO: 2207433 - RNA, 20 nt, Homo sapiens
aaugccuuugagacaguuuc

SEQ ID NO: 2207434 - RNA, 22 nt, Homo sapiens
guaguguccccagccuaccucu

SEQ ID NO: 2207435 - RNA, 17 nt, Homo sapiens
agacuguugccacuuaa

SEQ ID NO: 2207436 - RNA, 19 nt, Homo sapiens
agaauaugcgggacaugau

SEQ ID NO: 2207437 - RNA, 14 nt, Homo sapiens
ccauuauucuucuc

SEQ ID NO: 2207438 - RNA, 13 nt, Homo sapiens
acugcuguagaca

SEQ ID NO: 2207439 - RNA, 14 nt, Homo sapiens
cuccuccagaucaa

SEQ ID NO: 2207440 - RNA, 16 nt, Homo sapiens
guucuggccaccccag

SEQ ID NO: 2207441 - RNA, 18 nt, Homo sapiens
caagugaguuugguguuu

SEQ ID NO: 2207442 - RNA, 17 nt, Homo sapiens
auuguauuaauaccaaa

SEQ ID NO: 2207443 - RNA, 14 nt, Homo sapiens
cauacguacauucc

SEQ ID NO: 2207444 - RNA, 22 nt, Homo sapiens
uucucucuuucuuuugugcaua

SEQ ID NO: 2207445 - RNA, 13 nt, Homo sapiens
gcuucucccauuu

SEQ ID NO: 2207446 - RNA, 21 nt, Homo sapiens
cccacucccuggccaucucaa

SEQ ID NO: 2207447 - RNA, 21 nt, Homo sapiens
gcccaucccaccccaugaggc

SEQ ID NO: 2207448 - RNA, 21 nt, Homo sapiens
aacacuggugggcagcugagg

SEQ ID NO: 2207449 - RNA, 22 nt, Homo sapiens
ugugcugauaggguaaggggag

SEQ ID NO: 2207450 - RNA, 19 nt, Homo sapiens
auuccugcccaaacagcug

SEQ ID NO: 2207451 - RNA, 15 nt, Homo sapiens
uuuaaccuaguucaa

SEQ ID NO: 2207452 - RNA, 21 nt, Homo sapiens
ugcacacacacggaugcacac

SEQ ID NO: 2207453 - RNA, 21 nt, Homo sapiens
acagcuucucuacagacucca

SEQ ID NO: 2207454 - RNA, 23 nt, Homo sapiens
uuugaggaccccuuaaucuugcu

SEQ ID NO: 2207455 - RNA, 19 nt, Homo sapiens
caguagggcuuggugaaug

SEQ ID NO: 2207456 - RNA, 22 nt, Homo sapiens
cagcguuggcuuggaggacaaa

SEQ ID NO: 2207457 - RNA, 16 nt, Homo sapiens
cccagaacuggacuca

SEQ ID NO: 2207458 - RNA, 15 nt, Homo sapiens
aaggaauuccucuau

SEQ ID NO: 2207459 - RNA, 15 nt, Homo sapiens
uaacaaaauccucag

SEQ ID NO: 2207460 - RNA, 17 nt, Homo sapiens
ggaagggggcugggaca

SEQ ID NO: 2207461 - RNA, 23 nt, Homo sapiens
caaauauaaaauuaaaaacuuaa

SEQ ID NO: 2207462 - RNA, 18 nt, Homo sapiens
ugccuuucugguggcuuu

SEQ ID NO: 2207463 - RNA, 19 nt, Homo sapiens
aguccuugggguuaagucu

SEQ ID NO: 2207464 - RNA, 22 nt, Homo sapiens
gaacagggaugcuaucucgcua

SEQ ID NO: 2207465 - RNA, 17 nt, Homo sapiens
aagaauguccauggugg

SEQ ID NO: 2207466 - RNA, 16 nt, Homo sapiens
aauauucaacaauuau

SEQ ID NO: 2207467 - RNA, 23 nt, Homo sapiens
ucaaggcgggagggccugcagug

SEQ ID NO: 2207468 - RNA, 23 nt, Homo sapiens
aaucuggucugaauaacacugga

SEQ ID NO: 2207469 - RNA, 21 nt, Homo sapiens
guggggcugguuuuucauuuc

SEQ ID NO: 2207470 - RNA, 14 nt, Homo sapiens
uaacaaguggguga

SEQ ID NO: 2207471 - RNA, 15 nt, Homo sapiens
aaacauuucuuguag

SEQ ID NO: 2207472 - RNA, 23 nt, Homo sapiens
ugcaguuagagcugagcacuuuu

SEQ ID NO: 2207473 - RNA, 14 nt, Homo sapiens
aguccuagagaauu

SEQ ID NO: 2207474 - RNA, 14 nt, Homo sapiens
auaaugcaaucaaa

SEQ ID NO: 2207475 - RNA, 17 nt, Homo sapiens
ugaacaucucacuuugc

SEQ ID NO: 2207476 - RNA, 20 nt, Homo sapiens
ucugcagucucuauaccaau

SEQ ID NO: 2207477 - RNA, 16 nt, Homo sapiens
uaggagugguucucau

SEQ ID NO: 2207478 - RNA, 19 nt, Homo sapiens
uuucccauuaaagagccag

SEQ ID NO: 2207479 - RNA, 14 nt, Homo sapiens
aggcagagucucau

SEQ ID NO: 2207480 - RNA, 21 nt, Homo sapiens
cucaaaugacccaaagaccaa

SEQ ID NO: 2207481 - RNA, 12 nt, Homo sapiens
uucccaaagcac

SEQ ID NO: 2207482 - RNA, 17 nt, Homo sapiens
ugaggaaggaaaucugg

SEQ ID NO: 2207483 - RNA, 19 nt, Homo sapiens
ugaaugaucuuguguaagg

SEQ ID NO: 2207484 - RNA, 21 nt, Homo sapiens
gccugcaaaaaugaaauccag

SEQ ID NO: 2207485 - RNA, 14 nt, Homo sapiens
ucacuagcugucuc

SEQ ID NO: 2207486 - RNA, 15 nt, Homo sapiens
gcucgcucaggugau

SEQ ID NO: 2207487 - RNA, 20 nt, Homo sapiens
uauaaaaaagccacuggaau

SEQ ID NO: 2207488 - RNA, 19 nt, Homo sapiens
uaccccaauuuacuugcca

SEQ ID NO: 2207489 - RNA, 22 nt, Homo sapiens
uaauagcaaugguggugcacca

SEQ ID NO: 2207490 - RNA, 22 nt, Homo sapiens
ccacuucccugcaaggugcacc

SEQ ID NO: 2207491 - RNA, 17 nt, Homo sapiens
ucuaaaaaugauucucu

SEQ ID NO: 2207492 - RNA, 14 nt, Homo sapiens
aucauacugcauac

SEQ ID NO: 2207493 - RNA, 15 nt, Homo sapiens
gaggacccagcacug

SEQ ID NO: 2207494 - RNA, 14 nt, Homo sapiens
aaacaggcagcuca

SEQ ID NO: 2207495 - RNA, 18 nt, Homo sapiens
uauucuuccccgaaucac

SEQ ID NO: 2207496 - RNA, 19 nt, Homo sapiens
cauuuuccugagaccucaa

SEQ ID NO: 2207497 - RNA, 17 nt, Homo sapiens
uccaauaaagcauuuua

SEQ ID NO: 2207498 - RNA, 15 nt, Homo sapiens
ugacucucacaagau

SEQ ID NO: 2207499 - RNA, 21 nt, Homo sapiens
cgggagcccccaaaacagccu

SEQ ID NO: 2207500 - RNA, 16 nt, Homo sapiens
cacauuccaugacgca

SEQ ID NO: 2207501 - RNA, 18 nt, Homo sapiens
uagagcucaggccugcug

SEQ ID NO: 2207502 - RNA, 15 nt, Homo sapiens
cugaucaguugccaa

SEQ ID NO: 2207503 - RNA, 14 nt, Homo sapiens
aaugccaguccugc

SEQ ID NO: 2207504 - RNA, 14 nt, Homo sapiens
aacaguggacaaag

SEQ ID NO: 2207505 - RNA, 20 nt, Homo sapiens
cuuaaaaaaaacucuuuaac

SEQ ID NO: 2207506 - RNA, 21 nt, Homo sapiens
auucccccaccagcugcagcc

SEQ ID NO: 2207507 - RNA, 16 nt, Homo sapiens
uccucacuguauccag

SEQ ID NO: 2207508 - RNA, 21 nt, Homo sapiens
aucugugcuuuccagcucacc

SEQ ID NO: 2207509 - RNA, 18 nt, Homo sapiens
uggucauagaaacaauaa

SEQ ID NO: 2207510 - RNA, 15 nt, Homo sapiens
ggaggacagcugccu

SEQ ID NO: 2207511 - RNA, 20 nt, Homo sapiens
aggcagacuaggguucaugu

SEQ ID NO: 2207512 - RNA, 15 nt, Homo sapiens
ccuuuaguggagcca

SEQ ID NO: 2207513 - RNA, 17 nt, Homo sapiens
acugugccuacaggugc

SEQ ID NO: 2207514 - RNA, 17 nt, Homo sapiens
agauaagaaaugaucuu

SEQ ID NO: 2207515 - RNA, 18 nt, Homo sapiens
aguguacauuaccauaua

SEQ ID NO: 2207516 - RNA, 17 nt, Homo sapiens
uuuugaaagaacaucag

SEQ ID NO: 2207517 - RNA, 17 nt, Homo sapiens
cuccaaucuugagauug

SEQ ID NO: 2207518 - RNA, 23 nt, Homo sapiens
gccaccucucagggccacuggca

SEQ ID NO: 2207519 - RNA, 18 nt, Homo sapiens
ugaucccuucuuacuuaa

SEQ ID NO: 2207520 - RNA, 22 nt, Homo sapiens
cccgugugaauguagcuuccac

SEQ ID NO: 2207521 - RNA, 15 nt, Homo sapiens
acugaaaccaggugg

SEQ ID NO: 2207522 - RNA, 12 nt, Homo sapiens
gaauaagccuuc

SEQ ID NO: 2207523 - RNA, 23 nt, Homo sapiens
aaucugaaggcgugagucuucau

SEQ ID NO: 2207524 - RNA, 20 nt, Homo sapiens
gcugugguuccuaagccugu

SEQ ID NO: 2207525 - RNA, 16 nt, Homo sapiens
gacuaaggaacuaaaa

SEQ ID NO: 2207526 - RNA, 19 nt, Homo sapiens
cuggguuccccacagugac

SEQ ID NO: 2207527 - RNA, 13 nt, Homo sapiens
gcauaaccugucu

SEQ ID NO: 2207528 - RNA, 20 nt, Homo sapiens
augcaugucaaacaugagau

SEQ ID NO: 2207529 - RNA, 23 nt, Homo sapiens
agcaggcgccucgggucccagau

SEQ ID NO: 2207530 - RNA, 22 nt, Homo sapiens
cauuaaaaaaauuagaaaguag

SEQ ID NO: 2207531 - RNA, 14 nt, Homo sapiens
uuccucauguugcu

SEQ ID NO: 2207532 - RNA, 20 nt, Homo sapiens
auuguaacaugacacuuaga

SEQ ID NO: 2207533 - RNA, 18 nt, Homo sapiens
uuuaauguuagugaucca

SEQ ID NO: 2207534 - RNA, 23 nt, Homo sapiens
agaauuggaaaucugucuuguca

SEQ ID NO: 2207535 - RNA, 15 nt, Homo sapiens
ucggcuuugcagugc

SEQ ID NO: 2207536 - RNA, 18 nt, Homo sapiens
augaauaauccaccccuu

SEQ ID NO: 2207537 - RNA, 15 nt, Homo sapiens
uguguacacauauga

SEQ ID NO: 2207538 - RNA, 23 nt, Homo sapiens
ucugacaccagagcccacuucca

SEQ ID NO: 2207539 - RNA, 23 nt, Homo sapiens
ccuuucacccucaugaaaacaca

SEQ ID NO: 2207540 - RNA, 18 nt, Homo sapiens
cauguuauuuauaguguu

SEQ ID NO: 2207541 - RNA, 22 nt, Homo sapiens
uuccuauuaaucuucagcugaa

SEQ ID NO: 2207542 - RNA, 23 nt, Homo sapiens
caugccucccugggccaccuccu

SEQ ID NO: 2207543 - RNA, 22 nt, Homo sapiens
uggcucagggagguuaagugac

SEQ ID NO: 2207544 - RNA, 22 nt, Homo sapiens
cuaaaaugcuguucucaaucau

SEQ ID NO: 2207545 - RNA, 14 nt, Homo sapiens
gauucaugucucac

SEQ ID NO: 2207546 - RNA, 20 nt, Homo sapiens
ggcucagauuguaauaugua

SEQ ID NO: 2207547 - RNA, 17 nt, Homo sapiens
gaaccugcaucauuccc

SEQ ID NO: 2207548 - RNA, 15 nt, Homo sapiens
agaggggcagccgcu

SEQ ID NO: 2207549 - RNA, 22 nt, Homo sapiens
gcuaaugcauuuugcacuagaa

SEQ ID NO: 2207550 - RNA, 20 nt, Homo sapiens
uggcucaugccuguaauccc

SEQ ID NO: 2207551 - RNA, 20 nt, Homo sapiens
gcagagccacagcugugcau

SEQ ID NO: 2207552 - RNA, 22 nt, Homo sapiens
cauucacuaagccaugccaugc

SEQ ID NO: 2207553 - RNA, 13 nt, Homo sapiens
accgagugcaaug

SEQ ID NO: 2207554 - RNA, 22 nt, Homo sapiens
aagacaggcaaauguacuucuc

SEQ ID NO: 2207555 - RNA, 13 nt, Homo sapiens
auucuacagugau

SEQ ID NO: 2207556 - RNA, 14 nt, Homo sapiens
augcaaauaucgcu

SEQ ID NO: 2207557 - RNA, 18 nt, Homo sapiens
acuugggaaacuauucau

SEQ ID NO: 2207558 - RNA, 23 nt, Homo sapiens
cucccugguugccucucuugccc

SEQ ID NO: 2207559 - RNA, 18 nt, Homo sapiens
uauuguaggcucccccuc

SEQ ID NO: 2207560 - RNA, 18 nt, Homo sapiens
ucaaauaauaaaguaauu

SEQ ID NO: 2207561 - RNA, 17 nt, Homo sapiens
gacaaggaaaaucuaua

SEQ ID NO: 2207562 - RNA, 20 nt, Homo sapiens
ccauguuucagaagcauuca

SEQ ID NO: 2207563 - RNA, 13 nt, Homo sapiens
uaggaccaggcca

SEQ ID NO: 2207564 - RNA, 23 nt, Homo sapiens
gugauggagaugcagucacuuau

SEQ ID NO: 2207565 - RNA, 15 nt, Homo sapiens
cuaacugccaaaaua

SEQ ID NO: 2207566 - RNA, 18 nt, Homo sapiens
aacucgaauaaaggaugg

SEQ ID NO: 2207567 - RNA, 21 nt, Homo sapiens
ccauggacagaagaaggcagc

SEQ ID NO: 2207568 - RNA, 14 nt, Homo sapiens
gccaccucagucuc

SEQ ID NO: 2207569 - RNA, 20 nt, Homo sapiens
acuaaaaguuuagggaaaaa

SEQ ID NO: 2207570 - RNA, 21 nt, Homo sapiens
aagugguucuggauaucuuuu

SEQ ID NO: 2207571 - RNA, 20 nt, Homo sapiens
uccgaggcuccccgccucca

SEQ ID NO: 2207572 - RNA, 13 nt, Homo sapiens
cuguuggcagcuc

SEQ ID NO: 2207573 - RNA, 12 nt, Homo sapiens
ucuccuugcagu

SEQ ID NO: 2207574 - RNA, 17 nt, Homo sapiens
cuuuauugcucacuguc

SEQ ID NO: 2207575 - RNA, 13 nt, Homo sapiens
cuccaugcaggcc

SEQ ID NO: 2207576 - RNA, 16 nt, Homo sapiens
aaauuccuacaacuua

SEQ ID NO: 2207577 - RNA, 18 nt, Homo sapiens
uucacuguagaaugauuu

SEQ ID NO: 2207578 - RNA, 15 nt, Homo sapiens
aguacucaguaauac

SEQ ID NO: 2207579 - RNA, 21 nt, Homo sapiens
cauaucaagguuccugauuca

SEQ ID NO: 2207580 - RNA, 20 nt, Homo sapiens
gaggcaagaaaaggacaaau

SEQ ID NO: 2207581 - RNA, 17 nt, Homo sapiens
ccugucaccuagcucaa

SEQ ID NO: 2207582 - RNA, 22 nt, Homo sapiens
aagauuuagaaaaaaguuuaca

SEQ ID NO: 2207583 - RNA, 17 nt, Homo sapiens
uagacaaaguucauuca

SEQ ID NO: 2207584 - RNA, 13 nt, Homo sapiens
aggucuagccuau

SEQ ID NO: 2207585 - RNA, 17 nt, Homo sapiens
uuucauuuaauggggau

SEQ ID NO: 2207586 - RNA, 18 nt, Homo sapiens
ugcuauauaguaucuacc

SEQ ID NO: 2207587 - RNA, 16 nt, Homo sapiens
ucuuagaaguggacca

SEQ ID NO: 2207588 - RNA, 20 nt, Homo sapiens
ccauaaucucauucaaagaa

SEQ ID NO: 2207589 - RNA, 21 nt, Homo sapiens
ccggaaagccuuccucaagau

SEQ ID NO: 2207590 - RNA, 20 nt, Homo sapiens
ugcucaggugcuggggccug

SEQ ID NO: 2207591 - RNA, 21 nt, Homo sapiens
aauggugguuguuucuuccaa

SEQ ID NO: 2207592 - RNA, 14 nt, Homo sapiens
uaccugccuuuuau

SEQ ID NO: 2207593 - RNA, 14 nt, Homo sapiens
ccucacacugcaag

SEQ ID NO: 2207594 - RNA, 14 nt, Homo sapiens
caugacacugaccu

SEQ ID NO: 2207595 - RNA, 19 nt, Homo sapiens
gagccaccgcguccggccu

SEQ ID NO: 2207596 - RNA, 17 nt, Homo sapiens
gcccgcauagcacuugc

SEQ ID NO: 2207597 - RNA, 20 nt, Homo sapiens
uucccuaacacuuaccccau

SEQ ID NO: 2207598 - RNA, 18 nt, Homo sapiens
augaccauaaccacugaa

SEQ ID NO: 2207599 - RNA, 24 nt, Homo sapiens
gguggauaaagauggauggcuguu

SEQ ID NO: 2207600 - RNA, 19 nt, Homo sapiens
uuccauaggaaggcuguga

SEQ ID NO: 2207601 - RNA, 20 nt, Homo sapiens
cacuuuaccucuguggaccu

SEQ ID NO: 2207602 - RNA, 20 nt, Homo sapiens
ccugucaaguuaacaaggaa

SEQ ID NO: 2207603 - RNA, 15 nt, Homo sapiens
ugacuggcaaaggac

SEQ ID NO: 2207604 - RNA, 16 nt, Homo sapiens
aagcauguagccaguu

SEQ ID NO: 2207605 - RNA, 22 nt, Homo sapiens
ugcuuccucaguuacacaaagg

SEQ ID NO: 2207606 - RNA, 15 nt, Homo sapiens
agauaccaugcaaua

SEQ ID NO: 2207607 - RNA, 20 nt, Homo sapiens
ugccuaaauuuaaugcugcc

SEQ ID NO: 2207608 - RNA, 21 nt, Homo sapiens
aaugcauuuuggaaagcuccu

SEQ ID NO: 2207609 - RNA, 21 nt, Homo sapiens
uccaaguguuauaccaacuaa

SEQ ID NO: 2207610 - RNA, 12 nt, Homo sapiens
ccacuaaacuac

SEQ ID NO: 2207611 - RNA, 16 nt, Homo sapiens
aucacuccaacccugc

SEQ ID NO: 2207612 - RNA, 15 nt, Homo sapiens
aucacuuaguucuca

SEQ ID NO: 2207613 - RNA, 16 nt, Homo sapiens
agcacugggcucugau

SEQ ID NO: 2207614 - RNA, 16 nt, Homo sapiens
ggucaugcacaugccu

SEQ ID NO: 2207615 - RNA, 17 nt, Homo sapiens
caguaacacagugcagu

SEQ ID NO: 2207616 - RNA, 21 nt, Homo sapiens
cacgauuccgaucgacugcca

SEQ ID NO: 2207617 - RNA, 17 nt, Homo sapiens
aauagaaauaaaccuau

SEQ ID NO: 2207618 - RNA, 20 nt, Homo sapiens
agugaccugcccuacauauc

SEQ ID NO: 2207619 - RNA, 14 nt, Homo sapiens
aaagaugaugcaag

SEQ ID NO: 2207620 - RNA, 15 nt, Homo sapiens
auguauaauuucaca

SEQ ID NO: 2207621 - RNA, 18 nt, Homo sapiens
uccaugggaccacaacua

SEQ ID NO: 2207622 - RNA, 22 nt, Homo sapiens
uuauauagaaaaauaacuuuag

SEQ ID NO: 2207623 - RNA, 22 nt, Homo sapiens
acaaguacugguugacuuucua

SEQ ID NO: 2207624 - RNA, 13 nt, Homo sapiens
gccugcuauugca

SEQ ID NO: 2207625 - RNA, 16 nt, Homo sapiens
gaaaaggguguugcua

SEQ ID NO: 2207626 - RNA, 21 nt, Homo sapiens
ucagauuuuacugucuaugga

SEQ ID NO: 2207627 - RNA, 19 nt, Homo sapiens
caggcuggagugcaaugca

SEQ ID NO: 2207628 - RNA, 21 nt, Homo sapiens
auauucuauguuaucagucuc

SEQ ID NO: 2207629 - RNA, 19 nt, Homo sapiens
guugcuuccuaacauccuu

SEQ ID NO: 2207630 - RNA, 16 nt, Homo sapiens
ucuuuggguccauuca

SEQ ID NO: 2207631 - RNA, 18 nt, Homo sapiens
aguaguaauaauagcagc

SEQ ID NO: 2207632 - RNA, 15 nt, Homo sapiens
cccuuuaacucauga

SEQ ID NO: 2207633 - RNA, 15 nt, Homo sapiens
cacagccaucaaggg

SEQ ID NO: 2207634 - RNA, 17 nt, Homo sapiens
aagauuuugccacauuu

SEQ ID NO: 2207635 - RNA, 21 nt, Homo sapiens
aucuggcagacuuacaaagcu

SEQ ID NO: 2207636 - RNA, 15 nt, Homo sapiens
uaugauauugcagcu

SEQ ID NO: 2207637 - RNA, 22 nt, Homo sapiens
caaaaaugcacccaacuagcuc

SEQ ID NO: 2207638 - RNA, 17 nt, Homo sapiens
ucuuggcccagcacugc

SEQ ID NO: 2207639 - RNA, 15 nt, Homo sapiens
gaaagcccucuagga

SEQ ID NO: 2207640 - RNA, 18 nt, Homo sapiens
ggacuuugagcacacuuu

SEQ ID NO: 2207641 - RNA, 22 nt, Homo sapiens
ugcaggcaaacuuggcucucaa

SEQ ID NO: 2207642 - RNA, 12 nt, Homo sapiens
gacuugaaccca

SEQ ID NO: 2207643 - RNA, 20 nt, Homo sapiens
acagcaaauuucuugaugaa

SEQ ID NO: 2207644 - RNA, 17 nt, Homo sapiens
uugaaugcugccagugu

SEQ ID NO: 2207645 - RNA, 22 nt, Homo sapiens
ccucaggggcacagaccucucc

SEQ ID NO: 2207646 - RNA, 19 nt, Homo sapiens
ugucugaauggugcgugaa

SEQ ID NO: 2207647 - RNA, 22 nt, Homo sapiens
uggucuuuguaagaguguagaa

SEQ ID NO: 2207648 - RNA, 22 nt, Homo sapiens
aagcauuacccauaggucuuaa

SEQ ID NO: 2207649 - RNA, 17 nt, Homo sapiens
auuuaaagaaagaaugc

SEQ ID NO: 2207650 - RNA, 15 nt, Homo sapiens
ugcuacagaaagcac

SEQ ID NO: 2207651 - RNA, 19 nt, Homo sapiens
uagaaaagcuuccuagcuu

SEQ ID NO: 2207652 - RNA, 19 nt, Homo sapiens
uagaauucuuaccaucuua

SEQ ID NO: 2207653 - RNA, 17 nt, Homo sapiens
ugcuccagcaagcaaac

SEQ ID NO: 2207654 - RNA, 22 nt, Homo sapiens
ccaggcaaauaggccccuuuga

SEQ ID NO: 2207655 - RNA, 9 nt, Homo sapiens
cgugcccuc

SEQ ID NO: 2207656 - RNA, 9 nt, Homo sapiens
agugcccua

SEQ ID NO: 2207657 - RNA, 16 nt, Homo sapiens
ggaggcugugugccug

SEQ ID NO: 2207658 - RNA, 12 nt, Homo sapiens
cuuuucacggga

SEQ ID NO: 2207659 - RNA, 23 nt, Homo sapiens
uccuuaauagccauaugcaauaa

SEQ ID NO: 2207660 - RNA, 21 nt, Homo sapiens
aguagacauggaauuuaugaa

SEQ ID NO: 2207661 - RNA, 22 nt, Homo sapiens
augguauuuucuagacugugaa

SEQ ID NO: 2207662 - RNA, 14 nt, Homo sapiens
cugcaaaccuuccu

SEQ ID NO: 2207663 - RNA, 13 nt, Homo sapiens
ccacugggcacug

SEQ ID NO: 2207664 - RNA, 15 nt, Homo sapiens
uucuaucaguacuuu

SEQ ID NO: 2207665 - RNA, 14 nt, Homo sapiens
cggcggcucggggc

SEQ ID NO: 2207666 - RNA, 20 nt, Homo sapiens
caugucucugguggugcugg

SEQ ID NO: 2207667 - RNA, 21 nt, Homo sapiens
aaggcagggccugauuuaucu

SEQ ID NO: 2207668 - RNA, 23 nt, Homo sapiens
agugccaguuugcuuaguucuca

SEQ ID NO: 2207669 - RNA, 23 nt, Homo sapiens
aaacaagaauuuucuuugcucug

SEQ ID NO: 2207670 - RNA, 20 nt, Homo sapiens
ucuuauuaagacuggcuuua

SEQ ID NO: 2207671 - RNA, 21 nt, Homo sapiens
cuguaaauugauucaagugag

SEQ ID NO: 2207672 - RNA, 20 nt, Homo sapiens
uaagaagcucagcuaugaaa

SEQ ID NO: 2207673 - RNA, 16 nt, Homo sapiens
uuagcaggguacauau

SEQ ID NO: 2207674 - RNA, 18 nt, Homo sapiens
cagaagauuuucaagaac

SEQ ID NO: 2207675 - RNA, 16 nt, Homo sapiens
uugcuggucuagucac

SEQ ID NO: 2207676 - RNA, 15 nt, Homo sapiens
uuaucuaagaauaca

SEQ ID NO: 2207677 - RNA, 15 nt, Homo sapiens
ccugaugggaacaga

SEQ ID NO: 2207678 - RNA, 20 nt, Homo sapiens
auacacucauccuacuucaa

SEQ ID NO: 2207679 - RNA, 17 nt, Homo sapiens
uuucuaggccacuggga

SEQ ID NO: 2207680 - RNA, 14 nt, Homo sapiens
gguugggcugagac

SEQ ID NO: 2207681 - RNA, 13 nt, Homo sapiens
gcagcuuugcaaa

SEQ ID NO: 2207682 - RNA, 17 nt, Homo sapiens
gcaguuggacucucagg

SEQ ID NO: 2207683 - RNA, 14 nt, Homo sapiens
auuuggucugccuc

SEQ ID NO: 2207684 - RNA, 15 nt, Homo sapiens
uagugguacucugaa

SEQ ID NO: 2207685 - RNA, 17 nt, Homo sapiens
cuggugccccacugaau

SEQ ID NO: 2207686 - RNA, 19 nt, Homo sapiens
aaaaaccugaugcagugcu

SEQ ID NO: 2207687 - RNA, 13 nt, Homo sapiens
ggcuucugugaug

SEQ ID NO: 2207688 - RNA, 22 nt, Homo sapiens
aaguuuauuacuuuauguacaa

SEQ ID NO: 2207689 - RNA, 19 nt, Homo sapiens
aaagccacaucuugcucug

SEQ ID NO: 2207690 - RNA, 17 nt, Homo sapiens
ggccgcuucgccauugc

SEQ ID NO: 2207691 - RNA, 21 nt, Homo sapiens
gccaacucuaacaggcacuuu

SEQ ID NO: 2207692 - RNA, 20 nt, Homo sapiens
cacagaaaucacagucaaug

SEQ ID NO: 2207693 - RNA, 14 nt, Homo sapiens
aaguaccacacuga

SEQ ID NO: 2207694 - RNA, 13 nt, Homo sapiens
uagaaaaccucac

SEQ ID NO: 2207695 - RNA, 13 nt, Homo sapiens
cugaaaacuacac

SEQ ID NO: 2207696 - RNA, 17 nt, Homo sapiens
aggaaaaaaauucuguu

SEQ ID NO: 2207697 - RNA, 22 nt, Homo sapiens
uccaccuuucagcccacgucac

SEQ ID NO: 2207698 - RNA, 23 nt, Homo sapiens
uaccauuaaaguucucaaugcaa

SEQ ID NO: 2207699 - RNA, 16 nt, Homo sapiens
caaucguucuguguuu

SEQ ID NO: 2207700 - RNA, 18 nt, Homo sapiens
uaauuuuuuaaacuguag

SEQ ID NO: 2207701 - RNA, 18 nt, Homo sapiens
agcauuuugaaugaagug

SEQ ID NO: 2207702 - RNA, 22 nt, Homo sapiens
gacuacuuagcauccuaagaaa

SEQ ID NO: 2207703 - RNA, 18 nt, Homo sapiens
cuacgugccaggcacugu

SEQ ID NO: 2207704 - RNA, 12 nt, Homo sapiens
ucaguuccagcu

SEQ ID NO: 2207705 - RNA, 15 nt, Homo sapiens
uaguuugacucagua

SEQ ID NO: 2207706 - RNA, 18 nt, Homo sapiens
cuaacacgugaugugaua

SEQ ID NO: 2207707 - RNA, 15 nt, Homo sapiens
uguauucgugcauuu

SEQ ID NO: 2207708 - RNA, 20 nt, Homo sapiens
cauuugcugaacucagcaca

SEQ ID NO: 2207709 - RNA, 23 nt, Homo sapiens
ccugcgcucucagcugaccauca

SEQ ID NO: 2207710 - RNA, 22 nt, Homo sapiens
ccuuuuauucauauuuucacau

SEQ ID NO: 2207711 - RNA, 20 nt, Homo sapiens
aucaaacccacgauuuucuc

SEQ ID NO: 2207712 - RNA, 15 nt, Homo sapiens
caugacaccugccau

SEQ ID NO: 2207713 - RNA, 15 nt, Homo sapiens
aagacaucaagcaca

SEQ ID NO: 2207714 - RNA, 23 nt, Homo sapiens
aggggagagaucuccaacucucu

SEQ ID NO: 2207715 - RNA, 12 nt, Homo sapiens
uguuuugccagc

SEQ ID NO: 2207716 - RNA, 20 nt, Homo sapiens
gcaaaguaucccuacuguaa

SEQ ID NO: 2207717 - RNA, 20 nt, Homo sapiens
ucaaugauuuacucaauauc

SEQ ID NO: 2207718 - RNA, 17 nt, Homo sapiens
uugggaaaacauuugcu

SEQ ID NO: 2207719 - RNA, 16 nt, Homo sapiens
guauaauaugcaguuc

SEQ ID NO: 2207720 - RNA, 15 nt, Homo sapiens
accucccagcccuau

SEQ ID NO: 2207721 - RNA, 19 nt, Homo sapiens
ggcagcugcuggcugugac

SEQ ID NO: 2207722 - RNA, 16 nt, Homo sapiens
ggagucagucuucacu

SEQ ID NO: 2207723 - RNA, 23 nt, Homo sapiens
uccuguucacaccagagaaccag

SEQ ID NO: 2207724 - RNA, 18 nt, Homo sapiens
gucacuggcccaaccaga

SEQ ID NO: 2207725 - RNA, 17 nt, Homo sapiens
acauaccacauggacag

SEQ ID NO: 2207726 - RNA, 16 nt, Homo sapiens
aaacccaagugcugca

SEQ ID NO: 2207727 - RNA, 13 nt, Homo sapiens
acugcuugaauaa

SEQ ID NO: 2207728 - RNA, 23 nt, Homo sapiens
ucuggucaaccccacaagcacca

SEQ ID NO: 2207729 - RNA, 21 nt, Homo sapiens
ucuaauuugggcuguuuuuca

SEQ ID NO: 2207730 - RNA, 15 nt, Homo sapiens
caaccccugcuccag

SEQ ID NO: 2207731 - RNA, 21 nt, Homo sapiens
uauaaaacagucauggccuga

SEQ ID NO: 2207732 - RNA, 15 nt, Homo sapiens
caucucugcagguuu

SEQ ID NO: 2207733 - RNA, 21 nt, Homo sapiens
gaaccagagaggcucugagaa

SEQ ID NO: 2207734 - RNA, 19 nt, Homo sapiens
uucauauucagcuugcaca

SEQ ID NO: 2207735 - RNA, 20 nt, Homo sapiens
cucucuaguugaacccuggg

SEQ ID NO: 2207736 - RNA, 14 nt, Homo sapiens
ggcgucaccaucca

SEQ ID NO: 2207737 - RNA, 19 nt, Homo sapiens
gcaggggcuugcuuugcag

SEQ ID NO: 2207738 - RNA, 16 nt, Homo sapiens
cucucaacacccaguu

SEQ ID NO: 2207739 - RNA, 19 nt, Homo sapiens
ucagagaagaaaaacguga

SEQ ID NO: 2207740 - RNA, 18 nt, Homo sapiens
ccacagcugcuguucuca

SEQ ID NO: 2207741 - RNA, 13 nt, Homo sapiens
ggugggugggaug

SEQ ID NO: 2207742 - RNA, 23 nt, Homo sapiens
ccuuggaauuggaauuacuguaa

SEQ ID NO: 2207743 - RNA, 18 nt, Homo sapiens
ugagaacaaauacaauuc

SEQ ID NO: 2207744 - RNA, 17 nt, Homo sapiens
gaccacccggcauucuc

SEQ ID NO: 2207745 - RNA, 16 nt, Homo sapiens
aucaagccugauucaa

SEQ ID NO: 2207746 - RNA, 15 nt, Homo sapiens
cuggaaggugccacu

SEQ ID NO: 2207747 - RNA, 19 nt, Homo sapiens
cuugguguuguuauggcaa

SEQ ID NO: 2207748 - RNA, 16 nt, Homo sapiens
cggacagccaggagcu

SEQ ID NO: 2207749 - RNA, 15 nt, Homo sapiens
ugcuacuucccucac

SEQ ID NO: 2207750 - RNA, 17 nt, Homo sapiens
cugcuugugcacuggau

SEQ ID NO: 2207751 - RNA, 16 nt, Homo sapiens
cagggaagagggcagu

SEQ ID NO: 2207752 - RNA, 12 nt, Homo sapiens
ugacagagguac

SEQ ID NO: 2207753 - RNA, 15 nt, Homo sapiens
uugugaugaacauau

SEQ ID NO: 2207754 - RNA, 18 nt, Homo sapiens
agauaguccauaauguuc

SEQ ID NO: 2207755 - RNA, 13 nt, Homo sapiens
agaaguagcuuca

SEQ ID NO: 2207756 - RNA, 14 nt, Homo sapiens
uuaagagauggcau

SEQ ID NO: 2207757 - RNA, 22 nt, Homo sapiens
uacugcuggcaguggaacuaag

SEQ ID NO: 2207758 - RNA, 21 nt, Homo sapiens
cccagaggugacccaaugcuc

SEQ ID NO: 2207759 - RNA, 23 nt, Homo sapiens
ugauuauccauauugagucaaau

SEQ ID NO: 2207760 - RNA, 15 nt, Homo sapiens
uaugagauacuuugc

SEQ ID NO: 2207761 - RNA, 23 nt, Homo sapiens
ugaaaagaaucggcaauguuuca

SEQ ID NO: 2207762 - RNA, 24 nt, Homo sapiens
cuugcauaggcucuuaagcagcau

SEQ ID NO: 2207763 - RNA, 15 nt, Homo sapiens
gaacagcaguguucu

SEQ ID NO: 2207764 - RNA, 23 nt, Homo sapiens
ggaaaagcagcccuuggccagaa

SEQ ID NO: 2207765 - RNA, 16 nt, Homo sapiens
agccuccugaguagau

SEQ ID NO: 2207766 - RNA, 19 nt, Homo sapiens
gaugugaucauagcucacu

SEQ ID NO: 2207767 - RNA, 16 nt, Homo sapiens
cucccugaaacacugc

SEQ ID NO: 2207768 - RNA, 20 nt, Homo sapiens
ugcaaauucccagauuugaa

SEQ ID NO: 2207769 - RNA, 20 nt, Homo sapiens
aauugaaaaauaaaaaccau

SEQ ID NO: 2207770 - RNA, 13 nt, Homo sapiens
ucccaaagcacuu

SEQ ID NO: 2207771 - RNA, 15 nt, Homo sapiens
acaugcacugacccu

SEQ ID NO: 2207772 - RNA, 19 nt, Homo sapiens
aaguguguauccagaagaa

SEQ ID NO: 2207773 - RNA, 22 nt, Homo sapiens
cuggcccuucuauuuauuugac

SEQ ID NO: 2207774 - RNA, 15 nt, Homo sapiens
uggaacagugcagga

SEQ ID NO: 2207775 - RNA, 15 nt, Homo sapiens
acaaagccaaucuca

SEQ ID NO: 2207776 - RNA, 14 nt, Homo sapiens
gccauacuuuacaa

SEQ ID NO: 2207777 - RNA, 17 nt, Homo sapiens
agaggcuguguggccaa

SEQ ID NO: 2207778 - RNA, 20 nt, Homo sapiens
acggacugugcauacuuucc

SEQ ID NO: 2207779 - RNA, 15 nt, Homo sapiens
agcaacaguuaucac

SEQ ID NO: 2207780 - RNA, 14 nt, Homo sapiens
uaacugcauugaga

SEQ ID NO: 2207781 - RNA, 20 nt, Homo sapiens
ugggaccacacagacagggu

SEQ ID NO: 2207782 - RNA, 15 nt, Homo sapiens
aacucugguuucuac

SEQ ID NO: 2207783 - RNA, 19 nt, Homo sapiens
aaagaaaaugugucugcaa

SEQ ID NO: 2207784 - RNA, 17 nt, Homo sapiens
gugcaacggaagccagg

SEQ ID NO: 2207785 - RNA, 12 nt, Homo sapiens
ugcuccggccug

SEQ ID NO: 2207786 - RNA, 17 nt, Homo sapiens
ucuuauuuugugaacua

SEQ ID NO: 2207787 - RNA, 17 nt, Homo sapiens
acucauaggucccugac

SEQ ID NO: 2207788 - RNA, 18 nt, Homo sapiens
gaguuuuuaaaaagugaa

SEQ ID NO: 2207789 - RNA, 17 nt, Homo sapiens
ucaggagggagcauaga

SEQ ID NO: 2207790 - RNA, 23 nt, Homo sapiens
gucaacuucuggcuccucaaaca

SEQ ID NO: 2207791 - RNA, 21 nt, Homo sapiens
aagucuaagaaagcaaugcaa

SEQ ID NO: 2207792 - RNA, 22 nt, Homo sapiens
uaugacacuguuaauaguacua

SEQ ID NO: 2207793 - RNA, 15 nt, Homo sapiens
uccuugcuuccuguc

SEQ ID NO: 2207794 - RNA, 14 nt, Homo sapiens
augcccacauacug

SEQ ID NO: 2207795 - RNA, 16 nt, Homo sapiens
cacuccguuuugcaaa

SEQ ID NO: 2207796 - RNA, 23 nt, Homo sapiens
cucugaugaaaaauugcugacug

SEQ ID NO: 2207797 - RNA, 13 nt, Homo sapiens
gugguacagagaa

SEQ ID NO: 2207798 - RNA, 13 nt, Homo sapiens
aauguacaauuaa

SEQ ID NO: 2207799 - RNA, 15 nt, Homo sapiens
cuaagacugauguca

SEQ ID NO: 2207800 - RNA, 22 nt, Homo sapiens
acaaaugcuccuccuccaugcu

SEQ ID NO: 2207801 - RNA, 18 nt, Homo sapiens
gcauccuggcuugccucc

SEQ ID NO: 2207802 - RNA, 15 nt, Homo sapiens
ugugacuggcaguau

SEQ ID NO: 2207803 - RNA, 20 nt, Homo sapiens
caagaagggaguuccaguca

SEQ ID NO: 2207804 - RNA, 21 nt, Homo sapiens
gugaccccuccccagugccuc

SEQ ID NO: 2207805 - RNA, 21 nt, Homo sapiens
ccaaaguaaaagaaaccacuu

SEQ ID NO: 2207806 - RNA, 18 nt, Homo sapiens
guugagaugccuguugaa

SEQ ID NO: 2207807 - RNA, 14 nt, Homo sapiens
ugcgaggacaucaa

SEQ ID NO: 2207808 - RNA, 18 nt, Homo sapiens
gggaaugaccccuaggca

SEQ ID NO: 2207809 - RNA, 19 nt, Homo sapiens
ucagauuuugcccaaccua

SEQ ID NO: 2207810 - RNA, 21 nt, Homo sapiens
ugccagguggcucagugccac

SEQ ID NO: 2207811 - RNA, 21 nt, Homo sapiens
gcagugagcuguguucuugcc

SEQ ID NO: 2207812 - RNA, 17 nt, Homo sapiens
uucccuagacucuguaa

SEQ ID NO: 2207813 - RNA, 22 nt, Homo sapiens
cuuucuaaggauagccuuugua

SEQ ID NO: 2207814 - RNA, 15 nt, Homo sapiens
uuugcaaauucauga

SEQ ID NO: 2207815 - RNA, 15 nt, Homo sapiens
uguguguaugcacau

SEQ ID NO: 2207816 - RNA, 20 nt, Homo sapiens
augcagcucuucaacaugac

SEQ ID NO: 2207817 - RNA, 23 nt, Homo sapiens
gugaagcauucgagacagaaccu

SEQ ID NO: 2207818 - RNA, 19 nt, Homo sapiens
aacgugucugagagccaua

SEQ ID NO: 2207819 - RNA, 18 nt, Homo sapiens
cuuuacucuuucaugcca

SEQ ID NO: 2207820 - RNA, 13 nt, Homo sapiens
cuuuugucccaga

SEQ ID NO: 2207821 - RNA, 13 nt, Homo sapiens
ccaacaaacaaug

SEQ ID NO: 2207822 - RNA, 23 nt, Homo sapiens
ccaaucccuuuauuacccccucc

SEQ ID NO: 2207823 - RNA, 14 nt, Homo sapiens
caauuaacugcccu

SEQ ID NO: 2207824 - RNA, 17 nt, Homo sapiens
aauaucccuacauguau

SEQ ID NO: 2207825 - RNA, 17 nt, Homo sapiens
gcccagcuauuaccaca

SEQ ID NO: 2207826 - RNA, 11 nt, Homo sapiens
ucucucuaugu

SEQ ID NO: 2207827 - RNA, 18 nt, Homo sapiens
uaaagaugguccaaaaau

SEQ ID NO: 2207828 - RNA, 18 nt, Homo sapiens
cuagagugacaggcacca

SEQ ID NO: 2207829 - RNA, 19 nt, Homo sapiens
ggauaccagauauuugaau

SEQ ID NO: 2207830 - RNA, 13 nt, Homo sapiens
gcaacucacacau

SEQ ID NO: 2207831 - RNA, 22 nt, Homo sapiens
agccucccccucagaugaucuc

SEQ ID NO: 2207832 - RNA, 20 nt, Homo sapiens
agcacaaggccaucugggcu

SEQ ID NO: 2207833 - RNA, 21 nt, Homo sapiens
agcaaagcaaaaggcugagaa

SEQ ID NO: 2207834 - RNA, 23 nt, Homo sapiens
uacaaaaaugguaacuagguuga

SEQ ID NO: 2207835 - RNA, 22 nt, Homo sapiens
cugagcagguacauuucugauu

SEQ ID NO: 2207836 - RNA, 13 nt, Homo sapiens
agaauugcucaaa

SEQ ID NO: 2207837 - RNA, 14 nt, Homo sapiens
acgucaagucuccu

SEQ ID NO: 2207838 - RNA, 16 nt, Homo sapiens
uugugauccaccccgc

SEQ ID NO: 2207839 - RNA, 23 nt, Homo sapiens
gucuuaauuaaguaaacuaauga

SEQ ID NO: 2207840 - RNA, 22 nt, Homo sapiens
ccucugcaaaaagauuuaacaa

SEQ ID NO: 2207841 - RNA, 14 nt, Homo sapiens
gcuccaggccugca

SEQ ID NO: 2207842 - RNA, 18 nt, Homo sapiens
ugcacagggggaggccau

SEQ ID NO: 2207843 - RNA, 18 nt, Homo sapiens
gaauuuuguuuuacuuuu

SEQ ID NO: 2207844 - RNA, 22 nt, Homo sapiens
aagcgcuuggccucuccuucuc

SEQ ID NO: 2207845 - RNA, 15 nt, Homo sapiens
uucuaguuucucuca

SEQ ID NO: 2207846 - RNA, 15 nt, Homo sapiens
gauuuauaccuaacu

SEQ ID NO: 2207847 - RNA, 15 nt, Homo sapiens
cauuaaaagcuauca

SEQ ID NO: 2207848 - RNA, 21 nt, Homo sapiens
cuccuuaauagccauaugcaa

SEQ ID NO: 2207849 - RNA, 22 nt, Homo sapiens
caagggacugaaguauacauuu

SEQ ID NO: 2207850 - RNA, 21 nt, Homo sapiens
uucaucacagcaugugcaaua

SEQ ID NO: 2207851 - RNA, 14 nt, Homo sapiens
ucaggacugugacc

SEQ ID NO: 2207852 - RNA, 15 nt, Homo sapiens
auuuucacucugggc

SEQ ID NO: 2207853 - RNA, 18 nt, Homo sapiens
agcugaggaggugccuug

SEQ ID NO: 2207854 - RNA, 20 nt, Homo sapiens
uacaggcauagaguucagac

SEQ ID NO: 2207855 - RNA, 15 nt, Homo sapiens
aucucaagugccaua

SEQ ID NO: 2207856 - RNA, 21 nt, Homo sapiens
gucuuaccagugacgcugcug

SEQ ID NO: 2207857 - RNA, 19 nt, Homo sapiens
caaaaugcucuaaugagca

SEQ ID NO: 2207858 - RNA, 23 nt, Homo sapiens
ucccacuaaguaguauugccuuc

SEQ ID NO: 2207859 - RNA, 16 nt, Homo sapiens
acaacccgucagagac

SEQ ID NO: 2207860 - RNA, 21 nt, Homo sapiens
ucagccagcaagagggaacaa

SEQ ID NO: 2207861 - RNA, 20 nt, Homo sapiens
aggaggcuuacaacuccugc

SEQ ID NO: 2207862 - RNA, 18 nt, Homo sapiens
accaggcuggagugcagu

SEQ ID NO: 2207863 - RNA, 22 nt, Homo sapiens
ugaaggcaguacuuauagaccu

SEQ ID NO: 2207864 - RNA, 18 nt, Homo sapiens
agcugugauuaugccauu

SEQ ID NO: 2207865 - RNA, 17 nt, Homo sapiens
gugauugucaccaugau

SEQ ID NO: 2207866 - RNA, 19 nt, Homo sapiens
uggccugcugggcucucca

SEQ ID NO: 2207867 - RNA, 20 nt, Homo sapiens
aaaaucaaagaaaacauagc

SEQ ID NO: 2207868 - RNA, 20 nt, Homo sapiens
uucuuacauuacuaaggcua

SEQ ID NO: 2207869 - RNA, 21 nt, Homo sapiens
cuucccaaguagcugggauua

SEQ ID NO: 2207870 - RNA, 21 nt, Homo sapiens
cgagcccuuagccuugcugua

SEQ ID NO: 2207871 - RNA, 21 nt, Homo sapiens
auaguucuaggcacuguaguu

SEQ ID NO: 2207872 - RNA, 19 nt, Homo sapiens
ugcccauauuaaaaagcca

SEQ ID NO: 2207873 - RNA, 13 nt, Homo sapiens
gaagccuuuugca

SEQ ID NO: 2207874 - RNA, 22 nt, Homo sapiens
aggggcccaaauucuuucagug

SEQ ID NO: 2207875 - RNA, 21 nt, Homo sapiens
ugaauuaagaacugacacaaa

SEQ ID NO: 2207876 - RNA, 23 nt, Homo sapiens
ugaccccaagggggcugcugcuc

SEQ ID NO: 2207877 - RNA, 13 nt, Homo sapiens
ccuugucaucucu

SEQ ID NO: 2207878 - RNA, 19 nt, Homo sapiens
agccauuugcugcauuucu

SEQ ID NO: 2207879 - RNA, 20 nt, Homo sapiens
cugaagcuaugucucuagca

SEQ ID NO: 2207880 - RNA, 21 nt, Homo sapiens
aagccucagcaacagccagug

SEQ ID NO: 2207881 - RNA, 23 nt, Homo sapiens
aaguaacucuuaccuaaacugag

SEQ ID NO: 2207882 - RNA, 22 nt, Homo sapiens
uuuugaauuuauauuguuucau

SEQ ID NO: 2207883 - RNA, 12 nt, Homo sapiens
caguacuuguca

SEQ ID NO: 2207884 - RNA, 19 nt, Homo sapiens
agcucugguuauuuuucuc

SEQ ID NO: 2207885 - RNA, 14 nt, Homo sapiens
agaaguuuguuaua

SEQ ID NO: 2207886 - RNA, 14 nt, Homo sapiens
cugcaucugauaaa

SEQ ID NO: 2207887 - RNA, 23 nt, Homo sapiens
ccguguugcaugaaggagcagca

SEQ ID NO: 2207888 - RNA, 14 nt, Homo sapiens
uaaaacuucugcuc

SEQ ID NO: 2207889 - RNA, 16 nt, Homo sapiens
cugcauuuagcuguau

SEQ ID NO: 2207890 - RNA, 15 nt, Homo sapiens
augcagagaagaaua

SEQ ID NO: 2207891 - RNA, 17 nt, Homo sapiens
gcaucaaacagggcaaa

SEQ ID NO: 2207892 - RNA, 18 nt, Homo sapiens
auugcaauagaaauccaa

SEQ ID NO: 2207893 - RNA, 16 nt, Homo sapiens
ccaagcaggcacucug

SEQ ID NO: 2207894 - RNA, 15 nt, Homo sapiens
aauauuauguuauga

SEQ ID NO: 2207895 - RNA, 21 nt, Homo sapiens
aucaauacccuugugauuucu

SEQ ID NO: 2207896 - RNA, 17 nt, Homo sapiens
ucagcagcaaaaccaaa

SEQ ID NO: 2207897 - RNA, 14 nt, Homo sapiens
aaacacuagcucug

SEQ ID NO: 2207898 - RNA, 14 nt, Homo sapiens
ugucucugaacugc

SEQ ID NO: 2207899 - RNA, 17 nt, Homo sapiens
ccaaaccuucaggaaau

SEQ ID NO: 2207900 - RNA, 18 nt, Homo sapiens
gaaacuuuggaagcacuu

SEQ ID NO: 2207901 - RNA, 19 nt, Homo sapiens
aauuggagaaaagcacuua

SEQ ID NO: 2207902 - RNA, 12 nt, Homo sapiens
aaaguuugcuca

SEQ ID NO: 2207903 - RNA, 22 nt, Homo sapiens
cccuuacucuugcugagucaga

SEQ ID NO: 2207904 - RNA, 22 nt, Homo sapiens
accaacuaaaacccccaauaaa

SEQ ID NO: 2207905 - RNA, 21 nt, Homo sapiens
ccaccccuacucuauucugua

SEQ ID NO: 2207906 - RNA, 13 nt, Homo sapiens
cugagcaggauuu

SEQ ID NO: 2207907 - RNA, 12 nt, Homo sapiens
caauuuacuuuu

SEQ ID NO: 2207908 - RNA, 21 nt, Homo sapiens
uaaguccuuccaccugccacc

SEQ ID NO: 2207909 - RNA, 14 nt, Homo sapiens
aaucauccaucacu

SEQ ID NO: 2207910 - RNA, 17 nt, Homo sapiens
auccuucucacugccau

SEQ ID NO: 2207911 - RNA, 21 nt, Homo sapiens
agggccgacguuccaccuggg

SEQ ID NO: 2207912 - RNA, 19 nt, Homo sapiens
aacagcuccuaggaaaaug

SEQ ID NO: 2207913 - RNA, 15 nt, Homo sapiens
ccuaacucuugcuca

SEQ ID NO: 2207914 - RNA, 20 nt, Homo sapiens
aucuuggagacccugcaaac

SEQ ID NO: 2207915 - RNA, 18 nt, Homo sapiens
uaccaucuaaucuaugca

SEQ ID NO: 2207916 - RNA, 19 nt, Homo sapiens
uggcaucccggccaggugg

SEQ ID NO: 2207917 - RNA, 13 nt, Homo sapiens
ugcagugucugug

SEQ ID NO: 2207918 - RNA, 14 nt, Homo sapiens
ugggagucaucuca

SEQ ID NO: 2207919 - RNA, 15 nt, Homo sapiens
auguuugaaugauuu

SEQ ID NO: 2207920 - RNA, 19 nt, Homo sapiens
guauguaugaaggccacau

SEQ ID NO: 2207921 - RNA, 17 nt, Homo sapiens
accaaguguguugggaa

SEQ ID NO: 2207922 - RNA, 15 nt, Homo sapiens
auguaaaccuaagca

SEQ ID NO: 2207923 - RNA, 23 nt, Homo sapiens
uauccuuuucuauuaagauauau

SEQ ID NO: 2207924 - RNA, 21 nt, Homo sapiens
agagguagucucacugcuuga

SEQ ID NO: 2207925 - RNA, 21 nt, Homo sapiens
aauauaauauuugaagcagcu

SEQ ID NO: 2207926 - RNA, 13 nt, Homo sapiens
aaagaugacaaaa

SEQ ID NO: 2207927 - RNA, 15 nt, Homo sapiens
caaauaaacugaagg

SEQ ID NO: 2207928 - RNA, 17 nt, Homo sapiens
aacaagacaaagcaaag

SEQ ID NO: 2207929 - RNA, 21 nt, Homo sapiens
acaagcaagggucuccuucaa

SEQ ID NO: 2207930 - RNA, 14 nt, Homo sapiens
acuacaucugauau

SEQ ID NO: 2207931 - RNA, 14 nt, Homo sapiens
acagauauucccuc

SEQ ID NO: 2207932 - RNA, 22 nt, Homo sapiens
auccaauaauuuuccugugaca

SEQ ID NO: 2207933 - RNA, 18 nt, Homo sapiens
gugaaaccuccucucuac

SEQ ID NO: 2207934 - RNA, 21 nt, Homo sapiens
aucuaaaaugugugccagaug

SEQ ID NO: 2207935 - RNA, 14 nt, Homo sapiens
uccgagcuccagcu

SEQ ID NO: 2207936 - RNA, 13 nt, Homo sapiens
ucgagaagccagg

SEQ ID NO: 2207937 - RNA, 16 nt, Homo sapiens
caugcaguaugugcag

SEQ ID NO: 2207938 - RNA, 21 nt, Homo sapiens
gaacuuugaagcuagugcauu

SEQ ID NO: 2207939 - RNA, 22 nt, Homo sapiens
caacgguauccagggacuauga

SEQ ID NO: 2207940 - RNA, 19 nt, Homo sapiens
caauguuuuaaacauucuu

SEQ ID NO: 2207941 - RNA, 14 nt, Homo sapiens
aauauuacagauaa

SEQ ID NO: 2207942 - RNA, 21 nt, Homo sapiens
gucucauugucaccucuguga

SEQ ID NO: 2207943 - RNA, 14 nt, Homo sapiens
uuauacuacuuugu

SEQ ID NO: 2207944 - RNA, 22 nt, Homo sapiens
cugaaaccauccgcaaccugag

SEQ ID NO: 2207945 - RNA, 16 nt, Homo sapiens
gucagccaugucugug

SEQ ID NO: 2207946 - RNA, 20 nt, Homo sapiens
aaggauguguuuucagucuu

SEQ ID NO: 2207947 - RNA, 14 nt, Homo sapiens
cuguaaccucuuca

SEQ ID NO: 2207948 - RNA, 21 nt, Homo sapiens
gcccccacguggggaggugga

SEQ ID NO: 2207949 - RNA, 14 nt, Homo sapiens
accucuguggugug

SEQ ID NO: 2207950 - RNA, 23 nt, Homo sapiens
gugauucucuugacguuuacaua

SEQ ID NO: 2207951 - RNA, 15 nt, Homo sapiens
cauucagcagucagu

SEQ ID NO: 2207952 - RNA, 13 nt, Homo sapiens
ugcucuuuccacc

SEQ ID NO: 2207953 - RNA, 17 nt, Homo sapiens
uccauagacacaguauu

SEQ ID NO: 2207954 - RNA, 14 nt, Homo sapiens
guuggcagcccacu

SEQ ID NO: 2207955 - RNA, 15 nt, Homo sapiens
ccgagcuacaaagca

SEQ ID NO: 2207956 - RNA, 19 nt, Homo sapiens
agguggccaggaauguuga

SEQ ID NO: 2207957 - RNA, 17 nt, Homo sapiens
gugccugggccuagcac

SEQ ID NO: 2207958 - RNA, 13 nt, Homo sapiens
acaaucacacuca

SEQ ID NO: 2207959 - RNA, 20 nt, Homo sapiens
aaaauguaaguugaccuucu

SEQ ID NO: 2207960 - RNA, 14 nt, Homo sapiens
cagcccuugaggga

SEQ ID NO: 2207961 - RNA, 16 nt, Homo sapiens
cagagaaccagugcag

SEQ ID NO: 2207962 - RNA, 14 nt, Homo sapiens
cagauggucccauu

SEQ ID NO: 2207963 - RNA, 21 nt, Homo sapiens
gcuuugacuggaggguccauu

SEQ ID NO: 2207964 - RNA, 16 nt, Homo sapiens
aggcucuaauguacaa

SEQ ID NO: 2207965 - RNA, 22 nt, Homo sapiens
agaagguuggugaauuucacaa

SEQ ID NO: 2207966 - RNA, 13 nt, Homo sapiens
cuguacagugaau

SEQ ID NO: 2207967 - RNA, 15 nt, Homo sapiens
gcagaugggaacuga

SEQ ID NO: 2207968 - RNA, 23 nt, Homo sapiens
ugcuugacaaaggagcauugcag

SEQ ID NO: 2207969 - RNA, 13 nt, Homo sapiens
gucacuugccaca

SEQ ID NO: 2207970 - RNA, 20 nt, Homo sapiens
cuucaggccuugccugggau

SEQ ID NO: 2207971 - RNA, 15 nt, Homo sapiens
ucugcuucucggggu

SEQ ID NO: 2207972 - RNA, 17 nt, Homo sapiens
uaucuuguuggacaucu

SEQ ID NO: 2207973 - RNA, 17 nt, Homo sapiens
uuaaaacauugguuaua

SEQ ID NO: 2207974 - RNA, 15 nt, Homo sapiens
auugcacgugcaaua

SEQ ID NO: 2207975 - RNA, 11 nt, Homo sapiens
uucccauaaca

SEQ ID NO: 2207976 - RNA, 18 nt, Homo sapiens
aggcuucuccgcccauuc

SEQ ID NO: 2207977 - RNA, 14 nt, Homo sapiens
uucuguugauccca

SEQ ID NO: 2207978 - RNA, 21 nt, Homo sapiens
agaauacccaggaagacuuug

SEQ ID NO: 2207979 - RNA, 18 nt, Homo sapiens
ggaaucccacuaaugcaa

SEQ ID NO: 2207980 - RNA, 17 nt, Homo sapiens
auuuguucagaucucau

SEQ ID NO: 2207981 - RNA, 19 nt, Homo sapiens
aaacaagaugaaauuccau

SEQ ID NO: 2207982 - RNA, 16 nt, Homo sapiens
uuacccaguauuccau

SEQ ID NO: 2207983 - RNA, 21 nt, Homo sapiens
cuuaauucagucucagcugcu

SEQ ID NO: 2207984 - RNA, 14 nt, Homo sapiens
ugggggccuccuca

SEQ ID NO: 2207985 - RNA, 20 nt, Homo sapiens
uuggacaacugcauggagcu

SEQ ID NO: 2207986 - RNA, 14 nt, Homo sapiens
cagggcaguaucuc

SEQ ID NO: 2207987 - RNA, 16 nt, Homo sapiens
cuucucuuugucccca

SEQ ID NO: 2207988 - RNA, 23 nt, Homo sapiens
uuuaaguuugugucguuccuuaa

SEQ ID NO: 2207989 - RNA, 13 nt, Homo sapiens
acaaaucguccaa

SEQ ID NO: 2207990 - RNA, 19 nt, Homo sapiens
acccaauuccacucugaua

SEQ ID NO: 2207991 - RNA, 15 nt, Homo sapiens
uuuccacuacugcua

SEQ ID NO: 2207992 - RNA, 17 nt, Homo sapiens
auugcaguucauacuga

SEQ ID NO: 2207993 - RNA, 16 nt, Homo sapiens
uaccuuaaaucugccu

SEQ ID NO: 2207994 - RNA, 20 nt, Homo sapiens
cacauagaacugaacuguaa

SEQ ID NO: 2207995 - RNA, 22 nt, Homo sapiens
aaauaagccuugaaaaagaaca

SEQ ID NO: 2207996 - RNA, 18 nt, Homo sapiens
cuccucugcuccaacaga

SEQ ID NO: 2207997 - RNA, 15 nt, Homo sapiens
auggugaacugucau

SEQ ID NO: 2207998 - RNA, 19 nt, Homo sapiens
acaagccauuuacuuugca

SEQ ID NO: 2207999 - RNA, 14 nt, Homo sapiens
acccugggaccaca

SEQ ID NO: 2208000 - RNA, 18 nt, Homo sapiens
uuuccauaaauuuggacu

SEQ ID NO: 2208001 - RNA, 15 nt, Homo sapiens
ucaaagacacacagg

SEQ ID NO: 2208002 - RNA, 15 nt, Homo sapiens
acacgggcucaagga

SEQ ID NO: 2208003 - RNA, 13 nt, Homo sapiens
accaccaagccuu

SEQ ID NO: 2208004 - RNA, 13 nt, Homo sapiens
auauucaaguaac

SEQ ID NO: 2208005 - RNA, 11 nt, Homo sapiens
auccacuuugg

SEQ ID NO: 2208006 - RNA, 13 nt, Homo sapiens
aaucugacauauu

SEQ ID NO: 2208007 - RNA, 15 nt, Homo sapiens
gacacuguuugccca

SEQ ID NO: 2208008 - RNA, 16 nt, Homo sapiens
ugaauuaaaacagcug

SEQ ID NO: 2208009 - RNA, 20 nt, Homo sapiens
cuauucugucccuagguguu

SEQ ID NO: 2208010 - RNA, 15 nt, Homo sapiens
gucucacauggugcu

SEQ ID NO: 2208011 - RNA, 23 nt, Homo sapiens
auaauacauugaauuagaaacau

SEQ ID NO: 2208012 - RNA, 17 nt, Homo sapiens
aaguugcucugaaguca

SEQ ID NO: 2208013 - RNA, 11 nt, Homo sapiens
uugacuuuguc

SEQ ID NO: 2208014 - RNA, 16 nt, Homo sapiens
uccuccaucuuagaua

SEQ ID NO: 2208015 - RNA, 23 nt, Homo sapiens
gcaaggcuguggaccauggagug

SEQ ID NO: 2208016 - RNA, 20 nt, Homo sapiens
uccagaaccgacgcaugaag

SEQ ID NO: 2208017 - RNA, 14 nt, Homo sapiens
ucaauaaagcuccu

SEQ ID NO: 2208018 - RNA, 12 nt, Homo sapiens
aagcgcagagaa

SEQ ID NO: 2208019 - RNA, 12 nt, Homo sapiens
auagacauguag

SEQ ID NO: 2208020 - RNA, 12 nt, Homo sapiens
ggaaacauagaa

SEQ ID NO: 2208021 - RNA, 15 nt, Homo sapiens
cacuagcauccacug

SEQ ID NO: 2208022 - RNA, 14 nt, Homo sapiens
aggagacacuguuc

SEQ ID NO: 2208023 - RNA, 21 nt, Homo sapiens
ucucccucuuuuucucuguau

SEQ ID NO: 2208024 - RNA, 20 nt, Homo sapiens
cauuuauucaaaguuaaaag

SEQ ID NO: 2208025 - RNA, 23 nt, Homo sapiens
gaaccuucuuaacaucacugucu

SEQ ID NO: 2208026 - RNA, 21 nt, Homo sapiens
ugagugagaggguuugaguca

SEQ ID NO: 2208027 - RNA, 17 nt, Homo sapiens
cgucaaagcugaaaugg

SEQ ID NO: 2208028 - RNA, 22 nt, Homo sapiens
cccaugaguagugcccacuuga

SEQ ID NO: 2208029 - RNA, 19 nt, Homo sapiens
cagugucuguguacaugua

SEQ ID NO: 2208030 - RNA, 16 nt, Homo sapiens
aaauauuuugucuaaa

SEQ ID NO: 2208031 - RNA, 19 nt, Homo sapiens
ccucgacguuuacaagccc

SEQ ID NO: 2208032 - RNA, 21 nt, Homo sapiens
cuuuuuaaauauuucuacuaa

SEQ ID NO: 2208033 - RNA, 20 nt, Homo sapiens
uccacauccuuucuaaacaa

SEQ ID NO: 2208034 - RNA, 11 nt, Homo sapiens
cagugcaagag

SEQ ID NO: 2208035 - RNA, 21 nt, Homo sapiens
aaacugccuuggcuucagggg

SEQ ID NO: 2208036 - RNA, 19 nt, Homo sapiens
gguccuucaaacaauguaa

SEQ ID NO: 2208037 - RNA, 12 nt, Homo sapiens
ggaaaccacagu

SEQ ID NO: 2208038 - RNA, 18 nt, Homo sapiens
aaaggucuaucuacuaaa

SEQ ID NO: 2208039 - RNA, 17 nt, Homo sapiens
ccccacuucccacuugc

SEQ ID NO: 2208040 - RNA, 18 nt, Homo sapiens
augaaagaaaauugaguu

SEQ ID NO: 2208041 - RNA, 22 nt, Homo sapiens
ucuucucugcugaguuugccuu

SEQ ID NO: 2208042 - RNA, 22 nt, Homo sapiens
ugaaucacaguauacgcuccau

SEQ ID NO: 2208043 - RNA, 16 nt, Homo sapiens
uccugcgugugcccac

SEQ ID NO: 2208044 - RNA, 17 nt, Homo sapiens
accagguccauuuugcc

SEQ ID NO: 2208045 - RNA, 17 nt, Homo sapiens
gaccucaggugcuaggg

SEQ ID NO: 2208046 - RNA, 15 nt, Homo sapiens
cacuaaauccccuca

SEQ ID NO: 2208047 - RNA, 19 nt, Homo sapiens
aaggacgagggaugggauu

SEQ ID NO: 2208048 - RNA, 20 nt, Homo sapiens
cuuccuguguaccucuagaa

SEQ ID NO: 2208049 - RNA, 14 nt, Homo sapiens
acugugcaucuccu

SEQ ID NO: 2208050 - RNA, 12 nt, Homo sapiens
gaacauguccua

SEQ ID NO: 2208051 - RNA, 17 nt, Homo sapiens
agacaaguuccauggga

SEQ ID NO: 2208052 - RNA, 13 nt, Homo sapiens
caauuucccuuca

SEQ ID NO: 2208053 - RNA, 23 nt, Homo sapiens
aaacuguaucaucuuugccaagu

SEQ ID NO: 2208054 - RNA, 19 nt, Homo sapiens
uaagugcaauuaacauaug

SEQ ID NO: 2208055 - RNA, 23 nt, Homo sapiens
ucaaagaggcugaggcuggcaca

SEQ ID NO: 2208056 - RNA, 14 nt, Homo sapiens
uuagacaccuauca

SEQ ID NO: 2208057 - RNA, 19 nt, Homo sapiens
ccagggccugggggcagug

SEQ ID NO: 2208058 - RNA, 19 nt, Homo sapiens
aguccucccagacuaccug

SEQ ID NO: 2208059 - RNA, 13 nt, Homo sapiens
aagaaaaaccacg

SEQ ID NO: 2208060 - RNA, 13 nt, Homo sapiens
cagagaaaacaca

SEQ ID NO: 2208061 - RNA, 20 nt, Homo sapiens
agugagcugagaucaugcca

SEQ ID NO: 2208062 - RNA, 14 nt, Homo sapiens
accucuucucuucc

SEQ ID NO: 2208063 - RNA, 14 nt, Homo sapiens
uccccuucacuccc

SEQ ID NO: 2208064 - RNA, 15 nt, Homo sapiens
gcuuuguuucugcau

SEQ ID NO: 2208065 - RNA, 21 nt, Homo sapiens
aaacuuauaaucaauacaaac

SEQ ID NO: 2208066 - RNA, 16 nt, Homo sapiens
ucaauguccuacugag

SEQ ID NO: 2208067 - RNA, 13 nt, Homo sapiens
ccuuccccagaga

SEQ ID NO: 2208068 - RNA, 18 nt, Homo sapiens
cauuaucuuugcuguuau

SEQ ID NO: 2208069 - RNA, 16 nt, Homo sapiens
ggaagacuauggugcu

SEQ ID NO: 2208070 - RNA, 17 nt, Homo sapiens
caguaaccuagugaauu

SEQ ID NO: 2208071 - RNA, 15 nt, Homo sapiens
uccuguaacuuuuaa

SEQ ID NO: 2208072 - RNA, 15 nt, Homo sapiens
ccaagaguaacuuua

SEQ ID NO: 2208073 - RNA, 22 nt, Homo sapiens
caaggcugccagguguggaaca

SEQ ID NO: 2208074 - RNA, 14 nt, Homo sapiens
cucacgauuccagu

SEQ ID NO: 2208075 - RNA, 21 nt, Homo sapiens
auauguuguucuuacaaacca

SEQ ID NO: 2208076 - RNA, 14 nt, Homo sapiens
cuggccaggccucc

SEQ ID NO: 2208077 - RNA, 12 nt, Homo sapiens
ccaaauugcagc

SEQ ID NO: 2208078 - RNA, 12 nt, Homo sapiens
ucaucacuggau

SEQ ID NO: 2208079 - RNA, 20 nt, Homo sapiens
uccaguuugaagaccaauca

SEQ ID NO: 2208080 - RNA, 22 nt, Homo sapiens
ucauguggguucaugcacagua

SEQ ID NO: 2208081 - RNA, 17 nt, Homo sapiens
uguacgcuuugcucaaa

SEQ ID NO: 2208082 - RNA, 16 nt, Homo sapiens
aacacuaagcucucug

SEQ ID NO: 2208083 - RNA, 20 nt, Homo sapiens
cccaggcugcccacucuggg

SEQ ID NO: 2208084 - RNA, 16 nt, Homo sapiens
cagagauaaagaccuu

SEQ ID NO: 2208085 - RNA, 14 nt, Homo sapiens
aaggcauucaucuu

SEQ ID NO: 2208086 - RNA, 17 nt, Homo sapiens
uuaguacagguuacuca

SEQ ID NO: 2208087 - RNA, 20 nt, Homo sapiens
cacugcaaauaaacuuggua

SEQ ID NO: 2208088 - RNA, 18 nt, Homo sapiens
accccagccucacuccau

SEQ ID NO: 2208089 - RNA, 18 nt, Homo sapiens
acauugcuuuacugucaa

SEQ ID NO: 2208090 - RNA, 14 nt, Homo sapiens
auagaaaauuaugc

SEQ ID NO: 2208091 - RNA, 23 nt, Homo sapiens
cccaccuuuuuucuuugguugcu

SEQ ID NO: 2208092 - RNA, 22 nt, Homo sapiens
uaaauugggcuucaaucacugu

SEQ ID NO: 2208093 - RNA, 15 nt, Homo sapiens
uagguaggcaccaca

SEQ ID NO: 2208094 - RNA, 21 nt, Homo sapiens
caaucuguccuguuacaaaag

SEQ ID NO: 2208095 - RNA, 20 nt, Homo sapiens
gacagggacaugcccugugu

SEQ ID NO: 2208096 - RNA, 16 nt, Homo sapiens
uaaaagaucuugaaua

SEQ ID NO: 2208097 - RNA, 12 nt, Homo sapiens
ucccuggaugac

SEQ ID NO: 2208098 - RNA, 15 nt, Homo sapiens
auacugaaagaucuc

SEQ ID NO: 2208099 - RNA, 12 nt, Homo sapiens
uguggcauucau

SEQ ID NO: 2208100 - RNA, 17 nt, Homo sapiens
uggacuuccagugcuca

SEQ ID NO: 2208101 - RNA, 20 nt, Homo sapiens
gcucuggauccugcacucua

SEQ ID NO: 2208102 - RNA, 13 nt, Homo sapiens
ccaucugcuuaca

SEQ ID NO: 2208103 - RNA, 12 nt, Homo sapiens
caguagcugcua

SEQ ID NO: 2208104 - RNA, 23 nt, Homo sapiens
gaccaacugguuugccuauaauu

SEQ ID NO: 2208105 - RNA, 17 nt, Homo sapiens
aauaaacaccauuucau

SEQ ID NO: 2208106 - RNA, 17 nt, Homo sapiens
cugcaagcaaucaaaua

SEQ ID NO: 2208107 - RNA, 19 nt, Homo sapiens
gaacccaucgguaggcaaa

SEQ ID NO: 2208108 - RNA, 19 nt, Homo sapiens
cuccuggccucauacagaa

SEQ ID NO: 2208109 - RNA, 20 nt, Homo sapiens
auauucccuuguauggauau

SEQ ID NO: 2208110 - RNA, 13 nt, Homo sapiens
auuucaugugauc

SEQ ID NO: 2208111 - RNA, 19 nt, Homo sapiens
gccuuccagccacaucgcc

SEQ ID NO: 2208112 - RNA, 22 nt, Homo sapiens
acuuuugccauugacuucuucc

SEQ ID NO: 2208113 - RNA, 22 nt, Homo sapiens
cacauuguuauuuucagugaua

SEQ ID NO: 2208114 - RNA, 15 nt, Homo sapiens
gaaccuugcuguccu

SEQ ID NO: 2208115 - RNA, 22 nt, Homo sapiens
uagaugacaaccuccauucuau

SEQ ID NO: 2208116 - RNA, 14 nt, Homo sapiens
agcaugaaagugga

SEQ ID NO: 2208117 - RNA, 20 nt, Homo sapiens
aggaaaaucuuaaaauucuu

SEQ ID NO: 2208118 - RNA, 13 nt, Homo sapiens
gagcuuagcauau

SEQ ID NO: 2208119 - RNA, 22 nt, Homo sapiens
accuugaccgacaugaacugua

SEQ ID NO: 2208120 - RNA, 20 nt, Homo sapiens
uucaggacacagggaaauca

SEQ ID NO: 2208121 - RNA, 20 nt, Homo sapiens
aaccaguccccccacccuca

SEQ ID NO: 2208122 - RNA, 16 nt, Homo sapiens
cugugacacuuaucuc

SEQ ID NO: 2208123 - RNA, 14 nt, Homo sapiens
guccccaccuggga

SEQ ID NO: 2208124 - RNA, 14 nt, Homo sapiens
gcccccacccggga

SEQ ID NO: 2208125 - RNA, 14 nt, Homo sapiens
cacagaagaugaag

SEQ ID NO: 2208126 - RNA, 23 nt, Homo sapiens
ccuucauaaaacucuagcauucu

SEQ ID NO: 2208127 - RNA, 15 nt, Homo sapiens
gauuuuaccaaagca

SEQ ID NO: 2208128 - RNA, 23 nt, Homo sapiens
cccuggucuccuccccguagcca

SEQ ID NO: 2208129 - RNA, 22 nt, Homo sapiens
cugcccugcucugcccaggcaa

SEQ ID NO: 2208130 - RNA, 16 nt, Homo sapiens
cacggcccugccccau

SEQ ID NO: 2208131 - RNA, 15 nt, Homo sapiens
auguguugcuauccu

SEQ ID NO: 2208132 - RNA, 12 nt, Homo sapiens
ggaaggggcaaa

SEQ ID NO: 2208133 - RNA, 23 nt, Homo sapiens
ugcaguuuuagacucagcauugu

SEQ ID NO: 2208134 - RNA, 15 nt, Homo sapiens
ucuuguauugcucca

SEQ ID NO: 2208135 - RNA, 21 nt, Homo sapiens
accaagaacagagucucagga

SEQ ID NO: 2208136 - RNA, 18 nt, Homo sapiens
uagcagauuuaagauaug

SEQ ID NO: 2208137 - RNA, 22 nt, Homo sapiens
uucuguggagggagggcagcug

SEQ ID NO: 2208138 - RNA, 22 nt, Homo sapiens
auuugauugggaugaaugccau

SEQ ID NO: 2208139 - RNA, 17 nt, Homo sapiens
caaacucuccaccacac

SEQ ID NO: 2208140 - RNA, 15 nt, Homo sapiens
agucccagcuacuca

SEQ ID NO: 2208141 - RNA, 23 nt, Homo sapiens
cugugcccccagccucagcccaa

SEQ ID NO: 2208142 - RNA, 11 nt, Homo sapiens
cugcugugauu

SEQ ID NO: 2208143 - RNA, 15 nt, Homo sapiens
cuccuccguggcaca

SEQ ID NO: 2208144 - RNA, 18 nt, Homo sapiens
ugaucuaugcuauauuca

SEQ ID NO: 2208145 - RNA, 20 nt, Homo sapiens
ucuggggugcugagugagcu

SEQ ID NO: 2208146 - RNA, 17 nt, Homo sapiens
ggaggacagagugcccu

SEQ ID NO: 2208147 - RNA, 22 nt, Homo sapiens
cucuuccgguuggaggcucuca

SEQ ID NO: 2208148 - RNA, 17 nt, Homo sapiens
agcguguacuaccccag

SEQ ID NO: 2208149 - RNA, 15 nt, Homo sapiens
cucuuuccuucuugc

SEQ ID NO: 2208150 - RNA, 18 nt, Homo sapiens
ccagaagcuguacuuuua

SEQ ID NO: 2208151 - RNA, 22 nt, Homo sapiens
acagcuuuguaauaagaaaaau

SEQ ID NO: 2208152 - RNA, 16 nt, Homo sapiens
aguccucacuguccug

SEQ ID NO: 2208153 - RNA, 20 nt, Homo sapiens
gguuaugugcauuauucaua

SEQ ID NO: 2208154 - RNA, 14 nt, Homo sapiens
ccugugagagccac

SEQ ID NO: 2208155 - RNA, 13 nt, Homo sapiens
ccacagcugugca

SEQ ID NO: 2208156 - RNA, 15 nt, Homo sapiens
ugcuugaacuaggcu

SEQ ID NO: 2208157 - RNA, 17 nt, Homo sapiens
gcacacuggcucaccca

SEQ ID NO: 2208158 - RNA, 17 nt, Homo sapiens
uaauuuuguauuuucca

SEQ ID NO: 2208159 - RNA, 18 nt, Homo sapiens
ugggccauguccaaagag

SEQ ID NO: 2208160 - RNA, 20 nt, Homo sapiens
auacuucuuuuucauuauug

SEQ ID NO: 2208161 - RNA, 20 nt, Homo sapiens
uauguuagagaauuuccuua

SEQ ID NO: 2208162 - RNA, 16 nt, Homo sapiens
gugucuggucguuuga

SEQ ID NO: 2208163 - RNA, 14 nt, Homo sapiens
acuggaaacuucag

SEQ ID NO: 2208164 - RNA, 22 nt, Homo sapiens
ccucacccugcccuuguugucu

SEQ ID NO: 2208165 - RNA, 23 nt, Homo sapiens
uuguuaaguccuuggcuugccau

SEQ ID NO: 2208166 - RNA, 14 nt, Homo sapiens
aaagaggugaaaga

SEQ ID NO: 2208167 - RNA, 15 nt, Homo sapiens
agaaauauauauaca

SEQ ID NO: 2208168 - RNA, 21 nt, Homo sapiens
uguaaaacugugacauuccac

SEQ ID NO: 2208169 - RNA, 19 nt, Homo sapiens
auggcagcucacacaggga

SEQ ID NO: 2208170 - RNA, 24 nt, Homo sapiens
uuaggagcagguagggcuuguacu

SEQ ID NO: 2208171 - RNA, 21 nt, Homo sapiens
aaaacuuuaggcccugcccca

SEQ ID NO: 2208172 - RNA, 13 nt, Homo sapiens
caaagaaauagca

SEQ ID NO: 2208173 - RNA, 21 nt, Homo sapiens
aagauuauagauucuaaagau

SEQ ID NO: 2208174 - RNA, 16 nt, Homo sapiens
cagaagugguuuccca

SEQ ID NO: 2208175 - RNA, 15 nt, Homo sapiens
gcaacaaaaauuacu

SEQ ID NO: 2208176 - RNA, 21 nt, Homo sapiens
uuagaauaguguucugcaaaa

SEQ ID NO: 2208177 - RNA, 14 nt, Homo sapiens
auccuggaaggaca

SEQ ID NO: 2208178 - RNA, 18 nt, Homo sapiens
ggcuacucuugacuuaga

SEQ ID NO: 2208179 - RNA, 13 nt, Homo sapiens
ucuauaccugugu

SEQ ID NO: 2208180 - RNA, 21 nt, Homo sapiens
aaaugcgggcauuuaagucug

SEQ ID NO: 2208181 - RNA, 18 nt, Homo sapiens
cccagccccgcccgccug

SEQ ID NO: 2208182 - RNA, 21 nt, Homo sapiens
cuuuaaaaaagaaauuaucuu

SEQ ID NO: 2208183 - RNA, 16 nt, Homo sapiens
gaggaagaaaaacagg

SEQ ID NO: 2208184 - RNA, 20 nt, Homo sapiens
caaacaagcacacgaaaaga

SEQ ID NO: 2208185 - RNA, 23 nt, Homo sapiens
gacauggcuugccacagcucuug

SEQ ID NO: 2208186 - RNA, 11 nt, Homo sapiens
auuuuuguaca

SEQ ID NO: 2208187 - RNA, 17 nt, Homo sapiens
gcauugcuucagaauga

SEQ ID NO: 2208188 - RNA, 23 nt, Homo sapiens
aagauggugggguuguucaccuc

SEQ ID NO: 2208189 - RNA, 15 nt, Homo sapiens
uggggggcacagcca

SEQ ID NO: 2208190 - RNA, 21 nt, Homo sapiens
caauuuacuugccauuacuca

SEQ ID NO: 2208191 - RNA, 14 nt, Homo sapiens
cuggccucagggcu

SEQ ID NO: 2208192 - RNA, 14 nt, Homo sapiens
cagaggcggaaacc

SEQ ID NO: 2208193 - RNA, 21 nt, Homo sapiens
cugggggcaggccagggcagu

SEQ ID NO: 2208194 - RNA, 21 nt, Homo sapiens
aguuuggucccuaaauuugca

SEQ ID NO: 2208195 - RNA, 24 nt, Homo sapiens
accugaauuaaagucuacacugcc

SEQ ID NO: 2208196 - RNA, 12 nt, Homo sapiens
cucagacuguug

SEQ ID NO: 2208197 - RNA, 14 nt, Homo sapiens
gcugcugcugcuaa

SEQ ID NO: 2208198 - RNA, 13 nt, Homo sapiens
caaucguucugcu

SEQ ID NO: 2208199 - RNA, 16 nt, Homo sapiens
ugguuguaauaugcga

SEQ ID NO: 2208200 - RNA, 15 nt, Homo sapiens
gugcuagaugugcaa

SEQ ID NO: 2208201 - RNA, 20 nt, Homo sapiens
cuaauuuuuaccgauguuaa

SEQ ID NO: 2208202 - RNA, 20 nt, Homo sapiens
caccacauucugucucugcu

SEQ ID NO: 2208203 - RNA, 14 nt, Homo sapiens
ucaucuucucagcu

SEQ ID NO: 2208204 - RNA, 18 nt, Homo sapiens
agcucccgggcacaucca

SEQ ID NO: 2208205 - RNA, 19 nt, Homo sapiens
ccugaacuccagagguguc

SEQ ID NO: 2208206 - RNA, 21 nt, Homo sapiens
accucccauuacuuugauauc

SEQ ID NO: 2208207 - RNA, 20 nt, Homo sapiens
ggcuacaaucuucauuuaau

SEQ ID NO: 2208208 - RNA, 21 nt, Homo sapiens
aaauacuuagacaguaugcau

SEQ ID NO: 2208209 - RNA, 13 nt, Homo sapiens
cugguuagguaga

SEQ ID NO: 2208210 - RNA, 21 nt, Homo sapiens
gcguaaguacagagaagccau

SEQ ID NO: 2208211 - RNA, 18 nt, Homo sapiens
aauauuuuagccacucaa

SEQ ID NO: 2208212 - RNA, 22 nt, Homo sapiens
agauguuacugugugaagaaua

SEQ ID NO: 2208213 - RNA, 23 nt, Homo sapiens
caaagaucaaaauaaaaagugac

SEQ ID NO: 2208214 - RNA, 15 nt, Homo sapiens
aucagugccucuuug

SEQ ID NO: 2208215 - RNA, 10 nt, Homo sapiens
caguuugaua

SEQ ID NO: 2208216 - RNA, 16 nt, Homo sapiens
cagcacugaaguccag

SEQ ID NO: 2208217 - RNA, 23 nt, Homo sapiens
ucacaaaucuuaacuugaaggag

SEQ ID NO: 2208218 - RNA, 18 nt, Homo sapiens
ccguggcuaagagugucc

SEQ ID NO: 2208219 - RNA, 20 nt, Homo sapiens
augaaaggcaggccuauuuc

SEQ ID NO: 2208220 - RNA, 20 nt, Homo sapiens
gcccuuaauaauaaugccaa

SEQ ID NO: 2208221 - RNA, 14 nt, Homo sapiens
gagacacaucuccu

SEQ ID NO: 2208222 - RNA, 12 nt, Homo sapiens
gcgccaggacag

SEQ ID NO: 2208223 - RNA, 20 nt, Homo sapiens
cucccacggggaccacuggg

SEQ ID NO: 2208224 - RNA, 18 nt, Homo sapiens
aaagcagugcaguacuca

SEQ ID NO: 2208225 - RNA, 16 nt, Homo sapiens
caaagacacaggaaga

SEQ ID NO: 2208226 - RNA, 17 nt, Homo sapiens
caaagacccagagcaaa

SEQ ID NO: 2208227 - RNA, 13 nt, Homo sapiens
uguuaacacucau

SEQ ID NO: 2208228 - RNA, 15 nt, Homo sapiens
agcauguagccaguu

SEQ ID NO: 2208229 - RNA, 16 nt, Homo sapiens
aauguccuuggcauca

SEQ ID NO: 2208230 - RNA, 16 nt, Homo sapiens
guucuuugggccagac

SEQ ID NO: 2208231 - RNA, 15 nt, Homo sapiens
augacacuaaacucc

SEQ ID NO: 2208232 - RNA, 19 nt, Homo sapiens
cugcagacucacuguggga

SEQ ID NO: 2208233 - RNA, 22 nt, Homo sapiens
cucaaaaggagaacugugcucu

SEQ ID NO: 2208234 - RNA, 15 nt, Homo sapiens
aacaccccacugagc

SEQ ID NO: 2208235 - RNA, 14 nt, Homo sapiens
ccugacaugcacac

SEQ ID NO: 2208236 - RNA, 21 nt, Homo sapiens
uugaagaagcucuuuugggua

SEQ ID NO: 2208237 - RNA, 22 nt, Homo sapiens
aaaacucccaauggauaaauca

SEQ ID NO: 2208238 - RNA, 13 nt, Homo sapiens
aggaggaugccac

SEQ ID NO: 2208239 - RNA, 17 nt, Homo sapiens
ccagaucagacuuuaau

SEQ ID NO: 2208240 - RNA, 19 nt, Homo sapiens
auuuauucuucuuuuccaa

SEQ ID NO: 2208241 - RNA, 14 nt, Homo sapiens
gaucacucucugcu

SEQ ID NO: 2208242 - RNA, 13 nt, Homo sapiens
cuguagcucuccu

SEQ ID NO: 2208243 - RNA, 15 nt, Homo sapiens
gaaagugcuuuccag

SEQ ID NO: 2208244 - RNA, 22 nt, Homo sapiens
aaacauguggcaaccuguucuu

SEQ ID NO: 2208245 - RNA, 17 nt, Homo sapiens
uaggugagcuauaguga

SEQ ID NO: 2208246 - RNA, 22 nt, Homo sapiens
cuuugaaaacaugacucaauaa

SEQ ID NO: 2208247 - RNA, 23 nt, Homo sapiens
uggagaacuaaagguggccacaa

SEQ ID NO: 2208248 - RNA, 23 nt, Homo sapiens
augagcaagccuagguacgaaga

SEQ ID NO: 2208249 - RNA, 22 nt, Homo sapiens
cugggagugauaugauguguag

SEQ ID NO: 2208250 - RNA, 21 nt, Homo sapiens
agagcugugccugcucagcag

SEQ ID NO: 2208251 - RNA, 13 nt, Homo sapiens
uaaugcacucuca

SEQ ID NO: 2208252 - RNA, 19 nt, Homo sapiens
guaagaaauauuacuauaa

SEQ ID NO: 2208253 - RNA, 15 nt, Homo sapiens
ccugcucccagggac

SEQ ID NO: 2208254 - RNA, 14 nt, Homo sapiens
auuaaagacagagg

SEQ ID NO: 2208255 - RNA, 18 nt, Homo sapiens
cuggaugugcaucuggcc

SEQ ID NO: 2208256 - RNA, 22 nt, Homo sapiens
acacggacucccgggccacgcc

SEQ ID NO: 2208257 - RNA, 11 nt, Homo sapiens
ggcuuagucug

SEQ ID NO: 2208258 - RNA, 18 nt, Homo sapiens
aaccgacuuuucuaaagc

SEQ ID NO: 2208259 - RNA, 15 nt, Homo sapiens
aagauggagaaacaa

SEQ ID NO: 2208260 - RNA, 12 nt, Homo sapiens
ggcucacacagc

SEQ ID NO: 2208261 - RNA, 18 nt, Homo sapiens
uagacacguguuguucca

SEQ ID NO: 2208262 - RNA, 17 nt, Homo sapiens
aaggaggaagaauaggg

SEQ ID NO: 2208263 - RNA, 19 nt, Homo sapiens
auaaauguuuuauuucuag

SEQ ID NO: 2208264 - RNA, 22 nt, Homo sapiens
uguucacguguuuuccauccca

SEQ ID NO: 2208265 - RNA, 17 nt, Homo sapiens
gucauggacuguugcca

SEQ ID NO: 2208266 - RNA, 20 nt, Homo sapiens
uuucaaaugcaguccaguga

SEQ ID NO: 2208267 - RNA, 21 nt, Homo sapiens
gagcaucuccagugcucccca

SEQ ID NO: 2208268 - RNA, 15 nt, Homo sapiens
aaucaacaugcuuua

SEQ ID NO: 2208269 - RNA, 14 nt, Homo sapiens
aggccacuggggac

SEQ ID NO: 2208270 - RNA, 21 nt, Homo sapiens
aaaauuuacaauuugacauac

SEQ ID NO: 2208271 - RNA, 23 nt, Homo sapiens
acgggguuucaccacauucguca

SEQ ID NO: 2208272 - RNA, 22 nt, Homo sapiens
cacugaaaaaucuaagugauau

SEQ ID NO: 2208273 - RNA, 16 nt, Homo sapiens
auccagucacagccau

SEQ ID NO: 2208274 - RNA, 16 nt, Homo sapiens
uaauucaaaacauguu

SEQ ID NO: 2208275 - RNA, 19 nt, Homo sapiens
uagggaagguauaucagga

SEQ ID NO: 2208276 - RNA, 18 nt, Homo sapiens
cuugccuugcugaacucc

SEQ ID NO: 2208277 - RNA, 16 nt, Homo sapiens
cucacaagcaugaagu

SEQ ID NO: 2208278 - RNA, 20 nt, Homo sapiens
aguauagagaaaaguguauu

SEQ ID NO: 2208279 - RNA, 19 nt, Homo sapiens
uagacauuuuugugccauu

SEQ ID NO: 2208280 - RNA, 16 nt, Homo sapiens
cccgguguaugcagug

SEQ ID NO: 2208281 - RNA, 14 nt, Homo sapiens
aacuaccuuccacu

SEQ ID NO: 2208282 - RNA, 15 nt, Homo sapiens
agaugguccgugccc

SEQ ID NO: 2208283 - RNA, 18 nt, Homo sapiens
ccaaacugagacucuuaa

SEQ ID NO: 2208284 - RNA, 22 nt, Homo sapiens
gaggcugaggcaggagaauggc

SEQ ID NO: 2208285 - RNA, 14 nt, Homo sapiens
caucuuuggcugag

SEQ ID NO: 2208286 - RNA, 14 nt, Homo sapiens
ccucuguggaugau

SEQ ID NO: 2208287 - RNA, 21 nt, Homo sapiens
auugguccgaucuuugacucu

SEQ ID NO: 2208288 - RNA, 16 nt, Homo sapiens
uuauaaauaucaugca

SEQ ID NO: 2208289 - RNA, 17 nt, Homo sapiens
cugauuaggacuuuuau

SEQ ID NO: 2208290 - RNA, 21 nt, Homo sapiens
uguucacaacauaaggagaau

SEQ ID NO: 2208291 - RNA, 16 nt, Homo sapiens
agucugaaagacagaa

SEQ ID NO: 2208292 - RNA, 14 nt, Homo sapiens
acugggugccacgg

SEQ ID NO: 2208293 - RNA, 15 nt, Homo sapiens
uuuuuguacuuugcu

SEQ ID NO: 2208294 - RNA, 15 nt, Homo sapiens
cucagugcacgagcu

SEQ ID NO: 2208295 - RNA, 19 nt, Homo sapiens
uucauaauaucuaugcuga

SEQ ID NO: 2208296 - RNA, 12 nt, Homo sapiens
uggagacugaca

SEQ ID NO: 2208297 - RNA, 14 nt, Homo sapiens
uagaucacaacuga

SEQ ID NO: 2208298 - RNA, 21 nt, Homo sapiens
ugggauauuacaaauaaagcu

SEQ ID NO: 2208299 - RNA, 16 nt, Homo sapiens
aguuaauaacagcucc

SEQ ID NO: 2208300 - RNA, 15 nt, Homo sapiens
cuacaugaacacguc

SEQ ID NO: 2208301 - RNA, 16 nt, Homo sapiens
gcaggacaacacagcu

SEQ ID NO: 2208302 - RNA, 19 nt, Homo sapiens
gcuucuguaguacuccuua

SEQ ID NO: 2208303 - RNA, 16 nt, Homo sapiens
uguauucuucaaccuc

SEQ ID NO: 2208304 - RNA, 20 nt, Homo sapiens
agaagccuagugugugugcu

SEQ ID NO: 2208305 - RNA, 16 nt, Homo sapiens
ugucaguuucauggag

SEQ ID NO: 2208306 - RNA, 15 nt, Homo sapiens
aggagugguucucau

SEQ ID NO: 2208307 - RNA, 17 nt, Homo sapiens
ggcaaaaacaaaacucu

SEQ ID NO: 2208308 - RNA, 22 nt, Homo sapiens
agugcuaagaaagcaagccaau

SEQ ID NO: 2208309 - RNA, 14 nt, Homo sapiens
aaagcuauuucaga

SEQ ID NO: 2208310 - RNA, 16 nt, Homo sapiens
ccugagccugucucuc

SEQ ID NO: 2208311 - RNA, 14 nt, Homo sapiens
uauccuguauguaa

SEQ ID NO: 2208312 - RNA, 19 nt, Homo sapiens
aacuuauucuccaucucaa

SEQ ID NO: 2208313 - RNA, 21 nt, Homo sapiens
uauucccccaucuucauccca

SEQ ID NO: 2208314 - RNA, 21 nt, Homo sapiens
aacagaauuuuuuaaauugac

SEQ ID NO: 2208315 - RNA, 22 nt, Homo sapiens
aagggcgcugagggcaggguuc

SEQ ID NO: 2208316 - RNA, 15 nt, Homo sapiens
uggauuuaguuucag

SEQ ID NO: 2208317 - RNA, 13 nt, Homo sapiens
ugguaaaaacugc

SEQ ID NO: 2208318 - RNA, 16 nt, Homo sapiens
aucccaacauucugca

SEQ ID NO: 2208319 - RNA, 17 nt, Homo sapiens
cuaaauauaaauuuuca

SEQ ID NO: 2208320 - RNA, 12 nt, Homo sapiens
ccccaauccauc

SEQ ID NO: 2208321 - RNA, 23 nt, Homo sapiens
agaauguauuguaccuuuuaaca

SEQ ID NO: 2208322 - RNA, 21 nt, Homo sapiens
auagagucaagcucugucacc

SEQ ID NO: 2208323 - RNA, 16 nt, Homo sapiens
gguuucacuugcacau

SEQ ID NO: 2208324 - RNA, 19 nt, Homo sapiens
acauacgaaacacaaacca

SEQ ID NO: 2208325 - RNA, 12 nt, Homo sapiens
auugucacccca

SEQ ID NO: 2208326 - RNA, 21 nt, Homo sapiens
cucuggcuuugucucuagccg

SEQ ID NO: 2208327 - RNA, 17 nt, Homo sapiens
auacacuggaauucaga

SEQ ID NO: 2208328 - RNA, 13 nt, Homo sapiens
uuaaccuuaucag

SEQ ID NO: 2208329 - RNA, 22 nt, Homo sapiens
guaauggaaugcaaaaaagcca

SEQ ID NO: 2208330 - RNA, 18 nt, Homo sapiens
ugaucacggcucacugca

SEQ ID NO: 2208331 - RNA, 20 nt, Homo sapiens
ucugcacuaauugacccaaa

SEQ ID NO: 2208332 - RNA, 16 nt, Homo sapiens
ggccccgagucacuca

SEQ ID NO: 2208333 - RNA, 11 nt, Homo sapiens
ccucccggggc

SEQ ID NO: 2208334 - RNA, 21 nt, Homo sapiens
cacaucccauugggacuccau

SEQ ID NO: 2208335 - RNA, 19 nt, Homo sapiens
ucugguaggaauagcaugu

SEQ ID NO: 2208336 - RNA, 13 nt, Homo sapiens
cuauuauauucau

SEQ ID NO: 2208337 - RNA, 22 nt, Homo sapiens
cugaaaaaugccugcugcugcc

SEQ ID NO: 2208338 - RNA, 13 nt, Homo sapiens
agugugugucuuu

SEQ ID NO: 2208339 - RNA, 20 nt, Homo sapiens
gcccugauguguccucaggg

SEQ ID NO: 2208340 - RNA, 15 nt, Homo sapiens
ccaaggccaaaggaa

SEQ ID NO: 2208341 - RNA, 12 nt, Homo sapiens
gagaagugcuuu

SEQ ID NO: 2208342 - RNA, 23 nt, Homo sapiens
agcauuuccaacaccacagacac

SEQ ID NO: 2208343 - RNA, 20 nt, Homo sapiens
aacuacuaaagugccuaccc

SEQ ID NO: 2208344 - RNA, 23 nt, Homo sapiens
cgucacaaagaccuugcugauaa

SEQ ID NO: 2208345 - RNA, 15 nt, Homo sapiens
guucuccuuccucag

SEQ ID NO: 2208346 - RNA, 18 nt, Homo sapiens
caaagagaauguauuucc

SEQ ID NO: 2208347 - RNA, 20 nt, Homo sapiens
uaaauaaauuaugcuucaua

SEQ ID NO: 2208348 - RNA, 12 nt, Homo sapiens
auuuacauguau

SEQ ID NO: 2208349 - RNA, 21 nt, Homo sapiens
uugcacaugucuuaaugaagu

SEQ ID NO: 2208350 - RNA, 17 nt, Homo sapiens
ucaaaguacuacagcaa

SEQ ID NO: 2208351 - RNA, 22 nt, Homo sapiens
aggaaccaacaaggaaacuuuc

SEQ ID NO: 2208352 - RNA, 14 nt, Homo sapiens
uccauuuacugcau

SEQ ID NO: 2208353 - RNA, 13 nt, Homo sapiens
aguugaucugcuc

SEQ ID NO: 2208354 - RNA, 21 nt, Homo sapiens
uaggcaugguggacucgccug

SEQ ID NO: 2208355 - RNA, 18 nt, Homo sapiens
ucuuaagccuaaaugccu

SEQ ID NO: 2208356 - RNA, 21 nt, Homo sapiens
uaauuuuagagaaacuuugag

SEQ ID NO: 2208357 - RNA, 19 nt, Homo sapiens
ggugccacucccugagcuu

SEQ ID NO: 2208358 - RNA, 14 nt, Homo sapiens
uggaagcacauguu

SEQ ID NO: 2208359 - RNA, 23 nt, Homo sapiens
cacuguguuuauaugucuugcaa

SEQ ID NO: 2208360 - RNA, 17 nt, Homo sapiens
gguuugacauugcuaag

SEQ ID NO: 2208361 - RNA, 22 nt, Homo sapiens
ccuguaggguuuggacagaccc

SEQ ID NO: 2208362 - RNA, 14 nt, Homo sapiens
ucucaaacacugcu

SEQ ID NO: 2208363 - RNA, 16 nt, Homo sapiens
uccugccauagucuua

SEQ ID NO: 2208364 - RNA, 17 nt, Homo sapiens
agccccucacauuccua

SEQ ID NO: 2208365 - RNA, 20 nt, Homo sapiens
auaucccuuucucucuuguc

SEQ ID NO: 2208366 - RNA, 14 nt, Homo sapiens
uaaaagguauugag

SEQ ID NO: 2208367 - RNA, 16 nt, Homo sapiens
uuccuucccugggaag

SEQ ID NO: 2208368 - RNA, 14 nt, Homo sapiens
ccuaaaaacuggca

SEQ ID NO: 2208369 - RNA, 13 nt, Homo sapiens
aucaauaaauucc

SEQ ID NO: 2208370 - RNA, 13 nt, Homo sapiens
cuggucacuucaa

SEQ ID NO: 2208371 - RNA, 17 nt, Homo sapiens
ccuuuuuucaauaugca

SEQ ID NO: 2208372 - RNA, 14 nt, Homo sapiens
acugaaaagccaug

SEQ ID NO: 2208373 - RNA, 15 nt, Homo sapiens
uaacacaguguuuca

SEQ ID NO: 2208374 - RNA, 22 nt, Homo sapiens
cacagcuguauagcugcuucca

SEQ ID NO: 2208375 - RNA, 22 nt, Homo sapiens
ccuuuacuuucucucuccucuu

SEQ ID NO: 2208376 - RNA, 17 nt, Homo sapiens
gcucugcuggucuucaa

SEQ ID NO: 2208377 - RNA, 15 nt, Homo sapiens
auuuuguaccagugg

SEQ ID NO: 2208378 - RNA, 20 nt, Homo sapiens
ugcuguuaaaauaagaacaa

SEQ ID NO: 2208379 - RNA, 14 nt, Homo sapiens
agccuggacccugu

SEQ ID NO: 2208380 - RNA, 18 nt, Homo sapiens
ucucugccaagcccucaa

SEQ ID NO: 2208381 - RNA, 11 nt, Homo sapiens
ccaucugccaa

SEQ ID NO: 2208382 - RNA, 21 nt, Homo sapiens
uaucuauaguagacacacuau

SEQ ID NO: 2208383 - RNA, 21 nt, Homo sapiens
ugaauguauguaauguguggu

SEQ ID NO: 2208384 - RNA, 15 nt, Homo sapiens
ccucauucuucucuc

SEQ ID NO: 2208385 - RNA, 13 nt, Homo sapiens
ucacacuuuucag

SEQ ID NO: 2208386 - RNA, 12 nt, Homo sapiens
uucccucuggga

SEQ ID NO: 2208387 - RNA, 23 nt, Homo sapiens
gggaaaacccacccuaccacagu

SEQ ID NO: 2208388 - RNA, 14 nt, Homo sapiens
ugcuccagcacuca

SEQ ID NO: 2208389 - RNA, 14 nt, Homo sapiens
cacugcagugcuga

SEQ ID NO: 2208390 - RNA, 22 nt, Homo sapiens
ggagcagucuccugcccucucc

SEQ ID NO: 2208391 - RNA, 19 nt, Homo sapiens
guacaauggcgugaucuca

SEQ ID NO: 2208392 - RNA, 19 nt, Homo sapiens
gugcaauggcgugaucucg

SEQ ID NO: 2208393 - RNA, 16 nt, Homo sapiens
caacaccucauucuua

SEQ ID NO: 2208394 - RNA, 13 nt, Homo sapiens
aggagaaucacuu

SEQ ID NO: 2208395 - RNA, 15 nt, Homo sapiens
cagggcgagcacuuu

SEQ ID NO: 2208396 - RNA, 15 nt, Homo sapiens
cagggugagcacucu

SEQ ID NO: 2208397 - RNA, 17 nt, Homo sapiens
cacaugcuuuucuuccu

SEQ ID NO: 2208398 - RNA, 11 nt, Homo sapiens
ccccacuuuga

SEQ ID NO: 2208399 - RNA, 16 nt, Homo sapiens
cagaugguagaacuaa

SEQ ID NO: 2208400 - RNA, 14 nt, Homo sapiens
gaaggugacuuugg

SEQ ID NO: 2208401 - RNA, 21 nt, Homo sapiens
ugcuucccagaggagcagcuc

SEQ ID NO: 2208402 - RNA, 11 nt, Homo sapiens
ucaugaaggag

SEQ ID NO: 2208403 - RNA, 17 nt, Homo sapiens
cuugcuguuuucaucuc

SEQ ID NO: 2208404 - RNA, 16 nt, Homo sapiens
gaugacuauuacuuuu

SEQ ID NO: 2208405 - RNA, 18 nt, Homo sapiens
ugcuauauaaauauguca

SEQ ID NO: 2208406 - RNA, 21 nt, Homo sapiens
cuaaggaaaggaauuggcaug

SEQ ID NO: 2208407 - RNA, 14 nt, Homo sapiens
uaugcacauaugga

SEQ ID NO: 2208408 - RNA, 19 nt, Homo sapiens
ucuguuuucccauugcagu

SEQ ID NO: 2208409 - RNA, 18 nt, Homo sapiens
agagcccuaucuaugucc

SEQ ID NO: 2208410 - RNA, 19 nt, Homo sapiens
cuacaaaauauagcuuuca

SEQ ID NO: 2208411 - RNA, 13 nt, Homo sapiens
aaacuaguaucag

SEQ ID NO: 2208412 - RNA, 19 nt, Homo sapiens
auuuucuacacauacaugu

SEQ ID NO: 2208413 - RNA, 22 nt, Homo sapiens
aguauacuuuuugcauauguaa

SEQ ID NO: 2208414 - RNA, 13 nt, Homo sapiens
uggccaaugagau

SEQ ID NO: 2208415 - RNA, 16 nt, Homo sapiens
aggacgugucucagga

SEQ ID NO: 2208416 - RNA, 20 nt, Homo sapiens
uguuuggaaaccacagucag

SEQ ID NO: 2208417 - RNA, 23 nt, Homo sapiens
gcuucaaaacagaacggguucuc

SEQ ID NO: 2208418 - RNA, 20 nt, Homo sapiens
aucauuguuuauuguauacu

SEQ ID NO: 2208419 - RNA, 14 nt, Homo sapiens
cacucugugcccau

SEQ ID NO: 2208420 - RNA, 22 nt, Homo sapiens
auccaacuauuucuuucaucag

SEQ ID NO: 2208421 - RNA, 17 nt, Homo sapiens
caagcgcgcuguugauu

SEQ ID NO: 2208422 - RNA, 22 nt, Homo sapiens
uuuugaauagcaauuagugaua

SEQ ID NO: 2208423 - RNA, 13 nt, Homo sapiens
gucccguggcauu

SEQ ID NO: 2208424 - RNA, 16 nt, Homo sapiens
auucuccuuugcacug

SEQ ID NO: 2208425 - RNA, 18 nt, Homo sapiens
gaagauccccaacugcuc

SEQ ID NO: 2208426 - RNA, 12 nt, Homo sapiens
ggauuuugaacg

SEQ ID NO: 2208427 - RNA, 18 nt, Homo sapiens
auaaauauacucaaguuu

SEQ ID NO: 2208428 - RNA, 21 nt, Homo sapiens
ccaaauaaggauuuguucaca

SEQ ID NO: 2208429 - RNA, 14 nt, Homo sapiens
cuuggccucccaaa

SEQ ID NO: 2208430 - RNA, 13 nt, Homo sapiens
gaggacuggagag

SEQ ID NO: 2208431 - RNA, 13 nt, Homo sapiens
uaucuucauacaa

SEQ ID NO: 2208432 - RNA, 13 nt, Homo sapiens
uccauucaucuca

SEQ ID NO: 2208433 - RNA, 21 nt, Homo sapiens
aagauugccaauuuucuucau

SEQ ID NO: 2208434 - RNA, 14 nt, Homo sapiens
gaccacaucuuuau

SEQ ID NO: 2208435 - RNA, 23 nt, Homo sapiens
acuaguugaacaucucacuuugc

SEQ ID NO: 2208436 - RNA, 18 nt, Homo sapiens
agaugccucccugacccu

SEQ ID NO: 2208437 - RNA, 23 nt, Homo sapiens
aauuacuuacucaaauucaauga

SEQ ID NO: 2208438 - RNA, 18 nt, Homo sapiens
auguguauuuguauguac

SEQ ID NO: 2208439 - RNA, 18 nt, Homo sapiens
cuuauguagauauuuggc

SEQ ID NO: 2208440 - RNA, 22 nt, Homo sapiens
acccccccucccucucucugaa

SEQ ID NO: 2208441 - RNA, 23 nt, Homo sapiens
uaaucuguuuauuuacaagggaa

SEQ ID NO: 2208442 - RNA, 17 nt, Homo sapiens
uacuuuaugaugcuaug

SEQ ID NO: 2208443 - RNA, 17 nt, Homo sapiens
gaccuaaccuaagcaaa

SEQ ID NO: 2208444 - RNA, 19 nt, Homo sapiens
aguuucccuaucugcaaaa

SEQ ID NO: 2208445 - RNA, 18 nt, Homo sapiens
accaaggccccgagcuca

SEQ ID NO: 2208446 - RNA, 21 nt, Homo sapiens
ccaugccucuccaacaucuuc

SEQ ID NO: 2208447 - RNA, 15 nt, Homo sapiens
caaacaaacaaaaag

SEQ ID NO: 2208448 - RNA, 13 nt, Homo sapiens
acuuccuguggau

SEQ ID NO: 2208449 - RNA, 19 nt, Homo sapiens
ucugccgauuuuguaaaug

SEQ ID NO: 2208450 - RNA, 17 nt, Homo sapiens
uaccuucaugugauuca

SEQ ID NO: 2208451 - RNA, 18 nt, Homo sapiens
uaaguuucucagcuccca

SEQ ID NO: 2208452 - RNA, 15 nt, Homo sapiens
gcugcugagaaccug

SEQ ID NO: 2208453 - RNA, 14 nt, Homo sapiens
guuugccaccagaa

SEQ ID NO: 2208454 - RNA, 19 nt, Homo sapiens
uuucacaaauauaguugaa

SEQ ID NO: 2208455 - RNA, 16 nt, Homo sapiens
aggugggaggguggca

SEQ ID NO: 2208456 - RNA, 14 nt, Homo sapiens
acaggcucugacca

SEQ ID NO: 2208457 - RNA, 16 nt, Homo sapiens
gacagagaaacagaca

SEQ ID NO: 2208458 - RNA, 16 nt, Homo sapiens
gauaaugaaauaauca

SEQ ID NO: 2208459 - RNA, 21 nt, Homo sapiens
acacagcucuucuccaggcug

SEQ ID NO: 2208460 - RNA, 21 nt, Homo sapiens
aaaauauagacuggauaauca

SEQ ID NO: 2208461 - RNA, 17 nt, Homo sapiens
acugaggacacagaucc

SEQ ID NO: 2208462 - RNA, 13 nt, Homo sapiens
uuaccuaagagaa

SEQ ID NO: 2208463 - RNA, 16 nt, Homo sapiens
gugaauuugcugcuau

SEQ ID NO: 2208464 - RNA, 18 nt, Homo sapiens
caggagcagcagccagca

SEQ ID NO: 2208465 - RNA, 16 nt, Homo sapiens
cagccccuccaugucu

SEQ ID NO: 2208466 - RNA, 21 nt, Homo sapiens
cugcaucuuauagcacuuuga

SEQ ID NO: 2208467 - RNA, 13 nt, Homo sapiens
aggggacauucca

SEQ ID NO: 2208468 - RNA, 20 nt, Homo sapiens
uaaaggcagcugccucugcu

SEQ ID NO: 2208469 - RNA, 15 nt, Homo sapiens
agagaggcucugaga

SEQ ID NO: 2208470 - RNA, 18 nt, Homo sapiens
ucuuuguuuacaugaguu

SEQ ID NO: 2208471 - RNA, 14 nt, Homo sapiens
gcucuucugcccaa

SEQ ID NO: 2208472 - RNA, 19 nt, Homo sapiens
uguguugggaccugugauc

SEQ ID NO: 2208473 - RNA, 22 nt, Homo sapiens
cccccuggaagcugauucacua

SEQ ID NO: 2208474 - RNA, 16 nt, Homo sapiens
auacauacacuuguau

SEQ ID NO: 2208475 - RNA, 16 nt, Homo sapiens
acaggcugcuguccag

SEQ ID NO: 2208476 - RNA, 13 nt, Homo sapiens
cuccagacucuca

SEQ ID NO: 2208477 - RNA, 15 nt, Homo sapiens
cucuacgugcuccuc

SEQ ID NO: 2208478 - RNA, 15 nt, Homo sapiens
cccacuccugcugca

SEQ ID NO: 2208479 - RNA, 16 nt, Homo sapiens
acaaguuggaauucac

SEQ ID NO: 2208480 - RNA, 14 nt, Homo sapiens
aaaauuugucuuaa

SEQ ID NO: 2208481 - RNA, 21 nt, Homo sapiens
ugaaauugauguuacuguaua

SEQ ID NO: 2208482 - RNA, 20 nt, Homo sapiens
ccaguuggcuaggggagcag

SEQ ID NO: 2208483 - RNA, 15 nt, Homo sapiens
ugagcauggggccag

SEQ ID NO: 2208484 - RNA, 22 nt, Homo sapiens
auaaaggcccagacuccauggu

SEQ ID NO: 2208485 - RNA, 17 nt, Homo sapiens
uguaauaaaacauguuc

SEQ ID NO: 2208486 - RNA, 15 nt, Homo sapiens
cacuuaggaagaaau

SEQ ID NO: 2208487 - RNA, 18 nt, Homo sapiens
uuagacucaucuuacugu

SEQ ID NO: 2208488 - RNA, 16 nt, Homo sapiens
cuggcccuugcuuacc

SEQ ID NO: 2208489 - RNA, 18 nt, Homo sapiens
cauacuacauacaagcau

SEQ ID NO: 2208490 - RNA, 22 nt, Homo sapiens
cuguguaaaacuauauucucag

SEQ ID NO: 2208491 - RNA, 15 nt, Homo sapiens
cucuugcauugcaaa

SEQ ID NO: 2208492 - RNA, 18 nt, Homo sapiens
ggauguugcuuuugcacc

SEQ ID NO: 2208493 - RNA, 16 nt, Homo sapiens
cauauucaaugcaagu

SEQ ID NO: 2208494 - RNA, 16 nt, Homo sapiens
augauagucaucauca

SEQ ID NO: 2208495 - RNA, 16 nt, Homo sapiens
gacacaggcccggcuc

SEQ ID NO: 2208496 - RNA, 23 nt, Homo sapiens
caaguccagauuuacacugggag

SEQ ID NO: 2208497 - RNA, 13 nt, Homo sapiens
uaggaaucccaga

SEQ ID NO: 2208498 - RNA, 16 nt, Homo sapiens
cugagauccagaguuu

SEQ ID NO: 2208499 - RNA, 20 nt, Homo sapiens
acucccccaggauugugcaa

SEQ ID NO: 2208500 - RNA, 17 nt, Homo sapiens
ggaacaguaauuacuuu

SEQ ID NO: 2208501 - RNA, 23 nt, Homo sapiens
ucacauaaaugcagcccauuucu

SEQ ID NO: 2208502 - RNA, 17 nt, Homo sapiens
cuucagaggagaaagaa

SEQ ID NO: 2208503 - RNA, 15 nt, Homo sapiens
ccagugcacagggaa

SEQ ID NO: 2208504 - RNA, 13 nt, Homo sapiens
cccugaauucuuc

SEQ ID NO: 2208505 - RNA, 16 nt, Homo sapiens
uagugguacauuccau

SEQ ID NO: 2208506 - RNA, 20 nt, Homo sapiens
gagaggaacacaggcgcuga

SEQ ID NO: 2208507 - RNA, 16 nt, Homo sapiens
auucccacagcacuaa

SEQ ID NO: 2208508 - RNA, 22 nt, Homo sapiens
aauugugcuuuacaacuugaau

SEQ ID NO: 2208509 - RNA, 12 nt, Homo sapiens
uccaagucuuca

SEQ ID NO: 2208510 - RNA, 14 nt, Homo sapiens
gucauaacuagaac

SEQ ID NO: 2208511 - RNA, 19 nt, Homo sapiens
auuuuuuacguagcuauuu

SEQ ID NO: 2208512 - RNA, 12 nt, Homo sapiens
cagcagacacag

SEQ ID NO: 2208513 - RNA, 19 nt, Homo sapiens
aauuaaaugcauguccuca

SEQ ID NO: 2208514 - RNA, 20 nt, Homo sapiens
gaagcauggcggcaucugcu

SEQ ID NO: 2208515 - RNA, 22 nt, Homo sapiens
ccuaagcggcuguuuacugcuu

SEQ ID NO: 2208516 - RNA, 20 nt, Homo sapiens
acccuuaucaccagcugccu

SEQ ID NO: 2208517 - RNA, 22 nt, Homo sapiens
uuuaaagcuauucuuaugcugu

SEQ ID NO: 2208518 - RNA, 19 nt, Homo sapiens
aacauauuuauauauguau

SEQ ID NO: 2208519 - RNA, 16 nt, Homo sapiens
ggaaaguucuuaggca

SEQ ID NO: 2208520 - RNA, 14 nt, Homo sapiens
ccauuccuucacau

SEQ ID NO: 2208521 - RNA, 14 nt, Homo sapiens
ucuuuccuccucau

SEQ ID NO: 2208522 - RNA, 12 nt, Homo sapiens
gcugcugcugcc

SEQ ID NO: 2208523 - RNA, 22 nt, Homo sapiens
ggugaagugaggacaaaaucac

SEQ ID NO: 2208524 - RNA, 23 nt, Homo sapiens
uuaaggacaaagugccaaagaaa

SEQ ID NO: 2208525 - RNA, 17 nt, Homo sapiens
auuuuaaaauaggccaa

SEQ ID NO: 2208526 - RNA, 17 nt, Homo sapiens
gccuguggccuuugcaa

SEQ ID NO: 2208527 - RNA, 22 nt, Homo sapiens
aagcuguguccuugcaccugca

SEQ ID NO: 2208528 - RNA, 13 nt, Homo sapiens
auacagaauuuua

SEQ ID NO: 2208529 - RNA, 23 nt, Homo sapiens
cagaugccuccucuguccucauu

SEQ ID NO: 2208530 - RNA, 17 nt, Homo sapiens
aaaaugcaaaugcacuc

SEQ ID NO: 2208531 - RNA, 22 nt, Homo sapiens
cuggaguuauugaagcagagug

SEQ ID NO: 2208532 - RNA, 19 nt, Homo sapiens
aguucaauaaaugucuguu

SEQ ID NO: 2208533 - RNA, 17 nt, Homo sapiens
acugcuugugcacugga

SEQ ID NO: 2208534 - RNA, 22 nt, Homo sapiens
gccagcaggucaaaaaggccaa

SEQ ID NO: 2208535 - RNA, 21 nt, Homo sapiens
gagcuucaugugacacagggg

SEQ ID NO: 2208536 - RNA, 17 nt, Homo sapiens
caggaauacuuggaccu

SEQ ID NO: 2208537 - RNA, 14 nt, Homo sapiens
aaaaauacacccca

SEQ ID NO: 2208538 - RNA, 17 nt, Homo sapiens
ucuauguuuggcuucag

SEQ ID NO: 2208539 - RNA, 19 nt, Homo sapiens
guuuaagucagcaaaucuu

SEQ ID NO: 2208540 - RNA, 13 nt, Homo sapiens
augugucuuacca

SEQ ID NO: 2208541 - RNA, 18 nt, Homo sapiens
ccuagaagucucccugca

SEQ ID NO: 2208542 - RNA, 14 nt, Homo sapiens
uauaggauauugcu

SEQ ID NO: 2208543 - RNA, 16 nt, Homo sapiens
agagaugggauuucac

SEQ ID NO: 2208544 - RNA, 22 nt, Homo sapiens
aucaaguuugaccagugcaguu

SEQ ID NO: 2208545 - RNA, 15 nt, Homo sapiens
gcuuuagucacuaau

SEQ ID NO: 2208546 - RNA, 17 nt, Homo sapiens
aacucacuaacagggag

SEQ ID NO: 2208547 - RNA, 19 nt, Homo sapiens
augagauguuaaauacuuu

SEQ ID NO: 2208548 - RNA, 20 nt, Homo sapiens
acucucuguuuuaguguuua

SEQ ID NO: 2208549 - RNA, 14 nt, Homo sapiens
guuaauacuuaaca

SEQ ID NO: 2208550 - RNA, 14 nt, Homo sapiens
uccagaugagucag

SEQ ID NO: 2208551 - RNA, 14 nt, Homo sapiens
uuggcucaccauaa

SEQ ID NO: 2208552 - RNA, 18 nt, Homo sapiens
uauuacaagccuacauga

SEQ ID NO: 2208553 - RNA, 15 nt, Homo sapiens
aacagaauucacuug

SEQ ID NO: 2208554 - RNA, 15 nt, Homo sapiens
caauaauaaacauau

SEQ ID NO: 2208555 - RNA, 20 nt, Homo sapiens
uugucauuauguacaauaca

SEQ ID NO: 2208556 - RNA, 22 nt, Homo sapiens
auaugcuuauacacuguuggug

SEQ ID NO: 2208557 - RNA, 22 nt, Homo sapiens
cucaggauccagucccuuacac

SEQ ID NO: 2208558 - RNA, 15 nt, Homo sapiens
aauguuuuguaaaua

SEQ ID NO: 2208559 - RNA, 15 nt, Homo sapiens
guaaaauuaauguaa

SEQ ID NO: 2208560 - RNA, 22 nt, Homo sapiens
ugaggugguaguaaaacacaga

SEQ ID NO: 2208561 - RNA, 16 nt, Homo sapiens
uccuccguccauauca

SEQ ID NO: 2208562 - RNA, 14 nt, Homo sapiens
uacguugugcauuu

SEQ ID NO: 2208563 - RNA, 18 nt, Homo sapiens
cuauacagccauaaaaag

SEQ ID NO: 2208564 - RNA, 14 nt, Homo sapiens
ccauuaagagugaa

SEQ ID NO: 2208565 - RNA, 12 nt, Homo sapiens
gaaccucuccau

SEQ ID NO: 2208566 - RNA, 23 nt, Homo sapiens
uuguauaguguugauuugugcug

SEQ ID NO: 2208567 - RNA, 24 nt, Homo sapiens
caaaccacgccucuugaccaggcu

SEQ ID NO: 2208568 - RNA, 16 nt, Homo sapiens
ucucacugaagcucaa

SEQ ID NO: 2208569 - RNA, 13 nt, Homo sapiens
agcccuuugcacu

SEQ ID NO: 2208570 - RNA, 19 nt, Homo sapiens
cagggcuggggccaagagg

SEQ ID NO: 2208571 - RNA, 14 nt, Homo sapiens
cagcuugcugcuaa

SEQ ID NO: 2208572 - RNA, 18 nt, Homo sapiens
ugcuugcccgcucccaca

SEQ ID NO: 2208573 - RNA, 18 nt, Homo sapiens
cccacgccuccauccaca

SEQ ID NO: 2208574 - RNA, 14 nt, Homo sapiens
gcacugaucaccca

SEQ ID NO: 2208575 - RNA, 16 nt, Homo sapiens
ugagagcaugccugug

SEQ ID NO: 2208576 - RNA, 17 nt, Homo sapiens
guuugcaaaaaaaaaga

SEQ ID NO: 2208577 - RNA, 14 nt, Homo sapiens
ugaugguugccagg

SEQ ID NO: 2208578 - RNA, 15 nt, Homo sapiens
agcgcagcugcauuu

SEQ ID NO: 2208579 - RNA, 21 nt, Homo sapiens
aacuggcagguaccgugcuca

SEQ ID NO: 2208580 - RNA, 18 nt, Homo sapiens
aggaaaagggcaaaaaga

SEQ ID NO: 2208581 - RNA, 13 nt, Homo sapiens
cuagcacacucuu

SEQ ID NO: 2208582 - RNA, 17 nt, Homo sapiens
gcugaaaagagcuuugu

SEQ ID NO: 2208583 - RNA, 17 nt, Homo sapiens
caaauuguguauauauc

SEQ ID NO: 2208584 - RNA, 21 nt, Homo sapiens
auggguuguuaauacuauauu

SEQ ID NO: 2208585 - RNA, 13 nt, Homo sapiens
gagguugaagcua

SEQ ID NO: 2208586 - RNA, 16 nt, Homo sapiens
acacuaguagcuguuu

SEQ ID NO: 2208587 - RNA, 20 nt, Homo sapiens
cuccaaaguuuuaaaccugu

SEQ ID NO: 2208588 - RNA, 16 nt, Homo sapiens
ugucacuggaugucaa

SEQ ID NO: 2208589 - RNA, 15 nt, Homo sapiens
agaugcauccaugua

SEQ ID NO: 2208590 - RNA, 16 nt, Homo sapiens
uaggggagagaucucc

SEQ ID NO: 2208591 - RNA, 17 nt, Homo sapiens
cuggugccguugcugcg

SEQ ID NO: 2208592 - RNA, 18 nt, Homo sapiens
guuuuaauuuuugugauu

SEQ ID NO: 2208593 - RNA, 21 nt, Homo sapiens
ccugcgaccacagcagggauu

SEQ ID NO: 2208594 - RNA, 22 nt, Homo sapiens
aguugauuaaaaaugcuuuuag

SEQ ID NO: 2208595 - RNA, 22 nt, Homo sapiens
aggcgucagucaaaggcauuuu

SEQ ID NO: 2208596 - RNA, 22 nt, Homo sapiens
ucagaaacccuucagugcuaca

SEQ ID NO: 2208597 - RNA, 14 nt, Homo sapiens
gagccucauccagc

SEQ ID NO: 2208598 - RNA, 12 nt, Homo sapiens
cgcucugucacc

SEQ ID NO: 2208599 - RNA, 12 nt, Homo sapiens
uauccuguuguu

SEQ ID NO: 2208600 - RNA, 23 nt, Homo sapiens
ugguucucaacagacccagugag

SEQ ID NO: 2208601 - RNA, 17 nt, Homo sapiens
auauuuccuaaggcaug

SEQ ID NO: 2208602 - RNA, 23 nt, Homo sapiens
ggggugauaaggggccuugcucu

SEQ ID NO: 2208603 - RNA, 21 nt, Homo sapiens
ggcuagucugugccucaguga

SEQ ID NO: 2208604 - RNA, 15 nt, Homo sapiens
ccacuaugagcugcu

SEQ ID NO: 2208605 - RNA, 15 nt, Homo sapiens
ccagccagcaguuca

SEQ ID NO: 2208606 - RNA, 18 nt, Homo sapiens
caugacuuauuaugcaua

SEQ ID NO: 2208607 - RNA, 20 nt, Homo sapiens
agaagguggaccuggcagug

SEQ ID NO: 2208608 - RNA, 19 nt, Homo sapiens
augaaucaacaaaccacaa

SEQ ID NO: 2208609 - RNA, 16 nt, Homo sapiens
ucucaguccucaaagc

SEQ ID NO: 2208610 - RNA, 15 nt, Homo sapiens
agaaauaacgugcau

SEQ ID NO: 2208611 - RNA, 16 nt, Homo sapiens
ucugagacuauaacug

SEQ ID NO: 2208612 - RNA, 17 nt, Homo sapiens
cucaugcugagcgcugu

SEQ ID NO: 2208613 - RNA, 14 nt, Homo sapiens
cacaucucagggaa

SEQ ID NO: 2208614 - RNA, 16 nt, Homo sapiens
uucccaagcccaugag

SEQ ID NO: 2208615 - RNA, 21 nt, Homo sapiens
agaacuuucuaggcugagucu

SEQ ID NO: 2208616 - RNA, 17 nt, Homo sapiens
cucuguuuaggugccuc

SEQ ID NO: 2208617 - RNA, 21 nt, Homo sapiens
uggaaucuuuuauaaugauuc

SEQ ID NO: 2208618 - RNA, 14 nt, Homo sapiens
cugaacaugcucau

SEQ ID NO: 2208619 - RNA, 14 nt, Homo sapiens
gcgaacaucuucau

SEQ ID NO: 2208620 - RNA, 16 nt, Homo sapiens
cacagaguagaaacuc

SEQ ID NO: 2208621 - RNA, 23 nt, Homo sapiens
agccugucccauggacacuccag

SEQ ID NO: 2208622 - RNA, 13 nt, Homo sapiens
gcagcaggcaugg

SEQ ID NO: 2208623 - RNA, 15 nt, Homo sapiens
ucuuaauaggcuuua

SEQ ID NO: 2208624 - RNA, 19 nt, Homo sapiens
ucccuugguguugccccua

SEQ ID NO: 2208625 - RNA, 21 nt, Homo sapiens
aaccaaauucuauacauguau

SEQ ID NO: 2208626 - RNA, 19 nt, Homo sapiens
auuugugugaaaaugugac

SEQ ID NO: 2208627 - RNA, 12 nt, Homo sapiens
ccucucuuucac

SEQ ID NO: 2208628 - RNA, 11 nt, Homo sapiens
cagcauugcuu

SEQ ID NO: 2208629 - RNA, 20 nt, Homo sapiens
gaaccacucauugucuuuga

SEQ ID NO: 2208630 - RNA, 16 nt, Homo sapiens
acugccacacucucca

SEQ ID NO: 2208631 - RNA, 21 nt, Homo sapiens
cuccuuucuugcacuauucca

SEQ ID NO: 2208632 - RNA, 24 nt, Homo sapiens
cuuuguauaaaagggacugagaaa

SEQ ID NO: 2208633 - RNA, 13 nt, Homo sapiens
uucucucaucucu

SEQ ID NO: 2208634 - RNA, 17 nt, Homo sapiens
ucagccaggacagucag

SEQ ID NO: 2208635 - RNA, 15 nt, Homo sapiens
ugcauaagcacagaa

SEQ ID NO: 2208636 - RNA, 18 nt, Homo sapiens
ucugccuuguccugaugc

SEQ ID NO: 2208637 - RNA, 14 nt, Homo sapiens
uaguggugugauuu

SEQ ID NO: 2208638 - RNA, 15 nt, Homo sapiens
aauggcuuuuugccg

SEQ ID NO: 2208639 - RNA, 13 nt, Homo sapiens
aaaaugcuuuaaa

SEQ ID NO: 2208640 - RNA, 14 nt, Homo sapiens
acauuuuguauauu

SEQ ID NO: 2208641 - RNA, 16 nt, Homo sapiens
cgaaggugcuggaggu

SEQ ID NO: 2208642 - RNA, 15 nt, Homo sapiens
gcaggcaaucacuug

SEQ ID NO: 2208643 - RNA, 21 nt, Homo sapiens
uauacauaaaguauccaugca

SEQ ID NO: 2208644 - RNA, 21 nt, Homo sapiens
ugcaaaggagggccucagaga

SEQ ID NO: 2208645 - RNA, 14 nt, Homo sapiens
acccaccccugugc

SEQ ID NO: 2208646 - RNA, 14 nt, Homo sapiens
ggcuccccugugua

SEQ ID NO: 2208647 - RNA, 13 nt, Homo sapiens
gcaaccccaguuc

SEQ ID NO: 2208648 - RNA, 18 nt, Homo sapiens
uuuaaacucaucaaugug

SEQ ID NO: 2208649 - RNA, 14 nt, Homo sapiens
uugugucagugucu

SEQ ID NO: 2208650 - RNA, 16 nt, Homo sapiens
ccccaggccugagcug

SEQ ID NO: 2208651 - RNA, 15 nt, Homo sapiens
ucuugagcagaugau

SEQ ID NO: 2208652 - RNA, 17 nt, Homo sapiens
aauauuuguauacacau

SEQ ID NO: 2208653 - RNA, 19 nt, Homo sapiens
ccauacuuucccacagcac

SEQ ID NO: 2208654 - RNA, 13 nt, Homo sapiens
agccaccagugga

SEQ ID NO: 2208655 - RNA, 15 nt, Homo sapiens
ugggcugucugucac

SEQ ID NO: 2208656 - RNA, 12 nt, Homo sapiens
cucaaaugucag

SEQ ID NO: 2208657 - RNA, 17 nt, Homo sapiens
cuuaaacaacaccuccu

SEQ ID NO: 2208658 - RNA, 22 nt, Homo sapiens
uucuccagccuuuuucagggaa

SEQ ID NO: 2208659 - RNA, 16 nt, Homo sapiens
cacgucaucuaguuuu

SEQ ID NO: 2208660 - RNA, 17 nt, Homo sapiens
gccucccugcacuucau

SEQ ID NO: 2208661 - RNA, 13 nt, Homo sapiens
uacuaaaugcaga

SEQ ID NO: 2208662 - RNA, 14 nt, Homo sapiens
aagcucuagaaucu

SEQ ID NO: 2208663 - RNA, 16 nt, Homo sapiens
ccccggccucagcacc

SEQ ID NO: 2208664 - RNA, 23 nt, Homo sapiens
gugcagccaccagggcagaaaug

SEQ ID NO: 2208665 - RNA, 20 nt, Homo sapiens
aaagauaugcuuauacacug

SEQ ID NO: 2208666 - RNA, 18 nt, Homo sapiens
uuaauauuaccaacuaca

SEQ ID NO: 2208667 - RNA, 20 nt, Homo sapiens
cggcagcugguucugcaaug

SEQ ID NO: 2208668 - RNA, 21 nt, Homo sapiens
gaacuacaaagcuucuauccc

SEQ ID NO: 2208669 - RNA, 19 nt, Homo sapiens
ucccacaggugguacagcc

SEQ ID NO: 2208670 - RNA, 14 nt, Homo sapiens
ccaacagauuuuau

SEQ ID NO: 2208671 - RNA, 14 nt, Homo sapiens
ucagcaaagagugg

SEQ ID NO: 2208672 - RNA, 15 nt, Homo sapiens
accuaaguacuguaa

SEQ ID NO: 2208673 - RNA, 18 nt, Homo sapiens
ggccuugucucuuccucu

SEQ ID NO: 2208674 - RNA, 23 nt, Homo sapiens
aauccugagcaaacaaaaccacc

SEQ ID NO: 2208675 - RNA, 20 nt, Homo sapiens
gcgcaggccugcgugcgcug

SEQ ID NO: 2208676 - RNA, 11 nt, Homo sapiens
cuuacaaagug

SEQ ID NO: 2208677 - RNA, 14 nt, Homo sapiens
guugucaggccaua

SEQ ID NO: 2208678 - RNA, 21 nt, Homo sapiens
ugagaaaaguucaauacucuu

SEQ ID NO: 2208679 - RNA, 21 nt, Homo sapiens
gucauuucauacaaauuuucc

SEQ ID NO: 2208680 - RNA, 15 nt, Homo sapiens
ugcaucccgagcaac

SEQ ID NO: 2208681 - RNA, 16 nt, Homo sapiens
ugauuuuaucugugaa

SEQ ID NO: 2208682 - RNA, 15 nt, Homo sapiens
uaaauauauauucua

SEQ ID NO: 2208683 - RNA, 18 nt, Homo sapiens
gaagcuacuucuccacug

SEQ ID NO: 2208684 - RNA, 21 nt, Homo sapiens
ugaagaacuuggcacacucuc

SEQ ID NO: 2208685 - RNA, 16 nt, Homo sapiens
cauuucuuucaauaaa

SEQ ID NO: 2208686 - RNA, 18 nt, Homo sapiens
guacugugaccaucccaa

SEQ ID NO: 2208687 - RNA, 16 nt, Homo sapiens
cacagaugaccaaagu

SEQ ID NO: 2208688 - RNA, 17 nt, Homo sapiens
uuagaccuguguuacua

SEQ ID NO: 2208689 - RNA, 18 nt, Homo sapiens
uaaaauaagcacugugcu

SEQ ID NO: 2208690 - RNA, 15 nt, Homo sapiens
acauuccaucuuaca

SEQ ID NO: 2208691 - RNA, 14 nt, Homo sapiens
uauaucuuugcacu

SEQ ID NO: 2208692 - RNA, 14 nt, Homo sapiens
uucuacuuguaaaa

SEQ ID NO: 2208693 - RNA, 15 nt, Homo sapiens
cuaacuccagucucc

SEQ ID NO: 2208694 - RNA, 17 nt, Homo sapiens
cuguauuauugcaauuu

SEQ ID NO: 2208695 - RNA, 18 nt, Homo sapiens
cagcaaaacuccaucuca

SEQ ID NO: 2208696 - RNA, 19 nt, Homo sapiens
uucucugccuuugacauuu

SEQ ID NO: 2208697 - RNA, 20 nt, Homo sapiens
acagaaagccugggugacau

SEQ ID NO: 2208698 - RNA, 22 nt, Homo sapiens
ccaagauggaggggcugacuca

SEQ ID NO: 2208699 - RNA, 16 nt, Homo sapiens
gugcauuugugucugc

SEQ ID NO: 2208700 - RNA, 18 nt, Homo sapiens
aagguauuuauugagcac

SEQ ID NO: 2208701 - RNA, 22 nt, Homo sapiens
cuggaagaucagcacccuaaga

SEQ ID NO: 2208702 - RNA, 19 nt, Homo sapiens
gaacuagccaccaacucuu

SEQ ID NO: 2208703 - RNA, 16 nt, Homo sapiens
gucuuagugcaaaaaa

SEQ ID NO: 2208704 - RNA, 16 nt, Homo sapiens
ugaggugccuguccca

SEQ ID NO: 2208705 - RNA, 14 nt, Homo sapiens
aggaacagucuugu

SEQ ID NO: 2208706 - RNA, 22 nt, Homo sapiens
gcauuaucuuugucuguucacu

SEQ ID NO: 2208707 - RNA, 13 nt, Homo sapiens
aagcaaacugggg

SEQ ID NO: 2208708 - RNA, 18 nt, Homo sapiens
gcucaagguuacugggag

SEQ ID NO: 2208709 - RNA, 15 nt, Homo sapiens
guaccacacauauug

SEQ ID NO: 2208710 - RNA, 13 nt, Homo sapiens
uaccuugugcuaa

SEQ ID NO: 2208711 - RNA, 13 nt, Homo sapiens
aagaaguggagac

SEQ ID NO: 2208712 - RNA, 21 nt, Homo sapiens
cuuaaauggaauuauuuugaa

SEQ ID NO: 2208713 - RNA, 15 nt, Homo sapiens
cccuccucgcugugc

SEQ ID NO: 2208714 - RNA, 17 nt, Homo sapiens
cauuguggcuccuaucu

SEQ ID NO: 2208715 - RNA, 22 nt, Homo sapiens
aaagguaaaucccacaucccag

SEQ ID NO: 2208716 - RNA, 13 nt, Homo sapiens
gccaugagggaca

SEQ ID NO: 2208717 - RNA, 21 nt, Homo sapiens
ucuaguugacuucaaaugugu

SEQ ID NO: 2208718 - RNA, 19 nt, Homo sapiens
gaaauaaaguuggugacag

SEQ ID NO: 2208719 - RNA, 16 nt, Homo sapiens
cccacaggacuuugau

SEQ ID NO: 2208720 - RNA, 21 nt, Homo sapiens
auguagccauuguagcagcuu

SEQ ID NO: 2208721 - RNA, 13 nt, Homo sapiens
ugcugagcuguga

SEQ ID NO: 2208722 - RNA, 21 nt, Homo sapiens
ucaacaaauuucauugcacuu

SEQ ID NO: 2208723 - RNA, 19 nt, Homo sapiens
aauaugucugccacagaga

SEQ ID NO: 2208724 - RNA, 13 nt, Homo sapiens
ugcuggacagggg

SEQ ID NO: 2208725 - RNA, 13 nt, Homo sapiens
ggucagggugaga

SEQ ID NO: 2208726 - RNA, 13 nt, Homo sapiens
ggugagggugaca

SEQ ID NO: 2208727 - RNA, 13 nt, Homo sapiens
acacugauccagc

SEQ ID NO: 2208728 - RNA, 22 nt, Homo sapiens
cuuucacaaguacuaucuguuc

SEQ ID NO: 2208729 - RNA, 15 nt, Homo sapiens
aacuguucaaacuca

SEQ ID NO: 2208730 - RNA, 14 nt, Homo sapiens
aaaugaugccccag

SEQ ID NO: 2208731 - RNA, 14 nt, Homo sapiens
cugcuaugccauuu

SEQ ID NO: 2208732 - RNA, 16 nt, Homo sapiens
ccagcaucagccugua

SEQ ID NO: 2208733 - RNA, 15 nt, Homo sapiens
cugaccugagccaga

SEQ ID NO: 2208734 - RNA, 18 nt, Homo sapiens
aaccaucuaggaugauuu

SEQ ID NO: 2208735 - RNA, 23 nt, Homo sapiens
cagaauuauuuuuaagugguuuu

SEQ ID NO: 2208736 - RNA, 19 nt, Homo sapiens
cuggaagacgaaguguaaa

SEQ ID NO: 2208737 - RNA, 13 nt, Homo sapiens
ccaacauggugaa

SEQ ID NO: 2208738 - RNA, 14 nt, Homo sapiens
uggggagcggagcu

SEQ ID NO: 2208739 - RNA, 22 nt, Homo sapiens
cucucuccuuucagggccaauc

SEQ ID NO: 2208740 - RNA, 19 nt, Homo sapiens
auuugagagaaucuacuaa

SEQ ID NO: 2208741 - RNA, 20 nt, Homo sapiens
auagacaagagaaugcuguc

SEQ ID NO: 2208742 - RNA, 13 nt, Homo sapiens
caaauacugaugg

SEQ ID NO: 2208743 - RNA, 20 nt, Homo sapiens
cauguauaucucgagugagu

SEQ ID NO: 2208744 - RNA, 17 nt, Homo sapiens
cugcuccgcugcuccuu

SEQ ID NO: 2208745 - RNA, 15 nt, Homo sapiens
auaaaucaguuaugu

SEQ ID NO: 2208746 - RNA, 16 nt, Homo sapiens
cacuaaaagaucgcag

SEQ ID NO: 2208747 - RNA, 14 nt, Homo sapiens
ucauaaacagcauu

SEQ ID NO: 2208748 - RNA, 18 nt, Homo sapiens
ucuguaaggaacuggaac

SEQ ID NO: 2208749 - RNA, 15 nt, Homo sapiens
ucacugucccucaaa

SEQ ID NO: 2208750 - RNA, 14 nt, Homo sapiens
uugaccuugaccau

SEQ ID NO: 2208751 - RNA, 14 nt, Homo sapiens
gacugugucugccu

SEQ ID NO: 2208752 - RNA, 19 nt, Homo sapiens
gcugguugaaaaauggcaa

SEQ ID NO: 2208753 - RNA, 17 nt, Homo sapiens
aggggccaugcugugug

SEQ ID NO: 2208754 - RNA, 15 nt, Homo sapiens
augcgucucuggccc

SEQ ID NO: 2208755 - RNA, 16 nt, Homo sapiens
cguuuuucuggugcuu

SEQ ID NO: 2208756 - RNA, 18 nt, Homo sapiens
ggcauuguguucacugua

SEQ ID NO: 2208757 - RNA, 18 nt, Homo sapiens
cuguaaucccagcuacuu

SEQ ID NO: 2208758 - RNA, 16 nt, Homo sapiens
gcagcaacacccaagu

SEQ ID NO: 2208759 - RNA, 13 nt, Homo sapiens
cguagacuugaca

SEQ ID NO: 2208760 - RNA, 16 nt, Homo sapiens
cguaccguacacagag

SEQ ID NO: 2208761 - RNA, 20 nt, Homo sapiens
aucuuuacaaaacuacauga

SEQ ID NO: 2208762 - RNA, 13 nt, Homo sapiens
gaaauacauauga

SEQ ID NO: 2208763 - RNA, 23 nt, Homo sapiens
aacauuugaagacccuugugcau

SEQ ID NO: 2208764 - RNA, 17 nt, Homo sapiens
accaacucuugcucuca

SEQ ID NO: 2208765 - RNA, 19 nt, Homo sapiens
caguauucuagugauaaga

SEQ ID NO: 2208766 - RNA, 20 nt, Homo sapiens
ccuaaagccucaaaacaaag

SEQ ID NO: 2208767 - RNA, 15 nt, Homo sapiens
uuuugauaguauuua

SEQ ID NO: 2208768 - RNA, 16 nt, Homo sapiens
uaucaaaaaguauuau

SEQ ID NO: 2208769 - RNA, 20 nt, Homo sapiens
gcugggaacauguaccacug

SEQ ID NO: 2208770 - RNA, 18 nt, Homo sapiens
augggaggguucugggug

SEQ ID NO: 2208771 - RNA, 18 nt, Homo sapiens
acucuaucaaaugugaug

SEQ ID NO: 2208772 - RNA, 20 nt, Homo sapiens
ugaguuacuuagaaugccau

SEQ ID NO: 2208773 - RNA, 18 nt, Homo sapiens
auauuccugcauuuguga

SEQ ID NO: 2208774 - RNA, 17 nt, Homo sapiens
auucucacacacauaca

SEQ ID NO: 2208775 - RNA, 16 nt, Homo sapiens
gcgcccuggguggugg

SEQ ID NO: 2208776 - RNA, 15 nt, Homo sapiens
auccaccaccucccu

SEQ ID NO: 2208777 - RNA, 23 nt, Homo sapiens
ucuguguacacaucuauucucaa

SEQ ID NO: 2208778 - RNA, 21 nt, Homo sapiens
uagguaggaaaaugaagaaga

SEQ ID NO: 2208779 - RNA, 16 nt, Homo sapiens
augcguccgaagggaa

SEQ ID NO: 2208780 - RNA, 16 nt, Homo sapiens
agaaggccucacucaa

SEQ ID NO: 2208781 - RNA, 15 nt, Homo sapiens
aacacuucauuuuca

SEQ ID NO: 2208782 - RNA, 21 nt, Homo sapiens
ucagggcccagaguugggacu

SEQ ID NO: 2208783 - RNA, 21 nt, Homo sapiens
acagaaaaggcugcugugaac

SEQ ID NO: 2208784 - RNA, 21 nt, Homo sapiens
cuauuuuuuacuacauaauua

SEQ ID NO: 2208785 - RNA, 16 nt, Homo sapiens
caagugucuagaguca

SEQ ID NO: 2208786 - RNA, 17 nt, Homo sapiens
caucacacacauggaaa

SEQ ID NO: 2208787 - RNA, 15 nt, Homo sapiens
guaaggaauaccugu

SEQ ID NO: 2208788 - RNA, 23 nt, Homo sapiens
uucucccuguacaguguuaccau

SEQ ID NO: 2208789 - RNA, 22 nt, Homo sapiens
ggaacagagggugaaagggaca

SEQ ID NO: 2208790 - RNA, 17 nt, Homo sapiens
ugucuuagugcaaaaaa

SEQ ID NO: 2208791 - RNA, 18 nt, Homo sapiens
agcagccucugaucugug

SEQ ID NO: 2208792 - RNA, 21 nt, Homo sapiens
aagguguuuaaguaauugcca

SEQ ID NO: 2208793 - RNA, 18 nt, Homo sapiens
acucugugcugagcacag

SEQ ID NO: 2208794 - RNA, 15 nt, Homo sapiens
gcugauaccaccaga

SEQ ID NO: 2208795 - RNA, 15 nt, Homo sapiens
accccccgcccaugc

SEQ ID NO: 2208796 - RNA, 19 nt, Homo sapiens
aaaacaagagaccacuucc

SEQ ID NO: 2208797 - RNA, 19 nt, Homo sapiens
uccugggucuucagcauuc

SEQ ID NO: 2208798 - RNA, 15 nt, Homo sapiens
cuuagcaugcacaaa

SEQ ID NO: 2208799 - RNA, 23 nt, Homo sapiens
cacacgcacugcgccugucagua

SEQ ID NO: 2208800 - RNA, 12 nt, Homo sapiens
cacaagcacuuu

SEQ ID NO: 2208801 - RNA, 15 nt, Homo sapiens
ggccagucaugugcu

SEQ ID NO: 2208802 - RNA, 24 nt, Homo sapiens
ccaaguccugggaauaugcuagug

SEQ ID NO: 2208803 - RNA, 13 nt, Homo sapiens
uuguuuacauaag

SEQ ID NO: 2208804 - RNA, 15 nt, Homo sapiens
auacacauggaugca

SEQ ID NO: 2208805 - RNA, 20 nt, Homo sapiens
cugcugacguuugacaccag

SEQ ID NO: 2208806 - RNA, 14 nt, Homo sapiens
gagugcugcagcuu

SEQ ID NO: 2208807 - RNA, 15 nt, Homo sapiens
guccuuuuucacuuu

SEQ ID NO: 2208808 - RNA, 14 nt, Homo sapiens
ugagugaucacugg

SEQ ID NO: 2208809 - RNA, 13 nt, Homo sapiens
acacccacagugg

SEQ ID NO: 2208810 - RNA, 15 nt, Homo sapiens
caccacaccaggcug

SEQ ID NO: 2208811 - RNA, 18 nt, Homo sapiens
cucauuccccaaccacuu

SEQ ID NO: 2208812 - RNA, 20 nt, Homo sapiens
cacauggaaucaaucuuuaa

SEQ ID NO: 2208813 - RNA, 20 nt, Homo sapiens
uaaaacuaaauguaauuuau

SEQ ID NO: 2208814 - RNA, 17 nt, Homo sapiens
guuuuuccaguucacau

SEQ ID NO: 2208815 - RNA, 17 nt, Homo sapiens
ugguagaucuucaauuu

SEQ ID NO: 2208816 - RNA, 14 nt, Homo sapiens
ugcuucaaacuaac

SEQ ID NO: 2208817 - RNA, 14 nt, Homo sapiens
uguuugaaaccaag

SEQ ID NO: 2208818 - RNA, 16 nt, Homo sapiens
cugacacagacauccu

SEQ ID NO: 2208819 - RNA, 12 nt, Homo sapiens
aaucaacaguga

SEQ ID NO: 2208820 - RNA, 19 nt, Homo sapiens
cuucacauaagcucagaau

SEQ ID NO: 2208821 - RNA, 16 nt, Homo sapiens
acaggaaguaguucua

SEQ ID NO: 2208822 - RNA, 21 nt, Homo sapiens
ucacacacauggaaggugaug

SEQ ID NO: 2208823 - RNA, 19 nt, Homo sapiens
ggcgagucacccuccucac

SEQ ID NO: 2208824 - RNA, 16 nt, Homo sapiens
cagacgggcacacaga

SEQ ID NO: 2208825 - RNA, 22 nt, Homo sapiens
ugucuuaaugguauccuacuga

SEQ ID NO: 2208826 - RNA, 13 nt, Homo sapiens
accagagcaguuu

SEQ ID NO: 2208827 - RNA, 16 nt, Homo sapiens
aaaguggaaauggaga

SEQ ID NO: 2208828 - RNA, 14 nt, Homo sapiens
cuuuuuguuugcau

SEQ ID NO: 2208829 - RNA, 12 nt, Homo sapiens
ugauuagacuuu

SEQ ID NO: 2208830 - RNA, 17 nt, Homo sapiens
ugagacauugacaccag

SEQ ID NO: 2208831 - RNA, 18 nt, Homo sapiens
acagguaaugaagcuauu

SEQ ID NO: 2208832 - RNA, 23 nt, Homo sapiens
ucgccaagagggacaucagaaag

SEQ ID NO: 2208833 - RNA, 13 nt, Homo sapiens
agcugggauuuga

SEQ ID NO: 2208834 - RNA, 16 nt, Homo sapiens
ccucgcacacagggcu

SEQ ID NO: 2208835 - RNA, 14 nt, Homo sapiens
cuuguaaaagccua

SEQ ID NO: 2208836 - RNA, 12 nt, Homo sapiens
caugcccugugu

SEQ ID NO: 2208837 - RNA, 22 nt, Homo sapiens
cuccagugcuuggcugccccac

SEQ ID NO: 2208838 - RNA, 21 nt, Homo sapiens
uaggaggcucgaccaccucaa

SEQ ID NO: 2208839 - RNA, 14 nt, Homo sapiens
cuaaugacaaguga

SEQ ID NO: 2208840 - RNA, 16 nt, Homo sapiens
cuaugaguugaaaugu

SEQ ID NO: 2208841 - RNA, 18 nt, Homo sapiens
accagcagcccugucacg

SEQ ID NO: 2208842 - RNA, 15 nt, Homo sapiens
uuggacuaugcaugu

SEQ ID NO: 2208843 - RNA, 18 nt, Homo sapiens
ucuaucauguugaaguca

SEQ ID NO: 2208844 - RNA, 15 nt, Homo sapiens
uuagugucuguccau

SEQ ID NO: 2208845 - RNA, 15 nt, Homo sapiens
uuucugaaucucugg

SEQ ID NO: 2208846 - RNA, 18 nt, Homo sapiens
uguucacaaacuaccucu

SEQ ID NO: 2208847 - RNA, 15 nt, Homo sapiens
auauuuacauccagc

SEQ ID NO: 2208848 - RNA, 21 nt, Homo sapiens
caggccgcauccugaacugcu

SEQ ID NO: 2208849 - RNA, 16 nt, Homo sapiens
cuaaacucagaggcag

SEQ ID NO: 2208850 - RNA, 15 nt, Homo sapiens
augcugccuaggguu

SEQ ID NO: 2208851 - RNA, 15 nt, Homo sapiens
aucaagaauauucaa

SEQ ID NO: 2208852 - RNA, 22 nt, Homo sapiens
acgucccccaaaacgugcaugg

SEQ ID NO: 2208853 - RNA, 16 nt, Homo sapiens
gaaaauguaaguuaug

SEQ ID NO: 2208854 - RNA, 17 nt, Homo sapiens
uccuguauuuaacaaaa

SEQ ID NO: 2208855 - RNA, 18 nt, Homo sapiens
cauuucauauucuuucaa

SEQ ID NO: 2208856 - RNA, 16 nt, Homo sapiens
acagauguagcaacau

SEQ ID NO: 2208857 - RNA, 17 nt, Homo sapiens
ccccugucccauucuag

SEQ ID NO: 2208858 - RNA, 20 nt, Homo sapiens
caaaacagagggcugcauuc

SEQ ID NO: 2208859 - RNA, 22 nt, Homo sapiens
gcccacucuacugccccagcuc

SEQ ID NO: 2208860 - RNA, 15 nt, Homo sapiens
ucuaccucuuccagg

SEQ ID NO: 2208861 - RNA, 14 nt, Homo sapiens
agaugauaccugaa

SEQ ID NO: 2208862 - RNA, 16 nt, Homo sapiens
ccaaacacacuguaaa

SEQ ID NO: 2208863 - RNA, 16 nt, Homo sapiens
agggagggcuguggug

SEQ ID NO: 2208864 - RNA, 13 nt, Homo sapiens
ugccuccaaaaau

SEQ ID NO: 2208865 - RNA, 14 nt, Homo sapiens
ucacuggaaauuga

SEQ ID NO: 2208866 - RNA, 15 nt, Homo sapiens
aaagcuguguuccca

SEQ ID NO: 2208867 - RNA, 14 nt, Homo sapiens
accaugccauuuaa

SEQ ID NO: 2208868 - RNA, 17 nt, Homo sapiens
uagaacugucugugaac

SEQ ID NO: 2208869 - RNA, 20 nt, Homo sapiens
aacguauaauauguacauca

SEQ ID NO: 2208870 - RNA, 23 nt, Homo sapiens
accacagaggcuguggucagaga

SEQ ID NO: 2208871 - RNA, 15 nt, Homo sapiens
auacaggaaagcaau

SEQ ID NO: 2208872 - RNA, 11 nt, Homo sapiens
cccugccuugu

SEQ ID NO: 2208873 - RNA, 15 nt, Homo sapiens
auucacaucucaugu

SEQ ID NO: 2208874 - RNA, 22 nt, Homo sapiens
gaauaggcugaugggcaaaaaa

SEQ ID NO: 2208875 - RNA, 18 nt, Homo sapiens
gugaauugccugcagaga

SEQ ID NO: 2208876 - RNA, 21 nt, Homo sapiens
uuaguagaaacgggguuucac

SEQ ID NO: 2208877 - RNA, 21 nt, Homo sapiens
ugguguucaccaaaaccaaac

SEQ ID NO: 2208878 - RNA, 13 nt, Homo sapiens
aggcucaggagaa

SEQ ID NO: 2208879 - RNA, 12 nt, Homo sapiens
agaaguauuuau

SEQ ID NO: 2208880 - RNA, 13 nt, Homo sapiens
aacaaucaguaaa

SEQ ID NO: 2208881 - RNA, 16 nt, Homo sapiens
ucagccuugcaaauag

SEQ ID NO: 2208882 - RNA, 12 nt, Homo sapiens
uacagcaaauuu

SEQ ID NO: 2208883 - RNA, 22 nt, Homo sapiens
ucaggaugagaacacacugagu

SEQ ID NO: 2208884 - RNA, 14 nt, Homo sapiens
ugcauacacaugcc

SEQ ID NO: 2208885 - RNA, 16 nt, Homo sapiens
cuggggcagacaauaa

SEQ ID NO: 2208886 - RNA, 15 nt, Homo sapiens
uagagaauaaaccag

SEQ ID NO: 2208887 - RNA, 19 nt, Homo sapiens
auuuguaguugcauauuua

SEQ ID NO: 2208888 - RNA, 14 nt, Homo sapiens
acuucccuggucac

SEQ ID NO: 2208889 - RNA, 21 nt, Homo sapiens
uaccugcauguguuguacaau

SEQ ID NO: 2208890 - RNA, 15 nt, Homo sapiens
gaucuggcacacucc

SEQ ID NO: 2208891 - RNA, 18 nt, Homo sapiens
agggacuugaaguuguua

SEQ ID NO: 2208892 - RNA, 16 nt, Homo sapiens
ucaaguuuuucagaaa

SEQ ID NO: 2208893 - RNA, 12 nt, Homo sapiens
acuaacauuucc

SEQ ID NO: 2208894 - RNA, 19 nt, Homo sapiens
ugccaaaugcguaugccac

SEQ ID NO: 2208895 - RNA, 21 nt, Homo sapiens
cuuaaggggacccacaaguau

SEQ ID NO: 2208896 - RNA, 13 nt, Homo sapiens
augcaguucucac

SEQ ID NO: 2208897 - RNA, 15 nt, Homo sapiens
ucucgugguauguau

SEQ ID NO: 2208898 - RNA, 15 nt, Homo sapiens
agccuggaagccauc

SEQ ID NO: 2208899 - RNA, 18 nt, Homo sapiens
agcccucccucuucccag

SEQ ID NO: 2208900 - RNA, 14 nt, Homo sapiens
augaucugauugac

SEQ ID NO: 2208901 - RNA, 19 nt, Homo sapiens
aaguugcaccaacuuugaa

SEQ ID NO: 2208902 - RNA, 16 nt, Homo sapiens
gaagccaacuuggcuu

SEQ ID NO: 2208903 - RNA, 19 nt, Homo sapiens
cuggcauauguuucugcua

SEQ ID NO: 2208904 - RNA, 23 nt, Homo sapiens
cagucccaaaacccuuacaguga

SEQ ID NO: 2208905 - RNA, 18 nt, Homo sapiens
cccacugacccacucgga

SEQ ID NO: 2208906 - RNA, 18 nt, Homo sapiens
gucacagccacuugggau

SEQ ID NO: 2208907 - RNA, 21 nt, Homo sapiens
gucucucggguucaagcaauu

SEQ ID NO: 2208908 - RNA, 18 nt, Homo sapiens
caacccagccaugcaaug

SEQ ID NO: 2208909 - RNA, 12 nt, Homo sapiens
gccaaugcacac

SEQ ID NO: 2208910 - RNA, 14 nt, Homo sapiens
acuauucauaagau

SEQ ID NO: 2208911 - RNA, 13 nt, Homo sapiens
aauguucugacau

SEQ ID NO: 2208912 - RNA, 17 nt, Homo sapiens
acaaccuacucugcaaa

SEQ ID NO: 2208913 - RNA, 15 nt, Homo sapiens
aauuacaaaugcaau

SEQ ID NO: 2208914 - RNA, 16 nt, Homo sapiens
ucaccuacccaugacc

SEQ ID NO: 2208915 - RNA, 12 nt, Homo sapiens
uaauugucugua

SEQ ID NO: 2208916 - RNA, 13 nt, Homo sapiens
agaccaauuacug

SEQ ID NO: 2208917 - RNA, 20 nt, Homo sapiens
caggcuggaagauagcugug

SEQ ID NO: 2208918 - RNA, 21 nt, Homo sapiens
gaagggacucuaggugcccuc

SEQ ID NO: 2208919 - RNA, 13 nt, Homo sapiens
ccuucuaaucugc

SEQ ID NO: 2208920 - RNA, 23 nt, Homo sapiens
aaaacucuauguccggcuuuaac

SEQ ID NO: 2208921 - RNA, 21 nt, Homo sapiens
ugccuccacucccacuucccu

SEQ ID NO: 2208922 - RNA, 15 nt, Homo sapiens
uugacgcaccugugg

SEQ ID NO: 2208923 - RNA, 13 nt, Homo sapiens
cugcucaaguuga

SEQ ID NO: 2208924 - RNA, 16 nt, Homo sapiens
auuauccuucuacuug

SEQ ID NO: 2208925 - RNA, 17 nt, Homo sapiens
gccaagugccuaugcaa

SEQ ID NO: 2208926 - RNA, 18 nt, Homo sapiens
accuguucuguguugcaa

SEQ ID NO: 2208927 - RNA, 18 nt, Homo sapiens
cauaguacuggcacaaaa

SEQ ID NO: 2208928 - RNA, 17 nt, Homo sapiens
ucagacuuaaagcacug

SEQ ID NO: 2208929 - RNA, 14 nt, Homo sapiens
auggauaaagauga

SEQ ID NO: 2208930 - RNA, 19 nt, Homo sapiens
ucuaccccuaaugcaaaua

SEQ ID NO: 2208931 - RNA, 18 nt, Homo sapiens
cuggagcagccaccccau

SEQ ID NO: 2208932 - RNA, 13 nt, Homo sapiens
cuuccacugccuc

SEQ ID NO: 2208933 - RNA, 16 nt, Homo sapiens
aauaaagacugcacag

SEQ ID NO: 2208934 - RNA, 14 nt, Homo sapiens
auuauggcauauau

SEQ ID NO: 2208935 - RNA, 23 nt, Homo sapiens
uagguacaguaaaacaauuguga

SEQ ID NO: 2208936 - RNA, 15 nt, Homo sapiens
uccuucaacugcucu

SEQ ID NO: 2208937 - RNA, 22 nt, Homo sapiens
guguaaaaaacaaacauuugaa

SEQ ID NO: 2208938 - RNA, 20 nt, Homo sapiens
cuuaaagauuuucugcuuga

SEQ ID NO: 2208939 - RNA, 21 nt, Homo sapiens
gugaaaccucaucucuacuaa

SEQ ID NO: 2208940 - RNA, 17 nt, Homo sapiens
ucaaagauucugcauuu

SEQ ID NO: 2208941 - RNA, 17 nt, Homo sapiens
uauugaaugcauacucu

SEQ ID NO: 2208942 - RNA, 17 nt, Homo sapiens
gagauggaagagucaug

SEQ ID NO: 2208943 - RNA, 22 nt, Homo sapiens
aaagaagaaacgucuaugugua

SEQ ID NO: 2208944 - RNA, 19 nt, Homo sapiens
aguggccagccagugccau

SEQ ID NO: 2208945 - RNA, 11 nt, Homo sapiens
ucuacugcugg

SEQ ID NO: 2208946 - RNA, 20 nt, Homo sapiens
cugaguagucauuuugccca

SEQ ID NO: 2208947 - RNA, 16 nt, Homo sapiens
acaguuuugccuuaaa

SEQ ID NO: 2208948 - RNA, 19 nt, Homo sapiens
agccuauaggccaaugcau

SEQ ID NO: 2208949 - RNA, 17 nt, Homo sapiens
uucugcuguauacugua

SEQ ID NO: 2208950 - RNA, 16 nt, Homo sapiens
uuuauugauucaccuc

SEQ ID NO: 2208951 - RNA, 17 nt, Homo sapiens
ucccauggacacuccag

SEQ ID NO: 2208952 - RNA, 17 nt, Homo sapiens
caacuccccuacaucaa

SEQ ID NO: 2208953 - RNA, 17 nt, Homo sapiens
aagggagggcucugagg

SEQ ID NO: 2208954 - RNA, 19 nt, Homo sapiens
accagaaaccacaagcaaa

SEQ ID NO: 2208955 - RNA, 14 nt, Homo sapiens
uaauaccaccaaca

SEQ ID NO: 2208956 - RNA, 22 nt, Homo sapiens
uuugugugaucauacaguuaug

SEQ ID NO: 2208957 - RNA, 21 nt, Homo sapiens
uacucagggcuccucccagcu

SEQ ID NO: 2208958 - RNA, 16 nt, Homo sapiens
gaaaucaacucucuuc

SEQ ID NO: 2208959 - RNA, 17 nt, Homo sapiens
cuacauccaauguauga

SEQ ID NO: 2208960 - RNA, 18 nt, Homo sapiens
aucaugucuccucuccca

SEQ ID NO: 2208961 - RNA, 21 nt, Homo sapiens
uucacaccaccccccaugcca

SEQ ID NO: 2208962 - RNA, 21 nt, Homo sapiens
cgaggagcuuccagugcaugu

SEQ ID NO: 2208963 - RNA, 17 nt, Homo sapiens
acaggagucagugucug

SEQ ID NO: 2208964 - RNA, 18 nt, Homo sapiens
caaacugugaagcauuua

SEQ ID NO: 2208965 - RNA, 18 nt, Homo sapiens
cacuguuaucaccuaucc

SEQ ID NO: 2208966 - RNA, 13 nt, Homo sapiens
ccuguaaucacag

SEQ ID NO: 2208967 - RNA, 21 nt, Homo sapiens
gacccuccuccacuccaccuc

SEQ ID NO: 2208968 - RNA, 22 nt, Homo sapiens
ucaacaucuuggucagauuuga

SEQ ID NO: 2208969 - RNA, 17 nt, Homo sapiens
acaaaaauucucaguuc

SEQ ID NO: 2208970 - RNA, 17 nt, Homo sapiens
uaaaugaacaucuauaa

SEQ ID NO: 2208971 - RNA, 20 nt, Homo sapiens
ucccuacauggaguauaugu

SEQ ID NO: 2208972 - RNA, 15 nt, Homo sapiens
caaugugaaaagagu

SEQ ID NO: 2208973 - RNA, 19 nt, Homo sapiens
cugucccucauccauagca

SEQ ID NO: 2208974 - RNA, 13 nt, Homo sapiens
ggagaagacaauu

SEQ ID NO: 2208975 - RNA, 23 nt, Homo sapiens
ccucacuccauuucccacuucca

SEQ ID NO: 2208976 - RNA, 13 nt, Homo sapiens
gccgcccaaagag

SEQ ID NO: 2208977 - RNA, 17 nt, Homo sapiens
agucuuauuuccucaac

SEQ ID NO: 2208978 - RNA, 15 nt, Homo sapiens
cccuuccucccaaaa

SEQ ID NO: 2208979 - RNA, 13 nt, Homo sapiens
ugucgccaccacu

SEQ ID NO: 2208980 - RNA, 21 nt, Homo sapiens
auauauuuuccuaguagauau

SEQ ID NO: 2208981 - RNA, 22 nt, Homo sapiens
acauccccaaaggucaaaaaca

SEQ ID NO: 2208982 - RNA, 18 nt, Homo sapiens
uaaagguuguguugccug

SEQ ID NO: 2208983 - RNA, 14 nt, Homo sapiens
aaauaaaguaccac

SEQ ID NO: 2208984 - RNA, 18 nt, Homo sapiens
cccuggguuucaugagcu

SEQ ID NO: 2208985 - RNA, 18 nt, Homo sapiens
gccuuagggacagaauua

SEQ ID NO: 2208986 - RNA, 18 nt, Homo sapiens
ucauaauggaaaaaaaga

SEQ ID NO: 2208987 - RNA, 15 nt, Homo sapiens
acuacucugugccag

SEQ ID NO: 2208988 - RNA, 17 nt, Homo sapiens
aaaacagcucuguugaa

SEQ ID NO: 2208989 - RNA, 14 nt, Homo sapiens
auacucauggucau

SEQ ID NO: 2208990 - RNA, 15 nt, Homo sapiens
acugaaccaguccag

SEQ ID NO: 2208991 - RNA, 14 nt, Homo sapiens
aauuguacaaccug

SEQ ID NO: 2208992 - RNA, 11 nt, Homo sapiens
ugccagugccu

SEQ ID NO: 2208993 - RNA, 17 nt, Homo sapiens
gaagcaacuaggaaaau

SEQ ID NO: 2208994 - RNA, 17 nt, Homo sapiens
agugcauguugccauga

SEQ ID NO: 2208995 - RNA, 17 nt, Homo sapiens
aaacucaguuccaaagu

SEQ ID NO: 2208996 - RNA, 19 nt, Homo sapiens
gagaaugccagcccaaagc

SEQ ID NO: 2208997 - RNA, 22 nt, Homo sapiens
gcuaggcaugguggacucgccu

SEQ ID NO: 2208998 - RNA, 16 nt, Homo sapiens
ugauaaguucauacau

SEQ ID NO: 2208999 - RNA, 16 nt, Homo sapiens
cauugaacacaaacug

SEQ ID NO: 2209000 - RNA, 13 nt, Homo sapiens
auuuauuaaucua

SEQ ID NO: 2209001 - RNA, 12 nt, Homo sapiens
cagaaaggugau

SEQ ID NO: 2209002 - RNA, 16 nt, Homo sapiens
aggaaauaugagucau

SEQ ID NO: 2209003 - RNA, 17 nt, Homo sapiens
cuauacaguagcuugaa

SEQ ID NO: 2209004 - RNA, 15 nt, Homo sapiens
uaaagcuuguugacu

SEQ ID NO: 2209005 - RNA, 21 nt, Homo sapiens
aggcuugcgcuggaccugguu

SEQ ID NO: 2209006 - RNA, 22 nt, Homo sapiens
augcugaaaaaucauccaagac

SEQ ID NO: 2209007 - RNA, 12 nt, Homo sapiens
cauucucugucu

SEQ ID NO: 2209008 - RNA, 21 nt, Homo sapiens
cugguuccgccaggcgcugca

SEQ ID NO: 2209009 - RNA, 18 nt, Homo sapiens
uagauuaccuagcuuagu

SEQ ID NO: 2209010 - RNA, 14 nt, Homo sapiens
auuuucuuuuccau

SEQ ID NO: 2209011 - RNA, 18 nt, Homo sapiens
gcaacacugcuguccaca

SEQ ID NO: 2209012 - RNA, 18 nt, Homo sapiens
cuuaggcccuagcggcag

SEQ ID NO: 2209013 - RNA, 23 nt, Homo sapiens
ucuuuuugguagaugcugggcuc

SEQ ID NO: 2209014 - RNA, 17 nt, Homo sapiens
acugagcagaacugaaa

SEQ ID NO: 2209015 - RNA, 22 nt, Homo sapiens
ccaccaggagggaguggcagcu

SEQ ID NO: 2209016 - RNA, 19 nt, Homo sapiens
gcaggcugaucgggcaaug

SEQ ID NO: 2209017 - RNA, 16 nt, Homo sapiens
uagaaucagauacaaa

SEQ ID NO: 2209018 - RNA, 15 nt, Homo sapiens
ugggcaauaaaggca

SEQ ID NO: 2209019 - RNA, 22 nt, Homo sapiens
ggaugaagaacacagcaugugc

SEQ ID NO: 2209020 - RNA, 19 nt, Homo sapiens
gaagggucggagucuguaa

SEQ ID NO: 2209021 - RNA, 18 nt, Homo sapiens
uaauaauuagccaggcgu

SEQ ID NO: 2209022 - RNA, 22 nt, Homo sapiens
gagaaaagaaaccagagucaaa

SEQ ID NO: 2209023 - RNA, 15 nt, Homo sapiens
ucccuucaucuggaa

SEQ ID NO: 2209024 - RNA, 24 nt, Homo sapiens
ugccaagcccucaauaagccagca

SEQ ID NO: 2209025 - RNA, 17 nt, Homo sapiens
acaacgugcaacugaca

SEQ ID NO: 2209026 - RNA, 18 nt, Homo sapiens
caaagauauuuucaggau

SEQ ID NO: 2209027 - RNA, 23 nt, Homo sapiens
gaaauggcaucauuauaagcuau

SEQ ID NO: 2209028 - RNA, 17 nt, Homo sapiens
aguacauggucaaguau

SEQ ID NO: 2209029 - RNA, 14 nt, Homo sapiens
aggacugaacucca

SEQ ID NO: 2209030 - RNA, 23 nt, Homo sapiens
auuuuuauaagaaaaccaaacaa

SEQ ID NO: 2209031 - RNA, 20 nt, Homo sapiens
agagucaaugaacuuuccac

SEQ ID NO: 2209032 - RNA, 21 nt, Homo sapiens
ugugguuuucuuuugccauga

SEQ ID NO: 2209033 - RNA, 17 nt, Homo sapiens
gcaacucuauucauucc

SEQ ID NO: 2209034 - RNA, 21 nt, Homo sapiens
auccuaucacagucuacugac

SEQ ID NO: 2209035 - RNA, 16 nt, Homo sapiens
cuuuauuaaccucagc

SEQ ID NO: 2209036 - RNA, 15 nt, Homo sapiens
aaagaaggacacuug

SEQ ID NO: 2209037 - RNA, 17 nt, Homo sapiens
ccucugggucagugguc

SEQ ID NO: 2209038 - RNA, 14 nt, Homo sapiens
aucaagggcuuuau

SEQ ID NO: 2209039 - RNA, 14 nt, Homo sapiens
aauaugggcacuuu

SEQ ID NO: 2209040 - RNA, 15 nt, Homo sapiens
agaagcacauuuuca

SEQ ID NO: 2209041 - RNA, 22 nt, Homo sapiens
ucaccauggcccccucaucaua

SEQ ID NO: 2209042 - RNA, 22 nt, Homo sapiens
acuuuuuaacuuaacucaugaa

SEQ ID NO: 2209043 - RNA, 21 nt, Homo sapiens
uguccuggugcucucugccac

SEQ ID NO: 2209044 - RNA, 15 nt, Homo sapiens
uacgauuaugcccaa

SEQ ID NO: 2209045 - RNA, 16 nt, Homo sapiens
uugauauuucacuuac

SEQ ID NO: 2209046 - RNA, 19 nt, Homo sapiens
ugcuccguagcucugcugc

SEQ ID NO: 2209047 - RNA, 19 nt, Homo sapiens
auauauacagauacauauc

SEQ ID NO: 2209048 - RNA, 23 nt, Homo sapiens
acacaaaucccuauguugcuaua

SEQ ID NO: 2209049 - RNA, 13 nt, Homo sapiens
cugcccagacuga

SEQ ID NO: 2209050 - RNA, 18 nt, Homo sapiens
gugaguacccaggaugau

SEQ ID NO: 2209051 - RNA, 15 nt, Homo sapiens
cuguugacagugcca

SEQ ID NO: 2209052 - RNA, 16 nt, Homo sapiens
gggcuuagagcucuca

SEQ ID NO: 2209053 - RNA, 23 nt, Homo sapiens
augccuuggaggaaaugugcuca

SEQ ID NO: 2209054 - RNA, 15 nt, Homo sapiens
ucacgaacuguucac

SEQ ID NO: 2209055 - RNA, 20 nt, Homo sapiens
acggcugccugacacugagc

SEQ ID NO: 2209056 - RNA, 15 nt, Homo sapiens
uauuuuaagacguga

SEQ ID NO: 2209057 - RNA, 12 nt, Homo sapiens
auuacauuuuaa

SEQ ID NO: 2209058 - RNA, 13 nt, Homo sapiens
aucagaagcacua

SEQ ID NO: 2209059 - RNA, 17 nt, Homo sapiens
aauugaauuuacauaua

SEQ ID NO: 2209060 - RNA, 20 nt, Homo sapiens
ccucaacuccaggauuuagg

SEQ ID NO: 2209061 - RNA, 16 nt, Homo sapiens
aaaacacaccaaucag

SEQ ID NO: 2209062 - RNA, 19 nt, Homo sapiens
cuugggcaauaaaggcacc

SEQ ID NO: 2209063 - RNA, 13 nt, Homo sapiens
cuggaaaaagccc

SEQ ID NO: 2209064 - RNA, 19 nt, Homo sapiens
aaaccacuugucacuacaa

SEQ ID NO: 2209065 - RNA, 15 nt, Homo sapiens
guacuaccccagaac

SEQ ID NO: 2209066 - RNA, 21 nt, Homo sapiens
uacaacacauugaaacuguau

SEQ ID NO: 2209067 - RNA, 14 nt, Homo sapiens
gagagaggugccac

SEQ ID NO: 2209068 - RNA, 16 nt, Homo sapiens
augcgcacaaggcuga

SEQ ID NO: 2209069 - RNA, 23 nt, Homo sapiens
gaaaaauagguuuguagugaaau

SEQ ID NO: 2209070 - RNA, 20 nt, Homo sapiens
cggggguucauaggucacug

SEQ ID NO: 2209071 - RNA, 14 nt, Homo sapiens
gccauaagagguga

SEQ ID NO: 2209072 - RNA, 10 nt, Homo sapiens
gcagcauuuu

SEQ ID NO: 2209073 - RNA, 13 nt, Homo sapiens
ggcauuucacaaa

SEQ ID NO: 2209074 - RNA, 19 nt, Homo sapiens
cugcaagcagagguggcga

SEQ ID NO: 2209075 - RNA, 17 nt, Homo sapiens
uuugcuuaguauuguga

SEQ ID NO: 2209076 - RNA, 18 nt, Homo sapiens
aaagucccuugagacucc

SEQ ID NO: 2209077 - RNA, 19 nt, Homo sapiens
uaggagacacgacagcaca

SEQ ID NO: 2209078 - RNA, 13 nt, Homo sapiens
uucuuuuugacug

SEQ ID NO: 2209079 - RNA, 16 nt, Homo sapiens
auguguccuggugaga

SEQ ID NO: 2209080 - RNA, 17 nt, Homo sapiens
guaccaguguacugcuu

SEQ ID NO: 2209081 - RNA, 16 nt, Homo sapiens
gugcauguauguauac

SEQ ID NO: 2209082 - RNA, 13 nt, Homo sapiens
caucuaugugaga

SEQ ID NO: 2209083 - RNA, 15 nt, Homo sapiens
ucugccccagccugu

SEQ ID NO: 2209084 - RNA, 16 nt, Homo sapiens
aaaggacagcuuugau

SEQ ID NO: 2209085 - RNA, 17 nt, Homo sapiens
caucugcccaacugugu

SEQ ID NO: 2209086 - RNA, 16 nt, Homo sapiens
aacaaagucacccacu

SEQ ID NO: 2209087 - RNA, 18 nt, Homo sapiens
ggacagcuuuccugggug

SEQ ID NO: 2209088 - RNA, 13 nt, Homo sapiens
uguauugauucaa

SEQ ID NO: 2209089 - RNA, 16 nt, Homo sapiens
aucuguucccuuccuc

SEQ ID NO: 2209090 - RNA, 21 nt, Homo sapiens
agaaaucugggauguacuguu

SEQ ID NO: 2209091 - RNA, 16 nt, Homo sapiens
gcccuggccuaccaca

SEQ ID NO: 2209092 - RNA, 17 nt, Homo sapiens
ccauuggugcuaccugg

SEQ ID NO: 2209093 - RNA, 19 nt, Homo sapiens
aagaacuuuagcaugguau

SEQ ID NO: 2209094 - RNA, 13 nt, Homo sapiens
auuuaaaagacua

SEQ ID NO: 2209095 - RNA, 18 nt, Homo sapiens
gacagcuguuccacaggg

SEQ ID NO: 2209096 - RNA, 12 nt, Homo sapiens
ugauaccacugc

SEQ ID NO: 2209097 - RNA, 23 nt, Homo sapiens
cuuggaggcugucuucucaggcu

SEQ ID NO: 2209098 - RNA, 18 nt, Homo sapiens
cuggauuccacacugcac

SEQ ID NO: 2209099 - RNA, 13 nt, Homo sapiens
cuuuauaacccau

SEQ ID NO: 2209100 - RNA, 19 nt, Homo sapiens
ugauaugugaaugcucaua

SEQ ID NO: 2209101 - RNA, 14 nt, Homo sapiens
augguuuuacucau

SEQ ID NO: 2209102 - RNA, 16 nt, Homo sapiens
gcaccaucagccuguu

SEQ ID NO: 2209103 - RNA, 23 nt, Homo sapiens
uaggcauuucauuaugcuuugaa

SEQ ID NO: 2209104 - RNA, 17 nt, Homo sapiens
ugucaacacaaagacau

SEQ ID NO: 2209105 - RNA, 15 nt, Homo sapiens
cauaauacauaacau

SEQ ID NO: 2209106 - RNA, 20 nt, Homo sapiens
gacucagggacucaggccag

SEQ ID NO: 2209107 - RNA, 19 nt, Homo sapiens
cugucuucauccuuagcaa

SEQ ID NO: 2209108 - RNA, 20 nt, Homo sapiens
gcaggguucaagccuuccag

SEQ ID NO: 2209109 - RNA, 23 nt, Homo sapiens
ucuccugucugaaccugcccuua

SEQ ID NO: 2209110 - RNA, 16 nt, Homo sapiens
gcacagacaagcccuu

SEQ ID NO: 2209111 - RNA, 12 nt, Homo sapiens
gcuuccugauga

SEQ ID NO: 2209112 - RNA, 16 nt, Homo sapiens
ccuacacacacacucc

SEQ ID NO: 2209113 - RNA, 15 nt, Homo sapiens
gcuucagcaucuccu

SEQ ID NO: 2209114 - RNA, 11 nt, Homo sapiens
cccaaggagcu

SEQ ID NO: 2209115 - RNA, 15 nt, Homo sapiens
uggcccagcuuuuag

SEQ ID NO: 2209116 - RNA, 20 nt, Homo sapiens
uggccugaacagauguaaau

SEQ ID NO: 2209117 - RNA, 18 nt, Homo sapiens
auccugcagggcuucucc

SEQ ID NO: 2209118 - RNA, 14 nt, Homo sapiens
aguaggaugaauca

SEQ ID NO: 2209119 - RNA, 14 nt, Homo sapiens
ugugcuuacaguaa

SEQ ID NO: 2209120 - RNA, 19 nt, Homo sapiens
uggggacaucucuuugaau

SEQ ID NO: 2209121 - RNA, 12 nt, Homo sapiens
acucagugcuaa

SEQ ID NO: 2209122 - RNA, 12 nt, Homo sapiens
auaaagugccuc

SEQ ID NO: 2209123 - RNA, 20 nt, Homo sapiens
agcuguaaaguugcagguug

SEQ ID NO: 2209124 - RNA, 20 nt, Homo sapiens
acuaauuauacuacuuuguu

SEQ ID NO: 2209125 - RNA, 17 nt, Homo sapiens
gcaucccagcaccugcc

SEQ ID NO: 2209126 - RNA, 16 nt, Homo sapiens
caccagggccuggcug

SEQ ID NO: 2209127 - RNA, 18 nt, Homo sapiens
agauacacgucacaaaga

SEQ ID NO: 2209128 - RNA, 21 nt, Homo sapiens
uccucgucagucucucaaaga

SEQ ID NO: 2209129 - RNA, 18 nt, Homo sapiens
ugagaggcaggaaugggg

SEQ ID NO: 2209130 - RNA, 22 nt, Homo sapiens
gagucuucuccaauguccaaaa

SEQ ID NO: 2209131 - RNA, 16 nt, Homo sapiens
aaugaagggucauuuc

SEQ ID NO: 2209132 - RNA, 22 nt, Homo sapiens
aaaagacugguuuguuugcuua

SEQ ID NO: 2209133 - RNA, 23 nt, Homo sapiens
caccacaacaagcaagugcauuu

SEQ ID NO: 2209134 - RNA, 16 nt, Homo sapiens
aauauuguuuuugcac

SEQ ID NO: 2209135 - RNA, 20 nt, Homo sapiens
uuccccaaggacucuuccac

SEQ ID NO: 2209136 - RNA, 23 nt, Homo sapiens
ugggauuacaggcaugagccauu

SEQ ID NO: 2209137 - RNA, 22 nt, Homo sapiens
ccuggaaaagggaaaugugacu

SEQ ID NO: 2209138 - RNA, 17 nt, Homo sapiens
auuugggccugcuccag

SEQ ID NO: 2209139 - RNA, 19 nt, Homo sapiens
ccuguccugccuccucauc

SEQ ID NO: 2209140 - RNA, 21 nt, Homo sapiens
cuaggagaagggcugaacccu

SEQ ID NO: 2209141 - RNA, 20 nt, Homo sapiens
gucugcaugugcacgguggc

SEQ ID NO: 2209142 - RNA, 12 nt, Homo sapiens
ugguaugaaggu

SEQ ID NO: 2209143 - RNA, 15 nt, Homo sapiens
aauucuuaaccugga

SEQ ID NO: 2209144 - RNA, 16 nt, Homo sapiens
ugccagugcucaaggu

SEQ ID NO: 2209145 - RNA, 17 nt, Homo sapiens
guaaaucagacuaugaa

SEQ ID NO: 2209146 - RNA, 21 nt, Homo sapiens
ugccaguuuccucuacugcaa

SEQ ID NO: 2209147 - RNA, 17 nt, Homo sapiens
agaagaguguggaguca

SEQ ID NO: 2209148 - RNA, 17 nt, Homo sapiens
acugcagccacagggga

SEQ ID NO: 2209149 - RNA, 13 nt, Homo sapiens
gggacugugagac

SEQ ID NO: 2209150 - RNA, 13 nt, Homo sapiens
gaccauguggcca

SEQ ID NO: 2209151 - RNA, 24 nt, Homo sapiens
gccucuuccagugaacauucccag

SEQ ID NO: 2209152 - RNA, 18 nt, Homo sapiens
accagggcucacccacug

SEQ ID NO: 2209153 - RNA, 11 nt, Homo sapiens
uguaugugaca

SEQ ID NO: 2209154 - RNA, 13 nt, Homo sapiens
aucacucugaguc

SEQ ID NO: 2209155 - RNA, 16 nt, Homo sapiens
auauaaagucagugac

SEQ ID NO: 2209156 - RNA, 18 nt, Homo sapiens
gugacaggcccaguggaa

SEQ ID NO: 2209157 - RNA, 16 nt, Homo sapiens
caucuugcuaccagua

SEQ ID NO: 2209158 - RNA, 14 nt, Homo sapiens
ccaaucauuugcaa

SEQ ID NO: 2209159 - RNA, 19 nt, Homo sapiens
cagccccuuauuugcacuu

SEQ ID NO: 2209160 - RNA, 20 nt, Homo sapiens
ggcaggcugggccaugucca

SEQ ID NO: 2209161 - RNA, 21 nt, Homo sapiens
uauuuaugcaacucaucuuca

SEQ ID NO: 2209162 - RNA, 18 nt, Homo sapiens
uucuauguucauguuagu

SEQ ID NO: 2209163 - RNA, 20 nt, Homo sapiens
uguuccugaaccgaugagaa

SEQ ID NO: 2209164 - RNA, 19 nt, Homo sapiens
aacacuuuaaguaaaauau

SEQ ID NO: 2209165 - RNA, 17 nt, Homo sapiens
cuuuucauuuuggcuca

SEQ ID NO: 2209166 - RNA, 13 nt, Homo sapiens
uaccuacugcuga

SEQ ID NO: 2209167 - RNA, 21 nt, Homo sapiens
agccgggauggucuugaucuc

SEQ ID NO: 2209168 - RNA, 13 nt, Homo sapiens
caugugcuugugu

SEQ ID NO: 2209169 - RNA, 19 nt, Homo sapiens
agccaggccaacagcaccu

SEQ ID NO: 2209170 - RNA, 19 nt, Homo sapiens
aaacauuaguauagucucc

SEQ ID NO: 2209171 - RNA, 11 nt, Homo sapiens
uugggcaguuc

SEQ ID NO: 2209172 - RNA, 11 nt, Homo sapiens
uuaaugccaag

SEQ ID NO: 2209173 - RNA, 18 nt, Homo sapiens
cuccuuccccaaguaauu

SEQ ID NO: 2209174 - RNA, 22 nt, Homo sapiens
aagccucugucuuuucugggau

SEQ ID NO: 2209175 - RNA, 15 nt, Homo sapiens
gcugugggugcuaag

SEQ ID NO: 2209176 - RNA, 11 nt, Homo sapiens
cccugaccucc

SEQ ID NO: 2209177 - RNA, 15 nt, Homo sapiens
acaacauggugcuac

SEQ ID NO: 2209178 - RNA, 22 nt, Homo sapiens
uggcccgaaauagauccagugc

SEQ ID NO: 2209179 - RNA, 22 nt, Homo sapiens
cccugaaguaagcaaagacuuu

SEQ ID NO: 2209180 - RNA, 14 nt, Homo sapiens
ucuauaggcagcuu

SEQ ID NO: 2209181 - RNA, 16 nt, Homo sapiens
auuaaacuacccuuga

SEQ ID NO: 2209182 - RNA, 14 nt, Homo sapiens
ucccuguguucucu

SEQ ID NO: 2209183 - RNA, 18 nt, Homo sapiens
uaauuuuccaaugcacag

SEQ ID NO: 2209184 - RNA, 17 nt, Homo sapiens
aguuaggugugccaaac

SEQ ID NO: 2209185 - RNA, 13 nt, Homo sapiens
gugugagugcaug

SEQ ID NO: 2209186 - RNA, 19 nt, Homo sapiens
guucuucagagaucaugga

SEQ ID NO: 2209187 - RNA, 13 nt, Homo sapiens
agacaugaauaug

SEQ ID NO: 2209188 - RNA, 21 nt, Homo sapiens
caugaucccaccucccauuca

SEQ ID NO: 2209189 - RNA, 14 nt, Homo sapiens
ccaauuuacuggcc

SEQ ID NO: 2209190 - RNA, 14 nt, Homo sapiens
ugguggcaccagau

SEQ ID NO: 2209191 - RNA, 11 nt, Homo sapiens
aaaucccaaag

SEQ ID NO: 2209192 - RNA, 15 nt, Homo sapiens
ccugcucugugccca

SEQ ID NO: 2209193 - RNA, 18 nt, Homo sapiens
guuuucaugagcugagug

SEQ ID NO: 2209194 - RNA, 16 nt, Homo sapiens
uuaaaacucaucacau

SEQ ID NO: 2209195 - RNA, 13 nt, Homo sapiens
gagcgaaacucca

SEQ ID NO: 2209196 - RNA, 17 nt, Homo sapiens
agugauagaacaaaaga

SEQ ID NO: 2209197 - RNA, 17 nt, Homo sapiens
cacccacacacaucuau

SEQ ID NO: 2209198 - RNA, 16 nt, Homo sapiens
agcaucugacagguga

SEQ ID NO: 2209199 - RNA, 13 nt, Homo sapiens
gagcuggaccuga

SEQ ID NO: 2209200 - RNA, 18 nt, Homo sapiens
ggcccugugcgucucagu

SEQ ID NO: 2209201 - RNA, 16 nt, Homo sapiens
uaucuccauacuuugg

SEQ ID NO: 2209202 - RNA, 16 nt, Homo sapiens
caaagugaaguaaaag

SEQ ID NO: 2209203 - RNA, 20 nt, Homo sapiens
uccaccccuuguuuagcaua

SEQ ID NO: 2209204 - RNA, 20 nt, Homo sapiens
augaguggaaauacacucau

SEQ ID NO: 2209205 - RNA, 15 nt, Homo sapiens
cuugaaaauagaaca

SEQ ID NO: 2209206 - RNA, 15 nt, Homo sapiens
cagaucaauuuguaa

SEQ ID NO: 2209207 - RNA, 18 nt, Homo sapiens
caaauguaauugauuuau

SEQ ID NO: 2209208 - RNA, 16 nt, Homo sapiens
cuagcccucauuuuaa

SEQ ID NO: 2209209 - RNA, 14 nt, Homo sapiens
gccagcacgccgcu

SEQ ID NO: 2209210 - RNA, 18 nt, Homo sapiens
caccaucagucaaugaau

SEQ ID NO: 2209211 - RNA, 19 nt, Homo sapiens
agcuuugcagauaacaaaa

SEQ ID NO: 2209212 - RNA, 18 nt, Homo sapiens
auguaguacuaacuaagg

SEQ ID NO: 2209213 - RNA, 18 nt, Homo sapiens
auuuuaauguaaaauuca

SEQ ID NO: 2209214 - RNA, 17 nt, Homo sapiens
cugcuuuacuuugccca

SEQ ID NO: 2209215 - RNA, 22 nt, Homo sapiens
ccaggagaaguugaggggagca

SEQ ID NO: 2209216 - RNA, 22 nt, Homo sapiens
gcugccccaaccugcugaaggg

SEQ ID NO: 2209217 - RNA, 21 nt, Homo sapiens
ucuuauccugucccuccucca

SEQ ID NO: 2209218 - RNA, 18 nt, Homo sapiens
agccugugccagcaccuu

SEQ ID NO: 2209219 - RNA, 19 nt, Homo sapiens
gcaagguuuuagcuuucag

SEQ ID NO: 2209220 - RNA, 19 nt, Homo sapiens
gaguauuccaugagcugcu

SEQ ID NO: 2209221 - RNA, 21 nt, Homo sapiens
ccuaguuaguguuuugccuca

SEQ ID NO: 2209222 - RNA, 22 nt, Homo sapiens
uagccuaauauucaugcugccu

SEQ ID NO: 2209223 - RNA, 12 nt, Homo sapiens
caccaaaugaau

SEQ ID NO: 2209224 - RNA, 17 nt, Homo sapiens
ucauacacaugugcaca

SEQ ID NO: 2209225 - RNA, 17 nt, Homo sapiens
cuuuaugaaaacugaag

SEQ ID NO: 2209226 - RNA, 18 nt, Homo sapiens
cgucuuucccaaaggcau

SEQ ID NO: 2209227 - RNA, 23 nt, Homo sapiens
uuuucaauuuugaaaacucuaau

SEQ ID NO: 2209228 - RNA, 22 nt, Homo sapiens
cguuguuuugguuguacuuugg

SEQ ID NO: 2209229 - RNA, 23 nt, Homo sapiens
aacaucccaucuaagcauuccac

SEQ ID NO: 2209230 - RNA, 17 nt, Homo sapiens
aguucccggagcacagc

SEQ ID NO: 2209231 - RNA, 19 nt, Homo sapiens
uuucauccauaacugaaca

SEQ ID NO: 2209232 - RNA, 18 nt, Homo sapiens
gccuaggccugggcagug

SEQ ID NO: 2209233 - RNA, 13 nt, Homo sapiens
uaaaacacagagg

SEQ ID NO: 2209234 - RNA, 20 nt, Homo sapiens
uggcucacgccuguaauccc

SEQ ID NO: 2209235 - RNA, 15 nt, Homo sapiens
acaauucuucuguca

SEQ ID NO: 2209236 - RNA, 16 nt, Homo sapiens
ugaagaagcucuugac

SEQ ID NO: 2209237 - RNA, 16 nt, Homo sapiens
aaauguuagauauugc

SEQ ID NO: 2209238 - RNA, 22 nt, Homo sapiens
gugaacucaucccuuguuuaua

SEQ ID NO: 2209239 - RNA, 17 nt, Homo sapiens
gaaccuagaagggcuag

SEQ ID NO: 2209240 - RNA, 18 nt, Homo sapiens
cucaaagaaauuuccacu

SEQ ID NO: 2209241 - RNA, 19 nt, Homo sapiens
cuguguccuugcaccugca

SEQ ID NO: 2209242 - RNA, 10 nt, Homo sapiens
gucacagggu

SEQ ID NO: 2209243 - RNA, 17 nt, Homo sapiens
cuggaggggccaugggg

SEQ ID NO: 2209244 - RNA, 13 nt, Homo sapiens
cagugaacuauuu

SEQ ID NO: 2209245 - RNA, 20 nt, Homo sapiens
ccuucaguucugcuugcucc

SEQ ID NO: 2209246 - RNA, 15 nt, Homo sapiens
uuagacauaccucuc

SEQ ID NO: 2209247 - RNA, 23 nt, Homo sapiens
ggccaggaggugccacuggagug

SEQ ID NO: 2209248 - RNA, 16 nt, Homo sapiens
cucugccccacccuca

SEQ ID NO: 2209249 - RNA, 23 nt, Homo sapiens
ugcuguuuagaguaaauaaacug

SEQ ID NO: 2209250 - RNA, 22 nt, Homo sapiens
cagugaaguguucugcugagac

SEQ ID NO: 2209251 - RNA, 15 nt, Homo sapiens
gcccaguccuuccac

SEQ ID NO: 2209252 - RNA, 17 nt, Homo sapiens
caaaccuccacugcugc

SEQ ID NO: 2209253 - RNA, 17 nt, Homo sapiens
ucuuguugcugcaucuc

SEQ ID NO: 2209254 - RNA, 19 nt, Homo sapiens
cuggcacucugaggucucu

SEQ ID NO: 2209255 - RNA, 14 nt, Homo sapiens
uugcacaggccacu

SEQ ID NO: 2209256 - RNA, 22 nt, Homo sapiens
acucagccuggcugauuaucac

SEQ ID NO: 2209257 - RNA, 14 nt, Homo sapiens
guguacaacacugg

SEQ ID NO: 2209258 - RNA, 16 nt, Homo sapiens
gccacugguaaugggu

SEQ ID NO: 2209259 - RNA, 19 nt, Homo sapiens
caauaaagaccacuuuaca

SEQ ID NO: 2209260 - RNA, 17 nt, Homo sapiens
auacaugccgaaugcca

SEQ ID NO: 2209261 - RNA, 21 nt, Homo sapiens
cucuggacacagccccaugua

SEQ ID NO: 2209262 - RNA, 23 nt, Homo sapiens
cuuuugaaaguuuguucugcaga

SEQ ID NO: 2209263 - RNA, 12 nt, Homo sapiens
uucaagacagau

SEQ ID NO: 2209264 - RNA, 12 nt, Homo sapiens
uauuccagcuca

SEQ ID NO: 2209265 - RNA, 15 nt, Homo sapiens
cuuuauaagguuguc

SEQ ID NO: 2209266 - RNA, 15 nt, Homo sapiens
auguggaaugcagcc

SEQ ID NO: 2209267 - RNA, 19 nt, Homo sapiens
caaggacugguaaaauaca

SEQ ID NO: 2209268 - RNA, 13 nt, Homo sapiens
auaagugccauua

SEQ ID NO: 2209269 - RNA, 15 nt, Homo sapiens
agaguggcuuggccu

SEQ ID NO: 2209270 - RNA, 22 nt, Homo sapiens
acaauuguaaaauuuaaaucau

SEQ ID NO: 2209271 - RNA, 16 nt, Homo sapiens
agggucuaagcaccuu

SEQ ID NO: 2209272 - RNA, 12 nt, Homo sapiens
agcaaaaccaaa

SEQ ID NO: 2209273 - RNA, 12 nt, Homo sapiens
cacaaaacagaa

SEQ ID NO: 2209274 - RNA, 14 nt, Homo sapiens
uauuaaacucaugg

SEQ ID NO: 2209275 - RNA, 14 nt, Homo sapiens
aaauagacacuuga

SEQ ID NO: 2209276 - RNA, 15 nt, Homo sapiens
aaacaacuaccuccu

SEQ ID NO: 2209277 - RNA, 20 nt, Homo sapiens
cuuauaaaucauauucucau

SEQ ID NO: 2209278 - RNA, 23 nt, Homo sapiens
cagcaugaggacagaccacagag

SEQ ID NO: 2209279 - RNA, 13 nt, Homo sapiens
auccucacugugg

SEQ ID NO: 2209280 - RNA, 18 nt, Homo sapiens
gucugaacaaagugcuag

SEQ ID NO: 2209281 - RNA, 20 nt, Homo sapiens
auuccgaucgacugccaagc

SEQ ID NO: 2209282 - RNA, 19 nt, Homo sapiens
aauucacuuaacucugucu

SEQ ID NO: 2209283 - RNA, 16 nt, Homo sapiens
gcaauugagggcuaaa

SEQ ID NO: 2209284 - RNA, 18 nt, Homo sapiens
guuugaucacacagccac

SEQ ID NO: 2209285 - RNA, 21 nt, Homo sapiens
uaaaguaacauaauacauuaa

SEQ ID NO: 2209286 - RNA, 17 nt, Homo sapiens
agcuaucaucaacacaa

SEQ ID NO: 2209287 - RNA, 17 nt, Homo sapiens
cuggccuugucaggacc

SEQ ID NO: 2209288 - RNA, 11 nt, Homo sapiens
aacaugaauua

SEQ ID NO: 2209289 - RNA, 16 nt, Homo sapiens
guuggaaaaugugcaa

SEQ ID NO: 2209290 - RNA, 12 nt, Homo sapiens
ccuguacauucu

SEQ ID NO: 2209291 - RNA, 21 nt, Homo sapiens
guuacauuucuaucaguacuu

SEQ ID NO: 2209292 - RNA, 23 nt, Homo sapiens
ugggcagcggcuucaagagccag

SEQ ID NO: 2209293 - RNA, 17 nt, Homo sapiens
uuuuaacugacguagaa

SEQ ID NO: 2209294 - RNA, 20 nt, Homo sapiens
cagccucuucucugcacguu

SEQ ID NO: 2209295 - RNA, 12 nt, Homo sapiens
uuuuauggguac

SEQ ID NO: 2209296 - RNA, 15 nt, Homo sapiens
caucagccauuugcc

SEQ ID NO: 2209297 - RNA, 17 nt, Homo sapiens
cugggaacucccaagaa

SEQ ID NO: 2209298 - RNA, 19 nt, Homo sapiens
aaauguuuuuauggccauu

SEQ ID NO: 2209299 - RNA, 22 nt, Homo sapiens
ucucuaggagggagccuuguga

SEQ ID NO: 2209300 - RNA, 19 nt, Homo sapiens
ggacuguggcacuugccug

SEQ ID NO: 2209301 - RNA, 11 nt, Homo sapiens
aagacugucaa

SEQ ID NO: 2209302 - RNA, 22 nt, Homo sapiens
uaaacaaacuguguaacugccc

SEQ ID NO: 2209303 - RNA, 23 nt, Homo sapiens
guguaagguuuugguuauggagu

SEQ ID NO: 2209304 - RNA, 18 nt, Homo sapiens
auggaugcgacccaagac

SEQ ID NO: 2209305 - RNA, 23 nt, Homo sapiens
aauguguauuucuuaagaauuca

SEQ ID NO: 2209306 - RNA, 22 nt, Homo sapiens
cuaaugugaaaaucaucacuca

SEQ ID NO: 2209307 - RNA, 14 nt, Homo sapiens
acuuuuuauucaau

SEQ ID NO: 2209308 - RNA, 23 nt, Homo sapiens
aagcccugauguguccucaggga

SEQ ID NO: 2209309 - RNA, 21 nt, Homo sapiens
cacacugccaaauaaacagcu

SEQ ID NO: 2209310 - RNA, 15 nt, Homo sapiens
gccaguauuaugcau

SEQ ID NO: 2209311 - RNA, 14 nt, Homo sapiens
aaagaaguggggac

SEQ ID NO: 2209312 - RNA, 22 nt, Homo sapiens
ugcuagaaaggacguggaugaa

SEQ ID NO: 2209313 - RNA, 17 nt, Homo sapiens
auccacaaggaccucuu

SEQ ID NO: 2209314 - RNA, 21 nt, Homo sapiens
uaccuggauccagccauuccu

SEQ ID NO: 2209315 - RNA, 17 nt, Homo sapiens
ugacaaaagcagcacaa

SEQ ID NO: 2209316 - RNA, 22 nt, Homo sapiens
guuacauaagauaaaugugcug

SEQ ID NO: 2209317 - RNA, 12 nt, Homo sapiens
aguauuaauauc

SEQ ID NO: 2209318 - RNA, 16 nt, Homo sapiens
gccccaaccugcugaa

SEQ ID NO: 2209319 - RNA, 13 nt, Homo sapiens
auuuuaagugcuu

SEQ ID NO: 2209320 - RNA, 19 nt, Homo sapiens
auguaccaguguacugcuu

SEQ ID NO: 2209321 - RNA, 17 nt, Homo sapiens
auuuuagggcuguagac

SEQ ID NO: 2209322 - RNA, 15 nt, Homo sapiens
cgggaagucagggac

SEQ ID NO: 2209323 - RNA, 18 nt, Homo sapiens
uccaacucccucugggaa

SEQ ID NO: 2209324 - RNA, 17 nt, Homo sapiens
uuucuuaaucaguguag

SEQ ID NO: 2209325 - RNA, 22 nt, Homo sapiens
uugugaacccuagcugugucag

SEQ ID NO: 2209326 - RNA, 15 nt, Homo sapiens
ccuugaaaacucuca

SEQ ID NO: 2209327 - RNA, 15 nt, Homo sapiens
gugaaccacugugua

SEQ ID NO: 2209328 - RNA, 18 nt, Homo sapiens
accuucaggcagccagug

SEQ ID NO: 2209329 - RNA, 14 nt, Homo sapiens
uucccuggggagcc

SEQ ID NO: 2209330 - RNA, 17 nt, Homo sapiens
cugcuguucuucagucc

SEQ ID NO: 2209331 - RNA, 19 nt, Homo sapiens
uuuacagauaucugaaugg

SEQ ID NO: 2209332 - RNA, 18 nt, Homo sapiens
ugcucucucaacaucaca

SEQ ID NO: 2209333 - RNA, 13 nt, Homo sapiens
agagcuagggcug

SEQ ID NO: 2209334 - RNA, 23 nt, Homo sapiens
agcuucagugauugggggaggaa

SEQ ID NO: 2209335 - RNA, 23 nt, Homo sapiens
aguagcguuuuuuaaauguauac

SEQ ID NO: 2209336 - RNA, 13 nt, Homo sapiens
ccaccacugcucc

SEQ ID NO: 2209337 - RNA, 13 nt, Homo sapiens
ucuuugugugaca

SEQ ID NO: 2209338 - RNA, 16 nt, Homo sapiens
cccacuugacacuauu

SEQ ID NO: 2209339 - RNA, 22 nt, Homo sapiens
acuucgggggcggcucugggaa

SEQ ID NO: 2209340 - RNA, 16 nt, Homo sapiens
augcauacacucucaa

SEQ ID NO: 2209341 - RNA, 23 nt, Homo sapiens
aaaagaaaaaaaccaaaguacuu

SEQ ID NO: 2209342 - RNA, 12 nt, Homo sapiens
agaugcccuaau

SEQ ID NO: 2209343 - RNA, 21 nt, Homo sapiens
augugagugccuuuugcagaa

SEQ ID NO: 2209344 - RNA, 17 nt, Homo sapiens
uauccguaguuuugaua

SEQ ID NO: 2209345 - RNA, 19 nt, Homo sapiens
cccuguucuggacauuuca

SEQ ID NO: 2209346 - RNA, 15 nt, Homo sapiens
auccacuauuuccau

SEQ ID NO: 2209347 - RNA, 14 nt, Homo sapiens
aagguugauucuca

SEQ ID NO: 2209348 - RNA, 14 nt, Homo sapiens
acuuuguguauuaa

SEQ ID NO: 2209349 - RNA, 13 nt, Homo sapiens
gcggcuccagguc

SEQ ID NO: 2209350 - RNA, 20 nt, Homo sapiens
accacuucccgccuccauga

SEQ ID NO: 2209351 - RNA, 21 nt, Homo sapiens
acauccuguauaagcacugaa

SEQ ID NO: 2209352 - RNA, 22 nt, Homo sapiens
aagcugagaugaacccuggcau

SEQ ID NO: 2209353 - RNA, 13 nt, Homo sapiens
uugcaagcauuga

SEQ ID NO: 2209354 - RNA, 21 nt, Homo sapiens
ugagaaucgaccucacuguca

SEQ ID NO: 2209355 - RNA, 19 nt, Homo sapiens
ccaagaaguggcugccaaa

SEQ ID NO: 2209356 - RNA, 21 nt, Homo sapiens
aaaagcccacaccuaacauua

SEQ ID NO: 2209357 - RNA, 18 nt, Homo sapiens
gaucacuucauacuucua

SEQ ID NO: 2209358 - RNA, 22 nt, Homo sapiens
auccaggacugugccagcacaa

SEQ ID NO: 2209359 - RNA, 22 nt, Homo sapiens
uccaggacuggggcuugccagg

SEQ ID NO: 2209360 - RNA, 13 nt, Homo sapiens
ucuagaacuugac

SEQ ID NO: 2209361 - RNA, 13 nt, Homo sapiens
acugcaacauggg

SEQ ID NO: 2209362 - RNA, 12 nt, Homo sapiens
auacuaccucug

SEQ ID NO: 2209363 - RNA, 22 nt, Homo sapiens
aauugcagaauucaaaagugau

SEQ ID NO: 2209364 - RNA, 18 nt, Homo sapiens
accuauaaucccagcacu

SEQ ID NO: 2209365 - RNA, 20 nt, Homo sapiens
gauuauauaaaauacauaau

SEQ ID NO: 2209366 - RNA, 23 nt, Homo sapiens
uaaacccgaggaagaugcucauc

SEQ ID NO: 2209367 - RNA, 12 nt, Homo sapiens
agaggacacaau

SEQ ID NO: 2209368 - RNA, 13 nt, Homo sapiens
gccauaccauucc

SEQ ID NO: 2209369 - RNA, 13 nt, Homo sapiens
ucauacugaugcc

SEQ ID NO: 2209370 - RNA, 19 nt, Homo sapiens
gcaguagcagcagcaucuc

SEQ ID NO: 2209371 - RNA, 23 nt, Homo sapiens
uuauggaguucuucuucuccuag

SEQ ID NO: 2209372 - RNA, 14 nt, Homo sapiens
aguaucuugggugu

SEQ ID NO: 2209373 - RNA, 13 nt, Homo sapiens
uugauugauuugg

SEQ ID NO: 2209374 - RNA, 20 nt, Homo sapiens
aaauguaugagacugggcau

SEQ ID NO: 2209375 - RNA, 16 nt, Homo sapiens
auuacaguagugcauu

SEQ ID NO: 2209376 - RNA, 13 nt, Homo sapiens
gaguugggggcua

SEQ ID NO: 2209377 - RNA, 13 nt, Homo sapiens
gagcugggggcca

SEQ ID NO: 2209378 - RNA, 14 nt, Homo sapiens
acuaaagagcacua

SEQ ID NO: 2209379 - RNA, 21 nt, Homo sapiens
gaaacaccuucucuggagcca

SEQ ID NO: 2209380 - RNA, 15 nt, Homo sapiens
cucagcuuuccuuaa

SEQ ID NO: 2209381 - RNA, 14 nt, Homo sapiens
ccuuugaaauuucu

SEQ ID NO: 2209382 - RNA, 21 nt, Homo sapiens
uucucucaaaugauacaguca

SEQ ID NO: 2209383 - RNA, 22 nt, Homo sapiens
ccacauauuuuagacacuuccc

SEQ ID NO: 2209384 - RNA, 22 nt, Homo sapiens
gcccacgucccgggcacuguca

SEQ ID NO: 2209385 - RNA, 13 nt, Homo sapiens
caaauauucagua

SEQ ID NO: 2209386 - RNA, 20 nt, Homo sapiens
gcccuggaauugcagcugua

SEQ ID NO: 2209387 - RNA, 23 nt, Homo sapiens
cagacaggaaggaagcacaaaag

SEQ ID NO: 2209388 - RNA, 21 nt, Homo sapiens
uggcagcgccucaucuucaac

SEQ ID NO: 2209389 - RNA, 20 nt, Homo sapiens
gccauggagguuaagcacuu

SEQ ID NO: 2209390 - RNA, 13 nt, Homo sapiens
acaaaagaaggcu

SEQ ID NO: 2209391 - RNA, 22 nt, Homo sapiens
augaugaguaacuuaaccagca

SEQ ID NO: 2209392 - RNA, 22 nt, Homo sapiens
gcuccagcugauccagauguua

SEQ ID NO: 2209393 - RNA, 22 nt, Homo sapiens
acuguccagguaggaaacaauu

SEQ ID NO: 2209394 - RNA, 20 nt, Homo sapiens
uaaaauguugaaaagucaaa

SEQ ID NO: 2209395 - RNA, 20 nt, Homo sapiens
cuuaaaauagaaauauauua

SEQ ID NO: 2209396 - RNA, 20 nt, Homo sapiens
aaagaagaagagaugacaaa

SEQ ID NO: 2209397 - RNA, 20 nt, Homo sapiens
ccuuccccagacuugcacug

SEQ ID NO: 2209398 - RNA, 17 nt, Homo sapiens
agcaaaugaucagccuu

SEQ ID NO: 2209399 - RNA, 15 nt, Homo sapiens
auaacuauguugaua

SEQ ID NO: 2209400 - RNA, 20 nt, Homo sapiens
aacuuuagugcuacagaaaa

SEQ ID NO: 2209401 - RNA, 15 nt, Homo sapiens
cauuagggcaaagau

SEQ ID NO: 2209402 - RNA, 23 nt, Homo sapiens
acuuuuaaguugcugaugaacuc

SEQ ID NO: 2209403 - RNA, 20 nt, Homo sapiens
augggagggggcuccaugga

SEQ ID NO: 2209404 - RNA, 17 nt, Homo sapiens
ccucucuuaaaugcaag

SEQ ID NO: 2209405 - RNA, 16 nt, Homo sapiens
gucuucuuacuuggaa

SEQ ID NO: 2209406 - RNA, 19 nt, Homo sapiens
ucauuuuaacaucugagaa

SEQ ID NO: 2209407 - RNA, 15 nt, Homo sapiens
uuaauaugauucuag

SEQ ID NO: 2209408 - RNA, 15 nt, Homo sapiens
gcuccuguggcagcu

SEQ ID NO: 2209409 - RNA, 14 nt, Homo sapiens
cauuuucagacugc

SEQ ID NO: 2209410 - RNA, 17 nt, Homo sapiens
cuguaacuacaaugaug

SEQ ID NO: 2209411 - RNA, 16 nt, Homo sapiens
acuauggaaaagggau

SEQ ID NO: 2209412 - RNA, 16 nt, Homo sapiens
agagccguuacuacac

SEQ ID NO: 2209413 - RNA, 14 nt, Homo sapiens
ugcucaggccuccc

SEQ ID NO: 2209414 - RNA, 18 nt, Homo sapiens
auaugaacuggaccugca

SEQ ID NO: 2209415 - RNA, 22 nt, Homo sapiens
gcacacuuauuuuuuucccaag

SEQ ID NO: 2209416 - RNA, 14 nt, Homo sapiens
aaguuuuacuugau

SEQ ID NO: 2209417 - RNA, 19 nt, Homo sapiens
ugcuucaaacuaacacauu

SEQ ID NO: 2209418 - RNA, 20 nt, Homo sapiens
cccagggacugcagguugug

SEQ ID NO: 2209419 - RNA, 18 nt, Homo sapiens
uuaaagcuuucaacaugu

SEQ ID NO: 2209420 - RNA, 15 nt, Homo sapiens
caaaaagagacugau

SEQ ID NO: 2209421 - RNA, 21 nt, Homo sapiens
accaugagaccacuguuauca

SEQ ID NO: 2209422 - RNA, 18 nt, Homo sapiens
ucauuaaucaauuucuca

SEQ ID NO: 2209423 - RNA, 16 nt, Homo sapiens
ugggcuggaacaugua

SEQ ID NO: 2209424 - RNA, 12 nt, Homo sapiens
uguuacuuugaa

SEQ ID NO: 2209425 - RNA, 17 nt, Homo sapiens
cagagcuuuacagugcc

SEQ ID NO: 2209426 - RNA, 22 nt, Homo sapiens
aaagccacacucugggcuccag

SEQ ID NO: 2209427 - RNA, 18 nt, Homo sapiens
gaagucuggcuuugcucu

SEQ ID NO: 2209428 - RNA, 19 nt, Homo sapiens
guggaccaaugcaucucuu

SEQ ID NO: 2209429 - RNA, 18 nt, Homo sapiens
cuggccauggccugcaaa

SEQ ID NO: 2209430 - RNA, 22 nt, Homo sapiens
cggacaagacccccagcacuug

SEQ ID NO: 2209431 - RNA, 14 nt, Homo sapiens
gcauaaaucacuuc

SEQ ID NO: 2209432 - RNA, 16 nt, Homo sapiens
ucuuacuugcauuuau

SEQ ID NO: 2209433 - RNA, 14 nt, Homo sapiens
augcauaagcuuuu

SEQ ID NO: 2209434 - RNA, 20 nt, Homo sapiens
uccauguuugauguaucuga

SEQ ID NO: 2209435 - RNA, 23 nt, Homo sapiens
auacugccugacaagugccugac

SEQ ID NO: 2209436 - RNA, 12 nt, Homo sapiens
aggacauucuau

SEQ ID NO: 2209437 - RNA, 20 nt, Homo sapiens
cacagugcccaccugcucuu

SEQ ID NO: 2209438 - RNA, 14 nt, Homo sapiens
aacaauucugugac

SEQ ID NO: 2209439 - RNA, 15 nt, Homo sapiens
gauacauaccugguu

SEQ ID NO: 2209440 - RNA, 14 nt, Homo sapiens
gugaaccccaaagu

SEQ ID NO: 2209441 - RNA, 13 nt, Homo sapiens
agcauuagcuuua

SEQ ID NO: 2209442 - RNA, 14 nt, Homo sapiens
caauaacuucugac

SEQ ID NO: 2209443 - RNA, 17 nt, Homo sapiens
cuggcagggcccaguga

SEQ ID NO: 2209444 - RNA, 15 nt, Homo sapiens
aauuugaugacuuau

SEQ ID NO: 2209445 - RNA, 16 nt, Homo sapiens
gaugcaaagguugcag

SEQ ID NO: 2209446 - RNA, 23 nt, Homo sapiens
gagccaaggagggagggucuucc

SEQ ID NO: 2209447 - RNA, 20 nt, Homo sapiens
ccauguaagcaccccuucau

SEQ ID NO: 2209448 - RNA, 16 nt, Homo sapiens
auguauguacaauaca

SEQ ID NO: 2209449 - RNA, 16 nt, Homo sapiens
cccaggcaaggcugug

SEQ ID NO: 2209450 - RNA, 18 nt, Homo sapiens
cuguaaauugcagaauuc

SEQ ID NO: 2209451 - RNA, 14 nt, Homo sapiens
caucucaggggcca

SEQ ID NO: 2209452 - RNA, 14 nt, Homo sapiens
cauggggucccugc

SEQ ID NO: 2209453 - RNA, 11 nt, Homo sapiens
auaaugcagau

SEQ ID NO: 2209454 - RNA, 23 nt, Homo sapiens
uuccauuuugugaauugugacau

SEQ ID NO: 2209455 - RNA, 18 nt, Homo sapiens
ccuuggccuugcagcugg

SEQ ID NO: 2209456 - RNA, 13 nt, Homo sapiens
cacuggcaucucc

SEQ ID NO: 2209457 - RNA, 21 nt, Homo sapiens
aguuuuuuuuuauacacugua

SEQ ID NO: 2209458 - RNA, 18 nt, Homo sapiens
guaauugcauuucugcuc

SEQ ID NO: 2209459 - RNA, 12 nt, Homo sapiens
guauaaggugag

SEQ ID NO: 2209460 - RNA, 12 nt, Homo sapiens
gcugggugacag

SEQ ID NO: 2209461 - RNA, 12 nt, Homo sapiens
agguccugcuac

SEQ ID NO: 2209462 - RNA, 18 nt, Homo sapiens
gcuuugaaacuugccugg

SEQ ID NO: 2209463 - RNA, 19 nt, Homo sapiens
auaucuuacaaaauacaca

SEQ ID NO: 2209464 - RNA, 16 nt, Homo sapiens
accugucauuuugcac

SEQ ID NO: 2209465 - RNA, 19 nt, Homo sapiens
uugaguagaguugaucaaa

SEQ ID NO: 2209466 - RNA, 14 nt, Homo sapiens
aggugugggugccu

SEQ ID NO: 2209467 - RNA, 15 nt, Homo sapiens
gugaggcccguguga

SEQ ID NO: 2209468 - RNA, 16 nt, Homo sapiens
gcaagagaauuacuug

SEQ ID NO: 2209469 - RNA, 22 nt, Homo sapiens
aaaagaagaaauaaauaaucua

SEQ ID NO: 2209470 - RNA, 21 nt, Homo sapiens
uuaucacuuuuugaacuaaga

SEQ ID NO: 2209471 - RNA, 20 nt, Homo sapiens
gacaaaaugacuggcuccug

SEQ ID NO: 2209472 - RNA, 12 nt, Homo sapiens
cauuaccacuca

SEQ ID NO: 2209473 - RNA, 12 nt, Homo sapiens
aagacccagugu

SEQ ID NO: 2209474 - RNA, 17 nt, Homo sapiens
cuccagggucuaaagag

SEQ ID NO: 2209475 - RNA, 12 nt, Homo sapiens
guuguuguucuc

SEQ ID NO: 2209476 - RNA, 11 nt, Homo sapiens
aaagacuucca

SEQ ID NO: 2209477 - RNA, 13 nt, Homo sapiens
ucuaaaccacaaa

SEQ ID NO: 2209478 - RNA, 13 nt, Homo sapiens
agaguaccugugu

SEQ ID NO: 2209479 - RNA, 21 nt, Homo sapiens
caaaccaggauuuccuugacu

SEQ ID NO: 2209480 - RNA, 15 nt, Homo sapiens
uguuucugguaugaa

SEQ ID NO: 2209481 - RNA, 22 nt, Homo sapiens
augcugcagguguuugaccucc

SEQ ID NO: 2209482 - RNA, 18 nt, Homo sapiens
cuauuuacaaggaugaaa

SEQ ID NO: 2209483 - RNA, 13 nt, Homo sapiens
guauaguguucac

SEQ ID NO: 2209484 - RNA, 21 nt, Homo sapiens
cacaaaaagaaagcugugaaa

SEQ ID NO: 2209485 - RNA, 16 nt, Homo sapiens
guaaucaucuaaguca

SEQ ID NO: 2209486 - RNA, 17 nt, Homo sapiens
agauauacugggagaaa

SEQ ID NO: 2209487 - RNA, 15 nt, Homo sapiens
auaaaucaaucuuau

SEQ ID NO: 2209488 - RNA, 17 nt, Homo sapiens
gacaacucuuauuugaa

SEQ ID NO: 2209489 - RNA, 11 nt, Homo sapiens
auugucuucca

SEQ ID NO: 2209490 - RNA, 13 nt, Homo sapiens
aauuuaaaacuuu

SEQ ID NO: 2209491 - RNA, 13 nt, Homo sapiens
aaacaaaaacaca

SEQ ID NO: 2209492 - RNA, 17 nt, Homo sapiens
uaaaugcacagucaugu

SEQ ID NO: 2209493 - RNA, 23 nt, Homo sapiens
caggucccaggcuccuaugcaag

SEQ ID NO: 2209494 - RNA, 16 nt, Homo sapiens
cauguaaucacauaug

SEQ ID NO: 2209495 - RNA, 23 nt, Homo sapiens
acucuguuugaagaaaauaguca

SEQ ID NO: 2209496 - RNA, 19 nt, Homo sapiens
aauauuuuuguauauacuu

SEQ ID NO: 2209497 - RNA, 12 nt, Homo sapiens
gaaaacuggaaa

SEQ ID NO: 2209498 - RNA, 12 nt, Homo sapiens
agaaacugagaa

SEQ ID NO: 2209499 - RNA, 12 nt, Homo sapiens
caaaacugcaaa

SEQ ID NO: 2209500 - RNA, 12 nt, Homo sapiens
ugaaacugugaa

SEQ ID NO: 2209501 - RNA, 12 nt, Homo sapiens
gaagacuggaag

SEQ ID NO: 2209502 - RNA, 21 nt, Homo sapiens
caguaauuuuaaguaauuuca

SEQ ID NO: 2209503 - RNA, 20 nt, Homo sapiens
cuauaauaaguuuugauaua

SEQ ID NO: 2209504 - RNA, 22 nt, Homo sapiens
uagacaaaggccuuaacaaacg

SEQ ID NO: 2209505 - RNA, 21 nt, Homo sapiens
acgcuucgggaaaauauucau

SEQ ID NO: 2209506 - RNA, 12 nt, Homo sapiens
auuuuauuaaau

SEQ ID NO: 2209507 - RNA, 20 nt, Homo sapiens
uagccauuucuucuguucua

SEQ ID NO: 2209508 - RNA, 17 nt, Homo sapiens
ggacacuagugacagua

SEQ ID NO: 2209509 - RNA, 18 nt, Homo sapiens
uuaauuaauggaaucuuc

SEQ ID NO: 2209510 - RNA, 18 nt, Homo sapiens
uggcugcuuuugucuccc

SEQ ID NO: 2209511 - RNA, 20 nt, Homo sapiens
cuaccuugucuguuagccau

SEQ ID NO: 2209512 - RNA, 14 nt, Homo sapiens
ugaagacaaaccac

SEQ ID NO: 2209513 - RNA, 15 nt, Homo sapiens
cuggucugcucagga

SEQ ID NO: 2209514 - RNA, 19 nt, Homo sapiens
gaauaaacuagacucugaa

SEQ ID NO: 2209515 - RNA, 13 nt, Homo sapiens
ucuagaagccaag

SEQ ID NO: 2209516 - RNA, 13 nt, Homo sapiens
ucaugaagccuug

SEQ ID NO: 2209517 - RNA, 13 nt, Homo sapiens
uauaaaagcaaaa

SEQ ID NO: 2209518 - RNA, 18 nt, Homo sapiens
aggguucaucuguccaug

SEQ ID NO: 2209519 - RNA, 18 nt, Homo sapiens
uaaagugcugcacucaaa

SEQ ID NO: 2209520 - RNA, 20 nt, Homo sapiens
aaucugagccagugcuuuaa

SEQ ID NO: 2209521 - RNA, 15 nt, Homo sapiens
uuaccaauugcuaag

SEQ ID NO: 2209522 - RNA, 17 nt, Homo sapiens
acaaagggccagcaguc

SEQ ID NO: 2209523 - RNA, 15 nt, Homo sapiens
ugggguucucuacag

SEQ ID NO: 2209524 - RNA, 22 nt, Homo sapiens
agcugaagcccaugcuuuccca

SEQ ID NO: 2209525 - RNA, 14 nt, Homo sapiens
uaaaguuggaauuu

SEQ ID NO: 2209526 - RNA, 17 nt, Homo sapiens
ugcuugcacaaaccaau

SEQ ID NO: 2209527 - RNA, 18 nt, Homo sapiens
guacuauauuugugaaua

SEQ ID NO: 2209528 - RNA, 15 nt, Homo sapiens
auucucacaaggaaa

SEQ ID NO: 2209529 - RNA, 14 nt, Homo sapiens
uguaagugcugcua

SEQ ID NO: 2209530 - RNA, 15 nt, Homo sapiens
gaaaaaaaugaucua

SEQ ID NO: 2209531 - RNA, 22 nt, Homo sapiens
cauggcucauucugcaaugagc

SEQ ID NO: 2209532 - RNA, 21 nt, Homo sapiens
gaccgauagcaggugaacucg

SEQ ID NO: 2209533 - RNA, 22 nt, Homo sapiens
auauuuaaaaaaaaacauucaa

SEQ ID NO: 2209534 - RNA, 14 nt, Homo sapiens
uuaagggcauuuaa

SEQ ID NO: 2209535 - RNA, 13 nt, Homo sapiens
cuaaguauauuaa

SEQ ID NO: 2209536 - RNA, 20 nt, Homo sapiens
aaugaaggaaaaccucacuu

SEQ ID NO: 2209537 - RNA, 20 nt, Homo sapiens
guuacucaggguucaucugu

SEQ ID NO: 2209538 - RNA, 15 nt, Homo sapiens
gugcugggauuacag

SEQ ID NO: 2209539 - RNA, 18 nt, Homo sapiens
cuacugaacccagaguca

SEQ ID NO: 2209540 - RNA, 22 nt, Homo sapiens
cucugcacuauagccauuugcc

SEQ ID NO: 2209541 - RNA, 16 nt, Homo sapiens
acgcacuggugccaaa

SEQ ID NO: 2209542 - RNA, 20 nt, Homo sapiens
aaagaccaguuuccauuuau

SEQ ID NO: 2209543 - RNA, 17 nt, Homo sapiens
uugguuugugugaucau

SEQ ID NO: 2209544 - RNA, 14 nt, Homo sapiens
agccaggcguggug

SEQ ID NO: 2209545 - RNA, 14 nt, Homo sapiens
aggcuaugaauaua

SEQ ID NO: 2209546 - RNA, 14 nt, Homo sapiens
aauauaugaggcua

SEQ ID NO: 2209547 - RNA, 17 nt, Homo sapiens
cauuugaaugcuuaauu

SEQ ID NO: 2209548 - RNA, 18 nt, Homo sapiens
cagcagcugaagccagcu

SEQ ID NO: 2209549 - RNA, 15 nt, Homo sapiens
acaaauguaaugggc

SEQ ID NO: 2209550 - RNA, 18 nt, Homo sapiens
agaaccucaaacuaggag

SEQ ID NO: 2209551 - RNA, 13 nt, Homo sapiens
auaacaaucacaa

SEQ ID NO: 2209552 - RNA, 20 nt, Homo sapiens
uuugcagauauucucuaguc

SEQ ID NO: 2209553 - RNA, 19 nt, Homo sapiens
caggcuucugcaguucuca

SEQ ID NO: 2209554 - RNA, 17 nt, Homo sapiens
guuugauuauucagugu

SEQ ID NO: 2209555 - RNA, 16 nt, Homo sapiens
uuguugcugucaagau

SEQ ID NO: 2209556 - RNA, 24 nt, Homo sapiens
agacacugaagaagucacugaaca

SEQ ID NO: 2209557 - RNA, 21 nt, Homo sapiens
cacacgucuggcuucacagau

SEQ ID NO: 2209558 - RNA, 14 nt, Homo sapiens
auauggucccaaau

SEQ ID NO: 2209559 - RNA, 16 nt, Homo sapiens
aacauccuacaagaca

SEQ ID NO: 2209560 - RNA, 22 nt, Homo sapiens
gcucuggacucuaaagaccaaa

SEQ ID NO: 2209561 - RNA, 18 nt, Homo sapiens
aaccugcccacccacucc

SEQ ID NO: 2209562 - RNA, 15 nt, Homo sapiens
acauuuuacauuaaa

SEQ ID NO: 2209563 - RNA, 20 nt, Homo sapiens
aguucacagccuagaagaag

SEQ ID NO: 2209564 - RNA, 12 nt, Homo sapiens
ucugcugucuca

SEQ ID NO: 2209565 - RNA, 15 nt, Homo sapiens
cccuggugcugccac

SEQ ID NO: 2209566 - RNA, 19 nt, Homo sapiens
caccaguugaauuucauca

SEQ ID NO: 2209567 - RNA, 17 nt, Homo sapiens
ucugcauaaacuucauc

SEQ ID NO: 2209568 - RNA, 20 nt, Homo sapiens
accagcagcuggaaucugaa

SEQ ID NO: 2209569 - RNA, 16 nt, Homo sapiens
agauuguuaaaauaac

SEQ ID NO: 2209570 - RNA, 13 nt, Homo sapiens
gccaaagaccucc

SEQ ID NO: 2209571 - RNA, 18 nt, Homo sapiens
cauagagcagugcacauc

SEQ ID NO: 2209572 - RNA, 11 nt, Homo sapiens
uuuugcacuga

SEQ ID NO: 2209573 - RNA, 18 nt, Homo sapiens
cuauuaguccccacccaa

SEQ ID NO: 2209574 - RNA, 22 nt, Homo sapiens
cagcguuuuuaccuaggcacca

SEQ ID NO: 2209575 - RNA, 20 nt, Homo sapiens
cccaggcugcuggagugcag

SEQ ID NO: 2209576 - RNA, 17 nt, Homo sapiens
cuucgaguggccagcuu

SEQ ID NO: 2209577 - RNA, 22 nt, Homo sapiens
gcucacacugagaauguaagaa

SEQ ID NO: 2209578 - RNA, 17 nt, Homo sapiens
gcccuagagcacacugu

SEQ ID NO: 2209579 - RNA, 15 nt, Homo sapiens
gacugacgccagggu

SEQ ID NO: 2209580 - RNA, 14 nt, Homo sapiens
gaaggaugcugucu

SEQ ID NO: 2209581 - RNA, 15 nt, Homo sapiens
cgugcuccccugcuc

SEQ ID NO: 2209582 - RNA, 15 nt, Homo sapiens
agagauacacagaua

SEQ ID NO: 2209583 - RNA, 21 nt, Homo sapiens
caacacggugaaaccccaucu

SEQ ID NO: 2209584 - RNA, 17 nt, Homo sapiens
guauuauggugauacuc

SEQ ID NO: 2209585 - RNA, 16 nt, Homo sapiens
aaucugcucacuuuaa

SEQ ID NO: 2209586 - RNA, 18 nt, Homo sapiens
agagugcccagaacugga

SEQ ID NO: 2209587 - RNA, 14 nt, Homo sapiens
ccuugaaugccaua

SEQ ID NO: 2209588 - RNA, 22 nt, Homo sapiens
aagacaguauuuauuggugggu

SEQ ID NO: 2209589 - RNA, 20 nt, Homo sapiens
ccugagaugauuuggucaga

SEQ ID NO: 2209590 - RNA, 20 nt, Homo sapiens
aaugggagagcucuuguuau

SEQ ID NO: 2209591 - RNA, 19 nt, Homo sapiens
cuuggagagucggccagac

SEQ ID NO: 2209592 - RNA, 13 nt, Homo sapiens
ucugaaaacaaag

SEQ ID NO: 2209593 - RNA, 20 nt, Homo sapiens
ggauuuauugagugccaacu

SEQ ID NO: 2209594 - RNA, 22 nt, Homo sapiens
agacagcuauuucgcacuguau

SEQ ID NO: 2209595 - RNA, 13 nt, Homo sapiens
gaugagaacacac

SEQ ID NO: 2209596 - RNA, 21 nt, Homo sapiens
gcacacuugcacccaugugua

SEQ ID NO: 2209597 - RNA, 23 nt, Homo sapiens
uacuaagauguucacuguggcau

SEQ ID NO: 2209598 - RNA, 19 nt, Homo sapiens
agagauugugguggugcua

SEQ ID NO: 2209599 - RNA, 18 nt, Homo sapiens
aaaacucuucuacuuuca

SEQ ID NO: 2209600 - RNA, 13 nt, Homo sapiens
aucccaucugcau

SEQ ID NO: 2209601 - RNA, 22 nt, Homo sapiens
guuccucgggaugaaaagccau

SEQ ID NO: 2209602 - RNA, 22 nt, Homo sapiens
uagucugaacaauauauacuua

SEQ ID NO: 2209603 - RNA, 23 nt, Homo sapiens
gacauugauacagugaagauaca

SEQ ID NO: 2209604 - RNA, 20 nt, Homo sapiens
uggaaugaagaccaugccua

SEQ ID NO: 2209605 - RNA, 15 nt, Homo sapiens
agugauccacccacc

SEQ ID NO: 2209606 - RNA, 19 nt, Homo sapiens
auauuugugugaggacuuc

SEQ ID NO: 2209607 - RNA, 16 nt, Homo sapiens
ccaugacgcacugcuc

SEQ ID NO: 2209608 - RNA, 18 nt, Homo sapiens
acacauacacacucauac

SEQ ID NO: 2209609 - RNA, 20 nt, Homo sapiens
aaagcuguugcugucccuaa

SEQ ID NO: 2209610 - RNA, 16 nt, Homo sapiens
ccaccaccccaguuuc

SEQ ID NO: 2209611 - RNA, 15 nt, Homo sapiens
aagcuguccuugagc

SEQ ID NO: 2209612 - RNA, 16 nt, Homo sapiens
cuuuuaagcagucuca

SEQ ID NO: 2209613 - RNA, 16 nt, Homo sapiens
cgccccuuccuagguc

SEQ ID NO: 2209614 - RNA, 16 nt, Homo sapiens
aaguauuuauucagga

SEQ ID NO: 2209615 - RNA, 19 nt, Homo sapiens
gccacgggaagaaccaagc

SEQ ID NO: 2209616 - RNA, 17 nt, Homo sapiens
auagaaugcugaacuca

SEQ ID NO: 2209617 - RNA, 17 nt, Homo sapiens
ugucagcccaugugcac

SEQ ID NO: 2209618 - RNA, 21 nt, Homo sapiens
aggcccaugaaauugaugaac

SEQ ID NO: 2209619 - RNA, 16 nt, Homo sapiens
auccuccuugucuuaa

SEQ ID NO: 2209620 - RNA, 15 nt, Homo sapiens
uaaaugaaugcacaa

SEQ ID NO: 2209621 - RNA, 13 nt, Homo sapiens
acaguggacaaag

SEQ ID NO: 2209622 - RNA, 12 nt, Homo sapiens
ggguacuauuca

SEQ ID NO: 2209623 - RNA, 19 nt, Homo sapiens
aaggggcuguuacauaaca

SEQ ID NO: 2209624 - RNA, 13 nt, Homo sapiens
cuauuuauuucac

SEQ ID NO: 2209625 - RNA, 15 nt, Homo sapiens
ugaccugagccagac

SEQ ID NO: 2209626 - RNA, 23 nt, Homo sapiens
gacauccucugcuaccaucucau

SEQ ID NO: 2209627 - RNA, 16 nt, Homo sapiens
aaagaaauuccccaag

SEQ ID NO: 2209628 - RNA, 16 nt, Homo sapiens
ucuacguaucugcuac

SEQ ID NO: 2209629 - RNA, 15 nt, Homo sapiens
uggagaccucuccuu

SEQ ID NO: 2209630 - RNA, 15 nt, Homo sapiens
auauuguacauaaaa

SEQ ID NO: 2209631 - RNA, 15 nt, Homo sapiens
uagagcaaccaguca

SEQ ID NO: 2209632 - RNA, 23 nt, Homo sapiens
gucaauaccccuguuaagcaauu

SEQ ID NO: 2209633 - RNA, 22 nt, Homo sapiens
uuugagucccccagagauguca

SEQ ID NO: 2209634 - RNA, 16 nt, Homo sapiens
uauggcuagacaggaa

SEQ ID NO: 2209635 - RNA, 22 nt, Homo sapiens
cccagcccugaacaaagcaccu

SEQ ID NO: 2209636 - RNA, 17 nt, Homo sapiens
acccuuuugcaggcucc

SEQ ID NO: 2209637 - RNA, 19 nt, Homo sapiens
aaggacagcugaaugacgg

SEQ ID NO: 2209638 - RNA, 17 nt, Homo sapiens
cacauguacccuaaaac

SEQ ID NO: 2209639 - RNA, 14 nt, Homo sapiens
cagacaccagauuu

SEQ ID NO: 2209640 - RNA, 17 nt, Homo sapiens
uccuuagaauacuguau

SEQ ID NO: 2209641 - RNA, 18 nt, Homo sapiens
aaccccaacgcacaggaa

SEQ ID NO: 2209642 - RNA, 11 nt, Homo sapiens
cucacuacuga

SEQ ID NO: 2209643 - RNA, 12 nt, Homo sapiens
ugauuuccucua

SEQ ID NO: 2209644 - RNA, 21 nt, Homo sapiens
uguaaauuaguuugacacugc

SEQ ID NO: 2209645 - RNA, 23 nt, Homo sapiens
agaacggaagaagagaucaggaa

SEQ ID NO: 2209646 - RNA, 17 nt, Homo sapiens
cauuaaaauccaguauu

SEQ ID NO: 2209647 - RNA, 13 nt, Homo sapiens
gcaaagcccagcu

SEQ ID NO: 2209648 - RNA, 14 nt, Homo sapiens
ugcaccaccaagcc

SEQ ID NO: 2209649 - RNA, 14 nt, Homo sapiens
gaggcaaggggugg

SEQ ID NO: 2209650 - RNA, 11 nt, Homo sapiens
ccauucugcuu

SEQ ID NO: 2209651 - RNA, 15 nt, Homo sapiens
uagauaaauuucaau

SEQ ID NO: 2209652 - RNA, 23 nt, Homo sapiens
uugcuauggggagaaaagacaug

SEQ ID NO: 2209653 - RNA, 16 nt, Homo sapiens
uccacccuauucccua

SEQ ID NO: 2209654 - RNA, 18 nt, Homo sapiens
auaacaauauaugauaua

SEQ ID NO: 2209655 - RNA, 18 nt, Homo sapiens
cagaguaucugucuuauu

SEQ ID NO: 2209656 - RNA, 14 nt, Homo sapiens
uggcuugacucagg

SEQ ID NO: 2209657 - RNA, 13 nt, Homo sapiens
ccauaaucacuca

SEQ ID NO: 2209658 - RNA, 18 nt, Homo sapiens
guaaacuaguacuauuau

SEQ ID NO: 2209659 - RNA, 18 nt, Homo sapiens
gcuauaugccuuaagcca

SEQ ID NO: 2209660 - RNA, 19 nt, Homo sapiens
gccuagcaggcacaggaca

SEQ ID NO: 2209661 - RNA, 14 nt, Homo sapiens
ucaccccagaggac

SEQ ID NO: 2209662 - RNA, 23 nt, Homo sapiens
guuuccuaggaaaucacaggcuu

SEQ ID NO: 2209663 - RNA, 13 nt, Homo sapiens
ccuugaagcaaua

SEQ ID NO: 2209664 - RNA, 21 nt, Homo sapiens
gucaaugauuguguagccaug

SEQ ID NO: 2209665 - RNA, 20 nt, Homo sapiens
acacacgcacacaaaccaca

SEQ ID NO: 2209666 - RNA, 19 nt, Homo sapiens
uagagacagugaugccugc

SEQ ID NO: 2209667 - RNA, 15 nt, Homo sapiens
gcucccucacucuca

SEQ ID NO: 2209668 - RNA, 21 nt, Homo sapiens
cuuuuguuaaaagaugguaaa

SEQ ID NO: 2209669 - RNA, 15 nt, Homo sapiens
gaaacgccaacaaaa

SEQ ID NO: 2209670 - RNA, 20 nt, Homo sapiens
acaugaaacugaauaaggag

SEQ ID NO: 2209671 - RNA, 13 nt, Homo sapiens
ucucauccacuuu

SEQ ID NO: 2209672 - RNA, 21 nt, Homo sapiens
gccugaguguccacagggaca

SEQ ID NO: 2209673 - RNA, 17 nt, Homo sapiens
cucaucaccacagggau

SEQ ID NO: 2209674 - RNA, 12 nt, Homo sapiens
cuaaacuacuga

SEQ ID NO: 2209675 - RNA, 13 nt, Homo sapiens
uucuaaauggaaa

SEQ ID NO: 2209676 - RNA, 16 nt, Homo sapiens
acccucauuucugcca

SEQ ID NO: 2209677 - RNA, 13 nt, Homo sapiens
cacacacauauau

SEQ ID NO: 2209678 - RNA, 15 nt, Homo sapiens
uccucugcuugccau

SEQ ID NO: 2209679 - RNA, 20 nt, Homo sapiens
aaggguagguuagaugcuau

SEQ ID NO: 2209680 - RNA, 20 nt, Homo sapiens
gggagucucucuuccaaguc

SEQ ID NO: 2209681 - RNA, 22 nt, Homo sapiens
ugacaaugaagugacacuuuga

SEQ ID NO: 2209682 - RNA, 22 nt, Homo sapiens
uucuacaccuguugcaccucag

SEQ ID NO: 2209683 - RNA, 20 nt, Homo sapiens
aggguggcaagggaugugcu

SEQ ID NO: 2209684 - RNA, 14 nt, Homo sapiens
uccaucauaugccu

SEQ ID NO: 2209685 - RNA, 20 nt, Homo sapiens
ugacaaaugacgucuucacc

SEQ ID NO: 2209686 - RNA, 14 nt, Homo sapiens
aaaucacacuguaa

SEQ ID NO: 2209687 - RNA, 23 nt, Homo sapiens
auuuuugaauugagaugaucaau

SEQ ID NO: 2209688 - RNA, 21 nt, Homo sapiens
aagagucugugcugguugcca

SEQ ID NO: 2209689 - RNA, 15 nt, Homo sapiens
ccaacaaacauugau

SEQ ID NO: 2209690 - RNA, 20 nt, Homo sapiens
guauuaaguauuacugagua

SEQ ID NO: 2209691 - RNA, 18 nt, Homo sapiens
gaaccagauucuauccuc

SEQ ID NO: 2209692 - RNA, 23 nt, Homo sapiens
agagucauuaagcgggaucccag

SEQ ID NO: 2209693 - RNA, 12 nt, Homo sapiens
agugaaguaauu

SEQ ID NO: 2209694 - RNA, 15 nt, Homo sapiens
aaaaugcugcucuca

SEQ ID NO: 2209695 - RNA, 18 nt, Homo sapiens
cuaaguauauuaauauca

SEQ ID NO: 2209696 - RNA, 17 nt, Homo sapiens
ucccaauguugucauuu

SEQ ID NO: 2209697 - RNA, 13 nt, Homo sapiens
ucgagacauuccu

SEQ ID NO: 2209698 - RNA, 18 nt, Homo sapiens
uacuucugugugcaauug

SEQ ID NO: 2209699 - RNA, 18 nt, Homo sapiens
uucucacauaacagagua

SEQ ID NO: 2209700 - RNA, 17 nt, Homo sapiens
uuccagaaggauccaag

SEQ ID NO: 2209701 - RNA, 16 nt, Homo sapiens
agagaggccugugcua

SEQ ID NO: 2209702 - RNA, 20 nt, Homo sapiens
uacaaguguucuuagguuua

SEQ ID NO: 2209703 - RNA, 12 nt, Homo sapiens
uccagacacaug

SEQ ID NO: 2209704 - RNA, 15 nt, Homo sapiens
uauacaagugauaau

SEQ ID NO: 2209705 - RNA, 22 nt, Homo sapiens
agcagcaccuccuccaugcagg

SEQ ID NO: 2209706 - RNA, 14 nt, Homo sapiens
acaagcuucugucc

SEQ ID NO: 2209707 - RNA, 20 nt, Homo sapiens
gagguggggcuggaugucuc

SEQ ID NO: 2209708 - RNA, 18 nt, Homo sapiens
accuaucccacagcaauc

SEQ ID NO: 2209709 - RNA, 10 nt, Homo sapiens
ccucugcucu

SEQ ID NO: 2209710 - RNA, 20 nt, Homo sapiens
agaaacuccaccuauuuugc

SEQ ID NO: 2209711 - RNA, 20 nt, Homo sapiens
uaauacauuucugaguacca

SEQ ID NO: 2209712 - RNA, 18 nt, Homo sapiens
gccccuccccagacucuc

SEQ ID NO: 2209713 - RNA, 21 nt, Homo sapiens
cccuuguuucuauacauucua

SEQ ID NO: 2209714 - RNA, 15 nt, Homo sapiens
auauccauaaccucu

SEQ ID NO: 2209715 - RNA, 23 nt, Homo sapiens
guauuuuauuacaucuuucacau

SEQ ID NO: 2209716 - RNA, 13 nt, Homo sapiens
aaaaucaucaaag

SEQ ID NO: 2209717 - RNA, 13 nt, Homo sapiens
aaucucguuucaa

SEQ ID NO: 2209718 - RNA, 16 nt, Homo sapiens
agguuauuaugauuag

SEQ ID NO: 2209719 - RNA, 18 nt, Homo sapiens
gcuccccuuugcuugaag

SEQ ID NO: 2209720 - RNA, 21 nt, Homo sapiens
aaaaucccagacuacuucagc

SEQ ID NO: 2209721 - RNA, 20 nt, Homo sapiens
aauuagucuuuuguaauauc

SEQ ID NO: 2209722 - RNA, 13 nt, Homo sapiens
gaaauauauuuga

SEQ ID NO: 2209723 - RNA, 21 nt, Homo sapiens
gccagacaugguggcaugcac

SEQ ID NO: 2209724 - RNA, 20 nt, Homo sapiens
aaagcggggcuucaucugca

SEQ ID NO: 2209725 - RNA, 19 nt, Homo sapiens
caugcucaaccacuguggc

SEQ ID NO: 2209726 - RNA, 16 nt, Homo sapiens
ucaccugaaacacugg

SEQ ID NO: 2209727 - RNA, 14 nt, Homo sapiens
agcacuaccaguau

SEQ ID NO: 2209728 - RNA, 14 nt, Homo sapiens
uuggugauggggcu

SEQ ID NO: 2209729 - RNA, 20 nt, Homo sapiens
aguuuugccuaauggcaaaa

SEQ ID NO: 2209730 - RNA, 12 nt, Homo sapiens
aggaucaucucu

SEQ ID NO: 2209731 - RNA, 12 nt, Homo sapiens
agcaucaucugu

SEQ ID NO: 2209732 - RNA, 16 nt, Homo sapiens
gcaugacaauugucag

SEQ ID NO: 2209733 - RNA, 12 nt, Homo sapiens
caaaaaaucugu

SEQ ID NO: 2209734 - RNA, 23 nt, Homo sapiens
cacuuauaaauauccugcucaca

SEQ ID NO: 2209735 - RNA, 23 nt, Homo sapiens
ucuaaauccgacuugaauauucc

SEQ ID NO: 2209736 - RNA, 18 nt, Homo sapiens
uagaauguuucauuugca

SEQ ID NO: 2209737 - RNA, 20 nt, Homo sapiens
gcagaaauccugcaaugaaa

SEQ ID NO: 2209738 - RNA, 21 nt, Homo sapiens
agacauuuuguuuuuacugua

SEQ ID NO: 2209739 - RNA, 15 nt, Homo sapiens
cggcgugugcagugc

SEQ ID NO: 2209740 - RNA, 13 nt, Homo sapiens
ugugaggguggug

SEQ ID NO: 2209741 - RNA, 13 nt, Homo sapiens
gcggaggggcuug

SEQ ID NO: 2209742 - RNA, 19 nt, Homo sapiens
auaaaggaucagagauucu

SEQ ID NO: 2209743 - RNA, 17 nt, Homo sapiens
cacagccuccccugcca

SEQ ID NO: 2209744 - RNA, 19 nt, Homo sapiens
agccuugauaauacuugac

SEQ ID NO: 2209745 - RNA, 17 nt, Homo sapiens
aacaauaaagacugaga

SEQ ID NO: 2209746 - RNA, 14 nt, Homo sapiens
ggcuuugcaaaaua

SEQ ID NO: 2209747 - RNA, 22 nt, Homo sapiens
ugucuauauguuuauuuggacu

SEQ ID NO: 2209748 - RNA, 14 nt, Homo sapiens
ugcaauaaauaaca

SEQ ID NO: 2209749 - RNA, 22 nt, Homo sapiens
acuuguugccuauaagccaaaa

SEQ ID NO: 2209750 - RNA, 14 nt, Homo sapiens
guucucacacuggu

SEQ ID NO: 2209751 - RNA, 20 nt, Homo sapiens
agugaugugaucauagcuca

SEQ ID NO: 2209752 - RNA, 14 nt, Homo sapiens
gcaggccacugggg

SEQ ID NO: 2209753 - RNA, 19 nt, Homo sapiens
auguuaugacuccuugaua

SEQ ID NO: 2209754 - RNA, 19 nt, Homo sapiens
aaaaagggggcugcauucu

SEQ ID NO: 2209755 - RNA, 16 nt, Homo sapiens
aaauugguaauauaca

SEQ ID NO: 2209756 - RNA, 19 nt, Homo sapiens
cuuuccaucuuacuugccc

SEQ ID NO: 2209757 - RNA, 21 nt, Homo sapiens
ucaugccacagugguacucug

SEQ ID NO: 2209758 - RNA, 21 nt, Homo sapiens
ggaggcuucucuucugaccca

SEQ ID NO: 2209759 - RNA, 23 nt, Homo sapiens
gagagucagacccuucaauggaa

SEQ ID NO: 2209760 - RNA, 13 nt, Homo sapiens
gcuugcuggguac

SEQ ID NO: 2209761 - RNA, 19 nt, Homo sapiens
uaacugaaaaugaaagugu

SEQ ID NO: 2209762 - RNA, 12 nt, Homo sapiens
cagaauggagcu

SEQ ID NO: 2209763 - RNA, 17 nt, Homo sapiens
aauccuuguagaucuuu

SEQ ID NO: 2209764 - RNA, 16 nt, Homo sapiens
caaaauauuuuuugca

SEQ ID NO: 2209765 - RNA, 17 nt, Homo sapiens
uguguuucuggggacac

SEQ ID NO: 2209766 - RNA, 12 nt, Homo sapiens
uguucuguacaa

SEQ ID NO: 2209767 - RNA, 20 nt, Homo sapiens
caucaaauauuaccaaaaaa

SEQ ID NO: 2209768 - RNA, 17 nt, Homo sapiens
uuaccaaacauuacaaa

SEQ ID NO: 2209769 - RNA, 23 nt, Homo sapiens
cagggucugcucuuucucugcca

SEQ ID NO: 2209770 - RNA, 11 nt, Homo sapiens
uuuuugccagg

SEQ ID NO: 2209771 - RNA, 12 nt, Homo sapiens
ccuuucacugug

SEQ ID NO: 2209772 - RNA, 20 nt, Homo sapiens
auagacugcuacagguaaua

SEQ ID NO: 2209773 - RNA, 15 nt, Homo sapiens
accucggagggaugg

SEQ ID NO: 2209774 - RNA, 23 nt, Homo sapiens
auaguaauagggcccuuagcucu

SEQ ID NO: 2209775 - RNA, 21 nt, Homo sapiens
ccaugguacuccaugcauuca

SEQ ID NO: 2209776 - RNA, 21 nt, Homo sapiens
aagugccauuacuacuguaca

SEQ ID NO: 2209777 - RNA, 12 nt, Homo sapiens
aagccuguccau

SEQ ID NO: 2209778 - RNA, 17 nt, Homo sapiens
agccaggccugaccuca

SEQ ID NO: 2209779 - RNA, 16 nt, Homo sapiens
uuagauauauucucua

SEQ ID NO: 2209780 - RNA, 15 nt, Homo sapiens
aagucuguaccucaa

SEQ ID NO: 2209781 - RNA, 17 nt, Homo sapiens
caaggggucugcuccug

SEQ ID NO: 2209782 - RNA, 14 nt, Homo sapiens
uaaaagaacagccu

SEQ ID NO: 2209783 - RNA, 11 nt, Homo sapiens
cugaagcccau

SEQ ID NO: 2209784 - RNA, 12 nt, Homo sapiens
ggaaagucacag

SEQ ID NO: 2209785 - RNA, 22 nt, Homo sapiens
cucaacaaagaagaaccaucuu

SEQ ID NO: 2209786 - RNA, 14 nt, Homo sapiens
caccguguccuccu

SEQ ID NO: 2209787 - RNA, 18 nt, Homo sapiens
gaaacggaggccagagag

SEQ ID NO: 2209788 - RNA, 23 nt, Homo sapiens
cagaauagcuuugaauguggccc

SEQ ID NO: 2209789 - RNA, 15 nt, Homo sapiens
guuuauaaucuugca

SEQ ID NO: 2209790 - RNA, 24 nt, Homo sapiens
gaagaggccuagccugagccaaag

SEQ ID NO: 2209791 - RNA, 16 nt, Homo sapiens
uacaguauacauauau

SEQ ID NO: 2209792 - RNA, 17 nt, Homo sapiens
gaaaauguuaugugcuc

SEQ ID NO: 2209793 - RNA, 21 nt, Homo sapiens
ccacagaaggugaacuuugug

SEQ ID NO: 2209794 - RNA, 22 nt, Homo sapiens
acuuucuucaccaagugcaaua

SEQ ID NO: 2209795 - RNA, 14 nt, Homo sapiens
caggagcucuccau

SEQ ID NO: 2209796 - RNA, 19 nt, Homo sapiens
gaaaaaucuaagugauaua

SEQ ID NO: 2209797 - RNA, 16 nt, Homo sapiens
uauucuuuccaugaca

SEQ ID NO: 2209798 - RNA, 17 nt, Homo sapiens
uacagaggcugacuuca

SEQ ID NO: 2209799 - RNA, 20 nt, Homo sapiens
cuguguguguguguguaugu

SEQ ID NO: 2209800 - RNA, 18 nt, Homo sapiens
uacuuuucugccaaaaua

SEQ ID NO: 2209801 - RNA, 21 nt, Homo sapiens
gucacuuuuguucccagguac

SEQ ID NO: 2209802 - RNA, 18 nt, Homo sapiens
ugcugcuuucuuguugcu

SEQ ID NO: 2209803 - RNA, 23 nt, Homo sapiens
ugaaugcuccauuaauccaggga

SEQ ID NO: 2209804 - RNA, 21 nt, Homo sapiens
aucuacuagaaccuucuaauc

SEQ ID NO: 2209805 - RNA, 21 nt, Homo sapiens
cuugcuaaaagauuauagaag

SEQ ID NO: 2209806 - RNA, 12 nt, Homo sapiens
auaaauauguga

SEQ ID NO: 2209807 - RNA, 12 nt, Homo sapiens
auauauaugugu

SEQ ID NO: 2209808 - RNA, 21 nt, Homo sapiens
ugggggaaagcaaagcacaga

SEQ ID NO: 2209809 - RNA, 20 nt, Homo sapiens
gggccuggcaggacuccaga

SEQ ID NO: 2209810 - RNA, 22 nt, Homo sapiens
gacucugggcugucagcccaug

SEQ ID NO: 2209811 - RNA, 13 nt, Homo sapiens
gagauaagcaagu

SEQ ID NO: 2209812 - RNA, 16 nt, Homo sapiens
caauauguauuacaaa

SEQ ID NO: 2209813 - RNA, 16 nt, Homo sapiens
gacuggaaagcacaag

SEQ ID NO: 2209814 - RNA, 19 nt, Homo sapiens
auauuacugucuuuauucu

SEQ ID NO: 2209815 - RNA, 17 nt, Homo sapiens
cuuuacuagugccaaac

SEQ ID NO: 2209816 - RNA, 22 nt, Homo sapiens
agcuggagucugucaauguccu

SEQ ID NO: 2209817 - RNA, 11 nt, Homo sapiens
uuuaaugccaa

SEQ ID NO: 2209818 - RNA, 21 nt, Homo sapiens
acguauauuucauugaauacu

SEQ ID NO: 2209819 - RNA, 18 nt, Homo sapiens
uaugcaacucaucuucac

SEQ ID NO: 2209820 - RNA, 17 nt, Homo sapiens
agaguucuauccccaag

SEQ ID NO: 2209821 - RNA, 16 nt, Homo sapiens
agcccgucuuggcuua

SEQ ID NO: 2209822 - RNA, 23 nt, Homo sapiens
ccucuuaaaaaauaaaaacugac

SEQ ID NO: 2209823 - RNA, 18 nt, Homo sapiens
gaaaccccugacaccuuu

SEQ ID NO: 2209824 - RNA, 12 nt, Homo sapiens
gcucaagaacua

SEQ ID NO: 2209825 - RNA, 15 nt, Homo sapiens
ugcacaaagcccuuc

SEQ ID NO: 2209826 - RNA, 16 nt, Homo sapiens
uugacucaaaccauau

SEQ ID NO: 2209827 - RNA, 19 nt, Homo sapiens
ccucacuggugcauuuaaa

SEQ ID NO: 2209828 - RNA, 15 nt, Homo sapiens
gcggggaagggugca

SEQ ID NO: 2209829 - RNA, 12 nt, Homo sapiens
uggccuuugaau

SEQ ID NO: 2209830 - RNA, 13 nt, Homo sapiens
caacuuacauaug

SEQ ID NO: 2209831 - RNA, 19 nt, Homo sapiens
cagcugaacacaagcaaac

SEQ ID NO: 2209832 - RNA, 15 nt, Homo sapiens
auaucugcauguguc

SEQ ID NO: 2209833 - RNA, 14 nt, Homo sapiens
ggauagacacugga

SEQ ID NO: 2209834 - RNA, 18 nt, Homo sapiens
uauauuguauaggggcaa

SEQ ID NO: 2209835 - RNA, 20 nt, Homo sapiens
uguaauuuaaugcugcuaca

SEQ ID NO: 2209836 - RNA, 20 nt, Homo sapiens
uggagcuugucaccauugga

SEQ ID NO: 2209837 - RNA, 14 nt, Homo sapiens
uaaucuccuauucc

SEQ ID NO: 2209838 - RNA, 16 nt, Homo sapiens
agcuaucugucaucuc

SEQ ID NO: 2209839 - RNA, 12 nt, Homo sapiens
cagucagaggac

SEQ ID NO: 2209840 - RNA, 20 nt, Homo sapiens
uuugcaugcuucgugccaca

SEQ ID NO: 2209841 - RNA, 17 nt, Homo sapiens
ucacugcugucagccaa

SEQ ID NO: 2209842 - RNA, 20 nt, Homo sapiens
cuacugcacguaacacuccu

SEQ ID NO: 2209843 - RNA, 15 nt, Homo sapiens
caaggagaggcaaag

SEQ ID NO: 2209844 - RNA, 15 nt, Homo sapiens
cacggagaggaaaag

SEQ ID NO: 2209845 - RNA, 20 nt, Homo sapiens
cuggacacagcucuucauuc

SEQ ID NO: 2209846 - RNA, 16 nt, Homo sapiens
uaaugcucgucugugu

SEQ ID NO: 2209847 - RNA, 15 nt, Homo sapiens
gcaaaccucuccuca

SEQ ID NO: 2209848 - RNA, 14 nt, Homo sapiens
gaggguuugcagaa

SEQ ID NO: 2209849 - RNA, 16 nt, Homo sapiens
ucccaaagagcugccu

SEQ ID NO: 2209850 - RNA, 17 nt, Homo sapiens
uugaggagcugcacuga

SEQ ID NO: 2209851 - RNA, 14 nt, Homo sapiens
ucagagaugugcac

SEQ ID NO: 2209852 - RNA, 13 nt, Homo sapiens
ccauggggagcaa

SEQ ID NO: 2209853 - RNA, 16 nt, Homo sapiens
ugcaucggggauucca

SEQ ID NO: 2209854 - RNA, 20 nt, Homo sapiens
gcuccauugguguugacaua

SEQ ID NO: 2209855 - RNA, 19 nt, Homo sapiens
gcauacaguuugcacuuau

SEQ ID NO: 2209856 - RNA, 19 nt, Homo sapiens
acucuccugugaacacugg

SEQ ID NO: 2209857 - RNA, 21 nt, Homo sapiens
caccucccccuacccauaucc

SEQ ID NO: 2209858 - RNA, 20 nt, Homo sapiens
aauuagguguacuguacuga

SEQ ID NO: 2209859 - RNA, 19 nt, Homo sapiens
ucccuaaauuugcaugaaa

SEQ ID NO: 2209860 - RNA, 20 nt, Homo sapiens
agauuuugucgggacagaga

SEQ ID NO: 2209861 - RNA, 22 nt, Homo sapiens
ccgucuguggcuuucagccucu

SEQ ID NO: 2209862 - RNA, 19 nt, Homo sapiens
ccuuuccaaauaagugcau

SEQ ID NO: 2209863 - RNA, 17 nt, Homo sapiens
cauugcuauuuaucuca

SEQ ID NO: 2209864 - RNA, 15 nt, Homo sapiens
ccagggagcaagaca

SEQ ID NO: 2209865 - RNA, 12 nt, Homo sapiens
auaaguuucaua

SEQ ID NO: 2209866 - RNA, 20 nt, Homo sapiens
caucuaucagauuaaguuag

SEQ ID NO: 2209867 - RNA, 22 nt, Homo sapiens
cuuaguccgcaaguucagggaa

SEQ ID NO: 2209868 - RNA, 18 nt, Homo sapiens
aaaaauggcagugaugaa

SEQ ID NO: 2209869 - RNA, 18 nt, Homo sapiens
uauaaugaagaacacugu

SEQ ID NO: 2209870 - RNA, 20 nt, Homo sapiens
uagagagcuuuucacuguga

SEQ ID NO: 2209871 - RNA, 16 nt, Homo sapiens
auuuuaauacauugau

SEQ ID NO: 2209872 - RNA, 16 nt, Homo sapiens
gagggaguggcagcua

SEQ ID NO: 2209873 - RNA, 14 nt, Homo sapiens
cagggguacauucu

SEQ ID NO: 2209874 - RNA, 20 nt, Homo sapiens
gccagggcuuccccaucagc

SEQ ID NO: 2209875 - RNA, 21 nt, Homo sapiens
uuauucaguaaacaacuugua

SEQ ID NO: 2209876 - RNA, 13 nt, Homo sapiens
augugcacugccu

SEQ ID NO: 2209877 - RNA, 17 nt, Homo sapiens
uaggcagccucucugcu

SEQ ID NO: 2209878 - RNA, 14 nt, Homo sapiens
ugauggcuaugccu

SEQ ID NO: 2209879 - RNA, 17 nt, Homo sapiens
uucucuggaaccugacu

SEQ ID NO: 2209880 - RNA, 21 nt, Homo sapiens
uauaggaacugagguuuacau

SEQ ID NO: 2209881 - RNA, 18 nt, Homo sapiens
ccauuuuucuagacuguc

SEQ ID NO: 2209882 - RNA, 18 nt, Homo sapiens
caaguuuuuuauacugca

SEQ ID NO: 2209883 - RNA, 15 nt, Homo sapiens
uccccagccuaccuc

SEQ ID NO: 2209884 - RNA, 20 nt, Homo sapiens
cagguucaagcgauucucau

SEQ ID NO: 2209885 - RNA, 19 nt, Homo sapiens
gcugccccuggcaccugug

SEQ ID NO: 2209886 - RNA, 14 nt, Homo sapiens
aggauccgugcugu

SEQ ID NO: 2209887 - RNA, 18 nt, Homo sapiens
uuuuaaagagcauggaaa

SEQ ID NO: 2209888 - RNA, 15 nt, Homo sapiens
uagcuuccaccucau

SEQ ID NO: 2209889 - RNA, 20 nt, Homo sapiens
gcaaagagacccagucaauu

SEQ ID NO: 2209890 - RNA, 15 nt, Homo sapiens
cuuuaucuuugugua

SEQ ID NO: 2209891 - RNA, 11 nt, Homo sapiens
caaguacaaaa

SEQ ID NO: 2209892 - RNA, 13 nt, Homo sapiens
uguuguuggcaag

SEQ ID NO: 2209893 - RNA, 15 nt, Homo sapiens
caccaaagacaguug

SEQ ID NO: 2209894 - RNA, 19 nt, Homo sapiens
cuguuucuaauuugcugcu

SEQ ID NO: 2209895 - RNA, 21 nt, Homo sapiens
cuuuuaacuuuauaaauccag

SEQ ID NO: 2209896 - RNA, 19 nt, Homo sapiens
ccauuuagucacugaacau

SEQ ID NO: 2209897 - RNA, 15 nt, Homo sapiens
cccaauaacccagca

SEQ ID NO: 2209898 - RNA, 20 nt, Homo sapiens
acuauaaucucuugaauuug

SEQ ID NO: 2209899 - RNA, 15 nt, Homo sapiens
ugaaguaacuuugua

SEQ ID NO: 2209900 - RNA, 15 nt, Homo sapiens
uaaauuuaucaucuc

SEQ ID NO: 2209901 - RNA, 16 nt, Homo sapiens
ccacuuugaguaccaa

SEQ ID NO: 2209902 - RNA, 13 nt, Homo sapiens
agguauguugccu

SEQ ID NO: 2209903 - RNA, 14 nt, Homo sapiens
guaagcugcucuga

SEQ ID NO: 2209904 - RNA, 22 nt, Homo sapiens
uaaauccaacuuucacagugaa

SEQ ID NO: 2209905 - RNA, 15 nt, Homo sapiens
gauacucuaguaugu

SEQ ID NO: 2209906 - RNA, 17 nt, Homo sapiens
cggaaaagacaagagcc

SEQ ID NO: 2209907 - RNA, 23 nt, Homo sapiens
gcagcuuuggccuccauauugcu

SEQ ID NO: 2209908 - RNA, 16 nt, Homo sapiens
cccugccucacuguga

SEQ ID NO: 2209909 - RNA, 18 nt, Homo sapiens
uggaauuagaaauauauc

SEQ ID NO: 2209910 - RNA, 17 nt, Homo sapiens
acugaacgauccuucaa

SEQ ID NO: 2209911 - RNA, 22 nt, Homo sapiens
ccauauuuauuuuuauguucuu

SEQ ID NO: 2209912 - RNA, 17 nt, Homo sapiens
acaacugugcauuacaa

SEQ ID NO: 2209913 - RNA, 21 nt, Homo sapiens
gcaauacuauuauauuaugua

SEQ ID NO: 2209914 - RNA, 21 nt, Homo sapiens
gcagugagcugagaucaugcc

SEQ ID NO: 2209915 - RNA, 22 nt, Homo sapiens
acacagcccgaggaaucaacaa

SEQ ID NO: 2209916 - RNA, 13 nt, Homo sapiens
aauaaaaagcaug

SEQ ID NO: 2209917 - RNA, 20 nt, Homo sapiens
uuaaauggugauuucuugcu

SEQ ID NO: 2209918 - RNA, 17 nt, Homo sapiens
gucucugcuccuacauc

SEQ ID NO: 2209919 - RNA, 16 nt, Homo sapiens
agucuuagacaucaua

SEQ ID NO: 2209920 - RNA, 21 nt, Homo sapiens
gcacugcagauagccagacac

SEQ ID NO: 2209921 - RNA, 17 nt, Homo sapiens
ucaaaugcaguccagug

SEQ ID NO: 2209922 - RNA, 14 nt, Homo sapiens
gucaugucagcucc

SEQ ID NO: 2209923 - RNA, 17 nt, Homo sapiens
cuccagagacagggaaa

SEQ ID NO: 2209924 - RNA, 17 nt, Homo sapiens
auuccaaaugucuuuua

SEQ ID NO: 2209925 - RNA, 19 nt, Homo sapiens
cuguuuuuuucaggcuccu

SEQ ID NO: 2209926 - RNA, 18 nt, Homo sapiens
aagccuuuugcucacaaa

SEQ ID NO: 2209927 - RNA, 20 nt, Homo sapiens
uaaaauuaaaugcauguccu

SEQ ID NO: 2209928 - RNA, 15 nt, Homo sapiens
uaaaauugcacuuuu

SEQ ID NO: 2209929 - RNA, 19 nt, Homo sapiens
acuucuguguagacauggu

SEQ ID NO: 2209930 - RNA, 12 nt, Homo sapiens
uggaggccaagc

SEQ ID NO: 2209931 - RNA, 20 nt, Homo sapiens
gcucaaagcccuuccuaccu

SEQ ID NO: 2209932 - RNA, 15 nt, Homo sapiens
cucuguuuacaucuc

SEQ ID NO: 2209933 - RNA, 22 nt, Homo sapiens
aggggacacuggccccacagga

SEQ ID NO: 2209934 - RNA, 17 nt, Homo sapiens
augaugacguccucuca

SEQ ID NO: 2209935 - RNA, 23 nt, Homo sapiens
aucucuaaaugugacaugcaaag

SEQ ID NO: 2209936 - RNA, 14 nt, Homo sapiens
uucuuuaccugaga

SEQ ID NO: 2209937 - RNA, 19 nt, Homo sapiens
agcuuccuguuucuuccca

SEQ ID NO: 2209938 - RNA, 13 nt, Homo sapiens
gauaccacugcac

SEQ ID NO: 2209939 - RNA, 17 nt, Homo sapiens
ccuuuuauuucuuaaac

SEQ ID NO: 2209940 - RNA, 18 nt, Homo sapiens
ucuucaugguguccauuu

SEQ ID NO: 2209941 - RNA, 23 nt, Homo sapiens
aauacugauacauccauuuugau

SEQ ID NO: 2209942 - RNA, 20 nt, Homo sapiens
ucaauguuuguucauuacuu

SEQ ID NO: 2209943 - RNA, 22 nt, Homo sapiens
cugcuaaagggagaaaugccag

SEQ ID NO: 2209944 - RNA, 15 nt, Homo sapiens
aguuaggaacaugua

SEQ ID NO: 2209945 - RNA, 14 nt, Homo sapiens
acagauuguucuca

SEQ ID NO: 2209946 - RNA, 18 nt, Homo sapiens
aaaguaucaccagggugc

SEQ ID NO: 2209947 - RNA, 18 nt, Homo sapiens
ugguaaauucacaaauac

SEQ ID NO: 2209948 - RNA, 21 nt, Homo sapiens
auauguuuuaagaggcagggu

SEQ ID NO: 2209949 - RNA, 18 nt, Homo sapiens
uuugucauucaagccugu

SEQ ID NO: 2209950 - RNA, 19 nt, Homo sapiens
agugucugugccauggauu

SEQ ID NO: 2209951 - RNA, 21 nt, Homo sapiens
caacucuucgaagccuugccu

SEQ ID NO: 2209952 - RNA, 15 nt, Homo sapiens
caaugcccagaucaa

SEQ ID NO: 2209953 - RNA, 22 nt, Homo sapiens
acuuugugaucucauggcuuug

SEQ ID NO: 2209954 - RNA, 18 nt, Homo sapiens
cucaaagaaguacuguac

SEQ ID NO: 2209955 - RNA, 19 nt, Homo sapiens
gugaagauuucauggacau

SEQ ID NO: 2209956 - RNA, 16 nt, Homo sapiens
aaccucauugcagcua

SEQ ID NO: 2209957 - RNA, 16 nt, Homo sapiens
acaucacaacauuuac

SEQ ID NO: 2209958 - RNA, 23 nt, Homo sapiens
ugugauuuuuaaucgcuuugaua

SEQ ID NO: 2209959 - RNA, 22 nt, Homo sapiens
caguuguuuggagaacaacaag

SEQ ID NO: 2209960 - RNA, 19 nt, Homo sapiens
uaggaaagaagagaaccau

SEQ ID NO: 2209961 - RNA, 17 nt, Homo sapiens
uaguacccugcaggcca

SEQ ID NO: 2209962 - RNA, 19 nt, Homo sapiens
gccagcaauaaaaacuguc

SEQ ID NO: 2209963 - RNA, 22 nt, Homo sapiens
cuguguccccaaggagucccua

SEQ ID NO: 2209964 - RNA, 15 nt, Homo sapiens
gaggcaggaggauug

SEQ ID NO: 2209965 - RNA, 22 nt, Homo sapiens
gcacacugccagucucacugug

SEQ ID NO: 2209966 - RNA, 18 nt, Homo sapiens
gaaggcgcugggugccug

SEQ ID NO: 2209967 - RNA, 15 nt, Homo sapiens
auguaaagcacauca

SEQ ID NO: 2209968 - RNA, 17 nt, Homo sapiens
cagcgucuugcucuguu

SEQ ID NO: 2209969 - RNA, 11 nt, Homo sapiens
uaugugagcac

SEQ ID NO: 2209970 - RNA, 19 nt, Homo sapiens
cuccauucugaccauuuca

SEQ ID NO: 2209971 - RNA, 20 nt, Homo sapiens
caucagcugccacaacacca

SEQ ID NO: 2209972 - RNA, 23 nt, Homo sapiens
ucuucacucuauacuuaaucuca

SEQ ID NO: 2209973 - RNA, 19 nt, Homo sapiens
gcaauaauacaacuaucau

SEQ ID NO: 2209974 - RNA, 16 nt, Homo sapiens
cagagacagauaccuc

SEQ ID NO: 2209975 - RNA, 13 nt, Homo sapiens
cuugaacauauau

SEQ ID NO: 2209976 - RNA, 22 nt, Homo sapiens
cauauauuaaagcaucaggacc

SEQ ID NO: 2209977 - RNA, 17 nt, Homo sapiens
auugguacuuguuucac

SEQ ID NO: 2209978 - RNA, 14 nt, Homo sapiens
ugggacagcuugua

SEQ ID NO: 2209979 - RNA, 20 nt, Homo sapiens
gcaagggucucacacuguga

SEQ ID NO: 2209980 - RNA, 12 nt, Homo sapiens
uacaagucaaaa

SEQ ID NO: 2209981 - RNA, 17 nt, Homo sapiens
caacuuauaauuacaau

SEQ ID NO: 2209982 - RNA, 23 nt, Homo sapiens
aagaaaucuacuauaucccuuaa

SEQ ID NO: 2209983 - RNA, 22 nt, Homo sapiens
aacgggcugcccucagcucaca

SEQ ID NO: 2209984 - RNA, 14 nt, Homo sapiens
uuaaucugcaccuu

SEQ ID NO: 2209985 - RNA, 16 nt, Homo sapiens
aacagaagcuuccauu

SEQ ID NO: 2209986 - RNA, 13 nt, Homo sapiens
ggauuugcucagg

SEQ ID NO: 2209987 - RNA, 13 nt, Homo sapiens
guaaagguccaug

SEQ ID NO: 2209988 - RNA, 20 nt, Homo sapiens
uuaccuggcagcaaacugcu

SEQ ID NO: 2209989 - RNA, 20 nt, Homo sapiens
gaccucucauaaauuuacuu

SEQ ID NO: 2209990 - RNA, 15 nt, Homo sapiens
ccaaugaacaucuca

SEQ ID NO: 2209991 - RNA, 17 nt, Homo sapiens
aaugcugagguuaugaa

SEQ ID NO: 2209992 - RNA, 18 nt, Homo sapiens
ucaagagaucgagaccau

SEQ ID NO: 2209993 - RNA, 14 nt, Homo sapiens
cuuuuucaaagagg

SEQ ID NO: 2209994 - RNA, 17 nt, Homo sapiens
ugaaaaucuacacucca

SEQ ID NO: 2209995 - RNA, 21 nt, Homo sapiens
augugaucauaugaggaccuu

SEQ ID NO: 2209996 - RNA, 22 nt, Homo sapiens
auuauaggcaugagccaccacg

SEQ ID NO: 2209997 - RNA, 13 nt, Homo sapiens
gcuggcagugaca

SEQ ID NO: 2209998 - RNA, 20 nt, Homo sapiens
aaagcgagaucccaucucua

SEQ ID NO: 2209999 - RNA, 16 nt, Homo sapiens
aaaacauugacacaua

SEQ ID NO: 2210000 - RNA, 16 nt, Homo sapiens
ucauaauccagagaua

SEQ ID NO: 2210001 - RNA, 18 nt, Homo sapiens
ugaagacagaaccacagg

SEQ ID NO: 2210002 - RNA, 21 nt, Homo sapiens
aacccuuuuacagucacauuc

SEQ ID NO: 2210003 - RNA, 19 nt, Homo sapiens
cucuggcuaaauucaugcu

SEQ ID NO: 2210004 - RNA, 19 nt, Homo sapiens
auugauuuuuaaaguuuaa

SEQ ID NO: 2210005 - RNA, 17 nt, Homo sapiens
gcaacucacugauucuc

SEQ ID NO: 2210006 - RNA, 17 nt, Homo sapiens
ccugaaaaaaugccaag

SEQ ID NO: 2210007 - RNA, 15 nt, Homo sapiens
cacuuugugaucuca

SEQ ID NO: 2210008 - RNA, 15 nt, Homo sapiens
uuaaaaagaaugacg

SEQ ID NO: 2210009 - RNA, 19 nt, Homo sapiens
ugcgcugcguccucauggu

SEQ ID NO: 2210010 - RNA, 15 nt, Homo sapiens
aaugacuacuuagca

SEQ ID NO: 2210011 - RNA, 16 nt, Homo sapiens
uccccaaauagccucu

SEQ ID NO: 2210012 - RNA, 18 nt, Homo sapiens
gaacgcccagagaacaag

SEQ ID NO: 2210013 - RNA, 21 nt, Homo sapiens
ugcacauccgcgugugccugu

SEQ ID NO: 2210014 - RNA, 15 nt, Homo sapiens
cacuuuccuguugca

SEQ ID NO: 2210015 - RNA, 16 nt, Homo sapiens
ucacacagagugccug

SEQ ID NO: 2210016 - RNA, 15 nt, Homo sapiens
cacuuauuuccaugg

SEQ ID NO: 2210017 - RNA, 19 nt, Homo sapiens
cuucuagggaccagcaaua

SEQ ID NO: 2210018 - RNA, 19 nt, Homo sapiens
uuuuauggcuuuugugcau

SEQ ID NO: 2210019 - RNA, 13 nt, Homo sapiens
ugccuggugaaug

SEQ ID NO: 2210020 - RNA, 16 nt, Homo sapiens
ugucuccuuaacacug

SEQ ID NO: 2210021 - RNA, 16 nt, Homo sapiens
agaagcucagcugccu

SEQ ID NO: 2210022 - RNA, 14 nt, Homo sapiens
uuucuucaccaaau

SEQ ID NO: 2210023 - RNA, 19 nt, Homo sapiens
cacauuuaacgacagaagg

SEQ ID NO: 2210024 - RNA, 24 nt, Homo sapiens
ucagggcccaucccuucucugcag

SEQ ID NO: 2210025 - RNA, 21 nt, Homo sapiens
auauuguauacuaccauagug

SEQ ID NO: 2210026 - RNA, 13 nt, Homo sapiens
gucuuagcucugg

SEQ ID NO: 2210027 - RNA, 15 nt, Homo sapiens
cugagggcauuaaaa

SEQ ID NO: 2210028 - RNA, 15 nt, Homo sapiens
uaaaauguaaagguc

SEQ ID NO: 2210029 - RNA, 22 nt, Homo sapiens
ccccugggaacacagugcccca

SEQ ID NO: 2210030 - RNA, 15 nt, Homo sapiens
aggcagaucaccuga

SEQ ID NO: 2210031 - RNA, 23 nt, Homo sapiens
cuucuuacauuauuaaucauucc

SEQ ID NO: 2210032 - RNA, 17 nt, Homo sapiens
acagggcuguguagcau

SEQ ID NO: 2210033 - RNA, 13 nt, Homo sapiens
aaaccaugacugu

SEQ ID NO: 2210034 - RNA, 17 nt, Homo sapiens
guuaucuuccacuggaa

SEQ ID NO: 2210035 - RNA, 14 nt, Homo sapiens
aggccaagaacuug

SEQ ID NO: 2210036 - RNA, 24 nt, Homo sapiens
gcgccuccaccccgacugcucagu

SEQ ID NO: 2210037 - RNA, 17 nt, Homo sapiens
cacugccccucucucag

SEQ ID NO: 2210038 - RNA, 19 nt, Homo sapiens
cgauugcaggagucccugc

SEQ ID NO: 2210039 - RNA, 21 nt, Homo sapiens
uguacucacauauaacaugca

SEQ ID NO: 2210040 - RNA, 23 nt, Homo sapiens
ggagacauuguuuggauuuccuu

SEQ ID NO: 2210041 - RNA, 16 nt, Homo sapiens
gcaugaguaugugcac

SEQ ID NO: 2210042 - RNA, 16 nt, Homo sapiens
ucauugucucagugaa

SEQ ID NO: 2210043 - RNA, 18 nt, Homo sapiens
ccuaaucauauaccagag

SEQ ID NO: 2210044 - RNA, 18 nt, Homo sapiens
ccugaaccucauucuggu

SEQ ID NO: 2210045 - RNA, 16 nt, Homo sapiens
acaaauacauaaccuu

SEQ ID NO: 2210046 - RNA, 15 nt, Homo sapiens
aguaaaauuacagaa

SEQ ID NO: 2210047 - RNA, 21 nt, Homo sapiens
cacuagcaauaaaaugcuaau

SEQ ID NO: 2210048 - RNA, 19 nt, Homo sapiens
cccagaggcucccaaucag

SEQ ID NO: 2210049 - RNA, 16 nt, Homo sapiens
agcugcuggcugugac

SEQ ID NO: 2210050 - RNA, 13 nt, Homo sapiens
cucaccauacucc

SEQ ID NO: 2210051 - RNA, 14 nt, Homo sapiens
aauucaauuuggca

SEQ ID NO: 2210052 - RNA, 15 nt, Homo sapiens
aaaaagucaaacuuu

SEQ ID NO: 2210053 - RNA, 23 nt, Homo sapiens
cuuauauugcaagcuccaucucu

SEQ ID NO: 2210054 - RNA, 15 nt, Homo sapiens
uccauaugcaucuac

SEQ ID NO: 2210055 - RNA, 20 nt, Homo sapiens
gaagacuuuaaaccaccuag

SEQ ID NO: 2210056 - RNA, 12 nt, Homo sapiens
gaugaugaaggg

SEQ ID NO: 2210057 - RNA, 20 nt, Homo sapiens
agugaaacauuugugaaaaa

SEQ ID NO: 2210058 - RNA, 18 nt, Homo sapiens
gauagguauaaguggugu

SEQ ID NO: 2210059 - RNA, 19 nt, Homo sapiens
cacugcacuauagccuagg

SEQ ID NO: 2210060 - RNA, 21 nt, Homo sapiens
accucucugaacugcaacacu

SEQ ID NO: 2210061 - RNA, 22 nt, Homo sapiens
gaggcuggagagaacacagugc

SEQ ID NO: 2210062 - RNA, 13 nt, Homo sapiens
ugcaaagcacuga

SEQ ID NO: 2210063 - RNA, 16 nt, Homo sapiens
ggaccaagcagagcuc

SEQ ID NO: 2210064 - RNA, 21 nt, Homo sapiens
agaggcucaucuaacucuguc

SEQ ID NO: 2210065 - RNA, 19 nt, Homo sapiens
ucagagacauaaucagcug

SEQ ID NO: 2210066 - RNA, 15 nt, Homo sapiens
ugcuaucucucaaga

SEQ ID NO: 2210067 - RNA, 20 nt, Homo sapiens
gucaacaaagucacccacuu

SEQ ID NO: 2210068 - RNA, 19 nt, Homo sapiens
accaagcgugauuccugcu

SEQ ID NO: 2210069 - RNA, 13 nt, Homo sapiens
uauuaagcacuuu

SEQ ID NO: 2210070 - RNA, 19 nt, Homo sapiens
aaaaucuguaauugauaau

SEQ ID NO: 2210071 - RNA, 15 nt, Homo sapiens
gaagguugugaugaa

SEQ ID NO: 2210072 - RNA, 18 nt, Homo sapiens
uggagagguuugucaaca

SEQ ID NO: 2210073 - RNA, 19 nt, Homo sapiens
auccacccccaagcacucc

SEQ ID NO: 2210074 - RNA, 15 nt, Homo sapiens
gucuuuaaugcaaua

SEQ ID NO: 2210075 - RNA, 10 nt, Homo sapiens
cuuggcugug

SEQ ID NO: 2210076 - RNA, 20 nt, Homo sapiens
gggcacugcacccuguuuaa

SEQ ID NO: 2210077 - RNA, 21 nt, Homo sapiens
aagugacuuccucgaggucau

SEQ ID NO: 2210078 - RNA, 21 nt, Homo sapiens
gcgucagaccaguacugggaa

SEQ ID NO: 2210079 - RNA, 22 nt, Homo sapiens
uccauggccaccccgugccacc

SEQ ID NO: 2210080 - RNA, 17 nt, Homo sapiens
uguuaugugacuaucuu

SEQ ID NO: 2210081 - RNA, 21 nt, Homo sapiens
caaaaaaaguugaaggccuua

SEQ ID NO: 2210082 - RNA, 20 nt, Homo sapiens
cauguaaaaaauguaaaaug

SEQ ID NO: 2210083 - RNA, 17 nt, Homo sapiens
cuuccugaguggugcca

SEQ ID NO: 2210084 - RNA, 18 nt, Homo sapiens
aggccacccggcacuggc

SEQ ID NO: 2210085 - RNA, 12 nt, Homo sapiens
ccuaagagccac

SEQ ID NO: 2210086 - RNA, 16 nt, Homo sapiens
gaugggaaacugcuuu

SEQ ID NO: 2210087 - RNA, 18 nt, Homo sapiens
agcagucuaaucuaguga

SEQ ID NO: 2210088 - RNA, 16 nt, Homo sapiens
ucccagcuacucagga

SEQ ID NO: 2210089 - RNA, 20 nt, Homo sapiens
gauuuuuuucccaauugaga

SEQ ID NO: 2210090 - RNA, 15 nt, Homo sapiens
uccccuccuucccaa

SEQ ID NO: 2210091 - RNA, 16 nt, Homo sapiens
caagcaugaagugcug

SEQ ID NO: 2210092 - RNA, 18 nt, Homo sapiens
ccaacuccaucuucaaua

SEQ ID NO: 2210093 - RNA, 18 nt, Homo sapiens
acugaugccccagggauu

SEQ ID NO: 2210094 - RNA, 12 nt, Homo sapiens
aaauggucccaa

SEQ ID NO: 2210095 - RNA, 17 nt, Homo sapiens
accuccacucagcacuc

SEQ ID NO: 2210096 - RNA, 13 nt, Homo sapiens
gagucacugccuc

SEQ ID NO: 2210097 - RNA, 17 nt, Homo sapiens
cuccaggauaccagcaa

SEQ ID NO: 2210098 - RNA, 20 nt, Homo sapiens
accuugccacccauucuucc

SEQ ID NO: 2210099 - RNA, 17 nt, Homo sapiens
auaauagacacugggga

SEQ ID NO: 2210100 - RNA, 21 nt, Homo sapiens
agaccuuucucccuccuuccu

SEQ ID NO: 2210101 - RNA, 18 nt, Homo sapiens
acucagugccuccacaug

SEQ ID NO: 2210102 - RNA, 16 nt, Homo sapiens
gagcugcuccaucacc

SEQ ID NO: 2210103 - RNA, 14 nt, Homo sapiens
auaaaagaucuuga

SEQ ID NO: 2210104 - RNA, 13 nt, Homo sapiens
cucauugacaaga

SEQ ID NO: 2210105 - RNA, 12 nt, Homo sapiens
aaagaaucauuu

SEQ ID NO: 2210106 - RNA, 14 nt, Homo sapiens
agugguucagucua

SEQ ID NO: 2210107 - RNA, 23 nt, Homo sapiens
cccagcccagggcuccugcacuu

SEQ ID NO: 2210108 - RNA, 14 nt, Homo sapiens
aaggcugcugugua

SEQ ID NO: 2210109 - RNA, 16 nt, Homo sapiens
aauuucuguccagaaa

SEQ ID NO: 2210110 - RNA, 14 nt, Homo sapiens
cuucccuugccucg

SEQ ID NO: 2210111 - RNA, 13 nt, Homo sapiens
agcuccugccucu

SEQ ID NO: 2210112 - RNA, 13 nt, Homo sapiens
auuacugucuuua

SEQ ID NO: 2210113 - RNA, 13 nt, Homo sapiens
aucucugucucaa

SEQ ID NO: 2210114 - RNA, 17 nt, Homo sapiens
cugcaaauugccugcaa

SEQ ID NO: 2210115 - RNA, 12 nt, Homo sapiens
gaaagaagaaua

SEQ ID NO: 2210116 - RNA, 14 nt, Homo sapiens
aaggaacugcaaua

SEQ ID NO: 2210117 - RNA, 22 nt, Homo sapiens
acuuaguuugugauguaaggca

SEQ ID NO: 2210118 - RNA, 20 nt, Homo sapiens
cauccagggaaaugccucga

SEQ ID NO: 2210119 - RNA, 19 nt, Homo sapiens
guaaguuucaggugacaug

SEQ ID NO: 2210120 - RNA, 13 nt, Homo sapiens
cagcucccaugua

SEQ ID NO: 2210121 - RNA, 19 nt, Homo sapiens
aauagcaacguagcuucua

SEQ ID NO: 2210122 - RNA, 18 nt, Homo sapiens
ccugugucccuuguaaau

SEQ ID NO: 2210123 - RNA, 16 nt, Homo sapiens
aguaauuguauuguca

SEQ ID NO: 2210124 - RNA, 14 nt, Homo sapiens
ccucccauuuccca

SEQ ID NO: 2210125 - RNA, 19 nt, Homo sapiens
acuugugaacaugccuuau

SEQ ID NO: 2210126 - RNA, 15 nt, Homo sapiens
uuuagaagugucaug

SEQ ID NO: 2210127 - RNA, 17 nt, Homo sapiens
aggcacaggcuguugaa

SEQ ID NO: 2210128 - RNA, 13 nt, Homo sapiens
ggucccggggcca

SEQ ID NO: 2210129 - RNA, 20 nt, Homo sapiens
cucccuguuaucugcuagau

SEQ ID NO: 2210130 - RNA, 23 nt, Homo sapiens
agaauaagacaagagaucuacac

SEQ ID NO: 2210131 - RNA, 17 nt, Homo sapiens
aagucagauucuugcau

SEQ ID NO: 2210132 - RNA, 21 nt, Homo sapiens
cucacuugcuuuaguuguuaa

SEQ ID NO: 2210133 - RNA, 23 nt, Homo sapiens
auacuagcaacaaacaauaugaa

SEQ ID NO: 2210134 - RNA, 23 nt, Homo sapiens
cccaagaucugccagaccugcau

SEQ ID NO: 2210135 - RNA, 22 nt, Homo sapiens
ccacagaagugcuuucuucucc

SEQ ID NO: 2210136 - RNA, 16 nt, Homo sapiens
cucuacuuaaugagau

SEQ ID NO: 2210137 - RNA, 18 nt, Homo sapiens
caaaucuuggguggguga

SEQ ID NO: 2210138 - RNA, 18 nt, Homo sapiens
ucaugcugugugacucaa

SEQ ID NO: 2210139 - RNA, 14 nt, Homo sapiens
cuuucaugcuccuu

SEQ ID NO: 2210140 - RNA, 19 nt, Homo sapiens
gggagccaaaggcauccag

SEQ ID NO: 2210141 - RNA, 17 nt, Homo sapiens
ucaaauauuagauguga

SEQ ID NO: 2210142 - RNA, 20 nt, Homo sapiens
cagaaagccugggugacauu

SEQ ID NO: 2210143 - RNA, 17 nt, Homo sapiens
uccaagucuguaccuca

SEQ ID NO: 2210144 - RNA, 17 nt, Homo sapiens
gaaaaagaccugcauuu

SEQ ID NO: 2210145 - RNA, 15 nt, Homo sapiens
ugacauaagugcuau

SEQ ID NO: 2210146 - RNA, 16 nt, Homo sapiens
uacuguaaaugcauug

SEQ ID NO: 2210147 - RNA, 18 nt, Homo sapiens
ccacuuagaauagcauuu

SEQ ID NO: 2210148 - RNA, 18 nt, Homo sapiens
caaugaaauauugcugua

SEQ ID NO: 2210149 - RNA, 23 nt, Homo sapiens
uucgaagaauuggcagaagcagu

SEQ ID NO: 2210150 - RNA, 19 nt, Homo sapiens
uaaaaaggccaccuagcuu

SEQ ID NO: 2210151 - RNA, 19 nt, Homo sapiens
gcugcacacacucaccucu

SEQ ID NO: 2210152 - RNA, 23 nt, Homo sapiens
guggccuccuggcccgcccucac

SEQ ID NO: 2210153 - RNA, 18 nt, Homo sapiens
agcaugcauucauaacag

SEQ ID NO: 2210154 - RNA, 19 nt, Homo sapiens
caugcaaggggaaaaucuc

SEQ ID NO: 2210155 - RNA, 16 nt, Homo sapiens
uuuauuaaaugcauca

SEQ ID NO: 2210156 - RNA, 14 nt, Homo sapiens
ucucucaugaaccu

SEQ ID NO: 2210157 - RNA, 17 nt, Homo sapiens
aggauggcaggggcaaa

SEQ ID NO: 2210158 - RNA, 24 nt, Homo sapiens
ccuuuagaggguaccgucuucucc

SEQ ID NO: 2210159 - RNA, 19 nt, Homo sapiens
uggcuuuuuaaauuuucca

SEQ ID NO: 2210160 - RNA, 18 nt, Homo sapiens
aguuuaagggggacuuaa

SEQ ID NO: 2210161 - RNA, 20 nt, Homo sapiens
cuuucugcuuacaaagacaa

SEQ ID NO: 2210162 - RNA, 22 nt, Homo sapiens
gugcauuggaagaccccaccca

SEQ ID NO: 2210163 - RNA, 13 nt, Homo sapiens
cccaacagaugag

SEQ ID NO: 2210164 - RNA, 21 nt, Homo sapiens
ccuccugaguagcugggauua

SEQ ID NO: 2210165 - RNA, 15 nt, Homo sapiens
gagagcagacuggcg

SEQ ID NO: 2210166 - RNA, 19 nt, Homo sapiens
caaauuuucacugcugcuc

SEQ ID NO: 2210167 - RNA, 22 nt, Homo sapiens
caggacacagggaaaucagggu

SEQ ID NO: 2210168 - RNA, 16 nt, Homo sapiens
gggaauuuauugccuc

SEQ ID NO: 2210169 - RNA, 11 nt, Homo sapiens
ugaucucaggu

SEQ ID NO: 2210170 - RNA, 13 nt, Homo sapiens
uuauugcauaaca

SEQ ID NO: 2210171 - RNA, 15 nt, Homo sapiens
uggcagucucagucc

SEQ ID NO: 2210172 - RNA, 23 nt, Homo sapiens
ugaccugcggcaguauguacuuc

SEQ ID NO: 2210173 - RNA, 14 nt, Homo sapiens
ggcaauaaacuccu

SEQ ID NO: 2210174 - RNA, 13 nt, Homo sapiens
gcucagcccugag

SEQ ID NO: 2210175 - RNA, 19 nt, Homo sapiens
ucuggaucugcugcaucca

SEQ ID NO: 2210176 - RNA, 17 nt, Homo sapiens
ucacucugcucucagga

SEQ ID NO: 2210177 - RNA, 20 nt, Homo sapiens
gcuccugaccccgccaugca

SEQ ID NO: 2210178 - RNA, 17 nt, Homo sapiens
cuauaaggaagauuugg

SEQ ID NO: 2210179 - RNA, 18 nt, Homo sapiens
aacauuaaggaauuugau

SEQ ID NO: 2210180 - RNA, 18 nt, Homo sapiens
cuguccucccgagcuccu

SEQ ID NO: 2210181 - RNA, 17 nt, Homo sapiens
caauggucucagccuag

SEQ ID NO: 2210182 - RNA, 21 nt, Homo sapiens
accuggagauugugcucugca

SEQ ID NO: 2210183 - RNA, 20 nt, Homo sapiens
uccaaggaggggcuguaaaa

SEQ ID NO: 2210184 - RNA, 18 nt, Homo sapiens
uaaugugcugagcauuuu

SEQ ID NO: 2210185 - RNA, 22 nt, Homo sapiens
agcccgaggucaucaccuccca

SEQ ID NO: 2210186 - RNA, 18 nt, Homo sapiens
aaaaagcaacaucuucau

SEQ ID NO: 2210187 - RNA, 18 nt, Homo sapiens
aaucuauuccuguaaaua

SEQ ID NO: 2210188 - RNA, 21 nt, Homo sapiens
gagugugugacauuccagggg

SEQ ID NO: 2210189 - RNA, 17 nt, Homo sapiens
ucccuguuaucugcuag

SEQ ID NO: 2210190 - RNA, 13 nt, Homo sapiens
cuuuccaccaagc

SEQ ID NO: 2210191 - RNA, 13 nt, Homo sapiens
uaauccacuuugc

SEQ ID NO: 2210192 - RNA, 21 nt, Homo sapiens
acagcugccugugugggacug

SEQ ID NO: 2210193 - RNA, 16 nt, Homo sapiens
ccuuauaucauuucau

SEQ ID NO: 2210194 - RNA, 13 nt, Homo sapiens
uccagcucccacu

SEQ ID NO: 2210195 - RNA, 16 nt, Homo sapiens
guuaccuuacugaaaa

SEQ ID NO: 2210196 - RNA, 19 nt, Homo sapiens
auacacagauauauacaca

SEQ ID NO: 2210197 - RNA, 12 nt, Homo sapiens
aucaucuuguuc

SEQ ID NO: 2210198 - RNA, 20 nt, Homo sapiens
ugcaguaucucuuacaucag

SEQ ID NO: 2210199 - RNA, 17 nt, Homo sapiens
agaccuuuuaacuccuc

SEQ ID NO: 2210200 - RNA, 14 nt, Homo sapiens
uaucuuuaucuuua

SEQ ID NO: 2210201 - RNA, 21 nt, Homo sapiens
ugcuuugcccaggcuucucac

SEQ ID NO: 2210202 - RNA, 23 nt, Homo sapiens
ucacagaaggguguggcauuugg

SEQ ID NO: 2210203 - RNA, 14 nt, Homo sapiens
cacaugugugcgug

SEQ ID NO: 2210204 - RNA, 19 nt, Homo sapiens
guuuauuuuuauacuuuca

SEQ ID NO: 2210205 - RNA, 19 nt, Homo sapiens
ugccuacgauugaaaugaa

SEQ ID NO: 2210206 - RNA, 17 nt, Homo sapiens
aguguucugugacaaaa

SEQ ID NO: 2210207 - RNA, 16 nt, Homo sapiens
uauauaucugcuucua

SEQ ID NO: 2210208 - RNA, 17 nt, Homo sapiens
guucccuauccaaucaa

SEQ ID NO: 2210209 - RNA, 22 nt, Homo sapiens
acaugaucuguuuuucaccacu

SEQ ID NO: 2210210 - RNA, 15 nt, Homo sapiens
ugccagugcacuccg

SEQ ID NO: 2210211 - RNA, 13 nt, Homo sapiens
ccgcaucaccuca

SEQ ID NO: 2210212 - RNA, 13 nt, Homo sapiens
cugaaucacuuaa

SEQ ID NO: 2210213 - RNA, 16 nt, Homo sapiens
uuaaccuacuagacaa

SEQ ID NO: 2210214 - RNA, 18 nt, Homo sapiens
cugagaugguaugcacaa

SEQ ID NO: 2210215 - RNA, 10 nt, Homo sapiens
ggccaaagaa

SEQ ID NO: 2210216 - RNA, 14 nt, Homo sapiens
gaagauagccagag

SEQ ID NO: 2210217 - RNA, 17 nt, Homo sapiens
cuacaaggcuacaguaa

SEQ ID NO: 2210218 - RNA, 14 nt, Homo sapiens
acgaagaagcaacu

SEQ ID NO: 2210219 - RNA, 19 nt, Homo sapiens
ccauccaucugcuuacaau

SEQ ID NO: 2210220 - RNA, 16 nt, Homo sapiens
uaacaguugugucaua

SEQ ID NO: 2210221 - RNA, 18 nt, Homo sapiens
ccugggcauuccuuggga

SEQ ID NO: 2210222 - RNA, 16 nt, Homo sapiens
ggggcucugugcaggg

SEQ ID NO: 2210223 - RNA, 19 nt, Homo sapiens
agugguuuuugcucuaggg

SEQ ID NO: 2210224 - RNA, 18 nt, Homo sapiens
ggcaaaucagaugcagcu

SEQ ID NO: 2210225 - RNA, 19 nt, Homo sapiens
ggcaugauccaagcaagac

SEQ ID NO: 2210226 - RNA, 22 nt, Homo sapiens
cagcugugguuuucuuuugcca

SEQ ID NO: 2210227 - RNA, 23 nt, Homo sapiens
ugucauuaaauggggcucacaaa

SEQ ID NO: 2210228 - RNA, 22 nt, Homo sapiens
uaguuuaguagccuuacuguga

SEQ ID NO: 2210229 - RNA, 16 nt, Homo sapiens
gucuuacuuugugcaa

SEQ ID NO: 2210230 - RNA, 24 nt, Homo sapiens
aaaccaaauuauggggcugcuuuu

SEQ ID NO: 2210231 - RNA, 20 nt, Homo sapiens
guugugagcacucuacugca

SEQ ID NO: 2210232 - RNA, 16 nt, Homo sapiens
caacuccccuacauca

SEQ ID NO: 2210233 - RNA, 23 nt, Homo sapiens
aguccugaguggguguugcacag

SEQ ID NO: 2210234 - RNA, 15 nt, Homo sapiens
aguaagccucaucau

SEQ ID NO: 2210235 - RNA, 21 nt, Homo sapiens
aauacauuugauuuguucaug

SEQ ID NO: 2210236 - RNA, 18 nt, Homo sapiens
uugagacuauaaagcagu

SEQ ID NO: 2210237 - RNA, 12 nt, Homo sapiens
aaaaaacaugag

SEQ ID NO: 2210238 - RNA, 12 nt, Homo sapiens
guuuccugguca

SEQ ID NO: 2210239 - RNA, 18 nt, Homo sapiens
ucaagcaccugcaugugc

SEQ ID NO: 2210240 - RNA, 15 nt, Homo sapiens
aauacagaucaucuu

SEQ ID NO: 2210241 - RNA, 18 nt, Homo sapiens
ccuaggaggaaaauucca

SEQ ID NO: 2210242 - RNA, 17 nt, Homo sapiens
cugaguaaucgcuuaaa

SEQ ID NO: 2210243 - RNA, 18 nt, Homo sapiens
uaguggccacacucugcc

SEQ ID NO: 2210244 - RNA, 24 nt, Homo sapiens
cccaggucagcccugugucuguca

SEQ ID NO: 2210245 - RNA, 21 nt, Homo sapiens
ggaaaacuauuccauguuuua

SEQ ID NO: 2210246 - RNA, 20 nt, Homo sapiens
caggacucacccucauacca

SEQ ID NO: 2210247 - RNA, 17 nt, Homo sapiens
agaaacacggcugauau

SEQ ID NO: 2210248 - RNA, 22 nt, Homo sapiens
agacccugaguccuugggccag

SEQ ID NO: 2210249 - RNA, 14 nt, Homo sapiens
gaggcugauuccuc

SEQ ID NO: 2210250 - RNA, 18 nt, Homo sapiens
uucccugucuuccccacc

SEQ ID NO: 2210251 - RNA, 22 nt, Homo sapiens
ccagaauaauucuuaacagugg

SEQ ID NO: 2210252 - RNA, 17 nt, Homo sapiens
gcaacaaaaauuacucu

SEQ ID NO: 2210253 - RNA, 17 nt, Homo sapiens
ugaaagugagacuuuga

SEQ ID NO: 2210254 - RNA, 13 nt, Homo sapiens
auuguaggugcaa

SEQ ID NO: 2210255 - RNA, 17 nt, Homo sapiens
cccagccccaggggugc

SEQ ID NO: 2210256 - RNA, 18 nt, Homo sapiens
aaucaacuugcuuaucaa

SEQ ID NO: 2210257 - RNA, 18 nt, Homo sapiens
gggcuguccacuagacca

SEQ ID NO: 2210258 - RNA, 10 nt, Homo sapiens
acaucugccu

SEQ ID NO: 2210259 - RNA, 20 nt, Homo sapiens
agaaccucuaagugcugcug

SEQ ID NO: 2210260 - RNA, 14 nt, Homo sapiens
ucgugaaauugugc

SEQ ID NO: 2210261 - RNA, 14 nt, Homo sapiens
aucacaaaaccacc

SEQ ID NO: 2210262 - RNA, 18 nt, Homo sapiens
gcaggcucucaggccagc

SEQ ID NO: 2210263 - RNA, 19 nt, Homo sapiens
acucugguggccacuucau

SEQ ID NO: 2210264 - RNA, 20 nt, Homo sapiens
auaaacaguggcucauaaaa

SEQ ID NO: 2210265 - RNA, 17 nt, Homo sapiens
aucucaacaacauguca

SEQ ID NO: 2210266 - RNA, 14 nt, Homo sapiens
cagagacagugaaa

SEQ ID NO: 2210267 - RNA, 15 nt, Homo sapiens
agaugcguuugccuc

SEQ ID NO: 2210268 - RNA, 20 nt, Homo sapiens
gauuugguacuuuugagugu

SEQ ID NO: 2210269 - RNA, 22 nt, Homo sapiens
gacucaccaacuugccacaugu

SEQ ID NO: 2210270 - RNA, 20 nt, Homo sapiens
ccucccagaaaaacuggcuc

SEQ ID NO: 2210271 - RNA, 17 nt, Homo sapiens
gaagguuagagguuugu

SEQ ID NO: 2210272 - RNA, 22 nt, Homo sapiens
augaggacuugugucucugugc

SEQ ID NO: 2210273 - RNA, 19 nt, Homo sapiens
ugagguguugugcauuugu

SEQ ID NO: 2210274 - RNA, 14 nt, Homo sapiens
ggaagaccaagaca

SEQ ID NO: 2210275 - RNA, 13 nt, Homo sapiens
cuucuaaccacac

SEQ ID NO: 2210276 - RNA, 14 nt, Homo sapiens
gcaccucuuggcuu

SEQ ID NO: 2210277 - RNA, 14 nt, Homo sapiens
ucuuguuaauguca

SEQ ID NO: 2210278 - RNA, 15 nt, Homo sapiens
cuggagcaguggacu

SEQ ID NO: 2210279 - RNA, 15 nt, Homo sapiens
cugcaguagugcacc

SEQ ID NO: 2210280 - RNA, 15 nt, Homo sapiens
ggcuuaagcaauaag

SEQ ID NO: 2210281 - RNA, 15 nt, Homo sapiens
gagguacaaccuguu

SEQ ID NO: 2210282 - RNA, 13 nt, Homo sapiens
acaaagcaguuua

SEQ ID NO: 2210283 - RNA, 22 nt, Homo sapiens
gcaguccugaguggguguugca

SEQ ID NO: 2210284 - RNA, 17 nt, Homo sapiens
aggaaucaaaaauugaa

SEQ ID NO: 2210285 - RNA, 21 nt, Homo sapiens
agagauucuguugcauagacu

SEQ ID NO: 2210286 - RNA, 16 nt, Homo sapiens
gaucuggcacacuccc

SEQ ID NO: 2210287 - RNA, 14 nt, Homo sapiens
uuccugauuucaua

SEQ ID NO: 2210288 - RNA, 14 nt, Homo sapiens
uggaugcccugugg

SEQ ID NO: 2210289 - RNA, 13 nt, Homo sapiens
cuuucaaugcuga

SEQ ID NO: 2210290 - RNA, 13 nt, Homo sapiens
uuuauaugcuauu

SEQ ID NO: 2210291 - RNA, 17 nt, Homo sapiens
uagcuuauacaaaacau

SEQ ID NO: 2210292 - RNA, 23 nt, Homo sapiens
aauacaagaguggagagaagcuc

SEQ ID NO: 2210293 - RNA, 16 nt, Homo sapiens
uacaguaaauguuugu

SEQ ID NO: 2210294 - RNA, 22 nt, Homo sapiens
gagauucaaagcccaacugugg

SEQ ID NO: 2210295 - RNA, 14 nt, Homo sapiens
uccaagucuucuca

SEQ ID NO: 2210296 - RNA, 18 nt, Homo sapiens
agacacaaguggccuuaa

SEQ ID NO: 2210297 - RNA, 15 nt, Homo sapiens
gacagaaagagacag

SEQ ID NO: 2210298 - RNA, 23 nt, Homo sapiens
acuuaauacucaaaugaguaaca

SEQ ID NO: 2210299 - RNA, 17 nt, Homo sapiens
auccaaagaacuaugua

SEQ ID NO: 2210300 - RNA, 22 nt, Homo sapiens
uaucauugaaacauuuauaaac

SEQ ID NO: 2210301 - RNA, 13 nt, Homo sapiens
cgccuuucccacc

SEQ ID NO: 2210302 - RNA, 22 nt, Homo sapiens
ggagccugaacaugacauuucu

SEQ ID NO: 2210303 - RNA, 17 nt, Homo sapiens
cuuuaacuuuuacaaaa

SEQ ID NO: 2210304 - RNA, 17 nt, Homo sapiens
caggucgauuuguggua

SEQ ID NO: 2210305 - RNA, 17 nt, Homo sapiens
acucaucaauuuugucu

SEQ ID NO: 2210306 - RNA, 16 nt, Homo sapiens
auagucgcagcuacua

SEQ ID NO: 2210307 - RNA, 17 nt, Homo sapiens
ucacccacaauugccuu

SEQ ID NO: 2210308 - RNA, 13 nt, Homo sapiens
uguuaaacacgug

SEQ ID NO: 2210309 - RNA, 17 nt, Homo sapiens
agcucacggcagccuca

SEQ ID NO: 2210310 - RNA, 15 nt, Homo sapiens
gacagccaccaagaa

SEQ ID NO: 2210311 - RNA, 19 nt, Homo sapiens
gucacuuuuuuccugucaa

SEQ ID NO: 2210312 - RNA, 14 nt, Homo sapiens
agcccaggagcucc

SEQ ID NO: 2210313 - RNA, 22 nt, Homo sapiens
caucaccuugauaaugggauga

SEQ ID NO: 2210314 - RNA, 23 nt, Homo sapiens
acuguugugaaaaucugucauga

SEQ ID NO: 2210315 - RNA, 15 nt, Homo sapiens
ucaccugugugccca

SEQ ID NO: 2210316 - RNA, 16 nt, Homo sapiens
uucacagucucuggaa

SEQ ID NO: 2210317 - RNA, 14 nt, Homo sapiens
uaauaauccugcuu

SEQ ID NO: 2210318 - RNA, 15 nt, Homo sapiens
agugccauaccuucu

SEQ ID NO: 2210319 - RNA, 16 nt, Homo sapiens
ucaaauguacaucucc

SEQ ID NO: 2210320 - RNA, 15 nt, Homo sapiens
caugccugcaccugc

SEQ ID NO: 2210321 - RNA, 15 nt, Homo sapiens
cuggggagcucagga

SEQ ID NO: 2210322 - RNA, 15 nt, Homo sapiens
auccagauccagacu

SEQ ID NO: 2210323 - RNA, 15 nt, Homo sapiens
agagccugugugaaa

SEQ ID NO: 2210324 - RNA, 14 nt, Homo sapiens
guggcccucuggau

SEQ ID NO: 2210325 - RNA, 14 nt, Homo sapiens
cucccucuguccac

SEQ ID NO: 2210326 - RNA, 17 nt, Homo sapiens
aacagcaaaccaaugcu

SEQ ID NO: 2210327 - RNA, 17 nt, Homo sapiens
auuaaauucacaaacuu

SEQ ID NO: 2210328 - RNA, 14 nt, Homo sapiens
uagcuuuuauucau

SEQ ID NO: 2210329 - RNA, 17 nt, Homo sapiens
gucucuacaaaaauaca

SEQ ID NO: 2210330 - RNA, 12 nt, Homo sapiens
gcuugugaucuc

SEQ ID NO: 2210331 - RNA, 20 nt, Homo sapiens
ccacccugagauugggcaug

SEQ ID NO: 2210332 - RNA, 16 nt, Homo sapiens
guagguguaagagaaa

SEQ ID NO: 2210333 - RNA, 16 nt, Homo sapiens
ucccccaccaaaaaca

SEQ ID NO: 2210334 - RNA, 13 nt, Homo sapiens
ucucauguaucuu

SEQ ID NO: 2210335 - RNA, 13 nt, Homo sapiens
auuguaacauauu

SEQ ID NO: 2210336 - RNA, 23 nt, Homo sapiens
gaauauucuuuuuauauucugug

SEQ ID NO: 2210337 - RNA, 14 nt, Homo sapiens
ccucugugcugcac

SEQ ID NO: 2210338 - RNA, 16 nt, Homo sapiens
ugugagcaacugcgac

SEQ ID NO: 2210339 - RNA, 12 nt, Homo sapiens
acuuugcucaaa

SEQ ID NO: 2210340 - RNA, 16 nt, Homo sapiens
agaauucaauuugaac

SEQ ID NO: 2210341 - RNA, 14 nt, Homo sapiens
cagacacccaggac

SEQ ID NO: 2210342 - RNA, 20 nt, Homo sapiens
uccuucucacugccauggaa

SEQ ID NO: 2210343 - RNA, 17 nt, Homo sapiens
ccaccuugaccauaaau

SEQ ID NO: 2210344 - RNA, 17 nt, Homo sapiens
acugggucucugcaaac

SEQ ID NO: 2210345 - RNA, 21 nt, Homo sapiens
ggagcguguggcugugccccu

SEQ ID NO: 2210346 - RNA, 23 nt, Homo sapiens
ucuuucuuagauucucuuuguug

SEQ ID NO: 2210347 - RNA, 13 nt, Homo sapiens
acauaacuuccua

SEQ ID NO: 2210348 - RNA, 18 nt, Homo sapiens
cgaccgcccccuccucua

SEQ ID NO: 2210349 - RNA, 20 nt, Homo sapiens
gagaaggcaggaacacugga

SEQ ID NO: 2210350 - RNA, 21 nt, Homo sapiens
uagcaaagacuugugugaugc

SEQ ID NO: 2210351 - RNA, 18 nt, Homo sapiens
gaccccaccugcucuuuc

SEQ ID NO: 2210352 - RNA, 22 nt, Homo sapiens
acacugaucugcuagugcugua

SEQ ID NO: 2210353 - RNA, 22 nt, Homo sapiens
cccuucaccgcuccccacagcu

SEQ ID NO: 2210354 - RNA, 14 nt, Homo sapiens
gaaggaauggugcg

SEQ ID NO: 2210355 - RNA, 16 nt, Homo sapiens
auuggaaugcacucag

SEQ ID NO: 2210356 - RNA, 22 nt, Homo sapiens
caaagggaaaccccccagucac

SEQ ID NO: 2210357 - RNA, 14 nt, Homo sapiens
uaaaugugcuuaug

SEQ ID NO: 2210358 - RNA, 15 nt, Homo sapiens
aggccaagaauauug

SEQ ID NO: 2210359 - RNA, 15 nt, Homo sapiens
cauugaguaacaccc

SEQ ID NO: 2210360 - RNA, 13 nt, Homo sapiens
uccggaauccuug

SEQ ID NO: 2210361 - RNA, 18 nt, Homo sapiens
cgccacucccgggccaag

SEQ ID NO: 2210362 - RNA, 15 nt, Homo sapiens
ugaaugaugccauga

SEQ ID NO: 2210363 - RNA, 14 nt, Homo sapiens
acgucuaacuggaa

SEQ ID NO: 2210364 - RNA, 22 nt, Homo sapiens
auacauuuggaaauguggucau

SEQ ID NO: 2210365 - RNA, 18 nt, Homo sapiens
aaucugccauaaagccau

SEQ ID NO: 2210366 - RNA, 17 nt, Homo sapiens
ccuugagucagaaaaca

SEQ ID NO: 2210367 - RNA, 16 nt, Homo sapiens
uacaguuuaacagagu

SEQ ID NO: 2210368 - RNA, 17 nt, Homo sapiens
acauaucccuuccagau

SEQ ID NO: 2210369 - RNA, 20 nt, Homo sapiens
uccgccauuccaagucaaca

SEQ ID NO: 2210370 - RNA, 14 nt, Homo sapiens
caggcauugaggaa

SEQ ID NO: 2210371 - RNA, 18 nt, Homo sapiens
cucacaugccacuggaaa

SEQ ID NO: 2210372 - RNA, 17 nt, Homo sapiens
gaaggcugcuguuuacu

SEQ ID NO: 2210373 - RNA, 20 nt, Homo sapiens
uauucaacagcucaccaacu

SEQ ID NO: 2210374 - RNA, 16 nt, Homo sapiens
gaacacugugaccagg

SEQ ID NO: 2210375 - RNA, 18 nt, Homo sapiens
aaauacaugcacagucau

SEQ ID NO: 2210376 - RNA, 23 nt, Homo sapiens
uuugcugacuuuaaaaggauuaa

SEQ ID NO: 2210377 - RNA, 18 nt, Homo sapiens
uguauaaagccauuauuc

SEQ ID NO: 2210378 - RNA, 21 nt, Homo sapiens
agaggagaagagacauguacc

SEQ ID NO: 2210379 - RNA, 14 nt, Homo sapiens
uaccuucacuuaaa

SEQ ID NO: 2210380 - RNA, 21 nt, Homo sapiens
uucaaaugcagaauacuugac

SEQ ID NO: 2210381 - RNA, 15 nt, Homo sapiens
aguacacagauaccu

SEQ ID NO: 2210382 - RNA, 23 nt, Homo sapiens
cagguaccaucuuguauacacau

SEQ ID NO: 2210383 - RNA, 23 nt, Homo sapiens
gagggauggcucacgaggcuugg

SEQ ID NO: 2210384 - RNA, 16 nt, Homo sapiens
aguaucucuucagucu

SEQ ID NO: 2210385 - RNA, 19 nt, Homo sapiens
ucgcauuaaugaaauacca

SEQ ID NO: 2210386 - RNA, 21 nt, Homo sapiens
cuuaguguacaugaaagcgua

SEQ ID NO: 2210387 - RNA, 15 nt, Homo sapiens
guacuggccaguguc

SEQ ID NO: 2210388 - RNA, 15 nt, Homo sapiens
cccuggcccaucuca

SEQ ID NO: 2210389 - RNA, 15 nt, Homo sapiens
aaucugccaccugca

SEQ ID NO: 2210390 - RNA, 16 nt, Homo sapiens
caggccuuaucuccaa

SEQ ID NO: 2210391 - RNA, 13 nt, Homo sapiens
gucugaauucugc

SEQ ID NO: 2210392 - RNA, 24 nt, Homo sapiens
ugcccuggagggaggcucuucagu

SEQ ID NO: 2210393 - RNA, 16 nt, Homo sapiens
cgcuccccucuggaau

SEQ ID NO: 2210394 - RNA, 17 nt, Homo sapiens
gccucagggcucugacu

SEQ ID NO: 2210395 - RNA, 22 nt, Homo sapiens
augcagauuuugcccuugacaa

SEQ ID NO: 2210396 - RNA, 20 nt, Homo sapiens
cuggucccucugcagucucu

SEQ ID NO: 2210397 - RNA, 19 nt, Homo sapiens
ugccagcuccacagggugg

SEQ ID NO: 2210398 - RNA, 13 nt, Homo sapiens
caugccccggcug

SEQ ID NO: 2210399 - RNA, 15 nt, Homo sapiens
cuuucugcauaauaa

SEQ ID NO: 2210400 - RNA, 23 nt, Homo sapiens
cugaagauugcgguuuacagcua

SEQ ID NO: 2210401 - RNA, 13 nt, Homo sapiens
caccaccuugcca

SEQ ID NO: 2210402 - RNA, 21 nt, Homo sapiens
agacagaaccccuacaugaaa

SEQ ID NO: 2210403 - RNA, 19 nt, Homo sapiens
cugaguuguugagucuguu

SEQ ID NO: 2210404 - RNA, 16 nt, Homo sapiens
cucgaaucagacugaa

SEQ ID NO: 2210405 - RNA, 19 nt, Homo sapiens
ucauuaauucagcucuuca

SEQ ID NO: 2210406 - RNA, 16 nt, Homo sapiens
aauuuguaacuuuuau

SEQ ID NO: 2210407 - RNA, 19 nt, Homo sapiens
aguccugcccaaugccuug

SEQ ID NO: 2210408 - RNA, 13 nt, Homo sapiens
ccagcaucugcag

SEQ ID NO: 2210409 - RNA, 17 nt, Homo sapiens
gccucccgcaugcugcc

SEQ ID NO: 2210410 - RNA, 20 nt, Homo sapiens
gugcaguggcgcgaucucag

SEQ ID NO: 2210411 - RNA, 22 nt, Homo sapiens
cuggcagaaagcaaaugugacc

SEQ ID NO: 2210412 - RNA, 14 nt, Homo sapiens
aguugagacuugcc

SEQ ID NO: 2210413 - RNA, 14 nt, Homo sapiens
agacaguguaugua

SEQ ID NO: 2210414 - RNA, 14 nt, Homo sapiens
uauguaugagacag

SEQ ID NO: 2210415 - RNA, 20 nt, Homo sapiens
acaaauggacuauacauacu

SEQ ID NO: 2210416 - RNA, 20 nt, Homo sapiens
auauucccacucagcacuca

SEQ ID NO: 2210417 - RNA, 10 nt, Homo sapiens
aaaaacagac

SEQ ID NO: 2210418 - RNA, 17 nt, Homo sapiens
uucucuacagacuccaa

SEQ ID NO: 2210419 - RNA, 22 nt, Homo sapiens
gugccucucccaaguccagugu

SEQ ID NO: 2210420 - RNA, 15 nt, Homo sapiens
cauaaucuaguuuac

SEQ ID NO: 2210421 - RNA, 12 nt, Homo sapiens
gauuugaccucc

SEQ ID NO: 2210422 - RNA, 14 nt, Homo sapiens
uccauucacaccag

SEQ ID NO: 2210423 - RNA, 15 nt, Homo sapiens
uguaccgagaacugg

SEQ ID NO: 2210424 - RNA, 16 nt, Homo sapiens
aaacuauuucagugau

SEQ ID NO: 2210425 - RNA, 18 nt, Homo sapiens
ggguucccgcggggcugu

SEQ ID NO: 2210426 - RNA, 16 nt, Homo sapiens
acccugcaacuucuau

SEQ ID NO: 2210427 - RNA, 23 nt, Homo sapiens
agaauggcgccaccagcucugcc

SEQ ID NO: 2210428 - RNA, 14 nt, Homo sapiens
caaccugugaugag

SEQ ID NO: 2210429 - RNA, 17 nt, Homo sapiens
auauuuaccagaccaca

SEQ ID NO: 2210430 - RNA, 14 nt, Homo sapiens
ucccccaccugcag

SEQ ID NO: 2210431 - RNA, 15 nt, Homo sapiens
uuauaggcauaccuc

SEQ ID NO: 2210432 - RNA, 16 nt, Homo sapiens
cucagugucagcacuc

SEQ ID NO: 2210433 - RNA, 18 nt, Homo sapiens
aaggacauguguaaugaa

SEQ ID NO: 2210434 - RNA, 19 nt, Homo sapiens
aguucuagggagauguauu

SEQ ID NO: 2210435 - RNA, 19 nt, Homo sapiens
aauuuuugucuuucaugga

SEQ ID NO: 2210436 - RNA, 18 nt, Homo sapiens
acccacugugcuuacagu

SEQ ID NO: 2210437 - RNA, 16 nt, Homo sapiens
caggccgcacaucuca

SEQ ID NO: 2210438 - RNA, 23 nt, Homo sapiens
cuuuacagcuuuguuucugcauc

SEQ ID NO: 2210439 - RNA, 15 nt, Homo sapiens
guguuccugaagcug

SEQ ID NO: 2210440 - RNA, 14 nt, Homo sapiens
uuuguucacacucc

SEQ ID NO: 2210441 - RNA, 23 nt, Homo sapiens
uuccagugucacuugacucuuga

SEQ ID NO: 2210442 - RNA, 20 nt, Homo sapiens
agcugagauugcacuauugc

SEQ ID NO: 2210443 - RNA, 13 nt, Homo sapiens
ggagccaccucuu

SEQ ID NO: 2210444 - RNA, 14 nt, Homo sapiens
cacuugucacuaca

SEQ ID NO: 2210445 - RNA, 22 nt, Homo sapiens
ugguuuuuuuuugauccucuga

SEQ ID NO: 2210446 - RNA, 14 nt, Homo sapiens
uuugacccaggaac

SEQ ID NO: 2210447 - RNA, 13 nt, Homo sapiens
gcaaagauuucuc

SEQ ID NO: 2210448 - RNA, 16 nt, Homo sapiens
acauugaaaacagaua

SEQ ID NO: 2210449 - RNA, 22 nt, Homo sapiens
guacacacucagugacauuucu

SEQ ID NO: 2210450 - RNA, 21 nt, Homo sapiens
aguuagauggggaacauuuug

SEQ ID NO: 2210451 - RNA, 13 nt, Homo sapiens
ugcagacacacaa

SEQ ID NO: 2210452 - RNA, 20 nt, Homo sapiens
uaauaucugugaggugcuga

SEQ ID NO: 2210453 - RNA, 13 nt, Homo sapiens
aauuaaaugccuu

SEQ ID NO: 2210454 - RNA, 19 nt, Homo sapiens
acaaaauggaauacucuua

SEQ ID NO: 2210455 - RNA, 16 nt, Homo sapiens
auauuuuaagccuuca

SEQ ID NO: 2210456 - RNA, 12 nt, Homo sapiens
acuguuuuuacc

SEQ ID NO: 2210457 - RNA, 22 nt, Homo sapiens
gcugaaaagaagccucagcucc

SEQ ID NO: 2210458 - RNA, 22 nt, Homo sapiens
uaauucuuagauacacuaaaaa

SEQ ID NO: 2210459 - RNA, 16 nt, Homo sapiens
auucugucaaugucuu

SEQ ID NO: 2210460 - RNA, 23 nt, Homo sapiens
cagccucccaaagugcugagauu

SEQ ID NO: 2210461 - RNA, 13 nt, Homo sapiens
ucaaguaccaaaa

SEQ ID NO: 2210462 - RNA, 13 nt, Homo sapiens
uccuucagccuga

SEQ ID NO: 2210463 - RNA, 14 nt, Homo sapiens
cggggacccuguga

SEQ ID NO: 2210464 - RNA, 20 nt, Homo sapiens
ccuaucagaguugcugcaaa

SEQ ID NO: 2210465 - RNA, 20 nt, Homo sapiens
agaugcaucaucucuuccuc

SEQ ID NO: 2210466 - RNA, 14 nt, Homo sapiens
gaaggaacuaggga

SEQ ID NO: 2210467 - RNA, 15 nt, Homo sapiens
acuucauuugacaca

SEQ ID NO: 2210468 - RNA, 18 nt, Homo sapiens
cuguacgaggcuucucua

SEQ ID NO: 2210469 - RNA, 22 nt, Homo sapiens
gaagggcugauugggauuucca

SEQ ID NO: 2210470 - RNA, 15 nt, Homo sapiens
cacccauaccacagc

SEQ ID NO: 2210471 - RNA, 22 nt, Homo sapiens
auguacaugguauuaacacuua

SEQ ID NO: 2210472 - RNA, 14 nt, Homo sapiens
auggucuugaucuc

SEQ ID NO: 2210473 - RNA, 19 nt, Homo sapiens
cauagcuccucucccucac

SEQ ID NO: 2210474 - RNA, 20 nt, Homo sapiens
ugauaggacuaaguucucau

SEQ ID NO: 2210475 - RNA, 22 nt, Homo sapiens
agccugaacgcuucugcuuaau

SEQ ID NO: 2210476 - RNA, 19 nt, Homo sapiens
gaaugcuccucucuuugug

SEQ ID NO: 2210477 - RNA, 15 nt, Homo sapiens
caaaaugugaugcuu

SEQ ID NO: 2210478 - RNA, 22 nt, Homo sapiens
agaugugcagcauuucacuuau

SEQ ID NO: 2210479 - RNA, 17 nt, Homo sapiens
agccuccaucaugaaga

SEQ ID NO: 2210480 - RNA, 20 nt, Homo sapiens
aguuagugauuauauuucac

SEQ ID NO: 2210481 - RNA, 14 nt, Homo sapiens
aucuuuuucuauau

SEQ ID NO: 2210482 - RNA, 19 nt, Homo sapiens
acugcauuuuuaaauacaa

SEQ ID NO: 2210483 - RNA, 13 nt, Homo sapiens
uaacuuauugccu

SEQ ID NO: 2210484 - RNA, 15 nt, Homo sapiens
gaucccacucaccag

SEQ ID NO: 2210485 - RNA, 14 nt, Homo sapiens
gagcaguuugccac

SEQ ID NO: 2210486 - RNA, 13 nt, Homo sapiens
ucuuugcugccag

SEQ ID NO: 2210487 - RNA, 20 nt, Homo sapiens
aggagaucgagaccauccug

SEQ ID NO: 2210488 - RNA, 18 nt, Homo sapiens
cuuuguggcaguggccag

SEQ ID NO: 2210489 - RNA, 16 nt, Homo sapiens
aaaaugggaacuggag

SEQ ID NO: 2210490 - RNA, 15 nt, Homo sapiens
gucagauacccuguu

SEQ ID NO: 2210491 - RNA, 21 nt, Homo sapiens
aaucugcaaggacauuucuca

SEQ ID NO: 2210492 - RNA, 20 nt, Homo sapiens
cuccuggccucaagggaucc

SEQ ID NO: 2210493 - RNA, 22 nt, Homo sapiens
gguuuaaacuaccucaaaacac

SEQ ID NO: 2210494 - RNA, 24 nt, Homo sapiens
auugaacuuucacauagcacagaa

SEQ ID NO: 2210495 - RNA, 13 nt, Homo sapiens
ccccuugcucuca

SEQ ID NO: 2210496 - RNA, 15 nt, Homo sapiens
uuugugugugugaua

SEQ ID NO: 2210497 - RNA, 22 nt, Homo sapiens
gcaucacugauucccucuccca

SEQ ID NO: 2210498 - RNA, 17 nt, Homo sapiens
agcaacucagaaugcuc

SEQ ID NO: 2210499 - RNA, 21 nt, Homo sapiens
cuuggcuuccacucagcauca

SEQ ID NO: 2210500 - RNA, 15 nt, Homo sapiens
ucucuucuccgugca

SEQ ID NO: 2210501 - RNA, 13 nt, Homo sapiens
gaagccuugccau

SEQ ID NO: 2210502 - RNA, 15 nt, Homo sapiens
ccugucauauaauaa

SEQ ID NO: 2210503 - RNA, 16 nt, Homo sapiens
ugggagcagagaaaau

SEQ ID NO: 2210504 - RNA, 16 nt, Homo sapiens
cagcaaaagaagacaa

SEQ ID NO: 2210505 - RNA, 19 nt, Homo sapiens
caaacacucaguccacugu

SEQ ID NO: 2210506 - RNA, 20 nt, Homo sapiens
aaccguuugugauugccauu

SEQ ID NO: 2210507 - RNA, 22 nt, Homo sapiens
aacaauguaugugaaaguguaa

SEQ ID NO: 2210508 - RNA, 17 nt, Homo sapiens
gcacauccuaugcaaua

SEQ ID NO: 2210509 - RNA, 17 nt, Homo sapiens
acacuacuccugaggau

SEQ ID NO: 2210510 - RNA, 23 nt, Homo sapiens
cuucagaccccaaaggagucaga

SEQ ID NO: 2210511 - RNA, 19 nt, Homo sapiens
gcuggagcagucugaggaa

SEQ ID NO: 2210512 - RNA, 21 nt, Homo sapiens
cuuuacaaucugcacuuuaac

SEQ ID NO: 2210513 - RNA, 21 nt, Homo sapiens
acagcucuuggcauuuuccuc

SEQ ID NO: 2210514 - RNA, 13 nt, Homo sapiens
ugugugugugaau

SEQ ID NO: 2210515 - RNA, 17 nt, Homo sapiens
auuuauuugguagccca

SEQ ID NO: 2210516 - RNA, 23 nt, Homo sapiens
ccaaccauguucccuucuucuua

SEQ ID NO: 2210517 - RNA, 18 nt, Homo sapiens
cugugcuuaccugugaca

SEQ ID NO: 2210518 - RNA, 17 nt, Homo sapiens
uacugauucuccuguca

SEQ ID NO: 2210519 - RNA, 15 nt, Homo sapiens
ggacaggcacuccaa

SEQ ID NO: 2210520 - RNA, 21 nt, Homo sapiens
ucaguugggaucccuccucca

SEQ ID NO: 2210521 - RNA, 14 nt, Homo sapiens
auuaaauccaauaa

SEQ ID NO: 2210522 - RNA, 13 nt, Homo sapiens
cugugugucucca

SEQ ID NO: 2210523 - RNA, 18 nt, Homo sapiens
gauucugaucccugauca

SEQ ID NO: 2210524 - RNA, 15 nt, Homo sapiens
ugagagcacagcagg

SEQ ID NO: 2210525 - RNA, 19 nt, Homo sapiens
aaaauaaaaccaccaaagu

SEQ ID NO: 2210526 - RNA, 21 nt, Homo sapiens
ugacuuuauauggaugauuca

SEQ ID NO: 2210527 - RNA, 14 nt, Homo sapiens
uucaaaaauuucac

SEQ ID NO: 2210528 - RNA, 22 nt, Homo sapiens
agcuggggcuuauggguggcuu

SEQ ID NO: 2210529 - RNA, 22 nt, Homo sapiens
aaucugaagauugcgguuuaca

SEQ ID NO: 2210530 - RNA, 16 nt, Homo sapiens
uguaaauagcuaagau

SEQ ID NO: 2210531 - RNA, 17 nt, Homo sapiens
uacuauugcuaguacua

SEQ ID NO: 2210532 - RNA, 14 nt, Homo sapiens
ccuauuguucacuu

SEQ ID NO: 2210533 - RNA, 15 nt, Homo sapiens
cugcugcugcugcug

SEQ ID NO: 2210534 - RNA, 14 nt, Homo sapiens
ccaagccacaggga

SEQ ID NO: 2210535 - RNA, 13 nt, Homo sapiens
gcuucucagccac

SEQ ID NO: 2210536 - RNA, 13 nt, Homo sapiens
uuuugucauucag

SEQ ID NO: 2210537 - RNA, 17 nt, Homo sapiens
ccacccuccaugcuccu

SEQ ID NO: 2210538 - RNA, 13 nt, Homo sapiens
auuuaauuaugaa

SEQ ID NO: 2210539 - RNA, 13 nt, Homo sapiens
cuuuaucaaagaa

SEQ ID NO: 2210540 - RNA, 20 nt, Homo sapiens
aacucuacuauccaauaugg

SEQ ID NO: 2210541 - RNA, 23 nt, Homo sapiens
cauugaacagcugugagccaugc

SEQ ID NO: 2210542 - RNA, 14 nt, Homo sapiens
cuaugcccauuucc

SEQ ID NO: 2210543 - RNA, 19 nt, Homo sapiens
ggauucacuucuauuuauu

SEQ ID NO: 2210544 - RNA, 14 nt, Homo sapiens
uuuggggcuaagaa

SEQ ID NO: 2210545 - RNA, 17 nt, Homo sapiens
aaaaccuaccacauuca

SEQ ID NO: 2210546 - RNA, 16 nt, Homo sapiens
uacuccuaugaucuga

SEQ ID NO: 2210547 - RNA, 17 nt, Homo sapiens
aaagugacaaagcaauu

SEQ ID NO: 2210548 - RNA, 22 nt, Homo sapiens
agcugaagaccauggauuucau

SEQ ID NO: 2210549 - RNA, 14 nt, Homo sapiens
guggauuguuuaua

SEQ ID NO: 2210550 - RNA, 19 nt, Homo sapiens
guccaauuccaaagccaga

SEQ ID NO: 2210551 - RNA, 21 nt, Homo sapiens
agugagauauuugguaccaug

SEQ ID NO: 2210552 - RNA, 23 nt, Homo sapiens
auagaugaguuuugccaguucaa

SEQ ID NO: 2210553 - RNA, 18 nt, Homo sapiens
aauucccauuuugcaaaa

SEQ ID NO: 2210554 - RNA, 18 nt, Homo sapiens
accucacuagcuccccaa

SEQ ID NO: 2210555 - RNA, 20 nt, Homo sapiens
gggagucagucaugucacug

SEQ ID NO: 2210556 - RNA, 21 nt, Homo sapiens
uccuguguaccucacugucca

SEQ ID NO: 2210557 - RNA, 16 nt, Homo sapiens
uacagagcaccuguag

SEQ ID NO: 2210558 - RNA, 15 nt, Homo sapiens
cuuacacacuggaaa

SEQ ID NO: 2210559 - RNA, 13 nt, Homo sapiens
gcccccaacagca

SEQ ID NO: 2210560 - RNA, 20 nt, Homo sapiens
gggagguggagauugcagug

SEQ ID NO: 2210561 - RNA, 19 nt, Homo sapiens
ggcauucuuguacagugua

SEQ ID NO: 2210562 - RNA, 15 nt, Homo sapiens
acauaaucuguacaa

SEQ ID NO: 2210563 - RNA, 16 nt, Homo sapiens
auuguuguaauugcau

SEQ ID NO: 2210564 - RNA, 17 nt, Homo sapiens
guguuggcagccucuuc

SEQ ID NO: 2210565 - RNA, 20 nt, Homo sapiens
cucuacuaaaaauacaaaaa

SEQ ID NO: 2210566 - RNA, 11 nt, Homo sapiens
agcacugugag

SEQ ID NO: 2210567 - RNA, 11 nt, Homo sapiens
aggacugugac

SEQ ID NO: 2210568 - RNA, 19 nt, Homo sapiens
gugugcuuuguacugcugu

SEQ ID NO: 2210569 - RNA, 14 nt, Homo sapiens
auaccuacauucaa

SEQ ID NO: 2210570 - RNA, 14 nt, Homo sapiens
acauaaacacuucu

SEQ ID NO: 2210571 - RNA, 19 nt, Homo sapiens
cgugauaaaccugcuccaa

SEQ ID NO: 2210572 - RNA, 14 nt, Homo sapiens
auuauagcacaaaa

SEQ ID NO: 2210573 - RNA, 14 nt, Homo sapiens
auauuugcacuuau

SEQ ID NO: 2210574 - RNA, 14 nt, Homo sapiens
agaggguggcugga

SEQ ID NO: 2210575 - RNA, 16 nt, Homo sapiens
gaacgggacucaggug

SEQ ID NO: 2210576 - RNA, 17 nt, Homo sapiens
ggcuuaaugcuucuuuc

SEQ ID NO: 2210577 - RNA, 13 nt, Homo sapiens
ccuugcaccugca

SEQ ID NO: 2210578 - RNA, 15 nt, Homo sapiens
cugcugcaccuugua

SEQ ID NO: 2210579 - RNA, 22 nt, Homo sapiens
cuuucuguccuggagcuagcaa

SEQ ID NO: 2210580 - RNA, 22 nt, Homo sapiens
auauuuuaucuugguaguacau

SEQ ID NO: 2210581 - RNA, 15 nt, Homo sapiens
accagaagcauuuca

SEQ ID NO: 2210582 - RNA, 21 nt, Homo sapiens
cuuuguauauaggcuucucac

SEQ ID NO: 2210583 - RNA, 22 nt, Homo sapiens
ugaauuggccugaacagaugua

SEQ ID NO: 2210584 - RNA, 21 nt, Homo sapiens
uuacgugcauuuaaacucugc

SEQ ID NO: 2210585 - RNA, 20 nt, Homo sapiens
cagagccuucaagugccaaa

SEQ ID NO: 2210586 - RNA, 13 nt, Homo sapiens
caagaacugccau

SEQ ID NO: 2210587 - RNA, 23 nt, Homo sapiens
uccaaaccccaggguagccaugg

SEQ ID NO: 2210588 - RNA, 22 nt, Homo sapiens
uucuaaagauucuauaguucua

SEQ ID NO: 2210589 - RNA, 22 nt, Homo sapiens
acaggugugugugaacugggca

SEQ ID NO: 2210590 - RNA, 22 nt, Homo sapiens
ccagagcuggaaggcagggcag

SEQ ID NO: 2210591 - RNA, 17 nt, Homo sapiens
cacauuggcaguguguc

SEQ ID NO: 2210592 - RNA, 15 nt, Homo sapiens
cagacaaaaagaaca

SEQ ID NO: 2210593 - RNA, 22 nt, Homo sapiens
guccccggacgcuggcucggga

SEQ ID NO: 2210594 - RNA, 22 nt, Homo sapiens
cccaccaaugggccuccagaga

SEQ ID NO: 2210595 - RNA, 17 nt, Homo sapiens
cuauuucaggcacauca

SEQ ID NO: 2210596 - RNA, 21 nt, Homo sapiens
uaaucccaauaaaauucugag

SEQ ID NO: 2210597 - RNA, 12 nt, Homo sapiens
uaaaaaacaguc

SEQ ID NO: 2210598 - RNA, 21 nt, Homo sapiens
uauucccagcuacucaugagg

SEQ ID NO: 2210599 - RNA, 23 nt, Homo sapiens
uuucaaguggaaaccuugcugcu

SEQ ID NO: 2210600 - RNA, 12 nt, Homo sapiens
uagcuacuguag

SEQ ID NO: 2210601 - RNA, 15 nt, Homo sapiens
aaaagagagaucuug

SEQ ID NO: 2210602 - RNA, 19 nt, Homo sapiens
caaagugcuggaauuacag

SEQ ID NO: 2210603 - RNA, 20 nt, Homo sapiens
aagagccuucaauuguagau

SEQ ID NO: 2210604 - RNA, 19 nt, Homo sapiens
ucucuguuccuucucuguc

SEQ ID NO: 2210605 - RNA, 22 nt, Homo sapiens
aagcugugacauauucugagga

SEQ ID NO: 2210606 - RNA, 21 nt, Homo sapiens
aggugcugggcuggacuggcc

SEQ ID NO: 2210607 - RNA, 23 nt, Homo sapiens
agcccuugagucugucacacucu

SEQ ID NO: 2210608 - RNA, 17 nt, Homo sapiens
ugagccugucacguggu

SEQ ID NO: 2210609 - RNA, 14 nt, Homo sapiens
ugaagucucccuug

SEQ ID NO: 2210610 - RNA, 22 nt, Homo sapiens
gugucacucaaggcggugcuug

SEQ ID NO: 2210611 - RNA, 13 nt, Homo sapiens
cacaccccagugg

SEQ ID NO: 2210612 - RNA, 13 nt, Homo sapiens
caugaacauguac

SEQ ID NO: 2210613 - RNA, 18 nt, Homo sapiens
acucggccccuccucaau

SEQ ID NO: 2210614 - RNA, 14 nt, Homo sapiens
gacugguacucaag

SEQ ID NO: 2210615 - RNA, 17 nt, Homo sapiens
ugcauuuucuucacagu

SEQ ID NO: 2210616 - RNA, 18 nt, Homo sapiens
cgagaagggcugcuuccc

SEQ ID NO: 2210617 - RNA, 14 nt, Homo sapiens
ccaaauaagugcau

SEQ ID NO: 2210618 - RNA, 23 nt, Homo sapiens
aacaauggauauugccuguguuu

SEQ ID NO: 2210619 - RNA, 14 nt, Homo sapiens
aaaccuuccucagc

SEQ ID NO: 2210620 - RNA, 18 nt, Homo sapiens
aaguuaaacaaguuuuca

SEQ ID NO: 2210621 - RNA, 19 nt, Homo sapiens
acuucuugguacccaguca

SEQ ID NO: 2210622 - RNA, 23 nt, Homo sapiens
acugaccacuggccuaccccuuu

SEQ ID NO: 2210623 - RNA, 17 nt, Homo sapiens
ccuuccaagaauggaau

SEQ ID NO: 2210624 - RNA, 17 nt, Homo sapiens
guuuggagucacuguag

SEQ ID NO: 2210625 - RNA, 22 nt, Homo sapiens
gaaaucauaccaguuguucauu

SEQ ID NO: 2210626 - RNA, 23 nt, Homo sapiens
ccuguggugaugugccuguaauc

SEQ ID NO: 2210627 - RNA, 23 nt, Homo sapiens
aggccgugcaguggcugugccac

SEQ ID NO: 2210628 - RNA, 16 nt, Homo sapiens
aagcuuccauuccaca

SEQ ID NO: 2210629 - RNA, 18 nt, Homo sapiens
gcuagucugcccuaugga

SEQ ID NO: 2210630 - RNA, 23 nt, Homo sapiens
gaggcuuguggccacaguggcac

SEQ ID NO: 2210631 - RNA, 16 nt, Homo sapiens
uuuaccuaaucuccac

SEQ ID NO: 2210632 - RNA, 21 nt, Homo sapiens
aggcuucuaugaaagacucaa

SEQ ID NO: 2210633 - RNA, 19 nt, Homo sapiens
gcuccuucacugaacaugc

SEQ ID NO: 2210634 - RNA, 14 nt, Homo sapiens
aggacucagaggau

SEQ ID NO: 2210635 - RNA, 21 nt, Homo sapiens
cagucccucccuccuggcuca

SEQ ID NO: 2210636 - RNA, 16 nt, Homo sapiens
cucuuugaaagcuuug

SEQ ID NO: 2210637 - RNA, 18 nt, Homo sapiens
acucaaaacacccaaaaa

SEQ ID NO: 2210638 - RNA, 19 nt, Homo sapiens
ugacuuaucuaccauugaa

SEQ ID NO: 2210639 - RNA, 20 nt, Homo sapiens
gcgaucuggguucacugcaa

SEQ ID NO: 2210640 - RNA, 16 nt, Homo sapiens
acgugccagcucuagu

SEQ ID NO: 2210641 - RNA, 18 nt, Homo sapiens
gaaccuggguugcagaca

SEQ ID NO: 2210642 - RNA, 21 nt, Homo sapiens
uaaaaaggaaacuucaguuga

SEQ ID NO: 2210643 - RNA, 15 nt, Homo sapiens
ucaccauugugaagc

SEQ ID NO: 2210644 - RNA, 21 nt, Homo sapiens
acuuaguuagccuuagggaug

SEQ ID NO: 2210645 - RNA, 16 nt, Homo sapiens
aauuacauaguccagu

SEQ ID NO: 2210646 - RNA, 16 nt, Homo sapiens
cuaaacaaggcauuca

SEQ ID NO: 2210647 - RNA, 18 nt, Homo sapiens
agugauguuggcuagccc

SEQ ID NO: 2210648 - RNA, 23 nt, Homo sapiens
aaguauacuaagaguaaagcaac

SEQ ID NO: 2210649 - RNA, 15 nt, Homo sapiens
acagaaacaaaauca

SEQ ID NO: 2210650 - RNA, 15 nt, Homo sapiens
aaaguaacacaaaca

SEQ ID NO: 2210651 - RNA, 14 nt, Homo sapiens
agugggacuggcac

SEQ ID NO: 2210652 - RNA, 16 nt, Homo sapiens
cacagugacacuggac

SEQ ID NO: 2210653 - RNA, 21 nt, Homo sapiens
acuccagaauuucccaaagca

SEQ ID NO: 2210654 - RNA, 16 nt, Homo sapiens
ugcaacucaucuucac

SEQ ID NO: 2210655 - RNA, 20 nt, Homo sapiens
acugcugccaacuccauguc

SEQ ID NO: 2210656 - RNA, 17 nt, Homo sapiens
uuaaauugaauucuacu

SEQ ID NO: 2210657 - RNA, 15 nt, Homo sapiens
ggcuaaagugcucua

SEQ ID NO: 2210658 - RNA, 23 nt, Homo sapiens
cauauucccugcacacacaugca

SEQ ID NO: 2210659 - RNA, 18 nt, Homo sapiens
aacaugcuuuuacuuuau

SEQ ID NO: 2210660 - RNA, 15 nt, Homo sapiens
acaucuauucucucc

SEQ ID NO: 2210661 - RNA, 12 nt, Homo sapiens
uaaauagugauu

SEQ ID NO: 2210662 - RNA, 18 nt, Homo sapiens
cauuucuguaaauaccau

SEQ ID NO: 2210663 - RNA, 16 nt, Homo sapiens
ugcuuucccacucuca

SEQ ID NO: 2210664 - RNA, 18 nt, Homo sapiens
gugucaccaauuccacca

SEQ ID NO: 2210665 - RNA, 21 nt, Homo sapiens
uccaaauagcccacacgugcu

SEQ ID NO: 2210666 - RNA, 23 nt, Homo sapiens
gaucacagccucugaaaaccaau

SEQ ID NO: 2210667 - RNA, 21 nt, Homo sapiens
gagaaccuguugaaaugugaa

SEQ ID NO: 2210668 - RNA, 12 nt, Homo sapiens
agguaacaaagg

SEQ ID NO: 2210669 - RNA, 20 nt, Homo sapiens
cuuccucaaauacaugcaca

SEQ ID NO: 2210670 - RNA, 20 nt, Homo sapiens
auucccagcugucuguguca

SEQ ID NO: 2210671 - RNA, 19 nt, Homo sapiens
ucuuacccgaaagcaucac

SEQ ID NO: 2210672 - RNA, 19 nt, Homo sapiens
uagauugaugugcacugca

SEQ ID NO: 2210673 - RNA, 17 nt, Homo sapiens
uuccuugccugugacuu

SEQ ID NO: 2210674 - RNA, 20 nt, Homo sapiens
gguccugcaaucuccagggc

SEQ ID NO: 2210675 - RNA, 13 nt, Homo sapiens
uagaugugcaaua

SEQ ID NO: 2210676 - RNA, 15 nt, Homo sapiens
cugccucccuuucau

SEQ ID NO: 2210677 - RNA, 20 nt, Homo sapiens
uagucacauggccuaugcac

SEQ ID NO: 2210678 - RNA, 16 nt, Homo sapiens
aauggcagaaccaaag

SEQ ID NO: 2210679 - RNA, 13 nt, Homo sapiens
gggaaaugccuuu

SEQ ID NO: 2210680 - RNA, 19 nt, Homo sapiens
cuauuucacuggagcacaa

SEQ ID NO: 2210681 - RNA, 22 nt, Homo sapiens
uggcuacgaaaugcuugcucag

SEQ ID NO: 2210682 - RNA, 18 nt, Homo sapiens
ggaaaauccacuaugaca

SEQ ID NO: 2210683 - RNA, 20 nt, Homo sapiens
ucccaaagugcugggauuaa

SEQ ID NO: 2210684 - RNA, 14 nt, Homo sapiens
agugugcauuucag

SEQ ID NO: 2210685 - RNA, 15 nt, Homo sapiens
uggcacuauccagau

SEQ ID NO: 2210686 - RNA, 23 nt, Homo sapiens
aucaccacaguaaguuccuacua

SEQ ID NO: 2210687 - RNA, 21 nt, Homo sapiens
acaugucuuuucuuccacugc

SEQ ID NO: 2210688 - RNA, 12 nt, Homo sapiens
cuuuacuccucg

SEQ ID NO: 2210689 - RNA, 22 nt, Homo sapiens
aauuauuuuaggcaaaguccau

SEQ ID NO: 2210690 - RNA, 13 nt, Homo sapiens
aaaaaacugggau

SEQ ID NO: 2210691 - RNA, 20 nt, Homo sapiens
ucucacuuauaccaaaggga

SEQ ID NO: 2210692 - RNA, 12 nt, Homo sapiens
ucuuuugccaag

SEQ ID NO: 2210693 - RNA, 12 nt, Homo sapiens
uauuuugcccag

SEQ ID NO: 2210694 - RNA, 19 nt, Homo sapiens
ugaaaugauuucacagugu

SEQ ID NO: 2210695 - RNA, 19 nt, Homo sapiens
ccggaacgucagccagcuc

SEQ ID NO: 2210696 - RNA, 19 nt, Homo sapiens
cagccgccugaaagccaca

SEQ ID NO: 2210697 - RNA, 18 nt, Homo sapiens
aguguucauugaugcugc

SEQ ID NO: 2210698 - RNA, 18 nt, Homo sapiens
caugucauuaaucaauuu

SEQ ID NO: 2210699 - RNA, 16 nt, Homo sapiens
ggaguucuuacuugac

SEQ ID NO: 2210700 - RNA, 17 nt, Homo sapiens
ugaguacauauuguggu

SEQ ID NO: 2210701 - RNA, 15 nt, Homo sapiens
ucuaccuaaaucuuc

SEQ ID NO: 2210702 - RNA, 18 nt, Homo sapiens
uaaaauaacuaagcaagu

SEQ ID NO: 2210703 - RNA, 20 nt, Homo sapiens
cuuugauuuguaccauuccu

SEQ ID NO: 2210704 - RNA, 18 nt, Homo sapiens
uccaucucucucuugccu

SEQ ID NO: 2210705 - RNA, 20 nt, Homo sapiens
acacacagacuuucugugac

SEQ ID NO: 2210706 - RNA, 16 nt, Homo sapiens
ccugcuaugaaaggaa

SEQ ID NO: 2210707 - RNA, 21 nt, Homo sapiens
cuuccugguuuuguacacugc

SEQ ID NO: 2210708 - RNA, 19 nt, Homo sapiens
ugcagccuccucugugacu

SEQ ID NO: 2210709 - RNA, 19 nt, Homo sapiens
uaaaauauagcuguacaaa

SEQ ID NO: 2210710 - RNA, 18 nt, Homo sapiens
uggacuugaggauuuuga

SEQ ID NO: 2210711 - RNA, 23 nt, Homo sapiens
uguucacacuuuucagcaaaaau

SEQ ID NO: 2210712 - RNA, 19 nt, Homo sapiens
cccuuccauuucuacugua

SEQ ID NO: 2210713 - RNA, 21 nt, Homo sapiens
cauugucaccgcaggugcuca

SEQ ID NO: 2210714 - RNA, 18 nt, Homo sapiens
cccaauaaaagugacucu

SEQ ID NO: 2210715 - RNA, 14 nt, Homo sapiens
agugccugagaugc

SEQ ID NO: 2210716 - RNA, 15 nt, Homo sapiens
acgucucaagacuga

SEQ ID NO: 2210717 - RNA, 23 nt, Homo sapiens
gcucacuacugaacacaugugua

SEQ ID NO: 2210718 - RNA, 22 nt, Homo sapiens
cuucagguuaucgaaauaacaa

SEQ ID NO: 2210719 - RNA, 17 nt, Homo sapiens
gacagaagucagguguc

SEQ ID NO: 2210720 - RNA, 20 nt, Homo sapiens
uucuaaaaguugcauguuau

SEQ ID NO: 2210721 - RNA, 13 nt, Homo sapiens
gcucuuucagaga

SEQ ID NO: 2210722 - RNA, 23 nt, Homo sapiens
gagguuucacccuuaacccaagg

SEQ ID NO: 2210723 - RNA, 16 nt, Homo sapiens
aacaaagcaauuucuc

SEQ ID NO: 2210724 - RNA, 13 nt, Homo sapiens
accagcucugggg

SEQ ID NO: 2210725 - RNA, 22 nt, Homo sapiens
cauucuuuauaaaauguauaaa

SEQ ID NO: 2210726 - RNA, 16 nt, Homo sapiens
auuuuaaauagacaau

SEQ ID NO: 2210727 - RNA, 19 nt, Homo sapiens
agauguauaacuaggagcu

SEQ ID NO: 2210728 - RNA, 16 nt, Homo sapiens
cugggccccuccagga

SEQ ID NO: 2210729 - RNA, 20 nt, Homo sapiens
caccacuagguggugcugga

SEQ ID NO: 2210730 - RNA, 21 nt, Homo sapiens
ucuuaccagauccuuuuccag

SEQ ID NO: 2210731 - RNA, 22 nt, Homo sapiens
accagagugggaccaaguccaa

SEQ ID NO: 2210732 - RNA, 12 nt, Homo sapiens
auacuaccaagu

SEQ ID NO: 2210733 - RNA, 19 nt, Homo sapiens
uucauguggcucagugccu

SEQ ID NO: 2210734 - RNA, 21 nt, Homo sapiens
agccuuuuuaaaacacauguu

SEQ ID NO: 2210735 - RNA, 19 nt, Homo sapiens
uggcacucccuaaccaaau

SEQ ID NO: 2210736 - RNA, 14 nt, Homo sapiens
guuucugcagcccu

SEQ ID NO: 2210737 - RNA, 13 nt, Homo sapiens
ccuaguacuuuau

SEQ ID NO: 2210738 - RNA, 17 nt, Homo sapiens
gacagccugcacagugg

SEQ ID NO: 2210739 - RNA, 13 nt, Homo sapiens
ccucuugcucaaa

SEQ ID NO: 2210740 - RNA, 17 nt, Homo sapiens
aguguaugcacgugugc

SEQ ID NO: 2210741 - RNA, 17 nt, Homo sapiens
aauaagccagcaaacca

SEQ ID NO: 2210742 - RNA, 22 nt, Homo sapiens
uccuacccacuggucugcuuaa

SEQ ID NO: 2210743 - RNA, 19 nt, Homo sapiens
gccuacuucaucucaggac

SEQ ID NO: 2210744 - RNA, 14 nt, Homo sapiens
aaguugcacacuca

SEQ ID NO: 2210745 - RNA, 18 nt, Homo sapiens
ugccccggcuugccugua

SEQ ID NO: 2210746 - RNA, 15 nt, Homo sapiens
gaaaggucuaugcag

SEQ ID NO: 2210747 - RNA, 14 nt, Homo sapiens
cucacgcagacaca

SEQ ID NO: 2210748 - RNA, 19 nt, Homo sapiens
uguucauccuaacaugaca

SEQ ID NO: 2210749 - RNA, 22 nt, Homo sapiens
cagggccccgcugucacuugcc

SEQ ID NO: 2210750 - RNA, 19 nt, Homo sapiens
auaagucaaaauaaucuga

SEQ ID NO: 2210751 - RNA, 15 nt, Homo sapiens
auacaaguugcaaau

SEQ ID NO: 2210752 - RNA, 15 nt, Homo sapiens
uuaccuuuucuauaa

SEQ ID NO: 2210753 - RNA, 23 nt, Homo sapiens
acacucacagcaaggauggagcu

SEQ ID NO: 2210754 - RNA, 13 nt, Homo sapiens
accagcaccacuc

SEQ ID NO: 2210755 - RNA, 19 nt, Homo sapiens
uccuaggggccgagggaaa

SEQ ID NO: 2210756 - RNA, 21 nt, Homo sapiens
uuaagugcacaccgugugcca

SEQ ID NO: 2210757 - RNA, 20 nt, Homo sapiens
augcuaacaaagacaaaagu

SEQ ID NO: 2210758 - RNA, 15 nt, Homo sapiens
ggcgcccacccuggg

SEQ ID NO: 2210759 - RNA, 16 nt, Homo sapiens
ggauguauauugcuau

SEQ ID NO: 2210760 - RNA, 11 nt, Homo sapiens
acacugucaag

SEQ ID NO: 2210761 - RNA, 18 nt, Homo sapiens
acucaagugucuaccugg

SEQ ID NO: 2210762 - RNA, 18 nt, Homo sapiens
aucccagagcuucccagg

SEQ ID NO: 2210763 - RNA, 16 nt, Homo sapiens
ucccccaccccagagu

SEQ ID NO: 2210764 - RNA, 14 nt, Homo sapiens
auaaauuacauuaa

SEQ ID NO: 2210765 - RNA, 19 nt, Homo sapiens
auauuuaguauaccagaga

SEQ ID NO: 2210766 - RNA, 17 nt, Homo sapiens
ucggcucuggccuccaa

SEQ ID NO: 2210767 - RNA, 19 nt, Homo sapiens
ccugguugucugaacccag

SEQ ID NO: 2210768 - RNA, 22 nt, Homo sapiens
acucugccccuucuguuuccau

SEQ ID NO: 2210769 - RNA, 23 nt, Homo sapiens
acuuuauuacaagaucuuuccaa

SEQ ID NO: 2210770 - RNA, 15 nt, Homo sapiens
agcauccagaccuga

SEQ ID NO: 2210771 - RNA, 20 nt, Homo sapiens
guguugggaaaaaggccucu

SEQ ID NO: 2210772 - RNA, 16 nt, Homo sapiens
acaaagagguguacag

SEQ ID NO: 2210773 - RNA, 19 nt, Homo sapiens
agaaauuuuucuaguauau

SEQ ID NO: 2210774 - RNA, 18 nt, Homo sapiens
ucuuuucuucuauggggu

SEQ ID NO: 2210775 - RNA, 22 nt, Homo sapiens
ucuccuaaaacuuuaaaacuug

SEQ ID NO: 2210776 - RNA, 22 nt, Homo sapiens
uuagcaauuuccgccuggugau

SEQ ID NO: 2210777 - RNA, 15 nt, Homo sapiens
uagacaggaaagcca

SEQ ID NO: 2210778 - RNA, 15 nt, Homo sapiens
guaaugauguugaua

SEQ ID NO: 2210779 - RNA, 21 nt, Homo sapiens
uacaggugucaccaucauuuc

SEQ ID NO: 2210780 - RNA, 12 nt, Homo sapiens
cgucuuuaguuu

SEQ ID NO: 2210781 - RNA, 20 nt, Homo sapiens
ccccaggaaguugugugacc

SEQ ID NO: 2210782 - RNA, 22 nt, Homo sapiens
auuguuuucaguguacauggaa

SEQ ID NO: 2210783 - RNA, 17 nt, Homo sapiens
ugugaccugucagaaua

SEQ ID NO: 2210784 - RNA, 20 nt, Homo sapiens
uuaauuuuaaccaaaacaug

SEQ ID NO: 2210785 - RNA, 15 nt, Homo sapiens
acuuaugaccccuua

SEQ ID NO: 2210786 - RNA, 23 nt, Homo sapiens
acccaaaagaauuaaauugauua

SEQ ID NO: 2210787 - RNA, 15 nt, Homo sapiens
uacuaaagacgguau

SEQ ID NO: 2210788 - RNA, 18 nt, Homo sapiens
gugccugcuuaccugcca

SEQ ID NO: 2210789 - RNA, 14 nt, Homo sapiens
aaauuuauauuuca

SEQ ID NO: 2210790 - RNA, 14 nt, Homo sapiens
cuaguuaucaugca

SEQ ID NO: 2210791 - RNA, 18 nt, Homo sapiens
uuugccauucucuggguu

SEQ ID NO: 2210792 - RNA, 12 nt, Homo sapiens
uuuccuguauau

SEQ ID NO: 2210793 - RNA, 13 nt, Homo sapiens
aagagccacagua

SEQ ID NO: 2210794 - RNA, 16 nt, Homo sapiens
gagaagccagugcggc

SEQ ID NO: 2210795 - RNA, 17 nt, Homo sapiens
ugagcugacccaacacu

SEQ ID NO: 2210796 - RNA, 19 nt, Homo sapiens
auaacacuguuggcacuua

SEQ ID NO: 2210797 - RNA, 12 nt, Homo sapiens
aaugaaacagac

SEQ ID NO: 2210798 - RNA, 19 nt, Homo sapiens
guagaacucacagaaauaa

SEQ ID NO: 2210799 - RNA, 12 nt, Homo sapiens
ugaaaacucauc

SEQ ID NO: 2210800 - RNA, 16 nt, Homo sapiens
uccuugcuuguuacau

SEQ ID NO: 2210801 - RNA, 16 nt, Homo sapiens
cagauguggugauacu

SEQ ID NO: 2210802 - RNA, 17 nt, Homo sapiens
agggagugcuggcucac

SEQ ID NO: 2210803 - RNA, 12 nt, Homo sapiens
auggagggaugg

SEQ ID NO: 2210804 - RNA, 12 nt, Homo sapiens
caagagggcaag

SEQ ID NO: 2210805 - RNA, 21 nt, Homo sapiens
ggcucuucugacauuuaucag

SEQ ID NO: 2210806 - RNA, 21 nt, Homo sapiens
acuaccggcuacaucaaauca

SEQ ID NO: 2210807 - RNA, 22 nt, Homo sapiens
cauccuagucucuaucauuaaa

SEQ ID NO: 2210808 - RNA, 14 nt, Homo sapiens
uuacaaaguuucaa

SEQ ID NO: 2210809 - RNA, 14 nt, Homo sapiens
uuucuuaguuacuu

SEQ ID NO: 2210810 - RNA, 17 nt, Homo sapiens
cagucaugcagucuggg

SEQ ID NO: 2210811 - RNA, 17 nt, Homo sapiens
uuaaagucuacacugcc

SEQ ID NO: 2210812 - RNA, 15 nt, Homo sapiens
aggcucagcccugag

SEQ ID NO: 2210813 - RNA, 18 nt, Homo sapiens
gaacacauaauucaggaa

SEQ ID NO: 2210814 - RNA, 16 nt, Homo sapiens
uggccacacagcagcg

SEQ ID NO: 2210815 - RNA, 15 nt, Homo sapiens
gaagacuucuaugga

SEQ ID NO: 2210816 - RNA, 13 nt, Homo sapiens
ccugaaccagucc

SEQ ID NO: 2210817 - RNA, 14 nt, Homo sapiens
caccuguggauguu

SEQ ID NO: 2210818 - RNA, 13 nt, Homo sapiens
accguaugaugag

SEQ ID NO: 2210819 - RNA, 15 nt, Homo sapiens
augugaaucccucaa

SEQ ID NO: 2210820 - RNA, 21 nt, Homo sapiens
uauauuccccuaagauuugau

SEQ ID NO: 2210821 - RNA, 17 nt, Homo sapiens
auaaaaccaccaaaguc

SEQ ID NO: 2210822 - RNA, 13 nt, Homo sapiens
gacacagccuccc

SEQ ID NO: 2210823 - RNA, 13 nt, Homo sapiens
gucacagccaccc

SEQ ID NO: 2210824 - RNA, 17 nt, Homo sapiens
aauacaguaucucaggg

SEQ ID NO: 2210825 - RNA, 23 nt, Homo sapiens
ugggagguagaaggggaggacac

SEQ ID NO: 2210826 - RNA, 15 nt, Homo sapiens
uucaauuuggcaaaa

SEQ ID NO: 2210827 - RNA, 20 nt, Homo sapiens
aggcgugagccaccaugccc

SEQ ID NO: 2210828 - RNA, 16 nt, Homo sapiens
aaaaugaguuaccuca

SEQ ID NO: 2210829 - RNA, 21 nt, Homo sapiens
uucuguuagcugcucacuuaa

SEQ ID NO: 2210830 - RNA, 15 nt, Homo sapiens
gaaccauaugugcua

SEQ ID NO: 2210831 - RNA, 19 nt, Homo sapiens
aagacagauucuucacugu

SEQ ID NO: 2210832 - RNA, 10 nt, Homo sapiens
aaaguaggcu

SEQ ID NO: 2210833 - RNA, 13 nt, Homo sapiens
auacuguacauag

SEQ ID NO: 2210834 - RNA, 15 nt, Homo sapiens
ggccaggcacagggc

SEQ ID NO: 2210835 - RNA, 21 nt, Homo sapiens
ugagaagacauggaugaucug

SEQ ID NO: 2210836 - RNA, 20 nt, Homo sapiens
gauguggguguccugcagaa

SEQ ID NO: 2210837 - RNA, 13 nt, Homo sapiens
cugccauugugau

SEQ ID NO: 2210838 - RNA, 15 nt, Homo sapiens
acucuuuccagauaa

SEQ ID NO: 2210839 - RNA, 22 nt, Homo sapiens
caaaauauauuuuaucugugau

SEQ ID NO: 2210840 - RNA, 12 nt, Homo sapiens
aaaggacugacc

SEQ ID NO: 2210841 - RNA, 15 nt, Homo sapiens
uucuuguaagccauc

SEQ ID NO: 2210842 - RNA, 17 nt, Homo sapiens
auuuccaaaugaaugac

SEQ ID NO: 2210843 - RNA, 15 nt, Homo sapiens
uguccucuugcucaa

SEQ ID NO: 2210844 - RNA, 14 nt, Homo sapiens
gagcuaaggccaau

SEQ ID NO: 2210845 - RNA, 21 nt, Homo sapiens
caggagagacaggauugggcc

SEQ ID NO: 2210846 - RNA, 18 nt, Homo sapiens
ugaauaaauugaacuaaa

SEQ ID NO: 2210847 - RNA, 23 nt, Homo sapiens
ccaaugggccuccagagacccca

SEQ ID NO: 2210848 - RNA, 12 nt, Homo sapiens
ggaugccaguug

SEQ ID NO: 2210849 - RNA, 21 nt, Homo sapiens
acuucgccagccuccaaugua

SEQ ID NO: 2210850 - RNA, 18 nt, Homo sapiens
gagccuucugugcuguga

SEQ ID NO: 2210851 - RNA, 11 nt, Homo sapiens
gauuuuccucc

SEQ ID NO: 2210852 - RNA, 21 nt, Homo sapiens
cuaugacuggaguaaaccaug

SEQ ID NO: 2210853 - RNA, 11 nt, Homo sapiens
caucucugcaa

SEQ ID NO: 2210854 - RNA, 20 nt, Homo sapiens
cauggagacguggugggacu

SEQ ID NO: 2210855 - RNA, 22 nt, Homo sapiens
ucacugcaggggucuggugguc

SEQ ID NO: 2210856 - RNA, 16 nt, Homo sapiens
gucaacaaccaugcca

SEQ ID NO: 2210857 - RNA, 15 nt, Homo sapiens
auuuuuagucuggcu

SEQ ID NO: 2210858 - RNA, 13 nt, Homo sapiens
auuaugaagucau

SEQ ID NO: 2210859 - RNA, 16 nt, Homo sapiens
acaaacucagaucuca

SEQ ID NO: 2210860 - RNA, 18 nt, Homo sapiens
cacagagaaggcuaugua

SEQ ID NO: 2210861 - RNA, 22 nt, Homo sapiens
aaucaugagauccuuuaaaucc

SEQ ID NO: 2210862 - RNA, 22 nt, Homo sapiens
ccccaacaaugugagggguccc

SEQ ID NO: 2210863 - RNA, 21 nt, Homo sapiens
cgagaucaugccauugcauuc

SEQ ID NO: 2210864 - RNA, 22 nt, Homo sapiens
guuccggauuggcuuguguguu

SEQ ID NO: 2210865 - RNA, 15 nt, Homo sapiens
uucaaguguacaugu

SEQ ID NO: 2210866 - RNA, 15 nt, Homo sapiens
ucuccuuugcacugu

SEQ ID NO: 2210867 - RNA, 18 nt, Homo sapiens
ugaauucugucauuucaa

SEQ ID NO: 2210868 - RNA, 17 nt, Homo sapiens
auuuauaaaauaaugaa

SEQ ID NO: 2210869 - RNA, 23 nt, Homo sapiens
ugguggcauuuugagaaugguaa

SEQ ID NO: 2210870 - RNA, 17 nt, Homo sapiens
accgauaagugugcuua

SEQ ID NO: 2210871 - RNA, 15 nt, Homo sapiens
agcucugcauaagau

SEQ ID NO: 2210872 - RNA, 20 nt, Homo sapiens
ugaaagaagaguuccauggu

SEQ ID NO: 2210873 - RNA, 14 nt, Homo sapiens
cuuucuuuggugcc

SEQ ID NO: 2210874 - RNA, 16 nt, Homo sapiens
ggguucugauauugcc

SEQ ID NO: 2210875 - RNA, 20 nt, Homo sapiens
uuacagacuagcaggcuacu

SEQ ID NO: 2210876 - RNA, 15 nt, Homo sapiens
caagaagaugaaugg

SEQ ID NO: 2210877 - RNA, 23 nt, Homo sapiens
ugacugugaggugggccuuugag

SEQ ID NO: 2210878 - RNA, 20 nt, Homo sapiens
gacuuccuuuaggaucucag

SEQ ID NO: 2210879 - RNA, 18 nt, Homo sapiens
accuaguauaucagugac

SEQ ID NO: 2210880 - RNA, 22 nt, Homo sapiens
guggcccuuaugacugccaaga

SEQ ID NO: 2210881 - RNA, 17 nt, Homo sapiens
uaguuuggauuacuuaa

SEQ ID NO: 2210882 - RNA, 16 nt, Homo sapiens
gaugugcaaguguaug

SEQ ID NO: 2210883 - RNA, 22 nt, Homo sapiens
ucaacuuggugacacucuauaa

SEQ ID NO: 2210884 - RNA, 21 nt, Homo sapiens
aaaugaugucaugucagcucc

SEQ ID NO: 2210885 - RNA, 13 nt, Homo sapiens
cuugcuacugaaa

SEQ ID NO: 2210886 - RNA, 14 nt, Homo sapiens
gugggccuggcaca

SEQ ID NO: 2210887 - RNA, 15 nt, Homo sapiens
ccuuggaugugaugg

SEQ ID NO: 2210888 - RNA, 17 nt, Homo sapiens
ccuucgauauaugacuu

SEQ ID NO: 2210889 - RNA, 17 nt, Homo sapiens
gaaacccuauuucccca

SEQ ID NO: 2210890 - RNA, 18 nt, Homo sapiens
ugggagacaacuggacaa

SEQ ID NO: 2210891 - RNA, 20 nt, Homo sapiens
agacuuuauaauuccuucug

SEQ ID NO: 2210892 - RNA, 17 nt, Homo sapiens
ucucaugauagaaggcu

SEQ ID NO: 2210893 - RNA, 21 nt, Homo sapiens
agcucuuuuauaugcuaaagg

SEQ ID NO: 2210894 - RNA, 16 nt, Homo sapiens
auuccuuugucuucaa

SEQ ID NO: 2210895 - RNA, 21 nt, Homo sapiens
uaacaauguaugugaaagugu

SEQ ID NO: 2210896 - RNA, 23 nt, Homo sapiens
ucuucaggcaccugaagugagaa

SEQ ID NO: 2210897 - RNA, 16 nt, Homo sapiens
gaugugcgcacacaca

SEQ ID NO: 2210898 - RNA, 15 nt, Homo sapiens
acaccccaacacuuc

SEQ ID NO: 2210899 - RNA, 15 nt, Homo sapiens
cugcuucacugcccc

SEQ ID NO: 2210900 - RNA, 16 nt, Homo sapiens
uccaauaaaaugccuc

SEQ ID NO: 2210901 - RNA, 18 nt, Homo sapiens
aaaaucccaagucauuuc

SEQ ID NO: 2210902 - RNA, 13 nt, Homo sapiens
cccugcccggcug

SEQ ID NO: 2210903 - RNA, 16 nt, Homo sapiens
ugaaaucagaagccua

SEQ ID NO: 2210904 - RNA, 19 nt, Homo sapiens
gcaucauggaucaaccaag

SEQ ID NO: 2210905 - RNA, 17 nt, Homo sapiens
aauaaauguaucugaau

SEQ ID NO: 2210906 - RNA, 18 nt, Homo sapiens
aggccaggauggcacugu

SEQ ID NO: 2210907 - RNA, 18 nt, Homo sapiens
aaauaagucaaaauguga

SEQ ID NO: 2210908 - RNA, 18 nt, Homo sapiens
agcuccagccugacauca

SEQ ID NO: 2210909 - RNA, 21 nt, Homo sapiens
cugugucggauacacacucga

SEQ ID NO: 2210910 - RNA, 13 nt, Homo sapiens
auuuucaguuaca

SEQ ID NO: 2210911 - RNA, 14 nt, Homo sapiens
cccagcacugagga

SEQ ID NO: 2210912 - RNA, 19 nt, Homo sapiens
acuugcucaaaaucuguga

SEQ ID NO: 2210913 - RNA, 15 nt, Homo sapiens
cuccaaggacaucua

SEQ ID NO: 2210914 - RNA, 14 nt, Homo sapiens
ucuuugaggugauu

SEQ ID NO: 2210915 - RNA, 14 nt, Homo sapiens
agggacacuuucac

SEQ ID NO: 2210916 - RNA, 21 nt, Homo sapiens
uauagugaaacauguacuuug

SEQ ID NO: 2210917 - RNA, 18 nt, Homo sapiens
cucuggucuguagguuug

SEQ ID NO: 2210918 - RNA, 18 nt, Homo sapiens
aacagccucuuugcccaa

SEQ ID NO: 2210919 - RNA, 13 nt, Homo sapiens
aaggccuacccca

SEQ ID NO: 2210920 - RNA, 22 nt, Homo sapiens
ucuauaaugugccuggcucuga

SEQ ID NO: 2210921 - RNA, 23 nt, Homo sapiens
uucgaauacgucagauuggacca

SEQ ID NO: 2210922 - RNA, 14 nt, Homo sapiens
acaaaucaucugua

SEQ ID NO: 2210923 - RNA, 19 nt, Homo sapiens
uguccguccacccuuccau

SEQ ID NO: 2210924 - RNA, 17 nt, Homo sapiens
uuagaaauuuauauguc

SEQ ID NO: 2210925 - RNA, 12 nt, Homo sapiens
uggcacucuugg

SEQ ID NO: 2210926 - RNA, 17 nt, Homo sapiens
uacacugaaucauuaac

SEQ ID NO: 2210927 - RNA, 19 nt, Homo sapiens
gaaagucguacuguucaca

SEQ ID NO: 2210928 - RNA, 19 nt, Homo sapiens
aaaaaccacugcuaugcca

SEQ ID NO: 2210929 - RNA, 16 nt, Homo sapiens
agaagggagauucaaa

SEQ ID NO: 2210930 - RNA, 15 nt, Homo sapiens
uuaaauauuuugacu

SEQ ID NO: 2210931 - RNA, 15 nt, Homo sapiens
aaguauaacaugucg

SEQ ID NO: 2210932 - RNA, 16 nt, Homo sapiens
uauagcaagaucccau

SEQ ID NO: 2210933 - RNA, 17 nt, Homo sapiens
gaugcacaguaucugcu

SEQ ID NO: 2210934 - RNA, 22 nt, Homo sapiens
acuaugcauggugccccaggac

SEQ ID NO: 2210935 - RNA, 18 nt, Homo sapiens
uuugcacacugcacuguu

SEQ ID NO: 2210936 - RNA, 12 nt, Homo sapiens
cuauauuuacug

SEQ ID NO: 2210937 - RNA, 14 nt, Homo sapiens
gcugcauccaggac

SEQ ID NO: 2210938 - RNA, 14 nt, Homo sapiens
aagugccaugcuca

SEQ ID NO: 2210939 - RNA, 18 nt, Homo sapiens
uccucccagcguguguau

SEQ ID NO: 2210940 - RNA, 22 nt, Homo sapiens
ucaacagaucugcauuuggcug

SEQ ID NO: 2210941 - RNA, 17 nt, Homo sapiens
agugcaacagcacuggc

SEQ ID NO: 2210942 - RNA, 17 nt, Homo sapiens
cugaccaagauacuuaa

SEQ ID NO: 2210943 - RNA, 17 nt, Homo sapiens
ucugggccacucaggcc

SEQ ID NO: 2210944 - RNA, 13 nt, Homo sapiens
ccuuugcauucau

SEQ ID NO: 2210945 - RNA, 16 nt, Homo sapiens
agcccuuaaaugagau

SEQ ID NO: 2210946 - RNA, 15 nt, Homo sapiens
aacagucaucauuua

SEQ ID NO: 2210947 - RNA, 17 nt, Homo sapiens
gaaagcugacaucugua

SEQ ID NO: 2210948 - RNA, 22 nt, Homo sapiens
acuuuguuaaaugguuauccaa

SEQ ID NO: 2210949 - RNA, 12 nt, Homo sapiens
cagggguugugg

SEQ ID NO: 2210950 - RNA, 23 nt, Homo sapiens
uagucccacagggaaauguguau

SEQ ID NO: 2210951 - RNA, 19 nt, Homo sapiens
gauucugcaguaaaucuuu

SEQ ID NO: 2210952 - RNA, 20 nt, Homo sapiens
cagccagcucauuucacuuu

SEQ ID NO: 2210953 - RNA, 12 nt, Homo sapiens
agagauggcuca

SEQ ID NO: 2210954 - RNA, 14 nt, Homo sapiens
uaaagggacuugaa

SEQ ID NO: 2210955 - RNA, 20 nt, Homo sapiens
ccgacaggagcacugcaugu

SEQ ID NO: 2210956 - RNA, 21 nt, Homo sapiens
cgcaagggagaagaaauccau

SEQ ID NO: 2210957 - RNA, 17 nt, Homo sapiens
aaagcaaaucuguauaa

SEQ ID NO: 2210958 - RNA, 17 nt, Homo sapiens
uauuccucacauucaca

SEQ ID NO: 2210959 - RNA, 12 nt, Homo sapiens
gcauuugcuggu

SEQ ID NO: 2210960 - RNA, 18 nt, Homo sapiens
ucccaguccggugccuuc

SEQ ID NO: 2210961 - RNA, 14 nt, Homo sapiens
ccucagccaaugaa

SEQ ID NO: 2210962 - RNA, 14 nt, Homo sapiens
ccucugaagcauuu

SEQ ID NO: 2210963 - RNA, 14 nt, Homo sapiens
agucgcuugccaaa

SEQ ID NO: 2210964 - RNA, 11 nt, Homo sapiens
auugugugagu

SEQ ID NO: 2210965 - RNA, 20 nt, Homo sapiens
cauucccagaauuugcugca

SEQ ID NO: 2210966 - RNA, 16 nt, Homo sapiens
ugagugugcagacagc

SEQ ID NO: 2210967 - RNA, 15 nt, Homo sapiens
aauucuaaaccaauc

SEQ ID NO: 2210968 - RNA, 18 nt, Homo sapiens
aucaagaaaaacaucuuu

SEQ ID NO: 2210969 - RNA, 12 nt, Homo sapiens
accaauguucua

SEQ ID NO: 2210970 - RNA, 13 nt, Homo sapiens
aggcagguuucau

SEQ ID NO: 2210971 - RNA, 14 nt, Homo sapiens
cuuauuacugagag

SEQ ID NO: 2210972 - RNA, 14 nt, Homo sapiens
uagcaaugugccuu

SEQ ID NO: 2210973 - RNA, 18 nt, Homo sapiens
acucuuggggaccaaaua

SEQ ID NO: 2210974 - RNA, 19 nt, Homo sapiens
gccucccgccgccucgggc

SEQ ID NO: 2210975 - RNA, 19 nt, Homo sapiens
cgauuugggggcucgggga

SEQ ID NO: 2210976 - RNA, 15 nt, Homo sapiens
auaaauacugcugua

SEQ ID NO: 2210977 - RNA, 14 nt, Homo sapiens
gaaauaauguguag

SEQ ID NO: 2210978 - RNA, 22 nt, Homo sapiens
augaaauucuuauguugaauau

SEQ ID NO: 2210979 - RNA, 22 nt, Homo sapiens
cauaauuaauguaguaguaaua

SEQ ID NO: 2210980 - RNA, 17 nt, Homo sapiens
ggagguaucuagcaaug

SEQ ID NO: 2210981 - RNA, 18 nt, Homo sapiens
cuaaaguaucugagauua

SEQ ID NO: 2210982 - RNA, 18 nt, Homo sapiens
acaaucuuauugucaaca

SEQ ID NO: 2210983 - RNA, 13 nt, Homo sapiens
uccacccaaauau

SEQ ID NO: 2210984 - RNA, 13 nt, Homo sapiens
aacccccaucucu

SEQ ID NO: 2210985 - RNA, 13 nt, Homo sapiens
aaccuccaucucc

SEQ ID NO: 2210986 - RNA, 21 nt, Homo sapiens
ccuggcuggaaugggggccag

SEQ ID NO: 2210987 - RNA, 19 nt, Homo sapiens
gagguccacaacacacaga

SEQ ID NO: 2210988 - RNA, 22 nt, Homo sapiens
agcuuguugucuccacuuguau

SEQ ID NO: 2210989 - RNA, 20 nt, Homo sapiens
agccccaucccaaacccuuc

SEQ ID NO: 2210990 - RNA, 19 nt, Homo sapiens
augaaauggaggaucucua

SEQ ID NO: 2210991 - RNA, 15 nt, Homo sapiens
uaauuuaaucuucca

SEQ ID NO: 2210992 - RNA, 22 nt, Homo sapiens
acaagcaggcucaacauaacau

SEQ ID NO: 2210993 - RNA, 18 nt, Homo sapiens
uguuaucugaacugugga

SEQ ID NO: 2210994 - RNA, 19 nt, Homo sapiens
uguagccauggcucaggca

SEQ ID NO: 2210995 - RNA, 23 nt, Homo sapiens
ugaagggcugauugggauuucca

SEQ ID NO: 2210996 - RNA, 13 nt, Homo sapiens
acuugcucuggac

SEQ ID NO: 2210997 - RNA, 23 nt, Homo sapiens
uguuacgaugcaauucuagccaa

SEQ ID NO: 2210998 - RNA, 20 nt, Homo sapiens
aaaacauaugaccauugagu

SEQ ID NO: 2210999 - RNA, 22 nt, Homo sapiens
cacuacaaccuccgccucccau

SEQ ID NO: 2211000 - RNA, 23 nt, Homo sapiens
uaaguucaccguaguaacacaua

SEQ ID NO: 2211001 - RNA, 19 nt, Homo sapiens
gcuuuaaaaucuguucacu

SEQ ID NO: 2211002 - RNA, 14 nt, Homo sapiens
uuacuguagaccuu

SEQ ID NO: 2211003 - RNA, 17 nt, Homo sapiens
caacagugagucuguca

SEQ ID NO: 2211004 - RNA, 13 nt, Homo sapiens
agacugagcucaa

SEQ ID NO: 2211005 - RNA, 14 nt, Homo sapiens
cacagugacuuccu

SEQ ID NO: 2211006 - RNA, 15 nt, Homo sapiens
accuaaaaagaauag

SEQ ID NO: 2211007 - RNA, 13 nt, Homo sapiens
agagguacuguaa

SEQ ID NO: 2211008 - RNA, 18 nt, Homo sapiens
cugcgaaugggauccuga

SEQ ID NO: 2211009 - RNA, 17 nt, Homo sapiens
uggugggccauggccau

SEQ ID NO: 2211010 - RNA, 18 nt, Homo sapiens
augggugaaaaaugguaa

SEQ ID NO: 2211011 - RNA, 19 nt, Homo sapiens
aggagagaggcucuggggc

SEQ ID NO: 2211012 - RNA, 15 nt, Homo sapiens
cagccugggggacag

SEQ ID NO: 2211013 - RNA, 13 nt, Homo sapiens
aaggaaugauaua

SEQ ID NO: 2211014 - RNA, 17 nt, Homo sapiens
uaaaccagcuacuugau

SEQ ID NO: 2211015 - RNA, 19 nt, Homo sapiens
caacugccagaacauggau

SEQ ID NO: 2211016 - RNA, 15 nt, Homo sapiens
aggaaaauuugacau

SEQ ID NO: 2211017 - RNA, 15 nt, Homo sapiens
agugaauuuuugcaa

SEQ ID NO: 2211018 - RNA, 16 nt, Homo sapiens
acaugaaaacauugau

SEQ ID NO: 2211019 - RNA, 12 nt, Homo sapiens
caguaugcuugg

SEQ ID NO: 2211020 - RNA, 12 nt, Homo sapiens
uuugaugccauu

SEQ ID NO: 2211021 - RNA, 12 nt, Homo sapiens
uaugaugccuuu

SEQ ID NO: 2211022 - RNA, 16 nt, Homo sapiens
accaggucaucuccuu

SEQ ID NO: 2211023 - RNA, 17 nt, Homo sapiens
uagucccaaaauucaua

SEQ ID NO: 2211024 - RNA, 19 nt, Homo sapiens
ggaguucuuuggcucuauu

SEQ ID NO: 2211025 - RNA, 20 nt, Homo sapiens
agcaagacauacuuaaugca

SEQ ID NO: 2211026 - RNA, 18 nt, Homo sapiens
ugaagaaugaaaggcaau

SEQ ID NO: 2211027 - RNA, 16 nt, Homo sapiens
aggcucacagauuuaa

SEQ ID NO: 2211028 - RNA, 19 nt, Homo sapiens
ggcacagaagcucaucuca

SEQ ID NO: 2211029 - RNA, 20 nt, Homo sapiens
ugcugugacuagaaccauaa

SEQ ID NO: 2211030 - RNA, 22 nt, Homo sapiens
guccucuuugagaaaauguaaa

SEQ ID NO: 2211031 - RNA, 19 nt, Homo sapiens
uagaagagauuucuaaaag

SEQ ID NO: 2211032 - RNA, 20 nt, Homo sapiens
aagagcagcuucggugugca

SEQ ID NO: 2211033 - RNA, 15 nt, Homo sapiens
uggucugccagaaua

SEQ ID NO: 2211034 - RNA, 21 nt, Homo sapiens
ugucaucccauugucuucuga

SEQ ID NO: 2211035 - RNA, 22 nt, Homo sapiens
gcagucgaguuucuacguggug

SEQ ID NO: 2211036 - RNA, 23 nt, Homo sapiens
gcaugcagccagccaucaaauag

SEQ ID NO: 2211037 - RNA, 23 nt, Homo sapiens
acaaguguuuauuaaaauacugu

SEQ ID NO: 2211038 - RNA, 17 nt, Homo sapiens
uuuauaucaugcaaaau

SEQ ID NO: 2211039 - RNA, 19 nt, Homo sapiens
ucucaaaaccggguugcca

SEQ ID NO: 2211040 - RNA, 22 nt, Homo sapiens
gcaaugcaugauacuaucugug

SEQ ID NO: 2211041 - RNA, 22 nt, Homo sapiens
uuggucagaaagauaagccagu

SEQ ID NO: 2211042 - RNA, 16 nt, Homo sapiens
gguaguuuaaguuucc

SEQ ID NO: 2211043 - RNA, 13 nt, Homo sapiens
uuuauacuguaug

SEQ ID NO: 2211044 - RNA, 19 nt, Homo sapiens
guaaaaugcaccaaucagc

SEQ ID NO: 2211045 - RNA, 13 nt, Homo sapiens
uauguccagucau

SEQ ID NO: 2211046 - RNA, 14 nt, Homo sapiens
acaaaguacauucu

SEQ ID NO: 2211047 - RNA, 21 nt, Homo sapiens
uuugacaacgccaacugccca

SEQ ID NO: 2211048 - RNA, 13 nt, Homo sapiens
ccauguaucuuuu

SEQ ID NO: 2211049 - RNA, 20 nt, Homo sapiens
guagauauuguuuucuguaa

SEQ ID NO: 2211050 - RNA, 22 nt, Homo sapiens
uauuggcgcaccaagaucucca

SEQ ID NO: 2211051 - RNA, 17 nt, Homo sapiens
augcaagcucagggugc

SEQ ID NO: 2211052 - RNA, 20 nt, Homo sapiens
augccauguauguugcauga

SEQ ID NO: 2211053 - RNA, 14 nt, Homo sapiens
caccacacacacac

SEQ ID NO: 2211054 - RNA, 14 nt, Homo sapiens
accuauaccaauau

SEQ ID NO: 2211055 - RNA, 16 nt, Homo sapiens
gaaaauaagagcucag

SEQ ID NO: 2211056 - RNA, 19 nt, Homo sapiens
acuuguuugcugugaacaa

SEQ ID NO: 2211057 - RNA, 22 nt, Homo sapiens
ugggccggccagccuugcacug

SEQ ID NO: 2211058 - RNA, 17 nt, Homo sapiens
uagcauuaucuuaucau

SEQ ID NO: 2211059 - RNA, 17 nt, Homo sapiens
cggccucugccuuugca

SEQ ID NO: 2211060 - RNA, 17 nt, Homo sapiens
acuugcugauccaugag

SEQ ID NO: 2211061 - RNA, 17 nt, Homo sapiens
auuuuguauccaaggau

SEQ ID NO: 2211062 - RNA, 22 nt, Homo sapiens
acuaaaauuuuaggcacucuua

SEQ ID NO: 2211063 - RNA, 19 nt, Homo sapiens
aaaauuccauuuacuugau

SEQ ID NO: 2211064 - RNA, 14 nt, Homo sapiens
guuuucuucacuau

SEQ ID NO: 2211065 - RNA, 18 nt, Homo sapiens
accugucuauacuacagu

SEQ ID NO: 2211066 - RNA, 13 nt, Homo sapiens
aaaaugcuuuguu

SEQ ID NO: 2211067 - RNA, 20 nt, Homo sapiens
aacccuuuuaaaguugauau

SEQ ID NO: 2211068 - RNA, 9 nt, Homo sapiens
aaagugaug

SEQ ID NO: 2211069 - RNA, 21 nt, Homo sapiens
ugaaaagcaguucaugucuga

SEQ ID NO: 2211070 - RNA, 23 nt, Homo sapiens
cacuggccaagaaaauugccuuu

SEQ ID NO: 2211071 - RNA, 22 nt, Homo sapiens
gaaggagcauaugauugcucca

SEQ ID NO: 2211072 - RNA, 17 nt, Homo sapiens
auaauaugugccuuaag

SEQ ID NO: 2211073 - RNA, 14 nt, Homo sapiens
auacuauugccuca

SEQ ID NO: 2211074 - RNA, 19 nt, Homo sapiens
cgggugggcggcuggagac

SEQ ID NO: 2211075 - RNA, 16 nt, Homo sapiens
gcccuggcucugcugu

SEQ ID NO: 2211076 - RNA, 18 nt, Homo sapiens
aaugaaauggauugguaa

SEQ ID NO: 2211077 - RNA, 16 nt, Homo sapiens
cuguucuucaacuccu

SEQ ID NO: 2211078 - RNA, 21 nt, Homo sapiens
cugaaugcuccagucaacaaa

SEQ ID NO: 2211079 - RNA, 23 nt, Homo sapiens
ugccaggugcaaucuacuggaaa

SEQ ID NO: 2211080 - RNA, 11 nt, Homo sapiens
gucuugaucuc

SEQ ID NO: 2211081 - RNA, 21 nt, Homo sapiens
ucaugaaacuuguuucacuga

SEQ ID NO: 2211082 - RNA, 17 nt, Homo sapiens
aucacauauucuagugu

SEQ ID NO: 2211083 - RNA, 16 nt, Homo sapiens
ugaagucacacaguga

SEQ ID NO: 2211084 - RNA, 15 nt, Homo sapiens
gaagacuuuaucaug

SEQ ID NO: 2211085 - RNA, 19 nt, Homo sapiens
gcaggaacauacagacaca

SEQ ID NO: 2211086 - RNA, 18 nt, Homo sapiens
gcccuucccacagcauuc

SEQ ID NO: 2211087 - RNA, 14 nt, Homo sapiens
ucaugggaucccag

SEQ ID NO: 2211088 - RNA, 14 nt, Homo sapiens
cccugggaccacag

SEQ ID NO: 2211089 - RNA, 17 nt, Homo sapiens
aaacauacccaucugca

SEQ ID NO: 2211090 - RNA, 20 nt, Homo sapiens
acacaccgaugcugacucca

SEQ ID NO: 2211091 - RNA, 16 nt, Homo sapiens
ucaguuaaguguuucc

SEQ ID NO: 2211092 - RNA, 16 nt, Homo sapiens
ccuuuccucaggcaag

SEQ ID NO: 2211093 - RNA, 22 nt, Homo sapiens
cucuggaaaacucaggauucuc

SEQ ID NO: 2211094 - RNA, 19 nt, Homo sapiens
cacagcaguagcaguagau

SEQ ID NO: 2211095 - RNA, 12 nt, Homo sapiens
gacuaacagcug

SEQ ID NO: 2211096 - RNA, 20 nt, Homo sapiens
ucucuugagauaagguuuua

SEQ ID NO: 2211097 - RNA, 14 nt, Homo sapiens
cuggcauuaagggc

SEQ ID NO: 2211098 - RNA, 18 nt, Homo sapiens
cagccacuugacuaauac

SEQ ID NO: 2211099 - RNA, 15 nt, Homo sapiens
guaugcaugcacaaa

SEQ ID NO: 2211100 - RNA, 15 nt, Homo sapiens
cuaacucauucuuca

SEQ ID NO: 2211101 - RNA, 18 nt, Homo sapiens
cagacuucacuucccuga

SEQ ID NO: 2211102 - RNA, 18 nt, Homo sapiens
aguccugcuccagaauuu

SEQ ID NO: 2211103 - RNA, 23 nt, Homo sapiens
ugcaaucuguguucgauggcuca

SEQ ID NO: 2211104 - RNA, 21 nt, Homo sapiens
auauuauacacaucuggcuca

SEQ ID NO: 2211105 - RNA, 15 nt, Homo sapiens
ugaacaaaugacauc

SEQ ID NO: 2211106 - RNA, 19 nt, Homo sapiens
gcuggucacucugcccucu

SEQ ID NO: 2211107 - RNA, 18 nt, Homo sapiens
gauuauacaaaagagcau

SEQ ID NO: 2211108 - RNA, 19 nt, Homo sapiens
aguaucaaacuacugccau

SEQ ID NO: 2211109 - RNA, 16 nt, Homo sapiens
caguuguggccucauu

SEQ ID NO: 2211110 - RNA, 16 nt, Homo sapiens
ugcuuaaaauugugag

SEQ ID NO: 2211111 - RNA, 16 nt, Homo sapiens
aaccaaaauacuccaa

SEQ ID NO: 2211112 - RNA, 14 nt, Homo sapiens
ggccccuugcaaag

SEQ ID NO: 2211113 - RNA, 14 nt, Homo sapiens
gaacugucuacccu

SEQ ID NO: 2211114 - RNA, 15 nt, Homo sapiens
aguauauaggugcug

SEQ ID NO: 2211115 - RNA, 16 nt, Homo sapiens
aggggcacagugaaug

SEQ ID NO: 2211116 - RNA, 15 nt, Homo sapiens
aaggcuugccgcaca

SEQ ID NO: 2211117 - RNA, 13 nt, Homo sapiens
uuguauauacuuc

SEQ ID NO: 2211118 - RNA, 20 nt, Homo sapiens
aaucuguccguucacaugug

SEQ ID NO: 2211119 - RNA, 20 nt, Homo sapiens
gauaauggaaagcagcagcu

SEQ ID NO: 2211120 - RNA, 15 nt, Homo sapiens
ucacuaugcauuuua

SEQ ID NO: 2211121 - RNA, 18 nt, Homo sapiens
gacuuggguugaacuaua

SEQ ID NO: 2211122 - RNA, 20 nt, Homo sapiens
gcaggcccguggcaggagga

SEQ ID NO: 2211123 - RNA, 18 nt, Homo sapiens
acuuccaugauacuuuaa

SEQ ID NO: 2211124 - RNA, 21 nt, Homo sapiens
gugcugcuguggcaucaggaa

SEQ ID NO: 2211125 - RNA, 16 nt, Homo sapiens
ucaguaacagugcagu

SEQ ID NO: 2211126 - RNA, 17 nt, Homo sapiens
agagaccuccugauguc

SEQ ID NO: 2211127 - RNA, 13 nt, Homo sapiens
ugauuuaagacac

SEQ ID NO: 2211128 - RNA, 16 nt, Homo sapiens
ucaagggacaaguauu

SEQ ID NO: 2211129 - RNA, 21 nt, Homo sapiens
augcccaauccaggcccggug

SEQ ID NO: 2211130 - RNA, 16 nt, Homo sapiens
cauuuuucacuguaca

SEQ ID NO: 2211131 - RNA, 13 nt, Homo sapiens
aaaugaguauuuc

SEQ ID NO: 2211132 - RNA, 13 nt, Homo sapiens
aaaucaguauuug

SEQ ID NO: 2211133 - RNA, 18 nt, Homo sapiens
cccccaacccccugcaag

SEQ ID NO: 2211134 - RNA, 18 nt, Homo sapiens
cagucaccucacaaaccu

SEQ ID NO: 2211135 - RNA, 18 nt, Homo sapiens
ccaggccugcagacagac

SEQ ID NO: 2211136 - RNA, 17 nt, Homo sapiens
acagugccccucagcca

SEQ ID NO: 2211137 - RNA, 20 nt, Homo sapiens
cucacugccguccucaggug

SEQ ID NO: 2211138 - RNA, 23 nt, Homo sapiens
accaggugcaugcaugcccucuc

SEQ ID NO: 2211139 - RNA, 19 nt, Homo sapiens
ugcacaggucccacugccc

SEQ ID NO: 2211140 - RNA, 19 nt, Homo sapiens
aauauagauguuagcccaa

SEQ ID NO: 2211141 - RNA, 23 nt, Homo sapiens
agcuuuacaaggaguaacaaaac

SEQ ID NO: 2211142 - RNA, 15 nt, Homo sapiens
ugcgaaagacccaca

SEQ ID NO: 2211143 - RNA, 17 nt, Homo sapiens
aauaaagcguccucuca

SEQ ID NO: 2211144 - RNA, 22 nt, Homo sapiens
uuuguaaucucauaacuuucca

SEQ ID NO: 2211145 - RNA, 20 nt, Homo sapiens
uucuagaggucucucuggaa

SEQ ID NO: 2211146 - RNA, 13 nt, Homo sapiens
agugaucucaggg

SEQ ID NO: 2211147 - RNA, 13 nt, Homo sapiens
ucuacuacagggu

SEQ ID NO: 2211148 - RNA, 20 nt, Homo sapiens
aauaaaaagugacacagcag

SEQ ID NO: 2211149 - RNA, 19 nt, Homo sapiens
acagccagguuagccuuug

SEQ ID NO: 2211150 - RNA, 14 nt, Homo sapiens
uuccaugacugcuu

SEQ ID NO: 2211151 - RNA, 17 nt, Homo sapiens
acaucacugaaaugcua

SEQ ID NO: 2211152 - RNA, 18 nt, Homo sapiens
gcccaggcaacaguacuu

SEQ ID NO: 2211153 - RNA, 14 nt, Homo sapiens
acccaucucugaac

SEQ ID NO: 2211154 - RNA, 13 nt, Homo sapiens
aaaccuaaugauc

SEQ ID NO: 2211155 - RNA, 14 nt, Homo sapiens
ugcuguugauucuu

SEQ ID NO: 2211156 - RNA, 19 nt, Homo sapiens
ucucuccaguguuucuaca

SEQ ID NO: 2211157 - RNA, 17 nt, Homo sapiens
ggucaccccuccaggaa

SEQ ID NO: 2211158 - RNA, 16 nt, Homo sapiens
acccuauauguggcau

SEQ ID NO: 2211159 - RNA, 20 nt, Homo sapiens
cggagagaauggggugagca

SEQ ID NO: 2211160 - RNA, 17 nt, Homo sapiens
ccagcaguuacugugaa

SEQ ID NO: 2211161 - RNA, 23 nt, Homo sapiens
acguuaaaggcauuuuauuccag

SEQ ID NO: 2211162 - RNA, 20 nt, Homo sapiens
cauaacucauugucugugga

SEQ ID NO: 2211163 - RNA, 12 nt, Homo sapiens
aaauccaugugu

SEQ ID NO: 2211164 - RNA, 18 nt, Homo sapiens
ggccaucucugaacuuca

SEQ ID NO: 2211165 - RNA, 12 nt, Homo sapiens
cucauucuugcc

SEQ ID NO: 2211166 - RNA, 18 nt, Homo sapiens
auugauuagauaaagauu

SEQ ID NO: 2211167 - RNA, 23 nt, Homo sapiens
gaaggaugucccggguguguaca

SEQ ID NO: 2211168 - RNA, 17 nt, Homo sapiens
cuuccccaaacccagaa

SEQ ID NO: 2211169 - RNA, 15 nt, Homo sapiens
ccaagagugaaggga

SEQ ID NO: 2211170 - RNA, 19 nt, Homo sapiens
ugcagagaaucuguaguca

SEQ ID NO: 2211171 - RNA, 17 nt, Homo sapiens
aacccccaguucaagac

SEQ ID NO: 2211172 - RNA, 15 nt, Homo sapiens
caucuuagaccucca

SEQ ID NO: 2211173 - RNA, 19 nt, Homo sapiens
cugcugugcuagugccuga

SEQ ID NO: 2211174 - RNA, 15 nt, Homo sapiens
cuaacuccugccauu

SEQ ID NO: 2211175 - RNA, 17 nt, Homo sapiens
agaaagguuuuauucua

SEQ ID NO: 2211176 - RNA, 13 nt, Homo sapiens
uggaagcaguuuc

SEQ ID NO: 2211177 - RNA, 20 nt, Homo sapiens
ugaggcugcaaucacacuga

SEQ ID NO: 2211178 - RNA, 19 nt, Homo sapiens
gacaucggccuccaugacc

SEQ ID NO: 2211179 - RNA, 19 nt, Homo sapiens
caguggcuggaucugugag

SEQ ID NO: 2211180 - RNA, 21 nt, Homo sapiens
guggauucuucccacacagaa

SEQ ID NO: 2211181 - RNA, 16 nt, Homo sapiens
aaaauucacaaauggg

SEQ ID NO: 2211182 - RNA, 11 nt, Homo sapiens
gcauacuacag

SEQ ID NO: 2211183 - RNA, 20 nt, Homo sapiens
cacuugccuucuucacccag

SEQ ID NO: 2211184 - RNA, 19 nt, Homo sapiens
aacuuggcuaacauagcac

SEQ ID NO: 2211185 - RNA, 19 nt, Homo sapiens
uaaacuauaaacuacugua

SEQ ID NO: 2211186 - RNA, 17 nt, Homo sapiens
aaaucuucuaauuccaa

SEQ ID NO: 2211187 - RNA, 12 nt, Homo sapiens
ccucagugcauu

SEQ ID NO: 2211188 - RNA, 18 nt, Homo sapiens
ugagucccuuccagucau

SEQ ID NO: 2211189 - RNA, 16 nt, Homo sapiens
agccccucuaccuccu

SEQ ID NO: 2211190 - RNA, 22 nt, Homo sapiens
ucugagagugaaaccaugacug

SEQ ID NO: 2211191 - RNA, 22 nt, Homo sapiens
gcaucuagaauuaguggagcuu

SEQ ID NO: 2211192 - RNA, 16 nt, Homo sapiens
cauaaaaaaccacagc

SEQ ID NO: 2211193 - RNA, 17 nt, Homo sapiens
aaauucucacagaagaa

SEQ ID NO: 2211194 - RNA, 14 nt, Homo sapiens
cgacuguuuuccca

SEQ ID NO: 2211195 - RNA, 15 nt, Homo sapiens
uuaaagaaacuuggc

SEQ ID NO: 2211196 - RNA, 16 nt, Homo sapiens
uugaacuucaccugca

SEQ ID NO: 2211197 - RNA, 22 nt, Homo sapiens
aagguugucagcugcagccacu

SEQ ID NO: 2211198 - RNA, 15 nt, Homo sapiens
cugcuacuuaauucc

SEQ ID NO: 2211199 - RNA, 15 nt, Homo sapiens
acugaggcagggaag

SEQ ID NO: 2211200 - RNA, 20 nt, Homo sapiens
ugaaauccagugagcacuag

SEQ ID NO: 2211201 - RNA, 20 nt, Homo sapiens
ccaccccagaaauggugaaa

SEQ ID NO: 2211202 - RNA, 18 nt, Homo sapiens
aaaaauguucuuacacaa

SEQ ID NO: 2211203 - RNA, 15 nt, Homo sapiens
guuucccacucugaa

SEQ ID NO: 2211204 - RNA, 21 nt, Homo sapiens
caagccagcccccuccagcuc

SEQ ID NO: 2211205 - RNA, 17 nt, Homo sapiens
uucccacaggacauuuc

SEQ ID NO: 2211206 - RNA, 17 nt, Homo sapiens
ggccgucucugauucuc

SEQ ID NO: 2211207 - RNA, 14 nt, Homo sapiens
aaaguaccacacau

SEQ ID NO: 2211208 - RNA, 15 nt, Homo sapiens
gaguaucuaaagcca

SEQ ID NO: 2211209 - RNA, 15 nt, Homo sapiens
uccaagcacagagcc

SEQ ID NO: 2211210 - RNA, 23 nt, Homo sapiens
cacuccgagaggugggccagucu

SEQ ID NO: 2211211 - RNA, 14 nt, Homo sapiens
acaugcacucagcu

SEQ ID NO: 2211212 - RNA, 18 nt, Homo sapiens
uuuaucccccgcaaagac

SEQ ID NO: 2211213 - RNA, 17 nt, Homo sapiens
ggacucuggauauuugc

SEQ ID NO: 2211214 - RNA, 16 nt, Homo sapiens
ucaccgaggacaugaa

SEQ ID NO: 2211215 - RNA, 16 nt, Homo sapiens
uguucagggcugugau

SEQ ID NO: 2211216 - RNA, 19 nt, Homo sapiens
auuggaauucuacuggaaa

SEQ ID NO: 2211217 - RNA, 14 nt, Homo sapiens
ucauagccaaacag

SEQ ID NO: 2211218 - RNA, 22 nt, Homo sapiens
gagcuggggguccacacaucuc

SEQ ID NO: 2211219 - RNA, 20 nt, Homo sapiens
uuaugaucuggcccuugcuu

SEQ ID NO: 2211220 - RNA, 14 nt, Homo sapiens
acucugugaucuaa

SEQ ID NO: 2211221 - RNA, 14 nt, Homo sapiens
cucuaaugccucug

SEQ ID NO: 2211222 - RNA, 19 nt, Homo sapiens
cacuuaagcagagcagaac

SEQ ID NO: 2211223 - RNA, 15 nt, Homo sapiens
ucuguauugcuggca

SEQ ID NO: 2211224 - RNA, 20 nt, Homo sapiens
ugugguccagaagaaauuau

SEQ ID NO: 2211225 - RNA, 17 nt, Homo sapiens
ucauggggaagcuucca

SEQ ID NO: 2211226 - RNA, 15 nt, Homo sapiens
ucauuguuucugcau

SEQ ID NO: 2211227 - RNA, 19 nt, Homo sapiens
gucuaggucuccucagggu

SEQ ID NO: 2211228 - RNA, 14 nt, Homo sapiens
uacagauguagaua

SEQ ID NO: 2211229 - RNA, 21 nt, Homo sapiens
gaaguuugucaggcacaguaa

SEQ ID NO: 2211230 - RNA, 16 nt, Homo sapiens
aguacugacagaaagc

SEQ ID NO: 2211231 - RNA, 14 nt, Homo sapiens
gaaaaaaguguuua

SEQ ID NO: 2211232 - RNA, 17 nt, Homo sapiens
aguguuuugcaagggaa

SEQ ID NO: 2211233 - RNA, 14 nt, Homo sapiens
ucacgagccuuugu

SEQ ID NO: 2211234 - RNA, 15 nt, Homo sapiens
aaguagaacuuugua

SEQ ID NO: 2211235 - RNA, 21 nt, Homo sapiens
ucuaauguguggaaugugcag

SEQ ID NO: 2211236 - RNA, 13 nt, Homo sapiens
cuuccaacccacu

SEQ ID NO: 2211237 - RNA, 19 nt, Homo sapiens
acagaacugcuaaauacug

SEQ ID NO: 2211238 - RNA, 22 nt, Homo sapiens
ucgucccguucuccauucugcu

SEQ ID NO: 2211239 - RNA, 22 nt, Homo sapiens
ggcccgcagugcugggaccaga

SEQ ID NO: 2211240 - RNA, 22 nt, Homo sapiens
ugaauaggcauuaaaugcaaaa

SEQ ID NO: 2211241 - RNA, 21 nt, Homo sapiens
cauaacugcuucuuggagcuu

SEQ ID NO: 2211242 - RNA, 17 nt, Homo sapiens
uuauaggccugugugua

SEQ ID NO: 2211243 - RNA, 18 nt, Homo sapiens
uaacuaaaccacuuaaaa

SEQ ID NO: 2211244 - RNA, 22 nt, Homo sapiens
guuugaagaugccgcauuugga

SEQ ID NO: 2211245 - RNA, 19 nt, Homo sapiens
gaaccuuugugcccuauca

SEQ ID NO: 2211246 - RNA, 16 nt, Homo sapiens
cuguccucauguguug

SEQ ID NO: 2211247 - RNA, 13 nt, Homo sapiens
acugagcacugaa

SEQ ID NO: 2211248 - RNA, 15 nt, Homo sapiens
auuagaugcacuuaa

SEQ ID NO: 2211249 - RNA, 20 nt, Homo sapiens
uuuaugaaaccaacuguuga

SEQ ID NO: 2211250 - RNA, 17 nt, Homo sapiens
ggguugagcuguugccu

SEQ ID NO: 2211251 - RNA, 15 nt, Homo sapiens
gacaguuuucugcuu

SEQ ID NO: 2211252 - RNA, 18 nt, Homo sapiens
uuccaaguauuuugccac

SEQ ID NO: 2211253 - RNA, 17 nt, Homo sapiens
gacacucauauugcccu

SEQ ID NO: 2211254 - RNA, 20 nt, Homo sapiens
ccggaaggagacugugguuu

SEQ ID NO: 2211255 - RNA, 15 nt, Homo sapiens
cccaggguccacuga

SEQ ID NO: 2211256 - RNA, 16 nt, Homo sapiens
cccaagccugcaguca

SEQ ID NO: 2211257 - RNA, 18 nt, Homo sapiens
ugcaccaucacacaugca

SEQ ID NO: 2211258 - RNA, 20 nt, Homo sapiens
ugcuaccugauucauuuauu

SEQ ID NO: 2211259 - RNA, 23 nt, Homo sapiens
accucugccugaagucacacagu

SEQ ID NO: 2211260 - RNA, 12 nt, Homo sapiens
caaagacaugga

SEQ ID NO: 2211261 - RNA, 19 nt, Homo sapiens
ucaugggagggggcuugaa

SEQ ID NO: 2211262 - RNA, 18 nt, Homo sapiens
acagcugcugcuggaaau

SEQ ID NO: 2211263 - RNA, 18 nt, Homo sapiens
cauauaaagguuaugaaa

SEQ ID NO: 2211264 - RNA, 18 nt, Homo sapiens
gaugccagcgccaugcuu

SEQ ID NO: 2211265 - RNA, 21 nt, Homo sapiens
ccagaauggaauuuugcuaca

SEQ ID NO: 2211266 - RNA, 13 nt, Homo sapiens
cagggccugagcc

SEQ ID NO: 2211267 - RNA, 17 nt, Homo sapiens
agagggcccagcccaga

SEQ ID NO: 2211268 - RNA, 16 nt, Homo sapiens
ggagcuuuccaaagaa

SEQ ID NO: 2211269 - RNA, 21 nt, Homo sapiens
acuggaaauugaaauaaagau

SEQ ID NO: 2211270 - RNA, 22 nt, Homo sapiens
caaagugcugggauuacagaca

SEQ ID NO: 2211271 - RNA, 20 nt, Homo sapiens
agcagaacacugcagucaga

SEQ ID NO: 2211272 - RNA, 13 nt, Homo sapiens
ucuggucacuuca

SEQ ID NO: 2211273 - RNA, 21 nt, Homo sapiens
gacuucugcaucuuacaguca

SEQ ID NO: 2211274 - RNA, 14 nt, Homo sapiens
uaggaaaaccagag

SEQ ID NO: 2211275 - RNA, 20 nt, Homo sapiens
uggccacgggggcaguguga

SEQ ID NO: 2211276 - RNA, 22 nt, Homo sapiens
gcguguuucugacucugagcua

SEQ ID NO: 2211277 - RNA, 22 nt, Homo sapiens
uucauccaacgugaagauacca

SEQ ID NO: 2211278 - RNA, 15 nt, Homo sapiens
acagaccuucacaga

SEQ ID NO: 2211279 - RNA, 23 nt, Homo sapiens
uaggagagagugcugcagagcca

SEQ ID NO: 2211280 - RNA, 14 nt, Homo sapiens
ucaucacccagcac

SEQ ID NO: 2211281 - RNA, 13 nt, Homo sapiens
aaucagcacucug

SEQ ID NO: 2211282 - RNA, 15 nt, Homo sapiens
aacgaagcaccauca

SEQ ID NO: 2211283 - RNA, 18 nt, Homo sapiens
auguggcagcugucucaa

SEQ ID NO: 2211284 - RNA, 18 nt, Homo sapiens
gagggugggaggggccau

SEQ ID NO: 2211285 - RNA, 18 nt, Homo sapiens
aaaugaaaccuacaggaa

SEQ ID NO: 2211286 - RNA, 23 nt, Homo sapiens
agguuuuguugcuuguacagugu

SEQ ID NO: 2211287 - RNA, 14 nt, Homo sapiens
acgcuugacaguua

SEQ ID NO: 2211288 - RNA, 18 nt, Homo sapiens
uuauugaagaugugauca

SEQ ID NO: 2211289 - RNA, 19 nt, Homo sapiens
auuuccauaccauugugga

SEQ ID NO: 2211290 - RNA, 19 nt, Homo sapiens
auccccuuuggcuaccuga

SEQ ID NO: 2211291 - RNA, 21 nt, Homo sapiens
cuguucuaagugcuggcaauu

SEQ ID NO: 2211292 - RNA, 15 nt, Homo sapiens
cuuugacguggagcu

SEQ ID NO: 2211293 - RNA, 11 nt, Homo sapiens
aaccaccaaaa

SEQ ID NO: 2211294 - RNA, 22 nt, Homo sapiens
uuucucaugguauuaucuagua

SEQ ID NO: 2211295 - RNA, 17 nt, Homo sapiens
uaaaggaugggaccaac

SEQ ID NO: 2211296 - RNA, 17 nt, Homo sapiens
cgaggggcucauguuca

SEQ ID NO: 2211297 - RNA, 17 nt, Homo sapiens
aucaaagaacaaacauc

SEQ ID NO: 2211298 - RNA, 23 nt, Homo sapiens
uguuuugccaauuugcacauuaa

SEQ ID NO: 2211299 - RNA, 22 nt, Homo sapiens
uuuaauacaggguagauaaccu

SEQ ID NO: 2211300 - RNA, 15 nt, Homo sapiens
guugucacaccugaa

SEQ ID NO: 2211301 - RNA, 16 nt, Homo sapiens
uucugggcacuaagaa

SEQ ID NO: 2211302 - RNA, 20 nt, Homo sapiens
gcgugcgcgcgcuucuggga

SEQ ID NO: 2211303 - RNA, 14 nt, Homo sapiens
ucagcauaccugcu

SEQ ID NO: 2211304 - RNA, 13 nt, Homo sapiens
aauaaauucuaaa

SEQ ID NO: 2211305 - RNA, 15 nt, Homo sapiens
acuagacugccacaa

SEQ ID NO: 2211306 - RNA, 16 nt, Homo sapiens
caguuuagaacagagg

SEQ ID NO: 2211307 - RNA, 12 nt, Homo sapiens
cuaaccacauca

SEQ ID NO: 2211308 - RNA, 14 nt, Homo sapiens
aggaaaccacagcu

SEQ ID NO: 2211309 - RNA, 15 nt, Homo sapiens
cccucuggggcucag

SEQ ID NO: 2211310 - RNA, 18 nt, Homo sapiens
ugggggugcucucucuga

SEQ ID NO: 2211311 - RNA, 16 nt, Homo sapiens
ugcgcacacacagaua

SEQ ID NO: 2211312 - RNA, 15 nt, Homo sapiens
cuacaugcauuucaa

SEQ ID NO: 2211313 - RNA, 24 nt, Homo sapiens
uggccucagaugauggggucagca

SEQ ID NO: 2211314 - RNA, 20 nt, Homo sapiens
accggaggcaaaaggcagug

SEQ ID NO: 2211315 - RNA, 21 nt, Homo sapiens
caacuuaagcugggauaauca

SEQ ID NO: 2211316 - RNA, 14 nt, Homo sapiens
uauaauucugaaau

SEQ ID NO: 2211317 - RNA, 22 nt, Homo sapiens
cugucuucaccugauucaacua

SEQ ID NO: 2211318 - RNA, 21 nt, Homo sapiens
ugucaccucccugaaauugca

SEQ ID NO: 2211319 - RNA, 20 nt, Homo sapiens
ugaaauauuaaaaucacugu

SEQ ID NO: 2211320 - RNA, 16 nt, Homo sapiens
agggauuuuagccucu

SEQ ID NO: 2211321 - RNA, 18 nt, Homo sapiens
cggcugccgacuccccca

SEQ ID NO: 2211322 - RNA, 20 nt, Homo sapiens
ucccuaagaauucccagaua

SEQ ID NO: 2211323 - RNA, 22 nt, Homo sapiens
guauuuaacauucuuggucaca

SEQ ID NO: 2211324 - RNA, 20 nt, Homo sapiens
agugcaguuuuuuucuuguc

SEQ ID NO: 2211325 - RNA, 16 nt, Homo sapiens
cauugacgauuccuuc

SEQ ID NO: 2211326 - RNA, 14 nt, Homo sapiens
guaaguccuaauaa

SEQ ID NO: 2211327 - RNA, 23 nt, Homo sapiens
ugcacacagggaggcuguagcca

SEQ ID NO: 2211328 - RNA, 17 nt, Homo sapiens
cugaugacacauuuggc

SEQ ID NO: 2211329 - RNA, 20 nt, Homo sapiens
cacaggcuccuguauuugag

SEQ ID NO: 2211330 - RNA, 19 nt, Homo sapiens
uggaucacugauauuuuag

SEQ ID NO: 2211331 - RNA, 18 nt, Homo sapiens
aaauugggaaaacuccau

SEQ ID NO: 2211332 - RNA, 20 nt, Homo sapiens
cugugaggccauacuuguga

SEQ ID NO: 2211333 - RNA, 15 nt, Homo sapiens
cucagucaugcacuc

SEQ ID NO: 2211334 - RNA, 18 nt, Homo sapiens
gauuccugggcaagaacc

SEQ ID NO: 2211335 - RNA, 16 nt, Homo sapiens
acaaauaaagcaauga

SEQ ID NO: 2211336 - RNA, 14 nt, Homo sapiens
ucuugaaaguacca

SEQ ID NO: 2211337 - RNA, 15 nt, Homo sapiens
guaugaggcauuugu

SEQ ID NO: 2211338 - RNA, 21 nt, Homo sapiens
ucagcuacuucuccugcacuu

SEQ ID NO: 2211339 - RNA, 23 nt, Homo sapiens
aaagaaucccaauguuugacaaa

SEQ ID NO: 2211340 - RNA, 16 nt, Homo sapiens
agaacaaagagugaaa

SEQ ID NO: 2211341 - RNA, 22 nt, Homo sapiens
ugaauuuuuuucugcacagcuu

SEQ ID NO: 2211342 - RNA, 14 nt, Homo sapiens
ugagugcagccaaa

SEQ ID NO: 2211343 - RNA, 18 nt, Homo sapiens
gagguuuggaagagugaa

SEQ ID NO: 2211344 - RNA, 17 nt, Homo sapiens
ggaggagcuucucccag

SEQ ID NO: 2211345 - RNA, 17 nt, Homo sapiens
ugucugaauauucuaga

SEQ ID NO: 2211346 - RNA, 17 nt, Homo sapiens
cuguguucgauggcuca

SEQ ID NO: 2211347 - RNA, 22 nt, Homo sapiens
gucugugcauuucugguugcac

SEQ ID NO: 2211348 - RNA, 23 nt, Homo sapiens
ugccucccuggcagcacaggaaa

SEQ ID NO: 2211349 - RNA, 15 nt, Homo sapiens
uggaugucuguagca

SEQ ID NO: 2211350 - RNA, 21 nt, Homo sapiens
ucucaccugcuggggaccuca

SEQ ID NO: 2211351 - RNA, 15 nt, Homo sapiens
cugacugaugacaaa

SEQ ID NO: 2211352 - RNA, 17 nt, Homo sapiens
uucucugccuguacuga

SEQ ID NO: 2211353 - RNA, 14 nt, Homo sapiens
uaacagauguugaa

SEQ ID NO: 2211354 - RNA, 15 nt, Homo sapiens
agaccauuuguauua

SEQ ID NO: 2211355 - RNA, 15 nt, Homo sapiens
ugacuuauaguacau

SEQ ID NO: 2211356 - RNA, 18 nt, Homo sapiens
ggaaugauccaauacugu

SEQ ID NO: 2211357 - RNA, 16 nt, Homo sapiens
acuggcccaccccucu

SEQ ID NO: 2211358 - RNA, 15 nt, Homo sapiens
acacccacuccacac

SEQ ID NO: 2211359 - RNA, 16 nt, Homo sapiens
aacaccccacugagcc

SEQ ID NO: 2211360 - RNA, 18 nt, Homo sapiens
uauagaaaacgauuuuga

SEQ ID NO: 2211361 - RNA, 21 nt, Homo sapiens
ugcaccuacaccaacugcucu

SEQ ID NO: 2211362 - RNA, 13 nt, Homo sapiens
accacuccugcca

SEQ ID NO: 2211363 - RNA, 12 nt, Homo sapiens
gucaucaucaga

SEQ ID NO: 2211364 - RNA, 20 nt, Homo sapiens
auagcaguccccagugauuu

SEQ ID NO: 2211365 - RNA, 16 nt, Homo sapiens
agcuucaucuacccuu

SEQ ID NO: 2211366 - RNA, 15 nt, Homo sapiens
uaaucuggugacaaa

SEQ ID NO: 2211367 - RNA, 15 nt, Homo sapiens
agcuagaaccuggag

SEQ ID NO: 2211368 - RNA, 21 nt, Homo sapiens
gccucacuuccuuugcccuuc

SEQ ID NO: 2211369 - RNA, 23 nt, Homo sapiens
gauuccuuuucccgcgcuccaug

SEQ ID NO: 2211370 - RNA, 21 nt, Homo sapiens
uacgugacagaauuguacaca

SEQ ID NO: 2211371 - RNA, 21 nt, Homo sapiens
uuucucugagcagucagggug

SEQ ID NO: 2211372 - RNA, 22 nt, Homo sapiens
uuagugccguuaucauggagaa

SEQ ID NO: 2211373 - RNA, 20 nt, Homo sapiens
gaucacuggggggcucucag

SEQ ID NO: 2211374 - RNA, 19 nt, Homo sapiens
ucagcaggccaaacauggc

SEQ ID NO: 2211375 - RNA, 21 nt, Homo sapiens
uucuacaauguagaaaaugag

SEQ ID NO: 2211376 - RNA, 16 nt, Homo sapiens
cuggugcugugugacc

SEQ ID NO: 2211377 - RNA, 18 nt, Homo sapiens
agcuccucaaagccucaa

SEQ ID NO: 2211378 - RNA, 16 nt, Homo sapiens
aauaauaucucuaaua

SEQ ID NO: 2211379 - RNA, 22 nt, Homo sapiens
gucggcacgucccaugugcaug

SEQ ID NO: 2211380 - RNA, 23 nt, Homo sapiens
uggccuguguggugccacccugc

SEQ ID NO: 2211381 - RNA, 16 nt, Homo sapiens
gcaaagagaaaagcca

SEQ ID NO: 2211382 - RNA, 22 nt, Homo sapiens
gccuuucucucuuucucuuaau

SEQ ID NO: 2211383 - RNA, 15 nt, Homo sapiens
cuuuagaacagugcc

SEQ ID NO: 2211384 - RNA, 18 nt, Homo sapiens
gggguggugggaaccaug

SEQ ID NO: 2211385 - RNA, 13 nt, Homo sapiens
ugguacugcugag

SEQ ID NO: 2211386 - RNA, 16 nt, Homo sapiens
acaagaguuucaaaac

SEQ ID NO: 2211387 - RNA, 11 nt, Homo sapiens
cucaccagccu

SEQ ID NO: 2211388 - RNA, 21 nt, Homo sapiens
uggaagagcugcuguauuuga

SEQ ID NO: 2211389 - RNA, 17 nt, Homo sapiens
cccuuuucucucaccca

SEQ ID NO: 2211390 - RNA, 15 nt, Homo sapiens
cuuuuauugccauga

SEQ ID NO: 2211391 - RNA, 20 nt, Homo sapiens
aaacggaacucuucaucuua

SEQ ID NO: 2211392 - RNA, 17 nt, Homo sapiens
cuuuaccugcugggacc

SEQ ID NO: 2211393 - RNA, 13 nt, Homo sapiens
guaacaacugugg

SEQ ID NO: 2211394 - RNA, 15 nt, Homo sapiens
uaagcaacagcauaa

SEQ ID NO: 2211395 - RNA, 13 nt, Homo sapiens
cacugacuugaga

SEQ ID NO: 2211396 - RNA, 15 nt, Homo sapiens
uucuacugugacuga

SEQ ID NO: 2211397 - RNA, 17 nt, Homo sapiens
ccgggucccugagcucc

SEQ ID NO: 2211398 - RNA, 15 nt, Homo sapiens
ccagcagacaucaga

SEQ ID NO: 2211399 - RNA, 23 nt, Homo sapiens
gggacacuucccugggccucaac

SEQ ID NO: 2211400 - RNA, 12 nt, Homo sapiens
acacccugcaag

SEQ ID NO: 2211401 - RNA, 13 nt, Homo sapiens
agagagggagaag

SEQ ID NO: 2211402 - RNA, 20 nt, Homo sapiens
aaauucccucuggaguuuca

SEQ ID NO: 2211403 - RNA, 19 nt, Homo sapiens
uucuccaagcuuucagaca

SEQ ID NO: 2211404 - RNA, 14 nt, Homo sapiens
agauaaauguccau

SEQ ID NO: 2211405 - RNA, 20 nt, Homo sapiens
gcccagaaaagguacacuuu

SEQ ID NO: 2211406 - RNA, 19 nt, Homo sapiens
ucaucaucgaagucuuccc

SEQ ID NO: 2211407 - RNA, 21 nt, Homo sapiens
acaugacuuauuaugcauaaa

SEQ ID NO: 2211408 - RNA, 15 nt, Homo sapiens
cucaguccacugcug

SEQ ID NO: 2211409 - RNA, 21 nt, Homo sapiens
ggcaucuuucaacaaugacua

SEQ ID NO: 2211410 - RNA, 20 nt, Homo sapiens
ccaaagcuuuacuacugugg

SEQ ID NO: 2211411 - RNA, 19 nt, Homo sapiens
acuguccuaggcuucugau

SEQ ID NO: 2211412 - RNA, 16 nt, Homo sapiens
gaauaaacuccauuua

SEQ ID NO: 2211413 - RNA, 18 nt, Homo sapiens
agggcaagagccacagua

SEQ ID NO: 2211414 - RNA, 23 nt, Homo sapiens
aacccucgcccugucccucccac

SEQ ID NO: 2211415 - RNA, 15 nt, Homo sapiens
cacaugcgcacucuc

SEQ ID NO: 2211416 - RNA, 18 nt, Homo sapiens
ccaggguugaggggacca

SEQ ID NO: 2211417 - RNA, 21 nt, Homo sapiens
ccuucuuggaguuacaacaga

SEQ ID NO: 2211418 - RNA, 14 nt, Homo sapiens
cuguaaacugaaua

SEQ ID NO: 2211419 - RNA, 21 nt, Homo sapiens
ucaacuugcucucuuucccac

SEQ ID NO: 2211420 - RNA, 16 nt, Homo sapiens
uuacggacucuggaua

SEQ ID NO: 2211421 - RNA, 15 nt, Homo sapiens
auucaaaacuuucag

SEQ ID NO: 2211422 - RNA, 19 nt, Homo sapiens
gggccuauggagagcccug

SEQ ID NO: 2211423 - RNA, 14 nt, Homo sapiens
ggcuuagaaggcac

SEQ ID NO: 2211424 - RNA, 15 nt, Homo sapiens
cgggggggguugcuu

SEQ ID NO: 2211425 - RNA, 20 nt, Homo sapiens
uaccaaaugaaaugccaaag

SEQ ID NO: 2211426 - RNA, 22 nt, Homo sapiens
ugccuucucuguucccuugcag

SEQ ID NO: 2211427 - RNA, 19 nt, Homo sapiens
gccagaaaauuaacugaaa

SEQ ID NO: 2211428 - RNA, 14 nt, Homo sapiens
acacugaaaccaaa

SEQ ID NO: 2211429 - RNA, 20 nt, Homo sapiens
uaaagcuuagaauaguguga

SEQ ID NO: 2211430 - RNA, 23 nt, Homo sapiens
aucacguguacuggcuccucugu

SEQ ID NO: 2211431 - RNA, 22 nt, Homo sapiens
agacuuaauauguuuuauucag

SEQ ID NO: 2211432 - RNA, 18 nt, Homo sapiens
cuguaugccucugagcag

SEQ ID NO: 2211433 - RNA, 20 nt, Homo sapiens
gaccuccucccaagcacuuc

SEQ ID NO: 2211434 - RNA, 17 nt, Homo sapiens
agccuguucccacucag

SEQ ID NO: 2211435 - RNA, 22 nt, Homo sapiens
guuagugcuaguggauuuuaca

SEQ ID NO: 2211436 - RNA, 23 nt, Homo sapiens
uacaauaaauuuuuuuuggucaa

SEQ ID NO: 2211437 - RNA, 21 nt, Homo sapiens
gagacaggaggucagcacaag

SEQ ID NO: 2211438 - RNA, 21 nt, Homo sapiens
cuguugcaggcaaauguaaag

SEQ ID NO: 2211439 - RNA, 17 nt, Homo sapiens
ggaucggcuuccucagg

SEQ ID NO: 2211440 - RNA, 21 nt, Homo sapiens
ugagcucuucauguuucagga

SEQ ID NO: 2211441 - RNA, 19 nt, Homo sapiens
acugacugaggcaguuuga

SEQ ID NO: 2211442 - RNA, 13 nt, Homo sapiens
ggggaagggugca

SEQ ID NO: 2211443 - RNA, 20 nt, Homo sapiens
gauagaugcacuuaugcagu

SEQ ID NO: 2211444 - RNA, 16 nt, Homo sapiens
acaagugauaauacag

SEQ ID NO: 2211445 - RNA, 17 nt, Homo sapiens
ccaagugcugcacaaaa

SEQ ID NO: 2211446 - RNA, 15 nt, Homo sapiens
ugguuugaagugaau

SEQ ID NO: 2211447 - RNA, 11 nt, Homo sapiens
cugacuccccc

SEQ ID NO: 2211448 - RNA, 23 nt, Homo sapiens
cucaucuuuuaucuaacuauaug

SEQ ID NO: 2211449 - RNA, 13 nt, Homo sapiens
cuuccaacugcug

SEQ ID NO: 2211450 - RNA, 13 nt, Homo sapiens
gaauguaguauuu

SEQ ID NO: 2211451 - RNA, 17 nt, Homo sapiens
uaaggcuuuuucuuccc

SEQ ID NO: 2211452 - RNA, 20 nt, Homo sapiens
aauaaagugacccugcucuc

SEQ ID NO: 2211453 - RNA, 20 nt, Homo sapiens
ugcccaucagccauuugcca

SEQ ID NO: 2211454 - RNA, 23 nt, Homo sapiens
aucugcauaaauuuuacaguaga

SEQ ID NO: 2211455 - RNA, 16 nt, Homo sapiens
uguaaaauaaaaccac

SEQ ID NO: 2211456 - RNA, 12 nt, Homo sapiens
uugaaauggaaa

SEQ ID NO: 2211457 - RNA, 23 nt, Homo sapiens
uaaaacugccuuucugguggcuu

SEQ ID NO: 2211458 - RNA, 17 nt, Homo sapiens
uagaaacugaguccugu

SEQ ID NO: 2211459 - RNA, 22 nt, Homo sapiens
acuaguguucagaauguagcau

SEQ ID NO: 2211460 - RNA, 21 nt, Homo sapiens
auucaacccuggagaguucaa

SEQ ID NO: 2211461 - RNA, 12 nt, Homo sapiens
uauugacugccu

SEQ ID NO: 2211462 - RNA, 12 nt, Homo sapiens
aauuugccugua

SEQ ID NO: 2211463 - RNA, 15 nt, Homo sapiens
caguaauggaaugaa

SEQ ID NO: 2211464 - RNA, 22 nt, Homo sapiens
aucuagucaagcgauugucuga

SEQ ID NO: 2211465 - RNA, 17 nt, Homo sapiens
aggaaccagcacuccau

SEQ ID NO: 2211466 - RNA, 21 nt, Homo sapiens
gaaaugaaacauccuaugaaa

SEQ ID NO: 2211467 - RNA, 22 nt, Homo sapiens
ccuccagggcccgaggugaucc

SEQ ID NO: 2211468 - RNA, 20 nt, Homo sapiens
uugucuguaaaaaauggagc

SEQ ID NO: 2211469 - RNA, 20 nt, Homo sapiens
cagaaucauaugauucugcu

SEQ ID NO: 2211470 - RNA, 14 nt, Homo sapiens
uacaccacauuagu

SEQ ID NO: 2211471 - RNA, 16 nt, Homo sapiens
ugaagaucggcuuuca

SEQ ID NO: 2211472 - RNA, 22 nt, Homo sapiens
aggagccucuggcuucccuaaa

SEQ ID NO: 2211473 - RNA, 16 nt, Homo sapiens
ucaccgacaacaugcu

SEQ ID NO: 2211474 - RNA, 15 nt, Homo sapiens
acacuuaauagcaac

SEQ ID NO: 2211475 - RNA, 18 nt, Homo sapiens
accugggccaccaugcac

SEQ ID NO: 2211476 - RNA, 22 nt, Homo sapiens
uagcaaagccucgccuuccaug

SEQ ID NO: 2211477 - RNA, 18 nt, Homo sapiens
aucucuugucauucucau

SEQ ID NO: 2211478 - RNA, 13 nt, Homo sapiens
cuuuaauucugua

SEQ ID NO: 2211479 - RNA, 23 nt, Homo sapiens
cuuugaauguuguguaacaguua

SEQ ID NO: 2211480 - RNA, 13 nt, Homo sapiens
ggccugaccucaa

SEQ ID NO: 2211481 - RNA, 22 nt, Homo sapiens
gcauuucaauuagggaugcuca

SEQ ID NO: 2211482 - RNA, 14 nt, Homo sapiens
aggccugcacagcu

SEQ ID NO: 2211483 - RNA, 21 nt, Homo sapiens
caaguggggaauucugaugga

SEQ ID NO: 2211484 - RNA, 21 nt, Homo sapiens
aagucaggccucucugggaag

SEQ ID NO: 2211485 - RNA, 23 nt, Homo sapiens
ggaaccuugcuguccugaucugu

SEQ ID NO: 2211486 - RNA, 20 nt, Homo sapiens
ucacuaggccucugaccaca

SEQ ID NO: 2211487 - RNA, 20 nt, Homo sapiens
acgcagccugcagacucacu

SEQ ID NO: 2211488 - RNA, 15 nt, Homo sapiens
guggggcauguccuc

SEQ ID NO: 2211489 - RNA, 23 nt, Homo sapiens
gggauggguggaccaaacccuua

SEQ ID NO: 2211490 - RNA, 16 nt, Homo sapiens
uuccacaauucacuag

SEQ ID NO: 2211491 - RNA, 23 nt, Homo sapiens
gacauucucaucaccacagggau

SEQ ID NO: 2211492 - RNA, 17 nt, Homo sapiens
cauggccaaggggccag

SEQ ID NO: 2211493 - RNA, 16 nt, Homo sapiens
ucucuuauauaguauu

SEQ ID NO: 2211494 - RNA, 19 nt, Homo sapiens
ugguauucugcuuccacau

SEQ ID NO: 2211495 - RNA, 18 nt, Homo sapiens
cgcuggcugggggccuca

SEQ ID NO: 2211496 - RNA, 15 nt, Homo sapiens
uaggaaaugucauca

SEQ ID NO: 2211497 - RNA, 12 nt, Homo sapiens
aaagagacugag

SEQ ID NO: 2211498 - RNA, 17 nt, Homo sapiens
uggaauacagucauucc

SEQ ID NO: 2211499 - RNA, 14 nt, Homo sapiens
guucuccucaaaca

SEQ ID NO: 2211500 - RNA, 11 nt, Homo sapiens
aaaaaaagaga

SEQ ID NO: 2211501 - RNA, 16 nt, Homo sapiens
aggcccuggggagcuu

SEQ ID NO: 2211502 - RNA, 15 nt, Homo sapiens
aguaauaaagacucu

SEQ ID NO: 2211503 - RNA, 12 nt, Homo sapiens
cuggaaguagaa

SEQ ID NO: 2211504 - RNA, 13 nt, Homo sapiens
ucaagcacuccua

SEQ ID NO: 2211505 - RNA, 21 nt, Homo sapiens
cugaagucagaucugccuaag

SEQ ID NO: 2211506 - RNA, 18 nt, Homo sapiens
cuuugcacaggaugcugg

SEQ ID NO: 2211507 - RNA, 17 nt, Homo sapiens
gugaucugccgccucag

SEQ ID NO: 2211508 - RNA, 20 nt, Homo sapiens
cagccagaggguagggcaca

SEQ ID NO: 2211509 - RNA, 20 nt, Homo sapiens
uaacagugugcucauagaaa

SEQ ID NO: 2211510 - RNA, 16 nt, Homo sapiens
gcagaagagaaaccau

SEQ ID NO: 2211511 - RNA, 12 nt, Homo sapiens
ccccaaguccug

SEQ ID NO: 2211512 - RNA, 12 nt, Homo sapiens
gaccaagugaug

SEQ ID NO: 2211513 - RNA, 21 nt, Homo sapiens
uaugaguauaaugaacacuca

SEQ ID NO: 2211514 - RNA, 13 nt, Homo sapiens
ggagaccucagaa

SEQ ID NO: 2211515 - RNA, 23 nt, Homo sapiens
uggguuucccuugcccuuuccau

SEQ ID NO: 2211516 - RNA, 16 nt, Homo sapiens
caagagccccaaagau

SEQ ID NO: 2211517 - RNA, 17 nt, Homo sapiens
uuuaaaaauaauuuugu

SEQ ID NO: 2211518 - RNA, 23 nt, Homo sapiens
uaaaagaaccgagcaauuuucug

SEQ ID NO: 2211519 - RNA, 14 nt, Homo sapiens
agcuuggaccccuu

SEQ ID NO: 2211520 - RNA, 19 nt, Homo sapiens
acaaaugauuuacacugac

SEQ ID NO: 2211521 - RNA, 15 nt, Homo sapiens
gcucucaccgggcua

SEQ ID NO: 2211522 - RNA, 12 nt, Homo sapiens
ggggagguguau

SEQ ID NO: 2211523 - RNA, 14 nt, Homo sapiens
gggcugagacugga

SEQ ID NO: 2211524 - RNA, 16 nt, Homo sapiens
uaagaggcagugagau

SEQ ID NO: 2211525 - RNA, 14 nt, Homo sapiens
ggaugcagugccuu

SEQ ID NO: 2211526 - RNA, 12 nt, Homo sapiens
uccguguaaaau

SEQ ID NO: 2211527 - RNA, 22 nt, Homo sapiens
aacuaaagguggccacaaauuc

SEQ ID NO: 2211528 - RNA, 16 nt, Homo sapiens
ccagacacguccugca

SEQ ID NO: 2211529 - RNA, 21 nt, Homo sapiens
cuggagucccaaaugucauca

SEQ ID NO: 2211530 - RNA, 16 nt, Homo sapiens
guuucacuggcuggug

SEQ ID NO: 2211531 - RNA, 21 nt, Homo sapiens
aaggucugcucugcuccugaa

SEQ ID NO: 2211532 - RNA, 15 nt, Homo sapiens
caaagaccuaccucc

SEQ ID NO: 2211533 - RNA, 17 nt, Homo sapiens
gucaauuacauguuugg

SEQ ID NO: 2211534 - RNA, 20 nt, Homo sapiens
gcaugcaaaagaaagcaaau

SEQ ID NO: 2211535 - RNA, 23 nt, Homo sapiens
gucccaaacccuucuuguucucu

SEQ ID NO: 2211536 - RNA, 17 nt, Homo sapiens
ugcugcuugaugaugag

SEQ ID NO: 2211537 - RNA, 19 nt, Homo sapiens
aauaugaaaaauguaaaua

SEQ ID NO: 2211538 - RNA, 18 nt, Homo sapiens
ggaucccagcagugaugu

SEQ ID NO: 2211539 - RNA, 22 nt, Homo sapiens
uggagaaauuccuugauucaca

SEQ ID NO: 2211540 - RNA, 14 nt, Homo sapiens
caugugccugucac

SEQ ID NO: 2211541 - RNA, 14 nt, Homo sapiens
acuagaugacugua

SEQ ID NO: 2211542 - RNA, 14 nt, Homo sapiens
ugaguaugugaaga

SEQ ID NO: 2211543 - RNA, 23 nt, Homo sapiens
ucuugaguauaagaaaugcauau

SEQ ID NO: 2211544 - RNA, 21 nt, Homo sapiens
auaaaaaugugguuuguacau

SEQ ID NO: 2211545 - RNA, 15 nt, Homo sapiens
caaggaaaacaguaa

SEQ ID NO: 2211546 - RNA, 17 nt, Homo sapiens
cccuguguccacugaga

SEQ ID NO: 2211547 - RNA, 13 nt, Homo sapiens
guggcucacagug

SEQ ID NO: 2211548 - RNA, 18 nt, Homo sapiens
ugcagcuggaaugugcca

SEQ ID NO: 2211549 - RNA, 12 nt, Homo sapiens
ugucagacauaa

SEQ ID NO: 2211550 - RNA, 17 nt, Homo sapiens
auuucugacucuaucau

SEQ ID NO: 2211551 - RNA, 23 nt, Homo sapiens
auggucagaaccuuuggacaaga

SEQ ID NO: 2211552 - RNA, 20 nt, Homo sapiens
aguuugccucccugcacuuc

SEQ ID NO: 2211553 - RNA, 21 nt, Homo sapiens
agcuuauaaaaauaaagggaa

SEQ ID NO: 2211554 - RNA, 13 nt, Homo sapiens
ugccagcacaaag

SEQ ID NO: 2211555 - RNA, 14 nt, Homo sapiens
ugccagugcacucc

SEQ ID NO: 2211556 - RNA, 21 nt, Homo sapiens
gccuccugcccagcacaggaa

SEQ ID NO: 2211557 - RNA, 16 nt, Homo sapiens
gcucuuauauuuucau

SEQ ID NO: 2211558 - RNA, 19 nt, Homo sapiens
ucuuauucuuuuguaauau

SEQ ID NO: 2211559 - RNA, 15 nt, Homo sapiens
ugcaagucccaugau

SEQ ID NO: 2211560 - RNA, 17 nt, Homo sapiens
uucacaaucuugaacau

SEQ ID NO: 2211561 - RNA, 23 nt, Homo sapiens
ucuuauaaauucuguuagcugcu

SEQ ID NO: 2211562 - RNA, 20 nt, Homo sapiens
ccaccugguacugacccagg

SEQ ID NO: 2211563 - RNA, 19 nt, Homo sapiens
uggagacuuaauagacauu

SEQ ID NO: 2211564 - RNA, 20 nt, Homo sapiens
gaggaacuuuuucucuguua

SEQ ID NO: 2211565 - RNA, 18 nt, Homo sapiens
gugcaaauauaucugcua

SEQ ID NO: 2211566 - RNA, 19 nt, Homo sapiens
cugcacaaacucaccaucu

SEQ ID NO: 2211567 - RNA, 17 nt, Homo sapiens
ggcucccaugucaagag

SEQ ID NO: 2211568 - RNA, 16 nt, Homo sapiens
ggauuacaggcuugag

SEQ ID NO: 2211569 - RNA, 16 nt, Homo sapiens
acuacucuacuuccuc

SEQ ID NO: 2211570 - RNA, 15 nt, Homo sapiens
gguggcaggugagca

SEQ ID NO: 2211571 - RNA, 19 nt, Homo sapiens
aucauuuggccgagucagc

SEQ ID NO: 2211572 - RNA, 19 nt, Homo sapiens
cagcauugugacacuuccc

SEQ ID NO: 2211573 - RNA, 20 nt, Homo sapiens
ggauaucuguguauaugccc

SEQ ID NO: 2211574 - RNA, 15 nt, Homo sapiens
uacauaaaguaugug

SEQ ID NO: 2211575 - RNA, 18 nt, Homo sapiens
gaaacugagucuguggac

SEQ ID NO: 2211576 - RNA, 14 nt, Homo sapiens
uuacccaaugcagu

SEQ ID NO: 2211577 - RNA, 16 nt, Homo sapiens
gacagacccaggucuu

SEQ ID NO: 2211578 - RNA, 13 nt, Homo sapiens
cuuuccuccugag

SEQ ID NO: 2211579 - RNA, 19 nt, Homo sapiens
aggauggucuugaucuccu

SEQ ID NO: 2211580 - RNA, 18 nt, Homo sapiens
uuaauuucaucacuaaaa

SEQ ID NO: 2211581 - RNA, 20 nt, Homo sapiens
uauauuccccuaagauuuga

SEQ ID NO: 2211582 - RNA, 17 nt, Homo sapiens
uuagaaggcacugggaa

SEQ ID NO: 2211583 - RNA, 16 nt, Homo sapiens
gcagaggaugucucaa

SEQ ID NO: 2211584 - RNA, 13 nt, Homo sapiens
cuggaauaagccu

SEQ ID NO: 2211585 - RNA, 21 nt, Homo sapiens
ggaacaaaguaacagccuuuc

SEQ ID NO: 2211586 - RNA, 17 nt, Homo sapiens
uccgcacccaguuugau

SEQ ID NO: 2211587 - RNA, 22 nt, Homo sapiens
agagagguugugaaaacagcag

SEQ ID NO: 2211588 - RNA, 22 nt, Homo sapiens
gggcacaguacccggugacucu

SEQ ID NO: 2211589 - RNA, 16 nt, Homo sapiens
gccucuggcuucucag

SEQ ID NO: 2211590 - RNA, 14 nt, Homo sapiens
gaucauggaccugg

SEQ ID NO: 2211591 - RNA, 16 nt, Homo sapiens
ccugaaccuuccaucu

SEQ ID NO: 2211592 - RNA, 18 nt, Homo sapiens
cccucuccaaaucaagga

SEQ ID NO: 2211593 - RNA, 16 nt, Homo sapiens
gccugucugagacuca

SEQ ID NO: 2211594 - RNA, 16 nt, Homo sapiens
ggcagcugucauggaa

SEQ ID NO: 2211595 - RNA, 18 nt, Homo sapiens
caaauagaaaucagcaca

SEQ ID NO: 2211596 - RNA, 22 nt, Homo sapiens
agacgauuauuuaaaccugccc

SEQ ID NO: 2211597 - RNA, 22 nt, Homo sapiens
augaaacaacagagacagugaa

SEQ ID NO: 2211598 - RNA, 14 nt, Homo sapiens
aguagaaucucagc

SEQ ID NO: 2211599 - RNA, 23 nt, Homo sapiens
gucuguccaacugccuguucaau

SEQ ID NO: 2211600 - RNA, 14 nt, Homo sapiens
uccugggagcucau

SEQ ID NO: 2211601 - RNA, 16 nt, Homo sapiens
gacacuauucauuuga

SEQ ID NO: 2211602 - RNA, 14 nt, Homo sapiens
auaauaaaugggaa

SEQ ID NO: 2211603 - RNA, 11 nt, Homo sapiens
ugcugaccucu

SEQ ID NO: 2211604 - RNA, 15 nt, Homo sapiens
acagacaugugcaac

SEQ ID NO: 2211605 - RNA, 16 nt, Homo sapiens
aauuucucacaauaga

SEQ ID NO: 2211606 - RNA, 23 nt, Homo sapiens
uucaagcgauucucuugccucag

SEQ ID NO: 2211607 - RNA, 21 nt, Homo sapiens
gauagguuaccaguaacggaa

SEQ ID NO: 2211608 - RNA, 20 nt, Homo sapiens
ugagacucagugcagaugga

SEQ ID NO: 2211609 - RNA, 22 nt, Homo sapiens
cuucagugaauuuugauaaugg

SEQ ID NO: 2211610 - RNA, 19 nt, Homo sapiens
ucaacaucuuuuacauucu

SEQ ID NO: 2211611 - RNA, 16 nt, Homo sapiens
aaacugugucuguccc

SEQ ID NO: 2211612 - RNA, 16 nt, Homo sapiens
uaaugagccaucacua

SEQ ID NO: 2211613 - RNA, 19 nt, Homo sapiens
ccaugcugcccgcuucuca

SEQ ID NO: 2211614 - RNA, 17 nt, Homo sapiens
ccuagcuccacacccuc

SEQ ID NO: 2211615 - RNA, 13 nt, Homo sapiens
gcccacgaucccc

SEQ ID NO: 2211616 - RNA, 21 nt, Homo sapiens
aagcugggccgaguaccuuaa

SEQ ID NO: 2211617 - RNA, 20 nt, Homo sapiens
ccucaaccccuccccuccau

SEQ ID NO: 2211618 - RNA, 19 nt, Homo sapiens
aaggaagggacacauauca

SEQ ID NO: 2211619 - RNA, 18 nt, Homo sapiens
ugcacuuggccucagcug

SEQ ID NO: 2211620 - RNA, 17 nt, Homo sapiens
guuuuuaaguacucacu

SEQ ID NO: 2211621 - RNA, 14 nt, Homo sapiens
gggaucuuacccac

SEQ ID NO: 2211622 - RNA, 19 nt, Homo sapiens
gccagguccucacagcagu

SEQ ID NO: 2211623 - RNA, 18 nt, Homo sapiens
acaaguugaucaugcagg

SEQ ID NO: 2211624 - RNA, 13 nt, Homo sapiens
uggccaugcccuc

SEQ ID NO: 2211625 - RNA, 16 nt, Homo sapiens
gcacccuguucccucu

SEQ ID NO: 2211626 - RNA, 16 nt, Homo sapiens
cugggagucacacagu

SEQ ID NO: 2211627 - RNA, 15 nt, Homo sapiens
cacagauuugcuaau

SEQ ID NO: 2211628 - RNA, 16 nt, Homo sapiens
uagccagugaaaaacu

SEQ ID NO: 2211629 - RNA, 19 nt, Homo sapiens
cuucagacucagcccaaau

SEQ ID NO: 2211630 - RNA, 13 nt, Homo sapiens
gcuaaaugugauc

SEQ ID NO: 2211631 - RNA, 14 nt, Homo sapiens
guuuucuacuuuga

SEQ ID NO: 2211632 - RNA, 17 nt, Homo sapiens
ucacacagauagaccuu

SEQ ID NO: 2211633 - RNA, 20 nt, Homo sapiens
aggaccaaaaaaccucacug

SEQ ID NO: 2211634 - RNA, 17 nt, Homo sapiens
cagcuggguggcacugc

SEQ ID NO: 2211635 - RNA, 22 nt, Homo sapiens
aucuuuguguuuugaacaaagg

SEQ ID NO: 2211636 - RNA, 17 nt, Homo sapiens
gucuuccuguguaccuc

SEQ ID NO: 2211637 - RNA, 17 nt, Homo sapiens
ugcuuuuguccuguuau

SEQ ID NO: 2211638 - RNA, 21 nt, Homo sapiens
ccagauuuaaccauuccauaa

SEQ ID NO: 2211639 - RNA, 22 nt, Homo sapiens
aagcagaagaccagauccaaga

SEQ ID NO: 2211640 - RNA, 13 nt, Homo sapiens
ggccagccaguga

SEQ ID NO: 2211641 - RNA, 21 nt, Homo sapiens
ucauaaagguuuacagugaau

SEQ ID NO: 2211642 - RNA, 15 nt, Homo sapiens
aauuucuauucucuc

SEQ ID NO: 2211643 - RNA, 21 nt, Homo sapiens
agcucauguuuucuauaugaa

SEQ ID NO: 2211644 - RNA, 17 nt, Homo sapiens
agccacccugaggaguc

SEQ ID NO: 2211645 - RNA, 15 nt, Homo sapiens
guacagauucuuuca

SEQ ID NO: 2211646 - RNA, 17 nt, Homo sapiens
cucauuuggggugcaaa

SEQ ID NO: 2211647 - RNA, 22 nt, Homo sapiens
ccuauucugaaaaagacauaaa

SEQ ID NO: 2211648 - RNA, 20 nt, Homo sapiens
aaucauacaaauacuaucca

SEQ ID NO: 2211649 - RNA, 23 nt, Homo sapiens
gaacacauuuaaacaucaguauu

SEQ ID NO: 2211650 - RNA, 13 nt, Homo sapiens
cuaagccuguugc

SEQ ID NO: 2211651 - RNA, 23 nt, Homo sapiens
gcccauucucuuccuauuacuug

SEQ ID NO: 2211652 - RNA, 13 nt, Homo sapiens
aaccaugccuuuu

SEQ ID NO: 2211653 - RNA, 13 nt, Homo sapiens
cccacuuuugcca

SEQ ID NO: 2211654 - RNA, 14 nt, Homo sapiens
ggaugacugugauu

SEQ ID NO: 2211655 - RNA, 13 nt, Homo sapiens
cuugccaugcuaa

SEQ ID NO: 2211656 - RNA, 14 nt, Homo sapiens
cauuccuucccacc

SEQ ID NO: 2211657 - RNA, 12 nt, Homo sapiens
cacuucugccau

SEQ ID NO: 2211658 - RNA, 14 nt, Homo sapiens
cucagcccauuucu

SEQ ID NO: 2211659 - RNA, 18 nt, Homo sapiens
aagagaccaagacucuga

SEQ ID NO: 2211660 - RNA, 17 nt, Homo sapiens
cauuguuaaauacacau

SEQ ID NO: 2211661 - RNA, 17 nt, Homo sapiens
aaaaaggacucugcuuc

SEQ ID NO: 2211662 - RNA, 17 nt, Homo sapiens
uugaaauaaaugacaau

SEQ ID NO: 2211663 - RNA, 22 nt, Homo sapiens
augaacacacauggaugcacac

SEQ ID NO: 2211664 - RNA, 20 nt, Homo sapiens
cugagauugugccacuguac

SEQ ID NO: 2211665 - RNA, 16 nt, Homo sapiens
aauuauauauacuaua

SEQ ID NO: 2211666 - RNA, 22 nt, Homo sapiens
agugaaaaaucuguggaaugua

SEQ ID NO: 2211667 - RNA, 23 nt, Homo sapiens
cgagaguggguguuggacagugu

SEQ ID NO: 2211668 - RNA, 18 nt, Homo sapiens
ugaauauauacauaaaaa

SEQ ID NO: 2211669 - RNA, 14 nt, Homo sapiens
uuaccuauucugaa

SEQ ID NO: 2211670 - RNA, 16 nt, Homo sapiens
guaaagaaacugaugu

SEQ ID NO: 2211671 - RNA, 22 nt, Homo sapiens
cuuugucuuucuuugucauuca

SEQ ID NO: 2211672 - RNA, 22 nt, Homo sapiens
cacuugguuuuuggcucuuuca

SEQ ID NO: 2211673 - RNA, 14 nt, Homo sapiens
ucaugauugcccaa

SEQ ID NO: 2211674 - RNA, 21 nt, Homo sapiens
uccugagaaagcccaccuggg

SEQ ID NO: 2211675 - RNA, 15 nt, Homo sapiens
auauacugugugcuu

SEQ ID NO: 2211676 - RNA, 17 nt, Homo sapiens
aguauuucuacauuaca

SEQ ID NO: 2211677 - RNA, 13 nt, Homo sapiens
ucccucucugcac

SEQ ID NO: 2211678 - RNA, 14 nt, Homo sapiens
gcccuugucacugg

SEQ ID NO: 2211679 - RNA, 15 nt, Homo sapiens
aggaugagcauuuag

SEQ ID NO: 2211680 - RNA, 13 nt, Homo sapiens
gccuguugcugaa

SEQ ID NO: 2211681 - RNA, 20 nt, Homo sapiens
ggcucucagggaacagcagc

SEQ ID NO: 2211682 - RNA, 18 nt, Homo sapiens
agacuuccucuguucuca

SEQ ID NO: 2211683 - RNA, 18 nt, Homo sapiens
aaagcacauguauugaca

SEQ ID NO: 2211684 - RNA, 14 nt, Homo sapiens
acgugagaacaauc

SEQ ID NO: 2211685 - RNA, 16 nt, Homo sapiens
agagggcugaagggag

SEQ ID NO: 2211686 - RNA, 16 nt, Homo sapiens
uccccucagagugcaa

SEQ ID NO: 2211687 - RNA, 13 nt, Homo sapiens
agccugggacaca

SEQ ID NO: 2211688 - RNA, 20 nt, Homo sapiens
cuugacuugaaaugcucuuu

SEQ ID NO: 2211689 - RNA, 15 nt, Homo sapiens
auggacaaugaccca

SEQ ID NO: 2211690 - RNA, 22 nt, Homo sapiens
ucuuuccucccugaagcugugc

SEQ ID NO: 2211691 - RNA, 18 nt, Homo sapiens
ugacuuccccacugcucu

SEQ ID NO: 2211692 - RNA, 20 nt, Homo sapiens
uuucugcaauccaaugcacu

SEQ ID NO: 2211693 - RNA, 16 nt, Homo sapiens
auuccaaucauuguua

SEQ ID NO: 2211694 - RNA, 21 nt, Homo sapiens
ugcauacuuaugacugaaugu

SEQ ID NO: 2211695 - RNA, 17 nt, Homo sapiens
ccugggaccugaaccug

SEQ ID NO: 2211696 - RNA, 22 nt, Homo sapiens
ccuaagcaacagaaauaaucug

SEQ ID NO: 2211697 - RNA, 23 nt, Homo sapiens
aagagcagucacaacagagugaa

SEQ ID NO: 2211698 - RNA, 13 nt, Homo sapiens
gaaauagugucug

SEQ ID NO: 2211699 - RNA, 19 nt, Homo sapiens
uuguggaccucaccagaga

SEQ ID NO: 2211700 - RNA, 19 nt, Homo sapiens
agccacccguggggugcug

SEQ ID NO: 2211701 - RNA, 14 nt, Homo sapiens
uuaaaaccaaagag

SEQ ID NO: 2211702 - RNA, 22 nt, Homo sapiens
ugcuuggcccacagucuggcuc

SEQ ID NO: 2211703 - RNA, 14 nt, Homo sapiens
gucaaaaaguucca

SEQ ID NO: 2211704 - RNA, 14 nt, Homo sapiens
auuacaaaauccaa

SEQ ID NO: 2211705 - RNA, 22 nt, Homo sapiens
ucugaagcucgcauccagacag

SEQ ID NO: 2211706 - RNA, 22 nt, Homo sapiens
acuacagaauauuaaauauuau

SEQ ID NO: 2211707 - RNA, 18 nt, Homo sapiens
uaagugcagucugaucca

SEQ ID NO: 2211708 - RNA, 15 nt, Homo sapiens
caaucucacacagcu

SEQ ID NO: 2211709 - RNA, 19 nt, Homo sapiens
cccaggagcaaaugcugga

SEQ ID NO: 2211710 - RNA, 23 nt, Homo sapiens
uguccucacggcuggauuucucu

SEQ ID NO: 2211711 - RNA, 12 nt, Homo sapiens
caauaagcagaa

SEQ ID NO: 2211712 - RNA, 22 nt, Homo sapiens
uuagacuggaaguucauaccua

SEQ ID NO: 2211713 - RNA, 13 nt, Homo sapiens
caaagauucucca

SEQ ID NO: 2211714 - RNA, 16 nt, Homo sapiens
caguaacagugcagua

SEQ ID NO: 2211715 - RNA, 21 nt, Homo sapiens
acugccccccgaggcugcuag

SEQ ID NO: 2211716 - RNA, 21 nt, Homo sapiens
cuugccaaccuguaauaaaua

SEQ ID NO: 2211717 - RNA, 19 nt, Homo sapiens
guugaagaaaaaauggcaa

SEQ ID NO: 2211718 - RNA, 18 nt, Homo sapiens
caguaggaacuguacaug

SEQ ID NO: 2211719 - RNA, 13 nt, Homo sapiens
gcaccuacuuuau

SEQ ID NO: 2211720 - RNA, 19 nt, Homo sapiens
caagaagcccuccuugcca

SEQ ID NO: 2211721 - RNA, 15 nt, Homo sapiens
uacacuccucuauca

SEQ ID NO: 2211722 - RNA, 22 nt, Homo sapiens
ccucucuggcuuccaugcuccg

SEQ ID NO: 2211723 - RNA, 23 nt, Homo sapiens
auuccccacacucuccugugaac

SEQ ID NO: 2211724 - RNA, 19 nt, Homo sapiens
uccaguuccucuuuugugc

SEQ ID NO: 2211725 - RNA, 22 nt, Homo sapiens
agaaauugugggauaaucugua

SEQ ID NO: 2211726 - RNA, 17 nt, Homo sapiens
acuucugacccugugaa

SEQ ID NO: 2211727 - RNA, 14 nt, Homo sapiens
gacccuugucaucu

SEQ ID NO: 2211728 - RNA, 17 nt, Homo sapiens
ggguauugcuugccacu

SEQ ID NO: 2211729 - RNA, 19 nt, Homo sapiens
aaguacuagcuuacuuuug

SEQ ID NO: 2211730 - RNA, 16 nt, Homo sapiens
uccgugacagcacuuu

SEQ ID NO: 2211731 - RNA, 19 nt, Homo sapiens
aagaagcaucucugaccag

SEQ ID NO: 2211732 - RNA, 17 nt, Homo sapiens
gcaaauguuguauuuca

SEQ ID NO: 2211733 - RNA, 20 nt, Homo sapiens
gagcccagucgagaccucac

SEQ ID NO: 2211734 - RNA, 22 nt, Homo sapiens
cuguauuugccggugccuagga

SEQ ID NO: 2211735 - RNA, 19 nt, Homo sapiens
gcaccugggccccacugga

SEQ ID NO: 2211736 - RNA, 16 nt, Homo sapiens
acuguuacugugucag

SEQ ID NO: 2211737 - RNA, 15 nt, Homo sapiens
cucacuaguugucag

SEQ ID NO: 2211738 - RNA, 14 nt, Homo sapiens
accaguaugaauga

SEQ ID NO: 2211739 - RNA, 14 nt, Homo sapiens
gagggcggcacagg

SEQ ID NO: 2211740 - RNA, 15 nt, Homo sapiens
gaugcguucacucca

SEQ ID NO: 2211741 - RNA, 15 nt, Homo sapiens
gggauuucauuugaa

SEQ ID NO: 2211742 - RNA, 9 nt, Homo sapiens
cugugcacc

SEQ ID NO: 2211743 - RNA, 13 nt, Homo sapiens
gagugacucaaga

SEQ ID NO: 2211744 - RNA, 12 nt, Homo sapiens
auucucaaagau

SEQ ID NO: 2211745 - RNA, 15 nt, Homo sapiens
gcugccugacacuga

SEQ ID NO: 2211746 - RNA, 22 nt, Homo sapiens
gccacucagaaaagacgcacca

SEQ ID NO: 2211747 - RNA, 22 nt, Homo sapiens
cugacuucuccaggaccuaguc

SEQ ID NO: 2211748 - RNA, 22 nt, Homo sapiens
uucugaaaccacaguuucauua

SEQ ID NO: 2211749 - RNA, 15 nt, Homo sapiens
cucugcagcacuuua

SEQ ID NO: 2211750 - RNA, 13 nt, Homo sapiens
agggggucuggcu

SEQ ID NO: 2211751 - RNA, 20 nt, Homo sapiens
ucuaaaaggugugaagguga

SEQ ID NO: 2211752 - RNA, 20 nt, Homo sapiens
aaaaucuaauuagaauucuc

SEQ ID NO: 2211753 - RNA, 20 nt, Homo sapiens
uucauccaggcucccaaaag

SEQ ID NO: 2211754 - RNA, 21 nt, Homo sapiens
cccuaagcuucuagaggcuca

SEQ ID NO: 2211755 - RNA, 21 nt, Homo sapiens
uaacugauuaccugccaauug

SEQ ID NO: 2211756 - RNA, 19 nt, Homo sapiens
uuccaaugcuuugaucccu

SEQ ID NO: 2211757 - RNA, 17 nt, Homo sapiens
ccuuugcucuugccaaa

SEQ ID NO: 2211758 - RNA, 23 nt, Homo sapiens
uagaaguuaaugauuuuacuuaa

SEQ ID NO: 2211759 - RNA, 13 nt, Homo sapiens
gugcagcugugac

SEQ ID NO: 2211760 - RNA, 19 nt, Homo sapiens
gcuucccuacuccuacccu

SEQ ID NO: 2211761 - RNA, 14 nt, Homo sapiens
cgaguuacagacaa

SEQ ID NO: 2211762 - RNA, 19 nt, Homo sapiens
acaccuuauuaaugaucag

SEQ ID NO: 2211763 - RNA, 22 nt, Homo sapiens
caaucaggaauugaaaauuuaa

SEQ ID NO: 2211764 - RNA, 21 nt, Homo sapiens
aagcccagcucugggaacuga

SEQ ID NO: 2211765 - RNA, 17 nt, Homo sapiens
gcuccugagacacaugg

SEQ ID NO: 2211766 - RNA, 19 nt, Homo sapiens
ggagcugccuguucagcuc

SEQ ID NO: 2211767 - RNA, 17 nt, Homo sapiens
aggcugaggcacaagaa

SEQ ID NO: 2211768 - RNA, 13 nt, Homo sapiens
ugacuucaugcca

SEQ ID NO: 2211769 - RNA, 16 nt, Homo sapiens
aaagaagcagaccauu

SEQ ID NO: 2211770 - RNA, 21 nt, Homo sapiens
ggguggaaagugcucagugaa

SEQ ID NO: 2211771 - RNA, 13 nt, Homo sapiens
cugaccagccuug

SEQ ID NO: 2211772 - RNA, 14 nt, Homo sapiens
cugcccugccugag

SEQ ID NO: 2211773 - RNA, 11 nt, Homo sapiens
ggagcugcuau

SEQ ID NO: 2211774 - RNA, 19 nt, Homo sapiens
gcuuuuacugaagccuuuc

SEQ ID NO: 2211775 - RNA, 12 nt, Homo sapiens
auggugagcucu

SEQ ID NO: 2211776 - RNA, 16 nt, Homo sapiens
aucuguauaaauguga

SEQ ID NO: 2211777 - RNA, 13 nt, Homo sapiens
caguaaacgggaa

SEQ ID NO: 2211778 - RNA, 15 nt, Homo sapiens
uuguguaaaaagcaa

SEQ ID NO: 2211779 - RNA, 22 nt, Homo sapiens
cacaugggcagaaaaauggugg

SEQ ID NO: 2211780 - RNA, 21 nt, Homo sapiens
cacucaauaaagaaugaauuu

SEQ ID NO: 2211781 - RNA, 21 nt, Homo sapiens
gaacuuuaagaagcaguguuu

SEQ ID NO: 2211782 - RNA, 13 nt, Homo sapiens
caauccugcauug

SEQ ID NO: 2211783 - RNA, 23 nt, Homo sapiens
agaauuccucuuuggccacaaga

SEQ ID NO: 2211784 - RNA, 20 nt, Homo sapiens
uguuuuuucagucugugaaa

SEQ ID NO: 2211785 - RNA, 16 nt, Homo sapiens
gcuugucaaugugauu

SEQ ID NO: 2211786 - RNA, 13 nt, Homo sapiens
gcuugugaccuug

SEQ ID NO: 2211787 - RNA, 13 nt, Homo sapiens
ccugcugagcugc

SEQ ID NO: 2211788 - RNA, 16 nt, Homo sapiens
aacugagcuccuccac

SEQ ID NO: 2211789 - RNA, 15 nt, Homo sapiens
agacagagucucacu

SEQ ID NO: 2211790 - RNA, 21 nt, Homo sapiens
auguggguuaucauggaagaa

SEQ ID NO: 2211791 - RNA, 20 nt, Homo sapiens
uuacacuguuucaucucagc

SEQ ID NO: 2211792 - RNA, 20 nt, Homo sapiens
ccugaaacaugaacccaaaa

SEQ ID NO: 2211793 - RNA, 15 nt, Homo sapiens
gccuucucaccagcu

SEQ ID NO: 2211794 - RNA, 13 nt, Homo sapiens
agagguccaggcc

SEQ ID NO: 2211795 - RNA, 14 nt, Homo sapiens
cccagacucagcuc

SEQ ID NO: 2211796 - RNA, 18 nt, Homo sapiens
auaugcuaacccccaaau

SEQ ID NO: 2211797 - RNA, 14 nt, Homo sapiens
agugcagcauauac

SEQ ID NO: 2211798 - RNA, 23 nt, Homo sapiens
uagucaauccugucauauaauaa

SEQ ID NO: 2211799 - RNA, 18 nt, Homo sapiens
accuauucccaaaugccu

SEQ ID NO: 2211800 - RNA, 13 nt, Homo sapiens
gaagagucuucca

SEQ ID NO: 2211801 - RNA, 13 nt, Homo sapiens
gacuagugcugaa

SEQ ID NO: 2211802 - RNA, 13 nt, Homo sapiens
cugucguggacac

SEQ ID NO: 2211803 - RNA, 24 nt, Homo sapiens
aaaacuugcaugcagcagcuuuug

SEQ ID NO: 2211804 - RNA, 15 nt, Homo sapiens
cuucagucuucuuca

SEQ ID NO: 2211805 - RNA, 17 nt, Homo sapiens
gccucccagguucaaga

SEQ ID NO: 2211806 - RNA, 17 nt, Homo sapiens
gcugcaggggugccugg

SEQ ID NO: 2211807 - RNA, 13 nt, Homo sapiens
agaaugguuacaa

SEQ ID NO: 2211808 - RNA, 18 nt, Homo sapiens
cauuuuccuaaacccagu

SEQ ID NO: 2211809 - RNA, 16 nt, Homo sapiens
auagauuaauggcacu

SEQ ID NO: 2211810 - RNA, 15 nt, Homo sapiens
guuugaaaguacucc

SEQ ID NO: 2211811 - RNA, 17 nt, Homo sapiens
caggagaaaaauuauuc

SEQ ID NO: 2211812 - RNA, 19 nt, Homo sapiens
uggauuuagagacuguaaa

SEQ ID NO: 2211813 - RNA, 13 nt, Homo sapiens
cuccaaaaccucc

SEQ ID NO: 2211814 - RNA, 20 nt, Homo sapiens
ugucuuggucacugcugaga

SEQ ID NO: 2211815 - RNA, 20 nt, Homo sapiens
gcaugaccugugaccagcac

SEQ ID NO: 2211816 - RNA, 15 nt, Homo sapiens
uaugccucuguauuu

SEQ ID NO: 2211817 - RNA, 18 nt, Homo sapiens
uuagcuacguuuacucac

SEQ ID NO: 2211818 - RNA, 15 nt, Homo sapiens
gucuggcccaccagg

SEQ ID NO: 2211819 - RNA, 22 nt, Homo sapiens
gcugccaggauugucacuccaa

SEQ ID NO: 2211820 - RNA, 19 nt, Homo sapiens
cuuaauauuucuucaaaua

SEQ ID NO: 2211821 - RNA, 21 nt, Homo sapiens
uguaacacuguguacaccuca

SEQ ID NO: 2211822 - RNA, 13 nt, Homo sapiens
uuucagggccagg

SEQ ID NO: 2211823 - RNA, 17 nt, Homo sapiens
uagaauugcaggucucu

SEQ ID NO: 2211824 - RNA, 15 nt, Homo sapiens
guacuucaguucuca

SEQ ID NO: 2211825 - RNA, 18 nt, Homo sapiens
cucaaccucuacaggguu

SEQ ID NO: 2211826 - RNA, 12 nt, Homo sapiens
uccagaccugcu

SEQ ID NO: 2211827 - RNA, 21 nt, Homo sapiens
cuuugccccuggggcuuccau

SEQ ID NO: 2211828 - RNA, 21 nt, Homo sapiens
uugccagauuaccgacacugu

SEQ ID NO: 2211829 - RNA, 17 nt, Homo sapiens
ucaaugccauugugcag

SEQ ID NO: 2211830 - RNA, 14 nt, Homo sapiens
caggagaacaugcu

SEQ ID NO: 2211831 - RNA, 20 nt, Homo sapiens
ggcccaugaaauugaugaac

SEQ ID NO: 2211832 - RNA, 16 nt, Homo sapiens
accaagacugagccag

SEQ ID NO: 2211833 - RNA, 14 nt, Homo sapiens
aaggugacaugaca

SEQ ID NO: 2211834 - RNA, 13 nt, Homo sapiens
cucaccaccugcc

SEQ ID NO: 2211835 - RNA, 21 nt, Homo sapiens
accuguucuuccuaccaaaua

SEQ ID NO: 2211836 - RNA, 18 nt, Homo sapiens
uggaguccgaugauucuc

SEQ ID NO: 2211837 - RNA, 15 nt, Homo sapiens
aaccaauagcuuuaa

SEQ ID NO: 2211838 - RNA, 16 nt, Homo sapiens
uaagaauuuacaguuc

SEQ ID NO: 2211839 - RNA, 23 nt, Homo sapiens
uuaguauagccacaaaugccuug

SEQ ID NO: 2211840 - RNA, 15 nt, Homo sapiens
augcugucccuuacg

SEQ ID NO: 2211841 - RNA, 14 nt, Homo sapiens
caagcucugcaguc

SEQ ID NO: 2211842 - RNA, 14 nt, Homo sapiens
caaacccugcaauu

SEQ ID NO: 2211843 - RNA, 12 nt, Homo sapiens
gccuacauucac

SEQ ID NO: 2211844 - RNA, 12 nt, Homo sapiens
guacacauuucu

SEQ ID NO: 2211845 - RNA, 16 nt, Homo sapiens
cgcugcaguaagccau

SEQ ID NO: 2211846 - RNA, 22 nt, Homo sapiens
acaacuuccucccuuacagagc

SEQ ID NO: 2211847 - RNA, 14 nt, Homo sapiens
gcaaaccugccucc

SEQ ID NO: 2211848 - RNA, 20 nt, Homo sapiens
ccacugcccugggcagccau

SEQ ID NO: 2211849 - RNA, 17 nt, Homo sapiens
gaccucagcaagcugcc

SEQ ID NO: 2211850 - RNA, 18 nt, Homo sapiens
gaucugcagcucccagaa

SEQ ID NO: 2211851 - RNA, 15 nt, Homo sapiens
agugagcugauauca

SEQ ID NO: 2211852 - RNA, 18 nt, Homo sapiens
gccucgauuuugcacuuu

SEQ ID NO: 2211853 - RNA, 22 nt, Homo sapiens
ucagcacugccggcccagugac

SEQ ID NO: 2211854 - RNA, 17 nt, Homo sapiens
aagcacuuccagaacuu

SEQ ID NO: 2211855 - RNA, 18 nt, Homo sapiens
gauggcgggcagcuggug

SEQ ID NO: 2211856 - RNA, 13 nt, Homo sapiens
uuugaucuucagg

SEQ ID NO: 2211857 - RNA, 22 nt, Homo sapiens
auuccccuuggggaagacgaag

SEQ ID NO: 2211858 - RNA, 19 nt, Homo sapiens
uucucccaaaguguccuaa

SEQ ID NO: 2211859 - RNA, 21 nt, Homo sapiens
ccaucugccaaaaauuacuga

SEQ ID NO: 2211860 - RNA, 21 nt, Homo sapiens
auauguuuuccuuuuauucac

SEQ ID NO: 2211861 - RNA, 17 nt, Homo sapiens
uuuccauuaaacuacuu

SEQ ID NO: 2211862 - RNA, 16 nt, Homo sapiens
ccagaagcuguacuuu

SEQ ID NO: 2211863 - RNA, 17 nt, Homo sapiens
auaaaucacaggcaucu

SEQ ID NO: 2211864 - RNA, 15 nt, Homo sapiens
ucucugacucuugcc

SEQ ID NO: 2211865 - RNA, 16 nt, Homo sapiens
cucuaauccagcaaag

SEQ ID NO: 2211866 - RNA, 13 nt, Homo sapiens
acagaaauuguau

SEQ ID NO: 2211867 - RNA, 19 nt, Homo sapiens
uugcaucacagucacaugc

SEQ ID NO: 2211868 - RNA, 13 nt, Homo sapiens
gaguugggggcca

SEQ ID NO: 2211869 - RNA, 13 nt, Homo sapiens
cauuuacacuuuu

SEQ ID NO: 2211870 - RNA, 13 nt, Homo sapiens
cagagacacugag

SEQ ID NO: 2211871 - RNA, 13 nt, Homo sapiens
uuucaacauauca

SEQ ID NO: 2211872 - RNA, 22 nt, Homo sapiens
ugucucaaaccuccaaaagccc

SEQ ID NO: 2211873 - RNA, 17 nt, Homo sapiens
caagaggcagugguuug

SEQ ID NO: 2211874 - RNA, 17 nt, Homo sapiens
ccugagcaacaugguga

SEQ ID NO: 2211875 - RNA, 18 nt, Homo sapiens
gauucuugacauucacuu

SEQ ID NO: 2211876 - RNA, 21 nt, Homo sapiens
aagccuuugccagccauucuu

SEQ ID NO: 2211877 - RNA, 18 nt, Homo sapiens
aacuacagcuauaccuca

SEQ ID NO: 2211878 - RNA, 20 nt, Homo sapiens
aagucuaccaaccuguucaa

SEQ ID NO: 2211879 - RNA, 22 nt, Homo sapiens
ucaguuguggccucauucagca

SEQ ID NO: 2211880 - RNA, 22 nt, Homo sapiens
cuguguuucauguucuguguca

SEQ ID NO: 2211881 - RNA, 20 nt, Homo sapiens
aacuguugauugcaggaaua

SEQ ID NO: 2211882 - RNA, 22 nt, Homo sapiens
ccuaaaccuccuucagaucucu

SEQ ID NO: 2211883 - RNA, 20 nt, Homo sapiens
guguaccuccucucaguguu

SEQ ID NO: 2211884 - RNA, 17 nt, Homo sapiens
gggcucaggccauccag

SEQ ID NO: 2211885 - RNA, 22 nt, Homo sapiens
ucuacugcuuuggauccugggu

SEQ ID NO: 2211886 - RNA, 15 nt, Homo sapiens
gcauuaccacacuca

SEQ ID NO: 2211887 - RNA, 11 nt, Homo sapiens
uugcucagggg

SEQ ID NO: 2211888 - RNA, 16 nt, Homo sapiens
aucucaacagaauuaa

SEQ ID NO: 2211889 - RNA, 23 nt, Homo sapiens
aacaccuucuuggcuucugggac

SEQ ID NO: 2211890 - RNA, 16 nt, Homo sapiens
acccaguagaugccac

SEQ ID NO: 2211891 - RNA, 19 nt, Homo sapiens
agcuccuucucucuuacau

SEQ ID NO: 2211892 - RNA, 15 nt, Homo sapiens
agucucccacuaaaa

SEQ ID NO: 2211893 - RNA, 19 nt, Homo sapiens
ccugugcccucaccaccac

SEQ ID NO: 2211894 - RNA, 18 nt, Homo sapiens
auuaaaaaaaucauacau

SEQ ID NO: 2211895 - RNA, 22 nt, Homo sapiens
ucuucugaauauuuuaucuuuc

SEQ ID NO: 2211896 - RNA, 21 nt, Homo sapiens
cugccauaaauauuucucaac

SEQ ID NO: 2211897 - RNA, 13 nt, Homo sapiens
gauuaucauuuau

SEQ ID NO: 2211898 - RNA, 17 nt, Homo sapiens
uccuaccccuuugcacu

SEQ ID NO: 2211899 - RNA, 22 nt, Homo sapiens
uggccugaagaguccucugaau

SEQ ID NO: 2211900 - RNA, 17 nt, Homo sapiens
caugccacuaugagcuu

SEQ ID NO: 2211901 - RNA, 20 nt, Homo sapiens
aaguaaaaauaaacuguuau

SEQ ID NO: 2211902 - RNA, 20 nt, Homo sapiens
uuaaaaaaaaauacugaugu

SEQ ID NO: 2211903 - RNA, 21 nt, Homo sapiens
ccucucugagcucugcauuug

SEQ ID NO: 2211904 - RNA, 18 nt, Homo sapiens
agucuucuuugugccuga

SEQ ID NO: 2211905 - RNA, 17 nt, Homo sapiens
cuguuggcaaggugaca

SEQ ID NO: 2211906 - RNA, 16 nt, Homo sapiens
gaauuuuccuucuuca

SEQ ID NO: 2211907 - RNA, 18 nt, Homo sapiens
caguaagacgacaaggaa

SEQ ID NO: 2211908 - RNA, 18 nt, Homo sapiens
uaguuauaaaacuaugug

SEQ ID NO: 2211909 - RNA, 21 nt, Homo sapiens
uugccgucucaucuucucuca

SEQ ID NO: 2211910 - RNA, 12 nt, Homo sapiens
cauagcacuugc

SEQ ID NO: 2211911 - RNA, 14 nt, Homo sapiens
acuaaaaaggcaug

SEQ ID NO: 2211912 - RNA, 16 nt, Homo sapiens
caaccuguuaccacuu

SEQ ID NO: 2211913 - RNA, 21 nt, Homo sapiens
ggaaauguauuuugacacugg

SEQ ID NO: 2211914 - RNA, 15 nt, Homo sapiens
gggaaggauucugcu

SEQ ID NO: 2211915 - RNA, 15 nt, Homo sapiens
aguuguaacaaauac

SEQ ID NO: 2211916 - RNA, 11 nt, Homo sapiens
guguucagugu

SEQ ID NO: 2211917 - RNA, 23 nt, Homo sapiens
gaugccucccggcuuugcaggga

SEQ ID NO: 2211918 - RNA, 12 nt, Homo sapiens
ucagcugccuca

SEQ ID NO: 2211919 - RNA, 14 nt, Homo sapiens
auuaaaguguuaua

SEQ ID NO: 2211920 - RNA, 17 nt, Homo sapiens
ccaggccaacagcaccu

SEQ ID NO: 2211921 - RNA, 14 nt, Homo sapiens
uggccuggugcaca

SEQ ID NO: 2211922 - RNA, 15 nt, Homo sapiens
auguggccuccaugu

SEQ ID NO: 2211923 - RNA, 14 nt, Homo sapiens
acaauccuguggau

SEQ ID NO: 2211924 - RNA, 14 nt, Homo sapiens
ccacccuagcuuua

SEQ ID NO: 2211925 - RNA, 21 nt, Homo sapiens
uucuacuuuuuuugaugaccu

SEQ ID NO: 2211926 - RNA, 15 nt, Homo sapiens
cuaggcugagucuag

SEQ ID NO: 2211927 - RNA, 21 nt, Homo sapiens
agaaaguuugcuguaccacaa

SEQ ID NO: 2211928 - RNA, 13 nt, Homo sapiens
gaucgacugccaa

SEQ ID NO: 2211929 - RNA, 14 nt, Homo sapiens
uaaaugugugguau

SEQ ID NO: 2211930 - RNA, 14 nt, Homo sapiens
gcaucaauuuucaa

SEQ ID NO: 2211931 - RNA, 11 nt, Homo sapiens
cagacaagagu

SEQ ID NO: 2211932 - RNA, 21 nt, Homo sapiens
auuuccucuuuccaagaccaa

SEQ ID NO: 2211933 - RNA, 21 nt, Homo sapiens
gcuuauucacaagacccaaaa

SEQ ID NO: 2211934 - RNA, 14 nt, Homo sapiens
auaaacuguuuaua

SEQ ID NO: 2211935 - RNA, 17 nt, Homo sapiens
aagcuuccuuggcuuuu

SEQ ID NO: 2211936 - RNA, 13 nt, Homo sapiens
uuaaccacugugg

SEQ ID NO: 2211937 - RNA, 21 nt, Homo sapiens
aaaucccauggaauauuucca

SEQ ID NO: 2211938 - RNA, 18 nt, Homo sapiens
ucuugaucggaaagcucu

SEQ ID NO: 2211939 - RNA, 21 nt, Homo sapiens
auggcauaugguccuagacaa

SEQ ID NO: 2211940 - RNA, 20 nt, Homo sapiens
cucuuaaguacugaaauaca

SEQ ID NO: 2211941 - RNA, 14 nt, Homo sapiens
aacuagaagccuag

SEQ ID NO: 2211942 - RNA, 21 nt, Homo sapiens
uguuuuuuuuuaccuugucau

SEQ ID NO: 2211943 - RNA, 15 nt, Homo sapiens
cuuuugagugccuua

SEQ ID NO: 2211944 - RNA, 17 nt, Homo sapiens
guuuagaugaaugucag

SEQ ID NO: 2211945 - RNA, 16 nt, Homo sapiens
gaugggaucauuauuu

SEQ ID NO: 2211946 - RNA, 19 nt, Homo sapiens
uuucaaaggauaugcagaa

SEQ ID NO: 2211947 - RNA, 20 nt, Homo sapiens
ucuccccucacccaugcuuu

SEQ ID NO: 2211948 - RNA, 15 nt, Homo sapiens
caagucuuccaugac

SEQ ID NO: 2211949 - RNA, 23 nt, Homo sapiens
cauuuagcuuguucacacuuugc

SEQ ID NO: 2211950 - RNA, 21 nt, Homo sapiens
cucuuuacugagcaguaggua

SEQ ID NO: 2211951 - RNA, 17 nt, Homo sapiens
gcuguuuaguaguugaa

SEQ ID NO: 2211952 - RNA, 13 nt, Homo sapiens
uguccuaaaugca

SEQ ID NO: 2211953 - RNA, 20 nt, Homo sapiens
uucauucaaccccuucuggg

SEQ ID NO: 2211954 - RNA, 15 nt, Homo sapiens
cuugcugaauucucu

SEQ ID NO: 2211955 - RNA, 15 nt, Homo sapiens
uguauuuacaguuuc

SEQ ID NO: 2211956 - RNA, 20 nt, Homo sapiens
ggacauugagauacuaucau

SEQ ID NO: 2211957 - RNA, 18 nt, Homo sapiens
gauaacuauuuacauaua

SEQ ID NO: 2211958 - RNA, 12 nt, Homo sapiens
gagaaaacaugc

SEQ ID NO: 2211959 - RNA, 19 nt, Homo sapiens
acuucuggcuucaugcaau

SEQ ID NO: 2211960 - RNA, 20 nt, Homo sapiens
auguugaugaaaaauagcaa

SEQ ID NO: 2211961 - RNA, 24 nt, Homo sapiens
aaaucccuuguucucaguggugca

SEQ ID NO: 2211962 - RNA, 13 nt, Homo sapiens
agucugaacagcu

SEQ ID NO: 2211963 - RNA, 12 nt, Homo sapiens
accuugcacucc

SEQ ID NO: 2211964 - RNA, 20 nt, Homo sapiens
gaguaccuacugugugccag

SEQ ID NO: 2211965 - RNA, 12 nt, Homo sapiens
cucuuugcugca

SEQ ID NO: 2211966 - RNA, 23 nt, Homo sapiens
uuuugagucuauccuagucuuca

SEQ ID NO: 2211967 - RNA, 12 nt, Homo sapiens
ggcaucugugug

SEQ ID NO: 2211968 - RNA, 21 nt, Homo sapiens
agcaccaucucuuuaccuccu

SEQ ID NO: 2211969 - RNA, 22 nt, Homo sapiens
aacccuacuuugcuuccgccac

SEQ ID NO: 2211970 - RNA, 18 nt, Homo sapiens
acuaauuugucacuggaa

SEQ ID NO: 2211971 - RNA, 21 nt, Homo sapiens
cuuuuaaagacuugcacaaau

SEQ ID NO: 2211972 - RNA, 20 nt, Homo sapiens
aggcuuuuccaaaucaagga

SEQ ID NO: 2211973 - RNA, 12 nt, Homo sapiens
aucaucucugca

SEQ ID NO: 2211974 - RNA, 23 nt, Homo sapiens
aaaccacgccucuugaccaggcu

SEQ ID NO: 2211975 - RNA, 21 nt, Homo sapiens
cucuugaagacaacucugaaa

SEQ ID NO: 2211976 - RNA, 15 nt, Homo sapiens
acugaccugccugua

SEQ ID NO: 2211977 - RNA, 19 nt, Homo sapiens
uaauguuguaucauacucu

SEQ ID NO: 2211978 - RNA, 15 nt, Homo sapiens
gcacaaguucaguga

SEQ ID NO: 2211979 - RNA, 21 nt, Homo sapiens
agaugucuguucuaaguccac

SEQ ID NO: 2211980 - RNA, 17 nt, Homo sapiens
gcucugugggcugcacu

SEQ ID NO: 2211981 - RNA, 14 nt, Homo sapiens
uugaaagacugugc

SEQ ID NO: 2211982 - RNA, 21 nt, Homo sapiens
uacuacaguaacugugacuga

SEQ ID NO: 2211983 - RNA, 15 nt, Homo sapiens
ugggccugggaaucu

SEQ ID NO: 2211984 - RNA, 18 nt, Homo sapiens
ugccacccucaugcugug

SEQ ID NO: 2211985 - RNA, 18 nt, Homo sapiens
acuaaggaaauauuucaa

SEQ ID NO: 2211986 - RNA, 18 nt, Homo sapiens
cacaaggaaggcauuugg

SEQ ID NO: 2211987 - RNA, 24 nt, Homo sapiens
aaucaaaugguguuuucuuaugca

SEQ ID NO: 2211988 - RNA, 16 nt, Homo sapiens
aggaaaagacaccugu

SEQ ID NO: 2211989 - RNA, 22 nt, Homo sapiens
cagauggagguucucagagcca

SEQ ID NO: 2211990 - RNA, 20 nt, Homo sapiens
agaguauaugcacuuuccaa

SEQ ID NO: 2211991 - RNA, 20 nt, Homo sapiens
gccccggcaagccacaggaa

SEQ ID NO: 2211992 - RNA, 17 nt, Homo sapiens
cuaaacugaacacauga

SEQ ID NO: 2211993 - RNA, 13 nt, Homo sapiens
uucaaugugacac

SEQ ID NO: 2211994 - RNA, 18 nt, Homo sapiens
ucuaauccuuuuccuuau

SEQ ID NO: 2211995 - RNA, 15 nt, Homo sapiens
aaauuuuggucauag

SEQ ID NO: 2211996 - RNA, 19 nt, Homo sapiens
uaaaauuuuuugacccaag

SEQ ID NO: 2211997 - RNA, 21 nt, Homo sapiens
ggcuccccuccucggcuuccu

SEQ ID NO: 2211998 - RNA, 14 nt, Homo sapiens
ugaaaacucauuag

SEQ ID NO: 2211999 - RNA, 18 nt, Homo sapiens
uuaaacuuaccugggcau

SEQ ID NO: 2212000 - RNA, 16 nt, Homo sapiens
augacucucauuuuau

SEQ ID NO: 2212001 - RNA, 18 nt, Homo sapiens
cucuuuccuccugcuuca

SEQ ID NO: 2212002 - RNA, 19 nt, Homo sapiens
auugcuuuuuuaaauauua

SEQ ID NO: 2212003 - RNA, 17 nt, Homo sapiens
acaaaucaugcaaugca

SEQ ID NO: 2212004 - RNA, 23 nt, Homo sapiens
augcuucuucucaaagcacuguu

SEQ ID NO: 2212005 - RNA, 21 nt, Homo sapiens
guacacagaggcgggucuaua

SEQ ID NO: 2212006 - RNA, 16 nt, Homo sapiens
aguacugcaugaucuu

SEQ ID NO: 2212007 - RNA, 14 nt, Homo sapiens
agcuaaagccugaa

SEQ ID NO: 2212008 - RNA, 17 nt, Homo sapiens
gauuugggaaccaagcu

SEQ ID NO: 2212009 - RNA, 15 nt, Homo sapiens
uaaagguuuucucua

SEQ ID NO: 2212010 - RNA, 19 nt, Homo sapiens
ugaaggcucauuuacuuga

SEQ ID NO: 2212011 - RNA, 13 nt, Homo sapiens
aaucaacaucucu

SEQ ID NO: 2212012 - RNA, 15 nt, Homo sapiens
agguucaaaagcaau

SEQ ID NO: 2212013 - RNA, 21 nt, Homo sapiens
auguggacuggugcaaguuga

SEQ ID NO: 2212014 - RNA, 14 nt, Homo sapiens
cucccaacucuugc

SEQ ID NO: 2212015 - RNA, 14 nt, Homo sapiens
uaguccguuaacac

SEQ ID NO: 2212016 - RNA, 15 nt, Homo sapiens
aucucuaaagagcau

SEQ ID NO: 2212017 - RNA, 12 nt, Homo sapiens
cauccaaaaagu

SEQ ID NO: 2212018 - RNA, 22 nt, Homo sapiens
ccuguggauuuuuaaaacagau

SEQ ID NO: 2212019 - RNA, 13 nt, Homo sapiens
gucuacaguuuaa

SEQ ID NO: 2212020 - RNA, 17 nt, Homo sapiens
ucaggagcacagccaua

SEQ ID NO: 2212021 - RNA, 21 nt, Homo sapiens
ccuagguuuuccuuccaagca

SEQ ID NO: 2212022 - RNA, 19 nt, Homo sapiens
aaaacuaggaauccuccaa

SEQ ID NO: 2212023 - RNA, 18 nt, Homo sapiens
ugugcagacacaugugcc

SEQ ID NO: 2212024 - RNA, 15 nt, Homo sapiens
guuacuguucuugcu

SEQ ID NO: 2212025 - RNA, 17 nt, Homo sapiens
gcaauugauuucuuuuc

SEQ ID NO: 2212026 - RNA, 14 nt, Homo sapiens
ucaaucucuguugc

SEQ ID NO: 2212027 - RNA, 22 nt, Homo sapiens
uaaaacagguggagaaauuccu

SEQ ID NO: 2212028 - RNA, 21 nt, Homo sapiens
uccuuaaaaaucacacuguaa

SEQ ID NO: 2212029 - RNA, 16 nt, Homo sapiens
gagcaaacagcuguau

SEQ ID NO: 2212030 - RNA, 14 nt, Homo sapiens
aaacacccaaaaau

SEQ ID NO: 2212031 - RNA, 18 nt, Homo sapiens
cuuaucccucucuucccc

SEQ ID NO: 2212032 - RNA, 13 nt, Homo sapiens
uagaaauugaaca

SEQ ID NO: 2212033 - RNA, 13 nt, Homo sapiens
cgaguaccagcug

SEQ ID NO: 2212034 - RNA, 13 nt, Homo sapiens
aggcuuugccauu

SEQ ID NO: 2212035 - RNA, 20 nt, Homo sapiens
uaaaccaucgagaacacaaa

SEQ ID NO: 2212036 - RNA, 19 nt, Homo sapiens
gauauacauuuauuuacac

SEQ ID NO: 2212037 - RNA, 12 nt, Homo sapiens
aauuacuuucag

SEQ ID NO: 2212038 - RNA, 22 nt, Homo sapiens
auaccugcacguucauaaccaa

SEQ ID NO: 2212039 - RNA, 23 nt, Homo sapiens
gugucuggcaggcuacucugccc

SEQ ID NO: 2212040 - RNA, 23 nt, Homo sapiens
accaucucugugauuaccucuca

SEQ ID NO: 2212041 - RNA, 13 nt, Homo sapiens
uauauaagcuguu

SEQ ID NO: 2212042 - RNA, 22 nt, Homo sapiens
cuuaaaugaucugccucuaaaa

SEQ ID NO: 2212043 - RNA, 20 nt, Homo sapiens
aaauuuggcucacuugccuu

SEQ ID NO: 2212044 - RNA, 19 nt, Homo sapiens
agugcagaccccuuggcca

SEQ ID NO: 2212045 - RNA, 20 nt, Homo sapiens
uuaacucccccucauucaca

SEQ ID NO: 2212046 - RNA, 21 nt, Homo sapiens
cauuggugaccugcggcagua

SEQ ID NO: 2212047 - RNA, 21 nt, Homo sapiens
aggugcguguuuccugugcaa

SEQ ID NO: 2212048 - RNA, 16 nt, Homo sapiens
guaacuggggggccac

SEQ ID NO: 2212049 - RNA, 15 nt, Homo sapiens
auuacucagcacaga

SEQ ID NO: 2212050 - RNA, 16 nt, Homo sapiens
gguguuuuaagacuga

SEQ ID NO: 2212051 - RNA, 19 nt, Homo sapiens
aaguuuuggccaccacaug

SEQ ID NO: 2212052 - RNA, 12 nt, Homo sapiens
auggcacuuuug

SEQ ID NO: 2212053 - RNA, 17 nt, Homo sapiens
cuggaggacggucaguc

SEQ ID NO: 2212054 - RNA, 19 nt, Homo sapiens
guguuuauccuaucucucc

SEQ ID NO: 2212055 - RNA, 15 nt, Homo sapiens
ucaagcggugccuaa

SEQ ID NO: 2212056 - RNA, 20 nt, Homo sapiens
ucuuugcagacaggcaagca

SEQ ID NO: 2212057 - RNA, 17 nt, Homo sapiens
auggugcuacgccugca

SEQ ID NO: 2212058 - RNA, 13 nt, Homo sapiens
ugaggaacauuca

SEQ ID NO: 2212059 - RNA, 22 nt, Homo sapiens
gggccaucugacugccaagcca

SEQ ID NO: 2212060 - RNA, 14 nt, Homo sapiens
cuuauacuguacaa

SEQ ID NO: 2212061 - RNA, 14 nt, Homo sapiens
ugggcagggaugau

SEQ ID NO: 2212062 - RNA, 17 nt, Homo sapiens
cccugcaaaaugagacc

SEQ ID NO: 2212063 - RNA, 18 nt, Homo sapiens
ucagccaacauugccuug

SEQ ID NO: 2212064 - RNA, 19 nt, Homo sapiens
auaugauuuauauuacugu

SEQ ID NO: 2212065 - RNA, 19 nt, Homo sapiens
ucagcacuccucaucauca

SEQ ID NO: 2212066 - RNA, 16 nt, Homo sapiens
ggucaaaucaacugaa

SEQ ID NO: 2212067 - RNA, 16 nt, Homo sapiens
cuaaucugugcuguuu

SEQ ID NO: 2212068 - RNA, 13 nt, Homo sapiens
cugaaugacauau

SEQ ID NO: 2212069 - RNA, 21 nt, Homo sapiens
gcucccucacccaggcacugg

SEQ ID NO: 2212070 - RNA, 17 nt, Homo sapiens
ugccaagccuucuguga

SEQ ID NO: 2212071 - RNA, 20 nt, Homo sapiens
cuuaaagcauuugcaacagc

SEQ ID NO: 2212072 - RNA, 16 nt, Homo sapiens
caagaauacugaguca

SEQ ID NO: 2212073 - RNA, 19 nt, Homo sapiens
uuauaaaaagaugaucgcu

SEQ ID NO: 2212074 - RNA, 14 nt, Homo sapiens
cuuuuaacauaaua

SEQ ID NO: 2212075 - RNA, 19 nt, Homo sapiens
ccagguagaaaagaaaugg

SEQ ID NO: 2212076 - RNA, 19 nt, Homo sapiens
ucugaaguacuaacacaag

SEQ ID NO: 2212077 - RNA, 15 nt, Homo sapiens
cauaugaggggaccc

SEQ ID NO: 2212078 - RNA, 11 nt, Homo sapiens
ggaagcuguuu

SEQ ID NO: 2212079 - RNA, 13 nt, Homo sapiens
cccauaguucacu

SEQ ID NO: 2212080 - RNA, 16 nt, Homo sapiens
gcguuaaauaagcaaa

SEQ ID NO: 2212081 - RNA, 19 nt, Homo sapiens
uccacugccuccugugacg

SEQ ID NO: 2212082 - RNA, 13 nt, Homo sapiens
ggccaccacugca

SEQ ID NO: 2212083 - RNA, 21 nt, Homo sapiens
agaaacaccgagugaggccau

SEQ ID NO: 2212084 - RNA, 17 nt, Homo sapiens
cugaccuugugauccac

SEQ ID NO: 2212085 - RNA, 13 nt, Homo sapiens
cuuauugauccca

SEQ ID NO: 2212086 - RNA, 20 nt, Homo sapiens
acuugcauuuauuuaagaca

SEQ ID NO: 2212087 - RNA, 13 nt, Homo sapiens
aacucuugcacag

SEQ ID NO: 2212088 - RNA, 20 nt, Homo sapiens
caugggaaccucauaugcaa

SEQ ID NO: 2212089 - RNA, 13 nt, Homo sapiens
ccuaagucuuucu

SEQ ID NO: 2212090 - RNA, 17 nt, Homo sapiens
ugaagcccacccagaaa

SEQ ID NO: 2212091 - RNA, 17 nt, Homo sapiens
ccuuuaaaucugugaug

SEQ ID NO: 2212092 - RNA, 18 nt, Homo sapiens
caagacuugauacugcaa

SEQ ID NO: 2212093 - RNA, 17 nt, Homo sapiens
aaauaaaacaguaucuc

SEQ ID NO: 2212094 - RNA, 14 nt, Homo sapiens
guugagaugccugu

SEQ ID NO: 2212095 - RNA, 12 nt, Homo sapiens
aagcacugugcu

SEQ ID NO: 2212096 - RNA, 14 nt, Homo sapiens
cugugcguuacuaa

SEQ ID NO: 2212097 - RNA, 18 nt, Homo sapiens
gcauuagcacauauuuca

SEQ ID NO: 2212098 - RNA, 16 nt, Homo sapiens
caaaaacaagcaaugg

SEQ ID NO: 2212099 - RNA, 19 nt, Homo sapiens
agcugggagaaccaaaaag

SEQ ID NO: 2212100 - RNA, 12 nt, Homo sapiens
ugccuuccugcc

SEQ ID NO: 2212101 - RNA, 14 nt, Homo sapiens
cagagggacuugag

SEQ ID NO: 2212102 - RNA, 14 nt, Homo sapiens
cugguuaccacagu

SEQ ID NO: 2212103 - RNA, 19 nt, Homo sapiens
cacauccaggaaggaccuu

SEQ ID NO: 2212104 - RNA, 22 nt, Homo sapiens
auauuuguaucacaaaucuuaa

SEQ ID NO: 2212105 - RNA, 19 nt, Homo sapiens
cucuggucuaccugagauc

SEQ ID NO: 2212106 - RNA, 23 nt, Homo sapiens
gacaaaaaggugcagaaggcaau

SEQ ID NO: 2212107 - RNA, 17 nt, Homo sapiens
uaaucuccugaguugua

SEQ ID NO: 2212108 - RNA, 23 nt, Homo sapiens
aggcaguuaaauaauaauaguua

SEQ ID NO: 2212109 - RNA, 22 nt, Homo sapiens
auccugguuucauaacuuccug

SEQ ID NO: 2212110 - RNA, 15 nt, Homo sapiens
acacuguuuguucca

SEQ ID NO: 2212111 - RNA, 15 nt, Homo sapiens
gaccucgccugcugg

SEQ ID NO: 2212112 - RNA, 14 nt, Homo sapiens
augugugaugcaaa

SEQ ID NO: 2212113 - RNA, 19 nt, Homo sapiens
uggaaugaagaccaugccu

SEQ ID NO: 2212114 - RNA, 15 nt, Homo sapiens
acaggaggccagugg

SEQ ID NO: 2212115 - RNA, 18 nt, Homo sapiens
uaccagaaagcucuacau

SEQ ID NO: 2212116 - RNA, 21 nt, Homo sapiens
ugaucuuuguuuaaaugccaa

SEQ ID NO: 2212117 - RNA, 13 nt, Homo sapiens
acuccagccaaag

SEQ ID NO: 2212118 - RNA, 20 nt, Homo sapiens
gaagggacagcugcauucca

SEQ ID NO: 2212119 - RNA, 18 nt, Homo sapiens
uauccuccuguucugaaa

SEQ ID NO: 2212120 - RNA, 17 nt, Homo sapiens
gcucaucaagaacaaua

SEQ ID NO: 2212121 - RNA, 22 nt, Homo sapiens
aguuggugcuuuugagaaccaa

SEQ ID NO: 2212122 - RNA, 11 nt, Homo sapiens
ggcccaagacu

SEQ ID NO: 2212123 - RNA, 13 nt, Homo sapiens
gcaccgagaccaa

SEQ ID NO: 2212124 - RNA, 21 nt, Homo sapiens
uccaagugggucaauuccuua

SEQ ID NO: 2212125 - RNA, 23 nt, Homo sapiens
aggucgcccaccugugggccagc

SEQ ID NO: 2212126 - RNA, 18 nt, Homo sapiens
gaccaggaugacaccucc

SEQ ID NO: 2212127 - RNA, 14 nt, Homo sapiens
agcacguugcccaa

SEQ ID NO: 2212128 - RNA, 18 nt, Homo sapiens
aauauuuuuuuuuugcca

SEQ ID NO: 2212129 - RNA, 18 nt, Homo sapiens
gcucucugagagcaaaca

SEQ ID NO: 2212130 - RNA, 17 nt, Homo sapiens
ugacugaaggacaucug

SEQ ID NO: 2212131 - RNA, 23 nt, Homo sapiens
gcauucucucugcucagugaucu

SEQ ID NO: 2212132 - RNA, 19 nt, Homo sapiens
gaauucgagaccagccuga

SEQ ID NO: 2212133 - RNA, 22 nt, Homo sapiens
acagauuauaauaaauugucau

SEQ ID NO: 2212134 - RNA, 20 nt, Homo sapiens
uaaggacaaagugccaaaga

SEQ ID NO: 2212135 - RNA, 17 nt, Homo sapiens
auaagcuguaauaucau

SEQ ID NO: 2212136 - RNA, 17 nt, Homo sapiens
cauaauugcuuugccaa

SEQ ID NO: 2212137 - RNA, 14 nt, Homo sapiens
uuccagaaaggaua

SEQ ID NO: 2212138 - RNA, 21 nt, Homo sapiens
gaaaugcacccucccuccugc

SEQ ID NO: 2212139 - RNA, 23 nt, Homo sapiens
uaaguagaaaaauuguuuccaaa

SEQ ID NO: 2212140 - RNA, 16 nt, Homo sapiens
aaaacugcauuucacu

SEQ ID NO: 2212141 - RNA, 19 nt, Homo sapiens
aacacauguucugugccug

SEQ ID NO: 2212142 - RNA, 20 nt, Homo sapiens
ucccccagcuuucccgacac

SEQ ID NO: 2212143 - RNA, 17 nt, Homo sapiens
gucccuauggaagcaua

SEQ ID NO: 2212144 - RNA, 16 nt, Homo sapiens
uggaagaaagcaacaa

SEQ ID NO: 2212145 - RNA, 14 nt, Homo sapiens
ucaaugcaaugaaa

SEQ ID NO: 2212146 - RNA, 14 nt, Homo sapiens
acauguuucacuua

SEQ ID NO: 2212147 - RNA, 18 nt, Homo sapiens
uccacaaauguccucaga

SEQ ID NO: 2212148 - RNA, 22 nt, Homo sapiens
ucagccauuccuguucccauga

SEQ ID NO: 2212149 - RNA, 13 nt, Homo sapiens
accuaagcaauga

SEQ ID NO: 2212150 - RNA, 13 nt, Homo sapiens
cccugagccaugg

SEQ ID NO: 2212151 - RNA, 19 nt, Homo sapiens
uagacaguaugacauauag

SEQ ID NO: 2212152 - RNA, 13 nt, Homo sapiens
acuuuaccugcug

SEQ ID NO: 2212153 - RNA, 18 nt, Homo sapiens
uugucuaaacaaugcuga

SEQ ID NO: 2212154 - RNA, 21 nt, Homo sapiens
gggcgcugagcucccagaccc

SEQ ID NO: 2212155 - RNA, 13 nt, Homo sapiens
ggggacaggugac

SEQ ID NO: 2212156 - RNA, 13 nt, Homo sapiens
uaaaacagauucu

SEQ ID NO: 2212157 - RNA, 20 nt, Homo sapiens
augguaaagagaugucaaaa

SEQ ID NO: 2212158 - RNA, 21 nt, Homo sapiens
gagcuguggagaggggacccu

SEQ ID NO: 2212159 - RNA, 16 nt, Homo sapiens
ugccaaaccuguguag

SEQ ID NO: 2212160 - RNA, 14 nt, Homo sapiens
cgugugaggaugug

SEQ ID NO: 2212161 - RNA, 22 nt, Homo sapiens
gaugcugaccucaccugguccu

SEQ ID NO: 2212162 - RNA, 17 nt, Homo sapiens
gccuggggaccaggugc

SEQ ID NO: 2212163 - RNA, 15 nt, Homo sapiens
caggaugagaacaca

SEQ ID NO: 2212164 - RNA, 18 nt, Homo sapiens
uggagcuggcuuugccaa

SEQ ID NO: 2212165 - RNA, 18 nt, Homo sapiens
accuaguagucauuucau

SEQ ID NO: 2212166 - RNA, 15 nt, Homo sapiens
caaaaaaaucuucca

SEQ ID NO: 2212167 - RNA, 21 nt, Homo sapiens
ugugcuucuuaaaauagccau

SEQ ID NO: 2212168 - RNA, 15 nt, Homo sapiens
gauagagaccaucuu

SEQ ID NO: 2212169 - RNA, 23 nt, Homo sapiens
agccaccgcgcccagccucaucu

SEQ ID NO: 2212170 - RNA, 13 nt, Homo sapiens
cuacuagccauug

SEQ ID NO: 2212171 - RNA, 16 nt, Homo sapiens
acagaugauucacaga

SEQ ID NO: 2212172 - RNA, 15 nt, Homo sapiens
cuuauuuuaggauua

SEQ ID NO: 2212173 - RNA, 12 nt, Homo sapiens
aaagcaaaauau

SEQ ID NO: 2212174 - RNA, 18 nt, Homo sapiens
ggagugaccaaaaugcca

SEQ ID NO: 2212175 - RNA, 19 nt, Homo sapiens
uucugaaucaccaauuaaa

SEQ ID NO: 2212176 - RNA, 23 nt, Homo sapiens
uggccuugugucagagcugggag

SEQ ID NO: 2212177 - RNA, 13 nt, Homo sapiens
caucuuuacuaug

SEQ ID NO: 2212178 - RNA, 20 nt, Homo sapiens
auuaacugaauucugaacuu

SEQ ID NO: 2212179 - RNA, 20 nt, Homo sapiens
cagucccccacccaccuccu

SEQ ID NO: 2212180 - RNA, 20 nt, Homo sapiens
cugaggggauaccauaaaaa

SEQ ID NO: 2212181 - RNA, 16 nt, Homo sapiens
aauaguuugaacagau

SEQ ID NO: 2212182 - RNA, 20 nt, Homo sapiens
agacgucuagauggguucuu

SEQ ID NO: 2212183 - RNA, 18 nt, Homo sapiens
cuagugucacugaugaac

SEQ ID NO: 2212184 - RNA, 16 nt, Homo sapiens
acuaaucuuugcugaa

SEQ ID NO: 2212185 - RNA, 20 nt, Homo sapiens
augugauuacccucuggguc

SEQ ID NO: 2212186 - RNA, 15 nt, Homo sapiens
cauggugcacugagc

SEQ ID NO: 2212187 - RNA, 15 nt, Homo sapiens
auacagauguaucau

SEQ ID NO: 2212188 - RNA, 14 nt, Homo sapiens
auuaaaaacuacca

SEQ ID NO: 2212189 - RNA, 22 nt, Homo sapiens
ggccauuuggccggcucuggug

SEQ ID NO: 2212190 - RNA, 20 nt, Homo sapiens
gcacuccagccugggugaca

SEQ ID NO: 2212191 - RNA, 12 nt, Homo sapiens
uaacuacugugu

SEQ ID NO: 2212192 - RNA, 14 nt, Homo sapiens
agguccugcuaccc

SEQ ID NO: 2212193 - RNA, 19 nt, Homo sapiens
guaaggaguuuuuuuguca

SEQ ID NO: 2212194 - RNA, 21 nt, Homo sapiens
aacuugggggaccucauuccu

SEQ ID NO: 2212195 - RNA, 22 nt, Homo sapiens
auggguuauauaaagacugccu

SEQ ID NO: 2212196 - RNA, 13 nt, Homo sapiens
cauagagaucuau

SEQ ID NO: 2212197 - RNA, 15 nt, Homo sapiens
gcauaaaaaaaugau

SEQ ID NO: 2212198 - RNA, 21 nt, Homo sapiens
ccaugcaucacuauucagaag

SEQ ID NO: 2212199 - RNA, 23 nt, Homo sapiens
agucuccacgccgucagcugaga

SEQ ID NO: 2212200 - RNA, 21 nt, Homo sapiens
cacuguccuugaacccaacag

SEQ ID NO: 2212201 - RNA, 16 nt, Homo sapiens
aaaucacucacaagca

SEQ ID NO: 2212202 - RNA, 20 nt, Homo sapiens
gauacccaaguuauugggau

SEQ ID NO: 2212203 - RNA, 22 nt, Homo sapiens
agcauuagcuggcgcauauuaa

SEQ ID NO: 2212204 - RNA, 10 nt, Homo sapiens
aagaguccau

SEQ ID NO: 2212205 - RNA, 20 nt, Homo sapiens
aguuccaagagucuaaagau

SEQ ID NO: 2212206 - RNA, 18 nt, Homo sapiens
acauaauaauaauggguu

SEQ ID NO: 2212207 - RNA, 19 nt, Homo sapiens
acuuuguuauuguaccuaa

SEQ ID NO: 2212208 - RNA, 19 nt, Homo sapiens
auuauguuucuucuuguca

SEQ ID NO: 2212209 - RNA, 19 nt, Homo sapiens
aagacccaguguaaagaau

SEQ ID NO: 2212210 - RNA, 15 nt, Homo sapiens
gaaucucucuacuca

SEQ ID NO: 2212211 - RNA, 23 nt, Homo sapiens
uagucccggcaaccagauuucag

SEQ ID NO: 2212212 - RNA, 14 nt, Homo sapiens
cagaugaucucuua

SEQ ID NO: 2212213 - RNA, 21 nt, Homo sapiens
uccucaugcccccucagugag

SEQ ID NO: 2212214 - RNA, 18 nt, Homo sapiens
ugcugcuguucuguguac

SEQ ID NO: 2212215 - RNA, 19 nt, Homo sapiens
ccagcuaacaggucuagaa

SEQ ID NO: 2212216 - RNA, 21 nt, Homo sapiens
cucuaguuucuuccuguagua

SEQ ID NO: 2212217 - RNA, 18 nt, Homo sapiens
aauuuuucugugcucaau

SEQ ID NO: 2212218 - RNA, 17 nt, Homo sapiens
gagcuggaccucaccaa

SEQ ID NO: 2212219 - RNA, 20 nt, Homo sapiens
cagaaagaaggacacuugua

SEQ ID NO: 2212220 - RNA, 13 nt, Homo sapiens
aguaugguauaug

SEQ ID NO: 2212221 - RNA, 14 nt, Homo sapiens
cuccaugucuguag

SEQ ID NO: 2212222 - RNA, 15 nt, Homo sapiens
cucuugacccuguca

SEQ ID NO: 2212223 - RNA, 19 nt, Homo sapiens
ucaggauggcggcuggggc

SEQ ID NO: 2212224 - RNA, 15 nt, Homo sapiens
gaaaccagagucaaa

SEQ ID NO: 2212225 - RNA, 16 nt, Homo sapiens
cacucagccacuguca

SEQ ID NO: 2212226 - RNA, 15 nt, Homo sapiens
cuggagcccacugua

SEQ ID NO: 2212227 - RNA, 13 nt, Homo sapiens
auucuaugacaau

SEQ ID NO: 2212228 - RNA, 21 nt, Homo sapiens
uugaaguaggaaguaggaaau

SEQ ID NO: 2212229 - RNA, 17 nt, Homo sapiens
cacaugacgcaccaguu

SEQ ID NO: 2212230 - RNA, 16 nt, Homo sapiens
caaacagaacacugua

SEQ ID NO: 2212231 - RNA, 13 nt, Homo sapiens
aaucuguccugug

SEQ ID NO: 2212232 - RNA, 16 nt, Homo sapiens
gaaaaggugauuguca

SEQ ID NO: 2212233 - RNA, 19 nt, Homo sapiens
ggacuacaccaggguccug

SEQ ID NO: 2212234 - RNA, 10 nt, Homo sapiens
uuuguaaaag

SEQ ID NO: 2212235 - RNA, 20 nt, Homo sapiens
uaauuuuuauuuuugcugag

SEQ ID NO: 2212236 - RNA, 18 nt, Homo sapiens
ucguaggaauugaggagu

SEQ ID NO: 2212237 - RNA, 13 nt, Homo sapiens
accacaacugaca

SEQ ID NO: 2212238 - RNA, 14 nt, Homo sapiens
caaguuuuucuaac

SEQ ID NO: 2212239 - RNA, 22 nt, Homo sapiens
caugaucccaccucccauucac

SEQ ID NO: 2212240 - RNA, 19 nt, Homo sapiens
auaaaggcagcugccucug

SEQ ID NO: 2212241 - RNA, 21 nt, Homo sapiens
ugcagaaagaccgugugugaa

SEQ ID NO: 2212242 - RNA, 17 nt, Homo sapiens
cugcagaaaaagaaugu

SEQ ID NO: 2212243 - RNA, 12 nt, Homo sapiens
auauauuuuaga

SEQ ID NO: 2212244 - RNA, 17 nt, Homo sapiens
aggcugucuucucaggc

SEQ ID NO: 2212245 - RNA, 21 nt, Homo sapiens
gcuauuucagcaacaaccauc

SEQ ID NO: 2212246 - RNA, 21 nt, Homo sapiens
augguuuccaagggucuuccu

SEQ ID NO: 2212247 - RNA, 14 nt, Homo sapiens
caaucugcaguuug

SEQ ID NO: 2212248 - RNA, 15 nt, Homo sapiens
ugacucagugaccag

SEQ ID NO: 2212249 - RNA, 15 nt, Homo sapiens
agcccaggagccuca

SEQ ID NO: 2212250 - RNA, 13 nt, Homo sapiens
uggagauagggaa

SEQ ID NO: 2212251 - RNA, 14 nt, Homo sapiens
cugucugaagcaau

SEQ ID NO: 2212252 - RNA, 18 nt, Homo sapiens
gucucccuucuguuucuu

SEQ ID NO: 2212253 - RNA, 16 nt, Homo sapiens
cacucuaagucaugua

SEQ ID NO: 2212254 - RNA, 13 nt, Homo sapiens
ucuugugcucagu

SEQ ID NO: 2212255 - RNA, 23 nt, Homo sapiens
aacugacugccuugcuaaaagau

SEQ ID NO: 2212256 - RNA, 20 nt, Homo sapiens
agggaacucuggcauuccuu

SEQ ID NO: 2212257 - RNA, 22 nt, Homo sapiens
aggaauugacuucagcaggggu

SEQ ID NO: 2212258 - RNA, 21 nt, Homo sapiens
aaccucuggcuagaggacaua

SEQ ID NO: 2212259 - RNA, 20 nt, Homo sapiens
uaacccaaugccugugaagc

SEQ ID NO: 2212260 - RNA, 20 nt, Homo sapiens
ccugucuuccaaggagacca

SEQ ID NO: 2212261 - RNA, 12 nt, Homo sapiens
cucuaguuccau

SEQ ID NO: 2212262 - RNA, 12 nt, Homo sapiens
acguaacuauuu

SEQ ID NO: 2212263 - RNA, 17 nt, Homo sapiens
uacgcaggcaucugauu

SEQ ID NO: 2212264 - RNA, 22 nt, Homo sapiens
ccuccucuucccuuagccucuc

SEQ ID NO: 2212265 - RNA, 17 nt, Homo sapiens
aaguacauuaaaacacu

SEQ ID NO: 2212266 - RNA, 17 nt, Homo sapiens
uaaauuauuaguuuaca

SEQ ID NO: 2212267 - RNA, 17 nt, Homo sapiens
ccaaguucuucaccucu

SEQ ID NO: 2212268 - RNA, 13 nt, Homo sapiens
ugugucuacuguc

SEQ ID NO: 2212269 - RNA, 20 nt, Homo sapiens
agaaaaaaauauauaauacc

SEQ ID NO: 2212270 - RNA, 22 nt, Homo sapiens
ugaguggaguugaggugucaga

SEQ ID NO: 2212271 - RNA, 13 nt, Homo sapiens
uaacaucuugaau

SEQ ID NO: 2212272 - RNA, 23 nt, Homo sapiens
ugcagacaggccaugugagccac

SEQ ID NO: 2212273 - RNA, 21 nt, Homo sapiens
cuucuagaauccccacaggga

SEQ ID NO: 2212274 - RNA, 16 nt, Homo sapiens
uauaaauaaauaccaa

SEQ ID NO: 2212275 - RNA, 17 nt, Homo sapiens
uacucaggcagugcaau

SEQ ID NO: 2212276 - RNA, 17 nt, Homo sapiens
cuggaggagcugugcug

SEQ ID NO: 2212277 - RNA, 15 nt, Homo sapiens
agaugugccuagaca

SEQ ID NO: 2212278 - RNA, 19 nt, Homo sapiens
uggcugcuucaaaggccag

SEQ ID NO: 2212279 - RNA, 12 nt, Homo sapiens
cuuuaagugugc

SEQ ID NO: 2212280 - RNA, 20 nt, Homo sapiens
ucauuucauacaaauuuucc

SEQ ID NO: 2212281 - RNA, 21 nt, Homo sapiens
auggcaacaaacacauuguga

SEQ ID NO: 2212282 - RNA, 14 nt, Homo sapiens
uucacuguugaaaa

SEQ ID NO: 2212283 - RNA, 23 nt, Homo sapiens
aaaagggaauuaugaguuuuuca

SEQ ID NO: 2212284 - RNA, 14 nt, Homo sapiens
cuauuuguacaauu

SEQ ID NO: 2212285 - RNA, 14 nt, Homo sapiens
auuacaguccuuca

SEQ ID NO: 2212286 - RNA, 19 nt, Homo sapiens
cagccugaccaacaucgug

SEQ ID NO: 2212287 - RNA, 12 nt, Homo sapiens
ugcuagaacaag

SEQ ID NO: 2212288 - RNA, 14 nt, Homo sapiens
ugucuccccagaag

SEQ ID NO: 2212289 - RNA, 17 nt, Homo sapiens
ccagagcagaugcagag

SEQ ID NO: 2212290 - RNA, 16 nt, Homo sapiens
acagugaaugcacugu

SEQ ID NO: 2212291 - RNA, 22 nt, Homo sapiens
ccuguggcccucgcucugccuc

SEQ ID NO: 2212292 - RNA, 13 nt, Homo sapiens
auguacacacaca

SEQ ID NO: 2212293 - RNA, 15 nt, Homo sapiens
cccggcaaccagauu

SEQ ID NO: 2212294 - RNA, 16 nt, Homo sapiens
uccuagacucaaguga

SEQ ID NO: 2212295 - RNA, 20 nt, Homo sapiens
aauaucucaauuaccaauau

SEQ ID NO: 2212296 - RNA, 23 nt, Homo sapiens
uguuaccugaaaacacugugcac

SEQ ID NO: 2212297 - RNA, 17 nt, Homo sapiens
cccaacgugcaaagcca

SEQ ID NO: 2212298 - RNA, 16 nt, Homo sapiens
guuucuguuucuugcu

SEQ ID NO: 2212299 - RNA, 14 nt, Homo sapiens
ucugccuugccuuu

SEQ ID NO: 2212300 - RNA, 19 nt, Homo sapiens
acugcacccuggauuugca

SEQ ID NO: 2212301 - RNA, 12 nt, Homo sapiens
agcuuucugcca

SEQ ID NO: 2212302 - RNA, 14 nt, Homo sapiens
gaagugagcagugu

SEQ ID NO: 2212303 - RNA, 22 nt, Homo sapiens
guacugcacccagcagugucac

SEQ ID NO: 2212304 - RNA, 17 nt, Homo sapiens
accucacucuugccaac

SEQ ID NO: 2212305 - RNA, 13 nt, Homo sapiens
cuauuugaagugu

SEQ ID NO: 2212306 - RNA, 16 nt, Homo sapiens
cuccucugaagcauuu

SEQ ID NO: 2212307 - RNA, 22 nt, Homo sapiens
augcuaaagaaaaagucaucca

SEQ ID NO: 2212308 - RNA, 15 nt, Homo sapiens
ccacuggauugcuga

SEQ ID NO: 2212309 - RNA, 15 nt, Homo sapiens
auaaugcaccacuuu

SEQ ID NO: 2212310 - RNA, 15 nt, Homo sapiens
uccuuccugggaccc

SEQ ID NO: 2212311 - RNA, 21 nt, Homo sapiens
guuauucauuuggugacugug

SEQ ID NO: 2212312 - RNA, 15 nt, Homo sapiens
uaaaccugacaaugg

SEQ ID NO: 2212313 - RNA, 23 nt, Homo sapiens
uauauuuuaaaaauaaauucaaa

SEQ ID NO: 2212314 - RNA, 23 nt, Homo sapiens
ugucaguauuauucuacuauacu

SEQ ID NO: 2212315 - RNA, 20 nt, Homo sapiens
gcuaaguauuucccagcaca

SEQ ID NO: 2212316 - RNA, 19 nt, Homo sapiens
ugcaaaaugggaacaauga

SEQ ID NO: 2212317 - RNA, 18 nt, Homo sapiens
uccguccaggagccugug

SEQ ID NO: 2212318 - RNA, 22 nt, Homo sapiens
aaguaggauucaucauuccaua

SEQ ID NO: 2212319 - RNA, 17 nt, Homo sapiens
aagaaagcuucuuguga

SEQ ID NO: 2212320 - RNA, 19 nt, Homo sapiens
gaaauaaguuuuuguuuca

SEQ ID NO: 2212321 - RNA, 19 nt, Homo sapiens
auugcauugugacuaucca

SEQ ID NO: 2212322 - RNA, 11 nt, Homo sapiens
cgaaggugcug

SEQ ID NO: 2212323 - RNA, 22 nt, Homo sapiens
gaagagcauuugguacacacuu

SEQ ID NO: 2212324 - RNA, 16 nt, Homo sapiens
ccauugaaacaugcca

SEQ ID NO: 2212325 - RNA, 14 nt, Homo sapiens
uguuuacuaaagag

SEQ ID NO: 2212326 - RNA, 23 nt, Homo sapiens
aauggaugggcagucauuuugca

SEQ ID NO: 2212327 - RNA, 22 nt, Homo sapiens
ucugcagucgcuugccaaagca

SEQ ID NO: 2212328 - RNA, 21 nt, Homo sapiens
guuccgaagaagaugcuccag

SEQ ID NO: 2212329 - RNA, 16 nt, Homo sapiens
caggggccaggggugg

SEQ ID NO: 2212330 - RNA, 15 nt, Homo sapiens
uaaggauugugauau

SEQ ID NO: 2212331 - RNA, 16 nt, Homo sapiens
caguccucaucuccag

SEQ ID NO: 2212332 - RNA, 16 nt, Homo sapiens
gcuuucucagugucag

SEQ ID NO: 2212333 - RNA, 15 nt, Homo sapiens
caauaggcauuugau

SEQ ID NO: 2212334 - RNA, 16 nt, Homo sapiens
acuugcacccaugugu

SEQ ID NO: 2212335 - RNA, 16 nt, Homo sapiens
uuccaaauguguauaa

SEQ ID NO: 2212336 - RNA, 22 nt, Homo sapiens
cuuuucucugagacauuccacc

SEQ ID NO: 2212337 - RNA, 22 nt, Homo sapiens
gcagguuggaacuaugcagugu

SEQ ID NO: 2212338 - RNA, 22 nt, Homo sapiens
uuaagauuuggucacacucuca

SEQ ID NO: 2212339 - RNA, 18 nt, Homo sapiens
ccccguggagcuggccaa

SEQ ID NO: 2212340 - RNA, 13 nt, Homo sapiens
ugauucacagugu

SEQ ID NO: 2212341 - RNA, 23 nt, Homo sapiens
cggccgaggccugcgcccugaca

SEQ ID NO: 2212342 - RNA, 20 nt, Homo sapiens
uccaccucccaacacuguca

SEQ ID NO: 2212343 - RNA, 20 nt, Homo sapiens
guauuccaugagcugcucau

SEQ ID NO: 2212344 - RNA, 14 nt, Homo sapiens
aacuauaacauuca

SEQ ID NO: 2212345 - RNA, 23 nt, Homo sapiens
acggacgcgcgugacacaaugcu

SEQ ID NO: 2212346 - RNA, 13 nt, Homo sapiens
cuucuguaugcau

SEQ ID NO: 2212347 - RNA, 12 nt, Homo sapiens
gcagacagcagg

SEQ ID NO: 2212348 - RNA, 19 nt, Homo sapiens
aauuaauuugugcaucaga

SEQ ID NO: 2212349 - RNA, 22 nt, Homo sapiens
ccaugagaguucugucacgguc

SEQ ID NO: 2212350 - RNA, 23 nt, Homo sapiens
auguuaguuuauuugagcacuuu

SEQ ID NO: 2212351 - RNA, 22 nt, Homo sapiens
uguauuuucuuacacuguguca

SEQ ID NO: 2212352 - RNA, 15 nt, Homo sapiens
auaaauacgugucaa

SEQ ID NO: 2212353 - RNA, 20 nt, Homo sapiens
uauguuuucuuucucaccca

SEQ ID NO: 2212354 - RNA, 15 nt, Homo sapiens
caacauaaguuaaua

SEQ ID NO: 2212355 - RNA, 15 nt, Homo sapiens
gcauugaaaugcaau

SEQ ID NO: 2212356 - RNA, 16 nt, Homo sapiens
gaaucgauauaggcau

SEQ ID NO: 2212357 - RNA, 20 nt, Homo sapiens
cuguggagggagggcagcug

SEQ ID NO: 2212358 - RNA, 22 nt, Homo sapiens
ucaccugaaauaauacauugca

SEQ ID NO: 2212359 - RNA, 20 nt, Homo sapiens
auuaagaauugguugccaua

SEQ ID NO: 2212360 - RNA, 13 nt, Homo sapiens
uggcacaggagac

SEQ ID NO: 2212361 - RNA, 17 nt, Homo sapiens
ugacagagaugugcaug

SEQ ID NO: 2212362 - RNA, 19 nt, Homo sapiens
gucauucuagaaacaggaa

SEQ ID NO: 2212363 - RNA, 17 nt, Homo sapiens
ugggggccaugagcucc

SEQ ID NO: 2212364 - RNA, 20 nt, Homo sapiens
cugugaagauucaguucaaa

SEQ ID NO: 2212365 - RNA, 23 nt, Homo sapiens
gccccucgccuuuuaggcucagg

SEQ ID NO: 2212366 - RNA, 18 nt, Homo sapiens
caggugcccgccaccaca

SEQ ID NO: 2212367 - RNA, 23 nt, Homo sapiens
cacggagcucacccaugugcaca

SEQ ID NO: 2212368 - RNA, 22 nt, Homo sapiens
aaggugccgauuucaugcauuc

SEQ ID NO: 2212369 - RNA, 16 nt, Homo sapiens
ccaaccccucagauuu

SEQ ID NO: 2212370 - RNA, 15 nt, Homo sapiens
aagcaaggcuuuaaa

SEQ ID NO: 2212371 - RNA, 15 nt, Homo sapiens
gcaaggaaacguaau

SEQ ID NO: 2212372 - RNA, 14 nt, Homo sapiens
caguuuuucacuuc

SEQ ID NO: 2212373 - RNA, 23 nt, Homo sapiens
ggaagagagggaggcacguagga

SEQ ID NO: 2212374 - RNA, 15 nt, Homo sapiens
aggauuccucagggu

SEQ ID NO: 2212375 - RNA, 17 nt, Homo sapiens
cuccugagaaaggugag

SEQ ID NO: 2212376 - RNA, 15 nt, Homo sapiens
agggcacuggagcug

SEQ ID NO: 2212377 - RNA, 12 nt, Homo sapiens
gucaguuucacu

SEQ ID NO: 2212378 - RNA, 12 nt, Homo sapiens
cagaguuugugu

SEQ ID NO: 2212379 - RNA, 13 nt, Homo sapiens
cucugucccucac

SEQ ID NO: 2212380 - RNA, 14 nt, Homo sapiens
caucauaacugcau

SEQ ID NO: 2212381 - RNA, 14 nt, Homo sapiens
uaucaaaauugcaa

SEQ ID NO: 2212382 - RNA, 14 nt, Homo sapiens
cauuauaacuguau

SEQ ID NO: 2212383 - RNA, 14 nt, Homo sapiens
caggcaaacuugca

SEQ ID NO: 2212384 - RNA, 18 nt, Homo sapiens
caguuucuuuggccagaa

SEQ ID NO: 2212385 - RNA, 18 nt, Homo sapiens
ccuuggucuuuucuugcc

SEQ ID NO: 2212386 - RNA, 14 nt, Homo sapiens
agaccccagucaag

SEQ ID NO: 2212387 - RNA, 17 nt, Homo sapiens
agggauggcagugauuc

SEQ ID NO: 2212388 - RNA, 15 nt, Homo sapiens
gagacaggcaaacug

SEQ ID NO: 2212389 - RNA, 17 nt, Homo sapiens
auucccacuuucauuca

SEQ ID NO: 2212390 - RNA, 20 nt, Homo sapiens
ccaagaauguuaugugcaag

SEQ ID NO: 2212391 - RNA, 21 nt, Homo sapiens
gugcucuccauucugcuccuu

SEQ ID NO: 2212392 - RNA, 15 nt, Homo sapiens
ucuaaaaacuuagaa

SEQ ID NO: 2212393 - RNA, 22 nt, Homo sapiens
uccuuagccuuugucccagaau

SEQ ID NO: 2212394 - RNA, 22 nt, Homo sapiens
agcagcagcacuuagaccugcc

SEQ ID NO: 2212395 - RNA, 23 nt, Homo sapiens
caaugucugcaccaaugcuaaua

SEQ ID NO: 2212396 - RNA, 12 nt, Homo sapiens
uaagggggacca

SEQ ID NO: 2212397 - RNA, 15 nt, Homo sapiens
cuugcaauuucuacc

SEQ ID NO: 2212398 - RNA, 17 nt, Homo sapiens
uguaaaauagaauguua

SEQ ID NO: 2212399 - RNA, 19 nt, Homo sapiens
uaacuuuuauuacagucaa

SEQ ID NO: 2212400 - RNA, 14 nt, Homo sapiens
aauguaugugcucu

SEQ ID NO: 2212401 - RNA, 17 nt, Homo sapiens
gcuggauucagauauaa

SEQ ID NO: 2212402 - RNA, 15 nt, Homo sapiens
gauaaagguucaugc

SEQ ID NO: 2212403 - RNA, 14 nt, Homo sapiens
aagagucucuccag

SEQ ID NO: 2212404 - RNA, 14 nt, Homo sapiens
agcagucaggcgcu

SEQ ID NO: 2212405 - RNA, 17 nt, Homo sapiens
gccugcccaacguggug

SEQ ID NO: 2212406 - RNA, 13 nt, Homo sapiens
ucuccaaagaaga

SEQ ID NO: 2212407 - RNA, 23 nt, Homo sapiens
aagcacgauggagagagccuuau

SEQ ID NO: 2212408 - RNA, 20 nt, Homo sapiens
acgugauggaccaaagccac

SEQ ID NO: 2212409 - RNA, 15 nt, Homo sapiens
cuaagaaauauucca

SEQ ID NO: 2212410 - RNA, 17 nt, Homo sapiens
cacccuccugucuuccc

SEQ ID NO: 2212411 - RNA, 15 nt, Homo sapiens
uaguugucuuuccug

SEQ ID NO: 2212412 - RNA, 15 nt, Homo sapiens
agaggaauccaugua

SEQ ID NO: 2212413 - RNA, 23 nt, Homo sapiens
ccauugcaaaagguuaagccaua

SEQ ID NO: 2212414 - RNA, 19 nt, Homo sapiens
ucuggggcagcagagccau

SEQ ID NO: 2212415 - RNA, 18 nt, Homo sapiens
gcacauagcucaaucaca

SEQ ID NO: 2212416 - RNA, 13 nt, Homo sapiens
uaugucaaaugga

SEQ ID NO: 2212417 - RNA, 18 nt, Homo sapiens
auaaaacgaucuaaaggu

SEQ ID NO: 2212418 - RNA, 14 nt, Homo sapiens
ugugaagagacucu

SEQ ID NO: 2212419 - RNA, 20 nt, Homo sapiens
acuccccagagcugugccag

SEQ ID NO: 2212420 - RNA, 17 nt, Homo sapiens
gccuauuguugaauaaa

SEQ ID NO: 2212421 - RNA, 15 nt, Homo sapiens
uaaaaaaagacauaa

SEQ ID NO: 2212422 - RNA, 17 nt, Homo sapiens
cacagauuugcauuuca

SEQ ID NO: 2212423 - RNA, 18 nt, Homo sapiens
aggguaagacaauaugaa

SEQ ID NO: 2212424 - RNA, 15 nt, Homo sapiens
guauaaaugcaaaug

SEQ ID NO: 2212425 - RNA, 23 nt, Homo sapiens
cuggccuguaaucccagcuacuu

SEQ ID NO: 2212426 - RNA, 22 nt, Homo sapiens
gcccacagugccuguacaggaa

SEQ ID NO: 2212427 - RNA, 16 nt, Homo sapiens
uuuuaaugucaucucu

SEQ ID NO: 2212428 - RNA, 17 nt, Homo sapiens
uagaacacacacacuua

SEQ ID NO: 2212429 - RNA, 13 nt, Homo sapiens
cucuaaccccuug

SEQ ID NO: 2212430 - RNA, 13 nt, Homo sapiens
cuccaaccccucg

SEQ ID NO: 2212431 - RNA, 19 nt, Homo sapiens
caauucuaaaacagacuca

SEQ ID NO: 2212432 - RNA, 19 nt, Homo sapiens
cucuagccuggcaacagag

SEQ ID NO: 2212433 - RNA, 13 nt, Homo sapiens
uauauauauugcu

SEQ ID NO: 2212434 - RNA, 19 nt, Homo sapiens
agugcguguaauuaaauac

SEQ ID NO: 2212435 - RNA, 22 nt, Homo sapiens
uugaucauuuuuauaugaaaua

SEQ ID NO: 2212436 - RNA, 17 nt, Homo sapiens
uuaaaccagggaugucu

SEQ ID NO: 2212437 - RNA, 18 nt, Homo sapiens
gagagcacgccuguacua

SEQ ID NO: 2212438 - RNA, 18 nt, Homo sapiens
ugcugggcugggcccucu

SEQ ID NO: 2212439 - RNA, 16 nt, Homo sapiens
aaggaaauguuaguaa

SEQ ID NO: 2212440 - RNA, 15 nt, Homo sapiens
ccauauucacaccuc

SEQ ID NO: 2212441 - RNA, 18 nt, Homo sapiens
ugaugaaagugcuucauu

SEQ ID NO: 2212442 - RNA, 20 nt, Homo sapiens
ucugcggcuuucacugcuga

SEQ ID NO: 2212443 - RNA, 23 nt, Homo sapiens
agggugacccugaagugagcaca

SEQ ID NO: 2212444 - RNA, 17 nt, Homo sapiens
acuugaaguaacuauaa

SEQ ID NO: 2212445 - RNA, 22 nt, Homo sapiens
agaucguucauugccuuuccag

SEQ ID NO: 2212446 - RNA, 16 nt, Homo sapiens
aaauaacgccccagau

SEQ ID NO: 2212447 - RNA, 23 nt, Homo sapiens
cuguauuauaauaagcaaaaaga

SEQ ID NO: 2212448 - RNA, 16 nt, Homo sapiens
auccagucucccaacu

SEQ ID NO: 2212449 - RNA, 21 nt, Homo sapiens
uuauggaaauaguacuaaagg

SEQ ID NO: 2212450 - RNA, 18 nt, Homo sapiens
guuuaguaauacagccug

SEQ ID NO: 2212451 - RNA, 20 nt, Homo sapiens
agcgcauugagccaguggug

SEQ ID NO: 2212452 - RNA, 19 nt, Homo sapiens
uacuuaaguguucauuuua

SEQ ID NO: 2212453 - RNA, 12 nt, Homo sapiens
aaacucuugaga

SEQ ID NO: 2212454 - RNA, 19 nt, Homo sapiens
gcaugauuagugcaauaaa

SEQ ID NO: 2212455 - RNA, 18 nt, Homo sapiens
gucuaaacaaaauugcaa

SEQ ID NO: 2212456 - RNA, 21 nt, Homo sapiens
gguccuuccacugugcaccug

SEQ ID NO: 2212457 - RNA, 18 nt, Homo sapiens
acaggugucuagacugcc

SEQ ID NO: 2212458 - RNA, 23 nt, Homo sapiens
gaacugauuccugaaauaaugca

SEQ ID NO: 2212459 - RNA, 24 nt, Homo sapiens
ucuucaccauuuggcaaugccauc

SEQ ID NO: 2212460 - RNA, 16 nt, Homo sapiens
cucauguuccuuuuga

SEQ ID NO: 2212461 - RNA, 17 nt, Homo sapiens
agaacaauggcuauuca

SEQ ID NO: 2212462 - RNA, 20 nt, Homo sapiens
agggauauuuuuuucuauua

SEQ ID NO: 2212463 - RNA, 20 nt, Homo sapiens
agugucaccagcugccaaaa

SEQ ID NO: 2212464 - RNA, 17 nt, Homo sapiens
gaagagcugucuucccc

SEQ ID NO: 2212465 - RNA, 14 nt, Homo sapiens
accccucugggaaa

SEQ ID NO: 2212466 - RNA, 17 nt, Homo sapiens
uauuuugucacugcugu

SEQ ID NO: 2212467 - RNA, 13 nt, Homo sapiens
cagaggagcucua

SEQ ID NO: 2212468 - RNA, 12 nt, Homo sapiens
ucucgcuuuguu

SEQ ID NO: 2212469 - RNA, 15 nt, Homo sapiens
auagacaucagaaau

SEQ ID NO: 2212470 - RNA, 12 nt, Homo sapiens
agcacucagaga

SEQ ID NO: 2212471 - RNA, 12 nt, Homo sapiens
aacccucagggc

SEQ ID NO: 2212472 - RNA, 21 nt, Homo sapiens
guccucagagcaggggccaga

SEQ ID NO: 2212473 - RNA, 23 nt, Homo sapiens
gcuagacucccauggaauuggaa

SEQ ID NO: 2212474 - RNA, 22 nt, Homo sapiens
cauauuuguuuaugguaaaaaa

SEQ ID NO: 2212475 - RNA, 16 nt, Homo sapiens
agccacuuucugccag

SEQ ID NO: 2212476 - RNA, 19 nt, Homo sapiens
cuucuagagcuuagcauau

SEQ ID NO: 2212477 - RNA, 22 nt, Homo sapiens
uguguacucuuuauuucuagca

SEQ ID NO: 2212478 - RNA, 18 nt, Homo sapiens
aaaacuuaaaagcaagau

SEQ ID NO: 2212479 - RNA, 22 nt, Homo sapiens
uggauuccuagauuacaucugc

SEQ ID NO: 2212480 - RNA, 21 nt, Homo sapiens
cuuuacaaaccuuuguuucaa

SEQ ID NO: 2212481 - RNA, 12 nt, Homo sapiens
gauguacuauaa

SEQ ID NO: 2212482 - RNA, 11 nt, Homo sapiens
ccuggugggag

SEQ ID NO: 2212483 - RNA, 15 nt, Homo sapiens
aaaagggcacuccca

SEQ ID NO: 2212484 - RNA, 20 nt, Homo sapiens
uauuucaaaugaacacgugc

SEQ ID NO: 2212485 - RNA, 22 nt, Homo sapiens
uuaucaaaaaacagaaaaacaa

SEQ ID NO: 2212486 - RNA, 18 nt, Homo sapiens
caggcccuuccucuccac

SEQ ID NO: 2212487 - RNA, 16 nt, Homo sapiens
aguaugaggcauuugu

SEQ ID NO: 2212488 - RNA, 12 nt, Homo sapiens
uuugugcugcug

SEQ ID NO: 2212489 - RNA, 16 nt, Homo sapiens
uuucaaugcugacugg

SEQ ID NO: 2212490 - RNA, 15 nt, Homo sapiens
ugugugucugaagac

SEQ ID NO: 2212491 - RNA, 17 nt, Homo sapiens
gauccagaacugcacuc

SEQ ID NO: 2212492 - RNA, 15 nt, Homo sapiens
cuggaggcacgcacc

SEQ ID NO: 2212493 - RNA, 16 nt, Homo sapiens
uccuuaaaaauguaug

SEQ ID NO: 2212494 - RNA, 16 nt, Homo sapiens
aaugcauguccucaaa

SEQ ID NO: 2212495 - RNA, 23 nt, Homo sapiens
gcugccuggacccguucaugggg

SEQ ID NO: 2212496 - RNA, 20 nt, Homo sapiens
agccuucaaucaacaucucu

SEQ ID NO: 2212497 - RNA, 14 nt, Homo sapiens
ccaaaaccaaugcu

SEQ ID NO: 2212498 - RNA, 22 nt, Homo sapiens
uuagauugggucguuacuaaaa

SEQ ID NO: 2212499 - RNA, 18 nt, Homo sapiens
ugcaguaacacuggccuu

SEQ ID NO: 2212500 - RNA, 16 nt, Homo sapiens
uggcuuggaggacaaa

SEQ ID NO: 2212501 - RNA, 22 nt, Homo sapiens
ucagaggcuggggccaacugga

SEQ ID NO: 2212502 - RNA, 13 nt, Homo sapiens
acuagauacugaa

SEQ ID NO: 2212503 - RNA, 13 nt, Homo sapiens
agugacuggugcc

SEQ ID NO: 2212504 - RNA, 15 nt, Homo sapiens
aauuucuugcaauuu

SEQ ID NO: 2212505 - RNA, 16 nt, Homo sapiens
gcaaaaccucauuuaa

SEQ ID NO: 2212506 - RNA, 21 nt, Homo sapiens
cuacuuuugcuaagaugcauu

SEQ ID NO: 2212507 - RNA, 18 nt, Homo sapiens
acaauuguugacuaaaau

SEQ ID NO: 2212508 - RNA, 21 nt, Homo sapiens
ucugguuugaaagaugcagug

SEQ ID NO: 2212509 - RNA, 11 nt, Homo sapiens
cacacuguaaa

SEQ ID NO: 2212510 - RNA, 15 nt, Homo sapiens
cucagcuacugcaaa

SEQ ID NO: 2212511 - RNA, 22 nt, Homo sapiens
gugcugccccuugcaagccaua

SEQ ID NO: 2212512 - RNA, 14 nt, Homo sapiens
cacuaucuguaaug

SEQ ID NO: 2212513 - RNA, 14 nt, Homo sapiens
acccaacucaagga

SEQ ID NO: 2212514 - RNA, 12 nt, Homo sapiens
caucucuacuaa

SEQ ID NO: 2212515 - RNA, 12 nt, Homo sapiens
uauaucuauuac

SEQ ID NO: 2212516 - RNA, 16 nt, Homo sapiens
cacauaguguccugcc

SEQ ID NO: 2212517 - RNA, 14 nt, Homo sapiens
ucaccacagcugca

SEQ ID NO: 2212518 - RNA, 14 nt, Homo sapiens
ugacaucaggugau

SEQ ID NO: 2212519 - RNA, 18 nt, Homo sapiens
gcccagcagacaucaagc

SEQ ID NO: 2212520 - RNA, 18 nt, Homo sapiens
uccuuugcauuccaugau

SEQ ID NO: 2212521 - RNA, 12 nt, Homo sapiens
cugccacugccg

SEQ ID NO: 2212522 - RNA, 19 nt, Homo sapiens
ccucaccuuguaaccagug

SEQ ID NO: 2212523 - RNA, 15 nt, Homo sapiens
gacggcggcggcccu

SEQ ID NO: 2212524 - RNA, 17 nt, Homo sapiens
auugaaggauugugaac

SEQ ID NO: 2212525 - RNA, 20 nt, Homo sapiens
guggauugugagaaauucca

SEQ ID NO: 2212526 - RNA, 15 nt, Homo sapiens
acaucucucugcccu

SEQ ID NO: 2212527 - RNA, 19 nt, Homo sapiens
guucugggauuacaggugu

SEQ ID NO: 2212528 - RNA, 18 nt, Homo sapiens
cuugaguccccaccagcu

SEQ ID NO: 2212529 - RNA, 22 nt, Homo sapiens
ugugaccccuccccagugccuc

SEQ ID NO: 2212530 - RNA, 14 nt, Homo sapiens
gucucuaaguuaug

SEQ ID NO: 2212531 - RNA, 13 nt, Homo sapiens
uggaaacugcaaa

SEQ ID NO: 2212532 - RNA, 17 nt, Homo sapiens
cagccagguuagccuuu

SEQ ID NO: 2212533 - RNA, 15 nt, Homo sapiens
auuuguagugauuca

SEQ ID NO: 2212534 - RNA, 18 nt, Homo sapiens
ucaaaccacaauauccag

SEQ ID NO: 2212535 - RNA, 22 nt, Homo sapiens
agcccuguucugggugcagcug

SEQ ID NO: 2212536 - RNA, 22 nt, Homo sapiens
gacucuuacguggagagugcac

SEQ ID NO: 2212537 - RNA, 21 nt, Homo sapiens
uccuagaaccaagcuucagag

SEQ ID NO: 2212538 - RNA, 13 nt, Homo sapiens
agugcugcaguau

SEQ ID NO: 2212539 - RNA, 16 nt, Homo sapiens
aauauuuuagccuuaa

SEQ ID NO: 2212540 - RNA, 17 nt, Homo sapiens
uuuggacuguaacugac

SEQ ID NO: 2212541 - RNA, 15 nt, Homo sapiens
acuccgucucaaaaa

SEQ ID NO: 2212542 - RNA, 18 nt, Homo sapiens
ccacuuugacuacaaaga

SEQ ID NO: 2212543 - RNA, 11 nt, Homo sapiens
acacauuccau

SEQ ID NO: 2212544 - RNA, 16 nt, Homo sapiens
accuucacaccaauag

SEQ ID NO: 2212545 - RNA, 20 nt, Homo sapiens
uaggggcugggaacagugug

SEQ ID NO: 2212546 - RNA, 22 nt, Homo sapiens
aaccccagacccccaucacuug

SEQ ID NO: 2212547 - RNA, 17 nt, Homo sapiens
auaguuuucccuauucu

SEQ ID NO: 2212548 - RNA, 13 nt, Homo sapiens
augcuggcaaagg

SEQ ID NO: 2212549 - RNA, 19 nt, Homo sapiens
aauuacaauauguauuuau

SEQ ID NO: 2212550 - RNA, 16 nt, Homo sapiens
ugacagucuugcauuc

SEQ ID NO: 2212551 - RNA, 14 nt, Homo sapiens
cauggcagggccag

SEQ ID NO: 2212552 - RNA, 14 nt, Homo sapiens
uaaaaguacauuaa

SEQ ID NO: 2212553 - RNA, 16 nt, Homo sapiens
uacaguguauguacua

SEQ ID NO: 2212554 - RNA, 18 nt, Homo sapiens
gguuguauaaagcaaaag

SEQ ID NO: 2212555 - RNA, 22 nt, Homo sapiens
guccugcagucccacacugugc

SEQ ID NO: 2212556 - RNA, 17 nt, Homo sapiens
cuauuucccuugccuca

SEQ ID NO: 2212557 - RNA, 17 nt, Homo sapiens
cuaacagccucagcaca

SEQ ID NO: 2212558 - RNA, 15 nt, Homo sapiens
agcacauuuugacac

SEQ ID NO: 2212559 - RNA, 22 nt, Homo sapiens
uggggccacacguuugccaaau

SEQ ID NO: 2212560 - RNA, 20 nt, Homo sapiens
cagcucagcucuuuggauca

SEQ ID NO: 2212561 - RNA, 20 nt, Homo sapiens
uguucacagccagacuggca

SEQ ID NO: 2212562 - RNA, 17 nt, Homo sapiens
uucacugaaagacacca

SEQ ID NO: 2212563 - RNA, 16 nt, Homo sapiens
aaagagggagugcauu

SEQ ID NO: 2212564 - RNA, 21 nt, Homo sapiens
auaaugugcuuuauuugcaaa

SEQ ID NO: 2212565 - RNA, 18 nt, Homo sapiens
uaugcccagguaccaccc

SEQ ID NO: 2212566 - RNA, 13 nt, Homo sapiens
ucuauuacagcuu

SEQ ID NO: 2212567 - RNA, 20 nt, Homo sapiens
cuguagauaaagugguuuga

SEQ ID NO: 2212568 - RNA, 13 nt, Homo sapiens
cagcuucucuaca

SEQ ID NO: 2212569 - RNA, 20 nt, Homo sapiens
cucuucccagagucacaagu

SEQ ID NO: 2212570 - RNA, 11 nt, Homo sapiens
ugucucaguga

SEQ ID NO: 2212571 - RNA, 13 nt, Homo sapiens
gcucacugcugau

SEQ ID NO: 2212572 - RNA, 21 nt, Homo sapiens
auucaauaaagcugcugagaa

SEQ ID NO: 2212573 - RNA, 20 nt, Homo sapiens
cacuuuuuguuguucauuau

SEQ ID NO: 2212574 - RNA, 17 nt, Homo sapiens
uaucuuaacacugaaac

SEQ ID NO: 2212575 - RNA, 18 nt, Homo sapiens
aaaacacucgugugccca

SEQ ID NO: 2212576 - RNA, 18 nt, Homo sapiens
gagucuuucuccauuaua

SEQ ID NO: 2212577 - RNA, 9 nt, Homo sapiens
cgcacacac

SEQ ID NO: 2212578 - RNA, 14 nt, Homo sapiens
gcaggacuugccac

SEQ ID NO: 2212579 - RNA, 16 nt, Homo sapiens
gucuugaacaucccaa

SEQ ID NO: 2212580 - RNA, 19 nt, Homo sapiens
ccauuuggaaaucuuuaaa

SEQ ID NO: 2212581 - RNA, 14 nt, Homo sapiens
uaaacuuguuugcu

SEQ ID NO: 2212582 - RNA, 13 nt, Homo sapiens
ugacuugcaaucc

SEQ ID NO: 2212583 - RNA, 13 nt, Homo sapiens
accaugagcucac

SEQ ID NO: 2212584 - RNA, 22 nt, Homo sapiens
aaaauaaaguaccacacauauu

SEQ ID NO: 2212585 - RNA, 21 nt, Homo sapiens
agaacucuagagagccuuaac

SEQ ID NO: 2212586 - RNA, 12 nt, Homo sapiens
uugagccaugag

SEQ ID NO: 2212587 - RNA, 23 nt, Homo sapiens
caccucacacuccuccaaggcac

SEQ ID NO: 2212588 - RNA, 17 nt, Homo sapiens
uugcugaaaaugguauu

SEQ ID NO: 2212589 - RNA, 17 nt, Homo sapiens
gucccaggcugucaggg

SEQ ID NO: 2212590 - RNA, 23 nt, Homo sapiens
ugagugcagccaaaggggagcca

SEQ ID NO: 2212591 - RNA, 20 nt, Homo sapiens
cugcagggacuccaugcugc

SEQ ID NO: 2212592 - RNA, 22 nt, Homo sapiens
ugccuucagcccuaacauagug

SEQ ID NO: 2212593 - RNA, 21 nt, Homo sapiens
cugacacaaugguagcucuga

SEQ ID NO: 2212594 - RNA, 20 nt, Homo sapiens
ugcuauaacuaugaccaugc

SEQ ID NO: 2212595 - RNA, 16 nt, Homo sapiens
cgcugccuggaacacc

SEQ ID NO: 2212596 - RNA, 21 nt, Homo sapiens
ucuguauugggguacaggaau

SEQ ID NO: 2212597 - RNA, 16 nt, Homo sapiens
gcacucuuguacaaaa

SEQ ID NO: 2212598 - RNA, 16 nt, Homo sapiens
uucccaggcuggauac

SEQ ID NO: 2212599 - RNA, 19 nt, Homo sapiens
uaguucuauuucuauccca

SEQ ID NO: 2212600 - RNA, 20 nt, Homo sapiens
acaggugucuagacugccag

SEQ ID NO: 2212601 - RNA, 14 nt, Homo sapiens
uuccauaagcuauu

SEQ ID NO: 2212602 - RNA, 14 nt, Homo sapiens
gaugucaagcaaug

SEQ ID NO: 2212603 - RNA, 19 nt, Homo sapiens
cuggacucaggaugcccag

SEQ ID NO: 2212604 - RNA, 12 nt, Homo sapiens
auauuuacuacu

SEQ ID NO: 2212605 - RNA, 12 nt, Homo sapiens
uuaauuacaaca

SEQ ID NO: 2212606 - RNA, 21 nt, Homo sapiens
ggcaggggcuucuagcugacu

SEQ ID NO: 2212607 - RNA, 19 nt, Homo sapiens
cagcggucuucaggcauuu

SEQ ID NO: 2212608 - RNA, 16 nt, Homo sapiens
gauugugguggugcua

SEQ ID NO: 2212609 - RNA, 23 nt, Homo sapiens
cucugugagggugcugacuggcu

SEQ ID NO: 2212610 - RNA, 15 nt, Homo sapiens
gaugugaguccuguu

SEQ ID NO: 2212611 - RNA, 23 nt, Homo sapiens
aauucucaaaagaaaaggcaaaa

SEQ ID NO: 2212612 - RNA, 15 nt, Homo sapiens
agaugaccuguggua

SEQ ID NO: 2212613 - RNA, 23 nt, Homo sapiens
gaaaugauccccaaguggugaau

SEQ ID NO: 2212614 - RNA, 14 nt, Homo sapiens
guuacuagccucuc

SEQ ID NO: 2212615 - RNA, 17 nt, Homo sapiens
uauauagacaugcacac

SEQ ID NO: 2212616 - RNA, 11 nt, Homo sapiens
cugcugaccaa

SEQ ID NO: 2212617 - RNA, 21 nt, Homo sapiens
aauaugggcacuuuaaaugaa

SEQ ID NO: 2212618 - RNA, 16 nt, Homo sapiens
uucagaauuaaugcau

SEQ ID NO: 2212619 - RNA, 16 nt, Homo sapiens
gaaauacagucuucca

SEQ ID NO: 2212620 - RNA, 16 nt, Homo sapiens
uaaagauuuucugcuu

SEQ ID NO: 2212621 - RNA, 14 nt, Homo sapiens
uccucccaccucag

SEQ ID NO: 2212622 - RNA, 14 nt, Homo sapiens
accauuugcuuaaa

SEQ ID NO: 2212623 - RNA, 13 nt, Homo sapiens
cucauauugugau

SEQ ID NO: 2212624 - RNA, 18 nt, Homo sapiens
cugcuucuccaagcuuuc

SEQ ID NO: 2212625 - RNA, 16 nt, Homo sapiens
gcacacaccgaugugc

SEQ ID NO: 2212626 - RNA, 23 nt, Homo sapiens
aagaagggauaauagacacauca

SEQ ID NO: 2212627 - RNA, 17 nt, Homo sapiens
uuggccugacucaggaa

SEQ ID NO: 2212628 - RNA, 12 nt, Homo sapiens
uccagggccagg

SEQ ID NO: 2212629 - RNA, 19 nt, Homo sapiens
augugagguguugcuaaau

SEQ ID NO: 2212630 - RNA, 17 nt, Homo sapiens
aaaacugaacuugaagc

SEQ ID NO: 2212631 - RNA, 12 nt, Homo sapiens
acauucacaccu

SEQ ID NO: 2212632 - RNA, 19 nt, Homo sapiens
aaggcagcugccucugcuc

SEQ ID NO: 2212633 - RNA, 16 nt, Homo sapiens
ccuuggcuucgugaau

SEQ ID NO: 2212634 - RNA, 21 nt, Homo sapiens
aauuuuaaagaguguguuaua

SEQ ID NO: 2212635 - RNA, 21 nt, Homo sapiens
augcuguuaguaccuacauca

SEQ ID NO: 2212636 - RNA, 23 nt, Homo sapiens
uggguaccaaauuuaagcaagau

SEQ ID NO: 2212637 - RNA, 22 nt, Homo sapiens
ucacccacucugguggccacuu

SEQ ID NO: 2212638 - RNA, 15 nt, Homo sapiens
aguuggugccaagcu

SEQ ID NO: 2212639 - RNA, 17 nt, Homo sapiens
ucuuuucgccguggcug

SEQ ID NO: 2212640 - RNA, 16 nt, Homo sapiens
ugaccaucugugacua

SEQ ID NO: 2212641 - RNA, 16 nt, Homo sapiens
aaggacaaacagugaa

SEQ ID NO: 2212642 - RNA, 14 nt, Homo sapiens
gucccaaccccagu

SEQ ID NO: 2212643 - RNA, 23 nt, Homo sapiens
gacucuuuugagugguaaucaua

SEQ ID NO: 2212644 - RNA, 22 nt, Homo sapiens
gccuccacuuaguuuugggagg

SEQ ID NO: 2212645 - RNA, 21 nt, Homo sapiens
uguacuuuucugguuccaaac

SEQ ID NO: 2212646 - RNA, 21 nt, Homo sapiens
uaggcacuguaguucuaagac

SEQ ID NO: 2212647 - RNA, 13 nt, Homo sapiens
cagcaaaauguga

SEQ ID NO: 2212648 - RNA, 14 nt, Homo sapiens
uucacaaaauauca

SEQ ID NO: 2212649 - RNA, 18 nt, Homo sapiens
agcgugugugaacaaaug

SEQ ID NO: 2212650 - RNA, 24 nt, Homo sapiens
auucuuuccccucagagcucuuau

SEQ ID NO: 2212651 - RNA, 14 nt, Homo sapiens
ccaaucucauggag

SEQ ID NO: 2212652 - RNA, 16 nt, Homo sapiens
acaauuucagcuucau

SEQ ID NO: 2212653 - RNA, 17 nt, Homo sapiens
guuaauuuaaguuuuga

SEQ ID NO: 2212654 - RNA, 18 nt, Homo sapiens
acugaagcugcacagugu

SEQ ID NO: 2212655 - RNA, 15 nt, Homo sapiens
aguguagacuguggc

SEQ ID NO: 2212656 - RNA, 15 nt, Homo sapiens
cuggugcaaguugag

SEQ ID NO: 2212657 - RNA, 14 nt, Homo sapiens
aguggaaaaacaca

SEQ ID NO: 2212658 - RNA, 12 nt, Homo sapiens
uauagggaugag

SEQ ID NO: 2212659 - RNA, 19 nt, Homo sapiens
uucuagugggaaggggugc

SEQ ID NO: 2212660 - RNA, 13 nt, Homo sapiens
auuuuguacaaug

SEQ ID NO: 2212661 - RNA, 18 nt, Homo sapiens
aggacaauaaauuugaug

SEQ ID NO: 2212662 - RNA, 20 nt, Homo sapiens
aaaguuacugauucacugca

SEQ ID NO: 2212663 - RNA, 15 nt, Homo sapiens
cucgcuagcaguggc

SEQ ID NO: 2212664 - RNA, 13 nt, Homo sapiens
cacaaacaugugu

SEQ ID NO: 2212665 - RNA, 18 nt, Homo sapiens
caacagguuuguucucag

SEQ ID NO: 2212666 - RNA, 19 nt, Homo sapiens
agauaaauagaguuccaaa

SEQ ID NO: 2212667 - RNA, 13 nt, Homo sapiens
uauagaauuuuga

SEQ ID NO: 2212668 - RNA, 14 nt, Homo sapiens
uuguuucuugccug

SEQ ID NO: 2212669 - RNA, 13 nt, Homo sapiens
agcugugucugcc

SEQ ID NO: 2212670 - RNA, 18 nt, Homo sapiens
aaccucucuaagccacag

SEQ ID NO: 2212671 - RNA, 16 nt, Homo sapiens
gaaauuauacuuacuu

SEQ ID NO: 2212672 - RNA, 16 nt, Homo sapiens
cuggaguccuugaccg

SEQ ID NO: 2212673 - RNA, 22 nt, Homo sapiens
cauuuuauucacauaugucuua

SEQ ID NO: 2212674 - RNA, 23 nt, Homo sapiens
aucccaugugcccauaagcacag

SEQ ID NO: 2212675 - RNA, 22 nt, Homo sapiens
aagucaggacaucagucugauu

SEQ ID NO: 2212676 - RNA, 17 nt, Homo sapiens
aauguuucugugucauu

SEQ ID NO: 2212677 - RNA, 23 nt, Homo sapiens
uaugaaaaaauccauuaaggguc

SEQ ID NO: 2212678 - RNA, 21 nt, Homo sapiens
ucuagguccccauacuccuau

SEQ ID NO: 2212679 - RNA, 14 nt, Homo sapiens
uaaaugaagugauu

SEQ ID NO: 2212680 - RNA, 14 nt, Homo sapiens
ugcucugccccacc

SEQ ID NO: 2212681 - RNA, 16 nt, Homo sapiens
ucagagaaaacacuuu

SEQ ID NO: 2212682 - RNA, 18 nt, Homo sapiens
ugucacuaaacucucauu

SEQ ID NO: 2212683 - RNA, 22 nt, Homo sapiens
aagaauuauuuugugaugcaaa

SEQ ID NO: 2212684 - RNA, 16 nt, Homo sapiens
aaugccccaguguuau

SEQ ID NO: 2212685 - RNA, 16 nt, Homo sapiens
cugacaacaugcuagg

SEQ ID NO: 2212686 - RNA, 20 nt, Homo sapiens
ugaagauaagaaaugaucuu

SEQ ID NO: 2212687 - RNA, 16 nt, Homo sapiens
aauaugugaucuguga

SEQ ID NO: 2212688 - RNA, 18 nt, Homo sapiens
cuggaauucuucugcaac

SEQ ID NO: 2212689 - RNA, 18 nt, Homo sapiens
acaucagcuugcccuguu

SEQ ID NO: 2212690 - RNA, 18 nt, Homo sapiens
acaccaggccguccuccc

SEQ ID NO: 2212691 - RNA, 22 nt, Homo sapiens
uccuuccagcaaacguacggga

SEQ ID NO: 2212692 - RNA, 20 nt, Homo sapiens
aaaaucacucacaagcaauc

SEQ ID NO: 2212693 - RNA, 14 nt, Homo sapiens
ucacccacugcugc

SEQ ID NO: 2212694 - RNA, 18 nt, Homo sapiens
cuucuucuuagcaccaca

SEQ ID NO: 2212695 - RNA, 18 nt, Homo sapiens
gucugaacaggaugcuga

SEQ ID NO: 2212696 - RNA, 14 nt, Homo sapiens
uuugucaacacaaa

SEQ ID NO: 2212697 - RNA, 20 nt, Homo sapiens
cccucggggauguguccuga

SEQ ID NO: 2212698 - RNA, 23 nt, Homo sapiens
acaguauuucauugccuguguau

SEQ ID NO: 2212699 - RNA, 12 nt, Homo sapiens
cugcacagggau

SEQ ID NO: 2212700 - RNA, 16 nt, Homo sapiens
uucauuuucagauuca

SEQ ID NO: 2212701 - RNA, 14 nt, Homo sapiens
agugccggcugugg

SEQ ID NO: 2212702 - RNA, 17 nt, Homo sapiens
ccugugaagggacacag

SEQ ID NO: 2212703 - RNA, 18 nt, Homo sapiens
ucaguagugccugugauc

SEQ ID NO: 2212704 - RNA, 15 nt, Homo sapiens
aauauuuuaccacug

SEQ ID NO: 2212705 - RNA, 15 nt, Homo sapiens
guggaguuuucauga

SEQ ID NO: 2212706 - RNA, 20 nt, Homo sapiens
agauacacugacuuggugca

SEQ ID NO: 2212707 - RNA, 15 nt, Homo sapiens
ccccaccacauagca

SEQ ID NO: 2212708 - RNA, 21 nt, Homo sapiens
gaugaggucauagcagugcuu

SEQ ID NO: 2212709 - RNA, 15 nt, Homo sapiens
caaggccuccaggga

SEQ ID NO: 2212710 - RNA, 20 nt, Homo sapiens
acuaguuagauucacuuuga

SEQ ID NO: 2212711 - RNA, 19 nt, Homo sapiens
cugggaggcgucuccaagg

SEQ ID NO: 2212712 - RNA, 13 nt, Homo sapiens
aucaagccuguga

SEQ ID NO: 2212713 - RNA, 21 nt, Homo sapiens
cuaguuuaauguggauccaaa

SEQ ID NO: 2212714 - RNA, 12 nt, Homo sapiens
uauuaagugaaa

SEQ ID NO: 2212715 - RNA, 19 nt, Homo sapiens
uuaaacucuggacacucua

SEQ ID NO: 2212716 - RNA, 16 nt, Homo sapiens
uuuccaaugaaggaaa

SEQ ID NO: 2212717 - RNA, 12 nt, Homo sapiens
cuucgauguacu

SEQ ID NO: 2212718 - RNA, 13 nt, Homo sapiens
uccuuccugcugu

SEQ ID NO: 2212719 - RNA, 23 nt, Homo sapiens
uccccccccaggcccucccacca

SEQ ID NO: 2212720 - RNA, 19 nt, Homo sapiens
ugauaccauaugaaugaaa

SEQ ID NO: 2212721 - RNA, 18 nt, Homo sapiens
ucuuguuugucagcaucu

SEQ ID NO: 2212722 - RNA, 17 nt, Homo sapiens
cgacagagccagacugu

SEQ ID NO: 2212723 - RNA, 14 nt, Homo sapiens
ucacagccucugaa

SEQ ID NO: 2212724 - RNA, 19 nt, Homo sapiens
gagucagacagaugugguu

SEQ ID NO: 2212725 - RNA, 12 nt, Homo sapiens
uuggcuggaccc

SEQ ID NO: 2212726 - RNA, 20 nt, Homo sapiens
cuuaauuaccuaagagccac

SEQ ID NO: 2212727 - RNA, 23 nt, Homo sapiens
cugagaaaaaaagugagagaccu

SEQ ID NO: 2212728 - RNA, 14 nt, Homo sapiens
ccugucuccagcug

SEQ ID NO: 2212729 - RNA, 23 nt, Homo sapiens
uacuuuuccgaagcagaauguca

SEQ ID NO: 2212730 - RNA, 19 nt, Homo sapiens
gucucaggaguagucucau

SEQ ID NO: 2212731 - RNA, 12 nt, Homo sapiens
gcuccaagcaca

SEQ ID NO: 2212732 - RNA, 21 nt, Homo sapiens
aggccaagaaagaaaccagac

SEQ ID NO: 2212733 - RNA, 20 nt, Homo sapiens
acuuaugguuggacaccauc

SEQ ID NO: 2212734 - RNA, 16 nt, Homo sapiens
cauaucaauuggcagu

SEQ ID NO: 2212735 - RNA, 22 nt, Homo sapiens
cccguuucuuaaaaaacauaua

SEQ ID NO: 2212736 - RNA, 16 nt, Homo sapiens
cuccaucuaccccuuc

SEQ ID NO: 2212737 - RNA, 22 nt, Homo sapiens
cagggagaauugaaacugagua

SEQ ID NO: 2212738 - RNA, 18 nt, Homo sapiens
ggcaagaguguucuuuuc

SEQ ID NO: 2212739 - RNA, 21 nt, Homo sapiens
aguagcuguaagaauuuccca

SEQ ID NO: 2212740 - RNA, 15 nt, Homo sapiens
ucaauucuagucaua

SEQ ID NO: 2212741 - RNA, 22 nt, Homo sapiens
aggagaccauuuguauuaccau

SEQ ID NO: 2212742 - RNA, 17 nt, Homo sapiens
ggaagagggugauugcu

SEQ ID NO: 2212743 - RNA, 13 nt, Homo sapiens
cauaacuagagua

SEQ ID NO: 2212744 - RNA, 14 nt, Homo sapiens
auacaauacagauc

SEQ ID NO: 2212745 - RNA, 18 nt, Homo sapiens
cuuccacaagagugaauu

SEQ ID NO: 2212746 - RNA, 15 nt, Homo sapiens
auuuccuaugcaaau

SEQ ID NO: 2212747 - RNA, 12 nt, Homo sapiens
uagcucacugaa

SEQ ID NO: 2212748 - RNA, 23 nt, Homo sapiens
ugaaaauuuauuuuuagugauaa

SEQ ID NO: 2212749 - RNA, 14 nt, Homo sapiens
ggaaacaacagcuu

SEQ ID NO: 2212750 - RNA, 15 nt, Homo sapiens
uauguacagaugaug

SEQ ID NO: 2212751 - RNA, 17 nt, Homo sapiens
cuggauucuuaaccaag

SEQ ID NO: 2212752 - RNA, 13 nt, Homo sapiens
accagaaugauuu

SEQ ID NO: 2212753 - RNA, 22 nt, Homo sapiens
uagcuguuucaaaugugcauuu

SEQ ID NO: 2212754 - RNA, 18 nt, Homo sapiens
aucccagauaauggagaa

SEQ ID NO: 2212755 - RNA, 24 nt, Homo sapiens
cuguacuucugugugcaauuguaa

SEQ ID NO: 2212756 - RNA, 15 nt, Homo sapiens
gaauuucacacuguc

SEQ ID NO: 2212757 - RNA, 19 nt, Homo sapiens
aggagaugccacuucucac

SEQ ID NO: 2212758 - RNA, 14 nt, Homo sapiens
acaggcaccugcca

SEQ ID NO: 2212759 - RNA, 15 nt, Homo sapiens
ucaaccccaugagac

SEQ ID NO: 2212760 - RNA, 16 nt, Homo sapiens
ggugugggucagggag

SEQ ID NO: 2212761 - RNA, 20 nt, Homo sapiens
ucagacagguaaaugggcag

SEQ ID NO: 2212762 - RNA, 20 nt, Homo sapiens
aaguguguaugugcauuaaa

SEQ ID NO: 2212763 - RNA, 20 nt, Homo sapiens
ugggauguuauauuugagaa

SEQ ID NO: 2212764 - RNA, 18 nt, Homo sapiens
agccuggagacucgugga

SEQ ID NO: 2212765 - RNA, 18 nt, Homo sapiens
augcuggaaacauucacu

SEQ ID NO: 2212766 - RNA, 21 nt, Homo sapiens
uuccaaccuccccuguacuua

SEQ ID NO: 2212767 - RNA, 21 nt, Homo sapiens
accauuguuccuuaccuuuac

SEQ ID NO: 2212768 - RNA, 13 nt, Homo sapiens
aagacuacugaau

SEQ ID NO: 2212769 - RNA, 15 nt, Homo sapiens
gaucagcuucuugca

SEQ ID NO: 2212770 - RNA, 20 nt, Homo sapiens
uguaagagacaugaauggag

SEQ ID NO: 2212771 - RNA, 19 nt, Homo sapiens
agcucuggguacugaauug

SEQ ID NO: 2212772 - RNA, 11 nt, Homo sapiens
acccauuugaa

SEQ ID NO: 2212773 - RNA, 15 nt, Homo sapiens
caugaaagcaguuua

SEQ ID NO: 2212774 - RNA, 17 nt, Homo sapiens
cuuauguggaagaacug

SEQ ID NO: 2212775 - RNA, 23 nt, Homo sapiens
uaaaagcacacucauccccucac

SEQ ID NO: 2212776 - RNA, 14 nt, Homo sapiens
uucccauuggaugc

SEQ ID NO: 2212777 - RNA, 22 nt, Homo sapiens
cuugaaaacuugcuaagugaaa

SEQ ID NO: 2212778 - RNA, 18 nt, Homo sapiens
cugugcaccuauucugua

SEQ ID NO: 2212779 - RNA, 16 nt, Homo sapiens
uccugacuucaguguc

SEQ ID NO: 2212780 - RNA, 20 nt, Homo sapiens
caggaaggaacucaaggugg

SEQ ID NO: 2212781 - RNA, 14 nt, Homo sapiens
cucuucuuuccauu

SEQ ID NO: 2212782 - RNA, 14 nt, Homo sapiens
aggugcugacaaag

SEQ ID NO: 2212783 - RNA, 13 nt, Homo sapiens
auucauauuccug

SEQ ID NO: 2212784 - RNA, 13 nt, Homo sapiens
acuggggcuugcc

SEQ ID NO: 2212785 - RNA, 17 nt, Homo sapiens
uaaauaugugaaaauga

SEQ ID NO: 2212786 - RNA, 21 nt, Homo sapiens
caauaaaacauuccugugaaa

SEQ ID NO: 2212787 - RNA, 22 nt, Homo sapiens
uggaaacaugcuguacuaaaau

SEQ ID NO: 2212788 - RNA, 23 nt, Homo sapiens
cauuugauaugugaaugcucaua

SEQ ID NO: 2212789 - RNA, 15 nt, Homo sapiens
agacuucucaauaau

SEQ ID NO: 2212790 - RNA, 19 nt, Homo sapiens
cuacugcuaauguugauca

SEQ ID NO: 2212791 - RNA, 14 nt, Homo sapiens
ucuucaaaauguau

SEQ ID NO: 2212792 - RNA, 21 nt, Homo sapiens
cuguggagguugcugguacac

SEQ ID NO: 2212793 - RNA, 21 nt, Homo sapiens
gauucugagcagugccucuug

SEQ ID NO: 2212794 - RNA, 17 nt, Homo sapiens
uaaacaugaagcacaaa

SEQ ID NO: 2212795 - RNA, 21 nt, Homo sapiens
cuuuuaauggugaugggguaa

SEQ ID NO: 2212796 - RNA, 15 nt, Homo sapiens
agcugaccaucaucc

SEQ ID NO: 2212797 - RNA, 18 nt, Homo sapiens
guccaauacacgcgugug

SEQ ID NO: 2212798 - RNA, 16 nt, Homo sapiens
ugaaaagacaaauggg

SEQ ID NO: 2212799 - RNA, 14 nt, Homo sapiens
ccagcccgucuucu

SEQ ID NO: 2212800 - RNA, 15 nt, Homo sapiens
cggcaaccacauguc

SEQ ID NO: 2212801 - RNA, 17 nt, Homo sapiens
aaaauaacaaagcccuu

SEQ ID NO: 2212802 - RNA, 15 nt, Homo sapiens
gagagaagaucacug

SEQ ID NO: 2212803 - RNA, 20 nt, Homo sapiens
aguauaucucuagaugcaaa

SEQ ID NO: 2212804 - RNA, 17 nt, Homo sapiens
gcucaggccacugccca

SEQ ID NO: 2212805 - RNA, 22 nt, Homo sapiens
ccucaugauccacccaccucag

SEQ ID NO: 2212806 - RNA, 16 nt, Homo sapiens
aaauguauccagucug

SEQ ID NO: 2212807 - RNA, 13 nt, Homo sapiens
cuauuauccuucu

SEQ ID NO: 2212808 - RNA, 18 nt, Homo sapiens
uccuacaguacaaucagc

SEQ ID NO: 2212809 - RNA, 20 nt, Homo sapiens
aaauguuuugaaaagaacaa

SEQ ID NO: 2212810 - RNA, 18 nt, Homo sapiens
ucacgcuugccuggucac

SEQ ID NO: 2212811 - RNA, 12 nt, Homo sapiens
ccuugcucugca

SEQ ID NO: 2212812 - RNA, 18 nt, Homo sapiens
accuggggugaauacuua

SEQ ID NO: 2212813 - RNA, 18 nt, Homo sapiens
aaucgcuccaccuugcag

SEQ ID NO: 2212814 - RNA, 16 nt, Homo sapiens
agauaggaaacugaag

SEQ ID NO: 2212815 - RNA, 15 nt, Homo sapiens
ggcacacacugugcc

SEQ ID NO: 2212816 - RNA, 21 nt, Homo sapiens
aaugugcaaauuuugcauuua

SEQ ID NO: 2212817 - RNA, 20 nt, Homo sapiens
gugacccuucagggccagaa

SEQ ID NO: 2212818 - RNA, 14 nt, Homo sapiens
aagauucuguguca

SEQ ID NO: 2212819 - RNA, 13 nt, Homo sapiens
ccauaugugcuac

SEQ ID NO: 2212820 - RNA, 15 nt, Homo sapiens
caaucagcacugaaa

SEQ ID NO: 2212821 - RNA, 14 nt, Homo sapiens
uuggaagugcagag

SEQ ID NO: 2212822 - RNA, 19 nt, Homo sapiens
uccccauucucugccugua

SEQ ID NO: 2212823 - RNA, 23 nt, Homo sapiens
gaaugucuuugguccucuugcca

SEQ ID NO: 2212824 - RNA, 14 nt, Homo sapiens
aauucuacuuugag

SEQ ID NO: 2212825 - RNA, 12 nt, Homo sapiens
cucaugugaucc

SEQ ID NO: 2212826 - RNA, 20 nt, Homo sapiens
aggaagguagcccagcacug

SEQ ID NO: 2212827 - RNA, 21 nt, Homo sapiens
ucgcauggcagccaucaaaga

SEQ ID NO: 2212828 - RNA, 13 nt, Homo sapiens
caugagaagucac

SEQ ID NO: 2212829 - RNA, 19 nt, Homo sapiens
acaaaguaguugucccuuu

SEQ ID NO: 2212830 - RNA, 23 nt, Homo sapiens
cagcguggaugucgaugacuuca

SEQ ID NO: 2212831 - RNA, 17 nt, Homo sapiens
ugggagaagaucucaag

SEQ ID NO: 2212832 - RNA, 22 nt, Homo sapiens
uggcccaaucucugccauauca

SEQ ID NO: 2212833 - RNA, 17 nt, Homo sapiens
uccuacaguggcuguca

SEQ ID NO: 2212834 - RNA, 21 nt, Homo sapiens
agccacuguuuguuuacaaaa

SEQ ID NO: 2212835 - RNA, 13 nt, Homo sapiens
gauaaacaaacaa

SEQ ID NO: 2212836 - RNA, 12 nt, Homo sapiens
ugacacccagac

SEQ ID NO: 2212837 - RNA, 9 nt, Homo sapiens
accaugcug

SEQ ID NO: 2212838 - RNA, 16 nt, Homo sapiens
agugcccagcaugaag

SEQ ID NO: 2212839 - RNA, 22 nt, Homo sapiens
ggaaagacaggcugagcuuucu

SEQ ID NO: 2212840 - RNA, 11 nt, Homo sapiens
cccucaucccc

SEQ ID NO: 2212841 - RNA, 22 nt, Homo sapiens
aggcagauggggcacugaccca

SEQ ID NO: 2212842 - RNA, 15 nt, Homo sapiens
caagaccuaaggguu

SEQ ID NO: 2212843 - RNA, 17 nt, Homo sapiens
aaaauauuuuuucugua

SEQ ID NO: 2212844 - RNA, 18 nt, Homo sapiens
cauucaugaugaacucac

SEQ ID NO: 2212845 - RNA, 22 nt, Homo sapiens
acaguccugggagaaccucagg

SEQ ID NO: 2212846 - RNA, 20 nt, Homo sapiens
aggaggaggcugcccugagg

SEQ ID NO: 2212847 - RNA, 20 nt, Homo sapiens
gugggagucauggacaugaa

SEQ ID NO: 2212848 - RNA, 16 nt, Homo sapiens
aggaaaaugauacgca

SEQ ID NO: 2212849 - RNA, 16 nt, Homo sapiens
agggagcagaugcaau

SEQ ID NO: 2212850 - RNA, 12 nt, Homo sapiens
gagaacugauga

SEQ ID NO: 2212851 - RNA, 21 nt, Homo sapiens
uggacaugaagggaugcugca

SEQ ID NO: 2212852 - RNA, 13 nt, Homo sapiens
gagcuggaggcac

SEQ ID NO: 2212853 - RNA, 22 nt, Homo sapiens
cuguguaagggccagaaauauc

SEQ ID NO: 2212854 - RNA, 20 nt, Homo sapiens
uaguguucauugaugcugcu

SEQ ID NO: 2212855 - RNA, 22 nt, Homo sapiens
cagucacucuagucaaugacau

SEQ ID NO: 2212856 - RNA, 14 nt, Homo sapiens
ugaucucacacaca

SEQ ID NO: 2212857 - RNA, 15 nt, Homo sapiens
gaguacuccaagaca

SEQ ID NO: 2212858 - RNA, 14 nt, Homo sapiens
ucagcuaaacacca

SEQ ID NO: 2212859 - RNA, 16 nt, Homo sapiens
ugaggaaggugcuugc

SEQ ID NO: 2212860 - RNA, 19 nt, Homo sapiens
cacucuuugaucagaaaca

SEQ ID NO: 2212861 - RNA, 23 nt, Homo sapiens
cuuuggauugacucugcauuuga

SEQ ID NO: 2212862 - RNA, 14 nt, Homo sapiens
cuaaaagcuuuaaa

SEQ ID NO: 2212863 - RNA, 20 nt, Homo sapiens
aagauauccacuuaccugag

SEQ ID NO: 2212864 - RNA, 21 nt, Homo sapiens
agauuuuuaucuuaauugcaa

SEQ ID NO: 2212865 - RNA, 21 nt, Homo sapiens
caggaggaucauuugagcuca

SEQ ID NO: 2212866 - RNA, 21 nt, Homo sapiens
cacaauaaauggccagugcug

SEQ ID NO: 2212867 - RNA, 21 nt, Homo sapiens
agaggcggaaaccuugcagca

SEQ ID NO: 2212868 - RNA, 13 nt, Homo sapiens
aggcagugcagug

SEQ ID NO: 2212869 - RNA, 23 nt, Homo sapiens
acuuugagauguugaaauuacau

SEQ ID NO: 2212870 - RNA, 14 nt, Homo sapiens
uguccaguucccag

SEQ ID NO: 2212871 - RNA, 12 nt, Homo sapiens
augaaaggcagg

SEQ ID NO: 2212872 - RNA, 21 nt, Homo sapiens
ccugcucuggagccugcagau

SEQ ID NO: 2212873 - RNA, 14 nt, Homo sapiens
uggaacugcaauga

SEQ ID NO: 2212874 - RNA, 22 nt, Homo sapiens
caucugcuuuucccauugccau

SEQ ID NO: 2212875 - RNA, 15 nt, Homo sapiens
cacuaccccugauga

SEQ ID NO: 2212876 - RNA, 19 nt, Homo sapiens
uggcugauuaucaccaucc

SEQ ID NO: 2212877 - RNA, 18 nt, Homo sapiens
uggagccagccacccuaa

SEQ ID NO: 2212878 - RNA, 12 nt, Homo sapiens
gaaccacauauu

SEQ ID NO: 2212879 - RNA, 15 nt, Homo sapiens
uggcuguggagacaa

SEQ ID NO: 2212880 - RNA, 16 nt, Homo sapiens
ggugaacacuuaguga

SEQ ID NO: 2212881 - RNA, 14 nt, Homo sapiens
cuagccacaucacu

SEQ ID NO: 2212882 - RNA, 21 nt, Homo sapiens
gcucugggccucuuuuugccc

SEQ ID NO: 2212883 - RNA, 22 nt, Homo sapiens
ugaggggcuccuggaaaggcuc

SEQ ID NO: 2212884 - RNA, 18 nt, Homo sapiens
aggcugcacuugugagag

SEQ ID NO: 2212885 - RNA, 14 nt, Homo sapiens
uuccuaacugugau

SEQ ID NO: 2212886 - RNA, 16 nt, Homo sapiens
caugagcgcugaugau

SEQ ID NO: 2212887 - RNA, 17 nt, Homo sapiens
guuucucuuucugcaua

SEQ ID NO: 2212888 - RNA, 12 nt, Homo sapiens
ccacaacaugaa

SEQ ID NO: 2212889 - RNA, 21 nt, Homo sapiens
cuggccgggggaggugggugu

SEQ ID NO: 2212890 - RNA, 14 nt, Homo sapiens
ccuguaaugcacuc

SEQ ID NO: 2212891 - RNA, 17 nt, Homo sapiens
uucccuuugagguugcu

SEQ ID NO: 2212892 - RNA, 14 nt, Homo sapiens
ugcuugccagccag

SEQ ID NO: 2212893 - RNA, 13 nt, Homo sapiens
cucagaacugcaa

SEQ ID NO: 2212894 - RNA, 20 nt, Homo sapiens
augcauuuauagaucauuuc

SEQ ID NO: 2212895 - RNA, 13 nt, Homo sapiens
ggcagcugugaug

SEQ ID NO: 2212896 - RNA, 21 nt, Homo sapiens
gucagcuacuaaugauguuuu

SEQ ID NO: 2212897 - RNA, 22 nt, Homo sapiens
aauccauuugagucugcuccuu

SEQ ID NO: 2212898 - RNA, 18 nt, Homo sapiens
gcacagaaggaaucugug

SEQ ID NO: 2212899 - RNA, 20 nt, Homo sapiens
aaauaacccugggcugucca

SEQ ID NO: 2212900 - RNA, 17 nt, Homo sapiens
guugcccuucuguccaa

SEQ ID NO: 2212901 - RNA, 15 nt, Homo sapiens
cucuuaccuguuauu

SEQ ID NO: 2212902 - RNA, 22 nt, Homo sapiens
caaaggacagauccagggacug

SEQ ID NO: 2212903 - RNA, 16 nt, Homo sapiens
gcuauuuacacuauua

SEQ ID NO: 2212904 - RNA, 15 nt, Homo sapiens
ggccccgucucaggu

SEQ ID NO: 2212905 - RNA, 23 nt, Homo sapiens
ccugggagaaagaccaugcauuu

SEQ ID NO: 2212906 - RNA, 12 nt, Homo sapiens
uagaagucacac

SEQ ID NO: 2212907 - RNA, 13 nt, Homo sapiens
caugcauucacau

SEQ ID NO: 2212908 - RNA, 15 nt, Homo sapiens
ugcuucuugugaaac

SEQ ID NO: 2212909 - RNA, 20 nt, Homo sapiens
cccugaggaaaaguccacaa

SEQ ID NO: 2212910 - RNA, 17 nt, Homo sapiens
uuuugccucaccuaaua

SEQ ID NO: 2212911 - RNA, 22 nt, Homo sapiens
uuuauccacagaaacauuuuca

SEQ ID NO: 2212912 - RNA, 15 nt, Homo sapiens
uuugaggguguauau

SEQ ID NO: 2212913 - RNA, 21 nt, Homo sapiens
ucuggcauuuucuguuccagg

SEQ ID NO: 2212914 - RNA, 17 nt, Homo sapiens
gacaggucauccuugcc

SEQ ID NO: 2212915 - RNA, 13 nt, Homo sapiens
agaguguuuaccu

SEQ ID NO: 2212916 - RNA, 20 nt, Homo sapiens
uuaaaaaaaguauauauucu

SEQ ID NO: 2212917 - RNA, 13 nt, Homo sapiens
ugaacugugugua

SEQ ID NO: 2212918 - RNA, 16 nt, Homo sapiens
augcugaauacuccuc

SEQ ID NO: 2212919 - RNA, 13 nt, Homo sapiens
ugcuuccagugua

SEQ ID NO: 2212920 - RNA, 13 nt, Homo sapiens
uaagaugccaugu

SEQ ID NO: 2212921 - RNA, 12 nt, Homo sapiens
caaacagugcac

SEQ ID NO: 2212922 - RNA, 12 nt, Homo sapiens
ccaccagugaaa

SEQ ID NO: 2212923 - RNA, 17 nt, Homo sapiens
uauauuugaauaucauu

SEQ ID NO: 2212924 - RNA, 15 nt, Homo sapiens
gaaagacaggcugag

SEQ ID NO: 2212925 - RNA, 19 nt, Homo sapiens
guuuuuuauuaugcauuau

SEQ ID NO: 2212926 - RNA, 14 nt, Homo sapiens
aaauggcuguaaaa

SEQ ID NO: 2212927 - RNA, 11 nt, Homo sapiens
accaaccuggg

SEQ ID NO: 2212928 - RNA, 16 nt, Homo sapiens
cagaguacaaauccaa

SEQ ID NO: 2212929 - RNA, 14 nt, Homo sapiens
ccugugauguccca

SEQ ID NO: 2212930 - RNA, 11 nt, Homo sapiens
uguagacaugg

SEQ ID NO: 2212931 - RNA, 17 nt, Homo sapiens
uuccccuucggucuuaa

SEQ ID NO: 2212932 - RNA, 20 nt, Homo sapiens
gcauuccagccccuauguua

SEQ ID NO: 2212933 - RNA, 15 nt, Homo sapiens
ucucagagcauuuca

SEQ ID NO: 2212934 - RNA, 21 nt, Homo sapiens
cccuggggccuguacaaaagg

SEQ ID NO: 2212935 - RNA, 22 nt, Homo sapiens
gaaccccaccucccucccaccu

SEQ ID NO: 2212936 - RNA, 18 nt, Homo sapiens
acauuccccucccaccuc

SEQ ID NO: 2212937 - RNA, 14 nt, Homo sapiens
gaacagcugugagc

SEQ ID NO: 2212938 - RNA, 14 nt, Homo sapiens
gcccaccagugacu

SEQ ID NO: 2212939 - RNA, 12 nt, Homo sapiens
aacaauucagug

SEQ ID NO: 2212940 - RNA, 18 nt, Homo sapiens
agcuccuucaaugcaaag

SEQ ID NO: 2212941 - RNA, 15 nt, Homo sapiens
cccucgcccaucagu

SEQ ID NO: 2212942 - RNA, 14 nt, Homo sapiens
cuguuggugggacc

SEQ ID NO: 2212943 - RNA, 23 nt, Homo sapiens
aguuacauuaaaauaaaccaaau

SEQ ID NO: 2212944 - RNA, 22 nt, Homo sapiens
ggggagcccccucuuccacuca

SEQ ID NO: 2212945 - RNA, 19 nt, Homo sapiens
ucugucucucugucucucu

SEQ ID NO: 2212946 - RNA, 18 nt, Homo sapiens
uaucaaaaugaaugccag

SEQ ID NO: 2212947 - RNA, 19 nt, Homo sapiens
uacuccugaggaugcuacu

SEQ ID NO: 2212948 - RNA, 19 nt, Homo sapiens
uauagguuuccacugccaa

SEQ ID NO: 2212949 - RNA, 16 nt, Homo sapiens
uucuaggaggucuguu

SEQ ID NO: 2212950 - RNA, 19 nt, Homo sapiens
guugucuacaccaaugccc

SEQ ID NO: 2212951 - RNA, 21 nt, Homo sapiens
uuggagccaauguguggcuca

SEQ ID NO: 2212952 - RNA, 17 nt, Homo sapiens
gaguaaacuauucuaua

SEQ ID NO: 2212953 - RNA, 16 nt, Homo sapiens
acuucauucacauuca

SEQ ID NO: 2212954 - RNA, 11 nt, Homo sapiens
cuuagcugccu

SEQ ID NO: 2212955 - RNA, 14 nt, Homo sapiens
cagaauucaucuga

SEQ ID NO: 2212956 - RNA, 14 nt, Homo sapiens
agccaggugcugug

SEQ ID NO: 2212957 - RNA, 23 nt, Homo sapiens
auuuuaugcacaccuaagcccaa

SEQ ID NO: 2212958 - RNA, 18 nt, Homo sapiens
ugcaggauguucagggag

SEQ ID NO: 2212959 - RNA, 17 nt, Homo sapiens
ugaugaggcagaugccu

SEQ ID NO: 2212960 - RNA, 19 nt, Homo sapiens
agugauuguuaugccuugc

SEQ ID NO: 2212961 - RNA, 21 nt, Homo sapiens
cuggugaggguccucuuccuc

SEQ ID NO: 2212962 - RNA, 21 nt, Homo sapiens
ugagcauuguggcugucagca

SEQ ID NO: 2212963 - RNA, 17 nt, Homo sapiens
ugcuagagguugcagca

SEQ ID NO: 2212964 - RNA, 22 nt, Homo sapiens
aaacacccacauaccuggccca

SEQ ID NO: 2212965 - RNA, 18 nt, Homo sapiens
ccaaucccauuccugggc

SEQ ID NO: 2212966 - RNA, 18 nt, Homo sapiens
ggagccucccccucagau

SEQ ID NO: 2212967 - RNA, 15 nt, Homo sapiens
auguccuauguauau

SEQ ID NO: 2212968 - RNA, 15 nt, Homo sapiens
uuuuagucauucugc

SEQ ID NO: 2212969 - RNA, 13 nt, Homo sapiens
gcuagaaccugga

SEQ ID NO: 2212970 - RNA, 15 nt, Homo sapiens
aguccaggagcucag

SEQ ID NO: 2212971 - RNA, 14 nt, Homo sapiens
cccugagcugccac

SEQ ID NO: 2212972 - RNA, 17 nt, Homo sapiens
ccugacacccugggcuu

SEQ ID NO: 2212973 - RNA, 13 nt, Homo sapiens
gcccccacugacc

SEQ ID NO: 2212974 - RNA, 14 nt, Homo sapiens
uaacuuauauugaa

SEQ ID NO: 2212975 - RNA, 14 nt, Homo sapiens
cagugcaugcaugu

SEQ ID NO: 2212976 - RNA, 18 nt, Homo sapiens
gaucaacgccucacugaa

SEQ ID NO: 2212977 - RNA, 22 nt, Homo sapiens
ggcaauuucaccaccaaaugcc

SEQ ID NO: 2212978 - RNA, 23 nt, Homo sapiens
gaagaggagucaaguaauggagg

SEQ ID NO: 2212979 - RNA, 15 nt, Homo sapiens
auugcagaguacugg

SEQ ID NO: 2212980 - RNA, 15 nt, Homo sapiens
uacguaucagcggcc

SEQ ID NO: 2212981 - RNA, 17 nt, Homo sapiens
ugaaagucaaauuuacu

SEQ ID NO: 2212982 - RNA, 20 nt, Homo sapiens
uuccaugucuccuuuaagag

SEQ ID NO: 2212983 - RNA, 18 nt, Homo sapiens
cuaauaaaauauaaucua

SEQ ID NO: 2212984 - RNA, 16 nt, Homo sapiens
uugaacacaccucucu

SEQ ID NO: 2212985 - RNA, 12 nt, Homo sapiens
gggcccagugcu

SEQ ID NO: 2212986 - RNA, 15 nt, Homo sapiens
aaaucucacaaauga

SEQ ID NO: 2212987 - RNA, 16 nt, Homo sapiens
ugaaggauuacucucc

SEQ ID NO: 2212988 - RNA, 18 nt, Homo sapiens
gacaauacagaacccauu

SEQ ID NO: 2212989 - RNA, 22 nt, Homo sapiens
aaguccagcugggaagcccuuu

SEQ ID NO: 2212990 - RNA, 22 nt, Homo sapiens
ugaagaacaucccaagccagaa

SEQ ID NO: 2212991 - RNA, 19 nt, Homo sapiens
guuaaccaggaagugcuua

SEQ ID NO: 2212992 - RNA, 17 nt, Homo sapiens
ucuggauggcaccagag

SEQ ID NO: 2212993 - RNA, 23 nt, Homo sapiens
caacaaagauugagaagccaugu

SEQ ID NO: 2212994 - RNA, 20 nt, Homo sapiens
ugucaagccugugcaaaaaa

SEQ ID NO: 2212995 - RNA, 22 nt, Homo sapiens
agagaacuuucggagccugccu

SEQ ID NO: 2212996 - RNA, 20 nt, Homo sapiens
agagugcaauggcaccaucu

SEQ ID NO: 2212997 - RNA, 16 nt, Homo sapiens
ugugacaaugguuuca

SEQ ID NO: 2212998 - RNA, 21 nt, Homo sapiens
aacuacuuaucucuaaaccau

SEQ ID NO: 2212999 - RNA, 22 nt, Homo sapiens
gcaggaguuugugguaacuuga

SEQ ID NO: 2213000 - RNA, 23 nt, Homo sapiens
augacaccuccauuucucuccag

SEQ ID NO: 2213001 - RNA, 18 nt, Homo sapiens
gagcacaagaaggccagc

SEQ ID NO: 2213002 - RNA, 19 nt, Homo sapiens
ugagugcccaacccuaucc

SEQ ID NO: 2213003 - RNA, 15 nt, Homo sapiens
gcacuugccuggaau

SEQ ID NO: 2213004 - RNA, 19 nt, Homo sapiens
gccuuucugggagcagaaa

SEQ ID NO: 2213005 - RNA, 18 nt, Homo sapiens
acaugguaucucuuucuc

SEQ ID NO: 2213006 - RNA, 15 nt, Homo sapiens
gaaugcuccauucag

SEQ ID NO: 2213007 - RNA, 21 nt, Homo sapiens
cagaucugauuuguaacccac

SEQ ID NO: 2213008 - RNA, 20 nt, Homo sapiens
agcaucauuaaugcacaucu

SEQ ID NO: 2213009 - RNA, 13 nt, Homo sapiens
cuaguugugauca

SEQ ID NO: 2213010 - RNA, 13 nt, Homo sapiens
caagauguguucu

SEQ ID NO: 2213011 - RNA, 20 nt, Homo sapiens
acaaauccuugaauguucuc

SEQ ID NO: 2213012 - RNA, 17 nt, Homo sapiens
aaauuauugcaagcauu

SEQ ID NO: 2213013 - RNA, 21 nt, Homo sapiens
uugaaaaaaacuucauucucg

SEQ ID NO: 2213014 - RNA, 16 nt, Homo sapiens
aguaguaugaugauac

SEQ ID NO: 2213015 - RNA, 11 nt, Homo sapiens
ccacuguguuu

SEQ ID NO: 2213016 - RNA, 17 nt, Homo sapiens
gagcugagaucaugcca

SEQ ID NO: 2213017 - RNA, 17 nt, Homo sapiens
auccgucaccagaauua

SEQ ID NO: 2213018 - RNA, 14 nt, Homo sapiens
ccagggaaacaaag

SEQ ID NO: 2213019 - RNA, 21 nt, Homo sapiens
caacaaauugcccuuuagucu

SEQ ID NO: 2213020 - RNA, 14 nt, Homo sapiens
uuauaaaaguuuau

SEQ ID NO: 2213021 - RNA, 17 nt, Homo sapiens
caaagugagacuccguc

SEQ ID NO: 2213022 - RNA, 15 nt, Homo sapiens
uccuuccucuuggcu

SEQ ID NO: 2213023 - RNA, 14 nt, Homo sapiens
ccaucaacaagucu

SEQ ID NO: 2213024 - RNA, 15 nt, Homo sapiens
accauccaggcauau

SEQ ID NO: 2213025 - RNA, 18 nt, Homo sapiens
caggaagagaggacccau

SEQ ID NO: 2213026 - RNA, 16 nt, Homo sapiens
guauucauauauugca

SEQ ID NO: 2213027 - RNA, 23 nt, Homo sapiens
agcggcuggcagcccaccccuca

SEQ ID NO: 2213028 - RNA, 19 nt, Homo sapiens
gucggguucucccaugauu

SEQ ID NO: 2213029 - RNA, 23 nt, Homo sapiens
gucagacccauaaaccaccuccc

SEQ ID NO: 2213030 - RNA, 17 nt, Homo sapiens
caaagguuuauuccaga

SEQ ID NO: 2213031 - RNA, 19 nt, Homo sapiens
aagcaauaauggucccauc

SEQ ID NO: 2213032 - RNA, 19 nt, Homo sapiens
cugggguuggaagugcaga

SEQ ID NO: 2213033 - RNA, 15 nt, Homo sapiens
agggcaggcacaugu

SEQ ID NO: 2213034 - RNA, 14 nt, Homo sapiens
agugagagcacaaa

SEQ ID NO: 2213035 - RNA, 16 nt, Homo sapiens
aacacuuggaacagug

SEQ ID NO: 2213036 - RNA, 14 nt, Homo sapiens
cuccuuugcacugu

SEQ ID NO: 2213037 - RNA, 18 nt, Homo sapiens
gccuaaaacacuugccaa

SEQ ID NO: 2213038 - RNA, 12 nt, Homo sapiens
gaagggucuguu

SEQ ID NO: 2213039 - RNA, 20 nt, Homo sapiens
ggacaaggaugaucuaggaa

SEQ ID NO: 2213040 - RNA, 21 nt, Homo sapiens
uugguacuuauuacugcuaag

SEQ ID NO: 2213041 - RNA, 19 nt, Homo sapiens
cagagccuuuuuaccuggc

SEQ ID NO: 2213042 - RNA, 19 nt, Homo sapiens
uacaaauuacauuacugaa

SEQ ID NO: 2213043 - RNA, 23 nt, Homo sapiens
uaguaauuuauugucugucuaca

SEQ ID NO: 2213044 - RNA, 22 nt, Homo sapiens
aauaaaagaauaguugccaagg

SEQ ID NO: 2213045 - RNA, 13 nt, Homo sapiens
agaaacagacugc

SEQ ID NO: 2213046 - RNA, 17 nt, Homo sapiens
aaaucuauagaacugaa

SEQ ID NO: 2213047 - RNA, 18 nt, Homo sapiens
cugaaacagccagaucuc

SEQ ID NO: 2213048 - RNA, 20 nt, Homo sapiens
ucuuucugauaaugcauuag

SEQ ID NO: 2213049 - RNA, 15 nt, Homo sapiens
auugaaugugaaaca

SEQ ID NO: 2213050 - RNA, 16 nt, Homo sapiens
cuugggggucaggggg

SEQ ID NO: 2213051 - RNA, 18 nt, Homo sapiens
ucagugugcuaaccucac

SEQ ID NO: 2213052 - RNA, 15 nt, Homo sapiens
ugaauuucuaaaaaa

SEQ ID NO: 2213053 - RNA, 22 nt, Homo sapiens
auuaugcaucugcuacuguguc

SEQ ID NO: 2213054 - RNA, 23 nt, Homo sapiens
agguuugggauguauauugcuau

SEQ ID NO: 2213055 - RNA, 21 nt, Homo sapiens
cuucgaggagauaaacugaaa

SEQ ID NO: 2213056 - RNA, 14 nt, Homo sapiens
gaacuuacacugua

SEQ ID NO: 2213057 - RNA, 12 nt, Homo sapiens
gugcaugcaguu

SEQ ID NO: 2213058 - RNA, 11 nt, Homo sapiens
agccccugaaa

SEQ ID NO: 2213059 - RNA, 18 nt, Homo sapiens
cagaaauacauauuucca

SEQ ID NO: 2213060 - RNA, 22 nt, Homo sapiens
uggccccacccuuuccucuuaa

SEQ ID NO: 2213061 - RNA, 15 nt, Homo sapiens
uucccuaucacugaa

SEQ ID NO: 2213062 - RNA, 16 nt, Homo sapiens
auuacggggugaccuu

SEQ ID NO: 2213063 - RNA, 22 nt, Homo sapiens
uuauuggcaauaccuagugaua

SEQ ID NO: 2213064 - RNA, 13 nt, Homo sapiens
ugaggaggacaag

SEQ ID NO: 2213065 - RNA, 18 nt, Homo sapiens
gcucaaagauguacugag

SEQ ID NO: 2213066 - RNA, 23 nt, Homo sapiens
uaauacaaaggugcuaauuaaua

SEQ ID NO: 2213067 - RNA, 15 nt, Homo sapiens
caagugaaggagcug

SEQ ID NO: 2213068 - RNA, 15 nt, Homo sapiens
gugaccaaaucagug

SEQ ID NO: 2213069 - RNA, 20 nt, Homo sapiens
gcuuuucuaaucugcagugg

SEQ ID NO: 2213070 - RNA, 17 nt, Homo sapiens
caguuugaaaagacaaa

SEQ ID NO: 2213071 - RNA, 20 nt, Homo sapiens
gcaaauacaggaguuuucac

SEQ ID NO: 2213072 - RNA, 12 nt, Homo sapiens
uggcaccugcag

SEQ ID NO: 2213073 - RNA, 21 nt, Homo sapiens
ucagcuagauuuguguccaca

SEQ ID NO: 2213074 - RNA, 16 nt, Homo sapiens
ugguuccuguucacuc

SEQ ID NO: 2213075 - RNA, 21 nt, Homo sapiens
cuuccccucugcggcuuucac

SEQ ID NO: 2213076 - RNA, 15 nt, Homo sapiens
ugaagccagauccac

SEQ ID NO: 2213077 - RNA, 16 nt, Homo sapiens
cccaucccaucccauc

SEQ ID NO: 2213078 - RNA, 22 nt, Homo sapiens
gccauuuaaguaucuugugcuu

SEQ ID NO: 2213079 - RNA, 13 nt, Homo sapiens
auccgcaucucaa

SEQ ID NO: 2213080 - RNA, 14 nt, Homo sapiens
agucaacaaacuau

SEQ ID NO: 2213081 - RNA, 14 nt, Homo sapiens
uacuaucaugucaa

SEQ ID NO: 2213082 - RNA, 14 nt, Homo sapiens
ccacagauuaucaa

SEQ ID NO: 2213083 - RNA, 22 nt, Homo sapiens
ugaaucccaucaggcuguuauu

SEQ ID NO: 2213084 - RNA, 15 nt, Homo sapiens
ucucacagcauuugc

SEQ ID NO: 2213085 - RNA, 17 nt, Homo sapiens
gguguguguuacauaca

SEQ ID NO: 2213086 - RNA, 16 nt, Homo sapiens
gcucuucuuccucacc

SEQ ID NO: 2213087 - RNA, 15 nt, Homo sapiens
aggaguucacuucau

SEQ ID NO: 2213088 - RNA, 23 nt, Homo sapiens
acucggcccagggccgucaagga

SEQ ID NO: 2213089 - RNA, 23 nt, Homo sapiens
agacccuuuccuccaaacccaac

SEQ ID NO: 2213090 - RNA, 17 nt, Homo sapiens
ucaauacaaaaagccaa

SEQ ID NO: 2213091 - RNA, 14 nt, Homo sapiens
aaaagaacugucuc

SEQ ID NO: 2213092 - RNA, 16 nt, Homo sapiens
uuccccagcugaucau

SEQ ID NO: 2213093 - RNA, 12 nt, Homo sapiens
gaguaacacaua

SEQ ID NO: 2213094 - RNA, 18 nt, Homo sapiens
ucaaauuuuuuguagaca

SEQ ID NO: 2213095 - RNA, 18 nt, Homo sapiens
caaaagagcccaaaugac

SEQ ID NO: 2213096 - RNA, 15 nt, Homo sapiens
uuccaucuuacauua

SEQ ID NO: 2213097 - RNA, 13 nt, Homo sapiens
cauacugcuggag

SEQ ID NO: 2213098 - RNA, 15 nt, Homo sapiens
cccaucgcuggaaaa

SEQ ID NO: 2213099 - RNA, 19 nt, Homo sapiens
uagaaccuuaaagaaccau

SEQ ID NO: 2213100 - RNA, 18 nt, Homo sapiens
agaaaaaaacaugaauuu

SEQ ID NO: 2213101 - RNA, 23 nt, Homo sapiens
ucaagaaaugaaugcuccaugaa

SEQ ID NO: 2213102 - RNA, 12 nt, Homo sapiens
aaagaguaugua

SEQ ID NO: 2213103 - RNA, 16 nt, Homo sapiens
aacugcccccacuguc

SEQ ID NO: 2213104 - RNA, 12 nt, Homo sapiens
acuugagcaugu

SEQ ID NO: 2213105 - RNA, 20 nt, Homo sapiens
uucagaaaagaugugcagau

SEQ ID NO: 2213106 - RNA, 17 nt, Homo sapiens
uuugcccaaaacuguca

SEQ ID NO: 2213107 - RNA, 22 nt, Homo sapiens
aagcuuguauuaucagugaaua

SEQ ID NO: 2213108 - RNA, 19 nt, Homo sapiens
auuugucugaaacauuuca

SEQ ID NO: 2213109 - RNA, 15 nt, Homo sapiens
accauggacaugugu

SEQ ID NO: 2213110 - RNA, 21 nt, Homo sapiens
ggacuccccaggccaggccac

SEQ ID NO: 2213111 - RNA, 19 nt, Homo sapiens
ugcuuuugggagacuggaa

SEQ ID NO: 2213112 - RNA, 14 nt, Homo sapiens
uaggccuaccugau

SEQ ID NO: 2213113 - RNA, 11 nt, Homo sapiens
aagagggaugu

SEQ ID NO: 2213114 - RNA, 19 nt, Homo sapiens
uggcaacaaacugcacaug

SEQ ID NO: 2213115 - RNA, 22 nt, Homo sapiens
ucugccagaagacucacugugu

SEQ ID NO: 2213116 - RNA, 15 nt, Homo sapiens
acauaucauuuguga

SEQ ID NO: 2213117 - RNA, 19 nt, Homo sapiens
caggagauggguccagggg

SEQ ID NO: 2213118 - RNA, 15 nt, Homo sapiens
ccggguccccagcuc

SEQ ID NO: 2213119 - RNA, 18 nt, Homo sapiens
uggggcccaaguugcagu

SEQ ID NO: 2213120 - RNA, 21 nt, Homo sapiens
accccaggcaaggaugucuga

SEQ ID NO: 2213121 - RNA, 15 nt, Homo sapiens
ucagcucugccuugc

SEQ ID NO: 2213122 - RNA, 18 nt, Homo sapiens
ccuuuggaacaauuauuu

SEQ ID NO: 2213123 - RNA, 17 nt, Homo sapiens
uguuuaggugccucuac

SEQ ID NO: 2213124 - RNA, 19 nt, Homo sapiens
cauagcagcagugcauggg

SEQ ID NO: 2213125 - RNA, 17 nt, Homo sapiens
aucuggaaggacaucua

SEQ ID NO: 2213126 - RNA, 22 nt, Homo sapiens
gcacugcagucugcagaguucu

SEQ ID NO: 2213127 - RNA, 13 nt, Homo sapiens
auucccacugcac

SEQ ID NO: 2213128 - RNA, 13 nt, Homo sapiens
ugcaacacauuca

SEQ ID NO: 2213129 - RNA, 12 nt, Homo sapiens
auguaagccugg

SEQ ID NO: 2213130 - RNA, 15 nt, Homo sapiens
aguuguuauauucau

SEQ ID NO: 2213131 - RNA, 17 nt, Homo sapiens
uccugccaguguggaac

SEQ ID NO: 2213132 - RNA, 21 nt, Homo sapiens
gaauauuuauuaccucugaua

SEQ ID NO: 2213133 - RNA, 17 nt, Homo sapiens
acaaagacaugcuuucc

SEQ ID NO: 2213134 - RNA, 23 nt, Homo sapiens
ggauccuguaggcuaaaaggcuu

SEQ ID NO: 2213135 - RNA, 17 nt, Homo sapiens
auaaacacuagacugua

SEQ ID NO: 2213136 - RNA, 19 nt, Homo sapiens
ccuucucggagacccauug

SEQ ID NO: 2213137 - RNA, 18 nt, Homo sapiens
cagucugugggagcucag

SEQ ID NO: 2213138 - RNA, 18 nt, Homo sapiens
agcagcugcuuugcucua

SEQ ID NO: 2213139 - RNA, 23 nt, Homo sapiens
gcgugagcuggucaguugccaaa

SEQ ID NO: 2213140 - RNA, 19 nt, Homo sapiens
auguagcauuaugcaauua

SEQ ID NO: 2213141 - RNA, 18 nt, Homo sapiens
uaaugcuaaucuugugaa

SEQ ID NO: 2213142 - RNA, 15 nt, Homo sapiens
uccugggauguggcu

SEQ ID NO: 2213143 - RNA, 13 nt, Homo sapiens
ucuaaacuuuccc

SEQ ID NO: 2213144 - RNA, 13 nt, Homo sapiens
uacacaacuaguu

SEQ ID NO: 2213145 - RNA, 19 nt, Homo sapiens
ccagugguaccagcucacu

SEQ ID NO: 2213146 - RNA, 17 nt, Homo sapiens
gaucacgccacugcacu

SEQ ID NO: 2213147 - RNA, 18 nt, Homo sapiens
agaagcucccagaugcug

SEQ ID NO: 2213148 - RNA, 23 nt, Homo sapiens
acucaguggacacucagaccagc

SEQ ID NO: 2213149 - RNA, 21 nt, Homo sapiens
agccagcaaguaagcuagcca

SEQ ID NO: 2213150 - RNA, 13 nt, Homo sapiens
ccucuuaucucau

SEQ ID NO: 2213151 - RNA, 11 nt, Homo sapiens
uccuugaacaa

SEQ ID NO: 2213152 - RNA, 23 nt, Homo sapiens
auugaacuguaccaugugcuaca

SEQ ID NO: 2213153 - RNA, 14 nt, Homo sapiens
auggugcaaaaaug

SEQ ID NO: 2213154 - RNA, 21 nt, Homo sapiens
ucuauuuuaagacugauuuua

SEQ ID NO: 2213155 - RNA, 18 nt, Homo sapiens
gcucuggagcccacugua

SEQ ID NO: 2213156 - RNA, 21 nt, Homo sapiens
gcccacgccuguaaucccagc

SEQ ID NO: 2213157 - RNA, 17 nt, Homo sapiens
ucauugcaucauuuaca

SEQ ID NO: 2213158 - RNA, 20 nt, Homo sapiens
ucuaacuggacaugaaggaa

SEQ ID NO: 2213159 - RNA, 12 nt, Homo sapiens
acaacaaacuug

SEQ ID NO: 2213160 - RNA, 19 nt, Homo sapiens
acuaagaugaaaugcacug

SEQ ID NO: 2213161 - RNA, 20 nt, Homo sapiens
aagggccagcuggaggugaa

SEQ ID NO: 2213162 - RNA, 10 nt, Homo sapiens
acccuuccag

SEQ ID NO: 2213163 - RNA, 16 nt, Homo sapiens
gaagugguccaucucc

SEQ ID NO: 2213164 - RNA, 14 nt, Homo sapiens
auucuacagugaug

SEQ ID NO: 2213165 - RNA, 19 nt, Homo sapiens
cacuucgagcacuguccag

SEQ ID NO: 2213166 - RNA, 17 nt, Homo sapiens
uggccagacaagaagac

SEQ ID NO: 2213167 - RNA, 21 nt, Homo sapiens
ggcuaccucagaaagauuuga

SEQ ID NO: 2213168 - RNA, 17 nt, Homo sapiens
ucacaaauuucacuuau

SEQ ID NO: 2213169 - RNA, 21 nt, Homo sapiens
ugcucaauaaggcagugcagu

SEQ ID NO: 2213170 - RNA, 15 nt, Homo sapiens
uuuauucaccaucau

SEQ ID NO: 2213171 - RNA, 13 nt, Homo sapiens
aagugugcaaaau

SEQ ID NO: 2213172 - RNA, 21 nt, Homo sapiens
aacucugagaucuaaggaugu

SEQ ID NO: 2213173 - RNA, 17 nt, Homo sapiens
cauuaauguugauuucu

SEQ ID NO: 2213174 - RNA, 18 nt, Homo sapiens
agcaaaacaacggaugaa

SEQ ID NO: 2213175 - RNA, 17 nt, Homo sapiens
auccucacucauuccca

SEQ ID NO: 2213176 - RNA, 14 nt, Homo sapiens
cuucaugcagguga

SEQ ID NO: 2213177 - RNA, 14 nt, Homo sapiens
cacaagugcacaga

SEQ ID NO: 2213178 - RNA, 14 nt, Homo sapiens
uuacuugacuugaa

SEQ ID NO: 2213179 - RNA, 14 nt, Homo sapiens
cagucaucucauga

SEQ ID NO: 2213180 - RNA, 15 nt, Homo sapiens
uuauuuucacuccuu

SEQ ID NO: 2213181 - RNA, 14 nt, Homo sapiens
cuguauggcacuua

SEQ ID NO: 2213182 - RNA, 12 nt, Homo sapiens
gaggauugccuu

SEQ ID NO: 2213183 - RNA, 13 nt, Homo sapiens
aagcuaaccugcc

SEQ ID NO: 2213184 - RNA, 19 nt, Homo sapiens
aauguauuuuucacaaagg

SEQ ID NO: 2213185 - RNA, 18 nt, Homo sapiens
ucuucucccaacucagcc

SEQ ID NO: 2213186 - RNA, 17 nt, Homo sapiens
aucugccagaccugcau

SEQ ID NO: 2213187 - RNA, 19 nt, Homo sapiens
acucuugggacauccuguc

SEQ ID NO: 2213188 - RNA, 16 nt, Homo sapiens
ccaaaagaaacugaca

SEQ ID NO: 2213189 - RNA, 22 nt, Homo sapiens
uuccccaguacugagguggugg

SEQ ID NO: 2213190 - RNA, 12 nt, Homo sapiens
ucagggggccag

SEQ ID NO: 2213191 - RNA, 22 nt, Homo sapiens
gaagaagagaaaauuugaaaau

SEQ ID NO: 2213192 - RNA, 16 nt, Homo sapiens
agccacagcaaaaagu

SEQ ID NO: 2213193 - RNA, 20 nt, Homo sapiens
uaacugucuuaguacaccau

SEQ ID NO: 2213194 - RNA, 20 nt, Homo sapiens
cccaagagcuuccagagcuc

SEQ ID NO: 2213195 - RNA, 22 nt, Homo sapiens
cagggaauggagaaugguguuc

SEQ ID NO: 2213196 - RNA, 13 nt, Homo sapiens
auaaaucauaaaa

SEQ ID NO: 2213197 - RNA, 13 nt, Homo sapiens
aaucuucauuucu

SEQ ID NO: 2213198 - RNA, 13 nt, Homo sapiens
uaaaaucaauaaa

SEQ ID NO: 2213199 - RNA, 23 nt, Homo sapiens
uugauggugcuccccuuccugcc

SEQ ID NO: 2213200 - RNA, 12 nt, Homo sapiens
cuguucuacuuu

SEQ ID NO: 2213201 - RNA, 19 nt, Homo sapiens
aucccauugucaccuaacu

SEQ ID NO: 2213202 - RNA, 14 nt, Homo sapiens
ccaggggcugccuc

SEQ ID NO: 2213203 - RNA, 13 nt, Homo sapiens
ccaccagcucaaa

SEQ ID NO: 2213204 - RNA, 18 nt, Homo sapiens
cauuguagaaaagcuaua

SEQ ID NO: 2213205 - RNA, 15 nt, Homo sapiens
cacaacguccccuca

SEQ ID NO: 2213206 - RNA, 14 nt, Homo sapiens
guucacagugcaua

SEQ ID NO: 2213207 - RNA, 21 nt, Homo sapiens
gcaugcccccuccugcaaggg

SEQ ID NO: 2213208 - RNA, 20 nt, Homo sapiens
uucaucugugggaugcugaa

SEQ ID NO: 2213209 - RNA, 21 nt, Homo sapiens
aggaaggcuucugugucaaug

SEQ ID NO: 2213210 - RNA, 14 nt, Homo sapiens
aaggcauguacaaa

SEQ ID NO: 2213211 - RNA, 20 nt, Homo sapiens
gucuggagugguaacagcuc

SEQ ID NO: 2213212 - RNA, 20 nt, Homo sapiens
uccugacugaaaguaggggg

SEQ ID NO: 2213213 - RNA, 20 nt, Homo sapiens
gaugauggucuucagccucu

SEQ ID NO: 2213214 - RNA, 12 nt, Homo sapiens
gaucuccugacc

SEQ ID NO: 2213215 - RNA, 16 nt, Homo sapiens
uaccagauaguuauau

SEQ ID NO: 2213216 - RNA, 15 nt, Homo sapiens
guacauuucucaggc

SEQ ID NO: 2213217 - RNA, 19 nt, Homo sapiens
aggucuuccugcuuuccau

SEQ ID NO: 2213218 - RNA, 22 nt, Homo sapiens
ggcuacaaggacccagccugag

SEQ ID NO: 2213219 - RNA, 17 nt, Homo sapiens
agauaugauaccaaaga

SEQ ID NO: 2213220 - RNA, 21 nt, Homo sapiens
uuugauaccuguaguggaacu

SEQ ID NO: 2213221 - RNA, 21 nt, Homo sapiens
ugcauuuauuuaagacacugu

SEQ ID NO: 2213222 - RNA, 16 nt, Homo sapiens
gaaaccuauauuucaa

SEQ ID NO: 2213223 - RNA, 19 nt, Homo sapiens
cauaaaaaauaaaguacca

SEQ ID NO: 2213224 - RNA, 14 nt, Homo sapiens
cuagaacucuccau

SEQ ID NO: 2213225 - RNA, 14 nt, Homo sapiens
cuccauuuuagccc

SEQ ID NO: 2213226 - RNA, 15 nt, Homo sapiens
cucagggcacaaaga

SEQ ID NO: 2213227 - RNA, 16 nt, Homo sapiens
uccccacacagccucu

SEQ ID NO: 2213228 - RNA, 22 nt, Homo sapiens
uucccucucagcugcugggacg

SEQ ID NO: 2213229 - RNA, 15 nt, Homo sapiens
gcucccuacauuccc

SEQ ID NO: 2213230 - RNA, 18 nt, Homo sapiens
aauauuuugacccuuuau

SEQ ID NO: 2213231 - RNA, 19 nt, Homo sapiens
cuacaauuguaaacuaguu

SEQ ID NO: 2213232 - RNA, 15 nt, Homo sapiens
cacagcaugugcaau

SEQ ID NO: 2213233 - RNA, 22 nt, Homo sapiens
gaagaaaacaguacagaaggca

SEQ ID NO: 2213234 - RNA, 17 nt, Homo sapiens
auggaggaauuucuuga

SEQ ID NO: 2213235 - RNA, 22 nt, Homo sapiens
aaggauguguuuucagucuuuc

SEQ ID NO: 2213236 - RNA, 17 nt, Homo sapiens
ugaaggcauuugcagga

SEQ ID NO: 2213237 - RNA, 17 nt, Homo sapiens
ggccccaguucaaucuc

SEQ ID NO: 2213238 - RNA, 20 nt, Homo sapiens
auuggcccuguacaguuugc

SEQ ID NO: 2213239 - RNA, 16 nt, Homo sapiens
uugauagcagauauca

SEQ ID NO: 2213240 - RNA, 14 nt, Homo sapiens
cuaagacccaaagu

SEQ ID NO: 2213241 - RNA, 19 nt, Homo sapiens
uugaacacuagucugugua

SEQ ID NO: 2213242 - RNA, 18 nt, Homo sapiens
augcugacauccaggugg

SEQ ID NO: 2213243 - RNA, 20 nt, Homo sapiens
uaaaaaggcaaucacauaaa

SEQ ID NO: 2213244 - RNA, 22 nt, Homo sapiens
uagauacaggggcaaaagucau

SEQ ID NO: 2213245 - RNA, 19 nt, Homo sapiens
uccuauuugcacacgucca

SEQ ID NO: 2213246 - RNA, 19 nt, Homo sapiens
caaaaguuacauguuugca

SEQ ID NO: 2213247 - RNA, 22 nt, Homo sapiens
agugagcuccggccccaccucg

SEQ ID NO: 2213248 - RNA, 23 nt, Homo sapiens
uaccuucauguggcucagugccu

SEQ ID NO: 2213249 - RNA, 20 nt, Homo sapiens
auuuucuucaccucugcuac

SEQ ID NO: 2213250 - RNA, 16 nt, Homo sapiens
uuuauaaaacuuugaa

SEQ ID NO: 2213251 - RNA, 14 nt, Homo sapiens
cacaggccugagau

SEQ ID NO: 2213252 - RNA, 22 nt, Homo sapiens
gaacuccacaugcuggugcaua

SEQ ID NO: 2213253 - RNA, 17 nt, Homo sapiens
gucuguagggagugaag

SEQ ID NO: 2213254 - RNA, 19 nt, Homo sapiens
cagcuguacugaguucuca

SEQ ID NO: 2213255 - RNA, 22 nt, Homo sapiens
aaaagugcuucauucuuugcag

SEQ ID NO: 2213256 - RNA, 13 nt, Homo sapiens
ucccugcucagcc

SEQ ID NO: 2213257 - RNA, 13 nt, Homo sapiens
caguugcuuccuc

SEQ ID NO: 2213258 - RNA, 16 nt, Homo sapiens
ucaguuuuuuguuuua

SEQ ID NO: 2213259 - RNA, 15 nt, Homo sapiens
uuugcugcagacuca

SEQ ID NO: 2213260 - RNA, 19 nt, Homo sapiens
gagacuguucuguuccuug

SEQ ID NO: 2213261 - RNA, 15 nt, Homo sapiens
agcuaaccacuucgc

SEQ ID NO: 2213262 - RNA, 17 nt, Homo sapiens
cagcuccagugccagca

SEQ ID NO: 2213263 - RNA, 16 nt, Homo sapiens
gagacuaggagggaau

SEQ ID NO: 2213264 - RNA, 13 nt, Homo sapiens
cccacgagcacuu

SEQ ID NO: 2213265 - RNA, 20 nt, Homo sapiens
cuuaugcucuuaauugccac

SEQ ID NO: 2213266 - RNA, 20 nt, Homo sapiens
cuuguuguuuucccaaagag

SEQ ID NO: 2213267 - RNA, 19 nt, Homo sapiens
gaggcaggaaaaugcuucu

SEQ ID NO: 2213268 - RNA, 18 nt, Homo sapiens
auguaggcaucaugcaug

SEQ ID NO: 2213269 - RNA, 16 nt, Homo sapiens
cauucugcaugagcug

SEQ ID NO: 2213270 - RNA, 16 nt, Homo sapiens
cugcaggggugccugg

SEQ ID NO: 2213271 - RNA, 16 nt, Homo sapiens
auccuuuaucaagaag

SEQ ID NO: 2213272 - RNA, 16 nt, Homo sapiens
aaauaucauuuacucu

SEQ ID NO: 2213273 - RNA, 22 nt, Homo sapiens
acauuagccuugaacaaccaga

SEQ ID NO: 2213274 - RNA, 20 nt, Homo sapiens
uuaaaaaaaggagacugugu

SEQ ID NO: 2213275 - RNA, 22 nt, Homo sapiens
aucuuaaacauaauaaaucaca

SEQ ID NO: 2213276 - RNA, 14 nt, Homo sapiens
gacuccaucucaaa

SEQ ID NO: 2213277 - RNA, 18 nt, Homo sapiens
ucccuuuccuacucucag

SEQ ID NO: 2213278 - RNA, 14 nt, Homo sapiens
ucuccaauuugaag

SEQ ID NO: 2213279 - RNA, 20 nt, Homo sapiens
caggucuccaccugcacauu

SEQ ID NO: 2213280 - RNA, 22 nt, Homo sapiens
gcccuucugaugagaaaggccu

SEQ ID NO: 2213281 - RNA, 19 nt, Homo sapiens
uagaaaggucauccaaaga

SEQ ID NO: 2213282 - RNA, 16 nt, Homo sapiens
auuugcaacucacuga

SEQ ID NO: 2213283 - RNA, 13 nt, Homo sapiens
gagaggaacccag

SEQ ID NO: 2213284 - RNA, 14 nt, Homo sapiens
aaaagcaacaucag

SEQ ID NO: 2213285 - RNA, 16 nt, Homo sapiens
gggaggcagaaaggga

SEQ ID NO: 2213286 - RNA, 12 nt, Homo sapiens
ggcuaauggagg

SEQ ID NO: 2213287 - RNA, 16 nt, Homo sapiens
gaaucaauuacuugaa

SEQ ID NO: 2213288 - RNA, 18 nt, Homo sapiens
ccuguguuaucugugguu

SEQ ID NO: 2213289 - RNA, 18 nt, Homo sapiens
cacuuuaccucuguggac

SEQ ID NO: 2213290 - RNA, 18 nt, Homo sapiens
auguucgcucgugcagua

SEQ ID NO: 2213291 - RNA, 19 nt, Homo sapiens
cuguccaggaacuuuccag

SEQ ID NO: 2213292 - RNA, 15 nt, Homo sapiens
cauucuaaaccaaaa

SEQ ID NO: 2213293 - RNA, 16 nt, Homo sapiens
gugccaggcuugccug

SEQ ID NO: 2213294 - RNA, 16 nt, Homo sapiens
aaaggucauccaaaga

SEQ ID NO: 2213295 - RNA, 21 nt, Homo sapiens
cagacuccugcucucuaucca

SEQ ID NO: 2213296 - RNA, 22 nt, Homo sapiens
guagaaauuaacaaaugugcug

SEQ ID NO: 2213297 - RNA, 13 nt, Homo sapiens
cuuuugaaaaaca

SEQ ID NO: 2213298 - RNA, 18 nt, Homo sapiens
cagucucugaauacacag

SEQ ID NO: 2213299 - RNA, 18 nt, Homo sapiens
cuuuauccuaguuccauu

SEQ ID NO: 2213300 - RNA, 13 nt, Homo sapiens
aggaaugauccca

SEQ ID NO: 2213301 - RNA, 21 nt, Homo sapiens
cauaauguuacauuauuauca

SEQ ID NO: 2213302 - RNA, 16 nt, Homo sapiens
aacuauuuucaaagac

SEQ ID NO: 2213303 - RNA, 14 nt, Homo sapiens
uacagccuggacca

SEQ ID NO: 2213304 - RNA, 20 nt, Homo sapiens
guccccuucccaggggcgag

SEQ ID NO: 2213305 - RNA, 17 nt, Homo sapiens
cuggggcagaaacacuc

SEQ ID NO: 2213306 - RNA, 16 nt, Homo sapiens
augauuuguaacauuc

SEQ ID NO: 2213307 - RNA, 17 nt, Homo sapiens
aauuuacuuguauuccu

SEQ ID NO: 2213308 - RNA, 21 nt, Homo sapiens
aacauaaauuucuuuaaucau

SEQ ID NO: 2213309 - RNA, 16 nt, Homo sapiens
uuucaacaaguaacuu

SEQ ID NO: 2213310 - RNA, 12 nt, Homo sapiens
cucaggucugua

SEQ ID NO: 2213311 - RNA, 14 nt, Homo sapiens
uuccugugacaaaa

SEQ ID NO: 2213312 - RNA, 19 nt, Homo sapiens
ucacauuuauucugcucac

SEQ ID NO: 2213313 - RNA, 19 nt, Homo sapiens
auccauucucucugcccaa

SEQ ID NO: 2213314 - RNA, 20 nt, Homo sapiens
ccuuaugucuccugaccuga

SEQ ID NO: 2213315 - RNA, 15 nt, Homo sapiens
ggccauguggccugc

SEQ ID NO: 2213316 - RNA, 16 nt, Homo sapiens
auuuagaaaaagucaa

SEQ ID NO: 2213317 - RNA, 19 nt, Homo sapiens
aaacuuaaaaaaagcacau

SEQ ID NO: 2213318 - RNA, 13 nt, Homo sapiens
ccaaucuuucuau

SEQ ID NO: 2213319 - RNA, 23 nt, Homo sapiens
augacuccagaauuucccaaagc

SEQ ID NO: 2213320 - RNA, 20 nt, Homo sapiens
caucaaggguacacugccuu

SEQ ID NO: 2213321 - RNA, 11 nt, Homo sapiens
auuaugacaau

SEQ ID NO: 2213322 - RNA, 21 nt, Homo sapiens
ugagacgcaaggaucacuuga

SEQ ID NO: 2213323 - RNA, 20 nt, Homo sapiens
uugcuacgaagaaagacucc

SEQ ID NO: 2213324 - RNA, 20 nt, Homo sapiens
aguaagugugaauugcugca

SEQ ID NO: 2213325 - RNA, 18 nt, Homo sapiens
gcaugacgggaaaaccaa

SEQ ID NO: 2213326 - RNA, 15 nt, Homo sapiens
gccuuggcuucaggg

SEQ ID NO: 2213327 - RNA, 20 nt, Homo sapiens
cauuacagggcacaggccau

SEQ ID NO: 2213328 - RNA, 20 nt, Homo sapiens
accacccccaucaucaccga

SEQ ID NO: 2213329 - RNA, 16 nt, Homo sapiens
aaacaaagucugggaa

SEQ ID NO: 2213330 - RNA, 23 nt, Homo sapiens
cagaagcauugccuggacugacc

SEQ ID NO: 2213331 - RNA, 21 nt, Homo sapiens
uccuguuggauaucauacuuc

SEQ ID NO: 2213332 - RNA, 15 nt, Homo sapiens
gaaaccuacaagauu

SEQ ID NO: 2213333 - RNA, 22 nt, Homo sapiens
cauaagguuucguuucuguaua

SEQ ID NO: 2213334 - RNA, 13 nt, Homo sapiens
caugccuacagau

SEQ ID NO: 2213335 - RNA, 20 nt, Homo sapiens
gaugaacccgaggcugagaa

SEQ ID NO: 2213336 - RNA, 13 nt, Homo sapiens
uucucccuguaaa

SEQ ID NO: 2213337 - RNA, 21 nt, Homo sapiens
caguuggcaugguaguauaca

SEQ ID NO: 2213338 - RNA, 24 nt, Homo sapiens
aaaaaugaaaagagaaugaugcuc

SEQ ID NO: 2213339 - RNA, 20 nt, Homo sapiens
gugucugggagagccuggca

SEQ ID NO: 2213340 - RNA, 16 nt, Homo sapiens
ccaagagauccaucaa

SEQ ID NO: 2213341 - RNA, 19 nt, Homo sapiens
cugccugggccuguucacg

SEQ ID NO: 2213342 - RNA, 12 nt, Homo sapiens
ugcaaacugccu

SEQ ID NO: 2213343 - RNA, 12 nt, Homo sapiens
aucuaccugcuu

SEQ ID NO: 2213344 - RNA, 12 nt, Homo sapiens
auuaaccugcca

SEQ ID NO: 2213345 - RNA, 20 nt, Homo sapiens
agcucacacaaugucuuguu

SEQ ID NO: 2213346 - RNA, 12 nt, Homo sapiens
gcgcaccuguag

SEQ ID NO: 2213347 - RNA, 15 nt, Homo sapiens
uugaaacauuugcca

SEQ ID NO: 2213348 - RNA, 15 nt, Homo sapiens
aaugaacaaagacca

SEQ ID NO: 2213349 - RNA, 17 nt, Homo sapiens
ucccuugcucagugccu

SEQ ID NO: 2213350 - RNA, 20 nt, Homo sapiens
cuuucccucgcuaugugcac

SEQ ID NO: 2213351 - RNA, 15 nt, Homo sapiens
ugaaacagccagauc

SEQ ID NO: 2213352 - RNA, 19 nt, Homo sapiens
gcaaccuuuggaugcacuu

SEQ ID NO: 2213353 - RNA, 17 nt, Homo sapiens
caugucuuaaaugcuca

SEQ ID NO: 2213354 - RNA, 14 nt, Homo sapiens
ccaaccacagagaa

SEQ ID NO: 2213355 - RNA, 19 nt, Homo sapiens
aacagguucuccaggugau

SEQ ID NO: 2213356 - RNA, 21 nt, Homo sapiens
ggucauuggccacugucucca

SEQ ID NO: 2213357 - RNA, 20 nt, Homo sapiens
cugucuguuuccucuguaua

SEQ ID NO: 2213358 - RNA, 17 nt, Homo sapiens
ugggggccccucggcau

SEQ ID NO: 2213359 - RNA, 15 nt, Homo sapiens
agaaagaaaccagac

SEQ ID NO: 2213360 - RNA, 20 nt, Homo sapiens
caucuccacucuugugguca

SEQ ID NO: 2213361 - RNA, 14 nt, Homo sapiens
cagagguugcaaug

SEQ ID NO: 2213362 - RNA, 18 nt, Homo sapiens
ucucucuugucacaugga

SEQ ID NO: 2213363 - RNA, 22 nt, Homo sapiens
cauucuuccaucaucacuguaa

SEQ ID NO: 2213364 - RNA, 20 nt, Homo sapiens
gaccauuccaggaaaacugg

SEQ ID NO: 2213365 - RNA, 14 nt, Homo sapiens
auugucacaucuau

SEQ ID NO: 2213366 - RNA, 17 nt, Homo sapiens
uaaaaaaaaucaaguau

SEQ ID NO: 2213367 - RNA, 16 nt, Homo sapiens
acuucuccccuggguc

SEQ ID NO: 2213368 - RNA, 15 nt, Homo sapiens
uccauccuaccacaa

SEQ ID NO: 2213369 - RNA, 16 nt, Homo sapiens
acacugaaaugaaauc

SEQ ID NO: 2213370 - RNA, 13 nt, Homo sapiens
caauaaaccacaa

SEQ ID NO: 2213371 - RNA, 13 nt, Homo sapiens
aucuaaacauaaa

SEQ ID NO: 2213372 - RNA, 13 nt, Homo sapiens
uucauaacuuauu

SEQ ID NO: 2213373 - RNA, 14 nt, Homo sapiens
cugccacaguaaua

SEQ ID NO: 2213374 - RNA, 21 nt, Homo sapiens
uguaguagccuuuccugauga

SEQ ID NO: 2213375 - RNA, 16 nt, Homo sapiens
uucaucagaacagcug

SEQ ID NO: 2213376 - RNA, 16 nt, Homo sapiens
ucuuuuguuucauuaa

SEQ ID NO: 2213377 - RNA, 21 nt, Homo sapiens
aaaaauaagauaucaacugcc

SEQ ID NO: 2213378 - RNA, 17 nt, Homo sapiens
ucaauuucaacauggac

SEQ ID NO: 2213379 - RNA, 15 nt, Homo sapiens
caccuccucuaaggu

SEQ ID NO: 2213380 - RNA, 13 nt, Homo sapiens
cucauccuccuuc

SEQ ID NO: 2213381 - RNA, 22 nt, Homo sapiens
ccugcucacaaaaucacuuuaa

SEQ ID NO: 2213382 - RNA, 14 nt, Homo sapiens
accacaauauguau

SEQ ID NO: 2213383 - RNA, 14 nt, Homo sapiens
agugaaauucaauu

SEQ ID NO: 2213384 - RNA, 16 nt, Homo sapiens
ccaauuugacaaaacc

SEQ ID NO: 2213385 - RNA, 21 nt, Homo sapiens
cuauuaauuccaugugauaca

SEQ ID NO: 2213386 - RNA, 16 nt, Homo sapiens
gcucacaaagagauaa

SEQ ID NO: 2213387 - RNA, 20 nt, Homo sapiens
gacuacaugugaacugggac

SEQ ID NO: 2213388 - RNA, 17 nt, Homo sapiens
cuuguaggggaggggcu

SEQ ID NO: 2213389 - RNA, 15 nt, Homo sapiens
gagggagacuccauc

SEQ ID NO: 2213390 - RNA, 17 nt, Homo sapiens
cccccggagcagggguc

SEQ ID NO: 2213391 - RNA, 17 nt, Homo sapiens
cgccugcgccgcugugc

SEQ ID NO: 2213392 - RNA, 15 nt, Homo sapiens
cagugucauuucuca

SEQ ID NO: 2213393 - RNA, 18 nt, Homo sapiens
gaucuaaaaggaggacag

SEQ ID NO: 2213394 - RNA, 22 nt, Homo sapiens
uacaguuucauuaacuccuucc

SEQ ID NO: 2213395 - RNA, 16 nt, Homo sapiens
gcccacugaggggcca

SEQ ID NO: 2213396 - RNA, 19 nt, Homo sapiens
aucagcucuugaugccuuu

SEQ ID NO: 2213397 - RNA, 22 nt, Homo sapiens
agaggccagcacauuaucuuca

SEQ ID NO: 2213398 - RNA, 15 nt, Homo sapiens
augguugauggaaaa

SEQ ID NO: 2213399 - RNA, 19 nt, Homo sapiens
uaucaggacugugaccaaa

SEQ ID NO: 2213400 - RNA, 19 nt, Homo sapiens
caagaagcguuaugugcag

SEQ ID NO: 2213401 - RNA, 19 nt, Homo sapiens
aguuacauugugcuuggua

SEQ ID NO: 2213402 - RNA, 16 nt, Homo sapiens
ggucuggccacugucc

SEQ ID NO: 2213403 - RNA, 18 nt, Homo sapiens
auucuuuucccauugacu

SEQ ID NO: 2213404 - RNA, 17 nt, Homo sapiens
aacaaagacuucuguca

SEQ ID NO: 2213405 - RNA, 16 nt, Homo sapiens
cacugaccugccugua

SEQ ID NO: 2213406 - RNA, 14 nt, Homo sapiens
uggaucagcucuuc

SEQ ID NO: 2213407 - RNA, 17 nt, Homo sapiens
gacugagccaugcucag

SEQ ID NO: 2213408 - RNA, 18 nt, Homo sapiens
ucaccauguuagccuuag

SEQ ID NO: 2213409 - RNA, 16 nt, Homo sapiens
aaaccuugugcuacuu

SEQ ID NO: 2213410 - RNA, 15 nt, Homo sapiens
acaagugcucuuucc

SEQ ID NO: 2213411 - RNA, 22 nt, Homo sapiens
aaguacaaagguugcagugcug

SEQ ID NO: 2213412 - RNA, 18 nt, Homo sapiens
gacccagcugauugcacu

SEQ ID NO: 2213413 - RNA, 21 nt, Homo sapiens
aagaauuuuuauauccacuaa

SEQ ID NO: 2213414 - RNA, 15 nt, Homo sapiens
ucuccaggugcucau

SEQ ID NO: 2213415 - RNA, 24 nt, Homo sapiens
uugcacuuuuuuguuugaauguua

SEQ ID NO: 2213416 - RNA, 17 nt, Homo sapiens
caauuaacauaugucac

SEQ ID NO: 2213417 - RNA, 21 nt, Homo sapiens
aauuuuuuguucuucagagau

SEQ ID NO: 2213418 - RNA, 23 nt, Homo sapiens
ucaguaauacaguacaguacuca

SEQ ID NO: 2213419 - RNA, 17 nt, Homo sapiens
uggcacuguggagcuca

SEQ ID NO: 2213420 - RNA, 21 nt, Homo sapiens
guuauuuuguaaccuuccaau

SEQ ID NO: 2213421 - RNA, 19 nt, Homo sapiens
caugcucagaguggcugag

SEQ ID NO: 2213422 - RNA, 17 nt, Homo sapiens
gaucuguguuuacuuaa

SEQ ID NO: 2213423 - RNA, 16 nt, Homo sapiens
ggcuaauucaguguca

SEQ ID NO: 2213424 - RNA, 21 nt, Homo sapiens
cauauguuguguuugguucaa

SEQ ID NO: 2213425 - RNA, 15 nt, Homo sapiens
ucgggucccagaugu

SEQ ID NO: 2213426 - RNA, 14 nt, Homo sapiens
cuuucacacugugg

SEQ ID NO: 2213427 - RNA, 18 nt, Homo sapiens
ugucaguaguuucuuauu

SEQ ID NO: 2213428 - RNA, 13 nt, Homo sapiens
guuaugcaucauu

SEQ ID NO: 2213429 - RNA, 21 nt, Homo sapiens
uaaucuguaagcauaagcuua

SEQ ID NO: 2213430 - RNA, 19 nt, Homo sapiens
acaggggccauguccucuc

SEQ ID NO: 2213431 - RNA, 19 nt, Homo sapiens
agaacaccgagcacugaac

SEQ ID NO: 2213432 - RNA, 16 nt, Homo sapiens
uccacuccacuuugua

SEQ ID NO: 2213433 - RNA, 20 nt, Homo sapiens
uggaacuuuauuuacacucc

SEQ ID NO: 2213434 - RNA, 18 nt, Homo sapiens
aaacuuggacaacacgga

SEQ ID NO: 2213435 - RNA, 16 nt, Homo sapiens
aaaccaccaggcaucc

SEQ ID NO: 2213436 - RNA, 22 nt, Homo sapiens
gcucacgccuguaaucccaaca

SEQ ID NO: 2213437 - RNA, 15 nt, Homo sapiens
ccuaugguuuugcug

SEQ ID NO: 2213438 - RNA, 19 nt, Homo sapiens
ugaaauuauuugucauuca

SEQ ID NO: 2213439 - RNA, 16 nt, Homo sapiens
ccuucccuccaagaag

SEQ ID NO: 2213440 - RNA, 16 nt, Homo sapiens
aucugaaaacuuggcu

SEQ ID NO: 2213441 - RNA, 14 nt, Homo sapiens
agaaaaaaauucau

SEQ ID NO: 2213442 - RNA, 14 nt, Homo sapiens
gugauggaccaaag

SEQ ID NO: 2213443 - RNA, 19 nt, Homo sapiens
auuuuaccugggauaugac

SEQ ID NO: 2213444 - RNA, 21 nt, Homo sapiens
acugcaacuuccgccuccugu

SEQ ID NO: 2213445 - RNA, 15 nt, Homo sapiens
uucacucccagguga

SEQ ID NO: 2213446 - RNA, 19 nt, Homo sapiens
ccugaggucaugcauugua

SEQ ID NO: 2213447 - RNA, 16 nt, Homo sapiens
uugacauacauucccu

SEQ ID NO: 2213448 - RNA, 16 nt, Homo sapiens
uuggauggaguuaaac

SEQ ID NO: 2213449 - RNA, 19 nt, Homo sapiens
cccacuucucuacucugga

SEQ ID NO: 2213450 - RNA, 16 nt, Homo sapiens
ucucuguagcugcuag

SEQ ID NO: 2213451 - RNA, 18 nt, Homo sapiens
ugacaaaggccugugaag

SEQ ID NO: 2213452 - RNA, 16 nt, Homo sapiens
aaaaguguuguuauca

SEQ ID NO: 2213453 - RNA, 20 nt, Homo sapiens
aaucauuucugcaucagcug

SEQ ID NO: 2213454 - RNA, 20 nt, Homo sapiens
accacacagccaaggggaug

SEQ ID NO: 2213455 - RNA, 17 nt, Homo sapiens
uaaagcauuuugcaaac

SEQ ID NO: 2213456 - RNA, 20 nt, Homo sapiens
ccuuucuacuuccaagacuu

SEQ ID NO: 2213457 - RNA, 17 nt, Homo sapiens
ugcagcgagcugagauc

SEQ ID NO: 2213458 - RNA, 20 nt, Homo sapiens
gcacaaugucaugucuguga

SEQ ID NO: 2213459 - RNA, 17 nt, Homo sapiens
gcacuggccacccaagg

SEQ ID NO: 2213460 - RNA, 20 nt, Homo sapiens
cccuacacacacacucccug

SEQ ID NO: 2213461 - RNA, 17 nt, Homo sapiens
gagacuuuacauggaug

SEQ ID NO: 2213462 - RNA, 15 nt, Homo sapiens
gcaguuagcacagag

SEQ ID NO: 2213463 - RNA, 12 nt, Homo sapiens
gccaucacagga

SEQ ID NO: 2213464 - RNA, 22 nt, Homo sapiens
gcacccucugcuaugucuguga

SEQ ID NO: 2213465 - RNA, 20 nt, Homo sapiens
uguuuuuguucaaagccagc

SEQ ID NO: 2213466 - RNA, 19 nt, Homo sapiens
gcuucuuugccucccucag

SEQ ID NO: 2213467 - RNA, 20 nt, Homo sapiens
cccauucucaaaaacaaaga

SEQ ID NO: 2213468 - RNA, 23 nt, Homo sapiens
uauugagccuugcauguacuuga

SEQ ID NO: 2213469 - RNA, 13 nt, Homo sapiens
caugacuucugcc

SEQ ID NO: 2213470 - RNA, 15 nt, Homo sapiens
aaggcaggugggcuc

SEQ ID NO: 2213471 - RNA, 16 nt, Homo sapiens
aagaaugcaauaucau

SEQ ID NO: 2213472 - RNA, 14 nt, Homo sapiens
ucccaaacccagcc

SEQ ID NO: 2213473 - RNA, 14 nt, Homo sapiens
caccuccuggagaa

SEQ ID NO: 2213474 - RNA, 21 nt, Homo sapiens
guccugcugccucucuuucac

SEQ ID NO: 2213475 - RNA, 19 nt, Homo sapiens
ucccaggacuagagcacaa

SEQ ID NO: 2213476 - RNA, 16 nt, Homo sapiens
agguuuuaaagugauu

SEQ ID NO: 2213477 - RNA, 16 nt, Homo sapiens
gacuguuuggcuuaua

SEQ ID NO: 2213478 - RNA, 21 nt, Homo sapiens
caaaauauauuuuguuuacaa

SEQ ID NO: 2213479 - RNA, 12 nt, Homo sapiens
cuuugugaauua

SEQ ID NO: 2213480 - RNA, 14 nt, Homo sapiens
cagacacgcacuuc

SEQ ID NO: 2213481 - RNA, 23 nt, Homo sapiens
gccaccccuccccaguacagggg

SEQ ID NO: 2213482 - RNA, 16 nt, Homo sapiens
agugcacuguauauag

SEQ ID NO: 2213483 - RNA, 18 nt, Homo sapiens
ugugagcacaaugcauaa

SEQ ID NO: 2213484 - RNA, 13 nt, Homo sapiens
uuugagcacaaag

SEQ ID NO: 2213485 - RNA, 13 nt, Homo sapiens
ucuugugaacugu

SEQ ID NO: 2213486 - RNA, 19 nt, Homo sapiens
ucuccacgucuuuccugcu

SEQ ID NO: 2213487 - RNA, 18 nt, Homo sapiens
caagaccaucuacauaca

SEQ ID NO: 2213488 - RNA, 14 nt, Homo sapiens
uagagacaggguuu

SEQ ID NO: 2213489 - RNA, 17 nt, Homo sapiens
cugugugguauuuuggc

SEQ ID NO: 2213490 - RNA, 19 nt, Homo sapiens
uugacugaaauuacuuuaa

SEQ ID NO: 2213491 - RNA, 16 nt, Homo sapiens
augauguaaaaaauac

SEQ ID NO: 2213492 - RNA, 18 nt, Homo sapiens
auaacaguuacuccagua

SEQ ID NO: 2213493 - RNA, 20 nt, Homo sapiens
agcugugcugggugagcucu

SEQ ID NO: 2213494 - RNA, 21 nt, Homo sapiens
agcugguggcaauaaauauua

SEQ ID NO: 2213495 - RNA, 16 nt, Homo sapiens
uuuuguaucaccucuu

SEQ ID NO: 2213496 - RNA, 20 nt, Homo sapiens
cucuuuuuagauguagcacu

SEQ ID NO: 2213497 - RNA, 15 nt, Homo sapiens
aaauccccuccccaa

SEQ ID NO: 2213498 - RNA, 22 nt, Homo sapiens
uccagguggcgugagaggcaau

SEQ ID NO: 2213499 - RNA, 23 nt, Homo sapiens
aaugcuuugauuguucauaucaa

SEQ ID NO: 2213500 - RNA, 16 nt, Homo sapiens
acauggcuggcacuga

SEQ ID NO: 2213501 - RNA, 17 nt, Homo sapiens
gcauuguaaaugugcuu

SEQ ID NO: 2213502 - RNA, 17 nt, Homo sapiens
gcaucauuaaugcacau

SEQ ID NO: 2213503 - RNA, 16 nt, Homo sapiens
accaggcacccccaga

SEQ ID NO: 2213504 - RNA, 18 nt, Homo sapiens
uaugcaucugcuacugug

SEQ ID NO: 2213505 - RNA, 14 nt, Homo sapiens
cccgaagggagcau

SEQ ID NO: 2213506 - RNA, 18 nt, Homo sapiens
aguuugauuauucagugu

SEQ ID NO: 2213507 - RNA, 22 nt, Homo sapiens
cugacccggccucucugcccca

SEQ ID NO: 2213508 - RNA, 18 nt, Homo sapiens
ucaggugccuuacaucuu

SEQ ID NO: 2213509 - RNA, 19 nt, Homo sapiens
ugcaguuucaaguaccaaa

SEQ ID NO: 2213510 - RNA, 22 nt, Homo sapiens
aagcggggagaggguacacaau

SEQ ID NO: 2213511 - RNA, 15 nt, Homo sapiens
auaccaacucaguga

SEQ ID NO: 2213512 - RNA, 18 nt, Homo sapiens
ggcaucucccacacaaga

SEQ ID NO: 2213513 - RNA, 18 nt, Homo sapiens
accucuucuuuaccagaa

SEQ ID NO: 2213514 - RNA, 20 nt, Homo sapiens
ugaagaaagacucugagaug

SEQ ID NO: 2213515 - RNA, 20 nt, Homo sapiens
auguguaagacacugugcaa

SEQ ID NO: 2213516 - RNA, 21 nt, Homo sapiens
agguuacccuguaacaugcaa

SEQ ID NO: 2213517 - RNA, 17 nt, Homo sapiens
gagcuugggugugcuga

SEQ ID NO: 2213518 - RNA, 19 nt, Homo sapiens
auguggaaggcagcagagc

SEQ ID NO: 2213519 - RNA, 19 nt, Homo sapiens
uugcccuuuggccagugac

SEQ ID NO: 2213520 - RNA, 12 nt, Homo sapiens
auccagcuucau

SEQ ID NO: 2213521 - RNA, 14 nt, Homo sapiens
aguaccagugugcu

SEQ ID NO: 2213522 - RNA, 14 nt, Homo sapiens
acagauagucaaac

SEQ ID NO: 2213523 - RNA, 17 nt, Homo sapiens
accuguccuucucaggc

SEQ ID NO: 2213524 - RNA, 18 nt, Homo sapiens
aggagguuuuuuugucaa

SEQ ID NO: 2213525 - RNA, 12 nt, Homo sapiens
acuguacaugaa

SEQ ID NO: 2213526 - RNA, 19 nt, Homo sapiens
aggugagccggcucugccu

SEQ ID NO: 2213527 - RNA, 19 nt, Homo sapiens
uucauuuucucucagguga

SEQ ID NO: 2213528 - RNA, 11 nt, Homo sapiens
ucacucucuuc

SEQ ID NO: 2213529 - RNA, 22 nt, Homo sapiens
aauucgcugcaaccuguugaua

SEQ ID NO: 2213530 - RNA, 20 nt, Homo sapiens
uaaacaagucaaagacuugu

SEQ ID NO: 2213531 - RNA, 17 nt, Homo sapiens
uucaugugucaacuuca

SEQ ID NO: 2213532 - RNA, 12 nt, Homo sapiens
aagugugcacag

SEQ ID NO: 2213533 - RNA, 18 nt, Homo sapiens
guuuaccaguugccuuuu

SEQ ID NO: 2213534 - RNA, 23 nt, Homo sapiens
uucagaauauauugaauaggcau

SEQ ID NO: 2213535 - RNA, 14 nt, Homo sapiens
ccacccguccuccc

SEQ ID NO: 2213536 - RNA, 22 nt, Homo sapiens
cuuugcaccaaagauguccuga

SEQ ID NO: 2213537 - RNA, 17 nt, Homo sapiens
uagagaugauaauccca

SEQ ID NO: 2213538 - RNA, 13 nt, Homo sapiens
cacgucugccagg

SEQ ID NO: 2213539 - RNA, 11 nt, Homo sapiens
ucucuccucac

SEQ ID NO: 2213540 - RNA, 22 nt, Homo sapiens
gccguguucaaagagcaauauu

SEQ ID NO: 2213541 - RNA, 13 nt, Homo sapiens
uauauauuuacau

SEQ ID NO: 2213542 - RNA, 13 nt, Homo sapiens
acuuaauuaccua

SEQ ID NO: 2213543 - RNA, 20 nt, Homo sapiens
cuuuaucuuuuaagcuaucu

SEQ ID NO: 2213544 - RNA, 19 nt, Homo sapiens
guauccaauuaugugacaa

SEQ ID NO: 2213545 - RNA, 16 nt, Homo sapiens
uagaacuaucugcauu

SEQ ID NO: 2213546 - RNA, 14 nt, Homo sapiens
gcccaaucacugcc

SEQ ID NO: 2213547 - RNA, 14 nt, Homo sapiens
cucuaagugcugcu

SEQ ID NO: 2213548 - RNA, 13 nt, Homo sapiens
cuguaagaguguu

SEQ ID NO: 2213549 - RNA, 22 nt, Homo sapiens
aucuacacagcaguaugaauga

SEQ ID NO: 2213550 - RNA, 22 nt, Homo sapiens
caggacacuaaugggaagacca

SEQ ID NO: 2213551 - RNA, 17 nt, Homo sapiens
gcuaggguaggggcaag

SEQ ID NO: 2213552 - RNA, 22 nt, Homo sapiens
agcugagaaauuguaggcaugu

SEQ ID NO: 2213553 - RNA, 16 nt, Homo sapiens
gaauuauaacuguaaa

SEQ ID NO: 2213554 - RNA, 19 nt, Homo sapiens
aggugauguuuccagcugc

SEQ ID NO: 2213555 - RNA, 17 nt, Homo sapiens
cccuagcauugcacuug

SEQ ID NO: 2213556 - RNA, 19 nt, Homo sapiens
agaguaauucaucugugaa

SEQ ID NO: 2213557 - RNA, 22 nt, Homo sapiens
ugcuaaacuguugggaaagcuc

SEQ ID NO: 2213558 - RNA, 21 nt, Homo sapiens
cacaaaguagaggaauccaug

SEQ ID NO: 2213559 - RNA, 23 nt, Homo sapiens
cuaagagugucacugagcugugu

SEQ ID NO: 2213560 - RNA, 20 nt, Homo sapiens
cauuucucuuugcuucacag

SEQ ID NO: 2213561 - RNA, 20 nt, Homo sapiens
cugacuuaacguucuauaaa

SEQ ID NO: 2213562 - RNA, 12 nt, Homo sapiens
uauccuguucuu

SEQ ID NO: 2213563 - RNA, 14 nt, Homo sapiens
aaucugauauguau

SEQ ID NO: 2213564 - RNA, 16 nt, Homo sapiens
uagccucuccaggaau

SEQ ID NO: 2213565 - RNA, 10 nt, Homo sapiens
gugugccuuc

SEQ ID NO: 2213566 - RNA, 11 nt, Homo sapiens
acaaugccaau

SEQ ID NO: 2213567 - RNA, 22 nt, Homo sapiens
agaaguauccaauuaugugaca

SEQ ID NO: 2213568 - RNA, 17 nt, Homo sapiens
ucacaggagcaaucaca

SEQ ID NO: 2213569 - RNA, 15 nt, Homo sapiens
cauacaaaucaucca

SEQ ID NO: 2213570 - RNA, 18 nt, Homo sapiens
aaaccuagcaucuuacaa

SEQ ID NO: 2213571 - RNA, 13 nt, Homo sapiens
accccugcucagu

SEQ ID NO: 2213572 - RNA, 15 nt, Homo sapiens
gaaggaaaaugggga

SEQ ID NO: 2213573 - RNA, 14 nt, Homo sapiens
cacacacacacaua

SEQ ID NO: 2213574 - RNA, 17 nt, Homo sapiens
gauuccuuuccacucca

SEQ ID NO: 2213575 - RNA, 15 nt, Homo sapiens
agaugaaagauucag

SEQ ID NO: 2213576 - RNA, 18 nt, Homo sapiens
auggccaggccucaggga

SEQ ID NO: 2213577 - RNA, 14 nt, Homo sapiens
gaacucacuggggc

SEQ ID NO: 2213578 - RNA, 22 nt, Homo sapiens
aauauugaaaggcaaacauuug

SEQ ID NO: 2213579 - RNA, 14 nt, Homo sapiens
augugcucaggccc

SEQ ID NO: 2213580 - RNA, 17 nt, Homo sapiens
ccgagccgagcucuccu

SEQ ID NO: 2213581 - RNA, 13 nt, Homo sapiens
gcuccuguggcag

SEQ ID NO: 2213582 - RNA, 15 nt, Homo sapiens
uccuggaggcacugg

SEQ ID NO: 2213583 - RNA, 21 nt, Homo sapiens
ucagucaugcguccacuuucc

SEQ ID NO: 2213584 - RNA, 21 nt, Homo sapiens
uuacguauguuuguacuuggu

SEQ ID NO: 2213585 - RNA, 18 nt, Homo sapiens
acagguuauaacaguguu

SEQ ID NO: 2213586 - RNA, 22 nt, Homo sapiens
acagaacacuuauguuauacaa

SEQ ID NO: 2213587 - RNA, 16 nt, Homo sapiens
caggcugguuugcaag

SEQ ID NO: 2213588 - RNA, 21 nt, Homo sapiens
uuucauugcccgaaaccagag

SEQ ID NO: 2213589 - RNA, 15 nt, Homo sapiens
cagcacucuguaaaa

SEQ ID NO: 2213590 - RNA, 18 nt, Homo sapiens
gccgcauucgcacugggg

SEQ ID NO: 2213591 - RNA, 19 nt, Homo sapiens
cccuucugguuuaaacgcc

SEQ ID NO: 2213592 - RNA, 19 nt, Homo sapiens
gcagcucacacccuaccuu

SEQ ID NO: 2213593 - RNA, 23 nt, Homo sapiens
aaaucagggccaccauugucuca

SEQ ID NO: 2213594 - RNA, 21 nt, Homo sapiens
uggaauuauuguagacaugcc

SEQ ID NO: 2213595 - RNA, 21 nt, Homo sapiens
cugugauagagcagaacugaa

SEQ ID NO: 2213596 - RNA, 15 nt, Homo sapiens
auuaggaaguguaac

SEQ ID NO: 2213597 - RNA, 15 nt, Homo sapiens
uuccccuauggaauu

SEQ ID NO: 2213598 - RNA, 13 nt, Homo sapiens
gaguggacuggag

SEQ ID NO: 2213599 - RNA, 15 nt, Homo sapiens
uaaauauaaguaaug

SEQ ID NO: 2213600 - RNA, 21 nt, Homo sapiens
cccuggaauaaauuucgcaau

SEQ ID NO: 2213601 - RNA, 20 nt, Homo sapiens
uaacuuuggaaacaugggaa

SEQ ID NO: 2213602 - RNA, 17 nt, Homo sapiens
ccacugagcccuugcac

SEQ ID NO: 2213603 - RNA, 18 nt, Homo sapiens
accaaggaccauggguca

SEQ ID NO: 2213604 - RNA, 13 nt, Homo sapiens
gaauuuguugcua

SEQ ID NO: 2213605 - RNA, 14 nt, Homo sapiens
ggagaggaagcaca

SEQ ID NO: 2213606 - RNA, 15 nt, Homo sapiens
gaaauugucaaagac

SEQ ID NO: 2213607 - RNA, 18 nt, Homo sapiens
acauuuuuuaacuuucua

SEQ ID NO: 2213608 - RNA, 13 nt, Homo sapiens
gccacugcacucc

SEQ ID NO: 2213609 - RNA, 18 nt, Homo sapiens
auacauauauauauacac

SEQ ID NO: 2213610 - RNA, 22 nt, Homo sapiens
uagugucuugguguaguguaac

SEQ ID NO: 2213611 - RNA, 13 nt, Homo sapiens
uuacaugcauuac

SEQ ID NO: 2213612 - RNA, 18 nt, Homo sapiens
aagcguguucucagcaca

SEQ ID NO: 2213613 - RNA, 17 nt, Homo sapiens
aaccuuuuuauuuucac

SEQ ID NO: 2213614 - RNA, 16 nt, Homo sapiens
gaagcuuuccugacuu

SEQ ID NO: 2213615 - RNA, 14 nt, Homo sapiens
uaaaauaacuaaca

SEQ ID NO: 2213616 - RNA, 24 nt, Homo sapiens
gagccuuguggugugugcgcacac

SEQ ID NO: 2213617 - RNA, 16 nt, Homo sapiens
uccaguuuaaucuuca

SEQ ID NO: 2213618 - RNA, 17 nt, Homo sapiens
cccgccaugcucaggag

SEQ ID NO: 2213619 - RNA, 16 nt, Homo sapiens
cucaggggacuugaau

SEQ ID NO: 2213620 - RNA, 13 nt, Homo sapiens
uaaaggauauuaa

SEQ ID NO: 2213621 - RNA, 14 nt, Homo sapiens
aaccuccuaagcaa

SEQ ID NO: 2213622 - RNA, 11 nt, Homo sapiens
uugcacauaaa

SEQ ID NO: 2213623 - RNA, 17 nt, Homo sapiens
uaugcucuuaauugcca

SEQ ID NO: 2213624 - RNA, 13 nt, Homo sapiens
ugcaccacugcac

SEQ ID NO: 2213625 - RNA, 22 nt, Homo sapiens
agggacccagccuucagucaca

SEQ ID NO: 2213626 - RNA, 12 nt, Homo sapiens
auuuaccaaagc

SEQ ID NO: 2213627 - RNA, 22 nt, Homo sapiens
cgugcucugugggucuccccca

SEQ ID NO: 2213628 - RNA, 17 nt, Homo sapiens
agaggagccaccaguuc

SEQ ID NO: 2213629 - RNA, 20 nt, Homo sapiens
guccaacaacuccaggaaaa

SEQ ID NO: 2213630 - RNA, 11 nt, Homo sapiens
caggcucucuc

SEQ ID NO: 2213631 - RNA, 21 nt, Homo sapiens
ugcaauaguaggacugcugac

SEQ ID NO: 2213632 - RNA, 19 nt, Homo sapiens
agcagaugcaaagaggcaa

SEQ ID NO: 2213633 - RNA, 17 nt, Homo sapiens
ugauggauggacacaaa

SEQ ID NO: 2213634 - RNA, 20 nt, Homo sapiens
cuguuacuccauuacuguga

SEQ ID NO: 2213635 - RNA, 17 nt, Homo sapiens
cccaguaccuccaagca

SEQ ID NO: 2213636 - RNA, 15 nt, Homo sapiens
ucaucugcuccuucc

SEQ ID NO: 2213637 - RNA, 14 nt, Homo sapiens
uccugaguucaagc

SEQ ID NO: 2213638 - RNA, 13 nt, Homo sapiens
aagcucacaaaua

SEQ ID NO: 2213639 - RNA, 14 nt, Homo sapiens
cauuccuguucuuu

SEQ ID NO: 2213640 - RNA, 15 nt, Homo sapiens
cucaggaaaccacaa

SEQ ID NO: 2213641 - RNA, 12 nt, Homo sapiens
uguauacugugg

SEQ ID NO: 2213642 - RNA, 13 nt, Homo sapiens
guaguuacucuca

SEQ ID NO: 2213643 - RNA, 18 nt, Homo sapiens
ugggccuuuccucagugu

SEQ ID NO: 2213644 - RNA, 19 nt, Homo sapiens
aaaugauauauaccacuuu

SEQ ID NO: 2213645 - RNA, 13 nt, Homo sapiens
cugcuuguuggcu

SEQ ID NO: 2213646 - RNA, 22 nt, Homo sapiens
uaaaaacaaaaaaacacaaaaa

SEQ ID NO: 2213647 - RNA, 20 nt, Homo sapiens
agcugauuuugucacugucu

SEQ ID NO: 2213648 - RNA, 22 nt, Homo sapiens
aaaauguuuuccccaaaccaua

SEQ ID NO: 2213649 - RNA, 20 nt, Homo sapiens
ugaaggaaaaccucacuuga

SEQ ID NO: 2213650 - RNA, 15 nt, Homo sapiens
aagaguuugugacua

SEQ ID NO: 2213651 - RNA, 20 nt, Homo sapiens
auuaaaaacccauaacuacc

SEQ ID NO: 2213652 - RNA, 18 nt, Homo sapiens
auucuuguaacuuucuuc

SEQ ID NO: 2213653 - RNA, 22 nt, Homo sapiens
cuguccucgucucucugcaagg

SEQ ID NO: 2213654 - RNA, 18 nt, Homo sapiens
cuucauuucgccugguga

SEQ ID NO: 2213655 - RNA, 20 nt, Homo sapiens
uucccuauuuugccaguggg

SEQ ID NO: 2213656 - RNA, 21 nt, Homo sapiens
guuccucuccaccugcauuau

SEQ ID NO: 2213657 - RNA, 17 nt, Homo sapiens
cugagccccuaccccac

SEQ ID NO: 2213658 - RNA, 15 nt, Homo sapiens
cuucugcucacauuc

SEQ ID NO: 2213659 - RNA, 21 nt, Homo sapiens
auaauaaugccuaccuuguga

SEQ ID NO: 2213660 - RNA, 13 nt, Homo sapiens
aguguacauggaa

SEQ ID NO: 2213661 - RNA, 19 nt, Homo sapiens
uacauaggccgagcugugg

SEQ ID NO: 2213662 - RNA, 23 nt, Homo sapiens
gcuuccacgccaguugccucuug

SEQ ID NO: 2213663 - RNA, 19 nt, Homo sapiens
uguggucugggcaccaccu

SEQ ID NO: 2213664 - RNA, 20 nt, Homo sapiens
augucugaggauaccuucca

SEQ ID NO: 2213665 - RNA, 20 nt, Homo sapiens
gcagcauggagacagguaga

SEQ ID NO: 2213666 - RNA, 22 nt, Homo sapiens
acucccugccuacacacacagc

SEQ ID NO: 2213667 - RNA, 14 nt, Homo sapiens
uggggugaugcugg

SEQ ID NO: 2213668 - RNA, 22 nt, Homo sapiens
gcagugauccugcaaguucaag

SEQ ID NO: 2213669 - RNA, 14 nt, Homo sapiens
gaaaacaaauaaaa

SEQ ID NO: 2213670 - RNA, 20 nt, Homo sapiens
ggaggcugcagugagccaag

SEQ ID NO: 2213671 - RNA, 20 nt, Homo sapiens
ugggugguguauuugagaag

SEQ ID NO: 2213672 - RNA, 15 nt, Homo sapiens
uucccacaauggcug

SEQ ID NO: 2213673 - RNA, 14 nt, Homo sapiens
acacaggaagaaug

SEQ ID NO: 2213674 - RNA, 19 nt, Homo sapiens
auucuuuaagaaccuuauu

SEQ ID NO: 2213675 - RNA, 23 nt, Homo sapiens
uaugaacugaaggcagcauguau

SEQ ID NO: 2213676 - RNA, 14 nt, Homo sapiens
gacaccugccuuaa

SEQ ID NO: 2213677 - RNA, 15 nt, Homo sapiens
agcacugccaggagg

SEQ ID NO: 2213678 - RNA, 20 nt, Homo sapiens
caguuucaauaaaguuugau

SEQ ID NO: 2213679 - RNA, 22 nt, Homo sapiens
uuuggucuauuuucugcagaaa

SEQ ID NO: 2213680 - RNA, 17 nt, Homo sapiens
uacacaaaaucaaauaa

SEQ ID NO: 2213681 - RNA, 22 nt, Homo sapiens
augcugagguuaugaacaaagu

SEQ ID NO: 2213682 - RNA, 22 nt, Homo sapiens
ucauaggcaccuuuuacuguga

SEQ ID NO: 2213683 - RNA, 22 nt, Homo sapiens
ugcuaaauggucgcccaggaga

SEQ ID NO: 2213684 - RNA, 21 nt, Homo sapiens
uucgcugagccccugagccca

SEQ ID NO: 2213685 - RNA, 19 nt, Homo sapiens
uaggcaggaaggacugucc

SEQ ID NO: 2213686 - RNA, 21 nt, Homo sapiens
uaccauucaacccagcaaucu

SEQ ID NO: 2213687 - RNA, 22 nt, Homo sapiens
gaccuacagugcuguguacccu

SEQ ID NO: 2213688 - RNA, 15 nt, Homo sapiens
gccgaguccaagcug

SEQ ID NO: 2213689 - RNA, 14 nt, Homo sapiens
cgcagacgcaagag

SEQ ID NO: 2213690 - RNA, 17 nt, Homo sapiens
gauauuuuuuacuuuag

SEQ ID NO: 2213691 - RNA, 16 nt, Homo sapiens
aaaagccuuuuccaga

SEQ ID NO: 2213692 - RNA, 17 nt, Homo sapiens
ccaggcucaagcacuuu

SEQ ID NO: 2213693 - RNA, 19 nt, Homo sapiens
gcuauuuccucuaaugaag

SEQ ID NO: 2213694 - RNA, 20 nt, Homo sapiens
aggcacuagccuuuggcucu

SEQ ID NO: 2213695 - RNA, 23 nt, Homo sapiens
cugauuaaaaaaucucccaaagc

SEQ ID NO: 2213696 - RNA, 22 nt, Homo sapiens
uacaugacaggcaucaaucugg

SEQ ID NO: 2213697 - RNA, 22 nt, Homo sapiens
aguuuuacaauagacauugcaa

SEQ ID NO: 2213698 - RNA, 18 nt, Homo sapiens
ucuaggaugggaacaagg

SEQ ID NO: 2213699 - RNA, 18 nt, Homo sapiens
agggcaucuccugugcau

SEQ ID NO: 2213700 - RNA, 14 nt, Homo sapiens
acagguccccagau

SEQ ID NO: 2213701 - RNA, 16 nt, Homo sapiens
aggcuaugagugggau

SEQ ID NO: 2213702 - RNA, 19 nt, Homo sapiens
uauuuaacuggcuucagcc

SEQ ID NO: 2213703 - RNA, 18 nt, Homo sapiens
cgccaugaucagacauac

SEQ ID NO: 2213704 - RNA, 18 nt, Homo sapiens
cagaguuccgacugccau

SEQ ID NO: 2213705 - RNA, 19 nt, Homo sapiens
gcuaaggcccccaaacaua

SEQ ID NO: 2213706 - RNA, 18 nt, Homo sapiens
cuauauguaguauaaaga

SEQ ID NO: 2213707 - RNA, 23 nt, Homo sapiens
aggagcacauacuaccuagaagu

SEQ ID NO: 2213708 - RNA, 15 nt, Homo sapiens
gggacugagcccaug

SEQ ID NO: 2213709 - RNA, 12 nt, Homo sapiens
uucccaugcauu

SEQ ID NO: 2213710 - RNA, 20 nt, Homo sapiens
cucuuuucccaccaacuccu

SEQ ID NO: 2213711 - RNA, 19 nt, Homo sapiens
ucaaccuucaucggcccac

SEQ ID NO: 2213712 - RNA, 14 nt, Homo sapiens
agucugcauugcug

SEQ ID NO: 2213713 - RNA, 20 nt, Homo sapiens
agugaugaaccagaguuucu

SEQ ID NO: 2213714 - RNA, 19 nt, Homo sapiens
uacagacagaaaaaacuga

SEQ ID NO: 2213715 - RNA, 17 nt, Homo sapiens
ucccuuccaccucacaa

SEQ ID NO: 2213716 - RNA, 22 nt, Homo sapiens
cugaaucuuuuuaaguuugugu

SEQ ID NO: 2213717 - RNA, 14 nt, Homo sapiens
uauuacccuccuaa

SEQ ID NO: 2213718 - RNA, 14 nt, Homo sapiens
ucccucccuaucua

SEQ ID NO: 2213719 - RNA, 14 nt, Homo sapiens
cuccugcugaucca

SEQ ID NO: 2213720 - RNA, 23 nt, Homo sapiens
uaaaaauaaaguuccugauaaua

SEQ ID NO: 2213721 - RNA, 14 nt, Homo sapiens
uauugagugugauu

SEQ ID NO: 2213722 - RNA, 22 nt, Homo sapiens
uaaaagaaaaaguaugugaaua

SEQ ID NO: 2213723 - RNA, 19 nt, Homo sapiens
acuucucaaguaacaugac

SEQ ID NO: 2213724 - RNA, 16 nt, Homo sapiens
cccugaugcagccugu

SEQ ID NO: 2213725 - RNA, 17 nt, Homo sapiens
agacuuucccaaaugua

SEQ ID NO: 2213726 - RNA, 23 nt, Homo sapiens
caaaguugcucaccgacucaccu

SEQ ID NO: 2213727 - RNA, 18 nt, Homo sapiens
auccaccgccaccccacu

SEQ ID NO: 2213728 - RNA, 17 nt, Homo sapiens
uaguuuugaaacuagaa

SEQ ID NO: 2213729 - RNA, 13 nt, Homo sapiens
aucuguacuuugu

SEQ ID NO: 2213730 - RNA, 13 nt, Homo sapiens
agcuuuacugugg

SEQ ID NO: 2213731 - RNA, 16 nt, Homo sapiens
aacacaagacugucau

SEQ ID NO: 2213732 - RNA, 14 nt, Homo sapiens
uugcugccaaaugc

SEQ ID NO: 2213733 - RNA, 15 nt, Homo sapiens
gcugcucagagccaa

SEQ ID NO: 2213734 - RNA, 16 nt, Homo sapiens
acagcuccccuagaca

SEQ ID NO: 2213735 - RNA, 15 nt, Homo sapiens
ugauuguaacauauu

SEQ ID NO: 2213736 - RNA, 15 nt, Homo sapiens
cugucaugugccuug

SEQ ID NO: 2213737 - RNA, 18 nt, Homo sapiens
aacaaauaaaaugaaaua

SEQ ID NO: 2213738 - RNA, 13 nt, Homo sapiens
ugucuuuccuaga

SEQ ID NO: 2213739 - RNA, 14 nt, Homo sapiens
acaacauuuacuua

SEQ ID NO: 2213740 - RNA, 22 nt, Homo sapiens
gccauguaccaguguacugcuu

SEQ ID NO: 2213741 - RNA, 17 nt, Homo sapiens
cugcacaugucuuguac

SEQ ID NO: 2213742 - RNA, 11 nt, Homo sapiens
ugagcaucuca

SEQ ID NO: 2213743 - RNA, 20 nt, Homo sapiens
acaacaaacuuggucuuaca

SEQ ID NO: 2213744 - RNA, 21 nt, Homo sapiens
aauuugaccagaaaauaugau

SEQ ID NO: 2213745 - RNA, 13 nt, Homo sapiens
aaauaugagucau

SEQ ID NO: 2213746 - RNA, 19 nt, Homo sapiens
agguaaaagcaucacauga

SEQ ID NO: 2213747 - RNA, 21 nt, Homo sapiens
auuaugaugaaaaccuacaua

SEQ ID NO: 2213748 - RNA, 15 nt, Homo sapiens
aaaagaaaccuucca

SEQ ID NO: 2213749 - RNA, 17 nt, Homo sapiens
ugagaaccuaaugcacu

SEQ ID NO: 2213750 - RNA, 13 nt, Homo sapiens
cacacgaugcauu

SEQ ID NO: 2213751 - RNA, 15 nt, Homo sapiens
uaaaagugcauuuaa

SEQ ID NO: 2213752 - RNA, 23 nt, Homo sapiens
caggugauuuguaugcucauuga

SEQ ID NO: 2213753 - RNA, 21 nt, Homo sapiens
agccugacucagcuaauguca

SEQ ID NO: 2213754 - RNA, 16 nt, Homo sapiens
gagaacugucuuucau

SEQ ID NO: 2213755 - RNA, 19 nt, Homo sapiens
ggaggacggugcaacccaa

SEQ ID NO: 2213756 - RNA, 21 nt, Homo sapiens
acggaaggucaguugccaugg

SEQ ID NO: 2213757 - RNA, 20 nt, Homo sapiens
aaguaaccuuauacuacuaa

SEQ ID NO: 2213758 - RNA, 18 nt, Homo sapiens
uuaagggaauaugcauug

SEQ ID NO: 2213759 - RNA, 13 nt, Homo sapiens
auuccaaccccaa

SEQ ID NO: 2213760 - RNA, 18 nt, Homo sapiens
ucaaacucauuggcuuaa

SEQ ID NO: 2213761 - RNA, 17 nt, Homo sapiens
gugcagaccuuggggga

SEQ ID NO: 2213762 - RNA, 23 nt, Homo sapiens
gacuaugacggugacucuuggca

SEQ ID NO: 2213763 - RNA, 14 nt, Homo sapiens
gcagugccuugcau

SEQ ID NO: 2213764 - RNA, 13 nt, Homo sapiens
acuguuuuaucug

SEQ ID NO: 2213765 - RNA, 14 nt, Homo sapiens
uuuuaaacuuugau

SEQ ID NO: 2213766 - RNA, 23 nt, Homo sapiens
ccgcuccagggguggcuggagac

SEQ ID NO: 2213767 - RNA, 22 nt, Homo sapiens
ucaggcgccuggcacauuucag

SEQ ID NO: 2213768 - RNA, 17 nt, Homo sapiens
gauguuuuguacuuaca

SEQ ID NO: 2213769 - RNA, 19 nt, Homo sapiens
aguucugacgcugacaaua

SEQ ID NO: 2213770 - RNA, 18 nt, Homo sapiens
ucaggagaucgagaccau

SEQ ID NO: 2213771 - RNA, 20 nt, Homo sapiens
acugcacuccagccugggug

SEQ ID NO: 2213772 - RNA, 12 nt, Homo sapiens
ggacacccucac

SEQ ID NO: 2213773 - RNA, 13 nt, Homo sapiens
uacaaguguauau

SEQ ID NO: 2213774 - RNA, 13 nt, Homo sapiens
cccgugugccuga

SEQ ID NO: 2213775 - RNA, 15 nt, Homo sapiens
caacaaauaagucaa

SEQ ID NO: 2213776 - RNA, 15 nt, Homo sapiens
ggcuacucagcagua

SEQ ID NO: 2213777 - RNA, 15 nt, Homo sapiens
aucuaccugccucag

SEQ ID NO: 2213778 - RNA, 13 nt, Homo sapiens
cuuccgaaaacca

SEQ ID NO: 2213779 - RNA, 14 nt, Homo sapiens
acuaugcacugcug

SEQ ID NO: 2213780 - RNA, 16 nt, Homo sapiens
agugacacaaauugaa

SEQ ID NO: 2213781 - RNA, 22 nt, Homo sapiens
agaaguuccuagugauggcuua

SEQ ID NO: 2213782 - RNA, 17 nt, Homo sapiens
cacuguuugccauucuc

SEQ ID NO: 2213783 - RNA, 20 nt, Homo sapiens
gccugcccccuaucuugucc

SEQ ID NO: 2213784 - RNA, 24 nt, Homo sapiens
augaggucuguuuaaaguggcaau

SEQ ID NO: 2213785 - RNA, 16 nt, Homo sapiens
cuaaucgaaugaacaa

SEQ ID NO: 2213786 - RNA, 18 nt, Homo sapiens
accagagcacuguauacc

SEQ ID NO: 2213787 - RNA, 20 nt, Homo sapiens
gagaaauaaaaagccuguca

SEQ ID NO: 2213788 - RNA, 15 nt, Homo sapiens
cuucuccugccuaau

SEQ ID NO: 2213789 - RNA, 21 nt, Homo sapiens
ccaccugacauguccuucuga

SEQ ID NO: 2213790 - RNA, 19 nt, Homo sapiens
agcagacaucaagcucaag

SEQ ID NO: 2213791 - RNA, 17 nt, Homo sapiens
ggcacaguacccgguga

SEQ ID NO: 2213792 - RNA, 16 nt, Homo sapiens
auugucguuucauuca

SEQ ID NO: 2213793 - RNA, 23 nt, Homo sapiens
ccaaacaggauguggaaaaugaa

SEQ ID NO: 2213794 - RNA, 19 nt, Homo sapiens
uugcuguugugcagugugc

SEQ ID NO: 2213795 - RNA, 16 nt, Homo sapiens
gaaauaguucugugac

SEQ ID NO: 2213796 - RNA, 15 nt, Homo sapiens
ugcaaaugccuccaa

SEQ ID NO: 2213797 - RNA, 20 nt, Homo sapiens
caaguguaugcacgugugca

SEQ ID NO: 2213798 - RNA, 18 nt, Homo sapiens
guuaauacuccagagaca

SEQ ID NO: 2213799 - RNA, 23 nt, Homo sapiens
gcaaauuucuaucagccuugcua

SEQ ID NO: 2213800 - RNA, 22 nt, Homo sapiens
cacagacuuccaccaugugcau

SEQ ID NO: 2213801 - RNA, 12 nt, Homo sapiens
gaaaaugugcaa

SEQ ID NO: 2213802 - RNA, 17 nt, Homo sapiens
aauguaccggcuuccau

SEQ ID NO: 2213803 - RNA, 22 nt, Homo sapiens
aguccugguuuccucagccuca

SEQ ID NO: 2213804 - RNA, 20 nt, Homo sapiens
cucuuccacuuugauaccau

SEQ ID NO: 2213805 - RNA, 16 nt, Homo sapiens
agacggaggugccuga

SEQ ID NO: 2213806 - RNA, 21 nt, Homo sapiens
ugcaaaccucacagggucccc

SEQ ID NO: 2213807 - RNA, 23 nt, Homo sapiens
aaaccgaacugggcauauuucua

SEQ ID NO: 2213808 - RNA, 23 nt, Homo sapiens
ccuguuagacucuuacuuuuuaa

SEQ ID NO: 2213809 - RNA, 23 nt, Homo sapiens
ccaaggccucauccuggggagga

SEQ ID NO: 2213810 - RNA, 14 nt, Homo sapiens
agcacaguauuuaa

SEQ ID NO: 2213811 - RNA, 13 nt, Homo sapiens
agcuaaguacaca

SEQ ID NO: 2213812 - RNA, 12 nt, Homo sapiens
auagaucagcca

SEQ ID NO: 2213813 - RNA, 16 nt, Homo sapiens
cuggggauuaccauuc

SEQ ID NO: 2213814 - RNA, 18 nt, Homo sapiens
auuguuacauaguuaaau

SEQ ID NO: 2213815 - RNA, 19 nt, Homo sapiens
uccaucuguggaaaugaca

SEQ ID NO: 2213816 - RNA, 16 nt, Homo sapiens
caggugcucuguggau

SEQ ID NO: 2213817 - RNA, 22 nt, Homo sapiens
agaaacaccagccgaggccaca

SEQ ID NO: 2213818 - RNA, 19 nt, Homo sapiens
ugugucccugaaguauuua

SEQ ID NO: 2213819 - RNA, 21 nt, Homo sapiens
auucaauaccgcucaguauuu

SEQ ID NO: 2213820 - RNA, 11 nt, Homo sapiens
ccagcacucug

SEQ ID NO: 2213821 - RNA, 19 nt, Homo sapiens
cacauuucuccuguuuaca

SEQ ID NO: 2213822 - RNA, 13 nt, Homo sapiens
cuugcugacaaua

SEQ ID NO: 2213823 - RNA, 18 nt, Homo sapiens
agaucuaguuacuguggu

SEQ ID NO: 2213824 - RNA, 16 nt, Homo sapiens
augaaauacuugacaa

SEQ ID NO: 2213825 - RNA, 23 nt, Homo sapiens
aucugugaggggcucucucauga

SEQ ID NO: 2213826 - RNA, 18 nt, Homo sapiens
aguaauugggaaaaaagc

SEQ ID NO: 2213827 - RNA, 13 nt, Homo sapiens
gugucacuggcuu

SEQ ID NO: 2213828 - RNA, 23 nt, Homo sapiens
acccaucggguaagaugcuccug

SEQ ID NO: 2213829 - RNA, 19 nt, Homo sapiens
ucaacucccuucucggggu

SEQ ID NO: 2213830 - RNA, 23 nt, Homo sapiens
auucucaccuaaacccucuguga

SEQ ID NO: 2213831 - RNA, 17 nt, Homo sapiens
cugagauuacucugaaa

SEQ ID NO: 2213832 - RNA, 21 nt, Homo sapiens
caccuuuggugcagagguuuc

SEQ ID NO: 2213833 - RNA, 17 nt, Homo sapiens
uuucuucuucauuccau

SEQ ID NO: 2213834 - RNA, 15 nt, Homo sapiens
cuggcuccaaggugc

SEQ ID NO: 2213835 - RNA, 16 nt, Homo sapiens
gauauaucaaacugaa

SEQ ID NO: 2213836 - RNA, 18 nt, Homo sapiens
cuguuccuucacauccug

SEQ ID NO: 2213837 - RNA, 17 nt, Homo sapiens
aguccacacuuugucca

SEQ ID NO: 2213838 - RNA, 20 nt, Homo sapiens
gguuagaaaaaggacucugc

SEQ ID NO: 2213839 - RNA, 19 nt, Homo sapiens
augggcugcacaggcacug

SEQ ID NO: 2213840 - RNA, 14 nt, Homo sapiens
ucuggcacacuccc

SEQ ID NO: 2213841 - RNA, 21 nt, Homo sapiens
uuccagugguuugagacacug

SEQ ID NO: 2213842 - RNA, 22 nt, Homo sapiens
cugagcagugcuugaaugaagu

SEQ ID NO: 2213843 - RNA, 14 nt, Homo sapiens
cuaacacggugcuc

SEQ ID NO: 2213844 - RNA, 12 nt, Homo sapiens
uggcaagcugca

SEQ ID NO: 2213845 - RNA, 16 nt, Homo sapiens
accccaucucuacuga

SEQ ID NO: 2213846 - RNA, 19 nt, Homo sapiens
guaauuaaauacuauuaau

SEQ ID NO: 2213847 - RNA, 13 nt, Homo sapiens
uuucuaaagccac

SEQ ID NO: 2213848 - RNA, 17 nt, Homo sapiens
auuuaaaauugcuaugu

SEQ ID NO: 2213849 - RNA, 15 nt, Homo sapiens
augcuggacuugccu

SEQ ID NO: 2213850 - RNA, 16 nt, Homo sapiens
cacuuacagauggcag

SEQ ID NO: 2213851 - RNA, 20 nt, Homo sapiens
agaaucauacuuaacauuuc

SEQ ID NO: 2213852 - RNA, 13 nt, Homo sapiens
uccuagauguguu

SEQ ID NO: 2213853 - RNA, 16 nt, Homo sapiens
ccauucagacuuucag

SEQ ID NO: 2213854 - RNA, 16 nt, Homo sapiens
ccucaaacacacaaac

SEQ ID NO: 2213855 - RNA, 19 nt, Homo sapiens
cuuccuggaggugacacuu

SEQ ID NO: 2213856 - RNA, 19 nt, Homo sapiens
cuugcugcaaacccaugaa

SEQ ID NO: 2213857 - RNA, 15 nt, Homo sapiens
cuuuuguaagacauu

SEQ ID NO: 2213858 - RNA, 17 nt, Homo sapiens
uuaccaaauaaagcaaa

SEQ ID NO: 2213859 - RNA, 14 nt, Homo sapiens
uugaaaaaugcaug

SEQ ID NO: 2213860 - RNA, 20 nt, Homo sapiens
gugaggaacccugaucucuc

SEQ ID NO: 2213861 - RNA, 22 nt, Homo sapiens
ggaaaucugccaugagcacaaa

SEQ ID NO: 2213862 - RNA, 23 nt, Homo sapiens
ggccucaugguaagagucacaau

SEQ ID NO: 2213863 - RNA, 19 nt, Homo sapiens
cauuuuuuaaaaaagcaag

SEQ ID NO: 2213864 - RNA, 16 nt, Homo sapiens
uguaugugcgugugug

SEQ ID NO: 2213865 - RNA, 16 nt, Homo sapiens
uauauauacauguaua

SEQ ID NO: 2213866 - RNA, 20 nt, Homo sapiens
acuaccugaugugcaguuua

SEQ ID NO: 2213867 - RNA, 12 nt, Homo sapiens
uaggcacacaga

SEQ ID NO: 2213868 - RNA, 13 nt, Homo sapiens
uucugacaucagc

SEQ ID NO: 2213869 - RNA, 18 nt, Homo sapiens
uuaagcaauucauucucu

SEQ ID NO: 2213870 - RNA, 14 nt, Homo sapiens
gguucugcacuguu

SEQ ID NO: 2213871 - RNA, 21 nt, Homo sapiens
uucacaaaccagagaccaaau

SEQ ID NO: 2213872 - RNA, 19 nt, Homo sapiens
auucuuugcaauacugcuu

SEQ ID NO: 2213873 - RNA, 13 nt, Homo sapiens
uacaaacaagcac

SEQ ID NO: 2213874 - RNA, 22 nt, Homo sapiens
cugccaucgaccuggagacuga

SEQ ID NO: 2213875 - RNA, 23 nt, Homo sapiens
cugcuuaguacauuugaugcaaa

SEQ ID NO: 2213876 - RNA, 16 nt, Homo sapiens
cagggaccaaggagau

SEQ ID NO: 2213877 - RNA, 19 nt, Homo sapiens
aagaaccccucugucuuca

SEQ ID NO: 2213878 - RNA, 21 nt, Homo sapiens
aaguuaguuuuuaaucucucc

SEQ ID NO: 2213879 - RNA, 21 nt, Homo sapiens
cccaugggagggagcugagaa

SEQ ID NO: 2213880 - RNA, 13 nt, Homo sapiens
ucugaagaucuca

SEQ ID NO: 2213881 - RNA, 14 nt, Homo sapiens
gcccagagcccggu

SEQ ID NO: 2213882 - RNA, 14 nt, Homo sapiens
aaggaagaggaaga

SEQ ID NO: 2213883 - RNA, 18 nt, Homo sapiens
aguuacuacuuacaggug

SEQ ID NO: 2213884 - RNA, 15 nt, Homo sapiens
cagauuuaagccuua

SEQ ID NO: 2213885 - RNA, 21 nt, Homo sapiens
cucaggccaucaucaguggag

SEQ ID NO: 2213886 - RNA, 21 nt, Homo sapiens
caggagaauuucuacugagcg

SEQ ID NO: 2213887 - RNA, 13 nt, Homo sapiens
ccccacuuuucag

SEQ ID NO: 2213888 - RNA, 18 nt, Homo sapiens
agguugcaguaagccaag

SEQ ID NO: 2213889 - RNA, 16 nt, Homo sapiens
cucuaacagcaccaaa

SEQ ID NO: 2213890 - RNA, 14 nt, Homo sapiens
gacauccugugaug

SEQ ID NO: 2213891 - RNA, 21 nt, Homo sapiens
cagauucaauauuaugaauuc

SEQ ID NO: 2213892 - RNA, 23 nt, Homo sapiens
guuuuguuuuuuuucagccacua

SEQ ID NO: 2213893 - RNA, 13 nt, Homo sapiens
auuuaaguuaaau

SEQ ID NO: 2213894 - RNA, 12 nt, Homo sapiens
aaauccacagug

SEQ ID NO: 2213895 - RNA, 15 nt, Homo sapiens
cucuauuuagcauga

SEQ ID NO: 2213896 - RNA, 21 nt, Homo sapiens
cagagcuccugaguggaauca

SEQ ID NO: 2213897 - RNA, 12 nt, Homo sapiens
auucuuuagugu

SEQ ID NO: 2213898 - RNA, 14 nt, Homo sapiens
cuuccucuuaccug

SEQ ID NO: 2213899 - RNA, 22 nt, Homo sapiens
ggaggaggcugaggccugugaa

SEQ ID NO: 2213900 - RNA, 18 nt, Homo sapiens
ucaaaaagaacuaaauau

SEQ ID NO: 2213901 - RNA, 13 nt, Homo sapiens
ucacuuccuacaa

SEQ ID NO: 2213902 - RNA, 13 nt, Homo sapiens
ccacaucccacau

SEQ ID NO: 2213903 - RNA, 14 nt, Homo sapiens
acagcuccaggaca

SEQ ID NO: 2213904 - RNA, 19 nt, Homo sapiens
ccccggccacccagggauc

SEQ ID NO: 2213905 - RNA, 14 nt, Homo sapiens
ucucagccacugaa

SEQ ID NO: 2213906 - RNA, 16 nt, Homo sapiens
gcuucauuuccugugu

SEQ ID NO: 2213907 - RNA, 15 nt, Homo sapiens
auucuggaaucacaa

SEQ ID NO: 2213908 - RNA, 22 nt, Homo sapiens
accaugcugcuggggaagacag

SEQ ID NO: 2213909 - RNA, 20 nt, Homo sapiens
uggcauauccauuguggaaa

SEQ ID NO: 2213910 - RNA, 16 nt, Homo sapiens
cauuaaaagacaaaua

SEQ ID NO: 2213911 - RNA, 15 nt, Homo sapiens
acaagaccaccacuu

SEQ ID NO: 2213912 - RNA, 16 nt, Homo sapiens
accugaaacacuggac

SEQ ID NO: 2213913 - RNA, 12 nt, Homo sapiens
cccugcacugaa

SEQ ID NO: 2213914 - RNA, 13 nt, Homo sapiens
cucuuuugcacau

SEQ ID NO: 2213915 - RNA, 16 nt, Homo sapiens
gccuccauccacacac

SEQ ID NO: 2213916 - RNA, 16 nt, Homo sapiens
ugagaagaccaggaaa

SEQ ID NO: 2213917 - RNA, 16 nt, Homo sapiens
aauaaaugucuugccu

SEQ ID NO: 2213918 - RNA, 14 nt, Homo sapiens
gcaccagaugggau

SEQ ID NO: 2213919 - RNA, 22 nt, Homo sapiens
caacuguugauacaaauguuag

SEQ ID NO: 2213920 - RNA, 22 nt, Homo sapiens
cucccaggguggacuucagugu

SEQ ID NO: 2213921 - RNA, 15 nt, Homo sapiens
cuuaacaaucaaauc

SEQ ID NO: 2213922 - RNA, 22 nt, Homo sapiens
caauuaauugcuauuguguuau

SEQ ID NO: 2213923 - RNA, 15 nt, Homo sapiens
cauugucucagugaa

SEQ ID NO: 2213924 - RNA, 18 nt, Homo sapiens
gcugaugaggcuggugac

SEQ ID NO: 2213925 - RNA, 20 nt, Homo sapiens
ugggaaaagaagcugucaga

SEQ ID NO: 2213926 - RNA, 19 nt, Homo sapiens
uuaugauagugguaugaca

SEQ ID NO: 2213927 - RNA, 20 nt, Homo sapiens
aaaauagcuaaauaccucaa

SEQ ID NO: 2213928 - RNA, 16 nt, Homo sapiens
aguagauuuuuaacaa

SEQ ID NO: 2213929 - RNA, 15 nt, Homo sapiens
caccacuacaguaag

SEQ ID NO: 2213930 - RNA, 16 nt, Homo sapiens
ucaccacaaaggaccc

SEQ ID NO: 2213931 - RNA, 13 nt, Homo sapiens
uugcaccuagaca

SEQ ID NO: 2213932 - RNA, 18 nt, Homo sapiens
cauaagggguuugccauu

SEQ ID NO: 2213933 - RNA, 17 nt, Homo sapiens
gaaugcacaccaaaaaa

SEQ ID NO: 2213934 - RNA, 19 nt, Homo sapiens
gcccuggguuuaaugucaa

SEQ ID NO: 2213935 - RNA, 17 nt, Homo sapiens
agaguuaccacacccca

SEQ ID NO: 2213936 - RNA, 18 nt, Homo sapiens
uaaugaggaaauguguug

SEQ ID NO: 2213937 - RNA, 12 nt, Homo sapiens
ugcagccuaaga

SEQ ID NO: 2213938 - RNA, 17 nt, Homo sapiens
aauuuugcgauacacug

SEQ ID NO: 2213939 - RNA, 22 nt, Homo sapiens
acugugcugggaacauguacca

SEQ ID NO: 2213940 - RNA, 19 nt, Homo sapiens
uccucaucuuuaaaaugaa

SEQ ID NO: 2213941 - RNA, 19 nt, Homo sapiens
accaaacacccagaggucu

SEQ ID NO: 2213942 - RNA, 17 nt, Homo sapiens
uccucucuugacaucaa

SEQ ID NO: 2213943 - RNA, 20 nt, Homo sapiens
gcuuucguaguuuucauuua

SEQ ID NO: 2213944 - RNA, 14 nt, Homo sapiens
uaaaagaauuguga

SEQ ID NO: 2213945 - RNA, 20 nt, Homo sapiens
gcaagaugcccuaauccauc

SEQ ID NO: 2213946 - RNA, 15 nt, Homo sapiens
ggauuuauucugcca

SEQ ID NO: 2213947 - RNA, 17 nt, Homo sapiens
uggugacacacagcagc

SEQ ID NO: 2213948 - RNA, 15 nt, Homo sapiens
aacgucagccagcuc

SEQ ID NO: 2213949 - RNA, 17 nt, Homo sapiens
gggagaaggcagugauu

SEQ ID NO: 2213950 - RNA, 12 nt, Homo sapiens
ggucaguugcca

SEQ ID NO: 2213951 - RNA, 13 nt, Homo sapiens
ggcuugggcaaua

SEQ ID NO: 2213952 - RNA, 22 nt, Homo sapiens
gaauuaaaagucuacagcacua

SEQ ID NO: 2213953 - RNA, 14 nt, Homo sapiens
uccgccuguaaaau

SEQ ID NO: 2213954 - RNA, 16 nt, Homo sapiens
aaaauaaugcauuugu

SEQ ID NO: 2213955 - RNA, 16 nt, Homo sapiens
uagcccuggaccugcc

SEQ ID NO: 2213956 - RNA, 16 nt, Homo sapiens
aaccuuucaaauuuca

SEQ ID NO: 2213957 - RNA, 19 nt, Homo sapiens
uaaauauccacaguacuca

SEQ ID NO: 2213958 - RNA, 21 nt, Homo sapiens
agaggaaugaaguacucauac

SEQ ID NO: 2213959 - RNA, 19 nt, Homo sapiens
augucacagauuccuggca

SEQ ID NO: 2213960 - RNA, 11 nt, Homo sapiens
uguaaaaccaa

SEQ ID NO: 2213961 - RNA, 22 nt, Homo sapiens
cuggcugcccuucuucuugacc

SEQ ID NO: 2213962 - RNA, 22 nt, Homo sapiens
acucuuccccauaaucacugac

SEQ ID NO: 2213963 - RNA, 18 nt, Homo sapiens
auaguuaauuauuucaac

SEQ ID NO: 2213964 - RNA, 18 nt, Homo sapiens
uuugaucuuuuuauauuc

SEQ ID NO: 2213965 - RNA, 18 nt, Homo sapiens
aaagauaaaaauaucauc

SEQ ID NO: 2213966 - RNA, 17 nt, Homo sapiens
aucauuugcaaugcccu

SEQ ID NO: 2213967 - RNA, 20 nt, Homo sapiens
acuuugucacuucugcugua

SEQ ID NO: 2213968 - RNA, 17 nt, Homo sapiens
ugagugaaauauuacuc

SEQ ID NO: 2213969 - RNA, 14 nt, Homo sapiens
guuggaacauuuca

SEQ ID NO: 2213970 - RNA, 16 nt, Homo sapiens
caaagaccaaugugaa

SEQ ID NO: 2213971 - RNA, 13 nt, Homo sapiens
ugacagugccaau

SEQ ID NO: 2213972 - RNA, 15 nt, Homo sapiens
aacagcacccucucc

SEQ ID NO: 2213973 - RNA, 10 nt, Homo sapiens
aucagucuuu

SEQ ID NO: 2213974 - RNA, 18 nt, Homo sapiens
uuucauggcagcaagugu

SEQ ID NO: 2213975 - RNA, 20 nt, Homo sapiens
ucaucaaacauuugccaagu

SEQ ID NO: 2213976 - RNA, 11 nt, Homo sapiens
caccucuccaa

SEQ ID NO: 2213977 - RNA, 21 nt, Homo sapiens
ucacgaggcuuggaccugcug

SEQ ID NO: 2213978 - RNA, 16 nt, Homo sapiens
acuuggucaccagcuc

SEQ ID NO: 2213979 - RNA, 20 nt, Homo sapiens
auauucacugguuuuacaca

SEQ ID NO: 2213980 - RNA, 22 nt, Homo sapiens
uaacagauguagcaacaugaga

SEQ ID NO: 2213981 - RNA, 17 nt, Homo sapiens
aaaaagcccuaauagca

SEQ ID NO: 2213982 - RNA, 13 nt, Homo sapiens
auauauaauacug

SEQ ID NO: 2213983 - RNA, 16 nt, Homo sapiens
uaugaaaugggcuuua

SEQ ID NO: 2213984 - RNA, 19 nt, Homo sapiens
gacaugcuucagugcugcu

SEQ ID NO: 2213985 - RNA, 22 nt, Homo sapiens
uguagagacgaggucuugugau

SEQ ID NO: 2213986 - RNA, 15 nt, Homo sapiens
gacuccagccugaau

SEQ ID NO: 2213987 - RNA, 14 nt, Homo sapiens
ggugugaccacugc

SEQ ID NO: 2213988 - RNA, 16 nt, Homo sapiens
uguauuugcauaugua

SEQ ID NO: 2213989 - RNA, 20 nt, Homo sapiens
accaaguuggucuuacuuug

SEQ ID NO: 2213990 - RNA, 22 nt, Homo sapiens
cuuccacaacagaaguauuucu

SEQ ID NO: 2213991 - RNA, 17 nt, Homo sapiens
uguggacuccaugccuc

SEQ ID NO: 2213992 - RNA, 16 nt, Homo sapiens
uuucuuuguaucauuc

SEQ ID NO: 2213993 - RNA, 19 nt, Homo sapiens
gccagcagucuaccugcuc

SEQ ID NO: 2213994 - RNA, 23 nt, Homo sapiens
cugaaguugcugagcaguauucc

SEQ ID NO: 2213995 - RNA, 14 nt, Homo sapiens
uacacaagcaucac

SEQ ID NO: 2213996 - RNA, 19 nt, Homo sapiens
uugugguagugaugguugu

SEQ ID NO: 2213997 - RNA, 12 nt, Homo sapiens
uaggcacaugug

SEQ ID NO: 2213998 - RNA, 12 nt, Homo sapiens
uauacacaugga

SEQ ID NO: 2213999 - RNA, 19 nt, Homo sapiens
ccgggcaagcacuaccagg

SEQ ID NO: 2214000 - RNA, 23 nt, Homo sapiens
uaaaauguggucugccaaucugu

SEQ ID NO: 2214001 - RNA, 17 nt, Homo sapiens
uaacuaaccacauuuua

SEQ ID NO: 2214002 - RNA, 16 nt, Homo sapiens
cugggaacacaucugg

SEQ ID NO: 2214003 - RNA, 15 nt, Homo sapiens
ccgcuuucaugaaca

SEQ ID NO: 2214004 - RNA, 19 nt, Homo sapiens
acggccacuggccaucucc

SEQ ID NO: 2214005 - RNA, 20 nt, Homo sapiens
uguuacagguuacaugagag

SEQ ID NO: 2214006 - RNA, 16 nt, Homo sapiens
uauaggaaacuaagca

SEQ ID NO: 2214007 - RNA, 17 nt, Homo sapiens
cugcucugcccaggcaa

SEQ ID NO: 2214008 - RNA, 22 nt, Homo sapiens
acuaagccccgucugaccccag

SEQ ID NO: 2214009 - RNA, 17 nt, Homo sapiens
aaaaugacaaugaugau

SEQ ID NO: 2214010 - RNA, 22 nt, Homo sapiens
uacucaugcauucuuuugcaca

SEQ ID NO: 2214011 - RNA, 13 nt, Homo sapiens
uccagauauacuu

SEQ ID NO: 2214012 - RNA, 19 nt, Homo sapiens
aguacaugauaaaugauag

SEQ ID NO: 2214013 - RNA, 21 nt, Homo sapiens
gagaaucgcuugaacccagga

SEQ ID NO: 2214014 - RNA, 20 nt, Homo sapiens
gccaauuuuuguacuuuuag

SEQ ID NO: 2214015 - RNA, 22 nt, Homo sapiens
augauagcagacauuguuacaa

SEQ ID NO: 2214016 - RNA, 18 nt, Homo sapiens
gaaaccugcccugccuga

SEQ ID NO: 2214017 - RNA, 15 nt, Homo sapiens
aaacauaucauggua

SEQ ID NO: 2214018 - RNA, 12 nt, Homo sapiens
aacccaagagag

SEQ ID NO: 2214019 - RNA, 21 nt, Homo sapiens
aucacugucuugccagauuac

SEQ ID NO: 2214020 - RNA, 13 nt, Homo sapiens
aagaaguucacca

SEQ ID NO: 2214021 - RNA, 17 nt, Homo sapiens
aucugccauaaagccau

SEQ ID NO: 2214022 - RNA, 17 nt, Homo sapiens
aauuuauuuauauuccg

SEQ ID NO: 2214023 - RNA, 13 nt, Homo sapiens
acaaaaaaauuaa

SEQ ID NO: 2214024 - RNA, 16 nt, Homo sapiens
uaaguuuuuguaaaag

SEQ ID NO: 2214025 - RNA, 18 nt, Homo sapiens
ccugcuuaaaacuuuuca

SEQ ID NO: 2214026 - RNA, 19 nt, Homo sapiens
uucuguguaccacugggau

SEQ ID NO: 2214027 - RNA, 18 nt, Homo sapiens
ucucagcuaacauuccau

SEQ ID NO: 2214028 - RNA, 17 nt, Homo sapiens
aagucauuaaaauggaa

SEQ ID NO: 2214029 - RNA, 14 nt, Homo sapiens
ucaugcuacagaga

SEQ ID NO: 2214030 - RNA, 22 nt, Homo sapiens
cuuuaaugaauaaacauuugua

SEQ ID NO: 2214031 - RNA, 20 nt, Homo sapiens
cucuuaauaagcccacauau

SEQ ID NO: 2214032 - RNA, 18 nt, Homo sapiens
cagagggccauugaacuc

SEQ ID NO: 2214033 - RNA, 22 nt, Homo sapiens
auguccugcccacuaaaagaau

SEQ ID NO: 2214034 - RNA, 17 nt, Homo sapiens
uauuugagagacauuug

SEQ ID NO: 2214035 - RNA, 15 nt, Homo sapiens
auuaagcaucacaaa

SEQ ID NO: 2214036 - RNA, 23 nt, Homo sapiens
cagggaauccugaccugagccag

SEQ ID NO: 2214037 - RNA, 23 nt, Homo sapiens
gcaaaaucagaauggaaugcucu

SEQ ID NO: 2214038 - RNA, 14 nt, Homo sapiens
ccugacugcaauga

SEQ ID NO: 2214039 - RNA, 11 nt, Homo sapiens
ccuuugcugca

SEQ ID NO: 2214040 - RNA, 11 nt, Homo sapiens
cauuugcugaa

SEQ ID NO: 2214041 - RNA, 13 nt, Homo sapiens
aagaguguggugu

SEQ ID NO: 2214042 - RNA, 19 nt, Homo sapiens
ggcugaguguucugggauu

SEQ ID NO: 2214043 - RNA, 20 nt, Homo sapiens
aaagagaaagaaaaccugga

SEQ ID NO: 2214044 - RNA, 11 nt, Homo sapiens
ccaacauggau

SEQ ID NO: 2214045 - RNA, 22 nt, Homo sapiens
aaugcuuucucuccucuucucc

SEQ ID NO: 2214046 - RNA, 22 nt, Homo sapiens
acugauccucgcaucucagccu

SEQ ID NO: 2214047 - RNA, 12 nt, Homo sapiens
agguaucugaug

SEQ ID NO: 2214048 - RNA, 21 nt, Homo sapiens
auuuuuuuugcuucuggcuac

SEQ ID NO: 2214049 - RNA, 18 nt, Homo sapiens
uauuagguccauucauua

SEQ ID NO: 2214050 - RNA, 14 nt, Homo sapiens
cuuaagaugcaaau

SEQ ID NO: 2214051 - RNA, 13 nt, Homo sapiens
uugcaaauagcca

SEQ ID NO: 2214052 - RNA, 13 nt, Homo sapiens
gugaccaaccuuu

SEQ ID NO: 2214053 - RNA, 10 nt, Homo sapiens
caauagucaa

SEQ ID NO: 2214054 - RNA, 19 nt, Homo sapiens
aguauaaagucacuuccag

SEQ ID NO: 2214055 - RNA, 15 nt, Homo sapiens
guucuuugauuugua

SEQ ID NO: 2214056 - RNA, 17 nt, Homo sapiens
agccucccucugaccug

SEQ ID NO: 2214057 - RNA, 19 nt, Homo sapiens
gggcaacgagugaaacucc

SEQ ID NO: 2214058 - RNA, 16 nt, Homo sapiens
aacuucccuccaucca

SEQ ID NO: 2214059 - RNA, 22 nt, Homo sapiens
ccucccaggcucaagcuguccu

SEQ ID NO: 2214060 - RNA, 19 nt, Homo sapiens
aguaaucccccuugccaaa

SEQ ID NO: 2214061 - RNA, 22 nt, Homo sapiens
gcgagcccccggucaccuuccu

SEQ ID NO: 2214062 - RNA, 19 nt, Homo sapiens
guaucacgggucacuugaa

SEQ ID NO: 2214063 - RNA, 14 nt, Homo sapiens
uaaaaccuuacuua

SEQ ID NO: 2214064 - RNA, 14 nt, Homo sapiens
accauccuacauaa

SEQ ID NO: 2214065 - RNA, 13 nt, Homo sapiens
acccgagucaauu

SEQ ID NO: 2214066 - RNA, 12 nt, Homo sapiens
accucaccugcu

SEQ ID NO: 2214067 - RNA, 19 nt, Homo sapiens
uuucuuaucccagugauca

SEQ ID NO: 2214068 - RNA, 17 nt, Homo sapiens
cacaagaccaagguaua

SEQ ID NO: 2214069 - RNA, 19 nt, Homo sapiens
aguuguauuuuaauaaaga

SEQ ID NO: 2214070 - RNA, 17 nt, Homo sapiens
agaaacuguuacugucc

SEQ ID NO: 2214071 - RNA, 23 nt, Homo sapiens
uauguauauauuuuucugauuau

SEQ ID NO: 2214072 - RNA, 14 nt, Homo sapiens
cagcuggcucugac

SEQ ID NO: 2214073 - RNA, 23 nt, Homo sapiens
cacuggauccagaagcuauggaa

SEQ ID NO: 2214074 - RNA, 15 nt, Homo sapiens
cagauggaccaaaag

SEQ ID NO: 2214075 - RNA, 13 nt, Homo sapiens
cccugaacugcuu

SEQ ID NO: 2214076 - RNA, 19 nt, Homo sapiens
uggaggggacgcuggcuaa

SEQ ID NO: 2214077 - RNA, 16 nt, Homo sapiens
cugucugccagcauau

SEQ ID NO: 2214078 - RNA, 18 nt, Homo sapiens
guuacauguuugcaccuu

SEQ ID NO: 2214079 - RNA, 17 nt, Homo sapiens
ugccaccuuuauggacu

SEQ ID NO: 2214080 - RNA, 17 nt, Homo sapiens
uagggcgacgucuucag

SEQ ID NO: 2214081 - RNA, 13 nt, Homo sapiens
cuggccccaaaag

SEQ ID NO: 2214082 - RNA, 19 nt, Homo sapiens
cugauggcacuaacacugg

SEQ ID NO: 2214083 - RNA, 18 nt, Homo sapiens
accaaugaagaagacaaa

SEQ ID NO: 2214084 - RNA, 18 nt, Homo sapiens
agugacaguggucccaga

SEQ ID NO: 2214085 - RNA, 12 nt, Homo sapiens
ccuuuuccagaa

SEQ ID NO: 2214086 - RNA, 16 nt, Homo sapiens
ccugucccacuggcuc

SEQ ID NO: 2214087 - RNA, 19 nt, Homo sapiens
uaucugugucaaaagccag

SEQ ID NO: 2214088 - RNA, 22 nt, Homo sapiens
ugaaauaugauaauaaaggcau

SEQ ID NO: 2214089 - RNA, 16 nt, Homo sapiens
ucuuagucgagccaag

SEQ ID NO: 2214090 - RNA, 14 nt, Homo sapiens
cagaagaacaaaga

SEQ ID NO: 2214091 - RNA, 16 nt, Homo sapiens
cuugcuggucuaguca

SEQ ID NO: 2214092 - RNA, 13 nt, Homo sapiens
gucccugcagggc

SEQ ID NO: 2214093 - RNA, 17 nt, Homo sapiens
acaggcgcaacuccucc

SEQ ID NO: 2214094 - RNA, 20 nt, Homo sapiens
agagaauaaacuagaucuag

SEQ ID NO: 2214095 - RNA, 19 nt, Homo sapiens
acguguccagaacacucug

SEQ ID NO: 2214096 - RNA, 19 nt, Homo sapiens
uuacgcugcucuccugaca

SEQ ID NO: 2214097 - RNA, 15 nt, Homo sapiens
gcaagggcugugcug

SEQ ID NO: 2214098 - RNA, 22 nt, Homo sapiens
ugaggaugacagugacacccag

SEQ ID NO: 2214099 - RNA, 17 nt, Homo sapiens
gugccauagaugguucu

SEQ ID NO: 2214100 - RNA, 18 nt, Homo sapiens
gagcugagugcuagagua

SEQ ID NO: 2214101 - RNA, 16 nt, Homo sapiens
ggaugaugguugcaaa

SEQ ID NO: 2214102 - RNA, 16 nt, Homo sapiens
cccuacuuucuggaag

SEQ ID NO: 2214103 - RNA, 20 nt, Homo sapiens
cuccugcgucuggauuuuau

SEQ ID NO: 2214104 - RNA, 19 nt, Homo sapiens
gugaugguacacagugggu

SEQ ID NO: 2214105 - RNA, 15 nt, Homo sapiens
ugaagcccagugaau

SEQ ID NO: 2214106 - RNA, 23 nt, Homo sapiens
ucaugaauauauuaaucagcauu

SEQ ID NO: 2214107 - RNA, 18 nt, Homo sapiens
auuuaacugaacugugaa

SEQ ID NO: 2214108 - RNA, 17 nt, Homo sapiens
ugggucccggcucugug

SEQ ID NO: 2214109 - RNA, 22 nt, Homo sapiens
aggggugggggugccgcucucu

SEQ ID NO: 2214110 - RNA, 17 nt, Homo sapiens
ccuacuccgcucacuga

SEQ ID NO: 2214111 - RNA, 14 nt, Homo sapiens
gcgaagggugguuu

SEQ ID NO: 2214112 - RNA, 13 nt, Homo sapiens
agaagcuauuuca

SEQ ID NO: 2214113 - RNA, 21 nt, Homo sapiens
cagcggucagauagcaucaga

SEQ ID NO: 2214114 - RNA, 11 nt, Homo sapiens
uguaucuucac

SEQ ID NO: 2214115 - RNA, 12 nt, Homo sapiens
ugcuggggagcc

SEQ ID NO: 2214116 - RNA, 18 nt, Homo sapiens
agacugucuuaauuugca

SEQ ID NO: 2214117 - RNA, 15 nt, Homo sapiens
uaguccuguacugua

SEQ ID NO: 2214118 - RNA, 14 nt, Homo sapiens
auuuuguucauaca

SEQ ID NO: 2214119 - RNA, 17 nt, Homo sapiens
agcaggucccugugagc

SEQ ID NO: 2214120 - RNA, 12 nt, Homo sapiens
aggcacaucaau

SEQ ID NO: 2214121 - RNA, 16 nt, Homo sapiens
ucuguuauauagugga

SEQ ID NO: 2214122 - RNA, 18 nt, Homo sapiens
uaagaauuucaauaucaa

SEQ ID NO: 2214123 - RNA, 18 nt, Homo sapiens
ucagccugaccaacaugg

SEQ ID NO: 2214124 - RNA, 16 nt, Homo sapiens
uguauggaucuauauu

SEQ ID NO: 2214125 - RNA, 22 nt, Homo sapiens
ugaacuguggugccacaugacc

SEQ ID NO: 2214126 - RNA, 17 nt, Homo sapiens
cucagccaucuguagaa

SEQ ID NO: 2214127 - RNA, 17 nt, Homo sapiens
guuaacacuguaauauc

SEQ ID NO: 2214128 - RNA, 14 nt, Homo sapiens
caugaaauaugcau

SEQ ID NO: 2214129 - RNA, 20 nt, Homo sapiens
uaguaagggaacuauggaaa

SEQ ID NO: 2214130 - RNA, 22 nt, Homo sapiens
ccaaacaaaacugaaccacaaa

SEQ ID NO: 2214131 - RNA, 23 nt, Homo sapiens
cauuucucaaaugcacaucucau

SEQ ID NO: 2214132 - RNA, 13 nt, Homo sapiens
aaaugauccugcc

SEQ ID NO: 2214133 - RNA, 19 nt, Homo sapiens
uccagaaaacaaaacugca

SEQ ID NO: 2214134 - RNA, 14 nt, Homo sapiens
gcaacagccuguuu

SEQ ID NO: 2214135 - RNA, 23 nt, Homo sapiens
ccucaguaaauguacaacugcac

SEQ ID NO: 2214136 - RNA, 23 nt, Homo sapiens
aaucccucccugacccacugugc

SEQ ID NO: 2214137 - RNA, 16 nt, Homo sapiens
uaauauugacuuguau

SEQ ID NO: 2214138 - RNA, 18 nt, Homo sapiens
agaagcagagagaugcgg

SEQ ID NO: 2214139 - RNA, 23 nt, Homo sapiens
cuaaacauccuaagcucaucuau

SEQ ID NO: 2214140 - RNA, 13 nt, Homo sapiens
gcggcacguggug

SEQ ID NO: 2214141 - RNA, 16 nt, Homo sapiens
cauuuuuuccugagaa

SEQ ID NO: 2214142 - RNA, 21 nt, Homo sapiens
uaaauguauuuuagacuuccu

SEQ ID NO: 2214143 - RNA, 13 nt, Homo sapiens
ugcuccugccagc

SEQ ID NO: 2214144 - RNA, 23 nt, Homo sapiens
uuuaaaaaaaagaaucaccaaau

SEQ ID NO: 2214145 - RNA, 21 nt, Homo sapiens
cauuucaagacagauugugaa

SEQ ID NO: 2214146 - RNA, 17 nt, Homo sapiens
auuucaaccagcacauu

SEQ ID NO: 2214147 - RNA, 16 nt, Homo sapiens
ccccaagccaugguga

SEQ ID NO: 2214148 - RNA, 18 nt, Homo sapiens
gcaacgccgugggcugcg

SEQ ID NO: 2214149 - RNA, 15 nt, Homo sapiens
ccugcagggccagac

SEQ ID NO: 2214150 - RNA, 22 nt, Homo sapiens
ucuuccagugguuugagacacu

SEQ ID NO: 2214151 - RNA, 14 nt, Homo sapiens
ucaaauuucaugaa

SEQ ID NO: 2214152 - RNA, 21 nt, Homo sapiens
cuagacuggugcuaaugucaa

SEQ ID NO: 2214153 - RNA, 15 nt, Homo sapiens
caauuccaauuucaa

SEQ ID NO: 2214154 - RNA, 18 nt, Homo sapiens
aaaaagccaccacacacu

SEQ ID NO: 2214155 - RNA, 16 nt, Homo sapiens
auauguauaauuucac

SEQ ID NO: 2214156 - RNA, 21 nt, Homo sapiens
gagaugcuaaaauucuucgca

SEQ ID NO: 2214157 - RNA, 13 nt, Homo sapiens
ucuagccacugag

SEQ ID NO: 2214158 - RNA, 13 nt, Homo sapiens
cugccccaucucc

SEQ ID NO: 2214159 - RNA, 20 nt, Homo sapiens
acucauaggggaguaggggu

SEQ ID NO: 2214160 - RNA, 13 nt, Homo sapiens
ugcaaaugugcag

SEQ ID NO: 2214161 - RNA, 13 nt, Homo sapiens
gagcgauggagca

SEQ ID NO: 2214162 - RNA, 13 nt, Homo sapiens
uucuuuacuccau

SEQ ID NO: 2214163 - RNA, 23 nt, Homo sapiens
ucccaccgguugcuucugggaag

SEQ ID NO: 2214164 - RNA, 11 nt, Homo sapiens
aauuugaacug

SEQ ID NO: 2214165 - RNA, 20 nt, Homo sapiens
acugcagggguuauguggaa

SEQ ID NO: 2214166 - RNA, 18 nt, Homo sapiens
uccuccagugcauacugu

SEQ ID NO: 2214167 - RNA, 18 nt, Homo sapiens
uuaggauuuaccaaauag

SEQ ID NO: 2214168 - RNA, 21 nt, Homo sapiens
ucuugaaauuaagaaggcaaa

SEQ ID NO: 2214169 - RNA, 13 nt, Homo sapiens
aaucuacauucac

SEQ ID NO: 2214170 - RNA, 20 nt, Homo sapiens
aaguagccucuuucauccca

SEQ ID NO: 2214171 - RNA, 16 nt, Homo sapiens
ccucauuuugcuuccc

SEQ ID NO: 2214172 - RNA, 11 nt, Homo sapiens
uuuaauuuugu

SEQ ID NO: 2214173 - RNA, 18 nt, Homo sapiens
aaacaaugucuggggaca

SEQ ID NO: 2214174 - RNA, 19 nt, Homo sapiens
cuugugguguaaagcuggc

SEQ ID NO: 2214175 - RNA, 23 nt, Homo sapiens
aaaaagaaguguuccuucauuaa

SEQ ID NO: 2214176 - RNA, 13 nt, Homo sapiens
gucuaauguuugu

SEQ ID NO: 2214177 - RNA, 20 nt, Homo sapiens
ccugagcccuacugugucuc

SEQ ID NO: 2214178 - RNA, 17 nt, Homo sapiens
ucaggaaucagaaauca

SEQ ID NO: 2214179 - RNA, 19 nt, Homo sapiens
uguuaacacugcuaaugaa

SEQ ID NO: 2214180 - RNA, 14 nt, Homo sapiens
cuuguggucccaga

SEQ ID NO: 2214181 - RNA, 22 nt, Homo sapiens
uuuucuccuccgccugugucca

SEQ ID NO: 2214182 - RNA, 14 nt, Homo sapiens
caauugaacuucca

SEQ ID NO: 2214183 - RNA, 22 nt, Homo sapiens
aaaguaaguggagcauuuggaa

SEQ ID NO: 2214184 - RNA, 15 nt, Homo sapiens
caagugcacuugaac

SEQ ID NO: 2214185 - RNA, 15 nt, Homo sapiens
uacaggugucuagac

SEQ ID NO: 2214186 - RNA, 16 nt, Homo sapiens
aggaaaccacaaccuu

SEQ ID NO: 2214187 - RNA, 23 nt, Homo sapiens
aacaggauacaggugacagugaa

SEQ ID NO: 2214188 - RNA, 18 nt, Homo sapiens
cacccccucuguugcaca

SEQ ID NO: 2214189 - RNA, 16 nt, Homo sapiens
ucagcauagccugccu

SEQ ID NO: 2214190 - RNA, 21 nt, Homo sapiens
cugaaguacuuaaacuuccac

SEQ ID NO: 2214191 - RNA, 18 nt, Homo sapiens
agaaggcagccaccagcg

SEQ ID NO: 2214192 - RNA, 17 nt, Homo sapiens
uucuaaccuccuaagca

SEQ ID NO: 2214193 - RNA, 17 nt, Homo sapiens
cuccaggaccccagcaa

SEQ ID NO: 2214194 - RNA, 18 nt, Homo sapiens
ugaugauagucaucauca

SEQ ID NO: 2214195 - RNA, 23 nt, Homo sapiens
ucaccucaggaccaugugauaau

SEQ ID NO: 2214196 - RNA, 12 nt, Homo sapiens
acugacugagac

SEQ ID NO: 2214197 - RNA, 18 nt, Homo sapiens
aucuccuauaaucuguca

SEQ ID NO: 2214198 - RNA, 19 nt, Homo sapiens
gggcuuuuguucugagggg

SEQ ID NO: 2214199 - RNA, 12 nt, Homo sapiens
caccuacuccag

SEQ ID NO: 2214200 - RNA, 21 nt, Homo sapiens
uagccaccgguaauaagccaa

SEQ ID NO: 2214201 - RNA, 13 nt, Homo sapiens
cuuuuucauucuu

SEQ ID NO: 2214202 - RNA, 14 nt, Homo sapiens
gcugcucuggaaaa

SEQ ID NO: 2214203 - RNA, 18 nt, Homo sapiens
uguaaaguuuuugcuucc

SEQ ID NO: 2214204 - RNA, 21 nt, Homo sapiens
auccugguugguguugcagaa

SEQ ID NO: 2214205 - RNA, 17 nt, Homo sapiens
ccugggaaaggacccac

SEQ ID NO: 2214206 - RNA, 18 nt, Homo sapiens
agccugccucuuccagga

SEQ ID NO: 2214207 - RNA, 11 nt, Homo sapiens
ucaaguuccag

SEQ ID NO: 2214208 - RNA, 16 nt, Homo sapiens
cacagcaaaugagaug

SEQ ID NO: 2214209 - RNA, 20 nt, Homo sapiens
ugccuguaaucccagcacuu

SEQ ID NO: 2214210 - RNA, 16 nt, Homo sapiens
cucccuggaugacauu

SEQ ID NO: 2214211 - RNA, 16 nt, Homo sapiens
gacuccggaggacuga

SEQ ID NO: 2214212 - RNA, 14 nt, Homo sapiens
cacugaaucauuaa

SEQ ID NO: 2214213 - RNA, 15 nt, Homo sapiens
gucccaacccagaca

SEQ ID NO: 2214214 - RNA, 13 nt, Homo sapiens
ccagcaucuccca

SEQ ID NO: 2214215 - RNA, 23 nt, Homo sapiens
gaccagccugggcaacaaaguga

SEQ ID NO: 2214216 - RNA, 14 nt, Homo sapiens
gcugggcaggguga

SEQ ID NO: 2214217 - RNA, 13 nt, Homo sapiens
uggccaaagccaa

SEQ ID NO: 2214218 - RNA, 17 nt, Homo sapiens
ccuaaacuguacaugug

SEQ ID NO: 2214219 - RNA, 18 nt, Homo sapiens
cuccuucccuugcuucuu

SEQ ID NO: 2214220 - RNA, 15 nt, Homo sapiens
uguagaaauguuuca

SEQ ID NO: 2214221 - RNA, 15 nt, Homo sapiens
ugaagacaugauucc

SEQ ID NO: 2214222 - RNA, 13 nt, Homo sapiens
gcuacugccaagg

SEQ ID NO: 2214223 - RNA, 17 nt, Homo sapiens
cuuguguuacuuaauca

SEQ ID NO: 2214224 - RNA, 20 nt, Homo sapiens
gauuacaggugugagccacc

SEQ ID NO: 2214225 - RNA, 19 nt, Homo sapiens
aauuucccacccaucucca

SEQ ID NO: 2214226 - RNA, 19 nt, Homo sapiens
guaggagaaagagccuugg

SEQ ID NO: 2214227 - RNA, 14 nt, Homo sapiens
gugaaugcugguca

SEQ ID NO: 2214228 - RNA, 16 nt, Homo sapiens
gucagcucucugcccu

SEQ ID NO: 2214229 - RNA, 20 nt, Homo sapiens
aggacuugaauucaaagcau

SEQ ID NO: 2214230 - RNA, 21 nt, Homo sapiens
cuaagcccccacuacaaguga

SEQ ID NO: 2214231 - RNA, 17 nt, Homo sapiens
ugcuauuacuaguacua

SEQ ID NO: 2214232 - RNA, 17 nt, Homo sapiens
agcuggauuacaggcau

SEQ ID NO: 2214233 - RNA, 22 nt, Homo sapiens
agugcaguggcaucaucucagc

SEQ ID NO: 2214234 - RNA, 18 nt, Homo sapiens
ucuggagaaccucaucca

SEQ ID NO: 2214235 - RNA, 19 nt, Homo sapiens
guacaaaguacuagcuaaa

SEQ ID NO: 2214236 - RNA, 18 nt, Homo sapiens
gagccuugcugggccagg

SEQ ID NO: 2214237 - RNA, 13 nt, Homo sapiens
agcccugacuggu

SEQ ID NO: 2214238 - RNA, 15 nt, Homo sapiens
acuggagcaucugac

SEQ ID NO: 2214239 - RNA, 21 nt, Homo sapiens
uugcuguuuggauuauuccuc

SEQ ID NO: 2214240 - RNA, 21 nt, Homo sapiens
ugggcuggauugugcuuuggu

SEQ ID NO: 2214241 - RNA, 20 nt, Homo sapiens
uuugacacuucccaguggaa

SEQ ID NO: 2214242 - RNA, 18 nt, Homo sapiens
cuguauuuaacaaaaagu

SEQ ID NO: 2214243 - RNA, 21 nt, Homo sapiens
uauuuauauauuuauaacuca

SEQ ID NO: 2214244 - RNA, 15 nt, Homo sapiens
gaaugaaaauucauu

SEQ ID NO: 2214245 - RNA, 20 nt, Homo sapiens
ugugggaguaaaacuuuaau

SEQ ID NO: 2214246 - RNA, 17 nt, Homo sapiens
cugcauucuucugagca

SEQ ID NO: 2214247 - RNA, 14 nt, Homo sapiens
uucaaaacauugug

SEQ ID NO: 2214248 - RNA, 14 nt, Homo sapiens
aauccgugaaguca

SEQ ID NO: 2214249 - RNA, 14 nt, Homo sapiens
aucagcucucugca

SEQ ID NO: 2214250 - RNA, 23 nt, Homo sapiens
aucucccuuaauaaacucacaac

SEQ ID NO: 2214251 - RNA, 20 nt, Homo sapiens
cugccagcauaauacuugcu

SEQ ID NO: 2214252 - RNA, 18 nt, Homo sapiens
auguuuuuucugcaauga

SEQ ID NO: 2214253 - RNA, 18 nt, Homo sapiens
aauaauaagcuacuugcc

SEQ ID NO: 2214254 - RNA, 23 nt, Homo sapiens
cauccuccccuagcuuagcuguc

SEQ ID NO: 2214255 - RNA, 16 nt, Homo sapiens
gucacuuacuucauau

SEQ ID NO: 2214256 - RNA, 16 nt, Homo sapiens
acacugaaacagccag

SEQ ID NO: 2214257 - RNA, 16 nt, Homo sapiens
ucaguccccauggcac

SEQ ID NO: 2214258 - RNA, 17 nt, Homo sapiens
uggugcaaucacagcuc

SEQ ID NO: 2214259 - RNA, 14 nt, Homo sapiens
ugcccuuugggguc

SEQ ID NO: 2214260 - RNA, 22 nt, Homo sapiens
cugcacugaggcagcgaccuca

SEQ ID NO: 2214261 - RNA, 23 nt, Homo sapiens
cuuguaaaaagggggcugcauuc

SEQ ID NO: 2214262 - RNA, 21 nt, Homo sapiens
gcauuugucuauucuccagcu

SEQ ID NO: 2214263 - RNA, 22 nt, Homo sapiens
ucuacgcucuccuuucuuucua

SEQ ID NO: 2214264 - RNA, 13 nt, Homo sapiens
gacaaagucucca

SEQ ID NO: 2214265 - RNA, 18 nt, Homo sapiens
ggcauccaaauggcugcu

SEQ ID NO: 2214266 - RNA, 22 nt, Homo sapiens
uauaagaaaagcagacgcagca

SEQ ID NO: 2214267 - RNA, 21 nt, Homo sapiens
aauuacauaugaaaaacccuc

SEQ ID NO: 2214268 - RNA, 16 nt, Homo sapiens
ucccaggaaccaaaaa

SEQ ID NO: 2214269 - RNA, 20 nt, Homo sapiens
aggagucugggcacaagugu

SEQ ID NO: 2214270 - RNA, 19 nt, Homo sapiens
ggcucaagaggcccaggga

SEQ ID NO: 2214271 - RNA, 21 nt, Homo sapiens
auuuugauugcuuaccuacau

SEQ ID NO: 2214272 - RNA, 22 nt, Homo sapiens
guacugcaaaguguaugcagua

SEQ ID NO: 2214273 - RNA, 20 nt, Homo sapiens
ugccugugguuaacaucuca

SEQ ID NO: 2214274 - RNA, 22 nt, Homo sapiens
guaucugcauguaaaaucuuca

SEQ ID NO: 2214275 - RNA, 19 nt, Homo sapiens
aguccuugcccacuuccca

SEQ ID NO: 2214276 - RNA, 13 nt, Homo sapiens
ucuauguguacag

SEQ ID NO: 2214277 - RNA, 19 nt, Homo sapiens
acuucaaugggcucuucca

SEQ ID NO: 2214278 - RNA, 22 nt, Homo sapiens
cagucccagcuaacucugaccu

SEQ ID NO: 2214279 - RNA, 22 nt, Homo sapiens
ugggguccccagggcugucauc

SEQ ID NO: 2214280 - RNA, 19 nt, Homo sapiens
agaacuugcagcugauguu

SEQ ID NO: 2214281 - RNA, 23 nt, Homo sapiens
auacagugaucaguugcucucug

SEQ ID NO: 2214282 - RNA, 17 nt, Homo sapiens
uagaagggucacuuuaa

SEQ ID NO: 2214283 - RNA, 22 nt, Homo sapiens
gacugaugucuccuaagcaccu

SEQ ID NO: 2214284 - RNA, 22 nt, Homo sapiens
ccacagucucucccugggguuu

SEQ ID NO: 2214285 - RNA, 17 nt, Homo sapiens
ugcuguuggucaugugg

SEQ ID NO: 2214286 - RNA, 20 nt, Homo sapiens
ucuagccuauuuaccugcag

SEQ ID NO: 2214287 - RNA, 17 nt, Homo sapiens
cuuuuuaauaaagugga

SEQ ID NO: 2214288 - RNA, 13 nt, Homo sapiens
aacaguucacuug

SEQ ID NO: 2214289 - RNA, 18 nt, Homo sapiens
gucccaguagccaaggcc

SEQ ID NO: 2214290 - RNA, 17 nt, Homo sapiens
cagggggaagcaccagc

SEQ ID NO: 2214291 - RNA, 15 nt, Homo sapiens
aggcagcgaccucaa

SEQ ID NO: 2214292 - RNA, 17 nt, Homo sapiens
gaacaaacuaagccagg

SEQ ID NO: 2214293 - RNA, 14 nt, Homo sapiens
uuccaucagcacaa

SEQ ID NO: 2214294 - RNA, 23 nt, Homo sapiens
acaagaaucagucuauccacaga

SEQ ID NO: 2214295 - RNA, 18 nt, Homo sapiens
ucaccacaccaaaccucu

SEQ ID NO: 2214296 - RNA, 22 nt, Homo sapiens
cuuuagcagggaagucacuuca

SEQ ID NO: 2214297 - RNA, 13 nt, Homo sapiens
acuggacccuguu

SEQ ID NO: 2214298 - RNA, 20 nt, Homo sapiens
accuuuugggaauguuuuaa

SEQ ID NO: 2214299 - RNA, 17 nt, Homo sapiens
guccuuccaugcccuug

SEQ ID NO: 2214300 - RNA, 19 nt, Homo sapiens
aacuaacugcauacacuuu

SEQ ID NO: 2214301 - RNA, 15 nt, Homo sapiens
guaaacacagggaag

SEQ ID NO: 2214302 - RNA, 19 nt, Homo sapiens
ucuggggcuggcaccagca

SEQ ID NO: 2214303 - RNA, 15 nt, Homo sapiens
caaaacagagaaagc

SEQ ID NO: 2214304 - RNA, 16 nt, Homo sapiens
guacuuuagcuggaau

SEQ ID NO: 2214305 - RNA, 13 nt, Homo sapiens
uagugaucauuua

SEQ ID NO: 2214306 - RNA, 22 nt, Homo sapiens
aguuaaaaauaaaaaacauaua

SEQ ID NO: 2214307 - RNA, 21 nt, Homo sapiens
cagaacacuucagccugugca

SEQ ID NO: 2214308 - RNA, 15 nt, Homo sapiens
aaauucuacuuuaau

SEQ ID NO: 2214309 - RNA, 19 nt, Homo sapiens
cagucuucccagcaauuau

SEQ ID NO: 2214310 - RNA, 15 nt, Homo sapiens
ggccccagaacacag

SEQ ID NO: 2214311 - RNA, 13 nt, Homo sapiens
ccuuaugcuucuu

SEQ ID NO: 2214312 - RNA, 14 nt, Homo sapiens
cccacuguacuugc

SEQ ID NO: 2214313 - RNA, 17 nt, Homo sapiens
gugggacacaacacaga

SEQ ID NO: 2214314 - RNA, 15 nt, Homo sapiens
uauacuugguugauu

SEQ ID NO: 2214315 - RNA, 15 nt, Homo sapiens
ucuccaggacaaccu

SEQ ID NO: 2214316 - RNA, 17 nt, Homo sapiens
aacagauggcacuuuga

SEQ ID NO: 2214317 - RNA, 22 nt, Homo sapiens
gaccuugcuuugagacuccuca

SEQ ID NO: 2214318 - RNA, 15 nt, Homo sapiens
uuuggaaaccacagu

SEQ ID NO: 2214319 - RNA, 21 nt, Homo sapiens
gacauaaaauuuaaaaacuua

SEQ ID NO: 2214320 - RNA, 17 nt, Homo sapiens
cuggucacacacaggug

SEQ ID NO: 2214321 - RNA, 23 nt, Homo sapiens
agaaaacuuuuguuuagagcccu

SEQ ID NO: 2214322 - RNA, 21 nt, Homo sapiens
gcaaauaucauacuguucaau

SEQ ID NO: 2214323 - RNA, 21 nt, Homo sapiens
caaaaguuuaucuuugcacaa

SEQ ID NO: 2214324 - RNA, 17 nt, Homo sapiens
acuacagaguacgugaa

SEQ ID NO: 2214325 - RNA, 20 nt, Homo sapiens
ucuagacgcccccaaauccu

SEQ ID NO: 2214326 - RNA, 22 nt, Homo sapiens
uugauggauuaauuaaauaagu

SEQ ID NO: 2214327 - RNA, 12 nt, Homo sapiens
uaaaauggaaua

SEQ ID NO: 2214328 - RNA, 15 nt, Homo sapiens
gaacgagagugccuc

SEQ ID NO: 2214329 - RNA, 13 nt, Homo sapiens
aaacuucagagaa

SEQ ID NO: 2214330 - RNA, 19 nt, Homo sapiens
augacucaaggccaauaau

SEQ ID NO: 2214331 - RNA, 15 nt, Homo sapiens
gagaaucaaaaugca

SEQ ID NO: 2214332 - RNA, 13 nt, Homo sapiens
cccugcuggacca

SEQ ID NO: 2214333 - RNA, 13 nt, Homo sapiens
cucugcuccagag

SEQ ID NO: 2214334 - RNA, 13 nt, Homo sapiens
aagaccucaucuc

SEQ ID NO: 2214335 - RNA, 12 nt, Homo sapiens
caugaauaugau

SEQ ID NO: 2214336 - RNA, 19 nt, Homo sapiens
gauuuuaccaaagcaucaa

SEQ ID NO: 2214337 - RNA, 14 nt, Homo sapiens
gggugggggugcug

SEQ ID NO: 2214338 - RNA, 19 nt, Homo sapiens
cuaccaacuggaagcacag

SEQ ID NO: 2214339 - RNA, 14 nt, Homo sapiens
gaauaugaacggug

SEQ ID NO: 2214340 - RNA, 19 nt, Homo sapiens
agaggcaucaaagcuagaa

SEQ ID NO: 2214341 - RNA, 22 nt, Homo sapiens
ccccuuuuggggaucaccucuc

SEQ ID NO: 2214342 - RNA, 16 nt, Homo sapiens
guggcaccuucaccug

SEQ ID NO: 2214343 - RNA, 18 nt, Homo sapiens
aauuuuuaacuuaucucc

SEQ ID NO: 2214344 - RNA, 16 nt, Homo sapiens
aagucaggccaggugg

SEQ ID NO: 2214345 - RNA, 21 nt, Homo sapiens
uggccccuuugggcccugcau

SEQ ID NO: 2214346 - RNA, 21 nt, Homo sapiens
gcugcugcacccaacuacuga

SEQ ID NO: 2214347 - RNA, 21 nt, Homo sapiens
aaaaauaaacaagcauuucaa

SEQ ID NO: 2214348 - RNA, 21 nt, Homo sapiens
accacuacaugcagcccaugc

SEQ ID NO: 2214349 - RNA, 20 nt, Homo sapiens
agugaucucccugaacauuu

SEQ ID NO: 2214350 - RNA, 13 nt, Homo sapiens
agauuaugugacu

SEQ ID NO: 2214351 - RNA, 16 nt, Homo sapiens
guagaaaagaacugga

SEQ ID NO: 2214352 - RNA, 17 nt, Homo sapiens
uuguaauugcaugacaa

SEQ ID NO: 2214353 - RNA, 16 nt, Homo sapiens
uucauguucaugugau

SEQ ID NO: 2214354 - RNA, 22 nt, Homo sapiens
cauuguauuuuacuuugugcaa

SEQ ID NO: 2214355 - RNA, 20 nt, Homo sapiens
aauaauuuuacaugucucau

SEQ ID NO: 2214356 - RNA, 16 nt, Homo sapiens
accaagugaggccaua

SEQ ID NO: 2214357 - RNA, 15 nt, Homo sapiens
acacauacauugcca

SEQ ID NO: 2214358 - RNA, 15 nt, Homo sapiens
uucauuaguauuccu

SEQ ID NO: 2214359 - RNA, 20 nt, Homo sapiens
uguaguuuugaguguauaca

SEQ ID NO: 2214360 - RNA, 13 nt, Homo sapiens
uagcaacaaaucc

SEQ ID NO: 2214361 - RNA, 13 nt, Homo sapiens
uauacacaaagaa

SEQ ID NO: 2214362 - RNA, 17 nt, Homo sapiens
ccuuagaauacuguauu

SEQ ID NO: 2214363 - RNA, 23 nt, Homo sapiens
gacuggcaauaaacuccuacuaa

SEQ ID NO: 2214364 - RNA, 15 nt, Homo sapiens
aaacagggcacccca

SEQ ID NO: 2214365 - RNA, 18 nt, Homo sapiens
ucagcaacaucccaucua

SEQ ID NO: 2214366 - RNA, 13 nt, Homo sapiens
caggcaugcacaa

SEQ ID NO: 2214367 - RNA, 21 nt, Homo sapiens
ugaaaaccaaaaugacaucuu

SEQ ID NO: 2214368 - RNA, 17 nt, Homo sapiens
uugaaaauaauuguucc

SEQ ID NO: 2214369 - RNA, 21 nt, Homo sapiens
gguugauacggagccauguca

SEQ ID NO: 2214370 - RNA, 15 nt, Homo sapiens
ugacuuccugccaug

SEQ ID NO: 2214371 - RNA, 17 nt, Homo sapiens
auuacaaaaacauggcc

SEQ ID NO: 2214372 - RNA, 15 nt, Homo sapiens
caaauaaacacugug

SEQ ID NO: 2214373 - RNA, 15 nt, Homo sapiens
ccuguggccuugccc

SEQ ID NO: 2214374 - RNA, 19 nt, Homo sapiens
gcacaugcgaccccgagga

SEQ ID NO: 2214375 - RNA, 21 nt, Homo sapiens
cucucaaaccccugaccucaa

SEQ ID NO: 2214376 - RNA, 19 nt, Homo sapiens
cccaggcuuuugaaaaaca

SEQ ID NO: 2214377 - RNA, 12 nt, Homo sapiens
auuguguucucu

SEQ ID NO: 2214378 - RNA, 19 nt, Homo sapiens
ucgauggcucaaucuaucc

SEQ ID NO: 2214379 - RNA, 22 nt, Homo sapiens
uaagccuguuggauaaagaccu

SEQ ID NO: 2214380 - RNA, 16 nt, Homo sapiens
cugggagcuucucugc

SEQ ID NO: 2214381 - RNA, 22 nt, Homo sapiens
cauugucuucugaccucuauaa

SEQ ID NO: 2214382 - RNA, 18 nt, Homo sapiens
aaucacuucugagaacuc

SEQ ID NO: 2214383 - RNA, 17 nt, Homo sapiens
ccugcaggccccagcca

SEQ ID NO: 2214384 - RNA, 16 nt, Homo sapiens
gucacaucagcaauuu

SEQ ID NO: 2214385 - RNA, 12 nt, Homo sapiens
ugcacugaacag

SEQ ID NO: 2214386 - RNA, 21 nt, Homo sapiens
ugaauuuggucuguauagucu

SEQ ID NO: 2214387 - RNA, 21 nt, Homo sapiens
auuuaauaaaugugccuucau

SEQ ID NO: 2214388 - RNA, 16 nt, Homo sapiens
gaaagcugcugugauc

SEQ ID NO: 2214389 - RNA, 15 nt, Homo sapiens
cauaguguguguuua

SEQ ID NO: 2214390 - RNA, 22 nt, Homo sapiens
ucagacaagaaugugcacucuc

SEQ ID NO: 2214391 - RNA, 20 nt, Homo sapiens
aucacugccacacucuccau

SEQ ID NO: 2214392 - RNA, 16 nt, Homo sapiens
cuggaaaacccaaagu

SEQ ID NO: 2214393 - RNA, 18 nt, Homo sapiens
ccaauugcccugccaggc

SEQ ID NO: 2214394 - RNA, 23 nt, Homo sapiens
auuguauaaaacaguguuuccag

SEQ ID NO: 2214395 - RNA, 18 nt, Homo sapiens
gcacauuguuaugcacuu

SEQ ID NO: 2214396 - RNA, 22 nt, Homo sapiens
cacucacagagacacagggcau

SEQ ID NO: 2214397 - RNA, 16 nt, Homo sapiens
cuugaugcaguuucau

SEQ ID NO: 2214398 - RNA, 21 nt, Homo sapiens
ccaggaacugccugggccaug

SEQ ID NO: 2214399 - RNA, 14 nt, Homo sapiens
aguuuauaaagcca

SEQ ID NO: 2214400 - RNA, 15 nt, Homo sapiens
cuacuuucaucuuaa

SEQ ID NO: 2214401 - RNA, 17 nt, Homo sapiens
aaguauuuuugauuaac

SEQ ID NO: 2214402 - RNA, 19 nt, Homo sapiens
auugauuaguuugccuaau

SEQ ID NO: 2214403 - RNA, 23 nt, Homo sapiens
caguuacaagauuguaaguaaau

SEQ ID NO: 2214404 - RNA, 16 nt, Homo sapiens
accagucccuccccaa

SEQ ID NO: 2214405 - RNA, 16 nt, Homo sapiens
uguacaauuuuaguca

SEQ ID NO: 2214406 - RNA, 22 nt, Homo sapiens
cucagugccacuugacauuccu

SEQ ID NO: 2214407 - RNA, 17 nt, Homo sapiens
auaaugaucugaaucug

SEQ ID NO: 2214408 - RNA, 12 nt, Homo sapiens
guccugcccuug

SEQ ID NO: 2214409 - RNA, 20 nt, Homo sapiens
guauaugauucucugugguu

SEQ ID NO: 2214410 - RNA, 19 nt, Homo sapiens
aaaugugauuugucuuccc

SEQ ID NO: 2214411 - RNA, 17 nt, Homo sapiens
auuaccaucuuaaucuu

SEQ ID NO: 2214412 - RNA, 19 nt, Homo sapiens
cuggagccuguguaacagc

SEQ ID NO: 2214413 - RNA, 21 nt, Homo sapiens
aguuacguuguguauggccug

SEQ ID NO: 2214414 - RNA, 11 nt, Homo sapiens
gcacuuccuug

SEQ ID NO: 2214415 - RNA, 22 nt, Homo sapiens
aggaauuacgugcucugugggu

SEQ ID NO: 2214416 - RNA, 18 nt, Homo sapiens
auggccucuggccaggca

SEQ ID NO: 2214417 - RNA, 14 nt, Homo sapiens
accagaagaagggu

SEQ ID NO: 2214418 - RNA, 21 nt, Homo sapiens
aggcugucuuagugcaaaaaa

SEQ ID NO: 2214419 - RNA, 12 nt, Homo sapiens
gagaaaacacuu

SEQ ID NO: 2214420 - RNA, 14 nt, Homo sapiens
guuggaaucacugu

SEQ ID NO: 2214421 - RNA, 20 nt, Homo sapiens
cauucccguugaacgucaca

SEQ ID NO: 2214422 - RNA, 17 nt, Homo sapiens
ugguguaaugcacaauu

SEQ ID NO: 2214423 - RNA, 21 nt, Homo sapiens
ggcagcuccccaaaccaggcc

SEQ ID NO: 2214424 - RNA, 20 nt, Homo sapiens
aguuagucaauccugucaua

SEQ ID NO: 2214425 - RNA, 12 nt, Homo sapiens
aaugucauucac

SEQ ID NO: 2214426 - RNA, 19 nt, Homo sapiens
gccuccaaggggcuuuguc

SEQ ID NO: 2214427 - RNA, 13 nt, Homo sapiens
auaaaggacagug

SEQ ID NO: 2214428 - RNA, 23 nt, Homo sapiens
aggccaugucugacuucaaggaa

SEQ ID NO: 2214429 - RNA, 16 nt, Homo sapiens
aacccguuuuauucua

SEQ ID NO: 2214430 - RNA, 19 nt, Homo sapiens
aacaugccagccacuguga

SEQ ID NO: 2214431 - RNA, 14 nt, Homo sapiens
acagucuugcugaa

SEQ ID NO: 2214432 - RNA, 21 nt, Homo sapiens
uguaugcugauuuacuacuua

SEQ ID NO: 2214433 - RNA, 22 nt, Homo sapiens
accauaugccucauuuuaucau

SEQ ID NO: 2214434 - RNA, 14 nt, Homo sapiens
uucaccugaucaua

SEQ ID NO: 2214435 - RNA, 18 nt, Homo sapiens
ucauccauccuugccaau

SEQ ID NO: 2214436 - RNA, 21 nt, Homo sapiens
gauacauaaaagugcuuugca

SEQ ID NO: 2214437 - RNA, 21 nt, Homo sapiens
uguguaauaaaguguuuucag

SEQ ID NO: 2214438 - RNA, 16 nt, Homo sapiens
auguacuacauuugca

SEQ ID NO: 2214439 - RNA, 18 nt, Homo sapiens
ugcaaagggguugaggaa

SEQ ID NO: 2214440 - RNA, 16 nt, Homo sapiens
caaaucuucaaggugu

SEQ ID NO: 2214441 - RNA, 15 nt, Homo sapiens
cuacacagcucagca

SEQ ID NO: 2214442 - RNA, 13 nt, Homo sapiens
agaaguuaauucu

SEQ ID NO: 2214443 - RNA, 19 nt, Homo sapiens
augcacuuggcugcauaaa

SEQ ID NO: 2214444 - RNA, 20 nt, Homo sapiens
ugucauuuugcacuguaaau

SEQ ID NO: 2214445 - RNA, 14 nt, Homo sapiens
aagcaaaguaucaa

SEQ ID NO: 2214446 - RNA, 20 nt, Homo sapiens
cauauaggccagaguugcaa

SEQ ID NO: 2214447 - RNA, 22 nt, Homo sapiens
ugcuggcucugcuguccuugcc

SEQ ID NO: 2214448 - RNA, 23 nt, Homo sapiens
auuuugugaccccuuucacuuac

SEQ ID NO: 2214449 - RNA, 14 nt, Homo sapiens
uguccacacauaca

SEQ ID NO: 2214450 - RNA, 17 nt, Homo sapiens
agugaacacacucagca

SEQ ID NO: 2214451 - RNA, 21 nt, Homo sapiens
ugugucgauuucaccaagaag

SEQ ID NO: 2214452 - RNA, 20 nt, Homo sapiens
uagcugguuccugcuagaaa

SEQ ID NO: 2214453 - RNA, 19 nt, Homo sapiens
aagacuuugauccauguau

SEQ ID NO: 2214454 - RNA, 13 nt, Homo sapiens
gugaggauuaaau

SEQ ID NO: 2214455 - RNA, 21 nt, Homo sapiens
caccccgucguauacccugga

SEQ ID NO: 2214456 - RNA, 21 nt, Homo sapiens
accaguuugaaccaagaacuu

SEQ ID NO: 2214457 - RNA, 18 nt, Homo sapiens
caggguucaucuguccau

SEQ ID NO: 2214458 - RNA, 13 nt, Homo sapiens
ccucaggugaucc

SEQ ID NO: 2214459 - RNA, 20 nt, Homo sapiens
ggccuucugguuuuaggaaa

SEQ ID NO: 2214460 - RNA, 16 nt, Homo sapiens
gacaguggaugcugcu

SEQ ID NO: 2214461 - RNA, 22 nt, Homo sapiens
agacagauggacacugccaaga

SEQ ID NO: 2214462 - RNA, 16 nt, Homo sapiens
guauacauacauguau

SEQ ID NO: 2214463 - RNA, 15 nt, Homo sapiens
acguucuuaguuuac

SEQ ID NO: 2214464 - RNA, 21 nt, Homo sapiens
cccuugcaaucuucuacuuua

SEQ ID NO: 2214465 - RNA, 18 nt, Homo sapiens
uaucaauaagugccauua

SEQ ID NO: 2214466 - RNA, 12 nt, Homo sapiens
cacuucacuuuu

SEQ ID NO: 2214467 - RNA, 13 nt, Homo sapiens
uuguguacuguaa

SEQ ID NO: 2214468 - RNA, 16 nt, Homo sapiens
ggaaagucacccaaac

SEQ ID NO: 2214469 - RNA, 21 nt, Homo sapiens
augccacccucuccaugccca

SEQ ID NO: 2214470 - RNA, 18 nt, Homo sapiens
gaaaaucaaagaggccaa

SEQ ID NO: 2214471 - RNA, 21 nt, Homo sapiens
cauucugcauccuggcuugaa

SEQ ID NO: 2214472 - RNA, 23 nt, Homo sapiens
auauuugcuagauuucuaaagaa

SEQ ID NO: 2214473 - RNA, 15 nt, Homo sapiens
ugugcccacgugugc

SEQ ID NO: 2214474 - RNA, 22 nt, Homo sapiens
uaaaaaaaaaacguauugcauu

SEQ ID NO: 2214475 - RNA, 16 nt, Homo sapiens
aagcuaggccaaugaa

SEQ ID NO: 2214476 - RNA, 21 nt, Homo sapiens
gaaggcagcaggcauuugcua

SEQ ID NO: 2214477 - RNA, 18 nt, Homo sapiens
agggaacaaguacuucuu

SEQ ID NO: 2214478 - RNA, 16 nt, Homo sapiens
gccccaccaucuugcu

SEQ ID NO: 2214479 - RNA, 20 nt, Homo sapiens
aaauaaagguuagauaaguc

SEQ ID NO: 2214480 - RNA, 19 nt, Homo sapiens
ugcccacugaacaugcuca

SEQ ID NO: 2214481 - RNA, 16 nt, Homo sapiens
gguuccggcauggaca

SEQ ID NO: 2214482 - RNA, 15 nt, Homo sapiens
agugccuucagccaa

SEQ ID NO: 2214483 - RNA, 12 nt, Homo sapiens
ggaggggaccaa

SEQ ID NO: 2214484 - RNA, 22 nt, Homo sapiens
auaccauuaaauaaugcauaau

SEQ ID NO: 2214485 - RNA, 13 nt, Homo sapiens
accuccucauggc

SEQ ID NO: 2214486 - RNA, 12 nt, Homo sapiens
cuugagugguga

SEQ ID NO: 2214487 - RNA, 22 nt, Homo sapiens
ucuggcauuacaauugcaguuu

SEQ ID NO: 2214488 - RNA, 20 nt, Homo sapiens
caagccuguccuuccugacc

SEQ ID NO: 2214489 - RNA, 13 nt, Homo sapiens
guggcccaagacc

SEQ ID NO: 2214490 - RNA, 17 nt, Homo sapiens
cccccaucuucauccca

SEQ ID NO: 2214491 - RNA, 16 nt, Homo sapiens
augcaugucugccaaa

SEQ ID NO: 2214492 - RNA, 12 nt, Homo sapiens
agcacuggguug

SEQ ID NO: 2214493 - RNA, 18 nt, Homo sapiens
acaaguaaaacuguggua

SEQ ID NO: 2214494 - RNA, 13 nt, Homo sapiens
gacuccaguuaaa

SEQ ID NO: 2214495 - RNA, 13 nt, Homo sapiens
agaaugcccucag

SEQ ID NO: 2214496 - RNA, 17 nt, Homo sapiens
caaaguccugggauuac

SEQ ID NO: 2214497 - RNA, 16 nt, Homo sapiens
uuaguauuauaccuga

SEQ ID NO: 2214498 - RNA, 19 nt, Homo sapiens
uucauagcaauuaacugau

SEQ ID NO: 2214499 - RNA, 14 nt, Homo sapiens
uaccaauaaaguga

SEQ ID NO: 2214500 - RNA, 16 nt, Homo sapiens
guacuuucacaucucu

SEQ ID NO: 2214501 - RNA, 14 nt, Homo sapiens
augcacacaguagg

SEQ ID NO: 2214502 - RNA, 16 nt, Homo sapiens
auguacaaaaccauuu

SEQ ID NO: 2214503 - RNA, 12 nt, Homo sapiens
guggaugacccu

SEQ ID NO: 2214504 - RNA, 23 nt, Homo sapiens
ggcacuguaaggugcuugcuccc

SEQ ID NO: 2214505 - RNA, 15 nt, Homo sapiens
agcaucaaccuagga

SEQ ID NO: 2214506 - RNA, 17 nt, Homo sapiens
gcucccugccuccugcc

SEQ ID NO: 2214507 - RNA, 17 nt, Homo sapiens
ccagcccagacccagug

SEQ ID NO: 2214508 - RNA, 16 nt, Homo sapiens
gcauccuaugcuuaau

SEQ ID NO: 2214509 - RNA, 12 nt, Homo sapiens
uugucacaggac

SEQ ID NO: 2214510 - RNA, 17 nt, Homo sapiens
gcaucugcagccacuuu

SEQ ID NO: 2214511 - RNA, 19 nt, Homo sapiens
gaaaaaguuaaacauugaa

SEQ ID NO: 2214512 - RNA, 19 nt, Homo sapiens
aacaauuuugcacuguaga

SEQ ID NO: 2214513 - RNA, 13 nt, Homo sapiens
uuauuccuuugaa

SEQ ID NO: 2214514 - RNA, 13 nt, Homo sapiens
auaaaugucuagu

SEQ ID NO: 2214515 - RNA, 17 nt, Homo sapiens
aagcgcacauucaugug

SEQ ID NO: 2214516 - RNA, 15 nt, Homo sapiens
uugucuacucugaag

SEQ ID NO: 2214517 - RNA, 11 nt, Homo sapiens
agaaaccucac

SEQ ID NO: 2214518 - RNA, 16 nt, Homo sapiens
auggauuuccuagugg

SEQ ID NO: 2214519 - RNA, 14 nt, Homo sapiens
uugcugcuaaaggu

SEQ ID NO: 2214520 - RNA, 17 nt, Homo sapiens
ugaaauuaucauuggua

SEQ ID NO: 2214521 - RNA, 19 nt, Homo sapiens
gagaccccuuugccuuccc

SEQ ID NO: 2214522 - RNA, 18 nt, Homo sapiens
gcaagugugugcaugugu

SEQ ID NO: 2214523 - RNA, 18 nt, Homo sapiens
cugcaggggcaaggggcu

SEQ ID NO: 2214524 - RNA, 19 nt, Homo sapiens
caaaugaaaugccaaagga

SEQ ID NO: 2214525 - RNA, 23 nt, Homo sapiens
cacaugguccauuucaugugauc

SEQ ID NO: 2214526 - RNA, 16 nt, Homo sapiens
gucccugaagugccag

SEQ ID NO: 2214527 - RNA, 22 nt, Homo sapiens
augaaaauuuuaaugcauuguu

SEQ ID NO: 2214528 - RNA, 21 nt, Homo sapiens
uuuaccuucagccauagcuug

SEQ ID NO: 2214529 - RNA, 19 nt, Homo sapiens
caggugccaguuauggcua

SEQ ID NO: 2214530 - RNA, 21 nt, Homo sapiens
uucugcucuguccaauuccag

SEQ ID NO: 2214531 - RNA, 15 nt, Homo sapiens
cuggcaacacagagg

SEQ ID NO: 2214532 - RNA, 13 nt, Homo sapiens
acuccgcaaauau

SEQ ID NO: 2214533 - RNA, 14 nt, Homo sapiens
accauauuugaauu

SEQ ID NO: 2214534 - RNA, 19 nt, Homo sapiens
ccaaccccgugacaaaggu

SEQ ID NO: 2214535 - RNA, 11 nt, Homo sapiens
aauaugaauga

SEQ ID NO: 2214536 - RNA, 20 nt, Homo sapiens
cucaugccuguaaucccagc

SEQ ID NO: 2214537 - RNA, 23 nt, Homo sapiens
cauacauauguagaaacauuuag

SEQ ID NO: 2214538 - RNA, 22 nt, Homo sapiens
aguuuguacagacguaugcuua

SEQ ID NO: 2214539 - RNA, 18 nt, Homo sapiens
auuaaaguuaauagaacu

SEQ ID NO: 2214540 - RNA, 20 nt, Homo sapiens
aacacugucacuagucucac

SEQ ID NO: 2214541 - RNA, 18 nt, Homo sapiens
uuuuucacuguacauuau

SEQ ID NO: 2214542 - RNA, 22 nt, Homo sapiens
uguacccuccuccccacacaga

SEQ ID NO: 2214543 - RNA, 14 nt, Homo sapiens
uauggaaacccgag

SEQ ID NO: 2214544 - RNA, 15 nt, Homo sapiens
guaauguucauuucc

SEQ ID NO: 2214545 - RNA, 13 nt, Homo sapiens
auugauuacaauu

SEQ ID NO: 2214546 - RNA, 13 nt, Homo sapiens
uacauucuugcua

SEQ ID NO: 2214547 - RNA, 19 nt, Homo sapiens
ugucugcuuucuccauugu

SEQ ID NO: 2214548 - RNA, 16 nt, Homo sapiens
cugccuuggacugugu

SEQ ID NO: 2214549 - RNA, 21 nt, Homo sapiens
uugagcuagaaaucacaagaa

SEQ ID NO: 2214550 - RNA, 18 nt, Homo sapiens
cucaugagcuccugauca

SEQ ID NO: 2214551 - RNA, 16 nt, Homo sapiens
uuucaaaccagcuuca

SEQ ID NO: 2214552 - RNA, 23 nt, Homo sapiens
cacaauuaaaugacuuagaaaca

SEQ ID NO: 2214553 - RNA, 14 nt, Homo sapiens
uuuagugucuugaa

SEQ ID NO: 2214554 - RNA, 12 nt, Homo sapiens
ggagacuuguau

SEQ ID NO: 2214555 - RNA, 16 nt, Homo sapiens
aggaucccuacugcca

SEQ ID NO: 2214556 - RNA, 17 nt, Homo sapiens
uaguuuuagcuguagau

SEQ ID NO: 2214557 - RNA, 19 nt, Homo sapiens
ccugaagaaucccccaugg

SEQ ID NO: 2214558 - RNA, 14 nt, Homo sapiens
uagauaagugcuca

SEQ ID NO: 2214559 - RNA, 17 nt, Homo sapiens
gugcaugucacaugcca

SEQ ID NO: 2214560 - RNA, 22 nt, Homo sapiens
uugcaccucuguucauuucaca

SEQ ID NO: 2214561 - RNA, 16 nt, Homo sapiens
caacuuguauuuccaa

SEQ ID NO: 2214562 - RNA, 20 nt, Homo sapiens
cucaugucuucucacaagcc

SEQ ID NO: 2214563 - RNA, 15 nt, Homo sapiens
gaggaauaaaaugau

SEQ ID NO: 2214564 - RNA, 13 nt, Homo sapiens
uggaaggggccac

SEQ ID NO: 2214565 - RNA, 13 nt, Homo sapiens
gcuguuuuagaca

SEQ ID NO: 2214566 - RNA, 17 nt, Homo sapiens
aaucucucagcuuuuaa

SEQ ID NO: 2214567 - RNA, 15 nt, Homo sapiens
uccuuuaaaccauca

SEQ ID NO: 2214568 - RNA, 13 nt, Homo sapiens
augcaacuugauu

SEQ ID NO: 2214569 - RNA, 23 nt, Homo sapiens
cagaaggcagagguugcagugag

SEQ ID NO: 2214570 - RNA, 11 nt, Homo sapiens
cccacccaguc

SEQ ID NO: 2214571 - RNA, 12 nt, Homo sapiens
gaaugcugccag

SEQ ID NO: 2214572 - RNA, 22 nt, Homo sapiens
cccuaaauguggacaucaugaa

SEQ ID NO: 2214573 - RNA, 19 nt, Homo sapiens
agaaaggaaauagacuuug

SEQ ID NO: 2214574 - RNA, 22 nt, Homo sapiens
ggacugcaccauugcugcuccu

SEQ ID NO: 2214575 - RNA, 17 nt, Homo sapiens
aucuugaaacacauuua

SEQ ID NO: 2214576 - RNA, 17 nt, Homo sapiens
ugacauucacacagaga

SEQ ID NO: 2214577 - RNA, 23 nt, Homo sapiens
ugcuauuuuuaauuuccugugag

SEQ ID NO: 2214578 - RNA, 16 nt, Homo sapiens
ccauaaggcaguggcu

SEQ ID NO: 2214579 - RNA, 21 nt, Homo sapiens
cuggagguggaaaauggugcc

SEQ ID NO: 2214580 - RNA, 17 nt, Homo sapiens
cagcagugucacucugu

SEQ ID NO: 2214581 - RNA, 22 nt, Homo sapiens
auccuacaguuggaaauccauc

SEQ ID NO: 2214582 - RNA, 23 nt, Homo sapiens
auggcacuaguauuucuaugaaa

SEQ ID NO: 2214583 - RNA, 15 nt, Homo sapiens
uugggcugugccugg

SEQ ID NO: 2214584 - RNA, 15 nt, Homo sapiens
cacagagcugaaugg

SEQ ID NO: 2214585 - RNA, 17 nt, Homo sapiens
gaugaaagcuguuucau

SEQ ID NO: 2214586 - RNA, 14 nt, Homo sapiens
gcucugccucccau

SEQ ID NO: 2214587 - RNA, 14 nt, Homo sapiens
ucaauauuccugaa

SEQ ID NO: 2214588 - RNA, 17 nt, Homo sapiens
ucuguaaaugaacacau

SEQ ID NO: 2214589 - RNA, 15 nt, Homo sapiens
uugcaacuaguaaaa

SEQ ID NO: 2214590 - RNA, 14 nt, Homo sapiens
aaucaggggccaga

SEQ ID NO: 2214591 - RNA, 14 nt, Homo sapiens
aucaaaaaguaauu

SEQ ID NO: 2214592 - RNA, 20 nt, Homo sapiens
ugagggcuggggguggacuu

SEQ ID NO: 2214593 - RNA, 12 nt, Homo sapiens
ugaguuugacau

SEQ ID NO: 2214594 - RNA, 23 nt, Homo sapiens
aacguugaauugaugaugcaguu

SEQ ID NO: 2214595 - RNA, 17 nt, Homo sapiens
gcaauccugcaagaaca

SEQ ID NO: 2214596 - RNA, 18 nt, Homo sapiens
caauaaagaccacuuuac

SEQ ID NO: 2214597 - RNA, 22 nt, Homo sapiens
auugcugugucuccucucagag

SEQ ID NO: 2214598 - RNA, 18 nt, Homo sapiens
ucaguggaggccagagau

SEQ ID NO: 2214599 - RNA, 19 nt, Homo sapiens
ugguggcucacgccuguaa

SEQ ID NO: 2214600 - RNA, 14 nt, Homo sapiens
uucauuuauaucgc

SEQ ID NO: 2214601 - RNA, 24 nt, Homo sapiens
gguuuggggaccauaucaggagac

SEQ ID NO: 2214602 - RNA, 13 nt, Homo sapiens
ggcuucugaugau

SEQ ID NO: 2214603 - RNA, 20 nt, Homo sapiens
uauuucaauacuuacauauc

SEQ ID NO: 2214604 - RNA, 18 nt, Homo sapiens
aaguguguaugauaauga

SEQ ID NO: 2214605 - RNA, 14 nt, Homo sapiens
guauuacacuguau

SEQ ID NO: 2214606 - RNA, 18 nt, Homo sapiens
uaagccuugacacacugu

SEQ ID NO: 2214607 - RNA, 14 nt, Homo sapiens
uuucaggauauaau

SEQ ID NO: 2214608 - RNA, 17 nt, Homo sapiens
cagacauagacugcaaa

SEQ ID NO: 2214609 - RNA, 16 nt, Homo sapiens
uguuuucuacugcuau

SEQ ID NO: 2214610 - RNA, 19 nt, Homo sapiens
aaacguacgggaaugugcu

SEQ ID NO: 2214611 - RNA, 17 nt, Homo sapiens
uuuucacuuuauugcua

SEQ ID NO: 2214612 - RNA, 16 nt, Homo sapiens
gugaaccacuucauuc

SEQ ID NO: 2214613 - RNA, 22 nt, Homo sapiens
aggaaggcaaagccccuggaaa

SEQ ID NO: 2214614 - RNA, 21 nt, Homo sapiens
auaaacuuuauaaauucauaa

SEQ ID NO: 2214615 - RNA, 18 nt, Homo sapiens
uugguaaaucacacugaa

SEQ ID NO: 2214616 - RNA, 18 nt, Homo sapiens
ugaacugccaaguacugc

SEQ ID NO: 2214617 - RNA, 13 nt, Homo sapiens
aggcauucuugaa

SEQ ID NO: 2214618 - RNA, 19 nt, Homo sapiens
ggucaaccuuuguguggcu

SEQ ID NO: 2214619 - RNA, 20 nt, Homo sapiens
aucaccugccaaaugaauaa

SEQ ID NO: 2214620 - RNA, 12 nt, Homo sapiens
agccuugcuugu

SEQ ID NO: 2214621 - RNA, 19 nt, Homo sapiens
cuacugagcauuugcaccu

SEQ ID NO: 2214622 - RNA, 13 nt, Homo sapiens
aagcggcugccuc

SEQ ID NO: 2214623 - RNA, 17 nt, Homo sapiens
cuggcugguuccagaac

SEQ ID NO: 2214624 - RNA, 15 nt, Homo sapiens
aaacuuccagguucc

SEQ ID NO: 2214625 - RNA, 18 nt, Homo sapiens
aacccacagaugucucug

SEQ ID NO: 2214626 - RNA, 20 nt, Homo sapiens
cuugguucccagaaaacaca

SEQ ID NO: 2214627 - RNA, 13 nt, Homo sapiens
ucaaaaugcuuca

SEQ ID NO: 2214628 - RNA, 18 nt, Homo sapiens
gccgggcccccaccgccg

SEQ ID NO: 2214629 - RNA, 18 nt, Homo sapiens
uagcugagacuacaggug

SEQ ID NO: 2214630 - RNA, 15 nt, Homo sapiens
caucauuagaacaaa

SEQ ID NO: 2214631 - RNA, 19 nt, Homo sapiens
ucaaacuccugaccucagg

SEQ ID NO: 2214632 - RNA, 17 nt, Homo sapiens
guucugaugccaauacu

SEQ ID NO: 2214633 - RNA, 18 nt, Homo sapiens
cuaaccuggauaacugua

SEQ ID NO: 2214634 - RNA, 13 nt, Homo sapiens
uucccacacuguc

SEQ ID NO: 2214635 - RNA, 23 nt, Homo sapiens
acgugggugcccucuccaaaggc

SEQ ID NO: 2214636 - RNA, 22 nt, Homo sapiens
cauacuccaacugaaauguuaa

SEQ ID NO: 2214637 - RNA, 23 nt, Homo sapiens
gcagaaacaaaaugacuguagaa

SEQ ID NO: 2214638 - RNA, 18 nt, Homo sapiens
ucuuucaggacucuaccu

SEQ ID NO: 2214639 - RNA, 15 nt, Homo sapiens
acagguacagcaaca

SEQ ID NO: 2214640 - RNA, 14 nt, Homo sapiens
uuccugacugcuag

SEQ ID NO: 2214641 - RNA, 12 nt, Homo sapiens
aaucagccauaa

SEQ ID NO: 2214642 - RNA, 23 nt, Homo sapiens
gcguggcggagcugcugcugcuc

SEQ ID NO: 2214643 - RNA, 14 nt, Homo sapiens
uggucaugugaguc

SEQ ID NO: 2214644 - RNA, 18 nt, Homo sapiens
ccuucggguuggcaaaau

SEQ ID NO: 2214645 - RNA, 17 nt, Homo sapiens
ugaaaauuauuccuugc

SEQ ID NO: 2214646 - RNA, 12 nt, Homo sapiens
ccucaguucuca

SEQ ID NO: 2214647 - RNA, 22 nt, Homo sapiens
aagauguauuauaccagugaaa

SEQ ID NO: 2214648 - RNA, 22 nt, Homo sapiens
agcuuaauaguaguuagcuuaa

SEQ ID NO: 2214649 - RNA, 19 nt, Homo sapiens
acaguaaauacacugugaa

SEQ ID NO: 2214650 - RNA, 20 nt, Homo sapiens
aauauauuucaaaacuucag

SEQ ID NO: 2214651 - RNA, 21 nt, Homo sapiens
cacauaggaaaaugccaugaa

SEQ ID NO: 2214652 - RNA, 15 nt, Homo sapiens
ggagcuccacugcca

SEQ ID NO: 2214653 - RNA, 15 nt, Homo sapiens
ggugccccacagcua

SEQ ID NO: 2214654 - RNA, 13 nt, Homo sapiens
aagccuuuugcaa

SEQ ID NO: 2214655 - RNA, 12 nt, Homo sapiens
aaagaagagccg

SEQ ID NO: 2214656 - RNA, 20 nt, Homo sapiens
agcccaggccagagugcagu

SEQ ID NO: 2214657 - RNA, 23 nt, Homo sapiens
gagucacccaugaagacaggaca

SEQ ID NO: 2214658 - RNA, 20 nt, Homo sapiens
aaguagcaaaaaaguacaaa

SEQ ID NO: 2214659 - RNA, 19 nt, Homo sapiens
auguguauauguagcaaaa

SEQ ID NO: 2214660 - RNA, 17 nt, Homo sapiens
gcaggugguaggccaug

SEQ ID NO: 2214661 - RNA, 16 nt, Homo sapiens
uggcucgggacuucaa

SEQ ID NO: 2214662 - RNA, 16 nt, Homo sapiens
uaccaaggggguaaaa

SEQ ID NO: 2214663 - RNA, 23 nt, Homo sapiens
uccuggagaaggcauuccagggu

SEQ ID NO: 2214664 - RNA, 22 nt, Homo sapiens
uaccuagugcaaaaacuguaaa

SEQ ID NO: 2214665 - RNA, 19 nt, Homo sapiens
auggcauuuggucucaggc

SEQ ID NO: 2214666 - RNA, 15 nt, Homo sapiens
gcagaccagcacuuc

SEQ ID NO: 2214667 - RNA, 13 nt, Homo sapiens
uccuccaggguga

SEQ ID NO: 2214668 - RNA, 18 nt, Homo sapiens
ucuagacaacuaccccuu

SEQ ID NO: 2214669 - RNA, 15 nt, Homo sapiens
agccagauuccccag

SEQ ID NO: 2214670 - RNA, 20 nt, Homo sapiens
aucuaauuuuacacucugua

SEQ ID NO: 2214671 - RNA, 22 nt, Homo sapiens
guuuccugccugcggaccagau

SEQ ID NO: 2214672 - RNA, 17 nt, Homo sapiens
aagaacaccugcauucu

SEQ ID NO: 2214673 - RNA, 24 nt, Homo sapiens
cccaucauugguacccacuugcuu

SEQ ID NO: 2214674 - RNA, 16 nt, Homo sapiens
agucugagucagagau

SEQ ID NO: 2214675 - RNA, 17 nt, Homo sapiens
aauccuugccacagugu

SEQ ID NO: 2214676 - RNA, 20 nt, Homo sapiens
cacauugcugugaacaggaa

SEQ ID NO: 2214677 - RNA, 14 nt, Homo sapiens
aagcucgagugaau

SEQ ID NO: 2214678 - RNA, 15 nt, Homo sapiens
cgacuuuuaagcaaa

SEQ ID NO: 2214679 - RNA, 19 nt, Homo sapiens
ugguucccccacugaucac

SEQ ID NO: 2214680 - RNA, 15 nt, Homo sapiens
aagaaguucauuuug

SEQ ID NO: 2214681 - RNA, 22 nt, Homo sapiens
auuuaagaaaaguguuuucaca

SEQ ID NO: 2214682 - RNA, 23 nt, Homo sapiens
aggcuuggaaccguaggacccaa

SEQ ID NO: 2214683 - RNA, 22 nt, Homo sapiens
ccccgcgcucgcccagcaggag

SEQ ID NO: 2214684 - RNA, 18 nt, Homo sapiens
aguguguguuuaacauuc

SEQ ID NO: 2214685 - RNA, 13 nt, Homo sapiens
aagagcuuuacaa

SEQ ID NO: 2214686 - RNA, 15 nt, Homo sapiens
cuuuauaaauaucaa

SEQ ID NO: 2214687 - RNA, 15 nt, Homo sapiens
acugaagaccagcug

SEQ ID NO: 2214688 - RNA, 22 nt, Homo sapiens
ccacaggcccuuuccucaggca

SEQ ID NO: 2214689 - RNA, 19 nt, Homo sapiens
gccccucaccaacccagag

SEQ ID NO: 2214690 - RNA, 16 nt, Homo sapiens
cgcauuggugacucac

SEQ ID NO: 2214691 - RNA, 13 nt, Homo sapiens
cuggaacauucca

SEQ ID NO: 2214692 - RNA, 19 nt, Homo sapiens
gagaaaugaauaauuuccc

SEQ ID NO: 2214693 - RNA, 11 nt, Homo sapiens
aaaguacuggg

SEQ ID NO: 2214694 - RNA, 22 nt, Homo sapiens
ccgugcucgcccacaaacugau

SEQ ID NO: 2214695 - RNA, 23 nt, Homo sapiens
gaguucugggauuucuucucaca

SEQ ID NO: 2214696 - RNA, 12 nt, Homo sapiens
uucugcauuuaa

SEQ ID NO: 2214697 - RNA, 19 nt, Homo sapiens
cagcccugauugcgcaaaa

SEQ ID NO: 2214698 - RNA, 15 nt, Homo sapiens
ugcacaguagcugca

SEQ ID NO: 2214699 - RNA, 12 nt, Homo sapiens
ugggcaggugaa

SEQ ID NO: 2214700 - RNA, 20 nt, Homo sapiens
gcaauaauacaacuaucaua

SEQ ID NO: 2214701 - RNA, 22 nt, Homo sapiens
aaugugacuucaugcuauauau

SEQ ID NO: 2214702 - RNA, 21 nt, Homo sapiens
gauggaacaagagaaguacua

SEQ ID NO: 2214703 - RNA, 17 nt, Homo sapiens
gucagaguucugcucua

SEQ ID NO: 2214704 - RNA, 18 nt, Homo sapiens
uuacacugaggacugugg

SEQ ID NO: 2214705 - RNA, 14 nt, Homo sapiens
auaaagcccuugaa

SEQ ID NO: 2214706 - RNA, 20 nt, Homo sapiens
accaaaacuuccaaggcccu

SEQ ID NO: 2214707 - RNA, 22 nt, Homo sapiens
uauaaauaaaacauuuucacac

SEQ ID NO: 2214708 - RNA, 19 nt, Homo sapiens
ccuggccgguaggcugcug

SEQ ID NO: 2214709 - RNA, 19 nt, Homo sapiens
accuuugauuuuuugccca

SEQ ID NO: 2214710 - RNA, 16 nt, Homo sapiens
gcacugaucacccaau

SEQ ID NO: 2214711 - RNA, 11 nt, Homo sapiens
aauuaaagccc

SEQ ID NO: 2214712 - RNA, 14 nt, Homo sapiens
acucuaucccuggc

SEQ ID NO: 2214713 - RNA, 17 nt, Homo sapiens
uguuccugcuuuucuaa

SEQ ID NO: 2214714 - RNA, 17 nt, Homo sapiens
cugagcagagagcagca

SEQ ID NO: 2214715 - RNA, 21 nt, Homo sapiens
ccucucgccucauuacuguga

SEQ ID NO: 2214716 - RNA, 14 nt, Homo sapiens
auucaaaugcaaaa

SEQ ID NO: 2214717 - RNA, 19 nt, Homo sapiens
ccuagcaccuggcuaguuu

SEQ ID NO: 2214718 - RNA, 15 nt, Homo sapiens
auaaucucuuuccau

SEQ ID NO: 2214719 - RNA, 19 nt, Homo sapiens
uucuuucucccuaaccacu

SEQ ID NO: 2214720 - RNA, 22 nt, Homo sapiens
cggcaguauggaauuccagugc

SEQ ID NO: 2214721 - RNA, 16 nt, Homo sapiens
agcaauuagugauaua

SEQ ID NO: 2214722 - RNA, 23 nt, Homo sapiens
acaauguuguguuuggauuugua

SEQ ID NO: 2214723 - RNA, 15 nt, Homo sapiens
cgugccguggagcuu

SEQ ID NO: 2214724 - RNA, 20 nt, Homo sapiens
gcacuguuuaaucauaguua

SEQ ID NO: 2214725 - RNA, 19 nt, Homo sapiens
gagucucccuuagggcccu

SEQ ID NO: 2214726 - RNA, 11 nt, Homo sapiens
aggugagacag

SEQ ID NO: 2214727 - RNA, 17 nt, Homo sapiens
caugugcacgguggcga

SEQ ID NO: 2214728 - RNA, 16 nt, Homo sapiens
aaauuuuuaaauauuc

SEQ ID NO: 2214729 - RNA, 18 nt, Homo sapiens
cuuggaaaugguggugcu

SEQ ID NO: 2214730 - RNA, 17 nt, Homo sapiens
ucauuguucacuucuaa

SEQ ID NO: 2214731 - RNA, 16 nt, Homo sapiens
ucacugcccaccaaag

SEQ ID NO: 2214732 - RNA, 20 nt, Homo sapiens
acgagugaaacuccgucuca

SEQ ID NO: 2214733 - RNA, 12 nt, Homo sapiens
agucucuauacc

SEQ ID NO: 2214734 - RNA, 20 nt, Homo sapiens
uuacucaauaaaacuuuaaa

SEQ ID NO: 2214735 - RNA, 19 nt, Homo sapiens
ugggaaaugagcagggaug

SEQ ID NO: 2214736 - RNA, 12 nt, Homo sapiens
uaacuugagggu

SEQ ID NO: 2214737 - RNA, 15 nt, Homo sapiens
ugagaucaaugugac

SEQ ID NO: 2214738 - RNA, 20 nt, Homo sapiens
guggcucuggguaccugcaa

SEQ ID NO: 2214739 - RNA, 15 nt, Homo sapiens
ugaaauguggaugug

SEQ ID NO: 2214740 - RNA, 17 nt, Homo sapiens
gaaugugagcuuaccag

SEQ ID NO: 2214741 - RNA, 21 nt, Homo sapiens
acacacaugacgcaccaguua

SEQ ID NO: 2214742 - RNA, 14 nt, Homo sapiens
uguggggaauggga

SEQ ID NO: 2214743 - RNA, 18 nt, Homo sapiens
ucaaaauaaaaaccaaga

SEQ ID NO: 2214744 - RNA, 13 nt, Homo sapiens
gcuugaagccaaa

SEQ ID NO: 2214745 - RNA, 21 nt, Homo sapiens
cuggcucccagggccaugaac

SEQ ID NO: 2214746 - RNA, 16 nt, Homo sapiens
aaaggaagacagauuu

SEQ ID NO: 2214747 - RNA, 21 nt, Homo sapiens
acuugccuguucagagcacuc

SEQ ID NO: 2214748 - RNA, 17 nt, Homo sapiens
uaucauaacuauacuug

SEQ ID NO: 2214749 - RNA, 21 nt, Homo sapiens
acaugugcacaugaauccaua

SEQ ID NO: 2214750 - RNA, 13 nt, Homo sapiens
cuagguaucauuc

SEQ ID NO: 2214751 - RNA, 16 nt, Homo sapiens
ggaagaauaaaaaaga

SEQ ID NO: 2214752 - RNA, 17 nt, Homo sapiens
gauacccagagcauuac

SEQ ID NO: 2214753 - RNA, 12 nt, Homo sapiens
aaaauuuauuuc

SEQ ID NO: 2214754 - RNA, 22 nt, Homo sapiens
cuccaagggacccuuugccuuu

SEQ ID NO: 2214755 - RNA, 22 nt, Homo sapiens
aagcugaaaugcaggaaguggu

SEQ ID NO: 2214756 - RNA, 19 nt, Homo sapiens
ugagaaaagcuuugaaccc

SEQ ID NO: 2214757 - RNA, 21 nt, Homo sapiens
cagaaugcaaccaagucacac

SEQ ID NO: 2214758 - RNA, 22 nt, Homo sapiens
gaauguuccuuucgaaagcaau

SEQ ID NO: 2214759 - RNA, 18 nt, Homo sapiens
ugagccacagaugggcaa

SEQ ID NO: 2214760 - RNA, 14 nt, Homo sapiens
acgguuaacuguaa

SEQ ID NO: 2214761 - RNA, 24 nt, Homo sapiens
ccuccuucauaugaaaggugccau

SEQ ID NO: 2214762 - RNA, 16 nt, Homo sapiens
aauggcuuguucauca

SEQ ID NO: 2214763 - RNA, 19 nt, Homo sapiens
cuuggcuuuguugaugcuc

SEQ ID NO: 2214764 - RNA, 13 nt, Homo sapiens
augcugccuggug

SEQ ID NO: 2214765 - RNA, 23 nt, Homo sapiens
cugcauaacagcuugaaaacugg

SEQ ID NO: 2214766 - RNA, 16 nt, Homo sapiens
aaacacuucuccuuaa

SEQ ID NO: 2214767 - RNA, 14 nt, Homo sapiens
uguuccuuguguaa

SEQ ID NO: 2214768 - RNA, 17 nt, Homo sapiens
cccagcuuagaguucuu

SEQ ID NO: 2214769 - RNA, 16 nt, Homo sapiens
acucugagcucauuaa

SEQ ID NO: 2214770 - RNA, 15 nt, Homo sapiens
ucaguccaccugagc

SEQ ID NO: 2214771 - RNA, 14 nt, Homo sapiens
acaaaaaaaccaca

SEQ ID NO: 2214772 - RNA, 14 nt, Homo sapiens
aaacaaaaaaccca

SEQ ID NO: 2214773 - RNA, 19 nt, Homo sapiens
gccuaaguccaguguuucu

SEQ ID NO: 2214774 - RNA, 21 nt, Homo sapiens
gaguaucugggaacugugccu

SEQ ID NO: 2214775 - RNA, 17 nt, Homo sapiens
acaccuaugucauuuca

SEQ ID NO: 2214776 - RNA, 19 nt, Homo sapiens
gccuucuagcacacuuuuu

SEQ ID NO: 2214777 - RNA, 14 nt, Homo sapiens
aauuauacaaugau

SEQ ID NO: 2214778 - RNA, 17 nt, Homo sapiens
uauuuaaguauauagua

SEQ ID NO: 2214779 - RNA, 15 nt, Homo sapiens
gaugguacacagugg

SEQ ID NO: 2214780 - RNA, 20 nt, Homo sapiens
ucucuguguaguuccagcaa

SEQ ID NO: 2214781 - RNA, 13 nt, Homo sapiens
uauguuauugcau

SEQ ID NO: 2214782 - RNA, 21 nt, Homo sapiens
uggcugggaauaagugccagg

SEQ ID NO: 2214783 - RNA, 17 nt, Homo sapiens
uaacaauuuauucugau

SEQ ID NO: 2214784 - RNA, 15 nt, Homo sapiens
cuccaggggcaucuu

SEQ ID NO: 2214785 - RNA, 15 nt, Homo sapiens
cuguaaucccaacac

SEQ ID NO: 2214786 - RNA, 15 nt, Homo sapiens
auaccauuauauguu

SEQ ID NO: 2214787 - RNA, 15 nt, Homo sapiens
agaguguucccugac

SEQ ID NO: 2214788 - RNA, 13 nt, Homo sapiens
uaaaauaacacuu

SEQ ID NO: 2214789 - RNA, 12 nt, Homo sapiens
uccuccaucucu

SEQ ID NO: 2214790 - RNA, 12 nt, Homo sapiens
cuucccauucuc

SEQ ID NO: 2214791 - RNA, 23 nt, Homo sapiens
cagagugagacccagcccucauc

SEQ ID NO: 2214792 - RNA, 13 nt, Homo sapiens
agaagcucacaaa

SEQ ID NO: 2214793 - RNA, 13 nt, Homo sapiens
ucaggcucugaga

SEQ ID NO: 2214794 - RNA, 17 nt, Homo sapiens
ugcucaguaaggcagug

SEQ ID NO: 2214795 - RNA, 11 nt, Homo sapiens
aacuacuucuu

SEQ ID NO: 2214796 - RNA, 13 nt, Homo sapiens
aucagacauucag

SEQ ID NO: 2214797 - RNA, 16 nt, Homo sapiens
uaaaccuccuucggga

SEQ ID NO: 2214798 - RNA, 17 nt, Homo sapiens
uagugaaguugugcaac

SEQ ID NO: 2214799 - RNA, 20 nt, Homo sapiens
uguaaugccacucauacuca

SEQ ID NO: 2214800 - RNA, 15 nt, Homo sapiens
cacguggccucguga

SEQ ID NO: 2214801 - RNA, 14 nt, Homo sapiens
uuauacuuuaucaa

SEQ ID NO: 2214802 - RNA, 15 nt, Homo sapiens
ucacacuauauacag

SEQ ID NO: 2214803 - RNA, 13 nt, Homo sapiens
guacacaguuuaa

SEQ ID NO: 2214804 - RNA, 14 nt, Homo sapiens
ucuagcacuccuca

SEQ ID NO: 2214805 - RNA, 14 nt, Homo sapiens
uccagaacucuucc

SEQ ID NO: 2214806 - RNA, 19 nt, Homo sapiens
ucaugcucgacacuuacca

SEQ ID NO: 2214807 - RNA, 15 nt, Homo sapiens
guuugauccaguuga

SEQ ID NO: 2214808 - RNA, 18 nt, Homo sapiens
aaaguaauaaaugaguuc

SEQ ID NO: 2214809 - RNA, 12 nt, Homo sapiens
gaaauacauaug

SEQ ID NO: 2214810 - RNA, 16 nt, Homo sapiens
uauaaagccacccacg

SEQ ID NO: 2214811 - RNA, 24 nt, Homo sapiens
guuuccauaggaaucauguuggau

SEQ ID NO: 2214812 - RNA, 14 nt, Homo sapiens
acuacaacaugcau

SEQ ID NO: 2214813 - RNA, 13 nt, Homo sapiens
uauguuugcugau

SEQ ID NO: 2214814 - RNA, 15 nt, Homo sapiens
uacacgugacagagu

SEQ ID NO: 2214815 - RNA, 16 nt, Homo sapiens
uuggacuugaggauuu

SEQ ID NO: 2214816 - RNA, 20 nt, Homo sapiens
aaauucucauuuuucauuuc

SEQ ID NO: 2214817 - RNA, 18 nt, Homo sapiens
cuagacccacuggacuca

SEQ ID NO: 2214818 - RNA, 22 nt, Homo sapiens
aagcagaaauacauauuuccaa

SEQ ID NO: 2214819 - RNA, 19 nt, Homo sapiens
gacacaacccgucagagac

SEQ ID NO: 2214820 - RNA, 14 nt, Homo sapiens
cguuugcaaucuac

SEQ ID NO: 2214821 - RNA, 19 nt, Homo sapiens
cagcauacccuuacucugc

SEQ ID NO: 2214822 - RNA, 16 nt, Homo sapiens
ccaagagagacauugc

SEQ ID NO: 2214823 - RNA, 21 nt, Homo sapiens
cccaaccaucuucacuggcuu

SEQ ID NO: 2214824 - RNA, 21 nt, Homo sapiens
agaaaaucuuuccucuucuca

SEQ ID NO: 2214825 - RNA, 18 nt, Homo sapiens
aaccagguuaagugguaa

SEQ ID NO: 2214826 - RNA, 18 nt, Homo sapiens
caccuuucccagauucuc

SEQ ID NO: 2214827 - RNA, 14 nt, Homo sapiens
cuccaaagagacca

SEQ ID NO: 2214828 - RNA, 13 nt, Homo sapiens
acaaaggugcuaa

SEQ ID NO: 2214829 - RNA, 21 nt, Homo sapiens
ggaacacaucuggcugcacag

SEQ ID NO: 2214830 - RNA, 15 nt, Homo sapiens
gcuucagauguggag

SEQ ID NO: 2214831 - RNA, 17 nt, Homo sapiens
auuucuccauggaguug

SEQ ID NO: 2214832 - RNA, 19 nt, Homo sapiens
gcacuuggggcaccuugcu

SEQ ID NO: 2214833 - RNA, 16 nt, Homo sapiens
ccguaucacaguguuu

SEQ ID NO: 2214834 - RNA, 15 nt, Homo sapiens
agcaggccggaacca

SEQ ID NO: 2214835 - RNA, 20 nt, Homo sapiens
gaaggugaggggauggagua

SEQ ID NO: 2214836 - RNA, 22 nt, Homo sapiens
ucuccaggcauuuagcccucac

SEQ ID NO: 2214837 - RNA, 16 nt, Homo sapiens
ccccagacccagagau

SEQ ID NO: 2214838 - RNA, 15 nt, Homo sapiens
auuuacagugaaaau

SEQ ID NO: 2214839 - RNA, 17 nt, Homo sapiens
guccccacccuccacuc

SEQ ID NO: 2214840 - RNA, 23 nt, Homo sapiens
aagcucaaugaugcaggcaauaa

SEQ ID NO: 2214841 - RNA, 22 nt, Homo sapiens
caggccuggacuuccagugcuc

SEQ ID NO: 2214842 - RNA, 21 nt, Homo sapiens
uuauccuuaggaaaaugcuuc

SEQ ID NO: 2214843 - RNA, 13 nt, Homo sapiens
acaaaaaggcaaa

SEQ ID NO: 2214844 - RNA, 13 nt, Homo sapiens
gcacaaagacaca

SEQ ID NO: 2214845 - RNA, 17 nt, Homo sapiens
auacaggacauucucau

SEQ ID NO: 2214846 - RNA, 13 nt, Homo sapiens
augagcagucaca

SEQ ID NO: 2214847 - RNA, 17 nt, Homo sapiens
uguguauauauguguau

SEQ ID NO: 2214848 - RNA, 16 nt, Homo sapiens
gagguugggcuuccau

SEQ ID NO: 2214849 - RNA, 22 nt, Homo sapiens
uaaaugaaacuuaagaauugaa

SEQ ID NO: 2214850 - RNA, 13 nt, Homo sapiens
guuuaucauuuac

SEQ ID NO: 2214851 - RNA, 13 nt, Homo sapiens
uaaacucagaaua

SEQ ID NO: 2214852 - RNA, 16 nt, Homo sapiens
gguaagcauuagcaca

SEQ ID NO: 2214853 - RNA, 20 nt, Homo sapiens
ugcccgagagagcucuggcc

SEQ ID NO: 2214854 - RNA, 21 nt, Homo sapiens
ccucggggacacuagugacag

SEQ ID NO: 2214855 - RNA, 16 nt, Homo sapiens
gauggagaaacaagac

SEQ ID NO: 2214856 - RNA, 18 nt, Homo sapiens
aagcguuggauguagcau

SEQ ID NO: 2214857 - RNA, 16 nt, Homo sapiens
ccuggauccagcacug

SEQ ID NO: 2214858 - RNA, 20 nt, Homo sapiens
guuccaaccuccugcucugg

SEQ ID NO: 2214859 - RNA, 22 nt, Homo sapiens
ucaaagcaauugaaaugcauug

SEQ ID NO: 2214860 - RNA, 22 nt, Homo sapiens
auaugaaaugauaaagauguca

SEQ ID NO: 2214861 - RNA, 19 nt, Homo sapiens
cuauuuuauaaaacaaaua

SEQ ID NO: 2214862 - RNA, 17 nt, Homo sapiens
uuuacacuuuaugguaa

SEQ ID NO: 2214863 - RNA, 14 nt, Homo sapiens
cacugaaaccaggu

SEQ ID NO: 2214864 - RNA, 22 nt, Homo sapiens
aaaggaagucucugggcccaga

SEQ ID NO: 2214865 - RNA, 22 nt, Homo sapiens
uuuagcccugggcccucccuuu

SEQ ID NO: 2214866 - RNA, 22 nt, Homo sapiens
ucaacugcuuugaaacuugccu

SEQ ID NO: 2214867 - RNA, 12 nt, Homo sapiens
cugugggaaauu

SEQ ID NO: 2214868 - RNA, 20 nt, Homo sapiens
cagcccgaccaacauggaga

SEQ ID NO: 2214869 - RNA, 18 nt, Homo sapiens
aacaucagguuaggcagu

SEQ ID NO: 2214870 - RNA, 12 nt, Homo sapiens
acggaacacugu

SEQ ID NO: 2214871 - RNA, 18 nt, Homo sapiens
uaugcauuaccugggaau

SEQ ID NO: 2214872 - RNA, 14 nt, Homo sapiens
cuccugguccugga

SEQ ID NO: 2214873 - RNA, 13 nt, Homo sapiens
cugccaccccuuc

SEQ ID NO: 2214874 - RNA, 13 nt, Homo sapiens
acuuuaccaugcu

SEQ ID NO: 2214875 - RNA, 19 nt, Homo sapiens
acucuaagcucagugcucu

SEQ ID NO: 2214876 - RNA, 15 nt, Homo sapiens
cuuuaaaaucuguuc

SEQ ID NO: 2214877 - RNA, 15 nt, Homo sapiens
accaaaaaaccucac

SEQ ID NO: 2214878 - RNA, 15 nt, Homo sapiens
uguuaaaauguacac

SEQ ID NO: 2214879 - RNA, 15 nt, Homo sapiens
agaaauaaagaucuc

SEQ ID NO: 2214880 - RNA, 16 nt, Homo sapiens
gcugagucugcagaug

SEQ ID NO: 2214881 - RNA, 18 nt, Homo sapiens
gccagugccagcaccugc

SEQ ID NO: 2214882 - RNA, 24 nt, Homo sapiens
uuacuguuuauuucuguuucucau

SEQ ID NO: 2214883 - RNA, 16 nt, Homo sapiens
cuacaaacacaagcaa

SEQ ID NO: 2214884 - RNA, 13 nt, Homo sapiens
aucuaauaccauc

SEQ ID NO: 2214885 - RNA, 12 nt, Homo sapiens
gcaucugcagcc

SEQ ID NO: 2214886 - RNA, 14 nt, Homo sapiens
uaaccaaauuuuga

SEQ ID NO: 2214887 - RNA, 21 nt, Homo sapiens
ccaagcucacagccagcuccu

SEQ ID NO: 2214888 - RNA, 17 nt, Homo sapiens
agacuuuaaaauucuaa

SEQ ID NO: 2214889 - RNA, 18 nt, Homo sapiens
gcagugagugccaugcuu

SEQ ID NO: 2214890 - RNA, 19 nt, Homo sapiens
ggagggagggcgguggaca

SEQ ID NO: 2214891 - RNA, 12 nt, Homo sapiens
aaagcagcaacu

SEQ ID NO: 2214892 - RNA, 23 nt, Homo sapiens
ggggcucagccaggugcugugac

SEQ ID NO: 2214893 - RNA, 15 nt, Homo sapiens
cagacuucaucuuca

SEQ ID NO: 2214894 - RNA, 16 nt, Homo sapiens
uaaaagcaugucaaca

SEQ ID NO: 2214895 - RNA, 15 nt, Homo sapiens
ucuuugcacaaucaa

SEQ ID NO: 2214896 - RNA, 23 nt, Homo sapiens
gccauguuucaagaaaauggauu

SEQ ID NO: 2214897 - RNA, 16 nt, Homo sapiens
guccagagaacugaca

SEQ ID NO: 2214898 - RNA, 20 nt, Homo sapiens
ucaagaauggggaucacaga

SEQ ID NO: 2214899 - RNA, 18 nt, Homo sapiens
caggccacugaccuccca

SEQ ID NO: 2214900 - RNA, 22 nt, Homo sapiens
gcugcuggcccacagcucugcu

SEQ ID NO: 2214901 - RNA, 23 nt, Homo sapiens
guaggaaacucaucuccuuccug

SEQ ID NO: 2214902 - RNA, 13 nt, Homo sapiens
ucugucucuguca

SEQ ID NO: 2214903 - RNA, 17 nt, Homo sapiens
cuggugcucuaaugcca

SEQ ID NO: 2214904 - RNA, 14 nt, Homo sapiens
uuuuuacucccuga

SEQ ID NO: 2214905 - RNA, 16 nt, Homo sapiens
ggcagauaacugcugu

SEQ ID NO: 2214906 - RNA, 22 nt, Homo sapiens
uaggccugaaaugacauuucac

SEQ ID NO: 2214907 - RNA, 11 nt, Homo sapiens
uaaugagcucc

SEQ ID NO: 2214908 - RNA, 11 nt, Homo sapiens
uaggugucaug

SEQ ID NO: 2214909 - RNA, 21 nt, Homo sapiens
caagugggcagcauaaaguca

SEQ ID NO: 2214910 - RNA, 17 nt, Homo sapiens
ucauuacuuguugccua

SEQ ID NO: 2214911 - RNA, 20 nt, Homo sapiens
caucaaccucuguauuugaa

SEQ ID NO: 2214912 - RNA, 17 nt, Homo sapiens
cgaagggggucaaagga

SEQ ID NO: 2214913 - RNA, 12 nt, Homo sapiens
aucaaagcacau

SEQ ID NO: 2214914 - RNA, 23 nt, Homo sapiens
guggcugauuuacuaacaguaac

SEQ ID NO: 2214915 - RNA, 21 nt, Homo sapiens
auuguaucaaguggcaugugc

SEQ ID NO: 2214916 - RNA, 18 nt, Homo sapiens
uucacaggaggccagugg

SEQ ID NO: 2214917 - RNA, 14 nt, Homo sapiens
gagggagcccaguc

SEQ ID NO: 2214918 - RNA, 12 nt, Homo sapiens
ucagaaucugug

SEQ ID NO: 2214919 - RNA, 15 nt, Homo sapiens
ucccaccgcuuugug

SEQ ID NO: 2214920 - RNA, 15 nt, Homo sapiens
aauuccauaugcugu

SEQ ID NO: 2214921 - RNA, 13 nt, Homo sapiens
uucauaucucucc

SEQ ID NO: 2214922 - RNA, 16 nt, Homo sapiens
aacaaccuaugcacca

SEQ ID NO: 2214923 - RNA, 17 nt, Homo sapiens
gcgaaccacccaaaaca

SEQ ID NO: 2214924 - RNA, 22 nt, Homo sapiens
auucaugaaaauaaauguacau

SEQ ID NO: 2214925 - RNA, 22 nt, Homo sapiens
uaaaaccaacaaaaagaacaaa

SEQ ID NO: 2214926 - RNA, 19 nt, Homo sapiens
aaauaauuaucacaaugua

SEQ ID NO: 2214927 - RNA, 17 nt, Homo sapiens
ugugugaccaacugugu

SEQ ID NO: 2214928 - RNA, 15 nt, Homo sapiens
cuuucaucaaaacaa

SEQ ID NO: 2214929 - RNA, 15 nt, Homo sapiens
cauugcacauaagcu

SEQ ID NO: 2214930 - RNA, 14 nt, Homo sapiens
ugccuucugcugaa

SEQ ID NO: 2214931 - RNA, 14 nt, Homo sapiens
gguguucuucccaa

SEQ ID NO: 2214932 - RNA, 17 nt, Homo sapiens
aacacucagaagccugg

SEQ ID NO: 2214933 - RNA, 14 nt, Homo sapiens
ucugacccugaugc

SEQ ID NO: 2214934 - RNA, 15 nt, Homo sapiens
ucuccuuuugaccaa

SEQ ID NO: 2214935 - RNA, 15 nt, Homo sapiens
acauuuuuaguuuaa

SEQ ID NO: 2214936 - RNA, 12 nt, Homo sapiens
uuuuaaguauuu

SEQ ID NO: 2214937 - RNA, 20 nt, Homo sapiens
cugggagccacgccuaugcc

SEQ ID NO: 2214938 - RNA, 19 nt, Homo sapiens
gcucucccaacucuugcac

SEQ ID NO: 2214939 - RNA, 19 nt, Homo sapiens
uucucagcuauuuccagag

SEQ ID NO: 2214940 - RNA, 15 nt, Homo sapiens
aguuuugauacaaac

SEQ ID NO: 2214941 - RNA, 21 nt, Homo sapiens
agucauugaaggguguucacc

SEQ ID NO: 2214942 - RNA, 11 nt, Homo sapiens
guauacuguua

SEQ ID NO: 2214943 - RNA, 22 nt, Homo sapiens
cuaucuguaagagguacuaaaa

SEQ ID NO: 2214944 - RNA, 20 nt, Homo sapiens
aucuaaggaccccaguuugg

SEQ ID NO: 2214945 - RNA, 17 nt, Homo sapiens
agugaauuucacacugu

SEQ ID NO: 2214946 - RNA, 22 nt, Homo sapiens
aagaugaaacagggcaccccag

SEQ ID NO: 2214947 - RNA, 20 nt, Homo sapiens
cacacagguggggacugggc

SEQ ID NO: 2214948 - RNA, 22 nt, Homo sapiens
gcuuccuccugaaccagcacua

SEQ ID NO: 2214949 - RNA, 16 nt, Homo sapiens
agccaagaacgcaggg

SEQ ID NO: 2214950 - RNA, 20 nt, Homo sapiens
cagugacugucguguuuaca

SEQ ID NO: 2214951 - RNA, 20 nt, Homo sapiens
cuguagcgccaguguaaucc

SEQ ID NO: 2214952 - RNA, 17 nt, Homo sapiens
cuccucccaacucuagc

SEQ ID NO: 2214953 - RNA, 17 nt, Homo sapiens
auaaauagcugaaaacu

SEQ ID NO: 2214954 - RNA, 22 nt, Homo sapiens
cgaggcaggccgacuguacuaa

SEQ ID NO: 2214955 - RNA, 15 nt, Homo sapiens
ggagacacauucaca

SEQ ID NO: 2214956 - RNA, 20 nt, Homo sapiens
guuucugauaccacugcacu

SEQ ID NO: 2214957 - RNA, 22 nt, Homo sapiens
caguauggcaaaauuagucuug

SEQ ID NO: 2214958 - RNA, 13 nt, Homo sapiens
ccuccgacuucuc

SEQ ID NO: 2214959 - RNA, 18 nt, Homo sapiens
uggaugccugauugccaa

SEQ ID NO: 2214960 - RNA, 20 nt, Homo sapiens
gcuuugcagagaacucauaa

SEQ ID NO: 2214961 - RNA, 21 nt, Homo sapiens
ugccucaugccuguaauccca

SEQ ID NO: 2214962 - RNA, 12 nt, Homo sapiens
cugggaagacaa

SEQ ID NO: 2214963 - RNA, 17 nt, Homo sapiens
aagcucaucucagucau

SEQ ID NO: 2214964 - RNA, 11 nt, Homo sapiens
gcagguugaga

SEQ ID NO: 2214965 - RNA, 16 nt, Homo sapiens
acuaaaauuccacuca

SEQ ID NO: 2214966 - RNA, 16 nt, Homo sapiens
auaaaugcaaccauuu

SEQ ID NO: 2214967 - RNA, 19 nt, Homo sapiens
caucucuuuagauccaaaa

SEQ ID NO: 2214968 - RNA, 19 nt, Homo sapiens
ugaaaccuacacacuguca

SEQ ID NO: 2214969 - RNA, 14 nt, Homo sapiens
gcugcucuauauua

SEQ ID NO: 2214970 - RNA, 22 nt, Homo sapiens
ugaaaauaaguguaauuaccac

SEQ ID NO: 2214971 - RNA, 22 nt, Homo sapiens
ccucccagcguguguauccgac

SEQ ID NO: 2214972 - RNA, 19 nt, Homo sapiens
guagguaggaagcacugaa

SEQ ID NO: 2214973 - RNA, 17 nt, Homo sapiens
auaaacacuuucuggaa

SEQ ID NO: 2214974 - RNA, 15 nt, Homo sapiens
aucaggagcugcuca

SEQ ID NO: 2214975 - RNA, 19 nt, Homo sapiens
caccuuccucccaccucac

SEQ ID NO: 2214976 - RNA, 23 nt, Homo sapiens
uggaaaggccagcagccuuccag

SEQ ID NO: 2214977 - RNA, 13 nt, Homo sapiens
agucaucucagcc

SEQ ID NO: 2214978 - RNA, 18 nt, Homo sapiens
aaacccagccccacaaac

SEQ ID NO: 2214979 - RNA, 17 nt, Homo sapiens
aguuuuacccagacuca

SEQ ID NO: 2214980 - RNA, 22 nt, Homo sapiens
cuuuaccuucauauguguaaaa

SEQ ID NO: 2214981 - RNA, 21 nt, Homo sapiens
cuaauuuauccugaaauuuca

SEQ ID NO: 2214982 - RNA, 13 nt, Homo sapiens
augaaagcuauug

SEQ ID NO: 2214983 - RNA, 13 nt, Homo sapiens
uagaaagcauuug

SEQ ID NO: 2214984 - RNA, 11 nt, Homo sapiens
cuuuacuugac

SEQ ID NO: 2214985 - RNA, 14 nt, Homo sapiens
ugugaacaugccuu

SEQ ID NO: 2214986 - RNA, 18 nt, Homo sapiens
gguuuauauaaggaauaa

SEQ ID NO: 2214987 - RNA, 17 nt, Homo sapiens
ccaggcacccccagaau

SEQ ID NO: 2214988 - RNA, 21 nt, Homo sapiens
uagcuugauguuggaucucaa

SEQ ID NO: 2214989 - RNA, 18 nt, Homo sapiens
acagcucacuacaguuuc

SEQ ID NO: 2214990 - RNA, 18 nt, Homo sapiens
uacuuuuaaacuguguac

SEQ ID NO: 2214991 - RNA, 15 nt, Homo sapiens
aaaagaggugucaug

SEQ ID NO: 2214992 - RNA, 20 nt, Homo sapiens
cucacaggcauagagugacc

SEQ ID NO: 2214993 - RNA, 17 nt, Homo sapiens
ucaauuugcuauuuaca

SEQ ID NO: 2214994 - RNA, 20 nt, Homo sapiens
gacccugaagaggcauuuca

SEQ ID NO: 2214995 - RNA, 17 nt, Homo sapiens
guauauauacauaacag

SEQ ID NO: 2214996 - RNA, 14 nt, Homo sapiens
agugucucuucaag

SEQ ID NO: 2214997 - RNA, 21 nt, Homo sapiens
uaaaaucauaaauauaaucua

SEQ ID NO: 2214998 - RNA, 19 nt, Homo sapiens
uaauccucuuuuucuaguc

SEQ ID NO: 2214999 - RNA, 17 nt, Homo sapiens
gacagccacccugagaa

SEQ ID NO: 2215000 - RNA, 17 nt, Homo sapiens
caaugcguggcucuccu

SEQ ID NO: 2215001 - RNA, 17 nt, Homo sapiens
uagacuucugcuuucca

SEQ ID NO: 2215002 - RNA, 18 nt, Homo sapiens
ugguagcaagaagugauu

SEQ ID NO: 2215003 - RNA, 15 nt, Homo sapiens
cugaaacacuggacc

SEQ ID NO: 2215004 - RNA, 15 nt, Homo sapiens
cauacacacaugccc

SEQ ID NO: 2215005 - RNA, 15 nt, Homo sapiens
acaaacaaacagaaa

SEQ ID NO: 2215006 - RNA, 14 nt, Homo sapiens
ccugcuccugccca

SEQ ID NO: 2215007 - RNA, 11 nt, Homo sapiens
uaucugcuaug

SEQ ID NO: 2215008 - RNA, 17 nt, Homo sapiens
agcucaccaacuacaga

SEQ ID NO: 2215009 - RNA, 15 nt, Homo sapiens
gcccuucauugggga

SEQ ID NO: 2215010 - RNA, 15 nt, Homo sapiens
cggcucguuccccca

SEQ ID NO: 2215011 - RNA, 19 nt, Homo sapiens
aggagggugugaguggcau

SEQ ID NO: 2215012 - RNA, 12 nt, Homo sapiens
ucagauucaccu

SEQ ID NO: 2215013 - RNA, 15 nt, Homo sapiens
guagacagaccucca

SEQ ID NO: 2215014 - RNA, 19 nt, Homo sapiens
uacuaguccugacacugaa

SEQ ID NO: 2215015 - RNA, 21 nt, Homo sapiens
ggcaggccuggacuuccagug

SEQ ID NO: 2215016 - RNA, 14 nt, Homo sapiens
acuuucauaccacu

SEQ ID NO: 2215017 - RNA, 18 nt, Homo sapiens
guuaaggugaacgcacuu

SEQ ID NO: 2215018 - RNA, 17 nt, Homo sapiens
cuggguuucuaagcagu

SEQ ID NO: 2215019 - RNA, 15 nt, Homo sapiens
ccugucucccaaaaa

SEQ ID NO: 2215020 - RNA, 19 nt, Homo sapiens
ugguuaacgccuucauuua

SEQ ID NO: 2215021 - RNA, 22 nt, Homo sapiens
aacauaguaacguguuacugga

SEQ ID NO: 2215022 - RNA, 17 nt, Homo sapiens
acaacagucagccagcu

SEQ ID NO: 2215023 - RNA, 11 nt, Homo sapiens
uuccuugagaa

SEQ ID NO: 2215024 - RNA, 17 nt, Homo sapiens
cauucccccaccagcug

SEQ ID NO: 2215025 - RNA, 17 nt, Homo sapiens
gcauccauguaaucuau

SEQ ID NO: 2215026 - RNA, 20 nt, Homo sapiens
cucagacacaaauaaaggaa

SEQ ID NO: 2215027 - RNA, 20 nt, Homo sapiens
uuuuguauuguuuucugaca

SEQ ID NO: 2215028 - RNA, 16 nt, Homo sapiens
cguuuagcugacaaaa

SEQ ID NO: 2215029 - RNA, 17 nt, Homo sapiens
cuagaaacaacacugua

SEQ ID NO: 2215030 - RNA, 15 nt, Homo sapiens
uggaagaagaaagga

SEQ ID NO: 2215031 - RNA, 13 nt, Homo sapiens
aagauacuccaua

SEQ ID NO: 2215032 - RNA, 22 nt, Homo sapiens
auaacguggggcuaggacacug

SEQ ID NO: 2215033 - RNA, 18 nt, Homo sapiens
cugggucuugugaugaac

SEQ ID NO: 2215034 - RNA, 17 nt, Homo sapiens
acagagucuugcucugu

SEQ ID NO: 2215035 - RNA, 19 nt, Homo sapiens
uuaucaugugaaaucauuc

SEQ ID NO: 2215036 - RNA, 21 nt, Homo sapiens
uauaagugagagaaaugaagu

SEQ ID NO: 2215037 - RNA, 21 nt, Homo sapiens
caucacccucuuccugugauc

SEQ ID NO: 2215038 - RNA, 16 nt, Homo sapiens
ucauuccaaguguaua

SEQ ID NO: 2215039 - RNA, 21 nt, Homo sapiens
uguuuuccccaauuauccucc

SEQ ID NO: 2215040 - RNA, 16 nt, Homo sapiens
ggucauuuccagacaa

SEQ ID NO: 2215041 - RNA, 24 nt, Homo sapiens
gaggaucuauuacugaccguauga

SEQ ID NO: 2215042 - RNA, 17 nt, Homo sapiens
aauugaggacacugaua

SEQ ID NO: 2215043 - RNA, 18 nt, Homo sapiens
ucccuguaauauuuagcu

SEQ ID NO: 2215044 - RNA, 14 nt, Homo sapiens
cauaaauguuauau

SEQ ID NO: 2215045 - RNA, 11 nt, Homo sapiens
gaccacuuaau

SEQ ID NO: 2215046 - RNA, 19 nt, Homo sapiens
agccagaggcucuaaugua

SEQ ID NO: 2215047 - RNA, 18 nt, Homo sapiens
acauuaagaaaaacaaua

SEQ ID NO: 2215048 - RNA, 15 nt, Homo sapiens
uuuccaucugcuggg

SEQ ID NO: 2215049 - RNA, 17 nt, Homo sapiens
auuaucuauuaucucaa

SEQ ID NO: 2215050 - RNA, 19 nt, Homo sapiens
ucucccaacucagccuguu

SEQ ID NO: 2215051 - RNA, 17 nt, Homo sapiens
caucacugugucucaug

SEQ ID NO: 2215052 - RNA, 18 nt, Homo sapiens
uccaccugccguggacuu

SEQ ID NO: 2215053 - RNA, 14 nt, Homo sapiens
ccugcaccgucuca

SEQ ID NO: 2215054 - RNA, 13 nt, Homo sapiens
gauauugaugaaa

SEQ ID NO: 2215055 - RNA, 17 nt, Homo sapiens
aguacccaccugagcuu

SEQ ID NO: 2215056 - RNA, 15 nt, Homo sapiens
agcguggggacuucu

SEQ ID NO: 2215057 - RNA, 19 nt, Homo sapiens
cauaggcgcaggugcacag

SEQ ID NO: 2215058 - RNA, 18 nt, Homo sapiens
aggaauguguccaagaca

SEQ ID NO: 2215059 - RNA, 19 nt, Homo sapiens
auggccacaacaugaaaac

SEQ ID NO: 2215060 - RNA, 16 nt, Homo sapiens
ugagucuuguaauuaa

SEQ ID NO: 2215061 - RNA, 21 nt, Homo sapiens
uucacauauuuguagcuagaa

SEQ ID NO: 2215062 - RNA, 18 nt, Homo sapiens
gccaggugugguggugca

SEQ ID NO: 2215063 - RNA, 16 nt, Homo sapiens
aggugaauagcacagg

SEQ ID NO: 2215064 - RNA, 18 nt, Homo sapiens
gaccagugcaguuucuaa

SEQ ID NO: 2215065 - RNA, 18 nt, Homo sapiens
agguuucuacaacauauu

SEQ ID NO: 2215066 - RNA, 22 nt, Homo sapiens
cugacagacaaugauccaguca

SEQ ID NO: 2215067 - RNA, 16 nt, Homo sapiens
cgggucguaaugacuu

SEQ ID NO: 2215068 - RNA, 16 nt, Homo sapiens
aggaggccaugcccac

SEQ ID NO: 2215069 - RNA, 17 nt, Homo sapiens
uuuccaggguugcuuga

SEQ ID NO: 2215070 - RNA, 23 nt, Homo sapiens
uaccugagauacugaagugcagc

SEQ ID NO: 2215071 - RNA, 17 nt, Homo sapiens
acaccagcccugcugcu

SEQ ID NO: 2215072 - RNA, 17 nt, Homo sapiens
ugagacagaaucucagu

SEQ ID NO: 2215073 - RNA, 15 nt, Homo sapiens
aucugaagugguuca

SEQ ID NO: 2215074 - RNA, 20 nt, Homo sapiens
uuacuuguaaauaaagucua

SEQ ID NO: 2215075 - RNA, 18 nt, Homo sapiens
uaaagcaagggccauuua

SEQ ID NO: 2215076 - RNA, 15 nt, Homo sapiens
ccucuuaauucccaa

SEQ ID NO: 2215077 - RNA, 22 nt, Homo sapiens
aagaugcugacauccagguggg

SEQ ID NO: 2215078 - RNA, 16 nt, Homo sapiens
uuuggggaggggggua

SEQ ID NO: 2215079 - RNA, 20 nt, Homo sapiens
cuucugaacguuugguucaa

SEQ ID NO: 2215080 - RNA, 17 nt, Homo sapiens
cugcaaucacacugagg

SEQ ID NO: 2215081 - RNA, 15 nt, Homo sapiens
ugaauucuuaugcuu

SEQ ID NO: 2215082 - RNA, 18 nt, Homo sapiens
cauaaauaaaaauucaac

SEQ ID NO: 2215083 - RNA, 14 nt, Homo sapiens
acuugccucugcac

SEQ ID NO: 2215084 - RNA, 17 nt, Homo sapiens
guaguguccccagccua

SEQ ID NO: 2215085 - RNA, 18 nt, Homo sapiens
ccuggugcauugcugugu

SEQ ID NO: 2215086 - RNA, 22 nt, Homo sapiens
acuauaaauaauauucuauuca

SEQ ID NO: 2215087 - RNA, 15 nt, Homo sapiens
uuuggugcuuuccag

SEQ ID NO: 2215088 - RNA, 16 nt, Homo sapiens
aagcaucauuucccca

SEQ ID NO: 2215089 - RNA, 18 nt, Homo sapiens
aggcugagugcacuggca

SEQ ID NO: 2215090 - RNA, 15 nt, Homo sapiens
ccugagccaaaagag

SEQ ID NO: 2215091 - RNA, 23 nt, Homo sapiens
acuccagccugagcgacagugag

SEQ ID NO: 2215092 - RNA, 21 nt, Homo sapiens
uacaaaaauaccuacugcuga

SEQ ID NO: 2215093 - RNA, 14 nt, Homo sapiens
aaagucaacaugua

SEQ ID NO: 2215094 - RNA, 14 nt, Homo sapiens
ggagggagugcugu

SEQ ID NO: 2215095 - RNA, 21 nt, Homo sapiens
cucacauucgacauaccccac

SEQ ID NO: 2215096 - RNA, 23 nt, Homo sapiens
ugccccccagucuccccacucca

SEQ ID NO: 2215097 - RNA, 18 nt, Homo sapiens
cugaaaguuguacaugaa

SEQ ID NO: 2215098 - RNA, 14 nt, Homo sapiens
caugaacuauauga

SEQ ID NO: 2215099 - RNA, 12 nt, Homo sapiens
acucccaggacc

SEQ ID NO: 2215100 - RNA, 20 nt, Homo sapiens
ucucuggcuaaggacaggca

SEQ ID NO: 2215101 - RNA, 18 nt, Homo sapiens
ugucuuuguggugaugau

SEQ ID NO: 2215102 - RNA, 22 nt, Homo sapiens
cacucaaaacgcuacugaguca

SEQ ID NO: 2215103 - RNA, 16 nt, Homo sapiens
caaguuagcucaggag

SEQ ID NO: 2215104 - RNA, 18 nt, Homo sapiens
ccaaucugcauuucuuac

SEQ ID NO: 2215105 - RNA, 12 nt, Homo sapiens
gccuaguacaau

SEQ ID NO: 2215106 - RNA, 12 nt, Homo sapiens
ucucccgucucg

SEQ ID NO: 2215107 - RNA, 19 nt, Homo sapiens
guguguaaaauuaauguaa

SEQ ID NO: 2215108 - RNA, 17 nt, Homo sapiens
gacccuuuaauccaaaa

SEQ ID NO: 2215109 - RNA, 18 nt, Homo sapiens
agacuguuagacaaaagu

SEQ ID NO: 2215110 - RNA, 16 nt, Homo sapiens
cuuaaaaaacauauau

SEQ ID NO: 2215111 - RNA, 19 nt, Homo sapiens
gguccuagaugccaaaggg

SEQ ID NO: 2215112 - RNA, 16 nt, Homo sapiens
gggaaggagugugcaa

SEQ ID NO: 2215113 - RNA, 16 nt, Homo sapiens
aguugucuuuugccau

SEQ ID NO: 2215114 - RNA, 16 nt, Homo sapiens
aaauagaauuugagca

SEQ ID NO: 2215115 - RNA, 20 nt, Homo sapiens
augcaucugggaaaugaggu

SEQ ID NO: 2215116 - RNA, 23 nt, Homo sapiens
ccuaaugaaagugaugacauauu

SEQ ID NO: 2215117 - RNA, 12 nt, Homo sapiens
ucaaaaggugcc

SEQ ID NO: 2215118 - RNA, 17 nt, Homo sapiens
ggggcggggggcgggga

SEQ ID NO: 2215119 - RNA, 14 nt, Homo sapiens
aggauacaggugac

SEQ ID NO: 2215120 - RNA, 20 nt, Homo sapiens
ucuggaaaccucuacauauu

SEQ ID NO: 2215121 - RNA, 21 nt, Homo sapiens
ugaaaaaaagggcacucugau

SEQ ID NO: 2215122 - RNA, 18 nt, Homo sapiens
cugacaacagccugagaa

SEQ ID NO: 2215123 - RNA, 18 nt, Homo sapiens
agaauagcagagagccaa

SEQ ID NO: 2215124 - RNA, 22 nt, Homo sapiens
gucucaauucaaauccauagau

SEQ ID NO: 2215125 - RNA, 12 nt, Homo sapiens
cucuuuacauuu

SEQ ID NO: 2215126 - RNA, 14 nt, Homo sapiens
gccuuuuguagcug

SEQ ID NO: 2215127 - RNA, 21 nt, Homo sapiens
cgagacuccguuuccaaaaaa

SEQ ID NO: 2215128 - RNA, 20 nt, Homo sapiens
gaacggugucauccugggga

SEQ ID NO: 2215129 - RNA, 21 nt, Homo sapiens
cacugcaaccuccacauccca

SEQ ID NO: 2215130 - RNA, 18 nt, Homo sapiens
cuugcucagguacuugua

SEQ ID NO: 2215131 - RNA, 23 nt, Homo sapiens
agcuggauuggguuaugaauauu

SEQ ID NO: 2215132 - RNA, 11 nt, Homo sapiens
agaaugugauu

SEQ ID NO: 2215133 - RNA, 19 nt, Homo sapiens
ugaauggccuucauaucau

SEQ ID NO: 2215134 - RNA, 15 nt, Homo sapiens
caagugaacauuaca

SEQ ID NO: 2215135 - RNA, 19 nt, Homo sapiens
gaaggagcuugggugcauu

SEQ ID NO: 2215136 - RNA, 18 nt, Homo sapiens
gcuccccggacauacucu

SEQ ID NO: 2215137 - RNA, 18 nt, Homo sapiens
uuaaugaauaucaggcua

SEQ ID NO: 2215138 - RNA, 23 nt, Homo sapiens
auccccccgccaaaagcugcuca

SEQ ID NO: 2215139 - RNA, 18 nt, Homo sapiens
uuuauauaaaaaucccau

SEQ ID NO: 2215140 - RNA, 18 nt, Homo sapiens
uuuguugagugcacugac

SEQ ID NO: 2215141 - RNA, 17 nt, Homo sapiens
caaaaauagacaacugu

SEQ ID NO: 2215142 - RNA, 22 nt, Homo sapiens
uccauccauaaauccaguucua

SEQ ID NO: 2215143 - RNA, 15 nt, Homo sapiens
gcccauugcugccaa

SEQ ID NO: 2215144 - RNA, 22 nt, Homo sapiens
uguaccugggcuuggugcguuu

SEQ ID NO: 2215145 - RNA, 14 nt, Homo sapiens
acacuuaacagaug

SEQ ID NO: 2215146 - RNA, 18 nt, Homo sapiens
aauuuucuacaaccuaag

SEQ ID NO: 2215147 - RNA, 22 nt, Homo sapiens
uguguuacugcuuugcaaagac

SEQ ID NO: 2215148 - RNA, 17 nt, Homo sapiens
auguguucuuuguucca

SEQ ID NO: 2215149 - RNA, 17 nt, Homo sapiens
uaacaugacacauuuga

SEQ ID NO: 2215150 - RNA, 22 nt, Homo sapiens
caccagauguccacaacaauau

SEQ ID NO: 2215151 - RNA, 18 nt, Homo sapiens
uucaacaguuuuugcuaa

SEQ ID NO: 2215152 - RNA, 18 nt, Homo sapiens
gugcuccagauggugcua

SEQ ID NO: 2215153 - RNA, 14 nt, Homo sapiens
cuguaaacauucau

SEQ ID NO: 2215154 - RNA, 16 nt, Homo sapiens
gagcuuagauugccuc

SEQ ID NO: 2215155 - RNA, 18 nt, Homo sapiens
agaucgugccacugcacu

SEQ ID NO: 2215156 - RNA, 16 nt, Homo sapiens
agcugccaguuuuaca

SEQ ID NO: 2215157 - RNA, 22 nt, Homo sapiens
gcacuuugggaggcugaggcag

SEQ ID NO: 2215158 - RNA, 13 nt, Homo sapiens
uauuaaacaaagu

SEQ ID NO: 2215159 - RNA, 17 nt, Homo sapiens
gcaguggcaccaccaug

SEQ ID NO: 2215160 - RNA, 20 nt, Homo sapiens
uaaaguaaauacaugcauau

SEQ ID NO: 2215161 - RNA, 22 nt, Homo sapiens
aguuuauaaaagacugucuuaa

SEQ ID NO: 2215162 - RNA, 23 nt, Homo sapiens
aggucccuugucccaaguuccac

SEQ ID NO: 2215163 - RNA, 15 nt, Homo sapiens
aagggcaugccuugu

SEQ ID NO: 2215164 - RNA, 20 nt, Homo sapiens
cuucgggagugcuuacacuu

SEQ ID NO: 2215165 - RNA, 16 nt, Homo sapiens
uagagguacuuuccac

SEQ ID NO: 2215166 - RNA, 13 nt, Homo sapiens
cgaacuguucaca

SEQ ID NO: 2215167 - RNA, 15 nt, Homo sapiens
acagugcauuugccu

SEQ ID NO: 2215168 - RNA, 22 nt, Homo sapiens
aggcuucagccauccacuucac

SEQ ID NO: 2215169 - RNA, 14 nt, Homo sapiens
agagagguccagag

SEQ ID NO: 2215170 - RNA, 19 nt, Homo sapiens
aauagcuacagcugugucc

SEQ ID NO: 2215171 - RNA, 21 nt, Homo sapiens
uauuuacauccagcuucucau

SEQ ID NO: 2215172 - RNA, 23 nt, Homo sapiens
ccgccggacugggcagauccuca

SEQ ID NO: 2215173 - RNA, 22 nt, Homo sapiens
gagguauuugguaacuugcugu

SEQ ID NO: 2215174 - RNA, 17 nt, Homo sapiens
auacaaagaaccaagaa

SEQ ID NO: 2215175 - RNA, 18 nt, Homo sapiens
caccacggccucacccag

SEQ ID NO: 2215176 - RNA, 19 nt, Homo sapiens
ccugaaccuugagcaaauu

SEQ ID NO: 2215177 - RNA, 14 nt, Homo sapiens
ugagaacagcauau

SEQ ID NO: 2215178 - RNA, 22 nt, Homo sapiens
uucucuacugucuggauuaauu

SEQ ID NO: 2215179 - RNA, 16 nt, Homo sapiens
uaacugugaugaaaua

SEQ ID NO: 2215180 - RNA, 20 nt, Homo sapiens
caucucaaaaaaacaaguua

SEQ ID NO: 2215181 - RNA, 17 nt, Homo sapiens
uuggauguaaaacugaa

SEQ ID NO: 2215182 - RNA, 20 nt, Homo sapiens
cugucuauuuaagugcaauu

SEQ ID NO: 2215183 - RNA, 20 nt, Homo sapiens
guacucaguaacagugcagu

SEQ ID NO: 2215184 - RNA, 15 nt, Homo sapiens
acuuuccgcuuucac

SEQ ID NO: 2215185 - RNA, 19 nt, Homo sapiens
cacaagccugaauuucuca

SEQ ID NO: 2215186 - RNA, 16 nt, Homo sapiens
gaucucgacucacugc

SEQ ID NO: 2215187 - RNA, 23 nt, Homo sapiens
uugucaagucagaacagccaggu

SEQ ID NO: 2215188 - RNA, 17 nt, Homo sapiens
uuccuucauuucugaua

SEQ ID NO: 2215189 - RNA, 23 nt, Homo sapiens
cagugcagagauccuacuucucu

SEQ ID NO: 2215190 - RNA, 18 nt, Homo sapiens
cauguagaggaaaagaua

SEQ ID NO: 2215191 - RNA, 17 nt, Homo sapiens
acaaguacaucuguaca

SEQ ID NO: 2215192 - RNA, 13 nt, Homo sapiens
agaaccauuacaa

SEQ ID NO: 2215193 - RNA, 12 nt, Homo sapiens
ccuaacaugcac

SEQ ID NO: 2215194 - RNA, 20 nt, Homo sapiens
ccugacagaggugucaucca

SEQ ID NO: 2215195 - RNA, 20 nt, Homo sapiens
cauuuuagcucaaacccugu

SEQ ID NO: 2215196 - RNA, 20 nt, Homo sapiens
ucucagcucacugcaaccuc

SEQ ID NO: 2215197 - RNA, 20 nt, Homo sapiens
uaacaguugcauugacuguc

SEQ ID NO: 2215198 - RNA, 18 nt, Homo sapiens
ugugccuucucuauggcc

SEQ ID NO: 2215199 - RNA, 13 nt, Homo sapiens
gaagcugcugacc

SEQ ID NO: 2215200 - RNA, 15 nt, Homo sapiens
aaugaaaaaacugau

SEQ ID NO: 2215201 - RNA, 12 nt, Homo sapiens
aaguaauuuugc

SEQ ID NO: 2215202 - RNA, 14 nt, Homo sapiens
guaaguuacugaca

SEQ ID NO: 2215203 - RNA, 20 nt, Homo sapiens
caccuuggaauucgcuuucu

SEQ ID NO: 2215204 - RNA, 22 nt, Homo sapiens
cugucacagguuuucagagaau

SEQ ID NO: 2215205 - RNA, 20 nt, Homo sapiens
ucugccccagcucuggcuuc

SEQ ID NO: 2215206 - RNA, 13 nt, Homo sapiens
ggaccucgugcca

SEQ ID NO: 2215207 - RNA, 20 nt, Homo sapiens
cagcuggacagaggggacuc

SEQ ID NO: 2215208 - RNA, 20 nt, Homo sapiens
auccuaucacagucuacuga

SEQ ID NO: 2215209 - RNA, 20 nt, Homo sapiens
ugaacugcagcaaucacaaa

SEQ ID NO: 2215210 - RNA, 22 nt, Homo sapiens
gaacaaggaguucucuuccgca

SEQ ID NO: 2215211 - RNA, 13 nt, Homo sapiens
cagcccaucucaa

SEQ ID NO: 2215212 - RNA, 20 nt, Homo sapiens
ucaugaggagauucugccuu

SEQ ID NO: 2215213 - RNA, 18 nt, Homo sapiens
ccgagauccccagggcag

SEQ ID NO: 2215214 - RNA, 18 nt, Homo sapiens
gagcaggaggccaauaaa

SEQ ID NO: 2215215 - RNA, 16 nt, Homo sapiens
cccuguuagugcacug

SEQ ID NO: 2215216 - RNA, 18 nt, Homo sapiens
uaauuacuuaaugugaug

SEQ ID NO: 2215217 - RNA, 21 nt, Homo sapiens
gagcgagaacccucaacugac

SEQ ID NO: 2215218 - RNA, 23 nt, Homo sapiens
cccuuccaggggucaccuugaga

SEQ ID NO: 2215219 - RNA, 18 nt, Homo sapiens
ucauguguugcagcuuua

SEQ ID NO: 2215220 - RNA, 14 nt, Homo sapiens
aagugccaucccac

SEQ ID NO: 2215221 - RNA, 14 nt, Homo sapiens
gagggcccugagga

SEQ ID NO: 2215222 - RNA, 23 nt, Homo sapiens
acuucuaggauuuauuguuauau

SEQ ID NO: 2215223 - RNA, 14 nt, Homo sapiens
uuaaguaauuuugc

SEQ ID NO: 2215224 - RNA, 12 nt, Homo sapiens
ugcugcuuuguc

SEQ ID NO: 2215225 - RNA, 18 nt, Homo sapiens
gucccuugagacucccca

SEQ ID NO: 2215226 - RNA, 20 nt, Homo sapiens
aggaaccuccuccacaccag

SEQ ID NO: 2215227 - RNA, 20 nt, Homo sapiens
aauaagcuaguugaauacuu

SEQ ID NO: 2215228 - RNA, 18 nt, Homo sapiens
gcaaaugugcaguucagu

SEQ ID NO: 2215229 - RNA, 13 nt, Homo sapiens
acugaaguaaaac

SEQ ID NO: 2215230 - RNA, 15 nt, Homo sapiens
gccaccgggcagccu

SEQ ID NO: 2215231 - RNA, 15 nt, Homo sapiens
aaucaguguuuccaa

SEQ ID NO: 2215232 - RNA, 13 nt, Homo sapiens
ccucuuguuucug

SEQ ID NO: 2215233 - RNA, 15 nt, Homo sapiens
uacacccccaccucc

SEQ ID NO: 2215234 - RNA, 23 nt, Homo sapiens
agucauucagcagcaaauuuuca

SEQ ID NO: 2215235 - RNA, 12 nt, Homo sapiens
guaaaaaugaag

SEQ ID NO: 2215236 - RNA, 18 nt, Homo sapiens
ucccccacacccguguca

SEQ ID NO: 2215237 - RNA, 19 nt, Homo sapiens
cuguccaggacaugauacu

SEQ ID NO: 2215238 - RNA, 17 nt, Homo sapiens
cucuccauucugcuccu

SEQ ID NO: 2215239 - RNA, 15 nt, Homo sapiens
ugaaauggccaggau

SEQ ID NO: 2215240 - RNA, 19 nt, Homo sapiens
agccacucagucucuucca

SEQ ID NO: 2215241 - RNA, 12 nt, Homo sapiens
caccaacuucac

SEQ ID NO: 2215242 - RNA, 17 nt, Homo sapiens
uacuuuucacacugucu

SEQ ID NO: 2215243 - RNA, 15 nt, Homo sapiens
gggggccagcacagc

SEQ ID NO: 2215244 - RNA, 15 nt, Homo sapiens
aguccuagcuacuca

SEQ ID NO: 2215245 - RNA, 17 nt, Homo sapiens
uccucgugaaagugcau

SEQ ID NO: 2215246 - RNA, 14 nt, Homo sapiens
ucccagaaacucca

SEQ ID NO: 2215247 - RNA, 12 nt, Homo sapiens
ggcccauucuaa

SEQ ID NO: 2215248 - RNA, 20 nt, Homo sapiens
ucuagcccaaccuacauucc

SEQ ID NO: 2215249 - RNA, 13 nt, Homo sapiens
gagucuucacuaa

SEQ ID NO: 2215250 - RNA, 22 nt, Homo sapiens
gugcuuccacuucuaugcaaau

SEQ ID NO: 2215251 - RNA, 23 nt, Homo sapiens
acuuacugucuucuucaugucau

SEQ ID NO: 2215252 - RNA, 23 nt, Homo sapiens
ucaccauuucuuggcauuggaau

SEQ ID NO: 2215253 - RNA, 13 nt, Homo sapiens
auguuuaguguga

SEQ ID NO: 2215254 - RNA, 23 nt, Homo sapiens
uugccucccgggcucaagcgauu

SEQ ID NO: 2215255 - RNA, 13 nt, Homo sapiens
agaggcagugauu

SEQ ID NO: 2215256 - RNA, 19 nt, Homo sapiens
gaugcagugaugugaucau

SEQ ID NO: 2215257 - RNA, 13 nt, Homo sapiens
cauugagcugccu

SEQ ID NO: 2215258 - RNA, 20 nt, Homo sapiens
auuccugccaccacugggca

SEQ ID NO: 2215259 - RNA, 18 nt, Homo sapiens
ccucucccggcaacaucu

SEQ ID NO: 2215260 - RNA, 12 nt, Homo sapiens
guacaacccuga

SEQ ID NO: 2215261 - RNA, 20 nt, Homo sapiens
acagguuacgugagaacaau

SEQ ID NO: 2215262 - RNA, 18 nt, Homo sapiens
agggaacugaaucacuua

SEQ ID NO: 2215263 - RNA, 14 nt, Homo sapiens
acacauuucaucua

SEQ ID NO: 2215264 - RNA, 15 nt, Homo sapiens
gaaaauguucuuugu

SEQ ID NO: 2215265 - RNA, 16 nt, Homo sapiens
aaauacccacuaacaa

SEQ ID NO: 2215266 - RNA, 13 nt, Homo sapiens
gcacuuucuuccg

SEQ ID NO: 2215267 - RNA, 20 nt, Homo sapiens
cucugacuaacgccauccag

SEQ ID NO: 2215268 - RNA, 23 nt, Homo sapiens
gccugccgcuguggaagcuuugu

SEQ ID NO: 2215269 - RNA, 20 nt, Homo sapiens
ccuuggugauuccgcaguga

SEQ ID NO: 2215270 - RNA, 19 nt, Homo sapiens
gcgucaggcuugugacauu

SEQ ID NO: 2215271 - RNA, 14 nt, Homo sapiens
aacugccuuugaua

SEQ ID NO: 2215272 - RNA, 22 nt, Homo sapiens
agauccaguucuugaaaacacu

SEQ ID NO: 2215273 - RNA, 18 nt, Homo sapiens
acaugaggauaacuuccu

SEQ ID NO: 2215274 - RNA, 21 nt, Homo sapiens
uugaauugugucccccauaaa

SEQ ID NO: 2215275 - RNA, 21 nt, Homo sapiens
aaagaauauucauaguuuaau

SEQ ID NO: 2215276 - RNA, 22 nt, Homo sapiens
cugaucucagggaagcccagcu

SEQ ID NO: 2215277 - RNA, 18 nt, Homo sapiens
ucgucaucaggugcauag

SEQ ID NO: 2215278 - RNA, 16 nt, Homo sapiens
aaauguaaagacaaaa

SEQ ID NO: 2215279 - RNA, 14 nt, Homo sapiens
uucugaagggcaua

SEQ ID NO: 2215280 - RNA, 14 nt, Homo sapiens
agagaagcaagaca

SEQ ID NO: 2215281 - RNA, 15 nt, Homo sapiens
gaggcagaacaggcu

SEQ ID NO: 2215282 - RNA, 13 nt, Homo sapiens
uucuuaaccagau

SEQ ID NO: 2215283 - RNA, 21 nt, Homo sapiens
aguugaugaccaaucucugug

SEQ ID NO: 2215284 - RNA, 14 nt, Homo sapiens
uccaguuaacauca

SEQ ID NO: 2215285 - RNA, 17 nt, Homo sapiens
cuuccccaagggccaaa

SEQ ID NO: 2215286 - RNA, 23 nt, Homo sapiens
cugcuggcaucaggucugggcaa

SEQ ID NO: 2215287 - RNA, 19 nt, Homo sapiens
uuccuccccucucaucccc

SEQ ID NO: 2215288 - RNA, 23 nt, Homo sapiens
uuuuugguaauauguuacaauua

SEQ ID NO: 2215289 - RNA, 16 nt, Homo sapiens
uuuccuaggaggaaaa

SEQ ID NO: 2215290 - RNA, 13 nt, Homo sapiens
acccauauguccu

SEQ ID NO: 2215291 - RNA, 16 nt, Homo sapiens
uagugaugcaggcagu

SEQ ID NO: 2215292 - RNA, 22 nt, Homo sapiens
ucagcggucauucuacacugag

SEQ ID NO: 2215293 - RNA, 20 nt, Homo sapiens
auggcucauucugcaaugag

SEQ ID NO: 2215294 - RNA, 14 nt, Homo sapiens
ugcacacucaguuc

SEQ ID NO: 2215295 - RNA, 12 nt, Homo sapiens
gaaagacaucaa

SEQ ID NO: 2215296 - RNA, 16 nt, Homo sapiens
uaaaaauaaugcauuu

SEQ ID NO: 2215297 - RNA, 19 nt, Homo sapiens
ggagcucuggggacagcuu

SEQ ID NO: 2215298 - RNA, 13 nt, Homo sapiens
accaauaaacagc

SEQ ID NO: 2215299 - RNA, 17 nt, Homo sapiens
uauguagcuaaacauug

SEQ ID NO: 2215300 - RNA, 14 nt, Homo sapiens
cuuugcagcaauga

SEQ ID NO: 2215301 - RNA, 22 nt, Homo sapiens
ccucuuugucauaccuuuggau

SEQ ID NO: 2215302 - RNA, 15 nt, Homo sapiens
uugguguugacauac

SEQ ID NO: 2215303 - RNA, 23 nt, Homo sapiens
cuuguuuuuccacuacugcuacc

SEQ ID NO: 2215304 - RNA, 22 nt, Homo sapiens
aaggaggucagaagaaaauugg

SEQ ID NO: 2215305 - RNA, 12 nt, Homo sapiens
ccugaaagccau

SEQ ID NO: 2215306 - RNA, 16 nt, Homo sapiens
aagaaacuuuucugaa

SEQ ID NO: 2215307 - RNA, 16 nt, Homo sapiens
ucucucgcaagggaag

SEQ ID NO: 2215308 - RNA, 14 nt, Homo sapiens
auaugaagaaucug

SEQ ID NO: 2215309 - RNA, 12 nt, Homo sapiens
ucugcucugaga

SEQ ID NO: 2215310 - RNA, 21 nt, Homo sapiens
auucuauaaaacacaucauca

SEQ ID NO: 2215311 - RNA, 14 nt, Homo sapiens
auuuuuguacauua

SEQ ID NO: 2215312 - RNA, 14 nt, Homo sapiens
auaauaguacuauu

SEQ ID NO: 2215313 - RNA, 18 nt, Homo sapiens
auugaaauuuacugugag

SEQ ID NO: 2215314 - RNA, 18 nt, Homo sapiens
ugcuuuuccucugccuuc

SEQ ID NO: 2215315 - RNA, 13 nt, Homo sapiens
auauauuuuuaga

SEQ ID NO: 2215316 - RNA, 13 nt, Homo sapiens
ugugaauucaaua

SEQ ID NO: 2215317 - RNA, 19 nt, Homo sapiens
cucacuguguuacugcuuu

SEQ ID NO: 2215318 - RNA, 15 nt, Homo sapiens
cuggguucugcuacu

SEQ ID NO: 2215319 - RNA, 16 nt, Homo sapiens
ccuaaggaaccuuccu

SEQ ID NO: 2215320 - RNA, 16 nt, Homo sapiens
ccuaguuuugaugaau

SEQ ID NO: 2215321 - RNA, 16 nt, Homo sapiens
agauaaaauuguucaa

SEQ ID NO: 2215322 - RNA, 18 nt, Homo sapiens
aauguuuguauacauguu

SEQ ID NO: 2215323 - RNA, 20 nt, Homo sapiens
acaauacaaagguuccauuc

SEQ ID NO: 2215324 - RNA, 19 nt, Homo sapiens
ucccucuccuauguggcag

SEQ ID NO: 2215325 - RNA, 18 nt, Homo sapiens
ugucugccagcauaugca

SEQ ID NO: 2215326 - RNA, 13 nt, Homo sapiens
gaacucaguguga

SEQ ID NO: 2215327 - RNA, 22 nt, Homo sapiens
gacacugugcuacugaaacucc

SEQ ID NO: 2215328 - RNA, 18 nt, Homo sapiens
auugccauuugguagcau

SEQ ID NO: 2215329 - RNA, 14 nt, Homo sapiens
gcaugguguuuuca

SEQ ID NO: 2215330 - RNA, 18 nt, Homo sapiens
augcauucuagugcagaa

SEQ ID NO: 2215331 - RNA, 19 nt, Homo sapiens
cagacaucggccuccauga

SEQ ID NO: 2215332 - RNA, 13 nt, Homo sapiens
aaguuuuacuuga

SEQ ID NO: 2215333 - RNA, 18 nt, Homo sapiens
ucugcgucgucaccaaau

SEQ ID NO: 2215334 - RNA, 22 nt, Homo sapiens
gucucucccaccccggccucca

SEQ ID NO: 2215335 - RNA, 16 nt, Homo sapiens
aaaaguuauugugaua

SEQ ID NO: 2215336 - RNA, 18 nt, Homo sapiens
aagaugaccuuugucuca

SEQ ID NO: 2215337 - RNA, 20 nt, Homo sapiens
cacacaguuguugaaugacu

SEQ ID NO: 2215338 - RNA, 15 nt, Homo sapiens
gaaauauugugcuua

SEQ ID NO: 2215339 - RNA, 16 nt, Homo sapiens
ugaccauuuucugcca

SEQ ID NO: 2215340 - RNA, 20 nt, Homo sapiens
cgaaaccccaucucuacuaa

SEQ ID NO: 2215341 - RNA, 20 nt, Homo sapiens
ugaaacccuaucucuacuaa

SEQ ID NO: 2215342 - RNA, 21 nt, Homo sapiens
ugauuggcuccuggguuucau

SEQ ID NO: 2215343 - RNA, 17 nt, Homo sapiens
caggaaauacuuuguaa

SEQ ID NO: 2215344 - RNA, 14 nt, Homo sapiens
cuguggcagaguua

SEQ ID NO: 2215345 - RNA, 12 nt, Homo sapiens
gggaugagcaug

SEQ ID NO: 2215346 - RNA, 13 nt, Homo sapiens
ugcaaccucugcc

SEQ ID NO: 2215347 - RNA, 18 nt, Homo sapiens
aagucccaguauaccuca

SEQ ID NO: 2215348 - RNA, 24 nt, Homo sapiens
gcugccauuucccuucuggacacu

SEQ ID NO: 2215349 - RNA, 16 nt, Homo sapiens
ugaauuuugaaccaug

SEQ ID NO: 2215350 - RNA, 14 nt, Homo sapiens
agcagccucgcaca

SEQ ID NO: 2215351 - RNA, 14 nt, Homo sapiens
uugcccaaccaaug

SEQ ID NO: 2215352 - RNA, 13 nt, Homo sapiens
cuugaacaaaagg

SEQ ID NO: 2215353 - RNA, 17 nt, Homo sapiens
cauacacacacacaaaa

SEQ ID NO: 2215354 - RNA, 19 nt, Homo sapiens
uuucuucauguucagucac

SEQ ID NO: 2215355 - RNA, 19 nt, Homo sapiens
gcaaaacaaaaauuaggua

SEQ ID NO: 2215356 - RNA, 19 nt, Homo sapiens
caagagcuauucauucccu

SEQ ID NO: 2215357 - RNA, 20 nt, Homo sapiens
caagaggugugcacaccaaa

SEQ ID NO: 2215358 - RNA, 17 nt, Homo sapiens
cugugcgccuuguagaa

SEQ ID NO: 2215359 - RNA, 23 nt, Homo sapiens
uaaaaguuuuuuauuaugcauua

SEQ ID NO: 2215360 - RNA, 19 nt, Homo sapiens
ucuguuuauucuuccagaa

SEQ ID NO: 2215361 - RNA, 12 nt, Homo sapiens
aagaauugcacg

SEQ ID NO: 2215362 - RNA, 14 nt, Homo sapiens
cuauguugcccaag

SEQ ID NO: 2215363 - RNA, 17 nt, Homo sapiens
cccgacuggggcagggu

SEQ ID NO: 2215364 - RNA, 18 nt, Homo sapiens
ccagggaugacauguccc

SEQ ID NO: 2215365 - RNA, 21 nt, Homo sapiens
acuuauaaauauccugcucac

SEQ ID NO: 2215366 - RNA, 22 nt, Homo sapiens
guacagacauccuagcauuugu

SEQ ID NO: 2215367 - RNA, 17 nt, Homo sapiens
uacaagauauuauguau

SEQ ID NO: 2215368 - RNA, 16 nt, Homo sapiens
cgccuggcugcugcuu

SEQ ID NO: 2215369 - RNA, 18 nt, Homo sapiens
cucaucuugaugaugaua

SEQ ID NO: 2215370 - RNA, 22 nt, Homo sapiens
cuguguauaucucuguaaucuc

SEQ ID NO: 2215371 - RNA, 21 nt, Homo sapiens
ccugugucggggcugaccucu

SEQ ID NO: 2215372 - RNA, 13 nt, Homo sapiens
ugggcauccucuc

SEQ ID NO: 2215373 - RNA, 20 nt, Homo sapiens
uaauucuuauuuaaguuauu

SEQ ID NO: 2215374 - RNA, 15 nt, Homo sapiens
uaggaggacaaggac

SEQ ID NO: 2215375 - RNA, 21 nt, Homo sapiens
ggaaaauaaucaaaccaaaga

SEQ ID NO: 2215376 - RNA, 13 nt, Homo sapiens
cacuaucacuuua

SEQ ID NO: 2215377 - RNA, 15 nt, Homo sapiens
uucaguguaauguga

SEQ ID NO: 2215378 - RNA, 19 nt, Homo sapiens
uaagauaugcacagucuau

SEQ ID NO: 2215379 - RNA, 11 nt, Homo sapiens
auaucacucua

SEQ ID NO: 2215380 - RNA, 20 nt, Homo sapiens
guuaaugaaggugugcuaca

SEQ ID NO: 2215381 - RNA, 18 nt, Homo sapiens
cacacuuuccgcuuucac

SEQ ID NO: 2215382 - RNA, 16 nt, Homo sapiens
ugaggaugcagaguca

SEQ ID NO: 2215383 - RNA, 18 nt, Homo sapiens
caccccuagcaugaacuu

SEQ ID NO: 2215384 - RNA, 17 nt, Homo sapiens
uuucucucuggcuucuc

SEQ ID NO: 2215385 - RNA, 16 nt, Homo sapiens
ugacacaugcucucaa

SEQ ID NO: 2215386 - RNA, 16 nt, Homo sapiens
ucucaccuggacucca

SEQ ID NO: 2215387 - RNA, 17 nt, Homo sapiens
uaauaauaguacuauua

SEQ ID NO: 2215388 - RNA, 23 nt, Homo sapiens
gcugccccuucugaggaugcuga

SEQ ID NO: 2215389 - RNA, 18 nt, Homo sapiens
cagccuagacauccaggu

SEQ ID NO: 2215390 - RNA, 16 nt, Homo sapiens
caguguugacauagcc

SEQ ID NO: 2215391 - RNA, 21 nt, Homo sapiens
aaucucaagauucuacuuggu

SEQ ID NO: 2215392 - RNA, 16 nt, Homo sapiens
guaaaucuauuggcca

SEQ ID NO: 2215393 - RNA, 21 nt, Homo sapiens
aacagauggggucugugacug

SEQ ID NO: 2215394 - RNA, 16 nt, Homo sapiens
cagcccaccccugugc

SEQ ID NO: 2215395 - RNA, 12 nt, Homo sapiens
aucaagccaguu

SEQ ID NO: 2215396 - RNA, 13 nt, Homo sapiens
cuauacacacaca

SEQ ID NO: 2215397 - RNA, 15 nt, Homo sapiens
uaauacuccagagac

SEQ ID NO: 2215398 - RNA, 16 nt, Homo sapiens
caggcuccaaacugga

SEQ ID NO: 2215399 - RNA, 14 nt, Homo sapiens
agccaucucagguu

SEQ ID NO: 2215400 - RNA, 22 nt, Homo sapiens
cuugaaacuugguucccagaaa

SEQ ID NO: 2215401 - RNA, 15 nt, Homo sapiens
uucagauacuuguga

SEQ ID NO: 2215402 - RNA, 14 nt, Homo sapiens
aacugguucuugcc

SEQ ID NO: 2215403 - RNA, 20 nt, Homo sapiens
auucacccccaaacagugac

SEQ ID NO: 2215404 - RNA, 14 nt, Homo sapiens
gagcuaaaacuggc

SEQ ID NO: 2215405 - RNA, 23 nt, Homo sapiens
gcaguagcgcuggcgccaucugc

SEQ ID NO: 2215406 - RNA, 20 nt, Homo sapiens
ugcggacagcccuuccuccc

SEQ ID NO: 2215407 - RNA, 19 nt, Homo sapiens
acuuuaaauccuaccaaag

SEQ ID NO: 2215408 - RNA, 18 nt, Homo sapiens
cgcugcaccuaaagccua

SEQ ID NO: 2215409 - RNA, 20 nt, Homo sapiens
cacuccuucucucacugugu

SEQ ID NO: 2215410 - RNA, 20 nt, Homo sapiens
cauggcucccgaguacagua

SEQ ID NO: 2215411 - RNA, 17 nt, Homo sapiens
accguggcccuuccugg

SEQ ID NO: 2215412 - RNA, 23 nt, Homo sapiens
uaccagauguuuugauguuaucg

SEQ ID NO: 2215413 - RNA, 15 nt, Homo sapiens
auugcaaaagggaac

SEQ ID NO: 2215414 - RNA, 23 nt, Homo sapiens
acagcaguggaguaaguauuuag

SEQ ID NO: 2215415 - RNA, 15 nt, Homo sapiens
uggaaacauuuacaa

SEQ ID NO: 2215416 - RNA, 16 nt, Homo sapiens
acaucaagcucaaggc

SEQ ID NO: 2215417 - RNA, 15 nt, Homo sapiens
acaaacaucauuuua

SEQ ID NO: 2215418 - RNA, 20 nt, Homo sapiens
uuuccgagccuccaguccaa

SEQ ID NO: 2215419 - RNA, 17 nt, Homo sapiens
uuagauauguuaagcau

SEQ ID NO: 2215420 - RNA, 21 nt, Homo sapiens
gaauucagucaaagauacaca

SEQ ID NO: 2215421 - RNA, 20 nt, Homo sapiens
aacguggagaaucacaggcu

SEQ ID NO: 2215422 - RNA, 16 nt, Homo sapiens
uccccggacauacucu

SEQ ID NO: 2215423 - RNA, 13 nt, Homo sapiens
aaagauacaguua

SEQ ID NO: 2215424 - RNA, 21 nt, Homo sapiens
acucagucccuaaaaacacag

SEQ ID NO: 2215425 - RNA, 15 nt, Homo sapiens
uccuguuacuauggu

SEQ ID NO: 2215426 - RNA, 17 nt, Homo sapiens
uuuugcagaaaucacaa

SEQ ID NO: 2215427 - RNA, 14 nt, Homo sapiens
agggugcuacucau

SEQ ID NO: 2215428 - RNA, 14 nt, Homo sapiens
ugccugagauucuu

SEQ ID NO: 2215429 - RNA, 17 nt, Homo sapiens
caauguaaggagccuuu

SEQ ID NO: 2215430 - RNA, 15 nt, Homo sapiens
agaaagucauuccuu

SEQ ID NO: 2215431 - RNA, 15 nt, Homo sapiens
cuggcagacugagga

SEQ ID NO: 2215432 - RNA, 14 nt, Homo sapiens
aggcauugcacaga

SEQ ID NO: 2215433 - RNA, 15 nt, Homo sapiens
uugaucaagaaugca

SEQ ID NO: 2215434 - RNA, 20 nt, Homo sapiens
ucccaaaacccuuacaguga

SEQ ID NO: 2215435 - RNA, 18 nt, Homo sapiens
gcugucuaaaaugcagug

SEQ ID NO: 2215436 - RNA, 20 nt, Homo sapiens
ggaaacuguaugaaugucug

SEQ ID NO: 2215437 - RNA, 22 nt, Homo sapiens
cucccauggcuuugugcugcug

SEQ ID NO: 2215438 - RNA, 15 nt, Homo sapiens
gaguucugacauuca

SEQ ID NO: 2215439 - RNA, 21 nt, Homo sapiens
aucaugguuuuucuuaguaga

SEQ ID NO: 2215440 - RNA, 21 nt, Homo sapiens
acauggggucugggugggggc

SEQ ID NO: 2215441 - RNA, 18 nt, Homo sapiens
accuucccucuuucuaca

SEQ ID NO: 2215442 - RNA, 12 nt, Homo sapiens
ugucucagggug

SEQ ID NO: 2215443 - RNA, 14 nt, Homo sapiens
aaagaucuucuuua

SEQ ID NO: 2215444 - RNA, 23 nt, Homo sapiens
agcuuuugaggggcugacuucaa

SEQ ID NO: 2215445 - RNA, 15 nt, Homo sapiens
cauacauauuaucuc

SEQ ID NO: 2215446 - RNA, 13 nt, Homo sapiens
auuuaugucucag

SEQ ID NO: 2215447 - RNA, 16 nt, Homo sapiens
aaugacaaucaugugu

SEQ ID NO: 2215448 - RNA, 11 nt, Homo sapiens
uccaaagccaa

SEQ ID NO: 2215449 - RNA, 23 nt, Homo sapiens
gaauuagcuuggggccagggaag

SEQ ID NO: 2215450 - RNA, 14 nt, Homo sapiens
uuaagagauacauu

SEQ ID NO: 2215451 - RNA, 23 nt, Homo sapiens
uccuuucacccgcuccuacagcu

SEQ ID NO: 2215452 - RNA, 17 nt, Homo sapiens
ccaugcagggggcuccu

SEQ ID NO: 2215453 - RNA, 23 nt, Homo sapiens
ggccuguuugccgucugugacau

SEQ ID NO: 2215454 - RNA, 21 nt, Homo sapiens
uacugcuucauuuuuguaaua

SEQ ID NO: 2215455 - RNA, 12 nt, Homo sapiens
gaaaaagaacau

SEQ ID NO: 2215456 - RNA, 19 nt, Homo sapiens
cagauaaaaugccagucuc

SEQ ID NO: 2215457 - RNA, 20 nt, Homo sapiens
ucaucuauagaaagcuauau

SEQ ID NO: 2215458 - RNA, 14 nt, Homo sapiens
ggcaccgggcucca

SEQ ID NO: 2215459 - RNA, 20 nt, Homo sapiens
agaagaaccaggcauggaaa

SEQ ID NO: 2215460 - RNA, 21 nt, Homo sapiens
aaggguugggagcugaugaaa

SEQ ID NO: 2215461 - RNA, 24 nt, Homo sapiens
uccccugcuacaccuauuauccca

SEQ ID NO: 2215462 - RNA, 14 nt, Homo sapiens
gcgccgugcuguaa

SEQ ID NO: 2215463 - RNA, 12 nt, Homo sapiens
caagugugaaca

SEQ ID NO: 2215464 - RNA, 15 nt, Homo sapiens
cugcuucugaacuca

SEQ ID NO: 2215465 - RNA, 15 nt, Homo sapiens
ggauguaaagaucaa

SEQ ID NO: 2215466 - RNA, 20 nt, Homo sapiens
acacuugugguauaguauua

SEQ ID NO: 2215467 - RNA, 15 nt, Homo sapiens
cuaugaagaguauua

SEQ ID NO: 2215468 - RNA, 21 nt, Homo sapiens
cuuuggcuuaauuccaaucau

SEQ ID NO: 2215469 - RNA, 19 nt, Homo sapiens
ugaagaacuggcaucuuaa

SEQ ID NO: 2215470 - RNA, 23 nt, Homo sapiens
ugggcaacauaguaagaccccau

SEQ ID NO: 2215471 - RNA, 13 nt, Homo sapiens
aguucacugcugc

SEQ ID NO: 2215472 - RNA, 22 nt, Homo sapiens
uaguuuuguaaaaacugaagaa

SEQ ID NO: 2215473 - RNA, 14 nt, Homo sapiens
agccccacugccag

SEQ ID NO: 2215474 - RNA, 23 nt, Homo sapiens
cauaaugguuuuguuagauuuau

SEQ ID NO: 2215475 - RNA, 16 nt, Homo sapiens
gcacaucauuggaaua

SEQ ID NO: 2215476 - RNA, 19 nt, Homo sapiens
gaccaccaacacacaggaa

SEQ ID NO: 2215477 - RNA, 13 nt, Homo sapiens
ccuuugguuaaua

SEQ ID NO: 2215478 - RNA, 18 nt, Homo sapiens
cagauguaaauuaacuca

SEQ ID NO: 2215479 - RNA, 21 nt, Homo sapiens
augucuucacucuauacuuaa

SEQ ID NO: 2215480 - RNA, 22 nt, Homo sapiens
acauggacuacacacaauacag

SEQ ID NO: 2215481 - RNA, 16 nt, Homo sapiens
uacacugugaacucaa

SEQ ID NO: 2215482 - RNA, 17 nt, Homo sapiens
aauuaacauaugucacg

SEQ ID NO: 2215483 - RNA, 14 nt, Homo sapiens
ugccauuuuugcaa

SEQ ID NO: 2215484 - RNA, 16 nt, Homo sapiens
uucaaugugcuuuuaa

SEQ ID NO: 2215485 - RNA, 15 nt, Homo sapiens
ucaauaaacagcagg

SEQ ID NO: 2215486 - RNA, 11 nt, Homo sapiens
ugggggcuccu

SEQ ID NO: 2215487 - RNA, 15 nt, Homo sapiens
gcgagacuccgucuc

SEQ ID NO: 2215488 - RNA, 20 nt, Homo sapiens
cucagcauagccugccugau

SEQ ID NO: 2215489 - RNA, 15 nt, Homo sapiens
uaugaagacacuguc

SEQ ID NO: 2215490 - RNA, 16 nt, Homo sapiens
gauguauucugugaua

SEQ ID NO: 2215491 - RNA, 14 nt, Homo sapiens
ugcaccauugcacu

SEQ ID NO: 2215492 - RNA, 21 nt, Homo sapiens
acauccaggaaggaccuugcu

SEQ ID NO: 2215493 - RNA, 22 nt, Homo sapiens
ccgaaacguuuuuaaacaugaa

SEQ ID NO: 2215494 - RNA, 19 nt, Homo sapiens
cuuuucaauguuagccaca

SEQ ID NO: 2215495 - RNA, 15 nt, Homo sapiens
gcauuaacuuuugua

SEQ ID NO: 2215496 - RNA, 19 nt, Homo sapiens
ccuccugggagcucaugug

SEQ ID NO: 2215497 - RNA, 18 nt, Homo sapiens
uagaagaagcuacugcau

SEQ ID NO: 2215498 - RNA, 20 nt, Homo sapiens
ucaguaaauauuaaccugaa

SEQ ID NO: 2215499 - RNA, 17 nt, Homo sapiens
ucagauugcaugugacu

SEQ ID NO: 2215500 - RNA, 11 nt, Homo sapiens
uccuacugaug

SEQ ID NO: 2215501 - RNA, 15 nt, Homo sapiens
ugcaggaacaugacc

SEQ ID NO: 2215502 - RNA, 20 nt, Homo sapiens
auccaucugggcuaccccac

SEQ ID NO: 2215503 - RNA, 18 nt, Homo sapiens
ggcaaaguguaguguuau

SEQ ID NO: 2215504 - RNA, 23 nt, Homo sapiens
auuuauauguaaacaagcaauaa

SEQ ID NO: 2215505 - RNA, 18 nt, Homo sapiens
uucucugucucuguggaa

SEQ ID NO: 2215506 - RNA, 20 nt, Homo sapiens
gauguccaagugccacguga

SEQ ID NO: 2215507 - RNA, 17 nt, Homo sapiens
ggcauucuuuugcuguu

SEQ ID NO: 2215508 - RNA, 14 nt, Homo sapiens
cugcauguucugcu

SEQ ID NO: 2215509 - RNA, 14 nt, Homo sapiens
ucggccgucuucac

SEQ ID NO: 2215510 - RNA, 23 nt, Homo sapiens
acuauuuauuaaaaacaugacca

SEQ ID NO: 2215511 - RNA, 23 nt, Homo sapiens
agugaaagaagccacagcucuuc

SEQ ID NO: 2215512 - RNA, 13 nt, Homo sapiens
agaacagggucau

SEQ ID NO: 2215513 - RNA, 16 nt, Homo sapiens
aaauuguaaauacaug

SEQ ID NO: 2215514 - RNA, 22 nt, Homo sapiens
uagaauagcauuugccacuuag

SEQ ID NO: 2215515 - RNA, 23 nt, Homo sapiens
agaaacagcuucucaauuucuac

SEQ ID NO: 2215516 - RNA, 19 nt, Homo sapiens
auuuucccaugccaguuuu

SEQ ID NO: 2215517 - RNA, 21 nt, Homo sapiens
uguggagcgccagcucugccc

SEQ ID NO: 2215518 - RNA, 20 nt, Homo sapiens
cggguggaucaccugagguc

SEQ ID NO: 2215519 - RNA, 13 nt, Homo sapiens
aaaugaacuguaa

SEQ ID NO: 2215520 - RNA, 12 nt, Homo sapiens
ggcagggguccu

SEQ ID NO: 2215521 - RNA, 20 nt, Homo sapiens
gaccgggaaaagggaaccau

SEQ ID NO: 2215522 - RNA, 13 nt, Homo sapiens
ucaugacauuccu

SEQ ID NO: 2215523 - RNA, 19 nt, Homo sapiens
cugaauuucucacaaagga

SEQ ID NO: 2215524 - RNA, 14 nt, Homo sapiens
cuuaguuaucaguc

SEQ ID NO: 2215525 - RNA, 12 nt, Homo sapiens
aagacacuugau

SEQ ID NO: 2215526 - RNA, 12 nt, Homo sapiens
gacagucuugca

SEQ ID NO: 2215527 - RNA, 22 nt, Homo sapiens
aacaauaaacgaaacacagaac

SEQ ID NO: 2215528 - RNA, 19 nt, Homo sapiens
cauaacuugcugaauuuca

SEQ ID NO: 2215529 - RNA, 15 nt, Homo sapiens
auucuuuuaaugcca

SEQ ID NO: 2215530 - RNA, 18 nt, Homo sapiens
uaaagggagaaaugccag

SEQ ID NO: 2215531 - RNA, 13 nt, Homo sapiens
ugucuucuuuaug

SEQ ID NO: 2215532 - RNA, 23 nt, Homo sapiens
caguucuuaacccaguguccaug

SEQ ID NO: 2215533 - RNA, 19 nt, Homo sapiens
gccacauggccgcugccca

SEQ ID NO: 2215534 - RNA, 23 nt, Homo sapiens
ugauucgucugcgauuuuaucug

SEQ ID NO: 2215535 - RNA, 18 nt, Homo sapiens
accaaggaaaaagcagag

SEQ ID NO: 2215536 - RNA, 21 nt, Homo sapiens
cuguagccaccuccuuggcac

SEQ ID NO: 2215537 - RNA, 22 nt, Homo sapiens
ccagaggaaccagcacuccauc

SEQ ID NO: 2215538 - RNA, 16 nt, Homo sapiens
aagcaucugauagaau

SEQ ID NO: 2215539 - RNA, 21 nt, Homo sapiens
guuagaguuuaauuuugugaa

SEQ ID NO: 2215540 - RNA, 22 nt, Homo sapiens
caugcacacacacacaucucau

SEQ ID NO: 2215541 - RNA, 18 nt, Homo sapiens
cagggucauguuugcagg

SEQ ID NO: 2215542 - RNA, 18 nt, Homo sapiens
auuuuaaauaguuugaca

SEQ ID NO: 2215543 - RNA, 15 nt, Homo sapiens
aggcucagauuaaau

SEQ ID NO: 2215544 - RNA, 18 nt, Homo sapiens
caacaggaggacaauuca

SEQ ID NO: 2215545 - RNA, 19 nt, Homo sapiens
acaaaucaacagaagcauu

SEQ ID NO: 2215546 - RNA, 15 nt, Homo sapiens
uguugacagugccaa

SEQ ID NO: 2215547 - RNA, 16 nt, Homo sapiens
ggcagcuccacagggc

SEQ ID NO: 2215548 - RNA, 16 nt, Homo sapiens
ggccuggccaccucuc

SEQ ID NO: 2215549 - RNA, 21 nt, Homo sapiens
aacugagguauggccaugccc

SEQ ID NO: 2215550 - RNA, 22 nt, Homo sapiens
uuguccauuuaaaaaugaucug

SEQ ID NO: 2215551 - RNA, 18 nt, Homo sapiens
gaagagauuucaacauau

SEQ ID NO: 2215552 - RNA, 19 nt, Homo sapiens
ggccuccacucagcaguaa

SEQ ID NO: 2215553 - RNA, 21 nt, Homo sapiens
auccugaugcuguugggaaaa

SEQ ID NO: 2215554 - RNA, 21 nt, Homo sapiens
aucacacugaagccacagcug

SEQ ID NO: 2215555 - RNA, 16 nt, Homo sapiens
aggagguggcuguuaa

SEQ ID NO: 2215556 - RNA, 18 nt, Homo sapiens
ccuguuucuggucuucgc

SEQ ID NO: 2215557 - RNA, 16 nt, Homo sapiens
caaagcuagaauguga

SEQ ID NO: 2215558 - RNA, 17 nt, Homo sapiens
acaagacccucucaggc

SEQ ID NO: 2215559 - RNA, 14 nt, Homo sapiens
caaaugguacaaaa

SEQ ID NO: 2215560 - RNA, 23 nt, Homo sapiens
uccauccugcucaggaaaccaca

SEQ ID NO: 2215561 - RNA, 16 nt, Homo sapiens
ugguucccugcugcgc

SEQ ID NO: 2215562 - RNA, 15 nt, Homo sapiens
cuuccccaucagccu

SEQ ID NO: 2215563 - RNA, 23 nt, Homo sapiens
ccaaguagcugggacuacaggcg

SEQ ID NO: 2215564 - RNA, 15 nt, Homo sapiens
ucauugcacugcagu

SEQ ID NO: 2215565 - RNA, 22 nt, Homo sapiens
aauguuuuaaaguuuaaugccu

SEQ ID NO: 2215566 - RNA, 14 nt, Homo sapiens
cauucuuaaacuga

SEQ ID NO: 2215567 - RNA, 12 nt, Homo sapiens
auuuaaguauau

SEQ ID NO: 2215568 - RNA, 16 nt, Homo sapiens
ucucugguuuacuuca

SEQ ID NO: 2215569 - RNA, 18 nt, Homo sapiens
caugcuuccuauacaguu

SEQ ID NO: 2215570 - RNA, 14 nt, Homo sapiens
aucuaaaaauaacu

SEQ ID NO: 2215571 - RNA, 19 nt, Homo sapiens
gucaauaaaaccacuguac

SEQ ID NO: 2215572 - RNA, 15 nt, Homo sapiens
gagaagcucacccaa

SEQ ID NO: 2215573 - RNA, 16 nt, Homo sapiens
gaaauaacauggccuu

SEQ ID NO: 2215574 - RNA, 14 nt, Homo sapiens
cacacaagcccaca

SEQ ID NO: 2215575 - RNA, 23 nt, Homo sapiens
ugcaguguaacgaugcacuuugg

SEQ ID NO: 2215576 - RNA, 17 nt, Homo sapiens
uacaaauauugugaugc

SEQ ID NO: 2215577 - RNA, 11 nt, Homo sapiens
augaagcaaga

SEQ ID NO: 2215578 - RNA, 19 nt, Homo sapiens
ugagacugaagaccaguau

SEQ ID NO: 2215579 - RNA, 12 nt, Homo sapiens
uaaacugagaau

SEQ ID NO: 2215580 - RNA, 16 nt, Homo sapiens
aggauuugaaaacacc

SEQ ID NO: 2215581 - RNA, 23 nt, Homo sapiens
cagaauguggguauugaguguga

SEQ ID NO: 2215582 - RNA, 14 nt, Homo sapiens
uauuucuacuauga

SEQ ID NO: 2215583 - RNA, 13 nt, Homo sapiens
caucaagcuguac

SEQ ID NO: 2215584 - RNA, 21 nt, Homo sapiens
ccuggccaggcugcacacauu

SEQ ID NO: 2215585 - RNA, 21 nt, Homo sapiens
auuggcaccuaauccaggcag

SEQ ID NO: 2215586 - RNA, 17 nt, Homo sapiens
ccagcuacucaggaguc

SEQ ID NO: 2215587 - RNA, 22 nt, Homo sapiens
aauguuaccucugaauuuacuu

SEQ ID NO: 2215588 - RNA, 15 nt, Homo sapiens
gaacccuuguccucc

SEQ ID NO: 2215589 - RNA, 14 nt, Homo sapiens
ggaguuugcauucu

SEQ ID NO: 2215590 - RNA, 22 nt, Homo sapiens
cagaugaucccagucacuccuc

SEQ ID NO: 2215591 - RNA, 13 nt, Homo sapiens
cgcugacucuggg

SEQ ID NO: 2215592 - RNA, 18 nt, Homo sapiens
uuucaucucuucaaucac

SEQ ID NO: 2215593 - RNA, 18 nt, Homo sapiens
agucuuugucaaugcucu

SEQ ID NO: 2215594 - RNA, 17 nt, Homo sapiens
ugacaacugugacugua

SEQ ID NO: 2215595 - RNA, 21 nt, Homo sapiens
caguuuauauggaaaugcaaa

SEQ ID NO: 2215596 - RNA, 17 nt, Homo sapiens
guacugugucucaugga

SEQ ID NO: 2215597 - RNA, 12 nt, Homo sapiens
cucagaaccaaa

SEQ ID NO: 2215598 - RNA, 16 nt, Homo sapiens
acaagcugcacccuca

SEQ ID NO: 2215599 - RNA, 20 nt, Homo sapiens
ggugauaacuugcauacuau

SEQ ID NO: 2215600 - RNA, 12 nt, Homo sapiens
gauuaacuauga

SEQ ID NO: 2215601 - RNA, 22 nt, Homo sapiens
aaguacaagagcuuaacagugu

SEQ ID NO: 2215602 - RNA, 14 nt, Homo sapiens
cgucaagugcugcc

SEQ ID NO: 2215603 - RNA, 20 nt, Homo sapiens
caaccucgcuggacucucag

SEQ ID NO: 2215604 - RNA, 23 nt, Homo sapiens
uuguuuaaaaagcgcuaauuucu

SEQ ID NO: 2215605 - RNA, 22 nt, Homo sapiens
auagucauuccaaauaugagau

SEQ ID NO: 2215606 - RNA, 21 nt, Homo sapiens
uugcagcuuauauucauccau

SEQ ID NO: 2215607 - RNA, 16 nt, Homo sapiens
cuuccuggauggggca

SEQ ID NO: 2215608 - RNA, 21 nt, Homo sapiens
uauuguauauauaaucuauau

SEQ ID NO: 2215609 - RNA, 13 nt, Homo sapiens
uggggccagucag

SEQ ID NO: 2215610 - RNA, 15 nt, Homo sapiens
agacucuaacuucuc

SEQ ID NO: 2215611 - RNA, 14 nt, Homo sapiens
cagaauugugcaaa

SEQ ID NO: 2215612 - RNA, 11 nt, Homo sapiens
aguagaugcca

SEQ ID NO: 2215613 - RNA, 15 nt, Homo sapiens
ccugucagagaucug

SEQ ID NO: 2215614 - RNA, 22 nt, Homo sapiens
ugaaaaaaaauuuuauaguguc

SEQ ID NO: 2215615 - RNA, 16 nt, Homo sapiens
ccucaggugcuaggga

SEQ ID NO: 2215616 - RNA, 18 nt, Homo sapiens
auaauacaaaggugcuaa

SEQ ID NO: 2215617 - RNA, 14 nt, Homo sapiens
ugccagggccaguc

SEQ ID NO: 2215618 - RNA, 18 nt, Homo sapiens
ccugcgcauggugcagug

SEQ ID NO: 2215619 - RNA, 17 nt, Homo sapiens
acuacauuucuacuaug

SEQ ID NO: 2215620 - RNA, 17 nt, Homo sapiens
ugaccauaacagugcca

SEQ ID NO: 2215621 - RNA, 15 nt, Homo sapiens
caaauggaagacaca

SEQ ID NO: 2215622 - RNA, 22 nt, Homo sapiens
ccggggcaagagggaaggugac

SEQ ID NO: 2215623 - RNA, 17 nt, Homo sapiens
ugaaaaugaaaccgcau

SEQ ID NO: 2215624 - RNA, 22 nt, Homo sapiens
aucauucccuucgacagcauuu

SEQ ID NO: 2215625 - RNA, 13 nt, Homo sapiens
cucuuggugccuc

SEQ ID NO: 2215626 - RNA, 19 nt, Homo sapiens
gcuaaacaagggcagugag

SEQ ID NO: 2215627 - RNA, 16 nt, Homo sapiens
agaaacugaagccgug

SEQ ID NO: 2215628 - RNA, 16 nt, Homo sapiens
ccagaagcagcagcua

SEQ ID NO: 2215629 - RNA, 22 nt, Homo sapiens
uccuccagcccagacccagugg

SEQ ID NO: 2215630 - RNA, 21 nt, Homo sapiens
accagaaaaaugggaacaagg

SEQ ID NO: 2215631 - RNA, 23 nt, Homo sapiens
uaaaauuaaguuguaucauuuca

SEQ ID NO: 2215632 - RNA, 19 nt, Homo sapiens
ucucacucuguugcccagg

SEQ ID NO: 2215633 - RNA, 18 nt, Homo sapiens
auuuuuuaauccuaccuc

SEQ ID NO: 2215634 - RNA, 18 nt, Homo sapiens
uaguuguuggucuguagc

SEQ ID NO: 2215635 - RNA, 12 nt, Homo sapiens
ucuuuccuagau

SEQ ID NO: 2215636 - RNA, 16 nt, Homo sapiens
gugaucugaacagaaa

SEQ ID NO: 2215637 - RNA, 21 nt, Homo sapiens
ugauuuuuucuuuugcuuuau

SEQ ID NO: 2215638 - RNA, 18 nt, Homo sapiens
ggcugccuuugaucacag

SEQ ID NO: 2215639 - RNA, 13 nt, Homo sapiens
gucugugaucucu

SEQ ID NO: 2215640 - RNA, 12 nt, Homo sapiens
uggaagaaggga

SEQ ID NO: 2215641 - RNA, 22 nt, Homo sapiens
caacugaagauccacaaaagaa

SEQ ID NO: 2215642 - RNA, 19 nt, Homo sapiens
ggcuauuuaaaacuuguaa

SEQ ID NO: 2215643 - RNA, 17 nt, Homo sapiens
cuccccuuucuuugcaa

SEQ ID NO: 2215644 - RNA, 19 nt, Homo sapiens
cucuuguacugccugccac

SEQ ID NO: 2215645 - RNA, 15 nt, Homo sapiens
ucauagccaaacagg

SEQ ID NO: 2215646 - RNA, 14 nt, Homo sapiens
ugcaaauacaauca

SEQ ID NO: 2215647 - RNA, 18 nt, Homo sapiens
uguacucaaguaccacca

SEQ ID NO: 2215648 - RNA, 13 nt, Homo sapiens
cuacacaacaugu

SEQ ID NO: 2215649 - RNA, 18 nt, Homo sapiens
uuggugagaaaccuguau

SEQ ID NO: 2215650 - RNA, 15 nt, Homo sapiens
acugcccaccaaagg

SEQ ID NO: 2215651 - RNA, 14 nt, Homo sapiens
ugaaguuuuacugu

SEQ ID NO: 2215652 - RNA, 16 nt, Homo sapiens
gaacuagaaccuggag

SEQ ID NO: 2215653 - RNA, 18 nt, Homo sapiens
agagaaaaagcccagcuu

SEQ ID NO: 2215654 - RNA, 17 nt, Homo sapiens
cccgcagggccaugcag

SEQ ID NO: 2215655 - RNA, 18 nt, Homo sapiens
ugccauuauauuugcauu

SEQ ID NO: 2215656 - RNA, 13 nt, Homo sapiens
auuaguuaaucuc

SEQ ID NO: 2215657 - RNA, 15 nt, Homo sapiens
ggcaacaggucaugu

SEQ ID NO: 2215658 - RNA, 24 nt, Homo sapiens
agaaaccccaagaaauuugcaacu

SEQ ID NO: 2215659 - RNA, 13 nt, Homo sapiens
uacaugaagaaua

SEQ ID NO: 2215660 - RNA, 18 nt, Homo sapiens
accaccaaccacugcgac

SEQ ID NO: 2215661 - RNA, 22 nt, Homo sapiens
gggcagaucucccacaugccag

SEQ ID NO: 2215662 - RNA, 17 nt, Homo sapiens
gcacaagauacacguca

SEQ ID NO: 2215663 - RNA, 15 nt, Homo sapiens
agagcgagaguccau

SEQ ID NO: 2215664 - RNA, 11 nt, Homo sapiens
uauauaaacua

SEQ ID NO: 2215665 - RNA, 19 nt, Homo sapiens
ggacuagagggaccucucc

SEQ ID NO: 2215666 - RNA, 22 nt, Homo sapiens
gagcagcuccccaggagcucag

SEQ ID NO: 2215667 - RNA, 20 nt, Homo sapiens
cgccauccgggacgcuucca

SEQ ID NO: 2215668 - RNA, 15 nt, Homo sapiens
uuacuaauguauuaa

SEQ ID NO: 2215669 - RNA, 23 nt, Homo sapiens
ucacagagcacuguagcacuuaa

SEQ ID NO: 2215670 - RNA, 22 nt, Homo sapiens
auguguggcucagugccuggac

SEQ ID NO: 2215671 - RNA, 19 nt, Homo sapiens
caguuugguguguccuccg

SEQ ID NO: 2215672 - RNA, 18 nt, Homo sapiens
cuagggucuuguguugca

SEQ ID NO: 2215673 - RNA, 17 nt, Homo sapiens
cugaucaguugccaaag

SEQ ID NO: 2215674 - RNA, 19 nt, Homo sapiens
caggaauggcuugccuaag

SEQ ID NO: 2215675 - RNA, 14 nt, Homo sapiens
acuucaacugccca

SEQ ID NO: 2215676 - RNA, 16 nt, Homo sapiens
aaagugauccauacuu

SEQ ID NO: 2215677 - RNA, 19 nt, Homo sapiens
cucauuggccugcccuuca

SEQ ID NO: 2215678 - RNA, 18 nt, Homo sapiens
uucguaauaggugucaug

SEQ ID NO: 2215679 - RNA, 13 nt, Homo sapiens
ugccaugcuuuuu

SEQ ID NO: 2215680 - RNA, 13 nt, Homo sapiens
auuucuguguugc

SEQ ID NO: 2215681 - RNA, 16 nt, Homo sapiens
uaaaagacaagcacuu

SEQ ID NO: 2215682 - RNA, 16 nt, Homo sapiens
agccuucugacaagca

SEQ ID NO: 2215683 - RNA, 12 nt, Homo sapiens
gucuaauuugca

SEQ ID NO: 2215684 - RNA, 14 nt, Homo sapiens
cuugucauuccaga

SEQ ID NO: 2215685 - RNA, 18 nt, Homo sapiens
acuauacuguacaugaaa

SEQ ID NO: 2215686 - RNA, 20 nt, Homo sapiens
ucuauuuuuaucaugaauuc

SEQ ID NO: 2215687 - RNA, 15 nt, Homo sapiens
uccaucuccacucca

SEQ ID NO: 2215688 - RNA, 21 nt, Homo sapiens
aaugagagacacacugaagaa

SEQ ID NO: 2215689 - RNA, 14 nt, Homo sapiens
ggccauauuuacua

SEQ ID NO: 2215690 - RNA, 17 nt, Homo sapiens
aauccuggccacauuca

SEQ ID NO: 2215691 - RNA, 19 nt, Homo sapiens
gacggagcccuggcauguc

SEQ ID NO: 2215692 - RNA, 13 nt, Homo sapiens
ugguuuuuacuca

SEQ ID NO: 2215693 - RNA, 19 nt, Homo sapiens
caggaaagcguuuggaaaa

SEQ ID NO: 2215694 - RNA, 22 nt, Homo sapiens
guuccugccuuaacugaugaca

SEQ ID NO: 2215695 - RNA, 20 nt, Homo sapiens
acauguuauuuaaccugagu

SEQ ID NO: 2215696 - RNA, 13 nt, Homo sapiens
gguugauccugca

SEQ ID NO: 2215697 - RNA, 12 nt, Homo sapiens
auuuuuacuugu

SEQ ID NO: 2215698 - RNA, 15 nt, Homo sapiens
ucccagcccacaucu

SEQ ID NO: 2215699 - RNA, 13 nt, Homo sapiens
ggccacauugaca

SEQ ID NO: 2215700 - RNA, 16 nt, Homo sapiens
aaucauuucaguauca

SEQ ID NO: 2215701 - RNA, 18 nt, Homo sapiens
cuggccauccccagaggu

SEQ ID NO: 2215702 - RNA, 21 nt, Homo sapiens
aagggugccuaguugacuuac

SEQ ID NO: 2215703 - RNA, 14 nt, Homo sapiens
accaccuaauccuu

SEQ ID NO: 2215704 - RNA, 18 nt, Homo sapiens
aaguucuuaguguugguu

SEQ ID NO: 2215705 - RNA, 22 nt, Homo sapiens
agccuagugaacugcaaccuca

SEQ ID NO: 2215706 - RNA, 16 nt, Homo sapiens
cuguuucagaccagcc

SEQ ID NO: 2215707 - RNA, 20 nt, Homo sapiens
auuuauaauaaaucaguaua

SEQ ID NO: 2215708 - RNA, 12 nt, Homo sapiens
cauguccaguga

SEQ ID NO: 2215709 - RNA, 15 nt, Homo sapiens
auauuucaucaugau

SEQ ID NO: 2215710 - RNA, 15 nt, Homo sapiens
uucugguaagacugc

SEQ ID NO: 2215711 - RNA, 16 nt, Homo sapiens
agcugcugaaacugua

SEQ ID NO: 2215712 - RNA, 13 nt, Homo sapiens
ugauagacaccau

SEQ ID NO: 2215713 - RNA, 22 nt, Homo sapiens
ucugugcagggcacagaaggcu

SEQ ID NO: 2215714 - RNA, 20 nt, Homo sapiens
uccaagggcuuagagaugaa

SEQ ID NO: 2215715 - RNA, 17 nt, Homo sapiens
aaauacaagaaccaagg

SEQ ID NO: 2215716 - RNA, 17 nt, Homo sapiens
cacuggcagacaucuag

SEQ ID NO: 2215717 - RNA, 21 nt, Homo sapiens
ccgucagccaagucgccacau

SEQ ID NO: 2215718 - RNA, 19 nt, Homo sapiens
uugguccuuuaaauucugg

SEQ ID NO: 2215719 - RNA, 19 nt, Homo sapiens
aaaguuccagaaacuuuaa

SEQ ID NO: 2215720 - RNA, 14 nt, Homo sapiens
ccuaguuugcacua

SEQ ID NO: 2215721 - RNA, 19 nt, Homo sapiens
ucaaauauauuauuuaguc

SEQ ID NO: 2215722 - RNA, 17 nt, Homo sapiens
cucuucccccaccacca

SEQ ID NO: 2215723 - RNA, 15 nt, Homo sapiens
aauaauaaauccuca

SEQ ID NO: 2215724 - RNA, 21 nt, Homo sapiens
agagcuagaugugucuuacca

SEQ ID NO: 2215725 - RNA, 14 nt, Homo sapiens
uaaaaaauagacau

SEQ ID NO: 2215726 - RNA, 12 nt, Homo sapiens
caguuacagggc

SEQ ID NO: 2215727 - RNA, 16 nt, Homo sapiens
gccccugagcccagag

SEQ ID NO: 2215728 - RNA, 14 nt, Homo sapiens
cacagcccugaauc

SEQ ID NO: 2215729 - RNA, 18 nt, Homo sapiens
guaucccgagucugggac

SEQ ID NO: 2215730 - RNA, 16 nt, Homo sapiens
gcauucugccuaacag

SEQ ID NO: 2215731 - RNA, 14 nt, Homo sapiens
ggauuacaggcaug

SEQ ID NO: 2215732 - RNA, 17 nt, Homo sapiens
uuugcuguaaacuugua

SEQ ID NO: 2215733 - RNA, 21 nt, Homo sapiens
ccugccugcaucugugaaaag

SEQ ID NO: 2215734 - RNA, 18 nt, Homo sapiens
aucaaagacucauugcuu

SEQ ID NO: 2215735 - RNA, 16 nt, Homo sapiens
gcuuucaucacuaccu

SEQ ID NO: 2215736 - RNA, 14 nt, Homo sapiens
uccaaacugccuaa

SEQ ID NO: 2215737 - RNA, 21 nt, Homo sapiens
agagucuaggcuaagcacuuu

SEQ ID NO: 2215738 - RNA, 14 nt, Homo sapiens
augucauauaucaa

SEQ ID NO: 2215739 - RNA, 17 nt, Homo sapiens
cgagcaugaacuggccc

SEQ ID NO: 2215740 - RNA, 16 nt, Homo sapiens
ccaucaguuacugguu

SEQ ID NO: 2215741 - RNA, 13 nt, Homo sapiens
caauguuccagga

SEQ ID NO: 2215742 - RNA, 20 nt, Homo sapiens
ucacucccgcugagcccacu

SEQ ID NO: 2215743 - RNA, 16 nt, Homo sapiens
uggcaaacgagacuuu

SEQ ID NO: 2215744 - RNA, 15 nt, Homo sapiens
ccuggcuggagaccg

SEQ ID NO: 2215745 - RNA, 22 nt, Homo sapiens
aucaagcugugagacaguggga

SEQ ID NO: 2215746 - RNA, 22 nt, Homo sapiens
cagcagcaccuuucucugagaa

SEQ ID NO: 2215747 - RNA, 15 nt, Homo sapiens
aggugugacuugaac

SEQ ID NO: 2215748 - RNA, 9 nt, Homo sapiens
gcaucuccc

SEQ ID NO: 2215749 - RNA, 20 nt, Homo sapiens
cuacacacccccaagccaca

SEQ ID NO: 2215750 - RNA, 23 nt, Homo sapiens
cccccucaaaccuccucuucuga

SEQ ID NO: 2215751 - RNA, 21 nt, Homo sapiens
auuuauacuuugcaauccaaa

SEQ ID NO: 2215752 - RNA, 14 nt, Homo sapiens
auccuuccaaaaau

SEQ ID NO: 2215753 - RNA, 17 nt, Homo sapiens
cagcucccauuucauca

SEQ ID NO: 2215754 - RNA, 21 nt, Homo sapiens
ccucugauuuccuucugcuau

SEQ ID NO: 2215755 - RNA, 14 nt, Homo sapiens
ccucuaauaguaua

SEQ ID NO: 2215756 - RNA, 15 nt, Homo sapiens
ucaugucuugugcau

SEQ ID NO: 2215757 - RNA, 22 nt, Homo sapiens
caccgagcgggugcaagcacuc

SEQ ID NO: 2215758 - RNA, 16 nt, Homo sapiens
aaacaugauuguuuac

SEQ ID NO: 2215759 - RNA, 14 nt, Homo sapiens
agcgugugccacug

SEQ ID NO: 2215760 - RNA, 16 nt, Homo sapiens
cugagcagugccagcu

SEQ ID NO: 2215761 - RNA, 14 nt, Homo sapiens
agggaagcuuuguu

SEQ ID NO: 2215762 - RNA, 12 nt, Homo sapiens
accauguggcaa

SEQ ID NO: 2215763 - RNA, 15 nt, Homo sapiens
cuucugcuccaugcu

SEQ ID NO: 2215764 - RNA, 12 nt, Homo sapiens
caugaugcacag

SEQ ID NO: 2215765 - RNA, 14 nt, Homo sapiens
ucaaaucagucagu

SEQ ID NO: 2215766 - RNA, 14 nt, Homo sapiens
uuucagucugaucc

SEQ ID NO: 2215767 - RNA, 23 nt, Homo sapiens
uggcaagucuagagucucagaaa

SEQ ID NO: 2215768 - RNA, 23 nt, Homo sapiens
cugaaaguaauauaaugaugcug

SEQ ID NO: 2215769 - RNA, 13 nt, Homo sapiens
ucuguguacugaa

SEQ ID NO: 2215770 - RNA, 13 nt, Homo sapiens
gacaagcauggaa

SEQ ID NO: 2215771 - RNA, 21 nt, Homo sapiens
uuguacaugauaagacauuuu

SEQ ID NO: 2215772 - RNA, 14 nt, Homo sapiens
auaucaaaauucua

SEQ ID NO: 2215773 - RNA, 17 nt, Homo sapiens
ucaccaccucaugucau

SEQ ID NO: 2215774 - RNA, 20 nt, Homo sapiens
aucuuggagucaaaaggcaa

SEQ ID NO: 2215775 - RNA, 20 nt, Homo sapiens
auugucccugaaugcuccau

SEQ ID NO: 2215776 - RNA, 23 nt, Homo sapiens
uugaauguugguuuuaauacuug

SEQ ID NO: 2215777 - RNA, 15 nt, Homo sapiens
agagcccugagcuca

SEQ ID NO: 2215778 - RNA, 21 nt, Homo sapiens
aaucugaccaaaacaaacaaa

SEQ ID NO: 2215779 - RNA, 14 nt, Homo sapiens
gcuccccucuggaa

SEQ ID NO: 2215780 - RNA, 23 nt, Homo sapiens
agcggccacggugccuccagaug

SEQ ID NO: 2215781 - RNA, 13 nt, Homo sapiens
agauucagacuug

SEQ ID NO: 2215782 - RNA, 15 nt, Homo sapiens
gugccauaaccauga

SEQ ID NO: 2215783 - RNA, 19 nt, Homo sapiens
ucaucugggacaaaacugg

SEQ ID NO: 2215784 - RNA, 17 nt, Homo sapiens
aagccaugugcuaagaa

SEQ ID NO: 2215785 - RNA, 18 nt, Homo sapiens
auauaugacuuuuucuca

SEQ ID NO: 2215786 - RNA, 18 nt, Homo sapiens
uuuaauguuaaauucaau

SEQ ID NO: 2215787 - RNA, 15 nt, Homo sapiens
ucagcgagugcuugg

SEQ ID NO: 2215788 - RNA, 18 nt, Homo sapiens
uacguuuuucuggugcuu

SEQ ID NO: 2215789 - RNA, 21 nt, Homo sapiens
ccaagugaccauaaaggcaug

SEQ ID NO: 2215790 - RNA, 16 nt, Homo sapiens
gaauggaaaacacaug

SEQ ID NO: 2215791 - RNA, 18 nt, Homo sapiens
aaugaaucuucacaaaac

SEQ ID NO: 2215792 - RNA, 24 nt, Homo sapiens
aaguaauuccuguauucuacagca

SEQ ID NO: 2215793 - RNA, 14 nt, Homo sapiens
cuagccagcuguca

SEQ ID NO: 2215794 - RNA, 19 nt, Homo sapiens
cuccaaugucugcugagga

SEQ ID NO: 2215795 - RNA, 15 nt, Homo sapiens
ucacuauguugccua

SEQ ID NO: 2215796 - RNA, 12 nt, Homo sapiens
cugcaugcucug

SEQ ID NO: 2215797 - RNA, 16 nt, Homo sapiens
ccugcagagugcaaca

SEQ ID NO: 2215798 - RNA, 21 nt, Homo sapiens
uauuucaauauuagcaagaca

SEQ ID NO: 2215799 - RNA, 20 nt, Homo sapiens
cuuuccaagcuccaccacuu

SEQ ID NO: 2215800 - RNA, 18 nt, Homo sapiens
cuuuuucauuuuccaaua

SEQ ID NO: 2215801 - RNA, 15 nt, Homo sapiens
auucaaguguaccug

SEQ ID NO: 2215802 - RNA, 15 nt, Homo sapiens
aaaacauugauaauu

SEQ ID NO: 2215803 - RNA, 17 nt, Homo sapiens
cucuuuuuagauguagc

SEQ ID NO: 2215804 - RNA, 14 nt, Homo sapiens
cuuguuucuccugc

SEQ ID NO: 2215805 - RNA, 20 nt, Homo sapiens
uuacauuguauagccccaca

SEQ ID NO: 2215806 - RNA, 21 nt, Homo sapiens
caggagggcugggcuccacuu

SEQ ID NO: 2215807 - RNA, 22 nt, Homo sapiens
ucagcauauauauaaaauacac

SEQ ID NO: 2215808 - RNA, 18 nt, Homo sapiens
gcccuggagggaggcucu

SEQ ID NO: 2215809 - RNA, 14 nt, Homo sapiens
cacuguauaccccg

SEQ ID NO: 2215810 - RNA, 13 nt, Homo sapiens
cuauuuauuugac

SEQ ID NO: 2215811 - RNA, 17 nt, Homo sapiens
ucucagaguccagucaa

SEQ ID NO: 2215812 - RNA, 23 nt, Homo sapiens
ucuggggaugagguugcuuacua

SEQ ID NO: 2215813 - RNA, 15 nt, Homo sapiens
cuuuugaaaugccac

SEQ ID NO: 2215814 - RNA, 19 nt, Homo sapiens
gcucuggcuggagaggaaa

SEQ ID NO: 2215815 - RNA, 16 nt, Homo sapiens
uuuuguacugaaucuc

SEQ ID NO: 2215816 - RNA, 17 nt, Homo sapiens
agaauaauuguguacaa

SEQ ID NO: 2215817 - RNA, 13 nt, Homo sapiens
ucccuuuuucaca

SEQ ID NO: 2215818 - RNA, 13 nt, Homo sapiens
ugaauuuuugcaa

SEQ ID NO: 2215819 - RNA, 16 nt, Homo sapiens
cuuaaaugaacuacug

SEQ ID NO: 2215820 - RNA, 19 nt, Homo sapiens
gugucauuggggggaccgu

SEQ ID NO: 2215821 - RNA, 18 nt, Homo sapiens
uggugcaaucacagcuca

SEQ ID NO: 2215822 - RNA, 20 nt, Homo sapiens
ugagguaaauaaagccacuu

SEQ ID NO: 2215823 - RNA, 19 nt, Homo sapiens
ucuuggaccucugcucuga

SEQ ID NO: 2215824 - RNA, 19 nt, Homo sapiens
agcaagggcacaaacugca

SEQ ID NO: 2215825 - RNA, 17 nt, Homo sapiens
uccuguacuguauggaa

SEQ ID NO: 2215826 - RNA, 20 nt, Homo sapiens
ugugccaggacugugacuca

SEQ ID NO: 2215827 - RNA, 13 nt, Homo sapiens
auguuaacacuca

SEQ ID NO: 2215828 - RNA, 13 nt, Homo sapiens
acaacacugggaa

SEQ ID NO: 2215829 - RNA, 11 nt, Homo sapiens
uucacaaucuu

SEQ ID NO: 2215830 - RNA, 18 nt, Homo sapiens
aagauagggaacacucau

SEQ ID NO: 2215831 - RNA, 15 nt, Homo sapiens
acugagagugaagug

SEQ ID NO: 2215832 - RNA, 14 nt, Homo sapiens
uguucaaugcuaga

SEQ ID NO: 2215833 - RNA, 22 nt, Homo sapiens
accccagcuccuaggucucaga

SEQ ID NO: 2215834 - RNA, 19 nt, Homo sapiens
accuaugacauacauggaa

SEQ ID NO: 2215835 - RNA, 22 nt, Homo sapiens
augagacaggaaaaaccaacag

SEQ ID NO: 2215836 - RNA, 21 nt, Homo sapiens
ugcugguguugagaccaagua

SEQ ID NO: 2215837 - RNA, 20 nt, Homo sapiens
cuuguuuccuuuugggcuca

SEQ ID NO: 2215838 - RNA, 14 nt, Homo sapiens
uugacgccaccaua

SEQ ID NO: 2215839 - RNA, 19 nt, Homo sapiens
ugccugcaaaaaugaaauc

SEQ ID NO: 2215840 - RNA, 13 nt, Homo sapiens
guauucauugaag

SEQ ID NO: 2215841 - RNA, 17 nt, Homo sapiens
uccuagacucugugauc

SEQ ID NO: 2215842 - RNA, 21 nt, Homo sapiens
aaauccaaaaagaaaugaugu

SEQ ID NO: 2215843 - RNA, 20 nt, Homo sapiens
ccucccugcgcccuugaggg

SEQ ID NO: 2215844 - RNA, 16 nt, Homo sapiens
aguaauaugcucucau

SEQ ID NO: 2215845 - RNA, 15 nt, Homo sapiens
agcccauggcacucu

SEQ ID NO: 2215846 - RNA, 22 nt, Homo sapiens
gccaccagggagcuuccuggcu

SEQ ID NO: 2215847 - RNA, 23 nt, Homo sapiens
gaaggcaauuuuaguguauuaau

SEQ ID NO: 2215848 - RNA, 22 nt, Homo sapiens
aggcaaaaaaaucauauaagcu

SEQ ID NO: 2215849 - RNA, 23 nt, Homo sapiens
caaugagguggcucaugccugua

SEQ ID NO: 2215850 - RNA, 17 nt, Homo sapiens
cauaagcauuacuuuau

SEQ ID NO: 2215851 - RNA, 20 nt, Homo sapiens
aguagcccagagugagcuuu

SEQ ID NO: 2215852 - RNA, 22 nt, Homo sapiens
aaaucacgcaucucuacuccuc

SEQ ID NO: 2215853 - RNA, 15 nt, Homo sapiens
agaauaaauucccaa

SEQ ID NO: 2215854 - RNA, 18 nt, Homo sapiens
gccucacuggacuugucc

SEQ ID NO: 2215855 - RNA, 11 nt, Homo sapiens
gaaccuuccau

SEQ ID NO: 2215856 - RNA, 23 nt, Homo sapiens
aggcggccucgugccaugaucug

SEQ ID NO: 2215857 - RNA, 14 nt, Homo sapiens
gaucugcuuucugu

SEQ ID NO: 2215858 - RNA, 16 nt, Homo sapiens
ucucucccagguccca

SEQ ID NO: 2215859 - RNA, 23 nt, Homo sapiens
cucaaauugucagcaauuuaacu

SEQ ID NO: 2215860 - RNA, 16 nt, Homo sapiens
cugccagccuggcuuc

SEQ ID NO: 2215861 - RNA, 16 nt, Homo sapiens
ccuuguccucagccag

SEQ ID NO: 2215862 - RNA, 15 nt, Homo sapiens
cauaacuauacuuga

SEQ ID NO: 2215863 - RNA, 22 nt, Homo sapiens
auguccaagaagcccaggaaag

SEQ ID NO: 2215864 - RNA, 23 nt, Homo sapiens
caaugcgaggucgcaacugagau

SEQ ID NO: 2215865 - RNA, 15 nt, Homo sapiens
ugugcauauguuaaa

SEQ ID NO: 2215866 - RNA, 15 nt, Homo sapiens
ugugacuauguucca

SEQ ID NO: 2215867 - RNA, 22 nt, Homo sapiens
cugagguuugaaucugacuuua

SEQ ID NO: 2215868 - RNA, 19 nt, Homo sapiens
uuugccugcuucuuuccag

SEQ ID NO: 2215869 - RNA, 23 nt, Homo sapiens
ccaggagguggagguugcaguga

SEQ ID NO: 2215870 - RNA, 12 nt, Homo sapiens
guagccaugacc

SEQ ID NO: 2215871 - RNA, 16 nt, Homo sapiens
cagacucagacuccau

SEQ ID NO: 2215872 - RNA, 12 nt, Homo sapiens
ugaccuugagaa

SEQ ID NO: 2215873 - RNA, 22 nt, Homo sapiens
cuaugaaggcuguacacugcac

SEQ ID NO: 2215874 - RNA, 15 nt, Homo sapiens
agaaaaaugcugaau

SEQ ID NO: 2215875 - RNA, 21 nt, Homo sapiens
aaccuuuagaauaucuuuuca

SEQ ID NO: 2215876 - RNA, 14 nt, Homo sapiens
accuaccuauucau

SEQ ID NO: 2215877 - RNA, 23 nt, Homo sapiens
gcaaguguaugcacgugugcaca

SEQ ID NO: 2215878 - RNA, 22 nt, Homo sapiens
uuauauaaggaauaaagccuuu

SEQ ID NO: 2215879 - RNA, 16 nt, Homo sapiens
cccuccucuagccauc

SEQ ID NO: 2215880 - RNA, 20 nt, Homo sapiens
cccugcucugggcacuggga

SEQ ID NO: 2215881 - RNA, 17 nt, Homo sapiens
uagcagaaaaauguguu

SEQ ID NO: 2215882 - RNA, 18 nt, Homo sapiens
gacucuugaauaaaaaua

SEQ ID NO: 2215883 - RNA, 16 nt, Homo sapiens
uuccuuuguguuuaua

SEQ ID NO: 2215884 - RNA, 17 nt, Homo sapiens
ccaggugugguggugca

SEQ ID NO: 2215885 - RNA, 22 nt, Homo sapiens
cuguugcaaacucaguuccaaa

SEQ ID NO: 2215886 - RNA, 16 nt, Homo sapiens
uggguaucaaacagcu

SEQ ID NO: 2215887 - RNA, 16 nt, Homo sapiens
cagcucagugagcugg

SEQ ID NO: 2215888 - RNA, 16 nt, Homo sapiens
guaacaaaugacuggu

SEQ ID NO: 2215889 - RNA, 20 nt, Homo sapiens
uagccaaaccaggacccugu

SEQ ID NO: 2215890 - RNA, 18 nt, Homo sapiens
ccugggccaccaugcacu

SEQ ID NO: 2215891 - RNA, 16 nt, Homo sapiens
uaaauuuguguucuca

SEQ ID NO: 2215892 - RNA, 14 nt, Homo sapiens
uguuuccagugaca

SEQ ID NO: 2215893 - RNA, 16 nt, Homo sapiens
uaccaauucacccacu

SEQ ID NO: 2215894 - RNA, 21 nt, Homo sapiens
augcacacaaacaccuccuag

SEQ ID NO: 2215895 - RNA, 20 nt, Homo sapiens
aaagcacagggacacaaaga

SEQ ID NO: 2215896 - RNA, 20 nt, Homo sapiens
acacugugggugugugacuc

SEQ ID NO: 2215897 - RNA, 15 nt, Homo sapiens
cucccaaggcucuga

SEQ ID NO: 2215898 - RNA, 14 nt, Homo sapiens
uggccuaugcacau

SEQ ID NO: 2215899 - RNA, 19 nt, Homo sapiens
gaccuaccugcagugggaa

SEQ ID NO: 2215900 - RNA, 12 nt, Homo sapiens
gcuuaugugaca

SEQ ID NO: 2215901 - RNA, 16 nt, Homo sapiens
auguuuccagcacuau

SEQ ID NO: 2215902 - RNA, 22 nt, Homo sapiens
ggcgggguauucccacucacca

SEQ ID NO: 2215903 - RNA, 21 nt, Homo sapiens
gaacuuccugcuuccucagag

SEQ ID NO: 2215904 - RNA, 22 nt, Homo sapiens
aaaaccuuccuucccuggcuac

SEQ ID NO: 2215905 - RNA, 16 nt, Homo sapiens
aaccaauugugagaau

SEQ ID NO: 2215906 - RNA, 20 nt, Homo sapiens
aauuuaggauggaauacuuc

SEQ ID NO: 2215907 - RNA, 23 nt, Homo sapiens
cuuuugaaaugccacgugccauu

SEQ ID NO: 2215908 - RNA, 21 nt, Homo sapiens
ugcaaacuguggcaacugaga

SEQ ID NO: 2215909 - RNA, 19 nt, Homo sapiens
aaauguccauuuauaucau

SEQ ID NO: 2215910 - RNA, 20 nt, Homo sapiens
ugcucugcuugacaacaucu

SEQ ID NO: 2215911 - RNA, 17 nt, Homo sapiens
guugugugucaugccag

SEQ ID NO: 2215912 - RNA, 17 nt, Homo sapiens
cucugcucucaggagau

SEQ ID NO: 2215913 - RNA, 15 nt, Homo sapiens
ugccucuuauuacag

SEQ ID NO: 2215914 - RNA, 14 nt, Homo sapiens
acugcuacuugugg

SEQ ID NO: 2215915 - RNA, 15 nt, Homo sapiens
ucacucuuccacauu

SEQ ID NO: 2215916 - RNA, 13 nt, Homo sapiens
gauguguggacac

SEQ ID NO: 2215917 - RNA, 21 nt, Homo sapiens
uugcugcucuucaucccauuc

SEQ ID NO: 2215918 - RNA, 20 nt, Homo sapiens
cuucagaugcugagccaacu

SEQ ID NO: 2215919 - RNA, 14 nt, Homo sapiens
agcagaacccagac

SEQ ID NO: 2215920 - RNA, 12 nt, Homo sapiens
gcauuccagggu

SEQ ID NO: 2215921 - RNA, 16 nt, Homo sapiens
auguguuagcacugau

SEQ ID NO: 2215922 - RNA, 21 nt, Homo sapiens
gcaucauucucuaauauccac

SEQ ID NO: 2215923 - RNA, 13 nt, Homo sapiens
ggcaaucuugccc

SEQ ID NO: 2215924 - RNA, 13 nt, Homo sapiens
gccccucuuccaa

SEQ ID NO: 2215925 - RNA, 21 nt, Homo sapiens
ugaagguucccaaggacauga

SEQ ID NO: 2215926 - RNA, 15 nt, Homo sapiens
ggccuagcgaucucu

SEQ ID NO: 2215927 - RNA, 14 nt, Homo sapiens
ccuuaucugugcuc

SEQ ID NO: 2215928 - RNA, 15 nt, Homo sapiens
auuuuggcagagaug

SEQ ID NO: 2215929 - RNA, 20 nt, Homo sapiens
cuguacaggaaggugccugg

SEQ ID NO: 2215930 - RNA, 23 nt, Homo sapiens
aacauguaauaaaaaguauaugu

SEQ ID NO: 2215931 - RNA, 18 nt, Homo sapiens
auucagaguagaaccacu

SEQ ID NO: 2215932 - RNA, 21 nt, Homo sapiens
cuuggaggccagccagugacc

SEQ ID NO: 2215933 - RNA, 22 nt, Homo sapiens
aggaaugacuuggguuuaacaa

SEQ ID NO: 2215934 - RNA, 16 nt, Homo sapiens
aaaaucacaaacucau

SEQ ID NO: 2215935 - RNA, 20 nt, Homo sapiens
cuuauaaguuaaaacaaagg

SEQ ID NO: 2215936 - RNA, 16 nt, Homo sapiens
caugacuauauauaca

SEQ ID NO: 2215937 - RNA, 22 nt, Homo sapiens
aauugguaaaacucacugugau

SEQ ID NO: 2215938 - RNA, 22 nt, Homo sapiens
accccuuggcuuuugcuuggca

SEQ ID NO: 2215939 - RNA, 15 nt, Homo sapiens
ugcuguuaaucugau

SEQ ID NO: 2215940 - RNA, 16 nt, Homo sapiens
caucaauuuuuauaca

SEQ ID NO: 2215941 - RNA, 17 nt, Homo sapiens
ccucgauuuugcacuuu

SEQ ID NO: 2215942 - RNA, 17 nt, Homo sapiens
caucacaugcucaauga

SEQ ID NO: 2215943 - RNA, 21 nt, Homo sapiens
cauuugcugaauagcuacuau

SEQ ID NO: 2215944 - RNA, 22 nt, Homo sapiens
uguuauuuuguauaaaugggaa

SEQ ID NO: 2215945 - RNA, 20 nt, Homo sapiens
gcccccugcaggaaggagcu

SEQ ID NO: 2215946 - RNA, 15 nt, Homo sapiens
aaugaauggacucaa

SEQ ID NO: 2215947 - RNA, 21 nt, Homo sapiens
aauucuuauuggccaaaugcc

SEQ ID NO: 2215948 - RNA, 22 nt, Homo sapiens
acuucacccacccuccaggacc

SEQ ID NO: 2215949 - RNA, 14 nt, Homo sapiens
guuaacaggauauu

SEQ ID NO: 2215950 - RNA, 16 nt, Homo sapiens
aaacacagccugugua

SEQ ID NO: 2215951 - RNA, 14 nt, Homo sapiens
aaacagugugcaug

SEQ ID NO: 2215952 - RNA, 15 nt, Homo sapiens
agaagaaaauaucau

SEQ ID NO: 2215953 - RNA, 13 nt, Homo sapiens
gagagaaagggag

SEQ ID NO: 2215954 - RNA, 15 nt, Homo sapiens
ccccagcccuuugca

SEQ ID NO: 2215955 - RNA, 23 nt, Homo sapiens
auuuggugacuguguaacuuucu

SEQ ID NO: 2215956 - RNA, 22 nt, Homo sapiens
cgucuuagcaagaaguaaaaug

SEQ ID NO: 2215957 - RNA, 19 nt, Homo sapiens
acccauagugcacacuugu

SEQ ID NO: 2215958 - RNA, 17 nt, Homo sapiens
acacagcaugugccaag

SEQ ID NO: 2215959 - RNA, 14 nt, Homo sapiens
ccuggaccauucca

SEQ ID NO: 2215960 - RNA, 19 nt, Homo sapiens
caacucuauacucaaucaa

SEQ ID NO: 2215961 - RNA, 17 nt, Homo sapiens
auugccuguaacacaua

SEQ ID NO: 2215962 - RNA, 23 nt, Homo sapiens
uugucucagccgagcccagggga

SEQ ID NO: 2215963 - RNA, 15 nt, Homo sapiens
uugaaagaacaucag

SEQ ID NO: 2215964 - RNA, 18 nt, Homo sapiens
augauggggcaugugcca

SEQ ID NO: 2215965 - RNA, 18 nt, Homo sapiens
caucggagggagucccag

SEQ ID NO: 2215966 - RNA, 17 nt, Homo sapiens
ugaaggucuugccugaa

SEQ ID NO: 2215967 - RNA, 19 nt, Homo sapiens
agugaacugcaaccucaaa

SEQ ID NO: 2215968 - RNA, 17 nt, Homo sapiens
aaauaguugucugugcu

SEQ ID NO: 2215969 - RNA, 15 nt, Homo sapiens
aaauuacuucucucu

SEQ ID NO: 2215970 - RNA, 19 nt, Homo sapiens
ggcucacaucauguaauag

SEQ ID NO: 2215971 - RNA, 18 nt, Homo sapiens
guuccacagaagcuuugu

SEQ ID NO: 2215972 - RNA, 17 nt, Homo sapiens
cugagcacggacucucc

SEQ ID NO: 2215973 - RNA, 18 nt, Homo sapiens
acuccaccgccuauccca

SEQ ID NO: 2215974 - RNA, 15 nt, Homo sapiens
ucagcccugccaggu

SEQ ID NO: 2215975 - RNA, 16 nt, Homo sapiens
agggacgacccggggc

SEQ ID NO: 2215976 - RNA, 17 nt, Homo sapiens
cuccuaagggacuguga

SEQ ID NO: 2215977 - RNA, 19 nt, Homo sapiens
acaauguucuuuauauaca

SEQ ID NO: 2215978 - RNA, 16 nt, Homo sapiens
uagcaguacccuagcc

SEQ ID NO: 2215979 - RNA, 21 nt, Homo sapiens
gaaauaaauggugccugggau

SEQ ID NO: 2215980 - RNA, 14 nt, Homo sapiens
ucaguccucuuuca

SEQ ID NO: 2215981 - RNA, 22 nt, Homo sapiens
cacagcccugagagucagggug

SEQ ID NO: 2215982 - RNA, 15 nt, Homo sapiens
gccuacugaccaaau

SEQ ID NO: 2215983 - RNA, 17 nt, Homo sapiens
ugagguaucuucuuuag

SEQ ID NO: 2215984 - RNA, 16 nt, Homo sapiens
ucagauucagcauuug

SEQ ID NO: 2215985 - RNA, 18 nt, Homo sapiens
agcaggaacugagccaga

SEQ ID NO: 2215986 - RNA, 14 nt, Homo sapiens
auuauagugacaau

SEQ ID NO: 2215987 - RNA, 18 nt, Homo sapiens
ccucugacgcaccacugc

SEQ ID NO: 2215988 - RNA, 20 nt, Homo sapiens
caugauauagcuuugccaug

SEQ ID NO: 2215989 - RNA, 16 nt, Homo sapiens
cuauuuuucuuuccaa

SEQ ID NO: 2215990 - RNA, 21 nt, Homo sapiens
ugacucauaggucccugacau

SEQ ID NO: 2215991 - RNA, 22 nt, Homo sapiens
cugcuacccaguaaaaauccac

SEQ ID NO: 2215992 - RNA, 15 nt, Homo sapiens
gaggcaaagaacaau

SEQ ID NO: 2215993 - RNA, 17 nt, Homo sapiens
gggcaccucucugggaa

SEQ ID NO: 2215994 - RNA, 19 nt, Homo sapiens
gcuuuaaaaugucugugua

SEQ ID NO: 2215995 - RNA, 15 nt, Homo sapiens
acuagggagccaugu

SEQ ID NO: 2215996 - RNA, 18 nt, Homo sapiens
uaaggaacuucugaagau

SEQ ID NO: 2215997 - RNA, 20 nt, Homo sapiens
uagcucuaauguuugcauau

SEQ ID NO: 2215998 - RNA, 17 nt, Homo sapiens
agcaaccagagcacugu

SEQ ID NO: 2215999 - RNA, 19 nt, Homo sapiens
uacccaccugagcuuugga

SEQ ID NO: 2216000 - RNA, 18 nt, Homo sapiens
agccaguuguugccaacc

SEQ ID NO: 2216001 - RNA, 18 nt, Homo sapiens
uccaaacagaaaagugca

SEQ ID NO: 2216002 - RNA, 13 nt, Homo sapiens
guggugugucaau

SEQ ID NO: 2216003 - RNA, 17 nt, Homo sapiens
aaccagagaaucuuaag

SEQ ID NO: 2216004 - RNA, 13 nt, Homo sapiens
gaugguugccaag

SEQ ID NO: 2216005 - RNA, 14 nt, Homo sapiens
ucauaacaaaccau

SEQ ID NO: 2216006 - RNA, 23 nt, Homo sapiens
ucccuguucacggugacacaggu

SEQ ID NO: 2216007 - RNA, 15 nt, Homo sapiens
uucuccccucuccca

SEQ ID NO: 2216008 - RNA, 21 nt, Homo sapiens
aaaauuacagacaaaauuacu

SEQ ID NO: 2216009 - RNA, 14 nt, Homo sapiens
aguaaacacaggga

SEQ ID NO: 2216010 - RNA, 15 nt, Homo sapiens
ucauacucaccucac

SEQ ID NO: 2216011 - RNA, 20 nt, Homo sapiens
uuguucaauguuccauucuu

SEQ ID NO: 2216012 - RNA, 15 nt, Homo sapiens
auauguaaauagcuu

SEQ ID NO: 2216013 - RNA, 20 nt, Homo sapiens
cacccaugugcacaagugug

SEQ ID NO: 2216014 - RNA, 16 nt, Homo sapiens
ucagaccaguacuggg

SEQ ID NO: 2216015 - RNA, 19 nt, Homo sapiens
gcuguuuuuuuugcugcua

SEQ ID NO: 2216016 - RNA, 20 nt, Homo sapiens
cagggcguggagagcccuca

SEQ ID NO: 2216017 - RNA, 18 nt, Homo sapiens
uuguguguucacuaaacu

SEQ ID NO: 2216018 - RNA, 19 nt, Homo sapiens
acauuuggauuaaucucca

SEQ ID NO: 2216019 - RNA, 22 nt, Homo sapiens
gauauggcaggacuccuggcag

SEQ ID NO: 2216020 - RNA, 19 nt, Homo sapiens
uaaaagcuauuacuuggca

SEQ ID NO: 2216021 - RNA, 19 nt, Homo sapiens
gcccagaaaucauacugua

SEQ ID NO: 2216022 - RNA, 13 nt, Homo sapiens
uccaaaucaggcu

SEQ ID NO: 2216023 - RNA, 10 nt, Homo sapiens
aaacaaaaga

SEQ ID NO: 2216024 - RNA, 18 nt, Homo sapiens
ccugcagcaaacacucca

SEQ ID NO: 2216025 - RNA, 18 nt, Homo sapiens
uauaauauuguacaguua

SEQ ID NO: 2216026 - RNA, 22 nt, Homo sapiens
ccuaaaucuuccagcaugcauc

SEQ ID NO: 2216027 - RNA, 18 nt, Homo sapiens
ggauuguguuugugccau

SEQ ID NO: 2216028 - RNA, 19 nt, Homo sapiens
aggugugaccccaccugcu

SEQ ID NO: 2216029 - RNA, 22 nt, Homo sapiens
ccggaagucaucccagugcaca

SEQ ID NO: 2216030 - RNA, 13 nt, Homo sapiens
ccaauacauuugu

SEQ ID NO: 2216031 - RNA, 18 nt, Homo sapiens
cagacucgggaccaauac

SEQ ID NO: 2216032 - RNA, 23 nt, Homo sapiens
ccagucuauuuccacugaacaaa

SEQ ID NO: 2216033 - RNA, 16 nt, Homo sapiens
cagaggagccaugucc

SEQ ID NO: 2216034 - RNA, 20 nt, Homo sapiens
gcggacaagcagcuggugcu

SEQ ID NO: 2216035 - RNA, 20 nt, Homo sapiens
gucuguuuauuaacuacuga

SEQ ID NO: 2216036 - RNA, 18 nt, Homo sapiens
augagagcaaaugcaaaa

SEQ ID NO: 2216037 - RNA, 20 nt, Homo sapiens
auuaauuacugugugugagc

SEQ ID NO: 2216038 - RNA, 17 nt, Homo sapiens
uucuccuaugucuuuca

SEQ ID NO: 2216039 - RNA, 23 nt, Homo sapiens
gaacuggacuagugaaaaaucua

SEQ ID NO: 2216040 - RNA, 19 nt, Homo sapiens
cauuuuuauacagugauaa

SEQ ID NO: 2216041 - RNA, 15 nt, Homo sapiens
ggcagggccaggccu

SEQ ID NO: 2216042 - RNA, 21 nt, Homo sapiens
gcaacagguuuguucucagga

SEQ ID NO: 2216043 - RNA, 17 nt, Homo sapiens
uacuguggucacuugua

SEQ ID NO: 2216044 - RNA, 19 nt, Homo sapiens
ugccuuaucugaguuuucg

SEQ ID NO: 2216045 - RNA, 19 nt, Homo sapiens
auccaccccguugcucaag

SEQ ID NO: 2216046 - RNA, 21 nt, Homo sapiens
gcucccaacucccuucugcuu

SEQ ID NO: 2216047 - RNA, 18 nt, Homo sapiens
cuagcaggccuaagacau

SEQ ID NO: 2216048 - RNA, 18 nt, Homo sapiens
agccugaagggugccuag

SEQ ID NO: 2216049 - RNA, 15 nt, Homo sapiens
agaggcucagcacuu

SEQ ID NO: 2216050 - RNA, 11 nt, Homo sapiens
agguugccaau

SEQ ID NO: 2216051 - RNA, 16 nt, Homo sapiens
aagcuaacaucuuuac

SEQ ID NO: 2216052 - RNA, 18 nt, Homo sapiens
aauuacaaccgguuauca

SEQ ID NO: 2216053 - RNA, 21 nt, Homo sapiens
agugguaaucauaugugucuu

SEQ ID NO: 2216054 - RNA, 17 nt, Homo sapiens
ucccauagugugcauca

SEQ ID NO: 2216055 - RNA, 15 nt, Homo sapiens
cauauuaacauauuc

SEQ ID NO: 2216056 - RNA, 15 nt, Homo sapiens
caacaugcuccaaau

SEQ ID NO: 2216057 - RNA, 15 nt, Homo sapiens
ucacaugccacaaau

SEQ ID NO: 2216058 - RNA, 17 nt, Homo sapiens
gaauuucugcugugguc

SEQ ID NO: 2216059 - RNA, 15 nt, Homo sapiens
ccaucugugacuaua

SEQ ID NO: 2216060 - RNA, 12 nt, Homo sapiens
gccucuggaaua

SEQ ID NO: 2216061 - RNA, 13 nt, Homo sapiens
uuuuucuaaugga

SEQ ID NO: 2216062 - RNA, 23 nt, Homo sapiens
uuacuggcacuguggcacugcca

SEQ ID NO: 2216063 - RNA, 22 nt, Homo sapiens
ccuggaaauaacugagcacuuu

SEQ ID NO: 2216064 - RNA, 13 nt, Homo sapiens
uaaaauuagugag

SEQ ID NO: 2216065 - RNA, 21 nt, Homo sapiens
acugacccucaggcacaccuu

SEQ ID NO: 2216066 - RNA, 16 nt, Homo sapiens
gauucgcccaccucag

SEQ ID NO: 2216067 - RNA, 16 nt, Homo sapiens
agcucuuagucucuuu

SEQ ID NO: 2216068 - RNA, 23 nt, Homo sapiens
uggccgaggacuuugauugcaca

SEQ ID NO: 2216069 - RNA, 16 nt, Homo sapiens
caaaucaaaagacuuu

SEQ ID NO: 2216070 - RNA, 18 nt, Homo sapiens
ugucugauguggcaaaag

SEQ ID NO: 2216071 - RNA, 17 nt, Homo sapiens
agcuauggaaccagcag

SEQ ID NO: 2216072 - RNA, 12 nt, Homo sapiens
aaacucaguuca

SEQ ID NO: 2216073 - RNA, 17 nt, Homo sapiens
agcccagggaugcaaag

SEQ ID NO: 2216074 - RNA, 18 nt, Homo sapiens
ugcaucuuucucuuccca

SEQ ID NO: 2216075 - RNA, 16 nt, Homo sapiens
auggagagguuuguca

SEQ ID NO: 2216076 - RNA, 18 nt, Homo sapiens
cagugucuguucauugcc

SEQ ID NO: 2216077 - RNA, 19 nt, Homo sapiens
aauugcauacuacucucaa

SEQ ID NO: 2216078 - RNA, 22 nt, Homo sapiens
cgguuuuuuauuuucuuuacaa

SEQ ID NO: 2216079 - RNA, 17 nt, Homo sapiens
cccugcaaacagaacag

SEQ ID NO: 2216080 - RNA, 22 nt, Homo sapiens
uuauaacagaauuaaaguagau

SEQ ID NO: 2216081 - RNA, 23 nt, Homo sapiens
cuccggguuugagauggacacac

SEQ ID NO: 2216082 - RNA, 22 nt, Homo sapiens
uagcaaaugaaaaagucagcua

SEQ ID NO: 2216083 - RNA, 15 nt, Homo sapiens
uguaccucacugucc

SEQ ID NO: 2216084 - RNA, 17 nt, Homo sapiens
cacaucugccaccggaa

SEQ ID NO: 2216085 - RNA, 17 nt, Homo sapiens
aaccaucaccagaauua

SEQ ID NO: 2216086 - RNA, 18 nt, Homo sapiens
agacaggaugaggucucg

SEQ ID NO: 2216087 - RNA, 22 nt, Homo sapiens
guaagaugucuguuugcugaug

SEQ ID NO: 2216088 - RNA, 13 nt, Homo sapiens
gaugugcuuucau

SEQ ID NO: 2216089 - RNA, 16 nt, Homo sapiens
accccuuguugcacug

SEQ ID NO: 2216090 - RNA, 17 nt, Homo sapiens
agggucuuguguugcaa

SEQ ID NO: 2216091 - RNA, 17 nt, Homo sapiens
uggggaucucaggggcu

SEQ ID NO: 2216092 - RNA, 14 nt, Homo sapiens
cuugaaucuucuag

SEQ ID NO: 2216093 - RNA, 21 nt, Homo sapiens
cucacgaggcuuggaccugcu

SEQ ID NO: 2216094 - RNA, 22 nt, Homo sapiens
cgcaauuucacgacacacuuug

SEQ ID NO: 2216095 - RNA, 14 nt, Homo sapiens
gauauuuaaauuca

SEQ ID NO: 2216096 - RNA, 18 nt, Homo sapiens
aagcccacuuuguucgca

SEQ ID NO: 2216097 - RNA, 17 nt, Homo sapiens
ggagaguugggggccag

SEQ ID NO: 2216098 - RNA, 18 nt, Homo sapiens
cuggaagggguccagccu

SEQ ID NO: 2216099 - RNA, 19 nt, Homo sapiens
acagccccuggcacugcag

SEQ ID NO: 2216100 - RNA, 17 nt, Homo sapiens
ucugaaaggaagacauu

SEQ ID NO: 2216101 - RNA, 12 nt, Homo sapiens
ucacacugcuga

SEQ ID NO: 2216102 - RNA, 21 nt, Homo sapiens
gugagccaagaaacacugccu

SEQ ID NO: 2216103 - RNA, 20 nt, Homo sapiens
ucuagacauggagguucuaa

SEQ ID NO: 2216104 - RNA, 14 nt, Homo sapiens
uuuguugagccagg

SEQ ID NO: 2216105 - RNA, 15 nt, Homo sapiens
agcucuuaauguugc

SEQ ID NO: 2216106 - RNA, 15 nt, Homo sapiens
ugaaugaauaaagua

SEQ ID NO: 2216107 - RNA, 16 nt, Homo sapiens
auucauuucaaaggga

SEQ ID NO: 2216108 - RNA, 14 nt, Homo sapiens
cagcaaaauccaaa

SEQ ID NO: 2216109 - RNA, 19 nt, Homo sapiens
aaaaagcuaaugugcaggg

SEQ ID NO: 2216110 - RNA, 13 nt, Homo sapiens
cagcccuugcucu

SEQ ID NO: 2216111 - RNA, 19 nt, Homo sapiens
caaaacagauuacuagaaa

SEQ ID NO: 2216112 - RNA, 15 nt, Homo sapiens
ugcaaaccucaucuu

SEQ ID NO: 2216113 - RNA, 20 nt, Homo sapiens
cagggccucugggagccuga

SEQ ID NO: 2216114 - RNA, 18 nt, Homo sapiens
uuacaaucgagacugcaa

SEQ ID NO: 2216115 - RNA, 18 nt, Homo sapiens
uucccacauaauacauuc

SEQ ID NO: 2216116 - RNA, 14 nt, Homo sapiens
agcuagucuuucac

SEQ ID NO: 2216117 - RNA, 23 nt, Homo sapiens
ugugcugccuguggugagguccu

SEQ ID NO: 2216118 - RNA, 18 nt, Homo sapiens
ggucauggccacacugug

SEQ ID NO: 2216119 - RNA, 12 nt, Homo sapiens
gacuaugacaua

SEQ ID NO: 2216120 - RNA, 18 nt, Homo sapiens
accuggugggcucaacca

SEQ ID NO: 2216121 - RNA, 20 nt, Homo sapiens
agugguuguuuugucaugaa

SEQ ID NO: 2216122 - RNA, 13 nt, Homo sapiens
caggccagguggg

SEQ ID NO: 2216123 - RNA, 19 nt, Homo sapiens
ucggugugcugccaacuug

SEQ ID NO: 2216124 - RNA, 15 nt, Homo sapiens
acugucuagaacuua

SEQ ID NO: 2216125 - RNA, 15 nt, Homo sapiens
uccacagacucccuc

SEQ ID NO: 2216126 - RNA, 22 nt, Homo sapiens
uaaaccaaaggacauuaugugu

SEQ ID NO: 2216127 - RNA, 18 nt, Homo sapiens
aaugguuauuuguuacua

SEQ ID NO: 2216128 - RNA, 21 nt, Homo sapiens
auuuuucauuuuuccaugaca

SEQ ID NO: 2216129 - RNA, 22 nt, Homo sapiens
gaugugaauacucuucccacau

SEQ ID NO: 2216130 - RNA, 21 nt, Homo sapiens
cuugauugugggauacuauuu

SEQ ID NO: 2216131 - RNA, 14 nt, Homo sapiens
ugugcuuaccuguu

SEQ ID NO: 2216132 - RNA, 16 nt, Homo sapiens
auuugacucagcacug

SEQ ID NO: 2216133 - RNA, 13 nt, Homo sapiens
ugcgcuuaaucca

SEQ ID NO: 2216134 - RNA, 19 nt, Homo sapiens
gaugcugugauacacugaa

SEQ ID NO: 2216135 - RNA, 14 nt, Homo sapiens
gcucgucuuugcag

SEQ ID NO: 2216136 - RNA, 13 nt, Homo sapiens
caaacaaaaaacu

SEQ ID NO: 2216137 - RNA, 14 nt, Homo sapiens
cagaggaugaggug

SEQ ID NO: 2216138 - RNA, 22 nt, Homo sapiens
aauuccacaccuuuuauugaca

SEQ ID NO: 2216139 - RNA, 17 nt, Homo sapiens
cucauugagaauucaaa

SEQ ID NO: 2216140 - RNA, 16 nt, Homo sapiens
uggugugucaugcuca

SEQ ID NO: 2216141 - RNA, 22 nt, Homo sapiens
uuauucauguguacagaaacaa

SEQ ID NO: 2216142 - RNA, 23 nt, Homo sapiens
aaaauggacaaaauccaugaaca

SEQ ID NO: 2216143 - RNA, 14 nt, Homo sapiens
aacuucaucugcca

SEQ ID NO: 2216144 - RNA, 15 nt, Homo sapiens
aagcaguugagacaa

SEQ ID NO: 2216145 - RNA, 22 nt, Homo sapiens
agaacaccccaugcgugcugag

SEQ ID NO: 2216146 - RNA, 13 nt, Homo sapiens
uuugucucugcag

SEQ ID NO: 2216147 - RNA, 17 nt, Homo sapiens
guugaauguugcaaugu

SEQ ID NO: 2216148 - RNA, 14 nt, Homo sapiens
agaagggcuaucau

SEQ ID NO: 2216149 - RNA, 13 nt, Homo sapiens
uggauuaauguca

SEQ ID NO: 2216150 - RNA, 13 nt, Homo sapiens
gaagcacugccau

SEQ ID NO: 2216151 - RNA, 18 nt, Homo sapiens
uucgccagcagacaucag

SEQ ID NO: 2216152 - RNA, 14 nt, Homo sapiens
agcugaaaacauaa

SEQ ID NO: 2216153 - RNA, 16 nt, Homo sapiens
cagcaagucaggguug

SEQ ID NO: 2216154 - RNA, 12 nt, Homo sapiens
gugcacuuucuc

SEQ ID NO: 2216155 - RNA, 13 nt, Homo sapiens
aauaguggcauaa

SEQ ID NO: 2216156 - RNA, 22 nt, Homo sapiens
acauauagcccuuuccccacuc

SEQ ID NO: 2216157 - RNA, 22 nt, Homo sapiens
auguuguguggcaaugggauuu

SEQ ID NO: 2216158 - RNA, 18 nt, Homo sapiens
gggacugaaaaccucucc

SEQ ID NO: 2216159 - RNA, 22 nt, Homo sapiens
cuucuuugccaagaccuuucaa

SEQ ID NO: 2216160 - RNA, 12 nt, Homo sapiens
cuuuuucaugua

SEQ ID NO: 2216161 - RNA, 15 nt, Homo sapiens
cuuauuuauaccuca

SEQ ID NO: 2216162 - RNA, 14 nt, Homo sapiens
aucuaaaaacuuag

SEQ ID NO: 2216163 - RNA, 21 nt, Homo sapiens
ucugcccugugggaccccagg

SEQ ID NO: 2216164 - RNA, 17 nt, Homo sapiens
accuugucccagccagu

SEQ ID NO: 2216165 - RNA, 14 nt, Homo sapiens
cuggcaaacaugug

SEQ ID NO: 2216166 - RNA, 20 nt, Homo sapiens
ucugccagguuuaaggucac

SEQ ID NO: 2216167 - RNA, 17 nt, Homo sapiens
caucaucccuucuucca

SEQ ID NO: 2216168 - RNA, 21 nt, Homo sapiens
augaaagaagaguuccauggu

SEQ ID NO: 2216169 - RNA, 18 nt, Homo sapiens
accgacugaagugugugu

SEQ ID NO: 2216170 - RNA, 13 nt, Homo sapiens
uauuuagucugca

SEQ ID NO: 2216171 - RNA, 15 nt, Homo sapiens
gugagguucugcuga

SEQ ID NO: 2216172 - RNA, 13 nt, Homo sapiens
gaucuaccagcau

SEQ ID NO: 2216173 - RNA, 18 nt, Homo sapiens
gcaaagccuuuccagaaa

SEQ ID NO: 2216174 - RNA, 14 nt, Homo sapiens
ugucauccaccagu

SEQ ID NO: 2216175 - RNA, 21 nt, Homo sapiens
agacaauggcuuacuccagga

SEQ ID NO: 2216176 - RNA, 12 nt, Homo sapiens
gaaguaaagccu

SEQ ID NO: 2216177 - RNA, 17 nt, Homo sapiens
agaugacccaaucugcc

SEQ ID NO: 2216178 - RNA, 19 nt, Homo sapiens
gcugcuuuccaaagccaau

SEQ ID NO: 2216179 - RNA, 15 nt, Homo sapiens
ugggggugcucucuc

SEQ ID NO: 2216180 - RNA, 14 nt, Homo sapiens
aaagggcaguuuug

SEQ ID NO: 2216181 - RNA, 22 nt, Homo sapiens
ugucuauugucaagaugcuaca

SEQ ID NO: 2216182 - RNA, 16 nt, Homo sapiens
auucuucgcacagugu

SEQ ID NO: 2216183 - RNA, 18 nt, Homo sapiens
augcacugaagagcucuu

SEQ ID NO: 2216184 - RNA, 23 nt, Homo sapiens
acccugaaauauuuucuacuuua

SEQ ID NO: 2216185 - RNA, 18 nt, Homo sapiens
gaauugaggaugucccug

SEQ ID NO: 2216186 - RNA, 23 nt, Homo sapiens
auccagcccugaguuccuagcca

SEQ ID NO: 2216187 - RNA, 14 nt, Homo sapiens
ugaaaugaggagaa

SEQ ID NO: 2216188 - RNA, 17 nt, Homo sapiens
agcauaagcuuaugcuu

SEQ ID NO: 2216189 - RNA, 14 nt, Homo sapiens
uccagagcugcuuc

SEQ ID NO: 2216190 - RNA, 23 nt, Homo sapiens
cugccuuacccugguaaucagca

SEQ ID NO: 2216191 - RNA, 14 nt, Homo sapiens
gagcuggaggugga

SEQ ID NO: 2216192 - RNA, 21 nt, Homo sapiens
uaaauuuuaaguacuuugcug

SEQ ID NO: 2216193 - RNA, 20 nt, Homo sapiens
caugguggcaugcaccugca

SEQ ID NO: 2216194 - RNA, 16 nt, Homo sapiens
agguaaggugagggaa

SEQ ID NO: 2216195 - RNA, 16 nt, Homo sapiens
acccagucccacacug

SEQ ID NO: 2216196 - RNA, 20 nt, Homo sapiens
auuaagcagaaagucuucau

SEQ ID NO: 2216197 - RNA, 20 nt, Homo sapiens
gugcuuuaggauuuauugca

SEQ ID NO: 2216198 - RNA, 17 nt, Homo sapiens
ccgccagcgaacuugac

SEQ ID NO: 2216199 - RNA, 21 nt, Homo sapiens
ccauccagaggccauguucca

SEQ ID NO: 2216200 - RNA, 21 nt, Homo sapiens
aguggaugacgugaagccaca

SEQ ID NO: 2216201 - RNA, 18 nt, Homo sapiens
gaauguggaauaccuaag

SEQ ID NO: 2216202 - RNA, 16 nt, Homo sapiens
caguucccacauuaaa

SEQ ID NO: 2216203 - RNA, 19 nt, Homo sapiens
ccaaauuugaguugcaccc

SEQ ID NO: 2216204 - RNA, 16 nt, Homo sapiens
aacuggguaugaggcu

SEQ ID NO: 2216205 - RNA, 20 nt, Homo sapiens
cugcccacccccugcuggug

SEQ ID NO: 2216206 - RNA, 23 nt, Homo sapiens
uuacucuagauaccuaaaacaua

SEQ ID NO: 2216207 - RNA, 20 nt, Homo sapiens
uggugaugguuuccacagga

SEQ ID NO: 2216208 - RNA, 19 nt, Homo sapiens
caauaaugaaugagcaguu

SEQ ID NO: 2216209 - RNA, 16 nt, Homo sapiens
cuuccucaucaugaaa

SEQ ID NO: 2216210 - RNA, 20 nt, Homo sapiens
guucaaaaaacucuugauau

SEQ ID NO: 2216211 - RNA, 17 nt, Homo sapiens
auuucaucugagugugg

SEQ ID NO: 2216212 - RNA, 20 nt, Homo sapiens
gacgggcacacagacuggag

SEQ ID NO: 2216213 - RNA, 15 nt, Homo sapiens
uuccuucccagagau

SEQ ID NO: 2216214 - RNA, 11 nt, Homo sapiens
uggaagccauc

SEQ ID NO: 2216215 - RNA, 15 nt, Homo sapiens
aacacaaaguguaua

SEQ ID NO: 2216216 - RNA, 22 nt, Homo sapiens
guaacuuguuuacauagcauuu

SEQ ID NO: 2216217 - RNA, 12 nt, Homo sapiens
auuuuauaaaga

SEQ ID NO: 2216218 - RNA, 18 nt, Homo sapiens
cucccaaguccaguguga

SEQ ID NO: 2216219 - RNA, 22 nt, Homo sapiens
aucacuuguccucuugccagcu

SEQ ID NO: 2216220 - RNA, 18 nt, Homo sapiens
acaaaugugggaguucau

SEQ ID NO: 2216221 - RNA, 23 nt, Homo sapiens
augaagcugcucugaaaucuccu

SEQ ID NO: 2216222 - RNA, 23 nt, Homo sapiens
accugcugcagggacagcccuga

SEQ ID NO: 2216223 - RNA, 21 nt, Homo sapiens
gcaaaauuauguuugccacuu

SEQ ID NO: 2216224 - RNA, 22 nt, Homo sapiens
caguaauuuaacaucacuacaa

SEQ ID NO: 2216225 - RNA, 14 nt, Homo sapiens
caucaguguuaaaa

SEQ ID NO: 2216226 - RNA, 15 nt, Homo sapiens
acugagccauccuca

SEQ ID NO: 2216227 - RNA, 14 nt, Homo sapiens
uugguggguuuuga

SEQ ID NO: 2216228 - RNA, 21 nt, Homo sapiens
aaaguaaaaaauaacuaucaa

SEQ ID NO: 2216229 - RNA, 21 nt, Homo sapiens
uaaauauauuuuaaagcacuu

SEQ ID NO: 2216230 - RNA, 19 nt, Homo sapiens
aggcaugacacaccugggg

SEQ ID NO: 2216231 - RNA, 23 nt, Homo sapiens
gaggcuuucuccaggaggauuag

SEQ ID NO: 2216232 - RNA, 18 nt, Homo sapiens
ucugaauacaaagugaug

SEQ ID NO: 2216233 - RNA, 14 nt, Homo sapiens
ggaaccgcccagug

SEQ ID NO: 2216234 - RNA, 15 nt, Homo sapiens
ugggaggcagggaca

SEQ ID NO: 2216235 - RNA, 15 nt, Homo sapiens
acacuuuaccaggag

SEQ ID NO: 2216236 - RNA, 21 nt, Homo sapiens
ggguucuugagccagccaggc

SEQ ID NO: 2216237 - RNA, 16 nt, Homo sapiens
gaauuugugugguaug

SEQ ID NO: 2216238 - RNA, 15 nt, Homo sapiens
ugaaagcaacagcug

SEQ ID NO: 2216239 - RNA, 14 nt, Homo sapiens
cagugacuccugcu

SEQ ID NO: 2216240 - RNA, 13 nt, Homo sapiens
cccuuaaggacaa

SEQ ID NO: 2216241 - RNA, 20 nt, Homo sapiens
ccgcugggagaaaagccaga

SEQ ID NO: 2216242 - RNA, 15 nt, Homo sapiens
agcccaccccugugc

SEQ ID NO: 2216243 - RNA, 15 nt, Homo sapiens
uauauuuuauacugc

SEQ ID NO: 2216244 - RNA, 17 nt, Homo sapiens
ggccccuaggugcccag

SEQ ID NO: 2216245 - RNA, 19 nt, Homo sapiens
ucaauauaccaugacauga

SEQ ID NO: 2216246 - RNA, 17 nt, Homo sapiens
gccucaggccucugugc

SEQ ID NO: 2216247 - RNA, 19 nt, Homo sapiens
gcccacuucuucucagaaa

SEQ ID NO: 2216248 - RNA, 21 nt, Homo sapiens
ucccauguuagcuccaaagca

SEQ ID NO: 2216249 - RNA, 14 nt, Homo sapiens
accaacacagacac

SEQ ID NO: 2216250 - RNA, 13 nt, Homo sapiens
guacaagcugaug

SEQ ID NO: 2216251 - RNA, 17 nt, Homo sapiens
cugaaggggaggucaca

SEQ ID NO: 2216252 - RNA, 21 nt, Homo sapiens
aaacaugagcauccccagcca

SEQ ID NO: 2216253 - RNA, 20 nt, Homo sapiens
ucauuguuuauuaacaaauu

SEQ ID NO: 2216254 - RNA, 20 nt, Homo sapiens
uuuugaagauucuauguuaa

SEQ ID NO: 2216255 - RNA, 15 nt, Homo sapiens
accgggaaaggcauc

SEQ ID NO: 2216256 - RNA, 16 nt, Homo sapiens
guagaucauguucacu

SEQ ID NO: 2216257 - RNA, 14 nt, Homo sapiens
caugccagugcaug

SEQ ID NO: 2216258 - RNA, 12 nt, Homo sapiens
ccagacucuggg

SEQ ID NO: 2216259 - RNA, 16 nt, Homo sapiens
uuaguauuuauucacu

SEQ ID NO: 2216260 - RNA, 24 nt, Homo sapiens
ugaaaacucagaagaaagcucaga

SEQ ID NO: 2216261 - RNA, 13 nt, Homo sapiens
aauacuaaugaaa

SEQ ID NO: 2216262 - RNA, 22 nt, Homo sapiens
agcuguuccuccuaaaacaauc

SEQ ID NO: 2216263 - RNA, 15 nt, Homo sapiens
ucaguggccaggugc

SEQ ID NO: 2216264 - RNA, 15 nt, Homo sapiens
cagguggcucagugc

SEQ ID NO: 2216265 - RNA, 18 nt, Homo sapiens
aagauagucuucaguuuc

SEQ ID NO: 2216266 - RNA, 17 nt, Homo sapiens
aguguuauuugcacacu

SEQ ID NO: 2216267 - RNA, 19 nt, Homo sapiens
uuuaauagaaauaaauucc

SEQ ID NO: 2216268 - RNA, 17 nt, Homo sapiens
ugucauaaaugucacaa

SEQ ID NO: 2216269 - RNA, 21 nt, Homo sapiens
cuguauuuucaaagacugcca

SEQ ID NO: 2216270 - RNA, 20 nt, Homo sapiens
caguagcuccaacacuuuga

SEQ ID NO: 2216271 - RNA, 21 nt, Homo sapiens
uaacaauguauuuucuucacc

SEQ ID NO: 2216272 - RNA, 14 nt, Homo sapiens
aaucuguguacaaa

SEQ ID NO: 2216273 - RNA, 19 nt, Homo sapiens
cgucuuucacaguuucuuc

SEQ ID NO: 2216274 - RNA, 19 nt, Homo sapiens
caugauaguguauucuguu

SEQ ID NO: 2216275 - RNA, 23 nt, Homo sapiens
caccauggcaccuuuugcacaua

SEQ ID NO: 2216276 - RNA, 16 nt, Homo sapiens
gucagguucuuuacaa

SEQ ID NO: 2216277 - RNA, 19 nt, Homo sapiens
cuugcuaccugggauucca

SEQ ID NO: 2216278 - RNA, 11 nt, Homo sapiens
gaccaccacau

SEQ ID NO: 2216279 - RNA, 20 nt, Homo sapiens
augcacaacucuccaaaaca

SEQ ID NO: 2216280 - RNA, 15 nt, Homo sapiens
caccuuuacucugcu

SEQ ID NO: 2216281 - RNA, 13 nt, Homo sapiens
ucagacugccaaa

SEQ ID NO: 2216282 - RNA, 13 nt, Homo sapiens
aaguggaguccac

SEQ ID NO: 2216283 - RNA, 19 nt, Homo sapiens
gugauuucuuucuuugcac

SEQ ID NO: 2216284 - RNA, 18 nt, Homo sapiens
cuguugaucccacuucac

SEQ ID NO: 2216285 - RNA, 13 nt, Homo sapiens
cugagaauuucca

SEQ ID NO: 2216286 - RNA, 13 nt, Homo sapiens
ccaaguguuauac

SEQ ID NO: 2216287 - RNA, 18 nt, Homo sapiens
acugagcugggcaggaag

SEQ ID NO: 2216288 - RNA, 20 nt, Homo sapiens
caaaauguuuaagucacauu

SEQ ID NO: 2216289 - RNA, 20 nt, Homo sapiens
aggauacucuuaaucucacu

SEQ ID NO: 2216290 - RNA, 17 nt, Homo sapiens
gaccuggccucugccau

SEQ ID NO: 2216291 - RNA, 21 nt, Homo sapiens
gugauguugaaauaugcauac

SEQ ID NO: 2216292 - RNA, 15 nt, Homo sapiens
cagauggggccucug

SEQ ID NO: 2216293 - RNA, 16 nt, Homo sapiens
acauuuucauugauga

SEQ ID NO: 2216294 - RNA, 13 nt, Homo sapiens
agaaagaacuguc

SEQ ID NO: 2216295 - RNA, 21 nt, Homo sapiens
ugcaaauggcuacuaagcaca

SEQ ID NO: 2216296 - RNA, 21 nt, Homo sapiens
ggcaauaaguuccauguuaaa

SEQ ID NO: 2216297 - RNA, 17 nt, Homo sapiens
uccuugucuauccuucc

SEQ ID NO: 2216298 - RNA, 14 nt, Homo sapiens
uuggccucccaaaa

SEQ ID NO: 2216299 - RNA, 14 nt, Homo sapiens
gagugaaaguacuu

SEQ ID NO: 2216300 - RNA, 18 nt, Homo sapiens
agcgauguaugcagcuau

SEQ ID NO: 2216301 - RNA, 15 nt, Homo sapiens
aagaaagacuccuuu

SEQ ID NO: 2216302 - RNA, 19 nt, Homo sapiens
cagguguaagccaccgugc

SEQ ID NO: 2216303 - RNA, 19 nt, Homo sapiens
cgcauguacaaaaacacaa

SEQ ID NO: 2216304 - RNA, 15 nt, Homo sapiens
gccaggacuguguuu

SEQ ID NO: 2216305 - RNA, 18 nt, Homo sapiens
cccagcugcucagugcaa

SEQ ID NO: 2216306 - RNA, 12 nt, Homo sapiens
ggcacaucugcu

SEQ ID NO: 2216307 - RNA, 15 nt, Homo sapiens
uccaguuuccaaagg

SEQ ID NO: 2216308 - RNA, 21 nt, Homo sapiens
agauaaucauugcuuauguca

SEQ ID NO: 2216309 - RNA, 18 nt, Homo sapiens
augugcaaccacugcuuc

SEQ ID NO: 2216310 - RNA, 22 nt, Homo sapiens
caaguugagacagagaagggaa

SEQ ID NO: 2216311 - RNA, 14 nt, Homo sapiens
cuuuacaccaacuc

SEQ ID NO: 2216312 - RNA, 20 nt, Homo sapiens
ucuagaaccaggcaacuugg

SEQ ID NO: 2216313 - RNA, 14 nt, Homo sapiens
cuuggcugacauga

SEQ ID NO: 2216314 - RNA, 14 nt, Homo sapiens
cacucaaaagacaa

SEQ ID NO: 2216315 - RNA, 17 nt, Homo sapiens
gaccaguuuuguaucaa

SEQ ID NO: 2216316 - RNA, 13 nt, Homo sapiens
uccugugugcuga

SEQ ID NO: 2216317 - RNA, 21 nt, Homo sapiens
gccagauguggagucuguguc

SEQ ID NO: 2216318 - RNA, 22 nt, Homo sapiens
agaugauacauccaaagcagac

SEQ ID NO: 2216319 - RNA, 14 nt, Homo sapiens
aaugauaguuauaa

SEQ ID NO: 2216320 - RNA, 15 nt, Homo sapiens
aaggagcagcauuga

SEQ ID NO: 2216321 - RNA, 20 nt, Homo sapiens
gagaucugcaggcugccucu

SEQ ID NO: 2216322 - RNA, 12 nt, Homo sapiens
cagccccggggu

SEQ ID NO: 2216323 - RNA, 12 nt, Homo sapiens
uugcaaaguuug

SEQ ID NO: 2216324 - RNA, 16 nt, Homo sapiens
cauucuuagacuaguu

SEQ ID NO: 2216325 - RNA, 13 nt, Homo sapiens
caacugcuuguaa

SEQ ID NO: 2216326 - RNA, 16 nt, Homo sapiens
guuccaggauguggaa

SEQ ID NO: 2216327 - RNA, 16 nt, Homo sapiens
aauuuauucaucuugc

SEQ ID NO: 2216328 - RNA, 15 nt, Homo sapiens
cuguuguuacuggaa

SEQ ID NO: 2216329 - RNA, 16 nt, Homo sapiens
uccuaccaaccucuga

SEQ ID NO: 2216330 - RNA, 17 nt, Homo sapiens
ugcaaauugugaaauag

SEQ ID NO: 2216331 - RNA, 14 nt, Homo sapiens
cccugcaaagggaa

SEQ ID NO: 2216332 - RNA, 18 nt, Homo sapiens
uccccagugcuaccucuc

SEQ ID NO: 2216333 - RNA, 15 nt, Homo sapiens
acccccaguguaaua

SEQ ID NO: 2216334 - RNA, 19 nt, Homo sapiens
gcuaauauugauacaauga

SEQ ID NO: 2216335 - RNA, 20 nt, Homo sapiens
ccucugugcucuucucuucc

SEQ ID NO: 2216336 - RNA, 13 nt, Homo sapiens
aauauuaaauaca

SEQ ID NO: 2216337 - RNA, 17 nt, Homo sapiens
guaaccucaaacucugg

SEQ ID NO: 2216338 - RNA, 18 nt, Homo sapiens
acagcggcuggacuugga

SEQ ID NO: 2216339 - RNA, 15 nt, Homo sapiens
aagguugacacagga

SEQ ID NO: 2216340 - RNA, 13 nt, Homo sapiens
auggggacacaga

SEQ ID NO: 2216341 - RNA, 19 nt, Homo sapiens
auuaaacaagugcacuuga

SEQ ID NO: 2216342 - RNA, 20 nt, Homo sapiens
ugaacuacagcuauaccuca

SEQ ID NO: 2216343 - RNA, 23 nt, Homo sapiens
cccagaggcuucuccaaagggag

SEQ ID NO: 2216344 - RNA, 15 nt, Homo sapiens
cgugggaacaacugg

SEQ ID NO: 2216345 - RNA, 18 nt, Homo sapiens
cuuacaaaugucuagguc

SEQ ID NO: 2216346 - RNA, 20 nt, Homo sapiens
uaaucagcaauaaaaauccu

SEQ ID NO: 2216347 - RNA, 23 nt, Homo sapiens
uguaucuagcuucuucagagauc

SEQ ID NO: 2216348 - RNA, 16 nt, Homo sapiens
ugaaucaaaagugccu

SEQ ID NO: 2216349 - RNA, 23 nt, Homo sapiens
ucuggucuucacugccaugccuc

SEQ ID NO: 2216350 - RNA, 16 nt, Homo sapiens
cacucugaaauaauga

SEQ ID NO: 2216351 - RNA, 15 nt, Homo sapiens
ucugccucauggcaa

SEQ ID NO: 2216352 - RNA, 21 nt, Homo sapiens
acauguaacgaaacacuucaa

SEQ ID NO: 2216353 - RNA, 16 nt, Homo sapiens
auaguaacaucaaaga

SEQ ID NO: 2216354 - RNA, 16 nt, Homo sapiens
ucgagauugcacugcu

SEQ ID NO: 2216355 - RNA, 21 nt, Homo sapiens
cucugcugcuugagagcuauu

SEQ ID NO: 2216356 - RNA, 13 nt, Homo sapiens
aaggcuguugcau

SEQ ID NO: 2216357 - RNA, 21 nt, Homo sapiens
ugcaucacauauucauauugu

SEQ ID NO: 2216358 - RNA, 12 nt, Homo sapiens
acuacaccacac

SEQ ID NO: 2216359 - RNA, 17 nt, Homo sapiens
aaaaaauuaauacugaa

SEQ ID NO: 2216360 - RNA, 11 nt, Homo sapiens
cagagcacugg

SEQ ID NO: 2216361 - RNA, 19 nt, Homo sapiens
auugaaguccuccagacaa

SEQ ID NO: 2216362 - RNA, 23 nt, Homo sapiens
ccacagcacccaggcuccauggg

SEQ ID NO: 2216363 - RNA, 23 nt, Homo sapiens
cuguaagagguacuaaaaacacu

SEQ ID NO: 2216364 - RNA, 21 nt, Homo sapiens
ugugggaaguuaccuuuuaua

SEQ ID NO: 2216365 - RNA, 15 nt, Homo sapiens
ugaaaagucacuuac

SEQ ID NO: 2216366 - RNA, 21 nt, Homo sapiens
uccuggccaggauaauauauu

SEQ ID NO: 2216367 - RNA, 16 nt, Homo sapiens
auuauuuuccuuccau

SEQ ID NO: 2216368 - RNA, 22 nt, Homo sapiens
caguuaugaguauaauacauua

SEQ ID NO: 2216369 - RNA, 13 nt, Homo sapiens
cuuccuacuuugc

SEQ ID NO: 2216370 - RNA, 20 nt, Homo sapiens
agaugaacaugguguucaac

SEQ ID NO: 2216371 - RNA, 16 nt, Homo sapiens
cgugaccuugcaaugu

SEQ ID NO: 2216372 - RNA, 17 nt, Homo sapiens
ucuguuccccauggcca

SEQ ID NO: 2216373 - RNA, 14 nt, Homo sapiens
agaccuugccuccc

SEQ ID NO: 2216374 - RNA, 19 nt, Homo sapiens
cuuccugguagaccacugc

SEQ ID NO: 2216375 - RNA, 20 nt, Homo sapiens
gcugccagggaagacagagc

SEQ ID NO: 2216376 - RNA, 17 nt, Homo sapiens
ucuguggcuuaccuuga

SEQ ID NO: 2216377 - RNA, 14 nt, Homo sapiens
uauaccugcacguu

SEQ ID NO: 2216378 - RNA, 22 nt, Homo sapiens
gccugccuucucagggacuucu

SEQ ID NO: 2216379 - RNA, 15 nt, Homo sapiens
gacagcaccacugcu

SEQ ID NO: 2216380 - RNA, 16 nt, Homo sapiens
aagggguagucugccu

SEQ ID NO: 2216381 - RNA, 14 nt, Homo sapiens
cccugagcucuugc

SEQ ID NO: 2216382 - RNA, 21 nt, Homo sapiens
agccaguggggaugaggucac

SEQ ID NO: 2216383 - RNA, 16 nt, Homo sapiens
uucaguucuacgugaa

SEQ ID NO: 2216384 - RNA, 21 nt, Homo sapiens
aauauaaacugaaaaauguca

SEQ ID NO: 2216385 - RNA, 23 nt, Homo sapiens
uugagcuacuucaaaugugguau

SEQ ID NO: 2216386 - RNA, 17 nt, Homo sapiens
cacaucccuaacaucau

SEQ ID NO: 2216387 - RNA, 17 nt, Homo sapiens
acgucuguggacugaau

SEQ ID NO: 2216388 - RNA, 21 nt, Homo sapiens
guauaacugaaaaaggacuuu

SEQ ID NO: 2216389 - RNA, 19 nt, Homo sapiens
aucuucuuccagauuuccu

SEQ ID NO: 2216390 - RNA, 15 nt, Homo sapiens
aaaaaaugcauuuaa

SEQ ID NO: 2216391 - RNA, 15 nt, Homo sapiens
acuuuuugccaaaua

SEQ ID NO: 2216392 - RNA, 14 nt, Homo sapiens
aauacaacuaucau

SEQ ID NO: 2216393 - RNA, 12 nt, Homo sapiens
acucuuugccaa

SEQ ID NO: 2216394 - RNA, 22 nt, Homo sapiens
aaggaccggccuuugcaccucc

SEQ ID NO: 2216395 - RNA, 21 nt, Homo sapiens
gaauaauguacguacuaccua

SEQ ID NO: 2216396 - RNA, 15 nt, Homo sapiens
uuacuuguaucauug

SEQ ID NO: 2216397 - RNA, 21 nt, Homo sapiens
gucuucuaaauuugaaauaua

SEQ ID NO: 2216398 - RNA, 11 nt, Homo sapiens
gacuggcuuug

SEQ ID NO: 2216399 - RNA, 21 nt, Homo sapiens
caugcuuugaaguuucuggaa

SEQ ID NO: 2216400 - RNA, 20 nt, Homo sapiens
ggaaauaagcaaaaaacugc

SEQ ID NO: 2216401 - RNA, 14 nt, Homo sapiens
cugcagagcaauaa

SEQ ID NO: 2216402 - RNA, 9 nt, Homo sapiens
caagggagg

SEQ ID NO: 2216403 - RNA, 15 nt, Homo sapiens
auauacaaaacuuua

SEQ ID NO: 2216404 - RNA, 19 nt, Homo sapiens
cacaauaauuuucuaccug

SEQ ID NO: 2216405 - RNA, 16 nt, Homo sapiens
uccugaaauccucaau

SEQ ID NO: 2216406 - RNA, 14 nt, Homo sapiens
ucuuaaguggucua

SEQ ID NO: 2216407 - RNA, 20 nt, Homo sapiens
aacacugucaauggacugca

SEQ ID NO: 2216408 - RNA, 23 nt, Homo sapiens
aggcuggagugcaguggugcuau

SEQ ID NO: 2216409 - RNA, 20 nt, Homo sapiens
ccuaccccuccccagucucu

SEQ ID NO: 2216410 - RNA, 13 nt, Homo sapiens
ugaccucuugcug

SEQ ID NO: 2216411 - RNA, 15 nt, Homo sapiens
gugacuauuuauaua

SEQ ID NO: 2216412 - RNA, 17 nt, Homo sapiens
cuucuaucaaagcacau

SEQ ID NO: 2216413 - RNA, 13 nt, Homo sapiens
ugcagcuauucac

SEQ ID NO: 2216414 - RNA, 20 nt, Homo sapiens
ugugcugccuguuguuaugg

SEQ ID NO: 2216415 - RNA, 21 nt, Homo sapiens
aacguggacucauuucacuau

SEQ ID NO: 2216416 - RNA, 17 nt, Homo sapiens
agguaauucuagccuuu

SEQ ID NO: 2216417 - RNA, 17 nt, Homo sapiens
auacgucgugcucgagu

SEQ ID NO: 2216418 - RNA, 18 nt, Homo sapiens
agaucauugccaucacca

SEQ ID NO: 2216419 - RNA, 22 nt, Homo sapiens
cugguggaagucuuggguguua

SEQ ID NO: 2216420 - RNA, 16 nt, Homo sapiens
uacagacaugaaccac

SEQ ID NO: 2216421 - RNA, 15 nt, Homo sapiens
caucuuagucuuacc

SEQ ID NO: 2216422 - RNA, 19 nt, Homo sapiens
gaaugaacccaagagcaag

SEQ ID NO: 2216423 - RNA, 23 nt, Homo sapiens
cuuccucugagccgcagggccug

SEQ ID NO: 2216424 - RNA, 17 nt, Homo sapiens
aggucugauaguccucu

SEQ ID NO: 2216425 - RNA, 21 nt, Homo sapiens
agagucauauugcccaguggu

SEQ ID NO: 2216426 - RNA, 11 nt, Homo sapiens
cuagauuacag

SEQ ID NO: 2216427 - RNA, 22 nt, Homo sapiens
cucugaggggaggcaccuccag

SEQ ID NO: 2216428 - RNA, 18 nt, Homo sapiens
aagauuuuuuuugucaga

SEQ ID NO: 2216429 - RNA, 12 nt, Homo sapiens
aaaugagacaaa

SEQ ID NO: 2216430 - RNA, 12 nt, Homo sapiens
cuccucaaaagc

SEQ ID NO: 2216431 - RNA, 14 nt, Homo sapiens
guuuaggaaccgcu

SEQ ID NO: 2216432 - RNA, 16 nt, Homo sapiens
cccugcuaugcagaug

SEQ ID NO: 2216433 - RNA, 12 nt, Homo sapiens
aagaugucuccu

SEQ ID NO: 2216434 - RNA, 17 nt, Homo sapiens
ccacaguacucacuuuu

SEQ ID NO: 2216435 - RNA, 15 nt, Homo sapiens
ggccgucacccuggg

SEQ ID NO: 2216436 - RNA, 17 nt, Homo sapiens
ugggcacagcacagcca

SEQ ID NO: 2216437 - RNA, 23 nt, Homo sapiens
uagaaacacacauuucuuugaau

SEQ ID NO: 2216438 - RNA, 21 nt, Homo sapiens
ggaucuguuuguaaguggauu

SEQ ID NO: 2216439 - RNA, 19 nt, Homo sapiens
gaacagaaggaugaaugag

SEQ ID NO: 2216440 - RNA, 16 nt, Homo sapiens
gacuaguuucuuauua

SEQ ID NO: 2216441 - RNA, 16 nt, Homo sapiens
auuguuuuauguucua

SEQ ID NO: 2216442 - RNA, 12 nt, Homo sapiens
aaaagugcuaua

SEQ ID NO: 2216443 - RNA, 21 nt, Homo sapiens
cccgugcacgguucaauggua

SEQ ID NO: 2216444 - RNA, 12 nt, Homo sapiens
cagcucaucucu

SEQ ID NO: 2216445 - RNA, 13 nt, Homo sapiens
uucacuuuacaaa

SEQ ID NO: 2216446 - RNA, 19 nt, Homo sapiens
uaauugucaaaaaccagaa

SEQ ID NO: 2216447 - RNA, 15 nt, Homo sapiens
gaccugccagccggu

SEQ ID NO: 2216448 - RNA, 14 nt, Homo sapiens
cucuacagacucca

SEQ ID NO: 2216449 - RNA, 18 nt, Homo sapiens
cuccagugcauacuguag

SEQ ID NO: 2216450 - RNA, 22 nt, Homo sapiens
cgcgagcugcugauacagaaga

SEQ ID NO: 2216451 - RNA, 22 nt, Homo sapiens
cuggucccagccagcaguucag

SEQ ID NO: 2216452 - RNA, 22 nt, Homo sapiens
gccaucagggugggccacucuc

SEQ ID NO: 2216453 - RNA, 17 nt, Homo sapiens
ugauaguuuacaaacaa

SEQ ID NO: 2216454 - RNA, 22 nt, Homo sapiens
uuugaaugucacaaauugauca

SEQ ID NO: 2216455 - RNA, 15 nt, Homo sapiens
agaaccugugcucua

SEQ ID NO: 2216456 - RNA, 18 nt, Homo sapiens
cgucacugcccaccaaag

SEQ ID NO: 2216457 - RNA, 13 nt, Homo sapiens
aaucaaagcacuu

SEQ ID NO: 2216458 - RNA, 19 nt, Homo sapiens
ggugucacauggugccccu

SEQ ID NO: 2216459 - RNA, 17 nt, Homo sapiens
accagacagcacagggc

SEQ ID NO: 2216460 - RNA, 16 nt, Homo sapiens
uccaucuuauucccaa

SEQ ID NO: 2216461 - RNA, 21 nt, Homo sapiens
ugccucauuuucacagcacua

SEQ ID NO: 2216462 - RNA, 16 nt, Homo sapiens
caaaaaaaauuuaacu

SEQ ID NO: 2216463 - RNA, 15 nt, Homo sapiens
uggaggccucaggga

SEQ ID NO: 2216464 - RNA, 16 nt, Homo sapiens
cuaaccagccugguca

SEQ ID NO: 2216465 - RNA, 16 nt, Homo sapiens
gagcuuccagugcaug

SEQ ID NO: 2216466 - RNA, 14 nt, Homo sapiens
uaugggacacugaa

SEQ ID NO: 2216467 - RNA, 22 nt, Homo sapiens
gggcccccagccuggccagaca

SEQ ID NO: 2216468 - RNA, 21 nt, Homo sapiens
ucucuuuauauggccucaaga

SEQ ID NO: 2216469 - RNA, 13 nt, Homo sapiens
aaauaaaacacug

SEQ ID NO: 2216470 - RNA, 19 nt, Homo sapiens
uuugcauuucugucccaua

SEQ ID NO: 2216471 - RNA, 15 nt, Homo sapiens
ugagcuguugccuca

SEQ ID NO: 2216472 - RNA, 23 nt, Homo sapiens
caaaugucuaagguccccacugc

SEQ ID NO: 2216473 - RNA, 20 nt, Homo sapiens
gcccuggacagauggcccaa

SEQ ID NO: 2216474 - RNA, 20 nt, Homo sapiens
cucugauguucuuccaguga

SEQ ID NO: 2216475 - RNA, 22 nt, Homo sapiens
acuaaaauuguaucaaauguga

SEQ ID NO: 2216476 - RNA, 15 nt, Homo sapiens
aaaaauagcagcuuu

SEQ ID NO: 2216477 - RNA, 14 nt, Homo sapiens
gacauggugccuua

SEQ ID NO: 2216478 - RNA, 14 nt, Homo sapiens
gccugggugacaga

SEQ ID NO: 2216479 - RNA, 13 nt, Homo sapiens
auauuauaacucu

SEQ ID NO: 2216480 - RNA, 20 nt, Homo sapiens
ugaauaagaaaaacaauuga

SEQ ID NO: 2216481 - RNA, 22 nt, Homo sapiens
uuauaaaaauauaaauuguaca

SEQ ID NO: 2216482 - RNA, 18 nt, Homo sapiens
cucauacugucugggauu

SEQ ID NO: 2216483 - RNA, 20 nt, Homo sapiens
gccauuuccacuacagugag

SEQ ID NO: 2216484 - RNA, 23 nt, Homo sapiens
ccuuagaugccucgcucuuuuca

SEQ ID NO: 2216485 - RNA, 18 nt, Homo sapiens
agcagucgaccgcacuua

SEQ ID NO: 2216486 - RNA, 15 nt, Homo sapiens
uuguagagacagggu

SEQ ID NO: 2216487 - RNA, 15 nt, Homo sapiens
gagcaccagccccac

SEQ ID NO: 2216488 - RNA, 20 nt, Homo sapiens
uaauauuugucugugugcua

SEQ ID NO: 2216489 - RNA, 12 nt, Homo sapiens
caggaaucuccu

SEQ ID NO: 2216490 - RNA, 17 nt, Homo sapiens
ugacuuccucccacugu

SEQ ID NO: 2216491 - RNA, 14 nt, Homo sapiens
acggagccauguca

SEQ ID NO: 2216492 - RNA, 14 nt, Homo sapiens
guagauaacagauu

SEQ ID NO: 2216493 - RNA, 19 nt, Homo sapiens
gaccgugaccagugcugcu

SEQ ID NO: 2216494 - RNA, 18 nt, Homo sapiens
uugugaguggauaaucag

SEQ ID NO: 2216495 - RNA, 19 nt, Homo sapiens
cccagccccacuccucugc

SEQ ID NO: 2216496 - RNA, 16 nt, Homo sapiens
accccuggaugaaguu

SEQ ID NO: 2216497 - RNA, 14 nt, Homo sapiens
cauguuuucacuua

SEQ ID NO: 2216498 - RNA, 11 nt, Homo sapiens
gcacuucauau

SEQ ID NO: 2216499 - RNA, 20 nt, Homo sapiens
ugaaagcaaaaaugcuaaua

SEQ ID NO: 2216500 - RNA, 15 nt, Homo sapiens
uugccgucugugaca

SEQ ID NO: 2216501 - RNA, 17 nt, Homo sapiens
uaaaaccugagccauug

SEQ ID NO: 2216502 - RNA, 13 nt, Homo sapiens
cagaauucaucug

SEQ ID NO: 2216503 - RNA, 13 nt, Homo sapiens
acccugaaccuau

SEQ ID NO: 2216504 - RNA, 21 nt, Homo sapiens
ccccaacagcgacauagccca

SEQ ID NO: 2216505 - RNA, 16 nt, Homo sapiens
agcauguuacugacag

SEQ ID NO: 2216506 - RNA, 18 nt, Homo sapiens
acaccuuuuauugacaca

SEQ ID NO: 2216507 - RNA, 14 nt, Homo sapiens
acugugacugauau

SEQ ID NO: 2216508 - RNA, 17 nt, Homo sapiens
ugcaagugugugcaugu

SEQ ID NO: 2216509 - RNA, 14 nt, Homo sapiens
cugcuaccaaaaca

SEQ ID NO: 2216510 - RNA, 14 nt, Homo sapiens
cuacuuccaagacu

SEQ ID NO: 2216511 - RNA, 12 nt, Homo sapiens
gaguucugaugu

SEQ ID NO: 2216512 - RNA, 12 nt, Homo sapiens
accaaauacuuu

SEQ ID NO: 2216513 - RNA, 12 nt, Homo sapiens
acuuaauacuca

SEQ ID NO: 2216514 - RNA, 21 nt, Homo sapiens
ggcucagguuuugagaagcca

SEQ ID NO: 2216515 - RNA, 13 nt, Homo sapiens
gagcugagugagc

SEQ ID NO: 2216516 - RNA, 21 nt, Homo sapiens
auguaugcuuccagggacaag

SEQ ID NO: 2216517 - RNA, 16 nt, Homo sapiens
cuuaugcaaucuaugu

SEQ ID NO: 2216518 - RNA, 15 nt, Homo sapiens
uuuccuuugcuucaa

SEQ ID NO: 2216519 - RNA, 17 nt, Homo sapiens
auauaguggacaguaac

SEQ ID NO: 2216520 - RNA, 16 nt, Homo sapiens
aacacugcagcccucu

SEQ ID NO: 2216521 - RNA, 13 nt, Homo sapiens
ucaucacuguaaa

SEQ ID NO: 2216522 - RNA, 12 nt, Homo sapiens
uggaucagaaua

SEQ ID NO: 2216523 - RNA, 20 nt, Homo sapiens
uaguauuccagaccugaaga

SEQ ID NO: 2216524 - RNA, 21 nt, Homo sapiens
cuaucuuuuuuuuauuccaca

SEQ ID NO: 2216525 - RNA, 21 nt, Homo sapiens
ggaggcagaggguugcaguga

SEQ ID NO: 2216526 - RNA, 18 nt, Homo sapiens
guaucauucuuuacauau

SEQ ID NO: 2216527 - RNA, 16 nt, Homo sapiens
cucacaagaagaccag

SEQ ID NO: 2216528 - RNA, 22 nt, Homo sapiens
uucuguguggugcauuccugaa

SEQ ID NO: 2216529 - RNA, 14 nt, Homo sapiens
auugucaacuugaa

SEQ ID NO: 2216530 - RNA, 14 nt, Homo sapiens
caaaggaugcguga

SEQ ID NO: 2216531 - RNA, 19 nt, Homo sapiens
agcacauguguaagacacu

SEQ ID NO: 2216532 - RNA, 19 nt, Homo sapiens
agaauaccacaucaaauaa

SEQ ID NO: 2216533 - RNA, 23 nt, Homo sapiens
auaaauagaauguaaaugucuca

SEQ ID NO: 2216534 - RNA, 23 nt, Homo sapiens
cugcaaauauuagcaaagaagcu

SEQ ID NO: 2216535 - RNA, 21 nt, Homo sapiens
uugacuuacauagaugauaaa

SEQ ID NO: 2216536 - RNA, 13 nt, Homo sapiens
agcccagugcaaa

SEQ ID NO: 2216537 - RNA, 17 nt, Homo sapiens
agauuaaacugagugaa

SEQ ID NO: 2216538 - RNA, 15 nt, Homo sapiens
uacacuggaugaaaa

SEQ ID NO: 2216539 - RNA, 23 nt, Homo sapiens
cgugguggccagcagcagcuaca

SEQ ID NO: 2216540 - RNA, 16 nt, Homo sapiens
ugccagggcgcacuuu

SEQ ID NO: 2216541 - RNA, 12 nt, Homo sapiens
ggccgcacuggg

SEQ ID NO: 2216542 - RNA, 17 nt, Homo sapiens
ugggauaguguucugcu

SEQ ID NO: 2216543 - RNA, 21 nt, Homo sapiens
ccugcucucgaggcagcagug

SEQ ID NO: 2216544 - RNA, 15 nt, Homo sapiens
ucagcccagugcaaa

SEQ ID NO: 2216545 - RNA, 23 nt, Homo sapiens
aaacgccuccuucaaaaagcaau

SEQ ID NO: 2216546 - RNA, 20 nt, Homo sapiens
auaaagccuguauucucaaa

SEQ ID NO: 2216547 - RNA, 20 nt, Homo sapiens
caaaaccaaguaucacacuu

SEQ ID NO: 2216548 - RNA, 16 nt, Homo sapiens
acacaaagcucuguca

SEQ ID NO: 2216549 - RNA, 21 nt, Homo sapiens
agcugggcccaccgaggugcu

SEQ ID NO: 2216550 - RNA, 23 nt, Homo sapiens
uuaaacaaacauuguguugacau

SEQ ID NO: 2216551 - RNA, 20 nt, Homo sapiens
ucucaaaacaauauuacuuu

SEQ ID NO: 2216552 - RNA, 16 nt, Homo sapiens
cuggaagcagagcaaa

SEQ ID NO: 2216553 - RNA, 20 nt, Homo sapiens
auccaaugaagaaggucuca

SEQ ID NO: 2216554 - RNA, 11 nt, Homo sapiens
gaaugacaaag

SEQ ID NO: 2216555 - RNA, 15 nt, Homo sapiens
cagaaauggacugga

SEQ ID NO: 2216556 - RNA, 14 nt, Homo sapiens
ccuuguaucuugca

SEQ ID NO: 2216557 - RNA, 15 nt, Homo sapiens
cugacuuugugaucc

SEQ ID NO: 2216558 - RNA, 13 nt, Homo sapiens
cucagugccacaa

SEQ ID NO: 2216559 - RNA, 15 nt, Homo sapiens
cuuagaguguagcug

SEQ ID NO: 2216560 - RNA, 22 nt, Homo sapiens
gcucagcccugcaccaugcugc

SEQ ID NO: 2216561 - RNA, 22 nt, Homo sapiens
aagacccucucaggcuguccca

SEQ ID NO: 2216562 - RNA, 15 nt, Homo sapiens
ugaguaacauuugcu

SEQ ID NO: 2216563 - RNA, 18 nt, Homo sapiens
gccuguguacugccuuaa

SEQ ID NO: 2216564 - RNA, 22 nt, Homo sapiens
ugaagacuucuagcagaaaaau

SEQ ID NO: 2216565 - RNA, 16 nt, Homo sapiens
gcgcagugcuguccaa

SEQ ID NO: 2216566 - RNA, 21 nt, Homo sapiens
cuucucucggggcgaccccuc

SEQ ID NO: 2216567 - RNA, 20 nt, Homo sapiens
uugauaucucgaacuuucaa

SEQ ID NO: 2216568 - RNA, 21 nt, Homo sapiens
ggccacucccugccaacucca

SEQ ID NO: 2216569 - RNA, 18 nt, Homo sapiens
agcagaaaagaugaauuu

SEQ ID NO: 2216570 - RNA, 18 nt, Homo sapiens
aucucaauacagccugaa

SEQ ID NO: 2216571 - RNA, 22 nt, Homo sapiens
cucugagucagugguuauuuga

SEQ ID NO: 2216572 - RNA, 16 nt, Homo sapiens
gcauuguugaugcuca

SEQ ID NO: 2216573 - RNA, 16 nt, Homo sapiens
acagcaccugagaaga

SEQ ID NO: 2216574 - RNA, 20 nt, Homo sapiens
agauuuaacaccccacaggc

SEQ ID NO: 2216575 - RNA, 13 nt, Homo sapiens
gccagucccucag

SEQ ID NO: 2216576 - RNA, 21 nt, Homo sapiens
agugaggaagccuauuugaac

SEQ ID NO: 2216577 - RNA, 18 nt, Homo sapiens
gacacuaccacuccccau

SEQ ID NO: 2216578 - RNA, 17 nt, Homo sapiens
uggcagcuagugccuuu

SEQ ID NO: 2216579 - RNA, 21 nt, Homo sapiens
guggagcacaaaagccucuca

SEQ ID NO: 2216580 - RNA, 19 nt, Homo sapiens
acuacagccugccccugac

SEQ ID NO: 2216581 - RNA, 17 nt, Homo sapiens
uguggcucacgugagag

SEQ ID NO: 2216582 - RNA, 18 nt, Homo sapiens
ccuggccauccaugugau

SEQ ID NO: 2216583 - RNA, 23 nt, Homo sapiens
uuuucauccaggcucccaaaaga

SEQ ID NO: 2216584 - RNA, 23 nt, Homo sapiens
gcgacagagugaccagaaacccu

SEQ ID NO: 2216585 - RNA, 18 nt, Homo sapiens
auuugccaagaccauuuc

SEQ ID NO: 2216586 - RNA, 14 nt, Homo sapiens
uuccucugauuuga

SEQ ID NO: 2216587 - RNA, 15 nt, Homo sapiens
gggacauuccaaaga

SEQ ID NO: 2216588 - RNA, 23 nt, Homo sapiens
agacuuggcuccaccacugauau

SEQ ID NO: 2216589 - RNA, 15 nt, Homo sapiens
gaguggucacuguca

SEQ ID NO: 2216590 - RNA, 16 nt, Homo sapiens
gaaagaaaauuuaaua

SEQ ID NO: 2216591 - RNA, 21 nt, Homo sapiens
gcaucuggguagcuguaaggc

SEQ ID NO: 2216592 - RNA, 14 nt, Homo sapiens
uguaguugaauauu

SEQ ID NO: 2216593 - RNA, 19 nt, Homo sapiens
gcccugacggacuucauuc

SEQ ID NO: 2216594 - RNA, 20 nt, Homo sapiens
accuaaauggccucaugugg

SEQ ID NO: 2216595 - RNA, 18 nt, Homo sapiens
uuggaagguggguucugc

SEQ ID NO: 2216596 - RNA, 23 nt, Homo sapiens
acaggugugcagauuuuggccau

SEQ ID NO: 2216597 - RNA, 21 nt, Homo sapiens
ugaaucaugagccugcuggaa

SEQ ID NO: 2216598 - RNA, 21 nt, Homo sapiens
ccaccugugcccucaccacca

SEQ ID NO: 2216599 - RNA, 11 nt, Homo sapiens
ugggcuucuag

SEQ ID NO: 2216600 - RNA, 13 nt, Homo sapiens
uguuugcacuuug

SEQ ID NO: 2216601 - RNA, 13 nt, Homo sapiens
caggaaugcucug

SEQ ID NO: 2216602 - RNA, 15 nt, Homo sapiens
ucaguaaauguuugu

SEQ ID NO: 2216603 - RNA, 18 nt, Homo sapiens
ggcacagucuccaugugu

SEQ ID NO: 2216604 - RNA, 16 nt, Homo sapiens
aggaucuuugacugaa

SEQ ID NO: 2216605 - RNA, 15 nt, Homo sapiens
ugagcacuaaaggaa

SEQ ID NO: 2216606 - RNA, 22 nt, Homo sapiens
cuagggaauuccugcuaugaca

SEQ ID NO: 2216607 - RNA, 16 nt, Homo sapiens
uggauuagaccaauua

SEQ ID NO: 2216608 - RNA, 13 nt, Homo sapiens
caaaaaacuacuu

SEQ ID NO: 2216609 - RNA, 12 nt, Homo sapiens
cgcuagcauuag

SEQ ID NO: 2216610 - RNA, 19 nt, Homo sapiens
ucauguaccucagaucucu

SEQ ID NO: 2216611 - RNA, 19 nt, Homo sapiens
aguucugacuuugaauuua

SEQ ID NO: 2216612 - RNA, 19 nt, Homo sapiens
uuauuaagcacguauuuau

SEQ ID NO: 2216613 - RNA, 11 nt, Homo sapiens
uguucaucuca

SEQ ID NO: 2216614 - RNA, 12 nt, Homo sapiens
guuugcagagua

SEQ ID NO: 2216615 - RNA, 10 nt, Homo sapiens
aaacuggaag

SEQ ID NO: 2216616 - RNA, 19 nt, Homo sapiens
acguggaugaagcagagag

SEQ ID NO: 2216617 - RNA, 18 nt, Homo sapiens
ugaauaccacuuaccuca

SEQ ID NO: 2216618 - RNA, 15 nt, Homo sapiens
ugccugugugagcau

SEQ ID NO: 2216619 - RNA, 14 nt, Homo sapiens
acacacgcagacac

SEQ ID NO: 2216620 - RNA, 15 nt, Homo sapiens
cuguggcuucuuaau

SEQ ID NO: 2216621 - RNA, 12 nt, Homo sapiens
uggcuugaaccu

SEQ ID NO: 2216622 - RNA, 11 nt, Homo sapiens
ugagauuccag

SEQ ID NO: 2216623 - RNA, 17 nt, Homo sapiens
gagccccccacaaugau

SEQ ID NO: 2216624 - RNA, 23 nt, Homo sapiens
caggauuauucccaccugccaca

SEQ ID NO: 2216625 - RNA, 13 nt, Homo sapiens
cugagggugggag

SEQ ID NO: 2216626 - RNA, 19 nt, Homo sapiens
gcuucuuugaaacuuguau

SEQ ID NO: 2216627 - RNA, 14 nt, Homo sapiens
uuugccaguauuau

SEQ ID NO: 2216628 - RNA, 23 nt, Homo sapiens
cacugaguagucauuuugcccau

SEQ ID NO: 2216629 - RNA, 21 nt, Homo sapiens
cuuugggugccuuugccacaa

SEQ ID NO: 2216630 - RNA, 14 nt, Homo sapiens
gcuuaguucuugaa

SEQ ID NO: 2216631 - RNA, 16 nt, Homo sapiens
uacaguucugucauau

SEQ ID NO: 2216632 - RNA, 16 nt, Homo sapiens
acaacaugcacauuca

SEQ ID NO: 2216633 - RNA, 19 nt, Homo sapiens
cccaaagugcugagauuau

SEQ ID NO: 2216634 - RNA, 18 nt, Homo sapiens
cuuuagcuguacuguaau

SEQ ID NO: 2216635 - RNA, 18 nt, Homo sapiens
gcauaguaccucugcuau

SEQ ID NO: 2216636 - RNA, 20 nt, Homo sapiens
aucuuugacaauucugggug

SEQ ID NO: 2216637 - RNA, 14 nt, Homo sapiens
gauaacugcaauuu

SEQ ID NO: 2216638 - RNA, 22 nt, Homo sapiens
gcuccaguauggaagaaugggg

SEQ ID NO: 2216639 - RNA, 18 nt, Homo sapiens
cagcaugcaaacuuggau

SEQ ID NO: 2216640 - RNA, 17 nt, Homo sapiens
auaaacgguuaacaaua

SEQ ID NO: 2216641 - RNA, 15 nt, Homo sapiens
gcagucccacacugu

SEQ ID NO: 2216642 - RNA, 19 nt, Homo sapiens
acacugaauuuuuaugugu

SEQ ID NO: 2216643 - RNA, 21 nt, Homo sapiens
cuuggaggcccugcacugcca

SEQ ID NO: 2216644 - RNA, 17 nt, Homo sapiens
acuaggaauucuuugca

SEQ ID NO: 2216645 - RNA, 22 nt, Homo sapiens
uuuguucuuaaaaaugcauuua

SEQ ID NO: 2216646 - RNA, 20 nt, Homo sapiens
uaauaaauguuaaagccaga

SEQ ID NO: 2216647 - RNA, 12 nt, Homo sapiens
ucucacagagaa

SEQ ID NO: 2216648 - RNA, 22 nt, Homo sapiens
aguaacccaaaucuuguuuaca

SEQ ID NO: 2216649 - RNA, 17 nt, Homo sapiens
cucccuggggggaggca

SEQ ID NO: 2216650 - RNA, 22 nt, Homo sapiens
ccagccaccccgggcucucugc

SEQ ID NO: 2216651 - RNA, 19 nt, Homo sapiens
ccaccaguugaauuucauc

SEQ ID NO: 2216652 - RNA, 13 nt, Homo sapiens
uacugaagggaac

SEQ ID NO: 2216653 - RNA, 18 nt, Homo sapiens
cuuuuggucccauccucu

SEQ ID NO: 2216654 - RNA, 15 nt, Homo sapiens
cagagcucucugagg

SEQ ID NO: 2216655 - RNA, 23 nt, Homo sapiens
uuggcaauaaauaaagcuuggga

SEQ ID NO: 2216656 - RNA, 15 nt, Homo sapiens
acaacuccacugucu

SEQ ID NO: 2216657 - RNA, 12 nt, Homo sapiens
ugaaauaugcau

SEQ ID NO: 2216658 - RNA, 11 nt, Homo sapiens
accagaggcag

SEQ ID NO: 2216659 - RNA, 18 nt, Homo sapiens
aaauuagacaaccaagua

SEQ ID NO: 2216660 - RNA, 12 nt, Homo sapiens
uuuaacacuuuc

SEQ ID NO: 2216661 - RNA, 17 nt, Homo sapiens
caggugcgugccaccac

SEQ ID NO: 2216662 - RNA, 17 nt, Homo sapiens
uggauugcagacucaug

SEQ ID NO: 2216663 - RNA, 16 nt, Homo sapiens
cucuucccuuccucca

SEQ ID NO: 2216664 - RNA, 20 nt, Homo sapiens
ccauuuuuacauccaugaaa

SEQ ID NO: 2216665 - RNA, 15 nt, Homo sapiens
cauuuuauaucugga

SEQ ID NO: 2216666 - RNA, 20 nt, Homo sapiens
caucccagccuuggcaucua

SEQ ID NO: 2216667 - RNA, 14 nt, Homo sapiens
cgugagcaccacca

SEQ ID NO: 2216668 - RNA, 17 nt, Homo sapiens
aauaaguuuucagugga

SEQ ID NO: 2216669 - RNA, 18 nt, Homo sapiens
gcuccugccacugaccuc

SEQ ID NO: 2216670 - RNA, 20 nt, Homo sapiens
aaacugcaaagcucggugcu

SEQ ID NO: 2216671 - RNA, 16 nt, Homo sapiens
cuaccaguugcccuag

SEQ ID NO: 2216672 - RNA, 18 nt, Homo sapiens
cugauuugauaccauggc

SEQ ID NO: 2216673 - RNA, 11 nt, Homo sapiens
cucaagacuga

SEQ ID NO: 2216674 - RNA, 12 nt, Homo sapiens
uucagacucuca

SEQ ID NO: 2216675 - RNA, 14 nt, Homo sapiens
aaguaauaucuuuc

SEQ ID NO: 2216676 - RNA, 20 nt, Homo sapiens
uaauccuucucauuacccac

SEQ ID NO: 2216677 - RNA, 14 nt, Homo sapiens
ggaggccauugugu

SEQ ID NO: 2216678 - RNA, 17 nt, Homo sapiens
uuguauagaaccucuuu

SEQ ID NO: 2216679 - RNA, 21 nt, Homo sapiens
ggccaaugggcuagagggugc

SEQ ID NO: 2216680 - RNA, 14 nt, Homo sapiens
ugguacagcacugu

SEQ ID NO: 2216681 - RNA, 13 nt, Homo sapiens
ugauuuucuccau

SEQ ID NO: 2216682 - RNA, 15 nt, Homo sapiens
auaaagggugccagg

SEQ ID NO: 2216683 - RNA, 13 nt, Homo sapiens
ucuuggggccacu

SEQ ID NO: 2216684 - RNA, 20 nt, Homo sapiens
ugaugugagcuuggacuugc

SEQ ID NO: 2216685 - RNA, 16 nt, Homo sapiens
aaacguccuacuguau

SEQ ID NO: 2216686 - RNA, 19 nt, Homo sapiens
acuuuuuuagaaaugcaaa

SEQ ID NO: 2216687 - RNA, 16 nt, Homo sapiens
cagcacagguauuuca

SEQ ID NO: 2216688 - RNA, 17 nt, Homo sapiens
cuuccggcuuauggucu

SEQ ID NO: 2216689 - RNA, 15 nt, Homo sapiens
gcuuauaugugacac

SEQ ID NO: 2216690 - RNA, 16 nt, Homo sapiens
caaccugacuuccucu

SEQ ID NO: 2216691 - RNA, 22 nt, Homo sapiens
acagcugguguagcuacagaga

SEQ ID NO: 2216692 - RNA, 15 nt, Homo sapiens
aagaaagaaaccaga

SEQ ID NO: 2216693 - RNA, 15 nt, Homo sapiens
gugcggaucucugga

SEQ ID NO: 2216694 - RNA, 23 nt, Homo sapiens
ucuuggggggguggccgcugagu

SEQ ID NO: 2216695 - RNA, 15 nt, Homo sapiens
aauacaaguaauauu

SEQ ID NO: 2216696 - RNA, 16 nt, Homo sapiens
auuccauccucaacac

SEQ ID NO: 2216697 - RNA, 16 nt, Homo sapiens
gcaaauuuucuuccau

SEQ ID NO: 2216698 - RNA, 23 nt, Homo sapiens
ggaguaguugcuacucuucagaa

SEQ ID NO: 2216699 - RNA, 19 nt, Homo sapiens
auaacuuacaagacuguaa

SEQ ID NO: 2216700 - RNA, 15 nt, Homo sapiens
accucuuaugcacac

SEQ ID NO: 2216701 - RNA, 15 nt, Homo sapiens
uaauucuacccugaa

SEQ ID NO: 2216702 - RNA, 23 nt, Homo sapiens
aguuacgaguuuucccucaguga

SEQ ID NO: 2216703 - RNA, 14 nt, Homo sapiens
cauccaggcugccc

SEQ ID NO: 2216704 - RNA, 23 nt, Homo sapiens
cccuucaucuuccuguguccuga

SEQ ID NO: 2216705 - RNA, 18 nt, Homo sapiens
aauuccaacucacuuuuu

SEQ ID NO: 2216706 - RNA, 18 nt, Homo sapiens
ggcguuuuuauaguuuau

SEQ ID NO: 2216707 - RNA, 11 nt, Homo sapiens
cuuuguuaaaa

SEQ ID NO: 2216708 - RNA, 17 nt, Homo sapiens
ccacugccagacaugcc

SEQ ID NO: 2216709 - RNA, 15 nt, Homo sapiens
ugcacaccagugucg

SEQ ID NO: 2216710 - RNA, 13 nt, Homo sapiens
gcccuacucaccu

SEQ ID NO: 2216711 - RNA, 12 nt, Homo sapiens
cacugccucaug

SEQ ID NO: 2216712 - RNA, 20 nt, Homo sapiens
uguucugguuacuguucuaa

SEQ ID NO: 2216713 - RNA, 15 nt, Homo sapiens
cagagauguuaucaa

SEQ ID NO: 2216714 - RNA, 21 nt, Homo sapiens
gaaguuuaaaacaguauuuau

SEQ ID NO: 2216715 - RNA, 17 nt, Homo sapiens
aguuuuaaguaugucua

SEQ ID NO: 2216716 - RNA, 17 nt, Homo sapiens
ccugccgagugcucuga

SEQ ID NO: 2216717 - RNA, 17 nt, Homo sapiens
ucuuaaaaguacuuuaa

SEQ ID NO: 2216718 - RNA, 16 nt, Homo sapiens
uaguaaauuuucaaac

SEQ ID NO: 2216719 - RNA, 23 nt, Homo sapiens
gaaucuucaccucagaguggagu

SEQ ID NO: 2216720 - RNA, 13 nt, Homo sapiens
gaagguugcaccu

SEQ ID NO: 2216721 - RNA, 23 nt, Homo sapiens
acacuggcuuuggguagugccau

SEQ ID NO: 2216722 - RNA, 20 nt, Homo sapiens
ccucgagaucccaacacugc

SEQ ID NO: 2216723 - RNA, 19 nt, Homo sapiens
augaucgagccacugcacu

SEQ ID NO: 2216724 - RNA, 13 nt, Homo sapiens
caaaaugugaacu

SEQ ID NO: 2216725 - RNA, 15 nt, Homo sapiens
ggaccauuccaggaa

SEQ ID NO: 2216726 - RNA, 14 nt, Homo sapiens
ucugauuuguccug

SEQ ID NO: 2216727 - RNA, 17 nt, Homo sapiens
ccccaucugccccacag

SEQ ID NO: 2216728 - RNA, 16 nt, Homo sapiens
cuguugaggguccuca

SEQ ID NO: 2216729 - RNA, 15 nt, Homo sapiens
acaguugggaaaaua

SEQ ID NO: 2216730 - RNA, 14 nt, Homo sapiens
acuucugcagcuau

SEQ ID NO: 2216731 - RNA, 23 nt, Homo sapiens
accaaaucuucuccuaugcauuu

SEQ ID NO: 2216732 - RNA, 16 nt, Homo sapiens
acuuuguuuauuguaa

SEQ ID NO: 2216733 - RNA, 16 nt, Homo sapiens
aacaguuuuccaugaa

SEQ ID NO: 2216734 - RNA, 22 nt, Homo sapiens
ugaaagaggacguguuacccac

SEQ ID NO: 2216735 - RNA, 18 nt, Homo sapiens
ggaaccucacucuugcca

SEQ ID NO: 2216736 - RNA, 22 nt, Homo sapiens
aauaaagcaacagacuucucaa

SEQ ID NO: 2216737 - RNA, 17 nt, Homo sapiens
accauuggaaacauuua

SEQ ID NO: 2216738 - RNA, 13 nt, Homo sapiens
cuuugaaauucau

SEQ ID NO: 2216739 - RNA, 14 nt, Homo sapiens
auugguaugaugcu

SEQ ID NO: 2216740 - RNA, 16 nt, Homo sapiens
gagugcaguggcgcga

SEQ ID NO: 2216741 - RNA, 18 nt, Homo sapiens
gcccccaaccauuuccuc

SEQ ID NO: 2216742 - RNA, 21 nt, Homo sapiens
uccccaaggcugcaaagcaaa

SEQ ID NO: 2216743 - RNA, 14 nt, Homo sapiens
cuggcugcuaacaa

SEQ ID NO: 2216744 - RNA, 16 nt, Homo sapiens
uuaguacuuacaucag

SEQ ID NO: 2216745 - RNA, 16 nt, Homo sapiens
auuuucugcaucucca

SEQ ID NO: 2216746 - RNA, 13 nt, Homo sapiens
cacacucauccac

SEQ ID NO: 2216747 - RNA, 16 nt, Homo sapiens
gucuccuugcacuuuc

SEQ ID NO: 2216748 - RNA, 23 nt, Homo sapiens
ugcagcucuggagguacgaaaag

SEQ ID NO: 2216749 - RNA, 17 nt, Homo sapiens
agguacgaugacagugu

SEQ ID NO: 2216750 - RNA, 12 nt, Homo sapiens
caacaacaugua

SEQ ID NO: 2216751 - RNA, 15 nt, Homo sapiens
ccaagaauauaguua

SEQ ID NO: 2216752 - RNA, 19 nt, Homo sapiens
gcucugccuuacccuggua

SEQ ID NO: 2216753 - RNA, 17 nt, Homo sapiens
cauaagcauaauuuccu

SEQ ID NO: 2216754 - RNA, 20 nt, Homo sapiens
accuucccagcuagaauuca

SEQ ID NO: 2216755 - RNA, 15 nt, Homo sapiens
agcaugugggggaag

SEQ ID NO: 2216756 - RNA, 16 nt, Homo sapiens
agaaagaugacaaaag

SEQ ID NO: 2216757 - RNA, 16 nt, Homo sapiens
agaagguggacagauu

SEQ ID NO: 2216758 - RNA, 19 nt, Homo sapiens
uaagucuguuuuaugacuu

SEQ ID NO: 2216759 - RNA, 19 nt, Homo sapiens
uuccuggaguacaaacaca

SEQ ID NO: 2216760 - RNA, 22 nt, Homo sapiens
ggguuucccuugcccuuuccau

SEQ ID NO: 2216761 - RNA, 17 nt, Homo sapiens
gcuccauucacucccag

SEQ ID NO: 2216762 - RNA, 17 nt, Homo sapiens
ccaaacccuugucagug

SEQ ID NO: 2216763 - RNA, 17 nt, Homo sapiens
guaccccugaggaaaca

SEQ ID NO: 2216764 - RNA, 18 nt, Homo sapiens
cguuggccucagggccag

SEQ ID NO: 2216765 - RNA, 17 nt, Homo sapiens
aaugaccugacuuuuag

SEQ ID NO: 2216766 - RNA, 22 nt, Homo sapiens
uuuucuugaggcagggucucac

SEQ ID NO: 2216767 - RNA, 14 nt, Homo sapiens
uuuaucaaucagua

SEQ ID NO: 2216768 - RNA, 16 nt, Homo sapiens
auaggacauacugcau

SEQ ID NO: 2216769 - RNA, 23 nt, Homo sapiens
aaaucucuuuuugacucuugcaa

SEQ ID NO: 2216770 - RNA, 20 nt, Homo sapiens
acaugaaaugcccuccuaaa

SEQ ID NO: 2216771 - RNA, 14 nt, Homo sapiens
cuuugccacaaagc

SEQ ID NO: 2216772 - RNA, 21 nt, Homo sapiens
gucaagugugccugcuaucca

SEQ ID NO: 2216773 - RNA, 13 nt, Homo sapiens
guuuaucacacag

SEQ ID NO: 2216774 - RNA, 22 nt, Homo sapiens
cagaaaguccccccucgcccca

SEQ ID NO: 2216775 - RNA, 17 nt, Homo sapiens
caaccccuuugcugguu

SEQ ID NO: 2216776 - RNA, 19 nt, Homo sapiens
gaauaaagcccuugaacca

SEQ ID NO: 2216777 - RNA, 13 nt, Homo sapiens
acauuucaucuaa

SEQ ID NO: 2216778 - RNA, 19 nt, Homo sapiens
ucuuuagaaggacucagua

SEQ ID NO: 2216779 - RNA, 11 nt, Homo sapiens
uugggggaaaa

SEQ ID NO: 2216780 - RNA, 13 nt, Homo sapiens
aaaaaucaauaaa

SEQ ID NO: 2216781 - RNA, 13 nt, Homo sapiens
cauuuucacuuuu

SEQ ID NO: 2216782 - RNA, 16 nt, Homo sapiens
aguuaauccacuguga

SEQ ID NO: 2216783 - RNA, 12 nt, Homo sapiens
aaaacagacugu

SEQ ID NO: 2216784 - RNA, 14 nt, Homo sapiens
aucagccaugugcu

SEQ ID NO: 2216785 - RNA, 21 nt, Homo sapiens
uugaucuucagggaacugcau

SEQ ID NO: 2216786 - RNA, 14 nt, Homo sapiens
uaaaauauuacaca

SEQ ID NO: 2216787 - RNA, 18 nt, Homo sapiens
acugcugcucucccaagg

SEQ ID NO: 2216788 - RNA, 21 nt, Homo sapiens
uuccuucuggccucugcugaa

SEQ ID NO: 2216789 - RNA, 18 nt, Homo sapiens
uucaaaauauacauucaa

SEQ ID NO: 2216790 - RNA, 19 nt, Homo sapiens
uccuagcucucccagugaa

SEQ ID NO: 2216791 - RNA, 21 nt, Homo sapiens
uugcacacuccccugcacugg

SEQ ID NO: 2216792 - RNA, 18 nt, Homo sapiens
uaaauagccaacacccau

SEQ ID NO: 2216793 - RNA, 20 nt, Homo sapiens
uuaucaucucgaccacuuuu

SEQ ID NO: 2216794 - RNA, 20 nt, Homo sapiens
cagcuaugcaaaucagucuc

SEQ ID NO: 2216795 - RNA, 19 nt, Homo sapiens
gacccuucaucucuuacuu

SEQ ID NO: 2216796 - RNA, 18 nt, Homo sapiens
cucucagaccgucuuccu

SEQ ID NO: 2216797 - RNA, 21 nt, Homo sapiens
uguuggcagcauaaaggccuu

SEQ ID NO: 2216798 - RNA, 20 nt, Homo sapiens
caaucuuugccuuuaucucu

SEQ ID NO: 2216799 - RNA, 19 nt, Homo sapiens
gcuuguccugcucucuuca

SEQ ID NO: 2216800 - RNA, 13 nt, Homo sapiens
ucuuaguucucac

SEQ ID NO: 2216801 - RNA, 14 nt, Homo sapiens
augcagaagaggga

SEQ ID NO: 2216802 - RNA, 14 nt, Homo sapiens
ugagagagacaaga

SEQ ID NO: 2216803 - RNA, 18 nt, Homo sapiens
aacuucuuuccucuggag

SEQ ID NO: 2216804 - RNA, 18 nt, Homo sapiens
cugaaacuuugaggauaa

SEQ ID NO: 2216805 - RNA, 21 nt, Homo sapiens
cugcugcccccaccccgggga

SEQ ID NO: 2216806 - RNA, 12 nt, Homo sapiens
ugcagacgggaa

SEQ ID NO: 2216807 - RNA, 13 nt, Homo sapiens
aagucagcaacag

SEQ ID NO: 2216808 - RNA, 22 nt, Homo sapiens
gugagcgaagcccccacuacua

SEQ ID NO: 2216809 - RNA, 19 nt, Homo sapiens
auauccauaagauuugcaa

SEQ ID NO: 2216810 - RNA, 22 nt, Homo sapiens
guaaaauaaucaguguuuccaa

SEQ ID NO: 2216811 - RNA, 15 nt, Homo sapiens
agguacacacuuuca

SEQ ID NO: 2216812 - RNA, 16 nt, Homo sapiens
auacuguauuuuuacc

SEQ ID NO: 2216813 - RNA, 21 nt, Homo sapiens
ucuugcaguaucggcacugua

SEQ ID NO: 2216814 - RNA, 20 nt, Homo sapiens
uggaggcucucuugugcauu

SEQ ID NO: 2216815 - RNA, 19 nt, Homo sapiens
uuuuguucucaacuucaaa

SEQ ID NO: 2216816 - RNA, 19 nt, Homo sapiens
cccaggcggucacugccca

SEQ ID NO: 2216817 - RNA, 23 nt, Homo sapiens
ggacuaucaacaccacuaggaau

SEQ ID NO: 2216818 - RNA, 17 nt, Homo sapiens
guguugccuccuaccuu

SEQ ID NO: 2216819 - RNA, 14 nt, Homo sapiens
ccacaaaucuucag

SEQ ID NO: 2216820 - RNA, 22 nt, Homo sapiens
uaagcauuuugguuggauuucu

SEQ ID NO: 2216821 - RNA, 18 nt, Homo sapiens
ccagggcuugugugcaca

SEQ ID NO: 2216822 - RNA, 20 nt, Homo sapiens
guucguucuguacuguuacu

SEQ ID NO: 2216823 - RNA, 12 nt, Homo sapiens
uuccuuagcuua

SEQ ID NO: 2216824 - RNA, 12 nt, Homo sapiens
gcugagugacac

SEQ ID NO: 2216825 - RNA, 18 nt, Homo sapiens
ggacucaagcaagauuuc

SEQ ID NO: 2216826 - RNA, 22 nt, Homo sapiens
ggcauucucucugcucagugau

SEQ ID NO: 2216827 - RNA, 23 nt, Homo sapiens
cccaggcuggagugcagugccac

SEQ ID NO: 2216828 - RNA, 21 nt, Homo sapiens
ggugaaccacuucauucugca

SEQ ID NO: 2216829 - RNA, 14 nt, Homo sapiens
acuccuuacagaag

SEQ ID NO: 2216830 - RNA, 18 nt, Homo sapiens
uccuguugagauggggga

SEQ ID NO: 2216831 - RNA, 17 nt, Homo sapiens
ugcuuuguaugcacuuu

SEQ ID NO: 2216832 - RNA, 18 nt, Homo sapiens
agaaugugcagugucuug

SEQ ID NO: 2216833 - RNA, 19 nt, Homo sapiens
cuggggcaggucacuuuac

SEQ ID NO: 2216834 - RNA, 13 nt, Homo sapiens
gggcggccagugc

SEQ ID NO: 2216835 - RNA, 19 nt, Homo sapiens
uaugaagaaagauacuaau

SEQ ID NO: 2216836 - RNA, 22 nt, Homo sapiens
aaggagaaaaagacagcgauaa

SEQ ID NO: 2216837 - RNA, 19 nt, Homo sapiens
cauaaaugaagcagcuuua

SEQ ID NO: 2216838 - RNA, 17 nt, Homo sapiens
caggugguggcacugag

SEQ ID NO: 2216839 - RNA, 15 nt, Homo sapiens
ggagucggagccacu

SEQ ID NO: 2216840 - RNA, 15 nt, Homo sapiens
auaauucccuaucuu

SEQ ID NO: 2216841 - RNA, 14 nt, Homo sapiens
cugaucccuuccac

SEQ ID NO: 2216842 - RNA, 14 nt, Homo sapiens
ucaagaucacgcca

SEQ ID NO: 2216843 - RNA, 16 nt, Homo sapiens
aguugaccguuuucau

SEQ ID NO: 2216844 - RNA, 17 nt, Homo sapiens
uuaaaaucacuauugaa

SEQ ID NO: 2216845 - RNA, 17 nt, Homo sapiens
acuggaacggugaaggu

SEQ ID NO: 2216846 - RNA, 22 nt, Homo sapiens
ucggcauguggaggaaggcagc

SEQ ID NO: 2216847 - RNA, 20 nt, Homo sapiens
cugaaguuauaaacuuauaa

SEQ ID NO: 2216848 - RNA, 22 nt, Homo sapiens
ugugugugcauguaugugcaca

SEQ ID NO: 2216849 - RNA, 13 nt, Homo sapiens
uauguagcaguau

SEQ ID NO: 2216850 - RNA, 14 nt, Homo sapiens
cuuagaaaaaccac

SEQ ID NO: 2216851 - RNA, 23 nt, Homo sapiens
agucugggcuacgguuccauguu

SEQ ID NO: 2216852 - RNA, 14 nt, Homo sapiens
gcuauuuucauuua

SEQ ID NO: 2216853 - RNA, 19 nt, Homo sapiens
gugagcucaggccuaggug

SEQ ID NO: 2216854 - RNA, 16 nt, Homo sapiens
ggccuaugacccugug

SEQ ID NO: 2216855 - RNA, 23 nt, Homo sapiens
aagguuuuauaaggcugauguca

SEQ ID NO: 2216856 - RNA, 14 nt, Homo sapiens
auggacacacaguc

SEQ ID NO: 2216857 - RNA, 23 nt, Homo sapiens
ccugccugcgggggaguggggga

SEQ ID NO: 2216858 - RNA, 23 nt, Homo sapiens
accucuaguaaauuuaaguccac

SEQ ID NO: 2216859 - RNA, 20 nt, Homo sapiens
uaaucugauguauaauguaa

SEQ ID NO: 2216860 - RNA, 21 nt, Homo sapiens
acucacucucccccuccucuu

SEQ ID NO: 2216861 - RNA, 19 nt, Homo sapiens
auaucaaauccaggacuuu

SEQ ID NO: 2216862 - RNA, 14 nt, Homo sapiens
ugaaaucagugccu

SEQ ID NO: 2216863 - RNA, 17 nt, Homo sapiens
uugcacuuaugauuuca

SEQ ID NO: 2216864 - RNA, 17 nt, Homo sapiens
uuugcagcugugagaag

SEQ ID NO: 2216865 - RNA, 17 nt, Homo sapiens
ccaguuuuuuguuguua

SEQ ID NO: 2216866 - RNA, 18 nt, Homo sapiens
gcuugggaagacuccuag

SEQ ID NO: 2216867 - RNA, 14 nt, Homo sapiens
ccugaaucugugca

SEQ ID NO: 2216868 - RNA, 19 nt, Homo sapiens
accuucugguaucuuguua

SEQ ID NO: 2216869 - RNA, 20 nt, Homo sapiens
acaagaagacccauccugaa

SEQ ID NO: 2216870 - RNA, 21 nt, Homo sapiens
caagagugggcuuuccagggu

SEQ ID NO: 2216871 - RNA, 22 nt, Homo sapiens
aaugguccacacccaauuccac

SEQ ID NO: 2216872 - RNA, 16 nt, Homo sapiens
gauugagcuacuucag

SEQ ID NO: 2216873 - RNA, 17 nt, Homo sapiens
caugccuggauggggcu

SEQ ID NO: 2216874 - RNA, 13 nt, Homo sapiens
aaauuccacucau

SEQ ID NO: 2216875 - RNA, 16 nt, Homo sapiens
cuccaccccaggguca

SEQ ID NO: 2216876 - RNA, 15 nt, Homo sapiens
ccaauccuuuccacc

SEQ ID NO: 2216877 - RNA, 14 nt, Homo sapiens
cagcgaugugucac

SEQ ID NO: 2216878 - RNA, 16 nt, Homo sapiens
uuguuggucuguagca

SEQ ID NO: 2216879 - RNA, 19 nt, Homo sapiens
ucaccugaauaagggacuu

SEQ ID NO: 2216880 - RNA, 15 nt, Homo sapiens
gaacaugcccacaac

SEQ ID NO: 2216881 - RNA, 17 nt, Homo sapiens
gaacuaaaaagagacug

SEQ ID NO: 2216882 - RNA, 13 nt, Homo sapiens
accuauacauuau

SEQ ID NO: 2216883 - RNA, 15 nt, Homo sapiens
cuaaggaggggaaaa

SEQ ID NO: 2216884 - RNA, 20 nt, Homo sapiens
gcugaaaaauauagccuuua

SEQ ID NO: 2216885 - RNA, 14 nt, Homo sapiens
ucauuugaugcuaa

SEQ ID NO: 2216886 - RNA, 15 nt, Homo sapiens
agccugcugcucuca

SEQ ID NO: 2216887 - RNA, 12 nt, Homo sapiens
agucuaaaccaa

SEQ ID NO: 2216888 - RNA, 16 nt, Homo sapiens
cacugagucucaugga

SEQ ID NO: 2216889 - RNA, 18 nt, Homo sapiens
gaaauuaucauugguaaa

SEQ ID NO: 2216890 - RNA, 22 nt, Homo sapiens
acuucuagagggagaagacugu

SEQ ID NO: 2216891 - RNA, 20 nt, Homo sapiens
caguagcuaaagugcaagac

SEQ ID NO: 2216892 - RNA, 21 nt, Homo sapiens
ucuucaggguguuaaggcagu

SEQ ID NO: 2216893 - RNA, 14 nt, Homo sapiens
auuugaaaugucau

SEQ ID NO: 2216894 - RNA, 18 nt, Homo sapiens
uucaacauguaccucacc

SEQ ID NO: 2216895 - RNA, 18 nt, Homo sapiens
cuuacugcuuaauucaaa

SEQ ID NO: 2216896 - RNA, 18 nt, Homo sapiens
gcuggaaauaaaccugga

SEQ ID NO: 2216897 - RNA, 20 nt, Homo sapiens
cuucuccaagucuagcuuuc

SEQ ID NO: 2216898 - RNA, 15 nt, Homo sapiens
gacuggcccuugccc

SEQ ID NO: 2216899 - RNA, 24 nt, Homo sapiens
aauaguaccuaaaauugcaacuuc

SEQ ID NO: 2216900 - RNA, 20 nt, Homo sapiens
ucaggaugacaugugccauu

SEQ ID NO: 2216901 - RNA, 21 nt, Homo sapiens
uuuguaucacacaguauauga

SEQ ID NO: 2216902 - RNA, 22 nt, Homo sapiens
augcagugccggcugccaagac

SEQ ID NO: 2216903 - RNA, 15 nt, Homo sapiens
acaauaaagcaauaa

SEQ ID NO: 2216904 - RNA, 17 nt, Homo sapiens
agcaaaacagacugugu

SEQ ID NO: 2216905 - RNA, 23 nt, Homo sapiens
agacaugcugacuuucauuucuu

SEQ ID NO: 2216906 - RNA, 14 nt, Homo sapiens
aaaucccacaucca

SEQ ID NO: 2216907 - RNA, 14 nt, Homo sapiens
cucacguccaucac

SEQ ID NO: 2216908 - RNA, 13 nt, Homo sapiens
gggcugcuuccca

SEQ ID NO: 2216909 - RNA, 14 nt, Homo sapiens
ccaauacagucuag

SEQ ID NO: 2216910 - RNA, 21 nt, Homo sapiens
uuuaaucauggagcaagagaa

SEQ ID NO: 2216911 - RNA, 15 nt, Homo sapiens
guaagacagugcagu

SEQ ID NO: 2216912 - RNA, 22 nt, Homo sapiens
gccugcaugaaacauguucuca

SEQ ID NO: 2216913 - RNA, 16 nt, Homo sapiens
augccaauacuaguca

SEQ ID NO: 2216914 - RNA, 15 nt, Homo sapiens
uaacuuuauggagua

SEQ ID NO: 2216915 - RNA, 15 nt, Homo sapiens
guuugugaauugauu

SEQ ID NO: 2216916 - RNA, 20 nt, Homo sapiens
cuccacaccuccaaugcugc

SEQ ID NO: 2216917 - RNA, 14 nt, Homo sapiens
acauaaguaccuca

SEQ ID NO: 2216918 - RNA, 16 nt, Homo sapiens
auucuguuacacaaua

SEQ ID NO: 2216919 - RNA, 16 nt, Homo sapiens
auaaaaauacuaugaa

SEQ ID NO: 2216920 - RNA, 21 nt, Homo sapiens
cugacauaaguauuuaauuca

SEQ ID NO: 2216921 - RNA, 13 nt, Homo sapiens
ucagauguauuaa

SEQ ID NO: 2216922 - RNA, 16 nt, Homo sapiens
gcugaagccacacagc

SEQ ID NO: 2216923 - RNA, 21 nt, Homo sapiens
gagggacauagaaucugugac

SEQ ID NO: 2216924 - RNA, 22 nt, Homo sapiens
aucucaggagcuugcaagaagc

SEQ ID NO: 2216925 - RNA, 16 nt, Homo sapiens
aaacaaaaaugauccu

SEQ ID NO: 2216926 - RNA, 23 nt, Homo sapiens
caaggaguaaguacaaauauucc

SEQ ID NO: 2216927 - RNA, 16 nt, Homo sapiens
auacuuaggaggcuua

SEQ ID NO: 2216928 - RNA, 24 nt, Homo sapiens
gaugacacccacccugugccauca

SEQ ID NO: 2216929 - RNA, 14 nt, Homo sapiens
gagugcccccaaca

SEQ ID NO: 2216930 - RNA, 21 nt, Homo sapiens
cauauauuuagccccauuaca

SEQ ID NO: 2216931 - RNA, 15 nt, Homo sapiens
uaauauuuaugcucu

SEQ ID NO: 2216932 - RNA, 12 nt, Homo sapiens
auacaguuauuu

SEQ ID NO: 2216933 - RNA, 13 nt, Homo sapiens
caaacaaugcaga

SEQ ID NO: 2216934 - RNA, 17 nt, Homo sapiens
ccaagaauagcaucugu

SEQ ID NO: 2216935 - RNA, 12 nt, Homo sapiens
cuagaacagcca

SEQ ID NO: 2216936 - RNA, 15 nt, Homo sapiens
augccuaucugacca

SEQ ID NO: 2216937 - RNA, 16 nt, Homo sapiens
gucuugucuccauuug

SEQ ID NO: 2216938 - RNA, 13 nt, Homo sapiens
uucaccagcagca

SEQ ID NO: 2216939 - RNA, 23 nt, Homo sapiens
gggccccccaaaucccagggaag

SEQ ID NO: 2216940 - RNA, 16 nt, Homo sapiens
gucuaaaaacaccaaa

SEQ ID NO: 2216941 - RNA, 16 nt, Homo sapiens
agcucuugugucauug

SEQ ID NO: 2216942 - RNA, 17 nt, Homo sapiens
uauuugaagcaugcucu

SEQ ID NO: 2216943 - RNA, 13 nt, Homo sapiens
aaauaucacaaag

SEQ ID NO: 2216944 - RNA, 22 nt, Homo sapiens
ugcccacguaugugaaacacac

SEQ ID NO: 2216945 - RNA, 17 nt, Homo sapiens
gccaaugaacagcuccu

SEQ ID NO: 2216946 - RNA, 22 nt, Homo sapiens
caugccugccccccucaucuca

SEQ ID NO: 2216947 - RNA, 15 nt, Homo sapiens
accaucacaucccuu

SEQ ID NO: 2216948 - RNA, 16 nt, Homo sapiens
acuucugcaaccccag

SEQ ID NO: 2216949 - RNA, 19 nt, Homo sapiens
cauguaaauguaaacucag

SEQ ID NO: 2216950 - RNA, 20 nt, Homo sapiens
caaagccaagggcaacagau

SEQ ID NO: 2216951 - RNA, 16 nt, Homo sapiens
aucuggcacacucccu

SEQ ID NO: 2216952 - RNA, 16 nt, Homo sapiens
cagaaaauucccauga

SEQ ID NO: 2216953 - RNA, 22 nt, Homo sapiens
cauugaagacccugucucaaaa

SEQ ID NO: 2216954 - RNA, 15 nt, Homo sapiens
gcaugugcggcugaa

SEQ ID NO: 2216955 - RNA, 17 nt, Homo sapiens
acucuaguacugugaau

SEQ ID NO: 2216956 - RNA, 18 nt, Homo sapiens
ucccauguugcaugccua

SEQ ID NO: 2216957 - RNA, 13 nt, Homo sapiens
uauauggccucaa

SEQ ID NO: 2216958 - RNA, 14 nt, Homo sapiens
uucuucuacugcua

SEQ ID NO: 2216959 - RNA, 18 nt, Homo sapiens
acaauccuauuacucuuc

SEQ ID NO: 2216960 - RNA, 18 nt, Homo sapiens
cagugaagggaguggcag

SEQ ID NO: 2216961 - RNA, 19 nt, Homo sapiens
cacaguuguugaaugacug

SEQ ID NO: 2216962 - RNA, 17 nt, Homo sapiens
uggcucuuguccaucug

SEQ ID NO: 2216963 - RNA, 15 nt, Homo sapiens
acagcaggcuuucaa

SEQ ID NO: 2216964 - RNA, 18 nt, Homo sapiens
cauaaagaaaagaugaaa

SEQ ID NO: 2216965 - RNA, 14 nt, Homo sapiens
ggccaaaaugcaga

SEQ ID NO: 2216966 - RNA, 15 nt, Homo sapiens
gcaaauagccacaau

SEQ ID NO: 2216967 - RNA, 14 nt, Homo sapiens
ggcuguaguuacau

SEQ ID NO: 2216968 - RNA, 15 nt, Homo sapiens
auuauugcuguugcu

SEQ ID NO: 2216969 - RNA, 14 nt, Homo sapiens
uuauuacugaacua

SEQ ID NO: 2216970 - RNA, 11 nt, Homo sapiens
cuuuccuccac

SEQ ID NO: 2216971 - RNA, 19 nt, Homo sapiens
aaugggaauuuauaaccca

SEQ ID NO: 2216972 - RNA, 16 nt, Homo sapiens
gucugaguaguggcca

SEQ ID NO: 2216973 - RNA, 23 nt, Homo sapiens
uaaaaaauacacauagcagagua

SEQ ID NO: 2216974 - RNA, 14 nt, Homo sapiens
ugcuggagugcagu

SEQ ID NO: 2216975 - RNA, 15 nt, Homo sapiens
ggcuucaucugucaa

SEQ ID NO: 2216976 - RNA, 14 nt, Homo sapiens
guauaagcacugaa

SEQ ID NO: 2216977 - RNA, 23 nt, Homo sapiens
uagaucuuacaucugcagcucuu

SEQ ID NO: 2216978 - RNA, 13 nt, Homo sapiens
ugucaauaccccu

SEQ ID NO: 2216979 - RNA, 16 nt, Homo sapiens
gucgaaagcucuagaa

SEQ ID NO: 2216980 - RNA, 14 nt, Homo sapiens
uguaaugagcaccu

SEQ ID NO: 2216981 - RNA, 14 nt, Homo sapiens
gaaagaagcaguuu

SEQ ID NO: 2216982 - RNA, 13 nt, Homo sapiens
cucccaugcacac

SEQ ID NO: 2216983 - RNA, 17 nt, Homo sapiens
ugcaaaucaaacauauu

SEQ ID NO: 2216984 - RNA, 23 nt, Homo sapiens
agucccugacucucugugaccug

SEQ ID NO: 2216985 - RNA, 18 nt, Homo sapiens
uacucauugaaaugucac

SEQ ID NO: 2216986 - RNA, 21 nt, Homo sapiens
gaacgagcacuggccagagag

SEQ ID NO: 2216987 - RNA, 16 nt, Homo sapiens
gaggaaaauccaaaag

SEQ ID NO: 2216988 - RNA, 15 nt, Homo sapiens
uguagauaaagcacu

SEQ ID NO: 2216989 - RNA, 18 nt, Homo sapiens
ccugucuguuacacugga

SEQ ID NO: 2216990 - RNA, 13 nt, Homo sapiens
uaccucugagaag

SEQ ID NO: 2216991 - RNA, 15 nt, Homo sapiens
cacugacugucuccu

SEQ ID NO: 2216992 - RNA, 12 nt, Homo sapiens
augagcuuuaca

SEQ ID NO: 2216993 - RNA, 23 nt, Homo sapiens
ccucacuuugcugccccaccauc

SEQ ID NO: 2216994 - RNA, 21 nt, Homo sapiens
uaauguacguuacagcuuuca

SEQ ID NO: 2216995 - RNA, 15 nt, Homo sapiens
gccacauuugauuau

SEQ ID NO: 2216996 - RNA, 23 nt, Homo sapiens
uacucaaggaauuugcauuuagu

SEQ ID NO: 2216997 - RNA, 14 nt, Homo sapiens
auuaaauguugcuu

SEQ ID NO: 2216998 - RNA, 14 nt, Homo sapiens
uaucaaugaagauu

SEQ ID NO: 2216999 - RNA, 23 nt, Homo sapiens
ucucugcccaaguugcucuguau

SEQ ID NO: 2217000 - RNA, 21 nt, Homo sapiens
gcugaggcugaggcacuggcg

SEQ ID NO: 2217001 - RNA, 13 nt, Homo sapiens
gcuccccaaaggg

SEQ ID NO: 2217002 - RNA, 13 nt, Homo sapiens
caucugucuuguc

SEQ ID NO: 2217003 - RNA, 21 nt, Homo sapiens
aaaguucucccugccauccuu

SEQ ID NO: 2217004 - RNA, 12 nt, Homo sapiens
auguucagucac

SEQ ID NO: 2217005 - RNA, 18 nt, Homo sapiens
cugccacuccugacccag

SEQ ID NO: 2217006 - RNA, 17 nt, Homo sapiens
gggcacagcacagccag

SEQ ID NO: 2217007 - RNA, 23 nt, Homo sapiens
ucaucagggggcaugaagcacau

SEQ ID NO: 2217008 - RNA, 22 nt, Homo sapiens
auauacaacuuuggaauuugaa

SEQ ID NO: 2217009 - RNA, 20 nt, Homo sapiens
gcucugguggccacugagcu

SEQ ID NO: 2217010 - RNA, 16 nt, Homo sapiens
augauuuuacucauau

SEQ ID NO: 2217011 - RNA, 19 nt, Homo sapiens
ccugacacugcaauuggca

SEQ ID NO: 2217012 - RNA, 16 nt, Homo sapiens
uaacucaccagccucu

SEQ ID NO: 2217013 - RNA, 15 nt, Homo sapiens
caaccuuguuucuac

SEQ ID NO: 2217014 - RNA, 21 nt, Homo sapiens
ucucaguggcuucaucuguca

SEQ ID NO: 2217015 - RNA, 18 nt, Homo sapiens
ggauguccuacuaucacu

SEQ ID NO: 2217016 - RNA, 19 nt, Homo sapiens
uugugggcuuggaccacga

SEQ ID NO: 2217017 - RNA, 20 nt, Homo sapiens
ugagcagggcccucagagga

SEQ ID NO: 2217018 - RNA, 22 nt, Homo sapiens
gcauuugccugcuucuuuccag

SEQ ID NO: 2217019 - RNA, 20 nt, Homo sapiens
gcuuuccugccuccuugaaa

SEQ ID NO: 2217020 - RNA, 19 nt, Homo sapiens
acaugcuuauuccaugacu

SEQ ID NO: 2217021 - RNA, 20 nt, Homo sapiens
ccucauggaugcuuuggcaa

SEQ ID NO: 2217022 - RNA, 20 nt, Homo sapiens
ccucuuauugggauaucauu

SEQ ID NO: 2217023 - RNA, 16 nt, Homo sapiens
gccccaacuccagggg

SEQ ID NO: 2217024 - RNA, 19 nt, Homo sapiens
ugcuacucaaguagcauuu

SEQ ID NO: 2217025 - RNA, 18 nt, Homo sapiens
ccaacauggcacauguau

SEQ ID NO: 2217026 - RNA, 22 nt, Homo sapiens
aaauugacguacuugcaguuua

SEQ ID NO: 2217027 - RNA, 15 nt, Homo sapiens
agcaccaauuguaca

SEQ ID NO: 2217028 - RNA, 22 nt, Homo sapiens
aggugcuggccucaaacagcca

SEQ ID NO: 2217029 - RNA, 18 nt, Homo sapiens
auuuaaucuuaaucuguu

SEQ ID NO: 2217030 - RNA, 22 nt, Homo sapiens
agaauuccugaagccagaucca

SEQ ID NO: 2217031 - RNA, 20 nt, Homo sapiens
gcuaaaugugaguauuucug

SEQ ID NO: 2217032 - RNA, 16 nt, Homo sapiens
gccuggcuccccacga

SEQ ID NO: 2217033 - RNA, 11 nt, Homo sapiens
gggcugugauc

SEQ ID NO: 2217034 - RNA, 15 nt, Homo sapiens
caguaucuugggcau

SEQ ID NO: 2217035 - RNA, 20 nt, Homo sapiens
aacugccuuauuaaagcaaa

SEQ ID NO: 2217036 - RNA, 21 nt, Homo sapiens
uggggcuuacagaaaugacug

SEQ ID NO: 2217037 - RNA, 13 nt, Homo sapiens
gccaagguaggca

SEQ ID NO: 2217038 - RNA, 15 nt, Homo sapiens
uguaaucaacauucc

SEQ ID NO: 2217039 - RNA, 16 nt, Homo sapiens
ggagaaccugguugca

SEQ ID NO: 2217040 - RNA, 19 nt, Homo sapiens
uucaccaggaccaguucac

SEQ ID NO: 2217041 - RNA, 12 nt, Homo sapiens
ugggcuguaaag

SEQ ID NO: 2217042 - RNA, 20 nt, Homo sapiens
acccaaagggcuuauugacu

SEQ ID NO: 2217043 - RNA, 24 nt, Homo sapiens
ggcccaggaagcccacacuaugca

SEQ ID NO: 2217044 - RNA, 14 nt, Homo sapiens
caucaaaaagaaca

SEQ ID NO: 2217045 - RNA, 19 nt, Homo sapiens
acagucuaacaaauuccaa

SEQ ID NO: 2217046 - RNA, 13 nt, Homo sapiens
ccuuggcugugag

SEQ ID NO: 2217047 - RNA, 17 nt, Homo sapiens
cauugucguuucauuca

SEQ ID NO: 2217048 - RNA, 23 nt, Homo sapiens
gagggguguccgagaggcuggug

SEQ ID NO: 2217049 - RNA, 19 nt, Homo sapiens
acugaauuagggugggcuc

SEQ ID NO: 2217050 - RNA, 14 nt, Homo sapiens
cauagggauugucc

SEQ ID NO: 2217051 - RNA, 22 nt, Homo sapiens
cauaagcucaguaacugugcau

SEQ ID NO: 2217052 - RNA, 16 nt, Homo sapiens
ccugucccauucuaga

SEQ ID NO: 2217053 - RNA, 15 nt, Homo sapiens
auucacaaaugggau

SEQ ID NO: 2217054 - RNA, 16 nt, Homo sapiens
auauuucccugaaaua

SEQ ID NO: 2217055 - RNA, 23 nt, Homo sapiens
ugaaaccuuaguuucaagagucu

SEQ ID NO: 2217056 - RNA, 21 nt, Homo sapiens
cuauggguggggcacuccuuu

SEQ ID NO: 2217057 - RNA, 15 nt, Homo sapiens
ugaaaagcaauacaa

SEQ ID NO: 2217058 - RNA, 22 nt, Homo sapiens
uuccaucagugaaaacauuucu

SEQ ID NO: 2217059 - RNA, 20 nt, Homo sapiens
cucccaggugagaauucagg

SEQ ID NO: 2217060 - RNA, 15 nt, Homo sapiens
cuguacacacuuuau

SEQ ID NO: 2217061 - RNA, 15 nt, Homo sapiens
auguaaauuuacuga

SEQ ID NO: 2217062 - RNA, 18 nt, Homo sapiens
uuaaaaugauuuacauag

SEQ ID NO: 2217063 - RNA, 23 nt, Homo sapiens
cuuacuuuuuuuggaaguuauuu

SEQ ID NO: 2217064 - RNA, 22 nt, Homo sapiens
cagaacucgaugcacugaccug

SEQ ID NO: 2217065 - RNA, 14 nt, Homo sapiens
ccucauguucucau

SEQ ID NO: 2217066 - RNA, 18 nt, Homo sapiens
uucuauugccuucuuuga

SEQ ID NO: 2217067 - RNA, 18 nt, Homo sapiens
gagucugaacagcuguaa

SEQ ID NO: 2217068 - RNA, 19 nt, Homo sapiens
cucugccagucgguuccca

SEQ ID NO: 2217069 - RNA, 15 nt, Homo sapiens
acauuugcucaugga

SEQ ID NO: 2217070 - RNA, 22 nt, Homo sapiens
agcauguggaaaugacccaaac

SEQ ID NO: 2217071 - RNA, 18 nt, Homo sapiens
aaaagauaaccugcagaa

SEQ ID NO: 2217072 - RNA, 22 nt, Homo sapiens
aguuauuuucugagugugcaga

SEQ ID NO: 2217073 - RNA, 17 nt, Homo sapiens
uucuccaagcaggacau

SEQ ID NO: 2217074 - RNA, 12 nt, Homo sapiens
ggccgucugugu

SEQ ID NO: 2217075 - RNA, 22 nt, Homo sapiens
agucucuuuaaucuucaguuuu

SEQ ID NO: 2217076 - RNA, 14 nt, Homo sapiens
ugggcuucugucca

SEQ ID NO: 2217077 - RNA, 14 nt, Homo sapiens
auuccugaagggaa

SEQ ID NO: 2217078 - RNA, 13 nt, Homo sapiens
acagauagucaaa

SEQ ID NO: 2217079 - RNA, 15 nt, Homo sapiens
acaacagauggcugc

SEQ ID NO: 2217080 - RNA, 13 nt, Homo sapiens
auccuauggcaga

SEQ ID NO: 2217081 - RNA, 16 nt, Homo sapiens
cuggaauggaauucag

SEQ ID NO: 2217082 - RNA, 15 nt, Homo sapiens
ccuuaagacagagua

SEQ ID NO: 2217083 - RNA, 16 nt, Homo sapiens
auaauauuagugauuc

SEQ ID NO: 2217084 - RNA, 13 nt, Homo sapiens
cacaucacacaga

SEQ ID NO: 2217085 - RNA, 22 nt, Homo sapiens
cagagcuagguggaaaagccug

SEQ ID NO: 2217086 - RNA, 17 nt, Homo sapiens
agcuucagagccuagcc

SEQ ID NO: 2217087 - RNA, 18 nt, Homo sapiens
cacauucgggaccaauau

SEQ ID NO: 2217088 - RNA, 21 nt, Homo sapiens
uaggccaguacuacugcucuc

SEQ ID NO: 2217089 - RNA, 21 nt, Homo sapiens
gaauauauuauaaucuuccau

SEQ ID NO: 2217090 - RNA, 15 nt, Homo sapiens
ccaugcuaacaaaga

SEQ ID NO: 2217091 - RNA, 12 nt, Homo sapiens
ccaugauaucac

SEQ ID NO: 2217092 - RNA, 16 nt, Homo sapiens
gggguccccacucccu

SEQ ID NO: 2217093 - RNA, 16 nt, Homo sapiens
guugguagagcccuca

SEQ ID NO: 2217094 - RNA, 12 nt, Homo sapiens
cagcagcucaua

SEQ ID NO: 2217095 - RNA, 17 nt, Homo sapiens
cuacgcuccugucucca

SEQ ID NO: 2217096 - RNA, 20 nt, Homo sapiens
ccuggguucugggacuuuua

SEQ ID NO: 2217097 - RNA, 21 nt, Homo sapiens
uccuguguggccugccuucac

SEQ ID NO: 2217098 - RNA, 16 nt, Homo sapiens
uccaucccuccauuca

SEQ ID NO: 2217099 - RNA, 16 nt, Homo sapiens
auugccccauugcuca

SEQ ID NO: 2217100 - RNA, 14 nt, Homo sapiens
agacuaaccugccc

SEQ ID NO: 2217101 - RNA, 21 nt, Homo sapiens
aguucauaccuaaguacugua

SEQ ID NO: 2217102 - RNA, 20 nt, Homo sapiens
augccccgaauuuagucaca

SEQ ID NO: 2217103 - RNA, 12 nt, Homo sapiens
guuagcuuuauu

SEQ ID NO: 2217104 - RNA, 12 nt, Homo sapiens
ccaggccagugg

SEQ ID NO: 2217105 - RNA, 18 nt, Homo sapiens
cugauguuucugugaaau

SEQ ID NO: 2217106 - RNA, 12 nt, Homo sapiens
aaagugcugcug

SEQ ID NO: 2217107 - RNA, 12 nt, Homo sapiens
aaauugcugcuu

SEQ ID NO: 2217108 - RNA, 17 nt, Homo sapiens
ugguccacagcaucucc

SEQ ID NO: 2217109 - RNA, 15 nt, Homo sapiens
cagccaaaaguaagu

SEQ ID NO: 2217110 - RNA, 14 nt, Homo sapiens
ccaggcucugggaa

SEQ ID NO: 2217111 - RNA, 17 nt, Homo sapiens
uuuggaacuguguuuca

SEQ ID NO: 2217112 - RNA, 22 nt, Homo sapiens
ugagggcucuguuugugggacu

SEQ ID NO: 2217113 - RNA, 22 nt, Homo sapiens
agaaaagaauuuuaguguuaau

SEQ ID NO: 2217114 - RNA, 21 nt, Homo sapiens
gcaccacacuagggacuauca

SEQ ID NO: 2217115 - RNA, 14 nt, Homo sapiens
caucuagucacaaa

SEQ ID NO: 2217116 - RNA, 16 nt, Homo sapiens
uaaagaucacacauca

SEQ ID NO: 2217117 - RNA, 12 nt, Homo sapiens
aacucaccaucg

SEQ ID NO: 2217118 - RNA, 22 nt, Homo sapiens
uugcgugaaaguguuacauauu

SEQ ID NO: 2217119 - RNA, 19 nt, Homo sapiens
ucaaggcuucagugagcca

SEQ ID NO: 2217120 - RNA, 16 nt, Homo sapiens
gagcauaucuguuaua

SEQ ID NO: 2217121 - RNA, 24 nt, Homo sapiens
ggagaccagaaaccuuccagagaa

SEQ ID NO: 2217122 - RNA, 12 nt, Homo sapiens
cuaguacuagua

SEQ ID NO: 2217123 - RNA, 23 nt, Homo sapiens
cuucccaccuacugcacuuuccc

SEQ ID NO: 2217124 - RNA, 22 nt, Homo sapiens
ccugcugccagccccuuugcca

SEQ ID NO: 2217125 - RNA, 15 nt, Homo sapiens
cacuugaacccagga

SEQ ID NO: 2217126 - RNA, 15 nt, Homo sapiens
cagaugcaccguggc

SEQ ID NO: 2217127 - RNA, 15 nt, Homo sapiens
aucagacaagcacua

SEQ ID NO: 2217128 - RNA, 15 nt, Homo sapiens
ggugcuauccauuuc

SEQ ID NO: 2217129 - RNA, 18 nt, Homo sapiens
acaggaagcgacgccucu

SEQ ID NO: 2217130 - RNA, 17 nt, Homo sapiens
agcuggaccaguggugc

SEQ ID NO: 2217131 - RNA, 17 nt, Homo sapiens
ugucaauggacugcacc

SEQ ID NO: 2217132 - RNA, 21 nt, Homo sapiens
ccuagauuuaaccauggcacu

SEQ ID NO: 2217133 - RNA, 19 nt, Homo sapiens
aauaucauaaaaaugagug

SEQ ID NO: 2217134 - RNA, 20 nt, Homo sapiens
uuauuaaauguagaaaguga

SEQ ID NO: 2217135 - RNA, 19 nt, Homo sapiens
guauauuacccaauggaaa

SEQ ID NO: 2217136 - RNA, 16 nt, Homo sapiens
cuaacugcagaccaug

SEQ ID NO: 2217137 - RNA, 12 nt, Homo sapiens
aacaaggcaaug

SEQ ID NO: 2217138 - RNA, 14 nt, Homo sapiens
ccucccaggcucaa

SEQ ID NO: 2217139 - RNA, 22 nt, Homo sapiens
gcuguuuuccucccuucugcua

SEQ ID NO: 2217140 - RNA, 16 nt, Homo sapiens
aaauccaaauuucuca

SEQ ID NO: 2217141 - RNA, 16 nt, Homo sapiens
acggaagaggcugcug

SEQ ID NO: 2217142 - RNA, 17 nt, Homo sapiens
ccugacgcugcaugaga

SEQ ID NO: 2217143 - RNA, 23 nt, Homo sapiens
cgucagggucggggcuaggguag

SEQ ID NO: 2217144 - RNA, 18 nt, Homo sapiens
uauucuucacuuaaacuc

SEQ ID NO: 2217145 - RNA, 22 nt, Homo sapiens
acacgccugcaaacgcugccug

SEQ ID NO: 2217146 - RNA, 15 nt, Homo sapiens
agacauccugagcag

SEQ ID NO: 2217147 - RNA, 19 nt, Homo sapiens
uugaaaauguuuacaucau

SEQ ID NO: 2217148 - RNA, 22 nt, Homo sapiens
guauucccaaaaauuacuuugg

SEQ ID NO: 2217149 - RNA, 16 nt, Homo sapiens
uccccuccaaccuggg

SEQ ID NO: 2217150 - RNA, 15 nt, Homo sapiens
gauuguuuugccacu

SEQ ID NO: 2217151 - RNA, 19 nt, Homo sapiens
gaaguccugucacugagca

SEQ ID NO: 2217152 - RNA, 14 nt, Homo sapiens
uugcacacacccug

SEQ ID NO: 2217153 - RNA, 17 nt, Homo sapiens
aguggcuaguuuucaca

SEQ ID NO: 2217154 - RNA, 17 nt, Homo sapiens
guuuuaacuguggauau

SEQ ID NO: 2217155 - RNA, 17 nt, Homo sapiens
ugguauucacagaaagc

SEQ ID NO: 2217156 - RNA, 18 nt, Homo sapiens
cugcugaacacagugucu

SEQ ID NO: 2217157 - RNA, 20 nt, Homo sapiens
uuugacugugcuagcuaaaa

SEQ ID NO: 2217158 - RNA, 14 nt, Homo sapiens
ccguuuccauacag

SEQ ID NO: 2217159 - RNA, 16 nt, Homo sapiens
caucaaacauaaugau

SEQ ID NO: 2217160 - RNA, 22 nt, Homo sapiens
uucaauucucauuugucacaca

SEQ ID NO: 2217161 - RNA, 22 nt, Homo sapiens
ucauagaugagaaaacugagag

SEQ ID NO: 2217162 - RNA, 19 nt, Homo sapiens
caaaguuacaaauucaagg

SEQ ID NO: 2217163 - RNA, 13 nt, Homo sapiens
gcuaccugugagc

SEQ ID NO: 2217164 - RNA, 13 nt, Homo sapiens
gcugucugugaau

SEQ ID NO: 2217165 - RNA, 17 nt, Homo sapiens
ggcuaaccuggaccugg

SEQ ID NO: 2217166 - RNA, 23 nt, Homo sapiens
cuuccaaauauuagccaaagagg

SEQ ID NO: 2217167 - RNA, 22 nt, Homo sapiens
caacaccaugauuccuuuaaca

SEQ ID NO: 2217168 - RNA, 15 nt, Homo sapiens
gaucuuguaaaaaua

SEQ ID NO: 2217169 - RNA, 18 nt, Homo sapiens
gugcaugugcgcgcgugc

SEQ ID NO: 2217170 - RNA, 12 nt, Homo sapiens
gaaauucugcug

SEQ ID NO: 2217171 - RNA, 16 nt, Homo sapiens
auugcacauuguucaa

SEQ ID NO: 2217172 - RNA, 17 nt, Homo sapiens
aauaaaguacuacauca

SEQ ID NO: 2217173 - RNA, 23 nt, Homo sapiens
gauuagagguuugucaacacaaa

SEQ ID NO: 2217174 - RNA, 15 nt, Homo sapiens
ugggggccucugccu

SEQ ID NO: 2217175 - RNA, 19 nt, Homo sapiens
cauacgucuuucacaguuu

SEQ ID NO: 2217176 - RNA, 19 nt, Homo sapiens
aguccgacccagacaucca

SEQ ID NO: 2217177 - RNA, 15 nt, Homo sapiens
ucgcucugucuuucc

SEQ ID NO: 2217178 - RNA, 15 nt, Homo sapiens
aguggaguggaagaa

SEQ ID NO: 2217179 - RNA, 17 nt, Homo sapiens
aacauggaaaacagagu

SEQ ID NO: 2217180 - RNA, 21 nt, Homo sapiens
agcucuggugacaccagccuu

SEQ ID NO: 2217181 - RNA, 14 nt, Homo sapiens
ggcgccucaacucu

SEQ ID NO: 2217182 - RNA, 19 nt, Homo sapiens
aauuggggggaggugcugu

SEQ ID NO: 2217183 - RNA, 21 nt, Homo sapiens
auugccuucuuacaacagaga

SEQ ID NO: 2217184 - RNA, 13 nt, Homo sapiens
uuggccaaacaag

SEQ ID NO: 2217185 - RNA, 15 nt, Homo sapiens
ucacugcauuugccu

SEQ ID NO: 2217186 - RNA, 23 nt, Homo sapiens
uacaauaggugcuuauucucaaa

SEQ ID NO: 2217187 - RNA, 16 nt, Homo sapiens
cauauuggucacguca

SEQ ID NO: 2217188 - RNA, 20 nt, Homo sapiens
uguuucaaggcacucuagau

SEQ ID NO: 2217189 - RNA, 16 nt, Homo sapiens
uauuuucucuuaacaa

SEQ ID NO: 2217190 - RNA, 20 nt, Homo sapiens
auugcauuccagccugggca

SEQ ID NO: 2217191 - RNA, 14 nt, Homo sapiens
aacagccagugugu

SEQ ID NO: 2217192 - RNA, 21 nt, Homo sapiens
caacauggugagaccccaucu

SEQ ID NO: 2217193 - RNA, 15 nt, Homo sapiens
cgcuccccucuggaa

SEQ ID NO: 2217194 - RNA, 20 nt, Homo sapiens
gauacaaugaacacuuauaa

SEQ ID NO: 2217195 - RNA, 16 nt, Homo sapiens
uccccaguacacccca

SEQ ID NO: 2217196 - RNA, 16 nt, Homo sapiens
ugcugaucacaugugc

SEQ ID NO: 2217197 - RNA, 17 nt, Homo sapiens
acgauaugcaaguucau

SEQ ID NO: 2217198 - RNA, 13 nt, Homo sapiens
accauauacagcu

SEQ ID NO: 2217199 - RNA, 21 nt, Homo sapiens
ccagacucguucuucugggaa

SEQ ID NO: 2217200 - RNA, 23 nt, Homo sapiens
ugcuaguaauuggaaaggcagcu

SEQ ID NO: 2217201 - RNA, 15 nt, Homo sapiens
ucugacaacugugaa

SEQ ID NO: 2217202 - RNA, 21 nt, Homo sapiens
aguuugugucaauaaagucau

SEQ ID NO: 2217203 - RNA, 15 nt, Homo sapiens
ugcauguaagccaag

SEQ ID NO: 2217204 - RNA, 17 nt, Homo sapiens
cuguagaagaugaccuc

SEQ ID NO: 2217205 - RNA, 23 nt, Homo sapiens
auuuaacugccuaaaauguucuc

SEQ ID NO: 2217206 - RNA, 14 nt, Homo sapiens
uggcaccgagacca

SEQ ID NO: 2217207 - RNA, 22 nt, Homo sapiens
cuccuucacagcuaagaugcca

SEQ ID NO: 2217208 - RNA, 13 nt, Homo sapiens
acaacagauguac

SEQ ID NO: 2217209 - RNA, 15 nt, Homo sapiens
guuguaaauggcauu

SEQ ID NO: 2217210 - RNA, 22 nt, Homo sapiens
aucacacuuuguaauuugcaaa

SEQ ID NO: 2217211 - RNA, 13 nt, Homo sapiens
cuuugcugcacaa

SEQ ID NO: 2217212 - RNA, 23 nt, Homo sapiens
ggaaucucugcaaucugugucau

SEQ ID NO: 2217213 - RNA, 23 nt, Homo sapiens
acugaauucugccuugguucugg

SEQ ID NO: 2217214 - RNA, 16 nt, Homo sapiens
cauaaaggagcauaua

SEQ ID NO: 2217215 - RNA, 21 nt, Homo sapiens
acucuacaaagagaagcaaag

SEQ ID NO: 2217216 - RNA, 23 nt, Homo sapiens
acccaccaguugaauuucaucau

SEQ ID NO: 2217217 - RNA, 14 nt, Homo sapiens
agcuaccauuuauc

SEQ ID NO: 2217218 - RNA, 13 nt, Homo sapiens
ccuucuucugcca

SEQ ID NO: 2217219 - RNA, 14 nt, Homo sapiens
caggcucugagauu

SEQ ID NO: 2217220 - RNA, 16 nt, Homo sapiens
ggccauucuuucccaa

SEQ ID NO: 2217221 - RNA, 19 nt, Homo sapiens
uucacagcccugcagugcc

SEQ ID NO: 2217222 - RNA, 13 nt, Homo sapiens
ccagcugcuuggg

SEQ ID NO: 2217223 - RNA, 11 nt, Homo sapiens
agaaaugcaaa

SEQ ID NO: 2217224 - RNA, 23 nt, Homo sapiens
cagguacaguaggauaagccacu

SEQ ID NO: 2217225 - RNA, 18 nt, Homo sapiens
guaaaauagggcuuugua

SEQ ID NO: 2217226 - RNA, 16 nt, Homo sapiens
aggucuuucuccucag

SEQ ID NO: 2217227 - RNA, 19 nt, Homo sapiens
cuuucuguacaagggagaa

SEQ ID NO: 2217228 - RNA, 13 nt, Homo sapiens
uccugcuucuuca

SEQ ID NO: 2217229 - RNA, 18 nt, Homo sapiens
cauucaccuuagugcaac

SEQ ID NO: 2217230 - RNA, 19 nt, Homo sapiens
caggagguuguggaugcuc

SEQ ID NO: 2217231 - RNA, 12 nt, Homo sapiens
aggcggugagca

SEQ ID NO: 2217232 - RNA, 20 nt, Homo sapiens
aggauauuucaaaugauuau

SEQ ID NO: 2217233 - RNA, 14 nt, Homo sapiens
cucacagaacugca

SEQ ID NO: 2217234 - RNA, 12 nt, Homo sapiens
uaugcacaacuu

SEQ ID NO: 2217235 - RNA, 13 nt, Homo sapiens
gcugacugcaaaa

SEQ ID NO: 2217236 - RNA, 16 nt, Homo sapiens
gccguguggcacacac

SEQ ID NO: 2217237 - RNA, 17 nt, Homo sapiens
cuucauuugcaauucau

SEQ ID NO: 2217238 - RNA, 12 nt, Homo sapiens
gccagcagagua

SEQ ID NO: 2217239 - RNA, 18 nt, Homo sapiens
aucccucgugguccccaa

SEQ ID NO: 2217240 - RNA, 16 nt, Homo sapiens
aaacaacagcuuuaaa

SEQ ID NO: 2217241 - RNA, 21 nt, Homo sapiens
aauugccuucuagacacugaa

SEQ ID NO: 2217242 - RNA, 16 nt, Homo sapiens
uuuaauguuuccuuua

SEQ ID NO: 2217243 - RNA, 20 nt, Homo sapiens
cuaaguccuuccaccugcca

SEQ ID NO: 2217244 - RNA, 20 nt, Homo sapiens
cuaugauaaaguuguaaaua

SEQ ID NO: 2217245 - RNA, 21 nt, Homo sapiens
aagcugauggccuuguuucaa

SEQ ID NO: 2217246 - RNA, 17 nt, Homo sapiens
aaccccagauucaugca

SEQ ID NO: 2217247 - RNA, 16 nt, Homo sapiens
agacguggacuccucu

SEQ ID NO: 2217248 - RNA, 20 nt, Homo sapiens
guguuuuguaaaggauauca

SEQ ID NO: 2217249 - RNA, 17 nt, Homo sapiens
gauggucacgcaccugg

SEQ ID NO: 2217250 - RNA, 22 nt, Homo sapiens
cuuaaguacugaaauacauaug

SEQ ID NO: 2217251 - RNA, 14 nt, Homo sapiens
ucauuagugagcca

SEQ ID NO: 2217252 - RNA, 19 nt, Homo sapiens
acgugaguacaucaccuaa

SEQ ID NO: 2217253 - RNA, 16 nt, Homo sapiens
ccugggugacagagug

SEQ ID NO: 2217254 - RNA, 21 nt, Homo sapiens
cuuuugccagccuguucucug

SEQ ID NO: 2217255 - RNA, 18 nt, Homo sapiens
agagugaagagcauuugg

SEQ ID NO: 2217256 - RNA, 15 nt, Homo sapiens
gauaacaaguuuaau

SEQ ID NO: 2217257 - RNA, 20 nt, Homo sapiens
gugaaauaccacaagccuga

SEQ ID NO: 2217258 - RNA, 21 nt, Homo sapiens
ucccgagcuacucucuugcca

SEQ ID NO: 2217259 - RNA, 17 nt, Homo sapiens
cccaccaggaaugccgu

SEQ ID NO: 2217260 - RNA, 17 nt, Homo sapiens
cuauaauacaguuuucu

SEQ ID NO: 2217261 - RNA, 13 nt, Homo sapiens
aaaauuuucuuuc

SEQ ID NO: 2217262 - RNA, 23 nt, Homo sapiens
agauuguucuguccaguuuccaa

SEQ ID NO: 2217263 - RNA, 23 nt, Homo sapiens
ggcuucucucucuagcagcaccu

SEQ ID NO: 2217264 - RNA, 16 nt, Homo sapiens
ucuguuucccaccuca

SEQ ID NO: 2217265 - RNA, 12 nt, Homo sapiens
ugauuagcuuug

SEQ ID NO: 2217266 - RNA, 16 nt, Homo sapiens
gaacccaccaaaccaa

SEQ ID NO: 2217267 - RNA, 16 nt, Homo sapiens
caaguuucaaugguga

SEQ ID NO: 2217268 - RNA, 18 nt, Homo sapiens
uccaauuucacgcuuuua

SEQ ID NO: 2217269 - RNA, 22 nt, Homo sapiens
uagccgguaaguaaacagucag

SEQ ID NO: 2217270 - RNA, 21 nt, Homo sapiens
caucaugcggugggugcugcc

SEQ ID NO: 2217271 - RNA, 16 nt, Homo sapiens
gucucgggcugacccu

SEQ ID NO: 2217272 - RNA, 16 nt, Homo sapiens
uuuacauagcauuugu

SEQ ID NO: 2217273 - RNA, 17 nt, Homo sapiens
ugccauugaaacuaaga

SEQ ID NO: 2217274 - RNA, 12 nt, Homo sapiens
gauaccuccaac

SEQ ID NO: 2217275 - RNA, 18 nt, Homo sapiens
gccugcaucaccaccuca

SEQ ID NO: 2217276 - RNA, 17 nt, Homo sapiens
ccuccagucuguucuca

SEQ ID NO: 2217277 - RNA, 12 nt, Homo sapiens
agccuggcccag

SEQ ID NO: 2217278 - RNA, 15 nt, Homo sapiens
cugaauaaaccaaga

SEQ ID NO: 2217279 - RNA, 15 nt, Homo sapiens
uugucgaguuuacuu

SEQ ID NO: 2217280 - RNA, 18 nt, Homo sapiens
cuacucacuucuccuuua

SEQ ID NO: 2217281 - RNA, 20 nt, Homo sapiens
uuugauacucccagucuugu

SEQ ID NO: 2217282 - RNA, 16 nt, Homo sapiens
cuccauccuugcauca

SEQ ID NO: 2217283 - RNA, 18 nt, Homo sapiens
gugccuugugcaauguga

SEQ ID NO: 2217284 - RNA, 17 nt, Homo sapiens
cagggagccacacagag

SEQ ID NO: 2217285 - RNA, 17 nt, Homo sapiens
gcuucauuccaaucuau

SEQ ID NO: 2217286 - RNA, 16 nt, Homo sapiens
auuugcaaaguacugu

SEQ ID NO: 2217287 - RNA, 15 nt, Homo sapiens
acucugagaacuccu

SEQ ID NO: 2217288 - RNA, 17 nt, Homo sapiens
caguauuauguacucua

SEQ ID NO: 2217289 - RNA, 16 nt, Homo sapiens
gcacagaauuugucag

SEQ ID NO: 2217290 - RNA, 15 nt, Homo sapiens
caauuaucuguguca

SEQ ID NO: 2217291 - RNA, 23 nt, Homo sapiens
uguaauuuuaaccaaucagauga

SEQ ID NO: 2217292 - RNA, 15 nt, Homo sapiens
acacguguuguucca

SEQ ID NO: 2217293 - RNA, 19 nt, Homo sapiens
agccucauucagcaugggu

SEQ ID NO: 2217294 - RNA, 17 nt, Homo sapiens
aguuuaguucuguugac

SEQ ID NO: 2217295 - RNA, 22 nt, Homo sapiens
guggccuccuugcuuguuacau

SEQ ID NO: 2217296 - RNA, 13 nt, Homo sapiens
auuagacagucaa

SEQ ID NO: 2217297 - RNA, 22 nt, Homo sapiens
gaaagccacacggagaggccac

SEQ ID NO: 2217298 - RNA, 13 nt, Homo sapiens
agugagcauccuu

SEQ ID NO: 2217299 - RNA, 18 nt, Homo sapiens
guccugaugauuuuuauu

SEQ ID NO: 2217300 - RNA, 18 nt, Homo sapiens
aacuagaauuucauuuau

SEQ ID NO: 2217301 - RNA, 22 nt, Homo sapiens
agagcccuucaugcauuugcac

SEQ ID NO: 2217302 - RNA, 19 nt, Homo sapiens
cugacccagugugugcuca

SEQ ID NO: 2217303 - RNA, 13 nt, Homo sapiens
gaaaucuacugaa

SEQ ID NO: 2217304 - RNA, 13 nt, Homo sapiens
uaaaucacacuga

SEQ ID NO: 2217305 - RNA, 13 nt, Homo sapiens
auucaggagcuca

SEQ ID NO: 2217306 - RNA, 13 nt, Homo sapiens
acccaggagucca

SEQ ID NO: 2217307 - RNA, 14 nt, Homo sapiens
gcaucaucuguucg

SEQ ID NO: 2217308 - RNA, 12 nt, Homo sapiens
ugauugugaacu

SEQ ID NO: 2217309 - RNA, 13 nt, Homo sapiens
auaaccauauuca

SEQ ID NO: 2217310 - RNA, 22 nt, Homo sapiens
agaccucuagacugguucauuc

SEQ ID NO: 2217311 - RNA, 15 nt, Homo sapiens
auuaaaccuuuccau

SEQ ID NO: 2217312 - RNA, 16 nt, Homo sapiens
auaaaagggacugaga

SEQ ID NO: 2217313 - RNA, 16 nt, Homo sapiens
aaacuguccaccaaga

SEQ ID NO: 2217314 - RNA, 17 nt, Homo sapiens
augauuucagcagggau

SEQ ID NO: 2217315 - RNA, 17 nt, Homo sapiens
caaauucuuuuucacac

SEQ ID NO: 2217316 - RNA, 22 nt, Homo sapiens
gcugguacuaagaggcuauuua

SEQ ID NO: 2217317 - RNA, 15 nt, Homo sapiens
uuacuuuaucugggc

SEQ ID NO: 2217318 - RNA, 14 nt, Homo sapiens
ugccagcaaauaaa

SEQ ID NO: 2217319 - RNA, 12 nt, Homo sapiens
aggaugacaaaa

SEQ ID NO: 2217320 - RNA, 16 nt, Homo sapiens
auaaaacacugcccuc

SEQ ID NO: 2217321 - RNA, 17 nt, Homo sapiens
uccagguguguucagua

SEQ ID NO: 2217322 - RNA, 20 nt, Homo sapiens
cuccagagugugcagacuga

SEQ ID NO: 2217323 - RNA, 14 nt, Homo sapiens
gcuuugccuugcag

SEQ ID NO: 2217324 - RNA, 12 nt, Homo sapiens
guacaccccagc

SEQ ID NO: 2217325 - RNA, 15 nt, Homo sapiens
augacauuuauucaa

SEQ ID NO: 2217326 - RNA, 18 nt, Homo sapiens
aucaguguuuuaaauucu

SEQ ID NO: 2217327 - RNA, 15 nt, Homo sapiens
ugcuaugaugauggu

SEQ ID NO: 2217328 - RNA, 21 nt, Homo sapiens
uacaaaggcuuauuaauuuga

SEQ ID NO: 2217329 - RNA, 17 nt, Homo sapiens
cagcuccccagaguccu

SEQ ID NO: 2217330 - RNA, 17 nt, Homo sapiens
cagaauuuguugcuaau

SEQ ID NO: 2217331 - RNA, 15 nt, Homo sapiens
cauuaaacaugacau

SEQ ID NO: 2217332 - RNA, 19 nt, Homo sapiens
uugccaaacuaaauacugu

SEQ ID NO: 2217333 - RNA, 16 nt, Homo sapiens
ggagaauugcuugaac

SEQ ID NO: 2217334 - RNA, 18 nt, Homo sapiens
ugccucugacacacagcu

SEQ ID NO: 2217335 - RNA, 23 nt, Homo sapiens
ucagauuaccaguuauaggaaca

SEQ ID NO: 2217336 - RNA, 19 nt, Homo sapiens
auauaaugguuuacugcug

SEQ ID NO: 2217337 - RNA, 18 nt, Homo sapiens
ugccuguucuaugccuuu

SEQ ID NO: 2217338 - RNA, 20 nt, Homo sapiens
cccaugcuuccuugccugau

SEQ ID NO: 2217339 - RNA, 20 nt, Homo sapiens
aggguuuuccaaugugacua

SEQ ID NO: 2217340 - RNA, 14 nt, Homo sapiens
uguauuaccaaagc

SEQ ID NO: 2217341 - RNA, 20 nt, Homo sapiens
ucccccacgccuccauccac

SEQ ID NO: 2217342 - RNA, 17 nt, Homo sapiens
uguccucugucagucau

SEQ ID NO: 2217343 - RNA, 12 nt, Homo sapiens
uccugcugaaaa

SEQ ID NO: 2217344 - RNA, 17 nt, Homo sapiens
gaaggccgaggucccau

SEQ ID NO: 2217345 - RNA, 16 nt, Homo sapiens
gaaaaaaauaguuuua

SEQ ID NO: 2217346 - RNA, 17 nt, Homo sapiens
caagaguucuaaauaca

SEQ ID NO: 2217347 - RNA, 17 nt, Homo sapiens
uuuaagacuaugauuua

SEQ ID NO: 2217348 - RNA, 17 nt, Homo sapiens
auagugaaacauguacu

SEQ ID NO: 2217349 - RNA, 21 nt, Homo sapiens
gcugaugccuguguacugccu

SEQ ID NO: 2217350 - RNA, 14 nt, Homo sapiens
aauagcaaggugcu

SEQ ID NO: 2217351 - RNA, 17 nt, Homo sapiens
cucucugggacucuccu

SEQ ID NO: 2217352 - RNA, 15 nt, Homo sapiens
ucuuguaaaucuuuu

SEQ ID NO: 2217353 - RNA, 19 nt, Homo sapiens
cuugggcuacuggcagcuc

SEQ ID NO: 2217354 - RNA, 19 nt, Homo sapiens
ucacagagacccaccuuca

SEQ ID NO: 2217355 - RNA, 21 nt, Homo sapiens
agaauuuuauuuauaaaugag

SEQ ID NO: 2217356 - RNA, 20 nt, Homo sapiens
ugccugggggcuuuugccac

SEQ ID NO: 2217357 - RNA, 18 nt, Homo sapiens
aguuaacucacugagggu

SEQ ID NO: 2217358 - RNA, 16 nt, Homo sapiens
cugcuuuagacuugaa

SEQ ID NO: 2217359 - RNA, 16 nt, Homo sapiens
aacaugccauaucuca

SEQ ID NO: 2217360 - RNA, 21 nt, Homo sapiens
aguaucagaauacuugcacuc

SEQ ID NO: 2217361 - RNA, 16 nt, Homo sapiens
uccuucuguagugcca

SEQ ID NO: 2217362 - RNA, 13 nt, Homo sapiens
gcuugcagucucc

SEQ ID NO: 2217363 - RNA, 12 nt, Homo sapiens
acuuccuuaaca

SEQ ID NO: 2217364 - RNA, 16 nt, Homo sapiens
aagaaagcaaaacuca

SEQ ID NO: 2217365 - RNA, 19 nt, Homo sapiens
acuguccuguccugcucau

SEQ ID NO: 2217366 - RNA, 14 nt, Homo sapiens
cuuagucauaccau

SEQ ID NO: 2217367 - RNA, 19 nt, Homo sapiens
caaucagguagcuuaaugg

SEQ ID NO: 2217368 - RNA, 22 nt, Homo sapiens
cagugcccaaaagggcacccac

SEQ ID NO: 2217369 - RNA, 21 nt, Homo sapiens
auaggauuuucacacauucac

SEQ ID NO: 2217370 - RNA, 11 nt, Homo sapiens
caucuaagcau

SEQ ID NO: 2217371 - RNA, 21 nt, Homo sapiens
agauauuuguauuuauuucca

SEQ ID NO: 2217372 - RNA, 15 nt, Homo sapiens
gccaucgaccuggag

SEQ ID NO: 2217373 - RNA, 18 nt, Homo sapiens
cucuucugagcuaaggca

SEQ ID NO: 2217374 - RNA, 16 nt, Homo sapiens
auguuaguuaccuuau

SEQ ID NO: 2217375 - RNA, 21 nt, Homo sapiens
ugacacaaucucggcucacug

SEQ ID NO: 2217376 - RNA, 23 nt, Homo sapiens
agagacaacagauuuacauccca

SEQ ID NO: 2217377 - RNA, 14 nt, Homo sapiens
aagccgucucaugc

SEQ ID NO: 2217378 - RNA, 13 nt, Homo sapiens
uugucaaagaagg

SEQ ID NO: 2217379 - RNA, 23 nt, Homo sapiens
ugcaaugggauguaugaauacag

SEQ ID NO: 2217380 - RNA, 16 nt, Homo sapiens
uaaauauuguauuuga

SEQ ID NO: 2217381 - RNA, 15 nt, Homo sapiens
ucccauguugucaau

SEQ ID NO: 2217382 - RNA, 22 nt, Homo sapiens
cugcauccauucuccugaggau

SEQ ID NO: 2217383 - RNA, 14 nt, Homo sapiens
uaaccauugucaua

SEQ ID NO: 2217384 - RNA, 16 nt, Homo sapiens
uuugacccuauucaug

SEQ ID NO: 2217385 - RNA, 14 nt, Homo sapiens
gccccagaucugcc

SEQ ID NO: 2217386 - RNA, 21 nt, Homo sapiens
cuuggccucccagaaugcugg

SEQ ID NO: 2217387 - RNA, 19 nt, Homo sapiens
gaccucucauaaauuuacu

SEQ ID NO: 2217388 - RNA, 22 nt, Homo sapiens
uagaaugggggcagcaccuccu

SEQ ID NO: 2217389 - RNA, 11 nt, Homo sapiens
auuugagacag

SEQ ID NO: 2217390 - RNA, 21 nt, Homo sapiens
ucaccacaccacagguucuca

SEQ ID NO: 2217391 - RNA, 22 nt, Homo sapiens
acaauuccuccagagacacuga

SEQ ID NO: 2217392 - RNA, 21 nt, Homo sapiens
auaagaagaaguucaugucca

SEQ ID NO: 2217393 - RNA, 22 nt, Homo sapiens
gugccugaucugcacauuucau

SEQ ID NO: 2217394 - RNA, 15 nt, Homo sapiens
auuaugguagcaaau

SEQ ID NO: 2217395 - RNA, 23 nt, Homo sapiens
auccaagcaaaacuuuacuuuca

SEQ ID NO: 2217396 - RNA, 16 nt, Homo sapiens
uaaaauacauaacuuc

SEQ ID NO: 2217397 - RNA, 17 nt, Homo sapiens
aucacaagaaaacuaua

SEQ ID NO: 2217398 - RNA, 18 nt, Homo sapiens
auccgggagacugacacg

SEQ ID NO: 2217399 - RNA, 14 nt, Homo sapiens
ucuccucuuugaug

SEQ ID NO: 2217400 - RNA, 18 nt, Homo sapiens
uuugaacuccgcugccuu

SEQ ID NO: 2217401 - RNA, 18 nt, Homo sapiens
cugugcucauguuuggaa

SEQ ID NO: 2217402 - RNA, 22 nt, Homo sapiens
acuucugggucaugcacugagg

SEQ ID NO: 2217403 - RNA, 12 nt, Homo sapiens
acacauuacaaa

SEQ ID NO: 2217404 - RNA, 15 nt, Homo sapiens
ccgcccgcacagcuc

SEQ ID NO: 2217405 - RNA, 15 nt, Homo sapiens
gaccguuguuaacac

SEQ ID NO: 2217406 - RNA, 13 nt, Homo sapiens
uguuuacaaagca

SEQ ID NO: 2217407 - RNA, 19 nt, Homo sapiens
acuguagugguagcuuuca

SEQ ID NO: 2217408 - RNA, 16 nt, Homo sapiens
acagcuugcugucacu

SEQ ID NO: 2217409 - RNA, 17 nt, Homo sapiens
uuagcuuuuguuuacac

SEQ ID NO: 2217410 - RNA, 19 nt, Homo sapiens
gguauuugcuuuguaacuc

SEQ ID NO: 2217411 - RNA, 22 nt, Homo sapiens
auccccaacugcgacugugacc

SEQ ID NO: 2217412 - RNA, 19 nt, Homo sapiens
cuugcucccaagccccuga

SEQ ID NO: 2217413 - RNA, 22 nt, Homo sapiens
uaagagugccguaacaacugug

SEQ ID NO: 2217414 - RNA, 12 nt, Homo sapiens
auggaaccaaau

SEQ ID NO: 2217415 - RNA, 20 nt, Homo sapiens
auguacccuacccugcacau

SEQ ID NO: 2217416 - RNA, 19 nt, Homo sapiens
agaggccccaauaccccau

SEQ ID NO: 2217417 - RNA, 12 nt, Homo sapiens
gccauggcagcg

SEQ ID NO: 2217418 - RNA, 14 nt, Homo sapiens
uuuaguaaauguua

SEQ ID NO: 2217419 - RNA, 20 nt, Homo sapiens
ugucacuugcuggcugugaa

SEQ ID NO: 2217420 - RNA, 19 nt, Homo sapiens
uaacaaagcacauaacugg

SEQ ID NO: 2217421 - RNA, 17 nt, Homo sapiens
cacuuuagggcuguaaa

SEQ ID NO: 2217422 - RNA, 22 nt, Homo sapiens
uuuucaaucaucaaaaaguaau

SEQ ID NO: 2217423 - RNA, 18 nt, Homo sapiens
uucaaugggcucuuccaa

SEQ ID NO: 2217424 - RNA, 15 nt, Homo sapiens
uaaaaaacauuugua

SEQ ID NO: 2217425 - RNA, 16 nt, Homo sapiens
ggugaaagauggaacu

SEQ ID NO: 2217426 - RNA, 19 nt, Homo sapiens
guucaguuuuagacucuga

SEQ ID NO: 2217427 - RNA, 19 nt, Homo sapiens
gaauaaaauuguuauuuca

SEQ ID NO: 2217428 - RNA, 17 nt, Homo sapiens
gagcaggaagcauucag

SEQ ID NO: 2217429 - RNA, 17 nt, Homo sapiens
aaguuccacuugguuca

SEQ ID NO: 2217430 - RNA, 22 nt, Homo sapiens
caaaauggaaauuuaaaugaca

SEQ ID NO: 2217431 - RNA, 13 nt, Homo sapiens
aauaugagugcca

SEQ ID NO: 2217432 - RNA, 21 nt, Homo sapiens
auugaaauaauuacuaauuaa

SEQ ID NO: 2217433 - RNA, 12 nt, Homo sapiens
uucuuccuccaa

SEQ ID NO: 2217434 - RNA, 14 nt, Homo sapiens
ucuuugucuugccc

SEQ ID NO: 2217435 - RNA, 17 nt, Homo sapiens
gucacuuuuauuugaaa

SEQ ID NO: 2217436 - RNA, 18 nt, Homo sapiens
agggugcccagcuuauaa

SEQ ID NO: 2217437 - RNA, 19 nt, Homo sapiens
auuuauugugcauuaaaau

SEQ ID NO: 2217438 - RNA, 17 nt, Homo sapiens
auaauuagcuuguuaca

SEQ ID NO: 2217439 - RNA, 14 nt, Homo sapiens
auuuggagccugcc

SEQ ID NO: 2217440 - RNA, 20 nt, Homo sapiens
caaacauguuccugggauca

SEQ ID NO: 2217441 - RNA, 17 nt, Homo sapiens
auacuuuuaauuucacu

SEQ ID NO: 2217442 - RNA, 14 nt, Homo sapiens
agucugaaauaccu

SEQ ID NO: 2217443 - RNA, 22 nt, Homo sapiens
cucugcuacucaaguagcauuu

SEQ ID NO: 2217444 - RNA, 22 nt, Homo sapiens
gaaaggcaucuaagacauucac

SEQ ID NO: 2217445 - RNA, 22 nt, Homo sapiens
uagcuuuaacuuguaaaccaca

SEQ ID NO: 2217446 - RNA, 15 nt, Homo sapiens
uguauaguaucugua

SEQ ID NO: 2217447 - RNA, 17 nt, Homo sapiens
uaaagcaaugugguagu

SEQ ID NO: 2217448 - RNA, 14 nt, Homo sapiens
ucuacaucaauauc

SEQ ID NO: 2217449 - RNA, 14 nt, Homo sapiens
uggggcuccuggaa

SEQ ID NO: 2217450 - RNA, 19 nt, Homo sapiens
cacuccagaacaaaccucu

SEQ ID NO: 2217451 - RNA, 23 nt, Homo sapiens
acuuaccugcauguguuguacaa

SEQ ID NO: 2217452 - RNA, 22 nt, Homo sapiens
aaucuaccuguggugacugaac

SEQ ID NO: 2217453 - RNA, 18 nt, Homo sapiens
cauaugcuaccaccagcu

SEQ ID NO: 2217454 - RNA, 13 nt, Homo sapiens
ccacaccuaccac

SEQ ID NO: 2217455 - RNA, 23 nt, Homo sapiens
acuggguguugaucuuacaagau

SEQ ID NO: 2217456 - RNA, 19 nt, Homo sapiens
caaaacugcuuugugcaua

SEQ ID NO: 2217457 - RNA, 12 nt, Homo sapiens
uaaugcucacuu

SEQ ID NO: 2217458 - RNA, 22 nt, Homo sapiens
cugccaggacccaccacuggaa

SEQ ID NO: 2217459 - RNA, 16 nt, Homo sapiens
augaggaggaugcuaa

SEQ ID NO: 2217460 - RNA, 15 nt, Homo sapiens
cauaaaaaaaugaug

SEQ ID NO: 2217461 - RNA, 22 nt, Homo sapiens
gaguuaucaagagacacucccc

SEQ ID NO: 2217462 - RNA, 14 nt, Homo sapiens
cucugcauguguaa

SEQ ID NO: 2217463 - RNA, 19 nt, Homo sapiens
gaaaugggaacaauaucaa

SEQ ID NO: 2217464 - RNA, 21 nt, Homo sapiens
aacauggacuuucuugcauga

SEQ ID NO: 2217465 - RNA, 16 nt, Homo sapiens
cuguguuaugcaaaag

SEQ ID NO: 2217466 - RNA, 22 nt, Homo sapiens
cuccagaugagaguacacccca

SEQ ID NO: 2217467 - RNA, 14 nt, Homo sapiens
cagaaguucugggu

SEQ ID NO: 2217468 - RNA, 10 nt, Homo sapiens
uuguucugua

SEQ ID NO: 2217469 - RNA, 16 nt, Homo sapiens
uacaaggaauaugaca

SEQ ID NO: 2217470 - RNA, 19 nt, Homo sapiens
cacugugguuuugacuuaa

SEQ ID NO: 2217471 - RNA, 22 nt, Homo sapiens
cugugcacugacauguuucaca

SEQ ID NO: 2217472 - RNA, 13 nt, Homo sapiens
uugaucagacagc

SEQ ID NO: 2217473 - RNA, 18 nt, Homo sapiens
aaccccaguggauucuca

SEQ ID NO: 2217474 - RNA, 19 nt, Homo sapiens
cuuuuuccaguccccagaa

SEQ ID NO: 2217475 - RNA, 19 nt, Homo sapiens
ccaucgggagagcucugac

SEQ ID NO: 2217476 - RNA, 14 nt, Homo sapiens
aggcagaaaacugg

SEQ ID NO: 2217477 - RNA, 17 nt, Homo sapiens
acacuuucacuggggau

SEQ ID NO: 2217478 - RNA, 13 nt, Homo sapiens
aagaaucauuugc

SEQ ID NO: 2217479 - RNA, 20 nt, Homo sapiens
caaaaugucaauuugaugua

SEQ ID NO: 2217480 - RNA, 20 nt, Homo sapiens
cauuuugacacaauguugca

SEQ ID NO: 2217481 - RNA, 17 nt, Homo sapiens
gauugugaagauuucau

SEQ ID NO: 2217482 - RNA, 14 nt, Homo sapiens
cuggcccaucagug

SEQ ID NO: 2217483 - RNA, 16 nt, Homo sapiens
uucugccuuguuucau

SEQ ID NO: 2217484 - RNA, 23 nt, Homo sapiens
auaaacacccaugaaucaaagac

SEQ ID NO: 2217485 - RNA, 21 nt, Homo sapiens
uggauuggguaugucuaccug

SEQ ID NO: 2217486 - RNA, 15 nt, Homo sapiens
ccauugaacucugag

SEQ ID NO: 2217487 - RNA, 21 nt, Homo sapiens
gacaugcuccaccgucagggg

SEQ ID NO: 2217488 - RNA, 20 nt, Homo sapiens
uuaggagcagcucuucagca

SEQ ID NO: 2217489 - RNA, 17 nt, Homo sapiens
cuucucccaagcccacg

SEQ ID NO: 2217490 - RNA, 16 nt, Homo sapiens
cauuuucaauccagga

SEQ ID NO: 2217491 - RNA, 20 nt, Homo sapiens
acuucaaagaggaaccagga

SEQ ID NO: 2217492 - RNA, 16 nt, Homo sapiens
caaauaaacacugugu

SEQ ID NO: 2217493 - RNA, 12 nt, Homo sapiens
ucugcacagcuu

SEQ ID NO: 2217494 - RNA, 20 nt, Homo sapiens
gguaaaccgaggacccauga

SEQ ID NO: 2217495 - RNA, 21 nt, Homo sapiens
cuuggauaggagcuuccagau

SEQ ID NO: 2217496 - RNA, 15 nt, Homo sapiens
agaaagcauaguuau

SEQ ID NO: 2217497 - RNA, 17 nt, Homo sapiens
ccaggacugaccucuuc

SEQ ID NO: 2217498 - RNA, 17 nt, Homo sapiens
uaacaguuuuccaugaa

SEQ ID NO: 2217499 - RNA, 16 nt, Homo sapiens
gggacuccuccuuuau

SEQ ID NO: 2217500 - RNA, 20 nt, Homo sapiens
gcuggaguggaguggcacga

SEQ ID NO: 2217501 - RNA, 15 nt, Homo sapiens
caggaaggacugugc

SEQ ID NO: 2217502 - RNA, 22 nt, Homo sapiens
ucgaagaacuggcuuuacuuaa

SEQ ID NO: 2217503 - RNA, 23 nt, Homo sapiens
caagaaugcauugauauugugaa

SEQ ID NO: 2217504 - RNA, 19 nt, Homo sapiens
acagauuuuagacaaggac

SEQ ID NO: 2217505 - RNA, 18 nt, Homo sapiens
aaugguguuguaugccuu

SEQ ID NO: 2217506 - RNA, 23 nt, Homo sapiens
agaaauacaauuuuagauaucau

SEQ ID NO: 2217507 - RNA, 18 nt, Homo sapiens
agacacguggccucguga

SEQ ID NO: 2217508 - RNA, 22 nt, Homo sapiens
acagggcauccaacugagaaaa

SEQ ID NO: 2217509 - RNA, 15 nt, Homo sapiens
gccaagacucagggg

SEQ ID NO: 2217510 - RNA, 14 nt, Homo sapiens
cggggcuacagucc

SEQ ID NO: 2217511 - RNA, 20 nt, Homo sapiens
uucuaauuuauauuauccau

SEQ ID NO: 2217512 - RNA, 20 nt, Homo sapiens
cacauuucccccuagccugc

SEQ ID NO: 2217513 - RNA, 20 nt, Homo sapiens
auuaaagugaauuguugaca

SEQ ID NO: 2217514 - RNA, 15 nt, Homo sapiens
cucuguuauguacug

SEQ ID NO: 2217515 - RNA, 15 nt, Homo sapiens
aaucuccaguacuug

SEQ ID NO: 2217516 - RNA, 15 nt, Homo sapiens
aauuuugaguauucc

SEQ ID NO: 2217517 - RNA, 23 nt, Homo sapiens
uggcauagaaaaaaguagcaaau

SEQ ID NO: 2217518 - RNA, 20 nt, Homo sapiens
aauugacaguugaacagagc

SEQ ID NO: 2217519 - RNA, 13 nt, Homo sapiens
ucaaaaccaagua

SEQ ID NO: 2217520 - RNA, 15 nt, Homo sapiens
aagucuaccugggcu

SEQ ID NO: 2217521 - RNA, 16 nt, Homo sapiens
uuucccacauucccau

SEQ ID NO: 2217522 - RNA, 23 nt, Homo sapiens
aaauucuguuuauguucuugcag

SEQ ID NO: 2217523 - RNA, 19 nt, Homo sapiens
cgugauuuggcugcacuug

SEQ ID NO: 2217524 - RNA, 22 nt, Homo sapiens
ucaagcgauucuccugccucag

SEQ ID NO: 2217525 - RNA, 24 nt, Homo sapiens
gcaccuuuucauguacagcauuaa

SEQ ID NO: 2217526 - RNA, 18 nt, Homo sapiens
ccacauauggcacaacug

SEQ ID NO: 2217527 - RNA, 16 nt, Homo sapiens
ggagcacggacuguca

SEQ ID NO: 2217528 - RNA, 17 nt, Homo sapiens
ggcuguguuaugaaaau

SEQ ID NO: 2217529 - RNA, 20 nt, Homo sapiens
ucugacuaagguugacauaa

SEQ ID NO: 2217530 - RNA, 21 nt, Homo sapiens
uucugccuugguucuggccac

SEQ ID NO: 2217531 - RNA, 16 nt, Homo sapiens
ccauuuuagaaaauca

SEQ ID NO: 2217532 - RNA, 19 nt, Homo sapiens
guccucacgcagacacacc

SEQ ID NO: 2217533 - RNA, 18 nt, Homo sapiens
auaacucuguaaaaacac

SEQ ID NO: 2217534 - RNA, 13 nt, Homo sapiens
agaacuugauaua

SEQ ID NO: 2217535 - RNA, 18 nt, Homo sapiens
uugacaaacuucuuucac

SEQ ID NO: 2217536 - RNA, 11 nt, Homo sapiens
cugagccugac

SEQ ID NO: 2217537 - RNA, 18 nt, Homo sapiens
acagggucucacuauguu

SEQ ID NO: 2217538 - RNA, 14 nt, Homo sapiens
ucaaccagggauug

SEQ ID NO: 2217539 - RNA, 22 nt, Homo sapiens
uuaaacuaugaugcguauuuau

SEQ ID NO: 2217540 - RNA, 23 nt, Homo sapiens
ucaccuuccaacacuccauuauu

SEQ ID NO: 2217541 - RNA, 18 nt, Homo sapiens
gcagcuccaaaacuggac

SEQ ID NO: 2217542 - RNA, 18 nt, Homo sapiens
auagcagaugguuuccac

SEQ ID NO: 2217543 - RNA, 23 nt, Homo sapiens
gccaccagcgaaugcuaggucuc

SEQ ID NO: 2217544 - RNA, 22 nt, Homo sapiens
gacaccucuguuuccucuuccc

SEQ ID NO: 2217545 - RNA, 19 nt, Homo sapiens
caaauggcgacaguugcuu

SEQ ID NO: 2217546 - RNA, 13 nt, Homo sapiens
ccuccucugccag

SEQ ID NO: 2217547 - RNA, 23 nt, Homo sapiens
cgccauuccaagucaacacucuu

SEQ ID NO: 2217548 - RNA, 15 nt, Homo sapiens
cacccaggcugcagu

SEQ ID NO: 2217549 - RNA, 18 nt, Homo sapiens
agggaagcugucccucac

SEQ ID NO: 2217550 - RNA, 20 nt, Homo sapiens
cacuuccguagacuguuuag

SEQ ID NO: 2217551 - RNA, 19 nt, Homo sapiens
uaaaagaugaaagagcagu

SEQ ID NO: 2217552 - RNA, 14 nt, Homo sapiens
cagcacaagauaca

SEQ ID NO: 2217553 - RNA, 16 nt, Homo sapiens
cuuucaugccccggcu

SEQ ID NO: 2217554 - RNA, 22 nt, Homo sapiens
cuuuaacauuuuacugugcugu

SEQ ID NO: 2217555 - RNA, 21 nt, Homo sapiens
gaccagccugggcaacauacc

SEQ ID NO: 2217556 - RNA, 19 nt, Homo sapiens
cacuguguuuauaugucuu

SEQ ID NO: 2217557 - RNA, 20 nt, Homo sapiens
ggaagaucagcgacugccac

SEQ ID NO: 2217558 - RNA, 18 nt, Homo sapiens
uuagaacaggguuucuca

SEQ ID NO: 2217559 - RNA, 17 nt, Homo sapiens
caaguauuacaaccaua

SEQ ID NO: 2217560 - RNA, 16 nt, Homo sapiens
accaaucauuuccuug

SEQ ID NO: 2217561 - RNA, 14 nt, Homo sapiens
gaaaaggcaaauuu

SEQ ID NO: 2217562 - RNA, 20 nt, Homo sapiens
ugcuguuuuuuggugguucu

SEQ ID NO: 2217563 - RNA, 15 nt, Homo sapiens
aaaauaaagugucau

SEQ ID NO: 2217564 - RNA, 19 nt, Homo sapiens
ugggguccuccugugcuau

SEQ ID NO: 2217565 - RNA, 16 nt, Homo sapiens
cuuucauuuacugugg

SEQ ID NO: 2217566 - RNA, 16 nt, Homo sapiens
acagagcgagacucca

SEQ ID NO: 2217567 - RNA, 23 nt, Homo sapiens
ccacuauccuggcaacucaaggc

SEQ ID NO: 2217568 - RNA, 14 nt, Homo sapiens
cauacgguucuguu

SEQ ID NO: 2217569 - RNA, 22 nt, Homo sapiens
acucuguaguuacuguggucac

SEQ ID NO: 2217570 - RNA, 14 nt, Homo sapiens
agccuccucuguga

SEQ ID NO: 2217571 - RNA, 14 nt, Homo sapiens
gccugugcacacac

SEQ ID NO: 2217572 - RNA, 20 nt, Homo sapiens
caaagaaauuccccaagcac

SEQ ID NO: 2217573 - RNA, 19 nt, Homo sapiens
uuccaaugcacaguugcca

SEQ ID NO: 2217574 - RNA, 20 nt, Homo sapiens
ucaaugucuuaggucaggag

SEQ ID NO: 2217575 - RNA, 15 nt, Homo sapiens
gcugauggugacauu

SEQ ID NO: 2217576 - RNA, 17 nt, Homo sapiens
ugguggugggugccugu

SEQ ID NO: 2217577 - RNA, 23 nt, Homo sapiens
ucucuuuaacucaggacuccagc

SEQ ID NO: 2217578 - RNA, 17 nt, Homo sapiens
caguagaguuguguuua

SEQ ID NO: 2217579 - RNA, 17 nt, Homo sapiens
caagaguagcaccuuca

SEQ ID NO: 2217580 - RNA, 13 nt, Homo sapiens
cacaugcuauguu

SEQ ID NO: 2217581 - RNA, 15 nt, Homo sapiens
gagacccaaccacuu

SEQ ID NO: 2217582 - RNA, 20 nt, Homo sapiens
uuuucaaauuauaaucucau

SEQ ID NO: 2217583 - RNA, 19 nt, Homo sapiens
uuauaaaugagcaaaugga

SEQ ID NO: 2217584 - RNA, 13 nt, Homo sapiens
gaaaaguucuccu

SEQ ID NO: 2217585 - RNA, 20 nt, Homo sapiens
cuaguacuuuauuaguuuaa

SEQ ID NO: 2217586 - RNA, 11 nt, Homo sapiens
caacaugagga

SEQ ID NO: 2217587 - RNA, 19 nt, Homo sapiens
ugcaagagaacaauguuuc

SEQ ID NO: 2217588 - RNA, 20 nt, Homo sapiens
ucaccgccaugcaacuccau

SEQ ID NO: 2217589 - RNA, 13 nt, Homo sapiens
uggugugcuguau

SEQ ID NO: 2217590 - RNA, 23 nt, Homo sapiens
aucuggagaaccucauccagcuc

SEQ ID NO: 2217591 - RNA, 14 nt, Homo sapiens
uacaguguaaaaau

SEQ ID NO: 2217592 - RNA, 22 nt, Homo sapiens
caucauaaaaggugacccuucu

SEQ ID NO: 2217593 - RNA, 14 nt, Homo sapiens
gccuuguaccucaa

SEQ ID NO: 2217594 - RNA, 14 nt, Homo sapiens
agugcuuggcacau

SEQ ID NO: 2217595 - RNA, 20 nt, Homo sapiens
cccuggcuccucuacuguuu

SEQ ID NO: 2217596 - RNA, 13 nt, Homo sapiens
ggacuacaggugc

SEQ ID NO: 2217597 - RNA, 20 nt, Homo sapiens
cucuucccuccggacucuaa

SEQ ID NO: 2217598 - RNA, 23 nt, Homo sapiens
ccuuuuaacaccugauguguaca

SEQ ID NO: 2217599 - RNA, 20 nt, Homo sapiens
auacccuguugaggugugaa

SEQ ID NO: 2217600 - RNA, 18 nt, Homo sapiens
ccccaagauacucuuugu

SEQ ID NO: 2217601 - RNA, 24 nt, Homo sapiens
gccaaauguucaauaugagucuca

SEQ ID NO: 2217602 - RNA, 19 nt, Homo sapiens
ccugcuggugagaggugca

SEQ ID NO: 2217603 - RNA, 20 nt, Homo sapiens
gaaauacauagggauaugcg

SEQ ID NO: 2217604 - RNA, 19 nt, Homo sapiens
acauuaauugaggcuuaca

SEQ ID NO: 2217605 - RNA, 17 nt, Homo sapiens
ucuuaguuguacaaaua

SEQ ID NO: 2217606 - RNA, 21 nt, Homo sapiens
cagggugcagcccaaucugcc

SEQ ID NO: 2217607 - RNA, 18 nt, Homo sapiens
uaaaaugacaaagccauu

SEQ ID NO: 2217608 - RNA, 16 nt, Homo sapiens
guucaccuugggauga

SEQ ID NO: 2217609 - RNA, 22 nt, Homo sapiens
gaugcuggacacccucuuccca

SEQ ID NO: 2217610 - RNA, 20 nt, Homo sapiens
caguauguacuucagugcac

SEQ ID NO: 2217611 - RNA, 18 nt, Homo sapiens
caucaggaguuccagugc

SEQ ID NO: 2217612 - RNA, 19 nt, Homo sapiens
aauauuacuaauugcccaa

SEQ ID NO: 2217613 - RNA, 19 nt, Homo sapiens
ucugagcagugaaugauuc

SEQ ID NO: 2217614 - RNA, 12 nt, Homo sapiens
ucagaugaacuc

SEQ ID NO: 2217615 - RNA, 15 nt, Homo sapiens
ccaaucuuaguuucu

SEQ ID NO: 2217616 - RNA, 22 nt, Homo sapiens
gaccuucugaacaugaguguca

SEQ ID NO: 2217617 - RNA, 14 nt, Homo sapiens
cagccugggaccag

SEQ ID NO: 2217618 - RNA, 22 nt, Homo sapiens
ugagcuuaaaaaaaaaguauac

SEQ ID NO: 2217619 - RNA, 17 nt, Homo sapiens
auuaauuaaaccagacu

SEQ ID NO: 2217620 - RNA, 12 nt, Homo sapiens
uaacucaugcca

SEQ ID NO: 2217621 - RNA, 23 nt, Homo sapiens
aacagaaauuaucugucauuuga

SEQ ID NO: 2217622 - RNA, 20 nt, Homo sapiens
ccucuuuuuccuccuggaca

SEQ ID NO: 2217623 - RNA, 14 nt, Homo sapiens
ucauuuagugcccu

SEQ ID NO: 2217624 - RNA, 22 nt, Homo sapiens
ugccacuucuaagaaaagccua

SEQ ID NO: 2217625 - RNA, 20 nt, Homo sapiens
ucauacagcugugaagacuu

SEQ ID NO: 2217626 - RNA, 18 nt, Homo sapiens
auccuacuucuauaucau

SEQ ID NO: 2217627 - RNA, 16 nt, Homo sapiens
aauccucaggauuuca

SEQ ID NO: 2217628 - RNA, 21 nt, Homo sapiens
caauauuuacuauuucaauac

SEQ ID NO: 2217629 - RNA, 21 nt, Homo sapiens
aagccauuuccacuacaguga

SEQ ID NO: 2217630 - RNA, 14 nt, Homo sapiens
gauggguggugcuc

SEQ ID NO: 2217631 - RNA, 19 nt, Homo sapiens
aauaaucucuuuauucuaa

SEQ ID NO: 2217632 - RNA, 22 nt, Homo sapiens
auauugggccuaaaacaguauu

SEQ ID NO: 2217633 - RNA, 24 nt, Homo sapiens
auuaagcgggaucccagcaucuca

SEQ ID NO: 2217634 - RNA, 18 nt, Homo sapiens
ugaaguucuuuuacugua

SEQ ID NO: 2217635 - RNA, 21 nt, Homo sapiens
agcuaucucugaguugcccug

SEQ ID NO: 2217636 - RNA, 13 nt, Homo sapiens
cccagagauccug

SEQ ID NO: 2217637 - RNA, 17 nt, Homo sapiens
cacuucuaccuacauau

SEQ ID NO: 2217638 - RNA, 15 nt, Homo sapiens
uacugguaccaagac

SEQ ID NO: 2217639 - RNA, 14 nt, Homo sapiens
uaacuauugcccag

SEQ ID NO: 2217640 - RNA, 18 nt, Homo sapiens
uaauuuuaaguaauuuca

SEQ ID NO: 2217641 - RNA, 23 nt, Homo sapiens
guccccucauucuacuaauguga

SEQ ID NO: 2217642 - RNA, 18 nt, Homo sapiens
cuuucauauauguuaaag

SEQ ID NO: 2217643 - RNA, 21 nt, Homo sapiens
accgguguccuguuccugcca

SEQ ID NO: 2217644 - RNA, 14 nt, Homo sapiens
cugaaggaaccaaa

SEQ ID NO: 2217645 - RNA, 21 nt, Homo sapiens
ugaaauauacacacagcagua

SEQ ID NO: 2217646 - RNA, 19 nt, Homo sapiens
ccugaauuaucuauuucau

SEQ ID NO: 2217647 - RNA, 17 nt, Homo sapiens
agaggugugggugucug

SEQ ID NO: 2217648 - RNA, 22 nt, Homo sapiens
aauuuaauuccuucuaccuuaa

SEQ ID NO: 2217649 - RNA, 15 nt, Homo sapiens
ugcaguauguugcca

SEQ ID NO: 2217650 - RNA, 21 nt, Homo sapiens
gcauguuucucccauuuagaa

SEQ ID NO: 2217651 - RNA, 14 nt, Homo sapiens
acacgugacacugu

SEQ ID NO: 2217652 - RNA, 21 nt, Homo sapiens
gagcuuaggcauucuaaguca

SEQ ID NO: 2217653 - RNA, 19 nt, Homo sapiens
cuuuucaaaagucagaccc

SEQ ID NO: 2217654 - RNA, 19 nt, Homo sapiens
ccgacuaacagcugaagua

SEQ ID NO: 2217655 - RNA, 14 nt, Homo sapiens
agauaguucauuca

SEQ ID NO: 2217656 - RNA, 18 nt, Homo sapiens
uauuuaaaaaauuaugga

SEQ ID NO: 2217657 - RNA, 21 nt, Homo sapiens
aacagaugcuccuguuugcug

SEQ ID NO: 2217658 - RNA, 18 nt, Homo sapiens
ccugaaccuggagcacuu

SEQ ID NO: 2217659 - RNA, 21 nt, Homo sapiens
gagcacccugcccaccaagaa

SEQ ID NO: 2217660 - RNA, 16 nt, Homo sapiens
aacuuuccagcaguau

SEQ ID NO: 2217661 - RNA, 22 nt, Homo sapiens
aggguggggggccauguuccca

SEQ ID NO: 2217662 - RNA, 19 nt, Homo sapiens
ccagauuggcucacacuga

SEQ ID NO: 2217663 - RNA, 18 nt, Homo sapiens
gguggcccgguugaacuc

SEQ ID NO: 2217664 - RNA, 19 nt, Homo sapiens
gaucacgaggucaggagau

SEQ ID NO: 2217665 - RNA, 15 nt, Homo sapiens
guaucaggacuguga

SEQ ID NO: 2217666 - RNA, 20 nt, Homo sapiens
guuuuaaugacaaggugaua

SEQ ID NO: 2217667 - RNA, 17 nt, Homo sapiens
cuuaauaaacucacaac

SEQ ID NO: 2217668 - RNA, 14 nt, Homo sapiens
ggcagggagugucu

SEQ ID NO: 2217669 - RNA, 21 nt, Homo sapiens
aaucaguuuccacuacauucg

SEQ ID NO: 2217670 - RNA, 18 nt, Homo sapiens
ccucccaaaauacuggga

SEQ ID NO: 2217671 - RNA, 13 nt, Homo sapiens
aacaaacuuuaau

SEQ ID NO: 2217672 - RNA, 14 nt, Homo sapiens
aagugaaaaugcca

SEQ ID NO: 2217673 - RNA, 20 nt, Homo sapiens
ccggggccagccggacacaa

SEQ ID NO: 2217674 - RNA, 18 nt, Homo sapiens
acucuaaaguugauuuaa

SEQ ID NO: 2217675 - RNA, 19 nt, Homo sapiens
gcacacagcugagcacuua

SEQ ID NO: 2217676 - RNA, 13 nt, Homo sapiens
uaauuagauuaac

SEQ ID NO: 2217677 - RNA, 18 nt, Homo sapiens
cugugugguggagccagg

SEQ ID NO: 2217678 - RNA, 18 nt, Homo sapiens
gugucccagugucuggcc

SEQ ID NO: 2217679 - RNA, 17 nt, Homo sapiens
gccucagugaaggacua

SEQ ID NO: 2217680 - RNA, 15 nt, Homo sapiens
uagaaaagcacuuga

SEQ ID NO: 2217681 - RNA, 13 nt, Homo sapiens
ccaucuacaccag

SEQ ID NO: 2217682 - RNA, 21 nt, Homo sapiens
cucaguuaggcagugcaguac

SEQ ID NO: 2217683 - RNA, 20 nt, Homo sapiens
cugcuuuugcagaaaucaca

SEQ ID NO: 2217684 - RNA, 18 nt, Homo sapiens
auuccucagaaaccaaag

SEQ ID NO: 2217685 - RNA, 18 nt, Homo sapiens
aaugacuauauaauuuau

SEQ ID NO: 2217686 - RNA, 22 nt, Homo sapiens
aaaucuuaaaugagaccaaagu

SEQ ID NO: 2217687 - RNA, 18 nt, Homo sapiens
guggagcuccacugccau

SEQ ID NO: 2217688 - RNA, 13 nt, Homo sapiens
agaccccaugccu

SEQ ID NO: 2217689 - RNA, 18 nt, Homo sapiens
cuaccgacccaggguucc

SEQ ID NO: 2217690 - RNA, 19 nt, Homo sapiens
uaauggcucaugaccugga

SEQ ID NO: 2217691 - RNA, 15 nt, Homo sapiens
cuguagaacugcaau

SEQ ID NO: 2217692 - RNA, 17 nt, Homo sapiens
guucugagaccagugua

SEQ ID NO: 2217693 - RNA, 17 nt, Homo sapiens
augugggugucagucag

SEQ ID NO: 2217694 - RNA, 23 nt, Homo sapiens
guguaguuucuucauuucaggaa

SEQ ID NO: 2217695 - RNA, 18 nt, Homo sapiens
gccuguggcuaauggagg

SEQ ID NO: 2217696 - RNA, 20 nt, Homo sapiens
auuccaggggucguuugcuu

SEQ ID NO: 2217697 - RNA, 15 nt, Homo sapiens
cacuguccugaccau

SEQ ID NO: 2217698 - RNA, 18 nt, Homo sapiens
gaauuccugcuaugacag

SEQ ID NO: 2217699 - RNA, 16 nt, Homo sapiens
augcacucaucacaaa

SEQ ID NO: 2217700 - RNA, 16 nt, Homo sapiens
cccagcgacauuucuc

SEQ ID NO: 2217701 - RNA, 12 nt, Homo sapiens
cuuacagaacaa

SEQ ID NO: 2217702 - RNA, 16 nt, Homo sapiens
auggcucggccaggca

SEQ ID NO: 2217703 - RNA, 16 nt, Homo sapiens
cauaauaaagguugug

SEQ ID NO: 2217704 - RNA, 16 nt, Homo sapiens
accugccccagcacuc

SEQ ID NO: 2217705 - RNA, 18 nt, Homo sapiens
uguacugcauguuaccau

SEQ ID NO: 2217706 - RNA, 23 nt, Homo sapiens
ggccccugggcgagacacagcua

SEQ ID NO: 2217707 - RNA, 18 nt, Homo sapiens
gaagccauuuuccaguga

SEQ ID NO: 2217708 - RNA, 17 nt, Homo sapiens
ugauguagauuacugaa

SEQ ID NO: 2217709 - RNA, 19 nt, Homo sapiens
gacggagccgagccaugug

SEQ ID NO: 2217710 - RNA, 17 nt, Homo sapiens
cugccuccaccgagcca

SEQ ID NO: 2217711 - RNA, 19 nt, Homo sapiens
uguuuaauaauauguacaa

SEQ ID NO: 2217712 - RNA, 18 nt, Homo sapiens
guugacaaggcucugcua

SEQ ID NO: 2217713 - RNA, 17 nt, Homo sapiens
ucauucuuuugccacau

SEQ ID NO: 2217714 - RNA, 15 nt, Homo sapiens
cuuucaaaagcaaga

SEQ ID NO: 2217715 - RNA, 17 nt, Homo sapiens
cugggcucacugugcug

SEQ ID NO: 2217716 - RNA, 13 nt, Homo sapiens
uggugcuaccugg

SEQ ID NO: 2217717 - RNA, 22 nt, Homo sapiens
gaauaugaccauuugacuguuc

SEQ ID NO: 2217718 - RNA, 13 nt, Homo sapiens
uuguaauaagaaa

SEQ ID NO: 2217719 - RNA, 21 nt, Homo sapiens
acaagcacuguggaacugcua

SEQ ID NO: 2217720 - RNA, 13 nt, Homo sapiens
uaagguucuugcu

SEQ ID NO: 2217721 - RNA, 14 nt, Homo sapiens
cuucuguaguguau

SEQ ID NO: 2217722 - RNA, 16 nt, Homo sapiens
uggaguccuguucuca

SEQ ID NO: 2217723 - RNA, 20 nt, Homo sapiens
uuauccuauaagaugacaau

SEQ ID NO: 2217724 - RNA, 18 nt, Homo sapiens
cagcaaacccugauguga

SEQ ID NO: 2217725 - RNA, 16 nt, Homo sapiens
gccacuugucaaagaa

SEQ ID NO: 2217726 - RNA, 14 nt, Homo sapiens
guuaugcagugaac

SEQ ID NO: 2217727 - RNA, 16 nt, Homo sapiens
agccccgcccgccugg

SEQ ID NO: 2217728 - RNA, 21 nt, Homo sapiens
cacucccgaggauguguccua

SEQ ID NO: 2217729 - RNA, 12 nt, Homo sapiens
guaaaacuuaac

SEQ ID NO: 2217730 - RNA, 19 nt, Homo sapiens
aauuagacauaccucucaa

SEQ ID NO: 2217731 - RNA, 22 nt, Homo sapiens
uuguaacagacauuguuuugcc

SEQ ID NO: 2217732 - RNA, 19 nt, Homo sapiens
cauaaaugcacaaaaucug

SEQ ID NO: 2217733 - RNA, 14 nt, Homo sapiens
cacugauuugauac

SEQ ID NO: 2217734 - RNA, 12 nt, Homo sapiens
cuggugccauuu

SEQ ID NO: 2217735 - RNA, 20 nt, Homo sapiens
guacaggucacccaucagga

SEQ ID NO: 2217736 - RNA, 18 nt, Homo sapiens
ccuggcuggcugggaugc

SEQ ID NO: 2217737 - RNA, 13 nt, Homo sapiens
ccacacucagcua

SEQ ID NO: 2217738 - RNA, 22 nt, Homo sapiens
agauugauaaccauagcauuaa

SEQ ID NO: 2217739 - RNA, 18 nt, Homo sapiens
cugucccaccaugcagug

SEQ ID NO: 2217740 - RNA, 12 nt, Homo sapiens
uggcaugccuuc

SEQ ID NO: 2217741 - RNA, 16 nt, Homo sapiens
gacucacccuccacaa

SEQ ID NO: 2217742 - RNA, 20 nt, Homo sapiens
ugacuuuuaauuuucacuuu

SEQ ID NO: 2217743 - RNA, 19 nt, Homo sapiens
agccagcucccagccacau

SEQ ID NO: 2217744 - RNA, 15 nt, Homo sapiens
gacugaaaagccaug

SEQ ID NO: 2217745 - RNA, 19 nt, Homo sapiens
uacugcuggaguccagugc

SEQ ID NO: 2217746 - RNA, 16 nt, Homo sapiens
uagauuacugauguga

SEQ ID NO: 2217747 - RNA, 14 nt, Homo sapiens
gaaaugcuuagaaa

SEQ ID NO: 2217748 - RNA, 18 nt, Homo sapiens
gaaguuaucaacaugcac

SEQ ID NO: 2217749 - RNA, 21 nt, Homo sapiens
ccagaugcccagaggcuccau

SEQ ID NO: 2217750 - RNA, 16 nt, Homo sapiens
ugggagauacagccau

SEQ ID NO: 2217751 - RNA, 16 nt, Homo sapiens
uaaucguacauuuuca

SEQ ID NO: 2217752 - RNA, 16 nt, Homo sapiens
aaaguaucauuacaua

SEQ ID NO: 2217753 - RNA, 18 nt, Homo sapiens
gcaguuuaagagcagaac

SEQ ID NO: 2217754 - RNA, 19 nt, Homo sapiens
cuguaaaauuaaacaaaua

SEQ ID NO: 2217755 - RNA, 18 nt, Homo sapiens
guuagacuuaaacagcag

SEQ ID NO: 2217756 - RNA, 20 nt, Homo sapiens
acacugaaaugaaaucuucc

SEQ ID NO: 2217757 - RNA, 14 nt, Homo sapiens
acaucagcaagacu

SEQ ID NO: 2217758 - RNA, 13 nt, Homo sapiens
uacacgugacaga

SEQ ID NO: 2217759 - RNA, 15 nt, Homo sapiens
uucucaacuguccca

SEQ ID NO: 2217760 - RNA, 23 nt, Homo sapiens
uaagagaaagucaccugcccaag

SEQ ID NO: 2217761 - RNA, 17 nt, Homo sapiens
agagauuuucauuuuag

SEQ ID NO: 2217762 - RNA, 21 nt, Homo sapiens
agcugcagucaacaguucaaa

SEQ ID NO: 2217763 - RNA, 14 nt, Homo sapiens
cuucccccuugugg

SEQ ID NO: 2217764 - RNA, 11 nt, Homo sapiens
agcuguauuaa

SEQ ID NO: 2217765 - RNA, 21 nt, Homo sapiens
auccauuuuuaucaggauuuc

SEQ ID NO: 2217766 - RNA, 14 nt, Homo sapiens
ugaccccaaagagc

SEQ ID NO: 2217767 - RNA, 23 nt, Homo sapiens
aagggauugcuuugcauuacugu

SEQ ID NO: 2217768 - RNA, 16 nt, Homo sapiens
uacagcagcacuguuc

SEQ ID NO: 2217769 - RNA, 19 nt, Homo sapiens
uccggaaagccuuccucaa

SEQ ID NO: 2217770 - RNA, 18 nt, Homo sapiens
aguccguuccgaaggcau

SEQ ID NO: 2217771 - RNA, 15 nt, Homo sapiens
cuggaauucuaacaa

SEQ ID NO: 2217772 - RNA, 14 nt, Homo sapiens
cuaucgcaccacug

SEQ ID NO: 2217773 - RNA, 22 nt, Homo sapiens
gaaaaaucauaacucacuuuaa

SEQ ID NO: 2217774 - RNA, 16 nt, Homo sapiens
ugggccggccagccuu

SEQ ID NO: 2217775 - RNA, 22 nt, Homo sapiens
guuugugugaucauacaguuau

SEQ ID NO: 2217776 - RNA, 13 nt, Homo sapiens
caaagugcuaaau

SEQ ID NO: 2217777 - RNA, 13 nt, Homo sapiens
ccugaugcaaggg

SEQ ID NO: 2217778 - RNA, 20 nt, Homo sapiens
aaaucaaaagggccaaagaa

SEQ ID NO: 2217779 - RNA, 13 nt, Homo sapiens
cucaggacagaug

SEQ ID NO: 2217780 - RNA, 20 nt, Homo sapiens
gagcgcaagauagauuugga

SEQ ID NO: 2217781 - RNA, 16 nt, Homo sapiens
cuggugaaggaucuug

SEQ ID NO: 2217782 - RNA, 16 nt, Homo sapiens
auccauguaacugccu

SEQ ID NO: 2217783 - RNA, 19 nt, Homo sapiens
acaagauugucuuuuccua

SEQ ID NO: 2217784 - RNA, 19 nt, Homo sapiens
cacauuggaacagugaauc

SEQ ID NO: 2217785 - RNA, 17 nt, Homo sapiens
cugccagucccagauca

SEQ ID NO: 2217786 - RNA, 16 nt, Homo sapiens
gcacaauuccaugaau

SEQ ID NO: 2217787 - RNA, 16 nt, Homo sapiens
uucaugagcugaguga

SEQ ID NO: 2217788 - RNA, 22 nt, Homo sapiens
auacauuuucuggugggccuua

SEQ ID NO: 2217789 - RNA, 23 nt, Homo sapiens
acuucuuaaaaguugugauucca

SEQ ID NO: 2217790 - RNA, 22 nt, Homo sapiens
ugaguuacuuccuaucaagcca

SEQ ID NO: 2217791 - RNA, 22 nt, Homo sapiens
acuucggcgcagaaaacaaaag

SEQ ID NO: 2217792 - RNA, 18 nt, Homo sapiens
ccaucuccaucaggaaaa

SEQ ID NO: 2217793 - RNA, 12 nt, Homo sapiens
uugacaaacaca

SEQ ID NO: 2217794 - RNA, 18 nt, Homo sapiens
acuuguauagcaugaaau

SEQ ID NO: 2217795 - RNA, 16 nt, Homo sapiens
cucaauaagccagcaa

SEQ ID NO: 2217796 - RNA, 23 nt, Homo sapiens
aaucuauuuccuuuccagucauu

SEQ ID NO: 2217797 - RNA, 13 nt, Homo sapiens
auucuacccuguu

SEQ ID NO: 2217798 - RNA, 13 nt, Homo sapiens
acauauuaucuca

SEQ ID NO: 2217799 - RNA, 15 nt, Homo sapiens
caucuaauguauuau

SEQ ID NO: 2217800 - RNA, 22 nt, Homo sapiens
auuuaauuacuucuuaguaugu

SEQ ID NO: 2217801 - RNA, 13 nt, Homo sapiens
acacugagucaga

SEQ ID NO: 2217802 - RNA, 15 nt, Homo sapiens
cuuguccaugugguu

SEQ ID NO: 2217803 - RNA, 17 nt, Homo sapiens
agagucagcccuuggcu

SEQ ID NO: 2217804 - RNA, 20 nt, Homo sapiens
gcuacucaggagacugaguu

SEQ ID NO: 2217805 - RNA, 14 nt, Homo sapiens
uaaauuauagcuca

SEQ ID NO: 2217806 - RNA, 19 nt, Homo sapiens
ugaacaaauuuacagagac

SEQ ID NO: 2217807 - RNA, 16 nt, Homo sapiens
cuuuuuugccucacaa

SEQ ID NO: 2217808 - RNA, 14 nt, Homo sapiens
gaguugugaugaau

SEQ ID NO: 2217809 - RNA, 14 nt, Homo sapiens
guauuuugaaaaag

SEQ ID NO: 2217810 - RNA, 20 nt, Homo sapiens
ugauuguauaaaugcaauaa

SEQ ID NO: 2217811 - RNA, 15 nt, Homo sapiens
aaucaugggcauugc

SEQ ID NO: 2217812 - RNA, 13 nt, Homo sapiens
agggagaggaaga

SEQ ID NO: 2217813 - RNA, 14 nt, Homo sapiens
cccaccugaagggu

SEQ ID NO: 2217814 - RNA, 13 nt, Homo sapiens
ucuaaauguuugg

SEQ ID NO: 2217815 - RNA, 13 nt, Homo sapiens
ccaggaugcuaaa

SEQ ID NO: 2217816 - RNA, 19 nt, Homo sapiens
cacaccucuccuuugugac

SEQ ID NO: 2217817 - RNA, 23 nt, Homo sapiens
ggucacaaggucuuuacuuaugc

SEQ ID NO: 2217818 - RNA, 17 nt, Homo sapiens
uuuaucaaaauguagcu

SEQ ID NO: 2217819 - RNA, 14 nt, Homo sapiens
uccuuuguuacuuc

SEQ ID NO: 2217820 - RNA, 17 nt, Homo sapiens
cuccuugggcagggucu

SEQ ID NO: 2217821 - RNA, 19 nt, Homo sapiens
aagauaaaauauccucagg

SEQ ID NO: 2217822 - RNA, 14 nt, Homo sapiens
ccuggggaucacag

SEQ ID NO: 2217823 - RNA, 23 nt, Homo sapiens
acuggcugggaguccuuaccucg

SEQ ID NO: 2217824 - RNA, 21 nt, Homo sapiens
aguucugcagguugaagccau

SEQ ID NO: 2217825 - RNA, 14 nt, Homo sapiens
uggagugagaugaa

SEQ ID NO: 2217826 - RNA, 20 nt, Homo sapiens
aguugcaccauugcacucca

SEQ ID NO: 2217827 - RNA, 22 nt, Homo sapiens
cugucaguuguacuucugcucc

SEQ ID NO: 2217828 - RNA, 15 nt, Homo sapiens
gaagccuacugguag

SEQ ID NO: 2217829 - RNA, 22 nt, Homo sapiens
ucuggucuuauaaguaaagaca

SEQ ID NO: 2217830 - RNA, 20 nt, Homo sapiens
aagaaacuggggcuccucca

SEQ ID NO: 2217831 - RNA, 15 nt, Homo sapiens
acgugacuguggcac

SEQ ID NO: 2217832 - RNA, 14 nt, Homo sapiens
uaaacuuguuuaca

SEQ ID NO: 2217833 - RNA, 17 nt, Homo sapiens
cucaaugaauaauugua

SEQ ID NO: 2217834 - RNA, 13 nt, Homo sapiens
gccccaugagaca

SEQ ID NO: 2217835 - RNA, 19 nt, Homo sapiens
ugcuggugacccagcaucu

SEQ ID NO: 2217836 - RNA, 23 nt, Homo sapiens
aauauuccuauauguagcuuuau

SEQ ID NO: 2217837 - RNA, 13 nt, Homo sapiens
guuuucaacauug

SEQ ID NO: 2217838 - RNA, 11 nt, Homo sapiens
gcccucuggga

SEQ ID NO: 2217839 - RNA, 17 nt, Homo sapiens
cuguguacccacuccuc

SEQ ID NO: 2217840 - RNA, 23 nt, Homo sapiens
caagauuggccugaggcugcacu

SEQ ID NO: 2217841 - RNA, 15 nt, Homo sapiens
aggaucugaggacaa

SEQ ID NO: 2217842 - RNA, 15 nt, Homo sapiens
caaauaugcaaacca

SEQ ID NO: 2217843 - RNA, 16 nt, Homo sapiens
ugcuccuaaggguaga

SEQ ID NO: 2217844 - RNA, 21 nt, Homo sapiens
ggagcaguugcccucaggccu

SEQ ID NO: 2217845 - RNA, 13 nt, Homo sapiens
uuggaagacuucu

SEQ ID NO: 2217846 - RNA, 16 nt, Homo sapiens
aaauacugauuuucaa

SEQ ID NO: 2217847 - RNA, 19 nt, Homo sapiens
cagaauaucagaauaugau

SEQ ID NO: 2217848 - RNA, 20 nt, Homo sapiens
caacugaacuugcuauggaa

SEQ ID NO: 2217849 - RNA, 21 nt, Homo sapiens
guuucuaaaaacacacacaaa

SEQ ID NO: 2217850 - RNA, 17 nt, Homo sapiens
cauuugcagaugcacau

SEQ ID NO: 2217851 - RNA, 17 nt, Homo sapiens
uuaauuuucaguauaau

SEQ ID NO: 2217852 - RNA, 17 nt, Homo sapiens
ccuacugucccucucag

SEQ ID NO: 2217853 - RNA, 18 nt, Homo sapiens
cuggcacaggccgaggca

SEQ ID NO: 2217854 - RNA, 20 nt, Homo sapiens
agugcaguggcgugaucucg

SEQ ID NO: 2217855 - RNA, 20 nt, Homo sapiens
cuucauuguuuggaccugca

SEQ ID NO: 2217856 - RNA, 18 nt, Homo sapiens
cucucauaaugaagacau

SEQ ID NO: 2217857 - RNA, 14 nt, Homo sapiens
cuagaacagccaga

SEQ ID NO: 2217858 - RNA, 15 nt, Homo sapiens
aaguaauacaaacua

SEQ ID NO: 2217859 - RNA, 19 nt, Homo sapiens
cauuguuuauuguauacug

SEQ ID NO: 2217860 - RNA, 16 nt, Homo sapiens
cugcgagaagcacaga

SEQ ID NO: 2217861 - RNA, 20 nt, Homo sapiens
uguaaccuguugcuguguuu

SEQ ID NO: 2217862 - RNA, 21 nt, Homo sapiens
agacugguugaguucagguag

SEQ ID NO: 2217863 - RNA, 23 nt, Homo sapiens
ugaaagaucucugucacauccaa

SEQ ID NO: 2217864 - RNA, 14 nt, Homo sapiens
uuaacaaugcagua

SEQ ID NO: 2217865 - RNA, 13 nt, Homo sapiens
gaacaggccucuc

SEQ ID NO: 2217866 - RNA, 18 nt, Homo sapiens
uuuagagauuauaacaaa

SEQ ID NO: 2217867 - RNA, 15 nt, Homo sapiens
acagaaagugacaag

SEQ ID NO: 2217868 - RNA, 15 nt, Homo sapiens
cuuuuugccuuacaa

SEQ ID NO: 2217869 - RNA, 19 nt, Homo sapiens
agacuguugugaucuugca

SEQ ID NO: 2217870 - RNA, 12 nt, Homo sapiens
cagccaugagaa

SEQ ID NO: 2217871 - RNA, 21 nt, Homo sapiens
cacaaacugcagcugugagug

SEQ ID NO: 2217872 - RNA, 21 nt, Homo sapiens
agaagggaauuuauugccucu

SEQ ID NO: 2217873 - RNA, 17 nt, Homo sapiens
cugacuuuucugaccca

SEQ ID NO: 2217874 - RNA, 22 nt, Homo sapiens
uugagugggacaccauucugaa

SEQ ID NO: 2217875 - RNA, 17 nt, Homo sapiens
cucagugucagcacuca

SEQ ID NO: 2217876 - RNA, 13 nt, Homo sapiens
aacacacugauua

SEQ ID NO: 2217877 - RNA, 21 nt, Homo sapiens
cacauucccaugguggccuca

SEQ ID NO: 2217878 - RNA, 15 nt, Homo sapiens
acugcucaaccucac

SEQ ID NO: 2217879 - RNA, 18 nt, Homo sapiens
uugcaaacccaacuaagc

SEQ ID NO: 2217880 - RNA, 18 nt, Homo sapiens
caugcucaguuggugcug

SEQ ID NO: 2217881 - RNA, 18 nt, Homo sapiens
uggugacccagucagagu

SEQ ID NO: 2217882 - RNA, 20 nt, Homo sapiens
guguucacaaaggcagagag

SEQ ID NO: 2217883 - RNA, 20 nt, Homo sapiens
uugucuauaugucuagcuca

SEQ ID NO: 2217884 - RNA, 18 nt, Homo sapiens
gacuagaggcuugcauaa

SEQ ID NO: 2217885 - RNA, 18 nt, Homo sapiens
gugcauuuaugagcucuu

SEQ ID NO: 2217886 - RNA, 18 nt, Homo sapiens
accagggugguugggacg

SEQ ID NO: 2217887 - RNA, 20 nt, Homo sapiens
ggugugugugccaugucaca

SEQ ID NO: 2217888 - RNA, 13 nt, Homo sapiens
cuacuuacaggug

SEQ ID NO: 2217889 - RNA, 21 nt, Homo sapiens
ucuacaaacucccacuuguca

SEQ ID NO: 2217890 - RNA, 11 nt, Homo sapiens
ucaaacagcuc

SEQ ID NO: 2217891 - RNA, 21 nt, Homo sapiens
uggucacccaacucaaggaca

SEQ ID NO: 2217892 - RNA, 18 nt, Homo sapiens
aaugaacacaucuugagu

SEQ ID NO: 2217893 - RNA, 15 nt, Homo sapiens
uugaaaaauaguauu

SEQ ID NO: 2217894 - RNA, 21 nt, Homo sapiens
ucccugaagcuaugucucuag

SEQ ID NO: 2217895 - RNA, 17 nt, Homo sapiens
cuuccuggggaccaaga

SEQ ID NO: 2217896 - RNA, 13 nt, Homo sapiens
uccagguggacaa

SEQ ID NO: 2217897 - RNA, 20 nt, Homo sapiens
acugaauuuugggacuucua

SEQ ID NO: 2217898 - RNA, 18 nt, Homo sapiens
gugccaauauuucugaua

SEQ ID NO: 2217899 - RNA, 21 nt, Homo sapiens
uuucaucagaggaaaagggca

SEQ ID NO: 2217900 - RNA, 16 nt, Homo sapiens
uugaucagugugcuaa

SEQ ID NO: 2217901 - RNA, 23 nt, Homo sapiens
ccacgucauuaagguuaugcacu

SEQ ID NO: 2217902 - RNA, 14 nt, Homo sapiens
cucagggugcagag

SEQ ID NO: 2217903 - RNA, 19 nt, Homo sapiens
gcagguuguugucaucuga

SEQ ID NO: 2217904 - RNA, 16 nt, Homo sapiens
cuagauuuuguugacc

SEQ ID NO: 2217905 - RNA, 18 nt, Homo sapiens
caacguuucuucacuuuu

SEQ ID NO: 2217906 - RNA, 17 nt, Homo sapiens
agggggugggauuccac

SEQ ID NO: 2217907 - RNA, 16 nt, Homo sapiens
auacuauccaguuacu

SEQ ID NO: 2217908 - RNA, 23 nt, Homo sapiens
acagauuuacaucccagacacau

SEQ ID NO: 2217909 - RNA, 20 nt, Homo sapiens
uaauaugaguaauacaucaa

SEQ ID NO: 2217910 - RNA, 20 nt, Homo sapiens
aaauuagaaaguagccacgu

SEQ ID NO: 2217911 - RNA, 23 nt, Homo sapiens
caaacucagucauacuuuuauaa

SEQ ID NO: 2217912 - RNA, 17 nt, Homo sapiens
caccucccagguucaag

SEQ ID NO: 2217913 - RNA, 13 nt, Homo sapiens
cuuugucuugccc

SEQ ID NO: 2217914 - RNA, 19 nt, Homo sapiens
agccaggugugguggugca

SEQ ID NO: 2217915 - RNA, 19 nt, Homo sapiens
agccaggcaugguggcaca

SEQ ID NO: 2217916 - RNA, 14 nt, Homo sapiens
auggcagaagggaa

SEQ ID NO: 2217917 - RNA, 14 nt, Homo sapiens
ugcucagauucuaa

SEQ ID NO: 2217918 - RNA, 19 nt, Homo sapiens
ccaagaacagucaaaccca

SEQ ID NO: 2217919 - RNA, 19 nt, Homo sapiens
agccauguaccaguguacu

SEQ ID NO: 2217920 - RNA, 17 nt, Homo sapiens
uggguguuuaaaaaagu

SEQ ID NO: 2217921 - RNA, 23 nt, Homo sapiens
acuuaguccuuuaucauccuuaa

SEQ ID NO: 2217922 - RNA, 20 nt, Homo sapiens
uugaaaauguauuuccugaa

SEQ ID NO: 2217923 - RNA, 16 nt, Homo sapiens
uuccugacaucacagc

SEQ ID NO: 2217924 - RNA, 18 nt, Homo sapiens
accuagaacacuaacuca

SEQ ID NO: 2217925 - RNA, 16 nt, Homo sapiens
cuugugguggcugcuc

SEQ ID NO: 2217926 - RNA, 17 nt, Homo sapiens
aagccuuuuccauaaag

SEQ ID NO: 2217927 - RNA, 22 nt, Homo sapiens
auacuugguucucuccaccagg

SEQ ID NO: 2217928 - RNA, 21 nt, Homo sapiens
aaccuucucuuuuauaaucug

SEQ ID NO: 2217929 - RNA, 20 nt, Homo sapiens
caguucucagaaaugucaug

SEQ ID NO: 2217930 - RNA, 23 nt, Homo sapiens
gcacuucuguuccagguuuuucu

SEQ ID NO: 2217931 - RNA, 23 nt, Homo sapiens
gaaaagguuguuguuaaugaaua

SEQ ID NO: 2217932 - RNA, 18 nt, Homo sapiens
gcaaauaaagaccugaga

SEQ ID NO: 2217933 - RNA, 18 nt, Homo sapiens
ccuuuauagagugucuca

SEQ ID NO: 2217934 - RNA, 12 nt, Homo sapiens
uuucugcacuau

SEQ ID NO: 2217935 - RNA, 23 nt, Homo sapiens
cuaccuuccccagacuugcacug

SEQ ID NO: 2217936 - RNA, 16 nt, Homo sapiens
gagagucaaaugggaa

SEQ ID NO: 2217937 - RNA, 17 nt, Homo sapiens
uccuagaaacugacaca

SEQ ID NO: 2217938 - RNA, 23 nt, Homo sapiens
ucaccaguuucugcggccuucca

SEQ ID NO: 2217939 - RNA, 14 nt, Homo sapiens
ugugcaaacagugu

SEQ ID NO: 2217940 - RNA, 15 nt, Homo sapiens
ccuugcagauaucug

SEQ ID NO: 2217941 - RNA, 15 nt, Homo sapiens
aaguauuggcauuca

SEQ ID NO: 2217942 - RNA, 22 nt, Homo sapiens
ucaagugcaccuacaccaacug

SEQ ID NO: 2217943 - RNA, 15 nt, Homo sapiens
aauaaugagcuauua

SEQ ID NO: 2217944 - RNA, 19 nt, Homo sapiens
aaacuuggaugucacugcc

SEQ ID NO: 2217945 - RNA, 15 nt, Homo sapiens
uauuccauaauucca

SEQ ID NO: 2217946 - RNA, 15 nt, Homo sapiens
accugaguuccugag

SEQ ID NO: 2217947 - RNA, 16 nt, Homo sapiens
cacugauguacaauua

SEQ ID NO: 2217948 - RNA, 17 nt, Homo sapiens
ugagcacgcuaccaaau

SEQ ID NO: 2217949 - RNA, 14 nt, Homo sapiens
cagccuggcaaggg

SEQ ID NO: 2217950 - RNA, 17 nt, Homo sapiens
uacuuccagauggcugc

SEQ ID NO: 2217951 - RNA, 15 nt, Homo sapiens
gaucaacucauguua

SEQ ID NO: 2217952 - RNA, 12 nt, Homo sapiens
gugcaacacaaa

SEQ ID NO: 2217953 - RNA, 19 nt, Homo sapiens
caguuuaccgaaaaucaua

SEQ ID NO: 2217954 - RNA, 17 nt, Homo sapiens
uuuguagcacugacaga

SEQ ID NO: 2217955 - RNA, 11 nt, Homo sapiens
gaaugugauuu

SEQ ID NO: 2217956 - RNA, 23 nt, Homo sapiens
aggaagcgaaaggggauggagug

SEQ ID NO: 2217957 - RNA, 21 nt, Homo sapiens
gcaguaugugauggacugggg

SEQ ID NO: 2217958 - RNA, 22 nt, Homo sapiens
aucaagauuuaauccuagagau

SEQ ID NO: 2217959 - RNA, 12 nt, Homo sapiens
gccucaaccucc

SEQ ID NO: 2217960 - RNA, 20 nt, Homo sapiens
cucugcagucucuauaccaa

SEQ ID NO: 2217961 - RNA, 13 nt, Homo sapiens
gaagaacauagaa

SEQ ID NO: 2217962 - RNA, 15 nt, Homo sapiens
uucauuuuaguccag

SEQ ID NO: 2217963 - RNA, 22 nt, Homo sapiens
cauguggcccuccaguguauga

SEQ ID NO: 2217964 - RNA, 16 nt, Homo sapiens
cagaagccuuugauau

SEQ ID NO: 2217965 - RNA, 22 nt, Homo sapiens
cugugaggccccuggacaagca

SEQ ID NO: 2217966 - RNA, 15 nt, Homo sapiens
uaaaacaucucauca

SEQ ID NO: 2217967 - RNA, 18 nt, Homo sapiens
uuucuaaaggaugcugcu

SEQ ID NO: 2217968 - RNA, 22 nt, Homo sapiens
uaaguuuaauuaucugcauuua

SEQ ID NO: 2217969 - RNA, 16 nt, Homo sapiens
auuccgaaacauacaa

SEQ ID NO: 2217970 - RNA, 16 nt, Homo sapiens
aacucauuucuagcag

SEQ ID NO: 2217971 - RNA, 15 nt, Homo sapiens
gaccgccugcccugc

SEQ ID NO: 2217972 - RNA, 19 nt, Homo sapiens
gggaugucugaaaucagug

SEQ ID NO: 2217973 - RNA, 22 nt, Homo sapiens
ccaagugauccuuccaccucag

SEQ ID NO: 2217974 - RNA, 20 nt, Homo sapiens
gacucuuguuuucaguuuca

SEQ ID NO: 2217975 - RNA, 18 nt, Homo sapiens
aucuaguuuuggcaagaa

SEQ ID NO: 2217976 - RNA, 18 nt, Homo sapiens
aauauuugcaagacauag

SEQ ID NO: 2217977 - RNA, 16 nt, Homo sapiens
aaauuuuuacugagaa

SEQ ID NO: 2217978 - RNA, 16 nt, Homo sapiens
guuagauucacuuuga

SEQ ID NO: 2217979 - RNA, 15 nt, Homo sapiens
aaaugugcuggucac

SEQ ID NO: 2217980 - RNA, 19 nt, Homo sapiens
augaaucaaagacauggaa

SEQ ID NO: 2217981 - RNA, 11 nt, Homo sapiens
cuaaggcuucc

SEQ ID NO: 2217982 - RNA, 23 nt, Homo sapiens
caacaaaggauuaauugcugcaa

SEQ ID NO: 2217983 - RNA, 20 nt, Homo sapiens
ggucacccuaaggaaaggaa

SEQ ID NO: 2217984 - RNA, 18 nt, Homo sapiens
caagccaguacgugcuaa

SEQ ID NO: 2217985 - RNA, 23 nt, Homo sapiens
ccaagccuugauugguguugcca

SEQ ID NO: 2217986 - RNA, 13 nt, Homo sapiens
aagcucuucuaaa

SEQ ID NO: 2217987 - RNA, 18 nt, Homo sapiens
aauuaugugaaaugcuua

SEQ ID NO: 2217988 - RNA, 15 nt, Homo sapiens
caaagacuuguuaaa

SEQ ID NO: 2217989 - RNA, 17 nt, Homo sapiens
acaugaugacucaaggc

SEQ ID NO: 2217990 - RNA, 22 nt, Homo sapiens
acuauguuccaauaaaacuuua

SEQ ID NO: 2217991 - RNA, 14 nt, Homo sapiens
ccuuuggauggcua

SEQ ID NO: 2217992 - RNA, 15 nt, Homo sapiens
gccucagcaagccau

SEQ ID NO: 2217993 - RNA, 14 nt, Homo sapiens
uuuuuccuacuauc

SEQ ID NO: 2217994 - RNA, 14 nt, Homo sapiens
gccugucuggagcu

SEQ ID NO: 2217995 - RNA, 11 nt, Homo sapiens
caguaccucaa

SEQ ID NO: 2217996 - RNA, 14 nt, Homo sapiens
auuauuucuaaucc

SEQ ID NO: 2217997 - RNA, 22 nt, Homo sapiens
ccucaaagaagucggaauguca

SEQ ID NO: 2217998 - RNA, 13 nt, Homo sapiens
cuaggagcacugu

SEQ ID NO: 2217999 - RNA, 16 nt, Homo sapiens
uccccacccagucuca

SEQ ID NO: 2218000 - RNA, 22 nt, Homo sapiens
accagcauaauaaaaaggcaau

SEQ ID NO: 2218001 - RNA, 12 nt, Homo sapiens
aaacaaauaucg

SEQ ID NO: 2218002 - RNA, 12 nt, Homo sapiens
agcaggugcugu

SEQ ID NO: 2218003 - RNA, 22 nt, Homo sapiens
accaucucugugauuaccucuc

SEQ ID NO: 2218004 - RNA, 19 nt, Homo sapiens
caacuccacgaggugaaaa

SEQ ID NO: 2218005 - RNA, 12 nt, Homo sapiens
gauaucuacugu

SEQ ID NO: 2218006 - RNA, 16 nt, Homo sapiens
aggggcucauguucag

SEQ ID NO: 2218007 - RNA, 19 nt, Homo sapiens
aacugaggcucaggccaca

SEQ ID NO: 2218008 - RNA, 16 nt, Homo sapiens
agcuagaaaguggcag

SEQ ID NO: 2218009 - RNA, 22 nt, Homo sapiens
uaccucuuacuuugcuugagaa

SEQ ID NO: 2218010 - RNA, 20 nt, Homo sapiens
uuaagauucuugacuuauau

SEQ ID NO: 2218011 - RNA, 21 nt, Homo sapiens
agugauucaucuucacagcac

SEQ ID NO: 2218012 - RNA, 13 nt, Homo sapiens
ccccaugggaucu

SEQ ID NO: 2218013 - RNA, 18 nt, Homo sapiens
ugagcuuccccaagcacg

SEQ ID NO: 2218014 - RNA, 22 nt, Homo sapiens
cacacaauuacuaaaguacaga

SEQ ID NO: 2218015 - RNA, 17 nt, Homo sapiens
aacccagggcaaaugga

SEQ ID NO: 2218016 - RNA, 14 nt, Homo sapiens
uaauacucaccucc

SEQ ID NO: 2218017 - RNA, 19 nt, Homo sapiens
caugcaaucccauuugcag

SEQ ID NO: 2218018 - RNA, 19 nt, Homo sapiens
cuccgaggugguucagaca

SEQ ID NO: 2218019 - RNA, 19 nt, Homo sapiens
gcaaaaagauuuaacaaau

SEQ ID NO: 2218020 - RNA, 16 nt, Homo sapiens
gaauaauggaaucuau

SEQ ID NO: 2218021 - RNA, 22 nt, Homo sapiens
acugagaauauaauacuguauu

SEQ ID NO: 2218022 - RNA, 16 nt, Homo sapiens
caaguuauacaucuug

SEQ ID NO: 2218023 - RNA, 18 nt, Homo sapiens
uuuaaagacuaccuggga

SEQ ID NO: 2218024 - RNA, 21 nt, Homo sapiens
ccuagacucggggugcuuccu

SEQ ID NO: 2218025 - RNA, 14 nt, Homo sapiens
uuuaguuacuugag

SEQ ID NO: 2218026 - RNA, 18 nt, Homo sapiens
aagugacauugugucagu

SEQ ID NO: 2218027 - RNA, 22 nt, Homo sapiens
ccaggacccugaaggggccaug

SEQ ID NO: 2218028 - RNA, 14 nt, Homo sapiens
gaaaaugcccuguc

SEQ ID NO: 2218029 - RNA, 16 nt, Homo sapiens
cagaagggggucucuu

SEQ ID NO: 2218030 - RNA, 19 nt, Homo sapiens
uguccccacuuacagaucu

SEQ ID NO: 2218031 - RNA, 12 nt, Homo sapiens
cagcgcucccug

SEQ ID NO: 2218032 - RNA, 11 nt, Homo sapiens
acgccaaugca

SEQ ID NO: 2218033 - RNA, 14 nt, Homo sapiens
ugcugucaugccca

SEQ ID NO: 2218034 - RNA, 14 nt, Homo sapiens
cugccucacuguga

SEQ ID NO: 2218035 - RNA, 18 nt, Homo sapiens
aagaggugcuagcucuua

SEQ ID NO: 2218036 - RNA, 17 nt, Homo sapiens
accucacuuuugaaucu

SEQ ID NO: 2218037 - RNA, 22 nt, Homo sapiens
acuguagcccuggaccugccuc

SEQ ID NO: 2218038 - RNA, 14 nt, Homo sapiens
agauaccugugagg

SEQ ID NO: 2218039 - RNA, 13 nt, Homo sapiens
uagaaccaugaau

SEQ ID NO: 2218040 - RNA, 15 nt, Homo sapiens
aagaccaaagcauug

SEQ ID NO: 2218041 - RNA, 13 nt, Homo sapiens
ccacacccaggaa

SEQ ID NO: 2218042 - RNA, 20 nt, Homo sapiens
ccaugcaccucagggccaag

SEQ ID NO: 2218043 - RNA, 20 nt, Homo sapiens
ucggucaccuguuggcuaca

SEQ ID NO: 2218044 - RNA, 23 nt, Homo sapiens
ccaggccuacuguaaaccccaag

SEQ ID NO: 2218045 - RNA, 18 nt, Homo sapiens
gguuagagccaagcugca

SEQ ID NO: 2218046 - RNA, 20 nt, Homo sapiens
aacaucacugaaaugcuagc

SEQ ID NO: 2218047 - RNA, 15 nt, Homo sapiens
cuguguauucuagug

SEQ ID NO: 2218048 - RNA, 17 nt, Homo sapiens
caugugacuguggcauu

SEQ ID NO: 2218049 - RNA, 20 nt, Homo sapiens
auuuacagccucacuugaau

SEQ ID NO: 2218050 - RNA, 19 nt, Homo sapiens
uuauuaagguaacuacugc

SEQ ID NO: 2218051 - RNA, 22 nt, Homo sapiens
gagacccaagggcagagcauuu

SEQ ID NO: 2218052 - RNA, 22 nt, Homo sapiens
auuacauguguuuauucaucca

SEQ ID NO: 2218053 - RNA, 15 nt, Homo sapiens
caagggaugugcuua

SEQ ID NO: 2218054 - RNA, 18 nt, Homo sapiens
aucuguuagaugcuacua

SEQ ID NO: 2218055 - RNA, 15 nt, Homo sapiens
auauuuucaccauuu

SEQ ID NO: 2218056 - RNA, 18 nt, Homo sapiens
ugaauuuuugccuaucuu

SEQ ID NO: 2218057 - RNA, 16 nt, Homo sapiens
aucacuaaaccgauaa

SEQ ID NO: 2218058 - RNA, 15 nt, Homo sapiens
uauuauguagcugaa

SEQ ID NO: 2218059 - RNA, 18 nt, Homo sapiens
agggggagaauggguguu

SEQ ID NO: 2218060 - RNA, 14 nt, Homo sapiens
uuaaaaauaucaaa

SEQ ID NO: 2218061 - RNA, 19 nt, Homo sapiens
acccacccaauuggcccaa

SEQ ID NO: 2218062 - RNA, 17 nt, Homo sapiens
gccgagcccagaccucc

SEQ ID NO: 2218063 - RNA, 12 nt, Homo sapiens
gugcaucuggca

SEQ ID NO: 2218064 - RNA, 19 nt, Homo sapiens
cagucauccugcaggcaca

SEQ ID NO: 2218065 - RNA, 22 nt, Homo sapiens
ugauaagcaagaaagauuucau

SEQ ID NO: 2218066 - RNA, 13 nt, Homo sapiens
ccuucuaggcaaa

SEQ ID NO: 2218067 - RNA, 17 nt, Homo sapiens
augccuucacuuuacaa

SEQ ID NO: 2218068 - RNA, 22 nt, Homo sapiens
cagggucccuggaucaggguug

SEQ ID NO: 2218069 - RNA, 19 nt, Homo sapiens
gccccucuucccuuccucc

SEQ ID NO: 2218070 - RNA, 21 nt, Homo sapiens
uuuuccuuguauguucuuggg

SEQ ID NO: 2218071 - RNA, 15 nt, Homo sapiens
ccucuacaauuugcc

SEQ ID NO: 2218072 - RNA, 22 nt, Homo sapiens
aauucuagaggauguaucucac

SEQ ID NO: 2218073 - RNA, 16 nt, Homo sapiens
aauaguuacuauuuca

SEQ ID NO: 2218074 - RNA, 21 nt, Homo sapiens
gacaaggagugugaccacuga

SEQ ID NO: 2218075 - RNA, 15 nt, Homo sapiens
uccuugccugugacu

SEQ ID NO: 2218076 - RNA, 13 nt, Homo sapiens
uuccaaagccaau

SEQ ID NO: 2218077 - RNA, 13 nt, Homo sapiens
aggaaagauccca

SEQ ID NO: 2218078 - RNA, 18 nt, Homo sapiens
gcccugcagcccaccaga

SEQ ID NO: 2218079 - RNA, 23 nt, Homo sapiens
agaacugcccauuuccauggugc

SEQ ID NO: 2218080 - RNA, 13 nt, Homo sapiens
gaugcaugcaggg

SEQ ID NO: 2218081 - RNA, 14 nt, Homo sapiens
gagagauagccugu

SEQ ID NO: 2218082 - RNA, 14 nt, Homo sapiens
caaaaacuacacau

SEQ ID NO: 2218083 - RNA, 14 nt, Homo sapiens
agaccccuguucau

SEQ ID NO: 2218084 - RNA, 21 nt, Homo sapiens
cugccccggcaguggggagcg

SEQ ID NO: 2218085 - RNA, 20 nt, Homo sapiens
caaaacccucugcuucuccu

SEQ ID NO: 2218086 - RNA, 12 nt, Homo sapiens
uggcaccuguau

SEQ ID NO: 2218087 - RNA, 21 nt, Homo sapiens
uugaaggagaaaaugcauuau

SEQ ID NO: 2218088 - RNA, 18 nt, Homo sapiens
acaguacagcaugugccu

SEQ ID NO: 2218089 - RNA, 23 nt, Homo sapiens
ucccagugucuaauucccuguua

SEQ ID NO: 2218090 - RNA, 14 nt, Homo sapiens
ugauugucaccaug

SEQ ID NO: 2218091 - RNA, 22 nt, Homo sapiens
cuuuaaaauguauuuuucacaa

SEQ ID NO: 2218092 - RNA, 20 nt, Homo sapiens
auaaaugauuaaaaaaucag

SEQ ID NO: 2218093 - RNA, 11 nt, Homo sapiens
ugaacacuccc

SEQ ID NO: 2218094 - RNA, 14 nt, Homo sapiens
cuccacucacucca

SEQ ID NO: 2218095 - RNA, 17 nt, Homo sapiens
ucccugcacagugacuu

SEQ ID NO: 2218096 - RNA, 14 nt, Homo sapiens
gacugaaaauauau

SEQ ID NO: 2218097 - RNA, 18 nt, Homo sapiens
auauccuguguaccucac

SEQ ID NO: 2218098 - RNA, 13 nt, Homo sapiens
agagcuuacuuuu

SEQ ID NO: 2218099 - RNA, 21 nt, Homo sapiens
ugucugugcccuccaaagagc

SEQ ID NO: 2218100 - RNA, 21 nt, Homo sapiens
caggaacaauaaaaugucuuc

SEQ ID NO: 2218101 - RNA, 16 nt, Homo sapiens
ccaggcccaguccacu

SEQ ID NO: 2218102 - RNA, 13 nt, Homo sapiens
acauaaaaaccaa

SEQ ID NO: 2218103 - RNA, 21 nt, Homo sapiens
uaauaauucuuuguguucagu

SEQ ID NO: 2218104 - RNA, 22 nt, Homo sapiens
uggagccaccugucccaccuca

SEQ ID NO: 2218105 - RNA, 22 nt, Homo sapiens
uuaaacccaagugcugcacaaa

SEQ ID NO: 2218106 - RNA, 17 nt, Homo sapiens
uuucauuccaaagggga

SEQ ID NO: 2218107 - RNA, 18 nt, Homo sapiens
cagcgggacucuucucau

SEQ ID NO: 2218108 - RNA, 13 nt, Homo sapiens
agggucauagcau

SEQ ID NO: 2218109 - RNA, 21 nt, Homo sapiens
cugcauucaccuuagugcaac

SEQ ID NO: 2218110 - RNA, 16 nt, Homo sapiens
uaaauaacuaaugucu

SEQ ID NO: 2218111 - RNA, 15 nt, Homo sapiens
cugggaagugacuua

SEQ ID NO: 2218112 - RNA, 15 nt, Homo sapiens
guaaaugagccuuuc

SEQ ID NO: 2218113 - RNA, 17 nt, Homo sapiens
aggaauccccaacaugc

SEQ ID NO: 2218114 - RNA, 17 nt, Homo sapiens
ucagauccugggcauga

SEQ ID NO: 2218115 - RNA, 21 nt, Homo sapiens
gaauuauguaauauauuguac

SEQ ID NO: 2218116 - RNA, 21 nt, Homo sapiens
ccaggcugaucucaaacuccu

SEQ ID NO: 2218117 - RNA, 18 nt, Homo sapiens
uuaucaaagggugaaaau

SEQ ID NO: 2218118 - RNA, 19 nt, Homo sapiens
aucggguaagaugcuccug

SEQ ID NO: 2218119 - RNA, 17 nt, Homo sapiens
gcaaagaaugaaacaau

SEQ ID NO: 2218120 - RNA, 20 nt, Homo sapiens
agcaucgugcuguuugccuu

SEQ ID NO: 2218121 - RNA, 18 nt, Homo sapiens
uaaugaaggugugcuaca

SEQ ID NO: 2218122 - RNA, 12 nt, Homo sapiens
ugggccaaagaa

SEQ ID NO: 2218123 - RNA, 17 nt, Homo sapiens
gugaagccaaagggacu

SEQ ID NO: 2218124 - RNA, 12 nt, Homo sapiens
cagcucagggac

SEQ ID NO: 2218125 - RNA, 20 nt, Homo sapiens
acuggauucuuaaccaagaa

SEQ ID NO: 2218126 - RNA, 16 nt, Homo sapiens
aagccugcaugcauuc

SEQ ID NO: 2218127 - RNA, 11 nt, Homo sapiens
cagucauguca

SEQ ID NO: 2218128 - RNA, 20 nt, Homo sapiens
caggagaacaugcuggugaa

SEQ ID NO: 2218129 - RNA, 17 nt, Homo sapiens
uuuacauuuuucugaug

SEQ ID NO: 2218130 - RNA, 22 nt, Homo sapiens
uggaccaauagggcugagcucu

SEQ ID NO: 2218131 - RNA, 17 nt, Homo sapiens
guaacauuucuguucuc

SEQ ID NO: 2218132 - RNA, 12 nt, Homo sapiens
gggcagccagcc

SEQ ID NO: 2218133 - RNA, 15 nt, Homo sapiens
cugcuucugugcauu

SEQ ID NO: 2218134 - RNA, 18 nt, Homo sapiens
acaucccuacgugcccac

SEQ ID NO: 2218135 - RNA, 21 nt, Homo sapiens
agcuucuaaucccagcacuuu

SEQ ID NO: 2218136 - RNA, 21 nt, Homo sapiens
gcagcaaaacgacacugcgca

SEQ ID NO: 2218137 - RNA, 14 nt, Homo sapiens
ugaugaaacauuca

SEQ ID NO: 2218138 - RNA, 20 nt, Homo sapiens
aucuuccuccucuacuggua

SEQ ID NO: 2218139 - RNA, 23 nt, Homo sapiens
acuccuggucuccuccggggaug

SEQ ID NO: 2218140 - RNA, 22 nt, Homo sapiens
acucaacuucuuuccucuggag

SEQ ID NO: 2218141 - RNA, 22 nt, Homo sapiens
aagcugaccuggaaaugaauga

SEQ ID NO: 2218142 - RNA, 22 nt, Homo sapiens
aaaccuuccagagaacacaggg

SEQ ID NO: 2218143 - RNA, 14 nt, Homo sapiens
ccgcagagcucccu

SEQ ID NO: 2218144 - RNA, 14 nt, Homo sapiens
uagagcaacaguaa

SEQ ID NO: 2218145 - RNA, 23 nt, Homo sapiens
uuguauguuuaguagaaacgggg

SEQ ID NO: 2218146 - RNA, 20 nt, Homo sapiens
accugcgccuggcucuguca

SEQ ID NO: 2218147 - RNA, 15 nt, Homo sapiens
agaugcacacacacc

SEQ ID NO: 2218148 - RNA, 15 nt, Homo sapiens
ugcugcccucccaca

SEQ ID NO: 2218149 - RNA, 21 nt, Homo sapiens
aauguguguauauggacaaaa

SEQ ID NO: 2218150 - RNA, 19 nt, Homo sapiens
cucacaccuguaaucccaa

SEQ ID NO: 2218151 - RNA, 19 nt, Homo sapiens
gaagcucuugugaacuguc

SEQ ID NO: 2218152 - RNA, 19 nt, Homo sapiens
ucacaauaaaagaaacugu

SEQ ID NO: 2218153 - RNA, 16 nt, Homo sapiens
aagauauuguacauaa

SEQ ID NO: 2218154 - RNA, 18 nt, Homo sapiens
aggagcuugcaagaagca

SEQ ID NO: 2218155 - RNA, 18 nt, Homo sapiens
aucccaucucuccauaua

SEQ ID NO: 2218156 - RNA, 22 nt, Homo sapiens
ucuacucuuaaguuucucagcu

SEQ ID NO: 2218157 - RNA, 17 nt, Homo sapiens
uccuaggcuggaaggag

SEQ ID NO: 2218158 - RNA, 12 nt, Homo sapiens
aacuuuuugcca

SEQ ID NO: 2218159 - RNA, 16 nt, Homo sapiens
guucacacugcagaga

SEQ ID NO: 2218160 - RNA, 19 nt, Homo sapiens
cgagcccagcuacauuccu

SEQ ID NO: 2218161 - RNA, 22 nt, Homo sapiens
ugcuugggacauugcaauuugc

SEQ ID NO: 2218162 - RNA, 14 nt, Homo sapiens
agacgccuccccaa

SEQ ID NO: 2218163 - RNA, 19 nt, Homo sapiens
agaguguuuaauuguacuc

SEQ ID NO: 2218164 - RNA, 19 nt, Homo sapiens
auuuucacugcaaugucaa

SEQ ID NO: 2218165 - RNA, 16 nt, Homo sapiens
ggcucugggcggucca

SEQ ID NO: 2218166 - RNA, 13 nt, Homo sapiens
ggacuuuauuuaa

SEQ ID NO: 2218167 - RNA, 17 nt, Homo sapiens
ggacagccacacugcgc

SEQ ID NO: 2218168 - RNA, 12 nt, Homo sapiens
ggcuagagggug

SEQ ID NO: 2218169 - RNA, 22 nt, Homo sapiens
auuuucucccucuuucuuccca

SEQ ID NO: 2218170 - RNA, 21 nt, Homo sapiens
ggugcguguuuccugugcaag

SEQ ID NO: 2218171 - RNA, 16 nt, Homo sapiens
gcauagcucuauuuua

SEQ ID NO: 2218172 - RNA, 19 nt, Homo sapiens
ccauggcuguuggugggac

SEQ ID NO: 2218173 - RNA, 18 nt, Homo sapiens
uucauccuuccauccauc

SEQ ID NO: 2218174 - RNA, 13 nt, Homo sapiens
uucagugcuucuu

SEQ ID NO: 2218175 - RNA, 18 nt, Homo sapiens
cgggcuccagccaucuca

SEQ ID NO: 2218176 - RNA, 21 nt, Homo sapiens
uuguucuuuaaagucaggucc

SEQ ID NO: 2218177 - RNA, 18 nt, Homo sapiens
caaagcacaguuugaaca

SEQ ID NO: 2218178 - RNA, 18 nt, Homo sapiens
agaaugucauuugcuaau

SEQ ID NO: 2218179 - RNA, 11 nt, Homo sapiens
uucuuccaaaa

SEQ ID NO: 2218180 - RNA, 20 nt, Homo sapiens
gcguuaaagucaggauuuau

SEQ ID NO: 2218181 - RNA, 17 nt, Homo sapiens
caaaugcuuuaaaaacu

SEQ ID NO: 2218182 - RNA, 16 nt, Homo sapiens
cgcacaaauuccacau

SEQ ID NO: 2218183 - RNA, 19 nt, Homo sapiens
gcccccaucacacucggcc

SEQ ID NO: 2218184 - RNA, 21 nt, Homo sapiens
cgcccugcaugucuccucacc

SEQ ID NO: 2218185 - RNA, 21 nt, Homo sapiens
aaagaucauuuauaauacugu

SEQ ID NO: 2218186 - RNA, 18 nt, Homo sapiens
ugacaucagcaauacaga

SEQ ID NO: 2218187 - RNA, 15 nt, Homo sapiens
auguuuguacaagau

SEQ ID NO: 2218188 - RNA, 21 nt, Homo sapiens
uuuuuuaggaagcaagcuuaa

SEQ ID NO: 2218189 - RNA, 14 nt, Homo sapiens
acuaaacucugaau

SEQ ID NO: 2218190 - RNA, 18 nt, Homo sapiens
ccaauagggcugagcucu

SEQ ID NO: 2218191 - RNA, 17 nt, Homo sapiens
ugcauguauuagcucac

SEQ ID NO: 2218192 - RNA, 20 nt, Homo sapiens
cugcugcgucauuacagggc

SEQ ID NO: 2218193 - RNA, 18 nt, Homo sapiens
ccuuuaguuugcuucugu

SEQ ID NO: 2218194 - RNA, 15 nt, Homo sapiens
gcacucacacaggac

SEQ ID NO: 2218195 - RNA, 23 nt, Homo sapiens
uggcugagauucccucaccuguc

SEQ ID NO: 2218196 - RNA, 17 nt, Homo sapiens
aaauaguuuugcuuugu

SEQ ID NO: 2218197 - RNA, 16 nt, Homo sapiens
ucuagggcaguggagu

SEQ ID NO: 2218198 - RNA, 21 nt, Homo sapiens
ggcuauuauuuauuguauuag

SEQ ID NO: 2218199 - RNA, 17 nt, Homo sapiens
aaacuaaaucucuaaua

SEQ ID NO: 2218200 - RNA, 18 nt, Homo sapiens
ccaucgucucggccuuca

SEQ ID NO: 2218201 - RNA, 13 nt, Homo sapiens
aagucuccaugaa

SEQ ID NO: 2218202 - RNA, 20 nt, Homo sapiens
uauuugcacuauuuccacau

SEQ ID NO: 2218203 - RNA, 21 nt, Homo sapiens
caaauacuugacucagugaua

SEQ ID NO: 2218204 - RNA, 13 nt, Homo sapiens
uuggccuuaagga

SEQ ID NO: 2218205 - RNA, 17 nt, Homo sapiens
aaguccuuucuaaguau

SEQ ID NO: 2218206 - RNA, 15 nt, Homo sapiens
uacaguaaccaaaac

SEQ ID NO: 2218207 - RNA, 15 nt, Homo sapiens
aaaauaaaagcacuu

SEQ ID NO: 2218208 - RNA, 13 nt, Homo sapiens
uguauuaaugucu

SEQ ID NO: 2218209 - RNA, 18 nt, Homo sapiens
aagaaaauuugccaaucu

SEQ ID NO: 2218210 - RNA, 20 nt, Homo sapiens
gauacaugcauugcucuuau

SEQ ID NO: 2218211 - RNA, 20 nt, Homo sapiens
uauauaaagacaacaaaaga

SEQ ID NO: 2218212 - RNA, 19 nt, Homo sapiens
gacuucuuuuacucaugau

SEQ ID NO: 2218213 - RNA, 14 nt, Homo sapiens
acauuaaaccugga

SEQ ID NO: 2218214 - RNA, 14 nt, Homo sapiens
ugucuauuccauuc

SEQ ID NO: 2218215 - RNA, 22 nt, Homo sapiens
uagcaaggccagggcacagcug

SEQ ID NO: 2218216 - RNA, 23 nt, Homo sapiens
ugggauuauaggagugagccacc

SEQ ID NO: 2218217 - RNA, 14 nt, Homo sapiens
ugucaguucccaau

SEQ ID NO: 2218218 - RNA, 23 nt, Homo sapiens
gccucagcaucccaaagugcugg

SEQ ID NO: 2218219 - RNA, 22 nt, Homo sapiens
gcuggacgugcgcgaugccugg

SEQ ID NO: 2218220 - RNA, 18 nt, Homo sapiens
caccauuaacaggucuuu

SEQ ID NO: 2218221 - RNA, 18 nt, Homo sapiens
agauuuguugacagcaaa

SEQ ID NO: 2218222 - RNA, 15 nt, Homo sapiens
cccagccuacugccu

SEQ ID NO: 2218223 - RNA, 14 nt, Homo sapiens
uauuacauaugauu

SEQ ID NO: 2218224 - RNA, 14 nt, Homo sapiens
auacuaaauaugaa

SEQ ID NO: 2218225 - RNA, 14 nt, Homo sapiens
auagaaaauaucua

SEQ ID NO: 2218226 - RNA, 19 nt, Homo sapiens
ccaggaccacagagcuccu

SEQ ID NO: 2218227 - RNA, 17 nt, Homo sapiens
caugggucgcccaugag

SEQ ID NO: 2218228 - RNA, 17 nt, Homo sapiens
gagacagacacguguga

SEQ ID NO: 2218229 - RNA, 15 nt, Homo sapiens
ggccucaccugcugg

SEQ ID NO: 2218230 - RNA, 20 nt, Homo sapiens
guauucugacccaugggaga

SEQ ID NO: 2218231 - RNA, 16 nt, Homo sapiens
gacccgacacucucac

SEQ ID NO: 2218232 - RNA, 19 nt, Homo sapiens
ggaggcagggcagccucgc

SEQ ID NO: 2218233 - RNA, 22 nt, Homo sapiens
cugugucucaggugugcccuga

SEQ ID NO: 2218234 - RNA, 20 nt, Homo sapiens
ugcauucugagguaaccuca

SEQ ID NO: 2218235 - RNA, 19 nt, Homo sapiens
ggaaugccgcugucucuga

SEQ ID NO: 2218236 - RNA, 12 nt, Homo sapiens
gacgcugcugac

SEQ ID NO: 2218237 - RNA, 18 nt, Homo sapiens
ccuaaacccucugugaaa

SEQ ID NO: 2218238 - RNA, 22 nt, Homo sapiens
ggcuuuaauacaaaaagcaaaa

SEQ ID NO: 2218239 - RNA, 15 nt, Homo sapiens
augugcuuugcugca

SEQ ID NO: 2218240 - RNA, 20 nt, Homo sapiens
agugaagaugccagugaaac

SEQ ID NO: 2218241 - RNA, 18 nt, Homo sapiens
gaaggagcaagagaacau

SEQ ID NO: 2218242 - RNA, 19 nt, Homo sapiens
cuggggagacaaaucucag

SEQ ID NO: 2218243 - RNA, 21 nt, Homo sapiens
uuaaaacaaaccuugugcucu

SEQ ID NO: 2218244 - RNA, 13 nt, Homo sapiens
uucauugcacuuu

SEQ ID NO: 2218245 - RNA, 18 nt, Homo sapiens
auauuaucuaacagacaa

SEQ ID NO: 2218246 - RNA, 19 nt, Homo sapiens
uucugcuguucuucacuuc

SEQ ID NO: 2218247 - RNA, 21 nt, Homo sapiens
gucuccuaagcuggagugcag

SEQ ID NO: 2218248 - RNA, 21 nt, Homo sapiens
ccugacccugugaugccugac

SEQ ID NO: 2218249 - RNA, 19 nt, Homo sapiens
aaacaauccugacuuuuau

SEQ ID NO: 2218250 - RNA, 20 nt, Homo sapiens
gcccuccuuugccuuccacc

SEQ ID NO: 2218251 - RNA, 18 nt, Homo sapiens
ccaguggugcgggccagg

SEQ ID NO: 2218252 - RNA, 12 nt, Homo sapiens
guaaugcacaau

SEQ ID NO: 2218253 - RNA, 11 nt, Homo sapiens
uuuggggcuca

SEQ ID NO: 2218254 - RNA, 17 nt, Homo sapiens
ccuauugaaagaccaga

SEQ ID NO: 2218255 - RNA, 19 nt, Homo sapiens
uucaguugaucacuggcaa

SEQ ID NO: 2218256 - RNA, 15 nt, Homo sapiens
cauguaaaacaguua

SEQ ID NO: 2218257 - RNA, 21 nt, Homo sapiens
gcagaccacugauaaaaccau

SEQ ID NO: 2218258 - RNA, 18 nt, Homo sapiens
ccagcugggaagcccuuu

SEQ ID NO: 2218259 - RNA, 14 nt, Homo sapiens
uuaguacaauuuca

SEQ ID NO: 2218260 - RNA, 17 nt, Homo sapiens
cuuuggaaaauucagau

SEQ ID NO: 2218261 - RNA, 12 nt, Homo sapiens
gaagucuugggu

SEQ ID NO: 2218262 - RNA, 17 nt, Homo sapiens
cagcauaccacgccaca

SEQ ID NO: 2218263 - RNA, 18 nt, Homo sapiens
aacauaagaucacugcca

SEQ ID NO: 2218264 - RNA, 15 nt, Homo sapiens
augcauugcuaaaau

SEQ ID NO: 2218265 - RNA, 18 nt, Homo sapiens
gccauaagcaagucuaua

SEQ ID NO: 2218266 - RNA, 13 nt, Homo sapiens
ucuuagcuauguu

SEQ ID NO: 2218267 - RNA, 15 nt, Homo sapiens
ucauuggaagccauc

SEQ ID NO: 2218268 - RNA, 19 nt, Homo sapiens
agaguacugucccaggaau

SEQ ID NO: 2218269 - RNA, 14 nt, Homo sapiens
ucugggcccagaac

SEQ ID NO: 2218270 - RNA, 18 nt, Homo sapiens
acauuucuauagccaaaa

SEQ ID NO: 2218271 - RNA, 17 nt, Homo sapiens
cucaccaccugccucua

SEQ ID NO: 2218272 - RNA, 14 nt, Homo sapiens
ugcugcaugaaaag

SEQ ID NO: 2218273 - RNA, 24 nt, Homo sapiens
uaaaauaacuuauaucaucagcau

SEQ ID NO: 2218274 - RNA, 14 nt, Homo sapiens
accagagcaguuuc

SEQ ID NO: 2218275 - RNA, 14 nt, Homo sapiens
auguuuuguacuua

SEQ ID NO: 2218276 - RNA, 19 nt, Homo sapiens
ugcaagaacucaucacugu

SEQ ID NO: 2218277 - RNA, 22 nt, Homo sapiens
cccaauaaacucaccuacucau

SEQ ID NO: 2218278 - RNA, 14 nt, Homo sapiens
cuguuccccagaga

SEQ ID NO: 2218279 - RNA, 18 nt, Homo sapiens
uaaagaauaaaugaaucu

SEQ ID NO: 2218280 - RNA, 14 nt, Homo sapiens
aaggucugaugucu

SEQ ID NO: 2218281 - RNA, 22 nt, Homo sapiens
ccaggaacccuccagaccuccc

SEQ ID NO: 2218282 - RNA, 11 nt, Homo sapiens
ugaaaugccaa

SEQ ID NO: 2218283 - RNA, 20 nt, Homo sapiens
gaauccccgugcucacagua

SEQ ID NO: 2218284 - RNA, 23 nt, Homo sapiens
aggauauuuacuauuacucccag

SEQ ID NO: 2218285 - RNA, 14 nt, Homo sapiens
gcccagacccagcc

SEQ ID NO: 2218286 - RNA, 16 nt, Homo sapiens
uauucugcaagcaauc

SEQ ID NO: 2218287 - RNA, 12 nt, Homo sapiens
acauagcauuug

SEQ ID NO: 2218288 - RNA, 14 nt, Homo sapiens
uucuuguaucugga

SEQ ID NO: 2218289 - RNA, 21 nt, Homo sapiens
gagcacuaucuuucaggaaau

SEQ ID NO: 2218290 - RNA, 18 nt, Homo sapiens
ugucacgucuucugagaa

SEQ ID NO: 2218291 - RNA, 16 nt, Homo sapiens
uauuuaauucacuuaa

SEQ ID NO: 2218292 - RNA, 17 nt, Homo sapiens
uggucuuugcaaaaagg

SEQ ID NO: 2218293 - RNA, 13 nt, Homo sapiens
cuuuuaauucaaa

SEQ ID NO: 2218294 - RNA, 17 nt, Homo sapiens
ucaucaguccuaccuga

SEQ ID NO: 2218295 - RNA, 14 nt, Homo sapiens
augagaagauauau

SEQ ID NO: 2218296 - RNA, 23 nt, Homo sapiens
acuugaguuagcauaauacagaa

SEQ ID NO: 2218297 - RNA, 16 nt, Homo sapiens
acuacagaguguuaua

SEQ ID NO: 2218298 - RNA, 21 nt, Homo sapiens
acaguauuuuagguaugauuu

SEQ ID NO: 2218299 - RNA, 20 nt, Homo sapiens
cucugcugucuaaccuguga

SEQ ID NO: 2218300 - RNA, 16 nt, Homo sapiens
cuaggccugaaaugac

SEQ ID NO: 2218301 - RNA, 14 nt, Homo sapiens
agggggaagacaga

SEQ ID NO: 2218302 - RNA, 16 nt, Homo sapiens
cuauaaagaagaacuu

SEQ ID NO: 2218303 - RNA, 14 nt, Homo sapiens
ccacuuuauugcca

SEQ ID NO: 2218304 - RNA, 19 nt, Homo sapiens
aagagagaacaguugucca

SEQ ID NO: 2218305 - RNA, 12 nt, Homo sapiens
gauaguugccuu

SEQ ID NO: 2218306 - RNA, 16 nt, Homo sapiens
auuucuguuugaaugc

SEQ ID NO: 2218307 - RNA, 22 nt, Homo sapiens
aaguuaguuuuaguucuguaga

SEQ ID NO: 2218308 - RNA, 16 nt, Homo sapiens
uauggcuccuccauau

SEQ ID NO: 2218309 - RNA, 20 nt, Homo sapiens
uacacaucuuccacaggucu

SEQ ID NO: 2218310 - RNA, 22 nt, Homo sapiens
aguauagcuuuauacucucucc

SEQ ID NO: 2218311 - RNA, 17 nt, Homo sapiens
ugaggugcccaggagaa

SEQ ID NO: 2218312 - RNA, 16 nt, Homo sapiens
caggaaaaacccguca

SEQ ID NO: 2218313 - RNA, 17 nt, Homo sapiens
ccuuuuguuuuccacuc

SEQ ID NO: 2218314 - RNA, 15 nt, Homo sapiens
acuuuuaaguacuua

SEQ ID NO: 2218315 - RNA, 18 nt, Homo sapiens
gcacuccccguguucaua

SEQ ID NO: 2218316 - RNA, 20 nt, Homo sapiens
uuguacagacguaugcuuau

SEQ ID NO: 2218317 - RNA, 18 nt, Homo sapiens
aucucccucuaagcacau

SEQ ID NO: 2218318 - RNA, 19 nt, Homo sapiens
cagagagcggucucaggcu

SEQ ID NO: 2218319 - RNA, 21 nt, Homo sapiens
auuucuuuuuuaaaugaagaa

SEQ ID NO: 2218320 - RNA, 13 nt, Homo sapiens
cugcauugcuaga

SEQ ID NO: 2218321 - RNA, 19 nt, Homo sapiens
ccucauuuucacagcacua

SEQ ID NO: 2218322 - RNA, 16 nt, Homo sapiens
acaagaaacagccacu

SEQ ID NO: 2218323 - RNA, 17 nt, Homo sapiens
uggacacaacaccaaaa

SEQ ID NO: 2218324 - RNA, 20 nt, Homo sapiens
uacuaguacuauugcuauua

SEQ ID NO: 2218325 - RNA, 21 nt, Homo sapiens
ucauaaccucaaggaaccaua

SEQ ID NO: 2218326 - RNA, 20 nt, Homo sapiens
ggggcccaagccccaucuca

SEQ ID NO: 2218327 - RNA, 10 nt, Homo sapiens
ugcucucagc

SEQ ID NO: 2218328 - RNA, 15 nt, Homo sapiens
ugguaagaccucuga

SEQ ID NO: 2218329 - RNA, 21 nt, Homo sapiens
aauacaugucuagaacugauc

SEQ ID NO: 2218330 - RNA, 23 nt, Homo sapiens
auuucuucuucuaagaagacauu

SEQ ID NO: 2218331 - RNA, 19 nt, Homo sapiens
acguguguccuuugguacu

SEQ ID NO: 2218332 - RNA, 15 nt, Homo sapiens
ugcuggugucauugc

SEQ ID NO: 2218333 - RNA, 22 nt, Homo sapiens
cuugagugagaagagcuugcac

SEQ ID NO: 2218334 - RNA, 15 nt, Homo sapiens
aauugaaacauuuac

SEQ ID NO: 2218335 - RNA, 21 nt, Homo sapiens
acaucgaggcucuugcucaag

SEQ ID NO: 2218336 - RNA, 19 nt, Homo sapiens
cuuggcaaauuccuaguca

SEQ ID NO: 2218337 - RNA, 13 nt, Homo sapiens
auaaauccaguga

SEQ ID NO: 2218338 - RNA, 21 nt, Homo sapiens
ucugggccuucucaccacaga

SEQ ID NO: 2218339 - RNA, 13 nt, Homo sapiens
cuuuuacauucug

SEQ ID NO: 2218340 - RNA, 21 nt, Homo sapiens
cuaauaaauauuuagucugca

SEQ ID NO: 2218341 - RNA, 16 nt, Homo sapiens
uuuugagagacagggu

SEQ ID NO: 2218342 - RNA, 15 nt, Homo sapiens
aauuuaugcauuuca

SEQ ID NO: 2218343 - RNA, 18 nt, Homo sapiens
ugccuaguuucuuacaca

SEQ ID NO: 2218344 - RNA, 17 nt, Homo sapiens
aucuuauaaacugacuu

SEQ ID NO: 2218345 - RNA, 20 nt, Homo sapiens
uaaauacuguaacacuguau

SEQ ID NO: 2218346 - RNA, 19 nt, Homo sapiens
aacaaauuaacuagauaca

SEQ ID NO: 2218347 - RNA, 15 nt, Homo sapiens
ucucuccucaguuuc

SEQ ID NO: 2218348 - RNA, 21 nt, Homo sapiens
agcccuagugggagcccagca

SEQ ID NO: 2218349 - RNA, 21 nt, Homo sapiens
agccaccugggggagcuggaa

SEQ ID NO: 2218350 - RNA, 14 nt, Homo sapiens
auaaacaacuuuca

SEQ ID NO: 2218351 - RNA, 14 nt, Homo sapiens
cacuauuacuggga

SEQ ID NO: 2218352 - RNA, 18 nt, Homo sapiens
cagggagugaugauuugg

SEQ ID NO: 2218353 - RNA, 20 nt, Homo sapiens
aguaauucccaucugcuuua

SEQ ID NO: 2218354 - RNA, 18 nt, Homo sapiens
agauucagugguucaaua

SEQ ID NO: 2218355 - RNA, 17 nt, Homo sapiens
gaauucaccaguguucc

SEQ ID NO: 2218356 - RNA, 20 nt, Homo sapiens
agaggugaaagcuauaucaa

SEQ ID NO: 2218357 - RNA, 19 nt, Homo sapiens
aaauuacuuaguauugcaa

SEQ ID NO: 2218358 - RNA, 11 nt, Homo sapiens
cagucuucagc

SEQ ID NO: 2218359 - RNA, 20 nt, Homo sapiens
gaucagcuuugaaggcugga

SEQ ID NO: 2218360 - RNA, 15 nt, Homo sapiens
cugugaaaugacugc

SEQ ID NO: 2218361 - RNA, 20 nt, Homo sapiens
caugcaugucuaaccugauu

SEQ ID NO: 2218362 - RNA, 21 nt, Homo sapiens
uuccaaggaaauacauaugca

SEQ ID NO: 2218363 - RNA, 17 nt, Homo sapiens
ccaggcuuucaauguuu

SEQ ID NO: 2218364 - RNA, 21 nt, Homo sapiens
gccuucccuugcccaugugaa

SEQ ID NO: 2218365 - RNA, 17 nt, Homo sapiens
cacagagugccaucccu

SEQ ID NO: 2218366 - RNA, 21 nt, Homo sapiens
gcagaaggucuggucggcaaa

SEQ ID NO: 2218367 - RNA, 15 nt, Homo sapiens
gcccugcaccaugcu

SEQ ID NO: 2218368 - RNA, 15 nt, Homo sapiens
gaguucuauccccaa

SEQ ID NO: 2218369 - RNA, 15 nt, Homo sapiens
cgucuguccuccuuu

SEQ ID NO: 2218370 - RNA, 23 nt, Homo sapiens
uccccuuuguggauucuuuuugg

SEQ ID NO: 2218371 - RNA, 22 nt, Homo sapiens
aggcguugugaaugugucccau

SEQ ID NO: 2218372 - RNA, 20 nt, Homo sapiens
ucucccaacucuugcacagu

SEQ ID NO: 2218373 - RNA, 15 nt, Homo sapiens
cuggccucugugauu

SEQ ID NO: 2218374 - RNA, 16 nt, Homo sapiens
cugauagucaccugcu

SEQ ID NO: 2218375 - RNA, 23 nt, Homo sapiens
caauuuuuaaaaaguuugaauag

SEQ ID NO: 2218376 - RNA, 18 nt, Homo sapiens
aaucuauaacuacauauu

SEQ ID NO: 2218377 - RNA, 18 nt, Homo sapiens
acacuguuacuuucguac

SEQ ID NO: 2218378 - RNA, 19 nt, Homo sapiens
augacagcucuucuaagga

SEQ ID NO: 2218379 - RNA, 20 nt, Homo sapiens
ucuuuauauggccucaagau

SEQ ID NO: 2218380 - RNA, 13 nt, Homo sapiens
cggacaucauucu

SEQ ID NO: 2218381 - RNA, 18 nt, Homo sapiens
gagucugcaucauccucc

SEQ ID NO: 2218382 - RNA, 21 nt, Homo sapiens
uaagaaggcccugcaugugua

SEQ ID NO: 2218383 - RNA, 17 nt, Homo sapiens
accugggugugcccacg

SEQ ID NO: 2218384 - RNA, 15 nt, Homo sapiens
uguucuuagagugua

SEQ ID NO: 2218385 - RNA, 21 nt, Homo sapiens
cuugacuuuagucugcaaaau

SEQ ID NO: 2218386 - RNA, 14 nt, Homo sapiens
agugcuaagcauua

SEQ ID NO: 2218387 - RNA, 20 nt, Homo sapiens
caaacuuuugaaagauguau

SEQ ID NO: 2218388 - RNA, 12 nt, Homo sapiens
ccagucagggcc

SEQ ID NO: 2218389 - RNA, 15 nt, Homo sapiens
acuuguuucccuuuc

SEQ ID NO: 2218390 - RNA, 17 nt, Homo sapiens
guuauguuugcacuuug

SEQ ID NO: 2218391 - RNA, 18 nt, Homo sapiens
acacuagaaaacuugacu

SEQ ID NO: 2218392 - RNA, 18 nt, Homo sapiens
auagcagcacagcugcca

SEQ ID NO: 2218393 - RNA, 20 nt, Homo sapiens
aagaaugucuguaccuugau

SEQ ID NO: 2218394 - RNA, 13 nt, Homo sapiens
ugcguucuuucaa

SEQ ID NO: 2218395 - RNA, 13 nt, Homo sapiens
uuuauucuuguga

SEQ ID NO: 2218396 - RNA, 20 nt, Homo sapiens
uagaaauaaauaacuuugga

SEQ ID NO: 2218397 - RNA, 22 nt, Homo sapiens
cugcacacagggugguggcaca

SEQ ID NO: 2218398 - RNA, 17 nt, Homo sapiens
gcuccuuuaccuaccac

SEQ ID NO: 2218399 - RNA, 16 nt, Homo sapiens
acuguuauuaugcauu

SEQ ID NO: 2218400 - RNA, 14 nt, Homo sapiens
auucauguacaaug

SEQ ID NO: 2218401 - RNA, 17 nt, Homo sapiens
cuacaguuuuaacugug

SEQ ID NO: 2218402 - RNA, 14 nt, Homo sapiens
gaggccauggacuc

SEQ ID NO: 2218403 - RNA, 16 nt, Homo sapiens
ugggccuucgggguga

SEQ ID NO: 2218404 - RNA, 17 nt, Homo sapiens
cagauacugcuguguaa

SEQ ID NO: 2218405 - RNA, 15 nt, Homo sapiens
accaggauagcuuua

SEQ ID NO: 2218406 - RNA, 17 nt, Homo sapiens
aaugcuuaguuggugaa

SEQ ID NO: 2218407 - RNA, 16 nt, Homo sapiens
guguuuaaaacaugca

SEQ ID NO: 2218408 - RNA, 16 nt, Homo sapiens
ggcuucuacacugggu

SEQ ID NO: 2218409 - RNA, 15 nt, Homo sapiens
auauacuaguccuga

SEQ ID NO: 2218410 - RNA, 13 nt, Homo sapiens
ucugaagucacau

SEQ ID NO: 2218411 - RNA, 20 nt, Homo sapiens
aacuucaugcuggccugugu

SEQ ID NO: 2218412 - RNA, 16 nt, Homo sapiens
ucuucaaugguucucu

SEQ ID NO: 2218413 - RNA, 19 nt, Homo sapiens
uaaguaaaagcuacuaugu

SEQ ID NO: 2218414 - RNA, 20 nt, Homo sapiens
uuucccuuacucccuaucua

SEQ ID NO: 2218415 - RNA, 13 nt, Homo sapiens
augaaaacauuca

SEQ ID NO: 2218416 - RNA, 22 nt, Homo sapiens
aguucaccagcccugagccaug

SEQ ID NO: 2218417 - RNA, 21 nt, Homo sapiens
cagugggaaacaaacugucua

SEQ ID NO: 2218418 - RNA, 19 nt, Homo sapiens
aucuaguuucccuggugcc

SEQ ID NO: 2218419 - RNA, 18 nt, Homo sapiens
ucuuucggaaaugauuga

SEQ ID NO: 2218420 - RNA, 21 nt, Homo sapiens
ccuggccaccagccauccucc

SEQ ID NO: 2218421 - RNA, 22 nt, Homo sapiens
uggccccuucuggggguggugg

SEQ ID NO: 2218422 - RNA, 23 nt, Homo sapiens
guacacauuccugcauucaugua

SEQ ID NO: 2218423 - RNA, 14 nt, Homo sapiens
cugcagacuauaaa

SEQ ID NO: 2218424 - RNA, 20 nt, Homo sapiens
ccaauagcacuuucauugcc

SEQ ID NO: 2218425 - RNA, 17 nt, Homo sapiens
uggcagauuuucuucua

SEQ ID NO: 2218426 - RNA, 21 nt, Homo sapiens
cuucuuaaucuuuucacaaau

SEQ ID NO: 2218427 - RNA, 17 nt, Homo sapiens
ugucagauguacauaga

SEQ ID NO: 2218428 - RNA, 19 nt, Homo sapiens
ugaaccaauaugaacugca

SEQ ID NO: 2218429 - RNA, 12 nt, Homo sapiens
cauuucuuccac

SEQ ID NO: 2218430 - RNA, 12 nt, Homo sapiens
uuguugugagaa

SEQ ID NO: 2218431 - RNA, 13 nt, Homo sapiens
gcggagguugcag

SEQ ID NO: 2218432 - RNA, 22 nt, Homo sapiens
aaaauauguuuggaauauucca

SEQ ID NO: 2218433 - RNA, 22 nt, Homo sapiens
auuuacuaaaucaaucugcagu

SEQ ID NO: 2218434 - RNA, 14 nt, Homo sapiens
aagaggccugugau

SEQ ID NO: 2218435 - RNA, 21 nt, Homo sapiens
uucacaguucuuugggccaga

SEQ ID NO: 2218436 - RNA, 17 nt, Homo sapiens
agucaucagaaauucca

SEQ ID NO: 2218437 - RNA, 16 nt, Homo sapiens
caagauuucacaucag

SEQ ID NO: 2218438 - RNA, 24 nt, Homo sapiens
acacacaguuguugaaugacugac

SEQ ID NO: 2218439 - RNA, 21 nt, Homo sapiens
ugccuguggugagguccuguc

SEQ ID NO: 2218440 - RNA, 20 nt, Homo sapiens
guuaaaaaaaagaauaaagg

SEQ ID NO: 2218441 - RNA, 15 nt, Homo sapiens
ucuuccuccucccaa

SEQ ID NO: 2218442 - RNA, 15 nt, Homo sapiens
uguuauguggaggaa

SEQ ID NO: 2218443 - RNA, 16 nt, Homo sapiens
gacauauucacaguga

SEQ ID NO: 2218444 - RNA, 15 nt, Homo sapiens
gcucuuucucugcca

SEQ ID NO: 2218445 - RNA, 16 nt, Homo sapiens
augcaugagcucccuc

SEQ ID NO: 2218446 - RNA, 14 nt, Homo sapiens
agaaccugguggcu

SEQ ID NO: 2218447 - RNA, 21 nt, Homo sapiens
gcagcuuucaagcucaucugu

SEQ ID NO: 2218448 - RNA, 23 nt, Homo sapiens
agacucagcuggaagucuaccug

SEQ ID NO: 2218449 - RNA, 17 nt, Homo sapiens
gcucucaggugccaguc

SEQ ID NO: 2218450 - RNA, 20 nt, Homo sapiens
aaaauuuuuguuugguuaua

SEQ ID NO: 2218451 - RNA, 17 nt, Homo sapiens
ggggaugccuugguuuu

SEQ ID NO: 2218452 - RNA, 22 nt, Homo sapiens
caugaaacagcagcugaagcca

SEQ ID NO: 2218453 - RNA, 20 nt, Homo sapiens
auuacaugaaaguucagauu

SEQ ID NO: 2218454 - RNA, 18 nt, Homo sapiens
acaguuaugggacacuga

SEQ ID NO: 2218455 - RNA, 16 nt, Homo sapiens
cuucaauuagucucag

SEQ ID NO: 2218456 - RNA, 23 nt, Homo sapiens
cuccugcgcccuucauugccaca

SEQ ID NO: 2218457 - RNA, 16 nt, Homo sapiens
gcccacuucugccaua

SEQ ID NO: 2218458 - RNA, 19 nt, Homo sapiens
ugaagaugacaaaaguaaa

SEQ ID NO: 2218459 - RNA, 16 nt, Homo sapiens
uaaaagguuguguaca

SEQ ID NO: 2218460 - RNA, 22 nt, Homo sapiens
auguugagaauguucaucucuc

SEQ ID NO: 2218461 - RNA, 19 nt, Homo sapiens
uaaaacuguuauuuuuaca

SEQ ID NO: 2218462 - RNA, 22 nt, Homo sapiens
ugcccuuaccccacacacaguc

SEQ ID NO: 2218463 - RNA, 16 nt, Homo sapiens
ugguaacuuugcaaau

SEQ ID NO: 2218464 - RNA, 15 nt, Homo sapiens
uggucuccaugcuca

SEQ ID NO: 2218465 - RNA, 17 nt, Homo sapiens
agaauuguuuucuuaca

SEQ ID NO: 2218466 - RNA, 22 nt, Homo sapiens
uggcccaugugacuguggcauu

SEQ ID NO: 2218467 - RNA, 16 nt, Homo sapiens
cugaacucuaagcaga

SEQ ID NO: 2218468 - RNA, 15 nt, Homo sapiens
ucaccauguacauag

SEQ ID NO: 2218469 - RNA, 15 nt, Homo sapiens
auaugggcacuuuaa

SEQ ID NO: 2218470 - RNA, 14 nt, Homo sapiens
ugugcuaagucuuu

SEQ ID NO: 2218471 - RNA, 21 nt, Homo sapiens
uucaaauuaagugugcaugau

SEQ ID NO: 2218472 - RNA, 17 nt, Homo sapiens
acugggagcugcuccua

SEQ ID NO: 2218473 - RNA, 22 nt, Homo sapiens
uacucauucagggauagcacug

SEQ ID NO: 2218474 - RNA, 18 nt, Homo sapiens
aguauuuaggauaaccuu

SEQ ID NO: 2218475 - RNA, 23 nt, Homo sapiens
acagggccaguggggccugugga

SEQ ID NO: 2218476 - RNA, 13 nt, Homo sapiens
ccauugcuguuca

SEQ ID NO: 2218477 - RNA, 12 nt, Homo sapiens
aaaguuacugua

SEQ ID NO: 2218478 - RNA, 20 nt, Homo sapiens
cuucuuaaaaucaaauguaa

SEQ ID NO: 2218479 - RNA, 17 nt, Homo sapiens
ugcccacaacuugucac

SEQ ID NO: 2218480 - RNA, 19 nt, Homo sapiens
aggagugugugacauucca

SEQ ID NO: 2218481 - RNA, 19 nt, Homo sapiens
auuauguaauauauuguac

SEQ ID NO: 2218482 - RNA, 15 nt, Homo sapiens
cauguucccccuaaa

SEQ ID NO: 2218483 - RNA, 21 nt, Homo sapiens
cauuccucacgcccuucaaug

SEQ ID NO: 2218484 - RNA, 16 nt, Homo sapiens
uagcuuaagaucaaaa

SEQ ID NO: 2218485 - RNA, 15 nt, Homo sapiens
aagccuggcacccac

SEQ ID NO: 2218486 - RNA, 15 nt, Homo sapiens
agaagacaaggcaug

SEQ ID NO: 2218487 - RNA, 16 nt, Homo sapiens
ccagccguauuuuaca

SEQ ID NO: 2218488 - RNA, 23 nt, Homo sapiens
acugugcaggaguggccggggaa

SEQ ID NO: 2218489 - RNA, 16 nt, Homo sapiens
gagccuccucgucacc

SEQ ID NO: 2218490 - RNA, 18 nt, Homo sapiens
acccugagagucugagaa

SEQ ID NO: 2218491 - RNA, 21 nt, Homo sapiens
aauagcugggacuacaggugu

SEQ ID NO: 2218492 - RNA, 15 nt, Homo sapiens
ugaauuucuggaaga

SEQ ID NO: 2218493 - RNA, 20 nt, Homo sapiens
gaaagugagagccagcagca

SEQ ID NO: 2218494 - RNA, 19 nt, Homo sapiens
aacagugcaacacuggucu

SEQ ID NO: 2218495 - RNA, 16 nt, Homo sapiens
caugcauaaaugcgau

SEQ ID NO: 2218496 - RNA, 14 nt, Homo sapiens
ucaucucugugacc

SEQ ID NO: 2218497 - RNA, 15 nt, Homo sapiens
cucaauccuaucaca

SEQ ID NO: 2218498 - RNA, 21 nt, Homo sapiens
gaugguguguccagcacucga

SEQ ID NO: 2218499 - RNA, 19 nt, Homo sapiens
uucugagugugcagacagc

SEQ ID NO: 2218500 - RNA, 17 nt, Homo sapiens
ggggccgcugggguccg

SEQ ID NO: 2218501 - RNA, 16 nt, Homo sapiens
guucacaaacuaccuc

SEQ ID NO: 2218502 - RNA, 14 nt, Homo sapiens
uaugcucuaaacau

SEQ ID NO: 2218503 - RNA, 13 nt, Homo sapiens
cagugugcaaggg

SEQ ID NO: 2218504 - RNA, 19 nt, Homo sapiens
aucacagucaauggaucca

SEQ ID NO: 2218505 - RNA, 14 nt, Homo sapiens
gaaauguaacauac

SEQ ID NO: 2218506 - RNA, 14 nt, Homo sapiens
ucacuuaaucuuuc

SEQ ID NO: 2218507 - RNA, 15 nt, Homo sapiens
augggguuucacaaa

SEQ ID NO: 2218508 - RNA, 12 nt, Homo sapiens
agccauuuucca

SEQ ID NO: 2218509 - RNA, 12 nt, Homo sapiens
ucugacucccaa

SEQ ID NO: 2218510 - RNA, 20 nt, Homo sapiens
gaaaauaugcauaaucagac

SEQ ID NO: 2218511 - RNA, 15 nt, Homo sapiens
ucauguacagcauua

SEQ ID NO: 2218512 - RNA, 14 nt, Homo sapiens
ggagauccacuggg

SEQ ID NO: 2218513 - RNA, 21 nt, Homo sapiens
uuccuuaaugaaaaauacaua

SEQ ID NO: 2218514 - RNA, 18 nt, Homo sapiens
aguaccacacauauugca

SEQ ID NO: 2218515 - RNA, 23 nt, Homo sapiens
uuacugugauauuuuaaauaucc

SEQ ID NO: 2218516 - RNA, 16 nt, Homo sapiens
acucuggcugccaaga

SEQ ID NO: 2218517 - RNA, 15 nt, Homo sapiens
aagccauuccaaagu

SEQ ID NO: 2218518 - RNA, 24 nt, Homo sapiens
agaucucccuuaauaaacucacaa

SEQ ID NO: 2218519 - RNA, 23 nt, Homo sapiens
cagucugugauccuuggugcugu

SEQ ID NO: 2218520 - RNA, 17 nt, Homo sapiens
ugaaagugguacuugau

SEQ ID NO: 2218521 - RNA, 24 nt, Homo sapiens
ucugaagccuucuuuguggccuuu

SEQ ID NO: 2218522 - RNA, 14 nt, Homo sapiens
auagcucaauaaaa

SEQ ID NO: 2218523 - RNA, 14 nt, Homo sapiens
caaaaucacaagca

SEQ ID NO: 2218524 - RNA, 20 nt, Homo sapiens
ccuguaacccuggcacuuaa

SEQ ID NO: 2218525 - RNA, 11 nt, Homo sapiens
augcccagaag

SEQ ID NO: 2218526 - RNA, 12 nt, Homo sapiens
agaaacaaugac

SEQ ID NO: 2218527 - RNA, 14 nt, Homo sapiens
agcucaucacugug

SEQ ID NO: 2218528 - RNA, 12 nt, Homo sapiens
aaagccacuucu

SEQ ID NO: 2218529 - RNA, 22 nt, Homo sapiens
uggucacaacuugauggcugcg

SEQ ID NO: 2218530 - RNA, 20 nt, Homo sapiens
acuauucccacuuucauuca

SEQ ID NO: 2218531 - RNA, 21 nt, Homo sapiens
cucauuaucuugcagcuguaa

SEQ ID NO: 2218532 - RNA, 15 nt, Homo sapiens
gucuugucucaagaa

SEQ ID NO: 2218533 - RNA, 19 nt, Homo sapiens
ugguggccagccagaucaa

SEQ ID NO: 2218534 - RNA, 23 nt, Homo sapiens
gauccaaaagaagcccccagcua

SEQ ID NO: 2218535 - RNA, 19 nt, Homo sapiens
cuuuagcaguuuugugaua

SEQ ID NO: 2218536 - RNA, 15 nt, Homo sapiens
uagugcaccaucuca

SEQ ID NO: 2218537 - RNA, 11 nt, Homo sapiens
aaacaaaauac

SEQ ID NO: 2218538 - RNA, 11 nt, Homo sapiens
ugacaaaaagc

SEQ ID NO: 2218539 - RNA, 11 nt, Homo sapiens
ggcucucucac

SEQ ID NO: 2218540 - RNA, 13 nt, Homo sapiens
guuaugacuguga

SEQ ID NO: 2218541 - RNA, 13 nt, Homo sapiens
agcucaguggcaa

SEQ ID NO: 2218542 - RNA, 22 nt, Homo sapiens
uaauaaagcuucuguuccgugc

SEQ ID NO: 2218543 - RNA, 22 nt, Homo sapiens
uagaguccaacguggggcagca

SEQ ID NO: 2218544 - RNA, 17 nt, Homo sapiens
aaugucagaacagagug

SEQ ID NO: 2218545 - RNA, 18 nt, Homo sapiens
gauguuugaggcuuucag

SEQ ID NO: 2218546 - RNA, 17 nt, Homo sapiens
aaaccugugugccauuu

SEQ ID NO: 2218547 - RNA, 14 nt, Homo sapiens
ugaugggccugaac

SEQ ID NO: 2218548 - RNA, 15 nt, Homo sapiens
caauaaacugugucu

SEQ ID NO: 2218549 - RNA, 16 nt, Homo sapiens
auguuuucacagucac

SEQ ID NO: 2218550 - RNA, 14 nt, Homo sapiens
guguacauucuucc

SEQ ID NO: 2218551 - RNA, 20 nt, Homo sapiens
agagauagauauuguccuaa

SEQ ID NO: 2218552 - RNA, 23 nt, Homo sapiens
cagcaaguacgcaagaaauugga

SEQ ID NO: 2218553 - RNA, 19 nt, Homo sapiens
acaccauuuuccugccuca

SEQ ID NO: 2218554 - RNA, 16 nt, Homo sapiens
ccagaaugugcugccu

SEQ ID NO: 2218555 - RNA, 18 nt, Homo sapiens
augccauuccgaccuuca

SEQ ID NO: 2218556 - RNA, 16 nt, Homo sapiens
cuaaauauuucaugau

SEQ ID NO: 2218557 - RNA, 19 nt, Homo sapiens
ugaagaugcauuguaguuu

SEQ ID NO: 2218558 - RNA, 17 nt, Homo sapiens
aaguugucuccuuccau

SEQ ID NO: 2218559 - RNA, 20 nt, Homo sapiens
auuucaugauuucauuucaa

SEQ ID NO: 2218560 - RNA, 15 nt, Homo sapiens
cuuuaugugcaaaau

SEQ ID NO: 2218561 - RNA, 15 nt, Homo sapiens
aaucacucagugauu

SEQ ID NO: 2218562 - RNA, 17 nt, Homo sapiens
auuuaauggcaaugcaa

SEQ ID NO: 2218563 - RNA, 14 nt, Homo sapiens
aaugugacauugau

SEQ ID NO: 2218564 - RNA, 11 nt, Homo sapiens
ggcagggccag

SEQ ID NO: 2218565 - RNA, 16 nt, Homo sapiens
ccacuguguacugugg

SEQ ID NO: 2218566 - RNA, 23 nt, Homo sapiens
ggaaauaaagcguccucucagua

SEQ ID NO: 2218567 - RNA, 16 nt, Homo sapiens
uggggcuguccugcug

SEQ ID NO: 2218568 - RNA, 17 nt, Homo sapiens
ucugugaugacauuccc

SEQ ID NO: 2218569 - RNA, 19 nt, Homo sapiens
cuucuuguucugagauuca

SEQ ID NO: 2218570 - RNA, 14 nt, Homo sapiens
ucucaacuuugaua

SEQ ID NO: 2218571 - RNA, 20 nt, Homo sapiens
uaaagccagcauuuccucag

SEQ ID NO: 2218572 - RNA, 15 nt, Homo sapiens
cuggcuggugccuga

SEQ ID NO: 2218573 - RNA, 24 nt, Homo sapiens
agccucaguuuccucaucugcaga

SEQ ID NO: 2218574 - RNA, 16 nt, Homo sapiens
aaacacucagcuguuc

SEQ ID NO: 2218575 - RNA, 22 nt, Homo sapiens
caugaacacacauggaugcaca

SEQ ID NO: 2218576 - RNA, 23 nt, Homo sapiens
gccuuuggggacggccacucugu

SEQ ID NO: 2218577 - RNA, 18 nt, Homo sapiens
uccgucauuugacagggg

SEQ ID NO: 2218578 - RNA, 17 nt, Homo sapiens
uaaauaggaaucauuca

SEQ ID NO: 2218579 - RNA, 22 nt, Homo sapiens
agcgacguuuauuucaucucuu

SEQ ID NO: 2218580 - RNA, 16 nt, Homo sapiens
cugcccugugcauguc

SEQ ID NO: 2218581 - RNA, 23 nt, Homo sapiens
cagcuuuuaguacccaccugagc

SEQ ID NO: 2218582 - RNA, 22 nt, Homo sapiens
gccaguaccuccugccccaugc

SEQ ID NO: 2218583 - RNA, 23 nt, Homo sapiens
gcucagccccaccccagggcagc

SEQ ID NO: 2218584 - RNA, 20 nt, Homo sapiens
ucuugggacccccacuaaga

SEQ ID NO: 2218585 - RNA, 21 nt, Homo sapiens
ucccaggaaagaagcauuucu

SEQ ID NO: 2218586 - RNA, 19 nt, Homo sapiens
cagacugugcaauacuuag

SEQ ID NO: 2218587 - RNA, 16 nt, Homo sapiens
cugagaaucagacuga

SEQ ID NO: 2218588 - RNA, 20 nt, Homo sapiens
gaagaccagcuuugcaguga

SEQ ID NO: 2218589 - RNA, 17 nt, Homo sapiens
uauucuuuccaugacac

SEQ ID NO: 2218590 - RNA, 15 nt, Homo sapiens
ucaccagagcauuuc

SEQ ID NO: 2218591 - RNA, 13 nt, Homo sapiens
uuaaucaugagcc

SEQ ID NO: 2218592 - RNA, 19 nt, Homo sapiens
cugccuaauaguaacuggu

SEQ ID NO: 2218593 - RNA, 19 nt, Homo sapiens
aggcacagcugaguuauga

SEQ ID NO: 2218594 - RNA, 16 nt, Homo sapiens
auauuuaagcaauaaa

SEQ ID NO: 2218595 - RNA, 13 nt, Homo sapiens
ugaggaguggagu

SEQ ID NO: 2218596 - RNA, 14 nt, Homo sapiens
uauuuuuaugugca

SEQ ID NO: 2218597 - RNA, 22 nt, Homo sapiens
gcuucucugagcuccaguggaa

SEQ ID NO: 2218598 - RNA, 21 nt, Homo sapiens
aggacaagggaaaugucaggg

SEQ ID NO: 2218599 - RNA, 23 nt, Homo sapiens
caguggccccaucauagccugca

SEQ ID NO: 2218600 - RNA, 13 nt, Homo sapiens
cuccucggaggau

SEQ ID NO: 2218601 - RNA, 16 nt, Homo sapiens
ugugcagucaguguca

SEQ ID NO: 2218602 - RNA, 16 nt, Homo sapiens
ccagcuccuuucccuu

SEQ ID NO: 2218603 - RNA, 20 nt, Homo sapiens
cacagcugcuggagacuccu

SEQ ID NO: 2218604 - RNA, 17 nt, Homo sapiens
accuggucaauagugau

SEQ ID NO: 2218605 - RNA, 15 nt, Homo sapiens
agucccuuucagcug

SEQ ID NO: 2218606 - RNA, 20 nt, Homo sapiens
auauuugccaccaagugaaa

SEQ ID NO: 2218607 - RNA, 16 nt, Homo sapiens
augugauuucccucag

SEQ ID NO: 2218608 - RNA, 21 nt, Homo sapiens
auugggcuugugauuuccauu

SEQ ID NO: 2218609 - RNA, 20 nt, Homo sapiens
ggccucccaaagugcugaga

SEQ ID NO: 2218610 - RNA, 20 nt, Homo sapiens
ggccucccagagugcuggga

SEQ ID NO: 2218611 - RNA, 20 nt, Homo sapiens
uauuaauuauaaaaugcaau

SEQ ID NO: 2218612 - RNA, 18 nt, Homo sapiens
cucacagggacucuccau

SEQ ID NO: 2218613 - RNA, 23 nt, Homo sapiens
uccagugaaaauaagccaugaga

SEQ ID NO: 2218614 - RNA, 18 nt, Homo sapiens
ccccagauaccugugagg

SEQ ID NO: 2218615 - RNA, 21 nt, Homo sapiens
acugugaccuagagacuucac

SEQ ID NO: 2218616 - RNA, 16 nt, Homo sapiens
accauugugcauucua

SEQ ID NO: 2218617 - RNA, 19 nt, Homo sapiens
cccagaugaucccagucac

SEQ ID NO: 2218618 - RNA, 15 nt, Homo sapiens
guagaccacugccau

SEQ ID NO: 2218619 - RNA, 14 nt, Homo sapiens
uacaaaaacacagc

SEQ ID NO: 2218620 - RNA, 16 nt, Homo sapiens
ucugccuguaucucuc

SEQ ID NO: 2218621 - RNA, 17 nt, Homo sapiens
ugugcaguaucugugaa

SEQ ID NO: 2218622 - RNA, 17 nt, Homo sapiens
ccauggagagguuuguc

SEQ ID NO: 2218623 - RNA, 18 nt, Homo sapiens
uugagauuuagagcaaug

SEQ ID NO: 2218624 - RNA, 16 nt, Homo sapiens
cgugggggcacugacc

SEQ ID NO: 2218625 - RNA, 21 nt, Homo sapiens
guaggaccaagcaucuugggg

SEQ ID NO: 2218626 - RNA, 17 nt, Homo sapiens
uacgaauuguuucacaa

SEQ ID NO: 2218627 - RNA, 16 nt, Homo sapiens
aguggcccccacagaa

SEQ ID NO: 2218628 - RNA, 15 nt, Homo sapiens
uuuggguaacuucaa

SEQ ID NO: 2218629 - RNA, 15 nt, Homo sapiens
caaugcagugcagca

SEQ ID NO: 2218630 - RNA, 11 nt, Homo sapiens
gcgguggugcc

SEQ ID NO: 2218631 - RNA, 18 nt, Homo sapiens
guugcccuaauucaucuu

SEQ ID NO: 2218632 - RNA, 20 nt, Homo sapiens
aggguaaucugacuucucac

SEQ ID NO: 2218633 - RNA, 15 nt, Homo sapiens
auuagguagacuuug

SEQ ID NO: 2218634 - RNA, 14 nt, Homo sapiens
gaaccucucaggau

SEQ ID NO: 2218635 - RNA, 21 nt, Homo sapiens
aggcugugcagggacgucuca

SEQ ID NO: 2218636 - RNA, 16 nt, Homo sapiens
uuacuuuuccagucug

SEQ ID NO: 2218637 - RNA, 22 nt, Homo sapiens
cacacaacaaauaauuaaguga

SEQ ID NO: 2218638 - RNA, 21 nt, Homo sapiens
uguccugaugcuuuugucuaa

SEQ ID NO: 2218639 - RNA, 17 nt, Homo sapiens
ucuuaaauauuuccauc

SEQ ID NO: 2218640 - RNA, 16 nt, Homo sapiens
aggcccuggcccuuuc

SEQ ID NO: 2218641 - RNA, 14 nt, Homo sapiens
aucccucaccugua

SEQ ID NO: 2218642 - RNA, 20 nt, Homo sapiens
aaguacuugagacucuugaa

SEQ ID NO: 2218643 - RNA, 13 nt, Homo sapiens
agguggcucagug

SEQ ID NO: 2218644 - RNA, 14 nt, Homo sapiens
aaacauguacuaca

SEQ ID NO: 2218645 - RNA, 13 nt, Homo sapiens
uuccaaaaacugu

SEQ ID NO: 2218646 - RNA, 13 nt, Homo sapiens
acuguaaauucca

SEQ ID NO: 2218647 - RNA, 17 nt, Homo sapiens
augccacagaguaugaa

SEQ ID NO: 2218648 - RNA, 17 nt, Homo sapiens
accuuggcaccagacac

SEQ ID NO: 2218649 - RNA, 17 nt, Homo sapiens
uugaccgugaggccaga

SEQ ID NO: 2218650 - RNA, 15 nt, Homo sapiens
ccaauugugcugcca

SEQ ID NO: 2218651 - RNA, 14 nt, Homo sapiens
caucguuguuguua

SEQ ID NO: 2218652 - RNA, 13 nt, Homo sapiens
cucauacagaaag

SEQ ID NO: 2218653 - RNA, 21 nt, Homo sapiens
auucagaugcaagagaacaau

SEQ ID NO: 2218654 - RNA, 17 nt, Homo sapiens
cauuuauccaccuccau

SEQ ID NO: 2218655 - RNA, 18 nt, Homo sapiens
ugaggagggcagcuggag

SEQ ID NO: 2218656 - RNA, 20 nt, Homo sapiens
augcaguugcagugaauuca

SEQ ID NO: 2218657 - RNA, 17 nt, Homo sapiens
gcagacaccugccuuaa

SEQ ID NO: 2218658 - RNA, 23 nt, Homo sapiens
aaaaguuugaauaccagcuuucu

SEQ ID NO: 2218659 - RNA, 14 nt, Homo sapiens
gaugggugguguuu

SEQ ID NO: 2218660 - RNA, 17 nt, Homo sapiens
aucaugguauuugacca

SEQ ID NO: 2218661 - RNA, 19 nt, Homo sapiens
ccugcuucaauacccaaau

SEQ ID NO: 2218662 - RNA, 23 nt, Homo sapiens
acauucuguuuaucaagccauaa

SEQ ID NO: 2218663 - RNA, 21 nt, Homo sapiens
cuacagcugucuucacaugua

SEQ ID NO: 2218664 - RNA, 19 nt, Homo sapiens
cagacacaggucccugagc

SEQ ID NO: 2218665 - RNA, 19 nt, Homo sapiens
acaaugauguaaauauuuc

SEQ ID NO: 2218666 - RNA, 15 nt, Homo sapiens
ucaucuucacugcac

SEQ ID NO: 2218667 - RNA, 14 nt, Homo sapiens
aguuacauugcugg

SEQ ID NO: 2218668 - RNA, 19 nt, Homo sapiens
cuuaaaauucagugagaua

SEQ ID NO: 2218669 - RNA, 13 nt, Homo sapiens
auaguggcacuug

SEQ ID NO: 2218670 - RNA, 12 nt, Homo sapiens
augcggcuuccg

SEQ ID NO: 2218671 - RNA, 19 nt, Homo sapiens
gucugcaauggugacugau

SEQ ID NO: 2218672 - RNA, 15 nt, Homo sapiens
cucuuuuucugugau

SEQ ID NO: 2218673 - RNA, 19 nt, Homo sapiens
cauagaauucuagcuuuuu

SEQ ID NO: 2218674 - RNA, 17 nt, Homo sapiens
acaggaaagccaggcca

SEQ ID NO: 2218675 - RNA, 15 nt, Homo sapiens
caugcaaggcacuga

SEQ ID NO: 2218676 - RNA, 18 nt, Homo sapiens
auggugcuggguccuuaa

SEQ ID NO: 2218677 - RNA, 14 nt, Homo sapiens
uugaucauucucag

SEQ ID NO: 2218678 - RNA, 14 nt, Homo sapiens
ugcaguaaccauuu

SEQ ID NO: 2218679 - RNA, 15 nt, Homo sapiens
aacugucucuuucag

SEQ ID NO: 2218680 - RNA, 20 nt, Homo sapiens
gaauuaucaugggaaaagac

SEQ ID NO: 2218681 - RNA, 18 nt, Homo sapiens
aaaauucauaaccaaaga

SEQ ID NO: 2218682 - RNA, 18 nt, Homo sapiens
uggacagacacuguugca

SEQ ID NO: 2218683 - RNA, 22 nt, Homo sapiens
uuuucuuacuagaccuguaacu

SEQ ID NO: 2218684 - RNA, 20 nt, Homo sapiens
gauuaauuuguguagauugu

SEQ ID NO: 2218685 - RNA, 17 nt, Homo sapiens
cauauauaaguuuacac

SEQ ID NO: 2218686 - RNA, 15 nt, Homo sapiens
gaguauacaugacug

SEQ ID NO: 2218687 - RNA, 16 nt, Homo sapiens
ccacccccucccccau

SEQ ID NO: 2218688 - RNA, 20 nt, Homo sapiens
acaaugugugggauaauguc

SEQ ID NO: 2218689 - RNA, 20 nt, Homo sapiens
uagcaauuagugauauagug

SEQ ID NO: 2218690 - RNA, 20 nt, Homo sapiens
acuugcaauucaaaauucag

SEQ ID NO: 2218691 - RNA, 23 nt, Homo sapiens
accuggacacaacaccaaaaagg

SEQ ID NO: 2218692 - RNA, 12 nt, Homo sapiens
cuauuuaccucc

SEQ ID NO: 2218693 - RNA, 21 nt, Homo sapiens
aucccagucacuccucucuag

SEQ ID NO: 2218694 - RNA, 20 nt, Homo sapiens
cucgaccagaaucagauuca

SEQ ID NO: 2218695 - RNA, 19 nt, Homo sapiens
ccugagcucuugcuaucuc

SEQ ID NO: 2218696 - RNA, 14 nt, Homo sapiens
agcuccuugacucc

SEQ ID NO: 2218697 - RNA, 17 nt, Homo sapiens
gaaacccuccuucugug

SEQ ID NO: 2218698 - RNA, 17 nt, Homo sapiens
guccuccuccagggaca

SEQ ID NO: 2218699 - RNA, 12 nt, Homo sapiens
uaccaguacuug

SEQ ID NO: 2218700 - RNA, 14 nt, Homo sapiens
auucccuuuaugca

SEQ ID NO: 2218701 - RNA, 13 nt, Homo sapiens
caacggcuacuac

SEQ ID NO: 2218702 - RNA, 18 nt, Homo sapiens
cccccgcggguucuagac

SEQ ID NO: 2218703 - RNA, 13 nt, Homo sapiens
uuacagcuuucug

SEQ ID NO: 2218704 - RNA, 18 nt, Homo sapiens
uaaaauaucuuuugaccu

SEQ ID NO: 2218705 - RNA, 17 nt, Homo sapiens
ccagugacaaccaaaag

SEQ ID NO: 2218706 - RNA, 19 nt, Homo sapiens
ccugcucaucauauuccaa

SEQ ID NO: 2218707 - RNA, 13 nt, Homo sapiens
accuaauugcaca

SEQ ID NO: 2218708 - RNA, 24 nt, Homo sapiens
ucccucuuaacgcagcacuuagac

SEQ ID NO: 2218709 - RNA, 14 nt, Homo sapiens
ucuuuacucugcau

SEQ ID NO: 2218710 - RNA, 18 nt, Homo sapiens
caagaaaggcugcuguac

SEQ ID NO: 2218711 - RNA, 21 nt, Homo sapiens
ggcugggaagacuauggugcu

SEQ ID NO: 2218712 - RNA, 16 nt, Homo sapiens
acauaugcauuaugaa

SEQ ID NO: 2218713 - RNA, 16 nt, Homo sapiens
guaggcuucuaccugc

SEQ ID NO: 2218714 - RNA, 15 nt, Homo sapiens
acagugaaacuccau

SEQ ID NO: 2218715 - RNA, 20 nt, Homo sapiens
ugauucaaauaacccugaau

SEQ ID NO: 2218716 - RNA, 20 nt, Homo sapiens
cuaagccacauggcugggau

SEQ ID NO: 2218717 - RNA, 21 nt, Homo sapiens
agaacuagugguggcucugag

SEQ ID NO: 2218718 - RNA, 23 nt, Homo sapiens
ucauucaccaaaugaugccacuu

SEQ ID NO: 2218719 - RNA, 21 nt, Homo sapiens
agucucuuacaaaagcuuuga

SEQ ID NO: 2218720 - RNA, 22 nt, Homo sapiens
gcaucauuuacaagacaacauu

SEQ ID NO: 2218721 - RNA, 15 nt, Homo sapiens
ucagucucuguguaa

SEQ ID NO: 2218722 - RNA, 15 nt, Homo sapiens
uuaaaaacauaacau

SEQ ID NO: 2218723 - RNA, 18 nt, Homo sapiens
cauaauggggauuaauua

SEQ ID NO: 2218724 - RNA, 19 nt, Homo sapiens
acagugcccuuuucaucuc

SEQ ID NO: 2218725 - RNA, 16 nt, Homo sapiens
cuggggggacccagug

SEQ ID NO: 2218726 - RNA, 22 nt, Homo sapiens
uggcagaugagcuuauuucaaa

SEQ ID NO: 2218727 - RNA, 20 nt, Homo sapiens
gagccaccacgccuggcugg

SEQ ID NO: 2218728 - RNA, 21 nt, Homo sapiens
cauaacugaaaaugugcuaua

SEQ ID NO: 2218729 - RNA, 20 nt, Homo sapiens
auugcagauaacuuugacuu

SEQ ID NO: 2218730 - RNA, 17 nt, Homo sapiens
acacagcucccauaacc

SEQ ID NO: 2218731 - RNA, 19 nt, Homo sapiens
gcaucaucaaaaacuuugg

SEQ ID NO: 2218732 - RNA, 12 nt, Homo sapiens
gccuugcugcag

SEQ ID NO: 2218733 - RNA, 15 nt, Homo sapiens
caacuguaaugcagg

SEQ ID NO: 2218734 - RNA, 21 nt, Homo sapiens
ucuguggccagcugcaucugu

SEQ ID NO: 2218735 - RNA, 12 nt, Homo sapiens
agcaacaaugac

SEQ ID NO: 2218736 - RNA, 12 nt, Homo sapiens
ugccacaaagaa

SEQ ID NO: 2218737 - RNA, 23 nt, Homo sapiens
agaguauuaacaaaaccaaagga

SEQ ID NO: 2218738 - RNA, 20 nt, Homo sapiens
ugcugcuugguagcacuuua

SEQ ID NO: 2218739 - RNA, 15 nt, Homo sapiens
agacacgcucuucua

SEQ ID NO: 2218740 - RNA, 22 nt, Homo sapiens
uacagugagccaagauugcacc

SEQ ID NO: 2218741 - RNA, 22 nt, Homo sapiens
augaggacaagagggacaaggu

SEQ ID NO: 2218742 - RNA, 19 nt, Homo sapiens
cuguaaucccagcuacuca

SEQ ID NO: 2218743 - RNA, 14 nt, Homo sapiens
gcaagaaugaaaug

SEQ ID NO: 2218744 - RNA, 19 nt, Homo sapiens
ggggagggcgcuggaugca

SEQ ID NO: 2218745 - RNA, 21 nt, Homo sapiens
auggcacauaccaaagcugcu

SEQ ID NO: 2218746 - RNA, 19 nt, Homo sapiens
uuaagaaguaagcaacuag

SEQ ID NO: 2218747 - RNA, 20 nt, Homo sapiens
uauuggucauugccuugcca

SEQ ID NO: 2218748 - RNA, 18 nt, Homo sapiens
ucuggcuucaaaaagcca

SEQ ID NO: 2218749 - RNA, 23 nt, Homo sapiens
cucucuugcaggaaggacuauga

SEQ ID NO: 2218750 - RNA, 14 nt, Homo sapiens
cagugaaccaaaga

SEQ ID NO: 2218751 - RNA, 18 nt, Homo sapiens
ugcaugcauacacaccca

SEQ ID NO: 2218752 - RNA, 11 nt, Homo sapiens
ggcaguuacau

SEQ ID NO: 2218753 - RNA, 14 nt, Homo sapiens
ugcugcauuucaca

SEQ ID NO: 2218754 - RNA, 14 nt, Homo sapiens
cagccuguucucug

SEQ ID NO: 2218755 - RNA, 17 nt, Homo sapiens
gaauuuggucucuccca

SEQ ID NO: 2218756 - RNA, 15 nt, Homo sapiens
cuuucagaagguguu

SEQ ID NO: 2218757 - RNA, 22 nt, Homo sapiens
aagagcagugguaagaauagua

SEQ ID NO: 2218758 - RNA, 11 nt, Homo sapiens
gccacauuucu

SEQ ID NO: 2218759 - RNA, 19 nt, Homo sapiens
augucaguuggcccuuuaa

SEQ ID NO: 2218760 - RNA, 19 nt, Homo sapiens
gcagagccacccuguguug

SEQ ID NO: 2218761 - RNA, 15 nt, Homo sapiens
gcugugugaccuggg

SEQ ID NO: 2218762 - RNA, 22 nt, Homo sapiens
cugucccagagcuuauuggcca

SEQ ID NO: 2218763 - RNA, 14 nt, Homo sapiens
acccucauacacag

SEQ ID NO: 2218764 - RNA, 15 nt, Homo sapiens
aaaugggaauucuca

SEQ ID NO: 2218765 - RNA, 11 nt, Homo sapiens
acuugcuaaac

SEQ ID NO: 2218766 - RNA, 14 nt, Homo sapiens
gaagagggaaugag

SEQ ID NO: 2218767 - RNA, 22 nt, Homo sapiens
aacucccuuuuuacacuuuaug

SEQ ID NO: 2218768 - RNA, 14 nt, Homo sapiens
auuuuguuucacau

SEQ ID NO: 2218769 - RNA, 17 nt, Homo sapiens
acugcacccagcuccag

SEQ ID NO: 2218770 - RNA, 14 nt, Homo sapiens
ucccaauagcacuu

SEQ ID NO: 2218771 - RNA, 17 nt, Homo sapiens
gcaucagcaacaaccag

SEQ ID NO: 2218772 - RNA, 16 nt, Homo sapiens
auaccugggauacugu

SEQ ID NO: 2218773 - RNA, 14 nt, Homo sapiens
cuugccaucccucc

SEQ ID NO: 2218774 - RNA, 17 nt, Homo sapiens
ucggagcggcgucccuu

SEQ ID NO: 2218775 - RNA, 23 nt, Homo sapiens
cuaaaggacugguuaaaucaauu

SEQ ID NO: 2218776 - RNA, 19 nt, Homo sapiens
ucucaucuuucuugaucaa

SEQ ID NO: 2218777 - RNA, 22 nt, Homo sapiens
agauguauuuuugauguauaua

SEQ ID NO: 2218778 - RNA, 21 nt, Homo sapiens
cuaaggggguagaaguaguuu

SEQ ID NO: 2218779 - RNA, 20 nt, Homo sapiens
accaagaugucugucucuga

SEQ ID NO: 2218780 - RNA, 15 nt, Homo sapiens
aaaaccuuguguaag

SEQ ID NO: 2218781 - RNA, 19 nt, Homo sapiens
acugccuggaaagcccuuc

SEQ ID NO: 2218782 - RNA, 14 nt, Homo sapiens
aaacauuauucuca

SEQ ID NO: 2218783 - RNA, 17 nt, Homo sapiens
ucucagagcagcacugg

SEQ ID NO: 2218784 - RNA, 20 nt, Homo sapiens
ccaauacggcaaaaccucau

SEQ ID NO: 2218785 - RNA, 23 nt, Homo sapiens
caucagauggaagcuuacucucu

SEQ ID NO: 2218786 - RNA, 15 nt, Homo sapiens
aguuuguuguucaga

SEQ ID NO: 2218787 - RNA, 14 nt, Homo sapiens
uaaaacuuuauuaa

SEQ ID NO: 2218788 - RNA, 13 nt, Homo sapiens
ccuaguagcuuuc

SEQ ID NO: 2218789 - RNA, 18 nt, Homo sapiens
caauauuugguauuucaa

SEQ ID NO: 2218790 - RNA, 16 nt, Homo sapiens
uuuauuuguuugcaau

SEQ ID NO: 2218791 - RNA, 15 nt, Homo sapiens
uccauguccauaugc

SEQ ID NO: 2218792 - RNA, 22 nt, Homo sapiens
gaggacaagggaaaugucaggg

SEQ ID NO: 2218793 - RNA, 21 nt, Homo sapiens
cugaggagcuguuacugaaua

SEQ ID NO: 2218794 - RNA, 21 nt, Homo sapiens
acgcugccugccaaaguaguc

SEQ ID NO: 2218795 - RNA, 17 nt, Homo sapiens
uaggccuugccuaggca

SEQ ID NO: 2218796 - RNA, 15 nt, Homo sapiens
ccucagggccaagcc

SEQ ID NO: 2218797 - RNA, 16 nt, Homo sapiens
gcauccagugugagau

SEQ ID NO: 2218798 - RNA, 21 nt, Homo sapiens
aaagaaagggacccaccugcu

SEQ ID NO: 2218799 - RNA, 23 nt, Homo sapiens
ugccucucuuuuugggcuuucau

SEQ ID NO: 2218800 - RNA, 21 nt, Homo sapiens
ugacauugcuuuacugucaaa

SEQ ID NO: 2218801 - RNA, 13 nt, Homo sapiens
aggaacugcuugu

SEQ ID NO: 2218802 - RNA, 17 nt, Homo sapiens
caggauuagacagucaa

SEQ ID NO: 2218803 - RNA, 15 nt, Homo sapiens
ugccauggaucugau

SEQ ID NO: 2218804 - RNA, 17 nt, Homo sapiens
guaucucaguaccccau

SEQ ID NO: 2218805 - RNA, 16 nt, Homo sapiens
aguuaucuuugaauau

SEQ ID NO: 2218806 - RNA, 21 nt, Homo sapiens
uuugagcaagccgagcucucc

SEQ ID NO: 2218807 - RNA, 18 nt, Homo sapiens
ucagugagauauuuggua

SEQ ID NO: 2218808 - RNA, 15 nt, Homo sapiens
gcaccucuguucauu

SEQ ID NO: 2218809 - RNA, 15 nt, Homo sapiens
cuugaccauucucac

SEQ ID NO: 2218810 - RNA, 18 nt, Homo sapiens
aacugucuugugagcuga

SEQ ID NO: 2218811 - RNA, 14 nt, Homo sapiens
aucaccagugccac

SEQ ID NO: 2218812 - RNA, 20 nt, Homo sapiens
gggcccaagagucuggggac

SEQ ID NO: 2218813 - RNA, 20 nt, Homo sapiens
caaggcuucagugagccaug

SEQ ID NO: 2218814 - RNA, 17 nt, Homo sapiens
caggcccuacaaugcuc

SEQ ID NO: 2218815 - RNA, 17 nt, Homo sapiens
gcaaugagaaggccagg

SEQ ID NO: 2218816 - RNA, 14 nt, Homo sapiens
aguccaauuccuug

SEQ ID NO: 2218817 - RNA, 16 nt, Homo sapiens
agauuaaaaagcacag

SEQ ID NO: 2218818 - RNA, 14 nt, Homo sapiens
ucucuuagagccau

SEQ ID NO: 2218819 - RNA, 20 nt, Homo sapiens
aaguauuuugaaguuuacau

SEQ ID NO: 2218820 - RNA, 20 nt, Homo sapiens
cucuccuuuuucucuucaca

SEQ ID NO: 2218821 - RNA, 15 nt, Homo sapiens
cccuauuauuugccc

SEQ ID NO: 2218822 - RNA, 13 nt, Homo sapiens
cuucugaccucua

SEQ ID NO: 2218823 - RNA, 13 nt, Homo sapiens
uuuuagacuuccu

SEQ ID NO: 2218824 - RNA, 13 nt, Homo sapiens
aaauccuggugau

SEQ ID NO: 2218825 - RNA, 21 nt, Homo sapiens
cugcagaguuacuaacuucuc

SEQ ID NO: 2218826 - RNA, 19 nt, Homo sapiens
acuuagacacuuuaccucu

SEQ ID NO: 2218827 - RNA, 20 nt, Homo sapiens
ucaaacuccugaccucaggu

SEQ ID NO: 2218828 - RNA, 19 nt, Homo sapiens
gacagaagucuugucucaa

SEQ ID NO: 2218829 - RNA, 22 nt, Homo sapiens
acagccggggccugccuagcac

SEQ ID NO: 2218830 - RNA, 18 nt, Homo sapiens
cuguaggaauuuucuuga

SEQ ID NO: 2218831 - RNA, 15 nt, Homo sapiens
uaggucuccaagacc

SEQ ID NO: 2218832 - RNA, 20 nt, Homo sapiens
aucugguccaguuccuucac

SEQ ID NO: 2218833 - RNA, 12 nt, Homo sapiens
ggcugcugugaa

SEQ ID NO: 2218834 - RNA, 12 nt, Homo sapiens
ggcagcugugau

SEQ ID NO: 2218835 - RNA, 17 nt, Homo sapiens
caugaacagaaacaaua

SEQ ID NO: 2218836 - RNA, 17 nt, Homo sapiens
ugggguuugaagcugac

SEQ ID NO: 2218837 - RNA, 17 nt, Homo sapiens
cugagcaccuacuuaca

SEQ ID NO: 2218838 - RNA, 23 nt, Homo sapiens
cuuuguugcuuccguucauggaa

SEQ ID NO: 2218839 - RNA, 13 nt, Homo sapiens
ugggcauggugcg

SEQ ID NO: 2218840 - RNA, 22 nt, Homo sapiens
aacuuguuugguaguuagccau

SEQ ID NO: 2218841 - RNA, 22 nt, Homo sapiens
uguuuccuggaccagugaccaa

SEQ ID NO: 2218842 - RNA, 15 nt, Homo sapiens
ggucuugacaccagc

SEQ ID NO: 2218843 - RNA, 15 nt, Homo sapiens
aauuucauugcacuu

SEQ ID NO: 2218844 - RNA, 21 nt, Homo sapiens
ugcuauaacuauguugauaaa

SEQ ID NO: 2218845 - RNA, 15 nt, Homo sapiens
gaggcagacuccuga

SEQ ID NO: 2218846 - RNA, 14 nt, Homo sapiens
gaacucaugugauu

SEQ ID NO: 2218847 - RNA, 19 nt, Homo sapiens
auuuaccagcaacuugaac

SEQ ID NO: 2218848 - RNA, 19 nt, Homo sapiens
aucauuuauuuacaucuau

SEQ ID NO: 2218849 - RNA, 22 nt, Homo sapiens
ugccaggcuugcagucucccag

SEQ ID NO: 2218850 - RNA, 14 nt, Homo sapiens
uuugcagaaagcca

SEQ ID NO: 2218851 - RNA, 21 nt, Homo sapiens
agacaucggccuccaugaccu

SEQ ID NO: 2218852 - RNA, 14 nt, Homo sapiens
gauuaaugaucaua

SEQ ID NO: 2218853 - RNA, 18 nt, Homo sapiens
uccaacuuuaucauggaa

SEQ ID NO: 2218854 - RNA, 14 nt, Homo sapiens
cacucuguaaaacg

SEQ ID NO: 2218855 - RNA, 22 nt, Homo sapiens
agucgugaacgggacucaggug

SEQ ID NO: 2218856 - RNA, 13 nt, Homo sapiens
cuacacagaggac

SEQ ID NO: 2218857 - RNA, 12 nt, Homo sapiens
ccauccaaauaa

SEQ ID NO: 2218858 - RNA, 20 nt, Homo sapiens
cuugguguuucuuuuuccac

SEQ ID NO: 2218859 - RNA, 15 nt, Homo sapiens
ucccggugugcagcg

SEQ ID NO: 2218860 - RNA, 16 nt, Homo sapiens
cagucggcacagugca

SEQ ID NO: 2218861 - RNA, 21 nt, Homo sapiens
cacgugaccagccccguguag

SEQ ID NO: 2218862 - RNA, 15 nt, Homo sapiens
uucgaaugacacugu

SEQ ID NO: 2218863 - RNA, 12 nt, Homo sapiens
uauauguaccgu

SEQ ID NO: 2218864 - RNA, 13 nt, Homo sapiens
aaagcaaaggugc

SEQ ID NO: 2218865 - RNA, 17 nt, Homo sapiens
cuacuaaaaaugcaaaa

SEQ ID NO: 2218866 - RNA, 22 nt, Homo sapiens
ugaaugggugcccacaguguca

SEQ ID NO: 2218867 - RNA, 23 nt, Homo sapiens
agaagguggaccuuuuaaagugu

SEQ ID NO: 2218868 - RNA, 22 nt, Homo sapiens
gacucaagccccggacucaggc

SEQ ID NO: 2218869 - RNA, 15 nt, Homo sapiens
agugauguuagcaga

SEQ ID NO: 2218870 - RNA, 16 nt, Homo sapiens
uaauggccggcuggaa

SEQ ID NO: 2218871 - RNA, 19 nt, Homo sapiens
auacggcccaugcaauuuu

SEQ ID NO: 2218872 - RNA, 18 nt, Homo sapiens
ugaaauaccacaagccug

SEQ ID NO: 2218873 - RNA, 19 nt, Homo sapiens
accaggucucauaaugcau

SEQ ID NO: 2218874 - RNA, 13 nt, Homo sapiens
uaaaugagcuuaa

SEQ ID NO: 2218875 - RNA, 19 nt, Homo sapiens
aggacccaugaaacagcag

SEQ ID NO: 2218876 - RNA, 16 nt, Homo sapiens
gccaugccaguaacug

SEQ ID NO: 2218877 - RNA, 13 nt, Homo sapiens
ccauaugugcaaa

SEQ ID NO: 2218878 - RNA, 13 nt, Homo sapiens
gagaaugucagua

SEQ ID NO: 2218879 - RNA, 15 nt, Homo sapiens
guccuggcuucaggc

SEQ ID NO: 2218880 - RNA, 12 nt, Homo sapiens
auaaauucccaa

SEQ ID NO: 2218881 - RNA, 20 nt, Homo sapiens
gcaacucaaagaugauggaa

SEQ ID NO: 2218882 - RNA, 17 nt, Homo sapiens
cauaaaaaaaugaugca

SEQ ID NO: 2218883 - RNA, 12 nt, Homo sapiens
cuucaaauaucu

SEQ ID NO: 2218884 - RNA, 16 nt, Homo sapiens
auguaaacugugcacc

SEQ ID NO: 2218885 - RNA, 23 nt, Homo sapiens
aggcuugaucaugaaucacugca

SEQ ID NO: 2218886 - RNA, 15 nt, Homo sapiens
accaagugcugucuu

SEQ ID NO: 2218887 - RNA, 22 nt, Homo sapiens
cugcauggagaaggguucugcc

SEQ ID NO: 2218888 - RNA, 21 nt, Homo sapiens
augccaagggggugacuggaa

SEQ ID NO: 2218889 - RNA, 15 nt, Homo sapiens
aagcagguucuugau

SEQ ID NO: 2218890 - RNA, 19 nt, Homo sapiens
cuggugguucuacugaccc

SEQ ID NO: 2218891 - RNA, 12 nt, Homo sapiens
cuaaacauccau

SEQ ID NO: 2218892 - RNA, 23 nt, Homo sapiens
cucugagcccccugaccuuccaa

SEQ ID NO: 2218893 - RNA, 13 nt, Homo sapiens
auugagucaccau

SEQ ID NO: 2218894 - RNA, 16 nt, Homo sapiens
aaguuguggauaucag

SEQ ID NO: 2218895 - RNA, 22 nt, Homo sapiens
gaaaauucauuccccugaaaua

SEQ ID NO: 2218896 - RNA, 22 nt, Homo sapiens
cuacauuuucagaaguuaacau

SEQ ID NO: 2218897 - RNA, 19 nt, Homo sapiens
cauccugauggaccugccc

SEQ ID NO: 2218898 - RNA, 21 nt, Homo sapiens
uucugaggacauuccaagaca

SEQ ID NO: 2218899 - RNA, 21 nt, Homo sapiens
uugcaaagguuaaaacaaaaa

SEQ ID NO: 2218900 - RNA, 15 nt, Homo sapiens
aggagucaacuggcu

SEQ ID NO: 2218901 - RNA, 16 nt, Homo sapiens
ugcuuuccagacuuug

SEQ ID NO: 2218902 - RNA, 18 nt, Homo sapiens
ccagacccacaaggccag

SEQ ID NO: 2218903 - RNA, 22 nt, Homo sapiens
guguaauguaaacugugccaug

SEQ ID NO: 2218904 - RNA, 15 nt, Homo sapiens
aaguccaauuccaaa

SEQ ID NO: 2218905 - RNA, 14 nt, Homo sapiens
ucucugguggugcu

SEQ ID NO: 2218906 - RNA, 21 nt, Homo sapiens
ucaggggcucccuacauuccc

SEQ ID NO: 2218907 - RNA, 17 nt, Homo sapiens
uaauucagucuugccuu

SEQ ID NO: 2218908 - RNA, 17 nt, Homo sapiens
cacaaucucacacagcu

SEQ ID NO: 2218909 - RNA, 15 nt, Homo sapiens
caaugugacaacaug

SEQ ID NO: 2218910 - RNA, 15 nt, Homo sapiens
ugguccuccacuuug

SEQ ID NO: 2218911 - RNA, 22 nt, Homo sapiens
aguuucuugagaucugcugaca

SEQ ID NO: 2218912 - RNA, 21 nt, Homo sapiens
ccuaguggugaaacggaugag

SEQ ID NO: 2218913 - RNA, 23 nt, Homo sapiens
aguuagcccggccaaggacacug

SEQ ID NO: 2218914 - RNA, 18 nt, Homo sapiens
aaaagaaugaugcuauga

SEQ ID NO: 2218915 - RNA, 16 nt, Homo sapiens
ugacuuccccacugcu

SEQ ID NO: 2218916 - RNA, 16 nt, Homo sapiens
uuucacauucuuggcu

SEQ ID NO: 2218917 - RNA, 15 nt, Homo sapiens
guuuaagguucuugc

SEQ ID NO: 2218918 - RNA, 16 nt, Homo sapiens
ucaggggauacaggcc

SEQ ID NO: 2218919 - RNA, 22 nt, Homo sapiens
uauauuucuccaagaaagccaa

SEQ ID NO: 2218920 - RNA, 15 nt, Homo sapiens
acaggccauggugca

SEQ ID NO: 2218921 - RNA, 18 nt, Homo sapiens
cuucuacauguaaugaca

SEQ ID NO: 2218922 - RNA, 19 nt, Homo sapiens
cuucacucuucaaaugccu

SEQ ID NO: 2218923 - RNA, 20 nt, Homo sapiens
gagaaccauucccaagccau

SEQ ID NO: 2218924 - RNA, 18 nt, Homo sapiens
aagcagaucauuucccaa

SEQ ID NO: 2218925 - RNA, 16 nt, Homo sapiens
cagcccaggccaguca

SEQ ID NO: 2218926 - RNA, 20 nt, Homo sapiens
uguuuuuccuuuaauccagu

SEQ ID NO: 2218927 - RNA, 18 nt, Homo sapiens
gagugagacuccgucuca

SEQ ID NO: 2218928 - RNA, 17 nt, Homo sapiens
gcuuucuuucugcauga

SEQ ID NO: 2218929 - RNA, 18 nt, Homo sapiens
uccaacccgccggucuca

SEQ ID NO: 2218930 - RNA, 12 nt, Homo sapiens
ucuguaccuaaa

SEQ ID NO: 2218931 - RNA, 14 nt, Homo sapiens
gcugacucccuagg

SEQ ID NO: 2218932 - RNA, 14 nt, Homo sapiens
guuaaguccuuggc

SEQ ID NO: 2218933 - RNA, 14 nt, Homo sapiens
cuuacuagauucau

SEQ ID NO: 2218934 - RNA, 21 nt, Homo sapiens
uggcuccaggacagaccuuca

SEQ ID NO: 2218935 - RNA, 14 nt, Homo sapiens
ggauguauucugua

SEQ ID NO: 2218936 - RNA, 13 nt, Homo sapiens
aaaagaacuaaga

SEQ ID NO: 2218937 - RNA, 19 nt, Homo sapiens
uuggcaacaauauaguauu

SEQ ID NO: 2218938 - RNA, 23 nt, Homo sapiens
aucagcacucuguaaaaugcacc

SEQ ID NO: 2218939 - RNA, 12 nt, Homo sapiens
uuuucuacuugu

SEQ ID NO: 2218940 - RNA, 20 nt, Homo sapiens
auaauuucuagaaacaaaca

SEQ ID NO: 2218941 - RNA, 23 nt, Homo sapiens
cucaugccuuaaucccagcacuu

SEQ ID NO: 2218942 - RNA, 16 nt, Homo sapiens
uccugucugaacaaaa

SEQ ID NO: 2218943 - RNA, 16 nt, Homo sapiens
guugguuuacuguguu

SEQ ID NO: 2218944 - RNA, 23 nt, Homo sapiens
uucuguuauacacaguuccacaa

SEQ ID NO: 2218945 - RNA, 14 nt, Homo sapiens
aggcaguccaucua

SEQ ID NO: 2218946 - RNA, 20 nt, Homo sapiens
gacgugauuuugcuguagaa

SEQ ID NO: 2218947 - RNA, 16 nt, Homo sapiens
cguccuucuaaugaag

SEQ ID NO: 2218948 - RNA, 21 nt, Homo sapiens
accuggggaguuuacuaccug

SEQ ID NO: 2218949 - RNA, 17 nt, Homo sapiens
accaagagauaacugua

SEQ ID NO: 2218950 - RNA, 14 nt, Homo sapiens
accagagcauuucc

SEQ ID NO: 2218951 - RNA, 15 nt, Homo sapiens
auggaacucagagau

SEQ ID NO: 2218952 - RNA, 23 nt, Homo sapiens
auaacuucagauacuugugaaca

SEQ ID NO: 2218953 - RNA, 11 nt, Homo sapiens
cagauuuccau

SEQ ID NO: 2218954 - RNA, 20 nt, Homo sapiens
acagucaucauuuaucauca

SEQ ID NO: 2218955 - RNA, 20 nt, Homo sapiens
ugaauuccauggaauuucua

SEQ ID NO: 2218956 - RNA, 18 nt, Homo sapiens
cuguuuucaacauuguau

SEQ ID NO: 2218957 - RNA, 16 nt, Homo sapiens
cgugugcagacugugg

SEQ ID NO: 2218958 - RNA, 22 nt, Homo sapiens
acuggcaaacauuuuuccagua

SEQ ID NO: 2218959 - RNA, 21 nt, Homo sapiens
ugaggccacccacugacccaa

SEQ ID NO: 2218960 - RNA, 22 nt, Homo sapiens
gagaugaaggaaggacuaugac

SEQ ID NO: 2218961 - RNA, 15 nt, Homo sapiens
uugaaagcuguauaa

SEQ ID NO: 2218962 - RNA, 23 nt, Homo sapiens
uggaaaauuuaagacaaguucaa

SEQ ID NO: 2218963 - RNA, 13 nt, Homo sapiens
uauucuggacuaa

SEQ ID NO: 2218964 - RNA, 17 nt, Homo sapiens
aagcgauucuucugccu

SEQ ID NO: 2218965 - RNA, 19 nt, Homo sapiens
uucccuaaaauacauuuaa

SEQ ID NO: 2218966 - RNA, 16 nt, Homo sapiens
gcagcaacuauucaca

SEQ ID NO: 2218967 - RNA, 24 nt, Homo sapiens
auguauuuuguauuugcauaugua

SEQ ID NO: 2218968 - RNA, 11 nt, Homo sapiens
auauuacuuua

SEQ ID NO: 2218969 - RNA, 14 nt, Homo sapiens
gguaaacauucucu

SEQ ID NO: 2218970 - RNA, 22 nt, Homo sapiens
gagcugcucccuuuccugcacc

SEQ ID NO: 2218971 - RNA, 18 nt, Homo sapiens
gauuuaaaauuguucuac

SEQ ID NO: 2218972 - RNA, 17 nt, Homo sapiens
ucaccuggaacaccuga

SEQ ID NO: 2218973 - RNA, 20 nt, Homo sapiens
uuuaaccccacacagcacuu

SEQ ID NO: 2218974 - RNA, 21 nt, Homo sapiens
gggucgaggauucugugccuc

SEQ ID NO: 2218975 - RNA, 17 nt, Homo sapiens
ugugaagugcagaugag

SEQ ID NO: 2218976 - RNA, 21 nt, Homo sapiens
uagugaacauucgaccuccau

SEQ ID NO: 2218977 - RNA, 19 nt, Homo sapiens
agcccucccuggcauguca

SEQ ID NO: 2218978 - RNA, 17 nt, Homo sapiens
uguauucucagcacuuu

SEQ ID NO: 2218979 - RNA, 15 nt, Homo sapiens
ugcuuaacauugaca

SEQ ID NO: 2218980 - RNA, 18 nt, Homo sapiens
cuuuauuaaguagaugaa

SEQ ID NO: 2218981 - RNA, 23 nt, Homo sapiens
ucauccccacagcuggcucugac

SEQ ID NO: 2218982 - RNA, 20 nt, Homo sapiens
aguaacaaauaaagugcagu

SEQ ID NO: 2218983 - RNA, 16 nt, Homo sapiens
ggaugaaggggccaga

SEQ ID NO: 2218984 - RNA, 15 nt, Homo sapiens
ucacugcaaccucca

SEQ ID NO: 2218985 - RNA, 13 nt, Homo sapiens
gugcugaccaaag

SEQ ID NO: 2218986 - RNA, 20 nt, Homo sapiens
gguacugugaggaagagcag

SEQ ID NO: 2218987 - RNA, 13 nt, Homo sapiens
ggcuggcggccau

SEQ ID NO: 2218988 - RNA, 19 nt, Homo sapiens
augcuuuucccacucucau

SEQ ID NO: 2218989 - RNA, 17 nt, Homo sapiens
gugccagcaaugacauc

SEQ ID NO: 2218990 - RNA, 15 nt, Homo sapiens
cuguuuucaccaucu

SEQ ID NO: 2218991 - RNA, 17 nt, Homo sapiens
ugugugggugugugaga

SEQ ID NO: 2218992 - RNA, 19 nt, Homo sapiens
cucacccuccacaaagcaa

SEQ ID NO: 2218993 - RNA, 22 nt, Homo sapiens
cacggccgucucugauucuccc

SEQ ID NO: 2218994 - RNA, 19 nt, Homo sapiens
aaauacuucuugaagccga

SEQ ID NO: 2218995 - RNA, 15 nt, Homo sapiens
ggguuugacauuuca

SEQ ID NO: 2218996 - RNA, 12 nt, Homo sapiens
uguuaacugagg

SEQ ID NO: 2218997 - RNA, 19 nt, Homo sapiens
gauucaacugcaucuccaa

SEQ ID NO: 2218998 - RNA, 13 nt, Homo sapiens
gacuguaaacauc

SEQ ID NO: 2218999 - RNA, 22 nt, Homo sapiens
guaacauuggguccugggucuu

SEQ ID NO: 2219000 - RNA, 20 nt, Homo sapiens
augguggcgggcgccuguag

SEQ ID NO: 2219001 - RNA, 12 nt, Homo sapiens
ucuguugauuga

SEQ ID NO: 2219002 - RNA, 21 nt, Homo sapiens
caaaaaccuggagugcucaau

SEQ ID NO: 2219003 - RNA, 18 nt, Homo sapiens
uugaaauauaguugaaag

SEQ ID NO: 2219004 - RNA, 18 nt, Homo sapiens
gagaggccuuuuggaaug

SEQ ID NO: 2219005 - RNA, 16 nt, Homo sapiens
uuggacacacacagcu

SEQ ID NO: 2219006 - RNA, 15 nt, Homo sapiens
augcuuuugccacuu

SEQ ID NO: 2219007 - RNA, 15 nt, Homo sapiens
uacucccucuucacu

SEQ ID NO: 2219008 - RNA, 15 nt, Homo sapiens
ucaccaauaacuuca

SEQ ID NO: 2219009 - RNA, 22 nt, Homo sapiens
uaacgagaaaaacacacagaag

SEQ ID NO: 2219010 - RNA, 17 nt, Homo sapiens
ugugcgccugagugagu

SEQ ID NO: 2219011 - RNA, 20 nt, Homo sapiens
ccaaaugcucucucuucuua

SEQ ID NO: 2219012 - RNA, 22 nt, Homo sapiens
gaagcugaggccuaugcagaca

SEQ ID NO: 2219013 - RNA, 19 nt, Homo sapiens
auuuuguuuuaauccuuaa

SEQ ID NO: 2219014 - RNA, 16 nt, Homo sapiens
gagauucugugaucuu

SEQ ID NO: 2219015 - RNA, 15 nt, Homo sapiens
cuguuuuugcaaaaa

SEQ ID NO: 2219016 - RNA, 19 nt, Homo sapiens
accuguuuuuaagcuguuu

SEQ ID NO: 2219017 - RNA, 16 nt, Homo sapiens
uuuuuaaggagcaaaa

SEQ ID NO: 2219018 - RNA, 13 nt, Homo sapiens
uuaagaccaaaga

SEQ ID NO: 2219019 - RNA, 23 nt, Homo sapiens
agcuaaggucacauugugccuuu

SEQ ID NO: 2219020 - RNA, 19 nt, Homo sapiens
cugcaaccucaaaggagca

SEQ ID NO: 2219021 - RNA, 19 nt, Homo sapiens
ugcuggagucaugugccuc

SEQ ID NO: 2219022 - RNA, 18 nt, Homo sapiens
cguccuccguccauauca

SEQ ID NO: 2219023 - RNA, 19 nt, Homo sapiens
gagcauuacgugagccagg

SEQ ID NO: 2219024 - RNA, 13 nt, Homo sapiens
ugcugccacucua

SEQ ID NO: 2219025 - RNA, 16 nt, Homo sapiens
uuuacauuucauacaa

SEQ ID NO: 2219026 - RNA, 12 nt, Homo sapiens
aaauucaauaaa

SEQ ID NO: 2219027 - RNA, 16 nt, Homo sapiens
gcauuaucagccuguu

SEQ ID NO: 2219028 - RNA, 12 nt, Homo sapiens
uaaauucacugu

SEQ ID NO: 2219029 - RNA, 15 nt, Homo sapiens
auauuaaagcaccaa

SEQ ID NO: 2219030 - RNA, 24 nt, Homo sapiens
cgugcuccguagcucugcugcuga

SEQ ID NO: 2219031 - RNA, 12 nt, Homo sapiens
uucccuagcuuu

SEQ ID NO: 2219032 - RNA, 18 nt, Homo sapiens
gagggcgcauguguguau

SEQ ID NO: 2219033 - RNA, 18 nt, Homo sapiens
auuuccugcuacacaaaa

SEQ ID NO: 2219034 - RNA, 19 nt, Homo sapiens
ucacgauuccagugcagua

SEQ ID NO: 2219035 - RNA, 23 nt, Homo sapiens
gucucauaaugcauguggcacuu

SEQ ID NO: 2219036 - RNA, 14 nt, Homo sapiens
agacaagccugagu

SEQ ID NO: 2219037 - RNA, 16 nt, Homo sapiens
uauuacauagcucuga

SEQ ID NO: 2219038 - RNA, 22 nt, Homo sapiens
aagacuggagaaaugcuuacuu

SEQ ID NO: 2219039 - RNA, 23 nt, Homo sapiens
cugccugaaacagccauguccaa

SEQ ID NO: 2219040 - RNA, 17 nt, Homo sapiens
augggcuggcaugguga

SEQ ID NO: 2219041 - RNA, 14 nt, Homo sapiens
aacauuuacuuuug

SEQ ID NO: 2219042 - RNA, 20 nt, Homo sapiens
ucuccacgguagcacuugac

SEQ ID NO: 2219043 - RNA, 23 nt, Homo sapiens
uuacaaucaaaucuccugcugau

SEQ ID NO: 2219044 - RNA, 12 nt, Homo sapiens
ggggcugugagc

SEQ ID NO: 2219045 - RNA, 14 nt, Homo sapiens
aaguggcugugaca

SEQ ID NO: 2219046 - RNA, 13 nt, Homo sapiens
uauggugggagag

SEQ ID NO: 2219047 - RNA, 10 nt, Homo sapiens
uuuucacugc

SEQ ID NO: 2219048 - RNA, 10 nt, Homo sapiens
ucuucacugu

SEQ ID NO: 2219049 - RNA, 18 nt, Homo sapiens
augccaccgcuuccggcu

SEQ ID NO: 2219050 - RNA, 13 nt, Homo sapiens
ggagaagaucgca

SEQ ID NO: 2219051 - RNA, 18 nt, Homo sapiens
uaaauggcuggggggcca

SEQ ID NO: 2219052 - RNA, 13 nt, Homo sapiens
uacauagugaaaa

SEQ ID NO: 2219053 - RNA, 17 nt, Homo sapiens
auaaaccaagacaagac

SEQ ID NO: 2219054 - RNA, 16 nt, Homo sapiens
uucuaguuucucucaa

SEQ ID NO: 2219055 - RNA, 18 nt, Homo sapiens
agagccuguaaacuuuau

SEQ ID NO: 2219056 - RNA, 19 nt, Homo sapiens
ccgacugugaaaguaugug

SEQ ID NO: 2219057 - RNA, 13 nt, Homo sapiens
aauuggacaauaa

SEQ ID NO: 2219058 - RNA, 23 nt, Homo sapiens
uaaaaagugaacuuuuguaauuu

SEQ ID NO: 2219059 - RNA, 17 nt, Homo sapiens
uugccagccauucuuuc

SEQ ID NO: 2219060 - RNA, 18 nt, Homo sapiens
guggaagaagaaaacacu

SEQ ID NO: 2219061 - RNA, 17 nt, Homo sapiens
aauccaagcugcucauu

SEQ ID NO: 2219062 - RNA, 15 nt, Homo sapiens
uccagagcagaguuu

SEQ ID NO: 2219063 - RNA, 21 nt, Homo sapiens
ccucucucauccacuuuccaa

SEQ ID NO: 2219064 - RNA, 20 nt, Homo sapiens
ccaaacaaaaccaaauucua

SEQ ID NO: 2219065 - RNA, 13 nt, Homo sapiens
aaaaguacauuaa

SEQ ID NO: 2219066 - RNA, 22 nt, Homo sapiens
cacagaaggaaggagccagcuc

SEQ ID NO: 2219067 - RNA, 21 nt, Homo sapiens
cucaaguuaugucauaccuuu

SEQ ID NO: 2219068 - RNA, 22 nt, Homo sapiens
auggauccagaacugcacucuu

SEQ ID NO: 2219069 - RNA, 17 nt, Homo sapiens
acaaaccucaagccagc

SEQ ID NO: 2219070 - RNA, 20 nt, Homo sapiens
cauacccacccuuacuuccu

SEQ ID NO: 2219071 - RNA, 20 nt, Homo sapiens
uggccaucacuuucauucaa

SEQ ID NO: 2219072 - RNA, 20 nt, Homo sapiens
gcccaugugugagugugugc

SEQ ID NO: 2219073 - RNA, 19 nt, Homo sapiens
uaagaccuugaugugugau

SEQ ID NO: 2219074 - RNA, 18 nt, Homo sapiens
uauugagacacugucaag

SEQ ID NO: 2219075 - RNA, 19 nt, Homo sapiens
uguaauaaacucucuaggg

SEQ ID NO: 2219076 - RNA, 13 nt, Homo sapiens
aacauauaugugu

SEQ ID NO: 2219077 - RNA, 20 nt, Homo sapiens
acaauuuccaaaacugucca

SEQ ID NO: 2219078 - RNA, 13 nt, Homo sapiens
ugggaaaaaccac

SEQ ID NO: 2219079 - RNA, 14 nt, Homo sapiens
aauauguaaugcuu

SEQ ID NO: 2219080 - RNA, 16 nt, Homo sapiens
cucaugccuuaccuaa

SEQ ID NO: 2219081 - RNA, 16 nt, Homo sapiens
auaauuuuucacuuca

SEQ ID NO: 2219082 - RNA, 15 nt, Homo sapiens
uauuuauagcuguag

SEQ ID NO: 2219083 - RNA, 21 nt, Homo sapiens
cgaaaccgguggggcugguuc

SEQ ID NO: 2219084 - RNA, 15 nt, Homo sapiens
cuaacaacauuguag

SEQ ID NO: 2219085 - RNA, 22 nt, Homo sapiens
gccagagaaagcaaaggugcac

SEQ ID NO: 2219086 - RNA, 22 nt, Homo sapiens
aggcggcacauuggcagugugu

SEQ ID NO: 2219087 - RNA, 20 nt, Homo sapiens
cagccuccccacguggcacc

SEQ ID NO: 2219088 - RNA, 13 nt, Homo sapiens
ggaucccuuucac

SEQ ID NO: 2219089 - RNA, 15 nt, Homo sapiens
augugauacaugccg

SEQ ID NO: 2219090 - RNA, 15 nt, Homo sapiens
cugcuguguucucac

SEQ ID NO: 2219091 - RNA, 23 nt, Homo sapiens
auuuacacucaaccaugaccuca

SEQ ID NO: 2219092 - RNA, 13 nt, Homo sapiens
caggccuggacuu

SEQ ID NO: 2219093 - RNA, 21 nt, Homo sapiens
guuucagggcuaacgaccaca

SEQ ID NO: 2219094 - RNA, 19 nt, Homo sapiens
uggauuuuuaaaaugucaa

SEQ ID NO: 2219095 - RNA, 20 nt, Homo sapiens
ggcaaccaauaaaagccaga

SEQ ID NO: 2219096 - RNA, 20 nt, Homo sapiens
uagggacagucaaaaccaag

SEQ ID NO: 2219097 - RNA, 14 nt, Homo sapiens
caaaaguucccuga

SEQ ID NO: 2219098 - RNA, 13 nt, Homo sapiens
cuccuugcacuuu

SEQ ID NO: 2219099 - RNA, 13 nt, Homo sapiens
ugucccaugaccu

SEQ ID NO: 2219100 - RNA, 18 nt, Homo sapiens
uacuuccaugauacuuua

SEQ ID NO: 2219101 - RNA, 11 nt, Homo sapiens
uugcucccuau

SEQ ID NO: 2219102 - RNA, 22 nt, Homo sapiens
cagccaccguuucuuccugcca

SEQ ID NO: 2219103 - RNA, 18 nt, Homo sapiens
auccuucuccaccaaaga

SEQ ID NO: 2219104 - RNA, 21 nt, Homo sapiens
ugaucagcuuucaaagcauuu

SEQ ID NO: 2219105 - RNA, 18 nt, Homo sapiens
acaacccgucagagaccu

SEQ ID NO: 2219106 - RNA, 12 nt, Homo sapiens
uuuuuuaaucuc

SEQ ID NO: 2219107 - RNA, 23 nt, Homo sapiens
uagugcugaugccuguguacugc

SEQ ID NO: 2219108 - RNA, 18 nt, Homo sapiens
gcuggaguacaguggugu

SEQ ID NO: 2219109 - RNA, 17 nt, Homo sapiens
caguagaagugucacag

SEQ ID NO: 2219110 - RNA, 13 nt, Homo sapiens
auaaagcucucaa

SEQ ID NO: 2219111 - RNA, 16 nt, Homo sapiens
uauuuuuagacagagu

SEQ ID NO: 2219112 - RNA, 23 nt, Homo sapiens
uagaccuuuauuggguaucaaga

SEQ ID NO: 2219113 - RNA, 15 nt, Homo sapiens
guguuucccuuccuc

SEQ ID NO: 2219114 - RNA, 15 nt, Homo sapiens
uggagagaagcucuu

SEQ ID NO: 2219115 - RNA, 21 nt, Homo sapiens
ccugcccccuguacauuugug

SEQ ID NO: 2219116 - RNA, 12 nt, Homo sapiens
agaaaaucuuuc

SEQ ID NO: 2219117 - RNA, 17 nt, Homo sapiens
aauauguucugacauaa

SEQ ID NO: 2219118 - RNA, 20 nt, Homo sapiens
gacauguauucccauugcac

SEQ ID NO: 2219119 - RNA, 21 nt, Homo sapiens
gacuucaucuucaaaacugcc

SEQ ID NO: 2219120 - RNA, 18 nt, Homo sapiens
agaauagaauacauugau

SEQ ID NO: 2219121 - RNA, 17 nt, Homo sapiens
auauaaauaaucacaca

SEQ ID NO: 2219122 - RNA, 14 nt, Homo sapiens
aagcugacauugcc

SEQ ID NO: 2219123 - RNA, 18 nt, Homo sapiens
caagugggaucugucaca

SEQ ID NO: 2219124 - RNA, 11 nt, Homo sapiens
uguucaugccg

SEQ ID NO: 2219125 - RNA, 18 nt, Homo sapiens
auccaaguuauuaaucuu

SEQ ID NO: 2219126 - RNA, 19 nt, Homo sapiens
ccauggcugccaucucacc

SEQ ID NO: 2219127 - RNA, 12 nt, Homo sapiens
agaauauucucc

SEQ ID NO: 2219128 - RNA, 22 nt, Homo sapiens
uuuuaacagucagaaccacuaa

SEQ ID NO: 2219129 - RNA, 20 nt, Homo sapiens
auuuuuuuuuuuccaagaca

SEQ ID NO: 2219130 - RNA, 17 nt, Homo sapiens
ccuuugccacacugugg

SEQ ID NO: 2219131 - RNA, 13 nt, Homo sapiens
ucugucugcauuu

SEQ ID NO: 2219132 - RNA, 21 nt, Homo sapiens
aauuuaguuuguacucagugg

SEQ ID NO: 2219133 - RNA, 14 nt, Homo sapiens
gccgauauaagcca

SEQ ID NO: 2219134 - RNA, 18 nt, Homo sapiens
acugugccaugugccagg

SEQ ID NO: 2219135 - RNA, 21 nt, Homo sapiens
aaauucuauugaaaacagugu

SEQ ID NO: 2219136 - RNA, 21 nt, Homo sapiens
uguugcuggacugucauagaa

SEQ ID NO: 2219137 - RNA, 17 nt, Homo sapiens
caauuuuauagcacaaa

SEQ ID NO: 2219138 - RNA, 13 nt, Homo sapiens
auuugaaugauuu

SEQ ID NO: 2219139 - RNA, 15 nt, Homo sapiens
cacccccaugacauu

SEQ ID NO: 2219140 - RNA, 20 nt, Homo sapiens
cauaugaguaagggcacuga

SEQ ID NO: 2219141 - RNA, 16 nt, Homo sapiens
accucauccaggcuac

SEQ ID NO: 2219142 - RNA, 14 nt, Homo sapiens
cauuaaacuugaag

SEQ ID NO: 2219143 - RNA, 21 nt, Homo sapiens
aacauguaccacugagccuga

SEQ ID NO: 2219144 - RNA, 17 nt, Homo sapiens
acugaguauggagauua

SEQ ID NO: 2219145 - RNA, 12 nt, Homo sapiens
uuaugugcuaug

SEQ ID NO: 2219146 - RNA, 12 nt, Homo sapiens
uuuggugcuaau

SEQ ID NO: 2219147 - RNA, 20 nt, Homo sapiens
uaaaucguccucccaggcca

SEQ ID NO: 2219148 - RNA, 20 nt, Homo sapiens
guuuagccuagucaugugcc

SEQ ID NO: 2219149 - RNA, 22 nt, Homo sapiens
augucauaaaugucacaauaaa

SEQ ID NO: 2219150 - RNA, 20 nt, Homo sapiens
ucucuuuaaguuuugauuaa

SEQ ID NO: 2219151 - RNA, 15 nt, Homo sapiens
aaaauguaugaccac

SEQ ID NO: 2219152 - RNA, 17 nt, Homo sapiens
uccuugcuacccagaaa

SEQ ID NO: 2219153 - RNA, 19 nt, Homo sapiens
ugugagugugugcaaguau

SEQ ID NO: 2219154 - RNA, 17 nt, Homo sapiens
aauauauauacauaugu

SEQ ID NO: 2219155 - RNA, 15 nt, Homo sapiens
acagggcaccccagc

SEQ ID NO: 2219156 - RNA, 14 nt, Homo sapiens
caggcagaaggugg

SEQ ID NO: 2219157 - RNA, 14 nt, Homo sapiens
cacuguaaagacaa

SEQ ID NO: 2219158 - RNA, 16 nt, Homo sapiens
auagcugggauuugaa

SEQ ID NO: 2219159 - RNA, 21 nt, Homo sapiens
auuccucggggauagaccaaa

SEQ ID NO: 2219160 - RNA, 20 nt, Homo sapiens
auagcuuuagagaagccaua

SEQ ID NO: 2219161 - RNA, 20 nt, Homo sapiens
uaaauuugggggacuuacau

SEQ ID NO: 2219162 - RNA, 13 nt, Homo sapiens
agaggaugagcuc

SEQ ID NO: 2219163 - RNA, 13 nt, Homo sapiens
cacaugccacaaa

SEQ ID NO: 2219164 - RNA, 22 nt, Homo sapiens
gcaguggugcaaucacagcuca

SEQ ID NO: 2219165 - RNA, 18 nt, Homo sapiens
uggucuguuugcauuuga

SEQ ID NO: 2219166 - RNA, 16 nt, Homo sapiens
cuaacguuuaauugcc

SEQ ID NO: 2219167 - RNA, 15 nt, Homo sapiens
uaggggcugggagcu

SEQ ID NO: 2219168 - RNA, 17 nt, Homo sapiens
cugauuuagaccaaaag

SEQ ID NO: 2219169 - RNA, 17 nt, Homo sapiens
ggaaagggcagggccaa

SEQ ID NO: 2219170 - RNA, 19 nt, Homo sapiens
uaggcaccuuuuacuguga

SEQ ID NO: 2219171 - RNA, 14 nt, Homo sapiens
aucaggucuuuacu

SEQ ID NO: 2219172 - RNA, 15 nt, Homo sapiens
auauauuccaccagg

SEQ ID NO: 2219173 - RNA, 18 nt, Homo sapiens
cagugcugggaccagagc

SEQ ID NO: 2219174 - RNA, 15 nt, Homo sapiens
auuuauagcuaugaa

SEQ ID NO: 2219175 - RNA, 17 nt, Homo sapiens
gcaguugaaagggcaau

SEQ ID NO: 2219176 - RNA, 14 nt, Homo sapiens
agcugcacaugugc

SEQ ID NO: 2219177 - RNA, 14 nt, Homo sapiens
cgccucaccugcuc

SEQ ID NO: 2219178 - RNA, 21 nt, Homo sapiens
ugacagucagcaacaugauac

SEQ ID NO: 2219179 - RNA, 16 nt, Homo sapiens
uacauauuuguauguu

SEQ ID NO: 2219180 - RNA, 14 nt, Homo sapiens
ugacucagcacugu

SEQ ID NO: 2219181 - RNA, 23 nt, Homo sapiens
gaguguuuuucauggaaaagccu

SEQ ID NO: 2219182 - RNA, 18 nt, Homo sapiens
cuaaagaagauaaacaca

SEQ ID NO: 2219183 - RNA, 22 nt, Homo sapiens
aaagcaaggcaaaaauguaugc

SEQ ID NO: 2219184 - RNA, 16 nt, Homo sapiens
cagcaaggcccugcug

SEQ ID NO: 2219185 - RNA, 17 nt, Homo sapiens
ccaccccuaaagagaua

SEQ ID NO: 2219186 - RNA, 15 nt, Homo sapiens
auuauaacugugcaa

SEQ ID NO: 2219187 - RNA, 16 nt, Homo sapiens
aaucuguaauuucacu

SEQ ID NO: 2219188 - RNA, 19 nt, Homo sapiens
auuauguggaagaagcaaa

SEQ ID NO: 2219189 - RNA, 16 nt, Homo sapiens
uugucauguaugugaa

SEQ ID NO: 2219190 - RNA, 21 nt, Homo sapiens
agcucuucuccauccuaccac

SEQ ID NO: 2219191 - RNA, 17 nt, Homo sapiens
ucaagcgccagaaagag

SEQ ID NO: 2219192 - RNA, 16 nt, Homo sapiens
uauuaauuaaaccaga

SEQ ID NO: 2219193 - RNA, 21 nt, Homo sapiens
ggaaaauaaauacauucgaag

SEQ ID NO: 2219194 - RNA, 15 nt, Homo sapiens
ucuccugcccaugau

SEQ ID NO: 2219195 - RNA, 17 nt, Homo sapiens
uuauucauucagugaga

SEQ ID NO: 2219196 - RNA, 12 nt, Homo sapiens
uuaaauaguaaa

SEQ ID NO: 2219197 - RNA, 12 nt, Homo sapiens
cagaauagcuga

SEQ ID NO: 2219198 - RNA, 21 nt, Homo sapiens
gcuuauaccagguuaccucac

SEQ ID NO: 2219199 - RNA, 19 nt, Homo sapiens
gaauggaaaggauggagca

SEQ ID NO: 2219200 - RNA, 23 nt, Homo sapiens
ccaagucccucucacaggacaug

SEQ ID NO: 2219201 - RNA, 13 nt, Homo sapiens
auuaucugaacug

SEQ ID NO: 2219202 - RNA, 19 nt, Homo sapiens
gccaugguagaagaauuga

SEQ ID NO: 2219203 - RNA, 23 nt, Homo sapiens
gcacguugcccaagguugcacag

SEQ ID NO: 2219204 - RNA, 20 nt, Homo sapiens
caagcgcuguaaacccugac

SEQ ID NO: 2219205 - RNA, 19 nt, Homo sapiens
gugugggggaagcaccaua

SEQ ID NO: 2219206 - RNA, 15 nt, Homo sapiens
aauaauuguuccaaa

SEQ ID NO: 2219207 - RNA, 17 nt, Homo sapiens
cuuugaauacugugaaa

SEQ ID NO: 2219208 - RNA, 14 nt, Homo sapiens
gaaguucuaggaaa

SEQ ID NO: 2219209 - RNA, 13 nt, Homo sapiens
uaccuauauuaca

SEQ ID NO: 2219210 - RNA, 16 nt, Homo sapiens
aaugggcuagagggug

SEQ ID NO: 2219211 - RNA, 16 nt, Homo sapiens
ccuguucugugacugu

SEQ ID NO: 2219212 - RNA, 23 nt, Homo sapiens
acuuaguccugauguacuuuaaa

SEQ ID NO: 2219213 - RNA, 16 nt, Homo sapiens
agcauaucugccuuua

SEQ ID NO: 2219214 - RNA, 16 nt, Homo sapiens
ugucaaacaguaauaa

SEQ ID NO: 2219215 - RNA, 17 nt, Homo sapiens
gcuucugccacuuccca

SEQ ID NO: 2219216 - RNA, 23 nt, Homo sapiens
caaauucauuuuuuucacuggag

SEQ ID NO: 2219217 - RNA, 19 nt, Homo sapiens
agggauuugaggugagggu

SEQ ID NO: 2219218 - RNA, 12 nt, Homo sapiens
agcagcugcuac

SEQ ID NO: 2219219 - RNA, 15 nt, Homo sapiens
ccugaaggugccacu

SEQ ID NO: 2219220 - RNA, 22 nt, Homo sapiens
uauugugacagagccauggugu

SEQ ID NO: 2219221 - RNA, 15 nt, Homo sapiens
caugaaacauuucag

SEQ ID NO: 2219222 - RNA, 22 nt, Homo sapiens
gacuauggauguguucucuagg

SEQ ID NO: 2219223 - RNA, 13 nt, Homo sapiens
aaacaucuuucca

SEQ ID NO: 2219224 - RNA, 15 nt, Homo sapiens
caugggggcacuuga

SEQ ID NO: 2219225 - RNA, 18 nt, Homo sapiens
ucaucaucaagaauuuaa

SEQ ID NO: 2219226 - RNA, 17 nt, Homo sapiens
gcuugggccacugcccu

SEQ ID NO: 2219227 - RNA, 20 nt, Homo sapiens
acaguccucauuuacuggau

SEQ ID NO: 2219228 - RNA, 14 nt, Homo sapiens
uaauaugauucuag

SEQ ID NO: 2219229 - RNA, 13 nt, Homo sapiens
cugggcaccaccu

SEQ ID NO: 2219230 - RNA, 16 nt, Homo sapiens
agcagcugguaaucuu

SEQ ID NO: 2219231 - RNA, 12 nt, Homo sapiens
aaggccuacccc

SEQ ID NO: 2219232 - RNA, 15 nt, Homo sapiens
gcccaacgcaaauuc

SEQ ID NO: 2219233 - RNA, 23 nt, Homo sapiens
cuucccacuggaggcaugugaug

SEQ ID NO: 2219234 - RNA, 14 nt, Homo sapiens
uaagccuucauuug

SEQ ID NO: 2219235 - RNA, 14 nt, Homo sapiens
cuguccuggaggca

SEQ ID NO: 2219236 - RNA, 12 nt, Homo sapiens
uaguauucauga

SEQ ID NO: 2219237 - RNA, 12 nt, Homo sapiens
uaaaauucauau

SEQ ID NO: 2219238 - RNA, 16 nt, Homo sapiens
aaaggaggcaugccuc

SEQ ID NO: 2219239 - RNA, 16 nt, Homo sapiens
ugacagacuuuggaca

SEQ ID NO: 2219240 - RNA, 18 nt, Homo sapiens
auuuaugagaucacugaa

SEQ ID NO: 2219241 - RNA, 16 nt, Homo sapiens
ugagauaauacauucc

SEQ ID NO: 2219242 - RNA, 14 nt, Homo sapiens
ccuggcuucucuga

SEQ ID NO: 2219243 - RNA, 20 nt, Homo sapiens
aaauaaaccccagucuccca

SEQ ID NO: 2219244 - RNA, 19 nt, Homo sapiens
ugucucgcgcgacugagaa

SEQ ID NO: 2219245 - RNA, 23 nt, Homo sapiens
gguuaaggccagggccucuccaa

SEQ ID NO: 2219246 - RNA, 19 nt, Homo sapiens
aaagauugauagaaaucag

SEQ ID NO: 2219247 - RNA, 17 nt, Homo sapiens
gccggaggcugcaguga

SEQ ID NO: 2219248 - RNA, 14 nt, Homo sapiens
uaagacaccaaaua

SEQ ID NO: 2219249 - RNA, 14 nt, Homo sapiens
cccaagacuuggag

SEQ ID NO: 2219250 - RNA, 18 nt, Homo sapiens
guuuuccccaaaccauaa

SEQ ID NO: 2219251 - RNA, 17 nt, Homo sapiens
caacucgugacagccuc

SEQ ID NO: 2219252 - RNA, 15 nt, Homo sapiens
uacuccuaccucagc

SEQ ID NO: 2219253 - RNA, 14 nt, Homo sapiens
uauugaguucugaa

SEQ ID NO: 2219254 - RNA, 15 nt, Homo sapiens
gacucuaaagaaaca

SEQ ID NO: 2219255 - RNA, 20 nt, Homo sapiens
agauguucagggguauuaaa

SEQ ID NO: 2219256 - RNA, 21 nt, Homo sapiens
acccaggucuugacaccagcu

SEQ ID NO: 2219257 - RNA, 18 nt, Homo sapiens
gacaaguggacucagggc

SEQ ID NO: 2219258 - RNA, 18 nt, Homo sapiens
gaaugcaaagaugaaggu

SEQ ID NO: 2219259 - RNA, 16 nt, Homo sapiens
ucacauaaaaaugcaa

SEQ ID NO: 2219260 - RNA, 17 nt, Homo sapiens
guaggugaaagaacaag

SEQ ID NO: 2219261 - RNA, 13 nt, Homo sapiens
cucuaaagagcau

SEQ ID NO: 2219262 - RNA, 14 nt, Homo sapiens
aagaacgucauuuu

SEQ ID NO: 2219263 - RNA, 15 nt, Homo sapiens
guggcaacuugugau

SEQ ID NO: 2219264 - RNA, 18 nt, Homo sapiens
uugcaaagagacauuuca

SEQ ID NO: 2219265 - RNA, 15 nt, Homo sapiens
ccuuuggaauggugu

SEQ ID NO: 2219266 - RNA, 14 nt, Homo sapiens
aaaguuuagggaaa

SEQ ID NO: 2219267 - RNA, 13 nt, Homo sapiens
ccuuaccaaaaaa

SEQ ID NO: 2219268 - RNA, 19 nt, Homo sapiens
ucucccaauucauccucac

SEQ ID NO: 2219269 - RNA, 14 nt, Homo sapiens
aguaagaauaccac

SEQ ID NO: 2219270 - RNA, 15 nt, Homo sapiens
cauguaugugcacau

SEQ ID NO: 2219271 - RNA, 15 nt, Homo sapiens
gaagugccaucucaa

SEQ ID NO: 2219272 - RNA, 22 nt, Homo sapiens
caugaaucuugcugucaaggaa

SEQ ID NO: 2219273 - RNA, 16 nt, Homo sapiens
uguaaauguaaacuca

SEQ ID NO: 2219274 - RNA, 22 nt, Homo sapiens
cgguuuacagcuaucgaacuuc

SEQ ID NO: 2219275 - RNA, 14 nt, Homo sapiens
aaccauaaagcaua

SEQ ID NO: 2219276 - RNA, 17 nt, Homo sapiens
uagcacacuuuuccaca

SEQ ID NO: 2219277 - RNA, 12 nt, Homo sapiens
acugucaggguu

SEQ ID NO: 2219278 - RNA, 14 nt, Homo sapiens
uucuggagacagaa

SEQ ID NO: 2219279 - RNA, 17 nt, Homo sapiens
guuacuuacugccuuag

SEQ ID NO: 2219280 - RNA, 15 nt, Homo sapiens
gguggcagcucaaaa

SEQ ID NO: 2219281 - RNA, 12 nt, Homo sapiens
ccugcacacucc

SEQ ID NO: 2219282 - RNA, 15 nt, Homo sapiens
cucuucugacugccc

SEQ ID NO: 2219283 - RNA, 22 nt, Homo sapiens
cugcuccuacauccagcuccuc

SEQ ID NO: 2219284 - RNA, 22 nt, Homo sapiens
cugcagcggaagggacucuggg

SEQ ID NO: 2219285 - RNA, 13 nt, Homo sapiens
acaguauuuccac

SEQ ID NO: 2219286 - RNA, 16 nt, Homo sapiens
caaaccuugaugugcc

SEQ ID NO: 2219287 - RNA, 13 nt, Homo sapiens
ucuguuagcugcu

SEQ ID NO: 2219288 - RNA, 18 nt, Homo sapiens
aaugcugcaggaaaagca

SEQ ID NO: 2219289 - RNA, 15 nt, Homo sapiens
aucaccaacuguccc

SEQ ID NO: 2219290 - RNA, 16 nt, Homo sapiens
uauuuuaaaauuucac

SEQ ID NO: 2219291 - RNA, 16 nt, Homo sapiens
acuuguccucuugcca

SEQ ID NO: 2219292 - RNA, 16 nt, Homo sapiens
aaggauagugugaaga

SEQ ID NO: 2219293 - RNA, 17 nt, Homo sapiens
ucugauuccauccugug

SEQ ID NO: 2219294 - RNA, 14 nt, Homo sapiens
gcauuugcugguua

SEQ ID NO: 2219295 - RNA, 18 nt, Homo sapiens
aaacauaaugaugaguaa

SEQ ID NO: 2219296 - RNA, 20 nt, Homo sapiens
ugccauguaaaggccuuuaa

SEQ ID NO: 2219297 - RNA, 20 nt, Homo sapiens
aaguuaaugcaaaugacugu

SEQ ID NO: 2219298 - RNA, 16 nt, Homo sapiens
caaccugaagcacaag

SEQ ID NO: 2219299 - RNA, 20 nt, Homo sapiens
accacugagcccuugcacag

SEQ ID NO: 2219300 - RNA, 16 nt, Homo sapiens
uuacauuuuguauauu

SEQ ID NO: 2219301 - RNA, 13 nt, Homo sapiens
ugauaagugcagg

SEQ ID NO: 2219302 - RNA, 21 nt, Homo sapiens
auauuccugguguagcacuua

SEQ ID NO: 2219303 - RNA, 21 nt, Homo sapiens
ucgagagugagaaauggcagu

SEQ ID NO: 2219304 - RNA, 14 nt, Homo sapiens
guuauuuuauugcc

SEQ ID NO: 2219305 - RNA, 16 nt, Homo sapiens
cacaucgcacacuggg

SEQ ID NO: 2219306 - RNA, 23 nt, Homo sapiens
auacucaugcauucuuuugcaca

SEQ ID NO: 2219307 - RNA, 12 nt, Homo sapiens
ugcaugggaaaa

SEQ ID NO: 2219308 - RNA, 21 nt, Homo sapiens
gcaaacuucagaguucuugcc

SEQ ID NO: 2219309 - RNA, 12 nt, Homo sapiens
agacaauggcca

SEQ ID NO: 2219310 - RNA, 17 nt, Homo sapiens
cugaguggggagcaguu

SEQ ID NO: 2219311 - RNA, 17 nt, Homo sapiens
uuugcauacauucuuca

SEQ ID NO: 2219312 - RNA, 16 nt, Homo sapiens
ucaucucacauuuucc

SEQ ID NO: 2219313 - RNA, 15 nt, Homo sapiens
gccugcuuugaauaa

SEQ ID NO: 2219314 - RNA, 16 nt, Homo sapiens
uuaaaauuuaucuuaa

SEQ ID NO: 2219315 - RNA, 16 nt, Homo sapiens
ggaauaauauucaaua

SEQ ID NO: 2219316 - RNA, 19 nt, Homo sapiens
aagccagauuuuccugaaa

SEQ ID NO: 2219317 - RNA, 14 nt, Homo sapiens
gcuuauaugugaca

SEQ ID NO: 2219318 - RNA, 17 nt, Homo sapiens
cuguguauucauucuca

SEQ ID NO: 2219319 - RNA, 14 nt, Homo sapiens
caaggccuacccca

SEQ ID NO: 2219320 - RNA, 20 nt, Homo sapiens
ugaauaagcuuucucucaga

SEQ ID NO: 2219321 - RNA, 16 nt, Homo sapiens
ucagugugagucagaa

SEQ ID NO: 2219322 - RNA, 17 nt, Homo sapiens
gaaucugcccacucggg

SEQ ID NO: 2219323 - RNA, 16 nt, Homo sapiens
ucucugaguugcccug

SEQ ID NO: 2219324 - RNA, 14 nt, Homo sapiens
ugaauugcaugacu

SEQ ID NO: 2219325 - RNA, 18 nt, Homo sapiens
gcugggccauguccaaag

SEQ ID NO: 2219326 - RNA, 18 nt, Homo sapiens
uuagauuuugauagcaau

SEQ ID NO: 2219327 - RNA, 17 nt, Homo sapiens
cuauguuacauguacau

SEQ ID NO: 2219328 - RNA, 15 nt, Homo sapiens
uugcacacagguguu

SEQ ID NO: 2219329 - RNA, 18 nt, Homo sapiens
ccaugcccucccugcugc

SEQ ID NO: 2219330 - RNA, 15 nt, Homo sapiens
augcuguuaacuuaa

SEQ ID NO: 2219331 - RNA, 18 nt, Homo sapiens
auucuuuccaugcaguua

SEQ ID NO: 2219332 - RNA, 19 nt, Homo sapiens
auuuuguuauugacuaaca

SEQ ID NO: 2219333 - RNA, 21 nt, Homo sapiens
caugacaaaaaggccaagaga

SEQ ID NO: 2219334 - RNA, 15 nt, Homo sapiens
cgcuccaguaucucc

SEQ ID NO: 2219335 - RNA, 16 nt, Homo sapiens
cuccuuguacuugaau

SEQ ID NO: 2219336 - RNA, 16 nt, Homo sapiens
uuacuaucauaauuca

SEQ ID NO: 2219337 - RNA, 17 nt, Homo sapiens
accucugggcagcuccu

SEQ ID NO: 2219338 - RNA, 21 nt, Homo sapiens
uaaauacaagauucucugaua

SEQ ID NO: 2219339 - RNA, 17 nt, Homo sapiens
cucuuggguucaaguga

SEQ ID NO: 2219340 - RNA, 13 nt, Homo sapiens
ccaucugccagau

SEQ ID NO: 2219341 - RNA, 14 nt, Homo sapiens
ucauuccaaaaaga

SEQ ID NO: 2219342 - RNA, 14 nt, Homo sapiens
accagccauacuua

SEQ ID NO: 2219343 - RNA, 23 nt, Homo sapiens
agggaggccacacgcacuggugc

SEQ ID NO: 2219344 - RNA, 16 nt, Homo sapiens
cuugagcaaggcaaga

SEQ ID NO: 2219345 - RNA, 17 nt, Homo sapiens
uuaugaaaggucauuaa

SEQ ID NO: 2219346 - RNA, 15 nt, Homo sapiens
ggaaugccaauguca

SEQ ID NO: 2219347 - RNA, 21 nt, Homo sapiens
auacaugugccgaaugugcag

SEQ ID NO: 2219348 - RNA, 16 nt, Homo sapiens
guuucuggcagccagu

SEQ ID NO: 2219349 - RNA, 15 nt, Homo sapiens
cuggcccuggccaga

SEQ ID NO: 2219350 - RNA, 23 nt, Homo sapiens
cuuacuguauaaaggugugcugu

SEQ ID NO: 2219351 - RNA, 12 nt, Homo sapiens
agcuucuuguuu

SEQ ID NO: 2219352 - RNA, 16 nt, Homo sapiens
gcuuagccuccugacc

SEQ ID NO: 2219353 - RNA, 21 nt, Homo sapiens
caccauggcacccugcaccag

SEQ ID NO: 2219354 - RNA, 11 nt, Homo sapiens
cacagccaaac

SEQ ID NO: 2219355 - RNA, 11 nt, Homo sapiens
aagagccacag

SEQ ID NO: 2219356 - RNA, 22 nt, Homo sapiens
ccagcaucugaguuagguucca

SEQ ID NO: 2219357 - RNA, 16 nt, Homo sapiens
augccaguaacugugc

SEQ ID NO: 2219358 - RNA, 17 nt, Homo sapiens
ugaagaaaaaaucagaa

SEQ ID NO: 2219359 - RNA, 18 nt, Homo sapiens
auuuuugaugacucauca

SEQ ID NO: 2219360 - RNA, 14 nt, Homo sapiens
gccucuuguucaug

SEQ ID NO: 2219361 - RNA, 14 nt, Homo sapiens
gaggucucuguggc

SEQ ID NO: 2219362 - RNA, 15 nt, Homo sapiens
augauaaagagggau

SEQ ID NO: 2219363 - RNA, 20 nt, Homo sapiens
uccagugagcucuggaugaa

SEQ ID NO: 2219364 - RNA, 21 nt, Homo sapiens
cacuccuucucucacuguguu

SEQ ID NO: 2219365 - RNA, 21 nt, Homo sapiens
agacucgucucaaaaaaaaga

SEQ ID NO: 2219366 - RNA, 16 nt, Homo sapiens
ugaacccugccucuug

SEQ ID NO: 2219367 - RNA, 17 nt, Homo sapiens
aaugugagguguugcua

SEQ ID NO: 2219368 - RNA, 20 nt, Homo sapiens
aaugaguuaugaguuauuca

SEQ ID NO: 2219369 - RNA, 15 nt, Homo sapiens
aaucacggugguaaa

SEQ ID NO: 2219370 - RNA, 23 nt, Homo sapiens
gcuuaguuuuuucaguugcagua

SEQ ID NO: 2219371 - RNA, 14 nt, Homo sapiens
auacaacugagucu

SEQ ID NO: 2219372 - RNA, 14 nt, Homo sapiens
guuuauccuuaaga

SEQ ID NO: 2219373 - RNA, 20 nt, Homo sapiens
acacagcaagacuccgucuc

SEQ ID NO: 2219374 - RNA, 13 nt, Homo sapiens
ggcaggcuucuca

SEQ ID NO: 2219375 - RNA, 13 nt, Homo sapiens
gccaggcuuguca

SEQ ID NO: 2219376 - RNA, 15 nt, Homo sapiens
uaccuauucugaaaa

SEQ ID NO: 2219377 - RNA, 19 nt, Homo sapiens
agaggcggcagauccugcc

SEQ ID NO: 2219378 - RNA, 22 nt, Homo sapiens
acaaguucaauaaaaaucugcu

SEQ ID NO: 2219379 - RNA, 16 nt, Homo sapiens
auuucuuaaacacaaa

SEQ ID NO: 2219380 - RNA, 13 nt, Homo sapiens
caacaacaaggac

SEQ ID NO: 2219381 - RNA, 15 nt, Homo sapiens
gaaaucauuguagaa

SEQ ID NO: 2219382 - RNA, 18 nt, Homo sapiens
gaaaaugggaagcauuag

SEQ ID NO: 2219383 - RNA, 23 nt, Homo sapiens
aguuugugguaacuugagauuca

SEQ ID NO: 2219384 - RNA, 18 nt, Homo sapiens
aggcugcccacucuccau

SEQ ID NO: 2219385 - RNA, 15 nt, Homo sapiens
uguuucauuaaucaa

SEQ ID NO: 2219386 - RNA, 17 nt, Homo sapiens
agaucacgucacugcac

SEQ ID NO: 2219387 - RNA, 13 nt, Homo sapiens
uacaggaggaaug

SEQ ID NO: 2219388 - RNA, 20 nt, Homo sapiens
ucccuucgaaagccucucag

SEQ ID NO: 2219389 - RNA, 20 nt, Homo sapiens
aauaauccagaaaaacugug

SEQ ID NO: 2219390 - RNA, 21 nt, Homo sapiens
guauguucccucuugucccuu

SEQ ID NO: 2219391 - RNA, 21 nt, Homo sapiens
gggcuuguagaccacuguccu

SEQ ID NO: 2219392 - RNA, 15 nt, Homo sapiens
cuagccaucuugauc

SEQ ID NO: 2219393 - RNA, 14 nt, Homo sapiens
uuccucgccugaca

SEQ ID NO: 2219394 - RNA, 15 nt, Homo sapiens
aguugagucuccucu

SEQ ID NO: 2219395 - RNA, 16 nt, Homo sapiens
auguuaaccucagugu

SEQ ID NO: 2219396 - RNA, 23 nt, Homo sapiens
aacaugcacaaaaagaugcaucu

SEQ ID NO: 2219397 - RNA, 19 nt, Homo sapiens
agaggcguugcuuucacuc

SEQ ID NO: 2219398 - RNA, 22 nt, Homo sapiens
gggugucucccucgggggcucu

SEQ ID NO: 2219399 - RNA, 15 nt, Homo sapiens
gacccagucaaugaa

SEQ ID NO: 2219400 - RNA, 13 nt, Homo sapiens
aaagguccuugac

SEQ ID NO: 2219401 - RNA, 20 nt, Homo sapiens
ugcaccccaggcagccacuc

SEQ ID NO: 2219402 - RNA, 21 nt, Homo sapiens
ugccaucggucuagaaccacu

SEQ ID NO: 2219403 - RNA, 19 nt, Homo sapiens
aggauagacuuuucccaag

SEQ ID NO: 2219404 - RNA, 18 nt, Homo sapiens
gaggcuggugacaggcca

SEQ ID NO: 2219405 - RNA, 15 nt, Homo sapiens
agcuccuguggccac

SEQ ID NO: 2219406 - RNA, 14 nt, Homo sapiens
agcugcacuacagc

SEQ ID NO: 2219407 - RNA, 12 nt, Homo sapiens
caauacugagcc

SEQ ID NO: 2219408 - RNA, 15 nt, Homo sapiens
auauaucacuaagcu

SEQ ID NO: 2219409 - RNA, 23 nt, Homo sapiens
cuaagucaagaucaacauuccag

SEQ ID NO: 2219410 - RNA, 17 nt, Homo sapiens
uuuuacuucucuauaca

SEQ ID NO: 2219411 - RNA, 13 nt, Homo sapiens
cucagugaaggcu

SEQ ID NO: 2219412 - RNA, 14 nt, Homo sapiens
ccacagcugccauc

SEQ ID NO: 2219413 - RNA, 14 nt, Homo sapiens
caagaacaaauaca

SEQ ID NO: 2219414 - RNA, 13 nt, Homo sapiens
agucccucagcca

SEQ ID NO: 2219415 - RNA, 16 nt, Homo sapiens
uucacuccaaagagaa

SEQ ID NO: 2219416 - RNA, 14 nt, Homo sapiens
uccauauuugccuu

SEQ ID NO: 2219417 - RNA, 17 nt, Homo sapiens
gacaguugauuuccaac

SEQ ID NO: 2219418 - RNA, 23 nt, Homo sapiens
ccuggccggcuccaguuucccca

SEQ ID NO: 2219419 - RNA, 18 nt, Homo sapiens
cccagucucccuccagga

SEQ ID NO: 2219420 - RNA, 15 nt, Homo sapiens
uuaaagauacaguac

SEQ ID NO: 2219421 - RNA, 9 nt, Homo sapiens
gugguggga

SEQ ID NO: 2219422 - RNA, 17 nt, Homo sapiens
acuaucaccuauuacau

SEQ ID NO: 2219423 - RNA, 23 nt, Homo sapiens
aaugacuuuuugaaaguaaaagc

SEQ ID NO: 2219424 - RNA, 17 nt, Homo sapiens
ucuccuguuuuuugaug

SEQ ID NO: 2219425 - RNA, 14 nt, Homo sapiens
uuaaaauacaugaa

SEQ ID NO: 2219426 - RNA, 17 nt, Homo sapiens
gacuggcacacuggccu

SEQ ID NO: 2219427 - RNA, 17 nt, Homo sapiens
ugaggacccgaggacag

SEQ ID NO: 2219428 - RNA, 17 nt, Homo sapiens
ccagaaccaacugcauu

SEQ ID NO: 2219429 - RNA, 18 nt, Homo sapiens
ccaggugucuagaggcaa

SEQ ID NO: 2219430 - RNA, 13 nt, Homo sapiens
uuacuguggcuuc

SEQ ID NO: 2219431 - RNA, 23 nt, Homo sapiens
ucuuuguuagauauuagguccca

SEQ ID NO: 2219432 - RNA, 22 nt, Homo sapiens
uuuaaacugauuacguuuacau

SEQ ID NO: 2219433 - RNA, 17 nt, Homo sapiens
ucugucuuccuucauua

SEQ ID NO: 2219434 - RNA, 14 nt, Homo sapiens
caggccugaacuca

SEQ ID NO: 2219435 - RNA, 13 nt, Homo sapiens
aauaucaaugaag

SEQ ID NO: 2219436 - RNA, 16 nt, Homo sapiens
ccuucuccaccaaaga

SEQ ID NO: 2219437 - RNA, 18 nt, Homo sapiens
acaauuauaucaguccuc

SEQ ID NO: 2219438 - RNA, 14 nt, Homo sapiens
caauuucauacuaa

SEQ ID NO: 2219439 - RNA, 21 nt, Homo sapiens
acucuagguuuuacagauuua

SEQ ID NO: 2219440 - RNA, 23 nt, Homo sapiens
agcaugagauuugggcaggaaca

SEQ ID NO: 2219441 - RNA, 21 nt, Homo sapiens
auuggcuaauaaauguugcca

SEQ ID NO: 2219442 - RNA, 20 nt, Homo sapiens
uauuuuuugaaucuaugaac

SEQ ID NO: 2219443 - RNA, 22 nt, Homo sapiens
agggaaauuuuggggggaacau

SEQ ID NO: 2219444 - RNA, 13 nt, Homo sapiens
uggaauuacaggc

SEQ ID NO: 2219445 - RNA, 22 nt, Homo sapiens
cuccacgggcucuccugggcca

SEQ ID NO: 2219446 - RNA, 23 nt, Homo sapiens
cuuuugguguguuggacagagaa

SEQ ID NO: 2219447 - RNA, 17 nt, Homo sapiens
gcaccgaaaaacuaaaa

SEQ ID NO: 2219448 - RNA, 18 nt, Homo sapiens
gcuucuuugccucccuca

SEQ ID NO: 2219449 - RNA, 21 nt, Homo sapiens
uguucauaaaacggugcuuuc

SEQ ID NO: 2219450 - RNA, 18 nt, Homo sapiens
aauggguccccaaaaugg

SEQ ID NO: 2219451 - RNA, 23 nt, Homo sapiens
uugugaacccuagcugugucaga

SEQ ID NO: 2219452 - RNA, 17 nt, Homo sapiens
cuguccucuuucagcuc

SEQ ID NO: 2219453 - RNA, 23 nt, Homo sapiens
gccugcuuggcccggccggccug

SEQ ID NO: 2219454 - RNA, 17 nt, Homo sapiens
aaacaggcugcuuagau

SEQ ID NO: 2219455 - RNA, 21 nt, Homo sapiens
gucucucuugucaagucagaa

SEQ ID NO: 2219456 - RNA, 12 nt, Homo sapiens
uggugcagacag

SEQ ID NO: 2219457 - RNA, 15 nt, Homo sapiens
uagcgcccaagcuca

SEQ ID NO: 2219458 - RNA, 16 nt, Homo sapiens
aucuccauugcauuca

SEQ ID NO: 2219459 - RNA, 19 nt, Homo sapiens
uagaagacuacaauucagu

SEQ ID NO: 2219460 - RNA, 21 nt, Homo sapiens
uggcauaggccuuagcaguaa

SEQ ID NO: 2219461 - RNA, 23 nt, Homo sapiens
cccagaagcugauuuucaugaaa

SEQ ID NO: 2219462 - RNA, 19 nt, Homo sapiens
aagcacaaaggaaugaacu

SEQ ID NO: 2219463 - RNA, 18 nt, Homo sapiens
accccagcugaccuggua

SEQ ID NO: 2219464 - RNA, 16 nt, Homo sapiens
aagcuggcuuuuccca

SEQ ID NO: 2219465 - RNA, 19 nt, Homo sapiens
uuaaagcugaaaacugcaa

SEQ ID NO: 2219466 - RNA, 18 nt, Homo sapiens
auggucaugggucugccc

SEQ ID NO: 2219467 - RNA, 20 nt, Homo sapiens
guggucugggcaccaccucu

SEQ ID NO: 2219468 - RNA, 16 nt, Homo sapiens
aguggaaaaugcaaug

SEQ ID NO: 2219469 - RNA, 13 nt, Homo sapiens
cugugaugccuga

SEQ ID NO: 2219470 - RNA, 16 nt, Homo sapiens
acugguccugcugcug

SEQ ID NO: 2219471 - RNA, 19 nt, Homo sapiens
aguuuccucaucugucaca

SEQ ID NO: 2219472 - RNA, 20 nt, Homo sapiens
aauguaagggaaacugccag

SEQ ID NO: 2219473 - RNA, 18 nt, Homo sapiens
cacagcaucauuuugcau

SEQ ID NO: 2219474 - RNA, 16 nt, Homo sapiens
gucucuaugugaauau

SEQ ID NO: 2219475 - RNA, 16 nt, Homo sapiens
uuguaacauucacaca

SEQ ID NO: 2219476 - RNA, 21 nt, Homo sapiens
aucugaagccaccucucugcc

SEQ ID NO: 2219477 - RNA, 21 nt, Homo sapiens
ggucgucgaaaggugcagcug

SEQ ID NO: 2219478 - RNA, 18 nt, Homo sapiens
gcaaagggucuguggcca

SEQ ID NO: 2219479 - RNA, 14 nt, Homo sapiens
cuaccuuccaguca

SEQ ID NO: 2219480 - RNA, 19 nt, Homo sapiens
cauauuuauuuagaugcua

SEQ ID NO: 2219481 - RNA, 20 nt, Homo sapiens
auggcagaaggcaaagcaaa

SEQ ID NO: 2219482 - RNA, 20 nt, Homo sapiens
gcugucaccacgugcaguau

SEQ ID NO: 2219483 - RNA, 23 nt, Homo sapiens
aagaaaaccuuucuucaccaaau

SEQ ID NO: 2219484 - RNA, 17 nt, Homo sapiens
gcuauuuguucagagag

SEQ ID NO: 2219485 - RNA, 20 nt, Homo sapiens
aggugggucuaccucaucuc

SEQ ID NO: 2219486 - RNA, 19 nt, Homo sapiens
caaggaguacaaugcccag

SEQ ID NO: 2219487 - RNA, 16 nt, Homo sapiens
cagcccaagggugggu

SEQ ID NO: 2219488 - RNA, 23 nt, Homo sapiens
uucugaggcccugcccaaugaga

SEQ ID NO: 2219489 - RNA, 19 nt, Homo sapiens
gaugucccccaggggccca

SEQ ID NO: 2219490 - RNA, 14 nt, Homo sapiens
agaguuacacugga

SEQ ID NO: 2219491 - RNA, 19 nt, Homo sapiens
ugucaaaugaugugcaaaa

SEQ ID NO: 2219492 - RNA, 21 nt, Homo sapiens
uguguuucuggggacaccagc

SEQ ID NO: 2219493 - RNA, 19 nt, Homo sapiens
ugggggaggcggcacauug

SEQ ID NO: 2219494 - RNA, 16 nt, Homo sapiens
aaggccccugcaaugu

SEQ ID NO: 2219495 - RNA, 21 nt, Homo sapiens
guaaagaaauauauaugauau

SEQ ID NO: 2219496 - RNA, 19 nt, Homo sapiens
acuccagagucaguaguua

SEQ ID NO: 2219497 - RNA, 17 nt, Homo sapiens
gagagaggcugccucag

SEQ ID NO: 2219498 - RNA, 17 nt, Homo sapiens
aaugaguuuuacauuac

SEQ ID NO: 2219499 - RNA, 20 nt, Homo sapiens
cauuucaucagcaaguuugg

SEQ ID NO: 2219500 - RNA, 16 nt, Homo sapiens
guagcugggauuacag

SEQ ID NO: 2219501 - RNA, 18 nt, Homo sapiens
uacauuauuggacuucca

SEQ ID NO: 2219502 - RNA, 19 nt, Homo sapiens
ugcuucauuguacuaccug

SEQ ID NO: 2219503 - RNA, 22 nt, Homo sapiens
cccagucuuuggagagcucagu

SEQ ID NO: 2219504 - RNA, 21 nt, Homo sapiens
augagugggcuaggaggacaa

SEQ ID NO: 2219505 - RNA, 20 nt, Homo sapiens
ccuucuggggcuuugccauu

SEQ ID NO: 2219506 - RNA, 22 nt, Homo sapiens
aucauuauuacauagacuguga

SEQ ID NO: 2219507 - RNA, 16 nt, Homo sapiens
auggaauugauuugca

SEQ ID NO: 2219508 - RNA, 18 nt, Homo sapiens
uuacuuugugcaauauga

SEQ ID NO: 2219509 - RNA, 15 nt, Homo sapiens
gaaugcuuaaaugau

SEQ ID NO: 2219510 - RNA, 13 nt, Homo sapiens
aucaguugccaaa

SEQ ID NO: 2219511 - RNA, 15 nt, Homo sapiens
ugaguguccuugcag

SEQ ID NO: 2219512 - RNA, 17 nt, Homo sapiens
ugucacaucucagggaa

SEQ ID NO: 2219513 - RNA, 16 nt, Homo sapiens
uggauugacucugcau

SEQ ID NO: 2219514 - RNA, 22 nt, Homo sapiens
ucagggcauugccugugacuga

SEQ ID NO: 2219515 - RNA, 22 nt, Homo sapiens
ugagucuauccuagucuucaca

SEQ ID NO: 2219516 - RNA, 18 nt, Homo sapiens
caaauacaaucagcccag

SEQ ID NO: 2219517 - RNA, 17 nt, Homo sapiens
uaauaaaugaaugucac

SEQ ID NO: 2219518 - RNA, 23 nt, Homo sapiens
aggcagaauccuacaacuuccac

SEQ ID NO: 2219519 - RNA, 13 nt, Homo sapiens
ucgcuccuccuuc

SEQ ID NO: 2219520 - RNA, 18 nt, Homo sapiens
aauuacuugagcccagga

SEQ ID NO: 2219521 - RNA, 17 nt, Homo sapiens
accuguucaaaauucca

SEQ ID NO: 2219522 - RNA, 12 nt, Homo sapiens
uuuuacacugau

SEQ ID NO: 2219523 - RNA, 16 nt, Homo sapiens
cagcuaagccugauga

SEQ ID NO: 2219524 - RNA, 11 nt, Homo sapiens
aauuucuagag

SEQ ID NO: 2219525 - RNA, 14 nt, Homo sapiens
uucucaaccagaga

SEQ ID NO: 2219526 - RNA, 21 nt, Homo sapiens
uagacaaauacucauguguau

SEQ ID NO: 2219527 - RNA, 14 nt, Homo sapiens
gcagaagcagggua

SEQ ID NO: 2219528 - RNA, 22 nt, Homo sapiens
uaauccugcaaaguacagguac

SEQ ID NO: 2219529 - RNA, 19 nt, Homo sapiens
uuuuacauaacugccuuga

SEQ ID NO: 2219530 - RNA, 17 nt, Homo sapiens
aggucacuacugcauuu

SEQ ID NO: 2219531 - RNA, 21 nt, Homo sapiens
cuggaacaccagcagcacugg

SEQ ID NO: 2219532 - RNA, 19 nt, Homo sapiens
auagcuauuaagauacuua

SEQ ID NO: 2219533 - RNA, 22 nt, Homo sapiens
uaaauguagcaauggcacuguu

SEQ ID NO: 2219534 - RNA, 15 nt, Homo sapiens
gagugaaugccauuu

SEQ ID NO: 2219535 - RNA, 21 nt, Homo sapiens
cagcaagacuucucuuugccu

SEQ ID NO: 2219536 - RNA, 20 nt, Homo sapiens
augguccugcagaaagcuuu

SEQ ID NO: 2219537 - RNA, 21 nt, Homo sapiens
aauguuuauuaaaugcuucau

SEQ ID NO: 2219538 - RNA, 12 nt, Homo sapiens
uccuaacuacag

SEQ ID NO: 2219539 - RNA, 13 nt, Homo sapiens
uuauaauuaaaga

SEQ ID NO: 2219540 - RNA, 15 nt, Homo sapiens
ucgaacaauucauau

SEQ ID NO: 2219541 - RNA, 15 nt, Homo sapiens
aaaugugucuugcug

SEQ ID NO: 2219542 - RNA, 19 nt, Homo sapiens
ucugccagcuccacagggu

SEQ ID NO: 2219543 - RNA, 17 nt, Homo sapiens
gaagauaaagcuuuauu

SEQ ID NO: 2219544 - RNA, 19 nt, Homo sapiens
ugaaacucauagacacuga

SEQ ID NO: 2219545 - RNA, 22 nt, Homo sapiens
uccuaccagaaggaaagcacua

SEQ ID NO: 2219546 - RNA, 23 nt, Homo sapiens
cagucuuccucccuguguauuca

SEQ ID NO: 2219547 - RNA, 18 nt, Homo sapiens
ugguuuuuuuuuuuaccc

SEQ ID NO: 2219548 - RNA, 20 nt, Homo sapiens
gagaaacaaauaaacuaguc

SEQ ID NO: 2219549 - RNA, 14 nt, Homo sapiens
guuauuuacuugaa

SEQ ID NO: 2219550 - RNA, 15 nt, Homo sapiens
uacuguuauccauau

SEQ ID NO: 2219551 - RNA, 16 nt, Homo sapiens
ucccugucuccagggc

SEQ ID NO: 2219552 - RNA, 20 nt, Homo sapiens
cauuguucuggaaaucucca

SEQ ID NO: 2219553 - RNA, 15 nt, Homo sapiens
gaacagugcucugcc

SEQ ID NO: 2219554 - RNA, 22 nt, Homo sapiens
gaugcacgguuucuguucugcc

SEQ ID NO: 2219555 - RNA, 13 nt, Homo sapiens
ggauguacaaaga

SEQ ID NO: 2219556 - RNA, 22 nt, Homo sapiens
uguuaauuuuuuuuacuauaaa

SEQ ID NO: 2219557 - RNA, 15 nt, Homo sapiens
auccuuaaaggugag

SEQ ID NO: 2219558 - RNA, 18 nt, Homo sapiens
acccuggagagugcacau

SEQ ID NO: 2219559 - RNA, 20 nt, Homo sapiens
aucaagacugcaaacccuuu

SEQ ID NO: 2219560 - RNA, 16 nt, Homo sapiens
aaagaaagaaacugau

SEQ ID NO: 2219561 - RNA, 22 nt, Homo sapiens
gccaccgugcccggccaaguaa

SEQ ID NO: 2219562 - RNA, 16 nt, Homo sapiens
auauucaaaauuccaa

SEQ ID NO: 2219563 - RNA, 15 nt, Homo sapiens
aguaacugagauuac

SEQ ID NO: 2219564 - RNA, 19 nt, Homo sapiens
gccagacugguuagacagu

SEQ ID NO: 2219565 - RNA, 18 nt, Homo sapiens
agaccggcugguggagcu

SEQ ID NO: 2219566 - RNA, 13 nt, Homo sapiens
gaaagaacauuua

SEQ ID NO: 2219567 - RNA, 20 nt, Homo sapiens
gagaugagugauccugccuc

SEQ ID NO: 2219568 - RNA, 17 nt, Homo sapiens
gugcgagugugugcaug

SEQ ID NO: 2219569 - RNA, 19 nt, Homo sapiens
accucauccaugcacuuua

SEQ ID NO: 2219570 - RNA, 17 nt, Homo sapiens
uugaauuccugggcuca

SEQ ID NO: 2219571 - RNA, 23 nt, Homo sapiens
uauccacugauauccaugaugcu

SEQ ID NO: 2219572 - RNA, 17 nt, Homo sapiens
gggacaucacagggugg

SEQ ID NO: 2219573 - RNA, 18 nt, Homo sapiens
ggaggaagcuacccaagg

SEQ ID NO: 2219574 - RNA, 18 nt, Homo sapiens
cagcuuugauaaugucca

SEQ ID NO: 2219575 - RNA, 20 nt, Homo sapiens
ugaggaccucauccaaacaa

SEQ ID NO: 2219576 - RNA, 18 nt, Homo sapiens
gugcauagagccacguau

SEQ ID NO: 2219577 - RNA, 18 nt, Homo sapiens
cucccugcuuugcuguga

SEQ ID NO: 2219578 - RNA, 12 nt, Homo sapiens
gauuuugcaauc

SEQ ID NO: 2219579 - RNA, 14 nt, Homo sapiens
caaccgccucaaaa

SEQ ID NO: 2219580 - RNA, 21 nt, Homo sapiens
uuuagacuuauguggaacugu

SEQ ID NO: 2219581 - RNA, 13 nt, Homo sapiens
ucaagugccaaac

SEQ ID NO: 2219582 - RNA, 22 nt, Homo sapiens
ccaguuuguauuuagcugccaa

SEQ ID NO: 2219583 - RNA, 13 nt, Homo sapiens
cuucuaaaagcca

SEQ ID NO: 2219584 - RNA, 15 nt, Homo sapiens
ccaaccauuuccuca

SEQ ID NO: 2219585 - RNA, 14 nt, Homo sapiens
aaaggugucuuccu

SEQ ID NO: 2219586 - RNA, 19 nt, Homo sapiens
cucgcagcacccacagcac

SEQ ID NO: 2219587 - RNA, 18 nt, Homo sapiens
uuugcauuugcagugcau

SEQ ID NO: 2219588 - RNA, 17 nt, Homo sapiens
aaccaugaacucagcua

SEQ ID NO: 2219589 - RNA, 20 nt, Homo sapiens
ugcccagcaaucaaaggcaa

SEQ ID NO: 2219590 - RNA, 22 nt, Homo sapiens
ugcuuuucugaaaguaugagug

SEQ ID NO: 2219591 - RNA, 18 nt, Homo sapiens
ggaagcggcccuaaggga

SEQ ID NO: 2219592 - RNA, 13 nt, Homo sapiens
uauucgugaauag

SEQ ID NO: 2219593 - RNA, 15 nt, Homo sapiens
cucagggguuucauu

SEQ ID NO: 2219594 - RNA, 22 nt, Homo sapiens
ccuuggcucccauucacucuuc

SEQ ID NO: 2219595 - RNA, 19 nt, Homo sapiens
augggagugggcaccucag

SEQ ID NO: 2219596 - RNA, 14 nt, Homo sapiens
ugggagcacaggca

SEQ ID NO: 2219597 - RNA, 22 nt, Homo sapiens
accccugaaacuggaccugcau

SEQ ID NO: 2219598 - RNA, 19 nt, Homo sapiens
caggagcguguacuacccc

SEQ ID NO: 2219599 - RNA, 18 nt, Homo sapiens
ucuuggggcccagugcau

SEQ ID NO: 2219600 - RNA, 23 nt, Homo sapiens
cugaccaguugcagucacucuag

SEQ ID NO: 2219601 - RNA, 12 nt, Homo sapiens
aaaaguuaacau

SEQ ID NO: 2219602 - RNA, 22 nt, Homo sapiens
gcaguggcgcgaucucagcuca

SEQ ID NO: 2219603 - RNA, 22 nt, Homo sapiens
gcaguggcacgaucucggcuca

SEQ ID NO: 2219604 - RNA, 14 nt, Homo sapiens
aggguaggggcaag

SEQ ID NO: 2219605 - RNA, 21 nt, Homo sapiens
cuccccacaccucccuacucc

SEQ ID NO: 2219606 - RNA, 14 nt, Homo sapiens
acccagaacuggac

SEQ ID NO: 2219607 - RNA, 16 nt, Homo sapiens
caagaaacgucuucua

SEQ ID NO: 2219608 - RNA, 13 nt, Homo sapiens
ucugccagcaucu

SEQ ID NO: 2219609 - RNA, 19 nt, Homo sapiens
ccuuucaguauguccccau

SEQ ID NO: 2219610 - RNA, 21 nt, Homo sapiens
cauguugguuuauuuucacag

SEQ ID NO: 2219611 - RNA, 18 nt, Homo sapiens
cucaccgugcugucuucu

SEQ ID NO: 2219612 - RNA, 12 nt, Homo sapiens
gauuacagaucu

SEQ ID NO: 2219613 - RNA, 15 nt, Homo sapiens
uuaaugaagugcaau

SEQ ID NO: 2219614 - RNA, 12 nt, Homo sapiens
agggccagugau

SEQ ID NO: 2219615 - RNA, 17 nt, Homo sapiens
uucaagugcuucuccag

SEQ ID NO: 2219616 - RNA, 18 nt, Homo sapiens
ugcugggaaccuagcaca

SEQ ID NO: 2219617 - RNA, 19 nt, Homo sapiens
uguacauauuagaaaggga

SEQ ID NO: 2219618 - RNA, 24 nt, Homo sapiens
uuauauauguaucuaaaccauaug

SEQ ID NO: 2219619 - RNA, 15 nt, Homo sapiens
uuaaacaagugcacu

SEQ ID NO: 2219620 - RNA, 21 nt, Homo sapiens
aaaaagggauccguacauuca

SEQ ID NO: 2219621 - RNA, 14 nt, Homo sapiens
agcagcaucauuca

SEQ ID NO: 2219622 - RNA, 17 nt, Homo sapiens
auacggauccugcacug

SEQ ID NO: 2219623 - RNA, 16 nt, Homo sapiens
ugucugagagccauaa

SEQ ID NO: 2219624 - RNA, 12 nt, Homo sapiens
ucacucugaauc

SEQ ID NO: 2219625 - RNA, 14 nt, Homo sapiens
augaucacggcuca

SEQ ID NO: 2219626 - RNA, 12 nt, Homo sapiens
uauuaagacuua

SEQ ID NO: 2219627 - RNA, 23 nt, Homo sapiens
gcucuccccaaacuugcuuuaug

SEQ ID NO: 2219628 - RNA, 19 nt, Homo sapiens
uaaaaaaaaaaggaugaaa

SEQ ID NO: 2219629 - RNA, 18 nt, Homo sapiens
auaaugacaggcauccaa

SEQ ID NO: 2219630 - RNA, 14 nt, Homo sapiens
ccugcaccugacag

SEQ ID NO: 2219631 - RNA, 15 nt, Homo sapiens
ucuuuacuuaucucu

SEQ ID NO: 2219632 - RNA, 13 nt, Homo sapiens
aaccauagcauua

SEQ ID NO: 2219633 - RNA, 21 nt, Homo sapiens
gaaaaugccaccauccaauaa

SEQ ID NO: 2219634 - RNA, 17 nt, Homo sapiens
aggaaacccccagugua

SEQ ID NO: 2219635 - RNA, 22 nt, Homo sapiens
gcucuuucucugccagugacag

SEQ ID NO: 2219636 - RNA, 21 nt, Homo sapiens
uauugacuaaucuuugcugaa

SEQ ID NO: 2219637 - RNA, 17 nt, Homo sapiens
ucucauguaucaucugg

SEQ ID NO: 2219638 - RNA, 19 nt, Homo sapiens
guuaucugucccagguuau

SEQ ID NO: 2219639 - RNA, 14 nt, Homo sapiens
aaccaauugcugcu

SEQ ID NO: 2219640 - RNA, 20 nt, Homo sapiens
ucuaucaccaaggagccaaa

SEQ ID NO: 2219641 - RNA, 18 nt, Homo sapiens
gaggucugauuggcugcu

SEQ ID NO: 2219642 - RNA, 22 nt, Homo sapiens
gcugucuugucuuuuuccaaaa

SEQ ID NO: 2219643 - RNA, 22 nt, Homo sapiens
ggcauugaagcuugcaccuuuu

SEQ ID NO: 2219644 - RNA, 22 nt, Homo sapiens
aagucacccagggacacuccaa

SEQ ID NO: 2219645 - RNA, 20 nt, Homo sapiens
gggugccuucacugggccag

SEQ ID NO: 2219646 - RNA, 16 nt, Homo sapiens
cuauaguucacugaca

SEQ ID NO: 2219647 - RNA, 16 nt, Homo sapiens
aaucaccacucaaaaa

SEQ ID NO: 2219648 - RNA, 22 nt, Homo sapiens
cccacagugccuguacaggaag

SEQ ID NO: 2219649 - RNA, 21 nt, Homo sapiens
auccauguguccccccugugg

SEQ ID NO: 2219650 - RNA, 17 nt, Homo sapiens
ugcaaguggaugcauuc

SEQ ID NO: 2219651 - RNA, 13 nt, Homo sapiens
cuugucauucuca

SEQ ID NO: 2219652 - RNA, 18 nt, Homo sapiens
caaguaguuaagagcuaa

SEQ ID NO: 2219653 - RNA, 21 nt, Homo sapiens
ugcacuuuuuccuuacugugc

SEQ ID NO: 2219654 - RNA, 19 nt, Homo sapiens
uggcuuauaaacacauuga

SEQ ID NO: 2219655 - RNA, 19 nt, Homo sapiens
gugccagacauugcucuca

SEQ ID NO: 2219656 - RNA, 12 nt, Homo sapiens
ggaaaucugccu

SEQ ID NO: 2219657 - RNA, 17 nt, Homo sapiens
cccccuuguuguaaaaa

SEQ ID NO: 2219658 - RNA, 13 nt, Homo sapiens
aauuaguuugcac

SEQ ID NO: 2219659 - RNA, 12 nt, Homo sapiens
uucucaugcauu

SEQ ID NO: 2219660 - RNA, 21 nt, Homo sapiens
uccaccuaccacucacaugac

SEQ ID NO: 2219661 - RNA, 22 nt, Homo sapiens
aguuuucuguguggucuccagc

SEQ ID NO: 2219662 - RNA, 13 nt, Homo sapiens
auaucauaaauac

SEQ ID NO: 2219663 - RNA, 13 nt, Homo sapiens
cuuuaauacaaaa

SEQ ID NO: 2219664 - RNA, 18 nt, Homo sapiens
cugucauguuaauguggg

SEQ ID NO: 2219665 - RNA, 15 nt, Homo sapiens
uaagucucaacugcu

SEQ ID NO: 2219666 - RNA, 18 nt, Homo sapiens
gauugcuuaaaauagcaa

SEQ ID NO: 2219667 - RNA, 14 nt, Homo sapiens
ucauguaagggaag

SEQ ID NO: 2219668 - RNA, 22 nt, Homo sapiens
gcugggucuucaaggaucuccu

SEQ ID NO: 2219669 - RNA, 14 nt, Homo sapiens
aaugaacucuuuca

SEQ ID NO: 2219670 - RNA, 13 nt, Homo sapiens
aaacuucuacuga

SEQ ID NO: 2219671 - RNA, 12 nt, Homo sapiens
cgcccucggggc

SEQ ID NO: 2219672 - RNA, 16 nt, Homo sapiens
caccugcagugccagc

SEQ ID NO: 2219673 - RNA, 14 nt, Homo sapiens
ugggcuggggagcc

SEQ ID NO: 2219674 - RNA, 22 nt, Homo sapiens
caugaaugugcuggugaacacu

SEQ ID NO: 2219675 - RNA, 17 nt, Homo sapiens
gacucuuaacauuagag

SEQ ID NO: 2219676 - RNA, 23 nt, Homo sapiens
uggccuuccacgucuuccuccaa

SEQ ID NO: 2219677 - RNA, 15 nt, Homo sapiens
cacgagcuuaaucaa

SEQ ID NO: 2219678 - RNA, 20 nt, Homo sapiens
ccagccugggugacagagug

SEQ ID NO: 2219679 - RNA, 20 nt, Homo sapiens
ccagccugggcaacagagca

SEQ ID NO: 2219680 - RNA, 19 nt, Homo sapiens
ugcacacuuguauauugaa

SEQ ID NO: 2219681 - RNA, 15 nt, Homo sapiens
uugacuggcuuuccu

SEQ ID NO: 2219682 - RNA, 14 nt, Homo sapiens
accagguuaccuca

SEQ ID NO: 2219683 - RNA, 20 nt, Homo sapiens
ggagcacgaggucuggccaa

SEQ ID NO: 2219684 - RNA, 15 nt, Homo sapiens
ccucaggagaaagua

SEQ ID NO: 2219685 - RNA, 19 nt, Homo sapiens
aauaaaauuucuaagagag

SEQ ID NO: 2219686 - RNA, 15 nt, Homo sapiens
gaccauuuucugcca

SEQ ID NO: 2219687 - RNA, 20 nt, Homo sapiens
ccaugacuugggcuuucuga

SEQ ID NO: 2219688 - RNA, 14 nt, Homo sapiens
uugaauacugcauu

SEQ ID NO: 2219689 - RNA, 14 nt, Homo sapiens
augaauacagcauu

SEQ ID NO: 2219690 - RNA, 14 nt, Homo sapiens
aaugugaacacugg

SEQ ID NO: 2219691 - RNA, 18 nt, Homo sapiens
cauccccauccuccagcu

SEQ ID NO: 2219692 - RNA, 14 nt, Homo sapiens
gugaggcaucucuc

SEQ ID NO: 2219693 - RNA, 17 nt, Homo sapiens
acuggauggucaucucg

SEQ ID NO: 2219694 - RNA, 19 nt, Homo sapiens
ucugacgcuugugacagug

SEQ ID NO: 2219695 - RNA, 20 nt, Homo sapiens
ccgaggagcaggagugcuca

SEQ ID NO: 2219696 - RNA, 18 nt, Homo sapiens
uccccacagguccuccau

SEQ ID NO: 2219697 - RNA, 23 nt, Homo sapiens
cauucugcacucagaaaauggca

SEQ ID NO: 2219698 - RNA, 19 nt, Homo sapiens
cucguauaccgugccacuu

SEQ ID NO: 2219699 - RNA, 13 nt, Homo sapiens
uaucaacaugcac

SEQ ID NO: 2219700 - RNA, 19 nt, Homo sapiens
agugcacagggaagggcuu

SEQ ID NO: 2219701 - RNA, 18 nt, Homo sapiens
gacauacauauuaucuca

SEQ ID NO: 2219702 - RNA, 18 nt, Homo sapiens
acaauucuucugucaagc

SEQ ID NO: 2219703 - RNA, 22 nt, Homo sapiens
gaccacugggccccucagggga

SEQ ID NO: 2219704 - RNA, 20 nt, Homo sapiens
cagagcgagauuccgucuca

SEQ ID NO: 2219705 - RNA, 19 nt, Homo sapiens
auguauacauauguagcua

SEQ ID NO: 2219706 - RNA, 14 nt, Homo sapiens
cggaaacaggugug

SEQ ID NO: 2219707 - RNA, 13 nt, Homo sapiens
caaaauaaguguu

SEQ ID NO: 2219708 - RNA, 19 nt, Homo sapiens
cuaaaauacaaacaagcac

SEQ ID NO: 2219709 - RNA, 16 nt, Homo sapiens
uguggaaaugcuuaaa

SEQ ID NO: 2219710 - RNA, 16 nt, Homo sapiens
uccugccuucuguccu

SEQ ID NO: 2219711 - RNA, 20 nt, Homo sapiens
gcaaguugaggacuucuugc

SEQ ID NO: 2219712 - RNA, 16 nt, Homo sapiens
augauaugaccaaaau

SEQ ID NO: 2219713 - RNA, 15 nt, Homo sapiens
caagaccucccugga

SEQ ID NO: 2219714 - RNA, 15 nt, Homo sapiens
aaaaaacaaucugga

SEQ ID NO: 2219715 - RNA, 17 nt, Homo sapiens
cuccagccucagcucuc

SEQ ID NO: 2219716 - RNA, 19 nt, Homo sapiens
ggaucacuugaguucagga

SEQ ID NO: 2219717 - RNA, 13 nt, Homo sapiens
cuagccagaguuu

SEQ ID NO: 2219718 - RNA, 21 nt, Homo sapiens
aauaguucaguagaauuacca

SEQ ID NO: 2219719 - RNA, 17 nt, Homo sapiens
uguaguguaccauucuc

SEQ ID NO: 2219720 - RNA, 16 nt, Homo sapiens
caucuaccuauacuua

SEQ ID NO: 2219721 - RNA, 15 nt, Homo sapiens
uuuuucuauuguacu

SEQ ID NO: 2219722 - RNA, 13 nt, Homo sapiens
gcugcuagcacuu

SEQ ID NO: 2219723 - RNA, 17 nt, Homo sapiens
uguucaugcacacuugc

SEQ ID NO: 2219724 - RNA, 22 nt, Homo sapiens
gguccacuuugguaauguguca

SEQ ID NO: 2219725 - RNA, 20 nt, Homo sapiens
ugguuuuaaaaaagcauuau

SEQ ID NO: 2219726 - RNA, 18 nt, Homo sapiens
uacauaguuauguaaaaa

SEQ ID NO: 2219727 - RNA, 14 nt, Homo sapiens
aaucauagccaaga

SEQ ID NO: 2219728 - RNA, 15 nt, Homo sapiens
agcaauucauuucac

SEQ ID NO: 2219729 - RNA, 13 nt, Homo sapiens
ucuguccuuacau

SEQ ID NO: 2219730 - RNA, 19 nt, Homo sapiens
guauuuacacauacaacuu

SEQ ID NO: 2219731 - RNA, 20 nt, Homo sapiens
guucaagaaguaaucaguau

SEQ ID NO: 2219732 - RNA, 14 nt, Homo sapiens
uagauauacauauc

SEQ ID NO: 2219733 - RNA, 14 nt, Homo sapiens
cuuugcuauuguga

SEQ ID NO: 2219734 - RNA, 16 nt, Homo sapiens
ugccuuccaacugcca

SEQ ID NO: 2219735 - RNA, 16 nt, Homo sapiens
gaaagggauaguccaa

SEQ ID NO: 2219736 - RNA, 23 nt, Homo sapiens
gccucccacacugaaaccaaaac

SEQ ID NO: 2219737 - RNA, 14 nt, Homo sapiens
uuuaguuauaaaca

SEQ ID NO: 2219738 - RNA, 21 nt, Homo sapiens
ccccuccuuggcuuuaugcaa

SEQ ID NO: 2219739 - RNA, 15 nt, Homo sapiens
agggagaggucucag

SEQ ID NO: 2219740 - RNA, 15 nt, Homo sapiens
caagauuugacugua

SEQ ID NO: 2219741 - RNA, 15 nt, Homo sapiens
gacauuguuuugcca

SEQ ID NO: 2219742 - RNA, 20 nt, Homo sapiens
uucccuguggguggggagcu

SEQ ID NO: 2219743 - RNA, 20 nt, Homo sapiens
aagugauccucccaccucaa

SEQ ID NO: 2219744 - RNA, 20 nt, Homo sapiens
cuucagccccuagugcuauu

SEQ ID NO: 2219745 - RNA, 22 nt, Homo sapiens
uaccacccagaaauccauuuga

SEQ ID NO: 2219746 - RNA, 22 nt, Homo sapiens
cuguuuguguccucaggagcaa

SEQ ID NO: 2219747 - RNA, 23 nt, Homo sapiens
auuuucaaaaccagguccaauga

SEQ ID NO: 2219748 - RNA, 20 nt, Homo sapiens
cugugcgccgggggaccugg

SEQ ID NO: 2219749 - RNA, 12 nt, Homo sapiens
uauucagugaua

SEQ ID NO: 2219750 - RNA, 16 nt, Homo sapiens
cuuugagugacugggu

SEQ ID NO: 2219751 - RNA, 15 nt, Homo sapiens
aauguagcauucugu

SEQ ID NO: 2219752 - RNA, 13 nt, Homo sapiens
ggaauguucuuuc

SEQ ID NO: 2219753 - RNA, 21 nt, Homo sapiens
cgcaacccacguguaacuguc

SEQ ID NO: 2219754 - RNA, 14 nt, Homo sapiens
uaagacaaacacug

SEQ ID NO: 2219755 - RNA, 14 nt, Homo sapiens
acgugacuccucaa

SEQ ID NO: 2219756 - RNA, 16 nt, Homo sapiens
guguuguaacaaauau

SEQ ID NO: 2219757 - RNA, 13 nt, Homo sapiens
uagugaugccauc

SEQ ID NO: 2219758 - RNA, 23 nt, Homo sapiens
gccaugccaggccagagggcagu

SEQ ID NO: 2219759 - RNA, 20 nt, Homo sapiens
agucuucucauagcauuaac

SEQ ID NO: 2219760 - RNA, 17 nt, Homo sapiens
ucccccuaaggcagcug

SEQ ID NO: 2219761 - RNA, 13 nt, Homo sapiens
guaauagugccaa

SEQ ID NO: 2219762 - RNA, 16 nt, Homo sapiens
aucuguauaucagcuc

SEQ ID NO: 2219763 - RNA, 23 nt, Homo sapiens
agagaagucuggucagagccaca

SEQ ID NO: 2219764 - RNA, 20 nt, Homo sapiens
gugcauccgggggcagcucu

SEQ ID NO: 2219765 - RNA, 21 nt, Homo sapiens
cuugugcuccagucauugcac

SEQ ID NO: 2219766 - RNA, 14 nt, Homo sapiens
uagaagagccugac

SEQ ID NO: 2219767 - RNA, 17 nt, Homo sapiens
guuguuuucccaaagag

SEQ ID NO: 2219768 - RNA, 22 nt, Homo sapiens
aaagagcagcacaggaagcugc

SEQ ID NO: 2219769 - RNA, 23 nt, Homo sapiens
gauggaauaucaaugcccaacag

SEQ ID NO: 2219770 - RNA, 14 nt, Homo sapiens
aaauuacagacaaa

SEQ ID NO: 2219771 - RNA, 19 nt, Homo sapiens
aacucuguuuucuuucuaa

SEQ ID NO: 2219772 - RNA, 20 nt, Homo sapiens
caaaugugcuggucacccuu

SEQ ID NO: 2219773 - RNA, 16 nt, Homo sapiens
ccucucaauugucauu

SEQ ID NO: 2219774 - RNA, 18 nt, Homo sapiens
cauuuaagacacauugac

SEQ ID NO: 2219775 - RNA, 22 nt, Homo sapiens
gucucuuccugccucccaagca

SEQ ID NO: 2219776 - RNA, 21 nt, Homo sapiens
acagcugacucucgugcauuu

SEQ ID NO: 2219777 - RNA, 22 nt, Homo sapiens
aaaauggcaucaaccaccaugg

SEQ ID NO: 2219778 - RNA, 15 nt, Homo sapiens
ugcacgucuugcuau

SEQ ID NO: 2219779 - RNA, 15 nt, Homo sapiens
ccagggacccaaagc

SEQ ID NO: 2219780 - RNA, 17 nt, Homo sapiens
ucaucagauaugcuuac

SEQ ID NO: 2219781 - RNA, 22 nt, Homo sapiens
acaucaagccuagcaucucggg

SEQ ID NO: 2219782 - RNA, 23 nt, Homo sapiens
acccuccuccccacacagacucc

SEQ ID NO: 2219783 - RNA, 22 nt, Homo sapiens
auguuuuaauguagaaccucaa

SEQ ID NO: 2219784 - RNA, 18 nt, Homo sapiens
cccagagcugugccagca

SEQ ID NO: 2219785 - RNA, 17 nt, Homo sapiens
uguuuaaaaauacacau

SEQ ID NO: 2219786 - RNA, 21 nt, Homo sapiens
aauggauuguuaauuucaguc

SEQ ID NO: 2219787 - RNA, 20 nt, Homo sapiens
cagagcagagguggaaaaac

SEQ ID NO: 2219788 - RNA, 21 nt, Homo sapiens
caacucaagguucuaguggga

SEQ ID NO: 2219789 - RNA, 22 nt, Homo sapiens
cuggugacaggcagacacaugc

SEQ ID NO: 2219790 - RNA, 18 nt, Homo sapiens
gauuggguaucaaaauga

SEQ ID NO: 2219791 - RNA, 13 nt, Homo sapiens
guaaaugcuguaa

SEQ ID NO: 2219792 - RNA, 20 nt, Homo sapiens
uguucauuauuuugauugau

SEQ ID NO: 2219793 - RNA, 22 nt, Homo sapiens
aggggugacucagaagaaaaag

SEQ ID NO: 2219794 - RNA, 20 nt, Homo sapiens
ugggaggaacuccuugcaca

SEQ ID NO: 2219795 - RNA, 18 nt, Homo sapiens
aucaaccccagacacugg

SEQ ID NO: 2219796 - RNA, 16 nt, Homo sapiens
cuaggaguauccucau

SEQ ID NO: 2219797 - RNA, 14 nt, Homo sapiens
ccaucuagucacaa

SEQ ID NO: 2219798 - RNA, 14 nt, Homo sapiens
agauugaugugcac

SEQ ID NO: 2219799 - RNA, 21 nt, Homo sapiens
auccuuguuuugaaaaccuaa

SEQ ID NO: 2219800 - RNA, 18 nt, Homo sapiens
cuuuuuccuccuggaaca

SEQ ID NO: 2219801 - RNA, 20 nt, Homo sapiens
uaaacuuaaaaagaaaaccu

SEQ ID NO: 2219802 - RNA, 16 nt, Homo sapiens
ugccugugccaugccc

SEQ ID NO: 2219803 - RNA, 12 nt, Homo sapiens
gaagucuuccau

SEQ ID NO: 2219804 - RNA, 12 nt, Homo sapiens
guuuuacccaga

SEQ ID NO: 2219805 - RNA, 14 nt, Homo sapiens
gcuaugaagccaac

SEQ ID NO: 2219806 - RNA, 17 nt, Homo sapiens
aacccauuucuccagac

SEQ ID NO: 2219807 - RNA, 16 nt, Homo sapiens
cccuauucugccaugg

SEQ ID NO: 2219808 - RNA, 16 nt, Homo sapiens
cucuacugaaugucau

SEQ ID NO: 2219809 - RNA, 20 nt, Homo sapiens
caaaaggcuggaugugcuuu

SEQ ID NO: 2219810 - RNA, 18 nt, Homo sapiens
guaaaauguuuuagcaau

SEQ ID NO: 2219811 - RNA, 17 nt, Homo sapiens
cuuuucacaaacauuag

SEQ ID NO: 2219812 - RNA, 17 nt, Homo sapiens
ugggguuccccuggaaa

SEQ ID NO: 2219813 - RNA, 17 nt, Homo sapiens
agacuccaccucuacca

SEQ ID NO: 2219814 - RNA, 20 nt, Homo sapiens
aauaucaugcacaacuauaa

SEQ ID NO: 2219815 - RNA, 18 nt, Homo sapiens
guaucugcuuaggugcca

SEQ ID NO: 2219816 - RNA, 14 nt, Homo sapiens
gcaguugacucaga

SEQ ID NO: 2219817 - RNA, 18 nt, Homo sapiens
caccuagcagauauguau

SEQ ID NO: 2219818 - RNA, 22 nt, Homo sapiens
aauaucugagcucuuugcacua

SEQ ID NO: 2219819 - RNA, 16 nt, Homo sapiens
ggaccaccuagucugu

SEQ ID NO: 2219820 - RNA, 20 nt, Homo sapiens
aauucaugaacacaauacau

SEQ ID NO: 2219821 - RNA, 21 nt, Homo sapiens
gagcugguuccucucucccac

SEQ ID NO: 2219822 - RNA, 23 nt, Homo sapiens
acugcugccucuugaaugcaggg

SEQ ID NO: 2219823 - RNA, 14 nt, Homo sapiens
acugcaaugccagg

SEQ ID NO: 2219824 - RNA, 16 nt, Homo sapiens
auguucuaaguuucua

SEQ ID NO: 2219825 - RNA, 19 nt, Homo sapiens
ggcccugacugucagggag

SEQ ID NO: 2219826 - RNA, 20 nt, Homo sapiens
gaagagccccacucucagag

SEQ ID NO: 2219827 - RNA, 21 nt, Homo sapiens
cccugggcuacagaaaccaca

SEQ ID NO: 2219828 - RNA, 23 nt, Homo sapiens
acugugucauucuguuagauacu

SEQ ID NO: 2219829 - RNA, 16 nt, Homo sapiens
cugaagugucacagcc

SEQ ID NO: 2219830 - RNA, 17 nt, Homo sapiens
gaauacaacauugccaa

SEQ ID NO: 2219831 - RNA, 20 nt, Homo sapiens
gaaaggguuuguaauacuuu

SEQ ID NO: 2219832 - RNA, 21 nt, Homo sapiens
gcuccauggcugccaucucac

SEQ ID NO: 2219833 - RNA, 13 nt, Homo sapiens
ucauucauggcua

SEQ ID NO: 2219834 - RNA, 14 nt, Homo sapiens
ccccacugcucucu

SEQ ID NO: 2219835 - RNA, 17 nt, Homo sapiens
uuggagcuuuuucaaaa

SEQ ID NO: 2219836 - RNA, 18 nt, Homo sapiens
gaaaauaauccauuuuca

SEQ ID NO: 2219837 - RNA, 17 nt, Homo sapiens
guuuagugcaugcaucu

SEQ ID NO: 2219838 - RNA, 17 nt, Homo sapiens
ugauaacaaguuuaaua

SEQ ID NO: 2219839 - RNA, 17 nt, Homo sapiens
cuaguucuucaucccac

SEQ ID NO: 2219840 - RNA, 16 nt, Homo sapiens
cauuguuucccaucac

SEQ ID NO: 2219841 - RNA, 18 nt, Homo sapiens
gaaauguaauacuggaau

SEQ ID NO: 2219842 - RNA, 22 nt, Homo sapiens
agugacuguuuggcuuauaaac

SEQ ID NO: 2219843 - RNA, 12 nt, Homo sapiens
ccucaccuccau

SEQ ID NO: 2219844 - RNA, 17 nt, Homo sapiens
gcacuuuuccuuuccaa

SEQ ID NO: 2219845 - RNA, 12 nt, Homo sapiens
uuauaugcuugu

SEQ ID NO: 2219846 - RNA, 12 nt, Homo sapiens
uugaaugcuuaa

SEQ ID NO: 2219847 - RNA, 12 nt, Homo sapiens
acggaugcacag

SEQ ID NO: 2219848 - RNA, 19 nt, Homo sapiens
uucucuccccuccucugaa

SEQ ID NO: 2219849 - RNA, 21 nt, Homo sapiens
cccugccucacuccuccguga

SEQ ID NO: 2219850 - RNA, 18 nt, Homo sapiens
auugaugaaaauaauuua

SEQ ID NO: 2219851 - RNA, 16 nt, Homo sapiens
cugacuguugcuguaa

SEQ ID NO: 2219852 - RNA, 16 nt, Homo sapiens
aaaguucaacuuccaa

SEQ ID NO: 2219853 - RNA, 14 nt, Homo sapiens
gaaucacaaaccaa

SEQ ID NO: 2219854 - RNA, 22 nt, Homo sapiens
cauuuuaggaauaauaaauuca

SEQ ID NO: 2219855 - RNA, 14 nt, Homo sapiens
uuaugucugcugaa

SEQ ID NO: 2219856 - RNA, 14 nt, Homo sapiens
ucucucagggccag

SEQ ID NO: 2219857 - RNA, 17 nt, Homo sapiens
cuggaugugaguuucca

SEQ ID NO: 2219858 - RNA, 21 nt, Homo sapiens
cagaaauaucuucacuuguca

SEQ ID NO: 2219859 - RNA, 15 nt, Homo sapiens
uagaagcaucacagg

SEQ ID NO: 2219860 - RNA, 22 nt, Homo sapiens
agggcuuuucuuuaguggagaa

SEQ ID NO: 2219861 - RNA, 17 nt, Homo sapiens
aaaggcagggcaagaac

SEQ ID NO: 2219862 - RNA, 14 nt, Homo sapiens
cuccucucuugauu

SEQ ID NO: 2219863 - RNA, 15 nt, Homo sapiens
acuggacagccaggg

SEQ ID NO: 2219864 - RNA, 22 nt, Homo sapiens
auucuccauuaauuaaaagugu

SEQ ID NO: 2219865 - RNA, 18 nt, Homo sapiens
gaaaaaaggacaauuuca

SEQ ID NO: 2219866 - RNA, 17 nt, Homo sapiens
uuccucuaacucacugc

SEQ ID NO: 2219867 - RNA, 17 nt, Homo sapiens
cccacccccagucucca

SEQ ID NO: 2219868 - RNA, 11 nt, Homo sapiens
cugcaaaaaga

SEQ ID NO: 2219869 - RNA, 14 nt, Homo sapiens
uauuugaugcuaca

SEQ ID NO: 2219870 - RNA, 15 nt, Homo sapiens
uucuucacucuuuga

SEQ ID NO: 2219871 - RNA, 16 nt, Homo sapiens
aggaugugcugcagug

SEQ ID NO: 2219872 - RNA, 19 nt, Homo sapiens
cuaggcgauuuugucuacc

SEQ ID NO: 2219873 - RNA, 22 nt, Homo sapiens
cuuccucccuggugugaacucu

SEQ ID NO: 2219874 - RNA, 18 nt, Homo sapiens
aaguccaaccugccugug

SEQ ID NO: 2219875 - RNA, 13 nt, Homo sapiens
caguggacaccau

SEQ ID NO: 2219876 - RNA, 16 nt, Homo sapiens
cuuaauuuuagggaca

SEQ ID NO: 2219877 - RNA, 14 nt, Homo sapiens
ccuuaagcaugacg

SEQ ID NO: 2219878 - RNA, 20 nt, Homo sapiens
gagaguucuuuauauucaaa

SEQ ID NO: 2219879 - RNA, 22 nt, Homo sapiens
gauuccagcugucuugucuuuu

SEQ ID NO: 2219880 - RNA, 12 nt, Homo sapiens
gcauucacccag

SEQ ID NO: 2219881 - RNA, 19 nt, Homo sapiens
uuauaaaugauaucaaaga

SEQ ID NO: 2219882 - RNA, 22 nt, Homo sapiens
gcaggaacucccagcaacacaa

SEQ ID NO: 2219883 - RNA, 23 nt, Homo sapiens
gagaauaaacgccuucccaaaau

SEQ ID NO: 2219884 - RNA, 16 nt, Homo sapiens
caugccuggucuuucc

SEQ ID NO: 2219885 - RNA, 21 nt, Homo sapiens
gcuggguuugggcaguggaga

SEQ ID NO: 2219886 - RNA, 23 nt, Homo sapiens
uagccagaauguuuccuguggaa

SEQ ID NO: 2219887 - RNA, 11 nt, Homo sapiens
caaacuaguau

SEQ ID NO: 2219888 - RNA, 14 nt, Homo sapiens
ggacaacacuucau

SEQ ID NO: 2219889 - RNA, 17 nt, Homo sapiens
auggaaaaacugaggcu

SEQ ID NO: 2219890 - RNA, 19 nt, Homo sapiens
caccccaucuuugcugcca

SEQ ID NO: 2219891 - RNA, 18 nt, Homo sapiens
agagccuauuuuggugag

SEQ ID NO: 2219892 - RNA, 14 nt, Homo sapiens
gaauauaauacauu

SEQ ID NO: 2219893 - RNA, 19 nt, Homo sapiens
ucaaucacuugaaagugaa

SEQ ID NO: 2219894 - RNA, 19 nt, Homo sapiens
cacagccaccccugagauc

SEQ ID NO: 2219895 - RNA, 16 nt, Homo sapiens
cggagaucuccuugcc

SEQ ID NO: 2219896 - RNA, 15 nt, Homo sapiens
acagaccgugaacac

SEQ ID NO: 2219897 - RNA, 16 nt, Homo sapiens
gguguccaccaucccc

SEQ ID NO: 2219898 - RNA, 19 nt, Homo sapiens
caccacuugacagacugua

SEQ ID NO: 2219899 - RNA, 21 nt, Homo sapiens
uagcucucugaccuccuccuu

SEQ ID NO: 2219900 - RNA, 20 nt, Homo sapiens
ugaguuguuuaaacagucaa

SEQ ID NO: 2219901 - RNA, 14 nt, Homo sapiens
gccugaaccacagc

SEQ ID NO: 2219902 - RNA, 14 nt, Homo sapiens
agaagguuccuuga

SEQ ID NO: 2219903 - RNA, 21 nt, Homo sapiens
caagaggauuguaaaaugcac

SEQ ID NO: 2219904 - RNA, 18 nt, Homo sapiens
ugccuuuagaaacugagu

SEQ ID NO: 2219905 - RNA, 18 nt, Homo sapiens
cuacccugcugaccuccc

SEQ ID NO: 2219906 - RNA, 15 nt, Homo sapiens
cccucccugaggcag

SEQ ID NO: 2219907 - RNA, 15 nt, Homo sapiens
uaagacaacuacagc

SEQ ID NO: 2219908 - RNA, 21 nt, Homo sapiens
cauauuuuuguagcacugaca

SEQ ID NO: 2219909 - RNA, 13 nt, Homo sapiens
acucaagcacuga

SEQ ID NO: 2219910 - RNA, 12 nt, Homo sapiens
cauccauuucag

SEQ ID NO: 2219911 - RNA, 12 nt, Homo sapiens
ccaccauuuaug

SEQ ID NO: 2219912 - RNA, 20 nt, Homo sapiens
ccacagaccuacugcacuga

SEQ ID NO: 2219913 - RNA, 15 nt, Homo sapiens
cgcaggguccaaagg

SEQ ID NO: 2219914 - RNA, 15 nt, Homo sapiens
gcacaugucauugcc

SEQ ID NO: 2219915 - RNA, 22 nt, Homo sapiens
gaaaaacaaauauagauaggua

SEQ ID NO: 2219916 - RNA, 20 nt, Homo sapiens
ucaagggucaggccuuugag

SEQ ID NO: 2219917 - RNA, 23 nt, Homo sapiens
accaaguguauuguaauguauac

SEQ ID NO: 2219918 - RNA, 19 nt, Homo sapiens
ggcaaucuuugccuuuauc

SEQ ID NO: 2219919 - RNA, 19 nt, Homo sapiens
guauaaugguguuacuaaa

SEQ ID NO: 2219920 - RNA, 12 nt, Homo sapiens
cuugaaaaagca

SEQ ID NO: 2219921 - RNA, 21 nt, Homo sapiens
cauauuauagcuccuauuaaa

SEQ ID NO: 2219922 - RNA, 22 nt, Homo sapiens
augaagaaggucucauuaucuc

SEQ ID NO: 2219923 - RNA, 12 nt, Homo sapiens
gauaauucucag

SEQ ID NO: 2219924 - RNA, 18 nt, Homo sapiens
agacucuuucuucacuac

SEQ ID NO: 2219925 - RNA, 18 nt, Homo sapiens
gccagagcccaagugcca

SEQ ID NO: 2219926 - RNA, 15 nt, Homo sapiens
cuggguccucccagc

SEQ ID NO: 2219927 - RNA, 20 nt, Homo sapiens
ucuguuuugcauggaguauu

SEQ ID NO: 2219928 - RNA, 23 nt, Homo sapiens
agaaggaguguaugagugugagu

SEQ ID NO: 2219929 - RNA, 15 nt, Homo sapiens
cauuuacaacuucca

SEQ ID NO: 2219930 - RNA, 15 nt, Homo sapiens
aaaacacaccaauca

SEQ ID NO: 2219931 - RNA, 15 nt, Homo sapiens
gaaaaagccaccuag

SEQ ID NO: 2219932 - RNA, 10 nt, Homo sapiens
agaauuccuu

SEQ ID NO: 2219933 - RNA, 14 nt, Homo sapiens
gauggaagcuuguu

SEQ ID NO: 2219934 - RNA, 20 nt, Homo sapiens
cuuccuguaacacaagccac

SEQ ID NO: 2219935 - RNA, 19 nt, Homo sapiens
uaauugaucaaauucauuu

SEQ ID NO: 2219936 - RNA, 18 nt, Homo sapiens
cauccuggagggcuuucu

SEQ ID NO: 2219937 - RNA, 23 nt, Homo sapiens
uggagauucaguuuucauuuggu

SEQ ID NO: 2219938 - RNA, 14 nt, Homo sapiens
aaaggcccuuuuag

SEQ ID NO: 2219939 - RNA, 16 nt, Homo sapiens
ccagaguuggacccga

SEQ ID NO: 2219940 - RNA, 21 nt, Homo sapiens
caaauuugauugauuugaaga

SEQ ID NO: 2219941 - RNA, 13 nt, Homo sapiens
ugaaaauaaagca

SEQ ID NO: 2219942 - RNA, 17 nt, Homo sapiens
augucaagggccaagaa

SEQ ID NO: 2219943 - RNA, 17 nt, Homo sapiens
ggcaggugaauaugugg

SEQ ID NO: 2219944 - RNA, 13 nt, Homo sapiens
gaauauugccaau

SEQ ID NO: 2219945 - RNA, 20 nt, Homo sapiens
uggaaaccuguuaugccaaa

SEQ ID NO: 2219946 - RNA, 19 nt, Homo sapiens
aauuagugguacuucaggu

SEQ ID NO: 2219947 - RNA, 23 nt, Homo sapiens
gaagguuggcccccacgugggga

SEQ ID NO: 2219948 - RNA, 20 nt, Homo sapiens
acacacuguugucaaaaagu

SEQ ID NO: 2219949 - RNA, 17 nt, Homo sapiens
gguguccccucagcgga

SEQ ID NO: 2219950 - RNA, 22 nt, Homo sapiens
aggcuguucaccaccaucucca

SEQ ID NO: 2219951 - RNA, 20 nt, Homo sapiens
gcagaguggauuaaaggcaa

SEQ ID NO: 2219952 - RNA, 22 nt, Homo sapiens
ucauugucuuguuauguacaaa

SEQ ID NO: 2219953 - RNA, 23 nt, Homo sapiens
agagucaugugagccucguguca

SEQ ID NO: 2219954 - RNA, 21 nt, Homo sapiens
cauuccuuagcuauuuauccc

SEQ ID NO: 2219955 - RNA, 21 nt, Homo sapiens
uugccaccagccccacccugc

SEQ ID NO: 2219956 - RNA, 17 nt, Homo sapiens
agcaauuccucugaaca

SEQ ID NO: 2219957 - RNA, 16 nt, Homo sapiens
gcugagugcagccaaa

SEQ ID NO: 2219958 - RNA, 20 nt, Homo sapiens
agacaguuuacuuugccaac

SEQ ID NO: 2219959 - RNA, 14 nt, Homo sapiens
uagauuauguucaa

SEQ ID NO: 2219960 - RNA, 18 nt, Homo sapiens
uggcccugccguuucccc

SEQ ID NO: 2219961 - RNA, 20 nt, Homo sapiens
uacggcaaccacauguccca

SEQ ID NO: 2219962 - RNA, 14 nt, Homo sapiens
uccggggugcaaug

SEQ ID NO: 2219963 - RNA, 18 nt, Homo sapiens
uccuaauauuuuguucug

SEQ ID NO: 2219964 - RNA, 22 nt, Homo sapiens
ugucaauguccuacugagacag

SEQ ID NO: 2219965 - RNA, 20 nt, Homo sapiens
gaagaaaagcaugcauauca

SEQ ID NO: 2219966 - RNA, 14 nt, Homo sapiens
uccucuuccucaaa

SEQ ID NO: 2219967 - RNA, 20 nt, Homo sapiens
cgugggaacucgaacuugaa

SEQ ID NO: 2219968 - RNA, 12 nt, Homo sapiens
agagacuguaga

SEQ ID NO: 2219969 - RNA, 23 nt, Homo sapiens
acaacaaaggcaaguuaagagaa

SEQ ID NO: 2219970 - RNA, 13 nt, Homo sapiens
gcaccgugacagu

SEQ ID NO: 2219971 - RNA, 22 nt, Homo sapiens
gggcucccuggcaggaugcuga

SEQ ID NO: 2219972 - RNA, 17 nt, Homo sapiens
cuucagacuggcccuua

SEQ ID NO: 2219973 - RNA, 15 nt, Homo sapiens
uaccauuucuguuga

SEQ ID NO: 2219974 - RNA, 16 nt, Homo sapiens
ugcacaggcuugcugu

SEQ ID NO: 2219975 - RNA, 23 nt, Homo sapiens
gcugcuaaguggaagacagagau

SEQ ID NO: 2219976 - RNA, 16 nt, Homo sapiens
aaggauuuuaccaaag

SEQ ID NO: 2219977 - RNA, 18 nt, Homo sapiens
cuuggagauuuaacaccc

SEQ ID NO: 2219978 - RNA, 23 nt, Homo sapiens
ucauggguccagccuaaaaacca

SEQ ID NO: 2219979 - RNA, 22 nt, Homo sapiens
aaacuuguaauggucucugaaa

SEQ ID NO: 2219980 - RNA, 19 nt, Homo sapiens
agauuccuggcagagccau

SEQ ID NO: 2219981 - RNA, 22 nt, Homo sapiens
accuuauagagcacaauauuaa

SEQ ID NO: 2219982 - RNA, 20 nt, Homo sapiens
gagcagcccuaggcuuccac

SEQ ID NO: 2219983 - RNA, 20 nt, Homo sapiens
cuagcaacccuaacaguaag

SEQ ID NO: 2219984 - RNA, 17 nt, Homo sapiens
ccgagccuccaguccaa

SEQ ID NO: 2219985 - RNA, 14 nt, Homo sapiens
ccaaaucaccacaa

SEQ ID NO: 2219986 - RNA, 14 nt, Homo sapiens
uaaaaacauaacau

SEQ ID NO: 2219987 - RNA, 16 nt, Homo sapiens
aucuauagaacaucca

SEQ ID NO: 2219988 - RNA, 22 nt, Homo sapiens
ccuuggaaguugcauggcauca

SEQ ID NO: 2219989 - RNA, 22 nt, Homo sapiens
aagaaaaaugagcauacaucuu

SEQ ID NO: 2219990 - RNA, 22 nt, Homo sapiens
ugaaaucaagucaucuauaguu

SEQ ID NO: 2219991 - RNA, 12 nt, Homo sapiens
ugggacagggag

SEQ ID NO: 2219992 - RNA, 19 nt, Homo sapiens
aaguucagugagaaucugc

SEQ ID NO: 2219993 - RNA, 21 nt, Homo sapiens
gcuuuuccacugccugggaug

SEQ ID NO: 2219994 - RNA, 14 nt, Homo sapiens
ucacccugucuuac

SEQ ID NO: 2219995 - RNA, 16 nt, Homo sapiens
gaaucaccuugauuca

SEQ ID NO: 2219996 - RNA, 19 nt, Homo sapiens
aaaaguguuuuuacauaua

SEQ ID NO: 2219997 - RNA, 13 nt, Homo sapiens
ggcuggggccagg

SEQ ID NO: 2219998 - RNA, 15 nt, Homo sapiens
uaccauauaacugga

SEQ ID NO: 2219999 - RNA, 19 nt, Homo sapiens
caagcucacccugcuccua

SEQ ID NO: 2220000 - RNA, 21 nt, Homo sapiens
agacaccuucugugcucaugu

SEQ ID NO: 2220001 - RNA, 15 nt, Homo sapiens
cccaucuccuuucau

SEQ ID NO: 2220002 - RNA, 20 nt, Homo sapiens
uuccccuaguaagugccuuc

SEQ ID NO: 2220003 - RNA, 18 nt, Homo sapiens
aaaucaagugcaccuaca

SEQ ID NO: 2220004 - RNA, 15 nt, Homo sapiens
ucccaagaaugcaag

SEQ ID NO: 2220005 - RNA, 16 nt, Homo sapiens
auccccccacugagcu

SEQ ID NO: 2220006 - RNA, 16 nt, Homo sapiens
aggaauucuaggcauc

SEQ ID NO: 2220007 - RNA, 15 nt, Homo sapiens
cccaaguccucauuu

SEQ ID NO: 2220008 - RNA, 21 nt, Homo sapiens
gagaucgugccauugcacucc

SEQ ID NO: 2220009 - RNA, 14 nt, Homo sapiens
agaaguuauuuucc

SEQ ID NO: 2220010 - RNA, 17 nt, Homo sapiens
agaaaacugucugggag

SEQ ID NO: 2220011 - RNA, 24 nt, Homo sapiens
cuguaagaaaauaucacuugucaa

SEQ ID NO: 2220012 - RNA, 15 nt, Homo sapiens
uugccaaaaccaaga

SEQ ID NO: 2220013 - RNA, 17 nt, Homo sapiens
uggucaauaaaccacug

SEQ ID NO: 2220014 - RNA, 16 nt, Homo sapiens
ucuucccuacccuucc

SEQ ID NO: 2220015 - RNA, 17 nt, Homo sapiens
aaggaucuccucuggaa

SEQ ID NO: 2220016 - RNA, 17 nt, Homo sapiens
uucuuuauauugucauu

SEQ ID NO: 2220017 - RNA, 22 nt, Homo sapiens
cucauagccacuuuuauguuac

SEQ ID NO: 2220018 - RNA, 17 nt, Homo sapiens
gaagugcagcagguuaa

SEQ ID NO: 2220019 - RNA, 22 nt, Homo sapiens
aucucaauuuuuucaaaugaaa

SEQ ID NO: 2220020 - RNA, 20 nt, Homo sapiens
aaaauguaugccacaucuca

SEQ ID NO: 2220021 - RNA, 23 nt, Homo sapiens
acuuugcugucaaaacuacugac

SEQ ID NO: 2220022 - RNA, 15 nt, Homo sapiens
guacugauucaagaa

SEQ ID NO: 2220023 - RNA, 23 nt, Homo sapiens
ugaaaugaaagggaaacugggaa

SEQ ID NO: 2220024 - RNA, 18 nt, Homo sapiens
agugugugacauuccagg

SEQ ID NO: 2220025 - RNA, 22 nt, Homo sapiens
aaaugcauaauaacuacuucca

SEQ ID NO: 2220026 - RNA, 13 nt, Homo sapiens
agugccauuccac

SEQ ID NO: 2220027 - RNA, 22 nt, Homo sapiens
ccugaggaauaaagcuucucuc

SEQ ID NO: 2220028 - RNA, 15 nt, Homo sapiens
aaauguccuuucuca

SEQ ID NO: 2220029 - RNA, 20 nt, Homo sapiens
guauacauaaguuuaggaua

SEQ ID NO: 2220030 - RNA, 17 nt, Homo sapiens
uguauguguggcugugg

SEQ ID NO: 2220031 - RNA, 15 nt, Homo sapiens
gaaauauagugcaau

SEQ ID NO: 2220032 - RNA, 15 nt, Homo sapiens
gaggaugcaacaaau

SEQ ID NO: 2220033 - RNA, 14 nt, Homo sapiens
acccuccuguaaau

SEQ ID NO: 2220034 - RNA, 19 nt, Homo sapiens
uguuggaguggaacauugg

SEQ ID NO: 2220035 - RNA, 15 nt, Homo sapiens
agcuauuucucauca

SEQ ID NO: 2220036 - RNA, 18 nt, Homo sapiens
acacaaggugcaaaucaa

SEQ ID NO: 2220037 - RNA, 17 nt, Homo sapiens
cagugaagaugccagug

SEQ ID NO: 2220038 - RNA, 20 nt, Homo sapiens
aaaaucuuccaaauccaaaa

SEQ ID NO: 2220039 - RNA, 22 nt, Homo sapiens
agaaucuguuucccagcagugg

SEQ ID NO: 2220040 - RNA, 23 nt, Homo sapiens
cuguacucagccuuuugaugucu

SEQ ID NO: 2220041 - RNA, 19 nt, Homo sapiens
ugaaaaccguaaagugccu

SEQ ID NO: 2220042 - RNA, 21 nt, Homo sapiens
gcugggccuucggggugagcc

SEQ ID NO: 2220043 - RNA, 19 nt, Homo sapiens
ucauucucaguauccacug

SEQ ID NO: 2220044 - RNA, 14 nt, Homo sapiens
gugguuuuuugcca

SEQ ID NO: 2220045 - RNA, 13 nt, Homo sapiens
uacucaacccauu

SEQ ID NO: 2220046 - RNA, 19 nt, Homo sapiens
gcauccauuuacugacacu

SEQ ID NO: 2220047 - RNA, 17 nt, Homo sapiens
caauaaauuggaacacc

SEQ ID NO: 2220048 - RNA, 19 nt, Homo sapiens
agaagugaaaaggcugccu

SEQ ID NO: 2220049 - RNA, 23 nt, Homo sapiens
guagcaaaccauggcagacucac

SEQ ID NO: 2220050 - RNA, 20 nt, Homo sapiens
uuacacucuagugccauaua

SEQ ID NO: 2220051 - RNA, 16 nt, Homo sapiens
agguuaaacugaagca

SEQ ID NO: 2220052 - RNA, 13 nt, Homo sapiens
gaucuacaugaau

SEQ ID NO: 2220053 - RNA, 15 nt, Homo sapiens
ggagagaaguggcca

SEQ ID NO: 2220054 - RNA, 19 nt, Homo sapiens
aggugcacuccagacucug

SEQ ID NO: 2220055 - RNA, 11 nt, Homo sapiens
uuaugugacaa

SEQ ID NO: 2220056 - RNA, 11 nt, Homo sapiens
ggaaagcacag

SEQ ID NO: 2220057 - RNA, 20 nt, Homo sapiens
aggcgugagccaccgcgccu

SEQ ID NO: 2220058 - RNA, 21 nt, Homo sapiens
aucacuggcaauauuuguucu

SEQ ID NO: 2220059 - RNA, 14 nt, Homo sapiens
aaagauuuguacua

SEQ ID NO: 2220060 - RNA, 11 nt, Homo sapiens
ccuagccaccc

SEQ ID NO: 2220061 - RNA, 22 nt, Homo sapiens
gcaguuuccaauaaacgcaagc

SEQ ID NO: 2220062 - RNA, 12 nt, Homo sapiens
agcugcugugac

SEQ ID NO: 2220063 - RNA, 19 nt, Homo sapiens
ugcuuuauaauccuuguca

SEQ ID NO: 2220064 - RNA, 21 nt, Homo sapiens
uuugcuguaaacuuguagcau

SEQ ID NO: 2220065 - RNA, 13 nt, Homo sapiens
gcuaaguauugaa

SEQ ID NO: 2220066 - RNA, 19 nt, Homo sapiens
caacuuacugucuucuuca

SEQ ID NO: 2220067 - RNA, 22 nt, Homo sapiens
uagacuuuuaacuucaccuuaa

SEQ ID NO: 2220068 - RNA, 13 nt, Homo sapiens
aacagaugccaau

SEQ ID NO: 2220069 - RNA, 13 nt, Homo sapiens
gcccccugaccuu

SEQ ID NO: 2220070 - RNA, 11 nt, Homo sapiens
gauacgugugu

SEQ ID NO: 2220071 - RNA, 19 nt, Homo sapiens
uagaauauuaucuucauaa

SEQ ID NO: 2220072 - RNA, 18 nt, Homo sapiens
aaacuuuuuuuguuugcu

SEQ ID NO: 2220073 - RNA, 19 nt, Homo sapiens
ucaaaacaaucuugucaua

SEQ ID NO: 2220074 - RNA, 16 nt, Homo sapiens
cucacacccaccugcu

SEQ ID NO: 2220075 - RNA, 22 nt, Homo sapiens
uacacugaaucauuaacagugc

SEQ ID NO: 2220076 - RNA, 18 nt, Homo sapiens
ccaaaacaugcacccugg

SEQ ID NO: 2220077 - RNA, 21 nt, Homo sapiens
uaaaauacuuuuacucugccu

SEQ ID NO: 2220078 - RNA, 18 nt, Homo sapiens
uguaaucaguuuuaucca

SEQ ID NO: 2220079 - RNA, 22 nt, Homo sapiens
gcaguuuuacuaaaacacugaa

SEQ ID NO: 2220080 - RNA, 15 nt, Homo sapiens
uggccacugucccug

SEQ ID NO: 2220081 - RNA, 22 nt, Homo sapiens
gaauucauacucuguugccucc

SEQ ID NO: 2220082 - RNA, 22 nt, Homo sapiens
uacaaauuuuuacucaggcuuu

SEQ ID NO: 2220083 - RNA, 14 nt, Homo sapiens
ugcaaugcaugaua

SEQ ID NO: 2220084 - RNA, 15 nt, Homo sapiens
gcuaacaaacugaaa

SEQ ID NO: 2220085 - RNA, 21 nt, Homo sapiens
uuagcauacuagaaucagaua

SEQ ID NO: 2220086 - RNA, 12 nt, Homo sapiens
gagguggcugcc

SEQ ID NO: 2220087 - RNA, 20 nt, Homo sapiens
augucaccuacauguuauuc

SEQ ID NO: 2220088 - RNA, 18 nt, Homo sapiens
cagaacauaaaugcacaa

SEQ ID NO: 2220089 - RNA, 14 nt, Homo sapiens
ggcagggcccagug

SEQ ID NO: 2220090 - RNA, 17 nt, Homo sapiens
uguaggaaaagaggcca

SEQ ID NO: 2220091 - RNA, 14 nt, Homo sapiens
ucuuguauuaucau

SEQ ID NO: 2220092 - RNA, 15 nt, Homo sapiens
agugcuauuguagag

SEQ ID NO: 2220093 - RNA, 17 nt, Homo sapiens
aagaaacacccuuucau

SEQ ID NO: 2220094 - RNA, 14 nt, Homo sapiens
ugacaacucuuauu

SEQ ID NO: 2220095 - RNA, 17 nt, Homo sapiens
uaacugggugugguggc

SEQ ID NO: 2220096 - RNA, 23 nt, Homo sapiens
cucucaauaaaguuccccuguga

SEQ ID NO: 2220097 - RNA, 13 nt, Homo sapiens
uucaggacucugc

SEQ ID NO: 2220098 - RNA, 15 nt, Homo sapiens
ccugugcugaccaaa

SEQ ID NO: 2220099 - RNA, 13 nt, Homo sapiens
ccugggaccucac

SEQ ID NO: 2220100 - RNA, 12 nt, Homo sapiens
gauuuugcacuu

SEQ ID NO: 2220101 - RNA, 19 nt, Homo sapiens
agaccaaguuaucaucuca

SEQ ID NO: 2220102 - RNA, 19 nt, Homo sapiens
ucauuaucuuugcuguuau

SEQ ID NO: 2220103 - RNA, 15 nt, Homo sapiens
ggcaaaaacaaaggu

SEQ ID NO: 2220104 - RNA, 15 nt, Homo sapiens
ccagccagccacucu

SEQ ID NO: 2220105 - RNA, 19 nt, Homo sapiens
guauguucuaaccuuuaca

SEQ ID NO: 2220106 - RNA, 15 nt, Homo sapiens
ucaaccuacagugga

SEQ ID NO: 2220107 - RNA, 20 nt, Homo sapiens
aguaccccugguaaaccaag

SEQ ID NO: 2220108 - RNA, 23 nt, Homo sapiens
uagugggccagggcugcccugag

SEQ ID NO: 2220109 - RNA, 20 nt, Homo sapiens
agcaauuguauuacuuccuc

SEQ ID NO: 2220110 - RNA, 15 nt, Homo sapiens
agcccucucacugug

SEQ ID NO: 2220111 - RNA, 12 nt, Homo sapiens
aaaucugaggga

SEQ ID NO: 2220112 - RNA, 15 nt, Homo sapiens
agcaucaauuccauc

SEQ ID NO: 2220113 - RNA, 22 nt, Homo sapiens
cagucuaucauuguuggacauu

SEQ ID NO: 2220114 - RNA, 19 nt, Homo sapiens
ccaacuucucuugcuuucu

SEQ ID NO: 2220115 - RNA, 22 nt, Homo sapiens
augcuuaccaaguccugggaau

SEQ ID NO: 2220116 - RNA, 23 nt, Homo sapiens
guauuuccaaauuacugauauca

SEQ ID NO: 2220117 - RNA, 18 nt, Homo sapiens
agccaauaccagccgcca

SEQ ID NO: 2220118 - RNA, 23 nt, Homo sapiens
accuccuaagaaggcaccucucu

SEQ ID NO: 2220119 - RNA, 13 nt, Homo sapiens
ggagagcccuuca

SEQ ID NO: 2220120 - RNA, 16 nt, Homo sapiens
ucuguguucaggauac

SEQ ID NO: 2220121 - RNA, 20 nt, Homo sapiens
augcaauuuaaaauuauuca

SEQ ID NO: 2220122 - RNA, 23 nt, Homo sapiens
ugucuacacacccugcauaucau

SEQ ID NO: 2220123 - RNA, 21 nt, Homo sapiens
uacucgaguuacagacaaagc

SEQ ID NO: 2220124 - RNA, 13 nt, Homo sapiens
aguaaaagcagga

SEQ ID NO: 2220125 - RNA, 21 nt, Homo sapiens
cuuuccuuguuagaaugcaag

SEQ ID NO: 2220126 - RNA, 19 nt, Homo sapiens
ucaaagcccacauacugga

SEQ ID NO: 2220127 - RNA, 24 nt, Homo sapiens
ucuggcauuauaaagaacagcuga

SEQ ID NO: 2220128 - RNA, 22 nt, Homo sapiens
cucacaaaguccacuuuacuca

SEQ ID NO: 2220129 - RNA, 11 nt, Homo sapiens
cacacaguguu

SEQ ID NO: 2220130 - RNA, 17 nt, Homo sapiens
uccagacacguccugca

SEQ ID NO: 2220131 - RNA, 14 nt, Homo sapiens
acaauucaugccuu

SEQ ID NO: 2220132 - RNA, 14 nt, Homo sapiens
acgaggucuuguug

SEQ ID NO: 2220133 - RNA, 23 nt, Homo sapiens
agcuguacucuucugacugcccc

SEQ ID NO: 2220134 - RNA, 13 nt, Homo sapiens
gaaaauaaagugu

SEQ ID NO: 2220135 - RNA, 16 nt, Homo sapiens
uuucuaaaagccaauc

SEQ ID NO: 2220136 - RNA, 19 nt, Homo sapiens
aggaaacagcaaacagugg

SEQ ID NO: 2220137 - RNA, 10 nt, Homo sapiens
cauuuugcca

SEQ ID NO: 2220138 - RNA, 21 nt, Homo sapiens
aaucaaggugauugugauuau

SEQ ID NO: 2220139 - RNA, 17 nt, Homo sapiens
ucacauuccaagccuca

SEQ ID NO: 2220140 - RNA, 23 nt, Homo sapiens
ggcggagcugugcucagcacagg

SEQ ID NO: 2220141 - RNA, 21 nt, Homo sapiens
ugacacccauugggcccuucc

SEQ ID NO: 2220142 - RNA, 20 nt, Homo sapiens
gaugguggcccugaaccuca

SEQ ID NO: 2220143 - RNA, 22 nt, Homo sapiens
aggugaacagcaggaugcccug

SEQ ID NO: 2220144 - RNA, 17 nt, Homo sapiens
cucugaggcuauggagg

SEQ ID NO: 2220145 - RNA, 22 nt, Homo sapiens
uucuauuacgugcaauacuuca

SEQ ID NO: 2220146 - RNA, 19 nt, Homo sapiens
cuuguaccauuucacaaac

SEQ ID NO: 2220147 - RNA, 22 nt, Homo sapiens
ccaacugcaggaaaacccuuaa

SEQ ID NO: 2220148 - RNA, 16 nt, Homo sapiens
gccugggugacauuug

SEQ ID NO: 2220149 - RNA, 14 nt, Homo sapiens
uaagcaagagccaa

SEQ ID NO: 2220150 - RNA, 12 nt, Homo sapiens
uacugcacuuau

SEQ ID NO: 2220151 - RNA, 17 nt, Homo sapiens
uaaagaaacuuuauuca

SEQ ID NO: 2220152 - RNA, 15 nt, Homo sapiens
acuccaacuguggag

SEQ ID NO: 2220153 - RNA, 11 nt, Homo sapiens
aaaggccagac

SEQ ID NO: 2220154 - RNA, 10 nt, Homo sapiens
gaguguuccg

SEQ ID NO: 2220155 - RNA, 20 nt, Homo sapiens
cagcugaugaacuguggugc

SEQ ID NO: 2220156 - RNA, 15 nt, Homo sapiens
uaacugaauucugaa

SEQ ID NO: 2220157 - RNA, 15 nt, Homo sapiens
cugugaagaucucac

SEQ ID NO: 2220158 - RNA, 20 nt, Homo sapiens
ccaggcuagagugcaauggc

SEQ ID NO: 2220159 - RNA, 20 nt, Homo sapiens
ccaggcuggagugcaguggc

SEQ ID NO: 2220160 - RNA, 18 nt, Homo sapiens
agaucagaacauucagcu

SEQ ID NO: 2220161 - RNA, 14 nt, Homo sapiens
uauaaagauuuucu

SEQ ID NO: 2220162 - RNA, 19 nt, Homo sapiens
cugcgucaggcagugugag

SEQ ID NO: 2220163 - RNA, 18 nt, Homo sapiens
gucuuuuucuacagccag

SEQ ID NO: 2220164 - RNA, 12 nt, Homo sapiens
uuaaagucuaca

SEQ ID NO: 2220165 - RNA, 20 nt, Homo sapiens
aaaaagaauauauugccaaa

SEQ ID NO: 2220166 - RNA, 17 nt, Homo sapiens
uuucaaagaaauccaaa

SEQ ID NO: 2220167 - RNA, 23 nt, Homo sapiens
aaaaugugacccuccaaauggag

SEQ ID NO: 2220168 - RNA, 11 nt, Homo sapiens
cuccuggugcc

SEQ ID NO: 2220169 - RNA, 15 nt, Homo sapiens
uuucuccauaucaaa

SEQ ID NO: 2220170 - RNA, 15 nt, Homo sapiens
uguaccugugcacgu

SEQ ID NO: 2220171 - RNA, 21 nt, Homo sapiens
aacacgagcaggcuacuguca

SEQ ID NO: 2220172 - RNA, 22 nt, Homo sapiens
agagacugguuucuccauguug

SEQ ID NO: 2220173 - RNA, 14 nt, Homo sapiens
ucugcaagcccacu

SEQ ID NO: 2220174 - RNA, 16 nt, Homo sapiens
cuggaaguugaagguu

SEQ ID NO: 2220175 - RNA, 13 nt, Homo sapiens
aaugcauguugcc

SEQ ID NO: 2220176 - RNA, 14 nt, Homo sapiens
uccuucagcacuuu

SEQ ID NO: 2220177 - RNA, 21 nt, Homo sapiens
caaggugggcggaucaccuga

SEQ ID NO: 2220178 - RNA, 15 nt, Homo sapiens
cuccaagaauggagg

SEQ ID NO: 2220179 - RNA, 15 nt, Homo sapiens
aucacgccacugcac

SEQ ID NO: 2220180 - RNA, 18 nt, Homo sapiens
uauauguagaguguuuua

SEQ ID NO: 2220181 - RNA, 14 nt, Homo sapiens
cgugugcgugcaug

SEQ ID NO: 2220182 - RNA, 23 nt, Homo sapiens
ucauuucuuuucauuguaaucaa

SEQ ID NO: 2220183 - RNA, 19 nt, Homo sapiens
uaauaggguuuucagauga

SEQ ID NO: 2220184 - RNA, 19 nt, Homo sapiens
aguauuggaucugaaaaua

SEQ ID NO: 2220185 - RNA, 14 nt, Homo sapiens
gcauucuaguuuca

SEQ ID NO: 2220186 - RNA, 18 nt, Homo sapiens
agaaacuucugcuuuuaa

SEQ ID NO: 2220187 - RNA, 12 nt, Homo sapiens
gcaaggcugugc

SEQ ID NO: 2220188 - RNA, 21 nt, Homo sapiens
caggugcgcucagagcugucc

SEQ ID NO: 2220189 - RNA, 12 nt, Homo sapiens
agccuucuugau

SEQ ID NO: 2220190 - RNA, 21 nt, Homo sapiens
cugggaacugugccuuugagu

SEQ ID NO: 2220191 - RNA, 13 nt, Homo sapiens
ugguaaguagcag

SEQ ID NO: 2220192 - RNA, 15 nt, Homo sapiens
aggcuggagugcaau

SEQ ID NO: 2220193 - RNA, 15 nt, Homo sapiens
aggcuagagugcagu

SEQ ID NO: 2220194 - RNA, 23 nt, Homo sapiens
cuuggauaaccaggcugggcuca

SEQ ID NO: 2220195 - RNA, 19 nt, Homo sapiens
ucuguuuaggagugucuaa

SEQ ID NO: 2220196 - RNA, 16 nt, Homo sapiens
ccaugcugaccugugu

SEQ ID NO: 2220197 - RNA, 19 nt, Homo sapiens
ucagggagaggucaccagc

SEQ ID NO: 2220198 - RNA, 19 nt, Homo sapiens
cagaauguucauacugaug

SEQ ID NO: 2220199 - RNA, 15 nt, Homo sapiens
ugcauugaaaugcaa

SEQ ID NO: 2220200 - RNA, 11 nt, Homo sapiens
gaaucucugag

SEQ ID NO: 2220201 - RNA, 23 nt, Homo sapiens
ccuuugcuaaaauauaauuuuca

SEQ ID NO: 2220202 - RNA, 22 nt, Homo sapiens
uucacugagcuccccagaucuc

SEQ ID NO: 2220203 - RNA, 12 nt, Homo sapiens
uuugcaggugag

SEQ ID NO: 2220204 - RNA, 12 nt, Homo sapiens
auuuauccaaag

SEQ ID NO: 2220205 - RNA, 17 nt, Homo sapiens
aagacuuaucaacauuu

SEQ ID NO: 2220206 - RNA, 20 nt, Homo sapiens
cuugucucaggacucugaaa

SEQ ID NO: 2220207 - RNA, 14 nt, Homo sapiens
acccacccuguggc

SEQ ID NO: 2220208 - RNA, 12 nt, Homo sapiens
aauguaucugaa

SEQ ID NO: 2220209 - RNA, 17 nt, Homo sapiens
ggaagucuaaauauuca

SEQ ID NO: 2220210 - RNA, 16 nt, Homo sapiens
agcauuaacugucuua

SEQ ID NO: 2220211 - RNA, 15 nt, Homo sapiens
ugaaaacucuauguc

SEQ ID NO: 2220212 - RNA, 21 nt, Homo sapiens
cuuguggucucgaugcugcug

SEQ ID NO: 2220213 - RNA, 12 nt, Homo sapiens
uuuguuacugau

SEQ ID NO: 2220214 - RNA, 22 nt, Homo sapiens
ucgaggcugcagucagcccuga

SEQ ID NO: 2220215 - RNA, 18 nt, Homo sapiens
agacugggcaccccugcc

SEQ ID NO: 2220216 - RNA, 16 nt, Homo sapiens
agcaguggcuccauug

SEQ ID NO: 2220217 - RNA, 22 nt, Homo sapiens
ugaaaaggauauuaucuaccug

SEQ ID NO: 2220218 - RNA, 15 nt, Homo sapiens
augggccuucagauu

SEQ ID NO: 2220219 - RNA, 20 nt, Homo sapiens
aagaucgugcuggcgcuguu

SEQ ID NO: 2220220 - RNA, 19 nt, Homo sapiens
auggugccuauaucugaga

SEQ ID NO: 2220221 - RNA, 19 nt, Homo sapiens
uucaaggaaaaaugcugcu

SEQ ID NO: 2220222 - RNA, 17 nt, Homo sapiens
agucucgcuacauuucc

SEQ ID NO: 2220223 - RNA, 20 nt, Homo sapiens
agcaaguauauuuauuucua

SEQ ID NO: 2220224 - RNA, 14 nt, Homo sapiens
aacccacauauuaa

SEQ ID NO: 2220225 - RNA, 22 nt, Homo sapiens
auuuuguauaauuguaucguau

SEQ ID NO: 2220226 - RNA, 22 nt, Homo sapiens
uuaauagcaacagagcacuuga

SEQ ID NO: 2220227 - RNA, 12 nt, Homo sapiens
cugagccuggca

SEQ ID NO: 2220228 - RNA, 18 nt, Homo sapiens
ugaaaugccacgugccau

SEQ ID NO: 2220229 - RNA, 18 nt, Homo sapiens
ugggaggguggcaaggga

SEQ ID NO: 2220230 - RNA, 16 nt, Homo sapiens
ggaacaagccuaaaaa

SEQ ID NO: 2220231 - RNA, 22 nt, Homo sapiens
gcaauaacuucuauguugguuu

SEQ ID NO: 2220232 - RNA, 15 nt, Homo sapiens
aucggggaagccaga

SEQ ID NO: 2220233 - RNA, 19 nt, Homo sapiens
aguucugcacccagccaaa

SEQ ID NO: 2220234 - RNA, 14 nt, Homo sapiens
cccuguuaccuaau

SEQ ID NO: 2220235 - RNA, 19 nt, Homo sapiens
ccuggugaccuacuaaaaa

SEQ ID NO: 2220236 - RNA, 21 nt, Homo sapiens
ccaccaagaaguggcugccaa

SEQ ID NO: 2220237 - RNA, 18 nt, Homo sapiens
uacccuacaccucugggc

SEQ ID NO: 2220238 - RNA, 16 nt, Homo sapiens
guuaauucagcacuga

SEQ ID NO: 2220239 - RNA, 23 nt, Homo sapiens
gguuuuagacgaggccacagcug

SEQ ID NO: 2220240 - RNA, 19 nt, Homo sapiens
cauguaauuaaguacuaug

SEQ ID NO: 2220241 - RNA, 21 nt, Homo sapiens
ccacugggacccgaggauuuc

SEQ ID NO: 2220242 - RNA, 20 nt, Homo sapiens
caggauggucucgaucuccu

SEQ ID NO: 2220243 - RNA, 15 nt, Homo sapiens
gugggagguugugca

SEQ ID NO: 2220244 - RNA, 21 nt, Homo sapiens
cagccccaaacacccacccaa

SEQ ID NO: 2220245 - RNA, 21 nt, Homo sapiens
ucaaaacacacuacuaccucu

SEQ ID NO: 2220246 - RNA, 12 nt, Homo sapiens
uagucauacucc

SEQ ID NO: 2220247 - RNA, 17 nt, Homo sapiens
cucuggcccacucauga

SEQ ID NO: 2220248 - RNA, 21 nt, Homo sapiens
cccaacggcuacuacccggcg

SEQ ID NO: 2220249 - RNA, 15 nt, Homo sapiens
cuuccuaauugugcc

SEQ ID NO: 2220250 - RNA, 14 nt, Homo sapiens
gaacugagggcucu

SEQ ID NO: 2220251 - RNA, 17 nt, Homo sapiens
ccagguuacuaaagggu

SEQ ID NO: 2220252 - RNA, 21 nt, Homo sapiens
uacuugauauuauuucagggu

SEQ ID NO: 2220253 - RNA, 21 nt, Homo sapiens
gcucuuauagaagcuucagca

SEQ ID NO: 2220254 - RNA, 22 nt, Homo sapiens
ccacaacacgccuaaaacucaa

SEQ ID NO: 2220255 - RNA, 22 nt, Homo sapiens
caucacugagacaaucauguac

SEQ ID NO: 2220256 - RNA, 20 nt, Homo sapiens
ugacuuucuaacugugcaga

SEQ ID NO: 2220257 - RNA, 20 nt, Homo sapiens
agcuguaauauauaguaaaa

SEQ ID NO: 2220258 - RNA, 18 nt, Homo sapiens
gcuuugggggcuuuacaa

SEQ ID NO: 2220259 - RNA, 13 nt, Homo sapiens
agauaacuaggaa

SEQ ID NO: 2220260 - RNA, 18 nt, Homo sapiens
uguagaacucugcaggca

SEQ ID NO: 2220261 - RNA, 20 nt, Homo sapiens
aggcuuugugauagugacau

SEQ ID NO: 2220262 - RNA, 18 nt, Homo sapiens
acuuucuucaaagccaca

SEQ ID NO: 2220263 - RNA, 14 nt, Homo sapiens
caaggaagucuuca

SEQ ID NO: 2220264 - RNA, 17 nt, Homo sapiens
gacauacuuaaugcaua

SEQ ID NO: 2220265 - RNA, 16 nt, Homo sapiens
acaaacaaugcaauca

SEQ ID NO: 2220266 - RNA, 16 nt, Homo sapiens
ugcuacaaacauauca

SEQ ID NO: 2220267 - RNA, 14 nt, Homo sapiens
agucuucuuuauca

SEQ ID NO: 2220268 - RNA, 20 nt, Homo sapiens
ggaguggcugaccaggcccu

SEQ ID NO: 2220269 - RNA, 16 nt, Homo sapiens
gcaaaugccugacuca

SEQ ID NO: 2220270 - RNA, 19 nt, Homo sapiens
aaaugaugcgcaucaaugu

SEQ ID NO: 2220271 - RNA, 18 nt, Homo sapiens
gccaaguuggagugcaau

SEQ ID NO: 2220272 - RNA, 14 nt, Homo sapiens
caugucacaauaca

SEQ ID NO: 2220273 - RNA, 15 nt, Homo sapiens
caugugcugccugca

SEQ ID NO: 2220274 - RNA, 15 nt, Homo sapiens
cauguguagauauua

SEQ ID NO: 2220275 - RNA, 22 nt, Homo sapiens
agaaagaaugcauuccagaaca

SEQ ID NO: 2220276 - RNA, 20 nt, Homo sapiens
uucugccgcccccuccugaa

SEQ ID NO: 2220277 - RNA, 14 nt, Homo sapiens
uaauccacucccuu

SEQ ID NO: 2220278 - RNA, 21 nt, Homo sapiens
gcaggcguguggcagccacac

SEQ ID NO: 2220279 - RNA, 14 nt, Homo sapiens
aacacacuggccau

SEQ ID NO: 2220280 - RNA, 18 nt, Homo sapiens
ccccuugccagacaugug

SEQ ID NO: 2220281 - RNA, 16 nt, Homo sapiens
ugcucaucacccaguc

SEQ ID NO: 2220282 - RNA, 21 nt, Homo sapiens
uaaauuuuauaugcacaguaa

SEQ ID NO: 2220283 - RNA, 15 nt, Homo sapiens
uucauucugccaaag

SEQ ID NO: 2220284 - RNA, 17 nt, Homo sapiens
cagugagacugccccac

SEQ ID NO: 2220285 - RNA, 23 nt, Homo sapiens
cagccaugugccuuaguguccuu

SEQ ID NO: 2220286 - RNA, 15 nt, Homo sapiens
aaaucagaagcacaa

SEQ ID NO: 2220287 - RNA, 15 nt, Homo sapiens
agaauuaaaacuuug

SEQ ID NO: 2220288 - RNA, 19 nt, Homo sapiens
aauggaagcccuuaaaggu

SEQ ID NO: 2220289 - RNA, 20 nt, Homo sapiens
caugauuuuggcucacugca

SEQ ID NO: 2220290 - RNA, 14 nt, Homo sapiens
uacacguugcccau

SEQ ID NO: 2220291 - RNA, 18 nt, Homo sapiens
ccagaccagccugggcaa

SEQ ID NO: 2220292 - RNA, 19 nt, Homo sapiens
ccaggacgcagggagaccc

SEQ ID NO: 2220293 - RNA, 17 nt, Homo sapiens
ucccauaacauaaaagu

SEQ ID NO: 2220294 - RNA, 19 nt, Homo sapiens
aauaaucuuuuaacagugu

SEQ ID NO: 2220295 - RNA, 18 nt, Homo sapiens
ugcugcccagccacucca

SEQ ID NO: 2220296 - RNA, 17 nt, Homo sapiens
cuccagcgguugccuuu

SEQ ID NO: 2220297 - RNA, 14 nt, Homo sapiens
uggagguugugcau

SEQ ID NO: 2220298 - RNA, 17 nt, Homo sapiens
gcccccccuaucucuuc

SEQ ID NO: 2220299 - RNA, 12 nt, Homo sapiens
ggcacagccuuu

SEQ ID NO: 2220300 - RNA, 22 nt, Homo sapiens
cacccaccccacaccugcagug

SEQ ID NO: 2220301 - RNA, 19 nt, Homo sapiens
agcuagaaucacuugacuu

SEQ ID NO: 2220302 - RNA, 14 nt, Homo sapiens
cuguuuugauagau

SEQ ID NO: 2220303 - RNA, 14 nt, Homo sapiens
gaugaggucauuuc

SEQ ID NO: 2220304 - RNA, 15 nt, Homo sapiens
cacuuaaggaccuuu

SEQ ID NO: 2220305 - RNA, 23 nt, Homo sapiens
cagcagaggcggucuucaacauc

SEQ ID NO: 2220306 - RNA, 16 nt, Homo sapiens
cacacagcacucucua

SEQ ID NO: 2220307 - RNA, 15 nt, Homo sapiens
acagccaccaagaag

SEQ ID NO: 2220308 - RNA, 21 nt, Homo sapiens
uauagauagauaauguucucc

SEQ ID NO: 2220309 - RNA, 22 nt, Homo sapiens
acagcaucugccucuauucaau

SEQ ID NO: 2220310 - RNA, 23 nt, Homo sapiens
acaagccucagcaaacccaaaga

SEQ ID NO: 2220311 - RNA, 14 nt, Homo sapiens
cugucuuuguggga

SEQ ID NO: 2220312 - RNA, 12 nt, Homo sapiens
ugaaacagcagc

SEQ ID NO: 2220313 - RNA, 19 nt, Homo sapiens
gaaccauuggaaacauuua

SEQ ID NO: 2220314 - RNA, 21 nt, Homo sapiens
gcacauuuaagagacagucac

SEQ ID NO: 2220315 - RNA, 22 nt, Homo sapiens
ccaaacauggccagacucccuu

SEQ ID NO: 2220316 - RNA, 12 nt, Homo sapiens
aaaauaaauuca

SEQ ID NO: 2220317 - RNA, 13 nt, Homo sapiens
aacaguaucucaa

SEQ ID NO: 2220318 - RNA, 20 nt, Homo sapiens
cuguuugcccccauucacuu

SEQ ID NO: 2220319 - RNA, 17 nt, Homo sapiens
uggaucugcugcaucca

SEQ ID NO: 2220320 - RNA, 19 nt, Homo sapiens
aauuuaaacuuguuuacaa

SEQ ID NO: 2220321 - RNA, 23 nt, Homo sapiens
aagugggaucugucacaccagcc

SEQ ID NO: 2220322 - RNA, 19 nt, Homo sapiens
uuccauuuuacuuccauga

SEQ ID NO: 2220323 - RNA, 21 nt, Homo sapiens
auagcagcuuauucacaagac

SEQ ID NO: 2220324 - RNA, 13 nt, Homo sapiens
gaaucacauucuu

SEQ ID NO: 2220325 - RNA, 19 nt, Homo sapiens
agcaggcccaaugcugcuu

SEQ ID NO: 2220326 - RNA, 12 nt, Homo sapiens
ccauuuuguuaa

SEQ ID NO: 2220327 - RNA, 19 nt, Homo sapiens
cuuauacacaccugaauaa

SEQ ID NO: 2220328 - RNA, 19 nt, Homo sapiens
uugauucgaaggaugaaga

SEQ ID NO: 2220329 - RNA, 12 nt, Homo sapiens
ugaaaacagcua

SEQ ID NO: 2220330 - RNA, 17 nt, Homo sapiens
aucccagacucacccca

SEQ ID NO: 2220331 - RNA, 22 nt, Homo sapiens
aucaagucaucuauaguugaua

SEQ ID NO: 2220332 - RNA, 12 nt, Homo sapiens
gaauuguuacau

SEQ ID NO: 2220333 - RNA, 14 nt, Homo sapiens
ucagacauucagag

SEQ ID NO: 2220334 - RNA, 18 nt, Homo sapiens
uaauaauggaagccaaag

SEQ ID NO: 2220335 - RNA, 15 nt, Homo sapiens
aaauugcacagagca

SEQ ID NO: 2220336 - RNA, 16 nt, Homo sapiens
gagaaaaaaacuucuu

SEQ ID NO: 2220337 - RNA, 17 nt, Homo sapiens
ucccaaaguccugggau

SEQ ID NO: 2220338 - RNA, 13 nt, Homo sapiens
guggaaacagcug

SEQ ID NO: 2220339 - RNA, 14 nt, Homo sapiens
acccucaggugccu

SEQ ID NO: 2220340 - RNA, 21 nt, Homo sapiens
ccugcguagaagauauggaag

SEQ ID NO: 2220341 - RNA, 16 nt, Homo sapiens
gaauaauuucuauuaa

SEQ ID NO: 2220342 - RNA, 20 nt, Homo sapiens
gcgucauuuugaaucaucau

SEQ ID NO: 2220343 - RNA, 13 nt, Homo sapiens
acggcucacugua

SEQ ID NO: 2220344 - RNA, 15 nt, Homo sapiens
uuuacugaggugaug

SEQ ID NO: 2220345 - RNA, 23 nt, Homo sapiens
agagugaagugaagagaggcaaa

SEQ ID NO: 2220346 - RNA, 20 nt, Homo sapiens
gacauagagaggcugugaaa

SEQ ID NO: 2220347 - RNA, 15 nt, Homo sapiens
ugucagaaugcuauu

SEQ ID NO: 2220348 - RNA, 19 nt, Homo sapiens
gacaauaaauuuuaucuca

SEQ ID NO: 2220349 - RNA, 21 nt, Homo sapiens
uccaguguuuaaacuuugaca

SEQ ID NO: 2220350 - RNA, 21 nt, Homo sapiens
ugggagggggcuugaagccaa

SEQ ID NO: 2220351 - RNA, 16 nt, Homo sapiens
accacugcacugucug

SEQ ID NO: 2220352 - RNA, 13 nt, Homo sapiens
aauggaaguccau

SEQ ID NO: 2220353 - RNA, 11 nt, Homo sapiens
gaagcuuuauc

SEQ ID NO: 2220354 - RNA, 12 nt, Homo sapiens
uagaacaaagaa

SEQ ID NO: 2220355 - RNA, 21 nt, Homo sapiens
cacaggauuuguaauuccuua

SEQ ID NO: 2220356 - RNA, 18 nt, Homo sapiens
cagagacuggaggcauuu

SEQ ID NO: 2220357 - RNA, 21 nt, Homo sapiens
agcugggaccacaagugugca

SEQ ID NO: 2220358 - RNA, 22 nt, Homo sapiens
acccacuguggacuccaugccu

SEQ ID NO: 2220359 - RNA, 13 nt, Homo sapiens
gccugaacugagg

SEQ ID NO: 2220360 - RNA, 22 nt, Homo sapiens
uuucaaacugcugcauacuuug

SEQ ID NO: 2220361 - RNA, 22 nt, Homo sapiens
auucuguuagcugcucacuuaa

SEQ ID NO: 2220362 - RNA, 20 nt, Homo sapiens
gccgagcgccgaacucgcuc

SEQ ID NO: 2220363 - RNA, 15 nt, Homo sapiens
ucacauuuuaccaau

SEQ ID NO: 2220364 - RNA, 22 nt, Homo sapiens
agacucgauagugguggugaac

SEQ ID NO: 2220365 - RNA, 20 nt, Homo sapiens
ggaaacuugucacuugcaug

SEQ ID NO: 2220366 - RNA, 20 nt, Homo sapiens
aacuuccuucuuacuugcca

SEQ ID NO: 2220367 - RNA, 15 nt, Homo sapiens
acggaguuaauuuua

SEQ ID NO: 2220368 - RNA, 23 nt, Homo sapiens
auuaccuccauccauccuuccaa

SEQ ID NO: 2220369 - RNA, 11 nt, Homo sapiens
uuugugacuuu

SEQ ID NO: 2220370 - RNA, 16 nt, Homo sapiens
uugcagugagccauga

SEQ ID NO: 2220371 - RNA, 16 nt, Homo sapiens
ugaggagccucugauc

SEQ ID NO: 2220372 - RNA, 16 nt, Homo sapiens
gcagcagcugugacca

SEQ ID NO: 2220373 - RNA, 18 nt, Homo sapiens
cauccuaccccuuugcac

SEQ ID NO: 2220374 - RNA, 20 nt, Homo sapiens
augugugagaauaaacuaga

SEQ ID NO: 2220375 - RNA, 17 nt, Homo sapiens
ucacaucugcaguggag

SEQ ID NO: 2220376 - RNA, 12 nt, Homo sapiens
uccaaaggcagc

SEQ ID NO: 2220377 - RNA, 23 nt, Homo sapiens
ucacuacaaccuccaccuuccag

SEQ ID NO: 2220378 - RNA, 17 nt, Homo sapiens
gacaccauucauuccau

SEQ ID NO: 2220379 - RNA, 21 nt, Homo sapiens
ucacuuuuugaggcaaaagaa

SEQ ID NO: 2220380 - RNA, 17 nt, Homo sapiens
uugacauucuacaguug

SEQ ID NO: 2220381 - RNA, 19 nt, Homo sapiens
accuuaauuugaaauaaca

SEQ ID NO: 2220382 - RNA, 15 nt, Homo sapiens
acuccauccuccugu

SEQ ID NO: 2220383 - RNA, 15 nt, Homo sapiens
aauucuacuaaauau

SEQ ID NO: 2220384 - RNA, 20 nt, Homo sapiens
gauuccagguggcaucagug

SEQ ID NO: 2220385 - RNA, 12 nt, Homo sapiens
ggcccaaagccu

SEQ ID NO: 2220386 - RNA, 20 nt, Homo sapiens
uuccuuuuuaaccauuccaa

SEQ ID NO: 2220387 - RNA, 18 nt, Homo sapiens
uccugauggaacuaagga

SEQ ID NO: 2220388 - RNA, 17 nt, Homo sapiens
caccuuucccaccucuc

SEQ ID NO: 2220389 - RNA, 20 nt, Homo sapiens
aggccaucuggggcuccuuc

SEQ ID NO: 2220390 - RNA, 21 nt, Homo sapiens
uauugcucacccagugcccuc

SEQ ID NO: 2220391 - RNA, 13 nt, Homo sapiens
gacacaggccagc

SEQ ID NO: 2220392 - RNA, 19 nt, Homo sapiens
aaacuuuacucuaagucuc

SEQ ID NO: 2220393 - RNA, 19 nt, Homo sapiens
uguugcugcugcugcucau

SEQ ID NO: 2220394 - RNA, 18 nt, Homo sapiens
aaccuuaucuaagaacuu

SEQ ID NO: 2220395 - RNA, 15 nt, Homo sapiens
cccccaccuuuggga

SEQ ID NO: 2220396 - RNA, 17 nt, Homo sapiens
cagaggggcucagguca

SEQ ID NO: 2220397 - RNA, 23 nt, Homo sapiens
aucuauugcagagacucauuuca

SEQ ID NO: 2220398 - RNA, 18 nt, Homo sapiens
uagucaauccugucauau

SEQ ID NO: 2220399 - RNA, 17 nt, Homo sapiens
cagaaucaaaugcaauu

SEQ ID NO: 2220400 - RNA, 17 nt, Homo sapiens
auuuuucagcuccuuca

SEQ ID NO: 2220401 - RNA, 19 nt, Homo sapiens
cagcucacugcaaccucca

SEQ ID NO: 2220402 - RNA, 17 nt, Homo sapiens
ucacauugccuuaccua

SEQ ID NO: 2220403 - RNA, 13 nt, Homo sapiens
agcagguggcuug

SEQ ID NO: 2220404 - RNA, 14 nt, Homo sapiens
aaaugcaauuugau

SEQ ID NO: 2220405 - RNA, 18 nt, Homo sapiens
gacaucggccuccaugac

SEQ ID NO: 2220406 - RNA, 16 nt, Homo sapiens
ugaaccgcacagcuca

SEQ ID NO: 2220407 - RNA, 16 nt, Homo sapiens
aauugacuuccuccaa

SEQ ID NO: 2220408 - RNA, 17 nt, Homo sapiens
aggguaauugcugaggu

SEQ ID NO: 2220409 - RNA, 21 nt, Homo sapiens
cagcgagcuaugaucgcgcca

SEQ ID NO: 2220410 - RNA, 21 nt, Homo sapiens
cucaguuugucagacuuuaaa

SEQ ID NO: 2220411 - RNA, 20 nt, Homo sapiens
ugggccagccgauuccucca

SEQ ID NO: 2220412 - RNA, 15 nt, Homo sapiens
ucacaguuccucgcc

SEQ ID NO: 2220413 - RNA, 15 nt, Homo sapiens
augucggucuugcaa

SEQ ID NO: 2220414 - RNA, 13 nt, Homo sapiens
ucugcaaugacug

SEQ ID NO: 2220415 - RNA, 15 nt, Homo sapiens
gaggcuccucugaug

SEQ ID NO: 2220416 - RNA, 21 nt, Homo sapiens
caaucaaccaaaguuaguuca

SEQ ID NO: 2220417 - RNA, 12 nt, Homo sapiens
gcccaccaaagg

SEQ ID NO: 2220418 - RNA, 16 nt, Homo sapiens
cacugagccagucuuu

SEQ ID NO: 2220419 - RNA, 15 nt, Homo sapiens
ugccagcaucugcag

SEQ ID NO: 2220420 - RNA, 16 nt, Homo sapiens
guuggauguaguuuag

SEQ ID NO: 2220421 - RNA, 19 nt, Homo sapiens
gaggcaggcaaucacuuga

SEQ ID NO: 2220422 - RNA, 12 nt, Homo sapiens
ugagacagacua

SEQ ID NO: 2220423 - RNA, 17 nt, Homo sapiens
uucaguuuaaugucucc

SEQ ID NO: 2220424 - RNA, 18 nt, Homo sapiens
agaaaaggcggugcucag

SEQ ID NO: 2220425 - RNA, 15 nt, Homo sapiens
auucuucugccucag

SEQ ID NO: 2220426 - RNA, 17 nt, Homo sapiens
accccuuucuaguucaa

SEQ ID NO: 2220427 - RNA, 18 nt, Homo sapiens
uggcauuguugaugcuca

SEQ ID NO: 2220428 - RNA, 18 nt, Homo sapiens
cacuccuccuacuguauu

SEQ ID NO: 2220429 - RNA, 20 nt, Homo sapiens
cauguaucucaguaccccau

SEQ ID NO: 2220430 - RNA, 20 nt, Homo sapiens
acagaaaauuguugugcuua

SEQ ID NO: 2220431 - RNA, 16 nt, Homo sapiens
ugaguaaugguuacua

SEQ ID NO: 2220432 - RNA, 15 nt, Homo sapiens
uuacagaguucuggg

SEQ ID NO: 2220433 - RNA, 13 nt, Homo sapiens
uuucucuaaugcu

SEQ ID NO: 2220434 - RNA, 17 nt, Homo sapiens
uugaauagggguugagu

SEQ ID NO: 2220435 - RNA, 12 nt, Homo sapiens
ggucuaggccag

SEQ ID NO: 2220436 - RNA, 17 nt, Homo sapiens
uggauaaagccacugaa

SEQ ID NO: 2220437 - RNA, 14 nt, Homo sapiens
aguuaaaaagucaa

SEQ ID NO: 2220438 - RNA, 23 nt, Homo sapiens
cucguuuuaagaaacuagcagau

SEQ ID NO: 2220439 - RNA, 21 nt, Homo sapiens
uugcuaucuauaaaaaagaga

SEQ ID NO: 2220440 - RNA, 17 nt, Homo sapiens
gcugggcugggcaguau

SEQ ID NO: 2220441 - RNA, 17 nt, Homo sapiens
aagaccacacauuugug

SEQ ID NO: 2220442 - RNA, 19 nt, Homo sapiens
aaguuuggggacaugugau

SEQ ID NO: 2220443 - RNA, 16 nt, Homo sapiens
ccgccgccucacugca

SEQ ID NO: 2220444 - RNA, 14 nt, Homo sapiens
ugcugaagcugcug

SEQ ID NO: 2220445 - RNA, 13 nt, Homo sapiens
gaagaaaagaucu

SEQ ID NO: 2220446 - RNA, 15 nt, Homo sapiens
uuuauuucugauaag

SEQ ID NO: 2220447 - RNA, 21 nt, Homo sapiens
uuguauggagccucuucugcc

SEQ ID NO: 2220448 - RNA, 20 nt, Homo sapiens
caaagccccucacacugcaa

SEQ ID NO: 2220449 - RNA, 16 nt, Homo sapiens
gagaauccauccaaag

SEQ ID NO: 2220450 - RNA, 18 nt, Homo sapiens
aggaugagaaugugaccu

SEQ ID NO: 2220451 - RNA, 16 nt, Homo sapiens
ugugucuaagauucua

SEQ ID NO: 2220452 - RNA, 20 nt, Homo sapiens
ucauccuuugacugugcugg

SEQ ID NO: 2220453 - RNA, 18 nt, Homo sapiens
uaauuugcuggaacacaa

SEQ ID NO: 2220454 - RNA, 15 nt, Homo sapiens
ccucaguuaaaucuc

SEQ ID NO: 2220455 - RNA, 14 nt, Homo sapiens
ccugcccagacuga

SEQ ID NO: 2220456 - RNA, 23 nt, Homo sapiens
uggccucuugaguuccucugcag

SEQ ID NO: 2220457 - RNA, 20 nt, Homo sapiens
uggugacugccacauaauaa

SEQ ID NO: 2220458 - RNA, 16 nt, Homo sapiens
uaggaagaaaauguca

SEQ ID NO: 2220459 - RNA, 14 nt, Homo sapiens
uccuaguuugaccu

SEQ ID NO: 2220460 - RNA, 19 nt, Homo sapiens
aauuggccaugucgccaaa

SEQ ID NO: 2220461 - RNA, 23 nt, Homo sapiens
uggaguuucucucuuguugucca

SEQ ID NO: 2220462 - RNA, 21 nt, Homo sapiens
ugggagcuucucugcugcuua

SEQ ID NO: 2220463 - RNA, 23 nt, Homo sapiens
cuagaaagggcuaauuaggucuc

SEQ ID NO: 2220464 - RNA, 20 nt, Homo sapiens
ucuguuuuuaaacaucuuag

SEQ ID NO: 2220465 - RNA, 17 nt, Homo sapiens
gagcaguggcuggucca

SEQ ID NO: 2220466 - RNA, 17 nt, Homo sapiens
guacauuuaucacugaa

SEQ ID NO: 2220467 - RNA, 14 nt, Homo sapiens
aggauuauugucaa

SEQ ID NO: 2220468 - RNA, 22 nt, Homo sapiens
agggaauccugaccugagccag

SEQ ID NO: 2220469 - RNA, 20 nt, Homo sapiens
auguuuaucaccuuuauuga

SEQ ID NO: 2220470 - RNA, 15 nt, Homo sapiens
uuuuauuaacauuga

SEQ ID NO: 2220471 - RNA, 17 nt, Homo sapiens
gacuaguugaacaucuc

SEQ ID NO: 2220472 - RNA, 17 nt, Homo sapiens
cauuuauuuaucaauaa

SEQ ID NO: 2220473 - RNA, 18 nt, Homo sapiens
accuggggaugaagcuca

SEQ ID NO: 2220474 - RNA, 19 nt, Homo sapiens
ccucaggccaggugcagug

SEQ ID NO: 2220475 - RNA, 23 nt, Homo sapiens
gcucccucccccgcggugccuuc

SEQ ID NO: 2220476 - RNA, 21 nt, Homo sapiens
agucaccacuccauucccaac

SEQ ID NO: 2220477 - RNA, 15 nt, Homo sapiens
gcuccccagugcuac

SEQ ID NO: 2220478 - RNA, 15 nt, Homo sapiens
guaauuuugcaaaac

SEQ ID NO: 2220479 - RNA, 13 nt, Homo sapiens
caagugugugcac

SEQ ID NO: 2220480 - RNA, 13 nt, Homo sapiens
aaauugugaugcu

SEQ ID NO: 2220481 - RNA, 15 nt, Homo sapiens
cuaggaagugaaagg

SEQ ID NO: 2220482 - RNA, 22 nt, Homo sapiens
caaacuccuagguucacuuugg

SEQ ID NO: 2220483 - RNA, 23 nt, Homo sapiens
ugaagauguuucaaaaaaucuga

SEQ ID NO: 2220484 - RNA, 14 nt, Homo sapiens
caaagaaaguguau

SEQ ID NO: 2220485 - RNA, 17 nt, Homo sapiens
cacaggagcguguacua

SEQ ID NO: 2220486 - RNA, 13 nt, Homo sapiens
uagagcaguauau

SEQ ID NO: 2220487 - RNA, 19 nt, Homo sapiens
cauguauagcuagcuauuu

SEQ ID NO: 2220488 - RNA, 16 nt, Homo sapiens
aguacuaagggaacaa

SEQ ID NO: 2220489 - RNA, 19 nt, Homo sapiens
uaaucccagcuggccugua

SEQ ID NO: 2220490 - RNA, 17 nt, Homo sapiens
ccaagguuacucagcag

SEQ ID NO: 2220491 - RNA, 17 nt, Homo sapiens
cgggaagcgcucagaac

SEQ ID NO: 2220492 - RNA, 21 nt, Homo sapiens
aaaagaaaaaauauauacuca

SEQ ID NO: 2220493 - RNA, 15 nt, Homo sapiens
cagucaugacccuga

SEQ ID NO: 2220494 - RNA, 13 nt, Homo sapiens
aacugucaaccua

SEQ ID NO: 2220495 - RNA, 15 nt, Homo sapiens
uaaagaagaacuugc

SEQ ID NO: 2220496 - RNA, 21 nt, Homo sapiens
ucacaucuauccacacuguca

SEQ ID NO: 2220497 - RNA, 22 nt, Homo sapiens
auucaucuuuuaaucaugagcc

SEQ ID NO: 2220498 - RNA, 16 nt, Homo sapiens
gauggucucgaucucu

SEQ ID NO: 2220499 - RNA, 18 nt, Homo sapiens
aaccauaugaacauauau

SEQ ID NO: 2220500 - RNA, 14 nt, Homo sapiens
aauauuuucuacau

SEQ ID NO: 2220501 - RNA, 15 nt, Homo sapiens
ccuccaccugugaga

SEQ ID NO: 2220502 - RNA, 11 nt, Homo sapiens
ucaacauaugc

SEQ ID NO: 2220503 - RNA, 23 nt, Homo sapiens
aagcacucucgcacacacaguga

SEQ ID NO: 2220504 - RNA, 14 nt, Homo sapiens
ucaaaauugccuuu

SEQ ID NO: 2220505 - RNA, 14 nt, Homo sapiens
uuauuuuugucaaa

SEQ ID NO: 2220506 - RNA, 15 nt, Homo sapiens
guggccaugcuccuc

SEQ ID NO: 2220507 - RNA, 16 nt, Homo sapiens
agaacguauuuagcca

SEQ ID NO: 2220508 - RNA, 18 nt, Homo sapiens
auucaagaaagauaucua

SEQ ID NO: 2220509 - RNA, 18 nt, Homo sapiens
aaauagaaagaagccaua

SEQ ID NO: 2220510 - RNA, 16 nt, Homo sapiens
accugacaggccuucu

SEQ ID NO: 2220511 - RNA, 14 nt, Homo sapiens
cugccuccuguuuu

SEQ ID NO: 2220512 - RNA, 15 nt, Homo sapiens
ucacuaaagcaugaa

SEQ ID NO: 2220513 - RNA, 14 nt, Homo sapiens
gcuggcaccucuca

SEQ ID NO: 2220514 - RNA, 18 nt, Homo sapiens
agguauucgaaugaaaua

SEQ ID NO: 2220515 - RNA, 17 nt, Homo sapiens
cagggagugagcagcua

SEQ ID NO: 2220516 - RNA, 19 nt, Homo sapiens
agagguugcagugagccaa

SEQ ID NO: 2220517 - RNA, 19 nt, Homo sapiens
aagugaaaaaaacaaccua

SEQ ID NO: 2220518 - RNA, 16 nt, Homo sapiens
ucccuacuccuacccu

SEQ ID NO: 2220519 - RNA, 21 nt, Homo sapiens
ccaugacccaccccugugcuc

SEQ ID NO: 2220520 - RNA, 17 nt, Homo sapiens
uccugggcuaagugauc

SEQ ID NO: 2220521 - RNA, 18 nt, Homo sapiens
gugcagggauauugccuu

SEQ ID NO: 2220522 - RNA, 18 nt, Homo sapiens
aaggcagcucccagguuu

SEQ ID NO: 2220523 - RNA, 19 nt, Homo sapiens
aaauguuugcugagugagu

SEQ ID NO: 2220524 - RNA, 12 nt, Homo sapiens
uguaaugaucau

SEQ ID NO: 2220525 - RNA, 23 nt, Homo sapiens
ccuauacauuucuguucaucuua

SEQ ID NO: 2220526 - RNA, 16 nt, Homo sapiens
uuguuuuuuaagguga

SEQ ID NO: 2220527 - RNA, 23 nt, Homo sapiens
ccaacaauuggagggucuugagg

SEQ ID NO: 2220528 - RNA, 13 nt, Homo sapiens
ugggauuacaggc

SEQ ID NO: 2220529 - RNA, 19 nt, Homo sapiens
guaauuggcccaagucauu

SEQ ID NO: 2220530 - RNA, 15 nt, Homo sapiens
uggggccugugcacu

SEQ ID NO: 2220531 - RNA, 22 nt, Homo sapiens
cgucuguugugcgaaugacuga

SEQ ID NO: 2220532 - RNA, 20 nt, Homo sapiens
augugaaaaaugugucugua

SEQ ID NO: 2220533 - RNA, 15 nt, Homo sapiens
uaaauacacugugaa

SEQ ID NO: 2220534 - RNA, 15 nt, Homo sapiens
ccagagggcacucug

SEQ ID NO: 2220535 - RNA, 17 nt, Homo sapiens
agaaucugcagcuaacu

SEQ ID NO: 2220536 - RNA, 15 nt, Homo sapiens
cauuuucucuaauau

SEQ ID NO: 2220537 - RNA, 19 nt, Homo sapiens
uuauucaagguaaaauucu

SEQ ID NO: 2220538 - RNA, 16 nt, Homo sapiens
ugggaauugcgcucag

SEQ ID NO: 2220539 - RNA, 15 nt, Homo sapiens
agagauugugguggu

SEQ ID NO: 2220540 - RNA, 13 nt, Homo sapiens
caaaaacaucaac

SEQ ID NO: 2220541 - RNA, 22 nt, Homo sapiens
ggaacaaacagaaaugacugug

SEQ ID NO: 2220542 - RNA, 20 nt, Homo sapiens
cuuguuugucagcaucugac

SEQ ID NO: 2220543 - RNA, 15 nt, Homo sapiens
guauuucacagagca

SEQ ID NO: 2220544 - RNA, 16 nt, Homo sapiens
agacuucaccuaacua

SEQ ID NO: 2220545 - RNA, 14 nt, Homo sapiens
agauaaacuacaua

SEQ ID NO: 2220546 - RNA, 18 nt, Homo sapiens
cauuuucucccuuaggaa

SEQ ID NO: 2220547 - RNA, 21 nt, Homo sapiens
gcuucaggcccgaaggucucu

SEQ ID NO: 2220548 - RNA, 23 nt, Homo sapiens
agauagcaucagaccugcauuga

SEQ ID NO: 2220549 - RNA, 20 nt, Homo sapiens
caaaaucaugugacaauaau

SEQ ID NO: 2220550 - RNA, 13 nt, Homo sapiens
uccaggaguuuga

SEQ ID NO: 2220551 - RNA, 24 nt, Homo sapiens
ucauucagauuuguucuagauaau

SEQ ID NO: 2220552 - RNA, 16 nt, Homo sapiens
uccuaggaugucaugu

SEQ ID NO: 2220553 - RNA, 15 nt, Homo sapiens
cucugugucugcucu

SEQ ID NO: 2220554 - RNA, 17 nt, Homo sapiens
acgugccaccaugacug

SEQ ID NO: 2220555 - RNA, 19 nt, Homo sapiens
acccuauggaguacaugga

SEQ ID NO: 2220556 - RNA, 18 nt, Homo sapiens
uaaaugaaucuuacuccu

SEQ ID NO: 2220557 - RNA, 23 nt, Homo sapiens
ugagcgaugggcaucacacccuc

SEQ ID NO: 2220558 - RNA, 18 nt, Homo sapiens
ccucaccaacccagagaa

SEQ ID NO: 2220559 - RNA, 17 nt, Homo sapiens
aaucaugcucauguaua

SEQ ID NO: 2220560 - RNA, 19 nt, Homo sapiens
auuaaacaccugacacauc

SEQ ID NO: 2220561 - RNA, 14 nt, Homo sapiens
aguggcagccaugc

SEQ ID NO: 2220562 - RNA, 18 nt, Homo sapiens
ugggaaaacccaggguga

SEQ ID NO: 2220563 - RNA, 16 nt, Homo sapiens
ggggaccagcuuggcu

SEQ ID NO: 2220564 - RNA, 20 nt, Homo sapiens
aacucccaggucacaugcac

SEQ ID NO: 2220565 - RNA, 18 nt, Homo sapiens
gcuuauuaagaccaaaga

SEQ ID NO: 2220566 - RNA, 22 nt, Homo sapiens
guuguauaauuucgagauuugu

SEQ ID NO: 2220567 - RNA, 20 nt, Homo sapiens
aggacaggccacaccacagc

SEQ ID NO: 2220568 - RNA, 13 nt, Homo sapiens
uucaaugaaaugg

SEQ ID NO: 2220569 - RNA, 23 nt, Homo sapiens
uguuuucauuaaauuagcuauuu

SEQ ID NO: 2220570 - RNA, 18 nt, Homo sapiens
uggcccggaugcugcuuc

SEQ ID NO: 2220571 - RNA, 16 nt, Homo sapiens
cuggggucuccgaaga

SEQ ID NO: 2220572 - RNA, 23 nt, Homo sapiens
cccucuguggccugucucuauua

SEQ ID NO: 2220573 - RNA, 16 nt, Homo sapiens
aaaagaauacagaaag

SEQ ID NO: 2220574 - RNA, 14 nt, Homo sapiens
ggguguucagaggc

SEQ ID NO: 2220575 - RNA, 21 nt, Homo sapiens
cagccuggccaacauggugaa

SEQ ID NO: 2220576 - RNA, 14 nt, Homo sapiens
gagccugacugugu

SEQ ID NO: 2220577 - RNA, 18 nt, Homo sapiens
cucccuggggaugugcuu

SEQ ID NO: 2220578 - RNA, 21 nt, Homo sapiens
cuuuugagugccuuacacaau

SEQ ID NO: 2220579 - RNA, 21 nt, Homo sapiens
uugcauggauguuuuagccau

SEQ ID NO: 2220580 - RNA, 13 nt, Homo sapiens
gaucacugccaaa

SEQ ID NO: 2220581 - RNA, 21 nt, Homo sapiens
ggaagagagggcugagccaug

SEQ ID NO: 2220582 - RNA, 12 nt, Homo sapiens
accucaucugcc

SEQ ID NO: 2220583 - RNA, 12 nt, Homo sapiens
uccccaucagcu

SEQ ID NO: 2220584 - RNA, 16 nt, Homo sapiens
cucagcuggaucucca

SEQ ID NO: 2220585 - RNA, 21 nt, Homo sapiens
cugagucugugaauaaagcca

SEQ ID NO: 2220586 - RNA, 24 nt, Homo sapiens
aaguguauuuauuuuacagcucau

SEQ ID NO: 2220587 - RNA, 13 nt, Homo sapiens
gcuccccaaaagg

SEQ ID NO: 2220588 - RNA, 14 nt, Homo sapiens
uuauacaugugaua

SEQ ID NO: 2220589 - RNA, 20 nt, Homo sapiens
aaucucacacuucauccuau

SEQ ID NO: 2220590 - RNA, 17 nt, Homo sapiens
ugcuucccccacuucac

SEQ ID NO: 2220591 - RNA, 16 nt, Homo sapiens
guucuaacauguaauu

SEQ ID NO: 2220592 - RNA, 20 nt, Homo sapiens
gcccauggagauugaccugg

SEQ ID NO: 2220593 - RNA, 22 nt, Homo sapiens
cugaguugaagaggggagcuca

SEQ ID NO: 2220594 - RNA, 14 nt, Homo sapiens
gaccucaccugcug

SEQ ID NO: 2220595 - RNA, 20 nt, Homo sapiens
augcaguuaguauagcuuua

SEQ ID NO: 2220596 - RNA, 12 nt, Homo sapiens
acauaugacaau

SEQ ID NO: 2220597 - RNA, 22 nt, Homo sapiens
caucaggaguuccagugcugca

SEQ ID NO: 2220598 - RNA, 14 nt, Homo sapiens
caucacucuaggaa

SEQ ID NO: 2220599 - RNA, 15 nt, Homo sapiens
guguaccucauaucc

SEQ ID NO: 2220600 - RNA, 12 nt, Homo sapiens
cccuuccacggg

SEQ ID NO: 2220601 - RNA, 17 nt, Homo sapiens
cagccaaagauaaucuc

SEQ ID NO: 2220602 - RNA, 17 nt, Homo sapiens
agaaugugauauuugaa

SEQ ID NO: 2220603 - RNA, 23 nt, Homo sapiens
accuccaggcuuucccacuuccc

SEQ ID NO: 2220604 - RNA, 21 nt, Homo sapiens
uauucaagaaagccagucuua

SEQ ID NO: 2220605 - RNA, 16 nt, Homo sapiens
ucaagaggcugagaca

SEQ ID NO: 2220606 - RNA, 20 nt, Homo sapiens
gaccaaucaucaacuaccau

SEQ ID NO: 2220607 - RNA, 19 nt, Homo sapiens
aaagcucucaauuaagugu

SEQ ID NO: 2220608 - RNA, 12 nt, Homo sapiens
cacucacacugg

SEQ ID NO: 2220609 - RNA, 13 nt, Homo sapiens
cucacuucaggua

SEQ ID NO: 2220610 - RNA, 21 nt, Homo sapiens
aaaauuaccuguauaauggag

SEQ ID NO: 2220611 - RNA, 14 nt, Homo sapiens
cugcauacuaaccu

SEQ ID NO: 2220612 - RNA, 14 nt, Homo sapiens
gcccagccacugca

SEQ ID NO: 2220613 - RNA, 19 nt, Homo sapiens
agcccaugcucaaccacug

SEQ ID NO: 2220614 - RNA, 23 nt, Homo sapiens
gaccacacugcacacagugacuu

SEQ ID NO: 2220615 - RNA, 22 nt, Homo sapiens
cccuaucucuacuaaaaauaca

SEQ ID NO: 2220616 - RNA, 14 nt, Homo sapiens
uucagugccuuccu

SEQ ID NO: 2220617 - RNA, 19 nt, Homo sapiens
guacauuuuagugauuuga

SEQ ID NO: 2220618 - RNA, 13 nt, Homo sapiens
ccuccuaaggcuc

SEQ ID NO: 2220619 - RNA, 15 nt, Homo sapiens
uggauauugaugaaa

SEQ ID NO: 2220620 - RNA, 14 nt, Homo sapiens
aaaccuauauuuca

SEQ ID NO: 2220621 - RNA, 18 nt, Homo sapiens
acguucugcaaaacauuu

SEQ ID NO: 2220622 - RNA, 16 nt, Homo sapiens
cccacaacgugcaacu

SEQ ID NO: 2220623 - RNA, 17 nt, Homo sapiens
ccugaacaaagcaccuc

SEQ ID NO: 2220624 - RNA, 15 nt, Homo sapiens
aacuuacacugauca

SEQ ID NO: 2220625 - RNA, 12 nt, Homo sapiens
ccaccagaugag

SEQ ID NO: 2220626 - RNA, 17 nt, Homo sapiens
uccuguguguacucugu

SEQ ID NO: 2220627 - RNA, 18 nt, Homo sapiens
gucaccuaaguacuuaaa

SEQ ID NO: 2220628 - RNA, 21 nt, Homo sapiens
auagucauuccaaauaugaga

SEQ ID NO: 2220629 - RNA, 15 nt, Homo sapiens
cguguguacaugugc

SEQ ID NO: 2220630 - RNA, 22 nt, Homo sapiens
augggaacaccaaaauauucaa

SEQ ID NO: 2220631 - RNA, 22 nt, Homo sapiens
cuuagagaggacaauacugggg

SEQ ID NO: 2220632 - RNA, 23 nt, Homo sapiens
gcguuuggacccaguucagugag

SEQ ID NO: 2220633 - RNA, 12 nt, Homo sapiens
gccugcacacac

SEQ ID NO: 2220634 - RNA, 16 nt, Homo sapiens
cuccaggcugggugac

SEQ ID NO: 2220635 - RNA, 19 nt, Homo sapiens
cuagaacaugcacauuuau

SEQ ID NO: 2220636 - RNA, 15 nt, Homo sapiens
guuucacuaauacuu

SEQ ID NO: 2220637 - RNA, 19 nt, Homo sapiens
ugggauagcacguggagcu

SEQ ID NO: 2220638 - RNA, 14 nt, Homo sapiens
aggcuucuaccugc

SEQ ID NO: 2220639 - RNA, 11 nt, Homo sapiens
uuauuacauaa

SEQ ID NO: 2220640 - RNA, 16 nt, Homo sapiens
guuauaauuugcacaa

SEQ ID NO: 2220641 - RNA, 20 nt, Homo sapiens
acaugaauacgucuugauca

SEQ ID NO: 2220642 - RNA, 17 nt, Homo sapiens
ccaugggagaguccagg

SEQ ID NO: 2220643 - RNA, 20 nt, Homo sapiens
ccagagcaggagacuggcaa

SEQ ID NO: 2220644 - RNA, 17 nt, Homo sapiens
aggcauuaaaugcaaaa

SEQ ID NO: 2220645 - RNA, 18 nt, Homo sapiens
ucgggaguuugagaccag

SEQ ID NO: 2220646 - RNA, 16 nt, Homo sapiens
gcucagacuugccagg

SEQ ID NO: 2220647 - RNA, 14 nt, Homo sapiens
gcucuuuucaagaa

SEQ ID NO: 2220648 - RNA, 14 nt, Homo sapiens
cauguauugcacau

SEQ ID NO: 2220649 - RNA, 17 nt, Homo sapiens
aggauuuuugagcacaa

SEQ ID NO: 2220650 - RNA, 15 nt, Homo sapiens
cagagcucagaggag

SEQ ID NO: 2220651 - RNA, 16 nt, Homo sapiens
uuucaaucaaccaaag

SEQ ID NO: 2220652 - RNA, 14 nt, Homo sapiens
agcagaagcuguuu

SEQ ID NO: 2220653 - RNA, 13 nt, Homo sapiens
aagucauagccau

SEQ ID NO: 2220654 - RNA, 17 nt, Homo sapiens
ugauauaucaaacugaa

SEQ ID NO: 2220655 - RNA, 23 nt, Homo sapiens
aauaaaagauuguauagugcaug

SEQ ID NO: 2220656 - RNA, 14 nt, Homo sapiens
cacuguugccaaua

SEQ ID NO: 2220657 - RNA, 21 nt, Homo sapiens
uaauuucuauuguguuucaca

SEQ ID NO: 2220658 - RNA, 16 nt, Homo sapiens
aucugaucagaacaaa

SEQ ID NO: 2220659 - RNA, 18 nt, Homo sapiens
ggcaacagggccaugugc

SEQ ID NO: 2220660 - RNA, 19 nt, Homo sapiens
ucacaaacuuuuauacucu

SEQ ID NO: 2220661 - RNA, 22 nt, Homo sapiens
uccccuggggucucugcugcau

SEQ ID NO: 2220662 - RNA, 12 nt, Homo sapiens
uaaccauucuac

SEQ ID NO: 2220663 - RNA, 16 nt, Homo sapiens
cucagaggacaauaaa

SEQ ID NO: 2220664 - RNA, 15 nt, Homo sapiens
aagaaaauaaauguc

SEQ ID NO: 2220665 - RNA, 17 nt, Homo sapiens
uaauacuauauugcugu

SEQ ID NO: 2220666 - RNA, 22 nt, Homo sapiens
aaaagaauugucuuucugucuc

SEQ ID NO: 2220667 - RNA, 20 nt, Homo sapiens
cccuuucuguaccauuuauu

SEQ ID NO: 2220668 - RNA, 15 nt, Homo sapiens
aguuuacuggggaaa

SEQ ID NO: 2220669 - RNA, 22 nt, Homo sapiens
aaccccuuccagaucacugcca

SEQ ID NO: 2220670 - RNA, 17 nt, Homo sapiens
ggcauacucuccaggau

SEQ ID NO: 2220671 - RNA, 17 nt, Homo sapiens
cuguguuccuggcaaua

SEQ ID NO: 2220672 - RNA, 15 nt, Homo sapiens
gccccuccagcacca

SEQ ID NO: 2220673 - RNA, 20 nt, Homo sapiens
cuuacuagaaauauauucau

SEQ ID NO: 2220674 - RNA, 18 nt, Homo sapiens
aaaagcagcuauuugccu

SEQ ID NO: 2220675 - RNA, 14 nt, Homo sapiens
ccaaauaguuauuu

SEQ ID NO: 2220676 - RNA, 12 nt, Homo sapiens
ucaaacugcucc

SEQ ID NO: 2220677 - RNA, 21 nt, Homo sapiens
acuuccguccauccauucaga

SEQ ID NO: 2220678 - RNA, 21 nt, Homo sapiens
ugggaggcccugagacaggga

SEQ ID NO: 2220679 - RNA, 16 nt, Homo sapiens
auaaacaucugaguca

SEQ ID NO: 2220680 - RNA, 20 nt, Homo sapiens
ucuugugacccuccaugcca

SEQ ID NO: 2220681 - RNA, 19 nt, Homo sapiens
uuuaaguaaaaauccaaaa

SEQ ID NO: 2220682 - RNA, 14 nt, Homo sapiens
agaguaucacuccc

SEQ ID NO: 2220683 - RNA, 14 nt, Homo sapiens
aacaccagauucca

SEQ ID NO: 2220684 - RNA, 14 nt, Homo sapiens
gcuuucuuucacaa

SEQ ID NO: 2220685 - RNA, 19 nt, Homo sapiens
uccauuuuggugucuuucu

SEQ ID NO: 2220686 - RNA, 15 nt, Homo sapiens
ugaacagcggaugaa

SEQ ID NO: 2220687 - RNA, 18 nt, Homo sapiens
uuauuugcaggucuuuaa

SEQ ID NO: 2220688 - RNA, 19 nt, Homo sapiens
aguguggugggaggggugu

SEQ ID NO: 2220689 - RNA, 19 nt, Homo sapiens
uaagauaaucugucaguca

SEQ ID NO: 2220690 - RNA, 11 nt, Homo sapiens
uaagucucaac

SEQ ID NO: 2220691 - RNA, 11 nt, Homo sapiens
uuaauguaaua

SEQ ID NO: 2220692 - RNA, 15 nt, Homo sapiens
agagcagagguggaa

SEQ ID NO: 2220693 - RNA, 13 nt, Homo sapiens
cucuaguacugug

SEQ ID NO: 2220694 - RNA, 15 nt, Homo sapiens
ggagccccuggacau

SEQ ID NO: 2220695 - RNA, 17 nt, Homo sapiens
gaggccgggcgcagugg

SEQ ID NO: 2220696 - RNA, 16 nt, Homo sapiens
agccauaggugcaguu

SEQ ID NO: 2220697 - RNA, 14 nt, Homo sapiens
acaaagaguaucau

SEQ ID NO: 2220698 - RNA, 17 nt, Homo sapiens
cuuuuaacuucaccuua

SEQ ID NO: 2220699 - RNA, 20 nt, Homo sapiens
uucuguccgagcuuugaaaa

SEQ ID NO: 2220700 - RNA, 19 nt, Homo sapiens
ucaagaaacuuuguaaaau

SEQ ID NO: 2220701 - RNA, 16 nt, Homo sapiens
caguggcgugaucuca

SEQ ID NO: 2220702 - RNA, 12 nt, Homo sapiens
uagcuuugcucu

SEQ ID NO: 2220703 - RNA, 15 nt, Homo sapiens
uaugcuaagugaaau

SEQ ID NO: 2220704 - RNA, 17 nt, Homo sapiens
agagcccagaucaccca

SEQ ID NO: 2220705 - RNA, 18 nt, Homo sapiens
ugaagacgaagaagcaag

SEQ ID NO: 2220706 - RNA, 20 nt, Homo sapiens
cugcguucugauagaugggg

SEQ ID NO: 2220707 - RNA, 14 nt, Homo sapiens
ucggccccagcaca

SEQ ID NO: 2220708 - RNA, 19 nt, Homo sapiens
agccagucuuaacauuucu

SEQ ID NO: 2220709 - RNA, 19 nt, Homo sapiens
caggcuguuuuugggugca

SEQ ID NO: 2220710 - RNA, 21 nt, Homo sapiens
gucuuccuccuaaauuuccag

SEQ ID NO: 2220711 - RNA, 16 nt, Homo sapiens
gagauauuugguacca

SEQ ID NO: 2220712 - RNA, 15 nt, Homo sapiens
gucugucugcagugc

SEQ ID NO: 2220713 - RNA, 19 nt, Homo sapiens
cucuggaggucaucuggcg

SEQ ID NO: 2220714 - RNA, 14 nt, Homo sapiens
gcuaagcacuuuau

SEQ ID NO: 2220715 - RNA, 20 nt, Homo sapiens
ugccuggcgcuuccagcuga

SEQ ID NO: 2220716 - RNA, 21 nt, Homo sapiens
aacuucaccuacauuaucuca

SEQ ID NO: 2220717 - RNA, 21 nt, Homo sapiens
ucauucuacugaacaguccau

SEQ ID NO: 2220718 - RNA, 21 nt, Homo sapiens
ggaaccacagggccagaggga

SEQ ID NO: 2220719 - RNA, 16 nt, Homo sapiens
auucaggcacaugugu

SEQ ID NO: 2220720 - RNA, 12 nt, Homo sapiens
guuuuccauuug

SEQ ID NO: 2220721 - RNA, 19 nt, Homo sapiens
ggaaagguuugagaagcac

SEQ ID NO: 2220722 - RNA, 21 nt, Homo sapiens
cggaguucugcccaugggaag

SEQ ID NO: 2220723 - RNA, 16 nt, Homo sapiens
acuugguguacugggu

SEQ ID NO: 2220724 - RNA, 15 nt, Homo sapiens
cuagucagauggaug

SEQ ID NO: 2220725 - RNA, 18 nt, Homo sapiens
cuagaucuuacaucugca

SEQ ID NO: 2220726 - RNA, 17 nt, Homo sapiens
uagacuuccuguagggg

SEQ ID NO: 2220727 - RNA, 14 nt, Homo sapiens
guugcuuacagugu

SEQ ID NO: 2220728 - RNA, 15 nt, Homo sapiens
gccacucaaagucaa

SEQ ID NO: 2220729 - RNA, 22 nt, Homo sapiens
uaaguggcuuuuuguacuguag

SEQ ID NO: 2220730 - RNA, 16 nt, Homo sapiens
uacccuuuggggagca

SEQ ID NO: 2220731 - RNA, 19 nt, Homo sapiens
ggccaaaaagaaucugcau

SEQ ID NO: 2220732 - RNA, 19 nt, Homo sapiens
cuuuauacguguagcuaua

SEQ ID NO: 2220733 - RNA, 23 nt, Homo sapiens
gucuccggggaggcagggguccu

SEQ ID NO: 2220734 - RNA, 18 nt, Homo sapiens
uacuaacaaauguaaaau

SEQ ID NO: 2220735 - RNA, 16 nt, Homo sapiens
ggcuuguccugugcuu

SEQ ID NO: 2220736 - RNA, 12 nt, Homo sapiens
ccacaggccuua

SEQ ID NO: 2220737 - RNA, 13 nt, Homo sapiens
cugggcugaggca

SEQ ID NO: 2220738 - RNA, 20 nt, Homo sapiens
uccacuaagaacaccugcau

SEQ ID NO: 2220739 - RNA, 21 nt, Homo sapiens
uggcugcuuugccucuaccag

SEQ ID NO: 2220740 - RNA, 15 nt, Homo sapiens
aaaagggacugagaa

SEQ ID NO: 2220741 - RNA, 20 nt, Homo sapiens
ccacccuccuuucaccacau

SEQ ID NO: 2220742 - RNA, 11 nt, Homo sapiens
ugaacagcaga

SEQ ID NO: 2220743 - RNA, 12 nt, Homo sapiens
uuccaugcacuc

SEQ ID NO: 2220744 - RNA, 17 nt, Homo sapiens
guccagcgcucaggaau

SEQ ID NO: 2220745 - RNA, 17 nt, Homo sapiens
guguaaugaauaccuua

SEQ ID NO: 2220746 - RNA, 23 nt, Homo sapiens
uccauuuuuuucuuuacuuaucu

SEQ ID NO: 2220747 - RNA, 15 nt, Homo sapiens
guuucccuuccucca

SEQ ID NO: 2220748 - RNA, 22 nt, Homo sapiens
uaugacuaaagagagaauguag

SEQ ID NO: 2220749 - RNA, 13 nt, Homo sapiens
aguuagacucaaa

SEQ ID NO: 2220750 - RNA, 14 nt, Homo sapiens
cacacccaugcaca

SEQ ID NO: 2220751 - RNA, 15 nt, Homo sapiens
accuuaagacagagu

SEQ ID NO: 2220752 - RNA, 13 nt, Homo sapiens
ugccugacauuug

SEQ ID NO: 2220753 - RNA, 21 nt, Homo sapiens
gcauaaccccacccuuuacau

SEQ ID NO: 2220754 - RNA, 18 nt, Homo sapiens
uauuaaaaauguucucaa

SEQ ID NO: 2220755 - RNA, 15 nt, Homo sapiens
auucacccagaggga

SEQ ID NO: 2220756 - RNA, 23 nt, Homo sapiens
uuccccuuuuauuaauacauuca

SEQ ID NO: 2220757 - RNA, 22 nt, Homo sapiens
uuccauauauuggcacugcuaa

SEQ ID NO: 2220758 - RNA, 20 nt, Homo sapiens
gcuugaucaauucccuugaa

SEQ ID NO: 2220759 - RNA, 17 nt, Homo sapiens
agcccugaacauuucau

SEQ ID NO: 2220760 - RNA, 19 nt, Homo sapiens
cuuaccuugacuguugaug

SEQ ID NO: 2220761 - RNA, 22 nt, Homo sapiens
gguccucggcccuguagcccug

SEQ ID NO: 2220762 - RNA, 22 nt, Homo sapiens
uaaauaauugcuccuauacuau

SEQ ID NO: 2220763 - RNA, 17 nt, Homo sapiens
aguguagaucaacucau

SEQ ID NO: 2220764 - RNA, 18 nt, Homo sapiens
ucuugauugcggcuuuau

SEQ ID NO: 2220765 - RNA, 20 nt, Homo sapiens
ugcagaauuuuaugugacug

SEQ ID NO: 2220766 - RNA, 21 nt, Homo sapiens
acuacugccuuguacuuuuca

SEQ ID NO: 2220767 - RNA, 17 nt, Homo sapiens
ugcauuaucuugcucau

SEQ ID NO: 2220768 - RNA, 22 nt, Homo sapiens
gucauggccacacugugacaca

SEQ ID NO: 2220769 - RNA, 22 nt, Homo sapiens
aguucuuuaaaauguaaagcca

SEQ ID NO: 2220770 - RNA, 19 nt, Homo sapiens
gccuaguacaaucuuggga

SEQ ID NO: 2220771 - RNA, 16 nt, Homo sapiens
acuuugacuacaaaga

SEQ ID NO: 2220772 - RNA, 15 nt, Homo sapiens
gagaaagccugagaa

SEQ ID NO: 2220773 - RNA, 18 nt, Homo sapiens
cucacacgcugccuccuc

SEQ ID NO: 2220774 - RNA, 11 nt, Homo sapiens
accuugaacug

SEQ ID NO: 2220775 - RNA, 13 nt, Homo sapiens
cauguauacauau

SEQ ID NO: 2220776 - RNA, 14 nt, Homo sapiens
uccugaucugugau

SEQ ID NO: 2220777 - RNA, 20 nt, Homo sapiens
augaaaaggucagacugaaa

SEQ ID NO: 2220778 - RNA, 15 nt, Homo sapiens
ccuccauaugcugua

SEQ ID NO: 2220779 - RNA, 12 nt, Homo sapiens
uuacuacuuuaa

SEQ ID NO: 2220780 - RNA, 12 nt, Homo sapiens
cagcuacucaga

SEQ ID NO: 2220781 - RNA, 18 nt, Homo sapiens
ccaaaauauuuuuugcaa

SEQ ID NO: 2220782 - RNA, 23 nt, Homo sapiens
agcuugcucuucagugggagaaa

SEQ ID NO: 2220783 - RNA, 16 nt, Homo sapiens
agaagggacugagaga

SEQ ID NO: 2220784 - RNA, 20 nt, Homo sapiens
auccacuaacacuuuaguua

SEQ ID NO: 2220785 - RNA, 19 nt, Homo sapiens
uucacacuuccaccagccu

SEQ ID NO: 2220786 - RNA, 19 nt, Homo sapiens
ugacaauuuauguggauuu

SEQ ID NO: 2220787 - RNA, 16 nt, Homo sapiens
caaauggaaaacagga

SEQ ID NO: 2220788 - RNA, 20 nt, Homo sapiens
gaugcauuccugagucuucc

SEQ ID NO: 2220789 - RNA, 22 nt, Homo sapiens
auacaauguauguacaauacaa

SEQ ID NO: 2220790 - RNA, 21 nt, Homo sapiens
acugcaggguauggugagaaa

SEQ ID NO: 2220791 - RNA, 18 nt, Homo sapiens
ugaccacuugaggccuga

SEQ ID NO: 2220792 - RNA, 18 nt, Homo sapiens
ucaagaacaauaucgacu

SEQ ID NO: 2220793 - RNA, 17 nt, Homo sapiens
cguuaguucuacauuau

SEQ ID NO: 2220794 - RNA, 13 nt, Homo sapiens
aguuuacuaccug

SEQ ID NO: 2220795 - RNA, 16 nt, Homo sapiens
ucacccuuaacccaag

SEQ ID NO: 2220796 - RNA, 11 nt, Homo sapiens
cugagaccacg

SEQ ID NO: 2220797 - RNA, 17 nt, Homo sapiens
cagugcauagcgaagac

SEQ ID NO: 2220798 - RNA, 17 nt, Homo sapiens
acugcuggaaaucucaa

SEQ ID NO: 2220799 - RNA, 23 nt, Homo sapiens
cuguugccacacuuucacugggg

SEQ ID NO: 2220800 - RNA, 14 nt, Homo sapiens
aggagauguaagag

SEQ ID NO: 2220801 - RNA, 15 nt, Homo sapiens
uaagcuggagugcag

SEQ ID NO: 2220802 - RNA, 18 nt, Homo sapiens
cauggacuacaccagggu

SEQ ID NO: 2220803 - RNA, 16 nt, Homo sapiens
aacaugguaugaaggu

SEQ ID NO: 2220804 - RNA, 16 nt, Homo sapiens
gcuguccacaugaccu

SEQ ID NO: 2220805 - RNA, 23 nt, Homo sapiens
cugucugaucaggguggagggaa

SEQ ID NO: 2220806 - RNA, 23 nt, Homo sapiens
guaugaggucuaggaacauacuu

SEQ ID NO: 2220807 - RNA, 20 nt, Homo sapiens
cugaaacagccagaucucau

SEQ ID NO: 2220808 - RNA, 15 nt, Homo sapiens
ccaucuuugucaguu

SEQ ID NO: 2220809 - RNA, 16 nt, Homo sapiens
gaacaccuauugcacu

SEQ ID NO: 2220810 - RNA, 22 nt, Homo sapiens
ccagcugugggacaauuaucug

SEQ ID NO: 2220811 - RNA, 18 nt, Homo sapiens
uucacugaaggugauuca

SEQ ID NO: 2220812 - RNA, 15 nt, Homo sapiens
cacaugugccaguug

SEQ ID NO: 2220813 - RNA, 16 nt, Homo sapiens
augaauaauacauuga

SEQ ID NO: 2220814 - RNA, 20 nt, Homo sapiens
agagauauuuuccauuuuaa

SEQ ID NO: 2220815 - RNA, 13 nt, Homo sapiens
auugucaccuaac

SEQ ID NO: 2220816 - RNA, 13 nt, Homo sapiens
agaauucuuaaca

SEQ ID NO: 2220817 - RNA, 18 nt, Homo sapiens
agagcccgguacagggcc

SEQ ID NO: 2220818 - RNA, 21 nt, Homo sapiens
ugcaaaauggagagaauacaa

SEQ ID NO: 2220819 - RNA, 23 nt, Homo sapiens
ucuuccauauccgggugcucaau

SEQ ID NO: 2220820 - RNA, 23 nt, Homo sapiens
uuuuggggaguuguuaugccaug

SEQ ID NO: 2220821 - RNA, 20 nt, Homo sapiens
ugagaagccugaugacauca

SEQ ID NO: 2220822 - RNA, 14 nt, Homo sapiens
agugcaccaucuca

SEQ ID NO: 2220823 - RNA, 18 nt, Homo sapiens
auuucugggugaugaaaa

SEQ ID NO: 2220824 - RNA, 21 nt, Homo sapiens
aaugcucuuuugcacaaggaa

SEQ ID NO: 2220825 - RNA, 23 nt, Homo sapiens
uagacccucuauuuaccugcgaa

SEQ ID NO: 2220826 - RNA, 14 nt, Homo sapiens
aggcaauccuaccu

SEQ ID NO: 2220827 - RNA, 17 nt, Homo sapiens
aauggcauuugcaauaa

SEQ ID NO: 2220828 - RNA, 22 nt, Homo sapiens
gccaggaacuggcuccuuugcc

SEQ ID NO: 2220829 - RNA, 17 nt, Homo sapiens
ugaaguaccaccaaaaa

SEQ ID NO: 2220830 - RNA, 23 nt, Homo sapiens
ccucagaaaacaaggaugaauua

SEQ ID NO: 2220831 - RNA, 12 nt, Homo sapiens
aagaacuuggaa

SEQ ID NO: 2220832 - RNA, 12 nt, Homo sapiens
agggacuugaag

SEQ ID NO: 2220833 - RNA, 19 nt, Homo sapiens
caaggauggguccagaaga

SEQ ID NO: 2220834 - RNA, 19 nt, Homo sapiens
ucuuaauucccaaucccau

SEQ ID NO: 2220835 - RNA, 16 nt, Homo sapiens
uccugguagcaugacc

SEQ ID NO: 2220836 - RNA, 13 nt, Homo sapiens
cccaacugugaga

SEQ ID NO: 2220837 - RNA, 14 nt, Homo sapiens
ucaaaaugucucaa

SEQ ID NO: 2220838 - RNA, 17 nt, Homo sapiens
aggccuguguagcugug

SEQ ID NO: 2220839 - RNA, 17 nt, Homo sapiens
cucucccuagugccuuc

SEQ ID NO: 2220840 - RNA, 20 nt, Homo sapiens
caaaucauccugucacaagg

SEQ ID NO: 2220841 - RNA, 12 nt, Homo sapiens
cugcucucaugc

SEQ ID NO: 2220842 - RNA, 19 nt, Homo sapiens
augagaauuacagaaaauu

SEQ ID NO: 2220843 - RNA, 18 nt, Homo sapiens
guacagagaaauucugug

SEQ ID NO: 2220844 - RNA, 21 nt, Homo sapiens
caaguuccaugcuugagcaau

SEQ ID NO: 2220845 - RNA, 12 nt, Homo sapiens
uuccagcugcug

SEQ ID NO: 2220846 - RNA, 23 nt, Homo sapiens
auaaccagcugaaguugcagaug

SEQ ID NO: 2220847 - RNA, 18 nt, Homo sapiens
cagagugugcagacugau

SEQ ID NO: 2220848 - RNA, 16 nt, Homo sapiens
ugaagguuguggccuu

SEQ ID NO: 2220849 - RNA, 13 nt, Homo sapiens
uguugugugcaug

SEQ ID NO: 2220850 - RNA, 22 nt, Homo sapiens
gcaggggacaagggaggcagug

SEQ ID NO: 2220851 - RNA, 15 nt, Homo sapiens
uuaagcaucacauua

SEQ ID NO: 2220852 - RNA, 14 nt, Homo sapiens
ggccuuggggacaa

SEQ ID NO: 2220853 - RNA, 21 nt, Homo sapiens
agugagaaagaauaggggcug

SEQ ID NO: 2220854 - RNA, 18 nt, Homo sapiens
gucccgggcacugucaug

SEQ ID NO: 2220855 - RNA, 13 nt, Homo sapiens
cugggacagccac

SEQ ID NO: 2220856 - RNA, 15 nt, Homo sapiens
uggugcgaucuuggc

SEQ ID NO: 2220857 - RNA, 19 nt, Homo sapiens
uaagaaauccagcuucaua

SEQ ID NO: 2220858 - RNA, 17 nt, Homo sapiens
aacacguucauauucca

SEQ ID NO: 2220859 - RNA, 18 nt, Homo sapiens
cauaucaugguaaugaca

SEQ ID NO: 2220860 - RNA, 15 nt, Homo sapiens
cagcccugcaccaug

SEQ ID NO: 2220861 - RNA, 19 nt, Homo sapiens
ugaacuaaguuauuguuaa

SEQ ID NO: 2220862 - RNA, 14 nt, Homo sapiens
ugagaaaacuguga

SEQ ID NO: 2220863 - RNA, 12 nt, Homo sapiens
augacauguuau

SEQ ID NO: 2220864 - RNA, 14 nt, Homo sapiens
uagcccauguuaag

SEQ ID NO: 2220865 - RNA, 18 nt, Homo sapiens
cccuggccaccugccagg

SEQ ID NO: 2220866 - RNA, 12 nt, Homo sapiens
uugcauugacau

SEQ ID NO: 2220867 - RNA, 19 nt, Homo sapiens
uggacucgcuagugauuaa

SEQ ID NO: 2220868 - RNA, 22 nt, Homo sapiens
uuagauaaucgagucuaccucu

SEQ ID NO: 2220869 - RNA, 15 nt, Homo sapiens
aaucuuuaacugaac

SEQ ID NO: 2220870 - RNA, 13 nt, Homo sapiens
gauggcuaugccu

SEQ ID NO: 2220871 - RNA, 18 nt, Homo sapiens
gaaucaagcacacuguau

SEQ ID NO: 2220872 - RNA, 22 nt, Homo sapiens
uaagagaaacuuuauacauuag

SEQ ID NO: 2220873 - RNA, 16 nt, Homo sapiens
augugaguguguguga

SEQ ID NO: 2220874 - RNA, 17 nt, Homo sapiens
agaauauauugggcgaa

SEQ ID NO: 2220875 - RNA, 14 nt, Homo sapiens
aagcugcucaggga

SEQ ID NO: 2220876 - RNA, 14 nt, Homo sapiens
aggcaaaauaccag

SEQ ID NO: 2220877 - RNA, 22 nt, Homo sapiens
acugccucgggaaccucacucu

SEQ ID NO: 2220878 - RNA, 16 nt, Homo sapiens
cuugacaaucaucucc

SEQ ID NO: 2220879 - RNA, 15 nt, Homo sapiens
augcaacucuaacuc

SEQ ID NO: 2220880 - RNA, 22 nt, Homo sapiens
uauccaaaauucagggcuuuaa

SEQ ID NO: 2220881 - RNA, 17 nt, Homo sapiens
agaugcggaaagcccug

SEQ ID NO: 2220882 - RNA, 15 nt, Homo sapiens
uccuauucccuguca

SEQ ID NO: 2220883 - RNA, 18 nt, Homo sapiens
gcuggaaaccucaugcca

SEQ ID NO: 2220884 - RNA, 21 nt, Homo sapiens
cagaauuuguguaaaagugaa

SEQ ID NO: 2220885 - RNA, 15 nt, Homo sapiens
ccuggguauguguag

SEQ ID NO: 2220886 - RNA, 14 nt, Homo sapiens
auuacagaucugca

SEQ ID NO: 2220887 - RNA, 13 nt, Homo sapiens
agucauuggcaaa

SEQ ID NO: 2220888 - RNA, 13 nt, Homo sapiens
agaauuuggcucu

SEQ ID NO: 2220889 - RNA, 18 nt, Homo sapiens
cguuaagaauuguuaaag

SEQ ID NO: 2220890 - RNA, 15 nt, Homo sapiens
aaagcaaguugccug

SEQ ID NO: 2220891 - RNA, 23 nt, Homo sapiens
ccucaaaggagcaagccuugaaa

SEQ ID NO: 2220892 - RNA, 21 nt, Homo sapiens
aauuuggagcacaaaauucaa

SEQ ID NO: 2220893 - RNA, 21 nt, Homo sapiens
ucuacuaacaaucagcuccuu

SEQ ID NO: 2220894 - RNA, 12 nt, Homo sapiens
ccucuaaugaga

SEQ ID NO: 2220895 - RNA, 22 nt, Homo sapiens
uacaguaacaaauaaagugcag

SEQ ID NO: 2220896 - RNA, 17 nt, Homo sapiens
caccuaucaacagauca

SEQ ID NO: 2220897 - RNA, 13 nt, Homo sapiens
gucaaacuguaga

SEQ ID NO: 2220898 - RNA, 20 nt, Homo sapiens
augggaauugcgcucagggg

SEQ ID NO: 2220899 - RNA, 15 nt, Homo sapiens
cugcccagugcacac

SEQ ID NO: 2220900 - RNA, 21 nt, Homo sapiens
aacugugugcagacucaauaa

SEQ ID NO: 2220901 - RNA, 22 nt, Homo sapiens
aaguuuacuugucuuugauuau

SEQ ID NO: 2220902 - RNA, 14 nt, Homo sapiens
aagaugcagucucu

SEQ ID NO: 2220903 - RNA, 14 nt, Homo sapiens
caaagcagaauuuu

SEQ ID NO: 2220904 - RNA, 22 nt, Homo sapiens
cuugggacuuagaacaccgccg

SEQ ID NO: 2220905 - RNA, 16 nt, Homo sapiens
acaaauaaagucccag

SEQ ID NO: 2220906 - RNA, 16 nt, Homo sapiens
ggcauacagacugggg

SEQ ID NO: 2220907 - RNA, 21 nt, Homo sapiens
guuucauuuagucaugugacc

SEQ ID NO: 2220908 - RNA, 15 nt, Homo sapiens
uaacccaaaucuugu

SEQ ID NO: 2220909 - RNA, 18 nt, Homo sapiens
cccucuggcacuccagaa

SEQ ID NO: 2220910 - RNA, 21 nt, Homo sapiens
agcugauuccagaacaaauca

SEQ ID NO: 2220911 - RNA, 14 nt, Homo sapiens
uuccaugugccuuu

SEQ ID NO: 2220912 - RNA, 14 nt, Homo sapiens
gcuuuuguuuucau

SEQ ID NO: 2220913 - RNA, 23 nt, Homo sapiens
ggguaccuaguccccagccugcu

SEQ ID NO: 2220914 - RNA, 16 nt, Homo sapiens
ccgaucuccacuguug

SEQ ID NO: 2220915 - RNA, 16 nt, Homo sapiens
gaauaccacucuguaa

SEQ ID NO: 2220916 - RNA, 14 nt, Homo sapiens
aacacagccugugu

SEQ ID NO: 2220917 - RNA, 12 nt, Homo sapiens
ggucuucaagac

SEQ ID NO: 2220918 - RNA, 15 nt, Homo sapiens
uggccuuaacuggcc

SEQ ID NO: 2220919 - RNA, 19 nt, Homo sapiens
ggcaugaaggugucauaca

SEQ ID NO: 2220920 - RNA, 20 nt, Homo sapiens
auaaaauguuuuuaaacagu

SEQ ID NO: 2220921 - RNA, 17 nt, Homo sapiens
aauuaaagaugguuuau

SEQ ID NO: 2220922 - RNA, 23 nt, Homo sapiens
aaaccucaugccacccugcauuu

SEQ ID NO: 2220923 - RNA, 22 nt, Homo sapiens
uggagauaccagagacucugaa

SEQ ID NO: 2220924 - RNA, 23 nt, Homo sapiens
auuuucaucccguaucacagugu

SEQ ID NO: 2220925 - RNA, 19 nt, Homo sapiens
ugcuggcuuaaaauguaau

SEQ ID NO: 2220926 - RNA, 17 nt, Homo sapiens
gagaagauuuaugucag

SEQ ID NO: 2220927 - RNA, 14 nt, Homo sapiens
ugaaaggggaaaua

SEQ ID NO: 2220928 - RNA, 17 nt, Homo sapiens
aggcuuguugugcuuuu

SEQ ID NO: 2220929 - RNA, 22 nt, Homo sapiens
ggauuccuaagcagugcuugua

SEQ ID NO: 2220930 - RNA, 17 nt, Homo sapiens
gaggucuccucuagacu

SEQ ID NO: 2220931 - RNA, 17 nt, Homo sapiens
uuuccauuguagcucuu

SEQ ID NO: 2220932 - RNA, 16 nt, Homo sapiens
aauaugcaaaccagga

SEQ ID NO: 2220933 - RNA, 14 nt, Homo sapiens
gaagcugucuugga

SEQ ID NO: 2220934 - RNA, 21 nt, Homo sapiens
uuggaagcauucacaaaguag

SEQ ID NO: 2220935 - RNA, 14 nt, Homo sapiens
gaagccacugccuu

SEQ ID NO: 2220936 - RNA, 16 nt, Homo sapiens
aucccuauagaccacu

SEQ ID NO: 2220937 - RNA, 14 nt, Homo sapiens
agaaagcaugauau

SEQ ID NO: 2220938 - RNA, 18 nt, Homo sapiens
acauacgugcauacacau

SEQ ID NO: 2220939 - RNA, 15 nt, Homo sapiens
agaucuuugugccaa

SEQ ID NO: 2220940 - RNA, 18 nt, Homo sapiens
acauaguugaaauaucaa

SEQ ID NO: 2220941 - RNA, 16 nt, Homo sapiens
uggcagcagaauguuc

SEQ ID NO: 2220942 - RNA, 23 nt, Homo sapiens
ugaacucuccccuccccaucugu

SEQ ID NO: 2220943 - RNA, 12 nt, Homo sapiens
cccucggagccu

SEQ ID NO: 2220944 - RNA, 20 nt, Homo sapiens
auaauauuagugauucugau

SEQ ID NO: 2220945 - RNA, 17 nt, Homo sapiens
aaacaucccaauucuuu

SEQ ID NO: 2220946 - RNA, 16 nt, Homo sapiens
augauccccacgccac

SEQ ID NO: 2220947 - RNA, 16 nt, Homo sapiens
guucuuggaucugcca

SEQ ID NO: 2220948 - RNA, 10 nt, Homo sapiens
ugcagucucu

SEQ ID NO: 2220949 - RNA, 19 nt, Homo sapiens
gcuggcccgucauguuccu

SEQ ID NO: 2220950 - RNA, 15 nt, Homo sapiens
uaagacacucaaaua

SEQ ID NO: 2220951 - RNA, 22 nt, Homo sapiens
cauacgguaugauauugcagcu

SEQ ID NO: 2220952 - RNA, 20 nt, Homo sapiens
auaaaaagugacacagcagc

SEQ ID NO: 2220953 - RNA, 23 nt, Homo sapiens
auuaauuuggagcacaaaauuca

SEQ ID NO: 2220954 - RNA, 13 nt, Homo sapiens
agucauucuagga

SEQ ID NO: 2220955 - RNA, 21 nt, Homo sapiens
ugcauggcauuuguuccacag

SEQ ID NO: 2220956 - RNA, 20 nt, Homo sapiens
aauagcuccaagcuguuaaa

SEQ ID NO: 2220957 - RNA, 16 nt, Homo sapiens
gaaccaagggcccuca

SEQ ID NO: 2220958 - RNA, 16 nt, Homo sapiens
uugcgucucaaucucc

SEQ ID NO: 2220959 - RNA, 22 nt, Homo sapiens
cuugugagagcccauucccacc

SEQ ID NO: 2220960 - RNA, 15 nt, Homo sapiens
uuauacaccauaugc

SEQ ID NO: 2220961 - RNA, 19 nt, Homo sapiens
gccccaguuuggggugcca

SEQ ID NO: 2220962 - RNA, 17 nt, Homo sapiens
cuggugacccagcaucu

SEQ ID NO: 2220963 - RNA, 12 nt, Homo sapiens
cugagacugugc

SEQ ID NO: 2220964 - RNA, 21 nt, Homo sapiens
auaacccuaggaauuuagaca

SEQ ID NO: 2220965 - RNA, 22 nt, Homo sapiens
ucacagaaaguucuuaaacuca

SEQ ID NO: 2220966 - RNA, 16 nt, Homo sapiens
cugagcuagugauuug

SEQ ID NO: 2220967 - RNA, 15 nt, Homo sapiens
ucccacucuuugaau

SEQ ID NO: 2220968 - RNA, 21 nt, Homo sapiens
augaaucccacccacauguga

SEQ ID NO: 2220969 - RNA, 15 nt, Homo sapiens
cuucauagcccaaaa

SEQ ID NO: 2220970 - RNA, 16 nt, Homo sapiens
aauacuugagaaauuu

SEQ ID NO: 2220971 - RNA, 22 nt, Homo sapiens
uaauaauuggagaagauuuaug

SEQ ID NO: 2220972 - RNA, 18 nt, Homo sapiens
agacagacuugagaacuu

SEQ ID NO: 2220973 - RNA, 18 nt, Homo sapiens
cacuucuaaaugcauauc

SEQ ID NO: 2220974 - RNA, 19 nt, Homo sapiens
cagagcaagacccaucuca

SEQ ID NO: 2220975 - RNA, 17 nt, Homo sapiens
cagguuuguguuuucuu

SEQ ID NO: 2220976 - RNA, 17 nt, Homo sapiens
aaauuaccucucuugcu

SEQ ID NO: 2220977 - RNA, 15 nt, Homo sapiens
ucccaugccugagga

SEQ ID NO: 2220978 - RNA, 18 nt, Homo sapiens
uugaaaaauaaaaaccau

SEQ ID NO: 2220979 - RNA, 22 nt, Homo sapiens
ccagaagaaaauucuccugaua

SEQ ID NO: 2220980 - RNA, 22 nt, Homo sapiens
agucuugugccaaaccuacuag

SEQ ID NO: 2220981 - RNA, 14 nt, Homo sapiens
accaaaauguugcu

SEQ ID NO: 2220982 - RNA, 14 nt, Homo sapiens
gaggagauggccau

SEQ ID NO: 2220983 - RNA, 20 nt, Homo sapiens
agauguucccccaucucgcu

SEQ ID NO: 2220984 - RNA, 20 nt, Homo sapiens
ugggccucugcuucucucac

SEQ ID NO: 2220985 - RNA, 13 nt, Homo sapiens
caaccgguuauca

SEQ ID NO: 2220986 - RNA, 17 nt, Homo sapiens
acagccaauccaauuaa

SEQ ID NO: 2220987 - RNA, 21 nt, Homo sapiens
uugcauauaccaguugugaua

SEQ ID NO: 2220988 - RNA, 12 nt, Homo sapiens
agguagccauuu

SEQ ID NO: 2220989 - RNA, 21 nt, Homo sapiens
cuucaguggugagacuguauc

SEQ ID NO: 2220990 - RNA, 15 nt, Homo sapiens
uggcuaggggagcag

SEQ ID NO: 2220991 - RNA, 16 nt, Homo sapiens
aggcugcuguguagcu

SEQ ID NO: 2220992 - RNA, 15 nt, Homo sapiens
uuaaaagucuacagc

SEQ ID NO: 2220993 - RNA, 19 nt, Homo sapiens
ucgagacuuggguguuugu

SEQ ID NO: 2220994 - RNA, 18 nt, Homo sapiens
agccugggcaacauacca

SEQ ID NO: 2220995 - RNA, 16 nt, Homo sapiens
aaggagaaucauguuu

SEQ ID NO: 2220996 - RNA, 17 nt, Homo sapiens
cauuguuggaguguaaa

SEQ ID NO: 2220997 - RNA, 21 nt, Homo sapiens
ggaaugauaauggaaacuguc

SEQ ID NO: 2220998 - RNA, 14 nt, Homo sapiens
ucccaucugcauuu

SEQ ID NO: 2220999 - RNA, 14 nt, Homo sapiens
ggcuuucuugacau

SEQ ID NO: 2221000 - RNA, 22 nt, Homo sapiens
auggucccagcggaugcugcca

SEQ ID NO: 2221001 - RNA, 22 nt, Homo sapiens
gguaugguaaagagaugucaaa

SEQ ID NO: 2221002 - RNA, 12 nt, Homo sapiens
uauaccagcaga

SEQ ID NO: 2221003 - RNA, 16 nt, Homo sapiens
auaggcuuagugcuug

SEQ ID NO: 2221004 - RNA, 21 nt, Homo sapiens
gcaauuuagaacuagauuuug

SEQ ID NO: 2221005 - RNA, 20 nt, Homo sapiens
aaaggcaaaugcccaaggga

SEQ ID NO: 2221006 - RNA, 15 nt, Homo sapiens
auugugccccaugcu

SEQ ID NO: 2221007 - RNA, 13 nt, Homo sapiens
uaaauaugugaaa

SEQ ID NO: 2221008 - RNA, 17 nt, Homo sapiens
ucucacaaaaaggcaaa

SEQ ID NO: 2221009 - RNA, 14 nt, Homo sapiens
cuagucuccuuuga

SEQ ID NO: 2221010 - RNA, 15 nt, Homo sapiens
uuaacuaugacagau

SEQ ID NO: 2221011 - RNA, 16 nt, Homo sapiens
auacaauagcauugau

SEQ ID NO: 2221012 - RNA, 16 nt, Homo sapiens
ggaaaauauccauccu

SEQ ID NO: 2221013 - RNA, 22 nt, Homo sapiens
uccuggcccuggaaggugccac

SEQ ID NO: 2221014 - RNA, 19 nt, Homo sapiens
agcaaaauugauguguuua

SEQ ID NO: 2221015 - RNA, 21 nt, Homo sapiens
ucuccugugaugucccaguuu

SEQ ID NO: 2221016 - RNA, 19 nt, Homo sapiens
cuuggccaucuaaacauca

SEQ ID NO: 2221017 - RNA, 15 nt, Homo sapiens
cuaagauuuugugaa

SEQ ID NO: 2221018 - RNA, 14 nt, Homo sapiens
aucagaacaugagg

SEQ ID NO: 2221019 - RNA, 20 nt, Homo sapiens
augcaugugcugucuccaug

SEQ ID NO: 2221020 - RNA, 16 nt, Homo sapiens
auguaaaaagugcagu

SEQ ID NO: 2221021 - RNA, 21 nt, Homo sapiens
ugcuucaauuucaaacuuuug

SEQ ID NO: 2221022 - RNA, 16 nt, Homo sapiens
uucucuggcuggaaua

SEQ ID NO: 2221023 - RNA, 19 nt, Homo sapiens
agcaguguuuucaccucau

SEQ ID NO: 2221024 - RNA, 14 nt, Homo sapiens
gauuuuggcaaagc

SEQ ID NO: 2221025 - RNA, 11 nt, Homo sapiens
uuuaaccuuaa

SEQ ID NO: 2221026 - RNA, 14 nt, Homo sapiens
cauaccucugacca

SEQ ID NO: 2221027 - RNA, 20 nt, Homo sapiens
auauucaugcugccugccau

SEQ ID NO: 2221028 - RNA, 14 nt, Homo sapiens
gaguauccuaccca

SEQ ID NO: 2221029 - RNA, 21 nt, Homo sapiens
gaucaagccaguucuccuucc

SEQ ID NO: 2221030 - RNA, 14 nt, Homo sapiens
aaaauauauguaau

SEQ ID NO: 2221031 - RNA, 14 nt, Homo sapiens
cuucuggcucccaa

SEQ ID NO: 2221032 - RNA, 23 nt, Homo sapiens
gcaguuacucccuacacugaugc

SEQ ID NO: 2221033 - RNA, 15 nt, Homo sapiens
ugaaauaaaccccag

SEQ ID NO: 2221034 - RNA, 14 nt, Homo sapiens
aucaaaauguuguc

SEQ ID NO: 2221035 - RNA, 16 nt, Homo sapiens
ccucuggcucuacaca

SEQ ID NO: 2221036 - RNA, 16 nt, Homo sapiens
gcccagacaagauuuu

SEQ ID NO: 2221037 - RNA, 17 nt, Homo sapiens
auucuuuaaacuacuga

SEQ ID NO: 2221038 - RNA, 21 nt, Homo sapiens
acuacuuggaacuaggcucuu

SEQ ID NO: 2221039 - RNA, 18 nt, Homo sapiens
ccuuucccucuucccuga

SEQ ID NO: 2221040 - RNA, 22 nt, Homo sapiens
gugucuauucccuggaauucac

SEQ ID NO: 2221041 - RNA, 23 nt, Homo sapiens
uaggagacagucucaagcacuaa

SEQ ID NO: 2221042 - RNA, 19 nt, Homo sapiens
gcuggaguacagugacacg

SEQ ID NO: 2221043 - RNA, 15 nt, Homo sapiens
aguaaaaucacagau

SEQ ID NO: 2221044 - RNA, 16 nt, Homo sapiens
ugccaaaauaaaccug

SEQ ID NO: 2221045 - RNA, 20 nt, Homo sapiens
ucauaauaucaugugcacuu

SEQ ID NO: 2221046 - RNA, 15 nt, Homo sapiens
cuagucucaccagcc

SEQ ID NO: 2221047 - RNA, 19 nt, Homo sapiens
aaugucuugaugcaugcac

SEQ ID NO: 2221048 - RNA, 15 nt, Homo sapiens
gaacucagagccccu

SEQ ID NO: 2221049 - RNA, 18 nt, Homo sapiens
uccuuuuaggaauacugg

SEQ ID NO: 2221050 - RNA, 19 nt, Homo sapiens
uaugaaacuugaaaccgcc

SEQ ID NO: 2221051 - RNA, 18 nt, Homo sapiens
gcauuuagucuugccagg

SEQ ID NO: 2221052 - RNA, 14 nt, Homo sapiens
uuuagaacagggaa

SEQ ID NO: 2221053 - RNA, 14 nt, Homo sapiens
auaaacuauacacu

SEQ ID NO: 2221054 - RNA, 20 nt, Homo sapiens
cugaccaauauuguacaguu

SEQ ID NO: 2221055 - RNA, 18 nt, Homo sapiens
gcugcccuagcugacccc

SEQ ID NO: 2221056 - RNA, 22 nt, Homo sapiens
ggagccuguguuagugucuguc

SEQ ID NO: 2221057 - RNA, 19 nt, Homo sapiens
ugggcaaacccuggugcuu

SEQ ID NO: 2221058 - RNA, 20 nt, Homo sapiens
ggaugcccgcugccugcacu

SEQ ID NO: 2221059 - RNA, 14 nt, Homo sapiens
uguuuugcacugac

SEQ ID NO: 2221060 - RNA, 17 nt, Homo sapiens
cuccaacucuucggaau

SEQ ID NO: 2221061 - RNA, 21 nt, Homo sapiens
guucugccagguuuaagguca

SEQ ID NO: 2221062 - RNA, 13 nt, Homo sapiens
cuucacagaacac

SEQ ID NO: 2221063 - RNA, 16 nt, Homo sapiens
cuuauuaggggcuguu

SEQ ID NO: 2221064 - RNA, 20 nt, Homo sapiens
ucuauauaccaaagcacauu

SEQ ID NO: 2221065 - RNA, 19 nt, Homo sapiens
gucuauuugagacuuagaa

SEQ ID NO: 2221066 - RNA, 20 nt, Homo sapiens
gauuuaaaaaaagaacauaa

SEQ ID NO: 2221067 - RNA, 22 nt, Homo sapiens
uggagccaccaugcccagcuca

SEQ ID NO: 2221068 - RNA, 22 nt, Homo sapiens
auuugggauggaagcaggacag

SEQ ID NO: 2221069 - RNA, 13 nt, Homo sapiens
cuggauuccucga

SEQ ID NO: 2221070 - RNA, 18 nt, Homo sapiens
cauaauucuaagucuucc

SEQ ID NO: 2221071 - RNA, 15 nt, Homo sapiens
ucccccgccacuccu

SEQ ID NO: 2221072 - RNA, 23 nt, Homo sapiens
gcaugucgugaccaacuagacau

SEQ ID NO: 2221073 - RNA, 20 nt, Homo sapiens
gcaacugaauaaauaccucu

SEQ ID NO: 2221074 - RNA, 21 nt, Homo sapiens
agcaagcgcuguaaacccuga

SEQ ID NO: 2221075 - RNA, 20 nt, Homo sapiens
gugggccucaaggacuugaa

SEQ ID NO: 2221076 - RNA, 20 nt, Homo sapiens
cucuuaccgcgagacugaga

SEQ ID NO: 2221077 - RNA, 17 nt, Homo sapiens
ucugaggaugcauucga

SEQ ID NO: 2221078 - RNA, 15 nt, Homo sapiens
agccugcacggugaa

SEQ ID NO: 2221079 - RNA, 23 nt, Homo sapiens
cgccaucagggcaguggccaaga

SEQ ID NO: 2221080 - RNA, 22 nt, Homo sapiens
guauuuuuaguagagacagggu

SEQ ID NO: 2221081 - RNA, 19 nt, Homo sapiens
aaagcauuuucauuucacu

SEQ ID NO: 2221082 - RNA, 20 nt, Homo sapiens
uauauaguaaugcacucuca

SEQ ID NO: 2221083 - RNA, 18 nt, Homo sapiens
cuaauucuuguagaugca

SEQ ID NO: 2221084 - RNA, 17 nt, Homo sapiens
ccagacccgagucaauu

SEQ ID NO: 2221085 - RNA, 16 nt, Homo sapiens
ggccucagaccaacuc

SEQ ID NO: 2221086 - RNA, 15 nt, Homo sapiens
auccugcccaaaaug

SEQ ID NO: 2221087 - RNA, 18 nt, Homo sapiens
acagcccuuccuugggga

SEQ ID NO: 2221088 - RNA, 16 nt, Homo sapiens
cugggcuggcucccuc

SEQ ID NO: 2221089 - RNA, 20 nt, Homo sapiens
uggcugcaccuuuuugcaug

SEQ ID NO: 2221090 - RNA, 17 nt, Homo sapiens
gcuaagggugggugcuc

SEQ ID NO: 2221091 - RNA, 14 nt, Homo sapiens
gcucuauacugugg

SEQ ID NO: 2221092 - RNA, 13 nt, Homo sapiens
augcaugcugauu

SEQ ID NO: 2221093 - RNA, 23 nt, Homo sapiens
ucagaacccaggacagccacagc

SEQ ID NO: 2221094 - RNA, 16 nt, Homo sapiens
cgggcuucggaacacg

SEQ ID NO: 2221095 - RNA, 16 nt, Homo sapiens
aauugacccacaagaa

SEQ ID NO: 2221096 - RNA, 16 nt, Homo sapiens
agauuauuaagggaau

SEQ ID NO: 2221097 - RNA, 18 nt, Homo sapiens
ucacagugaagugccuuu

SEQ ID NO: 2221098 - RNA, 11 nt, Homo sapiens
uacacuggguu

SEQ ID NO: 2221099 - RNA, 21 nt, Homo sapiens
cagccuggucaacauggugaa

SEQ ID NO: 2221100 - RNA, 19 nt, Homo sapiens
ugugcaugcaaccagauaa

SEQ ID NO: 2221101 - RNA, 16 nt, Homo sapiens
aaugccugcauggaua

SEQ ID NO: 2221102 - RNA, 16 nt, Homo sapiens
ucagauaggagugaau

SEQ ID NO: 2221103 - RNA, 19 nt, Homo sapiens
aaggcaaugcucaccucuu

SEQ ID NO: 2221104 - RNA, 22 nt, Homo sapiens
ucuaguccuauucuauugcagu

SEQ ID NO: 2221105 - RNA, 17 nt, Homo sapiens
gcuucugggccacucag

SEQ ID NO: 2221106 - RNA, 14 nt, Homo sapiens
ucaaagcuccuuaa

SEQ ID NO: 2221107 - RNA, 13 nt, Homo sapiens
agccuaccucucc

SEQ ID NO: 2221108 - RNA, 20 nt, Homo sapiens
ucacccuugcaccguccuca

SEQ ID NO: 2221109 - RNA, 17 nt, Homo sapiens
ucuuucggaaaugauug

SEQ ID NO: 2221110 - RNA, 21 nt, Homo sapiens
uuaacucagaucacuacugca

SEQ ID NO: 2221111 - RNA, 19 nt, Homo sapiens
cagccugggugacagagca

SEQ ID NO: 2221112 - RNA, 19 nt, Homo sapiens
guaaggccuuucaauauua

SEQ ID NO: 2221113 - RNA, 22 nt, Homo sapiens
ccagcuauuuucugaccaaaau

SEQ ID NO: 2221114 - RNA, 21 nt, Homo sapiens
caagucuacuucacuaaugac

SEQ ID NO: 2221115 - RNA, 13 nt, Homo sapiens
gguucugcugagg

SEQ ID NO: 2221116 - RNA, 20 nt, Homo sapiens
aguucuucaucccacuccaa

SEQ ID NO: 2221117 - RNA, 16 nt, Homo sapiens
aaaaaugcagggugau

SEQ ID NO: 2221118 - RNA, 22 nt, Homo sapiens
ugccuuuuuguuuguacugguu

SEQ ID NO: 2221119 - RNA, 23 nt, Homo sapiens
uggaaaagugauguauuuucaua

SEQ ID NO: 2221120 - RNA, 15 nt, Homo sapiens
auacuugaacacugu

SEQ ID NO: 2221121 - RNA, 22 nt, Homo sapiens
aaauaucauaaucugaugauau

SEQ ID NO: 2221122 - RNA, 11 nt, Homo sapiens
gggcacgugug

SEQ ID NO: 2221123 - RNA, 14 nt, Homo sapiens
uauugguguuuacc

SEQ ID NO: 2221124 - RNA, 21 nt, Homo sapiens
ugugugcgagucugagucaga

SEQ ID NO: 2221125 - RNA, 16 nt, Homo sapiens
ucuauuuaacaacugg

SEQ ID NO: 2221126 - RNA, 17 nt, Homo sapiens
uucuguccaguuuccaa

SEQ ID NO: 2221127 - RNA, 15 nt, Homo sapiens
ggcuaugccaugugc

SEQ ID NO: 2221128 - RNA, 18 nt, Homo sapiens
uguggucauaucuaguca

SEQ ID NO: 2221129 - RNA, 13 nt, Homo sapiens
acuuuuuauucaa

SEQ ID NO: 2221130 - RNA, 13 nt, Homo sapiens
aaaacccagagag

SEQ ID NO: 2221131 - RNA, 21 nt, Homo sapiens
agagagcagcuuuaaacucag

SEQ ID NO: 2221132 - RNA, 12 nt, Homo sapiens
aagacuaagggg

SEQ ID NO: 2221133 - RNA, 12 nt, Homo sapiens
auaaaguaccau

SEQ ID NO: 2221134 - RNA, 21 nt, Homo sapiens
gcugagggaacauagacucac

SEQ ID NO: 2221135 - RNA, 19 nt, Homo sapiens
aauuauuuuuacaguucuc

SEQ ID NO: 2221136 - RNA, 14 nt, Homo sapiens
gcaagggugcugug

SEQ ID NO: 2221137 - RNA, 22 nt, Homo sapiens
aaugacucuggaaccauccucu

SEQ ID NO: 2221138 - RNA, 21 nt, Homo sapiens
cacccaguuggugacugggaa

SEQ ID NO: 2221139 - RNA, 15 nt, Homo sapiens
uucagcccucagaau

SEQ ID NO: 2221140 - RNA, 15 nt, Homo sapiens
gccugugcacuguug

SEQ ID NO: 2221141 - RNA, 12 nt, Homo sapiens
uaauccaugugc

SEQ ID NO: 2221142 - RNA, 14 nt, Homo sapiens
aaacauacccagug

SEQ ID NO: 2221143 - RNA, 22 nt, Homo sapiens
auaaggggccuugcucugagca

SEQ ID NO: 2221144 - RNA, 20 nt, Homo sapiens
uguucugcugggaguucuag

SEQ ID NO: 2221145 - RNA, 10 nt, Homo sapiens
ccugugagcu

SEQ ID NO: 2221146 - RNA, 23 nt, Homo sapiens
gaccuuauuaaagguaugcauuu

SEQ ID NO: 2221147 - RNA, 22 nt, Homo sapiens
gagcucaguuuucaacucuucc

SEQ ID NO: 2221148 - RNA, 14 nt, Homo sapiens
agagugcagaaagg

SEQ ID NO: 2221149 - RNA, 21 nt, Homo sapiens
ucagccucuucucugcacguu

SEQ ID NO: 2221150 - RNA, 22 nt, Homo sapiens
aaguugcaucagaaagcuuuau

SEQ ID NO: 2221151 - RNA, 13 nt, Homo sapiens
cacaucuuuucca

SEQ ID NO: 2221152 - RNA, 19 nt, Homo sapiens
uagaacacugccucugagu

SEQ ID NO: 2221153 - RNA, 14 nt, Homo sapiens
agcuuuacuacugu

SEQ ID NO: 2221154 - RNA, 17 nt, Homo sapiens
uucuuugcuagcacaau

SEQ ID NO: 2221155 - RNA, 22 nt, Homo sapiens
acucugaaaaacauuccaggaa

SEQ ID NO: 2221156 - RNA, 17 nt, Homo sapiens
augggcuaucaacuuaa

SEQ ID NO: 2221157 - RNA, 15 nt, Homo sapiens
ugcuaacugaacuuu

SEQ ID NO: 2221158 - RNA, 13 nt, Homo sapiens
ucacacacaugga

SEQ ID NO: 2221159 - RNA, 19 nt, Homo sapiens
aaacggccuauuggcuauu

SEQ ID NO: 2221160 - RNA, 19 nt, Homo sapiens
uucacaguaauaugguucc

SEQ ID NO: 2221161 - RNA, 19 nt, Homo sapiens
aaccugguggcaccagaug

SEQ ID NO: 2221162 - RNA, 17 nt, Homo sapiens
uacuaaauaugagacag

SEQ ID NO: 2221163 - RNA, 13 nt, Homo sapiens
ucacacagcuuaa

SEQ ID NO: 2221164 - RNA, 14 nt, Homo sapiens
gaaaauacuaccug

SEQ ID NO: 2221165 - RNA, 18 nt, Homo sapiens
cauugaaacaugccacuu

SEQ ID NO: 2221166 - RNA, 20 nt, Homo sapiens
agcauuuugcuaaaugugaa

SEQ ID NO: 2221167 - RNA, 18 nt, Homo sapiens
uugcuguaacucagacau

SEQ ID NO: 2221168 - RNA, 17 nt, Homo sapiens
cuugggcugacugccug

SEQ ID NO: 2221169 - RNA, 22 nt, Homo sapiens
uaccaguacguacauauuuuaa

SEQ ID NO: 2221170 - RNA, 13 nt, Homo sapiens
aauuuuguuaaca

SEQ ID NO: 2221171 - RNA, 18 nt, Homo sapiens
acaaccggucccuuccau

SEQ ID NO: 2221172 - RNA, 17 nt, Homo sapiens
ccugaugacauccaaua

SEQ ID NO: 2221173 - RNA, 17 nt, Homo sapiens
aucaggaugucccugaa

SEQ ID NO: 2221174 - RNA, 19 nt, Homo sapiens
ggagguggagcuugcagug

SEQ ID NO: 2221175 - RNA, 22 nt, Homo sapiens
ccaaugcuucuguugaucucag

SEQ ID NO: 2221176 - RNA, 15 nt, Homo sapiens
cuaaaaagauuagca

SEQ ID NO: 2221177 - RNA, 13 nt, Homo sapiens
ucuguacagauca

SEQ ID NO: 2221178 - RNA, 13 nt, Homo sapiens
gaugaacaucucu

SEQ ID NO: 2221179 - RNA, 21 nt, Homo sapiens
uucaaggaaaaaugcugcuuc

SEQ ID NO: 2221180 - RNA, 17 nt, Homo sapiens
caggaauguggcugcaa

SEQ ID NO: 2221181 - RNA, 20 nt, Homo sapiens
gagccaccagggcacugucu

SEQ ID NO: 2221182 - RNA, 15 nt, Homo sapiens
auuccucuugcauuu

SEQ ID NO: 2221183 - RNA, 14 nt, Homo sapiens
aucaggaguccacu

SEQ ID NO: 2221184 - RNA, 11 nt, Homo sapiens
cuucagccaag

SEQ ID NO: 2221185 - RNA, 18 nt, Homo sapiens
gaauuuuugcacauucua

SEQ ID NO: 2221186 - RNA, 18 nt, Homo sapiens
uauuuucccucucuugcc

SEQ ID NO: 2221187 - RNA, 15 nt, Homo sapiens
gugccccccuccucc

SEQ ID NO: 2221188 - RNA, 23 nt, Homo sapiens
auaacucuguaaaaacacugaaa

SEQ ID NO: 2221189 - RNA, 21 nt, Homo sapiens
gaguaccccccugagagcaug

SEQ ID NO: 2221190 - RNA, 22 nt, Homo sapiens
aggugugcaaacuuguaucuga

SEQ ID NO: 2221191 - RNA, 15 nt, Homo sapiens
uaaauuccacagauu

SEQ ID NO: 2221192 - RNA, 13 nt, Homo sapiens
cccagaaccacag

SEQ ID NO: 2221193 - RNA, 18 nt, Homo sapiens
cacagggugguggcacau

SEQ ID NO: 2221194 - RNA, 20 nt, Homo sapiens
cuacuugauauaauuacuua

SEQ ID NO: 2221195 - RNA, 16 nt, Homo sapiens
ccgagcuagagugcag

SEQ ID NO: 2221196 - RNA, 13 nt, Homo sapiens
caggaaucugauu

SEQ ID NO: 2221197 - RNA, 18 nt, Homo sapiens
ucaugcuugacauaccua

SEQ ID NO: 2221198 - RNA, 18 nt, Homo sapiens
uccuggcuuuacagacaa

SEQ ID NO: 2221199 - RNA, 14 nt, Homo sapiens
uucagaaauuccaa

SEQ ID NO: 2221200 - RNA, 13 nt, Homo sapiens
caggacugugcaa

SEQ ID NO: 2221201 - RNA, 23 nt, Homo sapiens
uaggagccugcuggucacagccu

SEQ ID NO: 2221202 - RNA, 22 nt, Homo sapiens
agcgcagguuuaguuuacucaa

SEQ ID NO: 2221203 - RNA, 17 nt, Homo sapiens
aaauguaugcuuuguac

SEQ ID NO: 2221204 - RNA, 18 nt, Homo sapiens
auaaaucauggaauuuau

SEQ ID NO: 2221205 - RNA, 17 nt, Homo sapiens
caccauguauucaucca

SEQ ID NO: 2221206 - RNA, 19 nt, Homo sapiens
cugaugccuugaggggugu

SEQ ID NO: 2221207 - RNA, 14 nt, Homo sapiens
caugggagguccug

SEQ ID NO: 2221208 - RNA, 23 nt, Homo sapiens
uauguaguaauugacaugugcca

SEQ ID NO: 2221209 - RNA, 14 nt, Homo sapiens
ucuuguacugugac

SEQ ID NO: 2221210 - RNA, 20 nt, Homo sapiens
uuucgccaaggcucacaugc

SEQ ID NO: 2221211 - RNA, 22 nt, Homo sapiens
gcuguggcccugccuggcuagu

SEQ ID NO: 2221212 - RNA, 14 nt, Homo sapiens
uccuuuaaacauac

SEQ ID NO: 2221213 - RNA, 19 nt, Homo sapiens
caacacuugcacaaucacg

SEQ ID NO: 2221214 - RNA, 19 nt, Homo sapiens
agcucaggcagcucgaggc

SEQ ID NO: 2221215 - RNA, 16 nt, Homo sapiens
guccacaacacacaga

SEQ ID NO: 2221216 - RNA, 18 nt, Homo sapiens
gauaaauucuuucuuuga

SEQ ID NO: 2221217 - RNA, 15 nt, Homo sapiens
uuagaaacacacuuu

SEQ ID NO: 2221218 - RNA, 12 nt, Homo sapiens
uuacacaauggu

SEQ ID NO: 2221219 - RNA, 21 nt, Homo sapiens
auacacuuuuuaaaaucucaa

SEQ ID NO: 2221220 - RNA, 19 nt, Homo sapiens
aacugaaugccacucugua

SEQ ID NO: 2221221 - RNA, 23 nt, Homo sapiens
gcagaaucccccaaagaaccagg

SEQ ID NO: 2221222 - RNA, 19 nt, Homo sapiens
ucuuaaaccacagcacuau

SEQ ID NO: 2221223 - RNA, 20 nt, Homo sapiens
uauacagauucgaaacucca

SEQ ID NO: 2221224 - RNA, 16 nt, Homo sapiens
ugcaaccuccaucucc

SEQ ID NO: 2221225 - RNA, 18 nt, Homo sapiens
uaauuaaaggagaagauu

SEQ ID NO: 2221226 - RNA, 21 nt, Homo sapiens
ucccaucaauucuuagaauau

SEQ ID NO: 2221227 - RNA, 14 nt, Homo sapiens
gccugcugcugcca

SEQ ID NO: 2221228 - RNA, 16 nt, Homo sapiens
auauaaccucaaacaa

SEQ ID NO: 2221229 - RNA, 18 nt, Homo sapiens
cccacugcccacuggccg

SEQ ID NO: 2221230 - RNA, 20 nt, Homo sapiens
ucuuaaccaguuucuauccc

SEQ ID NO: 2221231 - RNA, 15 nt, Homo sapiens
ccagacagcugcuca

SEQ ID NO: 2221232 - RNA, 15 nt, Homo sapiens
caaacucucccuuca

SEQ ID NO: 2221233 - RNA, 23 nt, Homo sapiens
ggcaacacuuuagcuugggucca

SEQ ID NO: 2221234 - RNA, 12 nt, Homo sapiens
ggcccuugccca

SEQ ID NO: 2221235 - RNA, 19 nt, Homo sapiens
ugcucuggagccugcagau

SEQ ID NO: 2221236 - RNA, 16 nt, Homo sapiens
uaaaugcaccaagaaa

SEQ ID NO: 2221237 - RNA, 16 nt, Homo sapiens
ggaaauuaaaacucau

SEQ ID NO: 2221238 - RNA, 11 nt, Homo sapiens
agucauugcag

SEQ ID NO: 2221239 - RNA, 15 nt, Homo sapiens
cuauaaucacuuggg

SEQ ID NO: 2221240 - RNA, 19 nt, Homo sapiens
gagucaggaaaacuacagg

SEQ ID NO: 2221241 - RNA, 14 nt, Homo sapiens
aaacagcugguacu

SEQ ID NO: 2221242 - RNA, 16 nt, Homo sapiens
ugaugcaagccagcuu

SEQ ID NO: 2221243 - RNA, 16 nt, Homo sapiens
uccauuugcaaauaua

SEQ ID NO: 2221244 - RNA, 21 nt, Homo sapiens
uauuggagccccaggggacaa

SEQ ID NO: 2221245 - RNA, 17 nt, Homo sapiens
ucuguguguguggcgug

SEQ ID NO: 2221246 - RNA, 19 nt, Homo sapiens
uggagagucagaucuuucu

SEQ ID NO: 2221247 - RNA, 21 nt, Homo sapiens
uccagcauugcuggacucuga

SEQ ID NO: 2221248 - RNA, 16 nt, Homo sapiens
uaccuaacauuauuua

SEQ ID NO: 2221249 - RNA, 17 nt, Homo sapiens
caaacagccacacugug

SEQ ID NO: 2221250 - RNA, 16 nt, Homo sapiens
auaacauccagagcuu

SEQ ID NO: 2221251 - RNA, 20 nt, Homo sapiens
ucagagacuauuuagacaaa

SEQ ID NO: 2221252 - RNA, 18 nt, Homo sapiens
uucagaguuuuacuaaga

SEQ ID NO: 2221253 - RNA, 16 nt, Homo sapiens
auauuugucauaugcu

SEQ ID NO: 2221254 - RNA, 19 nt, Homo sapiens
ugcuuaggaugugugcaug

SEQ ID NO: 2221255 - RNA, 19 nt, Homo sapiens
ggaaaguagaaauuuacca

SEQ ID NO: 2221256 - RNA, 15 nt, Homo sapiens
acuauauuaguaugu

SEQ ID NO: 2221257 - RNA, 18 nt, Homo sapiens
gucucacuuuuauugaua

SEQ ID NO: 2221258 - RNA, 15 nt, Homo sapiens
ucugagcuagugauu

SEQ ID NO: 2221259 - RNA, 17 nt, Homo sapiens
gcuucuggaaacuacca

SEQ ID NO: 2221260 - RNA, 17 nt, Homo sapiens
aguaauuuucuucucau

SEQ ID NO: 2221261 - RNA, 18 nt, Homo sapiens
ggccagaggaucaccagu

SEQ ID NO: 2221262 - RNA, 18 nt, Homo sapiens
aucaccccgugaagcaau

SEQ ID NO: 2221263 - RNA, 16 nt, Homo sapiens
caggggccugcagaag

SEQ ID NO: 2221264 - RNA, 21 nt, Homo sapiens
agccucucuuccuaucccauc

SEQ ID NO: 2221265 - RNA, 20 nt, Homo sapiens
aucagagaaggaacauaccc

SEQ ID NO: 2221266 - RNA, 18 nt, Homo sapiens
ugacaggucauccuugcc

SEQ ID NO: 2221267 - RNA, 21 nt, Homo sapiens
gcauauguguaaagauuuaua

SEQ ID NO: 2221268 - RNA, 14 nt, Homo sapiens
uauuuccaccuccu

SEQ ID NO: 2221269 - RNA, 20 nt, Homo sapiens
auccgguggccuauuccagg

SEQ ID NO: 2221270 - RNA, 20 nt, Homo sapiens
cccaggccaccucagucuca

SEQ ID NO: 2221271 - RNA, 11 nt, Homo sapiens
cuacuucucac

SEQ ID NO: 2221272 - RNA, 19 nt, Homo sapiens
aauggaaugaaauaauuca

SEQ ID NO: 2221273 - RNA, 20 nt, Homo sapiens
acaaaagaagugugacuaga

SEQ ID NO: 2221274 - RNA, 17 nt, Homo sapiens
gacaacuguggacucca

SEQ ID NO: 2221275 - RNA, 18 nt, Homo sapiens
guguccuccccucaagga

SEQ ID NO: 2221276 - RNA, 13 nt, Homo sapiens
ucuuaacuugaag

SEQ ID NO: 2221277 - RNA, 23 nt, Homo sapiens
agcauuccuucuuugauaauguu

SEQ ID NO: 2221278 - RNA, 17 nt, Homo sapiens
ucuccaacaucccuuau

SEQ ID NO: 2221279 - RNA, 15 nt, Homo sapiens
aauuuuaaguuauuu

SEQ ID NO: 2221280 - RNA, 15 nt, Homo sapiens
auccgccuaccucag

SEQ ID NO: 2221281 - RNA, 17 nt, Homo sapiens
ugcuaggugucugggau

SEQ ID NO: 2221282 - RNA, 19 nt, Homo sapiens
gaaaccuacaggaaucucu

SEQ ID NO: 2221283 - RNA, 18 nt, Homo sapiens
cuaccaaagugugguuug

SEQ ID NO: 2221284 - RNA, 20 nt, Homo sapiens
aguuaagaaugucgauuaaa

SEQ ID NO: 2221285 - RNA, 18 nt, Homo sapiens
caugccgggcgcaguggc

SEQ ID NO: 2221286 - RNA, 17 nt, Homo sapiens
uguuuacuuuuuggcug

SEQ ID NO: 2221287 - RNA, 17 nt, Homo sapiens
gagauugagcuacuuca

SEQ ID NO: 2221288 - RNA, 19 nt, Homo sapiens
ggaucacuuaagcccagga

SEQ ID NO: 2221289 - RNA, 19 nt, Homo sapiens
aaacacccucacacuggga

SEQ ID NO: 2221290 - RNA, 15 nt, Homo sapiens
uucucucagauuucc

SEQ ID NO: 2221291 - RNA, 13 nt, Homo sapiens
guggagguugcug

SEQ ID NO: 2221292 - RNA, 14 nt, Homo sapiens
cauuaaugcacauc

SEQ ID NO: 2221293 - RNA, 16 nt, Homo sapiens
auuuuuuuaaaacaca

SEQ ID NO: 2221294 - RNA, 24 nt, Homo sapiens
ugcuaauuaaaaaguuaaucuuca

SEQ ID NO: 2221295 - RNA, 18 nt, Homo sapiens
agugcaaaguuauucccc

SEQ ID NO: 2221296 - RNA, 19 nt, Homo sapiens
caaaaugggccucauggaa

SEQ ID NO: 2221297 - RNA, 21 nt, Homo sapiens
aaggauuuuggaacucuggag

SEQ ID NO: 2221298 - RNA, 19 nt, Homo sapiens
ugucucccagcucagggcu

SEQ ID NO: 2221299 - RNA, 17 nt, Homo sapiens
aucgugccacugcacuc

SEQ ID NO: 2221300 - RNA, 23 nt, Homo sapiens
aagacauuuuuugcuauaaucau

SEQ ID NO: 2221301 - RNA, 17 nt, Homo sapiens
acaucacuacaguacag

SEQ ID NO: 2221302 - RNA, 22 nt, Homo sapiens
acuuccuugguuuggacacagu

SEQ ID NO: 2221303 - RNA, 16 nt, Homo sapiens
uauucaagcaacagca

SEQ ID NO: 2221304 - RNA, 14 nt, Homo sapiens
gaaaagccagucaa

SEQ ID NO: 2221305 - RNA, 17 nt, Homo sapiens
aauucccaccacuaaaa

SEQ ID NO: 2221306 - RNA, 17 nt, Homo sapiens
ccugcuguguuccccaa

SEQ ID NO: 2221307 - RNA, 23 nt, Homo sapiens
agaauuuuaguguuaaugacucu

SEQ ID NO: 2221308 - RNA, 20 nt, Homo sapiens
gucucauaugauugugcaca

SEQ ID NO: 2221309 - RNA, 22 nt, Homo sapiens
ggcagcugcuauccccaucucc

SEQ ID NO: 2221310 - RNA, 12 nt, Homo sapiens
cuaucacugucu

SEQ ID NO: 2221311 - RNA, 13 nt, Homo sapiens
agaaauccuggga

SEQ ID NO: 2221312 - RNA, 17 nt, Homo sapiens
aaucagugccugguguu

SEQ ID NO: 2221313 - RNA, 21 nt, Homo sapiens
ccuguuccugacuuaaaacaa

SEQ ID NO: 2221314 - RNA, 21 nt, Homo sapiens
acuguaaagcuuugugcagau

SEQ ID NO: 2221315 - RNA, 16 nt, Homo sapiens
ugauuuaugaucacuu

SEQ ID NO: 2221316 - RNA, 13 nt, Homo sapiens
agaauuuuccuaa

SEQ ID NO: 2221317 - RNA, 21 nt, Homo sapiens
cugagaagcaguauaagccuu

SEQ ID NO: 2221318 - RNA, 12 nt, Homo sapiens
aucagcacaaag

SEQ ID NO: 2221319 - RNA, 18 nt, Homo sapiens
gauucugucuuauagggu

SEQ ID NO: 2221320 - RNA, 14 nt, Homo sapiens
aaugaaugcccaaa

SEQ ID NO: 2221321 - RNA, 23 nt, Homo sapiens
cuguuccccaaggacucuuccac

SEQ ID NO: 2221322 - RNA, 17 nt, Homo sapiens
augaacccaagagcaag

SEQ ID NO: 2221323 - RNA, 15 nt, Homo sapiens
aggcccccacuucuc

SEQ ID NO: 2221324 - RNA, 11 nt, Homo sapiens
acccugucaag

SEQ ID NO: 2221325 - RNA, 20 nt, Homo sapiens
gcaucuagauuauggagcuu

SEQ ID NO: 2221326 - RNA, 17 nt, Homo sapiens
aaauaugccuaguaaca

SEQ ID NO: 2221327 - RNA, 23 nt, Homo sapiens
uuaugaaauaaagaaauugcaau

SEQ ID NO: 2221328 - RNA, 16 nt, Homo sapiens
uucuaaguguggguuu

SEQ ID NO: 2221329 - RNA, 14 nt, Homo sapiens
aagccagacaucaa

SEQ ID NO: 2221330 - RNA, 17 nt, Homo sapiens
ucucagcaaggaacauc

SEQ ID NO: 2221331 - RNA, 14 nt, Homo sapiens
cuuaacaguuguau

SEQ ID NO: 2221332 - RNA, 15 nt, Homo sapiens
aguggcuucucccaa

SEQ ID NO: 2221333 - RNA, 16 nt, Homo sapiens
aaauauuauugguguu

SEQ ID NO: 2221334 - RNA, 20 nt, Homo sapiens
uguaugcuggugaacaguca

SEQ ID NO: 2221335 - RNA, 13 nt, Homo sapiens
cccacucugccag

SEQ ID NO: 2221336 - RNA, 23 nt, Homo sapiens
cucccacgugcacagcuuccuga

SEQ ID NO: 2221337 - RNA, 18 nt, Homo sapiens
cagcugcccuggcuguga

SEQ ID NO: 2221338 - RNA, 14 nt, Homo sapiens
gucauagcauucac

SEQ ID NO: 2221339 - RNA, 22 nt, Homo sapiens
uuucauaaaaacacucaacaaa

SEQ ID NO: 2221340 - RNA, 21 nt, Homo sapiens
gggcacgguggcucaugccug

SEQ ID NO: 2221341 - RNA, 17 nt, Homo sapiens
uguuucaggaggcugga

SEQ ID NO: 2221342 - RNA, 15 nt, Homo sapiens
ucuagcauagcacaa

SEQ ID NO: 2221343 - RNA, 19 nt, Homo sapiens
uuagacuucugcuuuccac

SEQ ID NO: 2221344 - RNA, 17 nt, Homo sapiens
uauucauuucauagcca

SEQ ID NO: 2221345 - RNA, 13 nt, Homo sapiens
ugaaggacacucu

SEQ ID NO: 2221346 - RNA, 16 nt, Homo sapiens
aaucaagagugaguga

SEQ ID NO: 2221347 - RNA, 15 nt, Homo sapiens
acaccaaugcgcaca

SEQ ID NO: 2221348 - RNA, 14 nt, Homo sapiens
ucuguugaucucag

SEQ ID NO: 2221349 - RNA, 12 nt, Homo sapiens
cugcucucagga

SEQ ID NO: 2221350 - RNA, 14 nt, Homo sapiens
agggccucagucug

SEQ ID NO: 2221351 - RNA, 20 nt, Homo sapiens
ugauacuuacugaacugugu

SEQ ID NO: 2221352 - RNA, 15 nt, Homo sapiens
ugacagcuucuacuu

SEQ ID NO: 2221353 - RNA, 23 nt, Homo sapiens
ggauuuaauacguacuuuagcug

SEQ ID NO: 2221354 - RNA, 20 nt, Homo sapiens
cauaagccuccauuuaguuc

SEQ ID NO: 2221355 - RNA, 15 nt, Homo sapiens
uuacagcaagagcca

SEQ ID NO: 2221356 - RNA, 15 nt, Homo sapiens
cagaguuuccaaaac

SEQ ID NO: 2221357 - RNA, 22 nt, Homo sapiens
uauggaaugauuuugguggaaa

SEQ ID NO: 2221358 - RNA, 17 nt, Homo sapiens
cauauaaacacaguaag

SEQ ID NO: 2221359 - RNA, 13 nt, Homo sapiens
aaguaauauauca

SEQ ID NO: 2221360 - RNA, 21 nt, Homo sapiens
cauuuacaggucuucucucca

SEQ ID NO: 2221361 - RNA, 14 nt, Homo sapiens
aggaaaauugcacu

SEQ ID NO: 2221362 - RNA, 18 nt, Homo sapiens
aggguaauaacaugggca

SEQ ID NO: 2221363 - RNA, 20 nt, Homo sapiens
acgcgguuccagauguggau

SEQ ID NO: 2221364 - RNA, 19 nt, Homo sapiens
aauaccccuuuacuagaag

SEQ ID NO: 2221365 - RNA, 14 nt, Homo sapiens
gcuuuacauuuuau

SEQ ID NO: 2221366 - RNA, 15 nt, Homo sapiens
acauaaauguucacu

SEQ ID NO: 2221367 - RNA, 19 nt, Homo sapiens
auuaauugugugucacaag

SEQ ID NO: 2221368 - RNA, 15 nt, Homo sapiens
ucaguuggugcugcu

SEQ ID NO: 2221369 - RNA, 20 nt, Homo sapiens
cuccuuaauagccauaugca

SEQ ID NO: 2221370 - RNA, 22 nt, Homo sapiens
cuugaaaauaguaauaccugag

SEQ ID NO: 2221371 - RNA, 14 nt, Homo sapiens
agaagugaacacuu

SEQ ID NO: 2221372 - RNA, 19 nt, Homo sapiens
ggcagcaagcaauucugcc

SEQ ID NO: 2221373 - RNA, 22 nt, Homo sapiens
uguagcaucuucuggagucucc

SEQ ID NO: 2221374 - RNA, 19 nt, Homo sapiens
gagaagaaguggcugccac

SEQ ID NO: 2221375 - RNA, 23 nt, Homo sapiens
aaauagcccuuggaucaguaugg

SEQ ID NO: 2221376 - RNA, 19 nt, Homo sapiens
ccauuucaguucaguuuca

SEQ ID NO: 2221377 - RNA, 16 nt, Homo sapiens
uucaaagccaagcaaa

SEQ ID NO: 2221378 - RNA, 15 nt, Homo sapiens
gucucuauaccaaua

SEQ ID NO: 2221379 - RNA, 17 nt, Homo sapiens
ggggcccgaacagggac

SEQ ID NO: 2221380 - RNA, 16 nt, Homo sapiens
ccauguuuuaauauca

SEQ ID NO: 2221381 - RNA, 12 nt, Homo sapiens
cccugaucuuca

SEQ ID NO: 2221382 - RNA, 13 nt, Homo sapiens
ugaaaacaucugc

SEQ ID NO: 2221383 - RNA, 21 nt, Homo sapiens
ucaccugagcaggaccucuga

SEQ ID NO: 2221384 - RNA, 18 nt, Homo sapiens
gaacagagugcaacccag

SEQ ID NO: 2221385 - RNA, 14 nt, Homo sapiens
aaacugaaccacaa

SEQ ID NO: 2221386 - RNA, 14 nt, Homo sapiens
aacaugaacccaaa

SEQ ID NO: 2221387 - RNA, 14 nt, Homo sapiens
aggccacugugagc

SEQ ID NO: 2221388 - RNA, 13 nt, Homo sapiens
ugcuagucacugg

SEQ ID NO: 2221389 - RNA, 13 nt, Homo sapiens
gaguuuucagugg

SEQ ID NO: 2221390 - RNA, 19 nt, Homo sapiens
caauguuuguccuguauaa

SEQ ID NO: 2221391 - RNA, 16 nt, Homo sapiens
agcuuuaaacucaggg

SEQ ID NO: 2221392 - RNA, 17 nt, Homo sapiens
gacaaguggggacugca

SEQ ID NO: 2221393 - RNA, 18 nt, Homo sapiens
aacauuugucuggucuua

SEQ ID NO: 2221394 - RNA, 23 nt, Homo sapiens
caaauguaaaauaaguauuucca

SEQ ID NO: 2221395 - RNA, 11 nt, Homo sapiens
ggaacauaaaa

SEQ ID NO: 2221396 - RNA, 18 nt, Homo sapiens
cugacauauuaugccuga

SEQ ID NO: 2221397 - RNA, 14 nt, Homo sapiens
acuguaugugaaag

SEQ ID NO: 2221398 - RNA, 14 nt, Homo sapiens
uggcucuaucuucc

SEQ ID NO: 2221399 - RNA, 15 nt, Homo sapiens
uaaaguuacuacuga

SEQ ID NO: 2221400 - RNA, 18 nt, Homo sapiens
cauuacaauuuucuguaa

SEQ ID NO: 2221401 - RNA, 16 nt, Homo sapiens
agucaccgaagguccu

SEQ ID NO: 2221402 - RNA, 15 nt, Homo sapiens
ucugauucuucaaag

SEQ ID NO: 2221403 - RNA, 20 nt, Homo sapiens
aucucguuguaaguacucua

SEQ ID NO: 2221404 - RNA, 18 nt, Homo sapiens
cccucugcuguucaggau

SEQ ID NO: 2221405 - RNA, 22 nt, Homo sapiens
cuggccgcccgcgccaggagcc

SEQ ID NO: 2221406 - RNA, 14 nt, Homo sapiens
uaguaaacaugugg

SEQ ID NO: 2221407 - RNA, 23 nt, Homo sapiens
ugagaaaugggguggaauaggga

SEQ ID NO: 2221408 - RNA, 23 nt, Homo sapiens
ccccgcucccaccuagugcccca

SEQ ID NO: 2221409 - RNA, 17 nt, Homo sapiens
ggcuuaauaccugggug

SEQ ID NO: 2221410 - RNA, 21 nt, Homo sapiens
auguaguuuuuauauguugua

SEQ ID NO: 2221411 - RNA, 23 nt, Homo sapiens
auauucuuguccacauucuacuu

SEQ ID NO: 2221412 - RNA, 15 nt, Homo sapiens
aguuacugugaaugu

SEQ ID NO: 2221413 - RNA, 16 nt, Homo sapiens
ugugugugugcacauc

SEQ ID NO: 2221414 - RNA, 17 nt, Homo sapiens
ccuugaucuuaacaaag

SEQ ID NO: 2221415 - RNA, 18 nt, Homo sapiens
caaaaaaaauuuuagcuc

SEQ ID NO: 2221416 - RNA, 16 nt, Homo sapiens
acugcauggcuucuga

SEQ ID NO: 2221417 - RNA, 23 nt, Homo sapiens
cucugcucaggccucccuagcac

SEQ ID NO: 2221418 - RNA, 19 nt, Homo sapiens
cuguuguugaaauugaugu

SEQ ID NO: 2221419 - RNA, 21 nt, Homo sapiens
cauugugacuauccagugauc

SEQ ID NO: 2221420 - RNA, 14 nt, Homo sapiens
ggucaucacuuuga

SEQ ID NO: 2221421 - RNA, 15 nt, Homo sapiens
aaaggaaguggaaug

SEQ ID NO: 2221422 - RNA, 19 nt, Homo sapiens
agauuuggaggcuaccuca

SEQ ID NO: 2221423 - RNA, 20 nt, Homo sapiens
uuauauguacauacauauau

SEQ ID NO: 2221424 - RNA, 19 nt, Homo sapiens
aggaugguccagaauucac

SEQ ID NO: 2221425 - RNA, 22 nt, Homo sapiens
caaaauguggggaaaaggcauu

SEQ ID NO: 2221426 - RNA, 16 nt, Homo sapiens
gucauccacagcccaa

SEQ ID NO: 2221427 - RNA, 14 nt, Homo sapiens
uauuuaagcaaaua

SEQ ID NO: 2221428 - RNA, 21 nt, Homo sapiens
uuaauccugcauuugcagaug

SEQ ID NO: 2221429 - RNA, 12 nt, Homo sapiens
accuccacaccc

SEQ ID NO: 2221430 - RNA, 15 nt, Homo sapiens
ugauuacguuuacau

SEQ ID NO: 2221431 - RNA, 17 nt, Homo sapiens
uggugauuucuugcuaa

SEQ ID NO: 2221432 - RNA, 15 nt, Homo sapiens
gcucccuccuagucu

SEQ ID NO: 2221433 - RNA, 21 nt, Homo sapiens
uuaguagagaugggguuucac

SEQ ID NO: 2221434 - RNA, 12 nt, Homo sapiens
gauacaaacugc

SEQ ID NO: 2221435 - RNA, 15 nt, Homo sapiens
uaauccaaauccauc

SEQ ID NO: 2221436 - RNA, 22 nt, Homo sapiens
cugggugggugggguacaggca

SEQ ID NO: 2221437 - RNA, 17 nt, Homo sapiens
gaucuacaugaaugcaa

SEQ ID NO: 2221438 - RNA, 20 nt, Homo sapiens
caucaaacacaaugccucau

SEQ ID NO: 2221439 - RNA, 22 nt, Homo sapiens
caucucagcccuuccccauggc

SEQ ID NO: 2221440 - RNA, 19 nt, Homo sapiens
ucaggaggcccugguguca

SEQ ID NO: 2221441 - RNA, 20 nt, Homo sapiens
agacaaagacucacucuguc

SEQ ID NO: 2221442 - RNA, 20 nt, Homo sapiens
uucaguucaagugcucuuca

SEQ ID NO: 2221443 - RNA, 19 nt, Homo sapiens
ucacuaaaguauaucuuua

SEQ ID NO: 2221444 - RNA, 23 nt, Homo sapiens
agaagccucugccucccuagcuu

SEQ ID NO: 2221445 - RNA, 23 nt, Homo sapiens
aaaucagagcagugauucucucu

SEQ ID NO: 2221446 - RNA, 17 nt, Homo sapiens
caaacugacaaccugug

SEQ ID NO: 2221447 - RNA, 21 nt, Homo sapiens
cacgaaacuuguuauugugaa

SEQ ID NO: 2221448 - RNA, 16 nt, Homo sapiens
cauaacucugugaucu

SEQ ID NO: 2221449 - RNA, 22 nt, Homo sapiens
uccugucauuuuuuuucucuag

SEQ ID NO: 2221450 - RNA, 20 nt, Homo sapiens
uauaauacaguuuucuauuc

SEQ ID NO: 2221451 - RNA, 21 nt, Homo sapiens
aaaucguccucccaggccagg

SEQ ID NO: 2221452 - RNA, 16 nt, Homo sapiens
ugggugggaguguuga

SEQ ID NO: 2221453 - RNA, 15 nt, Homo sapiens
guaaucccaacacuu

SEQ ID NO: 2221454 - RNA, 22 nt, Homo sapiens
ccagcaaugacaucucaggggc

SEQ ID NO: 2221455 - RNA, 21 nt, Homo sapiens
caaacuacuggcaauuuguaa

SEQ ID NO: 2221456 - RNA, 22 nt, Homo sapiens
gaccccgccugcucuuuccucc

SEQ ID NO: 2221457 - RNA, 13 nt, Homo sapiens
auuacaacuaagu

SEQ ID NO: 2221458 - RNA, 23 nt, Homo sapiens
ugugcuuuuuuguuuugugcuaa

SEQ ID NO: 2221459 - RNA, 18 nt, Homo sapiens
cacaggcugugccaacau

SEQ ID NO: 2221460 - RNA, 17 nt, Homo sapiens
caccuagcgucaguauu

SEQ ID NO: 2221461 - RNA, 21 nt, Homo sapiens
auguauuaguaugguucaaga

SEQ ID NO: 2221462 - RNA, 16 nt, Homo sapiens
cugacacuuccugucc

SEQ ID NO: 2221463 - RNA, 14 nt, Homo sapiens
gugggguacauuuc

SEQ ID NO: 2221464 - RNA, 19 nt, Homo sapiens
aauaugauuauacaaaaga

SEQ ID NO: 2221465 - RNA, 18 nt, Homo sapiens
auuugguaccauggugua

SEQ ID NO: 2221466 - RNA, 20 nt, Homo sapiens
cucuccagcaucaauuccau

SEQ ID NO: 2221467 - RNA, 18 nt, Homo sapiens
aggugguccuuccaccuc

SEQ ID NO: 2221468 - RNA, 19 nt, Homo sapiens
cuuggauaauuccccaaga

SEQ ID NO: 2221469 - RNA, 22 nt, Homo sapiens
gggcuuguagaccacuguccug

SEQ ID NO: 2221470 - RNA, 23 nt, Homo sapiens
ggacuauagugauuuaaacucau

SEQ ID NO: 2221471 - RNA, 18 nt, Homo sapiens
cucagggucaaagacaga

SEQ ID NO: 2221472 - RNA, 23 nt, Homo sapiens
aauguggaaggaaaauauuucau

SEQ ID NO: 2221473 - RNA, 17 nt, Homo sapiens
uugaaauuguagugcaa

SEQ ID NO: 2221474 - RNA, 14 nt, Homo sapiens
ucuucuauaucuga

SEQ ID NO: 2221475 - RNA, 14 nt, Homo sapiens
auuucaauuccugu

SEQ ID NO: 2221476 - RNA, 20 nt, Homo sapiens
ggaggcgcugcugguguucu

SEQ ID NO: 2221477 - RNA, 21 nt, Homo sapiens
acgucgcgguguguccucugu

SEQ ID NO: 2221478 - RNA, 13 nt, Homo sapiens
uugccugcaaaaa

SEQ ID NO: 2221479 - RNA, 16 nt, Homo sapiens
aacaaaagcucaucca

SEQ ID NO: 2221480 - RNA, 17 nt, Homo sapiens
aaggggagauacucucc

SEQ ID NO: 2221481 - RNA, 22 nt, Homo sapiens
cugguugaaaaauggcaaagaa

SEQ ID NO: 2221482 - RNA, 19 nt, Homo sapiens
aguacuuacccuaaaacau

SEQ ID NO: 2221483 - RNA, 16 nt, Homo sapiens
caccagggcacugucu

SEQ ID NO: 2221484 - RNA, 21 nt, Homo sapiens
guaccacuucgccuucuugcc

SEQ ID NO: 2221485 - RNA, 16 nt, Homo sapiens
guacuuuuuauucaau

SEQ ID NO: 2221486 - RNA, 20 nt, Homo sapiens
uauuagacuucuguuuucaa

SEQ ID NO: 2221487 - RNA, 18 nt, Homo sapiens
uuuaguuuuauacuauau

SEQ ID NO: 2221488 - RNA, 22 nt, Homo sapiens
agcaaugaaggagauagauuug

SEQ ID NO: 2221489 - RNA, 15 nt, Homo sapiens
gauugagcuacuuca

SEQ ID NO: 2221490 - RNA, 22 nt, Homo sapiens
cccuuggccagaagucaagccc

SEQ ID NO: 2221491 - RNA, 20 nt, Homo sapiens
cuuuaauucucaugugaucc

SEQ ID NO: 2221492 - RNA, 21 nt, Homo sapiens
aaccagcucuuuggugccagc

SEQ ID NO: 2221493 - RNA, 23 nt, Homo sapiens
uuuuuuaaaacacuaaaagcagc

SEQ ID NO: 2221494 - RNA, 14 nt, Homo sapiens
auuauucaucucuc

SEQ ID NO: 2221495 - RNA, 21 nt, Homo sapiens
ccugcacauuguuaugcacuu

SEQ ID NO: 2221496 - RNA, 15 nt, Homo sapiens
uaguguuauacuuga

SEQ ID NO: 2221497 - RNA, 12 nt, Homo sapiens
auauacuaugag

SEQ ID NO: 2221498 - RNA, 17 nt, Homo sapiens
uacuuguuuucacuuua

SEQ ID NO: 2221499 - RNA, 14 nt, Homo sapiens
aagaugaugcuauu

SEQ ID NO: 2221500 - RNA, 14 nt, Homo sapiens
uuuccauuccauaa

SEQ ID NO: 2221501 - RNA, 19 nt, Homo sapiens
aucuccagcugaucacaga

SEQ ID NO: 2221502 - RNA, 22 nt, Homo sapiens
agcacuugcaaccgucuguuau

SEQ ID NO: 2221503 - RNA, 15 nt, Homo sapiens
ucgggcgcuacugug

SEQ ID NO: 2221504 - RNA, 16 nt, Homo sapiens
aucacuggucuaaaag

SEQ ID NO: 2221505 - RNA, 16 nt, Homo sapiens
auuacugguccaaaag

SEQ ID NO: 2221506 - RNA, 14 nt, Homo sapiens
caacuccaggguua

SEQ ID NO: 2221507 - RNA, 21 nt, Homo sapiens
cucuagugucuuuugccuuua

SEQ ID NO: 2221508 - RNA, 21 nt, Homo sapiens
gaggcugagcuggaucacuug

SEQ ID NO: 2221509 - RNA, 17 nt, Homo sapiens
uaaauguuuaauaucug

SEQ ID NO: 2221510 - RNA, 13 nt, Homo sapiens
aggaaaggacuga

SEQ ID NO: 2221511 - RNA, 13 nt, Homo sapiens
aauaagcugccuu

SEQ ID NO: 2221512 - RNA, 16 nt, Homo sapiens
auaaggaaagcaauaa

SEQ ID NO: 2221513 - RNA, 14 nt, Homo sapiens
uuuuggaaagucag

SEQ ID NO: 2221514 - RNA, 15 nt, Homo sapiens
acaaauuucacuuau

SEQ ID NO: 2221515 - RNA, 16 nt, Homo sapiens
gaugaaacaaccguau

SEQ ID NO: 2221516 - RNA, 20 nt, Homo sapiens
gacauucuggaaaagcaaaa

SEQ ID NO: 2221517 - RNA, 12 nt, Homo sapiens
ugaagauuucau

SEQ ID NO: 2221518 - RNA, 14 nt, Homo sapiens
aacuagcaaugccu

SEQ ID NO: 2221519 - RNA, 18 nt, Homo sapiens
ggucaggagggugcagua

SEQ ID NO: 2221520 - RNA, 23 nt, Homo sapiens
aacuggauaaaaucuuccaaauc

SEQ ID NO: 2221521 - RNA, 21 nt, Homo sapiens
augcuuuuggggggcauauau

SEQ ID NO: 2221522 - RNA, 23 nt, Homo sapiens
uuuuaaguggguuuuuaugaacu

SEQ ID NO: 2221523 - RNA, 19 nt, Homo sapiens
ccuacucccaaggacacga

SEQ ID NO: 2221524 - RNA, 24 nt, Homo sapiens
aguccaggccucucucugcuccau

SEQ ID NO: 2221525 - RNA, 17 nt, Homo sapiens
gguguggcccguggccu

SEQ ID NO: 2221526 - RNA, 22 nt, Homo sapiens
cuugguuaaaauggcuacacuc

SEQ ID NO: 2221527 - RNA, 15 nt, Homo sapiens
ugugagagacggugu

SEQ ID NO: 2221528 - RNA, 19 nt, Homo sapiens
acgcacaacaugcacauuc

SEQ ID NO: 2221529 - RNA, 23 nt, Homo sapiens
ggaccuucugagccuucuacuua

SEQ ID NO: 2221530 - RNA, 12 nt, Homo sapiens
acccagucucau

SEQ ID NO: 2221531 - RNA, 20 nt, Homo sapiens
cagaagaaaaacacugagaa

SEQ ID NO: 2221532 - RNA, 15 nt, Homo sapiens
uuaguuauauucacu

SEQ ID NO: 2221533 - RNA, 17 nt, Homo sapiens
uacacuggauaaaaauc

SEQ ID NO: 2221534 - RNA, 19 nt, Homo sapiens
ccucccugucucugcaucu

SEQ ID NO: 2221535 - RNA, 14 nt, Homo sapiens
ugugccaccacguc

SEQ ID NO: 2221536 - RNA, 15 nt, Homo sapiens
aaacaguccuuuaaa

SEQ ID NO: 2221537 - RNA, 16 nt, Homo sapiens
auugcugaaugcaaga

SEQ ID NO: 2221538 - RNA, 14 nt, Homo sapiens
agaaccauuuacuu

SEQ ID NO: 2221539 - RNA, 18 nt, Homo sapiens
auauaugcucaaccagaa

SEQ ID NO: 2221540 - RNA, 22 nt, Homo sapiens
aagaaaccuucagauuuguguu

SEQ ID NO: 2221541 - RNA, 10 nt, Homo sapiens
auuugcacag

SEQ ID NO: 2221542 - RNA, 19 nt, Homo sapiens
uuuguauaccaugaugcau

SEQ ID NO: 2221543 - RNA, 15 nt, Homo sapiens
ugaguuaccucaugc

SEQ ID NO: 2221544 - RNA, 15 nt, Homo sapiens
uggcuucuuacugaa

SEQ ID NO: 2221545 - RNA, 20 nt, Homo sapiens
gauuguuuaaagaagcucuc

SEQ ID NO: 2221546 - RNA, 11 nt, Homo sapiens
uuuuaacuucc

SEQ ID NO: 2221547 - RNA, 22 nt, Homo sapiens
ugucuuggggugggcacaguac

SEQ ID NO: 2221548 - RNA, 13 nt, Homo sapiens
ccaggcugggcug

SEQ ID NO: 2221549 - RNA, 13 nt, Homo sapiens
cccuacugggaga

SEQ ID NO: 2221550 - RNA, 22 nt, Homo sapiens
uggugaacuucaaaagcuuuuu

SEQ ID NO: 2221551 - RNA, 20 nt, Homo sapiens
ucagccaauccgauugccuu

SEQ ID NO: 2221552 - RNA, 23 nt, Homo sapiens
uggguguagccagguauggcucu

SEQ ID NO: 2221553 - RNA, 22 nt, Homo sapiens
uuuaggaaaaucacuuugucua

SEQ ID NO: 2221554 - RNA, 22 nt, Homo sapiens
ggcccaggccuugcugacucuc

SEQ ID NO: 2221555 - RNA, 19 nt, Homo sapiens
auacaaaaguuaaccaggu

SEQ ID NO: 2221556 - RNA, 13 nt, Homo sapiens
ccuaaucauacac

SEQ ID NO: 2221557 - RNA, 18 nt, Homo sapiens
uacuguaauaauaccuca

SEQ ID NO: 2221558 - RNA, 15 nt, Homo sapiens
caggcucccugacca

SEQ ID NO: 2221559 - RNA, 16 nt, Homo sapiens
agugaaugaacaaaug

SEQ ID NO: 2221560 - RNA, 20 nt, Homo sapiens
cuguucaacauguaccucac

SEQ ID NO: 2221561 - RNA, 16 nt, Homo sapiens
cuccacauaaguccau

SEQ ID NO: 2221562 - RNA, 13 nt, Homo sapiens
ccccagaguguga

SEQ ID NO: 2221563 - RNA, 18 nt, Homo sapiens
gguuggcugggcccagaa

SEQ ID NO: 2221564 - RNA, 12 nt, Homo sapiens
ugcugugagcag

SEQ ID NO: 2221565 - RNA, 17 nt, Homo sapiens
aaagcaggcaagcaugu

SEQ ID NO: 2221566 - RNA, 14 nt, Homo sapiens
caaaacuacaugag

SEQ ID NO: 2221567 - RNA, 22 nt, Homo sapiens
gcaugcacuucuuacaauaauu

SEQ ID NO: 2221568 - RNA, 16 nt, Homo sapiens
ccuccugcacacaggg

SEQ ID NO: 2221569 - RNA, 19 nt, Homo sapiens
gcaucagagguuugcuucc

SEQ ID NO: 2221570 - RNA, 15 nt, Homo sapiens
caacaagcaaacuga

SEQ ID NO: 2221571 - RNA, 23 nt, Homo sapiens
uacccugcgcccaguccuuccac

SEQ ID NO: 2221572 - RNA, 20 nt, Homo sapiens
agcaacacuuugugaucuca

SEQ ID NO: 2221573 - RNA, 12 nt, Homo sapiens
aaagcacaguuu

SEQ ID NO: 2221574 - RNA, 23 nt, Homo sapiens
auuucugucuccacgauggugga

SEQ ID NO: 2221575 - RNA, 13 nt, Homo sapiens
aaggcaaugacaa

SEQ ID NO: 2221576 - RNA, 17 nt, Homo sapiens
agcaagaagcuguuacc

SEQ ID NO: 2221577 - RNA, 23 nt, Homo sapiens
aacacgcagauccuuugucuaca

SEQ ID NO: 2221578 - RNA, 23 nt, Homo sapiens
uugacugucacuguuccuuguca

SEQ ID NO: 2221579 - RNA, 22 nt, Homo sapiens
ucaggaaauguucacugaauaa

SEQ ID NO: 2221580 - RNA, 14 nt, Homo sapiens
aaccagcuacuuga

SEQ ID NO: 2221581 - RNA, 15 nt, Homo sapiens
ccaccuccuguggac

SEQ ID NO: 2221582 - RNA, 13 nt, Homo sapiens
uguaaaacuguga

SEQ ID NO: 2221583 - RNA, 18 nt, Homo sapiens
uaguauuuggcauucucu

SEQ ID NO: 2221584 - RNA, 15 nt, Homo sapiens
uuacuaucauucuca

SEQ ID NO: 2221585 - RNA, 20 nt, Homo sapiens
ccaguuuucguuuuuucuaa

SEQ ID NO: 2221586 - RNA, 21 nt, Homo sapiens
uauguagcucuuugucaggga

SEQ ID NO: 2221587 - RNA, 15 nt, Homo sapiens
uguucgcacaaucua

SEQ ID NO: 2221588 - RNA, 12 nt, Homo sapiens
caggaagccugu

SEQ ID NO: 2221589 - RNA, 13 nt, Homo sapiens
auaaauguuuaaa

SEQ ID NO: 2221590 - RNA, 20 nt, Homo sapiens
uuuaauguuauccucuugcu

SEQ ID NO: 2221591 - RNA, 18 nt, Homo sapiens
aauuuuaaugcauuguua

SEQ ID NO: 2221592 - RNA, 17 nt, Homo sapiens
agcuuuuaguauccaca

SEQ ID NO: 2221593 - RNA, 17 nt, Homo sapiens
uucaacauguaccucac

SEQ ID NO: 2221594 - RNA, 21 nt, Homo sapiens
gaccuuuuuuaggaagcaagc

SEQ ID NO: 2221595 - RNA, 21 nt, Homo sapiens
agaaaccuggccuuauaucau

SEQ ID NO: 2221596 - RNA, 22 nt, Homo sapiens
acugguauuguuuacguuugau

SEQ ID NO: 2221597 - RNA, 19 nt, Homo sapiens
uacuugucauagacuccuu

SEQ ID NO: 2221598 - RNA, 18 nt, Homo sapiens
auggugauuccagcaagu

SEQ ID NO: 2221599 - RNA, 14 nt, Homo sapiens
gaacauacuuucua

SEQ ID NO: 2221600 - RNA, 14 nt, Homo sapiens
gaagauacuuugua

SEQ ID NO: 2221601 - RNA, 13 nt, Homo sapiens
uucuuuucucuca

SEQ ID NO: 2221602 - RNA, 21 nt, Homo sapiens
uugacucuuguuuucaguuuc

SEQ ID NO: 2221603 - RNA, 18 nt, Homo sapiens
agggccccucccucugcc

SEQ ID NO: 2221604 - RNA, 12 nt, Homo sapiens
aauaugacagau

SEQ ID NO: 2221605 - RNA, 24 nt, Homo sapiens
aaauguuucaaaauagacaaguuu

SEQ ID NO: 2221606 - RNA, 14 nt, Homo sapiens
uggcugauuuagac

SEQ ID NO: 2221607 - RNA, 14 nt, Homo sapiens
cguucuaaaaucaa

SEQ ID NO: 2221608 - RNA, 17 nt, Homo sapiens
ucaagacauuugcugaa

SEQ ID NO: 2221609 - RNA, 18 nt, Homo sapiens
gccauuguuuugccagug

SEQ ID NO: 2221610 - RNA, 14 nt, Homo sapiens
cugugcacauucuc

SEQ ID NO: 2221611 - RNA, 15 nt, Homo sapiens
cgccagcgaccucuc

SEQ ID NO: 2221612 - RNA, 21 nt, Homo sapiens
gugaagagcagugagcagggu

SEQ ID NO: 2221613 - RNA, 19 nt, Homo sapiens
uaugcaaccaguuuaucca

SEQ ID NO: 2221614 - RNA, 13 nt, Homo sapiens
gauucagcauuuu

SEQ ID NO: 2221615 - RNA, 21 nt, Homo sapiens
uucauccuagucuagcauucu

SEQ ID NO: 2221616 - RNA, 21 nt, Homo sapiens
cacgcagccgccgccgcccac

SEQ ID NO: 2221617 - RNA, 22 nt, Homo sapiens
ucuagggcuaguagaacuggau

SEQ ID NO: 2221618 - RNA, 19 nt, Homo sapiens
ugguaauauuaauuuccac

SEQ ID NO: 2221619 - RNA, 11 nt, Homo sapiens
gaauuugcacc

SEQ ID NO: 2221620 - RNA, 20 nt, Homo sapiens
acuggcugccccgugacaca

SEQ ID NO: 2221621 - RNA, 16 nt, Homo sapiens
ucaggacacaucuauu

SEQ ID NO: 2221622 - RNA, 19 nt, Homo sapiens
caagucuucccugaucaag

SEQ ID NO: 2221623 - RNA, 16 nt, Homo sapiens
cuggcucccucacucu

SEQ ID NO: 2221624 - RNA, 17 nt, Homo sapiens
uccucuuccucaaaggg

SEQ ID NO: 2221625 - RNA, 15 nt, Homo sapiens
ccauuagaccaagcu

SEQ ID NO: 2221626 - RNA, 23 nt, Homo sapiens
caugaaucccacccacaugugac

SEQ ID NO: 2221627 - RNA, 13 nt, Homo sapiens
guauaugcaauau

SEQ ID NO: 2221628 - RNA, 16 nt, Homo sapiens
aaaccuuaguacugag

SEQ ID NO: 2221629 - RNA, 14 nt, Homo sapiens
uucugagcaggaag

SEQ ID NO: 2221630 - RNA, 16 nt, Homo sapiens
gcagaaccuucuuugg

SEQ ID NO: 2221631 - RNA, 17 nt, Homo sapiens
auacuugaccuugcaug

SEQ ID NO: 2221632 - RNA, 20 nt, Homo sapiens
uaagaaguuccagcauguug

SEQ ID NO: 2221633 - RNA, 17 nt, Homo sapiens
gucccaguauaccucau

SEQ ID NO: 2221634 - RNA, 15 nt, Homo sapiens
aaugauucauguuau

SEQ ID NO: 2221635 - RNA, 14 nt, Homo sapiens
auaauugucucuga

SEQ ID NO: 2221636 - RNA, 13 nt, Homo sapiens
cuccuuuguacag

SEQ ID NO: 2221637 - RNA, 20 nt, Homo sapiens
gugcaugccuguagucucag

SEQ ID NO: 2221638 - RNA, 16 nt, Homo sapiens
guuuuggaaaacuaau

SEQ ID NO: 2221639 - RNA, 17 nt, Homo sapiens
uuucugaaggcuuugug

SEQ ID NO: 2221640 - RNA, 16 nt, Homo sapiens
ucuacaaaugucuuca

SEQ ID NO: 2221641 - RNA, 20 nt, Homo sapiens
gggcacccagccucuaggga

SEQ ID NO: 2221642 - RNA, 19 nt, Homo sapiens
uacguaauuuaaacaaauu

SEQ ID NO: 2221643 - RNA, 15 nt, Homo sapiens
uuaacacuaccaauu

SEQ ID NO: 2221644 - RNA, 23 nt, Homo sapiens
uuuaagguagcaucauugaucuu

SEQ ID NO: 2221645 - RNA, 15 nt, Homo sapiens
uguuacugugugaag

SEQ ID NO: 2221646 - RNA, 14 nt, Homo sapiens
uacacagcuuuaug

SEQ ID NO: 2221647 - RNA, 17 nt, Homo sapiens
ugccucaccacacccag

SEQ ID NO: 2221648 - RNA, 23 nt, Homo sapiens
gucagacuuuguguucauuucau

SEQ ID NO: 2221649 - RNA, 20 nt, Homo sapiens
cccacuguggcugauuugga

SEQ ID NO: 2221650 - RNA, 14 nt, Homo sapiens
uggaguacaguggu

SEQ ID NO: 2221651 - RNA, 17 nt, Homo sapiens
aucugaaacacagucau

SEQ ID NO: 2221652 - RNA, 17 nt, Homo sapiens
aucaaaaucacuaucuu

SEQ ID NO: 2221653 - RNA, 21 nt, Homo sapiens
agaagcugcagugguauuaau

SEQ ID NO: 2221654 - RNA, 17 nt, Homo sapiens
cccauccacaguuguca

SEQ ID NO: 2221655 - RNA, 16 nt, Homo sapiens
uacaguuugugcucua

SEQ ID NO: 2221656 - RNA, 19 nt, Homo sapiens
uaaacauuuuuaaguauuu

SEQ ID NO: 2221657 - RNA, 12 nt, Homo sapiens
uugagguuucca

SEQ ID NO: 2221658 - RNA, 22 nt, Homo sapiens
aagugcugggauuacaggugua

SEQ ID NO: 2221659 - RNA, 12 nt, Homo sapiens
gcccuuacuuuc

SEQ ID NO: 2221660 - RNA, 17 nt, Homo sapiens
agauugggauacuguaa

SEQ ID NO: 2221661 - RNA, 12 nt, Homo sapiens
caacuaucauac

SEQ ID NO: 2221662 - RNA, 15 nt, Homo sapiens
ucccagagagugaau

SEQ ID NO: 2221663 - RNA, 15 nt, Homo sapiens
aaacuggugcaugac

SEQ ID NO: 2221664 - RNA, 18 nt, Homo sapiens
caccccuaccucuaguaa

SEQ ID NO: 2221665 - RNA, 13 nt, Homo sapiens
gucaaauacaaaa

SEQ ID NO: 2221666 - RNA, 13 nt, Homo sapiens
aaaucuagacuca

SEQ ID NO: 2221667 - RNA, 17 nt, Homo sapiens
ucauuagggaaaugcaa

SEQ ID NO: 2221668 - RNA, 20 nt, Homo sapiens
ccucccaaaguacugggauu

SEQ ID NO: 2221669 - RNA, 17 nt, Homo sapiens
aguuuuuauagcuauca

SEQ ID NO: 2221670 - RNA, 17 nt, Homo sapiens
aaacaaauguauuucaa

SEQ ID NO: 2221671 - RNA, 15 nt, Homo sapiens
gguaagggggugcag

SEQ ID NO: 2221672 - RNA, 17 nt, Homo sapiens
agggaggagcagcaaga

SEQ ID NO: 2221673 - RNA, 18 nt, Homo sapiens
ccggcacugcauguuccu

SEQ ID NO: 2221674 - RNA, 17 nt, Homo sapiens
cauccacaaacagcaga

SEQ ID NO: 2221675 - RNA, 13 nt, Homo sapiens
cuuucaaagucca

SEQ ID NO: 2221676 - RNA, 18 nt, Homo sapiens
caaggaaugccugugcca

SEQ ID NO: 2221677 - RNA, 19 nt, Homo sapiens
uagugugaaauaguucugc

SEQ ID NO: 2221678 - RNA, 15 nt, Homo sapiens
aaguauuauuuuaca

SEQ ID NO: 2221679 - RNA, 21 nt, Homo sapiens
gaaauaauaaauuaacauuau

SEQ ID NO: 2221680 - RNA, 16 nt, Homo sapiens
uagaauugaccaaaua

SEQ ID NO: 2221681 - RNA, 19 nt, Homo sapiens
ugcgacagcuugugauucc

SEQ ID NO: 2221682 - RNA, 15 nt, Homo sapiens
agcaugccuguggga

SEQ ID NO: 2221683 - RNA, 18 nt, Homo sapiens
gaaaugaaaucuucccag

SEQ ID NO: 2221684 - RNA, 19 nt, Homo sapiens
cuuauaccagguuaccuca

SEQ ID NO: 2221685 - RNA, 11 nt, Homo sapiens
agcaaccagag

SEQ ID NO: 2221686 - RNA, 18 nt, Homo sapiens
gcagccugagaaugaccu

SEQ ID NO: 2221687 - RNA, 22 nt, Homo sapiens
ugggcuccacuucauccagaug

SEQ ID NO: 2221688 - RNA, 14 nt, Homo sapiens
agaaagcucaucuc

SEQ ID NO: 2221689 - RNA, 21 nt, Homo sapiens
aaagcauguuugguuuuccaa

SEQ ID NO: 2221690 - RNA, 21 nt, Homo sapiens
caaaacaaguuuuucugucaa

SEQ ID NO: 2221691 - RNA, 23 nt, Homo sapiens
aucgcugcgauacuggcauuucc

SEQ ID NO: 2221692 - RNA, 21 nt, Homo sapiens
cacguguucccgacauaacau

SEQ ID NO: 2221693 - RNA, 18 nt, Homo sapiens
aaacugguuuguugcagc

SEQ ID NO: 2221694 - RNA, 22 nt, Homo sapiens
accaaacaggaaguggacauuc

SEQ ID NO: 2221695 - RNA, 12 nt, Homo sapiens
cuugaauauauc

SEQ ID NO: 2221696 - RNA, 20 nt, Homo sapiens
aggccuggacuuuccugcaa

SEQ ID NO: 2221697 - RNA, 20 nt, Homo sapiens
cuugagggugcuuguucccu

SEQ ID NO: 2221698 - RNA, 18 nt, Homo sapiens
auaacaaagcacauaacu

SEQ ID NO: 2221699 - RNA, 23 nt, Homo sapiens
cuuucucgugguagaagccagua

SEQ ID NO: 2221700 - RNA, 21 nt, Homo sapiens
guuaacauaggcuuauacaaa

SEQ ID NO: 2221701 - RNA, 18 nt, Homo sapiens
ggccuggcccucacucaa

SEQ ID NO: 2221702 - RNA, 21 nt, Homo sapiens
cucugccuuaaacacacauug

SEQ ID NO: 2221703 - RNA, 19 nt, Homo sapiens
aauugugaacucauugcuc

SEQ ID NO: 2221704 - RNA, 17 nt, Homo sapiens
accgucacccaacauca

SEQ ID NO: 2221705 - RNA, 22 nt, Homo sapiens
acacggcuugugggcacugugc

SEQ ID NO: 2221706 - RNA, 20 nt, Homo sapiens
cuuauauuuaaaacuugccu

SEQ ID NO: 2221707 - RNA, 18 nt, Homo sapiens
ugaaaaacagcucuguug

SEQ ID NO: 2221708 - RNA, 19 nt, Homo sapiens
cuugucaauaaaauccaua

SEQ ID NO: 2221709 - RNA, 16 nt, Homo sapiens
agugcaaugauaguca

SEQ ID NO: 2221710 - RNA, 21 nt, Homo sapiens
ucuugaaacauagagaucuau

SEQ ID NO: 2221711 - RNA, 21 nt, Homo sapiens
caaagaagauucuuaccaaga

SEQ ID NO: 2221712 - RNA, 18 nt, Homo sapiens
gucccacucaggucugua

SEQ ID NO: 2221713 - RNA, 20 nt, Homo sapiens
uguucagcuuuucagugaau

SEQ ID NO: 2221714 - RNA, 17 nt, Homo sapiens
cagccuggacaccucuc

SEQ ID NO: 2221715 - RNA, 18 nt, Homo sapiens
caaaugcuuuccaugagu

SEQ ID NO: 2221716 - RNA, 13 nt, Homo sapiens
caacuagacauuc

SEQ ID NO: 2221717 - RNA, 23 nt, Homo sapiens
ugcaucauuuaacugaacuguga

SEQ ID NO: 2221718 - RNA, 21 nt, Homo sapiens
gaaauaguuauuuuaauaccu

SEQ ID NO: 2221719 - RNA, 13 nt, Homo sapiens
agggaguguuccg

SEQ ID NO: 2221720 - RNA, 17 nt, Homo sapiens
uuugacuucagauugaa

SEQ ID NO: 2221721 - RNA, 16 nt, Homo sapiens
gggcuggcacugacug

SEQ ID NO: 2221722 - RNA, 18 nt, Homo sapiens
cuagaggauguaucucac

SEQ ID NO: 2221723 - RNA, 14 nt, Homo sapiens
gaaagcauuugaau

SEQ ID NO: 2221724 - RNA, 23 nt, Homo sapiens
cgggggcuuggcugugcccucag

SEQ ID NO: 2221725 - RNA, 12 nt, Homo sapiens
ccuuaauaugcu

SEQ ID NO: 2221726 - RNA, 21 nt, Homo sapiens
aguauuggacgguuucuagcc

SEQ ID NO: 2221727 - RNA, 18 nt, Homo sapiens
cauaaaauaggugcauug

SEQ ID NO: 2221728 - RNA, 14 nt, Homo sapiens
augaucaugccacu

SEQ ID NO: 2221729 - RNA, 21 nt, Homo sapiens
cuggcaauucacaaauagcca

SEQ ID NO: 2221730 - RNA, 18 nt, Homo sapiens
uuaauuaaacaaauuccu

SEQ ID NO: 2221731 - RNA, 21 nt, Homo sapiens
ugauucuuuugcccacacuug

SEQ ID NO: 2221732 - RNA, 13 nt, Homo sapiens
cagggcucugccc

SEQ ID NO: 2221733 - RNA, 22 nt, Homo sapiens
ggaaccucagccuggccagaca

SEQ ID NO: 2221734 - RNA, 17 nt, Homo sapiens
gggcugaggccucucau

SEQ ID NO: 2221735 - RNA, 16 nt, Homo sapiens
cccaggacagccacag

SEQ ID NO: 2221736 - RNA, 15 nt, Homo sapiens
uucucagguugccag

SEQ ID NO: 2221737 - RNA, 22 nt, Homo sapiens
gcccaucaggcaguguuaccug

SEQ ID NO: 2221738 - RNA, 16 nt, Homo sapiens
auaaaaacaaaaccac

SEQ ID NO: 2221739 - RNA, 21 nt, Homo sapiens
uuuagguucccaaaccuucag

SEQ ID NO: 2221740 - RNA, 15 nt, Homo sapiens
auaccaaaggugcua

SEQ ID NO: 2221741 - RNA, 22 nt, Homo sapiens
accggccgcagcccccacugac

SEQ ID NO: 2221742 - RNA, 20 nt, Homo sapiens
aggaaaguacugcaugaucu

SEQ ID NO: 2221743 - RNA, 19 nt, Homo sapiens
cagguuaagugugaguaau

SEQ ID NO: 2221744 - RNA, 16 nt, Homo sapiens
cacuuaaugauacaug

SEQ ID NO: 2221745 - RNA, 15 nt, Homo sapiens
uaaaaaugaaagcca

SEQ ID NO: 2221746 - RNA, 17 nt, Homo sapiens
uaauccuagcuacuugg

SEQ ID NO: 2221747 - RNA, 16 nt, Homo sapiens
ucuauuuucaaguaca

SEQ ID NO: 2221748 - RNA, 14 nt, Homo sapiens
uugaaaaaggugau

SEQ ID NO: 2221749 - RNA, 19 nt, Homo sapiens
acaggaaacuccugugacc

SEQ ID NO: 2221750 - RNA, 19 nt, Homo sapiens
uggagauaccagagacucu

SEQ ID NO: 2221751 - RNA, 23 nt, Homo sapiens
ugaaguucagugauaacucugag

SEQ ID NO: 2221752 - RNA, 21 nt, Homo sapiens
uggccuuacuguugaacaaua

SEQ ID NO: 2221753 - RNA, 23 nt, Homo sapiens
ggcuaauuuuuuguguuuuuaca

SEQ ID NO: 2221754 - RNA, 12 nt, Homo sapiens
gaccugcuucua

SEQ ID NO: 2221755 - RNA, 17 nt, Homo sapiens
cauguugaaaacuccau

SEQ ID NO: 2221756 - RNA, 19 nt, Homo sapiens
gagcauagcagaggggcca

SEQ ID NO: 2221757 - RNA, 19 nt, Homo sapiens
cuagaauguggauuugauu

SEQ ID NO: 2221758 - RNA, 16 nt, Homo sapiens
ccaggucuacagugau

SEQ ID NO: 2221759 - RNA, 16 nt, Homo sapiens
uucacaaauccuucaa

SEQ ID NO: 2221760 - RNA, 21 nt, Homo sapiens
aauuaaacaagugcacuugaa

SEQ ID NO: 2221761 - RNA, 16 nt, Homo sapiens
uggccaggauggucuc

SEQ ID NO: 2221762 - RNA, 20 nt, Homo sapiens
ccaagaggaaccucugauuu

SEQ ID NO: 2221763 - RNA, 13 nt, Homo sapiens
uaacacagugucu

SEQ ID NO: 2221764 - RNA, 17 nt, Homo sapiens
uacuggaaacuaauugu

SEQ ID NO: 2221765 - RNA, 14 nt, Homo sapiens
agcacugagcagaa

SEQ ID NO: 2221766 - RNA, 20 nt, Homo sapiens
cccagccuccccgugccaaa

SEQ ID NO: 2221767 - RNA, 15 nt, Homo sapiens
guuccccuucaguac

SEQ ID NO: 2221768 - RNA, 18 nt, Homo sapiens
ccaaagaaauagggcaug

SEQ ID NO: 2221769 - RNA, 15 nt, Homo sapiens
aauacaguaugaucu

SEQ ID NO: 2221770 - RNA, 16 nt, Homo sapiens
acucccccucuuucac

SEQ ID NO: 2221771 - RNA, 16 nt, Homo sapiens
uauucccaaaucucaa

SEQ ID NO: 2221772 - RNA, 15 nt, Homo sapiens
cucucacuccugccu

SEQ ID NO: 2221773 - RNA, 20 nt, Homo sapiens
acuaugcaaauauggaauag

SEQ ID NO: 2221774 - RNA, 17 nt, Homo sapiens
cuuaucaguaguaucaa

SEQ ID NO: 2221775 - RNA, 20 nt, Homo sapiens
uuaaaaguuugaaaagcaau

SEQ ID NO: 2221776 - RNA, 14 nt, Homo sapiens
augaacggugagca

SEQ ID NO: 2221777 - RNA, 18 nt, Homo sapiens
uccugaguaguaaucuca

SEQ ID NO: 2221778 - RNA, 13 nt, Homo sapiens
gggccuacugcca

SEQ ID NO: 2221779 - RNA, 16 nt, Homo sapiens
cuuaaauuuaaaacug

SEQ ID NO: 2221780 - RNA, 21 nt, Homo sapiens
aagacaauaauucuacauguu

SEQ ID NO: 2221781 - RNA, 18 nt, Homo sapiens
accaagccugccaugggu

SEQ ID NO: 2221782 - RNA, 14 nt, Homo sapiens
guguucucuggcuc

SEQ ID NO: 2221783 - RNA, 21 nt, Homo sapiens
aggagcugcuaaacucuuuca

SEQ ID NO: 2221784 - RNA, 22 nt, Homo sapiens
ugcuucacaguagagccagcuu

SEQ ID NO: 2221785 - RNA, 22 nt, Homo sapiens
ccauuuuacuuccaugauacuu

SEQ ID NO: 2221786 - RNA, 14 nt, Homo sapiens
aguggcacagcuaa

SEQ ID NO: 2221787 - RNA, 19 nt, Homo sapiens
uucugaauacaaagugaug

SEQ ID NO: 2221788 - RNA, 18 nt, Homo sapiens
ugaaguaugguguguuca

SEQ ID NO: 2221789 - RNA, 12 nt, Homo sapiens
uccucuucccug

SEQ ID NO: 2221790 - RNA, 21 nt, Homo sapiens
aaaaugaaucuucacaaaaca

SEQ ID NO: 2221791 - RNA, 16 nt, Homo sapiens
ggccaagagaugcagu

SEQ ID NO: 2221792 - RNA, 18 nt, Homo sapiens
gcccaggcuagagugcaa

SEQ ID NO: 2221793 - RNA, 18 nt, Homo sapiens
gcccaggcuggagugcag

SEQ ID NO: 2221794 - RNA, 15 nt, Homo sapiens
cucacuggugcauuu

SEQ ID NO: 2221795 - RNA, 18 nt, Homo sapiens
gauagauguugcucuuuc

SEQ ID NO: 2221796 - RNA, 14 nt, Homo sapiens
uccuugauuacaua

SEQ ID NO: 2221797 - RNA, 15 nt, Homo sapiens
gaaaggggaaugugg

SEQ ID NO: 2221798 - RNA, 17 nt, Homo sapiens
ucagaauccuaguuuau

SEQ ID NO: 2221799 - RNA, 15 nt, Homo sapiens
ggcaccaucugccaa

SEQ ID NO: 2221800 - RNA, 13 nt, Homo sapiens
agcacucagguag

SEQ ID NO: 2221801 - RNA, 17 nt, Homo sapiens
uguucuuuaguagcaac

SEQ ID NO: 2221802 - RNA, 17 nt, Homo sapiens
aaauguuauaggcacuu

SEQ ID NO: 2221803 - RNA, 12 nt, Homo sapiens
aauaaaguguau

SEQ ID NO: 2221804 - RNA, 19 nt, Homo sapiens
acacaagccacagaagcca

SEQ ID NO: 2221805 - RNA, 22 nt, Homo sapiens
caaccugguguuaggugugcaa

SEQ ID NO: 2221806 - RNA, 19 nt, Homo sapiens
cacugauauggguuuauaa

SEQ ID NO: 2221807 - RNA, 23 nt, Homo sapiens
gcccacccuuguguccacuguga

SEQ ID NO: 2221808 - RNA, 19 nt, Homo sapiens
ugcccuguaccugugcacg

SEQ ID NO: 2221809 - RNA, 16 nt, Homo sapiens
cugcuuguuggcucca

SEQ ID NO: 2221810 - RNA, 19 nt, Homo sapiens
gcaguucugggugcucccu

SEQ ID NO: 2221811 - RNA, 12 nt, Homo sapiens
ucagauugaacc

SEQ ID NO: 2221812 - RNA, 19 nt, Homo sapiens
ucugugggauaucacauca

SEQ ID NO: 2221813 - RNA, 15 nt, Homo sapiens
ggcacacacugugua

SEQ ID NO: 2221814 - RNA, 13 nt, Homo sapiens
uuucugcacauaa

SEQ ID NO: 2221815 - RNA, 20 nt, Homo sapiens
cagccugaauguuauuuccu

SEQ ID NO: 2221816 - RNA, 17 nt, Homo sapiens
aaucccuuccucuccca

SEQ ID NO: 2221817 - RNA, 14 nt, Homo sapiens
gaacuccugaccuu

SEQ ID NO: 2221818 - RNA, 14 nt, Homo sapiens
uagcacugacagau

SEQ ID NO: 2221819 - RNA, 16 nt, Homo sapiens
agaagggauaucuacu

SEQ ID NO: 2221820 - RNA, 23 nt, Homo sapiens
guucccgcucugcauugccugaa

SEQ ID NO: 2221821 - RNA, 13 nt, Homo sapiens
acugugcuccuaa

SEQ ID NO: 2221822 - RNA, 13 nt, Homo sapiens
caugugcuaauaa

SEQ ID NO: 2221823 - RNA, 15 nt, Homo sapiens
uggaacacggccaca

SEQ ID NO: 2221824 - RNA, 21 nt, Homo sapiens
ccacauuugugccgacacugu

SEQ ID NO: 2221825 - RNA, 22 nt, Homo sapiens
gccccuggacuauggugcugua

SEQ ID NO: 2221826 - RNA, 21 nt, Homo sapiens
auugagugcuccugugugcug

SEQ ID NO: 2221827 - RNA, 23 nt, Homo sapiens
gaccaaaucaaaugcucacuggg

SEQ ID NO: 2221828 - RNA, 16 nt, Homo sapiens
aagcagaaucuuugca

SEQ ID NO: 2221829 - RNA, 14 nt, Homo sapiens
cuaaucaguccuua

SEQ ID NO: 2221830 - RNA, 14 nt, Homo sapiens
aauaucaacucuca

SEQ ID NO: 2221831 - RNA, 22 nt, Homo sapiens
aaucccagcaugcugagauuac

SEQ ID NO: 2221832 - RNA, 21 nt, Homo sapiens
aaccacuuucaccugggauga

SEQ ID NO: 2221833 - RNA, 20 nt, Homo sapiens
cugccccaaacaaauaugca

SEQ ID NO: 2221834 - RNA, 11 nt, Homo sapiens
agccucuuguu

SEQ ID NO: 2221835 - RNA, 16 nt, Homo sapiens
gcaccucugugcugca

SEQ ID NO: 2221836 - RNA, 21 nt, Homo sapiens
ccuaaaagccaccccacuucu

SEQ ID NO: 2221837 - RNA, 15 nt, Homo sapiens
guuuucucucuguua

SEQ ID NO: 2221838 - RNA, 14 nt, Homo sapiens
cagcaguggacuca

SEQ ID NO: 2221839 - RNA, 14 nt, Homo sapiens
cucacucaccuuca

SEQ ID NO: 2221840 - RNA, 13 nt, Homo sapiens
aggaaaaggcccc

SEQ ID NO: 2221841 - RNA, 14 nt, Homo sapiens
agaaguuguggcuu

SEQ ID NO: 2221842 - RNA, 14 nt, Homo sapiens
ugaagcugaggcuc

SEQ ID NO: 2221843 - RNA, 22 nt, Homo sapiens
gaggccaagaaagaaaccagac

SEQ ID NO: 2221844 - RNA, 19 nt, Homo sapiens
cccaccagaaauuccagua

SEQ ID NO: 2221845 - RNA, 14 nt, Homo sapiens
ccccugaaagccau

SEQ ID NO: 2221846 - RNA, 15 nt, Homo sapiens
cauuugccugucaug

SEQ ID NO: 2221847 - RNA, 15 nt, Homo sapiens
ucuauaugauccuga

SEQ ID NO: 2221848 - RNA, 15 nt, Homo sapiens
cauguucccaaaaca

SEQ ID NO: 2221849 - RNA, 15 nt, Homo sapiens
ucucugcagcucuga

SEQ ID NO: 2221850 - RNA, 14 nt, Homo sapiens
aaugacucaaaguc

SEQ ID NO: 2221851 - RNA, 13 nt, Homo sapiens
uucagacacuacc

SEQ ID NO: 2221852 - RNA, 19 nt, Homo sapiens
gccaacuugugacuuugag

SEQ ID NO: 2221853 - RNA, 18 nt, Homo sapiens
gaagacgccaaaaacaau

SEQ ID NO: 2221854 - RNA, 18 nt, Homo sapiens
aauuuuuccuaugcuauu

SEQ ID NO: 2221855 - RNA, 21 nt, Homo sapiens
gccaagaucacgccauugcac

SEQ ID NO: 2221856 - RNA, 19 nt, Homo sapiens
gaggcuugaaggaaccagc

SEQ ID NO: 2221857 - RNA, 16 nt, Homo sapiens
uaaaccugauuuacua

SEQ ID NO: 2221858 - RNA, 14 nt, Homo sapiens
uggguguugaccac

SEQ ID NO: 2221859 - RNA, 14 nt, Homo sapiens
ugcauugagcugcc

SEQ ID NO: 2221860 - RNA, 16 nt, Homo sapiens
uggacacuugguuaga

SEQ ID NO: 2221861 - RNA, 14 nt, Homo sapiens
aguguucauagcuu

SEQ ID NO: 2221862 - RNA, 19 nt, Homo sapiens
aagaugcagcaaaauguga

SEQ ID NO: 2221863 - RNA, 21 nt, Homo sapiens
cuguccaggccacuguggcca

SEQ ID NO: 2221864 - RNA, 21 nt, Homo sapiens
ucauguuguugaggcugucac

SEQ ID NO: 2221865 - RNA, 14 nt, Homo sapiens
cugaugccaaagcu

SEQ ID NO: 2221866 - RNA, 16 nt, Homo sapiens
cagucucuauaccaau

SEQ ID NO: 2221867 - RNA, 12 nt, Homo sapiens
ucuuaugccauu

SEQ ID NO: 2221868 - RNA, 20 nt, Homo sapiens
caaagccuuuggcucuucua

SEQ ID NO: 2221869 - RNA, 22 nt, Homo sapiens
acugcuugugcacuggaugugg

SEQ ID NO: 2221870 - RNA, 21 nt, Homo sapiens
cccuucuucacacagacacua

SEQ ID NO: 2221871 - RNA, 20 nt, Homo sapiens
aggcauucuguggccagcca

SEQ ID NO: 2221872 - RNA, 16 nt, Homo sapiens
ggugacacacagcagc

SEQ ID NO: 2221873 - RNA, 14 nt, Homo sapiens
caucagagcagcua

SEQ ID NO: 2221874 - RNA, 14 nt, Homo sapiens
uuuauaaguugaag

SEQ ID NO: 2221875 - RNA, 18 nt, Homo sapiens
agaugagaaagcuuuuau

SEQ ID NO: 2221876 - RNA, 14 nt, Homo sapiens
acccugggggcaca

SEQ ID NO: 2221877 - RNA, 19 nt, Homo sapiens
aauaucuugaaacauagag

SEQ ID NO: 2221878 - RNA, 12 nt, Homo sapiens
ucauguuccuua

SEQ ID NO: 2221879 - RNA, 22 nt, Homo sapiens
ugaagguaacuagaaagugagu

SEQ ID NO: 2221880 - RNA, 20 nt, Homo sapiens
uuaagucaagaauauaauau

SEQ ID NO: 2221881 - RNA, 21 nt, Homo sapiens
ucaugugcaaacccacucaga

SEQ ID NO: 2221882 - RNA, 19 nt, Homo sapiens
uggaucaaccaaguuacac

SEQ ID NO: 2221883 - RNA, 23 nt, Homo sapiens
acuguugagaggguuacuuacau

SEQ ID NO: 2221884 - RNA, 23 nt, Homo sapiens
auuugcuuuuugugauaugcaca

SEQ ID NO: 2221885 - RNA, 23 nt, Homo sapiens
ugcauguggcuucucugucucug

SEQ ID NO: 2221886 - RNA, 22 nt, Homo sapiens
acaccacuuucccacacuguga

SEQ ID NO: 2221887 - RNA, 19 nt, Homo sapiens
uagcugauuuaacuuguau

SEQ ID NO: 2221888 - RNA, 17 nt, Homo sapiens
ucaaagcauuuacaagu

SEQ ID NO: 2221889 - RNA, 17 nt, Homo sapiens
uccugacaaaagggaca

SEQ ID NO: 2221890 - RNA, 19 nt, Homo sapiens
gaaccuugucccagccagu

SEQ ID NO: 2221891 - RNA, 18 nt, Homo sapiens
cugcaggguccccaagga

SEQ ID NO: 2221892 - RNA, 19 nt, Homo sapiens
gcaggaaacauagaacuca

SEQ ID NO: 2221893 - RNA, 19 nt, Homo sapiens
ugaugauaaaaggagaaua

SEQ ID NO: 2221894 - RNA, 19 nt, Homo sapiens
uagccuuuggggacggcca

SEQ ID NO: 2221895 - RNA, 18 nt, Homo sapiens
auuacagaauauacuuag

SEQ ID NO: 2221896 - RNA, 17 nt, Homo sapiens
cuuuauuagcuuucucc

SEQ ID NO: 2221897 - RNA, 23 nt, Homo sapiens
cccucuuuguuucugcuucauuu

SEQ ID NO: 2221898 - RNA, 21 nt, Homo sapiens
aggcugaggcaagagaauuac

SEQ ID NO: 2221899 - RNA, 17 nt, Homo sapiens
uuccaucagcccaucuc

SEQ ID NO: 2221900 - RNA, 20 nt, Homo sapiens
cuacuuuaauauaaacccau

SEQ ID NO: 2221901 - RNA, 16 nt, Homo sapiens
gcccaaggccuacccc

SEQ ID NO: 2221902 - RNA, 15 nt, Homo sapiens
aauuaguaagccaug

SEQ ID NO: 2221903 - RNA, 16 nt, Homo sapiens
ggggccuagacucugu

SEQ ID NO: 2221904 - RNA, 14 nt, Homo sapiens
ugagcauaaaucaa

SEQ ID NO: 2221905 - RNA, 16 nt, Homo sapiens
gcucugauggcugcuc

SEQ ID NO: 2221906 - RNA, 21 nt, Homo sapiens
auguucugacauaaguauuua

SEQ ID NO: 2221907 - RNA, 12 nt, Homo sapiens
uuaucugucaca

SEQ ID NO: 2221908 - RNA, 19 nt, Homo sapiens
uuaugggaacaaguguaca

SEQ ID NO: 2221909 - RNA, 16 nt, Homo sapiens
gacucaucauuuccau

SEQ ID NO: 2221910 - RNA, 23 nt, Homo sapiens
ccauauucugguucuugaaaaua

SEQ ID NO: 2221911 - RNA, 20 nt, Homo sapiens
ggucugugugugacaccacc

SEQ ID NO: 2221912 - RNA, 22 nt, Homo sapiens
agaugugaauuauugacacuga

SEQ ID NO: 2221913 - RNA, 16 nt, Homo sapiens
cccggacaguggcacc

SEQ ID NO: 2221914 - RNA, 22 nt, Homo sapiens
cugaaucuucagcauguucuca

SEQ ID NO: 2221915 - RNA, 18 nt, Homo sapiens
guauagaauaggcacuuu

SEQ ID NO: 2221916 - RNA, 17 nt, Homo sapiens
caauaaagugacccugu

SEQ ID NO: 2221917 - RNA, 18 nt, Homo sapiens
uuugcucuuuucaaugug

SEQ ID NO: 2221918 - RNA, 14 nt, Homo sapiens
aguggcucaugccu

SEQ ID NO: 2221919 - RNA, 21 nt, Homo sapiens
cuucuuuugaacaaaugacau

SEQ ID NO: 2221920 - RNA, 16 nt, Homo sapiens
gacacaccugaacaca

SEQ ID NO: 2221921 - RNA, 22 nt, Homo sapiens
cauggagaaugcaccauacuca

SEQ ID NO: 2221922 - RNA, 12 nt, Homo sapiens
caucucgcugcc

SEQ ID NO: 2221923 - RNA, 22 nt, Homo sapiens
aucagcccaaaagucaaucuua

SEQ ID NO: 2221924 - RNA, 13 nt, Homo sapiens
uggcagacugugu

SEQ ID NO: 2221925 - RNA, 14 nt, Homo sapiens
caccaugcacugua

SEQ ID NO: 2221926 - RNA, 15 nt, Homo sapiens
acauuccccagagug

SEQ ID NO: 2221927 - RNA, 20 nt, Homo sapiens
ccacugaccggaggcaaaag

SEQ ID NO: 2221928 - RNA, 21 nt, Homo sapiens
augccaauaauaaaugcccuc

SEQ ID NO: 2221929 - RNA, 15 nt, Homo sapiens
ccuuugauguggaug

SEQ ID NO: 2221930 - RNA, 13 nt, Homo sapiens
ccacgagggugcc

SEQ ID NO: 2221931 - RNA, 15 nt, Homo sapiens
aucccuggaugugga

SEQ ID NO: 2221932 - RNA, 13 nt, Homo sapiens
gagacuggcauuu

SEQ ID NO: 2221933 - RNA, 22 nt, Homo sapiens
ugcuaaugcaaauuaaaacaua

SEQ ID NO: 2221934 - RNA, 14 nt, Homo sapiens
aucgcaucaugcca

SEQ ID NO: 2221935 - RNA, 14 nt, Homo sapiens
cagcgauccacgga

SEQ ID NO: 2221936 - RNA, 16 nt, Homo sapiens
uggccugugccagcac

SEQ ID NO: 2221937 - RNA, 20 nt, Homo sapiens
auuuugagcccccauuccac

SEQ ID NO: 2221938 - RNA, 16 nt, Homo sapiens
cuguccauuaucuaua

SEQ ID NO: 2221939 - RNA, 16 nt, Homo sapiens
gaaucaauucaauuug

SEQ ID NO: 2221940 - RNA, 15 nt, Homo sapiens
ucauucagaccagug

SEQ ID NO: 2221941 - RNA, 15 nt, Homo sapiens
aggacuccacuggac

SEQ ID NO: 2221942 - RNA, 21 nt, Homo sapiens
aauacuugcuccauuuacaaa

SEQ ID NO: 2221943 - RNA, 18 nt, Homo sapiens
uuucaggagguacuguga

SEQ ID NO: 2221944 - RNA, 19 nt, Homo sapiens
aauuacagaagaagcuccu

SEQ ID NO: 2221945 - RNA, 15 nt, Homo sapiens
gauuccaucaaagag

SEQ ID NO: 2221946 - RNA, 14 nt, Homo sapiens
ccauuuaaagacca

SEQ ID NO: 2221947 - RNA, 23 nt, Homo sapiens
gccuuuggauugacucugcauuu

SEQ ID NO: 2221948 - RNA, 17 nt, Homo sapiens
aggaacgugguucagag

SEQ ID NO: 2221949 - RNA, 20 nt, Homo sapiens
gggcaugccccggccaccuc

SEQ ID NO: 2221950 - RNA, 19 nt, Homo sapiens
ucccaggacccugugccca

SEQ ID NO: 2221951 - RNA, 21 nt, Homo sapiens
cugccuuugucuuacuggcaa

SEQ ID NO: 2221952 - RNA, 14 nt, Homo sapiens
gccugaugcugaca

SEQ ID NO: 2221953 - RNA, 15 nt, Homo sapiens
gugauauauauuugu

SEQ ID NO: 2221954 - RNA, 20 nt, Homo sapiens
cagcuuagaaugcaucucau

SEQ ID NO: 2221955 - RNA, 17 nt, Homo sapiens
gaugcaggggauggugu

SEQ ID NO: 2221956 - RNA, 19 nt, Homo sapiens
ugacaucucaggggccaga

SEQ ID NO: 2221957 - RNA, 23 nt, Homo sapiens
gcacucaaguuguuuaacugugc

SEQ ID NO: 2221958 - RNA, 22 nt, Homo sapiens
auaauaaaaaaauuagugagua

SEQ ID NO: 2221959 - RNA, 21 nt, Homo sapiens
gugggugcugcccuguguaca

SEQ ID NO: 2221960 - RNA, 16 nt, Homo sapiens
gaaaauggaguuauca

SEQ ID NO: 2221961 - RNA, 21 nt, Homo sapiens
ccacauaaccucucugugcca

SEQ ID NO: 2221962 - RNA, 13 nt, Homo sapiens
ucuggcacacucc

SEQ ID NO: 2221963 - RNA, 19 nt, Homo sapiens
ggugcaugaagguuucuga

SEQ ID NO: 2221964 - RNA, 16 nt, Homo sapiens
ccuguccugccaugca

SEQ ID NO: 2221965 - RNA, 19 nt, Homo sapiens
cuucaugguguccauuuua

SEQ ID NO: 2221966 - RNA, 11 nt, Homo sapiens
aacuuccucag

SEQ ID NO: 2221967 - RNA, 19 nt, Homo sapiens
accucucagcugcuggaug

SEQ ID NO: 2221968 - RNA, 19 nt, Homo sapiens
acaaaugaauaaaugcaua

SEQ ID NO: 2221969 - RNA, 19 nt, Homo sapiens
accaaaucucaaaauaucc

SEQ ID NO: 2221970 - RNA, 23 nt, Homo sapiens
aguaagcauuuccagccuaucua

SEQ ID NO: 2221971 - RNA, 23 nt, Homo sapiens
acauuuuuugggcagcaauuuaa

SEQ ID NO: 2221972 - RNA, 22 nt, Homo sapiens
auucugcucagauagaaugaca

SEQ ID NO: 2221973 - RNA, 16 nt, Homo sapiens
ucaucaugugugucca

SEQ ID NO: 2221974 - RNA, 17 nt, Homo sapiens
uaaacauaaagaauuca

SEQ ID NO: 2221975 - RNA, 11 nt, Homo sapiens
aggaaauccaa

SEQ ID NO: 2221976 - RNA, 18 nt, Homo sapiens
cuuccaacguggcccaga

SEQ ID NO: 2221977 - RNA, 16 nt, Homo sapiens
cucuccugaauccuuu

SEQ ID NO: 2221978 - RNA, 23 nt, Homo sapiens
aggccuugggagcucaucccucu

SEQ ID NO: 2221979 - RNA, 17 nt, Homo sapiens
uucagaaaacuucaaga

SEQ ID NO: 2221980 - RNA, 21 nt, Homo sapiens
uaaacacuguguauuguugua

SEQ ID NO: 2221981 - RNA, 13 nt, Homo sapiens
auugaaacucucu

SEQ ID NO: 2221982 - RNA, 19 nt, Homo sapiens
ugacccgaguaacuuucug

SEQ ID NO: 2221983 - RNA, 22 nt, Homo sapiens
agaaaguacuucuccacccugc

SEQ ID NO: 2221984 - RNA, 19 nt, Homo sapiens
auggcguaaguacagagaa

SEQ ID NO: 2221985 - RNA, 13 nt, Homo sapiens
gaugcaagcaagg

SEQ ID NO: 2221986 - RNA, 21 nt, Homo sapiens
cacuuugcugccccaccaucu

SEQ ID NO: 2221987 - RNA, 24 nt, Homo sapiens
uaaaauacuuuuacucugccuaca

SEQ ID NO: 2221988 - RNA, 15 nt, Homo sapiens
ccaaaggaagacgug

SEQ ID NO: 2221989 - RNA, 17 nt, Homo sapiens
ucgcauuuccugagaac

SEQ ID NO: 2221990 - RNA, 20 nt, Homo sapiens
aaaacucuacacccucugcc

SEQ ID NO: 2221991 - RNA, 20 nt, Homo sapiens
auuuuaaaggaagaaaccau

SEQ ID NO: 2221992 - RNA, 19 nt, Homo sapiens
uccugacagaaggacucag

SEQ ID NO: 2221993 - RNA, 17 nt, Homo sapiens
aauuaagaauguucuca

SEQ ID NO: 2221994 - RNA, 16 nt, Homo sapiens
ugguugauucacacuu

SEQ ID NO: 2221995 - RNA, 18 nt, Homo sapiens
auuguacaaguauuacaa

SEQ ID NO: 2221996 - RNA, 18 nt, Homo sapiens
agugaauaguaacaauaa

SEQ ID NO: 2221997 - RNA, 20 nt, Homo sapiens
ccggggagaaacccagagau

SEQ ID NO: 2221998 - RNA, 17 nt, Homo sapiens
gaccaugcgacacuggg

SEQ ID NO: 2221999 - RNA, 18 nt, Homo sapiens
agugaaagaguagugcau

SEQ ID NO: 2222000 - RNA, 20 nt, Homo sapiens
acugcacuccagccugggca

SEQ ID NO: 2222001 - RNA, 18 nt, Homo sapiens
gcaugaauaaaacacuca

SEQ ID NO: 2222002 - RNA, 12 nt, Homo sapiens
cuucuggugacc

SEQ ID NO: 2222003 - RNA, 23 nt, Homo sapiens
aagccggcuugauuuccgugaac

SEQ ID NO: 2222004 - RNA, 16 nt, Homo sapiens
ccagggccuccagggc

SEQ ID NO: 2222005 - RNA, 16 nt, Homo sapiens
ucaaaaauacucacau

SEQ ID NO: 2222006 - RNA, 19 nt, Homo sapiens
agagagccgccaaacauuc

SEQ ID NO: 2222007 - RNA, 14 nt, Homo sapiens
uaacgacuucaggg

SEQ ID NO: 2222008 - RNA, 15 nt, Homo sapiens
aagauuuaaaauuaa

SEQ ID NO: 2222009 - RNA, 12 nt, Homo sapiens
cuguguguuccu

SEQ ID NO: 2222010 - RNA, 12 nt, Homo sapiens
uggacacccuca

SEQ ID NO: 2222011 - RNA, 18 nt, Homo sapiens
uugucccccaacuugaga

SEQ ID NO: 2222012 - RNA, 17 nt, Homo sapiens
auauguauuuugucaua

SEQ ID NO: 2222013 - RNA, 21 nt, Homo sapiens
cugugcaggagccaguccuga

SEQ ID NO: 2222014 - RNA, 19 nt, Homo sapiens
gaacagcaguguucucaca

SEQ ID NO: 2222015 - RNA, 15 nt, Homo sapiens
gucaggccuugaggg

SEQ ID NO: 2222016 - RNA, 23 nt, Homo sapiens
aaucucuuaugggauuacauguu

SEQ ID NO: 2222017 - RNA, 19 nt, Homo sapiens
cuuguauuaucuccuuuga

SEQ ID NO: 2222018 - RNA, 22 nt, Homo sapiens
aacacuggaacauuccagugga

SEQ ID NO: 2222019 - RNA, 21 nt, Homo sapiens
ggaagauggagcucccccauc

SEQ ID NO: 2222020 - RNA, 16 nt, Homo sapiens
cggugagaacucugcc

SEQ ID NO: 2222021 - RNA, 20 nt, Homo sapiens
aauuuaccacaaaagcaaaa

SEQ ID NO: 2222022 - RNA, 20 nt, Homo sapiens
agacugcaaacccuuucaua

SEQ ID NO: 2222023 - RNA, 20 nt, Homo sapiens
ucugggggacagagaaggcg

SEQ ID NO: 2222024 - RNA, 21 nt, Homo sapiens
gcauuccuuucucuucagugc

SEQ ID NO: 2222025 - RNA, 12 nt, Homo sapiens
cccucugugguc

SEQ ID NO: 2222026 - RNA, 17 nt, Homo sapiens
aaagcacauaacuggau

SEQ ID NO: 2222027 - RNA, 15 nt, Homo sapiens
gaauugagucuucca

SEQ ID NO: 2222028 - RNA, 16 nt, Homo sapiens
acaaagcaaaggcagu

SEQ ID NO: 2222029 - RNA, 16 nt, Homo sapiens
cauuacauugccauuu

SEQ ID NO: 2222030 - RNA, 13 nt, Homo sapiens
ucuuucccaacac

SEQ ID NO: 2222031 - RNA, 20 nt, Homo sapiens
cauaagcugauuugauacca

SEQ ID NO: 2222032 - RNA, 23 nt, Homo sapiens
cagaaaaucuuuccucuucucau

SEQ ID NO: 2222033 - RNA, 16 nt, Homo sapiens
guaaacauagguauaa

SEQ ID NO: 2222034 - RNA, 21 nt, Homo sapiens
guauuccccuuuauguacagg

SEQ ID NO: 2222035 - RNA, 16 nt, Homo sapiens
uaguagaagaagcuuu

SEQ ID NO: 2222036 - RNA, 22 nt, Homo sapiens
auuucauuaucauaugaacuug

SEQ ID NO: 2222037 - RNA, 19 nt, Homo sapiens
caaacagauccugaaagaa

SEQ ID NO: 2222038 - RNA, 18 nt, Homo sapiens
gcugcaucccaccagccu

SEQ ID NO: 2222039 - RNA, 15 nt, Homo sapiens
uuuuacguaugagau

SEQ ID NO: 2222040 - RNA, 11 nt, Homo sapiens
cauugugauca

SEQ ID NO: 2222041 - RNA, 20 nt, Homo sapiens
gaugcagcucuugggaccgu

SEQ ID NO: 2222042 - RNA, 15 nt, Homo sapiens
ugccagcauuucccu

SEQ ID NO: 2222043 - RNA, 21 nt, Homo sapiens
acccaaagggugacuuuucau

SEQ ID NO: 2222044 - RNA, 15 nt, Homo sapiens
ccaaucagcacucug

SEQ ID NO: 2222045 - RNA, 15 nt, Homo sapiens
ucaaauuuacuuuaa

SEQ ID NO: 2222046 - RNA, 22 nt, Homo sapiens
ggacccccuggcccugccucau

SEQ ID NO: 2222047 - RNA, 18 nt, Homo sapiens
gaaaauuuuaccagcaga

SEQ ID NO: 2222048 - RNA, 17 nt, Homo sapiens
uaauguccccacucccg

SEQ ID NO: 2222049 - RNA, 17 nt, Homo sapiens
uaacuuucuuaucccau

SEQ ID NO: 2222050 - RNA, 13 nt, Homo sapiens
ucuacacauacau

SEQ ID NO: 2222051 - RNA, 20 nt, Homo sapiens
aauuuuaaaaagucaauuca

SEQ ID NO: 2222052 - RNA, 17 nt, Homo sapiens
cauauuaagcacuuuaa

SEQ ID NO: 2222053 - RNA, 16 nt, Homo sapiens
uaugcuuacugauaua

SEQ ID NO: 2222054 - RNA, 20 nt, Homo sapiens
aacuuuauaaggaaauguau

SEQ ID NO: 2222055 - RNA, 22 nt, Homo sapiens
caguucagacacuaccccauau

SEQ ID NO: 2222056 - RNA, 14 nt, Homo sapiens
aucgccuuccccac

SEQ ID NO: 2222057 - RNA, 23 nt, Homo sapiens
cuccaccuuccaaagagugcuaa

SEQ ID NO: 2222058 - RNA, 12 nt, Homo sapiens
aggcccaucuca

SEQ ID NO: 2222059 - RNA, 21 nt, Homo sapiens
cccaauucaggacuggcucac

SEQ ID NO: 2222060 - RNA, 21 nt, Homo sapiens
augauuugggggaggcuuugg

SEQ ID NO: 2222061 - RNA, 16 nt, Homo sapiens
cagccagggcugccag

SEQ ID NO: 2222062 - RNA, 16 nt, Homo sapiens
ucucgauuagacucca

SEQ ID NO: 2222063 - RNA, 16 nt, Homo sapiens
cuggaaaagggcucag

SEQ ID NO: 2222064 - RNA, 15 nt, Homo sapiens
acuuaauaauugcau

SEQ ID NO: 2222065 - RNA, 19 nt, Homo sapiens
ucaggauugcuaggagcuc

SEQ ID NO: 2222066 - RNA, 22 nt, Homo sapiens
uauuuuuguuucuuccaaagca

SEQ ID NO: 2222067 - RNA, 22 nt, Homo sapiens
gcgcucuuucuucccucgugac

SEQ ID NO: 2222068 - RNA, 12 nt, Homo sapiens
uguuuacuuaag

SEQ ID NO: 2222069 - RNA, 17 nt, Homo sapiens
cacauuuuucagauaua

SEQ ID NO: 2222070 - RNA, 15 nt, Homo sapiens
caacuauuucuuuca

SEQ ID NO: 2222071 - RNA, 17 nt, Homo sapiens
ucuguuucaaagcacaa

SEQ ID NO: 2222072 - RNA, 16 nt, Homo sapiens
ccccuccuccacucuc

SEQ ID NO: 2222073 - RNA, 17 nt, Homo sapiens
acugugaccuuugucua

SEQ ID NO: 2222074 - RNA, 21 nt, Homo sapiens
cuccauuucuacaaugcacau

SEQ ID NO: 2222075 - RNA, 13 nt, Homo sapiens
ucuccuugcccua

SEQ ID NO: 2222076 - RNA, 13 nt, Homo sapiens
uccccuugccuua

SEQ ID NO: 2222077 - RNA, 16 nt, Homo sapiens
aaugaauuuaucugaa

SEQ ID NO: 2222078 - RNA, 18 nt, Homo sapiens
cacaaacaccuuaagcaa

SEQ ID NO: 2222079 - RNA, 20 nt, Homo sapiens
agccaguacagagaaauucu

SEQ ID NO: 2222080 - RNA, 16 nt, Homo sapiens
uaucauagauuuacaa

SEQ ID NO: 2222081 - RNA, 16 nt, Homo sapiens
ccuugcggaagccaua

SEQ ID NO: 2222082 - RNA, 21 nt, Homo sapiens
gagcacacauaaaagcacaaa

SEQ ID NO: 2222083 - RNA, 16 nt, Homo sapiens
uccaagaauacagaaa

SEQ ID NO: 2222084 - RNA, 16 nt, Homo sapiens
gugauacguacagcca

SEQ ID NO: 2222085 - RNA, 18 nt, Homo sapiens
accugaccggcaccugcg

SEQ ID NO: 2222086 - RNA, 15 nt, Homo sapiens
ggccuggcagcucag

SEQ ID NO: 2222087 - RNA, 22 nt, Homo sapiens
uauaauaaaauuucuugcugca

SEQ ID NO: 2222088 - RNA, 22 nt, Homo sapiens
cccuggggcuucuccugaccca

SEQ ID NO: 2222089 - RNA, 15 nt, Homo sapiens
aaugugaaugggaaa

SEQ ID NO: 2222090 - RNA, 12 nt, Homo sapiens
uggacagcagcu

SEQ ID NO: 2222091 - RNA, 22 nt, Homo sapiens
uauuuuuuuuuuuccaagacag

SEQ ID NO: 2222092 - RNA, 14 nt, Homo sapiens
cauguuuucuagcc

SEQ ID NO: 2222093 - RNA, 22 nt, Homo sapiens
cugcuguagaaaaaaaaauuca

SEQ ID NO: 2222094 - RNA, 21 nt, Homo sapiens
caugaccuuuuucacuguggc

SEQ ID NO: 2222095 - RNA, 21 nt, Homo sapiens
ccaaggaguuggaagugaagu

SEQ ID NO: 2222096 - RNA, 20 nt, Homo sapiens
cuguuuucuggaagugugca

SEQ ID NO: 2222097 - RNA, 16 nt, Homo sapiens
cucagggccucaggca

SEQ ID NO: 2222098 - RNA, 22 nt, Homo sapiens
ggaguaagugacacuuugaacu

SEQ ID NO: 2222099 - RNA, 18 nt, Homo sapiens
gagcaugggccuggccac

SEQ ID NO: 2222100 - RNA, 21 nt, Homo sapiens
uagagccaggcacacacugug

SEQ ID NO: 2222101 - RNA, 17 nt, Homo sapiens
caggccucacuggcuca

SEQ ID NO: 2222102 - RNA, 11 nt, Homo sapiens
gucuacacugc

SEQ ID NO: 2222103 - RNA, 19 nt, Homo sapiens
uagauccaauugcauuuau

SEQ ID NO: 2222104 - RNA, 23 nt, Homo sapiens
ccaugauuuggggugauuucuca

SEQ ID NO: 2222105 - RNA, 13 nt, Homo sapiens
aggugacugggaa

SEQ ID NO: 2222106 - RNA, 23 nt, Homo sapiens
caugaccaccccucucgccucau

SEQ ID NO: 2222107 - RNA, 12 nt, Homo sapiens
acaaacucugua

SEQ ID NO: 2222108 - RNA, 14 nt, Homo sapiens
gcagauucgaguca

SEQ ID NO: 2222109 - RNA, 15 nt, Homo sapiens
gggaggaacagggaa

SEQ ID NO: 2222110 - RNA, 13 nt, Homo sapiens
ugaggaaaauuaa

SEQ ID NO: 2222111 - RNA, 17 nt, Homo sapiens
uuccauauucuguauua

SEQ ID NO: 2222112 - RNA, 12 nt, Homo sapiens
guggcugcugug

SEQ ID NO: 2222113 - RNA, 14 nt, Homo sapiens
gaaccucaaacugg

SEQ ID NO: 2222114 - RNA, 18 nt, Homo sapiens
ucuuuccaaaacauuucu

SEQ ID NO: 2222115 - RNA, 20 nt, Homo sapiens
cuugagccaguaauuggucc

SEQ ID NO: 2222116 - RNA, 17 nt, Homo sapiens
agccaucugaagccacc

SEQ ID NO: 2222117 - RNA, 16 nt, Homo sapiens
gugccaguuugaaugc

SEQ ID NO: 2222118 - RNA, 18 nt, Homo sapiens
auuggaauuuucuuucau

SEQ ID NO: 2222119 - RNA, 16 nt, Homo sapiens
cuuaaacucuguuaca

SEQ ID NO: 2222120 - RNA, 15 nt, Homo sapiens
auuaagacaguguac

SEQ ID NO: 2222121 - RNA, 13 nt, Homo sapiens
cuugagccaguaa

SEQ ID NO: 2222122 - RNA, 18 nt, Homo sapiens
gcggcuggugcagggccu

SEQ ID NO: 2222123 - RNA, 15 nt, Homo sapiens
cuugccuugugauau

SEQ ID NO: 2222124 - RNA, 13 nt, Homo sapiens
accgccagccgcc

SEQ ID NO: 2222125 - RNA, 13 nt, Homo sapiens
ucuguaacagacu

SEQ ID NO: 2222126 - RNA, 17 nt, Homo sapiens
aguuuaauuaugccuuu

SEQ ID NO: 2222127 - RNA, 13 nt, Homo sapiens
caaguagcuuucc

SEQ ID NO: 2222128 - RNA, 19 nt, Homo sapiens
gaaaguuacuguuaagggu

SEQ ID NO: 2222129 - RNA, 12 nt, Homo sapiens
uacuuuaccucc

SEQ ID NO: 2222130 - RNA, 16 nt, Homo sapiens
gagccaaagaacaaau

SEQ ID NO: 2222131 - RNA, 20 nt, Homo sapiens
acgcugugucccucaauuac

SEQ ID NO: 2222132 - RNA, 15 nt, Homo sapiens
cagcgugaagggauu

SEQ ID NO: 2222133 - RNA, 14 nt, Homo sapiens
ggucaauuccuuag

SEQ ID NO: 2222134 - RNA, 20 nt, Homo sapiens
ugacugucuagccacucccu

SEQ ID NO: 2222135 - RNA, 12 nt, Homo sapiens
caguaacugaca

SEQ ID NO: 2222136 - RNA, 15 nt, Homo sapiens
aacagccaaaugcau

SEQ ID NO: 2222137 - RNA, 13 nt, Homo sapiens
uggucuggcaaua

SEQ ID NO: 2222138 - RNA, 14 nt, Homo sapiens
cugugugacucaaa

SEQ ID NO: 2222139 - RNA, 16 nt, Homo sapiens
ggcaacccucacugug

SEQ ID NO: 2222140 - RNA, 16 nt, Homo sapiens
agauaaguguucuuca

SEQ ID NO: 2222141 - RNA, 20 nt, Homo sapiens
ggcaggagaacuacuugaac

SEQ ID NO: 2222142 - RNA, 16 nt, Homo sapiens
gcauaugcaugugugu

SEQ ID NO: 2222143 - RNA, 17 nt, Homo sapiens
aaugaaaaacaaccaag

SEQ ID NO: 2222144 - RNA, 23 nt, Homo sapiens
gaauuuggcucuucugacauuua

SEQ ID NO: 2222145 - RNA, 17 nt, Homo sapiens
aaauucgacaacuugua

SEQ ID NO: 2222146 - RNA, 20 nt, Homo sapiens
gacuugaacaaagacauuua

SEQ ID NO: 2222147 - RNA, 13 nt, Homo sapiens
cuuaugugagccc

SEQ ID NO: 2222148 - RNA, 15 nt, Homo sapiens
cagaccccaaaccag

SEQ ID NO: 2222149 - RNA, 21 nt, Homo sapiens
cuggagaggaagccaguggag

SEQ ID NO: 2222150 - RNA, 20 nt, Homo sapiens
gggacauuccaauuugcacu

SEQ ID NO: 2222151 - RNA, 17 nt, Homo sapiens
uaauaauaguaauuccu

SEQ ID NO: 2222152 - RNA, 15 nt, Homo sapiens
cucaaguuaugucau

SEQ ID NO: 2222153 - RNA, 18 nt, Homo sapiens
ucccuccgggcaggggag

SEQ ID NO: 2222154 - RNA, 14 nt, Homo sapiens
gcccucuuaucuca

SEQ ID NO: 2222155 - RNA, 13 nt, Homo sapiens
gaagcagcacugu

SEQ ID NO: 2222156 - RNA, 14 nt, Homo sapiens
cauagcucuccuuc

SEQ ID NO: 2222157 - RNA, 15 nt, Homo sapiens
uauacuuagcuauau

SEQ ID NO: 2222158 - RNA, 17 nt, Homo sapiens
gcacagugguccagggu

SEQ ID NO: 2222159 - RNA, 14 nt, Homo sapiens
guuuaaagaccaaa

SEQ ID NO: 2222160 - RNA, 14 nt, Homo sapiens
aacuagaaccugga

SEQ ID NO: 2222161 - RNA, 17 nt, Homo sapiens
cuuggucccuccagaac

SEQ ID NO: 2222162 - RNA, 15 nt, Homo sapiens
uacccuuucccaaac

SEQ ID NO: 2222163 - RNA, 19 nt, Homo sapiens
cuuaagaguucuaaccaug

SEQ ID NO: 2222164 - RNA, 23 nt, Homo sapiens
ugggagcccacaagauccaggca

SEQ ID NO: 2222165 - RNA, 18 nt, Homo sapiens
auuuggguauagacaaua

SEQ ID NO: 2222166 - RNA, 20 nt, Homo sapiens
cuauucccucucucucccag

SEQ ID NO: 2222167 - RNA, 19 nt, Homo sapiens
acccugauaguuucccaua

SEQ ID NO: 2222168 - RNA, 12 nt, Homo sapiens
ucagauguggag

SEQ ID NO: 2222169 - RNA, 19 nt, Homo sapiens
agaggauuuaacugugaac

SEQ ID NO: 2222170 - RNA, 15 nt, Homo sapiens
gucuguggcuuucag

SEQ ID NO: 2222171 - RNA, 22 nt, Homo sapiens
acaauaagccacgaggugcagu

SEQ ID NO: 2222172 - RNA, 20 nt, Homo sapiens
agugagacaaucacagcucc

SEQ ID NO: 2222173 - RNA, 20 nt, Homo sapiens
gugaaacugggaugauaaua

SEQ ID NO: 2222174 - RNA, 15 nt, Homo sapiens
agacuccgcccuccu

SEQ ID NO: 2222175 - RNA, 18 nt, Homo sapiens
cuaaaugugauccugccu

SEQ ID NO: 2222176 - RNA, 21 nt, Homo sapiens
cuguggggcaggagugccagg

SEQ ID NO: 2222177 - RNA, 16 nt, Homo sapiens
gccuccaagcuccauc

SEQ ID NO: 2222178 - RNA, 18 nt, Homo sapiens
ugccacccaccuuugcca

SEQ ID NO: 2222179 - RNA, 14 nt, Homo sapiens
ccugcaugcugaaa

SEQ ID NO: 2222180 - RNA, 20 nt, Homo sapiens
accugugauuucugugccau

SEQ ID NO: 2222181 - RNA, 18 nt, Homo sapiens
ccccugucuacucaucca

SEQ ID NO: 2222182 - RNA, 17 nt, Homo sapiens
agagaauuuucugcauu

SEQ ID NO: 2222183 - RNA, 19 nt, Homo sapiens
caaaaccuuccucuuccag

SEQ ID NO: 2222184 - RNA, 22 nt, Homo sapiens
cacggcuccuccuuaugacucc

SEQ ID NO: 2222185 - RNA, 21 nt, Homo sapiens
auaugccuuggggaggacaaa

SEQ ID NO: 2222186 - RNA, 13 nt, Homo sapiens
acugauacuuuca

SEQ ID NO: 2222187 - RNA, 18 nt, Homo sapiens
ugaaaagaauagaagcua

SEQ ID NO: 2222188 - RNA, 14 nt, Homo sapiens
acagagggucacag

SEQ ID NO: 2222189 - RNA, 19 nt, Homo sapiens
acuucccgccuccaugacu

SEQ ID NO: 2222190 - RNA, 18 nt, Homo sapiens
gaaauaauaaaaugcaaa

SEQ ID NO: 2222191 - RNA, 21 nt, Homo sapiens
caaagccaacgaagugccaga

SEQ ID NO: 2222192 - RNA, 15 nt, Homo sapiens
gauaggaagugcccc

SEQ ID NO: 2222193 - RNA, 15 nt, Homo sapiens
ucauccaucacagau

SEQ ID NO: 2222194 - RNA, 14 nt, Homo sapiens
ccgggcaguguccc

SEQ ID NO: 2222195 - RNA, 18 nt, Homo sapiens
augccuccugcacacagc

SEQ ID NO: 2222196 - RNA, 19 nt, Homo sapiens
caacccacaccgucuuccu

SEQ ID NO: 2222197 - RNA, 17 nt, Homo sapiens
aaccauucaugaugaac

SEQ ID NO: 2222198 - RNA, 14 nt, Homo sapiens
uagcauccacugau

SEQ ID NO: 2222199 - RNA, 22 nt, Homo sapiens
aauauguauuguaaacaugugu

SEQ ID NO: 2222200 - RNA, 17 nt, Homo sapiens
caugggucuucuuuuac

SEQ ID NO: 2222201 - RNA, 16 nt, Homo sapiens
cauaugaucaaauacu

SEQ ID NO: 2222202 - RNA, 19 nt, Homo sapiens
ccagugaugaaaacauuca

SEQ ID NO: 2222203 - RNA, 20 nt, Homo sapiens
ugguuacaauuuacagugua

SEQ ID NO: 2222204 - RNA, 18 nt, Homo sapiens
ccucuaacagcaccaaau

SEQ ID NO: 2222205 - RNA, 17 nt, Homo sapiens
ugcaaggagcaacagcg

SEQ ID NO: 2222206 - RNA, 22 nt, Homo sapiens
uagcuuuagggcaauauugcca

SEQ ID NO: 2222207 - RNA, 13 nt, Homo sapiens
aggugccacuggu

SEQ ID NO: 2222208 - RNA, 21 nt, Homo sapiens
guacaugaagagcagcugguc

SEQ ID NO: 2222209 - RNA, 21 nt, Homo sapiens
gccccuauagaaacaccagua

SEQ ID NO: 2222210 - RNA, 14 nt, Homo sapiens
gacaauaggccaug

SEQ ID NO: 2222211 - RNA, 23 nt, Homo sapiens
gacaguccuauuuagacauguaa

SEQ ID NO: 2222212 - RNA, 23 nt, Homo sapiens
uucagaccagccccaccaugcaa

SEQ ID NO: 2222213 - RNA, 20 nt, Homo sapiens
aaaauuaaaugcauguccuc

SEQ ID NO: 2222214 - RNA, 15 nt, Homo sapiens
gagagaccucauccu

SEQ ID NO: 2222215 - RNA, 17 nt, Homo sapiens
accaggagcuagcccag

SEQ ID NO: 2222216 - RNA, 16 nt, Homo sapiens
ucccugcuauuucccu

SEQ ID NO: 2222217 - RNA, 20 nt, Homo sapiens
cuaaauuuacguauauuuca

SEQ ID NO: 2222218 - RNA, 19 nt, Homo sapiens
aaccuguccuugcacacuc

SEQ ID NO: 2222219 - RNA, 21 nt, Homo sapiens
gcucgacugcucaaccucacc

SEQ ID NO: 2222220 - RNA, 17 nt, Homo sapiens
uaagcauuuucuacaca

SEQ ID NO: 2222221 - RNA, 19 nt, Homo sapiens
cauucucuucuugcuauau

SEQ ID NO: 2222222 - RNA, 19 nt, Homo sapiens
ugguaccuauuugacuuac

SEQ ID NO: 2222223 - RNA, 17 nt, Homo sapiens
auuccaauuugcacuuu

SEQ ID NO: 2222224 - RNA, 22 nt, Homo sapiens
aucuaguuaagucgcugaacaa

SEQ ID NO: 2222225 - RNA, 20 nt, Homo sapiens
ugccaaaaacuaaaauucaa

SEQ ID NO: 2222226 - RNA, 20 nt, Homo sapiens
acccugcagcuaugcuggaa

SEQ ID NO: 2222227 - RNA, 18 nt, Homo sapiens
gacuuugauccauguaug

SEQ ID NO: 2222228 - RNA, 20 nt, Homo sapiens
gcuccuguguucuagaccuc

SEQ ID NO: 2222229 - RNA, 16 nt, Homo sapiens
uccuguucgugcuugu

SEQ ID NO: 2222230 - RNA, 19 nt, Homo sapiens
cuggaaugugccacagagg

SEQ ID NO: 2222231 - RNA, 19 nt, Homo sapiens
agucaguggcuuugcauag

SEQ ID NO: 2222232 - RNA, 17 nt, Homo sapiens
cuuuguuaugacaguga

SEQ ID NO: 2222233 - RNA, 17 nt, Homo sapiens
aaaauuaauaugauuau

SEQ ID NO: 2222234 - RNA, 18 nt, Homo sapiens
ccuucugaaugaagccuu

SEQ ID NO: 2222235 - RNA, 21 nt, Homo sapiens
agcagugccuaaaacccaguu

SEQ ID NO: 2222236 - RNA, 16 nt, Homo sapiens
guaagacagugcagug

SEQ ID NO: 2222237 - RNA, 15 nt, Homo sapiens
cacagcuaacaugga

SEQ ID NO: 2222238 - RNA, 15 nt, Homo sapiens
uaaauggcaccugua

SEQ ID NO: 2222239 - RNA, 17 nt, Homo sapiens
auccuaguaugccaaaa

SEQ ID NO: 2222240 - RNA, 14 nt, Homo sapiens
ucuggcagagauuc

SEQ ID NO: 2222241 - RNA, 22 nt, Homo sapiens
aacugucucucaugaaccucaa

SEQ ID NO: 2222242 - RNA, 13 nt, Homo sapiens
uuggcugauuccu

SEQ ID NO: 2222243 - RNA, 18 nt, Homo sapiens
caacagaagcuuccauuc

SEQ ID NO: 2222244 - RNA, 17 nt, Homo sapiens
uaguuuaaaacaucaga

SEQ ID NO: 2222245 - RNA, 23 nt, Homo sapiens
augguguagaacacuaauucaua

SEQ ID NO: 2222246 - RNA, 15 nt, Homo sapiens
uaaaguuugcuuuca

SEQ ID NO: 2222247 - RNA, 19 nt, Homo sapiens
auggacagcauugccagua

SEQ ID NO: 2222248 - RNA, 21 nt, Homo sapiens
ugacaccgugggucauuacaa

SEQ ID NO: 2222249 - RNA, 15 nt, Homo sapiens
aucugaacauuuacu

SEQ ID NO: 2222250 - RNA, 16 nt, Homo sapiens
uaagucaccuguauaa

SEQ ID NO: 2222251 - RNA, 16 nt, Homo sapiens
uuggcugaacuacaag

SEQ ID NO: 2222252 - RNA, 18 nt, Homo sapiens
ggucuuggucauuugcca

SEQ ID NO: 2222253 - RNA, 19 nt, Homo sapiens
ucagcuauuuagugauaua

SEQ ID NO: 2222254 - RNA, 18 nt, Homo sapiens
auagaauaaaauauaauu

SEQ ID NO: 2222255 - RNA, 16 nt, Homo sapiens
uuuaaagcuuauuucc

SEQ ID NO: 2222256 - RNA, 15 nt, Homo sapiens
ggacaaaugaugcca

SEQ ID NO: 2222257 - RNA, 13 nt, Homo sapiens
cauacaauuccaa

SEQ ID NO: 2222258 - RNA, 21 nt, Homo sapiens
auucaggacuuaacggcucca

SEQ ID NO: 2222259 - RNA, 16 nt, Homo sapiens
cccgggaauguuucag

SEQ ID NO: 2222260 - RNA, 18 nt, Homo sapiens
auucccccuuccuaguga

SEQ ID NO: 2222261 - RNA, 16 nt, Homo sapiens
gucaccccucacugug

SEQ ID NO: 2222262 - RNA, 18 nt, Homo sapiens
gaauauaaaacagucaug

SEQ ID NO: 2222263 - RNA, 15 nt, Homo sapiens
uguuccugcuaauaa

SEQ ID NO: 2222264 - RNA, 20 nt, Homo sapiens
acaaacccccacuccagcuc

SEQ ID NO: 2222265 - RNA, 21 nt, Homo sapiens
aagaucuguaaguaacuucac

SEQ ID NO: 2222266 - RNA, 17 nt, Homo sapiens
uguggguuuuuucacau

SEQ ID NO: 2222267 - RNA, 17 nt, Homo sapiens
uaccuggcaauucacaa

SEQ ID NO: 2222268 - RNA, 15 nt, Homo sapiens
cugcaagaaguacau

SEQ ID NO: 2222269 - RNA, 16 nt, Homo sapiens
aggccuggccaugugg

SEQ ID NO: 2222270 - RNA, 13 nt, Homo sapiens
ucucugccaugaa

SEQ ID NO: 2222271 - RNA, 14 nt, Homo sapiens
uggugcuggguccu

SEQ ID NO: 2222272 - RNA, 20 nt, Homo sapiens
gguugucagcugcagccacu

SEQ ID NO: 2222273 - RNA, 23 nt, Homo sapiens
cauacuacaguaacugugacuga

SEQ ID NO: 2222274 - RNA, 22 nt, Homo sapiens
guuuaucaguaaauaacuggaa

SEQ ID NO: 2222275 - RNA, 13 nt, Homo sapiens
aaccccaguggau

SEQ ID NO: 2222276 - RNA, 10 nt, Homo sapiens
uugcuucuag

SEQ ID NO: 2222277 - RNA, 23 nt, Homo sapiens
uaggaaagaccauuuuuccucca

SEQ ID NO: 2222278 - RNA, 19 nt, Homo sapiens
uacaggugccccaccuccc

SEQ ID NO: 2222279 - RNA, 18 nt, Homo sapiens
uggagucaccaaaaccag

SEQ ID NO: 2222280 - RNA, 15 nt, Homo sapiens
acugacuaccagcua

SEQ ID NO: 2222281 - RNA, 20 nt, Homo sapiens
gcuuuuaauugacagucacu

SEQ ID NO: 2222282 - RNA, 13 nt, Homo sapiens
uccucugauuuga

SEQ ID NO: 2222283 - RNA, 19 nt, Homo sapiens
aucuguagcugugcuuuga

SEQ ID NO: 2222284 - RNA, 19 nt, Homo sapiens
cucaugagugccaagcaaa

SEQ ID NO: 2222285 - RNA, 12 nt, Homo sapiens
cucuuuccauuc

SEQ ID NO: 2222286 - RNA, 16 nt, Homo sapiens
aggcaugaaucuuccc

SEQ ID NO: 2222287 - RNA, 12 nt, Homo sapiens
gucaguuuucau

SEQ ID NO: 2222288 - RNA, 19 nt, Homo sapiens
cuguucuguuggaugacuu

SEQ ID NO: 2222289 - RNA, 12 nt, Homo sapiens
cuugaggucucu

SEQ ID NO: 2222290 - RNA, 15 nt, Homo sapiens
aaaguauucuagugu

SEQ ID NO: 2222291 - RNA, 14 nt, Homo sapiens
uuccacuuccugcc

SEQ ID NO: 2222292 - RNA, 10 nt, Homo sapiens
aacaucucca

SEQ ID NO: 2222293 - RNA, 19 nt, Homo sapiens
auccuucuggcuguagaua

SEQ ID NO: 2222294 - RNA, 18 nt, Homo sapiens
ugagcugccuccagccug

SEQ ID NO: 2222295 - RNA, 19 nt, Homo sapiens
auuucaugggaauauucaa

SEQ ID NO: 2222296 - RNA, 22 nt, Homo sapiens
gucuuauucuugugcacuuuau

SEQ ID NO: 2222297 - RNA, 14 nt, Homo sapiens
ucuuugguggcaug

SEQ ID NO: 2222298 - RNA, 17 nt, Homo sapiens
augugagucccugugau

SEQ ID NO: 2222299 - RNA, 20 nt, Homo sapiens
caguaaaauacuauucucau

SEQ ID NO: 2222300 - RNA, 21 nt, Homo sapiens
aaaccuuaguacugaguuaca

SEQ ID NO: 2222301 - RNA, 18 nt, Homo sapiens
gcccucaaaauguccuga

SEQ ID NO: 2222302 - RNA, 21 nt, Homo sapiens
aaaaguugguguugacauaca

SEQ ID NO: 2222303 - RNA, 19 nt, Homo sapiens
agauaaucucuccauuccc

SEQ ID NO: 2222304 - RNA, 21 nt, Homo sapiens
ugccaucaccgcugggugguu

SEQ ID NO: 2222305 - RNA, 20 nt, Homo sapiens
acuuuagugauugcuuuuau

SEQ ID NO: 2222306 - RNA, 18 nt, Homo sapiens
uggcuauaacagugucuu

SEQ ID NO: 2222307 - RNA, 12 nt, Homo sapiens
gacaacauuuua

SEQ ID NO: 2222308 - RNA, 12 nt, Homo sapiens
gaugacauuucg

SEQ ID NO: 2222309 - RNA, 20 nt, Homo sapiens
uccuuaacuguccaguccag

SEQ ID NO: 2222310 - RNA, 23 nt, Homo sapiens
accaguuaagagacaacuaucaa

SEQ ID NO: 2222311 - RNA, 12 nt, Homo sapiens
agaccaguagug

SEQ ID NO: 2222312 - RNA, 22 nt, Homo sapiens
agaauaaaugaaucuuacuccu

SEQ ID NO: 2222313 - RNA, 21 nt, Homo sapiens
gucugaauacugcagcacucu

SEQ ID NO: 2222314 - RNA, 16 nt, Homo sapiens
uucugagugugcagac

SEQ ID NO: 2222315 - RNA, 14 nt, Homo sapiens
uguaguagucucau

SEQ ID NO: 2222316 - RNA, 21 nt, Homo sapiens
uuguucagucuuucauuuaga

SEQ ID NO: 2222317 - RNA, 13 nt, Homo sapiens
ugagcagguauca

SEQ ID NO: 2222318 - RNA, 16 nt, Homo sapiens
agaaggcacaggugua

SEQ ID NO: 2222319 - RNA, 11 nt, Homo sapiens
aaucugaugaa

SEQ ID NO: 2222320 - RNA, 18 nt, Homo sapiens
gagcuagaugugucuuac

SEQ ID NO: 2222321 - RNA, 20 nt, Homo sapiens
gugucagguuuuucaguguu

SEQ ID NO: 2222322 - RNA, 19 nt, Homo sapiens
ccuagugcaaaaacuguaa

SEQ ID NO: 2222323 - RNA, 14 nt, Homo sapiens
uaaaucugagaucu

SEQ ID NO: 2222324 - RNA, 18 nt, Homo sapiens
acgggucugagacugaaa

SEQ ID NO: 2222325 - RNA, 16 nt, Homo sapiens
auuccagucucugcau

SEQ ID NO: 2222326 - RNA, 17 nt, Homo sapiens
cacuaaggugugcucug

SEQ ID NO: 2222327 - RNA, 17 nt, Homo sapiens
aucccauggaaccacua

SEQ ID NO: 2222328 - RNA, 16 nt, Homo sapiens
caaggaaaccacagcu

SEQ ID NO: 2222329 - RNA, 12 nt, Homo sapiens
aucuauuuuccu

SEQ ID NO: 2222330 - RNA, 13 nt, Homo sapiens
gugcaaagggaac

SEQ ID NO: 2222331 - RNA, 21 nt, Homo sapiens
gauucacccccaaacagugac

SEQ ID NO: 2222332 - RNA, 19 nt, Homo sapiens
cgaugaaguuaugcuguca

SEQ ID NO: 2222333 - RNA, 13 nt, Homo sapiens
acagacaggaaag

SEQ ID NO: 2222334 - RNA, 16 nt, Homo sapiens
uuagccauuucuccau

SEQ ID NO: 2222335 - RNA, 22 nt, Homo sapiens
auaauaugaugcaaacugugcu

SEQ ID NO: 2222336 - RNA, 13 nt, Homo sapiens
aggcugcaccuac

SEQ ID NO: 2222337 - RNA, 17 nt, Homo sapiens
cugccacaccagucaca

SEQ ID NO: 2222338 - RNA, 17 nt, Homo sapiens
uuauagugacaaugaag

SEQ ID NO: 2222339 - RNA, 14 nt, Homo sapiens
ugggacaaccagac

SEQ ID NO: 2222340 - RNA, 22 nt, Homo sapiens
uccuuuggccauuccaacagcu

SEQ ID NO: 2222341 - RNA, 22 nt, Homo sapiens
cacagugcuggggaacaaccag

SEQ ID NO: 2222342 - RNA, 22 nt, Homo sapiens
ugaucacaugugcccucugcca

SEQ ID NO: 2222343 - RNA, 15 nt, Homo sapiens
acagccugucuucag

SEQ ID NO: 2222344 - RNA, 20 nt, Homo sapiens
augaaggcugggggcauuuu

SEQ ID NO: 2222345 - RNA, 17 nt, Homo sapiens
auaacucggauuccagc

SEQ ID NO: 2222346 - RNA, 13 nt, Homo sapiens
agcugcucaggcu

SEQ ID NO: 2222347 - RNA, 21 nt, Homo sapiens
cccuccaagucuguaccucaa

SEQ ID NO: 2222348 - RNA, 21 nt, Homo sapiens
uggcauaaggaguuagaacca

SEQ ID NO: 2222349 - RNA, 19 nt, Homo sapiens
cacagaggucaggaagcag

SEQ ID NO: 2222350 - RNA, 20 nt, Homo sapiens
cucaacaauauauguccuau

SEQ ID NO: 2222351 - RNA, 11 nt, Homo sapiens
cagguggaccc

SEQ ID NO: 2222352 - RNA, 12 nt, Homo sapiens
cagaguacauga

SEQ ID NO: 2222353 - RNA, 20 nt, Homo sapiens
aauaccagugaaccaaagag

SEQ ID NO: 2222354 - RNA, 21 nt, Homo sapiens
agaaagccugaguacuccaca

SEQ ID NO: 2222355 - RNA, 13 nt, Homo sapiens
cuuuugauaugau

SEQ ID NO: 2222356 - RNA, 20 nt, Homo sapiens
ugauucuguaauaacuagaa

SEQ ID NO: 2222357 - RNA, 20 nt, Homo sapiens
ccagcacuccaucacugaga

SEQ ID NO: 2222358 - RNA, 12 nt, Homo sapiens
cuaaaaucauga

SEQ ID NO: 2222359 - RNA, 17 nt, Homo sapiens
cccgugccaaguccagg

SEQ ID NO: 2222360 - RNA, 15 nt, Homo sapiens
ugucuguauucauac

SEQ ID NO: 2222361 - RNA, 14 nt, Homo sapiens
acuacugcauuuau

SEQ ID NO: 2222362 - RNA, 18 nt, Homo sapiens
auaauuuuugugagguau

SEQ ID NO: 2222363 - RNA, 14 nt, Homo sapiens
ugagccaagaaagu

SEQ ID NO: 2222364 - RNA, 22 nt, Homo sapiens
ccugcuuggguggagaagccau

SEQ ID NO: 2222365 - RNA, 14 nt, Homo sapiens
gcagggacuugaac

SEQ ID NO: 2222366 - RNA, 19 nt, Homo sapiens
ugaugugaaacacuuugcc

SEQ ID NO: 2222367 - RNA, 14 nt, Homo sapiens
cacaucagcccugu

SEQ ID NO: 2222368 - RNA, 22 nt, Homo sapiens
agagggguggaguuuuaacugu

SEQ ID NO: 2222369 - RNA, 15 nt, Homo sapiens
ugauuuugcuuucca

SEQ ID NO: 2222370 - RNA, 13 nt, Homo sapiens
uuucaauuuauca

SEQ ID NO: 2222371 - RNA, 18 nt, Homo sapiens
aaauauguauuuuccuaa

SEQ ID NO: 2222372 - RNA, 22 nt, Homo sapiens
aggcagcgcugcaguugcucag

SEQ ID NO: 2222373 - RNA, 18 nt, Homo sapiens
ccacagggucugcacucu

SEQ ID NO: 2222374 - RNA, 16 nt, Homo sapiens
accugaucccacgagg

SEQ ID NO: 2222375 - RNA, 23 nt, Homo sapiens
ucaaucuagaacuuuucuauuaa

SEQ ID NO: 2222376 - RNA, 21 nt, Homo sapiens
uuaaacucagggagcauuuau

SEQ ID NO: 2222377 - RNA, 17 nt, Homo sapiens
gaagauuauaugaaguu

SEQ ID NO: 2222378 - RNA, 19 nt, Homo sapiens
gugaaucugggugggauaa

SEQ ID NO: 2222379 - RNA, 16 nt, Homo sapiens
gcaacacucuacuuga

SEQ ID NO: 2222380 - RNA, 13 nt, Homo sapiens
uagagcagacagg

SEQ ID NO: 2222381 - RNA, 21 nt, Homo sapiens
guuacaucacaguguuugcaa

SEQ ID NO: 2222382 - RNA, 15 nt, Homo sapiens
agggaucaguugccc

SEQ ID NO: 2222383 - RNA, 23 nt, Homo sapiens
cauuagauuuggaggcuaccuca

SEQ ID NO: 2222384 - RNA, 16 nt, Homo sapiens
ccuacuacaugcaagg

SEQ ID NO: 2222385 - RNA, 22 nt, Homo sapiens
uugaggaaaaauauuccuguga

SEQ ID NO: 2222386 - RNA, 18 nt, Homo sapiens
uaagacaugauuuccuug

SEQ ID NO: 2222387 - RNA, 17 nt, Homo sapiens
agccccuuccuggguau

SEQ ID NO: 2222388 - RNA, 17 nt, Homo sapiens
aagaauguuaugugcaa

SEQ ID NO: 2222389 - RNA, 14 nt, Homo sapiens
ucuucccaucuguu

SEQ ID NO: 2222390 - RNA, 16 nt, Homo sapiens
uaaaggaugggaccaa

SEQ ID NO: 2222391 - RNA, 20 nt, Homo sapiens
uaaccugggcuuaaguuuua

SEQ ID NO: 2222392 - RNA, 19 nt, Homo sapiens
uacugcuaguaccuguaag

SEQ ID NO: 2222393 - RNA, 24 nt, Homo sapiens
uuauagucaauggcuuguucauca

SEQ ID NO: 2222394 - RNA, 14 nt, Homo sapiens
gacugccugugaag

SEQ ID NO: 2222395 - RNA, 16 nt, Homo sapiens
cacaaagacuccuucg

SEQ ID NO: 2222396 - RNA, 22 nt, Homo sapiens
acaucuggcggccaagugagga

SEQ ID NO: 2222397 - RNA, 20 nt, Homo sapiens
cuguucuuacaaaugugaaa

SEQ ID NO: 2222398 - RNA, 14 nt, Homo sapiens
guucuuuuacaaau

SEQ ID NO: 2222399 - RNA, 11 nt, Homo sapiens
gaaguuugcau

SEQ ID NO: 2222400 - RNA, 23 nt, Homo sapiens
ccagacuccaccgucagcuguaa

SEQ ID NO: 2222401 - RNA, 16 nt, Homo sapiens
aaggaaggacuaugac

SEQ ID NO: 2222402 - RNA, 19 nt, Homo sapiens
ucuguucuaaccacuucag

SEQ ID NO: 2222403 - RNA, 13 nt, Homo sapiens
cuuucuucauuca

SEQ ID NO: 2222404 - RNA, 22 nt, Homo sapiens
ugccugggagaguggaccugug

SEQ ID NO: 2222405 - RNA, 11 nt, Homo sapiens
cuaguacaaaa

SEQ ID NO: 2222406 - RNA, 22 nt, Homo sapiens
gaaggucuugccugaauccauc

SEQ ID NO: 2222407 - RNA, 21 nt, Homo sapiens
aacuuggugccuaauguucca

SEQ ID NO: 2222408 - RNA, 23 nt, Homo sapiens
aacauacugcauuucacucuggg

SEQ ID NO: 2222409 - RNA, 20 nt, Homo sapiens
uguggaggcuaucaacaaag

SEQ ID NO: 2222410 - RNA, 14 nt, Homo sapiens
uaaugauacuuaac

SEQ ID NO: 2222411 - RNA, 23 nt, Homo sapiens
cuuccuguguggccugccuucac

SEQ ID NO: 2222412 - RNA, 19 nt, Homo sapiens
ucccucugcagucucuaua

SEQ ID NO: 2222413 - RNA, 21 nt, Homo sapiens
gcaaacugccaucauuuacuu

SEQ ID NO: 2222414 - RNA, 14 nt, Homo sapiens
uauucaaaugaagg

SEQ ID NO: 2222415 - RNA, 18 nt, Homo sapiens
ugacaguggucccagaac

SEQ ID NO: 2222416 - RNA, 14 nt, Homo sapiens
ugacauucuacagu

SEQ ID NO: 2222417 - RNA, 18 nt, Homo sapiens
cuuaaaagaacauguaua

SEQ ID NO: 2222418 - RNA, 11 nt, Homo sapiens
auaguacuggc

SEQ ID NO: 2222419 - RNA, 23 nt, Homo sapiens
aauacugaaggacacagcagugg

SEQ ID NO: 2222420 - RNA, 22 nt, Homo sapiens
gccugacggggaggaaccacug

SEQ ID NO: 2222421 - RNA, 17 nt, Homo sapiens
uugacacuuguugucca

SEQ ID NO: 2222422 - RNA, 22 nt, Homo sapiens
agcuucuggagcagaacuuucc

SEQ ID NO: 2222423 - RNA, 21 nt, Homo sapiens
caccacucaggccacaguggg

SEQ ID NO: 2222424 - RNA, 14 nt, Homo sapiens
aagucuuaguacau

SEQ ID NO: 2222425 - RNA, 19 nt, Homo sapiens
aaggucugugggccaaaga

SEQ ID NO: 2222426 - RNA, 19 nt, Homo sapiens
agcacagaauuugucagaa

SEQ ID NO: 2222427 - RNA, 16 nt, Homo sapiens
acuguaaaagauucau

SEQ ID NO: 2222428 - RNA, 22 nt, Homo sapiens
cuuacaauaauucuaugagaua

SEQ ID NO: 2222429 - RNA, 22 nt, Homo sapiens
ccagccccucuccccucucugc

SEQ ID NO: 2222430 - RNA, 18 nt, Homo sapiens
auuguuuaagccagagug

SEQ ID NO: 2222431 - RNA, 15 nt, Homo sapiens
aaaacucacugugau

SEQ ID NO: 2222432 - RNA, 15 nt, Homo sapiens
gaacuacugcuggaa

SEQ ID NO: 2222433 - RNA, 22 nt, Homo sapiens
ugcccacccccgggauccugcc

SEQ ID NO: 2222434 - RNA, 12 nt, Homo sapiens
cucccagggugg

SEQ ID NO: 2222435 - RNA, 21 nt, Homo sapiens
ccccuuguuuagcauauaauc

SEQ ID NO: 2222436 - RNA, 22 nt, Homo sapiens
gaugucuuugcugcagucuucu

SEQ ID NO: 2222437 - RNA, 21 nt, Homo sapiens
aaucauacaaauacuauccaa

SEQ ID NO: 2222438 - RNA, 18 nt, Homo sapiens
acaguaaaaggacagaga

SEQ ID NO: 2222439 - RNA, 20 nt, Homo sapiens
uagaauauuauguuccucaa

SEQ ID NO: 2222440 - RNA, 14 nt, Homo sapiens
uuccaucacagcca

SEQ ID NO: 2222441 - RNA, 18 nt, Homo sapiens
acuugucugccuccugcu

SEQ ID NO: 2222442 - RNA, 19 nt, Homo sapiens
ugugcguguguccaugugu

SEQ ID NO: 2222443 - RNA, 17 nt, Homo sapiens
aucaaaggagagucaca

SEQ ID NO: 2222444 - RNA, 19 nt, Homo sapiens
caggaaacauucagugaaa

SEQ ID NO: 2222445 - RNA, 16 nt, Homo sapiens
auguucaccuuuauau

SEQ ID NO: 2222446 - RNA, 18 nt, Homo sapiens
aaguugcuuuuuugacuc

SEQ ID NO: 2222447 - RNA, 20 nt, Homo sapiens
ugcaaagugauucacugugc

SEQ ID NO: 2222448 - RNA, 17 nt, Homo sapiens
gcaguuaugugaccuca

SEQ ID NO: 2222449 - RNA, 15 nt, Homo sapiens
ccucauuauuaucua

SEQ ID NO: 2222450 - RNA, 18 nt, Homo sapiens
auaaaugucagauaauua

SEQ ID NO: 2222451 - RNA, 15 nt, Homo sapiens
aaccccucugggaaa

SEQ ID NO: 2222452 - RNA, 14 nt, Homo sapiens
gcauucuauugccu

SEQ ID NO: 2222453 - RNA, 16 nt, Homo sapiens
ucaccaaggugacaca

SEQ ID NO: 2222454 - RNA, 14 nt, Homo sapiens
guacauacuggccu

SEQ ID NO: 2222455 - RNA, 16 nt, Homo sapiens
gccacugcacaccagc

SEQ ID NO: 2222456 - RNA, 18 nt, Homo sapiens
cugguaauaaaugugacu

SEQ ID NO: 2222457 - RNA, 15 nt, Homo sapiens
cucuggaccagccug

SEQ ID NO: 2222458 - RNA, 14 nt, Homo sapiens
agauaauguugcuu

SEQ ID NO: 2222459 - RNA, 12 nt, Homo sapiens
caauucuugaga

SEQ ID NO: 2222460 - RNA, 13 nt, Homo sapiens
ggugugaggccac

SEQ ID NO: 2222461 - RNA, 18 nt, Homo sapiens
agugacuguaucugugua

SEQ ID NO: 2222462 - RNA, 14 nt, Homo sapiens
ucuaauccagcaaa

SEQ ID NO: 2222463 - RNA, 17 nt, Homo sapiens
aguguuugaaagcuuua

SEQ ID NO: 2222464 - RNA, 22 nt, Homo sapiens
acucugucauaauuaaaucaua

SEQ ID NO: 2222465 - RNA, 20 nt, Homo sapiens
acugcacuccaaucugggug

SEQ ID NO: 2222466 - RNA, 13 nt, Homo sapiens
ucugaugugaugu

SEQ ID NO: 2222467 - RNA, 11 nt, Homo sapiens
aacccacugcu

SEQ ID NO: 2222468 - RNA, 17 nt, Homo sapiens
uugaugagaauccugac

SEQ ID NO: 2222469 - RNA, 20 nt, Homo sapiens
uuagaaauguaaacugccau

SEQ ID NO: 2222470 - RNA, 19 nt, Homo sapiens
cugcccaccuggcugccaa

SEQ ID NO: 2222471 - RNA, 14 nt, Homo sapiens
gagucugaagcaga

SEQ ID NO: 2222472 - RNA, 20 nt, Homo sapiens
uuacucccuacacugaugca

SEQ ID NO: 2222473 - RNA, 12 nt, Homo sapiens
agugccaggacu

SEQ ID NO: 2222474 - RNA, 19 nt, Homo sapiens
cagccucuagcaccaggac

SEQ ID NO: 2222475 - RNA, 22 nt, Homo sapiens
uaaacauugguucuuguauuaa

SEQ ID NO: 2222476 - RNA, 13 nt, Homo sapiens
accaccagcacag

SEQ ID NO: 2222477 - RNA, 20 nt, Homo sapiens
gacagcuucaugaaacuguc

SEQ ID NO: 2222478 - RNA, 16 nt, Homo sapiens
aaucuuauacaacagc

SEQ ID NO: 2222479 - RNA, 15 nt, Homo sapiens
uaauauauuguacac

SEQ ID NO: 2222480 - RNA, 22 nt, Homo sapiens
cacggagcugaagcugggagcu

SEQ ID NO: 2222481 - RNA, 12 nt, Homo sapiens
ccaccucaggcu

SEQ ID NO: 2222482 - RNA, 18 nt, Homo sapiens
gugcuguggccugggcaa

SEQ ID NO: 2222483 - RNA, 15 nt, Homo sapiens
ugccuaacuuguaaa

SEQ ID NO: 2222484 - RNA, 13 nt, Homo sapiens
cguuaucauggag

SEQ ID NO: 2222485 - RNA, 20 nt, Homo sapiens
caaaaauagcccugcaaaaa

SEQ ID NO: 2222486 - RNA, 15 nt, Homo sapiens
guauauacuuugcca

SEQ ID NO: 2222487 - RNA, 22 nt, Homo sapiens
uccaaauacugauggugcauuu

SEQ ID NO: 2222488 - RNA, 20 nt, Homo sapiens
auacaaaagcaagacuucca

SEQ ID NO: 2222489 - RNA, 13 nt, Homo sapiens
agcauaaugugag

SEQ ID NO: 2222490 - RNA, 21 nt, Homo sapiens
agggagcuaucaggaacagcu

SEQ ID NO: 2222491 - RNA, 12 nt, Homo sapiens
ugcuucaccaag

SEQ ID NO: 2222492 - RNA, 17 nt, Homo sapiens
caaaggauuugaugcuu

SEQ ID NO: 2222493 - RNA, 13 nt, Homo sapiens
cugcuucagucca

SEQ ID NO: 2222494 - RNA, 20 nt, Homo sapiens
gccacgagacgucaccaaga

SEQ ID NO: 2222495 - RNA, 19 nt, Homo sapiens
ccugaccugucaccgugag

SEQ ID NO: 2222496 - RNA, 19 nt, Homo sapiens
aguaucuaacaaaaccaau

SEQ ID NO: 2222497 - RNA, 18 nt, Homo sapiens
ccaguggaucauaagaca

SEQ ID NO: 2222498 - RNA, 20 nt, Homo sapiens
agugauccuccugccucagc

SEQ ID NO: 2222499 - RNA, 17 nt, Homo sapiens
uggaaggaaaaggaauu

SEQ ID NO: 2222500 - RNA, 14 nt, Homo sapiens
guccucacacacgg

SEQ ID NO: 2222501 - RNA, 12 nt, Homo sapiens
cuucuacuuuua

SEQ ID NO: 2222502 - RNA, 20 nt, Homo sapiens
gaaguaauucuucugccuca

SEQ ID NO: 2222503 - RNA, 20 nt, Homo sapiens
uucucuguauaacuugugau

SEQ ID NO: 2222504 - RNA, 18 nt, Homo sapiens
caagccaggguuccagac

SEQ ID NO: 2222505 - RNA, 13 nt, Homo sapiens
gacucgggaccaa

SEQ ID NO: 2222506 - RNA, 14 nt, Homo sapiens
auguuuuugccaaa

SEQ ID NO: 2222507 - RNA, 21 nt, Homo sapiens
cauccuaagaaauaugugaga

SEQ ID NO: 2222508 - RNA, 20 nt, Homo sapiens
uaucauccugccuucaugga

SEQ ID NO: 2222509 - RNA, 17 nt, Homo sapiens
agcgacaucccaguagu

SEQ ID NO: 2222510 - RNA, 13 nt, Homo sapiens
uguauuugguaua

SEQ ID NO: 2222511 - RNA, 17 nt, Homo sapiens
ccuguucaauaaaagua

SEQ ID NO: 2222512 - RNA, 14 nt, Homo sapiens
ucuccacugugcuu

SEQ ID NO: 2222513 - RNA, 17 nt, Homo sapiens
gccaucccaaggcuccu

SEQ ID NO: 2222514 - RNA, 15 nt, Homo sapiens
gaccuggcucucaga

SEQ ID NO: 2222515 - RNA, 18 nt, Homo sapiens
auccauguguggacucaa

SEQ ID NO: 2222516 - RNA, 23 nt, Homo sapiens
ucuucagacuuaaagcacugaua

SEQ ID NO: 2222517 - RNA, 13 nt, Homo sapiens
uaaacgggaacau

SEQ ID NO: 2222518 - RNA, 17 nt, Homo sapiens
caugccuuaagccaguu

SEQ ID NO: 2222519 - RNA, 23 nt, Homo sapiens
gaaggugcaguugaauucagugg

SEQ ID NO: 2222520 - RNA, 20 nt, Homo sapiens
accauuuuuacauccaugaa

SEQ ID NO: 2222521 - RNA, 19 nt, Homo sapiens
ucagcuagacauugcaauu

SEQ ID NO: 2222522 - RNA, 21 nt, Homo sapiens
acucacuuucccuugugucaa

SEQ ID NO: 2222523 - RNA, 21 nt, Homo sapiens
cuuccaggggagguucaguga

SEQ ID NO: 2222524 - RNA, 12 nt, Homo sapiens
aguacaaccuga

SEQ ID NO: 2222525 - RNA, 23 nt, Homo sapiens
aaaagaaagagcugaaaauggag

SEQ ID NO: 2222526 - RNA, 17 nt, Homo sapiens
ucaguuguuccuacuca

SEQ ID NO: 2222527 - RNA, 14 nt, Homo sapiens
gguucuugagccag

SEQ ID NO: 2222528 - RNA, 15 nt, Homo sapiens
ccagcuuugcaguga

SEQ ID NO: 2222529 - RNA, 20 nt, Homo sapiens
gaauggucuggcaauauucu

SEQ ID NO: 2222530 - RNA, 16 nt, Homo sapiens
aaaucaaauugcuuaa

SEQ ID NO: 2222531 - RNA, 14 nt, Homo sapiens
accacauagacuuu

SEQ ID NO: 2222532 - RNA, 14 nt, Homo sapiens
acuaaccuacccca

SEQ ID NO: 2222533 - RNA, 20 nt, Homo sapiens
agcuguugagguaccuccaa

SEQ ID NO: 2222534 - RNA, 17 nt, Homo sapiens
guuaaauuuuacaugac

SEQ ID NO: 2222535 - RNA, 18 nt, Homo sapiens
auguacaauaaagcaaug

SEQ ID NO: 2222536 - RNA, 23 nt, Homo sapiens
uggguuggggacccccucaggau

SEQ ID NO: 2222537 - RNA, 13 nt, Homo sapiens
augagcuuuacag

SEQ ID NO: 2222538 - RNA, 13 nt, Homo sapiens
uuugccucaaaua

SEQ ID NO: 2222539 - RNA, 15 nt, Homo sapiens
ucgcuugaacccagg

SEQ ID NO: 2222540 - RNA, 19 nt, Homo sapiens
cugccagagagaccugcug

SEQ ID NO: 2222541 - RNA, 22 nt, Homo sapiens
agcuggcuuguuucuuaugcca

SEQ ID NO: 2222542 - RNA, 15 nt, Homo sapiens
ggacacuacacuggg

SEQ ID NO: 2222543 - RNA, 15 nt, Homo sapiens
aggugggcagaucau

SEQ ID NO: 2222544 - RNA, 22 nt, Homo sapiens
gauacauuucugaaugggcaau

SEQ ID NO: 2222545 - RNA, 12 nt, Homo sapiens
agagaccagacc

SEQ ID NO: 2222546 - RNA, 13 nt, Homo sapiens
cccaguucagugu

SEQ ID NO: 2222547 - RNA, 21 nt, Homo sapiens
aaggaucuccccgaaucucaa

SEQ ID NO: 2222548 - RNA, 15 nt, Homo sapiens
cuggagaaccucauc

SEQ ID NO: 2222549 - RNA, 18 nt, Homo sapiens
cacuugcacgcccaugug

SEQ ID NO: 2222550 - RNA, 15 nt, Homo sapiens
guuccuauugucauu

SEQ ID NO: 2222551 - RNA, 14 nt, Homo sapiens
gucaucuaccugag

SEQ ID NO: 2222552 - RNA, 13 nt, Homo sapiens
ugugugugcauau

SEQ ID NO: 2222553 - RNA, 13 nt, Homo sapiens
acaguacuaugua

SEQ ID NO: 2222554 - RNA, 13 nt, Homo sapiens
cccuuuccacgag

SEQ ID NO: 2222555 - RNA, 23 nt, Homo sapiens
cuauuuaaaaaaaaagucagaga

SEQ ID NO: 2222556 - RNA, 19 nt, Homo sapiens
ucaaguccuacaagcuaaa

SEQ ID NO: 2222557 - RNA, 22 nt, Homo sapiens
caaggugggaagaucauuugag

SEQ ID NO: 2222558 - RNA, 13 nt, Homo sapiens
ugugccaccuccc

SEQ ID NO: 2222559 - RNA, 14 nt, Homo sapiens
ucuugccuuugaag

SEQ ID NO: 2222560 - RNA, 13 nt, Homo sapiens
ggauguucuagca

SEQ ID NO: 2222561 - RNA, 17 nt, Homo sapiens
caccuggcccuugcaau

SEQ ID NO: 2222562 - RNA, 17 nt, Homo sapiens
ggggcagcccugagugg

SEQ ID NO: 2222563 - RNA, 18 nt, Homo sapiens
uauaguuugcuguugcau

SEQ ID NO: 2222564 - RNA, 14 nt, Homo sapiens
uuugauaaacugaa

SEQ ID NO: 2222565 - RNA, 15 nt, Homo sapiens
ucaacccugcaauca

SEQ ID NO: 2222566 - RNA, 23 nt, Homo sapiens
uacuaaugaaauuuacagugaua

SEQ ID NO: 2222567 - RNA, 19 nt, Homo sapiens
ugcaacagguuuguucuca

SEQ ID NO: 2222568 - RNA, 17 nt, Homo sapiens
acagcugcaggugccca

SEQ ID NO: 2222569 - RNA, 21 nt, Homo sapiens
ccacagccccucaaagacuuu

SEQ ID NO: 2222570 - RNA, 13 nt, Homo sapiens
cugaguggggcca

SEQ ID NO: 2222571 - RNA, 17 nt, Homo sapiens
ucaagugcugugcaagg

SEQ ID NO: 2222572 - RNA, 14 nt, Homo sapiens
aguuguucaaacau

SEQ ID NO: 2222573 - RNA, 23 nt, Homo sapiens
uguccucaggccugaacucacca

SEQ ID NO: 2222574 - RNA, 13 nt, Homo sapiens
cuggauucuacaa

SEQ ID NO: 2222575 - RNA, 15 nt, Homo sapiens
cagggaugcugccaa

SEQ ID NO: 2222576 - RNA, 21 nt, Homo sapiens
ggccaggcccgcaccccggcc

SEQ ID NO: 2222577 - RNA, 22 nt, Homo sapiens
gugccccuccaagucacaaaga

SEQ ID NO: 2222578 - RNA, 14 nt, Homo sapiens
ucgcggucuugggc

SEQ ID NO: 2222579 - RNA, 15 nt, Homo sapiens
gcaugucacuccagc

SEQ ID NO: 2222580 - RNA, 19 nt, Homo sapiens
aaacaguccaaacuguucu

SEQ ID NO: 2222581 - RNA, 14 nt, Homo sapiens
ucucagaauucuuc

SEQ ID NO: 2222582 - RNA, 20 nt, Homo sapiens
uacauauggaaauccuguua

SEQ ID NO: 2222583 - RNA, 16 nt, Homo sapiens
caggugagagcccuuu

SEQ ID NO: 2222584 - RNA, 17 nt, Homo sapiens
auuuguuauacuucaaa

SEQ ID NO: 2222585 - RNA, 19 nt, Homo sapiens
gagugcgccgagucugucu

SEQ ID NO: 2222586 - RNA, 20 nt, Homo sapiens
gauuuucuuccuccaauagu

SEQ ID NO: 2222587 - RNA, 17 nt, Homo sapiens
uaauauuguauugcugc

SEQ ID NO: 2222588 - RNA, 18 nt, Homo sapiens
uugaaguauucaaucaag

SEQ ID NO: 2222589 - RNA, 12 nt, Homo sapiens
guggaaggugag

SEQ ID NO: 2222590 - RNA, 18 nt, Homo sapiens
uucacagugucuguaaau

SEQ ID NO: 2222591 - RNA, 13 nt, Homo sapiens
ggcugaugaucca

SEQ ID NO: 2222592 - RNA, 23 nt, Homo sapiens
gauuacucuccauaucccuuccu

SEQ ID NO: 2222593 - RNA, 14 nt, Homo sapiens
ugaaacuuaacucc

SEQ ID NO: 2222594 - RNA, 14 nt, Homo sapiens
cugccugaccccag

SEQ ID NO: 2222595 - RNA, 18 nt, Homo sapiens
aggugcaagagacagagc

SEQ ID NO: 2222596 - RNA, 19 nt, Homo sapiens
uggugaagaauggacuuaa

SEQ ID NO: 2222597 - RNA, 18 nt, Homo sapiens
gccgggucacccugugac

SEQ ID NO: 2222598 - RNA, 20 nt, Homo sapiens
gaaccauaggacuguggcaa

SEQ ID NO: 2222599 - RNA, 21 nt, Homo sapiens
ugggagggaguuacugaaguc

SEQ ID NO: 2222600 - RNA, 18 nt, Homo sapiens
ucaccucaauauuuacua

SEQ ID NO: 2222601 - RNA, 18 nt, Homo sapiens
uaugaauccaacguguaa

SEQ ID NO: 2222602 - RNA, 16 nt, Homo sapiens
agugucuccaccuaca

SEQ ID NO: 2222603 - RNA, 15 nt, Homo sapiens
ucuggggaccagcuu

SEQ ID NO: 2222604 - RNA, 19 nt, Homo sapiens
acagaugugucagccagga

SEQ ID NO: 2222605 - RNA, 10 nt, Homo sapiens
ucuacugcuu

SEQ ID NO: 2222606 - RNA, 21 nt, Homo sapiens
uguaagaguguucaacuguga

SEQ ID NO: 2222607 - RNA, 23 nt, Homo sapiens
cugggagguggagcuugcaguga

SEQ ID NO: 2222608 - RNA, 22 nt, Homo sapiens
cccgccuguccugccucucugc

SEQ ID NO: 2222609 - RNA, 16 nt, Homo sapiens
aaaacaggcacuuggc

SEQ ID NO: 2222610 - RNA, 20 nt, Homo sapiens
cauugggguuccgcacuuuc

SEQ ID NO: 2222611 - RNA, 18 nt, Homo sapiens
cugcccuuccugccugau

SEQ ID NO: 2222612 - RNA, 21 nt, Homo sapiens
cuuuaauucauaaaucacaaa

SEQ ID NO: 2222613 - RNA, 20 nt, Homo sapiens
caaaccugccucccauucua

SEQ ID NO: 2222614 - RNA, 13 nt, Homo sapiens
aauaaaguuauuc

SEQ ID NO: 2222615 - RNA, 20 nt, Homo sapiens
ugaugaaaaccuacauauuc

SEQ ID NO: 2222616 - RNA, 21 nt, Homo sapiens
uauauguguguggcgugugua

SEQ ID NO: 2222617 - RNA, 13 nt, Homo sapiens
ugucaggaggaaa

SEQ ID NO: 2222618 - RNA, 13 nt, Homo sapiens
gugccucauuaag

SEQ ID NO: 2222619 - RNA, 14 nt, Homo sapiens
auuucugccaggca

SEQ ID NO: 2222620 - RNA, 17 nt, Homo sapiens
gacucuuuagagcagcu

SEQ ID NO: 2222621 - RNA, 12 nt, Homo sapiens
uuucuucugcua

SEQ ID NO: 2222622 - RNA, 22 nt, Homo sapiens
ugaaagaagagaugagaaauga

SEQ ID NO: 2222623 - RNA, 22 nt, Homo sapiens
caggcguuucugaagugcucuu

SEQ ID NO: 2222624 - RNA, 21 nt, Homo sapiens
cacaaacguauguaaauguau

SEQ ID NO: 2222625 - RNA, 16 nt, Homo sapiens
ccuacacacacccagg

SEQ ID NO: 2222626 - RNA, 23 nt, Homo sapiens
uaauggcucaucaacaaucacaa

SEQ ID NO: 2222627 - RNA, 11 nt, Homo sapiens
cugagccucac

SEQ ID NO: 2222628 - RNA, 11 nt, Homo sapiens
cucagccucag

SEQ ID NO: 2222629 - RNA, 22 nt, Homo sapiens
ccucagggccacguuaccacag

SEQ ID NO: 2222630 - RNA, 17 nt, Homo sapiens
aaugugcaaccacugcu

SEQ ID NO: 2222631 - RNA, 18 nt, Homo sapiens
guggaccucuacuuucca

SEQ ID NO: 2222632 - RNA, 20 nt, Homo sapiens
aagacuauuaagagcaauaa

SEQ ID NO: 2222633 - RNA, 20 nt, Homo sapiens
acuccugaccccucuccuca

SEQ ID NO: 2222634 - RNA, 16 nt, Homo sapiens
auuuuuaacacuuaaa

SEQ ID NO: 2222635 - RNA, 20 nt, Homo sapiens
ucugucuacuguggugaucu

SEQ ID NO: 2222636 - RNA, 21 nt, Homo sapiens
cuucccaguggcugcugccca

SEQ ID NO: 2222637 - RNA, 21 nt, Homo sapiens
cuguaaucccaacacuuuggg

SEQ ID NO: 2222638 - RNA, 22 nt, Homo sapiens
acucgggaccaauacuacugac

SEQ ID NO: 2222639 - RNA, 19 nt, Homo sapiens
ugcagagccugcaggguga

SEQ ID NO: 2222640 - RNA, 19 nt, Homo sapiens
auuauaggagugagccacc

SEQ ID NO: 2222641 - RNA, 14 nt, Homo sapiens
acuuuauaguuguu

SEQ ID NO: 2222642 - RNA, 22 nt, Homo sapiens
acacuuuaaaaccaguuaccca

SEQ ID NO: 2222643 - RNA, 20 nt, Homo sapiens
uuuuauacagugauauacuu

SEQ ID NO: 2222644 - RNA, 14 nt, Homo sapiens
agauuaacauuuca

SEQ ID NO: 2222645 - RNA, 16 nt, Homo sapiens
acaagagcaucaggcu

SEQ ID NO: 2222646 - RNA, 23 nt, Homo sapiens
agaauauuauuggaaaauucucu

SEQ ID NO: 2222647 - RNA, 17 nt, Homo sapiens
caguuuuuuguuguuau

SEQ ID NO: 2222648 - RNA, 22 nt, Homo sapiens
gaagaaauggaaucagcuuuua

SEQ ID NO: 2222649 - RNA, 17 nt, Homo sapiens
gauguguaaacaggcac

SEQ ID NO: 2222650 - RNA, 14 nt, Homo sapiens
gugaggggcaagcu

SEQ ID NO: 2222651 - RNA, 16 nt, Homo sapiens
cugcuuagacauaaca

SEQ ID NO: 2222652 - RNA, 19 nt, Homo sapiens
aggugggaaaaucacuuga

SEQ ID NO: 2222653 - RNA, 17 nt, Homo sapiens
ccuaggauugugccugu

SEQ ID NO: 2222654 - RNA, 10 nt, Homo sapiens
cuagaaggca

SEQ ID NO: 2222655 - RNA, 17 nt, Homo sapiens
uguugguguauuugcca

SEQ ID NO: 2222656 - RNA, 22 nt, Homo sapiens
aaggugggccuugcuaccucaa

SEQ ID NO: 2222657 - RNA, 19 nt, Homo sapiens
uguauccauccauggggcu

SEQ ID NO: 2222658 - RNA, 23 nt, Homo sapiens
aucacaaaggcugacauucacug

SEQ ID NO: 2222659 - RNA, 18 nt, Homo sapiens
aaacuggacagucacugc

SEQ ID NO: 2222660 - RNA, 14 nt, Homo sapiens
aagaaauucugcaa

SEQ ID NO: 2222661 - RNA, 15 nt, Homo sapiens
gucgaccgcacuuau

SEQ ID NO: 2222662 - RNA, 13 nt, Homo sapiens
uuuuuuucuccuc

SEQ ID NO: 2222663 - RNA, 16 nt, Homo sapiens
acaagauauuauguau

SEQ ID NO: 2222664 - RNA, 17 nt, Homo sapiens
uguaacugugugagauu

SEQ ID NO: 2222665 - RNA, 15 nt, Homo sapiens
augcgcacugcauuc

SEQ ID NO: 2222666 - RNA, 14 nt, Homo sapiens
gcugagagugcuau

SEQ ID NO: 2222667 - RNA, 16 nt, Homo sapiens
uggccccucaaccucc

SEQ ID NO: 2222668 - RNA, 12 nt, Homo sapiens
augugacucagc

SEQ ID NO: 2222669 - RNA, 15 nt, Homo sapiens
gggucaaagugcggc

SEQ ID NO: 2222670 - RNA, 16 nt, Homo sapiens
cugagaucacucgcuu

SEQ ID NO: 2222671 - RNA, 13 nt, Homo sapiens
uuucauguaaucc

SEQ ID NO: 2222672 - RNA, 19 nt, Homo sapiens
uuucagauacacugugaua

SEQ ID NO: 2222673 - RNA, 21 nt, Homo sapiens
cacccuguccaaacugccuaa

SEQ ID NO: 2222674 - RNA, 14 nt, Homo sapiens
uuaacaacugugaa

SEQ ID NO: 2222675 - RNA, 23 nt, Homo sapiens
cuguugaucccacuucacuguga

SEQ ID NO: 2222676 - RNA, 20 nt, Homo sapiens
accaggguuucucugaagaa

SEQ ID NO: 2222677 - RNA, 21 nt, Homo sapiens
gauauaaucuuucaaaccagc

SEQ ID NO: 2222678 - RNA, 20 nt, Homo sapiens
augccgccccggacaguggc

SEQ ID NO: 2222679 - RNA, 15 nt, Homo sapiens
ccccuccccagugcc

SEQ ID NO: 2222680 - RNA, 19 nt, Homo sapiens
agugauuccuucuugcuca

SEQ ID NO: 2222681 - RNA, 19 nt, Homo sapiens
aaauguuaacagaguuuga

SEQ ID NO: 2222682 - RNA, 18 nt, Homo sapiens
gccuguuggggaccucac

SEQ ID NO: 2222683 - RNA, 23 nt, Homo sapiens
cuuucugauaacuagauggugcu

SEQ ID NO: 2222684 - RNA, 14 nt, Homo sapiens
cuauaaucucagaa

SEQ ID NO: 2222685 - RNA, 13 nt, Homo sapiens
auauuaugaagcu

SEQ ID NO: 2222686 - RNA, 15 nt, Homo sapiens
acacccaaugcugcu

SEQ ID NO: 2222687 - RNA, 21 nt, Homo sapiens
uccucuaauuaaaaugugcag

SEQ ID NO: 2222688 - RNA, 13 nt, Homo sapiens
agaaagugaucca

SEQ ID NO: 2222689 - RNA, 17 nt, Homo sapiens
uaagaagaugacuuccc

SEQ ID NO: 2222690 - RNA, 15 nt, Homo sapiens
aagacccccaggaag

SEQ ID NO: 2222691 - RNA, 17 nt, Homo sapiens
gcccgcccucaccucug

SEQ ID NO: 2222692 - RNA, 23 nt, Homo sapiens
ggcgugaucucagcucacucugc

SEQ ID NO: 2222693 - RNA, 17 nt, Homo sapiens
uggaucagaggucaucc

SEQ ID NO: 2222694 - RNA, 23 nt, Homo sapiens
cacccccaggaaggccacagugc

SEQ ID NO: 2222695 - RNA, 22 nt, Homo sapiens
cuaauuuuuucccagacuacua

SEQ ID NO: 2222696 - RNA, 23 nt, Homo sapiens
ucuuuugggggcuggggcuuuag

SEQ ID NO: 2222697 - RNA, 20 nt, Homo sapiens
uguaucuuaaaggacauaaa

SEQ ID NO: 2222698 - RNA, 16 nt, Homo sapiens
uuucugugcagagaug

SEQ ID NO: 2222699 - RNA, 15 nt, Homo sapiens
uccaagaccagacuc

SEQ ID NO: 2222700 - RNA, 15 nt, Homo sapiens
aaagacguucccuuu

SEQ ID NO: 2222701 - RNA, 18 nt, Homo sapiens
ccaacgcuugacacaaag

SEQ ID NO: 2222702 - RNA, 21 nt, Homo sapiens
cacugggcugcagagacugga

SEQ ID NO: 2222703 - RNA, 17 nt, Homo sapiens
acauugauaaaagcauu

SEQ ID NO: 2222704 - RNA, 13 nt, Homo sapiens
agacuucuuggcu

SEQ ID NO: 2222705 - RNA, 20 nt, Homo sapiens
uggaauaacucuguggcauu

SEQ ID NO: 2222706 - RNA, 13 nt, Homo sapiens
ggcagaguggccu

SEQ ID NO: 2222707 - RNA, 13 nt, Homo sapiens
aauuagucacugc

SEQ ID NO: 2222708 - RNA, 10 nt, Homo sapiens
caaugcacaa

SEQ ID NO: 2222709 - RNA, 18 nt, Homo sapiens
agacauuucugcacaugg

SEQ ID NO: 2222710 - RNA, 18 nt, Homo sapiens
guucucaaucauugucag

SEQ ID NO: 2222711 - RNA, 14 nt, Homo sapiens
aauaagaaacacaa

SEQ ID NO: 2222712 - RNA, 17 nt, Homo sapiens
agaacaugagugcugau

SEQ ID NO: 2222713 - RNA, 19 nt, Homo sapiens
cuaaaaaucaaauaagcua

SEQ ID NO: 2222714 - RNA, 21 nt, Homo sapiens
auccuccugucuaauuugcac

SEQ ID NO: 2222715 - RNA, 13 nt, Homo sapiens
gaugagaaauuca

SEQ ID NO: 2222716 - RNA, 18 nt, Homo sapiens
agaccagcccagccaaca

SEQ ID NO: 2222717 - RNA, 21 nt, Homo sapiens
gcugaauguuuguuucagugc

SEQ ID NO: 2222718 - RNA, 22 nt, Homo sapiens
aggaaugauugcugacucacag

SEQ ID NO: 2222719 - RNA, 22 nt, Homo sapiens
caagauuucagaagccaaguuu

SEQ ID NO: 2222720 - RNA, 13 nt, Homo sapiens
aauaauaugugau

SEQ ID NO: 2222721 - RNA, 24 nt, Homo sapiens
agaaguaagcagaguucuuugcaa

SEQ ID NO: 2222722 - RNA, 21 nt, Homo sapiens
aguuugaagcacaacucccuu

SEQ ID NO: 2222723 - RNA, 17 nt, Homo sapiens
uuaggaaaaaaacuauu

SEQ ID NO: 2222724 - RNA, 13 nt, Homo sapiens
gccgcugggagag

SEQ ID NO: 2222725 - RNA, 12 nt, Homo sapiens
ugggcuuucaua

SEQ ID NO: 2222726 - RNA, 14 nt, Homo sapiens
uuaacauagccaaa

SEQ ID NO: 2222727 - RNA, 17 nt, Homo sapiens
agcaagacucugucuca

SEQ ID NO: 2222728 - RNA, 17 nt, Homo sapiens
agugagacuccaucuca

SEQ ID NO: 2222729 - RNA, 14 nt, Homo sapiens
cuucaugugcugcc

SEQ ID NO: 2222730 - RNA, 20 nt, Homo sapiens
ucauuauaaacgugaugauc

SEQ ID NO: 2222731 - RNA, 14 nt, Homo sapiens
aacaguaaugacuc

SEQ ID NO: 2222732 - RNA, 17 nt, Homo sapiens
gccuuauuaaagcaaaa

SEQ ID NO: 2222733 - RNA, 14 nt, Homo sapiens
ccagugaaccaaag

SEQ ID NO: 2222734 - RNA, 21 nt, Homo sapiens
ugcuguugacucuuccauuca

SEQ ID NO: 2222735 - RNA, 19 nt, Homo sapiens
uagcacccccagccaucua

SEQ ID NO: 2222736 - RNA, 16 nt, Homo sapiens
ucauguaugucagaag

SEQ ID NO: 2222737 - RNA, 21 nt, Homo sapiens
gaaacaccacuuaaucuucuc

SEQ ID NO: 2222738 - RNA, 21 nt, Homo sapiens
ugcgccgagaccgcagaggga

SEQ ID NO: 2222739 - RNA, 15 nt, Homo sapiens
gucugggacuuccuu

SEQ ID NO: 2222740 - RNA, 16 nt, Homo sapiens
cagaugggaacugaau

SEQ ID NO: 2222741 - RNA, 19 nt, Homo sapiens
uccuccuggaacagaagac

SEQ ID NO: 2222742 - RNA, 20 nt, Homo sapiens
gauacccaucccauaugccu

SEQ ID NO: 2222743 - RNA, 17 nt, Homo sapiens
ugagccugaaccuuaau

SEQ ID NO: 2222744 - RNA, 22 nt, Homo sapiens
caaagaacuucuccuacuguag

SEQ ID NO: 2222745 - RNA, 17 nt, Homo sapiens
uuacuaucaugucaaac

SEQ ID NO: 2222746 - RNA, 21 nt, Homo sapiens
caucccucuggggcuguucac

SEQ ID NO: 2222747 - RNA, 21 nt, Homo sapiens
uaauucacccaccagacuuuu

SEQ ID NO: 2222748 - RNA, 15 nt, Homo sapiens
ggcaaaguccagcuc

SEQ ID NO: 2222749 - RNA, 18 nt, Homo sapiens
cucagcccaggcacaacu

SEQ ID NO: 2222750 - RNA, 18 nt, Homo sapiens
aagggauaguccaaagac

SEQ ID NO: 2222751 - RNA, 13 nt, Homo sapiens
cacugcucaagaa

SEQ ID NO: 2222752 - RNA, 20 nt, Homo sapiens
aggaagaaaccccaagcagc

SEQ ID NO: 2222753 - RNA, 14 nt, Homo sapiens
gaucuucacucugg

SEQ ID NO: 2222754 - RNA, 21 nt, Homo sapiens
cagugagaguuccucuuugcc

SEQ ID NO: 2222755 - RNA, 11 nt, Homo sapiens
cccuccaaaga

SEQ ID NO: 2222756 - RNA, 20 nt, Homo sapiens
cauccuggcuaacacgugaa

SEQ ID NO: 2222757 - RNA, 14 nt, Homo sapiens
cuuuaacucaggag

SEQ ID NO: 2222758 - RNA, 19 nt, Homo sapiens
ucuuuuuaaguaaugugga

SEQ ID NO: 2222759 - RNA, 12 nt, Homo sapiens
uuaaauugugcc

SEQ ID NO: 2222760 - RNA, 16 nt, Homo sapiens
cccugagucaccagga

SEQ ID NO: 2222761 - RNA, 12 nt, Homo sapiens
uugcuguuccca

SEQ ID NO: 2222762 - RNA, 13 nt, Homo sapiens
cuaaagcuuuauc

SEQ ID NO: 2222763 - RNA, 16 nt, Homo sapiens
aaugaaauugucaaaa

SEQ ID NO: 2222764 - RNA, 21 nt, Homo sapiens
uauacugacaaaccagagaaa

SEQ ID NO: 2222765 - RNA, 14 nt, Homo sapiens
gcccacucccaucc

SEQ ID NO: 2222766 - RNA, 11 nt, Homo sapiens
aauagacauac

SEQ ID NO: 2222767 - RNA, 15 nt, Homo sapiens
ccacuucgcacacac

SEQ ID NO: 2222768 - RNA, 18 nt, Homo sapiens
uugcugauaaaacagauu

SEQ ID NO: 2222769 - RNA, 22 nt, Homo sapiens
ugauucuccugccucagccucc

SEQ ID NO: 2222770 - RNA, 16 nt, Homo sapiens
ccagcuggcucugcag

SEQ ID NO: 2222771 - RNA, 21 nt, Homo sapiens
gcuucucaauagaguguuguu

SEQ ID NO: 2222772 - RNA, 19 nt, Homo sapiens
cauuuaaagacaaagacau

SEQ ID NO: 2222773 - RNA, 15 nt, Homo sapiens
ucauaagacacuuag

SEQ ID NO: 2222774 - RNA, 14 nt, Homo sapiens
uauucagcucaugg

SEQ ID NO: 2222775 - RNA, 15 nt, Homo sapiens
aggacagaacagugu

SEQ ID NO: 2222776 - RNA, 13 nt, Homo sapiens
accagcacugucu

SEQ ID NO: 2222777 - RNA, 14 nt, Homo sapiens
aaagagcuguuaua

SEQ ID NO: 2222778 - RNA, 21 nt, Homo sapiens
gacugagaaauuauacuuacu

SEQ ID NO: 2222779 - RNA, 13 nt, Homo sapiens
ccugccacucuca

SEQ ID NO: 2222780 - RNA, 13 nt, Homo sapiens
uaccccaccacga

SEQ ID NO: 2222781 - RNA, 14 nt, Homo sapiens
aauggccugagaca

SEQ ID NO: 2222782 - RNA, 21 nt, Homo sapiens
uuucuggauaucaagauguua

SEQ ID NO: 2222783 - RNA, 20 nt, Homo sapiens
cuauaucagggccugaguga

SEQ ID NO: 2222784 - RNA, 19 nt, Homo sapiens
uggaccaauuagcauucca

SEQ ID NO: 2222785 - RNA, 19 nt, Homo sapiens
caacuuggaaaaagaaaga

SEQ ID NO: 2222786 - RNA, 15 nt, Homo sapiens
ccgggcauccagugg

SEQ ID NO: 2222787 - RNA, 11 nt, Homo sapiens
uguuggcucac

SEQ ID NO: 2222788 - RNA, 18 nt, Homo sapiens
caauuaauucaucccuua

SEQ ID NO: 2222789 - RNA, 24 nt, Homo sapiens
cuguucuguagauucaugcaagug

SEQ ID NO: 2222790 - RNA, 21 nt, Homo sapiens
caaaucacgcaucucuacucc

SEQ ID NO: 2222791 - RNA, 14 nt, Homo sapiens
gcccaagcacuuca

SEQ ID NO: 2222792 - RNA, 19 nt, Homo sapiens
aaacaccaagugaggccau

SEQ ID NO: 2222793 - RNA, 11 nt, Homo sapiens
ccccaccuacu

SEQ ID NO: 2222794 - RNA, 15 nt, Homo sapiens
cugccaaaaugcucu

SEQ ID NO: 2222795 - RNA, 19 nt, Homo sapiens
cuccaggauugaagagcau

SEQ ID NO: 2222796 - RNA, 14 nt, Homo sapiens
guuugcuucuuaug

SEQ ID NO: 2222797 - RNA, 17 nt, Homo sapiens
gauuucagcauuuccua

SEQ ID NO: 2222798 - RNA, 19 nt, Homo sapiens
gggagaagcuccucucccc

SEQ ID NO: 2222799 - RNA, 16 nt, Homo sapiens
accagaggucaggugu

SEQ ID NO: 2222800 - RNA, 13 nt, Homo sapiens
uuaaccugggacc

SEQ ID NO: 2222801 - RNA, 24 nt, Homo sapiens
cuauauuuuuuguaacauaaugca

SEQ ID NO: 2222802 - RNA, 16 nt, Homo sapiens
guccuaaagaugcuga

SEQ ID NO: 2222803 - RNA, 19 nt, Homo sapiens
uuucccccaaagaugugua

SEQ ID NO: 2222804 - RNA, 11 nt, Homo sapiens
gccuccucacc

SEQ ID NO: 2222805 - RNA, 14 nt, Homo sapiens
uagugaucauuuaa

SEQ ID NO: 2222806 - RNA, 17 nt, Homo sapiens
caaauaaaauaaaugaa

SEQ ID NO: 2222807 - RNA, 23 nt, Homo sapiens
cccaccccuagccaccagugucc

SEQ ID NO: 2222808 - RNA, 15 nt, Homo sapiens
gcucuaccaagacau

SEQ ID NO: 2222809 - RNA, 13 nt, Homo sapiens
auauugcaaaaac

SEQ ID NO: 2222810 - RNA, 21 nt, Homo sapiens
gaguugguguucauaauuuca

SEQ ID NO: 2222811 - RNA, 16 nt, Homo sapiens
auuaaaauguaugcau

SEQ ID NO: 2222812 - RNA, 12 nt, Homo sapiens
cuacucauucag

SEQ ID NO: 2222813 - RNA, 14 nt, Homo sapiens
aaaagaucuugaau

SEQ ID NO: 2222814 - RNA, 20 nt, Homo sapiens
gaagaccaaagcauugccug

SEQ ID NO: 2222815 - RNA, 19 nt, Homo sapiens
uugccaaguggcauuacau

SEQ ID NO: 2222816 - RNA, 12 nt, Homo sapiens
ucccuccagggu

SEQ ID NO: 2222817 - RNA, 19 nt, Homo sapiens
aggugugaggacuucugca

SEQ ID NO: 2222818 - RNA, 15 nt, Homo sapiens
uggauaaaaugaggu

SEQ ID NO: 2222819 - RNA, 20 nt, Homo sapiens
augcacacauuuaacgacag

SEQ ID NO: 2222820 - RNA, 23 nt, Homo sapiens
uacuugcuuuaccuuuucagggc

SEQ ID NO: 2222821 - RNA, 17 nt, Homo sapiens
acugugagaggugacac

SEQ ID NO: 2222822 - RNA, 18 nt, Homo sapiens
gcugcuccuucucuaguu

SEQ ID NO: 2222823 - RNA, 16 nt, Homo sapiens
uaguaauggcagagca

SEQ ID NO: 2222824 - RNA, 23 nt, Homo sapiens
uacagucacuaauauaguagauu

SEQ ID NO: 2222825 - RNA, 14 nt, Homo sapiens
gguuucaccauguu

SEQ ID NO: 2222826 - RNA, 19 nt, Homo sapiens
ucauuauuacguggcaaaa

SEQ ID NO: 2222827 - RNA, 14 nt, Homo sapiens
cucuucuugaacac

SEQ ID NO: 2222828 - RNA, 13 nt, Homo sapiens
uaucaauagucaa

SEQ ID NO: 2222829 - RNA, 17 nt, Homo sapiens
ugaaccaaaacauuccg

SEQ ID NO: 2222830 - RNA, 19 nt, Homo sapiens
ucauucuuuuuauggcuga

SEQ ID NO: 2222831 - RNA, 16 nt, Homo sapiens
accaucuggaauucca

SEQ ID NO: 2222832 - RNA, 14 nt, Homo sapiens
gucagagcacuccc

SEQ ID NO: 2222833 - RNA, 17 nt, Homo sapiens
ugaggaagucacuuuac

SEQ ID NO: 2222834 - RNA, 16 nt, Homo sapiens
aucuccuguggaguca

SEQ ID NO: 2222835 - RNA, 13 nt, Homo sapiens
cuagauacuggaa

SEQ ID NO: 2222836 - RNA, 13 nt, Homo sapiens
cuuuacuggcuua

SEQ ID NO: 2222837 - RNA, 13 nt, Homo sapiens
guuggcugccugg

SEQ ID NO: 2222838 - RNA, 19 nt, Homo sapiens
agccuugcauguacuugaa

SEQ ID NO: 2222839 - RNA, 15 nt, Homo sapiens
uauaacaaucacugg

SEQ ID NO: 2222840 - RNA, 22 nt, Homo sapiens
uuugaaucuuucguagccuaaa

SEQ ID NO: 2222841 - RNA, 19 nt, Homo sapiens
gggccagcauacuccguga

SEQ ID NO: 2222842 - RNA, 19 nt, Homo sapiens
augcucaguuggugcugcu

SEQ ID NO: 2222843 - RNA, 15 nt, Homo sapiens
auuucuguaccuuca

SEQ ID NO: 2222844 - RNA, 16 nt, Homo sapiens
uuccacacuucugggc

SEQ ID NO: 2222845 - RNA, 19 nt, Homo sapiens
ugcauugccaagugccaua

SEQ ID NO: 2222846 - RNA, 14 nt, Homo sapiens
acgaagcauguaua

SEQ ID NO: 2222847 - RNA, 15 nt, Homo sapiens
cauuguagaaacaca

SEQ ID NO: 2222848 - RNA, 19 nt, Homo sapiens
gcuuucugaagcuuuacca

SEQ ID NO: 2222849 - RNA, 14 nt, Homo sapiens
gaaaacauguuaau

SEQ ID NO: 2222850 - RNA, 20 nt, Homo sapiens
acuuagcuggccacagugag

SEQ ID NO: 2222851 - RNA, 23 nt, Homo sapiens
acuguuucaaaaauaaauuugca

SEQ ID NO: 2222852 - RNA, 20 nt, Homo sapiens
aauucauauccauagauagu

SEQ ID NO: 2222853 - RNA, 20 nt, Homo sapiens
uuuucuccacuuuguuggaa

SEQ ID NO: 2222854 - RNA, 20 nt, Homo sapiens
auggaaagacaaacugcaca

SEQ ID NO: 2222855 - RNA, 13 nt, Homo sapiens
cuaggugaucuca

SEQ ID NO: 2222856 - RNA, 11 nt, Homo sapiens
uaagggaacaa

SEQ ID NO: 2222857 - RNA, 18 nt, Homo sapiens
ugaccucccccuccuucc

SEQ ID NO: 2222858 - RNA, 18 nt, Homo sapiens
uccuagauuacaucugcc

SEQ ID NO: 2222859 - RNA, 22 nt, Homo sapiens
auauagagggcuuaugauucag

SEQ ID NO: 2222860 - RNA, 16 nt, Homo sapiens
aaggcgccugccuugg

SEQ ID NO: 2222861 - RNA, 15 nt, Homo sapiens
gaacaaucucaaaaa

SEQ ID NO: 2222862 - RNA, 12 nt, Homo sapiens
auaccucuaaua

SEQ ID NO: 2222863 - RNA, 21 nt, Homo sapiens
cagauaacaaccccggacaaa

SEQ ID NO: 2222864 - RNA, 19 nt, Homo sapiens
caggagucaccaugcaagg

SEQ ID NO: 2222865 - RNA, 15 nt, Homo sapiens
gccuucuaccugcag

SEQ ID NO: 2222866 - RNA, 22 nt, Homo sapiens
cuggcgaaccaucucaauguaa

SEQ ID NO: 2222867 - RNA, 19 nt, Homo sapiens
uuacuggauuugacuucag

SEQ ID NO: 2222868 - RNA, 19 nt, Homo sapiens
uuucuguuauuaacaaaca

SEQ ID NO: 2222869 - RNA, 16 nt, Homo sapiens
cuuuaaaucugugaug

SEQ ID NO: 2222870 - RNA, 16 nt, Homo sapiens
gaggucacauucagga

SEQ ID NO: 2222871 - RNA, 16 nt, Homo sapiens
caugaacccugcccug

SEQ ID NO: 2222872 - RNA, 17 nt, Homo sapiens
uuaucaguaauuugacu

SEQ ID NO: 2222873 - RNA, 12 nt, Homo sapiens
aaauggacaaac

SEQ ID NO: 2222874 - RNA, 22 nt, Homo sapiens
gccccucccccuaaggcagcug

SEQ ID NO: 2222875 - RNA, 15 nt, Homo sapiens
uagucagaaaauugg

SEQ ID NO: 2222876 - RNA, 13 nt, Homo sapiens
caaaugaaaguga

SEQ ID NO: 2222877 - RNA, 17 nt, Homo sapiens
ucuuacucugucaccca

SEQ ID NO: 2222878 - RNA, 16 nt, Homo sapiens
ugucucuguuuuacaa

SEQ ID NO: 2222879 - RNA, 15 nt, Homo sapiens
aaguaaugaucucaa

SEQ ID NO: 2222880 - RNA, 14 nt, Homo sapiens
augaaggcuguaca

SEQ ID NO: 2222881 - RNA, 19 nt, Homo sapiens
gaccacaccuaaaacugcc

SEQ ID NO: 2222882 - RNA, 21 nt, Homo sapiens
uuuaaaccaccuaguucuccc

SEQ ID NO: 2222883 - RNA, 18 nt, Homo sapiens
ccugggugggacagccuc

SEQ ID NO: 2222884 - RNA, 19 nt, Homo sapiens
aaggcgggcggaucacuua

SEQ ID NO: 2222885 - RNA, 14 nt, Homo sapiens
ugcugcuguuuaca

SEQ ID NO: 2222886 - RNA, 18 nt, Homo sapiens
ggugugaagaaagccaga

SEQ ID NO: 2222887 - RNA, 20 nt, Homo sapiens
uuagaugugcugcuuugaua

SEQ ID NO: 2222888 - RNA, 17 nt, Homo sapiens
aggagaaucacuugcac

SEQ ID NO: 2222889 - RNA, 20 nt, Homo sapiens
cuucuccucucugggccuuu

SEQ ID NO: 2222890 - RNA, 23 nt, Homo sapiens
ugcucaaggccagcuuauaguca

SEQ ID NO: 2222891 - RNA, 15 nt, Homo sapiens
cugcucugggcacug

SEQ ID NO: 2222892 - RNA, 13 nt, Homo sapiens
gccacacuaccca

SEQ ID NO: 2222893 - RNA, 20 nt, Homo sapiens
gaagagccccccacugcaga

SEQ ID NO: 2222894 - RNA, 17 nt, Homo sapiens
cagaaauauauuaugaa

SEQ ID NO: 2222895 - RNA, 23 nt, Homo sapiens
cuacuuacauaguugaaauauca

SEQ ID NO: 2222896 - RNA, 16 nt, Homo sapiens
augugugcuuggaaaa

SEQ ID NO: 2222897 - RNA, 16 nt, Homo sapiens
auaaaucuuccaaagu

SEQ ID NO: 2222898 - RNA, 19 nt, Homo sapiens
ucuucuaucaaagcacaua

SEQ ID NO: 2222899 - RNA, 23 nt, Homo sapiens
uucaauaguggcauaccaaaugg

SEQ ID NO: 2222900 - RNA, 16 nt, Homo sapiens
agaaacaaacaucuaa

SEQ ID NO: 2222901 - RNA, 17 nt, Homo sapiens
agauaguuuucauuuua

SEQ ID NO: 2222902 - RNA, 15 nt, Homo sapiens
aauaauaaauuugau

SEQ ID NO: 2222903 - RNA, 15 nt, Homo sapiens
cugaauuacagugaa

SEQ ID NO: 2222904 - RNA, 13 nt, Homo sapiens
guuccauaugggu

SEQ ID NO: 2222905 - RNA, 23 nt, Homo sapiens
caucuggcuuauuuuaaugugau

SEQ ID NO: 2222906 - RNA, 15 nt, Homo sapiens
ucauguucacuguga

SEQ ID NO: 2222907 - RNA, 19 nt, Homo sapiens
uaucgaauauaguucugug

SEQ ID NO: 2222908 - RNA, 17 nt, Homo sapiens
cucccacaaugcugaau

SEQ ID NO: 2222909 - RNA, 18 nt, Homo sapiens
agcuggagcccagcguca

SEQ ID NO: 2222910 - RNA, 20 nt, Homo sapiens
uaaacauauccaaguuugaa

SEQ ID NO: 2222911 - RNA, 18 nt, Homo sapiens
aguuaugaguauaauaca

SEQ ID NO: 2222912 - RNA, 18 nt, Homo sapiens
aguguucuucaguguaau

SEQ ID NO: 2222913 - RNA, 23 nt, Homo sapiens
cauauuuugguuuguguauccau

SEQ ID NO: 2222914 - RNA, 16 nt, Homo sapiens
agcaucuaugugagac

SEQ ID NO: 2222915 - RNA, 14 nt, Homo sapiens
uaauaucugugagg

SEQ ID NO: 2222916 - RNA, 21 nt, Homo sapiens
cccccgggacugggcuaggag

SEQ ID NO: 2222917 - RNA, 21 nt, Homo sapiens
aacagaguugagguuguuaaa

SEQ ID NO: 2222918 - RNA, 16 nt, Homo sapiens
aacaguagcuuugcuu

SEQ ID NO: 2222919 - RNA, 18 nt, Homo sapiens
ggacgcuggcuacugucu

SEQ ID NO: 2222920 - RNA, 16 nt, Homo sapiens
accuuguuuugccagu

SEQ ID NO: 2222921 - RNA, 20 nt, Homo sapiens
agugcugggaugacaggugu

SEQ ID NO: 2222922 - RNA, 21 nt, Homo sapiens
aaacugacaguaaaucucaca

SEQ ID NO: 2222923 - RNA, 21 nt, Homo sapiens
cauguagguacccugccacgg

SEQ ID NO: 2222924 - RNA, 20 nt, Homo sapiens
gcagcauuuuuaauuuucac

SEQ ID NO: 2222925 - RNA, 22 nt, Homo sapiens
acuucucagccugguacuugua

SEQ ID NO: 2222926 - RNA, 14 nt, Homo sapiens
cacugaaaccaaaa

SEQ ID NO: 2222927 - RNA, 17 nt, Homo sapiens
cugauuaaagguggugc

SEQ ID NO: 2222928 - RNA, 15 nt, Homo sapiens
ugggccccaggggaa

SEQ ID NO: 2222929 - RNA, 15 nt, Homo sapiens
cuuccuaaacccaau

SEQ ID NO: 2222930 - RNA, 15 nt, Homo sapiens
cgauauaagccauag

SEQ ID NO: 2222931 - RNA, 17 nt, Homo sapiens
uugcugugggccaaaau

SEQ ID NO: 2222932 - RNA, 18 nt, Homo sapiens
auguacaucagccugaaa

SEQ ID NO: 2222933 - RNA, 15 nt, Homo sapiens
cuauuacaguauugc

SEQ ID NO: 2222934 - RNA, 12 nt, Homo sapiens
cagaacccugcu

SEQ ID NO: 2222935 - RNA, 18 nt, Homo sapiens
ugaguaacaggugccuuc

SEQ ID NO: 2222936 - RNA, 24 nt, Homo sapiens
aagacauuucgaagucaucauucc

SEQ ID NO: 2222937 - RNA, 23 nt, Homo sapiens
aacauuuacauguauuauuucau

SEQ ID NO: 2222938 - RNA, 22 nt, Homo sapiens
uaaguggacucucugacaaagu

SEQ ID NO: 2222939 - RNA, 15 nt, Homo sapiens
cucagcucaucuuca

SEQ ID NO: 2222940 - RNA, 13 nt, Homo sapiens
aacagacccagug

SEQ ID NO: 2222941 - RNA, 14 nt, Homo sapiens
uucacaaaugggau

SEQ ID NO: 2222942 - RNA, 13 nt, Homo sapiens
cugaguuaggaga

SEQ ID NO: 2222943 - RNA, 17 nt, Homo sapiens
uaguugagaaagucaca

SEQ ID NO: 2222944 - RNA, 18 nt, Homo sapiens
accgugagugacauagcc

SEQ ID NO: 2222945 - RNA, 21 nt, Homo sapiens
guguaaagcuggcccugccuc

SEQ ID NO: 2222946 - RNA, 17 nt, Homo sapiens
caagauuuaaccugcaa

SEQ ID NO: 2222947 - RNA, 18 nt, Homo sapiens
gaugaauugucacaucua

SEQ ID NO: 2222948 - RNA, 15 nt, Homo sapiens
ggcagcacagugugu

SEQ ID NO: 2222949 - RNA, 20 nt, Homo sapiens
uguucuggccucagaccaac

SEQ ID NO: 2222950 - RNA, 14 nt, Homo sapiens
ugugcagcauuaaa

SEQ ID NO: 2222951 - RNA, 19 nt, Homo sapiens
agugugaggaggagacagc

SEQ ID NO: 2222952 - RNA, 11 nt, Homo sapiens
guucaaaaaga

SEQ ID NO: 2222953 - RNA, 14 nt, Homo sapiens
aaguaaugcuucaa

SEQ ID NO: 2222954 - RNA, 17 nt, Homo sapiens
acauuggcaccuaaucc

SEQ ID NO: 2222955 - RNA, 19 nt, Homo sapiens
uguaaucccaacacuuugg

SEQ ID NO: 2222956 - RNA, 20 nt, Homo sapiens
aaacagccaagauuuuccuc

SEQ ID NO: 2222957 - RNA, 13 nt, Homo sapiens
gcguuaaagucag

SEQ ID NO: 2222958 - RNA, 12 nt, Homo sapiens
ggucuugcaagc

SEQ ID NO: 2222959 - RNA, 13 nt, Homo sapiens
gccggcugugcag

SEQ ID NO: 2222960 - RNA, 14 nt, Homo sapiens
ugcaguuccaucag

SEQ ID NO: 2222961 - RNA, 14 nt, Homo sapiens
agugugacuucccu

SEQ ID NO: 2222962 - RNA, 17 nt, Homo sapiens
gucucuaucuugcaucu

SEQ ID NO: 2222963 - RNA, 14 nt, Homo sapiens
agccugagugguga

SEQ ID NO: 2222964 - RNA, 16 nt, Homo sapiens
agggaaaaaauugcuu

SEQ ID NO: 2222965 - RNA, 14 nt, Homo sapiens
ugcacagcaucuca

SEQ ID NO: 2222966 - RNA, 14 nt, Homo sapiens
ccaguaacccaaau

SEQ ID NO: 2222967 - RNA, 16 nt, Homo sapiens
augugugcgagugugu

SEQ ID NO: 2222968 - RNA, 16 nt, Homo sapiens
acauacuuacauuuca

SEQ ID NO: 2222969 - RNA, 16 nt, Homo sapiens
uuaaacuuuuaauuca

SEQ ID NO: 2222970 - RNA, 16 nt, Homo sapiens
ucuaaaucauaaucau

SEQ ID NO: 2222971 - RNA, 13 nt, Homo sapiens
cauggcagacuca

SEQ ID NO: 2222972 - RNA, 18 nt, Homo sapiens
cucaacguugcuccccau

SEQ ID NO: 2222973 - RNA, 18 nt, Homo sapiens
caccccuaaucugcagug

SEQ ID NO: 2222974 - RNA, 18 nt, Homo sapiens
caugcaagcuuggucaaa

SEQ ID NO: 2222975 - RNA, 14 nt, Homo sapiens
uggaugcauuucaa

SEQ ID NO: 2222976 - RNA, 13 nt, Homo sapiens
uaguuacaugaau

SEQ ID NO: 2222977 - RNA, 14 nt, Homo sapiens
ccuuucuaguucaa

SEQ ID NO: 2222978 - RNA, 18 nt, Homo sapiens
aaucuaagugggagacaa

SEQ ID NO: 2222979 - RNA, 17 nt, Homo sapiens
ugaucggaaagcucuuc

SEQ ID NO: 2222980 - RNA, 22 nt, Homo sapiens
cucuuccacuuugauaccauug

SEQ ID NO: 2222981 - RNA, 13 nt, Homo sapiens
cuuggcuugccau

SEQ ID NO: 2222982 - RNA, 22 nt, Homo sapiens
uuggaacugcaccaccgaccaa

SEQ ID NO: 2222983 - RNA, 13 nt, Homo sapiens
ucuucucuacucu

SEQ ID NO: 2222984 - RNA, 19 nt, Homo sapiens
aauuuguaacuuuguugca

SEQ ID NO: 2222985 - RNA, 16 nt, Homo sapiens
uucagcagacuaugaa

SEQ ID NO: 2222986 - RNA, 22 nt, Homo sapiens
caagcacgcacacacacgcaaa

SEQ ID NO: 2222987 - RNA, 15 nt, Homo sapiens
ucccagauguugcau

SEQ ID NO: 2222988 - RNA, 18 nt, Homo sapiens
cccagaaacaacacaauc

SEQ ID NO: 2222989 - RNA, 14 nt, Homo sapiens
uagugaaacaugua

SEQ ID NO: 2222990 - RNA, 14 nt, Homo sapiens
aguuguccgugaua

SEQ ID NO: 2222991 - RNA, 20 nt, Homo sapiens
caaaacugauacccuuugaa

SEQ ID NO: 2222992 - RNA, 17 nt, Homo sapiens
cucuuaugugugccuuu

SEQ ID NO: 2222993 - RNA, 14 nt, Homo sapiens
aggaugcagcacug

SEQ ID NO: 2222994 - RNA, 18 nt, Homo sapiens
accuauuucccuugccuc

SEQ ID NO: 2222995 - RNA, 16 nt, Homo sapiens
uaaagauuaacacuca

SEQ ID NO: 2222996 - RNA, 17 nt, Homo sapiens
cuuugcuuaaacuacaa

SEQ ID NO: 2222997 - RNA, 15 nt, Homo sapiens
guuacaucugugcag

SEQ ID NO: 2222998 - RNA, 15 nt, Homo sapiens
uagcacuacaaacac

SEQ ID NO: 2222999 - RNA, 16 nt, Homo sapiens
cuucacucugggcaca

SEQ ID NO: 2223000 - RNA, 23 nt, Homo sapiens
aggauuauuuugauuauauacuu

SEQ ID NO: 2223001 - RNA, 19 nt, Homo sapiens
cucugcuauuugcuguuau

SEQ ID NO: 2223002 - RNA, 17 nt, Homo sapiens
aggcaggagaauggcau

SEQ ID NO: 2223003 - RNA, 19 nt, Homo sapiens
cauaaaauugcaguuucau

SEQ ID NO: 2223004 - RNA, 12 nt, Homo sapiens
agcaucauucag

SEQ ID NO: 2223005 - RNA, 21 nt, Homo sapiens
gccuucugccaacgccuccug

SEQ ID NO: 2223006 - RNA, 17 nt, Homo sapiens
aaagcuuucaacaugua

SEQ ID NO: 2223007 - RNA, 15 nt, Homo sapiens
ggccaaagacaaaua

SEQ ID NO: 2223008 - RNA, 15 nt, Homo sapiens
acuccccuacaucaa

SEQ ID NO: 2223009 - RNA, 14 nt, Homo sapiens
uguuuauccaugua

SEQ ID NO: 2223010 - RNA, 14 nt, Homo sapiens
cacaagugucccug

SEQ ID NO: 2223011 - RNA, 15 nt, Homo sapiens
ugcuuuuuccagauu

SEQ ID NO: 2223012 - RNA, 21 nt, Homo sapiens
aaaucccaauccccaaaucag

SEQ ID NO: 2223013 - RNA, 14 nt, Homo sapiens
acuuuaaugggagg

SEQ ID NO: 2223014 - RNA, 19 nt, Homo sapiens
acuaagcauagcaaacaga

SEQ ID NO: 2223015 - RNA, 24 nt, Homo sapiens
cagcagaaagguuaguaucaucag

SEQ ID NO: 2223016 - RNA, 22 nt, Homo sapiens
gcagugaugacuugcuguccag

SEQ ID NO: 2223017 - RNA, 15 nt, Homo sapiens
cuuuacgguccaugc

SEQ ID NO: 2223018 - RNA, 23 nt, Homo sapiens
auuacgguguacaguuuaacaga

SEQ ID NO: 2223019 - RNA, 15 nt, Homo sapiens
gcauuaaacauuuga

SEQ ID NO: 2223020 - RNA, 15 nt, Homo sapiens
gaaauaaaccuauga

SEQ ID NO: 2223021 - RNA, 15 nt, Homo sapiens
caaggaagguggugg

SEQ ID NO: 2223022 - RNA, 13 nt, Homo sapiens
accacugggcaaa

SEQ ID NO: 2223023 - RNA, 20 nt, Homo sapiens
cuuuguaauaucuaaaaacu

SEQ ID NO: 2223024 - RNA, 20 nt, Homo sapiens
cccggcugaguguacuagua

SEQ ID NO: 2223025 - RNA, 20 nt, Homo sapiens
cuauaauugccacugagaga

SEQ ID NO: 2223026 - RNA, 22 nt, Homo sapiens
cuccugagcauauuuaaaacaa

SEQ ID NO: 2223027 - RNA, 13 nt, Homo sapiens
gccugagugaucc

SEQ ID NO: 2223028 - RNA, 19 nt, Homo sapiens
cccagaaauguauggcaug

SEQ ID NO: 2223029 - RNA, 20 nt, Homo sapiens
gggauugaauuaaaacagcu

SEQ ID NO: 2223030 - RNA, 13 nt, Homo sapiens
gcucuggugcuuu

SEQ ID NO: 2223031 - RNA, 17 nt, Homo sapiens
ucgcagagaaugugaac

SEQ ID NO: 2223032 - RNA, 21 nt, Homo sapiens
aagaaguggauuguauuguga

SEQ ID NO: 2223033 - RNA, 15 nt, Homo sapiens
aaggacucaacauua

SEQ ID NO: 2223034 - RNA, 17 nt, Homo sapiens
aucugucugugcacaug

SEQ ID NO: 2223035 - RNA, 20 nt, Homo sapiens
uggccuuauggauuuggacu

SEQ ID NO: 2223036 - RNA, 21 nt, Homo sapiens
acacucuccugugaacacugg

SEQ ID NO: 2223037 - RNA, 19 nt, Homo sapiens
ucccagcuucggcauuuga

SEQ ID NO: 2223038 - RNA, 16 nt, Homo sapiens
uagcuagagcuuuucu

SEQ ID NO: 2223039 - RNA, 19 nt, Homo sapiens
cagccugggcaacagagca

SEQ ID NO: 2223040 - RNA, 15 nt, Homo sapiens
aggaaaagauguaug

SEQ ID NO: 2223041 - RNA, 13 nt, Homo sapiens
augagaccuggaa

SEQ ID NO: 2223042 - RNA, 21 nt, Homo sapiens
uccucugucagucacagccac

SEQ ID NO: 2223043 - RNA, 21 nt, Homo sapiens
ugcugcuauuuuacugucuua

SEQ ID NO: 2223044 - RNA, 16 nt, Homo sapiens
ggagaaaacuucucac

SEQ ID NO: 2223045 - RNA, 14 nt, Homo sapiens
acagcugugcucug

SEQ ID NO: 2223046 - RNA, 15 nt, Homo sapiens
ugugaccacagcagu

SEQ ID NO: 2223047 - RNA, 20 nt, Homo sapiens
caagcuaagcugcaggcaca

SEQ ID NO: 2223048 - RNA, 15 nt, Homo sapiens
uaauuaccaguuuuc

SEQ ID NO: 2223049 - RNA, 14 nt, Homo sapiens
ugccaaaaugcucu

SEQ ID NO: 2223050 - RNA, 14 nt, Homo sapiens
ugcucuaaugccaa

SEQ ID NO: 2223051 - RNA, 14 nt, Homo sapiens
acccacagccauag

SEQ ID NO: 2223052 - RNA, 20 nt, Homo sapiens
gaaaauucaaaaaguguuua

SEQ ID NO: 2223053 - RNA, 24 nt, Homo sapiens
acauuccuuagucucaagggcuag

SEQ ID NO: 2223054 - RNA, 21 nt, Homo sapiens
aaaaagugaaaacaauguaag

SEQ ID NO: 2223055 - RNA, 12 nt, Homo sapiens
cccuguuuccaa

SEQ ID NO: 2223056 - RNA, 23 nt, Homo sapiens
gcguccaauacacgcgugugcuc

SEQ ID NO: 2223057 - RNA, 17 nt, Homo sapiens
uaaugagugaguucuca

SEQ ID NO: 2223058 - RNA, 23 nt, Homo sapiens
acacguuaggaauguccagacug

SEQ ID NO: 2223059 - RNA, 13 nt, Homo sapiens
gaaggcuguggug

SEQ ID NO: 2223060 - RNA, 17 nt, Homo sapiens
accuucuacccuggguc

SEQ ID NO: 2223061 - RNA, 16 nt, Homo sapiens
gccauccaaagaaaca

SEQ ID NO: 2223062 - RNA, 17 nt, Homo sapiens
acagauucuucacugug

SEQ ID NO: 2223063 - RNA, 20 nt, Homo sapiens
cuaccucagcgucucuucca

SEQ ID NO: 2223064 - RNA, 16 nt, Homo sapiens
agugacagaaggcccg

SEQ ID NO: 2223065 - RNA, 13 nt, Homo sapiens
uuuuuuuuaccuc

SEQ ID NO: 2223066 - RNA, 22 nt, Homo sapiens
gggaggcagagguugcagugaa

SEQ ID NO: 2223067 - RNA, 19 nt, Homo sapiens
ccaguggcagacaaacaga

SEQ ID NO: 2223068 - RNA, 21 nt, Homo sapiens
ucaacugcucuuuuauacugu

SEQ ID NO: 2223069 - RNA, 21 nt, Homo sapiens
aacauuugcaaagaccuuuag

SEQ ID NO: 2223070 - RNA, 16 nt, Homo sapiens
aaucuccucuuuguga

SEQ ID NO: 2223071 - RNA, 18 nt, Homo sapiens
ccccaucuccaucaggaa

SEQ ID NO: 2223072 - RNA, 20 nt, Homo sapiens
agucuagccuuguguuauag

SEQ ID NO: 2223073 - RNA, 21 nt, Homo sapiens
uguccuagcacagauggccag

SEQ ID NO: 2223074 - RNA, 16 nt, Homo sapiens
agaauuaucaucccaa

SEQ ID NO: 2223075 - RNA, 20 nt, Homo sapiens
gcccagggaagccaaaagau

SEQ ID NO: 2223076 - RNA, 20 nt, Homo sapiens
cacaugccuguaaucccagc

SEQ ID NO: 2223077 - RNA, 19 nt, Homo sapiens
uguaacucaaaggguggaa

SEQ ID NO: 2223078 - RNA, 19 nt, Homo sapiens
uuaagauggcuacaccuca

SEQ ID NO: 2223079 - RNA, 14 nt, Homo sapiens
guccauucaucuca

SEQ ID NO: 2223080 - RNA, 23 nt, Homo sapiens
uggggagaggggagugcauuuag

SEQ ID NO: 2223081 - RNA, 19 nt, Homo sapiens
ggagaacuaaagguggcca

SEQ ID NO: 2223082 - RNA, 14 nt, Homo sapiens
aauaucuaccugcc

SEQ ID NO: 2223083 - RNA, 19 nt, Homo sapiens
gaacacagccugggaccag

SEQ ID NO: 2223084 - RNA, 20 nt, Homo sapiens
agaggggaaaccaguguagc

SEQ ID NO: 2223085 - RNA, 17 nt, Homo sapiens
guucuuuuuucuuuuga

SEQ ID NO: 2223086 - RNA, 14 nt, Homo sapiens
agaucccccagacu

SEQ ID NO: 2223087 - RNA, 22 nt, Homo sapiens
uuuaaaaaaaacaauuccacac

SEQ ID NO: 2223088 - RNA, 13 nt, Homo sapiens
acaacauguucua

SEQ ID NO: 2223089 - RNA, 18 nt, Homo sapiens
gagcaaggguucccucaa

SEQ ID NO: 2223090 - RNA, 19 nt, Homo sapiens
ucuaauaaaaauacaaaaa

SEQ ID NO: 2223091 - RNA, 22 nt, Homo sapiens
uagaacucaaccucuacagggu

SEQ ID NO: 2223092 - RNA, 17 nt, Homo sapiens
aguguaugauuacuggc

SEQ ID NO: 2223093 - RNA, 17 nt, Homo sapiens
aucuuacaaaauacaca

SEQ ID NO: 2223094 - RNA, 17 nt, Homo sapiens
caagagguacuguaaug

SEQ ID NO: 2223095 - RNA, 17 nt, Homo sapiens
gacucccacucuuugaa

SEQ ID NO: 2223096 - RNA, 13 nt, Homo sapiens
aacccauuuugaa

SEQ ID NO: 2223097 - RNA, 15 nt, Homo sapiens
gaacaucccuacccu

SEQ ID NO: 2223098 - RNA, 18 nt, Homo sapiens
agugggcuaggaggacaa

SEQ ID NO: 2223099 - RNA, 19 nt, Homo sapiens
ccaggccccugaugcucca

SEQ ID NO: 2223100 - RNA, 17 nt, Homo sapiens
cuuuuaaggaaaggcaa

SEQ ID NO: 2223101 - RNA, 12 nt, Homo sapiens
aagauuaauuaa

SEQ ID NO: 2223102 - RNA, 21 nt, Homo sapiens
ggaucccugcccuucucaaga

SEQ ID NO: 2223103 - RNA, 19 nt, Homo sapiens
cuguuguauuaccaaagca

SEQ ID NO: 2223104 - RNA, 19 nt, Homo sapiens
uagauccucugauauacaa

SEQ ID NO: 2223105 - RNA, 14 nt, Homo sapiens
cugcacacagggug

SEQ ID NO: 2223106 - RNA, 24 nt, Homo sapiens
ccuuccuaugcuguucacuggaca

SEQ ID NO: 2223107 - RNA, 22 nt, Homo sapiens
aaaguuagucaauccugucaua

SEQ ID NO: 2223108 - RNA, 21 nt, Homo sapiens
cauauaggaaaacaauaauuu

SEQ ID NO: 2223109 - RNA, 23 nt, Homo sapiens
uuaaaagaccaucuccuguaaaa

SEQ ID NO: 2223110 - RNA, 22 nt, Homo sapiens
ccucuaguaagaugcacugaaa

SEQ ID NO: 2223111 - RNA, 15 nt, Homo sapiens
cagauaggauggggu

SEQ ID NO: 2223112 - RNA, 12 nt, Homo sapiens
ugcgaacacuga

SEQ ID NO: 2223113 - RNA, 14 nt, Homo sapiens
ugucauaugcugcu

SEQ ID NO: 2223114 - RNA, 21 nt, Homo sapiens
aucaggacagguggugcaaau

SEQ ID NO: 2223115 - RNA, 22 nt, Homo sapiens
ccuggacaguuuucugcuuuaa

SEQ ID NO: 2223116 - RNA, 22 nt, Homo sapiens
gcagccuugugaugucauacag

SEQ ID NO: 2223117 - RNA, 15 nt, Homo sapiens
aggacgcaugcaggg

SEQ ID NO: 2223118 - RNA, 18 nt, Homo sapiens
agucagugaggaguaaaa

SEQ ID NO: 2223119 - RNA, 22 nt, Homo sapiens
uggaugccaaccggucacccag

SEQ ID NO: 2223120 - RNA, 14 nt, Homo sapiens
uuugaaacauacag

SEQ ID NO: 2223121 - RNA, 14 nt, Homo sapiens
cacacucacuggca

SEQ ID NO: 2223122 - RNA, 22 nt, Homo sapiens
gugcccacugucucuuccacuu

SEQ ID NO: 2223123 - RNA, 23 nt, Homo sapiens
gaaaucucaaaacuguacugucu

SEQ ID NO: 2223124 - RNA, 12 nt, Homo sapiens
aaauauguguau

SEQ ID NO: 2223125 - RNA, 22 nt, Homo sapiens
caggaucucagaucacugcaac

SEQ ID NO: 2223126 - RNA, 22 nt, Homo sapiens
uucccuccacaacucaguuuca

SEQ ID NO: 2223127 - RNA, 15 nt, Homo sapiens
caaaucgaaacaaca

SEQ ID NO: 2223128 - RNA, 23 nt, Homo sapiens
acaaauaugucaagaacaggaca

SEQ ID NO: 2223129 - RNA, 16 nt, Homo sapiens
aaacuuagcuuuugau

SEQ ID NO: 2223130 - RNA, 13 nt, Homo sapiens
ucaagaguuguga

SEQ ID NO: 2223131 - RNA, 17 nt, Homo sapiens
agcucuguagaaagaau

SEQ ID NO: 2223132 - RNA, 12 nt, Homo sapiens
ucuuagcuuucu

SEQ ID NO: 2223133 - RNA, 20 nt, Homo sapiens
uuaaaaaaaaagucagagac

SEQ ID NO: 2223134 - RNA, 16 nt, Homo sapiens
uucaccucuucuuucc

SEQ ID NO: 2223135 - RNA, 16 nt, Homo sapiens
cuugcguagaauugca

SEQ ID NO: 2223136 - RNA, 21 nt, Homo sapiens
agauggauuugggugaucuga

SEQ ID NO: 2223137 - RNA, 18 nt, Homo sapiens
cugauuuaauaugcaaag

SEQ ID NO: 2223138 - RNA, 12 nt, Homo sapiens
aacucuggaccc

SEQ ID NO: 2223139 - RNA, 22 nt, Homo sapiens
cugguacaucgaggcucuugcu

SEQ ID NO: 2223140 - RNA, 20 nt, Homo sapiens
caaaagaauugugccucucc

SEQ ID NO: 2223141 - RNA, 20 nt, Homo sapiens
gccaagaucacgccacugca

SEQ ID NO: 2223142 - RNA, 20 nt, Homo sapiens
gcugagaucacaccacugua

SEQ ID NO: 2223143 - RNA, 16 nt, Homo sapiens
uuaaugcagacaaaca

SEQ ID NO: 2223144 - RNA, 12 nt, Homo sapiens
guuccuugcuag

SEQ ID NO: 2223145 - RNA, 11 nt, Homo sapiens
uuccugccacc

SEQ ID NO: 2223146 - RNA, 19 nt, Homo sapiens
uugaggcggauggcuguga

SEQ ID NO: 2223147 - RNA, 21 nt, Homo sapiens
acauuuguuucccccacaguu

SEQ ID NO: 2223148 - RNA, 17 nt, Homo sapiens
cagggccaggacugagc

SEQ ID NO: 2223149 - RNA, 15 nt, Homo sapiens
acagaagucuugucu

SEQ ID NO: 2223150 - RNA, 19 nt, Homo sapiens
gagcugccuccagccuggu

SEQ ID NO: 2223151 - RNA, 21 nt, Homo sapiens
ugccguaacaacuguggucaa

SEQ ID NO: 2223152 - RNA, 16 nt, Homo sapiens
uaauaaagacacuggc

SEQ ID NO: 2223153 - RNA, 18 nt, Homo sapiens
agacaaauacucaugugu

SEQ ID NO: 2223154 - RNA, 13 nt, Homo sapiens
uuuuaauuuucac

SEQ ID NO: 2223155 - RNA, 12 nt, Homo sapiens
uggcaugugcag

SEQ ID NO: 2223156 - RNA, 18 nt, Homo sapiens
acagaaauacugcucuga

SEQ ID NO: 2223157 - RNA, 18 nt, Homo sapiens
aagguuuucuucauucau

SEQ ID NO: 2223158 - RNA, 20 nt, Homo sapiens
gcucagcccaccccccucau

SEQ ID NO: 2223159 - RNA, 17 nt, Homo sapiens
ggccaacggcaacagca

SEQ ID NO: 2223160 - RNA, 19 nt, Homo sapiens
uuucuggggcaacugagag

SEQ ID NO: 2223161 - RNA, 23 nt, Homo sapiens
uaccaccaagggaucugccauug

SEQ ID NO: 2223162 - RNA, 14 nt, Homo sapiens
aauugcaggucucu

SEQ ID NO: 2223163 - RNA, 22 nt, Homo sapiens
aaugcgccaauaaaccaaugaa

SEQ ID NO: 2223164 - RNA, 13 nt, Homo sapiens
uucuccacagugu

SEQ ID NO: 2223165 - RNA, 14 nt, Homo sapiens
acaaccaucccugc

SEQ ID NO: 2223166 - RNA, 23 nt, Homo sapiens
caggucagcgcgguccugacucc

SEQ ID NO: 2223167 - RNA, 14 nt, Homo sapiens
ccccucucuuugag

SEQ ID NO: 2223168 - RNA, 14 nt, Homo sapiens
cuccgcaacagcca

SEQ ID NO: 2223169 - RNA, 13 nt, Homo sapiens
aggacucacccuc

SEQ ID NO: 2223170 - RNA, 22 nt, Homo sapiens
auggaguacacagcugagcaau

SEQ ID NO: 2223171 - RNA, 19 nt, Homo sapiens
aaacauaaagagaacucug

SEQ ID NO: 2223172 - RNA, 15 nt, Homo sapiens
auuauuuucugcuac

SEQ ID NO: 2223173 - RNA, 22 nt, Homo sapiens
caugaacaucauggacugagcu

SEQ ID NO: 2223174 - RNA, 21 nt, Homo sapiens
auauuucugggagacagaaaa

SEQ ID NO: 2223175 - RNA, 20 nt, Homo sapiens
cagaaggagaugcugcugag

SEQ ID NO: 2223176 - RNA, 23 nt, Homo sapiens
gaugcagaaauguggaugcucuu

SEQ ID NO: 2223177 - RNA, 20 nt, Homo sapiens
uccacacccacccccucugg

SEQ ID NO: 2223178 - RNA, 20 nt, Homo sapiens
uacggguguaaacacugaug

SEQ ID NO: 2223179 - RNA, 14 nt, Homo sapiens
uaaugacaugccua

SEQ ID NO: 2223180 - RNA, 23 nt, Homo sapiens
cacauugacuccuuuccaauaga

SEQ ID NO: 2223181 - RNA, 15 nt, Homo sapiens
cuuagugugugcaau

SEQ ID NO: 2223182 - RNA, 15 nt, Homo sapiens
cagcuggucuuuucu

SEQ ID NO: 2223183 - RNA, 16 nt, Homo sapiens
aacuuccauucuuucu

SEQ ID NO: 2223184 - RNA, 23 nt, Homo sapiens
cagagauggaggccgagccaaua

SEQ ID NO: 2223185 - RNA, 12 nt, Homo sapiens
caauugucuuaa

SEQ ID NO: 2223186 - RNA, 14 nt, Homo sapiens
gccagggcaccuac

SEQ ID NO: 2223187 - RNA, 23 nt, Homo sapiens
ugucuacaguuuaauaaauagca

SEQ ID NO: 2223188 - RNA, 20 nt, Homo sapiens
agaccguuuaccuagaagaa

SEQ ID NO: 2223189 - RNA, 21 nt, Homo sapiens
gagagaacaacuacugugauc

SEQ ID NO: 2223190 - RNA, 16 nt, Homo sapiens
gcauuuggucaggggg

SEQ ID NO: 2223191 - RNA, 18 nt, Homo sapiens
uccgcuagcaguacuaau

SEQ ID NO: 2223192 - RNA, 12 nt, Homo sapiens
ucauagugauag

SEQ ID NO: 2223193 - RNA, 18 nt, Homo sapiens
gagaggcacucagugagc

SEQ ID NO: 2223194 - RNA, 12 nt, Homo sapiens
cucagcacuuug

SEQ ID NO: 2223195 - RNA, 23 nt, Homo sapiens
aagccggggaagagauccaaaga

SEQ ID NO: 2223196 - RNA, 15 nt, Homo sapiens
auuaacaugucacaa

SEQ ID NO: 2223197 - RNA, 12 nt, Homo sapiens
aguuacauauua

SEQ ID NO: 2223198 - RNA, 14 nt, Homo sapiens
cagcuuugcaaaau

SEQ ID NO: 2223199 - RNA, 22 nt, Homo sapiens
gguauaguguguguugcaaauc

SEQ ID NO: 2223200 - RNA, 21 nt, Homo sapiens
aauuuuguuuguaauccugua

SEQ ID NO: 2223201 - RNA, 16 nt, Homo sapiens
uagaacugauccagca

SEQ ID NO: 2223202 - RNA, 23 nt, Homo sapiens
gcaacgccugccuucugggcaag

SEQ ID NO: 2223203 - RNA, 13 nt, Homo sapiens
agacaagcacuuu

SEQ ID NO: 2223204 - RNA, 23 nt, Homo sapiens
aauuagcaauugacugucacugu

SEQ ID NO: 2223205 - RNA, 16 nt, Homo sapiens
cagagcagaaccaaag

SEQ ID NO: 2223206 - RNA, 15 nt, Homo sapiens
agaugauacuuccaa

SEQ ID NO: 2223207 - RNA, 22 nt, Homo sapiens
ugcacuuaguagcuaugugauu

SEQ ID NO: 2223208 - RNA, 13 nt, Homo sapiens
uuuuaugauauca

SEQ ID NO: 2223209 - RNA, 12 nt, Homo sapiens
cacaaacaauau

SEQ ID NO: 2223210 - RNA, 23 nt, Homo sapiens
caauuauaucaguccucuuucaa

SEQ ID NO: 2223211 - RNA, 17 nt, Homo sapiens
uuagagaaaaccuuaaa

SEQ ID NO: 2223212 - RNA, 15 nt, Homo sapiens
aguuugggaggcuga

SEQ ID NO: 2223213 - RNA, 15 nt, Homo sapiens
aggccaggaguucaa

SEQ ID NO: 2223214 - RNA, 17 nt, Homo sapiens
cuaauagagagauuagu

SEQ ID NO: 2223215 - RNA, 20 nt, Homo sapiens
cgugagggggggguggguga

SEQ ID NO: 2223216 - RNA, 21 nt, Homo sapiens
auagcgcugcucuuaugccau

SEQ ID NO: 2223217 - RNA, 21 nt, Homo sapiens
aaagcuacuauguacugccuu

SEQ ID NO: 2223218 - RNA, 18 nt, Homo sapiens
gccagagccucaggcaga

SEQ ID NO: 2223219 - RNA, 17 nt, Homo sapiens
agccaauucacaaguua

SEQ ID NO: 2223220 - RNA, 22 nt, Homo sapiens
uaaucaucuaagucaguaccca

SEQ ID NO: 2223221 - RNA, 17 nt, Homo sapiens
ggacagaugaaugccgu

SEQ ID NO: 2223222 - RNA, 11 nt, Homo sapiens
aauccuuccaa

SEQ ID NO: 2223223 - RNA, 22 nt, Homo sapiens
ccacauauagagcuccagggac

SEQ ID NO: 2223224 - RNA, 21 nt, Homo sapiens
gacacaggcuccaaacuggag

SEQ ID NO: 2223225 - RNA, 17 nt, Homo sapiens
uacaaccugaugucaua

SEQ ID NO: 2223226 - RNA, 16 nt, Homo sapiens
agcaaggaucuuucac

SEQ ID NO: 2223227 - RNA, 15 nt, Homo sapiens
cgugguauaaucucc

SEQ ID NO: 2223228 - RNA, 17 nt, Homo sapiens
ucagagagggugacaag

SEQ ID NO: 2223229 - RNA, 12 nt, Homo sapiens
aaacccagagau

SEQ ID NO: 2223230 - RNA, 16 nt, Homo sapiens
auacuuugaauguugu

SEQ ID NO: 2223231 - RNA, 15 nt, Homo sapiens
cugccaucauuguaa

SEQ ID NO: 2223232 - RNA, 17 nt, Homo sapiens
cacaauucuucugucaa

SEQ ID NO: 2223233 - RNA, 22 nt, Homo sapiens
accuggcagggcucacacuccu

SEQ ID NO: 2223234 - RNA, 18 nt, Homo sapiens
agucccaccuuggcugca

SEQ ID NO: 2223235 - RNA, 21 nt, Homo sapiens
auaacugugaugaaauaugaa

SEQ ID NO: 2223236 - RNA, 19 nt, Homo sapiens
agacagcuuacugcagcac

SEQ ID NO: 2223237 - RNA, 13 nt, Homo sapiens
ccugcaggugcug

SEQ ID NO: 2223238 - RNA, 15 nt, Homo sapiens
agcccggacugacca

SEQ ID NO: 2223239 - RNA, 10 nt, Homo sapiens
uccucugugc

SEQ ID NO: 2223240 - RNA, 14 nt, Homo sapiens
uuuaaaacaugcac

SEQ ID NO: 2223241 - RNA, 21 nt, Homo sapiens
ccacgcauacacacaugcccu

SEQ ID NO: 2223242 - RNA, 19 nt, Homo sapiens
gcccaggcuggagugcaau

SEQ ID NO: 2223243 - RNA, 19 nt, Homo sapiens
gcccaggcuagagugcagu

SEQ ID NO: 2223244 - RNA, 15 nt, Homo sapiens
uccuguucaugccca

SEQ ID NO: 2223245 - RNA, 22 nt, Homo sapiens
cugcaaauaaggacagcagcug

SEQ ID NO: 2223246 - RNA, 15 nt, Homo sapiens
gaacucucaaaucca

SEQ ID NO: 2223247 - RNA, 21 nt, Homo sapiens
cauuucauauaaauggaauca

SEQ ID NO: 2223248 - RNA, 21 nt, Homo sapiens
uauuuccuuuccaaguauuuc

SEQ ID NO: 2223249 - RNA, 14 nt, Homo sapiens
uaaagcaucaucug

SEQ ID NO: 2223250 - RNA, 15 nt, Homo sapiens
acccuuaucaccagc

SEQ ID NO: 2223251 - RNA, 15 nt, Homo sapiens
cuguguccaucugac

SEQ ID NO: 2223252 - RNA, 14 nt, Homo sapiens
agggucagugccaa

SEQ ID NO: 2223253 - RNA, 16 nt, Homo sapiens
cccuacugcaaauggc

SEQ ID NO: 2223254 - RNA, 22 nt, Homo sapiens
cugcccacgucccgggcacugu

SEQ ID NO: 2223255 - RNA, 19 nt, Homo sapiens
auccagguaauccaagaua

SEQ ID NO: 2223256 - RNA, 14 nt, Homo sapiens
aaaaugaaaggaag

SEQ ID NO: 2223257 - RNA, 14 nt, Homo sapiens
agaaaccugacuca

SEQ ID NO: 2223258 - RNA, 14 nt, Homo sapiens
cugcugaaugcagg

SEQ ID NO: 2223259 - RNA, 16 nt, Homo sapiens
ugaagccuuugccagc

SEQ ID NO: 2223260 - RNA, 14 nt, Homo sapiens
cccaaccacaggaa

SEQ ID NO: 2223261 - RNA, 19 nt, Homo sapiens
ggaccuccaccugggagau

SEQ ID NO: 2223262 - RNA, 15 nt, Homo sapiens
auagccuccaaacau

SEQ ID NO: 2223263 - RNA, 18 nt, Homo sapiens
auaaauauuuuugccaua

SEQ ID NO: 2223264 - RNA, 22 nt, Homo sapiens
gcacguggccaggagccaugac

SEQ ID NO: 2223265 - RNA, 22 nt, Homo sapiens
gaaggaguuucacccugaccau

SEQ ID NO: 2223266 - RNA, 18 nt, Homo sapiens
caaauauuagcaaagaag

SEQ ID NO: 2223267 - RNA, 14 nt, Homo sapiens
uggucugugcugcc

SEQ ID NO: 2223268 - RNA, 15 nt, Homo sapiens
gaaguggcugccaaa

SEQ ID NO: 2223269 - RNA, 21 nt, Homo sapiens
aaaccucagcuagcucugcca

SEQ ID NO: 2223270 - RNA, 15 nt, Homo sapiens
uauucaucagaaugu

SEQ ID NO: 2223271 - RNA, 17 nt, Homo sapiens
ugcacugagagugaagu

SEQ ID NO: 2223272 - RNA, 21 nt, Homo sapiens
caaaguguuuuuuauugaaug

SEQ ID NO: 2223273 - RNA, 19 nt, Homo sapiens
agcucuggugacaccagcc

SEQ ID NO: 2223274 - RNA, 16 nt, Homo sapiens
gagcuguccccuggag

SEQ ID NO: 2223275 - RNA, 21 nt, Homo sapiens
cuguggaagauaucacaugaa

SEQ ID NO: 2223276 - RNA, 17 nt, Homo sapiens
aguggccaagccugcug

SEQ ID NO: 2223277 - RNA, 20 nt, Homo sapiens
gcccugggggauaccagcug

SEQ ID NO: 2223278 - RNA, 11 nt, Homo sapiens
uggugugauuu

SEQ ID NO: 2223279 - RNA, 18 nt, Homo sapiens
aagguauugcaaggucac

SEQ ID NO: 2223280 - RNA, 12 nt, Homo sapiens
cugccccagaga

SEQ ID NO: 2223281 - RNA, 22 nt, Homo sapiens
cauugcacaauauauuuuuacu

SEQ ID NO: 2223282 - RNA, 22 nt, Homo sapiens
aaugcaguccagaauaagugcu

SEQ ID NO: 2223283 - RNA, 14 nt, Homo sapiens
uaccgucugugauu

SEQ ID NO: 2223284 - RNA, 13 nt, Homo sapiens
agcuacugaugag

SEQ ID NO: 2223285 - RNA, 22 nt, Homo sapiens
gauauucccccugagcugccac

SEQ ID NO: 2223286 - RNA, 18 nt, Homo sapiens
uuucuuuaagucaguuca

SEQ ID NO: 2223287 - RNA, 20 nt, Homo sapiens
aauacuuauuuucagugcau

SEQ ID NO: 2223288 - RNA, 19 nt, Homo sapiens
uaaucuggaauaugcaaca

SEQ ID NO: 2223289 - RNA, 20 nt, Homo sapiens
augaaccugcaucauucccc

SEQ ID NO: 2223290 - RNA, 21 nt, Homo sapiens
ucucaggccccgggcuucccu

SEQ ID NO: 2223291 - RNA, 18 nt, Homo sapiens
ggggaggcggcacuccaa

SEQ ID NO: 2223292 - RNA, 13 nt, Homo sapiens
ggugcagccagag

SEQ ID NO: 2223293 - RNA, 10 nt, Homo sapiens
uugugcacug

SEQ ID NO: 2223294 - RNA, 19 nt, Homo sapiens
aaauaaguggaaaccgugu

SEQ ID NO: 2223295 - RNA, 23 nt, Homo sapiens
augggagcauaugugagaaauaa

SEQ ID NO: 2223296 - RNA, 14 nt, Homo sapiens
uuucaggaagugaa

SEQ ID NO: 2223297 - RNA, 16 nt, Homo sapiens
aaaaaugcacaccuca

SEQ ID NO: 2223298 - RNA, 21 nt, Homo sapiens
cauguuguacauuagaccucu

SEQ ID NO: 2223299 - RNA, 14 nt, Homo sapiens
ggugcccagcuuau

SEQ ID NO: 2223300 - RNA, 19 nt, Homo sapiens
gcuuguguacaaacccaga

SEQ ID NO: 2223301 - RNA, 14 nt, Homo sapiens
uccaugauacuuua

SEQ ID NO: 2223302 - RNA, 15 nt, Homo sapiens
uccaugcuauaauuc

SEQ ID NO: 2223303 - RNA, 16 nt, Homo sapiens
gugacaccaccacugu

SEQ ID NO: 2223304 - RNA, 18 nt, Homo sapiens
auucaacuggaacauuuu

SEQ ID NO: 2223305 - RNA, 18 nt, Homo sapiens
guaacacuguauaacauu

SEQ ID NO: 2223306 - RNA, 22 nt, Homo sapiens
aaagcuuuauauguaauuaaca

SEQ ID NO: 2223307 - RNA, 17 nt, Homo sapiens
caucucugcuuucacuc

SEQ ID NO: 2223308 - RNA, 23 nt, Homo sapiens
guugccaggagauggaauaucaa

SEQ ID NO: 2223309 - RNA, 14 nt, Homo sapiens
cagccacccaagcc

SEQ ID NO: 2223310 - RNA, 16 nt, Homo sapiens
agccccagacaacagc

SEQ ID NO: 2223311 - RNA, 13 nt, Homo sapiens
accaacaugguga

SEQ ID NO: 2223312 - RNA, 20 nt, Homo sapiens
auaagaagcuuucaguauua

SEQ ID NO: 2223313 - RNA, 23 nt, Homo sapiens
ugcccucuccccaccccuuccaa

SEQ ID NO: 2223314 - RNA, 15 nt, Homo sapiens
cacuuauaccaaagg

SEQ ID NO: 2223315 - RNA, 14 nt, Homo sapiens
uccucuugcaaaag

SEQ ID NO: 2223316 - RNA, 15 nt, Homo sapiens
cagaucugugccugg

SEQ ID NO: 2223317 - RNA, 16 nt, Homo sapiens
agcugaaggugaaaca

SEQ ID NO: 2223318 - RNA, 22 nt, Homo sapiens
cugcagcuuggagaacuccgcu

SEQ ID NO: 2223319 - RNA, 14 nt, Homo sapiens
aucagaaacucaaa

SEQ ID NO: 2223320 - RNA, 19 nt, Homo sapiens
agcaaggguuggaggcaau

SEQ ID NO: 2223321 - RNA, 19 nt, Homo sapiens
aauguugaaaaguaauuga

SEQ ID NO: 2223322 - RNA, 19 nt, Homo sapiens
ggucuguguucgacucagc

SEQ ID NO: 2223323 - RNA, 15 nt, Homo sapiens
cucaaauacauaccu

SEQ ID NO: 2223324 - RNA, 17 nt, Homo sapiens
aacuuaaaaauauccau

SEQ ID NO: 2223325 - RNA, 13 nt, Homo sapiens
aaacagaaauugc

SEQ ID NO: 2223326 - RNA, 15 nt, Homo sapiens
aguuaucuaagaaua

SEQ ID NO: 2223327 - RNA, 18 nt, Homo sapiens
aacuguguuguauuaaca

SEQ ID NO: 2223328 - RNA, 18 nt, Homo sapiens
uuaugaaacauuacaguu

SEQ ID NO: 2223329 - RNA, 14 nt, Homo sapiens
uuacaccacaagua

SEQ ID NO: 2223330 - RNA, 19 nt, Homo sapiens
uaaauaacuggaaaacaga

SEQ ID NO: 2223331 - RNA, 14 nt, Homo sapiens
cugcucucuucagg

SEQ ID NO: 2223332 - RNA, 15 nt, Homo sapiens
uaaguuacuucacuu

SEQ ID NO: 2223333 - RNA, 15 nt, Homo sapiens
ccaggaucauggugu

SEQ ID NO: 2223334 - RNA, 15 nt, Homo sapiens
cugguggcacaggag

SEQ ID NO: 2223335 - RNA, 15 nt, Homo sapiens
ucuagaacagccaga

SEQ ID NO: 2223336 - RNA, 15 nt, Homo sapiens
guaaaguagcuguaa

SEQ ID NO: 2223337 - RNA, 23 nt, Homo sapiens
caacauaauguuuucacaguucc

SEQ ID NO: 2223338 - RNA, 15 nt, Homo sapiens
cagccucccuuugau

SEQ ID NO: 2223339 - RNA, 16 nt, Homo sapiens
aacaucuguuaucaaa

SEQ ID NO: 2223340 - RNA, 21 nt, Homo sapiens
ccucuguccuggcugugcaca

SEQ ID NO: 2223341 - RNA, 15 nt, Homo sapiens
ccacgcuuuuugacu

SEQ ID NO: 2223342 - RNA, 12 nt, Homo sapiens
acaaucuuguca

SEQ ID NO: 2223343 - RNA, 20 nt, Homo sapiens
cuggugcuguacccccgacg

SEQ ID NO: 2223344 - RNA, 15 nt, Homo sapiens
uauaaauagccuuca

SEQ ID NO: 2223345 - RNA, 17 nt, Homo sapiens
gauccacgcugggccua

SEQ ID NO: 2223346 - RNA, 16 nt, Homo sapiens
uacuuucccucaucca

SEQ ID NO: 2223347 - RNA, 23 nt, Homo sapiens
cacuguuacuuucguacauuggc

SEQ ID NO: 2223348 - RNA, 14 nt, Homo sapiens
guacaagugagaaa

SEQ ID NO: 2223349 - RNA, 16 nt, Homo sapiens
aagcucagcuaugaaa

SEQ ID NO: 2223350 - RNA, 23 nt, Homo sapiens
uuuucuggcauuuucuguuccag

SEQ ID NO: 2223351 - RNA, 16 nt, Homo sapiens
cauagcuccuucucuc

SEQ ID NO: 2223352 - RNA, 19 nt, Homo sapiens
uuaaagaacucaacuuucc

SEQ ID NO: 2223353 - RNA, 22 nt, Homo sapiens
cacagugagucgaggacaggga

SEQ ID NO: 2223354 - RNA, 13 nt, Homo sapiens
agcaacccugggu

SEQ ID NO: 2223355 - RNA, 17 nt, Homo sapiens
aacaugcaccuugcucc

SEQ ID NO: 2223356 - RNA, 21 nt, Homo sapiens
agauaacuucaugaagacuua

SEQ ID NO: 2223357 - RNA, 14 nt, Homo sapiens
accaagaaguggcu

SEQ ID NO: 2223358 - RNA, 15 nt, Homo sapiens
agacaggaagaccaa

SEQ ID NO: 2223359 - RNA, 22 nt, Homo sapiens
caggugcgcgccaccgugccug

SEQ ID NO: 2223360 - RNA, 14 nt, Homo sapiens
aucuguacauauua

SEQ ID NO: 2223361 - RNA, 17 nt, Homo sapiens
gacagcuuagaagccau

SEQ ID NO: 2223362 - RNA, 14 nt, Homo sapiens
accuugucucauga

SEQ ID NO: 2223363 - RNA, 20 nt, Homo sapiens
gaauaugaucccuaaugugu

SEQ ID NO: 2223364 - RNA, 21 nt, Homo sapiens
ugcuuauuuuguuggaguauu

SEQ ID NO: 2223365 - RNA, 18 nt, Homo sapiens
cuccuggccuucuaggaa

SEQ ID NO: 2223366 - RNA, 13 nt, Homo sapiens
ugccuugaugaag

SEQ ID NO: 2223367 - RNA, 13 nt, Homo sapiens
gggaacauuucug

SEQ ID NO: 2223368 - RNA, 17 nt, Homo sapiens
ugggaguuuugcucucu

SEQ ID NO: 2223369 - RNA, 15 nt, Homo sapiens
guccucccuagcucu

SEQ ID NO: 2223370 - RNA, 18 nt, Homo sapiens
acuauggcucuacuuuca

SEQ ID NO: 2223371 - RNA, 19 nt, Homo sapiens
gcuaauugguccaacccag

SEQ ID NO: 2223372 - RNA, 15 nt, Homo sapiens
aauuauaauguugcc

SEQ ID NO: 2223373 - RNA, 17 nt, Homo sapiens
cugugucacaucacgaa

SEQ ID NO: 2223374 - RNA, 20 nt, Homo sapiens
ccuucacaaagcccaaggga

SEQ ID NO: 2223375 - RNA, 14 nt, Homo sapiens
ccuggaaggugcca

SEQ ID NO: 2223376 - RNA, 10 nt, Homo sapiens
uguccaucuu

SEQ ID NO: 2223377 - RNA, 14 nt, Homo sapiens
ucugcaaaggccug

SEQ ID NO: 2223378 - RNA, 14 nt, Homo sapiens
agcauguucuugga

SEQ ID NO: 2223379 - RNA, 12 nt, Homo sapiens
uuugauauuuga

SEQ ID NO: 2223380 - RNA, 15 nt, Homo sapiens
guaaucccagcacuu

SEQ ID NO: 2223381 - RNA, 12 nt, Homo sapiens
ucaaaacacaua

SEQ ID NO: 2223382 - RNA, 13 nt, Homo sapiens
aucaagagcugcc

SEQ ID NO: 2223383 - RNA, 17 nt, Homo sapiens
uccauaaaaaaacaauu

SEQ ID NO: 2223384 - RNA, 17 nt, Homo sapiens
cauacaagauucuuccu

SEQ ID NO: 2223385 - RNA, 12 nt, Homo sapiens
aaguagccacag

SEQ ID NO: 2223386 - RNA, 23 nt, Homo sapiens
uaguggccacacucugccuuccu

SEQ ID NO: 2223387 - RNA, 18 nt, Homo sapiens
uacuaaugaugcuuuuau

SEQ ID NO: 2223388 - RNA, 14 nt, Homo sapiens
cucagggcagccuc

SEQ ID NO: 2223389 - RNA, 19 nt, Homo sapiens
cagcacuuugguaggcaaa

SEQ ID NO: 2223390 - RNA, 17 nt, Homo sapiens
ucggcucacaaagagau

SEQ ID NO: 2223391 - RNA, 15 nt, Homo sapiens
uuugggguguauacu

SEQ ID NO: 2223392 - RNA, 16 nt, Homo sapiens
auguucacuguggcau

SEQ ID NO: 2223393 - RNA, 14 nt, Homo sapiens
ugcuucaaacugag

SEQ ID NO: 2223394 - RNA, 17 nt, Homo sapiens
gaauugcccguuuccau

SEQ ID NO: 2223395 - RNA, 20 nt, Homo sapiens
cccuccucgcugugccacca

SEQ ID NO: 2223396 - RNA, 18 nt, Homo sapiens
aggcugcucggcuacugg

SEQ ID NO: 2223397 - RNA, 21 nt, Homo sapiens
caugaagcccaagugaaauca

SEQ ID NO: 2223398 - RNA, 19 nt, Homo sapiens
agauuguuuugccacuuag

SEQ ID NO: 2223399 - RNA, 13 nt, Homo sapiens
ucauagccaaagc

SEQ ID NO: 2223400 - RNA, 13 nt, Homo sapiens
gauugucuguuca

SEQ ID NO: 2223401 - RNA, 14 nt, Homo sapiens
ucgcccuuugcuca

SEQ ID NO: 2223402 - RNA, 16 nt, Homo sapiens
caaauucuauccugug

SEQ ID NO: 2223403 - RNA, 21 nt, Homo sapiens
cuuuauauauggacagcuuua

SEQ ID NO: 2223404 - RNA, 14 nt, Homo sapiens
uggcauucgcagug

SEQ ID NO: 2223405 - RNA, 14 nt, Homo sapiens
ccuacugcccacau

SEQ ID NO: 2223406 - RNA, 18 nt, Homo sapiens
caagucaagugaaaaagg

SEQ ID NO: 2223407 - RNA, 22 nt, Homo sapiens
agacaaguaaaauuauccucuu

SEQ ID NO: 2223408 - RNA, 14 nt, Homo sapiens
cuguuaacacugcu

SEQ ID NO: 2223409 - RNA, 13 nt, Homo sapiens
auuaucgucuucu

SEQ ID NO: 2223410 - RNA, 14 nt, Homo sapiens
caagaaagcucacu

SEQ ID NO: 2223411 - RNA, 16 nt, Homo sapiens
accugucacauugcau

SEQ ID NO: 2223412 - RNA, 18 nt, Homo sapiens
gcccacuuccucccggcc

SEQ ID NO: 2223413 - RNA, 23 nt, Homo sapiens
ucagacgggcugagaggaugaac

SEQ ID NO: 2223414 - RNA, 20 nt, Homo sapiens
uaaggggccuugcucugagc

SEQ ID NO: 2223415 - RNA, 19 nt, Homo sapiens
ugcagaagcaaacaagcuu

SEQ ID NO: 2223416 - RNA, 12 nt, Homo sapiens
caucacuaccuu

SEQ ID NO: 2223417 - RNA, 14 nt, Homo sapiens
gcaccucugaccua

SEQ ID NO: 2223418 - RNA, 23 nt, Homo sapiens
aagaaaugugauuugucuucccu

SEQ ID NO: 2223419 - RNA, 23 nt, Homo sapiens
uuucaagaccuucuccccauucu

SEQ ID NO: 2223420 - RNA, 13 nt, Homo sapiens
cgcgcccagccuu

SEQ ID NO: 2223421 - RNA, 18 nt, Homo sapiens
ugcucacugcucacacgc

SEQ ID NO: 2223422 - RNA, 12 nt, Homo sapiens
auccuguucuca

SEQ ID NO: 2223423 - RNA, 13 nt, Homo sapiens
ugggaaaacuggg

SEQ ID NO: 2223424 - RNA, 23 nt, Homo sapiens
uuauaggaaaaguuauugugaua

SEQ ID NO: 2223425 - RNA, 14 nt, Homo sapiens
uaaauuaugacugc

SEQ ID NO: 2223426 - RNA, 12 nt, Homo sapiens
cuguucugggac

SEQ ID NO: 2223427 - RNA, 16 nt, Homo sapiens
ccugcccucaucauca

SEQ ID NO: 2223428 - RNA, 18 nt, Homo sapiens
agacaguaacacuggcga

SEQ ID NO: 2223429 - RNA, 18 nt, Homo sapiens
uuagcugucucagagaua

SEQ ID NO: 2223430 - RNA, 13 nt, Homo sapiens
ucaugaagauauu

SEQ ID NO: 2223431 - RNA, 17 nt, Homo sapiens
cugcuggggaccuuggc

SEQ ID NO: 2223432 - RNA, 12 nt, Homo sapiens
aggcacugcuga

SEQ ID NO: 2223433 - RNA, 16 nt, Homo sapiens
cugaagcccauuucuc

SEQ ID NO: 2223434 - RNA, 18 nt, Homo sapiens
cucagcaaggugugaaug

SEQ ID NO: 2223435 - RNA, 23 nt, Homo sapiens
uguaucaauggagcaugugugca

SEQ ID NO: 2223436 - RNA, 14 nt, Homo sapiens
uuuuucaagagcuc

SEQ ID NO: 2223437 - RNA, 18 nt, Homo sapiens
ugauuuuuuuacuaauga

SEQ ID NO: 2223438 - RNA, 16 nt, Homo sapiens
uuagaauaaauuucag

SEQ ID NO: 2223439 - RNA, 23 nt, Homo sapiens
aucaugaugcuagccagcaaaga

SEQ ID NO: 2223440 - RNA, 20 nt, Homo sapiens
cuuuugacacugcucuaaca

SEQ ID NO: 2223441 - RNA, 18 nt, Homo sapiens
aucuucacugaauaucau

SEQ ID NO: 2223442 - RNA, 15 nt, Homo sapiens
uuuauguucugcuca

SEQ ID NO: 2223443 - RNA, 13 nt, Homo sapiens
cuacaaagauauu

SEQ ID NO: 2223444 - RNA, 18 nt, Homo sapiens
ccugggagucucuugacu

SEQ ID NO: 2223445 - RNA, 20 nt, Homo sapiens
uuuccauugaccagcucucu

SEQ ID NO: 2223446 - RNA, 17 nt, Homo sapiens
gaacaguauuacagugu

SEQ ID NO: 2223447 - RNA, 17 nt, Homo sapiens
aagagcaggugagcaaa

SEQ ID NO: 2223448 - RNA, 23 nt, Homo sapiens
aacaaaucguccaaagaucucaa

SEQ ID NO: 2223449 - RNA, 23 nt, Homo sapiens
agacccaggagccggacacuucu

SEQ ID NO: 2223450 - RNA, 23 nt, Homo sapiens
acuaugaaaucgcugcucaaaaa

SEQ ID NO: 2223451 - RNA, 19 nt, Homo sapiens
ugaaaauauucuacuggcc

SEQ ID NO: 2223452 - RNA, 19 nt, Homo sapiens
agguuauagaguagaagau

SEQ ID NO: 2223453 - RNA, 14 nt, Homo sapiens
cacccagaccccag

SEQ ID NO: 2223454 - RNA, 22 nt, Homo sapiens
aaagcagccacgaggugcaaca

SEQ ID NO: 2223455 - RNA, 20 nt, Homo sapiens
gccugugguuaacaucucag

SEQ ID NO: 2223456 - RNA, 22 nt, Homo sapiens
aguauguacaggcugagacaca

SEQ ID NO: 2223457 - RNA, 20 nt, Homo sapiens
cucugcugaucucaguuucc

SEQ ID NO: 2223458 - RNA, 13 nt, Homo sapiens
caggugcuucagg

SEQ ID NO: 2223459 - RNA, 18 nt, Homo sapiens
cuccauugguguugacau

SEQ ID NO: 2223460 - RNA, 18 nt, Homo sapiens
caggggauccagcucaag

SEQ ID NO: 2223461 - RNA, 12 nt, Homo sapiens
ugggcaguuaca

SEQ ID NO: 2223462 - RNA, 13 nt, Homo sapiens
gcacauugugcag

SEQ ID NO: 2223463 - RNA, 14 nt, Homo sapiens
guuauaauuugcac

SEQ ID NO: 2223464 - RNA, 17 nt, Homo sapiens
accgagucuugcucugu

SEQ ID NO: 2223465 - RNA, 12 nt, Homo sapiens
aauaagcuuuau

SEQ ID NO: 2223466 - RNA, 12 nt, Homo sapiens
ucuuacacaaga

SEQ ID NO: 2223467 - RNA, 24 nt, Homo sapiens
cuccgcucuguagugcuacagggu

SEQ ID NO: 2223468 - RNA, 23 nt, Homo sapiens
gaccagccugggcaacauaguga

SEQ ID NO: 2223469 - RNA, 21 nt, Homo sapiens
acaucuccuccauacucagga

SEQ ID NO: 2223470 - RNA, 16 nt, Homo sapiens
ucaaaagauccuucau

SEQ ID NO: 2223471 - RNA, 15 nt, Homo sapiens
gggagaaagaccaug

SEQ ID NO: 2223472 - RNA, 22 nt, Homo sapiens
uaauagcuauggaaucaauuca

SEQ ID NO: 2223473 - RNA, 21 nt, Homo sapiens
gaaacuaacuggugugaguca

SEQ ID NO: 2223474 - RNA, 16 nt, Homo sapiens
caauggggguguagua

SEQ ID NO: 2223475 - RNA, 15 nt, Homo sapiens
ccaacccugccguca

SEQ ID NO: 2223476 - RNA, 16 nt, Homo sapiens
uucucaccugugagac

SEQ ID NO: 2223477 - RNA, 19 nt, Homo sapiens
auuuuuaccuaaagacguc

SEQ ID NO: 2223478 - RNA, 18 nt, Homo sapiens
guccugugucaucuguca

SEQ ID NO: 2223479 - RNA, 13 nt, Homo sapiens
uguaagaacugua

SEQ ID NO: 2223480 - RNA, 19 nt, Homo sapiens
caucuuucaacaaugacua

SEQ ID NO: 2223481 - RNA, 21 nt, Homo sapiens
ccaacucuacacagcucagca

SEQ ID NO: 2223482 - RNA, 13 nt, Homo sapiens
uuuugcuguagaa

SEQ ID NO: 2223483 - RNA, 22 nt, Homo sapiens
accugacccuucucucacuucu

SEQ ID NO: 2223484 - RNA, 23 nt, Homo sapiens
caauucugugacauacauauuau

SEQ ID NO: 2223485 - RNA, 16 nt, Homo sapiens
ugccuggugugccuca

SEQ ID NO: 2223486 - RNA, 24 nt, Homo sapiens
uucacacauagucuugaugacauu

SEQ ID NO: 2223487 - RNA, 12 nt, Homo sapiens
guuacacagggu

SEQ ID NO: 2223488 - RNA, 11 nt, Homo sapiens
gaugugccagu

SEQ ID NO: 2223489 - RNA, 22 nt, Homo sapiens
caaugauuuuuaagcuaugaaa

SEQ ID NO: 2223490 - RNA, 20 nt, Homo sapiens
ugaugaaauaacacagcagu

SEQ ID NO: 2223491 - RNA, 19 nt, Homo sapiens
agcuggaaauaaaccugga

SEQ ID NO: 2223492 - RNA, 20 nt, Homo sapiens
gacucuggguccuuccugaa

SEQ ID NO: 2223493 - RNA, 17 nt, Homo sapiens
gcuccuacauccagcuc

SEQ ID NO: 2223494 - RNA, 14 nt, Homo sapiens
cuucucaucuugcc

SEQ ID NO: 2223495 - RNA, 18 nt, Homo sapiens
ugucuuuguugaaguauu

SEQ ID NO: 2223496 - RNA, 15 nt, Homo sapiens
uaaauuucugccaag

SEQ ID NO: 2223497 - RNA, 21 nt, Homo sapiens
caugccuuaaucccagcacuu

SEQ ID NO: 2223498 - RNA, 14 nt, Homo sapiens
gaaaauuaauucua

SEQ ID NO: 2223499 - RNA, 19 nt, Homo sapiens
agauggauagucuguccaa

SEQ ID NO: 2223500 - RNA, 12 nt, Homo sapiens
ugacggugucca

SEQ ID NO: 2223501 - RNA, 19 nt, Homo sapiens
uuugugagagcccagucau

SEQ ID NO: 2223502 - RNA, 21 nt, Homo sapiens
ccuggaggagcuagaguaucc

SEQ ID NO: 2223503 - RNA, 21 nt, Homo sapiens
ccuuaaguucagcaacuguuu

SEQ ID NO: 2223504 - RNA, 22 nt, Homo sapiens
ugauggaccuccuucgcuggaa

SEQ ID NO: 2223505 - RNA, 16 nt, Homo sapiens
acacucuccaaacagu

SEQ ID NO: 2223506 - RNA, 20 nt, Homo sapiens
agauuguuaggagugguucu

SEQ ID NO: 2223507 - RNA, 23 nt, Homo sapiens
aggcugaaaagaagccucagcuc

SEQ ID NO: 2223508 - RNA, 15 nt, Homo sapiens
aaaaguuuuguaaau

SEQ ID NO: 2223509 - RNA, 22 nt, Homo sapiens
agaguaugagucuucuguaauu

SEQ ID NO: 2223510 - RNA, 14 nt, Homo sapiens
uacuugagcaaaga

SEQ ID NO: 2223511 - RNA, 21 nt, Homo sapiens
uuugagcuccaucaaggguau

SEQ ID NO: 2223512 - RNA, 23 nt, Homo sapiens
uucugauguguucucugaucugc

SEQ ID NO: 2223513 - RNA, 19 nt, Homo sapiens
uaacauuucuuugugaaag

SEQ ID NO: 2223514 - RNA, 15 nt, Homo sapiens
uuaaaggaaaagcac

SEQ ID NO: 2223515 - RNA, 20 nt, Homo sapiens
uuguacuccagccugggcaa

SEQ ID NO: 2223516 - RNA, 15 nt, Homo sapiens
aacccaaacuuccaa

SEQ ID NO: 2223517 - RNA, 20 nt, Homo sapiens
agccugcucccucacccagg

SEQ ID NO: 2223518 - RNA, 17 nt, Homo sapiens
aacaguuggcacuguaa

SEQ ID NO: 2223519 - RNA, 17 nt, Homo sapiens
augggugucuguugcaa

SEQ ID NO: 2223520 - RNA, 16 nt, Homo sapiens
cagagcaaguccucac

SEQ ID NO: 2223521 - RNA, 16 nt, Homo sapiens
aucaugccauguugga

SEQ ID NO: 2223522 - RNA, 11 nt, Homo sapiens
ugaggcucacg

SEQ ID NO: 2223523 - RNA, 18 nt, Homo sapiens
uaauuuuuguacauccca

SEQ ID NO: 2223524 - RNA, 19 nt, Homo sapiens
aguuguuagggcugaggaa

SEQ ID NO: 2223525 - RNA, 22 nt, Homo sapiens
ggcagagacaauaaaacauucc

SEQ ID NO: 2223526 - RNA, 14 nt, Homo sapiens
gaucagaugucuau

SEQ ID NO: 2223527 - RNA, 17 nt, Homo sapiens
ggacaacaagauacaaa

SEQ ID NO: 2223528 - RNA, 18 nt, Homo sapiens
gcucucugugucugagag

SEQ ID NO: 2223529 - RNA, 14 nt, Homo sapiens
auuuuuauaaccug

SEQ ID NO: 2223530 - RNA, 17 nt, Homo sapiens
auugaggagcucaagaa

SEQ ID NO: 2223531 - RNA, 13 nt, Homo sapiens
auuaauagcuuuu

SEQ ID NO: 2223532 - RNA, 15 nt, Homo sapiens
uaccuaucaucuuaa

SEQ ID NO: 2223533 - RNA, 13 nt, Homo sapiens
acugcaagcucca

SEQ ID NO: 2223534 - RNA, 14 nt, Homo sapiens
uccaucaguauuaa

SEQ ID NO: 2223535 - RNA, 12 nt, Homo sapiens
aaaccauucacc

SEQ ID NO: 2223536 - RNA, 23 nt, Homo sapiens
cagggccccuggggaucuugccc

SEQ ID NO: 2223537 - RNA, 18 nt, Homo sapiens
gccucgaccucccuggcu

SEQ ID NO: 2223538 - RNA, 15 nt, Homo sapiens
ucuacuaauuccaca

SEQ ID NO: 2223539 - RNA, 17 nt, Homo sapiens
cggguucucccaugauu

SEQ ID NO: 2223540 - RNA, 23 nt, Homo sapiens
gaggcagcgugaaagcagaugag

SEQ ID NO: 2223541 - RNA, 18 nt, Homo sapiens
auugcaugugacucugaa

SEQ ID NO: 2223542 - RNA, 23 nt, Homo sapiens
gggauacuuagugguaugucucu

SEQ ID NO: 2223543 - RNA, 17 nt, Homo sapiens
gagggugcccagcuuau

SEQ ID NO: 2223544 - RNA, 18 nt, Homo sapiens
uugcuaagcguggcauuc

SEQ ID NO: 2223545 - RNA, 18 nt, Homo sapiens
uagagccagggucucacu

SEQ ID NO: 2223546 - RNA, 22 nt, Homo sapiens
ucuuucccaccaaacaucuuuc

SEQ ID NO: 2223547 - RNA, 21 nt, Homo sapiens
uccugaguagcugggaugaca

SEQ ID NO: 2223548 - RNA, 20 nt, Homo sapiens
agaaaugacugccggucauu

SEQ ID NO: 2223549 - RNA, 12 nt, Homo sapiens
uuuuuaucucca

SEQ ID NO: 2223550 - RNA, 22 nt, Homo sapiens
ugccuuuguauguggaaguaua

SEQ ID NO: 2223551 - RNA, 20 nt, Homo sapiens
ucagugaugaaaauuugccu

SEQ ID NO: 2223552 - RNA, 14 nt, Homo sapiens
auauauaagccaaa

SEQ ID NO: 2223553 - RNA, 14 nt, Homo sapiens
acucacugccuagg

SEQ ID NO: 2223554 - RNA, 19 nt, Homo sapiens
auguccccugcuugaacac

SEQ ID NO: 2223555 - RNA, 23 nt, Homo sapiens
uuaagagauacuugaugccaaaa

SEQ ID NO: 2223556 - RNA, 19 nt, Homo sapiens
aaacuugguuucugugaga

SEQ ID NO: 2223557 - RNA, 17 nt, Homo sapiens
acaguaaauacacugug

SEQ ID NO: 2223558 - RNA, 13 nt, Homo sapiens
guucucuuccacu

SEQ ID NO: 2223559 - RNA, 18 nt, Homo sapiens
caaguacagagauucuau

SEQ ID NO: 2223560 - RNA, 15 nt, Homo sapiens
agauguucucuccca

SEQ ID NO: 2223561 - RNA, 11 nt, Homo sapiens
gccuguuaaau

SEQ ID NO: 2223562 - RNA, 18 nt, Homo sapiens
gaagagaugacaaaccau

SEQ ID NO: 2223563 - RNA, 19 nt, Homo sapiens
aaaugacaagugagacaaa

SEQ ID NO: 2223564 - RNA, 21 nt, Homo sapiens
uauacaaauuagaaaauguua

SEQ ID NO: 2223565 - RNA, 21 nt, Homo sapiens
cuaagccacucuuccaaaggc

SEQ ID NO: 2223566 - RNA, 14 nt, Homo sapiens
aaggaaaagcacaa

SEQ ID NO: 2223567 - RNA, 19 nt, Homo sapiens
cccaguuucuucuuacacu

SEQ ID NO: 2223568 - RNA, 14 nt, Homo sapiens
auuguacucaaugg

SEQ ID NO: 2223569 - RNA, 20 nt, Homo sapiens
auacacaguacuuccuccca

SEQ ID NO: 2223570 - RNA, 14 nt, Homo sapiens
uuguuuuaagccaa

SEQ ID NO: 2223571 - RNA, 18 nt, Homo sapiens
caacagcugaugcccuau

SEQ ID NO: 2223572 - RNA, 12 nt, Homo sapiens
guuguguaguca

SEQ ID NO: 2223573 - RNA, 13 nt, Homo sapiens
uuaaaauaaugaa

SEQ ID NO: 2223574 - RNA, 19 nt, Homo sapiens
auauacacacacaaagaga

SEQ ID NO: 2223575 - RNA, 20 nt, Homo sapiens
ugcacugcaaugccaggugg

SEQ ID NO: 2223576 - RNA, 16 nt, Homo sapiens
uugccuuugcucuuau

SEQ ID NO: 2223577 - RNA, 19 nt, Homo sapiens
gccuugaugccauaugccu

SEQ ID NO: 2223578 - RNA, 21 nt, Homo sapiens
caugccacaggggauucuccu

SEQ ID NO: 2223579 - RNA, 18 nt, Homo sapiens
uccagggcauugcucagc

SEQ ID NO: 2223580 - RNA, 22 nt, Homo sapiens
accuuauuaaagguaugcauuu

SEQ ID NO: 2223581 - RNA, 15 nt, Homo sapiens
gaauuugggccucuu

SEQ ID NO: 2223582 - RNA, 19 nt, Homo sapiens
auauugauaaaaccauaca

SEQ ID NO: 2223583 - RNA, 22 nt, Homo sapiens
cacauaguuaaaaaagaaacaa

SEQ ID NO: 2223584 - RNA, 16 nt, Homo sapiens
gaacucuuaggcacau

SEQ ID NO: 2223585 - RNA, 17 nt, Homo sapiens
ugugugaaggucuugcc

SEQ ID NO: 2223586 - RNA, 14 nt, Homo sapiens
cagcaucuuuucca

SEQ ID NO: 2223587 - RNA, 16 nt, Homo sapiens
acacgauuagcuuuau

SEQ ID NO: 2223588 - RNA, 17 nt, Homo sapiens
ugaugaaaacuuucuaa

SEQ ID NO: 2223589 - RNA, 20 nt, Homo sapiens
uguaacuuuuugcacuauug

SEQ ID NO: 2223590 - RNA, 19 nt, Homo sapiens
uucaacucugugucccagc

SEQ ID NO: 2223591 - RNA, 13 nt, Homo sapiens
uugcaagugcugg

SEQ ID NO: 2223592 - RNA, 13 nt, Homo sapiens
agggucugcacuc

SEQ ID NO: 2223593 - RNA, 16 nt, Homo sapiens
uauacauguguguaua

SEQ ID NO: 2223594 - RNA, 18 nt, Homo sapiens
uaaaacccaaacuuccaa

SEQ ID NO: 2223595 - RNA, 22 nt, Homo sapiens
guaacugccuagaaacaacacu

SEQ ID NO: 2223596 - RNA, 17 nt, Homo sapiens
auucauuuugcaacuug

SEQ ID NO: 2223597 - RNA, 23 nt, Homo sapiens
uccaucuuguuucauuugcuugc

SEQ ID NO: 2223598 - RNA, 21 nt, Homo sapiens
ugcucccaggagggcuuugug

SEQ ID NO: 2223599 - RNA, 15 nt, Homo sapiens
auuuaucaacuguca

SEQ ID NO: 2223600 - RNA, 22 nt, Homo sapiens
ugucauuccccuuugcacugua

SEQ ID NO: 2223601 - RNA, 20 nt, Homo sapiens
uggcuacaaagaccuaccua

SEQ ID NO: 2223602 - RNA, 15 nt, Homo sapiens
caugugagauaguuu

SEQ ID NO: 2223603 - RNA, 18 nt, Homo sapiens
uguuuccccccuuuucag

SEQ ID NO: 2223604 - RNA, 15 nt, Homo sapiens
acuucagcugccuga

SEQ ID NO: 2223605 - RNA, 22 nt, Homo sapiens
gggcagcgcccuuccucuccac

SEQ ID NO: 2223606 - RNA, 19 nt, Homo sapiens
ugcagacaaaaagaacaaa

SEQ ID NO: 2223607 - RNA, 23 nt, Homo sapiens
accugcgcuguggacacugagaa

SEQ ID NO: 2223608 - RNA, 18 nt, Homo sapiens
ugcaagugucugugugca

SEQ ID NO: 2223609 - RNA, 19 nt, Homo sapiens
cugccagccccuuugccau

SEQ ID NO: 2223610 - RNA, 18 nt, Homo sapiens
auagucuuuugccagaga

SEQ ID NO: 2223611 - RNA, 21 nt, Homo sapiens
uggcagguggccagggcucca

SEQ ID NO: 2223612 - RNA, 14 nt, Homo sapiens
uuuuauuugcuuau

SEQ ID NO: 2223613 - RNA, 14 nt, Homo sapiens
uggaccccacuggc

SEQ ID NO: 2223614 - RNA, 20 nt, Homo sapiens
caaaaucagugaugggagua

SEQ ID NO: 2223615 - RNA, 22 nt, Homo sapiens
uuaauauuuaaacagcaguguu

SEQ ID NO: 2223616 - RNA, 16 nt, Homo sapiens
cauagacauggaugcg

SEQ ID NO: 2223617 - RNA, 17 nt, Homo sapiens
cccugcugucccggcuc

SEQ ID NO: 2223618 - RNA, 18 nt, Homo sapiens
auugauaaaagcauuguu

SEQ ID NO: 2223619 - RNA, 17 nt, Homo sapiens
acuucggcucucuggac

SEQ ID NO: 2223620 - RNA, 18 nt, Homo sapiens
gauggugcuaaaccauuc

SEQ ID NO: 2223621 - RNA, 21 nt, Homo sapiens
cuccuuccagccugagaugua

SEQ ID NO: 2223622 - RNA, 17 nt, Homo sapiens
uacuaucucuugucaua

SEQ ID NO: 2223623 - RNA, 22 nt, Homo sapiens
agccugaguagaaaggccuuua

SEQ ID NO: 2223624 - RNA, 19 nt, Homo sapiens
caauuuguuaguuccugua

SEQ ID NO: 2223625 - RNA, 22 nt, Homo sapiens
agcuuaaaauaaacaguuguga

SEQ ID NO: 2223626 - RNA, 13 nt, Homo sapiens
gcauggugcaguu

SEQ ID NO: 2223627 - RNA, 17 nt, Homo sapiens
agacuuccuguaggggg

SEQ ID NO: 2223628 - RNA, 20 nt, Homo sapiens
cccagaccaacccugggacc

SEQ ID NO: 2223629 - RNA, 15 nt, Homo sapiens
guaaaagcagcauaa

SEQ ID NO: 2223630 - RNA, 21 nt, Homo sapiens
cucugaaauuggguuccauau

SEQ ID NO: 2223631 - RNA, 18 nt, Homo sapiens
ugacugaaggcugucagg

SEQ ID NO: 2223632 - RNA, 22 nt, Homo sapiens
auaaccguuuccuuucauuuac

SEQ ID NO: 2223633 - RNA, 19 nt, Homo sapiens
cuaaaaugaguuaccuaca

SEQ ID NO: 2223634 - RNA, 18 nt, Homo sapiens
ccuccaauccccacuccu

SEQ ID NO: 2223635 - RNA, 15 nt, Homo sapiens
ccccauucugacauc

SEQ ID NO: 2223636 - RNA, 16 nt, Homo sapiens
auggaacucauuccug

SEQ ID NO: 2223637 - RNA, 13 nt, Homo sapiens
gcuaccaucucau

SEQ ID NO: 2223638 - RNA, 18 nt, Homo sapiens
auaguuuuaucuggaaaa

SEQ ID NO: 2223639 - RNA, 22 nt, Homo sapiens
aucgucuaaacuuuagaauuaa

SEQ ID NO: 2223640 - RNA, 20 nt, Homo sapiens
uguuuauauggauaaucuga

SEQ ID NO: 2223641 - RNA, 19 nt, Homo sapiens
uucaaggaugcacagcuca

SEQ ID NO: 2223642 - RNA, 21 nt, Homo sapiens
aucuauuuagagaaacauuuu

SEQ ID NO: 2223643 - RNA, 20 nt, Homo sapiens
uugcaacaagacaaagcaaa

SEQ ID NO: 2223644 - RNA, 13 nt, Homo sapiens
uguaauaagcaau

SEQ ID NO: 2223645 - RNA, 21 nt, Homo sapiens
ccuccugguugauacuuguuc

SEQ ID NO: 2223646 - RNA, 17 nt, Homo sapiens
cagggucucacuauguu

SEQ ID NO: 2223647 - RNA, 13 nt, Homo sapiens
caguccucccacc

SEQ ID NO: 2223648 - RNA, 15 nt, Homo sapiens
acauugacacaauaa

SEQ ID NO: 2223649 - RNA, 15 nt, Homo sapiens
acuuuaccacuaugc

SEQ ID NO: 2223650 - RNA, 22 nt, Homo sapiens
agcucagcugggguugugcaag

SEQ ID NO: 2223651 - RNA, 18 nt, Homo sapiens
agguauaccucaguucca

SEQ ID NO: 2223652 - RNA, 19 nt, Homo sapiens
gcccuugaguccccauuga

SEQ ID NO: 2223653 - RNA, 16 nt, Homo sapiens
uccugggagugagcug

SEQ ID NO: 2223654 - RNA, 16 nt, Homo sapiens
uuauuuuuaugaugcu

SEQ ID NO: 2223655 - RNA, 17 nt, Homo sapiens
cagaaaucccaguucau

SEQ ID NO: 2223656 - RNA, 14 nt, Homo sapiens
guuaccucugcaug

SEQ ID NO: 2223657 - RNA, 15 nt, Homo sapiens
augccuuuccagugc

SEQ ID NO: 2223658 - RNA, 16 nt, Homo sapiens
accaaaaccacagugc

SEQ ID NO: 2223659 - RNA, 22 nt, Homo sapiens
aggaaugugaccuuuaauucag

SEQ ID NO: 2223660 - RNA, 23 nt, Homo sapiens
ucuauuucuuuaaaugcuuuuau

SEQ ID NO: 2223661 - RNA, 16 nt, Homo sapiens
gcagggacugccaguc

SEQ ID NO: 2223662 - RNA, 14 nt, Homo sapiens
gcuguuucuggaaa

SEQ ID NO: 2223663 - RNA, 18 nt, Homo sapiens
agguccugagagcugcuu

SEQ ID NO: 2223664 - RNA, 20 nt, Homo sapiens
gacucaaggucacacaguga

SEQ ID NO: 2223665 - RNA, 15 nt, Homo sapiens
cuucucuuugacaaa

SEQ ID NO: 2223666 - RNA, 21 nt, Homo sapiens
acaaaucagaaauaugacaau

SEQ ID NO: 2223667 - RNA, 17 nt, Homo sapiens
cagguguucugggcucc

SEQ ID NO: 2223668 - RNA, 17 nt, Homo sapiens
cuuuguaugacagugaa

SEQ ID NO: 2223669 - RNA, 23 nt, Homo sapiens
uucaagcagucgugccugugucc

SEQ ID NO: 2223670 - RNA, 17 nt, Homo sapiens
ggaccagaaguguuuca

SEQ ID NO: 2223671 - RNA, 15 nt, Homo sapiens
aaugagccuguccaa

SEQ ID NO: 2223672 - RNA, 15 nt, Homo sapiens
ggaagggaccccaga

SEQ ID NO: 2223673 - RNA, 15 nt, Homo sapiens
ccaagugaggccaua

SEQ ID NO: 2223674 - RNA, 21 nt, Homo sapiens
accacagaaaucacagucaau

SEQ ID NO: 2223675 - RNA, 20 nt, Homo sapiens
uuaacagcugucaauagaua

SEQ ID NO: 2223676 - RNA, 14 nt, Homo sapiens
cuuuuauagaggcu

SEQ ID NO: 2223677 - RNA, 16 nt, Homo sapiens
auugcgugauucaaug

SEQ ID NO: 2223678 - RNA, 13 nt, Homo sapiens
auuauuacuguuc

SEQ ID NO: 2223679 - RNA, 14 nt, Homo sapiens
auaauuuucuaauu

SEQ ID NO: 2223680 - RNA, 15 nt, Homo sapiens
ccuguaauuccagca

SEQ ID NO: 2223681 - RNA, 14 nt, Homo sapiens
uaccgagagccaaa

SEQ ID NO: 2223682 - RNA, 15 nt, Homo sapiens
gauauauaccacuuu

SEQ ID NO: 2223683 - RNA, 22 nt, Homo sapiens
uucaccauccagagaccaaaua

SEQ ID NO: 2223684 - RNA, 12 nt, Homo sapiens
caucuguacuca

SEQ ID NO: 2223685 - RNA, 18 nt, Homo sapiens
gcuucauaaucauggcuc

SEQ ID NO: 2223686 - RNA, 22 nt, Homo sapiens
cacucugcucgccuuagcacua

SEQ ID NO: 2223687 - RNA, 15 nt, Homo sapiens
uguuugaccuucaca

SEQ ID NO: 2223688 - RNA, 17 nt, Homo sapiens
ccgaaagggacacaaug

SEQ ID NO: 2223689 - RNA, 22 nt, Homo sapiens
gauaucugaacacauacuagaa

SEQ ID NO: 2223690 - RNA, 19 nt, Homo sapiens
uccuaccuuugcugaugcc

SEQ ID NO: 2223691 - RNA, 17 nt, Homo sapiens
gauaaagguucaugcaa

SEQ ID NO: 2223692 - RNA, 12 nt, Homo sapiens
uacuguacagac

SEQ ID NO: 2223693 - RNA, 21 nt, Homo sapiens
acugaaaaaaacauauccaaa

SEQ ID NO: 2223694 - RNA, 13 nt, Homo sapiens
gcuggugucgcau

SEQ ID NO: 2223695 - RNA, 18 nt, Homo sapiens
gaaaccgccuaguuuacu

SEQ ID NO: 2223696 - RNA, 16 nt, Homo sapiens
agcacccugcaaaaug

SEQ ID NO: 2223697 - RNA, 18 nt, Homo sapiens
gaucuugaacuccugacc

SEQ ID NO: 2223698 - RNA, 16 nt, Homo sapiens
caccaaugcaacauuu

SEQ ID NO: 2223699 - RNA, 13 nt, Homo sapiens
gccugcacugaga

SEQ ID NO: 2223700 - RNA, 15 nt, Homo sapiens
acagaguucugggau

SEQ ID NO: 2223701 - RNA, 15 nt, Homo sapiens
agaguaaucugggac

SEQ ID NO: 2223702 - RNA, 15 nt, Homo sapiens
aaaaacaggucuuca

SEQ ID NO: 2223703 - RNA, 14 nt, Homo sapiens
acagaaaaaacuga

SEQ ID NO: 2223704 - RNA, 15 nt, Homo sapiens
cuuggaccguaucac

SEQ ID NO: 2223705 - RNA, 15 nt, Homo sapiens
gcaucaucccuggau

SEQ ID NO: 2223706 - RNA, 17 nt, Homo sapiens
caaaauuuguacuauua

SEQ ID NO: 2223707 - RNA, 18 nt, Homo sapiens
ucuccuccacucugagcc

SEQ ID NO: 2223708 - RNA, 19 nt, Homo sapiens
acugucuccuuucucuuau

SEQ ID NO: 2223709 - RNA, 14 nt, Homo sapiens
ugcaauugaccucu

SEQ ID NO: 2223710 - RNA, 18 nt, Homo sapiens
uauuuuagaaacuccaau

SEQ ID NO: 2223711 - RNA, 21 nt, Homo sapiens
cuuacugguccuuaccagaga

SEQ ID NO: 2223712 - RNA, 17 nt, Homo sapiens
ucugccucucaacauca

SEQ ID NO: 2223713 - RNA, 18 nt, Homo sapiens
ccugguguagcacuuaac

SEQ ID NO: 2223714 - RNA, 11 nt, Homo sapiens
ugcccagacaa

SEQ ID NO: 2223715 - RNA, 20 nt, Homo sapiens
ugggauccuauugaaccaug

SEQ ID NO: 2223716 - RNA, 17 nt, Homo sapiens
aaaacuggcaucugaca

SEQ ID NO: 2223717 - RNA, 17 nt, Homo sapiens
uauuuuaaaucuuaaca

SEQ ID NO: 2223718 - RNA, 17 nt, Homo sapiens
aacuuuuauuuuuauca

SEQ ID NO: 2223719 - RNA, 13 nt, Homo sapiens
uuugaggggguca

SEQ ID NO: 2223720 - RNA, 22 nt, Homo sapiens
cugugcaggccugucccuggga

SEQ ID NO: 2223721 - RNA, 15 nt, Homo sapiens
auaugguagagcaau

SEQ ID NO: 2223722 - RNA, 21 nt, Homo sapiens
ucauuaaugaaaagcagauug

SEQ ID NO: 2223723 - RNA, 20 nt, Homo sapiens
ucucccgaauucgcuguuac

SEQ ID NO: 2223724 - RNA, 18 nt, Homo sapiens
aaauggaaagucaugcaa

SEQ ID NO: 2223725 - RNA, 16 nt, Homo sapiens
gaucagcucagacaua

SEQ ID NO: 2223726 - RNA, 22 nt, Homo sapiens
ugagaaaaacuguucuuuugca

SEQ ID NO: 2223727 - RNA, 12 nt, Homo sapiens
acuccauucucu

SEQ ID NO: 2223728 - RNA, 20 nt, Homo sapiens
aauaugcaaccugugcaaaa

SEQ ID NO: 2223729 - RNA, 16 nt, Homo sapiens
aacaucuagcuggcuu

SEQ ID NO: 2223730 - RNA, 16 nt, Homo sapiens
aaaaccauaaacauuu

SEQ ID NO: 2223731 - RNA, 20 nt, Homo sapiens
uugcaacaauaaaguacuuu

SEQ ID NO: 2223732 - RNA, 19 nt, Homo sapiens
ucuuucuuuuuuggccauc

SEQ ID NO: 2223733 - RNA, 18 nt, Homo sapiens
cauuuuuaucccauugag

SEQ ID NO: 2223734 - RNA, 18 nt, Homo sapiens
agaucuaaggaugucaca

SEQ ID NO: 2223735 - RNA, 16 nt, Homo sapiens
aauuugauaucacagu

SEQ ID NO: 2223736 - RNA, 14 nt, Homo sapiens
caucuggagucuuc

SEQ ID NO: 2223737 - RNA, 20 nt, Homo sapiens
cuggcuguuccccugcucug

SEQ ID NO: 2223738 - RNA, 15 nt, Homo sapiens
aggcaaagaacaauu

SEQ ID NO: 2223739 - RNA, 12 nt, Homo sapiens
uguaccacacua

SEQ ID NO: 2223740 - RNA, 17 nt, Homo sapiens
agguauacuuuaguaga

SEQ ID NO: 2223741 - RNA, 17 nt, Homo sapiens
aguugcugaugaacucu

SEQ ID NO: 2223742 - RNA, 22 nt, Homo sapiens
ugcacagugaagugcuggcaac

SEQ ID NO: 2223743 - RNA, 14 nt, Homo sapiens
uggagaacuucaua

SEQ ID NO: 2223744 - RNA, 17 nt, Homo sapiens
cucggggauagaccaaa

SEQ ID NO: 2223745 - RNA, 16 nt, Homo sapiens
aguuuuaaacccaaaa

SEQ ID NO: 2223746 - RNA, 16 nt, Homo sapiens
gcacuguuucucucac

SEQ ID NO: 2223747 - RNA, 22 nt, Homo sapiens
cuuccauagcuucauccacuga

SEQ ID NO: 2223748 - RNA, 14 nt, Homo sapiens
uaucuacauucuau

SEQ ID NO: 2223749 - RNA, 11 nt, Homo sapiens
aaaggugacca

SEQ ID NO: 2223750 - RNA, 20 nt, Homo sapiens
gaacccgggaggcagagguu

SEQ ID NO: 2223751 - RNA, 22 nt, Homo sapiens
cacugccuggcccaaaacgucu

SEQ ID NO: 2223752 - RNA, 20 nt, Homo sapiens
ucugaaugcugccacaacca

SEQ ID NO: 2223753 - RNA, 18 nt, Homo sapiens
uaaauaagaucagacucu

SEQ ID NO: 2223754 - RNA, 19 nt, Homo sapiens
aaugcuguuuucaacauug

SEQ ID NO: 2223755 - RNA, 18 nt, Homo sapiens
aaugucccaacccagaca

SEQ ID NO: 2223756 - RNA, 18 nt, Homo sapiens
gccaaaaaaugcuugcuu

SEQ ID NO: 2223757 - RNA, 15 nt, Homo sapiens
gaaauugaaccuggu

SEQ ID NO: 2223758 - RNA, 20 nt, Homo sapiens
ugacgucagcgcaccaaaac

SEQ ID NO: 2223759 - RNA, 14 nt, Homo sapiens
cacacagacagggu

SEQ ID NO: 2223760 - RNA, 16 nt, Homo sapiens
gacccugccucuccca

SEQ ID NO: 2223761 - RNA, 15 nt, Homo sapiens
agauucaugcaagug

SEQ ID NO: 2223762 - RNA, 20 nt, Homo sapiens
ugaugugguuuuuugccagg

SEQ ID NO: 2223763 - RNA, 21 nt, Homo sapiens
cuauagucccacuacuugugg

SEQ ID NO: 2223764 - RNA, 14 nt, Homo sapiens
cuuaacuauuucac

SEQ ID NO: 2223765 - RNA, 22 nt, Homo sapiens
cccuccaaaaccuccauucccc

SEQ ID NO: 2223766 - RNA, 19 nt, Homo sapiens
gacacguggugcauuuugc

SEQ ID NO: 2223767 - RNA, 14 nt, Homo sapiens
uuguggaagcacuu

SEQ ID NO: 2223768 - RNA, 22 nt, Homo sapiens
cagucaaacccauggagacaga

SEQ ID NO: 2223769 - RNA, 14 nt, Homo sapiens
acucugccauuaaa

SEQ ID NO: 2223770 - RNA, 17 nt, Homo sapiens
cacuuagugaucauuua

SEQ ID NO: 2223771 - RNA, 17 nt, Homo sapiens
cggagucuugcucuguu

SEQ ID NO: 2223772 - RNA, 17 nt, Homo sapiens
uggagucucgcucuguu

SEQ ID NO: 2223773 - RNA, 21 nt, Homo sapiens
cugcaauguaaauaguauaaa

SEQ ID NO: 2223774 - RNA, 13 nt, Homo sapiens
cagauauguauuu

SEQ ID NO: 2223775 - RNA, 13 nt, Homo sapiens
ccucggcacacac

SEQ ID NO: 2223776 - RNA, 13 nt, Homo sapiens
gccaggcagaucc

SEQ ID NO: 2223777 - RNA, 17 nt, Homo sapiens
uacagaaucuaacuggu

SEQ ID NO: 2223778 - RNA, 16 nt, Homo sapiens
cuagauuccauacagu

SEQ ID NO: 2223779 - RNA, 14 nt, Homo sapiens
uguccuaagcacuu

SEQ ID NO: 2223780 - RNA, 21 nt, Homo sapiens
gaauuaugugcacuaccauag

SEQ ID NO: 2223781 - RNA, 20 nt, Homo sapiens
gauaaaaaaauauguagcaa

SEQ ID NO: 2223782 - RNA, 23 nt, Homo sapiens
ucagauacgccaaguacuacaag

SEQ ID NO: 2223783 - RNA, 15 nt, Homo sapiens
ugccauggacauaaa

SEQ ID NO: 2223784 - RNA, 19 nt, Homo sapiens
aaacauggaggaacaguau

SEQ ID NO: 2223785 - RNA, 19 nt, Homo sapiens
cauaugcagauacuuauua

SEQ ID NO: 2223786 - RNA, 16 nt, Homo sapiens
uuauuuuguucauaca

SEQ ID NO: 2223787 - RNA, 13 nt, Homo sapiens
uggaaugcuguau

SEQ ID NO: 2223788 - RNA, 21 nt, Homo sapiens
uuucagcacgccguaaccagg

SEQ ID NO: 2223789 - RNA, 17 nt, Homo sapiens
uuguaaaguagcuguaa

SEQ ID NO: 2223790 - RNA, 21 nt, Homo sapiens
aggcagcuucuacuccugccu

SEQ ID NO: 2223791 - RNA, 13 nt, Homo sapiens
ggcuauaccuggg

SEQ ID NO: 2223792 - RNA, 23 nt, Homo sapiens
gccuagauccacacacagaggaa

SEQ ID NO: 2223793 - RNA, 20 nt, Homo sapiens
cccagcucacaggagcuuaa

SEQ ID NO: 2223794 - RNA, 17 nt, Homo sapiens
agcaacauaucucugcc

SEQ ID NO: 2223795 - RNA, 16 nt, Homo sapiens
cagccuuaugauuaaa

SEQ ID NO: 2223796 - RNA, 20 nt, Homo sapiens
guaauaaaccuccuucggga

SEQ ID NO: 2223797 - RNA, 15 nt, Homo sapiens
cggagggaacccuga

SEQ ID NO: 2223798 - RNA, 15 nt, Homo sapiens
uaaaauuaauuugug

SEQ ID NO: 2223799 - RNA, 16 nt, Homo sapiens
aaagaacgugaucucc

SEQ ID NO: 2223800 - RNA, 12 nt, Homo sapiens
cacuuccauuag

SEQ ID NO: 2223801 - RNA, 17 nt, Homo sapiens
cuucaaccccaugagac

SEQ ID NO: 2223802 - RNA, 12 nt, Homo sapiens
auauaacuggag

SEQ ID NO: 2223803 - RNA, 12 nt, Homo sapiens
cuagcuucuacc

SEQ ID NO: 2223804 - RNA, 14 nt, Homo sapiens
cuuauuaauacaaa

SEQ ID NO: 2223805 - RNA, 14 nt, Homo sapiens
accaugaucucaau

SEQ ID NO: 2223806 - RNA, 19 nt, Homo sapiens
ugcccucuccgagcuggua

SEQ ID NO: 2223807 - RNA, 14 nt, Homo sapiens
ugaucuuggaccau

SEQ ID NO: 2223808 - RNA, 19 nt, Homo sapiens
cuagugaaacugcauuauu

SEQ ID NO: 2223809 - RNA, 17 nt, Homo sapiens
guuaaaauuuaaccuac

SEQ ID NO: 2223810 - RNA, 14 nt, Homo sapiens
gcaaaccaaaccau

SEQ ID NO: 2223811 - RNA, 20 nt, Homo sapiens
aaucuuugguggccaaagau

SEQ ID NO: 2223812 - RNA, 16 nt, Homo sapiens
ggcaggcuacucugcc

SEQ ID NO: 2223813 - RNA, 20 nt, Homo sapiens
caagugccccaccacucccc

SEQ ID NO: 2223814 - RNA, 21 nt, Homo sapiens
cuuaaaacugaaaaauuuuau

SEQ ID NO: 2223815 - RNA, 19 nt, Homo sapiens
aggguuaaagaaaggcaga

SEQ ID NO: 2223816 - RNA, 15 nt, Homo sapiens
cuuugcucuuuggua

SEQ ID NO: 2223817 - RNA, 22 nt, Homo sapiens
cugguaaaauuaagcacacuaa

SEQ ID NO: 2223818 - RNA, 20 nt, Homo sapiens
ggcagaauaaauaagcaaaa

SEQ ID NO: 2223819 - RNA, 13 nt, Homo sapiens
auuuaagccuuau

SEQ ID NO: 2223820 - RNA, 22 nt, Homo sapiens
uuggggaggacaaaacuucuug

SEQ ID NO: 2223821 - RNA, 21 nt, Homo sapiens
aaucagaaaccccacuuccau

SEQ ID NO: 2223822 - RNA, 17 nt, Homo sapiens
auucagaguccuugcaa

SEQ ID NO: 2223823 - RNA, 13 nt, Homo sapiens
agugagucucuuc

SEQ ID NO: 2223824 - RNA, 19 nt, Homo sapiens
agagggaaguuuaaaaccc

SEQ ID NO: 2223825 - RNA, 24 nt, Homo sapiens
ccacagaauacaagccacuaccuu

SEQ ID NO: 2223826 - RNA, 16 nt, Homo sapiens
accuucaugaaaaccu

SEQ ID NO: 2223827 - RNA, 19 nt, Homo sapiens
acagaagagaaggaagcca

SEQ ID NO: 2223828 - RNA, 14 nt, Homo sapiens
guuuuauaauuaau

SEQ ID NO: 2223829 - RNA, 17 nt, Homo sapiens
acccuccuaucaccucc

SEQ ID NO: 2223830 - RNA, 12 nt, Homo sapiens
auauauugaacu

SEQ ID NO: 2223831 - RNA, 15 nt, Homo sapiens
uaggcagggauuuga

SEQ ID NO: 2223832 - RNA, 15 nt, Homo sapiens
ucuugccccaguuug

SEQ ID NO: 2223833 - RNA, 23 nt, Homo sapiens
gagguuaucugucugcauuuuaa

SEQ ID NO: 2223834 - RNA, 18 nt, Homo sapiens
gaauacuuucuuagauuu

SEQ ID NO: 2223835 - RNA, 21 nt, Homo sapiens
gagaacucagcuguccagcug

SEQ ID NO: 2223836 - RNA, 13 nt, Homo sapiens
auccacuugucca

SEQ ID NO: 2223837 - RNA, 19 nt, Homo sapiens
cagaguggauuaaaggcaa

SEQ ID NO: 2223838 - RNA, 11 nt, Homo sapiens
cucccauuuca

SEQ ID NO: 2223839 - RNA, 20 nt, Homo sapiens
ccauagaauggcacauguca

SEQ ID NO: 2223840 - RNA, 20 nt, Homo sapiens
agucuuccaguuuaaugaac

SEQ ID NO: 2223841 - RNA, 16 nt, Homo sapiens
auuaugcagacaaccu

SEQ ID NO: 2223842 - RNA, 16 nt, Homo sapiens
guucuggaaaccacgu

SEQ ID NO: 2223843 - RNA, 17 nt, Homo sapiens
ggccacauagaugcuga

SEQ ID NO: 2223844 - RNA, 11 nt, Homo sapiens
cacagcauuua

SEQ ID NO: 2223845 - RNA, 16 nt, Homo sapiens
aagcacaacucccuua

SEQ ID NO: 2223846 - RNA, 15 nt, Homo sapiens
guuauagaaacugau

SEQ ID NO: 2223847 - RNA, 21 nt, Homo sapiens
auucuauuuauauguacauga

SEQ ID NO: 2223848 - RNA, 22 nt, Homo sapiens
uuauauuuggcccaaacucauc

SEQ ID NO: 2223849 - RNA, 18 nt, Homo sapiens
accauugcuguucuacuu

SEQ ID NO: 2223850 - RNA, 18 nt, Homo sapiens
ugagcccgguaagagcaa

SEQ ID NO: 2223851 - RNA, 22 nt, Homo sapiens
gagcaaagcagacuaugcagcu

SEQ ID NO: 2223852 - RNA, 15 nt, Homo sapiens
cagccacccugaguu

SEQ ID NO: 2223853 - RNA, 20 nt, Homo sapiens
cuuagggugcugagugccug

SEQ ID NO: 2223854 - RNA, 15 nt, Homo sapiens
aggcaggucgggcug

SEQ ID NO: 2223855 - RNA, 15 nt, Homo sapiens
aaauauuugacuuua

SEQ ID NO: 2223856 - RNA, 18 nt, Homo sapiens
uaaauaaccaauuccuca

SEQ ID NO: 2223857 - RNA, 20 nt, Homo sapiens
auagcagcucuugaaguaua

SEQ ID NO: 2223858 - RNA, 21 nt, Homo sapiens
gugagcauuugucucuguuau

SEQ ID NO: 2223859 - RNA, 12 nt, Homo sapiens
cagacuggcaau

SEQ ID NO: 2223860 - RNA, 20 nt, Homo sapiens
aauugcaacagaagcaaaaa

SEQ ID NO: 2223861 - RNA, 19 nt, Homo sapiens
auuucuccucccuuccuuu

SEQ ID NO: 2223862 - RNA, 20 nt, Homo sapiens
agagaugacacuagucagaa

SEQ ID NO: 2223863 - RNA, 18 nt, Homo sapiens
aagaccagcuguguuucu

SEQ ID NO: 2223864 - RNA, 18 nt, Homo sapiens
accauucuccugccucag

SEQ ID NO: 2223865 - RNA, 14 nt, Homo sapiens
acugcucauuucau

SEQ ID NO: 2223866 - RNA, 16 nt, Homo sapiens
ugggcugggaaaaacu

SEQ ID NO: 2223867 - RNA, 17 nt, Homo sapiens
acagcagcaguuacaaa

SEQ ID NO: 2223868 - RNA, 19 nt, Homo sapiens
cugcccuggguucuuccac

SEQ ID NO: 2223869 - RNA, 13 nt, Homo sapiens
cucuguguagcaa

SEQ ID NO: 2223870 - RNA, 18 nt, Homo sapiens
gcuuuuuuaaacuugaau

SEQ ID NO: 2223871 - RNA, 23 nt, Homo sapiens
ccuuucaaauuuaggauggaaua

SEQ ID NO: 2223872 - RNA, 16 nt, Homo sapiens
augacauccacaugca

SEQ ID NO: 2223873 - RNA, 18 nt, Homo sapiens
aacuaaaguuuacagucu

SEQ ID NO: 2223874 - RNA, 16 nt, Homo sapiens
cuggugagucaccacu

SEQ ID NO: 2223875 - RNA, 18 nt, Homo sapiens
ugaacuguggugccacau

SEQ ID NO: 2223876 - RNA, 22 nt, Homo sapiens
uuuaaggagauugggagacaau

SEQ ID NO: 2223877 - RNA, 19 nt, Homo sapiens
gggcaggaacagaggguga

SEQ ID NO: 2223878 - RNA, 12 nt, Homo sapiens
aagauauggaau

SEQ ID NO: 2223879 - RNA, 16 nt, Homo sapiens
guuugcguauauguua

SEQ ID NO: 2223880 - RNA, 21 nt, Homo sapiens
augcccaguaaaauuucagga

SEQ ID NO: 2223881 - RNA, 17 nt, Homo sapiens
cuaagcagaccacugau

SEQ ID NO: 2223882 - RNA, 14 nt, Homo sapiens
cuccucccaccagu

SEQ ID NO: 2223883 - RNA, 21 nt, Homo sapiens
cccuagucuauucauuauauu

SEQ ID NO: 2223884 - RNA, 12 nt, Homo sapiens
uaccuaacuccc

SEQ ID NO: 2223885 - RNA, 12 nt, Homo sapiens
uuccaaaccauc

SEQ ID NO: 2223886 - RNA, 17 nt, Homo sapiens
cacacaaagacuccuug

SEQ ID NO: 2223887 - RNA, 18 nt, Homo sapiens
gagacaggaaaaaccaac

SEQ ID NO: 2223888 - RNA, 14 nt, Homo sapiens
uauauguaacugaa

SEQ ID NO: 2223889 - RNA, 12 nt, Homo sapiens
aaguugcugcuu

SEQ ID NO: 2223890 - RNA, 17 nt, Homo sapiens
caguauugagacacugu

SEQ ID NO: 2223891 - RNA, 20 nt, Homo sapiens
cugcagugcaauggcgcgau

SEQ ID NO: 2223892 - RNA, 17 nt, Homo sapiens
cauucaucacuccaaaa

SEQ ID NO: 2223893 - RNA, 16 nt, Homo sapiens
ggaagggcaugggcua

SEQ ID NO: 2223894 - RNA, 14 nt, Homo sapiens
cugaaacacacuga

SEQ ID NO: 2223895 - RNA, 18 nt, Homo sapiens
uccaaugaaaucucagga

SEQ ID NO: 2223896 - RNA, 14 nt, Homo sapiens
gcauaccacuugaa

SEQ ID NO: 2223897 - RNA, 23 nt, Homo sapiens
ugcucuucagaugccacuucuaa

SEQ ID NO: 2223898 - RNA, 21 nt, Homo sapiens
guugcagugucuaguuucuca

SEQ ID NO: 2223899 - RNA, 15 nt, Homo sapiens
cuccacccaugaccu

SEQ ID NO: 2223900 - RNA, 18 nt, Homo sapiens
cauaaucaauauaaucug

SEQ ID NO: 2223901 - RNA, 19 nt, Homo sapiens
auacuugugaacaugccuu

SEQ ID NO: 2223902 - RNA, 22 nt, Homo sapiens
ugaacaugcucauguguacaca

SEQ ID NO: 2223903 - RNA, 19 nt, Homo sapiens
auagacuuaauacaugcaa

SEQ ID NO: 2223904 - RNA, 17 nt, Homo sapiens
uagcugggaagaccaau

SEQ ID NO: 2223905 - RNA, 21 nt, Homo sapiens
agugccuucugagcugucuaa

SEQ ID NO: 2223906 - RNA, 13 nt, Homo sapiens
agguaaguggcag

SEQ ID NO: 2223907 - RNA, 19 nt, Homo sapiens
agcuguuucaaaugugcau

SEQ ID NO: 2223908 - RNA, 12 nt, Homo sapiens
agcuagaaccua

SEQ ID NO: 2223909 - RNA, 17 nt, Homo sapiens
auagagccuuugaucuu

SEQ ID NO: 2223910 - RNA, 14 nt, Homo sapiens
aaaauagucuucca

SEQ ID NO: 2223911 - RNA, 23 nt, Homo sapiens
augaauucuugauuuccuuucag

SEQ ID NO: 2223912 - RNA, 13 nt, Homo sapiens
uacucuauauacu

SEQ ID NO: 2223913 - RNA, 22 nt, Homo sapiens
cauuccuugggacucaggagcu

SEQ ID NO: 2223914 - RNA, 10 nt, Homo sapiens
caagacauag

SEQ ID NO: 2223915 - RNA, 15 nt, Homo sapiens
agcaauagguuugua

SEQ ID NO: 2223916 - RNA, 17 nt, Homo sapiens
cuaguucugccaggaga

SEQ ID NO: 2223917 - RNA, 16 nt, Homo sapiens
cugcucccaaugugcc

SEQ ID NO: 2223918 - RNA, 14 nt, Homo sapiens
gcuguccugcagca

SEQ ID NO: 2223919 - RNA, 21 nt, Homo sapiens
cugaaggcacagcuaaccacu

SEQ ID NO: 2223920 - RNA, 13 nt, Homo sapiens
uuagaggggaaaa

SEQ ID NO: 2223921 - RNA, 19 nt, Homo sapiens
auggcuuugugauucaauc

SEQ ID NO: 2223922 - RNA, 21 nt, Homo sapiens
caguaguuccaggacucaggg

SEQ ID NO: 2223923 - RNA, 18 nt, Homo sapiens
cuuguagcagaaggcaag

SEQ ID NO: 2223924 - RNA, 20 nt, Homo sapiens
cuuucaacucauugcaucau

SEQ ID NO: 2223925 - RNA, 19 nt, Homo sapiens
uuaaaauauucuuuaauac

SEQ ID NO: 2223926 - RNA, 16 nt, Homo sapiens
gcuaugucugugaugu

SEQ ID NO: 2223927 - RNA, 23 nt, Homo sapiens
caaaaagaacuaaauaugcaaua

SEQ ID NO: 2223928 - RNA, 15 nt, Homo sapiens
auauuaaaugacuuu

SEQ ID NO: 2223929 - RNA, 16 nt, Homo sapiens
aauaauuacuaauuaa

SEQ ID NO: 2223930 - RNA, 13 nt, Homo sapiens
ugauauacauugu

SEQ ID NO: 2223931 - RNA, 19 nt, Homo sapiens
gaauaugaucaaaccuuca

SEQ ID NO: 2223932 - RNA, 22 nt, Homo sapiens
ucuccuggcuuuacagacaaaa

SEQ ID NO: 2223933 - RNA, 23 nt, Homo sapiens
gccaaaccucuguucaguguaaa

SEQ ID NO: 2223934 - RNA, 18 nt, Homo sapiens
ccaccuucccucaugcug

SEQ ID NO: 2223935 - RNA, 17 nt, Homo sapiens
ggacauucacuauaaug

SEQ ID NO: 2223936 - RNA, 18 nt, Homo sapiens
ucaaaccauaaacuucau

SEQ ID NO: 2223937 - RNA, 13 nt, Homo sapiens
augaugcccuccc

SEQ ID NO: 2223938 - RNA, 21 nt, Homo sapiens
gcauaccaguucuugcaauaa

SEQ ID NO: 2223939 - RNA, 14 nt, Homo sapiens
ccugcggccgucac

SEQ ID NO: 2223940 - RNA, 23 nt, Homo sapiens
aauauuuuucuaaagaaauuaca

SEQ ID NO: 2223941 - RNA, 15 nt, Homo sapiens
aguaagucucaaggu

SEQ ID NO: 2223942 - RNA, 17 nt, Homo sapiens
gcugcugggucaggcca

SEQ ID NO: 2223943 - RNA, 17 nt, Homo sapiens
ugagaacuacucaggga

SEQ ID NO: 2223944 - RNA, 14 nt, Homo sapiens
cacuuggugcugcg

SEQ ID NO: 2223945 - RNA, 13 nt, Homo sapiens
accugcuccugcc

SEQ ID NO: 2223946 - RNA, 18 nt, Homo sapiens
caauuuuuuuucuguaaa

SEQ ID NO: 2223947 - RNA, 18 nt, Homo sapiens
acugguugguuuugccau

SEQ ID NO: 2223948 - RNA, 14 nt, Homo sapiens
caaauaauuggcau

SEQ ID NO: 2223949 - RNA, 15 nt, Homo sapiens
cagcagcacccagug

SEQ ID NO: 2223950 - RNA, 14 nt, Homo sapiens
guaucaacacuguu

SEQ ID NO: 2223951 - RNA, 12 nt, Homo sapiens
aauagaugacau

SEQ ID NO: 2223952 - RNA, 19 nt, Homo sapiens
cagugaaagacaagcugca

SEQ ID NO: 2223953 - RNA, 22 nt, Homo sapiens
ugaucacucuuugcacacucuu

SEQ ID NO: 2223954 - RNA, 21 nt, Homo sapiens
ccuuugccagccauucuuucc

SEQ ID NO: 2223955 - RNA, 17 nt, Homo sapiens
gagggcgaggcggggga

SEQ ID NO: 2223956 - RNA, 17 nt, Homo sapiens
caggccacuggggacag

SEQ ID NO: 2223957 - RNA, 23 nt, Homo sapiens
gagucaccuccuccacucacucc

SEQ ID NO: 2223958 - RNA, 22 nt, Homo sapiens
gaacuuuguccgguggaaggcc

SEQ ID NO: 2223959 - RNA, 18 nt, Homo sapiens
guauugcuaaucauuaag

SEQ ID NO: 2223960 - RNA, 14 nt, Homo sapiens
ugaaagugccaaaa

SEQ ID NO: 2223961 - RNA, 22 nt, Homo sapiens
acuuagacacguguuguuccac

SEQ ID NO: 2223962 - RNA, 19 nt, Homo sapiens
ugugacuuuuucagaguug

SEQ ID NO: 2223963 - RNA, 20 nt, Homo sapiens
ucacuguccaccaccaccug

SEQ ID NO: 2223964 - RNA, 13 nt, Homo sapiens
gauaaguucauac

SEQ ID NO: 2223965 - RNA, 19 nt, Homo sapiens
auucagcauggguccuuga

SEQ ID NO: 2223966 - RNA, 16 nt, Homo sapiens
cccucaacccuugaga

SEQ ID NO: 2223967 - RNA, 11 nt, Homo sapiens
cauucuucccg

SEQ ID NO: 2223968 - RNA, 14 nt, Homo sapiens
caacauaccagacc

SEQ ID NO: 2223969 - RNA, 16 nt, Homo sapiens
uuaagggaauaagcca

SEQ ID NO: 2223970 - RNA, 16 nt, Homo sapiens
uaugcucauaacugug

SEQ ID NO: 2223971 - RNA, 20 nt, Homo sapiens
auaugugaagaaaaauguau

SEQ ID NO: 2223972 - RNA, 15 nt, Homo sapiens
agcacuucaaaggaa

SEQ ID NO: 2223973 - RNA, 18 nt, Homo sapiens
agugcaccuacaccaacu

SEQ ID NO: 2223974 - RNA, 15 nt, Homo sapiens
gcaauaaacuuuuag

SEQ ID NO: 2223975 - RNA, 21 nt, Homo sapiens
uguacuggagagcaacacagg

SEQ ID NO: 2223976 - RNA, 21 nt, Homo sapiens
auccuacccccugugccuugu

SEQ ID NO: 2223977 - RNA, 15 nt, Homo sapiens
gccaagccaugucua

SEQ ID NO: 2223978 - RNA, 16 nt, Homo sapiens
uguucauggacuauuc

SEQ ID NO: 2223979 - RNA, 19 nt, Homo sapiens
gccucuuguugagugccag

SEQ ID NO: 2223980 - RNA, 17 nt, Homo sapiens
ugaucaauccuucuuau

SEQ ID NO: 2223981 - RNA, 18 nt, Homo sapiens
acccugaagaaauccugg

SEQ ID NO: 2223982 - RNA, 21 nt, Homo sapiens
gaugccugacggcagcugguu

SEQ ID NO: 2223983 - RNA, 16 nt, Homo sapiens
agcacagccucagaau

SEQ ID NO: 2223984 - RNA, 23 nt, Homo sapiens
uuuugggggggggcggacaggag

SEQ ID NO: 2223985 - RNA, 18 nt, Homo sapiens
uaccugagucccaaagcu

SEQ ID NO: 2223986 - RNA, 23 nt, Homo sapiens
ccucgggaaccucacucuugcca

SEQ ID NO: 2223987 - RNA, 23 nt, Homo sapiens
accagaccgcuccccaauacucu

SEQ ID NO: 2223988 - RNA, 14 nt, Homo sapiens
aaagcaugccaauu

SEQ ID NO: 2223989 - RNA, 13 nt, Homo sapiens
aaggaagacuuga

SEQ ID NO: 2223990 - RNA, 22 nt, Homo sapiens
uuuaaacacggggcuugcaacu

SEQ ID NO: 2223991 - RNA, 11 nt, Homo sapiens
gcaacuuugau

SEQ ID NO: 2223992 - RNA, 11 nt, Homo sapiens
ucuacuuuuaa

SEQ ID NO: 2223993 - RNA, 23 nt, Homo sapiens
uuccauuuccguuccagagggaa

SEQ ID NO: 2223994 - RNA, 12 nt, Homo sapiens
agagcagugugg

SEQ ID NO: 2223995 - RNA, 21 nt, Homo sapiens
ugaccagccugucacccagcu

SEQ ID NO: 2223996 - RNA, 23 nt, Homo sapiens
cuccuucauggcaggcaucgcca

SEQ ID NO: 2223997 - RNA, 17 nt, Homo sapiens
aagcagaacuaagcuca

SEQ ID NO: 2223998 - RNA, 20 nt, Homo sapiens
caaauccuagacugcuccug

SEQ ID NO: 2223999 - RNA, 14 nt, Homo sapiens
ggcccuugcccaac

SEQ ID NO: 2224000 - RNA, 21 nt, Homo sapiens
cagaugaguguguguucuucc

SEQ ID NO: 2224001 - RNA, 18 nt, Homo sapiens
aaugugguuuuccugaaa

SEQ ID NO: 2224002 - RNA, 20 nt, Homo sapiens
gcuuucaaggauaggcuuua

SEQ ID NO: 2224003 - RNA, 15 nt, Homo sapiens
ugcaguccauuuccu

SEQ ID NO: 2224004 - RNA, 17 nt, Homo sapiens
uaaagucuacacugccu

SEQ ID NO: 2224005 - RNA, 17 nt, Homo sapiens
auaccgaccaucgucca

SEQ ID NO: 2224006 - RNA, 13 nt, Homo sapiens
cuguucccaugag

SEQ ID NO: 2224007 - RNA, 18 nt, Homo sapiens
gcauauaaaaacaucagu

SEQ ID NO: 2224008 - RNA, 15 nt, Homo sapiens
uagaguaggugcaga

SEQ ID NO: 2224009 - RNA, 16 nt, Homo sapiens
ccucucagguggguua

SEQ ID NO: 2224010 - RNA, 23 nt, Homo sapiens
aacuuuuuaaagaagugcaugaa

SEQ ID NO: 2224011 - RNA, 12 nt, Homo sapiens
ugaacauuucau

SEQ ID NO: 2224012 - RNA, 22 nt, Homo sapiens
ucugccuccaggagggcaucag

SEQ ID NO: 2224013 - RNA, 15 nt, Homo sapiens
cauaacacacuacug

SEQ ID NO: 2224014 - RNA, 16 nt, Homo sapiens
uagucaauccugucau

SEQ ID NO: 2224015 - RNA, 17 nt, Homo sapiens
acugcgcaucaccuacc

SEQ ID NO: 2224016 - RNA, 16 nt, Homo sapiens
uuggggacaugugauu

SEQ ID NO: 2224017 - RNA, 17 nt, Homo sapiens
ugugcagugugggauuu

SEQ ID NO: 2224018 - RNA, 16 nt, Homo sapiens
gaguucaaauugccuu

SEQ ID NO: 2224019 - RNA, 17 nt, Homo sapiens
guacuaucuagugucua

SEQ ID NO: 2224020 - RNA, 21 nt, Homo sapiens
cuaaggaugguuuuaucuucc

SEQ ID NO: 2224021 - RNA, 12 nt, Homo sapiens
cacggaaagccu

SEQ ID NO: 2224022 - RNA, 19 nt, Homo sapiens
uaaugaaguguuuagcaua

SEQ ID NO: 2224023 - RNA, 23 nt, Homo sapiens
aaaugugaacguccuuccuugac

SEQ ID NO: 2224024 - RNA, 15 nt, Homo sapiens
agucuucuucacuuc

SEQ ID NO: 2224025 - RNA, 19 nt, Homo sapiens
uguguuucagccauguauu

SEQ ID NO: 2224026 - RNA, 12 nt, Homo sapiens
agcccuauucau

SEQ ID NO: 2224027 - RNA, 14 nt, Homo sapiens
ggaaccgauggugg

SEQ ID NO: 2224028 - RNA, 18 nt, Homo sapiens
gcaaaaugcugcuuucug

SEQ ID NO: 2224029 - RNA, 20 nt, Homo sapiens
acauguauccuuucacacau

SEQ ID NO: 2224030 - RNA, 22 nt, Homo sapiens
uucuaugguugacauuguauau

SEQ ID NO: 2224031 - RNA, 21 nt, Homo sapiens
cuggcagagguuucuagggug

SEQ ID NO: 2224032 - RNA, 16 nt, Homo sapiens
ugggaucugugcccag

SEQ ID NO: 2224033 - RNA, 17 nt, Homo sapiens
ccagaagggggccauga

SEQ ID NO: 2224034 - RNA, 23 nt, Homo sapiens
cacuuuuuuuuuuuuuuugacag

SEQ ID NO: 2224035 - RNA, 19 nt, Homo sapiens
ccaaggccacagggagcuc

SEQ ID NO: 2224036 - RNA, 16 nt, Homo sapiens
uguguucacacuguaa

SEQ ID NO: 2224037 - RNA, 16 nt, Homo sapiens
gggaagcagccagcuc

SEQ ID NO: 2224038 - RNA, 21 nt, Homo sapiens
auacauuaggaagcugaauua

SEQ ID NO: 2224039 - RNA, 23 nt, Homo sapiens
acuuuaccucuucuucuccaaag

SEQ ID NO: 2224040 - RNA, 18 nt, Homo sapiens
cuccaguguuacuuuuaa

SEQ ID NO: 2224041 - RNA, 15 nt, Homo sapiens
acauccggaacagcc

SEQ ID NO: 2224042 - RNA, 16 nt, Homo sapiens
ggaaacacuaggugcc

SEQ ID NO: 2224043 - RNA, 22 nt, Homo sapiens
gccuguguggaggccucaggga

SEQ ID NO: 2224044 - RNA, 13 nt, Homo sapiens
gagugcugggauu

SEQ ID NO: 2224045 - RNA, 13 nt, Homo sapiens
gggagcuggaaau

SEQ ID NO: 2224046 - RNA, 23 nt, Homo sapiens
uaaacuguuagcacuguugaugu

SEQ ID NO: 2224047 - RNA, 23 nt, Homo sapiens
uuccagguagcucggcaccaacu

SEQ ID NO: 2224048 - RNA, 22 nt, Homo sapiens
cuuuuguaucuuaagccaagaa

SEQ ID NO: 2224049 - RNA, 16 nt, Homo sapiens
ccugguuugcaaagac

SEQ ID NO: 2224050 - RNA, 21 nt, Homo sapiens
acuaugauuuaccuauacauu

SEQ ID NO: 2224051 - RNA, 16 nt, Homo sapiens
guaagauuucauucug

SEQ ID NO: 2224052 - RNA, 19 nt, Homo sapiens
caguauugagcugccugag

SEQ ID NO: 2224053 - RNA, 16 nt, Homo sapiens
cuuuccccaggggcau

SEQ ID NO: 2224054 - RNA, 19 nt, Homo sapiens
uuccuacuucauuccagca

SEQ ID NO: 2224055 - RNA, 17 nt, Homo sapiens
aucacgggucacuugaa

SEQ ID NO: 2224056 - RNA, 17 nt, Homo sapiens
cauuagaacaaaggaca

SEQ ID NO: 2224057 - RNA, 20 nt, Homo sapiens
ccaugaauucuugaguuuac

SEQ ID NO: 2224058 - RNA, 15 nt, Homo sapiens
uucuuaguggaagac

SEQ ID NO: 2224059 - RNA, 18 nt, Homo sapiens
cuuucccacgucacuuga

SEQ ID NO: 2224060 - RNA, 23 nt, Homo sapiens
guuuauguacuguaaacaguucu

SEQ ID NO: 2224061 - RNA, 16 nt, Homo sapiens
guucauguuugcuuca

SEQ ID NO: 2224062 - RNA, 19 nt, Homo sapiens
cuccucgguggcauuugcu

SEQ ID NO: 2224063 - RNA, 16 nt, Homo sapiens
agccucaaauccagga

SEQ ID NO: 2224064 - RNA, 23 nt, Homo sapiens
aucacaggagcaaucacaggaaa

SEQ ID NO: 2224065 - RNA, 13 nt, Homo sapiens
cuggaaauacuga

SEQ ID NO: 2224066 - RNA, 19 nt, Homo sapiens
caaaauugauaauuacguu

SEQ ID NO: 2224067 - RNA, 20 nt, Homo sapiens
auaaauguacuacauuugca

SEQ ID NO: 2224068 - RNA, 15 nt, Homo sapiens
uaagcuacugccauc

SEQ ID NO: 2224069 - RNA, 13 nt, Homo sapiens
cagcaggugcuga

SEQ ID NO: 2224070 - RNA, 17 nt, Homo sapiens
uacuuugacuuuuugca

SEQ ID NO: 2224071 - RNA, 15 nt, Homo sapiens
guuucuugugggcua

SEQ ID NO: 2224072 - RNA, 19 nt, Homo sapiens
uggaggaucaaagaacuga

SEQ ID NO: 2224073 - RNA, 19 nt, Homo sapiens
uaaucgauuugucugucaa

SEQ ID NO: 2224074 - RNA, 17 nt, Homo sapiens
aguccuacccugaaccu

SEQ ID NO: 2224075 - RNA, 20 nt, Homo sapiens
gccucaccguccucacccau

SEQ ID NO: 2224076 - RNA, 17 nt, Homo sapiens
uccucauaaacauuuga

SEQ ID NO: 2224077 - RNA, 14 nt, Homo sapiens
ugcuguguguccca

SEQ ID NO: 2224078 - RNA, 15 nt, Homo sapiens
gcauucauaaccaaa

SEQ ID NO: 2224079 - RNA, 19 nt, Homo sapiens
acagagaucagaauugaac

SEQ ID NO: 2224080 - RNA, 15 nt, Homo sapiens
aaguuaaaagcacaa

SEQ ID NO: 2224081 - RNA, 20 nt, Homo sapiens
cucuuaagugugcacagaua

SEQ ID NO: 2224082 - RNA, 22 nt, Homo sapiens
acaaauaggagugaguguaugu

SEQ ID NO: 2224083 - RNA, 13 nt, Homo sapiens
aguauugacaaaa

SEQ ID NO: 2224084 - RNA, 20 nt, Homo sapiens
cuaacuuuaugaacucccuc

SEQ ID NO: 2224085 - RNA, 20 nt, Homo sapiens
cauuuuuuuuuuaucagagu

SEQ ID NO: 2224086 - RNA, 14 nt, Homo sapiens
aacaaguguacaga

SEQ ID NO: 2224087 - RNA, 15 nt, Homo sapiens
uguucuagcagugaa

SEQ ID NO: 2224088 - RNA, 23 nt, Homo sapiens
acgguaaguguucucaugaagca

SEQ ID NO: 2224089 - RNA, 20 nt, Homo sapiens
ugggcugcacaggcacuguc

SEQ ID NO: 2224090 - RNA, 23 nt, Homo sapiens
cugaaauucaggaugcugugaua

SEQ ID NO: 2224091 - RNA, 15 nt, Homo sapiens
agagugaagagugaa

SEQ ID NO: 2224092 - RNA, 14 nt, Homo sapiens
agccuggcacagga

SEQ ID NO: 2224093 - RNA, 22 nt, Homo sapiens
cuuuaucaaaaaguacaauaau

SEQ ID NO: 2224094 - RNA, 18 nt, Homo sapiens
ucagcccugcaccaugcu

SEQ ID NO: 2224095 - RNA, 23 nt, Homo sapiens
auuaugagcuuucuuugcacuua

SEQ ID NO: 2224096 - RNA, 12 nt, Homo sapiens
aggccucaggga

SEQ ID NO: 2224097 - RNA, 20 nt, Homo sapiens
gaaugguagucuaaccaaau

SEQ ID NO: 2224098 - RNA, 18 nt, Homo sapiens
aaucauuuagaugcacuu

SEQ ID NO: 2224099 - RNA, 19 nt, Homo sapiens
agggccucacucuguugcu

SEQ ID NO: 2224100 - RNA, 22 nt, Homo sapiens
cuucaggaagcauaaagcaauu

SEQ ID NO: 2224101 - RNA, 16 nt, Homo sapiens
caggggaguaugcaaa

SEQ ID NO: 2224102 - RNA, 19 nt, Homo sapiens
cauuucuuuuucauuugac

SEQ ID NO: 2224103 - RNA, 17 nt, Homo sapiens
cagcaacccuccuauca

SEQ ID NO: 2224104 - RNA, 13 nt, Homo sapiens
auuggcugagaua

SEQ ID NO: 2224105 - RNA, 17 nt, Homo sapiens
aaagaacgugaucuccu

SEQ ID NO: 2224106 - RNA, 13 nt, Homo sapiens
aaagcacauaacu

SEQ ID NO: 2224107 - RNA, 14 nt, Homo sapiens
ucagcccugagcug

SEQ ID NO: 2224108 - RNA, 21 nt, Homo sapiens
gaaauccuuccuaaacccaau

SEQ ID NO: 2224109 - RNA, 17 nt, Homo sapiens
cacuuguguuuugcaag

SEQ ID NO: 2224110 - RNA, 18 nt, Homo sapiens
auuccacuuuuuguuaca

SEQ ID NO: 2224111 - RNA, 17 nt, Homo sapiens
uuguaguucuuaguccc

SEQ ID NO: 2224112 - RNA, 22 nt, Homo sapiens
uacuaagugguggagccaagau

SEQ ID NO: 2224113 - RNA, 16 nt, Homo sapiens
aaucugcaaacaugcc

SEQ ID NO: 2224114 - RNA, 15 nt, Homo sapiens
ugucauaacauuuaa

SEQ ID NO: 2224115 - RNA, 18 nt, Homo sapiens
ucuccccuaggcgcuguu

SEQ ID NO: 2224116 - RNA, 19 nt, Homo sapiens
ucugcuccagguucacuuu

SEQ ID NO: 2224117 - RNA, 17 nt, Homo sapiens
agcacaugccuacugcu

SEQ ID NO: 2224118 - RNA, 17 nt, Homo sapiens
gaacagaggcauuuaaa

SEQ ID NO: 2224119 - RNA, 13 nt, Homo sapiens
aauuuguauuucc

SEQ ID NO: 2224120 - RNA, 18 nt, Homo sapiens
aauuaauaauauguacua

SEQ ID NO: 2224121 - RNA, 17 nt, Homo sapiens
ugcauggccucuaagag

SEQ ID NO: 2224122 - RNA, 22 nt, Homo sapiens
gugacuuccucgccucucccac

SEQ ID NO: 2224123 - RNA, 16 nt, Homo sapiens
gugaaugcacagugaa

SEQ ID NO: 2224124 - RNA, 19 nt, Homo sapiens
gaaugagcaaaaccaaaua

SEQ ID NO: 2224125 - RNA, 15 nt, Homo sapiens
agaggugcagcugga

SEQ ID NO: 2224126 - RNA, 14 nt, Homo sapiens
caacaucccauugc

SEQ ID NO: 2224127 - RNA, 16 nt, Homo sapiens
uugcucugaccuccuc

SEQ ID NO: 2224128 - RNA, 18 nt, Homo sapiens
accaucuccccaggcuau

SEQ ID NO: 2224129 - RNA, 17 nt, Homo sapiens
cuuuucccaaacugauc

SEQ ID NO: 2224130 - RNA, 22 nt, Homo sapiens
ucuuguuguggaggcugaaaag

SEQ ID NO: 2224131 - RNA, 14 nt, Homo sapiens
cuccaaucugguaa

SEQ ID NO: 2224132 - RNA, 19 nt, Homo sapiens
gaaacucaccuuccucauc

SEQ ID NO: 2224133 - RNA, 21 nt, Homo sapiens
cuuggacauuuauguacaaaa

SEQ ID NO: 2224134 - RNA, 23 nt, Homo sapiens
cuuaggaauuucuccuacuuuac

SEQ ID NO: 2224135 - RNA, 23 nt, Homo sapiens
ugauucuuucccuuccuuuccuc

SEQ ID NO: 2224136 - RNA, 14 nt, Homo sapiens
uccaugggauacaa

SEQ ID NO: 2224137 - RNA, 12 nt, Homo sapiens
uuucaguucacu

SEQ ID NO: 2224138 - RNA, 21 nt, Homo sapiens
auuagaugugccaauaaccaa

SEQ ID NO: 2224139 - RNA, 16 nt, Homo sapiens
guuacugucauuccca

SEQ ID NO: 2224140 - RNA, 17 nt, Homo sapiens
gaaacauacguucuuuu

SEQ ID NO: 2224141 - RNA, 11 nt, Homo sapiens
ugaacauuuca

SEQ ID NO: 2224142 - RNA, 17 nt, Homo sapiens
cguggacucauuucacu

SEQ ID NO: 2224143 - RNA, 17 nt, Homo sapiens
cagauccagcagcugcu

SEQ ID NO: 2224144 - RNA, 21 nt, Homo sapiens
uguggaaagaaagaccaucuc

SEQ ID NO: 2224145 - RNA, 19 nt, Homo sapiens
accuggaggacagcuggac

SEQ ID NO: 2224146 - RNA, 15 nt, Homo sapiens
uaauuuguagacuua

SEQ ID NO: 2224147 - RNA, 20 nt, Homo sapiens
ugaacagcccucucucucac

SEQ ID NO: 2224148 - RNA, 14 nt, Homo sapiens
acugaaugagguca

SEQ ID NO: 2224149 - RNA, 19 nt, Homo sapiens
ggcuucacagccacaccug

SEQ ID NO: 2224150 - RNA, 16 nt, Homo sapiens
guauaauuuaacuuca

SEQ ID NO: 2224151 - RNA, 20 nt, Homo sapiens
uagucaaggaggaaagggau

SEQ ID NO: 2224152 - RNA, 20 nt, Homo sapiens
uaaagaaaggaacuaaguca

SEQ ID NO: 2224153 - RNA, 14 nt, Homo sapiens
agagggcccaggca

SEQ ID NO: 2224154 - RNA, 14 nt, Homo sapiens
caaggucauagaca

SEQ ID NO: 2224155 - RNA, 16 nt, Homo sapiens
ccuucauguacaucca

SEQ ID NO: 2224156 - RNA, 14 nt, Homo sapiens
ugacuucacagcag

SEQ ID NO: 2224157 - RNA, 22 nt, Homo sapiens
cacugugcuaauaacagugcau

SEQ ID NO: 2224158 - RNA, 17 nt, Homo sapiens
acauugaguuggaauca

SEQ ID NO: 2224159 - RNA, 14 nt, Homo sapiens
ucaaauacaugcac

SEQ ID NO: 2224160 - RNA, 15 nt, Homo sapiens
uguuagaugugcaca

SEQ ID NO: 2224161 - RNA, 18 nt, Homo sapiens
ugagaauaaaaccuucaa

SEQ ID NO: 2224162 - RNA, 17 nt, Homo sapiens
ugaaagcccaaggugcu

SEQ ID NO: 2224163 - RNA, 15 nt, Homo sapiens
uucauccuugacuaa

SEQ ID NO: 2224164 - RNA, 15 nt, Homo sapiens
uucaucauugacuac

SEQ ID NO: 2224165 - RNA, 15 nt, Homo sapiens
caaucagcacucugu

SEQ ID NO: 2224166 - RNA, 11 nt, Homo sapiens
caaacaagcac

SEQ ID NO: 2224167 - RNA, 17 nt, Homo sapiens
gccuaaaaaugcaacuu

SEQ ID NO: 2224168 - RNA, 21 nt, Homo sapiens
cuuuacuaucuuuucaucuca

SEQ ID NO: 2224169 - RNA, 14 nt, Homo sapiens
aagauaaacacaaa

SEQ ID NO: 2224170 - RNA, 18 nt, Homo sapiens
uaaaucaauucauugugu

SEQ ID NO: 2224171 - RNA, 14 nt, Homo sapiens
ugaaugaugugaua

SEQ ID NO: 2224172 - RNA, 15 nt, Homo sapiens
agagcuggggcugcc

SEQ ID NO: 2224173 - RNA, 18 nt, Homo sapiens
ggagaacaugcuggugaa

SEQ ID NO: 2224174 - RNA, 20 nt, Homo sapiens
gcaauccaagugauccuccc

SEQ ID NO: 2224175 - RNA, 21 nt, Homo sapiens
agccuccaaugcauuggccuc

SEQ ID NO: 2224176 - RNA, 19 nt, Homo sapiens
cguuuguuccccaagacau

SEQ ID NO: 2224177 - RNA, 21 nt, Homo sapiens
cuaacuaugcauggugcccca

SEQ ID NO: 2224178 - RNA, 18 nt, Homo sapiens
uaauuuuacaugucucau

SEQ ID NO: 2224179 - RNA, 14 nt, Homo sapiens
ucaucauccuacaa

SEQ ID NO: 2224180 - RNA, 16 nt, Homo sapiens
auuguacucugcuuua

SEQ ID NO: 2224181 - RNA, 14 nt, Homo sapiens
acaaacaaugccau

SEQ ID NO: 2224182 - RNA, 14 nt, Homo sapiens
ccucacuguggaau

SEQ ID NO: 2224183 - RNA, 20 nt, Homo sapiens
cccuacccccaguaaaauca

SEQ ID NO: 2224184 - RNA, 22 nt, Homo sapiens
caaacgcuucagagacacacaa

SEQ ID NO: 2224185 - RNA, 18 nt, Homo sapiens
ugcaaggggaaaaucuca

SEQ ID NO: 2224186 - RNA, 22 nt, Homo sapiens
caucauuuaacugaacugugaa

SEQ ID NO: 2224187 - RNA, 15 nt, Homo sapiens
acuuuagaagcacag

SEQ ID NO: 2224188 - RNA, 22 nt, Homo sapiens
cacaauuccauuuccaguucau

SEQ ID NO: 2224189 - RNA, 20 nt, Homo sapiens
uugccugucaaguuguacau

SEQ ID NO: 2224190 - RNA, 17 nt, Homo sapiens
uuauuuuuuuacuuccu

SEQ ID NO: 2224191 - RNA, 16 nt, Homo sapiens
acacaauccauuguca

SEQ ID NO: 2224192 - RNA, 17 nt, Homo sapiens
aagguuucauguagauu

SEQ ID NO: 2224193 - RNA, 17 nt, Homo sapiens
ggagauuacuaacugug

SEQ ID NO: 2224194 - RNA, 16 nt, Homo sapiens
ccccacuccagcuccu

SEQ ID NO: 2224195 - RNA, 21 nt, Homo sapiens
cacccucccucccugaucccg

SEQ ID NO: 2224196 - RNA, 21 nt, Homo sapiens
gacuuguaggaaucugccuuc

SEQ ID NO: 2224197 - RNA, 15 nt, Homo sapiens
cuauacacacacaca

SEQ ID NO: 2224198 - RNA, 15 nt, Homo sapiens
cuucccccacuuccc

SEQ ID NO: 2224199 - RNA, 21 nt, Homo sapiens
agucuagccuuguagcuguua

SEQ ID NO: 2224200 - RNA, 14 nt, Homo sapiens
cagaaguacuccua

SEQ ID NO: 2224201 - RNA, 12 nt, Homo sapiens
aaggggucugua

SEQ ID NO: 2224202 - RNA, 11 nt, Homo sapiens
accacagcaga

SEQ ID NO: 2224203 - RNA, 15 nt, Homo sapiens
uccuucuguggcaac

SEQ ID NO: 2224204 - RNA, 19 nt, Homo sapiens
uauaaugcaguuaucuucu

SEQ ID NO: 2224205 - RNA, 15 nt, Homo sapiens
agucagaacagccag

SEQ ID NO: 2224206 - RNA, 12 nt, Homo sapiens
auucugcugaug

SEQ ID NO: 2224207 - RNA, 16 nt, Homo sapiens
aaacccuucuuuacua

SEQ ID NO: 2224208 - RNA, 15 nt, Homo sapiens
gccuggaggugggca

SEQ ID NO: 2224209 - RNA, 23 nt, Homo sapiens
aagucugauugguuuuaauugaa

SEQ ID NO: 2224210 - RNA, 17 nt, Homo sapiens
uuugcagauuuauuuag

SEQ ID NO: 2224211 - RNA, 20 nt, Homo sapiens
gcuuaaaggagggugaauaa

SEQ ID NO: 2224212 - RNA, 24 nt, Homo sapiens
caaaggaggcuuacaacuccugca

SEQ ID NO: 2224213 - RNA, 18 nt, Homo sapiens
aacccuuagaccuguaga

SEQ ID NO: 2224214 - RNA, 19 nt, Homo sapiens
acagcgagacuccgucuca

SEQ ID NO: 2224215 - RNA, 19 nt, Homo sapiens
acagugagacucugucuca

SEQ ID NO: 2224216 - RNA, 22 nt, Homo sapiens
uuuauaauguagcagcucauaa

SEQ ID NO: 2224217 - RNA, 18 nt, Homo sapiens
ucuuccaacacauuucac

SEQ ID NO: 2224218 - RNA, 11 nt, Homo sapiens
agcugcccuag

SEQ ID NO: 2224219 - RNA, 13 nt, Homo sapiens
aguccagcuugua

SEQ ID NO: 2224220 - RNA, 19 nt, Homo sapiens
cuggggaagcugugaaaga

SEQ ID NO: 2224221 - RNA, 18 nt, Homo sapiens
auagccucaccuucccua

SEQ ID NO: 2224222 - RNA, 21 nt, Homo sapiens
aaaacaaagccuuauccagca

SEQ ID NO: 2224223 - RNA, 18 nt, Homo sapiens
cagaggagagaggacccc

SEQ ID NO: 2224224 - RNA, 16 nt, Homo sapiens
uuauuuacaaugcaga

SEQ ID NO: 2224225 - RNA, 12 nt, Homo sapiens
aauucaauacag

SEQ ID NO: 2224226 - RNA, 11 nt, Homo sapiens
uccuccaucuc

SEQ ID NO: 2224227 - RNA, 15 nt, Homo sapiens
ugaaaucaaguucca

SEQ ID NO: 2224228 - RNA, 17 nt, Homo sapiens
ggcugcacccacccagg

SEQ ID NO: 2224229 - RNA, 15 nt, Homo sapiens
cuucuggguggcucc

SEQ ID NO: 2224230 - RNA, 16 nt, Homo sapiens
gauaauugugcacacc

SEQ ID NO: 2224231 - RNA, 19 nt, Homo sapiens
uaugcagaauggcauuugc

SEQ ID NO: 2224232 - RNA, 16 nt, Homo sapiens
gaccugguccacaggg

SEQ ID NO: 2224233 - RNA, 15 nt, Homo sapiens
uuacaucccagacac

SEQ ID NO: 2224234 - RNA, 23 nt, Homo sapiens
uuacaugaauacgucuugaucag

SEQ ID NO: 2224235 - RNA, 12 nt, Homo sapiens
uaacaucuccau

SEQ ID NO: 2224236 - RNA, 22 nt, Homo sapiens
aggaacagacucgaugcaagug

SEQ ID NO: 2224237 - RNA, 18 nt, Homo sapiens
gagaugccacuucucacu

SEQ ID NO: 2224238 - RNA, 17 nt, Homo sapiens
ugcagugcccugagcca

SEQ ID NO: 2224239 - RNA, 20 nt, Homo sapiens
gcagaggcccaggcugccgu

SEQ ID NO: 2224240 - RNA, 15 nt, Homo sapiens
agagucggauuacca

SEQ ID NO: 2224241 - RNA, 15 nt, Homo sapiens
agaaucuaaagccag

SEQ ID NO: 2224242 - RNA, 15 nt, Homo sapiens
uucuaaguagaguau

SEQ ID NO: 2224243 - RNA, 23 nt, Homo sapiens
cagugacugggggaggaccugcu

SEQ ID NO: 2224244 - RNA, 18 nt, Homo sapiens
aaaagcaucucacugcaa

SEQ ID NO: 2224245 - RNA, 14 nt, Homo sapiens
auggaacucgcuca

SEQ ID NO: 2224246 - RNA, 16 nt, Homo sapiens
ccccguggugccugca

SEQ ID NO: 2224247 - RNA, 17 nt, Homo sapiens
agcauagggucuggaac

SEQ ID NO: 2224248 - RNA, 17 nt, Homo sapiens
gcccaccagaccuguuc

SEQ ID NO: 2224249 - RNA, 21 nt, Homo sapiens
cuguauuccgauacaaagugu

SEQ ID NO: 2224250 - RNA, 14 nt, Homo sapiens
agagaaaugagcuu

SEQ ID NO: 2224251 - RNA, 20 nt, Homo sapiens
uauagccacaaaugccuuga

SEQ ID NO: 2224252 - RNA, 19 nt, Homo sapiens
auuauaagcuaugucacua

SEQ ID NO: 2224253 - RNA, 13 nt, Homo sapiens
gcaaauguuaaaa

SEQ ID NO: 2224254 - RNA, 12 nt, Homo sapiens
ugacaguuuaca

SEQ ID NO: 2224255 - RNA, 22 nt, Homo sapiens
ccagguaggauacguacaccuc

SEQ ID NO: 2224256 - RNA, 17 nt, Homo sapiens
uucauugcacuuuccuu

SEQ ID NO: 2224257 - RNA, 21 nt, Homo sapiens
cacaauuccauuuccaguuca

SEQ ID NO: 2224258 - RNA, 16 nt, Homo sapiens
aaguacuacuccucaa

SEQ ID NO: 2224259 - RNA, 16 nt, Homo sapiens
cuggaucucagccucu

SEQ ID NO: 2224260 - RNA, 20 nt, Homo sapiens
gacagagugagaccauguuu

SEQ ID NO: 2224261 - RNA, 14 nt, Homo sapiens
ggcaauagucaaau

SEQ ID NO: 2224262 - RNA, 18 nt, Homo sapiens
gguauugucuacucugaa

SEQ ID NO: 2224263 - RNA, 23 nt, Homo sapiens
aacaagagacugcuugacaaagg

SEQ ID NO: 2224264 - RNA, 20 nt, Homo sapiens
gcugacggcgcaagaccagc

SEQ ID NO: 2224265 - RNA, 22 nt, Homo sapiens
uucucucccuuccucucuccuu

SEQ ID NO: 2224266 - RNA, 18 nt, Homo sapiens
uuuauaucuuuaugcaaa

SEQ ID NO: 2224267 - RNA, 18 nt, Homo sapiens
ccgcagggcugggcggga

SEQ ID NO: 2224268 - RNA, 13 nt, Homo sapiens
uuuuugugcuuua

SEQ ID NO: 2224269 - RNA, 13 nt, Homo sapiens
ucuuagugccuuu

SEQ ID NO: 2224270 - RNA, 13 nt, Homo sapiens
uauuugaaucuuu

SEQ ID NO: 2224271 - RNA, 14 nt, Homo sapiens
cccccugggcugag

SEQ ID NO: 2224272 - RNA, 18 nt, Homo sapiens
auuaaucagcuguugcag

SEQ ID NO: 2224273 - RNA, 16 nt, Homo sapiens
ugguacacaguucugg

SEQ ID NO: 2224274 - RNA, 13 nt, Homo sapiens
ucuucacucagga

SEQ ID NO: 2224275 - RNA, 17 nt, Homo sapiens
acuguggcacuugccug

SEQ ID NO: 2224276 - RNA, 15 nt, Homo sapiens
aaauaaaccccaguc

SEQ ID NO: 2224277 - RNA, 14 nt, Homo sapiens
uaauguaauacugu

SEQ ID NO: 2224278 - RNA, 14 nt, Homo sapiens
accuuaaaacauua

SEQ ID NO: 2224279 - RNA, 14 nt, Homo sapiens
gaaaauaagacaau

SEQ ID NO: 2224280 - RNA, 19 nt, Homo sapiens
gaaagcauuacauuuccaa

SEQ ID NO: 2224281 - RNA, 17 nt, Homo sapiens
acaaucuacacugccuu

SEQ ID NO: 2224282 - RNA, 12 nt, Homo sapiens
gucauacaguaa

SEQ ID NO: 2224283 - RNA, 17 nt, Homo sapiens
auugugauauuugacag

SEQ ID NO: 2224284 - RNA, 13 nt, Homo sapiens
agcaacuuuccuu

SEQ ID NO: 2224285 - RNA, 22 nt, Homo sapiens
cagauaagguaaaaugccauga

SEQ ID NO: 2224286 - RNA, 17 nt, Homo sapiens
uuaagaaaaacaauaaa

SEQ ID NO: 2224287 - RNA, 21 nt, Homo sapiens
acucuuaugcuguacccaguu

SEQ ID NO: 2224288 - RNA, 18 nt, Homo sapiens
cugcacauccuucuuggc

SEQ ID NO: 2224289 - RNA, 20 nt, Homo sapiens
uugauaccauggcacugaca

SEQ ID NO: 2224290 - RNA, 21 nt, Homo sapiens
augacuuggagauuuaucucu

SEQ ID NO: 2224291 - RNA, 23 nt, Homo sapiens
gacucuaaauauuucaugauuca

SEQ ID NO: 2224292 - RNA, 16 nt, Homo sapiens
aaucucggcucauuga

SEQ ID NO: 2224293 - RNA, 18 nt, Homo sapiens
uauaucuauaaacacugu

SEQ ID NO: 2224294 - RNA, 16 nt, Homo sapiens
cacgugagaucauuca

SEQ ID NO: 2224295 - RNA, 12 nt, Homo sapiens
cuaaauaucuca

SEQ ID NO: 2224296 - RNA, 16 nt, Homo sapiens
ugccauggccugugcu

SEQ ID NO: 2224297 - RNA, 19 nt, Homo sapiens
aaccucaaauauaguauau

SEQ ID NO: 2224298 - RNA, 19 nt, Homo sapiens
caauguuccguucaucuga

SEQ ID NO: 2224299 - RNA, 13 nt, Homo sapiens
gauaaugaggcaa

SEQ ID NO: 2224300 - RNA, 15 nt, Homo sapiens
aaugucagcaucaag

SEQ ID NO: 2224301 - RNA, 16 nt, Homo sapiens
gggcagugaguccucu

SEQ ID NO: 2224302 - RNA, 13 nt, Homo sapiens
uacuauguacugc

SEQ ID NO: 2224303 - RNA, 24 nt, Homo sapiens
gacacccuucucccacucuccuag

SEQ ID NO: 2224304 - RNA, 14 nt, Homo sapiens
guggggagucugag

SEQ ID NO: 2224305 - RNA, 19 nt, Homo sapiens
caggguagguuugugucuu

SEQ ID NO: 2224306 - RNA, 21 nt, Homo sapiens
ucagucaacaacuuacacuua

SEQ ID NO: 2224307 - RNA, 19 nt, Homo sapiens
aacauacacugagcugcuu

SEQ ID NO: 2224308 - RNA, 23 nt, Homo sapiens
cagauuuuaagggggaaaacugu

SEQ ID NO: 2224309 - RNA, 14 nt, Homo sapiens
auuacaaguggcuc

SEQ ID NO: 2224310 - RNA, 15 nt, Homo sapiens
uuuaaaaucagugau

SEQ ID NO: 2224311 - RNA, 11 nt, Homo sapiens
aacccaaugac

SEQ ID NO: 2224312 - RNA, 14 nt, Homo sapiens
ucucuugacuccac

SEQ ID NO: 2224313 - RNA, 16 nt, Homo sapiens
aaguacugagcaguau

SEQ ID NO: 2224314 - RNA, 20 nt, Homo sapiens
acuccaggauccuccuggag

SEQ ID NO: 2224315 - RNA, 21 nt, Homo sapiens
uugggcaggcagauguuccua

SEQ ID NO: 2224316 - RNA, 19 nt, Homo sapiens
cucagcuaacauuccaugu

SEQ ID NO: 2224317 - RNA, 13 nt, Homo sapiens
cuagacugugaag

SEQ ID NO: 2224318 - RNA, 13 nt, Homo sapiens
ucccugugucagg

SEQ ID NO: 2224319 - RNA, 17 nt, Homo sapiens
gagugagacucgucuca

SEQ ID NO: 2224320 - RNA, 19 nt, Homo sapiens
gccuaugcacauauggacu

SEQ ID NO: 2224321 - RNA, 19 nt, Homo sapiens
cggagcccugucuccucuc

SEQ ID NO: 2224322 - RNA, 11 nt, Homo sapiens
aauggggacag

SEQ ID NO: 2224323 - RNA, 12 nt, Homo sapiens
accucaagccau

SEQ ID NO: 2224324 - RNA, 18 nt, Homo sapiens
cuggaaaaauuccagaag

SEQ ID NO: 2224325 - RNA, 20 nt, Homo sapiens
cuggcauagcuggacaucca

SEQ ID NO: 2224326 - RNA, 13 nt, Homo sapiens
aauuguccguguu

SEQ ID NO: 2224327 - RNA, 14 nt, Homo sapiens
cuuuauguaucucu

SEQ ID NO: 2224328 - RNA, 16 nt, Homo sapiens
gaagaacuugucccuc

SEQ ID NO: 2224329 - RNA, 20 nt, Homo sapiens
ucccugggccugcugcugag

SEQ ID NO: 2224330 - RNA, 20 nt, Homo sapiens
cacuucugggucaugcacug

SEQ ID NO: 2224331 - RNA, 21 nt, Homo sapiens
cagauuacuccuuccuuccaa

SEQ ID NO: 2224332 - RNA, 15 nt, Homo sapiens
cagccugucuucaga

SEQ ID NO: 2224333 - RNA, 15 nt, Homo sapiens
cccucagguguagcu

SEQ ID NO: 2224334 - RNA, 21 nt, Homo sapiens
gcaguucccaaggacagucag

SEQ ID NO: 2224335 - RNA, 14 nt, Homo sapiens
guagacugugccag

SEQ ID NO: 2224336 - RNA, 22 nt, Homo sapiens
uacccaaaacccugaagccauu

SEQ ID NO: 2224337 - RNA, 18 nt, Homo sapiens
gaaccgcaauaugggagg

SEQ ID NO: 2224338 - RNA, 21 nt, Homo sapiens
agugcaggcuggcaccgccuu

SEQ ID NO: 2224339 - RNA, 18 nt, Homo sapiens
cgccuuaugagaacaugg

SEQ ID NO: 2224340 - RNA, 17 nt, Homo sapiens
ucuuuuuucaacuggcu

SEQ ID NO: 2224341 - RNA, 18 nt, Homo sapiens
ucauacuaaacuucaccu

SEQ ID NO: 2224342 - RNA, 13 nt, Homo sapiens
caaagacugcagu

SEQ ID NO: 2224343 - RNA, 12 nt, Homo sapiens
auuugaauuaga

SEQ ID NO: 2224344 - RNA, 14 nt, Homo sapiens
ucugucccuaggug

SEQ ID NO: 2224345 - RNA, 17 nt, Homo sapiens
ugcccugaggcacugaa

SEQ ID NO: 2224346 - RNA, 18 nt, Homo sapiens
cugagacagcaccacugc

SEQ ID NO: 2224347 - RNA, 20 nt, Homo sapiens
uucugggaaaggugcucaaa

SEQ ID NO: 2224348 - RNA, 19 nt, Homo sapiens
ucaguaacaaguauuggga

SEQ ID NO: 2224349 - RNA, 16 nt, Homo sapiens
aagcacuuugugcugu

SEQ ID NO: 2224350 - RNA, 14 nt, Homo sapiens
uaagcacagacaau

SEQ ID NO: 2224351 - RNA, 13 nt, Homo sapiens
ccacccuggagac

SEQ ID NO: 2224352 - RNA, 22 nt, Homo sapiens
ugugacuuuuuagccagugacu

SEQ ID NO: 2224353 - RNA, 16 nt, Homo sapiens
auuuuuuaaggcaaua

SEQ ID NO: 2224354 - RNA, 19 nt, Homo sapiens
caugacgaagacgccaaaa

SEQ ID NO: 2224355 - RNA, 17 nt, Homo sapiens
aaaagaauaguugccaa

SEQ ID NO: 2224356 - RNA, 16 nt, Homo sapiens
gagcacacuuggccca

SEQ ID NO: 2224357 - RNA, 11 nt, Homo sapiens
aagacugacca

SEQ ID NO: 2224358 - RNA, 15 nt, Homo sapiens
uuauuccuccaggaa

SEQ ID NO: 2224359 - RNA, 19 nt, Homo sapiens
ucuuugaauuauaugucua

SEQ ID NO: 2224360 - RNA, 17 nt, Homo sapiens
gcucguuuggcuuuaua

SEQ ID NO: 2224361 - RNA, 13 nt, Homo sapiens
guaaggagcuaaa

SEQ ID NO: 2224362 - RNA, 16 nt, Homo sapiens
ccaagucucagaagag

SEQ ID NO: 2224363 - RNA, 13 nt, Homo sapiens
aaaucuaccuguu

SEQ ID NO: 2224364 - RNA, 15 nt, Homo sapiens
aagacuacuauacaa

SEQ ID NO: 2224365 - RNA, 12 nt, Homo sapiens
cagugucauuua

SEQ ID NO: 2224366 - RNA, 12 nt, Homo sapiens
uagugucacuua

SEQ ID NO: 2224367 - RNA, 21 nt, Homo sapiens
aggugaggauuccaaaaacau

SEQ ID NO: 2224368 - RNA, 12 nt, Homo sapiens
uacacacuuuau

SEQ ID NO: 2224369 - RNA, 12 nt, Homo sapiens
aucucacuaaaa

SEQ ID NO: 2224370 - RNA, 19 nt, Homo sapiens
cacuaguccauaagcuuua

SEQ ID NO: 2224371 - RNA, 19 nt, Homo sapiens
ggaagcccaggagccucac

SEQ ID NO: 2224372 - RNA, 19 nt, Homo sapiens
gucuugcuauguugcccaa

SEQ ID NO: 2224373 - RNA, 16 nt, Homo sapiens
uggggacggggcuccc

SEQ ID NO: 2224374 - RNA, 15 nt, Homo sapiens
uguuauuuauugcua

SEQ ID NO: 2224375 - RNA, 12 nt, Homo sapiens
ucacauguccua

SEQ ID NO: 2224376 - RNA, 16 nt, Homo sapiens
ugcugcuccagugcag

SEQ ID NO: 2224377 - RNA, 14 nt, Homo sapiens
acucaaugcaugau

SEQ ID NO: 2224378 - RNA, 23 nt, Homo sapiens
ccggaauccuuggggagcacuug

SEQ ID NO: 2224379 - RNA, 23 nt, Homo sapiens
uguaauucaucagucauuauuag

SEQ ID NO: 2224380 - RNA, 22 nt, Homo sapiens
aacucaguccucucccuuguga

SEQ ID NO: 2224381 - RNA, 18 nt, Homo sapiens
cuguaaugaaacaccuuc

SEQ ID NO: 2224382 - RNA, 15 nt, Homo sapiens
aauggggaucacaga

SEQ ID NO: 2224383 - RNA, 14 nt, Homo sapiens
gauugacuugacuu

SEQ ID NO: 2224384 - RNA, 17 nt, Homo sapiens
uuggcuaguugaaucua

SEQ ID NO: 2224385 - RNA, 21 nt, Homo sapiens
acuuuaucaauuaacugagua

SEQ ID NO: 2224386 - RNA, 16 nt, Homo sapiens
ugugcuucagugccau

SEQ ID NO: 2224387 - RNA, 17 nt, Homo sapiens
caguggcaucaucucag

SEQ ID NO: 2224388 - RNA, 19 nt, Homo sapiens
caguggacucaaaacccau

SEQ ID NO: 2224389 - RNA, 13 nt, Homo sapiens
uaggaaguaggaa

SEQ ID NO: 2224390 - RNA, 17 nt, Homo sapiens
aggaaauaucugugaag

SEQ ID NO: 2224391 - RNA, 14 nt, Homo sapiens
uuaaaaaauaacau

SEQ ID NO: 2224392 - RNA, 13 nt, Homo sapiens
gagccagucucac

SEQ ID NO: 2224393 - RNA, 20 nt, Homo sapiens
cagggcucugugaccaggaa

SEQ ID NO: 2224394 - RNA, 22 nt, Homo sapiens
gucacuuuuuaaaccacuguau

SEQ ID NO: 2224395 - RNA, 16 nt, Homo sapiens
acuauccucuuuggaa

SEQ ID NO: 2224396 - RNA, 18 nt, Homo sapiens
cuacuuugauaugacugu

SEQ ID NO: 2224397 - RNA, 19 nt, Homo sapiens
uccacaaauuauuaaugaa

SEQ ID NO: 2224398 - RNA, 15 nt, Homo sapiens
uccugccaacugauu

SEQ ID NO: 2224399 - RNA, 21 nt, Homo sapiens
ugucaguuuuguacauagcaa

SEQ ID NO: 2224400 - RNA, 22 nt, Homo sapiens
cagguaaaugguaugaucaaua

SEQ ID NO: 2224401 - RNA, 12 nt, Homo sapiens
uaauaucuguga

SEQ ID NO: 2224402 - RNA, 23 nt, Homo sapiens
aucuuguuuuuccacuacugcua

SEQ ID NO: 2224403 - RNA, 16 nt, Homo sapiens
uccugcaacucaagga

SEQ ID NO: 2224404 - RNA, 18 nt, Homo sapiens
aauuuauuuggggggaaa

SEQ ID NO: 2224405 - RNA, 18 nt, Homo sapiens
cgugccguggagcuugga

SEQ ID NO: 2224406 - RNA, 17 nt, Homo sapiens
uauauauggggcuuuag

SEQ ID NO: 2224407 - RNA, 19 nt, Homo sapiens
caggguugagguccagccc

SEQ ID NO: 2224408 - RNA, 13 nt, Homo sapiens
uguucccuuggca

SEQ ID NO: 2224409 - RNA, 19 nt, Homo sapiens
caauuugagauguauuuca

SEQ ID NO: 2224410 - RNA, 16 nt, Homo sapiens
aagucuaaacaaugaa

SEQ ID NO: 2224411 - RNA, 20 nt, Homo sapiens
gccaaauaagauucccauug

SEQ ID NO: 2224412 - RNA, 16 nt, Homo sapiens
ugacacucuccuugca

SEQ ID NO: 2224413 - RNA, 22 nt, Homo sapiens
cccacguggucgccugcauuuc

SEQ ID NO: 2224414 - RNA, 11 nt, Homo sapiens
aguagaacuca

SEQ ID NO: 2224415 - RNA, 19 nt, Homo sapiens
caaaaccccccagauauca

SEQ ID NO: 2224416 - RNA, 12 nt, Homo sapiens
uccuaucugugu

SEQ ID NO: 2224417 - RNA, 12 nt, Homo sapiens
uccaaucuguga

SEQ ID NO: 2224418 - RNA, 20 nt, Homo sapiens
cauuuuccuuaggaaaaaca

SEQ ID NO: 2224419 - RNA, 19 nt, Homo sapiens
aaaauguuuugauggucuu

SEQ ID NO: 2224420 - RNA, 16 nt, Homo sapiens
aggagugaugggcaag

SEQ ID NO: 2224421 - RNA, 17 nt, Homo sapiens
ugaaccauguguggcaa

SEQ ID NO: 2224422 - RNA, 20 nt, Homo sapiens
uacuuucuguuaaaaugcau

SEQ ID NO: 2224423 - RNA, 21 nt, Homo sapiens
uugcaugaauucacaaacaaa

SEQ ID NO: 2224424 - RNA, 13 nt, Homo sapiens
uggccacucuuga

SEQ ID NO: 2224425 - RNA, 15 nt, Homo sapiens
gggcacuaaccccau

SEQ ID NO: 2224426 - RNA, 15 nt, Homo sapiens
uuaaauuaauaucuu

SEQ ID NO: 2224427 - RNA, 15 nt, Homo sapiens
agucuggaaagugau

SEQ ID NO: 2224428 - RNA, 21 nt, Homo sapiens
cagaugugaaaacaucucaau

SEQ ID NO: 2224429 - RNA, 17 nt, Homo sapiens
uaaaggugcugcacugg

SEQ ID NO: 2224430 - RNA, 15 nt, Homo sapiens
acauccucacuuugc

SEQ ID NO: 2224431 - RNA, 15 nt, Homo sapiens
caacucuuugagaaa

SEQ ID NO: 2224432 - RNA, 14 nt, Homo sapiens
auucauuguugauc

SEQ ID NO: 2224433 - RNA, 20 nt, Homo sapiens
gccaaguuuuauaauccuua

SEQ ID NO: 2224434 - RNA, 17 nt, Homo sapiens
uuuggauacgaagacca

SEQ ID NO: 2224435 - RNA, 21 nt, Homo sapiens
uacuauuuuuacuaaucuuuc

SEQ ID NO: 2224436 - RNA, 18 nt, Homo sapiens
aaaauaccuucugaacua

SEQ ID NO: 2224437 - RNA, 16 nt, Homo sapiens
cauauauauuaauacu

SEQ ID NO: 2224438 - RNA, 16 nt, Homo sapiens
acuuugguccucugau

SEQ ID NO: 2224439 - RNA, 13 nt, Homo sapiens
acccuuucugcca

SEQ ID NO: 2224440 - RNA, 17 nt, Homo sapiens
ucacauccaaugcauag

SEQ ID NO: 2224441 - RNA, 17 nt, Homo sapiens
caagucauggacauuca

SEQ ID NO: 2224442 - RNA, 18 nt, Homo sapiens
aagagcauggaugcauuu

SEQ ID NO: 2224443 - RNA, 19 nt, Homo sapiens
acugggcgcaguuggucuu

SEQ ID NO: 2224444 - RNA, 16 nt, Homo sapiens
ucaucgggguggugca

SEQ ID NO: 2224445 - RNA, 17 nt, Homo sapiens
acuuaaaauagucucau

SEQ ID NO: 2224446 - RNA, 13 nt, Homo sapiens
cagcugaaauuga

SEQ ID NO: 2224447 - RNA, 14 nt, Homo sapiens
augagcuauuucca

SEQ ID NO: 2224448 - RNA, 15 nt, Homo sapiens
ucccacggggucccc

SEQ ID NO: 2224449 - RNA, 15 nt, Homo sapiens
gaugcccaguaucau

SEQ ID NO: 2224450 - RNA, 16 nt, Homo sapiens
uuccucagcugugugg

SEQ ID NO: 2224451 - RNA, 21 nt, Homo sapiens
uuagucuguagaaucuagcca

SEQ ID NO: 2224452 - RNA, 16 nt, Homo sapiens
uuaccuuaaaugcuga

SEQ ID NO: 2224453 - RNA, 22 nt, Homo sapiens
uugauguacauaacuccugucc

SEQ ID NO: 2224454 - RNA, 17 nt, Homo sapiens
ugagugaaucaccugug

SEQ ID NO: 2224455 - RNA, 16 nt, Homo sapiens
gauucagcccucagaa

SEQ ID NO: 2224456 - RNA, 16 nt, Homo sapiens
aauaaaaagugaacuu

SEQ ID NO: 2224457 - RNA, 23 nt, Homo sapiens
caccuaugagugagaauaugugg

SEQ ID NO: 2224458 - RNA, 22 nt, Homo sapiens
cuagauggauauuagaugcccg

SEQ ID NO: 2224459 - RNA, 14 nt, Homo sapiens
ucacugcaguagca

SEQ ID NO: 2224460 - RNA, 12 nt, Homo sapiens
uucaaaagaagu

SEQ ID NO: 2224461 - RNA, 17 nt, Homo sapiens
uuguaaagaaauuuacu

SEQ ID NO: 2224462 - RNA, 21 nt, Homo sapiens
ccugggucuuucaugggguga

SEQ ID NO: 2224463 - RNA, 15 nt, Homo sapiens
cuagguagaaaaagg

SEQ ID NO: 2224464 - RNA, 22 nt, Homo sapiens
auuaaaccuuucaguacucuua

SEQ ID NO: 2224465 - RNA, 16 nt, Homo sapiens
uuccucuuuguuggaa

SEQ ID NO: 2224466 - RNA, 20 nt, Homo sapiens
ccaccuguugaucuaagggg

SEQ ID NO: 2224467 - RNA, 20 nt, Homo sapiens
cucuucagccauaguggauc

SEQ ID NO: 2224468 - RNA, 20 nt, Homo sapiens
caccuguagucccagcacuu

SEQ ID NO: 2224469 - RNA, 13 nt, Homo sapiens
uuagacuugaaau

SEQ ID NO: 2224470 - RNA, 14 nt, Homo sapiens
gcaaaaaauacccu

SEQ ID NO: 2224471 - RNA, 16 nt, Homo sapiens
aaagaaugaaacaauc

SEQ ID NO: 2224472 - RNA, 19 nt, Homo sapiens
ggggaggaggaacgggcag

SEQ ID NO: 2224473 - RNA, 11 nt, Homo sapiens
ggagcacuuuc

SEQ ID NO: 2224474 - RNA, 22 nt, Homo sapiens
cuuaaaugcuacugaaacuuac

SEQ ID NO: 2224475 - RNA, 22 nt, Homo sapiens
gauauaugcucugcauguuaca

SEQ ID NO: 2224476 - RNA, 21 nt, Homo sapiens
ugucugcaccaaugcuaauaa

SEQ ID NO: 2224477 - RNA, 18 nt, Homo sapiens
gacaaaucuuuaagaaua

SEQ ID NO: 2224478 - RNA, 19 nt, Homo sapiens
guagcucuggaccugucuc

SEQ ID NO: 2224479 - RNA, 15 nt, Homo sapiens
ucagacagaacuuga

SEQ ID NO: 2224480 - RNA, 21 nt, Homo sapiens
caugacucuuuauugucugua

SEQ ID NO: 2224481 - RNA, 19 nt, Homo sapiens
aauuaugacugcugaauca

SEQ ID NO: 2224482 - RNA, 17 nt, Homo sapiens
uuccuacccuuccucac

SEQ ID NO: 2224483 - RNA, 12 nt, Homo sapiens
uaaagcuuuaua

SEQ ID NO: 2224484 - RNA, 18 nt, Homo sapiens
ccccaucauguggcccaa

SEQ ID NO: 2224485 - RNA, 23 nt, Homo sapiens
auauauuuccacuucuucauucu

SEQ ID NO: 2224486 - RNA, 14 nt, Homo sapiens
ucaaaaccuuucaa

SEQ ID NO: 2224487 - RNA, 20 nt, Homo sapiens
cuaugugggugggaccacag

SEQ ID NO: 2224488 - RNA, 21 nt, Homo sapiens
aaacuucauauguaaucucua

SEQ ID NO: 2224489 - RNA, 22 nt, Homo sapiens
aaagagaacaccuccagcuuuu

SEQ ID NO: 2224490 - RNA, 18 nt, Homo sapiens
acucacuuucuagauuaa

SEQ ID NO: 2224491 - RNA, 20 nt, Homo sapiens
cuaagaucucgguuugccaa

SEQ ID NO: 2224492 - RNA, 13 nt, Homo sapiens
gaggccuauaaug

SEQ ID NO: 2224493 - RNA, 12 nt, Homo sapiens
gucagaguauaa

SEQ ID NO: 2224494 - RNA, 11 nt, Homo sapiens
uggaagacagc

SEQ ID NO: 2224495 - RNA, 16 nt, Homo sapiens
ucauucuuugaaggau

SEQ ID NO: 2224496 - RNA, 22 nt, Homo sapiens
gggcuugcuauaguguccaggc

SEQ ID NO: 2224497 - RNA, 20 nt, Homo sapiens
ccccauaucuuuaaagugug

SEQ ID NO: 2224498 - RNA, 20 nt, Homo sapiens
cacucuaauauaauauggau

SEQ ID NO: 2224499 - RNA, 15 nt, Homo sapiens
uccccuguccuguga

SEQ ID NO: 2224500 - RNA, 17 nt, Homo sapiens
agaaaaauauauacuaa

SEQ ID NO: 2224501 - RNA, 17 nt, Homo sapiens
auuacacuccagccuga

SEQ ID NO: 2224502 - RNA, 19 nt, Homo sapiens
agugugauuuuuuucacau

SEQ ID NO: 2224503 - RNA, 20 nt, Homo sapiens
aaucauacuuugccaaauag

SEQ ID NO: 2224504 - RNA, 22 nt, Homo sapiens
aggucucauuaucuccaugaua

SEQ ID NO: 2224505 - RNA, 20 nt, Homo sapiens
ucaaaaauacucacauggcu

SEQ ID NO: 2224506 - RNA, 16 nt, Homo sapiens
ucuaucaaaugugaug

SEQ ID NO: 2224507 - RNA, 19 nt, Homo sapiens
uggccaagggccagacaga

SEQ ID NO: 2224508 - RNA, 15 nt, Homo sapiens
gccagauuaggccug

SEQ ID NO: 2224509 - RNA, 23 nt, Homo sapiens
agcucaaugaugcaggcaauaaa

SEQ ID NO: 2224510 - RNA, 20 nt, Homo sapiens
uuuggaaauucagacuugau

SEQ ID NO: 2224511 - RNA, 16 nt, Homo sapiens
agcauuccuauugaca

SEQ ID NO: 2224512 - RNA, 18 nt, Homo sapiens
augugaagucucugggug

SEQ ID NO: 2224513 - RNA, 23 nt, Homo sapiens
auugaaauuuuuaaaucauuuca

SEQ ID NO: 2224514 - RNA, 18 nt, Homo sapiens
aaggggagaguaacccug

SEQ ID NO: 2224515 - RNA, 15 nt, Homo sapiens
uccucuaauaugccu

SEQ ID NO: 2224516 - RNA, 20 nt, Homo sapiens
cuucagguucucaugauacc

SEQ ID NO: 2224517 - RNA, 23 nt, Homo sapiens
acacuguccaugaagcacugagc

SEQ ID NO: 2224518 - RNA, 15 nt, Homo sapiens
ugcuuugcaaauuca

SEQ ID NO: 2224519 - RNA, 15 nt, Homo sapiens
gucuuuuauauuugu

SEQ ID NO: 2224520 - RNA, 13 nt, Homo sapiens
uuucucucuggcc

SEQ ID NO: 2224521 - RNA, 19 nt, Homo sapiens
cacaguucuccauuucacu

SEQ ID NO: 2224522 - RNA, 14 nt, Homo sapiens
accucaauauuuac

SEQ ID NO: 2224523 - RNA, 24 nt, Homo sapiens
uggcauggagaaugcaccauacuc

SEQ ID NO: 2224524 - RNA, 17 nt, Homo sapiens
auacacucaagugccau

SEQ ID NO: 2224525 - RNA, 17 nt, Homo sapiens
uuacacucuagugccau

SEQ ID NO: 2224526 - RNA, 17 nt, Homo sapiens
aauaguaaugugaugcu

SEQ ID NO: 2224527 - RNA, 15 nt, Homo sapiens
uuagagauacuguug

SEQ ID NO: 2224528 - RNA, 21 nt, Homo sapiens
aucccuggguucaacucugcu

SEQ ID NO: 2224529 - RNA, 20 nt, Homo sapiens
agcucaggugacaaccauua

SEQ ID NO: 2224530 - RNA, 23 nt, Homo sapiens
ugaauuuuaaauuaaagcaaagu

SEQ ID NO: 2224531 - RNA, 14 nt, Homo sapiens
ugaaaagaguaugu

SEQ ID NO: 2224532 - RNA, 14 nt, Homo sapiens
aagaaagauuacuu

SEQ ID NO: 2224533 - RNA, 21 nt, Homo sapiens
ccagggagcugcaggggcaug

SEQ ID NO: 2224534 - RNA, 14 nt, Homo sapiens
aggagaaaggcaug

SEQ ID NO: 2224535 - RNA, 16 nt, Homo sapiens
cuuaauucacucccac

SEQ ID NO: 2224536 - RNA, 13 nt, Homo sapiens
ccugaaccuuccu

SEQ ID NO: 2224537 - RNA, 18 nt, Homo sapiens
cuaaagacuaacuugaaa

SEQ ID NO: 2224538 - RNA, 15 nt, Homo sapiens
uacccagggccugca

SEQ ID NO: 2224539 - RNA, 15 nt, Homo sapiens
caaucagagagcuca

SEQ ID NO: 2224540 - RNA, 16 nt, Homo sapiens
ucauuguaaaaagccc

SEQ ID NO: 2224541 - RNA, 23 nt, Homo sapiens
agaaagacuauucaaacagucuc

SEQ ID NO: 2224542 - RNA, 23 nt, Homo sapiens
ccagggauggccccuagccacag

SEQ ID NO: 2224543 - RNA, 17 nt, Homo sapiens
acacagugcaucucaga

SEQ ID NO: 2224544 - RNA, 18 nt, Homo sapiens
cuugagcccagagugaac

SEQ ID NO: 2224545 - RNA, 15 nt, Homo sapiens
aucugugaacauguu

SEQ ID NO: 2224546 - RNA, 21 nt, Homo sapiens
cccuguccuaagcacuuuaua

SEQ ID NO: 2224547 - RNA, 20 nt, Homo sapiens
ucaccccagccucacuccau

SEQ ID NO: 2224548 - RNA, 13 nt, Homo sapiens
caugccucugagg

SEQ ID NO: 2224549 - RNA, 20 nt, Homo sapiens
auuugaguuuaggguucugg

SEQ ID NO: 2224550 - RNA, 22 nt, Homo sapiens
aaaauacuuuugcuuucaggga

SEQ ID NO: 2224551 - RNA, 9 nt, Homo sapiens
ccaguggga

SEQ ID NO: 2224552 - RNA, 15 nt, Homo sapiens
uaaaaacauugccuu

SEQ ID NO: 2224553 - RNA, 15 nt, Homo sapiens
ucauggccaccucca

SEQ ID NO: 2224554 - RNA, 18 nt, Homo sapiens
aagaucacagugaacuua

SEQ ID NO: 2224555 - RNA, 16 nt, Homo sapiens
ugccuaaauauaauua

SEQ ID NO: 2224556 - RNA, 17 nt, Homo sapiens
ugaagguggggccagug

SEQ ID NO: 2224557 - RNA, 13 nt, Homo sapiens
gauacaugucuuu

SEQ ID NO: 2224558 - RNA, 23 nt, Homo sapiens
uccauuucuuuuacucuguguaa

SEQ ID NO: 2224559 - RNA, 22 nt, Homo sapiens
aauuuaggaaugcucaaugugc

SEQ ID NO: 2224560 - RNA, 17 nt, Homo sapiens
aacuaagacauaugcau

SEQ ID NO: 2224561 - RNA, 20 nt, Homo sapiens
cuuuauugcccuaacaauuu

SEQ ID NO: 2224562 - RNA, 20 nt, Homo sapiens
caaaaaugaaauccagugag

SEQ ID NO: 2224563 - RNA, 15 nt, Homo sapiens
cucaccaacuuuuaa

SEQ ID NO: 2224564 - RNA, 20 nt, Homo sapiens
aaugugaauaaguaaagaau

SEQ ID NO: 2224565 - RNA, 21 nt, Homo sapiens
caaaucauacuuucucuucaa

SEQ ID NO: 2224566 - RNA, 21 nt, Homo sapiens
auauuuuccaucuuauuccca

SEQ ID NO: 2224567 - RNA, 21 nt, Homo sapiens
cugcucccugcacccaugaca

SEQ ID NO: 2224568 - RNA, 14 nt, Homo sapiens
uuaaauuacaauuu

SEQ ID NO: 2224569 - RNA, 16 nt, Homo sapiens
ugcagaaacuacugac

SEQ ID NO: 2224570 - RNA, 14 nt, Homo sapiens
caccucaggagcuu

SEQ ID NO: 2224571 - RNA, 15 nt, Homo sapiens
uaugaaugaaauucu

SEQ ID NO: 2224572 - RNA, 23 nt, Homo sapiens
cacuuauaagaaagaucaaagac

SEQ ID NO: 2224573 - RNA, 15 nt, Homo sapiens
cauaaugaacacuca

SEQ ID NO: 2224574 - RNA, 14 nt, Homo sapiens
aggcagcuagccag

SEQ ID NO: 2224575 - RNA, 14 nt, Homo sapiens
gagccccugacccc

SEQ ID NO: 2224576 - RNA, 15 nt, Homo sapiens
accaaaaaugaugcg

SEQ ID NO: 2224577 - RNA, 19 nt, Homo sapiens
ggaaaaaaagacugaugaa

SEQ ID NO: 2224578 - RNA, 14 nt, Homo sapiens
ccuuccacugccuc

SEQ ID NO: 2224579 - RNA, 21 nt, Homo sapiens
gaaccaaggcagccuccagag

SEQ ID NO: 2224580 - RNA, 15 nt, Homo sapiens
ugauuucagcacauu

SEQ ID NO: 2224581 - RNA, 17 nt, Homo sapiens
ucauuucaaauacaucu

SEQ ID NO: 2224582 - RNA, 20 nt, Homo sapiens
ucagucaauaaauuugcaaa

SEQ ID NO: 2224583 - RNA, 19 nt, Homo sapiens
aggccacugcccacccugg

SEQ ID NO: 2224584 - RNA, 16 nt, Homo sapiens
gcugagcugaacccau

SEQ ID NO: 2224585 - RNA, 21 nt, Homo sapiens
ucaauuuucacaucaaagaca

SEQ ID NO: 2224586 - RNA, 12 nt, Homo sapiens
ccugcuucucag

SEQ ID NO: 2224587 - RNA, 13 nt, Homo sapiens
ugggagacuggaa

SEQ ID NO: 2224588 - RNA, 13 nt, Homo sapiens
agggagacaggaa

SEQ ID NO: 2224589 - RNA, 21 nt, Homo sapiens
aaaugauaucuuauuucuaca

SEQ ID NO: 2224590 - RNA, 22 nt, Homo sapiens
ggaggccagugaaagcugacau

SEQ ID NO: 2224591 - RNA, 18 nt, Homo sapiens
uuccaagugcuacucuca

SEQ ID NO: 2224592 - RNA, 22 nt, Homo sapiens
uccaagucuuccugaccaccuu

SEQ ID NO: 2224593 - RNA, 16 nt, Homo sapiens
uuccccuuccacugag

SEQ ID NO: 2224594 - RNA, 16 nt, Homo sapiens
agcugcugcacagcug

SEQ ID NO: 2224595 - RNA, 19 nt, Homo sapiens
caagacuuagagcugggaa

SEQ ID NO: 2224596 - RNA, 22 nt, Homo sapiens
uccugauucauauuuaauuuga

SEQ ID NO: 2224597 - RNA, 12 nt, Homo sapiens
ccugauuucccu

SEQ ID NO: 2224598 - RNA, 21 nt, Homo sapiens
aaagcggacaucagcugguca

SEQ ID NO: 2224599 - RNA, 22 nt, Homo sapiens
gaacacagccugggaccagggc

SEQ ID NO: 2224600 - RNA, 18 nt, Homo sapiens
ucgaagcuguucucugcu

SEQ ID NO: 2224601 - RNA, 12 nt, Homo sapiens
uucugugcaaaa

SEQ ID NO: 2224602 - RNA, 17 nt, Homo sapiens
cagauccugggcaugau

SEQ ID NO: 2224603 - RNA, 19 nt, Homo sapiens
uccaggaauaggcauuugc

SEQ ID NO: 2224604 - RNA, 19 nt, Homo sapiens
aguuagguuaauaaaucaa

SEQ ID NO: 2224605 - RNA, 17 nt, Homo sapiens
auugaaacccuccaaau

SEQ ID NO: 2224606 - RNA, 15 nt, Homo sapiens
aguggggugaucuca

SEQ ID NO: 2224607 - RNA, 23 nt, Homo sapiens
agacagauggacacugccaagag

SEQ ID NO: 2224608 - RNA, 13 nt, Homo sapiens
acuuucacugaau

SEQ ID NO: 2224609 - RNA, 13 nt, Homo sapiens
ucaaacacaguua

SEQ ID NO: 2224610 - RNA, 14 nt, Homo sapiens
aauaauaugaagca

SEQ ID NO: 2224611 - RNA, 16 nt, Homo sapiens
ucccaaauuugauuga

SEQ ID NO: 2224612 - RNA, 14 nt, Homo sapiens
gcaauaaugucaac

SEQ ID NO: 2224613 - RNA, 18 nt, Homo sapiens
accaucagcugcuuuuaa

SEQ ID NO: 2224614 - RNA, 20 nt, Homo sapiens
gcuugauuguuuuggucuca

SEQ ID NO: 2224615 - RNA, 16 nt, Homo sapiens
uuuaaugauaaguaaa

SEQ ID NO: 2224616 - RNA, 19 nt, Homo sapiens
cagaccgccgucuaacuca

SEQ ID NO: 2224617 - RNA, 21 nt, Homo sapiens
ccuacauguauugcacauugu

SEQ ID NO: 2224618 - RNA, 14 nt, Homo sapiens
agaugaucaucucc

SEQ ID NO: 2224619 - RNA, 15 nt, Homo sapiens
acaaugaaguugaaa

SEQ ID NO: 2224620 - RNA, 21 nt, Homo sapiens
ugggcagcccaacagcacuuu

SEQ ID NO: 2224621 - RNA, 19 nt, Homo sapiens
aucuuuguagacuguuccu

SEQ ID NO: 2224622 - RNA, 15 nt, Homo sapiens
cuuaaaguuguaaca

SEQ ID NO: 2224623 - RNA, 18 nt, Homo sapiens
uaaacauugugaugauua

SEQ ID NO: 2224624 - RNA, 13 nt, Homo sapiens
ccugaagcuggcc

SEQ ID NO: 2224625 - RNA, 13 nt, Homo sapiens
aaaaccuauucca

SEQ ID NO: 2224626 - RNA, 18 nt, Homo sapiens
aaugagcacccauuccaa

SEQ ID NO: 2224627 - RNA, 16 nt, Homo sapiens
ccaccuccacaccagg

SEQ ID NO: 2224628 - RNA, 19 nt, Homo sapiens
auuuugugguuccuucccu

SEQ ID NO: 2224629 - RNA, 21 nt, Homo sapiens
cauagcacaagauaaauugag

SEQ ID NO: 2224630 - RNA, 18 nt, Homo sapiens
gcagauccagagguuucu

SEQ ID NO: 2224631 - RNA, 23 nt, Homo sapiens
uugcauuuaauuuauugaggcuu

SEQ ID NO: 2224632 - RNA, 20 nt, Homo sapiens
auuuagcccuaaaaugacaa

SEQ ID NO: 2224633 - RNA, 11 nt, Homo sapiens
cuguugcuuga

SEQ ID NO: 2224634 - RNA, 16 nt, Homo sapiens
cauuaaagagccaguu

SEQ ID NO: 2224635 - RNA, 23 nt, Homo sapiens
caccuggcucuguggcgagccau

SEQ ID NO: 2224636 - RNA, 21 nt, Homo sapiens
uuucuacuugccagcagagua

SEQ ID NO: 2224637 - RNA, 17 nt, Homo sapiens
ucuaagcuuuucauuaa

SEQ ID NO: 2224638 - RNA, 16 nt, Homo sapiens
ccccaccuucuuggga

SEQ ID NO: 2224639 - RNA, 20 nt, Homo sapiens
uuuccucaugugaucacaau

SEQ ID NO: 2224640 - RNA, 20 nt, Homo sapiens
cuuagagaaccuauagcauc

SEQ ID NO: 2224641 - RNA, 16 nt, Homo sapiens
ggcagagccagugugc

SEQ ID NO: 2224642 - RNA, 13 nt, Homo sapiens
ucugcugcugaua

SEQ ID NO: 2224643 - RNA, 19 nt, Homo sapiens
gcacacuuuuccacauucc

SEQ ID NO: 2224644 - RNA, 17 nt, Homo sapiens
ccuuugauuuuuugccc

SEQ ID NO: 2224645 - RNA, 17 nt, Homo sapiens
cccaaguagcugggauu

SEQ ID NO: 2224646 - RNA, 19 nt, Homo sapiens
cugggugaccucacuuuag

SEQ ID NO: 2224647 - RNA, 14 nt, Homo sapiens
uaaauuaacauuau

SEQ ID NO: 2224648 - RNA, 20 nt, Homo sapiens
cucugaacuaggugaucuca

SEQ ID NO: 2224649 - RNA, 19 nt, Homo sapiens
gcuucaaggcccucagaga

SEQ ID NO: 2224650 - RNA, 20 nt, Homo sapiens
cagauuaagaguugccaaaa

SEQ ID NO: 2224651 - RNA, 16 nt, Homo sapiens
agcugguacugauguu

SEQ ID NO: 2224652 - RNA, 13 nt, Homo sapiens
gcaucuugcauua

SEQ ID NO: 2224653 - RNA, 22 nt, Homo sapiens
ucaaaguucugggacuacaggc

SEQ ID NO: 2224654 - RNA, 14 nt, Homo sapiens
ugucccucugcuac

SEQ ID NO: 2224655 - RNA, 16 nt, Homo sapiens
cuccggccugaugaca

SEQ ID NO: 2224656 - RNA, 13 nt, Homo sapiens
ucuuuaaggcaua

SEQ ID NO: 2224657 - RNA, 22 nt, Homo sapiens
uccaauugaacuuucacauagc

SEQ ID NO: 2224658 - RNA, 16 nt, Homo sapiens
agcauguugauucuag

SEQ ID NO: 2224659 - RNA, 23 nt, Homo sapiens
cuuuauuauggucauauuucaca

SEQ ID NO: 2224660 - RNA, 19 nt, Homo sapiens
ucguaggggauguggagug

SEQ ID NO: 2224661 - RNA, 21 nt, Homo sapiens
uugcaaggcaaagacuauucc

SEQ ID NO: 2224662 - RNA, 23 nt, Homo sapiens
cacagugugaaucuuggugucua

SEQ ID NO: 2224663 - RNA, 17 nt, Homo sapiens
cagcugccccaauguga

SEQ ID NO: 2224664 - RNA, 14 nt, Homo sapiens
cacuacaacauaug

SEQ ID NO: 2224665 - RNA, 13 nt, Homo sapiens
aucauccaagaca

SEQ ID NO: 2224666 - RNA, 19 nt, Homo sapiens
aauaugguuugaagugaau

SEQ ID NO: 2224667 - RNA, 22 nt, Homo sapiens
acccagccucuagaacagccag

SEQ ID NO: 2224668 - RNA, 15 nt, Homo sapiens
ucaacucuccuccag

SEQ ID NO: 2224669 - RNA, 13 nt, Homo sapiens
cucaacaccagac

SEQ ID NO: 2224670 - RNA, 23 nt, Homo sapiens
aucuccccucucaccucauuccc

SEQ ID NO: 2224671 - RNA, 20 nt, Homo sapiens
aaacuccugggcucaaguga

SEQ ID NO: 2224672 - RNA, 23 nt, Homo sapiens
ugcccaauaagcagaagccauaa

SEQ ID NO: 2224673 - RNA, 11 nt, Homo sapiens
uugcuacugac

SEQ ID NO: 2224674 - RNA, 16 nt, Homo sapiens
auugcauuugcuguug

SEQ ID NO: 2224675 - RNA, 19 nt, Homo sapiens
gucuuuauuaguaacauca

SEQ ID NO: 2224676 - RNA, 14 nt, Homo sapiens
gcauucuagugcag

SEQ ID NO: 2224677 - RNA, 20 nt, Homo sapiens
guaucacacaguauaugaug

SEQ ID NO: 2224678 - RNA, 16 nt, Homo sapiens
agauuugaagacaaaa

SEQ ID NO: 2224679 - RNA, 21 nt, Homo sapiens
auacucuuuuuacaauccaua

SEQ ID NO: 2224680 - RNA, 23 nt, Homo sapiens
ucuauagguuuuuaaauggaauu

SEQ ID NO: 2224681 - RNA, 18 nt, Homo sapiens
acuuucauucccuuucau

SEQ ID NO: 2224682 - RNA, 21 nt, Homo sapiens
auucagacaacauuaugaucu

SEQ ID NO: 2224683 - RNA, 22 nt, Homo sapiens
agaagcccccaccuucccucca

SEQ ID NO: 2224684 - RNA, 13 nt, Homo sapiens
gaccuauuuccag

SEQ ID NO: 2224685 - RNA, 19 nt, Homo sapiens
ccaauuucucuuuacuuga

SEQ ID NO: 2224686 - RNA, 21 nt, Homo sapiens
augagaguuuuggaugcagug

SEQ ID NO: 2224687 - RNA, 14 nt, Homo sapiens
agaacuuugugcca

SEQ ID NO: 2224688 - RNA, 17 nt, Homo sapiens
gaaccagagcucagaga

SEQ ID NO: 2224689 - RNA, 19 nt, Homo sapiens
guuuauaucaaaugagcau

SEQ ID NO: 2224690 - RNA, 19 nt, Homo sapiens
aaaggacucuugagcccuc

SEQ ID NO: 2224691 - RNA, 17 nt, Homo sapiens
cugugauucgguggaga

SEQ ID NO: 2224692 - RNA, 18 nt, Homo sapiens
uucuauucucuuuuacug

SEQ ID NO: 2224693 - RNA, 22 nt, Homo sapiens
gauaacaugcuuuggguggaau

SEQ ID NO: 2224694 - RNA, 21 nt, Homo sapiens
acaucuccuguggucucugac

SEQ ID NO: 2224695 - RNA, 18 nt, Homo sapiens
uacuuugaguaaacuuac

SEQ ID NO: 2224696 - RNA, 19 nt, Homo sapiens
caagagugaauucccucac

SEQ ID NO: 2224697 - RNA, 18 nt, Homo sapiens
ucugcacucuuguacaaa

SEQ ID NO: 2224698 - RNA, 20 nt, Homo sapiens
caguauggccccaccugcuc

SEQ ID NO: 2224699 - RNA, 15 nt, Homo sapiens
acauuuaguccugua

SEQ ID NO: 2224700 - RNA, 23 nt, Homo sapiens
cagagagggucacugggggacac

SEQ ID NO: 2224701 - RNA, 12 nt, Homo sapiens
auaugcaaugug

SEQ ID NO: 2224702 - RNA, 13 nt, Homo sapiens
uuaauguggcaag

SEQ ID NO: 2224703 - RNA, 21 nt, Homo sapiens
cagcuuauuuuuuucuacaua

SEQ ID NO: 2224704 - RNA, 16 nt, Homo sapiens
gaucccgugugccacc

SEQ ID NO: 2224705 - RNA, 20 nt, Homo sapiens
accaucugccaaugccauga

SEQ ID NO: 2224706 - RNA, 23 nt, Homo sapiens
agucuucucuuugaagaauuuaa

SEQ ID NO: 2224707 - RNA, 18 nt, Homo sapiens
ucauuacagggcacaggc

SEQ ID NO: 2224708 - RNA, 13 nt, Homo sapiens
auuaaaagaaucc

SEQ ID NO: 2224709 - RNA, 20 nt, Homo sapiens
ucuccaggauugaagagcau

SEQ ID NO: 2224710 - RNA, 15 nt, Homo sapiens
cagaaaacagagccu

SEQ ID NO: 2224711 - RNA, 22 nt, Homo sapiens
ugcccagggcugcgucugcaaa

SEQ ID NO: 2224712 - RNA, 17 nt, Homo sapiens
uaggagauagaagaaga

SEQ ID NO: 2224713 - RNA, 18 nt, Homo sapiens
guucucaucuuucuugau

SEQ ID NO: 2224714 - RNA, 23 nt, Homo sapiens
auuccagcuccuccgugcuuccu

SEQ ID NO: 2224715 - RNA, 20 nt, Homo sapiens
auuccuaagcagugcuugua

SEQ ID NO: 2224716 - RNA, 16 nt, Homo sapiens
accucugagaccaaaa

SEQ ID NO: 2224717 - RNA, 16 nt, Homo sapiens
guuggaccuauugcca

SEQ ID NO: 2224718 - RNA, 16 nt, Homo sapiens
ggcuccaucaccagcc

SEQ ID NO: 2224719 - RNA, 12 nt, Homo sapiens
gaaagacaguaa

SEQ ID NO: 2224720 - RNA, 20 nt, Homo sapiens
acuucacuaaugaucacauu

SEQ ID NO: 2224721 - RNA, 11 nt, Homo sapiens
ugagcccuuca

SEQ ID NO: 2224722 - RNA, 17 nt, Homo sapiens
uuugccagugccucuca

SEQ ID NO: 2224723 - RNA, 16 nt, Homo sapiens
cccucagacccaggag

SEQ ID NO: 2224724 - RNA, 19 nt, Homo sapiens
gagaauuaggaaggccaug

SEQ ID NO: 2224725 - RNA, 20 nt, Homo sapiens
acaucccagacacauucaca

SEQ ID NO: 2224726 - RNA, 17 nt, Homo sapiens
ucucuucccaccuguca

SEQ ID NO: 2224727 - RNA, 14 nt, Homo sapiens
cuugcuauauugcc

SEQ ID NO: 2224728 - RNA, 17 nt, Homo sapiens
gaacuuugucacaucua

SEQ ID NO: 2224729 - RNA, 16 nt, Homo sapiens
cucaaugaaugaacaa

SEQ ID NO: 2224730 - RNA, 22 nt, Homo sapiens
aggcuguugaaucaaagugauu

SEQ ID NO: 2224731 - RNA, 22 nt, Homo sapiens
ggacgcugccgggagacugcca

SEQ ID NO: 2224732 - RNA, 17 nt, Homo sapiens
ggaagacgugaugccag

SEQ ID NO: 2224733 - RNA, 17 nt, Homo sapiens
uuuuccuauuuacaugu

SEQ ID NO: 2224734 - RNA, 18 nt, Homo sapiens
augaauaccuuuguucaa

SEQ ID NO: 2224735 - RNA, 15 nt, Homo sapiens
agagcgugcuccagc

SEQ ID NO: 2224736 - RNA, 16 nt, Homo sapiens
auguaccacauaacaa

SEQ ID NO: 2224737 - RNA, 16 nt, Homo sapiens
gaaacucugucacucc

SEQ ID NO: 2224738 - RNA, 15 nt, Homo sapiens
aaugugcaaccacug

SEQ ID NO: 2224739 - RNA, 12 nt, Homo sapiens
aaugcauucccu

SEQ ID NO: 2224740 - RNA, 22 nt, Homo sapiens
uucauaauaaauagacacuuga

SEQ ID NO: 2224741 - RNA, 19 nt, Homo sapiens
agugccuggccaaagggau

SEQ ID NO: 2224742 - RNA, 15 nt, Homo sapiens
aaauuacacacuugc

SEQ ID NO: 2224743 - RNA, 20 nt, Homo sapiens
ccgcuggugcccaccagcug

SEQ ID NO: 2224744 - RNA, 14 nt, Homo sapiens
ccacugucuuucaa

SEQ ID NO: 2224745 - RNA, 22 nt, Homo sapiens
uccucuuggccucagcagcucu

SEQ ID NO: 2224746 - RNA, 17 nt, Homo sapiens
augucugguguuuguca

SEQ ID NO: 2224747 - RNA, 14 nt, Homo sapiens
gggauuucauuuga

SEQ ID NO: 2224748 - RNA, 18 nt, Homo sapiens
auagugauuguaacaaau

SEQ ID NO: 2224749 - RNA, 22 nt, Homo sapiens
ugcuacuucaguaaugucuaua

SEQ ID NO: 2224750 - RNA, 13 nt, Homo sapiens
uugcagaaaccua

SEQ ID NO: 2224751 - RNA, 17 nt, Homo sapiens
caccaauacccuguaaa

SEQ ID NO: 2224752 - RNA, 14 nt, Homo sapiens
aguuuuguacaaag

SEQ ID NO: 2224753 - RNA, 12 nt, Homo sapiens
aaaauacaauua

SEQ ID NO: 2224754 - RNA, 11 nt, Homo sapiens
cucagcacagg

SEQ ID NO: 2224755 - RNA, 21 nt, Homo sapiens
agagaauaagcugaacuugua

SEQ ID NO: 2224756 - RNA, 18 nt, Homo sapiens
cagucccucacaccuggg

SEQ ID NO: 2224757 - RNA, 17 nt, Homo sapiens
caguaagcugguuuaca

SEQ ID NO: 2224758 - RNA, 21 nt, Homo sapiens
cuguaagaaaccuacugccca

SEQ ID NO: 2224759 - RNA, 19 nt, Homo sapiens
gguggaaugcgggggagca

SEQ ID NO: 2224760 - RNA, 16 nt, Homo sapiens
cccaaugaaauacuga

SEQ ID NO: 2224761 - RNA, 15 nt, Homo sapiens
agauuaacauuucac

SEQ ID NO: 2224762 - RNA, 16 nt, Homo sapiens
aauguuacaguaacaa

SEQ ID NO: 2224763 - RNA, 15 nt, Homo sapiens
uuccagagaagccau

SEQ ID NO: 2224764 - RNA, 18 nt, Homo sapiens
cucugucucaguccauga

SEQ ID NO: 2224765 - RNA, 11 nt, Homo sapiens
ccuaggcaaag

SEQ ID NO: 2224766 - RNA, 21 nt, Homo sapiens
aagccacagcagguccuccau

SEQ ID NO: 2224767 - RNA, 21 nt, Homo sapiens
augaugcaaaucugccaagag

SEQ ID NO: 2224768 - RNA, 16 nt, Homo sapiens
ucaggcggggugcugu

SEQ ID NO: 2224769 - RNA, 18 nt, Homo sapiens
cuuuuuccaucuucuccc

SEQ ID NO: 2224770 - RNA, 19 nt, Homo sapiens
uggcauuaaagugcuguau

SEQ ID NO: 2224771 - RNA, 17 nt, Homo sapiens
uuucaaauuauaugcua

SEQ ID NO: 2224772 - RNA, 17 nt, Homo sapiens
uuuauacauaucagaaa

SEQ ID NO: 2224773 - RNA, 22 nt, Homo sapiens
uagaaagcuggacugaccaaag

SEQ ID NO: 2224774 - RNA, 16 nt, Homo sapiens
aggcccagaugugguu

SEQ ID NO: 2224775 - RNA, 15 nt, Homo sapiens
ggccauggcaugugu

SEQ ID NO: 2224776 - RNA, 19 nt, Homo sapiens
aaaauggaggccauugugu

SEQ ID NO: 2224777 - RNA, 16 nt, Homo sapiens
aacaaaaaccaaaaaa

SEQ ID NO: 2224778 - RNA, 20 nt, Homo sapiens
ccuacaugucuuuucuucca

SEQ ID NO: 2224779 - RNA, 16 nt, Homo sapiens
gccaccucaccaagga

SEQ ID NO: 2224780 - RNA, 23 nt, Homo sapiens
uccggcugaaggcugaguguccg

SEQ ID NO: 2224781 - RNA, 21 nt, Homo sapiens
ccuugcuggacggggacuggg

SEQ ID NO: 2224782 - RNA, 18 nt, Homo sapiens
caugccccuaaucccagc

SEQ ID NO: 2224783 - RNA, 23 nt, Homo sapiens
ucuuucacacuuccaccagccug

SEQ ID NO: 2224784 - RNA, 14 nt, Homo sapiens
caucagucaacaga

SEQ ID NO: 2224785 - RNA, 20 nt, Homo sapiens
uaccuggcccugugccuugg

SEQ ID NO: 2224786 - RNA, 18 nt, Homo sapiens
gguguccagcauugcugg

SEQ ID NO: 2224787 - RNA, 19 nt, Homo sapiens
caaugccacccucaucuuu

SEQ ID NO: 2224788 - RNA, 18 nt, Homo sapiens
cuuuagauauacauauca

SEQ ID NO: 2224789 - RNA, 23 nt, Homo sapiens
ucaccuucggagaggacacuuca

SEQ ID NO: 2224790 - RNA, 23 nt, Homo sapiens
cucuguacagcugcucuuaccca

SEQ ID NO: 2224791 - RNA, 18 nt, Homo sapiens
aaacgguaauacgugaaa

SEQ ID NO: 2224792 - RNA, 15 nt, Homo sapiens
cagugguaugaucac

SEQ ID NO: 2224793 - RNA, 16 nt, Homo sapiens
uugggagagugcagua

SEQ ID NO: 2224794 - RNA, 12 nt, Homo sapiens
uaacuaugcuuu

SEQ ID NO: 2224795 - RNA, 18 nt, Homo sapiens
uggucaagcccuugccca

SEQ ID NO: 2224796 - RNA, 18 nt, Homo sapiens
cuuucgaauaaagugaau

SEQ ID NO: 2224797 - RNA, 19 nt, Homo sapiens
ucaagcagcaaaauccuua

SEQ ID NO: 2224798 - RNA, 16 nt, Homo sapiens
aacuggugcaugacaa

SEQ ID NO: 2224799 - RNA, 15 nt, Homo sapiens
ucagaggaaggacuu

SEQ ID NO: 2224800 - RNA, 16 nt, Homo sapiens
cagcagcacaccucag

SEQ ID NO: 2224801 - RNA, 14 nt, Homo sapiens
ucugccaccaaagg

SEQ ID NO: 2224802 - RNA, 22 nt, Homo sapiens
auaguauugugcauagagccac

SEQ ID NO: 2224803 - RNA, 20 nt, Homo sapiens
uuagaagauauuauuugucu

SEQ ID NO: 2224804 - RNA, 21 nt, Homo sapiens
aggcuccugguuguuccucuc

SEQ ID NO: 2224805 - RNA, 14 nt, Homo sapiens
uuccaacaauucag

SEQ ID NO: 2224806 - RNA, 14 nt, Homo sapiens
acuuagcauccuaa

SEQ ID NO: 2224807 - RNA, 20 nt, Homo sapiens
ccucagaaagucaccaggac

SEQ ID NO: 2224808 - RNA, 22 nt, Homo sapiens
aaagccaggccugacgcauucu

SEQ ID NO: 2224809 - RNA, 16 nt, Homo sapiens
caguuugucacaugaa

SEQ ID NO: 2224810 - RNA, 22 nt, Homo sapiens
ccagagccagccagcauggcca

SEQ ID NO: 2224811 - RNA, 15 nt, Homo sapiens
uggcagaaccaaagc

SEQ ID NO: 2224812 - RNA, 23 nt, Homo sapiens
ugccuccaacccagcaguucucu

SEQ ID NO: 2224813 - RNA, 19 nt, Homo sapiens
auguucaaagugugacauu

SEQ ID NO: 2224814 - RNA, 11 nt, Homo sapiens
gacugcaguug

SEQ ID NO: 2224815 - RNA, 14 nt, Homo sapiens
uuauguaaacauca

SEQ ID NO: 2224816 - RNA, 19 nt, Homo sapiens
auuacagggaaugccugag

SEQ ID NO: 2224817 - RNA, 13 nt, Homo sapiens
gaaagcauugcca

SEQ ID NO: 2224818 - RNA, 10 nt, Homo sapiens
aaacaaagug

SEQ ID NO: 2224819 - RNA, 16 nt, Homo sapiens
uguucauuauuuugau

SEQ ID NO: 2224820 - RNA, 18 nt, Homo sapiens
gacucaggaugcccaggg

SEQ ID NO: 2224821 - RNA, 17 nt, Homo sapiens
caagggaccugcucauc

SEQ ID NO: 2224822 - RNA, 21 nt, Homo sapiens
aagaccaggucuacagugaua

SEQ ID NO: 2224823 - RNA, 14 nt, Homo sapiens
cacccugugccauc

SEQ ID NO: 2224824 - RNA, 13 nt, Homo sapiens
aaacagcugccuu

SEQ ID NO: 2224825 - RNA, 17 nt, Homo sapiens
auuauaaucucauuuca

SEQ ID NO: 2224826 - RNA, 23 nt, Homo sapiens
cugcagucagacugaaauauaaa

SEQ ID NO: 2224827 - RNA, 15 nt, Homo sapiens
uaaaaucauuucacu

SEQ ID NO: 2224828 - RNA, 14 nt, Homo sapiens
cugacaauauacaa

SEQ ID NO: 2224829 - RNA, 17 nt, Homo sapiens
cccuuuacaaugugaau

SEQ ID NO: 2224830 - RNA, 13 nt, Homo sapiens
ccguguguuauau

SEQ ID NO: 2224831 - RNA, 17 nt, Homo sapiens
aacacucaguuguucaa

SEQ ID NO: 2224832 - RNA, 18 nt, Homo sapiens
ggaucaagaaggggacag

SEQ ID NO: 2224833 - RNA, 18 nt, Homo sapiens
ucccuacccuuguccaca

SEQ ID NO: 2224834 - RNA, 19 nt, Homo sapiens
ucaccucaggaccauguga

SEQ ID NO: 2224835 - RNA, 19 nt, Homo sapiens
aauaauauuuucuguguaa

SEQ ID NO: 2224836 - RNA, 22 nt, Homo sapiens
cacuuggauuucauuuguaacu

SEQ ID NO: 2224837 - RNA, 22 nt, Homo sapiens
cugguaggaagauggagguuua

SEQ ID NO: 2224838 - RNA, 22 nt, Homo sapiens
ccaugagccugcccgcugcaau

SEQ ID NO: 2224839 - RNA, 13 nt, Homo sapiens
acugccucugcca

SEQ ID NO: 2224840 - RNA, 21 nt, Homo sapiens
cauuucucaagggccaugugg

SEQ ID NO: 2224841 - RNA, 15 nt, Homo sapiens
gauuuggugaccaac

SEQ ID NO: 2224842 - RNA, 13 nt, Homo sapiens
acucugcucugau

SEQ ID NO: 2224843 - RNA, 15 nt, Homo sapiens
cgaaggauauuguca

SEQ ID NO: 2224844 - RNA, 23 nt, Homo sapiens
gugaaacucauaauagacuuccc

SEQ ID NO: 2224845 - RNA, 18 nt, Homo sapiens
ucgugggccgcacugggg

SEQ ID NO: 2224846 - RNA, 15 nt, Homo sapiens
ccaucggcaggcagu

SEQ ID NO: 2224847 - RNA, 23 nt, Homo sapiens
ucaaaaggcacugugaacuauuu

SEQ ID NO: 2224848 - RNA, 18 nt, Homo sapiens
auuucauugauuaaucuc

SEQ ID NO: 2224849 - RNA, 20 nt, Homo sapiens
caguuauuaaaauguuaaaa

SEQ ID NO: 2224850 - RNA, 22 nt, Homo sapiens
uuccaugagaacagcaggguag

SEQ ID NO: 2224851 - RNA, 20 nt, Homo sapiens
ugaucagacuugauuuacaa

SEQ ID NO: 2224852 - RNA, 19 nt, Homo sapiens
gugauggcgggcacugggu

SEQ ID NO: 2224853 - RNA, 21 nt, Homo sapiens
caggcucuggagccagagaga

SEQ ID NO: 2224854 - RNA, 20 nt, Homo sapiens
acagcuugcuucuuugccca

SEQ ID NO: 2224855 - RNA, 20 nt, Homo sapiens
auuccagugcaguagugcca

SEQ ID NO: 2224856 - RNA, 16 nt, Homo sapiens
uauucuuuccaugcag

SEQ ID NO: 2224857 - RNA, 20 nt, Homo sapiens
agcccucgaaccaaggcagc

SEQ ID NO: 2224858 - RNA, 13 nt, Homo sapiens
ugaagaugaucau

SEQ ID NO: 2224859 - RNA, 15 nt, Homo sapiens
uuuauugcugaauga

SEQ ID NO: 2224860 - RNA, 21 nt, Homo sapiens
ccccuccucccccggcugggc

SEQ ID NO: 2224861 - RNA, 21 nt, Homo sapiens
aggggcaggagcucagaugaa

SEQ ID NO: 2224862 - RNA, 13 nt, Homo sapiens
ggcuggugacaga

SEQ ID NO: 2224863 - RNA, 24 nt, Homo sapiens
ccuuugggcccagggacaccagcc

SEQ ID NO: 2224864 - RNA, 14 nt, Homo sapiens
ggagcugauggcag

SEQ ID NO: 2224865 - RNA, 16 nt, Homo sapiens
aguuauuuucagacau

SEQ ID NO: 2224866 - RNA, 23 nt, Homo sapiens
ucuucagaugcucuugggguuca

SEQ ID NO: 2224867 - RNA, 16 nt, Homo sapiens
guuuaauuacaacagc

SEQ ID NO: 2224868 - RNA, 15 nt, Homo sapiens
ggaaugcauccaaau

SEQ ID NO: 2224869 - RNA, 16 nt, Homo sapiens
uccugaugacuccucc

SEQ ID NO: 2224870 - RNA, 20 nt, Homo sapiens
acaggaggcagacaaugacc

SEQ ID NO: 2224871 - RNA, 18 nt, Homo sapiens
uaauggaaaaaaagacug

SEQ ID NO: 2224872 - RNA, 20 nt, Homo sapiens
agcuuucaaacacuccucag

SEQ ID NO: 2224873 - RNA, 14 nt, Homo sapiens
uuauuuuuucagac

SEQ ID NO: 2224874 - RNA, 19 nt, Homo sapiens
agaaacucugccaacacug

SEQ ID NO: 2224875 - RNA, 22 nt, Homo sapiens
uggauauguccagucauccugc

SEQ ID NO: 2224876 - RNA, 19 nt, Homo sapiens
acacgcaugccucagccag

SEQ ID NO: 2224877 - RNA, 18 nt, Homo sapiens
guaaauaaagaacuagca

SEQ ID NO: 2224878 - RNA, 22 nt, Homo sapiens
cggaaccugaaggugcugacaa

SEQ ID NO: 2224879 - RNA, 23 nt, Homo sapiens
auuuugugaucuguaacagggua

SEQ ID NO: 2224880 - RNA, 17 nt, Homo sapiens
ccacacugaaacagcca

SEQ ID NO: 2224881 - RNA, 14 nt, Homo sapiens
gugaaaaacuuaag

SEQ ID NO: 2224882 - RNA, 22 nt, Homo sapiens
ugacucugcucuugcauaguaa

SEQ ID NO: 2224883 - RNA, 15 nt, Homo sapiens
ucuuucugcaugacu

SEQ ID NO: 2224884 - RNA, 15 nt, Homo sapiens
ugauucaacagggaa

SEQ ID NO: 2224885 - RNA, 16 nt, Homo sapiens
uuaaaaaaaaauuccc

SEQ ID NO: 2224886 - RNA, 14 nt, Homo sapiens
accccuuguuacuc

SEQ ID NO: 2224887 - RNA, 18 nt, Homo sapiens
aacccucuggggagcuca

SEQ ID NO: 2224888 - RNA, 18 nt, Homo sapiens
guuauuuuuucagacugu

SEQ ID NO: 2224889 - RNA, 18 nt, Homo sapiens
ccaauaaagaguuccuuc

SEQ ID NO: 2224890 - RNA, 14 nt, Homo sapiens
cacucccugccuac

SEQ ID NO: 2224891 - RNA, 16 nt, Homo sapiens
cauuucugagaucaaa

SEQ ID NO: 2224892 - RNA, 13 nt, Homo sapiens
gacccccaucccc

SEQ ID NO: 2224893 - RNA, 16 nt, Homo sapiens
agguuaaauuucaagc

SEQ ID NO: 2224894 - RNA, 13 nt, Homo sapiens
augcccaccaucg

SEQ ID NO: 2224895 - RNA, 17 nt, Homo sapiens
ugucacagaaucuccau

SEQ ID NO: 2224896 - RNA, 22 nt, Homo sapiens
gaaaugugguagccucacuuuu

SEQ ID NO: 2224897 - RNA, 19 nt, Homo sapiens
guuuuggggaaauguggag

SEQ ID NO: 2224898 - RNA, 22 nt, Homo sapiens
auacuucuuuauucacaguauc

SEQ ID NO: 2224899 - RNA, 13 nt, Homo sapiens
acuacucuaggga

SEQ ID NO: 2224900 - RNA, 14 nt, Homo sapiens
ggcugcuuccugug

SEQ ID NO: 2224901 - RNA, 21 nt, Homo sapiens
gccuguaaucccagcacuuug

SEQ ID NO: 2224902 - RNA, 14 nt, Homo sapiens
ccuguguacuuccc

SEQ ID NO: 2224903 - RNA, 18 nt, Homo sapiens
acccucaccaggaugaag

SEQ ID NO: 2224904 - RNA, 16 nt, Homo sapiens
ucagcaucugugaugg

SEQ ID NO: 2224905 - RNA, 15 nt, Homo sapiens
agugugucacacuga

SEQ ID NO: 2224906 - RNA, 15 nt, Homo sapiens
acacauucagugaua

SEQ ID NO: 2224907 - RNA, 15 nt, Homo sapiens
agaaauaaccacugc

SEQ ID NO: 2224908 - RNA, 16 nt, Homo sapiens
accuggcgugcucaga

SEQ ID NO: 2224909 - RNA, 21 nt, Homo sapiens
uuccaacccaggucugcuuug

SEQ ID NO: 2224910 - RNA, 16 nt, Homo sapiens
ucaugccccaguauua

SEQ ID NO: 2224911 - RNA, 19 nt, Homo sapiens
gguucucagguguugccaa

SEQ ID NO: 2224912 - RNA, 17 nt, Homo sapiens
uccaaauauuguugaca

SEQ ID NO: 2224913 - RNA, 16 nt, Homo sapiens
uucccaauugacaagu

SEQ ID NO: 2224914 - RNA, 17 nt, Homo sapiens
cugcccaucagugacag

SEQ ID NO: 2224915 - RNA, 17 nt, Homo sapiens
cucugcaucacccacag

SEQ ID NO: 2224916 - RNA, 22 nt, Homo sapiens
uccuauucugaugaaucucaaa

SEQ ID NO: 2224917 - RNA, 13 nt, Homo sapiens
ugcgagacauugg

SEQ ID NO: 2224918 - RNA, 16 nt, Homo sapiens
gcuccuccccucuuga

SEQ ID NO: 2224919 - RNA, 23 nt, Homo sapiens
cugcuuuuggggcucuugaucag

SEQ ID NO: 2224920 - RNA, 18 nt, Homo sapiens
agugggcuccuggcagaa

SEQ ID NO: 2224921 - RNA, 15 nt, Homo sapiens
agccacaacacccag

SEQ ID NO: 2224922 - RNA, 15 nt, Homo sapiens
ggaugaacaauuaua

SEQ ID NO: 2224923 - RNA, 18 nt, Homo sapiens
agccugaaaaggacuucu

SEQ ID NO: 2224924 - RNA, 22 nt, Homo sapiens
aaacagccucuuuuugauacug

SEQ ID NO: 2224925 - RNA, 17 nt, Homo sapiens
ugccauggccugugcug

SEQ ID NO: 2224926 - RNA, 14 nt, Homo sapiens
gauguauacugcca

SEQ ID NO: 2224927 - RNA, 13 nt, Homo sapiens
caaacaggcaguu

SEQ ID NO: 2224928 - RNA, 15 nt, Homo sapiens
cacugccuucaccuu

SEQ ID NO: 2224929 - RNA, 21 nt, Homo sapiens
uuucagcauucccaauuauca

SEQ ID NO: 2224930 - RNA, 22 nt, Homo sapiens
cagccuccuuuguguguauuca

SEQ ID NO: 2224931 - RNA, 17 nt, Homo sapiens
uaaaauuccauuaucuu

SEQ ID NO: 2224932 - RNA, 22 nt, Homo sapiens
uuccuagauuacaucugccuua

SEQ ID NO: 2224933 - RNA, 17 nt, Homo sapiens
acuacaggcacacgcca

SEQ ID NO: 2224934 - RNA, 18 nt, Homo sapiens
acucucuacuacacaggc

SEQ ID NO: 2224935 - RNA, 13 nt, Homo sapiens
gucauaugcugcu

SEQ ID NO: 2224936 - RNA, 17 nt, Homo sapiens
accauggcaaaguggau

SEQ ID NO: 2224937 - RNA, 18 nt, Homo sapiens
gaaggggcgcuccuccca

SEQ ID NO: 2224938 - RNA, 17 nt, Homo sapiens
ugcuucuguagcuucua

SEQ ID NO: 2224939 - RNA, 13 nt, Homo sapiens
accucuccacgug

SEQ ID NO: 2224940 - RNA, 22 nt, Homo sapiens
agauucuaauggcuuuauugca

SEQ ID NO: 2224941 - RNA, 19 nt, Homo sapiens
gcaucuuuauaugcuugug

SEQ ID NO: 2224942 - RNA, 23 nt, Homo sapiens
gucuucagccuagccgaccucag

SEQ ID NO: 2224943 - RNA, 20 nt, Homo sapiens
accccaccugaccucugcaa

SEQ ID NO: 2224944 - RNA, 15 nt, Homo sapiens
uacaaaguucuucau

SEQ ID NO: 2224945 - RNA, 20 nt, Homo sapiens
uccccauucgguguggugca

SEQ ID NO: 2224946 - RNA, 18 nt, Homo sapiens
aucugaaagaaauggcau

SEQ ID NO: 2224947 - RNA, 20 nt, Homo sapiens
ccccauaaugugggcagauu

SEQ ID NO: 2224948 - RNA, 13 nt, Homo sapiens
cuuauauacagac

SEQ ID NO: 2224949 - RNA, 19 nt, Homo sapiens
uguuuaagaaaaaauaaca

SEQ ID NO: 2224950 - RNA, 21 nt, Homo sapiens
ugccaaagugucuacaugugc

SEQ ID NO: 2224951 - RNA, 15 nt, Homo sapiens
augcuugcauuauau

SEQ ID NO: 2224952 - RNA, 18 nt, Homo sapiens
ucuaaacuguuuacucac

SEQ ID NO: 2224953 - RNA, 18 nt, Homo sapiens
uucucaacauacuguaau

SEQ ID NO: 2224954 - RNA, 13 nt, Homo sapiens
ucacaccuguaau

SEQ ID NO: 2224955 - RNA, 14 nt, Homo sapiens
aaagagacagugau

SEQ ID NO: 2224956 - RNA, 16 nt, Homo sapiens
ucucaagaccaacaga

SEQ ID NO: 2224957 - RNA, 14 nt, Homo sapiens
uauccagaauggaa

SEQ ID NO: 2224958 - RNA, 20 nt, Homo sapiens
auaggauccgaagugcaaug

SEQ ID NO: 2224959 - RNA, 16 nt, Homo sapiens
auagcaccauugcacu

SEQ ID NO: 2224960 - RNA, 19 nt, Homo sapiens
uauaaauaaauaccaaaaa

SEQ ID NO: 2224961 - RNA, 23 nt, Homo sapiens
guacucaguaacacagugcagua

SEQ ID NO: 2224962 - RNA, 20 nt, Homo sapiens
gcuccucuccuuacuccauc

SEQ ID NO: 2224963 - RNA, 16 nt, Homo sapiens
ccaggauggugcagga

SEQ ID NO: 2224964 - RNA, 18 nt, Homo sapiens
ugcccuggagaugucaca

SEQ ID NO: 2224965 - RNA, 20 nt, Homo sapiens
ccagccugggggacagagca

SEQ ID NO: 2224966 - RNA, 14 nt, Homo sapiens
auuuucugaucuca

SEQ ID NO: 2224967 - RNA, 21 nt, Homo sapiens
ggcacacccucucuguccaau

SEQ ID NO: 2224968 - RNA, 15 nt, Homo sapiens
gcccucucuccgccc

SEQ ID NO: 2224969 - RNA, 22 nt, Homo sapiens
gcugcaggccgugugucuguca

SEQ ID NO: 2224970 - RNA, 15 nt, Homo sapiens
auggauauuauuaga

SEQ ID NO: 2224971 - RNA, 16 nt, Homo sapiens
cuucucuuuaugucaa

SEQ ID NO: 2224972 - RNA, 18 nt, Homo sapiens
guucauuauuuugugguu

SEQ ID NO: 2224973 - RNA, 14 nt, Homo sapiens
acuagucuguguaa

SEQ ID NO: 2224974 - RNA, 12 nt, Homo sapiens
guucuguucuca

SEQ ID NO: 2224975 - RNA, 12 nt, Homo sapiens
cuucuguuguca

SEQ ID NO: 2224976 - RNA, 21 nt, Homo sapiens
agacauaguugugcaugccug

SEQ ID NO: 2224977 - RNA, 14 nt, Homo sapiens
aagcucuguugcaa

SEQ ID NO: 2224978 - RNA, 15 nt, Homo sapiens
ccucccagcuucuua

SEQ ID NO: 2224979 - RNA, 23 nt, Homo sapiens
ugagguugcgccacuacacucca

SEQ ID NO: 2224980 - RNA, 14 nt, Homo sapiens
ucaugaagauauuu

SEQ ID NO: 2224981 - RNA, 19 nt, Homo sapiens
ugacacugguauuccugcc

SEQ ID NO: 2224982 - RNA, 18 nt, Homo sapiens
cuguggcugucuggaucc

SEQ ID NO: 2224983 - RNA, 16 nt, Homo sapiens
gguggaccuggcagug

SEQ ID NO: 2224984 - RNA, 19 nt, Homo sapiens
uacaggaggcagacaauga

SEQ ID NO: 2224985 - RNA, 21 nt, Homo sapiens
guacugccaauacugccaacc

SEQ ID NO: 2224986 - RNA, 17 nt, Homo sapiens
uuugagacugagucucu

SEQ ID NO: 2224987 - RNA, 20 nt, Homo sapiens
ugggccucugggcugcugua

SEQ ID NO: 2224988 - RNA, 21 nt, Homo sapiens
cugugacuuaagaagccuuac

SEQ ID NO: 2224989 - RNA, 15 nt, Homo sapiens
cacucaguucuuccu

SEQ ID NO: 2224990 - RNA, 23 nt, Homo sapiens
ccaagaccucagggcacaaagau

SEQ ID NO: 2224991 - RNA, 14 nt, Homo sapiens
aguucucaauuuca

SEQ ID NO: 2224992 - RNA, 20 nt, Homo sapiens
aauaccuuuaaauaucauuc

SEQ ID NO: 2224993 - RNA, 15 nt, Homo sapiens
cucccucccuuucua

SEQ ID NO: 2224994 - RNA, 17 nt, Homo sapiens
gugaugaaaacauucaa

SEQ ID NO: 2224995 - RNA, 19 nt, Homo sapiens
gccuaggguggucugggag

SEQ ID NO: 2224996 - RNA, 14 nt, Homo sapiens
acugaaucucaccu

SEQ ID NO: 2224997 - RNA, 14 nt, Homo sapiens
uuacaaucauugcu

SEQ ID NO: 2224998 - RNA, 21 nt, Homo sapiens
cacacaggagaaaaugcaauu

SEQ ID NO: 2224999 - RNA, 14 nt, Homo sapiens
aaaggcagucuccg

SEQ ID NO: 2225000 - RNA, 13 nt, Homo sapiens
agcaacuugaggg

SEQ ID NO: 2225001 - RNA, 15 nt, Homo sapiens
gcacugucaugccca

SEQ ID NO: 2225002 - RNA, 18 nt, Homo sapiens
gaaaacccccagcauuac

SEQ ID NO: 2225003 - RNA, 16 nt, Homo sapiens
ugccaccggaggucac

SEQ ID NO: 2225004 - RNA, 18 nt, Homo sapiens
cagaccccacgcugacca

SEQ ID NO: 2225005 - RNA, 14 nt, Homo sapiens
cacccugcacuuuc

SEQ ID NO: 2225006 - RNA, 16 nt, Homo sapiens
cauaggugacagggcc

SEQ ID NO: 2225007 - RNA, 19 nt, Homo sapiens
cuuuccaagcuccaccacu

SEQ ID NO: 2225008 - RNA, 18 nt, Homo sapiens
caccuauauauccaagaa

SEQ ID NO: 2225009 - RNA, 20 nt, Homo sapiens
agucacugccacuuugcaca

SEQ ID NO: 2225010 - RNA, 20 nt, Homo sapiens
uucacccugauuuuacacac

SEQ ID NO: 2225011 - RNA, 18 nt, Homo sapiens
cucacaaggaaaaggcca

SEQ ID NO: 2225012 - RNA, 17 nt, Homo sapiens
uaaguuugggcugaaga

SEQ ID NO: 2225013 - RNA, 21 nt, Homo sapiens
caauaaaguuccccugugaca

SEQ ID NO: 2225014 - RNA, 18 nt, Homo sapiens
cuacuugccacacacugu

SEQ ID NO: 2225015 - RNA, 19 nt, Homo sapiens
ccuuccaucccagagggug

SEQ ID NO: 2225016 - RNA, 14 nt, Homo sapiens
gcugagcaugugga

SEQ ID NO: 2225017 - RNA, 20 nt, Homo sapiens
uugcgucaagucuaaaccaa

SEQ ID NO: 2225018 - RNA, 17 nt, Homo sapiens
uccuuggauggcaccau

SEQ ID NO: 2225019 - RNA, 19 nt, Homo sapiens
cagccuccccgugccaaaa

SEQ ID NO: 2225020 - RNA, 21 nt, Homo sapiens
cuuuucuaauuaauagccaaa

SEQ ID NO: 2225021 - RNA, 21 nt, Homo sapiens
aacacaggcagguacugucug

SEQ ID NO: 2225022 - RNA, 10 nt, Homo sapiens
ccacuggaaa

SEQ ID NO: 2225023 - RNA, 15 nt, Homo sapiens
auuguaacuuaugaa

SEQ ID NO: 2225024 - RNA, 16 nt, Homo sapiens
uaccuggaaaccagaa

SEQ ID NO: 2225025 - RNA, 17 nt, Homo sapiens
uacuuuaaaaugccaau

SEQ ID NO: 2225026 - RNA, 15 nt, Homo sapiens
cagagacacugagcc

SEQ ID NO: 2225027 - RNA, 17 nt, Homo sapiens
ucugggagucacacagu

SEQ ID NO: 2225028 - RNA, 18 nt, Homo sapiens
cauccuaagguucuugcu

SEQ ID NO: 2225029 - RNA, 22 nt, Homo sapiens
uuguuuuuuacucaaauuggga

SEQ ID NO: 2225030 - RNA, 21 nt, Homo sapiens
uacauacuggccucugugauu

SEQ ID NO: 2225031 - RNA, 15 nt, Homo sapiens
cuguguagugauuug

SEQ ID NO: 2225032 - RNA, 16 nt, Homo sapiens
uuacuauucauuaaau

SEQ ID NO: 2225033 - RNA, 19 nt, Homo sapiens
uuuauaacauuuugagaaa

SEQ ID NO: 2225034 - RNA, 23 nt, Homo sapiens
ugggcagccccaccucacagcca

SEQ ID NO: 2225035 - RNA, 21 nt, Homo sapiens
gcagaccagcacuucaaccua

SEQ ID NO: 2225036 - RNA, 17 nt, Homo sapiens
ccuucugaggagaggca

SEQ ID NO: 2225037 - RNA, 12 nt, Homo sapiens
uacaauugugag

SEQ ID NO: 2225038 - RNA, 15 nt, Homo sapiens
uauguguaugugcca

SEQ ID NO: 2225039 - RNA, 23 nt, Homo sapiens
cucugcuaugcauuuucuucaca

SEQ ID NO: 2225040 - RNA, 18 nt, Homo sapiens
cuacauauuugcacugaa

SEQ ID NO: 2225041 - RNA, 17 nt, Homo sapiens
gcaauaaauaccagaca

SEQ ID NO: 2225042 - RNA, 12 nt, Homo sapiens
ucucagcacuuu

SEQ ID NO: 2225043 - RNA, 21 nt, Homo sapiens
uggaagaggaauccagugaau

SEQ ID NO: 2225044 - RNA, 15 nt, Homo sapiens
aagaagcaacuaagu

SEQ ID NO: 2225045 - RNA, 17 nt, Homo sapiens
aggaaucaaugacuuaa

SEQ ID NO: 2225046 - RNA, 16 nt, Homo sapiens
ccuaagaggcagugag

SEQ ID NO: 2225047 - RNA, 17 nt, Homo sapiens
agcauaaagucacucau

SEQ ID NO: 2225048 - RNA, 22 nt, Homo sapiens
aagaagauggcaaaaucaucuu

SEQ ID NO: 2225049 - RNA, 16 nt, Homo sapiens
auauagugacuaugaa

SEQ ID NO: 2225050 - RNA, 20 nt, Homo sapiens
aaacuuuaacaaacaggcug

SEQ ID NO: 2225051 - RNA, 16 nt, Homo sapiens
gguagaaaaauuauua

SEQ ID NO: 2225052 - RNA, 16 nt, Homo sapiens
acuagucuguguaacu

SEQ ID NO: 2225053 - RNA, 20 nt, Homo sapiens
uaucugugugugauuugcua

SEQ ID NO: 2225054 - RNA, 23 nt, Homo sapiens
cgacaagccuucagccacaggga

SEQ ID NO: 2225055 - RNA, 19 nt, Homo sapiens
gcauuuucacauuuugccu

SEQ ID NO: 2225056 - RNA, 22 nt, Homo sapiens
uuuauggcucacacagcuuaag

SEQ ID NO: 2225057 - RNA, 19 nt, Homo sapiens
ccaacuaacguacauucaa

SEQ ID NO: 2225058 - RNA, 18 nt, Homo sapiens
auaaauuggaauaaugua

SEQ ID NO: 2225059 - RNA, 13 nt, Homo sapiens
cacccccugccaa

SEQ ID NO: 2225060 - RNA, 23 nt, Homo sapiens
ggcaaccccagacccaacccaug

SEQ ID NO: 2225061 - RNA, 22 nt, Homo sapiens
guuccuuccaggugauucuguu

SEQ ID NO: 2225062 - RNA, 15 nt, Homo sapiens
agcuuagaguucuuc

SEQ ID NO: 2225063 - RNA, 13 nt, Homo sapiens
gcugcuggggaag

SEQ ID NO: 2225064 - RNA, 22 nt, Homo sapiens
cuugugucuuuggaggugcugc

SEQ ID NO: 2225065 - RNA, 17 nt, Homo sapiens
aggucacugaaacuuca

SEQ ID NO: 2225066 - RNA, 15 nt, Homo sapiens
ccuggccggcaaccc

SEQ ID NO: 2225067 - RNA, 14 nt, Homo sapiens
aagacaaugugcca

SEQ ID NO: 2225068 - RNA, 16 nt, Homo sapiens
aaagcccagcucuuug

SEQ ID NO: 2225069 - RNA, 16 nt, Homo sapiens
gcugcuccucugacuu

SEQ ID NO: 2225070 - RNA, 21 nt, Homo sapiens
aagaugguuagaaccagcaga

SEQ ID NO: 2225071 - RNA, 15 nt, Homo sapiens
gccucuuaccuuccc

SEQ ID NO: 2225072 - RNA, 20 nt, Homo sapiens
aucacauguggacuuuuauu

SEQ ID NO: 2225073 - RNA, 20 nt, Homo sapiens
uauucuuuuuauauucugug

SEQ ID NO: 2225074 - RNA, 11 nt, Homo sapiens
aucaaccaaag

SEQ ID NO: 2225075 - RNA, 20 nt, Homo sapiens
guuggauccguuugaccaau

SEQ ID NO: 2225076 - RNA, 22 nt, Homo sapiens
auguucacccaaccacauccca

SEQ ID NO: 2225077 - RNA, 23 nt, Homo sapiens
gcccucgugguggaaacuuuucu

SEQ ID NO: 2225078 - RNA, 15 nt, Homo sapiens
ccaagaaggagaccu

SEQ ID NO: 2225079 - RNA, 19 nt, Homo sapiens
ucagauaauuaugcuuuua

SEQ ID NO: 2225080 - RNA, 18 nt, Homo sapiens
ugauuagaagccaagaca

SEQ ID NO: 2225081 - RNA, 18 nt, Homo sapiens
auccuuauuuauauauca

SEQ ID NO: 2225082 - RNA, 21 nt, Homo sapiens
aaaaaucaugagauccuuuaa

SEQ ID NO: 2225083 - RNA, 15 nt, Homo sapiens
aaagaaaucuugucu

SEQ ID NO: 2225084 - RNA, 14 nt, Homo sapiens
uuucauagcuaaaa

SEQ ID NO: 2225085 - RNA, 18 nt, Homo sapiens
agcugagaagggcaggga

SEQ ID NO: 2225086 - RNA, 17 nt, Homo sapiens
gucaccucagagacaua

SEQ ID NO: 2225087 - RNA, 13 nt, Homo sapiens
uccucacacucca

SEQ ID NO: 2225088 - RNA, 15 nt, Homo sapiens
acucugaauuuccag

SEQ ID NO: 2225089 - RNA, 17 nt, Homo sapiens
ccagacucuugccuguu

SEQ ID NO: 2225090 - RNA, 12 nt, Homo sapiens
uggcaggcccac

SEQ ID NO: 2225091 - RNA, 16 nt, Homo sapiens
agaaaaguauucucaa

SEQ ID NO: 2225092 - RNA, 13 nt, Homo sapiens
accaguacuugag

SEQ ID NO: 2225093 - RNA, 16 nt, Homo sapiens
acacguaaguauaaau

SEQ ID NO: 2225094 - RNA, 15 nt, Homo sapiens
ggugaggucuguucc

SEQ ID NO: 2225095 - RNA, 23 nt, Homo sapiens
ucccucgggcuggugucuugaga

SEQ ID NO: 2225096 - RNA, 14 nt, Homo sapiens
cccacuuggcauca

SEQ ID NO: 2225097 - RNA, 22 nt, Homo sapiens
acucugugccagagccuggggc

SEQ ID NO: 2225098 - RNA, 22 nt, Homo sapiens
uucaguggcuaccuacauacaa

SEQ ID NO: 2225099 - RNA, 15 nt, Homo sapiens
uuaauaugagcuuca

SEQ ID NO: 2225100 - RNA, 18 nt, Homo sapiens
cuuauaauuugcauacca

SEQ ID NO: 2225101 - RNA, 17 nt, Homo sapiens
ugccuuaccgagagcca

SEQ ID NO: 2225102 - RNA, 23 nt, Homo sapiens
auuauacgcuggcaacacagagg

SEQ ID NO: 2225103 - RNA, 22 nt, Homo sapiens
uuaaaugcuuuuuaucgcuaaa

SEQ ID NO: 2225104 - RNA, 13 nt, Homo sapiens
uuuguucagugag

SEQ ID NO: 2225105 - RNA, 16 nt, Homo sapiens
ucuaagcugugugcag

SEQ ID NO: 2225106 - RNA, 14 nt, Homo sapiens
auaaagucaaggac

SEQ ID NO: 2225107 - RNA, 19 nt, Homo sapiens
caggcucuccgggccuuuc

SEQ ID NO: 2225108 - RNA, 20 nt, Homo sapiens
auuacaggcaugagccacug

SEQ ID NO: 2225109 - RNA, 13 nt, Homo sapiens
gcaucauuacugu

SEQ ID NO: 2225110 - RNA, 16 nt, Homo sapiens
caaaaauuaauacaca

SEQ ID NO: 2225111 - RNA, 14 nt, Homo sapiens
caccaagcccaguu

SEQ ID NO: 2225112 - RNA, 15 nt, Homo sapiens
agacucacucuucca

SEQ ID NO: 2225113 - RNA, 18 nt, Homo sapiens
aguacauuguuaccucua

SEQ ID NO: 2225114 - RNA, 23 nt, Homo sapiens
ucuguguuuguacugugcaguuu

SEQ ID NO: 2225115 - RNA, 21 nt, Homo sapiens
gagaugggggcuucuuccuca

SEQ ID NO: 2225116 - RNA, 17 nt, Homo sapiens
uuugaggugaggguugg

SEQ ID NO: 2225117 - RNA, 15 nt, Homo sapiens
ugaugacuaccucag

SEQ ID NO: 2225118 - RNA, 23 nt, Homo sapiens
cccauguaagcaccccuucauuu

SEQ ID NO: 2225119 - RNA, 20 nt, Homo sapiens
agugaccccagccuccugcc

SEQ ID NO: 2225120 - RNA, 13 nt, Homo sapiens
uguauagaacugg

SEQ ID NO: 2225121 - RNA, 18 nt, Homo sapiens
auacauuuaugcacauuc

SEQ ID NO: 2225122 - RNA, 21 nt, Homo sapiens
cucagguuauucguuacucua

SEQ ID NO: 2225123 - RNA, 14 nt, Homo sapiens
ugugcacagccaug

SEQ ID NO: 2225124 - RNA, 13 nt, Homo sapiens
cuauguucuuagu

SEQ ID NO: 2225125 - RNA, 18 nt, Homo sapiens
ccccagaggccuuggcca

SEQ ID NO: 2225126 - RNA, 12 nt, Homo sapiens
ggggggguucuu

SEQ ID NO: 2225127 - RNA, 22 nt, Homo sapiens
ucccauuuguaauguaucuuau

SEQ ID NO: 2225128 - RNA, 15 nt, Homo sapiens
cuucaagcucucugu

SEQ ID NO: 2225129 - RNA, 21 nt, Homo sapiens
caagccuagcccuucucucau

SEQ ID NO: 2225130 - RNA, 16 nt, Homo sapiens
uaaagauuucuaguag

SEQ ID NO: 2225131 - RNA, 18 nt, Homo sapiens
cacucuguugguagcaau

SEQ ID NO: 2225132 - RNA, 21 nt, Homo sapiens
agaagauucuucccauucucc

SEQ ID NO: 2225133 - RNA, 19 nt, Homo sapiens
gaaaacuuaugcugauuua

SEQ ID NO: 2225134 - RNA, 13 nt, Homo sapiens
guagucauuucau

SEQ ID NO: 2225135 - RNA, 13 nt, Homo sapiens
auuaucugcauuu

SEQ ID NO: 2225136 - RNA, 14 nt, Homo sapiens
cuuauucucaagaa

SEQ ID NO: 2225137 - RNA, 16 nt, Homo sapiens
cucagcucacugcaag

SEQ ID NO: 2225138 - RNA, 23 nt, Homo sapiens
uuccugaaggacgcgccagggga

SEQ ID NO: 2225139 - RNA, 16 nt, Homo sapiens
gccccgccucccgggg

SEQ ID NO: 2225140 - RNA, 15 nt, Homo sapiens
acccugaucuucacu

SEQ ID NO: 2225141 - RNA, 16 nt, Homo sapiens
gucugauuuaugguuu

SEQ ID NO: 2225142 - RNA, 20 nt, Homo sapiens
uguccuucuacagaaccuga

SEQ ID NO: 2225143 - RNA, 20 nt, Homo sapiens
cuuccugaauacugaaacua

SEQ ID NO: 2225144 - RNA, 17 nt, Homo sapiens
acacaauuaaaugacuu

SEQ ID NO: 2225145 - RNA, 16 nt, Homo sapiens
ucugauacaucuguca

SEQ ID NO: 2225146 - RNA, 20 nt, Homo sapiens
gccccacuggacaacacuga

SEQ ID NO: 2225147 - RNA, 15 nt, Homo sapiens
cucagccucauccuc

SEQ ID NO: 2225148 - RNA, 15 nt, Homo sapiens
cgugcaauguuuuaa

SEQ ID NO: 2225149 - RNA, 20 nt, Homo sapiens
augcaguauucuugcacuga

SEQ ID NO: 2225150 - RNA, 18 nt, Homo sapiens
ccccaccacugagccauc

SEQ ID NO: 2225151 - RNA, 14 nt, Homo sapiens
cguaacaacugugg

SEQ ID NO: 2225152 - RNA, 16 nt, Homo sapiens
acacgcugguggugcu

SEQ ID NO: 2225153 - RNA, 23 nt, Homo sapiens
gacuccucugggccuggggugca

SEQ ID NO: 2225154 - RNA, 20 nt, Homo sapiens
guguguccaugugugugcaa

SEQ ID NO: 2225155 - RNA, 21 nt, Homo sapiens
aacucucaccaugaugugaag

SEQ ID NO: 2225156 - RNA, 14 nt, Homo sapiens
cugucucugagggg

SEQ ID NO: 2225157 - RNA, 13 nt, Homo sapiens
uuuucuaccuccu

SEQ ID NO: 2225158 - RNA, 20 nt, Homo sapiens
gcgcacggagcgccccggcc

SEQ ID NO: 2225159 - RNA, 21 nt, Homo sapiens
ucgcaccacugcacuccagcc

SEQ ID NO: 2225160 - RNA, 21 nt, Homo sapiens
ucacaccacuacacuccagcc

SEQ ID NO: 2225161 - RNA, 21 nt, Homo sapiens
cuuaagaaugugcuagaguua

SEQ ID NO: 2225162 - RNA, 21 nt, Homo sapiens
uuaaaauaaaaaagcaaaaac

SEQ ID NO: 2225163 - RNA, 19 nt, Homo sapiens
acacaaugauuuuguacau

SEQ ID NO: 2225164 - RNA, 22 nt, Homo sapiens
uaaguucuuuuacaaauaucua

SEQ ID NO: 2225165 - RNA, 20 nt, Homo sapiens
auaauaugcaauccuacuuc

SEQ ID NO: 2225166 - RNA, 21 nt, Homo sapiens
gccccaugaguuugccauguu

SEQ ID NO: 2225167 - RNA, 11 nt, Homo sapiens
aagcagucuca

SEQ ID NO: 2225168 - RNA, 16 nt, Homo sapiens
ggaugucugaacuuug

SEQ ID NO: 2225169 - RNA, 14 nt, Homo sapiens
acacaauuacuaaa

SEQ ID NO: 2225170 - RNA, 16 nt, Homo sapiens
augguaacagauuugc

SEQ ID NO: 2225171 - RNA, 19 nt, Homo sapiens
caugaguucugcacauaca

SEQ ID NO: 2225172 - RNA, 17 nt, Homo sapiens
ggacugcugcucuccca

SEQ ID NO: 2225173 - RNA, 21 nt, Homo sapiens
auuaaagaaguugauggauau

SEQ ID NO: 2225174 - RNA, 16 nt, Homo sapiens
ugacucagcauaccug

SEQ ID NO: 2225175 - RNA, 14 nt, Homo sapiens
cacucugaauucca

SEQ ID NO: 2225176 - RNA, 16 nt, Homo sapiens
cuaauuagucuaucaa

SEQ ID NO: 2225177 - RNA, 16 nt, Homo sapiens
aguuuuauaugcuucu

SEQ ID NO: 2225178 - RNA, 17 nt, Homo sapiens
aagacuuaccugaauaa

SEQ ID NO: 2225179 - RNA, 14 nt, Homo sapiens
uaaguaaucucaca

SEQ ID NO: 2225180 - RNA, 19 nt, Homo sapiens
aggcgcugacccaagagaa

SEQ ID NO: 2225181 - RNA, 17 nt, Homo sapiens
aguuuugccaguucaag

SEQ ID NO: 2225182 - RNA, 13 nt, Homo sapiens
cacaugugcaguc

SEQ ID NO: 2225183 - RNA, 20 nt, Homo sapiens
agacuacaggugagugccac

SEQ ID NO: 2225184 - RNA, 17 nt, Homo sapiens
acuccaucugacaaauu

SEQ ID NO: 2225185 - RNA, 17 nt, Homo sapiens
uccauguuugcaccugu

SEQ ID NO: 2225186 - RNA, 11 nt, Homo sapiens
guucuuuacaa

SEQ ID NO: 2225187 - RNA, 14 nt, Homo sapiens
aaguuagccuccac

SEQ ID NO: 2225188 - RNA, 15 nt, Homo sapiens
cugggcuucagccuc

SEQ ID NO: 2225189 - RNA, 14 nt, Homo sapiens
aacagaagcuucca

SEQ ID NO: 2225190 - RNA, 18 nt, Homo sapiens
cagauuacuagaaauauu

SEQ ID NO: 2225191 - RNA, 16 nt, Homo sapiens
gaaauaaaggaguuau

SEQ ID NO: 2225192 - RNA, 16 nt, Homo sapiens
cgcgcacacacacucu

SEQ ID NO: 2225193 - RNA, 20 nt, Homo sapiens
aaacagauucugauucccuu

SEQ ID NO: 2225194 - RNA, 14 nt, Homo sapiens
acacacacauacag

SEQ ID NO: 2225195 - RNA, 17 nt, Homo sapiens
uccuugacuccaagaaa

SEQ ID NO: 2225196 - RNA, 23 nt, Homo sapiens
ggaaaacaugcugcucuggugca

SEQ ID NO: 2225197 - RNA, 13 nt, Homo sapiens
ucaccaaaaccag

SEQ ID NO: 2225198 - RNA, 14 nt, Homo sapiens
gaauauccauguac

SEQ ID NO: 2225199 - RNA, 12 nt, Homo sapiens
cugguguagcuc

SEQ ID NO: 2225200 - RNA, 14 nt, Homo sapiens
uuuguggaaaagaa

SEQ ID NO: 2225201 - RNA, 12 nt, Homo sapiens
ggagugaugaac

SEQ ID NO: 2225202 - RNA, 13 nt, Homo sapiens
cccuggcuccuug

SEQ ID NO: 2225203 - RNA, 14 nt, Homo sapiens
agggccgccugccu

SEQ ID NO: 2225204 - RNA, 19 nt, Homo sapiens
cagccaccucccucugcca

SEQ ID NO: 2225205 - RNA, 15 nt, Homo sapiens
aaaugcugcuucucc

SEQ ID NO: 2225206 - RNA, 17 nt, Homo sapiens
augccucucuacagucu

SEQ ID NO: 2225207 - RNA, 21 nt, Homo sapiens
aagacauugggucuauuccag

SEQ ID NO: 2225208 - RNA, 23 nt, Homo sapiens
guaaaguuuccgugcguggcacu

SEQ ID NO: 2225209 - RNA, 19 nt, Homo sapiens
cuuggucuugaagucugua

SEQ ID NO: 2225210 - RNA, 17 nt, Homo sapiens
gauuugcaacuuuagaa

SEQ ID NO: 2225211 - RNA, 17 nt, Homo sapiens
uugucccacucaagcca

SEQ ID NO: 2225212 - RNA, 15 nt, Homo sapiens
acauauuuguuaaau

SEQ ID NO: 2225213 - RNA, 15 nt, Homo sapiens
auuagaaugcaugua

SEQ ID NO: 2225214 - RNA, 21 nt, Homo sapiens
acugaaauuacggguaccuga

SEQ ID NO: 2225215 - RNA, 23 nt, Homo sapiens
ucuuauauugccauuucuuccac

SEQ ID NO: 2225216 - RNA, 21 nt, Homo sapiens
aaugcauccagcaguacaaua

SEQ ID NO: 2225217 - RNA, 19 nt, Homo sapiens
agaguggugcugcuuuaau

SEQ ID NO: 2225218 - RNA, 15 nt, Homo sapiens
uaucgcugccuugcc

SEQ ID NO: 2225219 - RNA, 18 nt, Homo sapiens
uuguccagguugaucuug

SEQ ID NO: 2225220 - RNA, 21 nt, Homo sapiens
acuuccuuuuaacugccaaga

SEQ ID NO: 2225221 - RNA, 18 nt, Homo sapiens
aaagcccugccucugugu

SEQ ID NO: 2225222 - RNA, 23 nt, Homo sapiens
uacauacaggccauacuuuacaa

SEQ ID NO: 2225223 - RNA, 15 nt, Homo sapiens
ucccaaagugcugga

SEQ ID NO: 2225224 - RNA, 18 nt, Homo sapiens
agcacugauaggacuuaa

SEQ ID NO: 2225225 - RNA, 15 nt, Homo sapiens
ucuuaggcaugugcu

SEQ ID NO: 2225226 - RNA, 21 nt, Homo sapiens
auccaaugaagaaggucucau

SEQ ID NO: 2225227 - RNA, 16 nt, Homo sapiens
accaaauuaucuugau

SEQ ID NO: 2225228 - RNA, 16 nt, Homo sapiens
auuaugugacuuaaag

SEQ ID NO: 2225229 - RNA, 15 nt, Homo sapiens
gauuuaauaugcaaa

SEQ ID NO: 2225230 - RNA, 15 nt, Homo sapiens
agguugacagauacu

SEQ ID NO: 2225231 - RNA, 15 nt, Homo sapiens
cugcaguccuacuca

SEQ ID NO: 2225232 - RNA, 23 nt, Homo sapiens
gaaugucuuuggcucaguucauu

SEQ ID NO: 2225233 - RNA, 20 nt, Homo sapiens
uugaccacaucgcucuagga

SEQ ID NO: 2225234 - RNA, 12 nt, Homo sapiens
aggacagccaca

SEQ ID NO: 2225235 - RNA, 18 nt, Homo sapiens
agggcaucauccucagca

SEQ ID NO: 2225236 - RNA, 14 nt, Homo sapiens
agaaaugacuuuga

SEQ ID NO: 2225237 - RNA, 17 nt, Homo sapiens
uguuugauacaguauua

SEQ ID NO: 2225238 - RNA, 19 nt, Homo sapiens
ucaacauuccugccccaga

SEQ ID NO: 2225239 - RNA, 11 nt, Homo sapiens
aaucaugucag

SEQ ID NO: 2225240 - RNA, 17 nt, Homo sapiens
uuuggauauaagugaua

SEQ ID NO: 2225241 - RNA, 14 nt, Homo sapiens
ucacaucacacaaa

SEQ ID NO: 2225242 - RNA, 13 nt, Homo sapiens
ucuccuacccuga

SEQ ID NO: 2225243 - RNA, 22 nt, Homo sapiens
uugcuaauacccaguuacuuau

SEQ ID NO: 2225244 - RNA, 18 nt, Homo sapiens
ugcugaacuccuuguuag

SEQ ID NO: 2225245 - RNA, 17 nt, Homo sapiens
acaacuaaauaacugua

SEQ ID NO: 2225246 - RNA, 20 nt, Homo sapiens
acucuugucgggagauugaa

SEQ ID NO: 2225247 - RNA, 14 nt, Homo sapiens
cugccagagcuuug

SEQ ID NO: 2225248 - RNA, 19 nt, Homo sapiens
acagugccuaauaauacug

SEQ ID NO: 2225249 - RNA, 18 nt, Homo sapiens
agaaacagagcaguacca

SEQ ID NO: 2225250 - RNA, 22 nt, Homo sapiens
cuuugauagauuucuacacuga

SEQ ID NO: 2225251 - RNA, 20 nt, Homo sapiens
augugugguggccucagcug

SEQ ID NO: 2225252 - RNA, 19 nt, Homo sapiens
cuggaaaggaugcuucugc

SEQ ID NO: 2225253 - RNA, 16 nt, Homo sapiens
gccauaagaaagcacu

SEQ ID NO: 2225254 - RNA, 12 nt, Homo sapiens
ucacacugagga

SEQ ID NO: 2225255 - RNA, 17 nt, Homo sapiens
cuaaagcuaaacaaaac

SEQ ID NO: 2225256 - RNA, 21 nt, Homo sapiens
cuucaggauccaagugacaaa

SEQ ID NO: 2225257 - RNA, 15 nt, Homo sapiens
ggacaucauucugca

SEQ ID NO: 2225258 - RNA, 17 nt, Homo sapiens
gaaucacuuaaauguca

SEQ ID NO: 2225259 - RNA, 13 nt, Homo sapiens
aaaaaucccucca

SEQ ID NO: 2225260 - RNA, 20 nt, Homo sapiens
caaaugcuggggucauauaa

SEQ ID NO: 2225261 - RNA, 18 nt, Homo sapiens
cuggcuggcuguguccuc

SEQ ID NO: 2225262 - RNA, 18 nt, Homo sapiens
ucuccaguugggacucag

SEQ ID NO: 2225263 - RNA, 22 nt, Homo sapiens
aaagaguucaagugucuguaua

SEQ ID NO: 2225264 - RNA, 23 nt, Homo sapiens
auaggccuaguacaaucuuggga

SEQ ID NO: 2225265 - RNA, 20 nt, Homo sapiens
agugacagagcgagacucca

SEQ ID NO: 2225266 - RNA, 18 nt, Homo sapiens
cugucugcucaaugccau

SEQ ID NO: 2225267 - RNA, 16 nt, Homo sapiens
acccagacugucucca

SEQ ID NO: 2225268 - RNA, 13 nt, Homo sapiens
cauauuuacuucu

SEQ ID NO: 2225269 - RNA, 14 nt, Homo sapiens
uccucuaguaguau

SEQ ID NO: 2225270 - RNA, 19 nt, Homo sapiens
uaaguuccagcagaugcca

SEQ ID NO: 2225271 - RNA, 23 nt, Homo sapiens
acacuccacuugaagcacuuaag

SEQ ID NO: 2225272 - RNA, 17 nt, Homo sapiens
auauguuuauacacaca

SEQ ID NO: 2225273 - RNA, 19 nt, Homo sapiens
gccuuuccuagcacccuau

SEQ ID NO: 2225274 - RNA, 21 nt, Homo sapiens
ugguggcccacugacuaagaa

SEQ ID NO: 2225275 - RNA, 20 nt, Homo sapiens
ccuugcgauucugcagccac

SEQ ID NO: 2225276 - RNA, 15 nt, Homo sapiens
aggucauccaaagaa

SEQ ID NO: 2225277 - RNA, 16 nt, Homo sapiens
agauccccccacugag

SEQ ID NO: 2225278 - RNA, 19 nt, Homo sapiens
ugaccccugccaccuuccg

SEQ ID NO: 2225279 - RNA, 10 nt, Homo sapiens
cuacuccucc

SEQ ID NO: 2225280 - RNA, 15 nt, Homo sapiens
caaagauucuaguga

SEQ ID NO: 2225281 - RNA, 17 nt, Homo sapiens
cuggcgccccuuccuag

SEQ ID NO: 2225282 - RNA, 16 nt, Homo sapiens
uauaaguuucuuuaga

SEQ ID NO: 2225283 - RNA, 20 nt, Homo sapiens
acuugcacaaaaucacacag

SEQ ID NO: 2225284 - RNA, 16 nt, Homo sapiens
agaacguggcucugcu

SEQ ID NO: 2225285 - RNA, 20 nt, Homo sapiens
uuccaaccccccaguauaaa

SEQ ID NO: 2225286 - RNA, 18 nt, Homo sapiens
cauuaggaaacacugauu

SEQ ID NO: 2225287 - RNA, 20 nt, Homo sapiens
uagugaaccaaaaauagaaa

SEQ ID NO: 2225288 - RNA, 18 nt, Homo sapiens
aggcacacuuucuggcaa

SEQ ID NO: 2225289 - RNA, 17 nt, Homo sapiens
uacaguggaauugugaa

SEQ ID NO: 2225290 - RNA, 16 nt, Homo sapiens
cuggaagcacuacaga

SEQ ID NO: 2225291 - RNA, 19 nt, Homo sapiens
agcuuugccagcugcugcu

SEQ ID NO: 2225292 - RNA, 18 nt, Homo sapiens
uuuugucuagaccuauua

SEQ ID NO: 2225293 - RNA, 17 nt, Homo sapiens
aauuggccgcugucacu

SEQ ID NO: 2225294 - RNA, 23 nt, Homo sapiens
gagccuuuuaccccugcacaguu

SEQ ID NO: 2225295 - RNA, 20 nt, Homo sapiens
cugcugcuugaguugccuga

SEQ ID NO: 2225296 - RNA, 19 nt, Homo sapiens
aggccuuggcuugauggaa

SEQ ID NO: 2225297 - RNA, 15 nt, Homo sapiens
acauuuugugcagug

SEQ ID NO: 2225298 - RNA, 12 nt, Homo sapiens
ugauguugucac

SEQ ID NO: 2225299 - RNA, 14 nt, Homo sapiens
aauguaaaagcaca

SEQ ID NO: 2225300 - RNA, 19 nt, Homo sapiens
aguucucagggcuccugcc

SEQ ID NO: 2225301 - RNA, 15 nt, Homo sapiens
agccauaacuugaaa

SEQ ID NO: 2225302 - RNA, 13 nt, Homo sapiens
aucugacaaaaug

SEQ ID NO: 2225303 - RNA, 21 nt, Homo sapiens
caaugcugaugaaucacuguu

SEQ ID NO: 2225304 - RNA, 15 nt, Homo sapiens
gugacuucacuguau

SEQ ID NO: 2225305 - RNA, 21 nt, Homo sapiens
cauuuauuuacacucuugauu

SEQ ID NO: 2225306 - RNA, 19 nt, Homo sapiens
gcaaaaauaaaauggacag

SEQ ID NO: 2225307 - RNA, 18 nt, Homo sapiens
agggcgagcggcaaaggc

SEQ ID NO: 2225308 - RNA, 16 nt, Homo sapiens
uaaguauuccuuggcc

SEQ ID NO: 2225309 - RNA, 20 nt, Homo sapiens
aaaagcugaauccagaucau

SEQ ID NO: 2225310 - RNA, 22 nt, Homo sapiens
augauguagauuacugaaaaau

SEQ ID NO: 2225311 - RNA, 15 nt, Homo sapiens
aacuucccuguucuu

SEQ ID NO: 2225312 - RNA, 14 nt, Homo sapiens
auugaccucagcug

SEQ ID NO: 2225313 - RNA, 18 nt, Homo sapiens
ccugggugugaccugaca

SEQ ID NO: 2225314 - RNA, 16 nt, Homo sapiens
ugagaggaacaagaag

SEQ ID NO: 2225315 - RNA, 16 nt, Homo sapiens
cuugaaugaugccaug

SEQ ID NO: 2225316 - RNA, 18 nt, Homo sapiens
cuaacuggacagccucuu

SEQ ID NO: 2225317 - RNA, 13 nt, Homo sapiens
uucaacuaugcaa

SEQ ID NO: 2225318 - RNA, 18 nt, Homo sapiens
aaaucauuguauggauag

SEQ ID NO: 2225319 - RNA, 18 nt, Homo sapiens
cagcaauagggugcaguu

SEQ ID NO: 2225320 - RNA, 17 nt, Homo sapiens
uucauuuuagacauuca

SEQ ID NO: 2225321 - RNA, 23 nt, Homo sapiens
agggauggcgaggccucucucag

SEQ ID NO: 2225322 - RNA, 18 nt, Homo sapiens
uguuaagcguugagccac

SEQ ID NO: 2225323 - RNA, 19 nt, Homo sapiens
uuuccuuaacgcuagagau

SEQ ID NO: 2225324 - RNA, 19 nt, Homo sapiens
ggucucuucuuggggccca

SEQ ID NO: 2225325 - RNA, 22 nt, Homo sapiens
uaaagagcacguuuuccauuau

SEQ ID NO: 2225326 - RNA, 18 nt, Homo sapiens
ugggguccuccugugcua

SEQ ID NO: 2225327 - RNA, 18 nt, Homo sapiens
uggggugcaccuguccaa

SEQ ID NO: 2225328 - RNA, 19 nt, Homo sapiens
accucaaggucaggaugag

SEQ ID NO: 2225329 - RNA, 21 nt, Homo sapiens
cccaaggaaaauggacauauu

SEQ ID NO: 2225330 - RNA, 17 nt, Homo sapiens
gcacccugauccucacc

SEQ ID NO: 2225331 - RNA, 12 nt, Homo sapiens
uaauuuuugcau

SEQ ID NO: 2225332 - RNA, 14 nt, Homo sapiens
uuugugugugugca

SEQ ID NO: 2225333 - RNA, 13 nt, Homo sapiens
caagaggacacaa

SEQ ID NO: 2225334 - RNA, 14 nt, Homo sapiens
gauuuacacuggga

SEQ ID NO: 2225335 - RNA, 14 nt, Homo sapiens
cuuagacauaacaa

SEQ ID NO: 2225336 - RNA, 15 nt, Homo sapiens
ugcagaaugacucca

SEQ ID NO: 2225337 - RNA, 11 nt, Homo sapiens
ccguuuugccu

SEQ ID NO: 2225338 - RNA, 18 nt, Homo sapiens
gaccuuugauuuuugccc

SEQ ID NO: 2225339 - RNA, 22 nt, Homo sapiens
ugaaaccugagauggagcugcc

SEQ ID NO: 2225340 - RNA, 15 nt, Homo sapiens
agcguguacuacccc

SEQ ID NO: 2225341 - RNA, 13 nt, Homo sapiens
uccucuuccugaa

SEQ ID NO: 2225342 - RNA, 22 nt, Homo sapiens
gccaguaaaugggggugcauuu

SEQ ID NO: 2225343 - RNA, 22 nt, Homo sapiens
agauagguauggaaaaagcaua

SEQ ID NO: 2225344 - RNA, 20 nt, Homo sapiens
aacuucaccuacauuaucuc

SEQ ID NO: 2225345 - RNA, 15 nt, Homo sapiens
ugaagcaaguacaau

SEQ ID NO: 2225346 - RNA, 18 nt, Homo sapiens
guuaauuacaacugcuau

SEQ ID NO: 2225347 - RNA, 22 nt, Homo sapiens
gauuaagauauucagaaguaua

SEQ ID NO: 2225348 - RNA, 12 nt, Homo sapiens
ggcucacagcug

SEQ ID NO: 2225349 - RNA, 15 nt, Homo sapiens
uuuuacacugauaaa

SEQ ID NO: 2225350 - RNA, 14 nt, Homo sapiens
aagaaaacaacuuc

SEQ ID NO: 2225351 - RNA, 23 nt, Homo sapiens
caccagaggcugcagaaggccaa

SEQ ID NO: 2225352 - RNA, 16 nt, Homo sapiens
uaaaucccaagugucu

SEQ ID NO: 2225353 - RNA, 20 nt, Homo sapiens
acuucacuaccaagcagcuc

SEQ ID NO: 2225354 - RNA, 18 nt, Homo sapiens
ucauuuaagaauuuacca

SEQ ID NO: 2225355 - RNA, 16 nt, Homo sapiens
gugccucuuauuacag

SEQ ID NO: 2225356 - RNA, 19 nt, Homo sapiens
cagaaaguaagcauuucca

SEQ ID NO: 2225357 - RNA, 18 nt, Homo sapiens
acaaaauauaaaucacag

SEQ ID NO: 2225358 - RNA, 23 nt, Homo sapiens
aaaguaucagaggugaaugcaca

SEQ ID NO: 2225359 - RNA, 20 nt, Homo sapiens
uauaguguuuggacagcuga

SEQ ID NO: 2225360 - RNA, 17 nt, Homo sapiens
auauaggugugugagac

SEQ ID NO: 2225361 - RNA, 17 nt, Homo sapiens
aaaaaucccuuguucuc

SEQ ID NO: 2225362 - RNA, 22 nt, Homo sapiens
gaagugcaucugucagccagac

SEQ ID NO: 2225363 - RNA, 16 nt, Homo sapiens
gccgauauaagccaua

SEQ ID NO: 2225364 - RNA, 13 nt, Homo sapiens
aacucagccuuaa

SEQ ID NO: 2225365 - RNA, 22 nt, Homo sapiens
ugucaccacccacccuaccugc

SEQ ID NO: 2225366 - RNA, 17 nt, Homo sapiens
ugguaaccagcccugca

SEQ ID NO: 2225367 - RNA, 15 nt, Homo sapiens
caaagugcugagauu

SEQ ID NO: 2225368 - RNA, 15 nt, Homo sapiens
ggaggccaaccagcc

SEQ ID NO: 2225369 - RNA, 21 nt, Homo sapiens
aacacauuucucugaucucca

SEQ ID NO: 2225370 - RNA, 14 nt, Homo sapiens
ggacuuucuugcaa

SEQ ID NO: 2225371 - RNA, 22 nt, Homo sapiens
cugggaagacgccugagcucac

SEQ ID NO: 2225372 - RNA, 19 nt, Homo sapiens
cagaucugcccacaucuuu

SEQ ID NO: 2225373 - RNA, 16 nt, Homo sapiens
cuauauccccaaaaug

SEQ ID NO: 2225374 - RNA, 14 nt, Homo sapiens
ccaaugccaugacu

SEQ ID NO: 2225375 - RNA, 15 nt, Homo sapiens
cagauuugcauuuca

SEQ ID NO: 2225376 - RNA, 15 nt, Homo sapiens
cuuaacagcuguauu

SEQ ID NO: 2225377 - RNA, 15 nt, Homo sapiens
aucaaaggcacacag

SEQ ID NO: 2225378 - RNA, 12 nt, Homo sapiens
ggacacuuguau

SEQ ID NO: 2225379 - RNA, 13 nt, Homo sapiens
accacaugccaag

SEQ ID NO: 2225380 - RNA, 13 nt, Homo sapiens
accucaugccaug

SEQ ID NO: 2225381 - RNA, 22 nt, Homo sapiens
agauaaauagaacuaucugcau

SEQ ID NO: 2225382 - RNA, 19 nt, Homo sapiens
acggcguuucaccauguug

SEQ ID NO: 2225383 - RNA, 17 nt, Homo sapiens
guggaacgagacaagca

SEQ ID NO: 2225384 - RNA, 14 nt, Homo sapiens
cauacuucucucag

SEQ ID NO: 2225385 - RNA, 17 nt, Homo sapiens
agcucacuacccuauuc

SEQ ID NO: 2225386 - RNA, 14 nt, Homo sapiens
aaguugauaaugaa

SEQ ID NO: 2225387 - RNA, 13 nt, Homo sapiens
acagggcgggggu

SEQ ID NO: 2225388 - RNA, 22 nt, Homo sapiens
ccauccacacggcugaccucau

SEQ ID NO: 2225389 - RNA, 12 nt, Homo sapiens
caguaacuaagc

SEQ ID NO: 2225390 - RNA, 20 nt, Homo sapiens
gccaagacaaaucaacagaa

SEQ ID NO: 2225391 - RNA, 18 nt, Homo sapiens
gacaccaccacugugucc

SEQ ID NO: 2225392 - RNA, 19 nt, Homo sapiens
uuccauuagagaguggcaa

SEQ ID NO: 2225393 - RNA, 22 nt, Homo sapiens
caugcaaauaaauuaugcaauu

SEQ ID NO: 2225394 - RNA, 20 nt, Homo sapiens
gaggccaauccuauggcaga

SEQ ID NO: 2225395 - RNA, 22 nt, Homo sapiens
gccaggauuccucucucagguc

SEQ ID NO: 2225396 - RNA, 19 nt, Homo sapiens
ccugaccaacauggugaaa

SEQ ID NO: 2225397 - RNA, 15 nt, Homo sapiens
aaaugcauguccuca

SEQ ID NO: 2225398 - RNA, 15 nt, Homo sapiens
auacguagcucucuu

SEQ ID NO: 2225399 - RNA, 19 nt, Homo sapiens
ugacuuaacauagccaaaa

SEQ ID NO: 2225400 - RNA, 17 nt, Homo sapiens
cccaugggagauuugga

SEQ ID NO: 2225401 - RNA, 23 nt, Homo sapiens
gcaagcugggacuggcaggaaau

SEQ ID NO: 2225402 - RNA, 13 nt, Homo sapiens
uacugaccagcaa

SEQ ID NO: 2225403 - RNA, 21 nt, Homo sapiens
caaaagucuggcccacugugc

SEQ ID NO: 2225404 - RNA, 16 nt, Homo sapiens
cuuugaaaacacuaca

SEQ ID NO: 2225405 - RNA, 18 nt, Homo sapiens
gaaauuuauuuaauguga

SEQ ID NO: 2225406 - RNA, 14 nt, Homo sapiens
aaagaaguucacau

SEQ ID NO: 2225407 - RNA, 10 nt, Homo sapiens
ggagccacuc

SEQ ID NO: 2225408 - RNA, 17 nt, Homo sapiens
ggagccuuaacccucaa

SEQ ID NO: 2225409 - RNA, 18 nt, Homo sapiens
gcauuucuucacgcaccu

SEQ ID NO: 2225410 - RNA, 21 nt, Homo sapiens
aucuuaacacugaaauugccu

SEQ ID NO: 2225411 - RNA, 15 nt, Homo sapiens
gccagcuccacaggg

SEQ ID NO: 2225412 - RNA, 22 nt, Homo sapiens
guagguacuucacauugcaaac

SEQ ID NO: 2225413 - RNA, 19 nt, Homo sapiens
cuuucucaucuugucccca

SEQ ID NO: 2225414 - RNA, 17 nt, Homo sapiens
ggacaaacugccaguuu

SEQ ID NO: 2225415 - RNA, 20 nt, Homo sapiens
agcauuuccaacaccacaga

SEQ ID NO: 2225416 - RNA, 17 nt, Homo sapiens
cagcuucauuaucugag

SEQ ID NO: 2225417 - RNA, 13 nt, Homo sapiens
ccugccgucuuca

SEQ ID NO: 2225418 - RNA, 15 nt, Homo sapiens
caucugcagcucuuu

SEQ ID NO: 2225419 - RNA, 15 nt, Homo sapiens
guagcguacaucaau

SEQ ID NO: 2225420 - RNA, 17 nt, Homo sapiens
acaugagaagugauaaa

SEQ ID NO: 2225421 - RNA, 19 nt, Homo sapiens
gccucacacccagagggua

SEQ ID NO: 2225422 - RNA, 13 nt, Homo sapiens
cugcaaacuggga

SEQ ID NO: 2225423 - RNA, 11 nt, Homo sapiens
uuauguacaaa

SEQ ID NO: 2225424 - RNA, 11 nt, Homo sapiens
uucuguacaac

SEQ ID NO: 2225425 - RNA, 19 nt, Homo sapiens
agugcacuugcuggaagac

SEQ ID NO: 2225426 - RNA, 13 nt, Homo sapiens
uucccauugcagu

SEQ ID NO: 2225427 - RNA, 17 nt, Homo sapiens
gcaggugggacuuuguu

SEQ ID NO: 2225428 - RNA, 16 nt, Homo sapiens
aaugaagcguugccau

SEQ ID NO: 2225429 - RNA, 15 nt, Homo sapiens
gcauugaagugucga

SEQ ID NO: 2225430 - RNA, 14 nt, Homo sapiens
agaccaaaucucag

SEQ ID NO: 2225431 - RNA, 14 nt, Homo sapiens
uacuuucacacuaa

SEQ ID NO: 2225432 - RNA, 23 nt, Homo sapiens
ugcccacuuuagauguaucuaau

SEQ ID NO: 2225433 - RNA, 13 nt, Homo sapiens
ucaugcaucucca

SEQ ID NO: 2225434 - RNA, 19 nt, Homo sapiens
acacaugguuuccaagggu

SEQ ID NO: 2225435 - RNA, 19 nt, Homo sapiens
gcucaggcuggagugcagu

SEQ ID NO: 2225436 - RNA, 16 nt, Homo sapiens
ucaggacuuucccuga

SEQ ID NO: 2225437 - RNA, 17 nt, Homo sapiens
ucugauaccacugcacu

SEQ ID NO: 2225438 - RNA, 23 nt, Homo sapiens
ccgccauccaccccguugcucaa

SEQ ID NO: 2225439 - RNA, 14 nt, Homo sapiens
ucagggaacauauu

SEQ ID NO: 2225440 - RNA, 20 nt, Homo sapiens
aaggcaauuuuaguguauua

SEQ ID NO: 2225441 - RNA, 22 nt, Homo sapiens
agggaaguggggaguauuugaa

SEQ ID NO: 2225442 - RNA, 14 nt, Homo sapiens
cugugaaugcuaag

SEQ ID NO: 2225443 - RNA, 21 nt, Homo sapiens
gccaucccccucucacgccac

SEQ ID NO: 2225444 - RNA, 17 nt, Homo sapiens
cacuguucaguuuagca

SEQ ID NO: 2225445 - RNA, 16 nt, Homo sapiens
gugcauuucuugacuu

SEQ ID NO: 2225446 - RNA, 16 nt, Homo sapiens
aaaccauuaccuuaaa

SEQ ID NO: 2225447 - RNA, 18 nt, Homo sapiens
gcaucaaccuacuuagaa

SEQ ID NO: 2225448 - RNA, 15 nt, Homo sapiens
gaccugacagcccaa

SEQ ID NO: 2225449 - RNA, 12 nt, Homo sapiens
auaaaugaaucu

SEQ ID NO: 2225450 - RNA, 12 nt, Homo sapiens
uuauaugauuca

SEQ ID NO: 2225451 - RNA, 17 nt, Homo sapiens
aucccauuugcccuccu

SEQ ID NO: 2225452 - RNA, 17 nt, Homo sapiens
guuaaaucaguaaucug

SEQ ID NO: 2225453 - RNA, 21 nt, Homo sapiens
uacacggaggucucuguaaaa

SEQ ID NO: 2225454 - RNA, 15 nt, Homo sapiens
gauuacaggcaccca

SEQ ID NO: 2225455 - RNA, 19 nt, Homo sapiens
auucgugguaucugugaac

SEQ ID NO: 2225456 - RNA, 17 nt, Homo sapiens
auguugaaagaucaaaa

SEQ ID NO: 2225457 - RNA, 17 nt, Homo sapiens
ggagugcaguggcacaa

SEQ ID NO: 2225458 - RNA, 13 nt, Homo sapiens
gccuuggggacaa

SEQ ID NO: 2225459 - RNA, 17 nt, Homo sapiens
guuugugggacuggguu

SEQ ID NO: 2225460 - RNA, 23 nt, Homo sapiens
uauuucuauguaaauuauuguaa

SEQ ID NO: 2225461 - RNA, 17 nt, Homo sapiens
cuauauacacagacaug

SEQ ID NO: 2225462 - RNA, 16 nt, Homo sapiens
uugcucucagcugcca

SEQ ID NO: 2225463 - RNA, 14 nt, Homo sapiens
uccuuuaugugaug

SEQ ID NO: 2225464 - RNA, 13 nt, Homo sapiens
gccauucuugcug

SEQ ID NO: 2225465 - RNA, 12 nt, Homo sapiens
cagaacuaggag

SEQ ID NO: 2225466 - RNA, 21 nt, Homo sapiens
cccagcuagaauucacuccac

SEQ ID NO: 2225467 - RNA, 13 nt, Homo sapiens
cuucagcaaguua

SEQ ID NO: 2225468 - RNA, 16 nt, Homo sapiens
gccacaucccuuugaa

SEQ ID NO: 2225469 - RNA, 20 nt, Homo sapiens
uguacauguguagccugugc

SEQ ID NO: 2225470 - RNA, 15 nt, Homo sapiens
cacagaucacagcuu

SEQ ID NO: 2225471 - RNA, 21 nt, Homo sapiens
caagggaugggaccugaugac

SEQ ID NO: 2225472 - RNA, 20 nt, Homo sapiens
uagcucgugacuacauugaa

SEQ ID NO: 2225473 - RNA, 22 nt, Homo sapiens
agaagggcagcuccacagggca

SEQ ID NO: 2225474 - RNA, 14 nt, Homo sapiens
aauguucacaacau

SEQ ID NO: 2225475 - RNA, 19 nt, Homo sapiens
auccaugcguuucuuccac

SEQ ID NO: 2225476 - RNA, 19 nt, Homo sapiens
ccaaagggcuccguggaga

SEQ ID NO: 2225477 - RNA, 17 nt, Homo sapiens
uuaauggguaugcucag

SEQ ID NO: 2225478 - RNA, 18 nt, Homo sapiens
cuugcccccuuugaccuu

SEQ ID NO: 2225479 - RNA, 18 nt, Homo sapiens
acuugaccuaaacuucua

SEQ ID NO: 2225480 - RNA, 15 nt, Homo sapiens
gcaccuucauucucc

SEQ ID NO: 2225481 - RNA, 20 nt, Homo sapiens
ucauaaucuauaaacaauga

SEQ ID NO: 2225482 - RNA, 11 nt, Homo sapiens
ucacucuguca

SEQ ID NO: 2225483 - RNA, 17 nt, Homo sapiens
gugugcauagcguccug

SEQ ID NO: 2225484 - RNA, 19 nt, Homo sapiens
cuguaaucccagcuacucu

SEQ ID NO: 2225485 - RNA, 17 nt, Homo sapiens
cuguacaugacuguaua

SEQ ID NO: 2225486 - RNA, 14 nt, Homo sapiens
ccgguggcagugga

SEQ ID NO: 2225487 - RNA, 21 nt, Homo sapiens
ccuggcuggcauggaggguga

SEQ ID NO: 2225488 - RNA, 18 nt, Homo sapiens
auaaaauauaaucuaauu

SEQ ID NO: 2225489 - RNA, 23 nt, Homo sapiens
uccuguccccaaaaugugaugcu

SEQ ID NO: 2225490 - RNA, 16 nt, Homo sapiens
cagagcugagcccuca

SEQ ID NO: 2225491 - RNA, 23 nt, Homo sapiens
caguacuugucuucaccaacacu

SEQ ID NO: 2225492 - RNA, 14 nt, Homo sapiens
ucccagcaguggac

SEQ ID NO: 2225493 - RNA, 22 nt, Homo sapiens
gccagccugcgggaagcugacc

SEQ ID NO: 2225494 - RNA, 19 nt, Homo sapiens
acagaguuggggagauaaa

SEQ ID NO: 2225495 - RNA, 19 nt, Homo sapiens
ucuggacuggaaagcacaa

SEQ ID NO: 2225496 - RNA, 18 nt, Homo sapiens
guggucaaaccgcacuca

SEQ ID NO: 2225497 - RNA, 13 nt, Homo sapiens
ugcugguucucau

SEQ ID NO: 2225498 - RNA, 19 nt, Homo sapiens
cagagcauuuaagagugaa

SEQ ID NO: 2225499 - RNA, 15 nt, Homo sapiens
caguggcuucuccag

SEQ ID NO: 2225500 - RNA, 21 nt, Homo sapiens
ccaaaaauaucuccuccaaug

SEQ ID NO: 2225501 - RNA, 18 nt, Homo sapiens
uuaugaccucaacaaaga

SEQ ID NO: 2225502 - RNA, 20 nt, Homo sapiens
ccugcacacacaugcauacu

SEQ ID NO: 2225503 - RNA, 18 nt, Homo sapiens
agggaggcggauuucccu

SEQ ID NO: 2225504 - RNA, 22 nt, Homo sapiens
ucugccgugagagcccaaucac

SEQ ID NO: 2225505 - RNA, 15 nt, Homo sapiens
cuuucuaauguuucu

SEQ ID NO: 2225506 - RNA, 16 nt, Homo sapiens
cauucugaugagcaac

SEQ ID NO: 2225507 - RNA, 19 nt, Homo sapiens
aagauccuccugaccucaa

SEQ ID NO: 2225508 - RNA, 17 nt, Homo sapiens
gcacguuuggcauuucu

SEQ ID NO: 2225509 - RNA, 12 nt, Homo sapiens
accacucaggcc

SEQ ID NO: 2225510 - RNA, 21 nt, Homo sapiens
ugguaaaaugcaucaaaagac

SEQ ID NO: 2225511 - RNA, 21 nt, Homo sapiens
aacauccggcaaaacugaaaa

SEQ ID NO: 2225512 - RNA, 22 nt, Homo sapiens
ccuagugggagcccagcacacu

SEQ ID NO: 2225513 - RNA, 20 nt, Homo sapiens
caugggaaaaaccacugcua

SEQ ID NO: 2225514 - RNA, 14 nt, Homo sapiens
ucaacauuacuguu

SEQ ID NO: 2225515 - RNA, 22 nt, Homo sapiens
uccuguacauugugggauguuc

SEQ ID NO: 2225516 - RNA, 15 nt, Homo sapiens
aaagcccuuccaugu

SEQ ID NO: 2225517 - RNA, 14 nt, Homo sapiens
ucuguuaaaaucag

SEQ ID NO: 2225518 - RNA, 18 nt, Homo sapiens
ugaaaauguaagcuguuu

SEQ ID NO: 2225519 - RNA, 21 nt, Homo sapiens
aaacuauaacauuauauaaca

SEQ ID NO: 2225520 - RNA, 16 nt, Homo sapiens
ugggaggccaaggugg

SEQ ID NO: 2225521 - RNA, 17 nt, Homo sapiens
ggaagggacagcugcau

SEQ ID NO: 2225522 - RNA, 21 nt, Homo sapiens
guaagggguugguaucucagg

SEQ ID NO: 2225523 - RNA, 22 nt, Homo sapiens
caaaaguggggcuaaaugaagu

SEQ ID NO: 2225524 - RNA, 15 nt, Homo sapiens
agauaguauacacau

SEQ ID NO: 2225525 - RNA, 14 nt, Homo sapiens
cagcucguucucug

SEQ ID NO: 2225526 - RNA, 15 nt, Homo sapiens
acauucagaaguaau

SEQ ID NO: 2225527 - RNA, 20 nt, Homo sapiens
aaacaaaucgcagccagcuu

SEQ ID NO: 2225528 - RNA, 23 nt, Homo sapiens
ucuaugggacucaaugcacugac

SEQ ID NO: 2225529 - RNA, 17 nt, Homo sapiens
gugaagaauuuaucucu

SEQ ID NO: 2225530 - RNA, 21 nt, Homo sapiens
acuuuacacgcucauggacug

SEQ ID NO: 2225531 - RNA, 14 nt, Homo sapiens
gcuucaacaacuuu

SEQ ID NO: 2225532 - RNA, 13 nt, Homo sapiens
ccaggugggccug

SEQ ID NO: 2225533 - RNA, 20 nt, Homo sapiens
agcaccuuuccuucaagcca

SEQ ID NO: 2225534 - RNA, 21 nt, Homo sapiens
guagcuuuuaugcccucagga

SEQ ID NO: 2225535 - RNA, 16 nt, Homo sapiens
acaaagugccaaagaa

SEQ ID NO: 2225536 - RNA, 19 nt, Homo sapiens
cagaacuucccuccaucca

SEQ ID NO: 2225537 - RNA, 20 nt, Homo sapiens
cagagaacugcagaccucac

SEQ ID NO: 2225538 - RNA, 17 nt, Homo sapiens
ucacaugcuucuggcaa

SEQ ID NO: 2225539 - RNA, 23 nt, Homo sapiens
accuaugugugugcuuugccacu

SEQ ID NO: 2225540 - RNA, 22 nt, Homo sapiens
aaauaguguugaucagaucuua

SEQ ID NO: 2225541 - RNA, 19 nt, Homo sapiens
ggaggcagagguugcaaug

SEQ ID NO: 2225542 - RNA, 16 nt, Homo sapiens
augagauacauuugau

SEQ ID NO: 2225543 - RNA, 12 nt, Homo sapiens
agcuuugcucuu

SEQ ID NO: 2225544 - RNA, 12 nt, Homo sapiens
ucuuuugcagcu

SEQ ID NO: 2225545 - RNA, 20 nt, Homo sapiens
ggaaguuuagcucugagaac

SEQ ID NO: 2225546 - RNA, 20 nt, Homo sapiens
cauguuaagugccauuacua

SEQ ID NO: 2225547 - RNA, 21 nt, Homo sapiens
acccaguggucagcagguguc

SEQ ID NO: 2225548 - RNA, 21 nt, Homo sapiens
auuguauagccccacagauua

SEQ ID NO: 2225549 - RNA, 16 nt, Homo sapiens
caucuaaucuaugcau

SEQ ID NO: 2225550 - RNA, 18 nt, Homo sapiens
uggcagccauuucuccau

SEQ ID NO: 2225551 - RNA, 20 nt, Homo sapiens
ugagaaauauggacacuuaa

SEQ ID NO: 2225552 - RNA, 13 nt, Homo sapiens
cuaaagaauauaa

SEQ ID NO: 2225553 - RNA, 19 nt, Homo sapiens
gcccauggaggcgcugcug

SEQ ID NO: 2225554 - RNA, 12 nt, Homo sapiens
acaaaaccagaa

SEQ ID NO: 2225555 - RNA, 18 nt, Homo sapiens
aaaaauucuugcauauau

SEQ ID NO: 2225556 - RNA, 21 nt, Homo sapiens
aagcacugauaucuggccuaa

SEQ ID NO: 2225557 - RNA, 23 nt, Homo sapiens
guauaaaaccauguaaagucauc

SEQ ID NO: 2225558 - RNA, 16 nt, Homo sapiens
gaaauuuagagucaau

SEQ ID NO: 2225559 - RNA, 20 nt, Homo sapiens
aacuugauguguuaucucuu

SEQ ID NO: 2225560 - RNA, 16 nt, Homo sapiens
uacucacuaaagggcu

SEQ ID NO: 2225561 - RNA, 17 nt, Homo sapiens
auucuauuuauauguac

SEQ ID NO: 2225562 - RNA, 19 nt, Homo sapiens
ucaaugaaaacugaaucaa

SEQ ID NO: 2225563 - RNA, 12 nt, Homo sapiens
cagaaagaucuu

SEQ ID NO: 2225564 - RNA, 16 nt, Homo sapiens
acaugcuucagugcug

SEQ ID NO: 2225565 - RNA, 20 nt, Homo sapiens
acauucugcaagcacaucug

SEQ ID NO: 2225566 - RNA, 14 nt, Homo sapiens
auuuaaucuuccau

SEQ ID NO: 2225567 - RNA, 16 nt, Homo sapiens
gucuucguauucccau

SEQ ID NO: 2225568 - RNA, 19 nt, Homo sapiens
cccauggguuaagagcuca

SEQ ID NO: 2225569 - RNA, 18 nt, Homo sapiens
aaggugaaacgacucaaa

SEQ ID NO: 2225570 - RNA, 13 nt, Homo sapiens
ccuccacauucau

SEQ ID NO: 2225571 - RNA, 17 nt, Homo sapiens
auuuaaagccaaaugua

SEQ ID NO: 2225572 - RNA, 16 nt, Homo sapiens
ggcagggaugauggca

SEQ ID NO: 2225573 - RNA, 18 nt, Homo sapiens
ugugaccuuaguguuucu

SEQ ID NO: 2225574 - RNA, 21 nt, Homo sapiens
cacuguuuuuagacaccuuca

SEQ ID NO: 2225575 - RNA, 14 nt, Homo sapiens
gaaagauggaacuu

SEQ ID NO: 2225576 - RNA, 20 nt, Homo sapiens
caaguuuaaaggcuguguca

SEQ ID NO: 2225577 - RNA, 18 nt, Homo sapiens
cauuaauuuucaacucaa

SEQ ID NO: 2225578 - RNA, 17 nt, Homo sapiens
acaguuuguggcuuaua

SEQ ID NO: 2225579 - RNA, 17 nt, Homo sapiens
agagcaucugcucugag

SEQ ID NO: 2225580 - RNA, 20 nt, Homo sapiens
aaaacaaguuuagaaagcug

SEQ ID NO: 2225581 - RNA, 14 nt, Homo sapiens
cugauagacaccau

SEQ ID NO: 2225582 - RNA, 16 nt, Homo sapiens
uaaaagaaugauuaug

SEQ ID NO: 2225583 - RNA, 14 nt, Homo sapiens
gaaagaaaucaugu

SEQ ID NO: 2225584 - RNA, 12 nt, Homo sapiens
aaagacauggaa

SEQ ID NO: 2225585 - RNA, 21 nt, Homo sapiens
aagcguaauuuugccaaauaa

SEQ ID NO: 2225586 - RNA, 20 nt, Homo sapiens
agaaaauggaugacaaagaa

SEQ ID NO: 2225587 - RNA, 20 nt, Homo sapiens
gauaaguggccuugacacau

SEQ ID NO: 2225588 - RNA, 17 nt, Homo sapiens
uugaaaugauuucacag

SEQ ID NO: 2225589 - RNA, 15 nt, Homo sapiens
ccccauccagccaga

SEQ ID NO: 2225590 - RNA, 11 nt, Homo sapiens
ucagccuucaa

SEQ ID NO: 2225591 - RNA, 11 nt, Homo sapiens
aagcaaugugg

SEQ ID NO: 2225592 - RNA, 17 nt, Homo sapiens
uugcugaagcugagcua

SEQ ID NO: 2225593 - RNA, 19 nt, Homo sapiens
aagcccauuuguguacaca

SEQ ID NO: 2225594 - RNA, 21 nt, Homo sapiens
aaacugugaagcauuuacaga

SEQ ID NO: 2225595 - RNA, 14 nt, Homo sapiens
gcauuccagccuug

SEQ ID NO: 2225596 - RNA, 17 nt, Homo sapiens
cugaacccuccaaagga

SEQ ID NO: 2225597 - RNA, 17 nt, Homo sapiens
uccccuccuuggcuuua

SEQ ID NO: 2225598 - RNA, 20 nt, Homo sapiens
ccugacucccccauuguguu

SEQ ID NO: 2225599 - RNA, 19 nt, Homo sapiens
gucuguauauacauuucau

SEQ ID NO: 2225600 - RNA, 16 nt, Homo sapiens
gagcaugaagauaaau

SEQ ID NO: 2225601 - RNA, 15 nt, Homo sapiens
acaugcuugaauauc

SEQ ID NO: 2225602 - RNA, 18 nt, Homo sapiens
uuugaauucuugaucucu

SEQ ID NO: 2225603 - RNA, 19 nt, Homo sapiens
ugagggaaugacaccauca

SEQ ID NO: 2225604 - RNA, 14 nt, Homo sapiens
acucaggaugggaa

SEQ ID NO: 2225605 - RNA, 14 nt, Homo sapiens
uguaguuccacuua

SEQ ID NO: 2225606 - RNA, 17 nt, Homo sapiens
aagcagucuuuuucuac

SEQ ID NO: 2225607 - RNA, 15 nt, Homo sapiens
caguacuuccuccca

SEQ ID NO: 2225608 - RNA, 22 nt, Homo sapiens
aguuggggcacugggcgucuga

SEQ ID NO: 2225609 - RNA, 16 nt, Homo sapiens
ugcuuugugagccagc

SEQ ID NO: 2225610 - RNA, 20 nt, Homo sapiens
uacuugagaggcugaggcaa

SEQ ID NO: 2225611 - RNA, 23 nt, Homo sapiens
ggccacagucaugguggccacgg

SEQ ID NO: 2225612 - RNA, 19 nt, Homo sapiens
aacuuauaaaucauauucu

SEQ ID NO: 2225613 - RNA, 22 nt, Homo sapiens
caaagguuccauucagugcagc

SEQ ID NO: 2225614 - RNA, 18 nt, Homo sapiens
cccuuggccuccauuucu

SEQ ID NO: 2225615 - RNA, 12 nt, Homo sapiens
gcucuacuguua

SEQ ID NO: 2225616 - RNA, 23 nt, Homo sapiens
auuacuggugugagccacugugu

SEQ ID NO: 2225617 - RNA, 19 nt, Homo sapiens
uaauaagcaaucaagguua

SEQ ID NO: 2225618 - RNA, 12 nt, Homo sapiens
guccugcugcug

SEQ ID NO: 2225619 - RNA, 23 nt, Homo sapiens
ucccccuuaagccaacaaccaca

SEQ ID NO: 2225620 - RNA, 13 nt, Homo sapiens
ugcacacugccug

SEQ ID NO: 2225621 - RNA, 14 nt, Homo sapiens
ugccuugcacaaaa

SEQ ID NO: 2225622 - RNA, 20 nt, Homo sapiens
gaacagcuccuccucuugga

SEQ ID NO: 2225623 - RNA, 14 nt, Homo sapiens
cccugcacaaagcc

SEQ ID NO: 2225624 - RNA, 14 nt, Homo sapiens
cccugaacaaagca

SEQ ID NO: 2225625 - RNA, 23 nt, Homo sapiens
cguugugccugguucgugccaug

SEQ ID NO: 2225626 - RNA, 21 nt, Homo sapiens
aggacgaaaaacacagugcac

SEQ ID NO: 2225627 - RNA, 15 nt, Homo sapiens
auggagagaauacaa

SEQ ID NO: 2225628 - RNA, 18 nt, Homo sapiens
ucuuugugauaauucuca

SEQ ID NO: 2225629 - RNA, 15 nt, Homo sapiens
aagguuuguguccag

SEQ ID NO: 2225630 - RNA, 19 nt, Homo sapiens
cacaaugcaugugcugucu

SEQ ID NO: 2225631 - RNA, 22 nt, Homo sapiens
gaggcugggcucccuucccacc

SEQ ID NO: 2225632 - RNA, 21 nt, Homo sapiens
gcuucacuagaguucuuugaa

SEQ ID NO: 2225633 - RNA, 15 nt, Homo sapiens
gaaaagaagugaagu

SEQ ID NO: 2225634 - RNA, 19 nt, Homo sapiens
ucacauaacuucucugagu

SEQ ID NO: 2225635 - RNA, 19 nt, Homo sapiens
accuggggucaucgauuca

SEQ ID NO: 2225636 - RNA, 19 nt, Homo sapiens
cugaagcuacuuucuuaaa

SEQ ID NO: 2225637 - RNA, 21 nt, Homo sapiens
cuuccauauuugccuugggaa

SEQ ID NO: 2225638 - RNA, 21 nt, Homo sapiens
ugacaggaagcccaaggcagu

SEQ ID NO: 2225639 - RNA, 21 nt, Homo sapiens
agaauucaaaagugauuaucu

SEQ ID NO: 2225640 - RNA, 19 nt, Homo sapiens
uuauauuguuucaucccau

SEQ ID NO: 2225641 - RNA, 20 nt, Homo sapiens
cacagaucaagugaacauua

SEQ ID NO: 2225642 - RNA, 23 nt, Homo sapiens
auggccgaaaaggauaugcagua

SEQ ID NO: 2225643 - RNA, 15 nt, Homo sapiens
acaaugcuggguggu

SEQ ID NO: 2225644 - RNA, 15 nt, Homo sapiens
cagccuuagcucucc

SEQ ID NO: 2225645 - RNA, 18 nt, Homo sapiens
aagcuaacaccagacaga

SEQ ID NO: 2225646 - RNA, 19 nt, Homo sapiens
ggcaacauucauugccaag

SEQ ID NO: 2225647 - RNA, 16 nt, Homo sapiens
augauaacuaaaaucc

SEQ ID NO: 2225648 - RNA, 13 nt, Homo sapiens
ucccuucauuuaa

SEQ ID NO: 2225649 - RNA, 22 nt, Homo sapiens
ccaaaaugggagaaaacgccag

SEQ ID NO: 2225650 - RNA, 16 nt, Homo sapiens
cccaggaguauccucu

SEQ ID NO: 2225651 - RNA, 16 nt, Homo sapiens
accacucccaccacag

SEQ ID NO: 2225652 - RNA, 14 nt, Homo sapiens
cuagcuauaugcau

SEQ ID NO: 2225653 - RNA, 15 nt, Homo sapiens
agaguguagcuguaa

SEQ ID NO: 2225654 - RNA, 16 nt, Homo sapiens
guguucagccaaguga

SEQ ID NO: 2225655 - RNA, 22 nt, Homo sapiens
uuuugagauggagucuugcucu

SEQ ID NO: 2225656 - RNA, 17 nt, Homo sapiens
caaaguuuugaagucau

SEQ ID NO: 2225657 - RNA, 20 nt, Homo sapiens
cauccagguggagacccuga

SEQ ID NO: 2225658 - RNA, 23 nt, Homo sapiens
gccaagguuuggggaagaacgaa

SEQ ID NO: 2225659 - RNA, 21 nt, Homo sapiens
aaaugugucauuggaagccau

SEQ ID NO: 2225660 - RNA, 23 nt, Homo sapiens
cuugaguugaguauuacacauua

SEQ ID NO: 2225661 - RNA, 16 nt, Homo sapiens
gugguuaacaucucag

SEQ ID NO: 2225662 - RNA, 13 nt, Homo sapiens
ucuuauugacaau

SEQ ID NO: 2225663 - RNA, 17 nt, Homo sapiens
caggaccagcucaggac

SEQ ID NO: 2225664 - RNA, 13 nt, Homo sapiens
cccagugaccuga

SEQ ID NO: 2225665 - RNA, 22 nt, Homo sapiens
cugagucccuuagccaagcagu

SEQ ID NO: 2225666 - RNA, 14 nt, Homo sapiens
gagauaaagucaaa

SEQ ID NO: 2225667 - RNA, 15 nt, Homo sapiens
ucacacacacaaaaa

SEQ ID NO: 2225668 - RNA, 12 nt, Homo sapiens
gcauucuguucc

SEQ ID NO: 2225669 - RNA, 14 nt, Homo sapiens
uaaacaagaaaucu

SEQ ID NO: 2225670 - RNA, 16 nt, Homo sapiens
ugcaaugcuaucacug

SEQ ID NO: 2225671 - RNA, 17 nt, Homo sapiens
uuuuggaggauagcuca

SEQ ID NO: 2225672 - RNA, 14 nt, Homo sapiens
aaauccauuuaccc

SEQ ID NO: 2225673 - RNA, 17 nt, Homo sapiens
uaucacagaaaagcaug

SEQ ID NO: 2225674 - RNA, 22 nt, Homo sapiens
ccuuauugcugccaaaaccaca

SEQ ID NO: 2225675 - RNA, 18 nt, Homo sapiens
gcaaaggaagacgugaug

SEQ ID NO: 2225676 - RNA, 14 nt, Homo sapiens
gaccccacuggaga

SEQ ID NO: 2225677 - RNA, 22 nt, Homo sapiens
uaauaugaagcaggaucacaaa

SEQ ID NO: 2225678 - RNA, 19 nt, Homo sapiens
gcugauucaaaccaaagcu

SEQ ID NO: 2225679 - RNA, 13 nt, Homo sapiens
aaauuaugugaca

SEQ ID NO: 2225680 - RNA, 23 nt, Homo sapiens
cugugagccgauuguccuaucuc

SEQ ID NO: 2225681 - RNA, 16 nt, Homo sapiens
cagccaaaugcaggga

SEQ ID NO: 2225682 - RNA, 12 nt, Homo sapiens
ugucaccuucac

SEQ ID NO: 2225683 - RNA, 20 nt, Homo sapiens
guauuguauaaguccuugca

SEQ ID NO: 2225684 - RNA, 14 nt, Homo sapiens
auaaugagcauguu

SEQ ID NO: 2225685 - RNA, 13 nt, Homo sapiens
ccuuggguucauu

SEQ ID NO: 2225686 - RNA, 17 nt, Homo sapiens
ugcugggauaacuggcc

SEQ ID NO: 2225687 - RNA, 17 nt, Homo sapiens
cagcagcaaauuuucag

SEQ ID NO: 2225688 - RNA, 16 nt, Homo sapiens
acagugucuggcacuu

SEQ ID NO: 2225689 - RNA, 22 nt, Homo sapiens
ugugcuuuucgcuuucuuucug

SEQ ID NO: 2225690 - RNA, 16 nt, Homo sapiens
ccaaaguccaggacac

SEQ ID NO: 2225691 - RNA, 23 nt, Homo sapiens
agucggauacccuggagcaagac

SEQ ID NO: 2225692 - RNA, 22 nt, Homo sapiens
agacacguggcagccacacuca

SEQ ID NO: 2225693 - RNA, 14 nt, Homo sapiens
augccuuaccuaag

SEQ ID NO: 2225694 - RNA, 18 nt, Homo sapiens
aguacuggcacaaaaaca

SEQ ID NO: 2225695 - RNA, 23 nt, Homo sapiens
acacuguguccuggugcucucug

SEQ ID NO: 2225696 - RNA, 16 nt, Homo sapiens
acuuauaucaucagca

SEQ ID NO: 2225697 - RNA, 22 nt, Homo sapiens
cuuuucuuuuucccaggccaga

SEQ ID NO: 2225698 - RNA, 16 nt, Homo sapiens
accuucagucaagaaa

SEQ ID NO: 2225699 - RNA, 18 nt, Homo sapiens
ugccacgcacuuccucuc

SEQ ID NO: 2225700 - RNA, 21 nt, Homo sapiens
aguuucccuucucccagucca

SEQ ID NO: 2225701 - RNA, 20 nt, Homo sapiens
auagauauuuuauauguaug

SEQ ID NO: 2225702 - RNA, 16 nt, Homo sapiens
caccucagcugauauu

SEQ ID NO: 2225703 - RNA, 16 nt, Homo sapiens
agagugcaguggugca

SEQ ID NO: 2225704 - RNA, 17 nt, Homo sapiens
gcccuucacuuccauca

SEQ ID NO: 2225705 - RNA, 17 nt, Homo sapiens
guacaaugaguguuaua

SEQ ID NO: 2225706 - RNA, 17 nt, Homo sapiens
cucaaucacugcucccc

SEQ ID NO: 2225707 - RNA, 22 nt, Homo sapiens
uggagacccugccacagccaga

SEQ ID NO: 2225708 - RNA, 21 nt, Homo sapiens
acacggcugugacgagguggc

SEQ ID NO: 2225709 - RNA, 16 nt, Homo sapiens
uccuacugauguuccu

SEQ ID NO: 2225710 - RNA, 21 nt, Homo sapiens
accaguguaucaggucaggga

SEQ ID NO: 2225711 - RNA, 18 nt, Homo sapiens
uggugaauaacuaugcca

SEQ ID NO: 2225712 - RNA, 23 nt, Homo sapiens
aaauauucaguaacuuguuuaca

SEQ ID NO: 2225713 - RNA, 22 nt, Homo sapiens
ccugcuagucgccccucagagc

SEQ ID NO: 2225714 - RNA, 22 nt, Homo sapiens
ugcacacucacuggcaucuuug

SEQ ID NO: 2225715 - RNA, 19 nt, Homo sapiens
gugucaccucccugaaauu

SEQ ID NO: 2225716 - RNA, 14 nt, Homo sapiens
cugugacccacuua

SEQ ID NO: 2225717 - RNA, 13 nt, Homo sapiens
cuacagaaaagaa

SEQ ID NO: 2225718 - RNA, 16 nt, Homo sapiens
uuccuuuccauuguag

SEQ ID NO: 2225719 - RNA, 13 nt, Homo sapiens
augagcaaccugg

SEQ ID NO: 2225720 - RNA, 21 nt, Homo sapiens
ugaggguccucaguccacugc

SEQ ID NO: 2225721 - RNA, 19 nt, Homo sapiens
ugcaagauuucacaucagc

SEQ ID NO: 2225722 - RNA, 22 nt, Homo sapiens
aggcugccuccuuuaaacugca

SEQ ID NO: 2225723 - RNA, 15 nt, Homo sapiens
agcuuagauugccuc

SEQ ID NO: 2225724 - RNA, 12 nt, Homo sapiens
cagucccggggg

SEQ ID NO: 2225725 - RNA, 14 nt, Homo sapiens
caagcaagacugag

SEQ ID NO: 2225726 - RNA, 21 nt, Homo sapiens
agauggaaaagggagauucag

SEQ ID NO: 2225727 - RNA, 15 nt, Homo sapiens
aagacucacuucuca

SEQ ID NO: 2225728 - RNA, 21 nt, Homo sapiens
uuguauguuuucuguaaggaa

SEQ ID NO: 2225729 - RNA, 22 nt, Homo sapiens
auuuaguuugauuauucagugu

SEQ ID NO: 2225730 - RNA, 21 nt, Homo sapiens
aaaauuuugugacauuccuuc

SEQ ID NO: 2225731 - RNA, 16 nt, Homo sapiens
uuugcuuuaguacaau

SEQ ID NO: 2225732 - RNA, 16 nt, Homo sapiens
aaacccagugucagga

SEQ ID NO: 2225733 - RNA, 12 nt, Homo sapiens
cuacuaccucuu

SEQ ID NO: 2225734 - RNA, 18 nt, Homo sapiens
auagcucuguaguggaau

SEQ ID NO: 2225735 - RNA, 14 nt, Homo sapiens
cuuauucccagugu

SEQ ID NO: 2225736 - RNA, 21 nt, Homo sapiens
acuagcccaaugaaaugaauu

SEQ ID NO: 2225737 - RNA, 19 nt, Homo sapiens
ugguguagguaggucuguu

SEQ ID NO: 2225738 - RNA, 21 nt, Homo sapiens
cuguugcauuuuuaaccaaca

SEQ ID NO: 2225739 - RNA, 22 nt, Homo sapiens
auuuuauaccaaaggugcuaca

SEQ ID NO: 2225740 - RNA, 23 nt, Homo sapiens
uugcugcuucaauuuauaccuca

SEQ ID NO: 2225741 - RNA, 22 nt, Homo sapiens
guacauuuggcauuuguguuau

SEQ ID NO: 2225742 - RNA, 12 nt, Homo sapiens
aaauauuucagg

SEQ ID NO: 2225743 - RNA, 20 nt, Homo sapiens
uuauuuaaccugaguauagu

SEQ ID NO: 2225744 - RNA, 22 nt, Homo sapiens
uuuaccuuucagugcaguuucu

SEQ ID NO: 2225745 - RNA, 23 nt, Homo sapiens
aauuaaccauuuuaaaguaaaca

SEQ ID NO: 2225746 - RNA, 23 nt, Homo sapiens
uacaagguguuguuaaaacacaa

SEQ ID NO: 2225747 - RNA, 15 nt, Homo sapiens
uuagccauuucucca

SEQ ID NO: 2225748 - RNA, 16 nt, Homo sapiens
uauucuguaguugcag

SEQ ID NO: 2225749 - RNA, 18 nt, Homo sapiens
aauucuuccuuagacuua

SEQ ID NO: 2225750 - RNA, 17 nt, Homo sapiens
ugagcagcuuagacagc

SEQ ID NO: 2225751 - RNA, 21 nt, Homo sapiens
aaauucugguauacauugaau

SEQ ID NO: 2225752 - RNA, 18 nt, Homo sapiens
gccaaggcuuuugcaaag

SEQ ID NO: 2225753 - RNA, 16 nt, Homo sapiens
ugccuuggugugcugu

SEQ ID NO: 2225754 - RNA, 19 nt, Homo sapiens
gccauggugacauugugga

SEQ ID NO: 2225755 - RNA, 21 nt, Homo sapiens
gccuuauuuuuguaugccuuu

SEQ ID NO: 2225756 - RNA, 18 nt, Homo sapiens
uauucauuuauuggcuua

SEQ ID NO: 2225757 - RNA, 16 nt, Homo sapiens
gacccuccccaaaggc

SEQ ID NO: 2225758 - RNA, 20 nt, Homo sapiens
uucacccugcauuacaugug

SEQ ID NO: 2225759 - RNA, 23 nt, Homo sapiens
aaguacuuuucuguucaucacca

SEQ ID NO: 2225760 - RNA, 17 nt, Homo sapiens
aggccuuuuaacauuuu

SEQ ID NO: 2225761 - RNA, 13 nt, Homo sapiens
gacccacauguaa

SEQ ID NO: 2225762 - RNA, 23 nt, Homo sapiens
auaaauuucugggauauuuaacu

SEQ ID NO: 2225763 - RNA, 16 nt, Homo sapiens
aggguauauacaaauu

SEQ ID NO: 2225764 - RNA, 17 nt, Homo sapiens
agaauaaaggcaguuuu

SEQ ID NO: 2225765 - RNA, 22 nt, Homo sapiens
uaguacuauuauggaauuacuc

SEQ ID NO: 2225766 - RNA, 13 nt, Homo sapiens
ccccacacagcua

SEQ ID NO: 2225767 - RNA, 18 nt, Homo sapiens
uguauuuugaaaacacuu

SEQ ID NO: 2225768 - RNA, 17 nt, Homo sapiens
acugugucugaaucaug

SEQ ID NO: 2225769 - RNA, 13 nt, Homo sapiens
uuuucugccaaaa

SEQ ID NO: 2225770 - RNA, 21 nt, Homo sapiens
agagacuuggggaccagaggu

SEQ ID NO: 2225771 - RNA, 13 nt, Homo sapiens
agcaaaacaagga

SEQ ID NO: 2225772 - RNA, 15 nt, Homo sapiens
aacccucugaagaag

SEQ ID NO: 2225773 - RNA, 19 nt, Homo sapiens
auaugaagagcaacuggga

SEQ ID NO: 2225774 - RNA, 16 nt, Homo sapiens
cuaaucacaugugcug

SEQ ID NO: 2225775 - RNA, 14 nt, Homo sapiens
cuagauacuggaaa

SEQ ID NO: 2225776 - RNA, 19 nt, Homo sapiens
agagcccuugccuccccau

SEQ ID NO: 2225777 - RNA, 19 nt, Homo sapiens
cucagagagggcaggcaug

SEQ ID NO: 2225778 - RNA, 11 nt, Homo sapiens
uccacuggccu

SEQ ID NO: 2225779 - RNA, 19 nt, Homo sapiens
agccuuagaagucacacag

SEQ ID NO: 2225780 - RNA, 17 nt, Homo sapiens
uacacagaaacacugcc

SEQ ID NO: 2225781 - RNA, 20 nt, Homo sapiens
aauuuugugcaugaaacaga

SEQ ID NO: 2225782 - RNA, 14 nt, Homo sapiens
auucauuacuagau

SEQ ID NO: 2225783 - RNA, 19 nt, Homo sapiens
gcucaggacagaugccaca

SEQ ID NO: 2225784 - RNA, 19 nt, Homo sapiens
agagauauugugaggacaa

SEQ ID NO: 2225785 - RNA, 18 nt, Homo sapiens
agagugaaaccaugacug

SEQ ID NO: 2225786 - RNA, 19 nt, Homo sapiens
uaugauggggcaugugcca

SEQ ID NO: 2225787 - RNA, 23 nt, Homo sapiens
auccaagacuuagagcugggaau

SEQ ID NO: 2225788 - RNA, 23 nt, Homo sapiens
aacuccccauuggugcuaccugg

SEQ ID NO: 2225789 - RNA, 20 nt, Homo sapiens
acaccauaagcuacugccau

SEQ ID NO: 2225790 - RNA, 18 nt, Homo sapiens
uaaaauaguuccagauaa

SEQ ID NO: 2225791 - RNA, 19 nt, Homo sapiens
aauugaaaguuuauaugcu

SEQ ID NO: 2225792 - RNA, 12 nt, Homo sapiens
cucaugcugcuc

SEQ ID NO: 2225793 - RNA, 22 nt, Homo sapiens
agaugacauugcuaagaugcuc

SEQ ID NO: 2225794 - RNA, 13 nt, Homo sapiens
aguccaugcuucu

SEQ ID NO: 2225795 - RNA, 14 nt, Homo sapiens
agcaggugaccucc

SEQ ID NO: 2225796 - RNA, 14 nt, Homo sapiens
gguuaaaacauaag

SEQ ID NO: 2225797 - RNA, 14 nt, Homo sapiens
aaaaauguaucaaa

SEQ ID NO: 2225798 - RNA, 20 nt, Homo sapiens
agccuugacaauagaacauu

SEQ ID NO: 2225799 - RNA, 18 nt, Homo sapiens
gaaaagcugccauuuccc

SEQ ID NO: 2225800 - RNA, 13 nt, Homo sapiens
aacauguccccuu

SEQ ID NO: 2225801 - RNA, 17 nt, Homo sapiens
gaaauggcuguaucauu

SEQ ID NO: 2225802 - RNA, 14 nt, Homo sapiens
gccuguccccaugc

SEQ ID NO: 2225803 - RNA, 22 nt, Homo sapiens
ccugaaacccgcccucaggggc

SEQ ID NO: 2225804 - RNA, 24 nt, Homo sapiens
gacacacuguuacacgugccugua

SEQ ID NO: 2225805 - RNA, 13 nt, Homo sapiens
gguccaugucuau

SEQ ID NO: 2225806 - RNA, 15 nt, Homo sapiens
uccuacuucuauauc

SEQ ID NO: 2225807 - RNA, 19 nt, Homo sapiens
uggaagaugcagaagcaau

SEQ ID NO: 2225808 - RNA, 15 nt, Homo sapiens
ccagcgcggcugcuu

SEQ ID NO: 2225809 - RNA, 23 nt, Homo sapiens
aacugaaagcugaauccuuccau

SEQ ID NO: 2225810 - RNA, 14 nt, Homo sapiens
cugcuuuaauuuca

SEQ ID NO: 2225811 - RNA, 19 nt, Homo sapiens
auugagggagcugggagac

SEQ ID NO: 2225812 - RNA, 11 nt, Homo sapiens
cugcagccuuc

SEQ ID NO: 2225813 - RNA, 22 nt, Homo sapiens
ugcugccccucccugccuccac

SEQ ID NO: 2225814 - RNA, 17 nt, Homo sapiens
cuaguaauaauguaaua

SEQ ID NO: 2225815 - RNA, 22 nt, Homo sapiens
aucaacauucccccaacauuac

SEQ ID NO: 2225816 - RNA, 15 nt, Homo sapiens
ccuggaacacaaaac

SEQ ID NO: 2225817 - RNA, 17 nt, Homo sapiens
agaccucaucugccugc

SEQ ID NO: 2225818 - RNA, 18 nt, Homo sapiens
aucaaaaaaccuuuacag

SEQ ID NO: 2225819 - RNA, 14 nt, Homo sapiens
ucaacagaaugaaa

SEQ ID NO: 2225820 - RNA, 15 nt, Homo sapiens
ugcccuggccuacca

SEQ ID NO: 2225821 - RNA, 23 nt, Homo sapiens
cugccucugccaugcccagagaa

SEQ ID NO: 2225822 - RNA, 21 nt, Homo sapiens
agcugaguggccagccagugc

SEQ ID NO: 2225823 - RNA, 13 nt, Homo sapiens
cuagguucaggaa

SEQ ID NO: 2225824 - RNA, 16 nt, Homo sapiens
gcuucaaaacaauaua

SEQ ID NO: 2225825 - RNA, 16 nt, Homo sapiens
gcauuuuuacuacuau

SEQ ID NO: 2225826 - RNA, 22 nt, Homo sapiens
caugcuaugcugaagacauuca

SEQ ID NO: 2225827 - RNA, 18 nt, Homo sapiens
cuauuucaauacuuacau

SEQ ID NO: 2225828 - RNA, 23 nt, Homo sapiens
guauuuuaauaguacauaaucuu

SEQ ID NO: 2225829 - RNA, 12 nt, Homo sapiens
gaaucugaccac

SEQ ID NO: 2225830 - RNA, 12 nt, Homo sapiens
gacucugacccc

SEQ ID NO: 2225831 - RNA, 21 nt, Homo sapiens
agcauccacucucccuugucc

SEQ ID NO: 2225832 - RNA, 12 nt, Homo sapiens
aucccaagagaa

SEQ ID NO: 2225833 - RNA, 16 nt, Homo sapiens
auuuuaauccuucuaa

SEQ ID NO: 2225834 - RNA, 20 nt, Homo sapiens
agcuggcacugccacugugg

SEQ ID NO: 2225835 - RNA, 17 nt, Homo sapiens
cagccccgaugauucuu

SEQ ID NO: 2225836 - RNA, 21 nt, Homo sapiens
cagccuuucguucugcugacc

SEQ ID NO: 2225837 - RNA, 17 nt, Homo sapiens
uuccuccccaaccugca

SEQ ID NO: 2225838 - RNA, 21 nt, Homo sapiens
gugaacaaaguuuaccagaaa

SEQ ID NO: 2225839 - RNA, 15 nt, Homo sapiens
caaaacccacagaag

SEQ ID NO: 2225840 - RNA, 17 nt, Homo sapiens
gcugcuuuguucaaugc

SEQ ID NO: 2225841 - RNA, 16 nt, Homo sapiens
uaccuauugcacucca

SEQ ID NO: 2225842 - RNA, 13 nt, Homo sapiens
cacuuaauagcaa

SEQ ID NO: 2225843 - RNA, 22 nt, Homo sapiens
guuggucaggcuggucucaaac

SEQ ID NO: 2225844 - RNA, 19 nt, Homo sapiens
gcaagaacauucaaaccaa

SEQ ID NO: 2225845 - RNA, 14 nt, Homo sapiens
uucauauugcauca

SEQ ID NO: 2225846 - RNA, 18 nt, Homo sapiens
guuuuacuguccaaagac

SEQ ID NO: 2225847 - RNA, 18 nt, Homo sapiens
auucuuguagaugcauua

SEQ ID NO: 2225848 - RNA, 20 nt, Homo sapiens
ggugcacagaccucagagau

SEQ ID NO: 2225849 - RNA, 12 nt, Homo sapiens
uuaaucaaugau

SEQ ID NO: 2225850 - RNA, 17 nt, Homo sapiens
ccugugucaucugucag

SEQ ID NO: 2225851 - RNA, 12 nt, Homo sapiens
uauaaugaauuu

SEQ ID NO: 2225852 - RNA, 22 nt, Homo sapiens
cucaaaacagagggcugcauuc

SEQ ID NO: 2225853 - RNA, 17 nt, Homo sapiens
aacugaggucacugggu

SEQ ID NO: 2225854 - RNA, 17 nt, Homo sapiens
cacccaggugauuuccu

SEQ ID NO: 2225855 - RNA, 21 nt, Homo sapiens
aguuucugcggaagcugguga

SEQ ID NO: 2225856 - RNA, 23 nt, Homo sapiens
cauuaccuguucuugccuaauaa

SEQ ID NO: 2225857 - RNA, 23 nt, Homo sapiens
gagugcuuauaauauacauaacu

SEQ ID NO: 2225858 - RNA, 18 nt, Homo sapiens
uugucacuuuccucuucc

SEQ ID NO: 2225859 - RNA, 13 nt, Homo sapiens
ugacaaccaaaag

SEQ ID NO: 2225860 - RNA, 18 nt, Homo sapiens
ccuaauuaaacuaugaug

SEQ ID NO: 2225861 - RNA, 20 nt, Homo sapiens
ggccuuacuucccagcccug

SEQ ID NO: 2225862 - RNA, 16 nt, Homo sapiens
ucuccagugugccaga

SEQ ID NO: 2225863 - RNA, 18 nt, Homo sapiens
guuuacagcaauuccugg

SEQ ID NO: 2225864 - RNA, 21 nt, Homo sapiens
ccaugccucccccuagccauu

SEQ ID NO: 2225865 - RNA, 21 nt, Homo sapiens
auucuaaguuauuuacuuuua

SEQ ID NO: 2225866 - RNA, 14 nt, Homo sapiens
ccaugaagaccaca

SEQ ID NO: 2225867 - RNA, 16 nt, Homo sapiens
accuccacucugccau

SEQ ID NO: 2225868 - RNA, 15 nt, Homo sapiens
uaaaaaugagugcuu

SEQ ID NO: 2225869 - RNA, 14 nt, Homo sapiens
gccucuuccagggc

SEQ ID NO: 2225870 - RNA, 12 nt, Homo sapiens
agugccaaagaa

SEQ ID NO: 2225871 - RNA, 12 nt, Homo sapiens
aaugccaaaaaa

SEQ ID NO: 2225872 - RNA, 16 nt, Homo sapiens
gagaucuuacagguau

SEQ ID NO: 2225873 - RNA, 23 nt, Homo sapiens
gccaugcuuccuauacaguucua

SEQ ID NO: 2225874 - RNA, 18 nt, Homo sapiens
acuuugggccgggcagca

SEQ ID NO: 2225875 - RNA, 18 nt, Homo sapiens
aaacagcucgacuuuaaa

SEQ ID NO: 2225876 - RNA, 16 nt, Homo sapiens
cucgcacuacaucuga

SEQ ID NO: 2225877 - RNA, 20 nt, Homo sapiens
acaaaucaaguuuccaagca

SEQ ID NO: 2225878 - RNA, 15 nt, Homo sapiens
cugaaauagaggcua

SEQ ID NO: 2225879 - RNA, 20 nt, Homo sapiens
gcuaucuaauuuuacacucu

SEQ ID NO: 2225880 - RNA, 17 nt, Homo sapiens
aggaaggaaagcacagc

SEQ ID NO: 2225881 - RNA, 13 nt, Homo sapiens
agucuggcucugu

SEQ ID NO: 2225882 - RNA, 18 nt, Homo sapiens
cggcucacgccuguaauc

SEQ ID NO: 2225883 - RNA, 12 nt, Homo sapiens
aucugacuauga

SEQ ID NO: 2225884 - RNA, 12 nt, Homo sapiens
uggagacuugcu

SEQ ID NO: 2225885 - RNA, 13 nt, Homo sapiens
aaugcuuaauuca

SEQ ID NO: 2225886 - RNA, 18 nt, Homo sapiens
aucuucacugucugacuu

SEQ ID NO: 2225887 - RNA, 15 nt, Homo sapiens
ucugaguuuuaccaa

SEQ ID NO: 2225888 - RNA, 14 nt, Homo sapiens
uauuaagagcaauu

SEQ ID NO: 2225889 - RNA, 23 nt, Homo sapiens
uagauacaaucagcugcuuuguu

SEQ ID NO: 2225890 - RNA, 13 nt, Homo sapiens
agaccacauccac

SEQ ID NO: 2225891 - RNA, 14 nt, Homo sapiens
cuggcuuccagggg

SEQ ID NO: 2225892 - RNA, 14 nt, Homo sapiens
aaugucauuugcua

SEQ ID NO: 2225893 - RNA, 15 nt, Homo sapiens
uuuagggaagacauu

SEQ ID NO: 2225894 - RNA, 16 nt, Homo sapiens
gcugugugacuuugaa

SEQ ID NO: 2225895 - RNA, 22 nt, Homo sapiens
gaaaaauauaauguugauaaua

SEQ ID NO: 2225896 - RNA, 12 nt, Homo sapiens
uggcugugacaa

SEQ ID NO: 2225897 - RNA, 23 nt, Homo sapiens
agaaacguguacccauauauaau

SEQ ID NO: 2225898 - RNA, 15 nt, Homo sapiens
uaaauccauuuucua

SEQ ID NO: 2225899 - RNA, 16 nt, Homo sapiens
gaagcuggaagcacug

SEQ ID NO: 2225900 - RNA, 21 nt, Homo sapiens
ucugccaggcucuaaagccaa

SEQ ID NO: 2225901 - RNA, 14 nt, Homo sapiens
uugauaaugggaug

SEQ ID NO: 2225902 - RNA, 15 nt, Homo sapiens
gcacgaacaccaagu

SEQ ID NO: 2225903 - RNA, 22 nt, Homo sapiens
guugccugggggcuuuugccac

SEQ ID NO: 2225904 - RNA, 17 nt, Homo sapiens
ugccaagcucaggacca

SEQ ID NO: 2225905 - RNA, 14 nt, Homo sapiens
gaaagggacacaau

SEQ ID NO: 2225906 - RNA, 20 nt, Homo sapiens
uguggaugagcccucagaac

SEQ ID NO: 2225907 - RNA, 15 nt, Homo sapiens
ccuacugcaaauggc

SEQ ID NO: 2225908 - RNA, 19 nt, Homo sapiens
ucucuggagccaaguccag

SEQ ID NO: 2225909 - RNA, 18 nt, Homo sapiens
ccuucgccaccuggguuc

SEQ ID NO: 2225910 - RNA, 21 nt, Homo sapiens
uaaaugcugucaacuaugaua

SEQ ID NO: 2225911 - RNA, 21 nt, Homo sapiens
gccaggcugccugugugcaug

SEQ ID NO: 2225912 - RNA, 11 nt, Homo sapiens
cagacuugccu

SEQ ID NO: 2225913 - RNA, 14 nt, Homo sapiens
ucgcccccacuuuu

SEQ ID NO: 2225914 - RNA, 14 nt, Homo sapiens
cucccuagccagag

SEQ ID NO: 2225915 - RNA, 16 nt, Homo sapiens
uggagcccagcgucag

SEQ ID NO: 2225916 - RNA, 17 nt, Homo sapiens
cugacgcagccugagaa

SEQ ID NO: 2225917 - RNA, 12 nt, Homo sapiens
uagggcucagag

SEQ ID NO: 2225918 - RNA, 23 nt, Homo sapiens
acuucuguugcccuugugcucca

SEQ ID NO: 2225919 - RNA, 18 nt, Homo sapiens
agucucugagggcuuccu

SEQ ID NO: 2225920 - RNA, 22 nt, Homo sapiens
uuuaacacuagaaaacauucca

SEQ ID NO: 2225921 - RNA, 23 nt, Homo sapiens
ggcaggcuucucagucucugucc

SEQ ID NO: 2225922 - RNA, 17 nt, Homo sapiens
uaguuccugugcacagc

SEQ ID NO: 2225923 - RNA, 15 nt, Homo sapiens
cucuuagauucuuaa

SEQ ID NO: 2225924 - RNA, 12 nt, Homo sapiens
cucuuuaccucc

SEQ ID NO: 2225925 - RNA, 13 nt, Homo sapiens
aaagggacuaccu

SEQ ID NO: 2225926 - RNA, 17 nt, Homo sapiens
accguugcacaaaaagg

SEQ ID NO: 2225927 - RNA, 14 nt, Homo sapiens
cucguguuucacag

SEQ ID NO: 2225928 - RNA, 17 nt, Homo sapiens
guuuaggaauccuuugg

SEQ ID NO: 2225929 - RNA, 13 nt, Homo sapiens
cuacaaauuugag

SEQ ID NO: 2225930 - RNA, 22 nt, Homo sapiens
ccuaauguggcagcugucucaa

SEQ ID NO: 2225931 - RNA, 20 nt, Homo sapiens
cuggcaugagccacugugcc

SEQ ID NO: 2225932 - RNA, 12 nt, Homo sapiens
ggagcuugccug

SEQ ID NO: 2225933 - RNA, 14 nt, Homo sapiens
caccucauucugaa

SEQ ID NO: 2225934 - RNA, 23 nt, Homo sapiens
uaagucauuuguaugaauaugug

SEQ ID NO: 2225935 - RNA, 14 nt, Homo sapiens
acuugagccaucca

SEQ ID NO: 2225936 - RNA, 14 nt, Homo sapiens
acccguagaugcca

SEQ ID NO: 2225937 - RNA, 20 nt, Homo sapiens
uucucugccgguggggccag

SEQ ID NO: 2225938 - RNA, 20 nt, Homo sapiens
uggaggguguucggggccca

SEQ ID NO: 2225939 - RNA, 19 nt, Homo sapiens
aggaaaaaaagcauguaug

SEQ ID NO: 2225940 - RNA, 13 nt, Homo sapiens
ugcuguacaugac

SEQ ID NO: 2225941 - RNA, 16 nt, Homo sapiens
accaaauuauugucca

SEQ ID NO: 2225942 - RNA, 21 nt, Homo sapiens
uugaaucuugucccagccuca

SEQ ID NO: 2225943 - RNA, 21 nt, Homo sapiens
cuagaagcuccagugauaaga

SEQ ID NO: 2225944 - RNA, 23 nt, Homo sapiens
cauauggguaguuaugggguuua

SEQ ID NO: 2225945 - RNA, 15 nt, Homo sapiens
acuuaguauugcaaa

SEQ ID NO: 2225946 - RNA, 15 nt, Homo sapiens
ugcuuaguaucucau

SEQ ID NO: 2225947 - RNA, 22 nt, Homo sapiens
aaauguucaagucaugccugag

SEQ ID NO: 2225948 - RNA, 15 nt, Homo sapiens
ccuguuaggccaacu

SEQ ID NO: 2225949 - RNA, 17 nt, Homo sapiens
ugucuauguagcugaaa

SEQ ID NO: 2225950 - RNA, 16 nt, Homo sapiens
ucccaugcugaccugu

SEQ ID NO: 2225951 - RNA, 12 nt, Homo sapiens
uguguguggcag

SEQ ID NO: 2225952 - RNA, 12 nt, Homo sapiens
ggucugugucac

SEQ ID NO: 2225953 - RNA, 16 nt, Homo sapiens
auucuccugccuuagc

SEQ ID NO: 2225954 - RNA, 17 nt, Homo sapiens
gaaccaaauugcacuga

SEQ ID NO: 2225955 - RNA, 16 nt, Homo sapiens
caauucagucugcucu

SEQ ID NO: 2225956 - RNA, 15 nt, Homo sapiens
agggaagaaagcaga

SEQ ID NO: 2225957 - RNA, 17 nt, Homo sapiens
gccagcuuaucucaggg

SEQ ID NO: 2225958 - RNA, 23 nt, Homo sapiens
ggaguaggugggggaacacugag

SEQ ID NO: 2225959 - RNA, 22 nt, Homo sapiens
ugcuggaaaucucaaaacugua

SEQ ID NO: 2225960 - RNA, 11 nt, Homo sapiens
aguaagagcuu

SEQ ID NO: 2225961 - RNA, 19 nt, Homo sapiens
gccaggcuggagugcagug

SEQ ID NO: 2225962 - RNA, 17 nt, Homo sapiens
auaucacaugucagcca

SEQ ID NO: 2225963 - RNA, 23 nt, Homo sapiens
caucaauaguguccuaugcaaua

SEQ ID NO: 2225964 - RNA, 18 nt, Homo sapiens
auauuaaggcaguaugcc

SEQ ID NO: 2225965 - RNA, 21 nt, Homo sapiens
cuaauccucuuuuucuagucu

SEQ ID NO: 2225966 - RNA, 19 nt, Homo sapiens
acauuugguuucugaauaa

SEQ ID NO: 2225967 - RNA, 13 nt, Homo sapiens
ugagguaccucca

SEQ ID NO: 2225968 - RNA, 13 nt, Homo sapiens
agcuuuacgcuca

SEQ ID NO: 2225969 - RNA, 19 nt, Homo sapiens
cuccaaagucauaauugca

SEQ ID NO: 2225970 - RNA, 14 nt, Homo sapiens
ugaaugauaaacuc

SEQ ID NO: 2225971 - RNA, 16 nt, Homo sapiens
uaaaaugcaccaauca

SEQ ID NO: 2225972 - RNA, 15 nt, Homo sapiens
ugguagaaaggcagu

SEQ ID NO: 2225973 - RNA, 20 nt, Homo sapiens
gagaaaggggauguauccau

SEQ ID NO: 2225974 - RNA, 18 nt, Homo sapiens
cucuccagcaucccagcc

SEQ ID NO: 2225975 - RNA, 14 nt, Homo sapiens
gcacaaaagggacu

SEQ ID NO: 2225976 - RNA, 14 nt, Homo sapiens
agcucaaagacuuc

SEQ ID NO: 2225977 - RNA, 23 nt, Homo sapiens
acaccagggccagccucuagagc

SEQ ID NO: 2225978 - RNA, 14 nt, Homo sapiens
ggcacgguggcuca

SEQ ID NO: 2225979 - RNA, 17 nt, Homo sapiens
uguggacuaaauaucug

SEQ ID NO: 2225980 - RNA, 22 nt, Homo sapiens
aagagaagcccagcucugggaa

SEQ ID NO: 2225981 - RNA, 24 nt, Homo sapiens
ccggccgauggagacaccaaccga

SEQ ID NO: 2225982 - RNA, 11 nt, Homo sapiens
ggggccagugg

SEQ ID NO: 2225983 - RNA, 22 nt, Homo sapiens
auuuuuauaaauuacuaucugu

SEQ ID NO: 2225984 - RNA, 18 nt, Homo sapiens
acacccucccuccagggu

SEQ ID NO: 2225985 - RNA, 18 nt, Homo sapiens
ugcagugauguuugccau

SEQ ID NO: 2225986 - RNA, 12 nt, Homo sapiens
guaaauacaugu

SEQ ID NO: 2225987 - RNA, 16 nt, Homo sapiens
gcagggacuccaugcu

SEQ ID NO: 2225988 - RNA, 17 nt, Homo sapiens
ugggacuggcacuauuu

SEQ ID NO: 2225989 - RNA, 16 nt, Homo sapiens
guaugaaaaucagcau

SEQ ID NO: 2225990 - RNA, 12 nt, Homo sapiens
aauaucaugcaa

SEQ ID NO: 2225991 - RNA, 18 nt, Homo sapiens
caguagaaauaauaugca

SEQ ID NO: 2225992 - RNA, 20 nt, Homo sapiens
ugaauaacauuuaaauucca

SEQ ID NO: 2225993 - RNA, 13 nt, Homo sapiens
acuuaauuugaaa

SEQ ID NO: 2225994 - RNA, 18 nt, Homo sapiens
ugcauacagagacagaua

SEQ ID NO: 2225995 - RNA, 21 nt, Homo sapiens
gagaagccagcuuuccucauc

SEQ ID NO: 2225996 - RNA, 22 nt, Homo sapiens
ugccauauugcacaugucuuaa

SEQ ID NO: 2225997 - RNA, 17 nt, Homo sapiens
uaagauguaaguauuaa

SEQ ID NO: 2225998 - RNA, 22 nt, Homo sapiens
gaagacaucuuauccauccuca

SEQ ID NO: 2225999 - RNA, 13 nt, Homo sapiens
uuaguguugugga

SEQ ID NO: 2226000 - RNA, 16 nt, Homo sapiens
uauacaaaacuuuauc

SEQ ID NO: 2226001 - RNA, 12 nt, Homo sapiens
accugcaggcug

SEQ ID NO: 2226002 - RNA, 23 nt, Homo sapiens
aagaauuaaucaagacucuugaa

SEQ ID NO: 2226003 - RNA, 19 nt, Homo sapiens
accugucaaccugaauuaa

SEQ ID NO: 2226004 - RNA, 18 nt, Homo sapiens
cugcucaggguucaucug

SEQ ID NO: 2226005 - RNA, 22 nt, Homo sapiens
cugaagaccagcuguguuucuu

SEQ ID NO: 2226006 - RNA, 15 nt, Homo sapiens
ugccagguuccugua

SEQ ID NO: 2226007 - RNA, 21 nt, Homo sapiens
gaccaaacccuuagcagccca

SEQ ID NO: 2226008 - RNA, 20 nt, Homo sapiens
ccugauuuccauuugcaaca

SEQ ID NO: 2226009 - RNA, 12 nt, Homo sapiens
gagagucuccca

SEQ ID NO: 2226010 - RNA, 13 nt, Homo sapiens
uugaagcucagaa

SEQ ID NO: 2226011 - RNA, 16 nt, Homo sapiens
cuacuuguaaaggugc

SEQ ID NO: 2226012 - RNA, 13 nt, Homo sapiens
uagacacagguca

SEQ ID NO: 2226013 - RNA, 17 nt, Homo sapiens
uauuaauauauuuccau

SEQ ID NO: 2226014 - RNA, 15 nt, Homo sapiens
gagaagaaacagcag

SEQ ID NO: 2226015 - RNA, 19 nt, Homo sapiens
uuugaauuauccacaugaa

SEQ ID NO: 2226016 - RNA, 18 nt, Homo sapiens
cucaaaccaagcaaagga

SEQ ID NO: 2226017 - RNA, 18 nt, Homo sapiens
agggcagccagggagagc

SEQ ID NO: 2226018 - RNA, 16 nt, Homo sapiens
uaacuauuuuuccuca

SEQ ID NO: 2226019 - RNA, 21 nt, Homo sapiens
cagggcucagccuggugggcc

SEQ ID NO: 2226020 - RNA, 22 nt, Homo sapiens
ccugagccccuuauucccgcuc

SEQ ID NO: 2226021 - RNA, 22 nt, Homo sapiens
ccucuuccagggccucugggag

SEQ ID NO: 2226022 - RNA, 23 nt, Homo sapiens
uaaccugacagaggugucaucca

SEQ ID NO: 2226023 - RNA, 20 nt, Homo sapiens
cugagguuuuuaacauguau

SEQ ID NO: 2226024 - RNA, 22 nt, Homo sapiens
ucugcuccccugugaacccacu

SEQ ID NO: 2226025 - RNA, 18 nt, Homo sapiens
gggaaaggaaucagagag

SEQ ID NO: 2226026 - RNA, 13 nt, Homo sapiens
ccagacuugccuu

SEQ ID NO: 2226027 - RNA, 13 nt, Homo sapiens
gacauacaugcua

SEQ ID NO: 2226028 - RNA, 22 nt, Homo sapiens
ugccccaucccaugcuguccau

SEQ ID NO: 2226029 - RNA, 15 nt, Homo sapiens
agaguauggagcuca

SEQ ID NO: 2226030 - RNA, 13 nt, Homo sapiens
uaauaaaggccuu

SEQ ID NO: 2226031 - RNA, 17 nt, Homo sapiens
uccuacucagacuguug

SEQ ID NO: 2226032 - RNA, 15 nt, Homo sapiens
aaccuuaaaccugca

SEQ ID NO: 2226033 - RNA, 17 nt, Homo sapiens
accuucuauuugcccag

SEQ ID NO: 2226034 - RNA, 20 nt, Homo sapiens
ucuuccaucagcucucugca

SEQ ID NO: 2226035 - RNA, 16 nt, Homo sapiens
uggaaacauggaggaa

SEQ ID NO: 2226036 - RNA, 17 nt, Homo sapiens
ugguuccuccagccacc

SEQ ID NO: 2226037 - RNA, 19 nt, Homo sapiens
ucucuauugaccaccaguu

SEQ ID NO: 2226038 - RNA, 14 nt, Homo sapiens
gcuauguaaggguc

SEQ ID NO: 2226039 - RNA, 19 nt, Homo sapiens
uguaccaaaaaauauugcu

SEQ ID NO: 2226040 - RNA, 22 nt, Homo sapiens
cagagcgugcacuugugauccu

SEQ ID NO: 2226041 - RNA, 20 nt, Homo sapiens
guuaguuuuucuuacuugca

SEQ ID NO: 2226042 - RNA, 18 nt, Homo sapiens
cuggaguggccacuaagc

SEQ ID NO: 2226043 - RNA, 14 nt, Homo sapiens
cuagaaacacacau

SEQ ID NO: 2226044 - RNA, 16 nt, Homo sapiens
gacucuguggggccac

SEQ ID NO: 2226045 - RNA, 15 nt, Homo sapiens
uuguucauucuguga

SEQ ID NO: 2226046 - RNA, 12 nt, Homo sapiens
aaaaaccugccc

SEQ ID NO: 2226047 - RNA, 23 nt, Homo sapiens
aguggcucacgccuguaauccca

SEQ ID NO: 2226048 - RNA, 20 nt, Homo sapiens
agggccguugcccccagacu

SEQ ID NO: 2226049 - RNA, 17 nt, Homo sapiens
agccucauccagccuca

SEQ ID NO: 2226050 - RNA, 23 nt, Homo sapiens
aacaacguacuauggaagccaca

SEQ ID NO: 2226051 - RNA, 12 nt, Homo sapiens
uugcuucaauua

SEQ ID NO: 2226052 - RNA, 23 nt, Homo sapiens
uagcagaaguauaaagugaucag

SEQ ID NO: 2226053 - RNA, 12 nt, Homo sapiens
ggaacugcauca

SEQ ID NO: 2226054 - RNA, 18 nt, Homo sapiens
uccaaacuguucugagaa

SEQ ID NO: 2226055 - RNA, 20 nt, Homo sapiens
caagccuggagccccugugu

SEQ ID NO: 2226056 - RNA, 18 nt, Homo sapiens
aaagcuaaugugcaggga

SEQ ID NO: 2226057 - RNA, 17 nt, Homo sapiens
ucuaugaacaacuccaa

SEQ ID NO: 2226058 - RNA, 23 nt, Homo sapiens
gggguggccucaagagcacacag

SEQ ID NO: 2226059 - RNA, 21 nt, Homo sapiens
uaaaauuacuugguuugugaa

SEQ ID NO: 2226060 - RNA, 20 nt, Homo sapiens
aucaggaaauaucugugaag

SEQ ID NO: 2226061 - RNA, 23 nt, Homo sapiens
acugagcacuguuuucuagugua

SEQ ID NO: 2226062 - RNA, 16 nt, Homo sapiens
aaacuugagcauucaa

SEQ ID NO: 2226063 - RNA, 24 nt, Homo sapiens
gccaugauuuuggccacuuugcag

SEQ ID NO: 2226064 - RNA, 19 nt, Homo sapiens
uuaaucacuauuguuccag

SEQ ID NO: 2226065 - RNA, 20 nt, Homo sapiens
cugcuucuagaaacucuggc

SEQ ID NO: 2226066 - RNA, 13 nt, Homo sapiens
cugagacagcagu

SEQ ID NO: 2226067 - RNA, 13 nt, Homo sapiens
guacagucuugca

SEQ ID NO: 2226068 - RNA, 19 nt, Homo sapiens
aagaguaggaagacuuugg

SEQ ID NO: 2226069 - RNA, 12 nt, Homo sapiens
aaagccaugacc

SEQ ID NO: 2226070 - RNA, 15 nt, Homo sapiens
cugaggucccugugu

SEQ ID NO: 2226071 - RNA, 14 nt, Homo sapiens
agaggaucaucugg

SEQ ID NO: 2226072 - RNA, 13 nt, Homo sapiens
ugagggacaaugc

SEQ ID NO: 2226073 - RNA, 13 nt, Homo sapiens
aaaagccaugagu

SEQ ID NO: 2226074 - RNA, 23 nt, Homo sapiens
ccucuuuucugcaucaucuguag

SEQ ID NO: 2226075 - RNA, 14 nt, Homo sapiens
cuguaaaugaacac

SEQ ID NO: 2226076 - RNA, 23 nt, Homo sapiens
aguggccagccagugccauucca

SEQ ID NO: 2226077 - RNA, 16 nt, Homo sapiens
cugauuuauugaaauu

SEQ ID NO: 2226078 - RNA, 13 nt, Homo sapiens
uuaauagcacuaa

SEQ ID NO: 2226079 - RNA, 15 nt, Homo sapiens
ggauaguuucuuccc

SEQ ID NO: 2226080 - RNA, 17 nt, Homo sapiens
cagaggugaaugcacag

SEQ ID NO: 2226081 - RNA, 14 nt, Homo sapiens
gagaauauaccuua

SEQ ID NO: 2226082 - RNA, 14 nt, Homo sapiens
accugugugccagg

SEQ ID NO: 2226083 - RNA, 19 nt, Homo sapiens
cucacaggugucuccauac

SEQ ID NO: 2226084 - RNA, 17 nt, Homo sapiens
ucugauguucuuccagu

SEQ ID NO: 2226085 - RNA, 19 nt, Homo sapiens
ucuuuuccauuaaacuacu

SEQ ID NO: 2226086 - RNA, 14 nt, Homo sapiens
auucuuacuagugu

SEQ ID NO: 2226087 - RNA, 16 nt, Homo sapiens
cgcagccucacauucc

SEQ ID NO: 2226088 - RNA, 14 nt, Homo sapiens
aaggauugcaaugc

SEQ ID NO: 2226089 - RNA, 19 nt, Homo sapiens
auauuuauacagcagagaa

SEQ ID NO: 2226090 - RNA, 12 nt, Homo sapiens
ugucccuguggu

SEQ ID NO: 2226091 - RNA, 18 nt, Homo sapiens
gcauccaaauggcugcuu

SEQ ID NO: 2226092 - RNA, 21 nt, Homo sapiens
agagugaaucauccagacucc

SEQ ID NO: 2226093 - RNA, 23 nt, Homo sapiens
auagacggguugaaagacaucaa

SEQ ID NO: 2226094 - RNA, 16 nt, Homo sapiens
ugcucaguagcuuaag

SEQ ID NO: 2226095 - RNA, 22 nt, Homo sapiens
aaacuuaacaaaagugauguaa

SEQ ID NO: 2226096 - RNA, 19 nt, Homo sapiens
cauguucagucacaugugc

SEQ ID NO: 2226097 - RNA, 14 nt, Homo sapiens
ccgcugacugccac

SEQ ID NO: 2226098 - RNA, 14 nt, Homo sapiens
uguguugcuucucu

SEQ ID NO: 2226099 - RNA, 13 nt, Homo sapiens
acuacuaccucuu

SEQ ID NO: 2226100 - RNA, 19 nt, Homo sapiens
aaugaaucaacaaaccaca

SEQ ID NO: 2226101 - RNA, 16 nt, Homo sapiens
gcucuguagccaccuc

SEQ ID NO: 2226102 - RNA, 15 nt, Homo sapiens
cugacagaaugagac

SEQ ID NO: 2226103 - RNA, 16 nt, Homo sapiens
augugauuuauuuuga

SEQ ID NO: 2226104 - RNA, 15 nt, Homo sapiens
ugguuggcauuugcu

SEQ ID NO: 2226105 - RNA, 16 nt, Homo sapiens
uaucuugauaaacuag

SEQ ID NO: 2226106 - RNA, 20 nt, Homo sapiens
gagcuccccuccccaacuga

SEQ ID NO: 2226107 - RNA, 18 nt, Homo sapiens
guccgcaucacucugcau

SEQ ID NO: 2226108 - RNA, 17 nt, Homo sapiens
uggugucaugaggaaaa

SEQ ID NO: 2226109 - RNA, 23 nt, Homo sapiens
auauuugaauguguaagcauugu

SEQ ID NO: 2226110 - RNA, 22 nt, Homo sapiens
aucccugaggcuggacuccaga

SEQ ID NO: 2226111 - RNA, 14 nt, Homo sapiens
gcuuugcugcuuau

SEQ ID NO: 2226112 - RNA, 21 nt, Homo sapiens
agacuuuugugacccacuaau

SEQ ID NO: 2226113 - RNA, 16 nt, Homo sapiens
ugcagccaaacagagc

SEQ ID NO: 2226114 - RNA, 23 nt, Homo sapiens
uccgcauacaggcguacacaugc

SEQ ID NO: 2226115 - RNA, 22 nt, Homo sapiens
cugaggcaggaggauugcuuga

SEQ ID NO: 2226116 - RNA, 15 nt, Homo sapiens
agcagaaggugugcu

SEQ ID NO: 2226117 - RNA, 16 nt, Homo sapiens
cacagggcaccagagg

SEQ ID NO: 2226118 - RNA, 15 nt, Homo sapiens
gcaccuggugaucac

SEQ ID NO: 2226119 - RNA, 14 nt, Homo sapiens
uaaucucagcacuu

SEQ ID NO: 2226120 - RNA, 16 nt, Homo sapiens
acugaggggccaggga

SEQ ID NO: 2226121 - RNA, 22 nt, Homo sapiens
cuacuggaaugguguuuuguca

SEQ ID NO: 2226122 - RNA, 17 nt, Homo sapiens
agugagcccaucugcac

SEQ ID NO: 2226123 - RNA, 19 nt, Homo sapiens
guacaauaaagcaaugugg

SEQ ID NO: 2226124 - RNA, 18 nt, Homo sapiens
ugauggugucaucugcuc

SEQ ID NO: 2226125 - RNA, 22 nt, Homo sapiens
guucuacugagaaaagccucuc

SEQ ID NO: 2226126 - RNA, 23 nt, Homo sapiens
gaaaaccugaggccaaauauuga

SEQ ID NO: 2226127 - RNA, 22 nt, Homo sapiens
gccacugccccccgaggcugcu

SEQ ID NO: 2226128 - RNA, 19 nt, Homo sapiens
auucaaaagaugccauuca

SEQ ID NO: 2226129 - RNA, 14 nt, Homo sapiens
aagcccagcauuug

SEQ ID NO: 2226130 - RNA, 17 nt, Homo sapiens
aucuagagcaaagccau

SEQ ID NO: 2226131 - RNA, 18 nt, Homo sapiens
aucaccgauucuuccuug

SEQ ID NO: 2226132 - RNA, 18 nt, Homo sapiens
auaacuaaauuugauacu

SEQ ID NO: 2226133 - RNA, 13 nt, Homo sapiens
cuuucucuacuga

SEQ ID NO: 2226134 - RNA, 17 nt, Homo sapiens
guacugcugucuuccaa

SEQ ID NO: 2226135 - RNA, 17 nt, Homo sapiens
uauguagaaacauuuag

SEQ ID NO: 2226136 - RNA, 18 nt, Homo sapiens
ccagcuucugguacucuc

SEQ ID NO: 2226137 - RNA, 13 nt, Homo sapiens
uuuaaguacuuug

SEQ ID NO: 2226138 - RNA, 13 nt, Homo sapiens
agaagcacuacac

SEQ ID NO: 2226139 - RNA, 19 nt, Homo sapiens
uagcugggauuacaggugu

SEQ ID NO: 2226140 - RNA, 24 nt, Homo sapiens
gcugccuuuuuuaacacuagaaaa

SEQ ID NO: 2226141 - RNA, 18 nt, Homo sapiens
aauccccaaaaaagcgaa

SEQ ID NO: 2226142 - RNA, 13 nt, Homo sapiens
aaccauaaacuuc

SEQ ID NO: 2226143 - RNA, 12 nt, Homo sapiens
uucuuauucacu

SEQ ID NO: 2226144 - RNA, 15 nt, Homo sapiens
accagcaagucccag

SEQ ID NO: 2226145 - RNA, 14 nt, Homo sapiens
auguagcagcucau

SEQ ID NO: 2226146 - RNA, 18 nt, Homo sapiens
ggcaaagaaaagccagag

SEQ ID NO: 2226147 - RNA, 14 nt, Homo sapiens
uaaaagaucuugca

SEQ ID NO: 2226148 - RNA, 16 nt, Homo sapiens
agagcaggacugcaca

SEQ ID NO: 2226149 - RNA, 20 nt, Homo sapiens
ggucccucuucucuccucag

SEQ ID NO: 2226150 - RNA, 20 nt, Homo sapiens
ugaacaaaauuaaacuucaa

SEQ ID NO: 2226151 - RNA, 21 nt, Homo sapiens
acuuucucuagcaaguguaag

SEQ ID NO: 2226152 - RNA, 18 nt, Homo sapiens
gaaacuguagucucagga

SEQ ID NO: 2226153 - RNA, 15 nt, Homo sapiens
cagaguucugugaca

SEQ ID NO: 2226154 - RNA, 15 nt, Homo sapiens
uggggagggagacag

SEQ ID NO: 2226155 - RNA, 15 nt, Homo sapiens
uccguagacuguuua

SEQ ID NO: 2226156 - RNA, 21 nt, Homo sapiens
uggcuaccgaaguaaacugau

SEQ ID NO: 2226157 - RNA, 18 nt, Homo sapiens
auuuggaaaauaaaucaa

SEQ ID NO: 2226158 - RNA, 16 nt, Homo sapiens
gccucuguguucaucc

SEQ ID NO: 2226159 - RNA, 18 nt, Homo sapiens
gccaccgccagagcuccu

SEQ ID NO: 2226160 - RNA, 23 nt, Homo sapiens
ccaauuuucuucaucuuugccau

SEQ ID NO: 2226161 - RNA, 20 nt, Homo sapiens
ucccgcguggaguucuccuc

SEQ ID NO: 2226162 - RNA, 22 nt, Homo sapiens
acacaugcuuuucuguuacugu

SEQ ID NO: 2226163 - RNA, 15 nt, Homo sapiens
aaagccaucaaacac

SEQ ID NO: 2226164 - RNA, 18 nt, Homo sapiens
ugcaagaguggacugaau

SEQ ID NO: 2226165 - RNA, 14 nt, Homo sapiens
agccaggagcagcc

SEQ ID NO: 2226166 - RNA, 16 nt, Homo sapiens
ucuugacaucaaggga

SEQ ID NO: 2226167 - RNA, 14 nt, Homo sapiens
uucugucaauuuca

SEQ ID NO: 2226168 - RNA, 19 nt, Homo sapiens
cccucagcacagacucuuu

SEQ ID NO: 2226169 - RNA, 18 nt, Homo sapiens
uugcuaaaaucauccuau

SEQ ID NO: 2226170 - RNA, 15 nt, Homo sapiens
uagacuacucaauau

SEQ ID NO: 2226171 - RNA, 20 nt, Homo sapiens
cauaucuuccaggucccaga

SEQ ID NO: 2226172 - RNA, 21 nt, Homo sapiens
cccgucucuacuaaaaauaca

SEQ ID NO: 2226173 - RNA, 17 nt, Homo sapiens
caggugucccugagaac

SEQ ID NO: 2226174 - RNA, 23 nt, Homo sapiens
uucgcaccuaccaucagggacag

SEQ ID NO: 2226175 - RNA, 19 nt, Homo sapiens
aaaucaaugcuuuaucuga

SEQ ID NO: 2226176 - RNA, 16 nt, Homo sapiens
aguaucauucuuuaca

SEQ ID NO: 2226177 - RNA, 14 nt, Homo sapiens
uggcaaaaccagua

SEQ ID NO: 2226178 - RNA, 23 nt, Homo sapiens
ggggaagggccccacucagggau

SEQ ID NO: 2226179 - RNA, 14 nt, Homo sapiens
ucgcccucucucac

SEQ ID NO: 2226180 - RNA, 22 nt, Homo sapiens
gccaaggagucagauggcaaug

SEQ ID NO: 2226181 - RNA, 16 nt, Homo sapiens
ugaacuucagcuagag

SEQ ID NO: 2226182 - RNA, 14 nt, Homo sapiens
ucuacagaggccau

SEQ ID NO: 2226183 - RNA, 16 nt, Homo sapiens
ccacuccuuccuucag

SEQ ID NO: 2226184 - RNA, 15 nt, Homo sapiens
ccagccuguggugcu

SEQ ID NO: 2226185 - RNA, 23 nt, Homo sapiens
ucuguuuaggaagaagugguacu

SEQ ID NO: 2226186 - RNA, 15 nt, Homo sapiens
caccauacccagcua

SEQ ID NO: 2226187 - RNA, 19 nt, Homo sapiens
cucaacucucuuauugccu

SEQ ID NO: 2226188 - RNA, 15 nt, Homo sapiens
cuauuaaccuagaga

SEQ ID NO: 2226189 - RNA, 14 nt, Homo sapiens
ccuccaaaagcccu

SEQ ID NO: 2226190 - RNA, 23 nt, Homo sapiens
aucaacagaaguaucaagccaug

SEQ ID NO: 2226191 - RNA, 20 nt, Homo sapiens
ucauaugaaaggugccaugg

SEQ ID NO: 2226192 - RNA, 16 nt, Homo sapiens
aucagagagcucacua

SEQ ID NO: 2226193 - RNA, 16 nt, Homo sapiens
gagcacccauuccaaa

SEQ ID NO: 2226194 - RNA, 12 nt, Homo sapiens
cacuuccagucc

SEQ ID NO: 2226195 - RNA, 20 nt, Homo sapiens
uuccuccgucaccucagaga

SEQ ID NO: 2226196 - RNA, 15 nt, Homo sapiens
agcauuuagugcaca

SEQ ID NO: 2226197 - RNA, 22 nt, Homo sapiens
cguaguggaauuaacaggaaau

SEQ ID NO: 2226198 - RNA, 23 nt, Homo sapiens
agaaaucuggcuucuggccagga

SEQ ID NO: 2226199 - RNA, 22 nt, Homo sapiens
auugucgaaaagagucuuccaa

SEQ ID NO: 2226200 - RNA, 14 nt, Homo sapiens
cuugaaucaggacu

SEQ ID NO: 2226201 - RNA, 18 nt, Homo sapiens
guaaaaaauguaugcuau

SEQ ID NO: 2226202 - RNA, 14 nt, Homo sapiens
ccuuccugggaccc

SEQ ID NO: 2226203 - RNA, 23 nt, Homo sapiens
gcuaucccuuuccaaaggccaug

SEQ ID NO: 2226204 - RNA, 22 nt, Homo sapiens
cucccuggagaagcaccagcaa

SEQ ID NO: 2226205 - RNA, 15 nt, Homo sapiens
agcaucccucaccca

SEQ ID NO: 2226206 - RNA, 22 nt, Homo sapiens
auuguccuguuucuucauauaa

SEQ ID NO: 2226207 - RNA, 18 nt, Homo sapiens
uauuagugcuagucucag

SEQ ID NO: 2226208 - RNA, 18 nt, Homo sapiens
cuugcacagcuggagaaa

SEQ ID NO: 2226209 - RNA, 16 nt, Homo sapiens
cagcauccacacugcc

SEQ ID NO: 2226210 - RNA, 18 nt, Homo sapiens
uccaaucaacagcaguga

SEQ ID NO: 2226211 - RNA, 17 nt, Homo sapiens
aggcuuacguacuacuu

SEQ ID NO: 2226212 - RNA, 18 nt, Homo sapiens
ucuguguccaucagugac

SEQ ID NO: 2226213 - RNA, 12 nt, Homo sapiens
cucuuucaucaa

SEQ ID NO: 2226214 - RNA, 22 nt, Homo sapiens
uaagcaucaaauauuugugcaa

SEQ ID NO: 2226215 - RNA, 13 nt, Homo sapiens
uggaaaacugccu

SEQ ID NO: 2226216 - RNA, 15 nt, Homo sapiens
uguuuggguggguua

SEQ ID NO: 2226217 - RNA, 17 nt, Homo sapiens
uuugacuuguauaacau

SEQ ID NO: 2226218 - RNA, 20 nt, Homo sapiens
uuccaaauuugaauggauua

SEQ ID NO: 2226219 - RNA, 16 nt, Homo sapiens
agacuggcccucuagc

SEQ ID NO: 2226220 - RNA, 19 nt, Homo sapiens
aacuaugguucccaauaaa

SEQ ID NO: 2226221 - RNA, 22 nt, Homo sapiens
ugcaagggaugaauuguaaaag

SEQ ID NO: 2226222 - RNA, 19 nt, Homo sapiens
aaguauccuucagccugaa

SEQ ID NO: 2226223 - RNA, 19 nt, Homo sapiens
cacuccuuuuuugcaugug

SEQ ID NO: 2226224 - RNA, 13 nt, Homo sapiens
auuaauguuuaca

SEQ ID NO: 2226225 - RNA, 12 nt, Homo sapiens
uuuaaacuucag

SEQ ID NO: 2226226 - RNA, 15 nt, Homo sapiens
agggggggagcaaaa

SEQ ID NO: 2226227 - RNA, 18 nt, Homo sapiens
aagccacauggcugggau

SEQ ID NO: 2226228 - RNA, 24 nt, Homo sapiens
uuggcucacugcaaccucuaccuc

SEQ ID NO: 2226229 - RNA, 14 nt, Homo sapiens
aguggggacagauu

SEQ ID NO: 2226230 - RNA, 16 nt, Homo sapiens
uccaaugugugcauag

SEQ ID NO: 2226231 - RNA, 14 nt, Homo sapiens
ugagauugccccua

SEQ ID NO: 2226232 - RNA, 12 nt, Homo sapiens
uucuuuccugag

SEQ ID NO: 2226233 - RNA, 13 nt, Homo sapiens
ccuuuuuugagau

SEQ ID NO: 2226234 - RNA, 22 nt, Homo sapiens
gagcucuugcuaucucucaaga

SEQ ID NO: 2226235 - RNA, 18 nt, Homo sapiens
aucaacaacauccacugu

SEQ ID NO: 2226236 - RNA, 19 nt, Homo sapiens
cggccccucccacacccaa

SEQ ID NO: 2226237 - RNA, 19 nt, Homo sapiens
gaugcauguuacugccaaa

SEQ ID NO: 2226238 - RNA, 12 nt, Homo sapiens
uacaguugauau

SEQ ID NO: 2226239 - RNA, 20 nt, Homo sapiens
uuuacacgcucauggacuga

SEQ ID NO: 2226240 - RNA, 16 nt, Homo sapiens
gacuucuaccugcccu

SEQ ID NO: 2226241 - RNA, 19 nt, Homo sapiens
cuuuuaauuaauauguuca

SEQ ID NO: 2226242 - RNA, 12 nt, Homo sapiens
cuccacugucac

SEQ ID NO: 2226243 - RNA, 17 nt, Homo sapiens
gcuccuaguuugaccuc

SEQ ID NO: 2226244 - RNA, 20 nt, Homo sapiens
cauagugauagagugcagug

SEQ ID NO: 2226245 - RNA, 17 nt, Homo sapiens
gaaacacagaaaccuuu

SEQ ID NO: 2226246 - RNA, 14 nt, Homo sapiens
guguguacaccagc

SEQ ID NO: 2226247 - RNA, 17 nt, Homo sapiens
accuucaccuucaucca

SEQ ID NO: 2226248 - RNA, 16 nt, Homo sapiens
gaaacaguuccauuca

SEQ ID NO: 2226249 - RNA, 21 nt, Homo sapiens
ugcacacacacagagauaugc

SEQ ID NO: 2226250 - RNA, 20 nt, Homo sapiens
gcaccacugcucuccagccu

SEQ ID NO: 2226251 - RNA, 22 nt, Homo sapiens
accugcugcgggggagccaguu

SEQ ID NO: 2226252 - RNA, 17 nt, Homo sapiens
ucccccaaaaugcauuu

SEQ ID NO: 2226253 - RNA, 14 nt, Homo sapiens
uucugucuucccaa

SEQ ID NO: 2226254 - RNA, 16 nt, Homo sapiens
uguaauaauaccucaa

SEQ ID NO: 2226255 - RNA, 12 nt, Homo sapiens
guuccuuauaua

SEQ ID NO: 2226256 - RNA, 12 nt, Homo sapiens
ccccagcucacc

SEQ ID NO: 2226257 - RNA, 18 nt, Homo sapiens
cuaugccacccugcaaua

SEQ ID NO: 2226258 - RNA, 18 nt, Homo sapiens
uuauacaaaccuaccaaa

SEQ ID NO: 2226259 - RNA, 18 nt, Homo sapiens
ucagauugaggagcucaa

SEQ ID NO: 2226260 - RNA, 13 nt, Homo sapiens
aauauaguuugag

SEQ ID NO: 2226261 - RNA, 17 nt, Homo sapiens
gaaucugugcuggccau

SEQ ID NO: 2226262 - RNA, 15 nt, Homo sapiens
gaaacauaagagcuu

SEQ ID NO: 2226263 - RNA, 22 nt, Homo sapiens
ugcagccuaagaagaaggccag

SEQ ID NO: 2226264 - RNA, 16 nt, Homo sapiens
uaguaggcacuaaaua

SEQ ID NO: 2226265 - RNA, 18 nt, Homo sapiens
uugagacuauugagauau

SEQ ID NO: 2226266 - RNA, 15 nt, Homo sapiens
agaaaggcauugcac

SEQ ID NO: 2226267 - RNA, 18 nt, Homo sapiens
gucaucauuacuugggaa

SEQ ID NO: 2226268 - RNA, 20 nt, Homo sapiens
auaaauacugucaaacaaua

SEQ ID NO: 2226269 - RNA, 14 nt, Homo sapiens
ucgcacagggcaug

SEQ ID NO: 2226270 - RNA, 14 nt, Homo sapiens
acgaggacagguug

SEQ ID NO: 2226271 - RNA, 21 nt, Homo sapiens
gguaaauaaucauacacagaa

SEQ ID NO: 2226272 - RNA, 22 nt, Homo sapiens
accacagaaaucacagucaaug

SEQ ID NO: 2226273 - RNA, 16 nt, Homo sapiens
cucugaggaguggagu

SEQ ID NO: 2226274 - RNA, 23 nt, Homo sapiens
cacaccuggcauggugcagggag

SEQ ID NO: 2226275 - RNA, 13 nt, Homo sapiens
acuucacacagca

SEQ ID NO: 2226276 - RNA, 13 nt, Homo sapiens
guggcuucaagag

SEQ ID NO: 2226277 - RNA, 16 nt, Homo sapiens
gguucacaccauucuc

SEQ ID NO: 2226278 - RNA, 14 nt, Homo sapiens
auauugaagacauu

SEQ ID NO: 2226279 - RNA, 18 nt, Homo sapiens
aaucagaguguacaaauu

SEQ ID NO: 2226280 - RNA, 22 nt, Homo sapiens
uuuccuggaauugccagcugac

SEQ ID NO: 2226281 - RNA, 16 nt, Homo sapiens
agggcucccugccauu

SEQ ID NO: 2226282 - RNA, 13 nt, Homo sapiens
gagucacaccaga

SEQ ID NO: 2226283 - RNA, 14 nt, Homo sapiens
caugcuggggcaag

SEQ ID NO: 2226284 - RNA, 15 nt, Homo sapiens
ugcuagcaacaccca

SEQ ID NO: 2226285 - RNA, 16 nt, Homo sapiens
cagggccuuccugguu

SEQ ID NO: 2226286 - RNA, 16 nt, Homo sapiens
accuguuagcagacag

SEQ ID NO: 2226287 - RNA, 22 nt, Homo sapiens
ggcaacccaccaucuacccacu

SEQ ID NO: 2226288 - RNA, 22 nt, Homo sapiens
uugcaacagcaguguucugggu

SEQ ID NO: 2226289 - RNA, 23 nt, Homo sapiens
auuacuguaaacagccuacugaa

SEQ ID NO: 2226290 - RNA, 23 nt, Homo sapiens
ccuucaaucucguuuagugccaa

SEQ ID NO: 2226291 - RNA, 19 nt, Homo sapiens
agccagcagccagcucuca

SEQ ID NO: 2226292 - RNA, 16 nt, Homo sapiens
uuccaggcgaugugca

SEQ ID NO: 2226293 - RNA, 23 nt, Homo sapiens
ggauguguccaguuugugcucua

SEQ ID NO: 2226294 - RNA, 16 nt, Homo sapiens
auagguggcacuaccc

SEQ ID NO: 2226295 - RNA, 16 nt, Homo sapiens
uuccacaaacacauua

SEQ ID NO: 2226296 - RNA, 14 nt, Homo sapiens
aauugugugugcaa

SEQ ID NO: 2226297 - RNA, 20 nt, Homo sapiens
ggagcugaggaggugccuug

SEQ ID NO: 2226298 - RNA, 19 nt, Homo sapiens
gugguuacuuccuacugua

SEQ ID NO: 2226299 - RNA, 22 nt, Homo sapiens
auucuuccagauaauguccuug

SEQ ID NO: 2226300 - RNA, 21 nt, Homo sapiens
gccuucaucuucacugcaauu

SEQ ID NO: 2226301 - RNA, 22 nt, Homo sapiens
acuguacaaguuuuguuuacuu

SEQ ID NO: 2226302 - RNA, 20 nt, Homo sapiens
uguucacuguacucuguggg

SEQ ID NO: 2226303 - RNA, 17 nt, Homo sapiens
gcugagcugcccacagc

SEQ ID NO: 2226304 - RNA, 14 nt, Homo sapiens
ggccuguggcugcc

SEQ ID NO: 2226305 - RNA, 22 nt, Homo sapiens
ccuuuuugaaaaagaaaacacu

SEQ ID NO: 2226306 - RNA, 18 nt, Homo sapiens
ccaggcagaauggcugca

SEQ ID NO: 2226307 - RNA, 11 nt, Homo sapiens
guaaaugcucg

SEQ ID NO: 2226308 - RNA, 12 nt, Homo sapiens
agggcacaagcu

SEQ ID NO: 2226309 - RNA, 17 nt, Homo sapiens
ucccaacguuuuacaua

SEQ ID NO: 2226310 - RNA, 14 nt, Homo sapiens
gccuuaaccagucu

SEQ ID NO: 2226311 - RNA, 17 nt, Homo sapiens
gugucaugccaagacag

SEQ ID NO: 2226312 - RNA, 17 nt, Homo sapiens
auuuaagagacagucac

SEQ ID NO: 2226313 - RNA, 18 nt, Homo sapiens
aauuauucauuuaaucaa

SEQ ID NO: 2226314 - RNA, 18 nt, Homo sapiens
caucaaagaugacuugaa

SEQ ID NO: 2226315 - RNA, 17 nt, Homo sapiens
auggaauucacaaagua

SEQ ID NO: 2226316 - RNA, 21 nt, Homo sapiens
guuuacuucaaauuaacucua

SEQ ID NO: 2226317 - RNA, 20 nt, Homo sapiens
ccugucaagguuuguguuac

SEQ ID NO: 2226318 - RNA, 21 nt, Homo sapiens
ccuugcucucuguucucuugc

SEQ ID NO: 2226319 - RNA, 21 nt, Homo sapiens
cgaggugggagaggccucauc

SEQ ID NO: 2226320 - RNA, 15 nt, Homo sapiens
uucagagaauuacua

SEQ ID NO: 2226321 - RNA, 19 nt, Homo sapiens
cauccuggcccagccucuu

SEQ ID NO: 2226322 - RNA, 12 nt, Homo sapiens
cuuuucacaaac

SEQ ID NO: 2226323 - RNA, 18 nt, Homo sapiens
accaugcuaauguuacua

SEQ ID NO: 2226324 - RNA, 19 nt, Homo sapiens
ucucaggacccgcccaaga

SEQ ID NO: 2226325 - RNA, 19 nt, Homo sapiens
aaaggcugggaccacguga

SEQ ID NO: 2226326 - RNA, 23 nt, Homo sapiens
accaagggggcggggacugcugg

SEQ ID NO: 2226327 - RNA, 14 nt, Homo sapiens
cauuugcauuugcu

SEQ ID NO: 2226328 - RNA, 16 nt, Homo sapiens
cuagcucuuugagaua

SEQ ID NO: 2226329 - RNA, 19 nt, Homo sapiens
agaaacauucuuuccuaaa

SEQ ID NO: 2226330 - RNA, 16 nt, Homo sapiens
uguuguuuuaggggcu

SEQ ID NO: 2226331 - RNA, 18 nt, Homo sapiens
ccuuccaagacugaagac

SEQ ID NO: 2226332 - RNA, 17 nt, Homo sapiens
aaaucugccaccugcac

SEQ ID NO: 2226333 - RNA, 15 nt, Homo sapiens
aucucuuuaccuccu

SEQ ID NO: 2226334 - RNA, 22 nt, Homo sapiens
agagagaagagccccacucuca

SEQ ID NO: 2226335 - RNA, 14 nt, Homo sapiens
agcccagaaccaca

SEQ ID NO: 2226336 - RNA, 15 nt, Homo sapiens
aaaguauuuauugua

SEQ ID NO: 2226337 - RNA, 23 nt, Homo sapiens
uuacaggggagaaaaaugacaaa

SEQ ID NO: 2226338 - RNA, 17 nt, Homo sapiens
accuguuccugacuuaa

SEQ ID NO: 2226339 - RNA, 16 nt, Homo sapiens
agcccuauucaucccu

SEQ ID NO: 2226340 - RNA, 13 nt, Homo sapiens
ugaaauagugucu

SEQ ID NO: 2226341 - RNA, 16 nt, Homo sapiens
cacaacgggccagcuc

SEQ ID NO: 2226342 - RNA, 19 nt, Homo sapiens
gauuccugguuugacucag

SEQ ID NO: 2226343 - RNA, 21 nt, Homo sapiens
aauauguacacuggaacugua

SEQ ID NO: 2226344 - RNA, 15 nt, Homo sapiens
uauccgaacuuuaau

SEQ ID NO: 2226345 - RNA, 20 nt, Homo sapiens
uggcagaaggcaaagcaaag

SEQ ID NO: 2226346 - RNA, 17 nt, Homo sapiens
aauguacaauaaagcaa

SEQ ID NO: 2226347 - RNA, 22 nt, Homo sapiens
guaaucagcaauaaaaauccua

SEQ ID NO: 2226348 - RNA, 20 nt, Homo sapiens
auucuggcugcgggucucag

SEQ ID NO: 2226349 - RNA, 22 nt, Homo sapiens
ggaguaaucuguguacaaagaa

SEQ ID NO: 2226350 - RNA, 14 nt, Homo sapiens
cacagagaugcaug

SEQ ID NO: 2226351 - RNA, 15 nt, Homo sapiens
agauggaguuucacu

SEQ ID NO: 2226352 - RNA, 19 nt, Homo sapiens
cuuaauguugaaugcugcu

SEQ ID NO: 2226353 - RNA, 14 nt, Homo sapiens
gaguggaucuccaa

SEQ ID NO: 2226354 - RNA, 20 nt, Homo sapiens
uugguauucaccgugccuga

SEQ ID NO: 2226355 - RNA, 18 nt, Homo sapiens
acccucgcccaacuccac

SEQ ID NO: 2226356 - RNA, 17 nt, Homo sapiens
cugucccucuuuggcag

SEQ ID NO: 2226357 - RNA, 16 nt, Homo sapiens
gcugccaagcacucga

SEQ ID NO: 2226358 - RNA, 13 nt, Homo sapiens
cuagauacuguau

SEQ ID NO: 2226359 - RNA, 22 nt, Homo sapiens
ucauccuugcccaucgggacca

SEQ ID NO: 2226360 - RNA, 18 nt, Homo sapiens
uggcuucugggaccugug

SEQ ID NO: 2226361 - RNA, 17 nt, Homo sapiens
auuuuacacaaagggaa

SEQ ID NO: 2226362 - RNA, 13 nt, Homo sapiens
guggagcucagcc

SEQ ID NO: 2226363 - RNA, 20 nt, Homo sapiens
cugcauuucaaguuaauucu

SEQ ID NO: 2226364 - RNA, 16 nt, Homo sapiens
gaguggaucuguagaa

SEQ ID NO: 2226365 - RNA, 19 nt, Homo sapiens
uccugacagaaggugccac

SEQ ID NO: 2226366 - RNA, 18 nt, Homo sapiens
cacugcauuccacaggug

SEQ ID NO: 2226367 - RNA, 18 nt, Homo sapiens
augaaaauaagcauuugg

SEQ ID NO: 2226368 - RNA, 15 nt, Homo sapiens
aaccuugaaauggaa

SEQ ID NO: 2226369 - RNA, 15 nt, Homo sapiens
cgccgcugacugcca

SEQ ID NO: 2226370 - RNA, 19 nt, Homo sapiens
cucagccaggugcugugac

SEQ ID NO: 2226371 - RNA, 12 nt, Homo sapiens
auccgacuugaa

SEQ ID NO: 2226372 - RNA, 15 nt, Homo sapiens
cagccaugcccuuga

SEQ ID NO: 2226373 - RNA, 23 nt, Homo sapiens
gucuuucauguaaaaagugcagu

SEQ ID NO: 2226374 - RNA, 19 nt, Homo sapiens
uuugaagacguggacuccu

SEQ ID NO: 2226375 - RNA, 13 nt, Homo sapiens
gaauuaaaacagc

SEQ ID NO: 2226376 - RNA, 21 nt, Homo sapiens
cuaacaggaauuuucauuguu

SEQ ID NO: 2226377 - RNA, 21 nt, Homo sapiens
uuguuucaaaugaaacuuuaa

SEQ ID NO: 2226378 - RNA, 15 nt, Homo sapiens
aaaacuacauugaca

SEQ ID NO: 2226379 - RNA, 15 nt, Homo sapiens
caugccuccaaaaau

SEQ ID NO: 2226380 - RNA, 21 nt, Homo sapiens
ggauauauuugaaauaguaua

SEQ ID NO: 2226381 - RNA, 18 nt, Homo sapiens
auucacuucgccauucau

SEQ ID NO: 2226382 - RNA, 15 nt, Homo sapiens
ccacucugcucugau

SEQ ID NO: 2226383 - RNA, 13 nt, Homo sapiens
uaaaaaagauauc

SEQ ID NO: 2226384 - RNA, 19 nt, Homo sapiens
guaauuugauacugaccuu

SEQ ID NO: 2226385 - RNA, 21 nt, Homo sapiens
ggguguggcgcagcauauuca

SEQ ID NO: 2226386 - RNA, 13 nt, Homo sapiens
acaggagcucuua

SEQ ID NO: 2226387 - RNA, 20 nt, Homo sapiens
ucaagaugccuccugucaga

SEQ ID NO: 2226388 - RNA, 14 nt, Homo sapiens
ccaucugauaugac

SEQ ID NO: 2226389 - RNA, 13 nt, Homo sapiens
cccauuuccugau

SEQ ID NO: 2226390 - RNA, 22 nt, Homo sapiens
aucugaaaaauggccauguugu

SEQ ID NO: 2226391 - RNA, 15 nt, Homo sapiens
ugcaaagacucugag

SEQ ID NO: 2226392 - RNA, 21 nt, Homo sapiens
ucucagcucaucuucacugca

SEQ ID NO: 2226393 - RNA, 15 nt, Homo sapiens
acauccucuacaggu

SEQ ID NO: 2226394 - RNA, 20 nt, Homo sapiens
aauagcuagcuauuacugca

SEQ ID NO: 2226395 - RNA, 21 nt, Homo sapiens
ucugauaagcuuccuagaaag

SEQ ID NO: 2226396 - RNA, 22 nt, Homo sapiens
gccagagaaaauguuggaagag

SEQ ID NO: 2226397 - RNA, 16 nt, Homo sapiens
acagggccucucacua

SEQ ID NO: 2226398 - RNA, 16 nt, Homo sapiens
gcccacccugggagac

SEQ ID NO: 2226399 - RNA, 23 nt, Homo sapiens
cuuuucggccccauguaucucag

SEQ ID NO: 2226400 - RNA, 19 nt, Homo sapiens
cacuggaaggagcacauac

SEQ ID NO: 2226401 - RNA, 12 nt, Homo sapiens
cuggaccagcug

SEQ ID NO: 2226402 - RNA, 18 nt, Homo sapiens
accacaugauucugaugu

SEQ ID NO: 2226403 - RNA, 22 nt, Homo sapiens
acugucuucuucaugucaucaa

SEQ ID NO: 2226404 - RNA, 14 nt, Homo sapiens
caugaaugaaaaua

SEQ ID NO: 2226405 - RNA, 22 nt, Homo sapiens
acucauaggggaguaggggugg

SEQ ID NO: 2226406 - RNA, 18 nt, Homo sapiens
uaaaauuaaaugcauguc

SEQ ID NO: 2226407 - RNA, 15 nt, Homo sapiens
uccaaaaacagugau

SEQ ID NO: 2226408 - RNA, 21 nt, Homo sapiens
aguuaaugaaauaaaauuuga

SEQ ID NO: 2226409 - RNA, 22 nt, Homo sapiens
acuuuaaaauaucuacauuaau

SEQ ID NO: 2226410 - RNA, 14 nt, Homo sapiens
ucacgauauuauua

SEQ ID NO: 2226411 - RNA, 17 nt, Homo sapiens
ucaugguagagaaucuc

SEQ ID NO: 2226412 - RNA, 13 nt, Homo sapiens
ccagcuagugacc

SEQ ID NO: 2226413 - RNA, 22 nt, Homo sapiens
agcaaaaugcugcuuucugccu

SEQ ID NO: 2226414 - RNA, 15 nt, Homo sapiens
aaaguuaaacauuga

SEQ ID NO: 2226415 - RNA, 15 nt, Homo sapiens
auacacauauuugca

SEQ ID NO: 2226416 - RNA, 15 nt, Homo sapiens
acugcugcuucuuaa

SEQ ID NO: 2226417 - RNA, 22 nt, Homo sapiens
aguugcuguucuuacaucugua

SEQ ID NO: 2226418 - RNA, 18 nt, Homo sapiens
caaccaagucaugugcau

SEQ ID NO: 2226419 - RNA, 23 nt, Homo sapiens
uccugacuuugcccccuugccca

SEQ ID NO: 2226420 - RNA, 18 nt, Homo sapiens
cuuuuguuguccuugccc

SEQ ID NO: 2226421 - RNA, 14 nt, Homo sapiens
cauuuucaagugau

SEQ ID NO: 2226422 - RNA, 12 nt, Homo sapiens
agcaacuugaac

SEQ ID NO: 2226423 - RNA, 20 nt, Homo sapiens
cuuuccuccacccauaauaa

SEQ ID NO: 2226424 - RNA, 21 nt, Homo sapiens
agagcuaauuuacuggacaaa

SEQ ID NO: 2226425 - RNA, 22 nt, Homo sapiens
gacagaauggagcuauggacgu

SEQ ID NO: 2226426 - RNA, 12 nt, Homo sapiens
auaauuuugcca

SEQ ID NO: 2226427 - RNA, 19 nt, Homo sapiens
auaagagcuggaugcacau

SEQ ID NO: 2226428 - RNA, 16 nt, Homo sapiens
agugugggggguccuu

SEQ ID NO: 2226429 - RNA, 18 nt, Homo sapiens
agcagccuaacacggugc

SEQ ID NO: 2226430 - RNA, 19 nt, Homo sapiens
cuaauguacuguacauaaa

SEQ ID NO: 2226431 - RNA, 21 nt, Homo sapiens
aucauugcaggagccauauga

SEQ ID NO: 2226432 - RNA, 20 nt, Homo sapiens
aagccugaugcugacauuca

SEQ ID NO: 2226433 - RNA, 17 nt, Homo sapiens
cguagugguacauucca

SEQ ID NO: 2226434 - RNA, 18 nt, Homo sapiens
gaacagcccucucucuca

SEQ ID NO: 2226435 - RNA, 17 nt, Homo sapiens
gaucccacuuuugccag

SEQ ID NO: 2226436 - RNA, 14 nt, Homo sapiens
uuccugccuggucu

SEQ ID NO: 2226437 - RNA, 15 nt, Homo sapiens
uguuguuuaaucuga

SEQ ID NO: 2226438 - RNA, 13 nt, Homo sapiens
ccaguacauuuaa

SEQ ID NO: 2226439 - RNA, 13 nt, Homo sapiens
ucaaaacacuugu

SEQ ID NO: 2226440 - RNA, 21 nt, Homo sapiens
gagaggaugcacaguuugcua

SEQ ID NO: 2226441 - RNA, 13 nt, Homo sapiens
ccaacagcacuuu

SEQ ID NO: 2226442 - RNA, 16 nt, Homo sapiens
aacuuuuauuacuggg

SEQ ID NO: 2226443 - RNA, 23 nt, Homo sapiens
gacaagcagucccuuaauauuga

SEQ ID NO: 2226444 - RNA, 13 nt, Homo sapiens
uugcaugcugaaa

SEQ ID NO: 2226445 - RNA, 16 nt, Homo sapiens
auggaauaucagaagu

SEQ ID NO: 2226446 - RNA, 18 nt, Homo sapiens
ugcauuguggcugucaaa

SEQ ID NO: 2226447 - RNA, 12 nt, Homo sapiens
cugcuccagcug

SEQ ID NO: 2226448 - RNA, 14 nt, Homo sapiens
ggcaacaaugagca

SEQ ID NO: 2226449 - RNA, 23 nt, Homo sapiens
ucacaacagauuauuaccuuaca

SEQ ID NO: 2226450 - RNA, 21 nt, Homo sapiens
caaaaagaaauauuaauaugu

SEQ ID NO: 2226451 - RNA, 12 nt, Homo sapiens
gacuacugccca

SEQ ID NO: 2226452 - RNA, 20 nt, Homo sapiens
uuguaagucaguguugagau

SEQ ID NO: 2226453 - RNA, 15 nt, Homo sapiens
aaaccaucucucuuc

SEQ ID NO: 2226454 - RNA, 21 nt, Homo sapiens
aaucagugauuauuuuuccag

SEQ ID NO: 2226455 - RNA, 16 nt, Homo sapiens
uccuacagggccacaa

SEQ ID NO: 2226456 - RNA, 14 nt, Homo sapiens
auucuuuucacugu

SEQ ID NO: 2226457 - RNA, 15 nt, Homo sapiens
cuuuuaacaccugau

SEQ ID NO: 2226458 - RNA, 17 nt, Homo sapiens
ucauauauauacauaca

SEQ ID NO: 2226459 - RNA, 22 nt, Homo sapiens
gacccagaauauccaaauaagc

SEQ ID NO: 2226460 - RNA, 13 nt, Homo sapiens
auauuccugcauu

SEQ ID NO: 2226461 - RNA, 20 nt, Homo sapiens
aggacauggcugacuuugcc

SEQ ID NO: 2226462 - RNA, 13 nt, Homo sapiens
acuuuugcuugaa

SEQ ID NO: 2226463 - RNA, 12 nt, Homo sapiens
uuuguucacuua

SEQ ID NO: 2226464 - RNA, 17 nt, Homo sapiens
ccagcuuuccucaucag

SEQ ID NO: 2226465 - RNA, 16 nt, Homo sapiens
uuuuugaacauggaaa

SEQ ID NO: 2226466 - RNA, 22 nt, Homo sapiens
cagaguugguggagaacagaaa

SEQ ID NO: 2226467 - RNA, 20 nt, Homo sapiens
auuuuuaaguuuuucacuuu

SEQ ID NO: 2226468 - RNA, 12 nt, Homo sapiens
cugucagucaug

SEQ ID NO: 2226469 - RNA, 16 nt, Homo sapiens
aauuuuugcugaugaa

SEQ ID NO: 2226470 - RNA, 19 nt, Homo sapiens
ugcaaauccuaugugauuu

SEQ ID NO: 2226471 - RNA, 23 nt, Homo sapiens
aacccaggucugaugccaaagcu

SEQ ID NO: 2226472 - RNA, 22 nt, Homo sapiens
cuacagagucuggugaagcuca

SEQ ID NO: 2226473 - RNA, 20 nt, Homo sapiens
auuuauggucaacacuuaag

SEQ ID NO: 2226474 - RNA, 13 nt, Homo sapiens
ucauagagacuug

SEQ ID NO: 2226475 - RNA, 18 nt, Homo sapiens
uucaugcagcaaauaugg

SEQ ID NO: 2226476 - RNA, 20 nt, Homo sapiens
gaauuccugacccacaggaa

SEQ ID NO: 2226477 - RNA, 18 nt, Homo sapiens
uagguuaaaaacagggaa

SEQ ID NO: 2226478 - RNA, 13 nt, Homo sapiens
ccaaucugugaga

SEQ ID NO: 2226479 - RNA, 24 nt, Homo sapiens
aauucucucaccucuaacaucaga

SEQ ID NO: 2226480 - RNA, 19 nt, Homo sapiens
ucuuuaguauagccacaaa

SEQ ID NO: 2226481 - RNA, 18 nt, Homo sapiens
ugugcuuguuaacugagu

SEQ ID NO: 2226482 - RNA, 23 nt, Homo sapiens
uuguagaaaucuguaauucuauu

SEQ ID NO: 2226483 - RNA, 21 nt, Homo sapiens
caggggcuuuggaagcucugu

SEQ ID NO: 2226484 - RNA, 19 nt, Homo sapiens
cucuucaacugaccagccu

SEQ ID NO: 2226485 - RNA, 19 nt, Homo sapiens
auuuccaaaccaucagcug

SEQ ID NO: 2226486 - RNA, 22 nt, Homo sapiens
uucucuuugauuauuugcaugu

SEQ ID NO: 2226487 - RNA, 14 nt, Homo sapiens
agcugcaggggcau

SEQ ID NO: 2226488 - RNA, 22 nt, Homo sapiens
ugcagagaaacuuaagcaaagg

SEQ ID NO: 2226489 - RNA, 16 nt, Homo sapiens
ucagcagacauccaca

SEQ ID NO: 2226490 - RNA, 21 nt, Homo sapiens
gaacaaaaugaauucugggaa

SEQ ID NO: 2226491 - RNA, 17 nt, Homo sapiens
ugacguguuucuugaac

SEQ ID NO: 2226492 - RNA, 13 nt, Homo sapiens
acagauaccucca

SEQ ID NO: 2226493 - RNA, 17 nt, Homo sapiens
cagcacuccaguagcga

SEQ ID NO: 2226494 - RNA, 23 nt, Homo sapiens
caccaaagcuauuggagauuugc

SEQ ID NO: 2226495 - RNA, 18 nt, Homo sapiens
agcagacugaccaucucc

SEQ ID NO: 2226496 - RNA, 15 nt, Homo sapiens
cuguuauucuuguua

SEQ ID NO: 2226497 - RNA, 20 nt, Homo sapiens
acuugucuaauucguaggga

SEQ ID NO: 2226498 - RNA, 22 nt, Homo sapiens
ggcugguuagagguucccuuug

SEQ ID NO: 2226499 - RNA, 19 nt, Homo sapiens
caggaacacccgacuccuc

SEQ ID NO: 2226500 - RNA, 16 nt, Homo sapiens
auuucaguagugguga

SEQ ID NO: 2226501 - RNA, 20 nt, Homo sapiens
uucauacuauuaagauucua

SEQ ID NO: 2226502 - RNA, 22 nt, Homo sapiens
cucccaagggaggcccauguga

SEQ ID NO: 2226503 - RNA, 15 nt, Homo sapiens
gaugcagaacuuccc

SEQ ID NO: 2226504 - RNA, 23 nt, Homo sapiens
auuuccaccaggccgugccuugu

SEQ ID NO: 2226505 - RNA, 14 nt, Homo sapiens
agguuuucuuggcc

SEQ ID NO: 2226506 - RNA, 19 nt, Homo sapiens
caaaggaaaaagcacaaga

SEQ ID NO: 2226507 - RNA, 13 nt, Homo sapiens
caguggaugcugc

SEQ ID NO: 2226508 - RNA, 14 nt, Homo sapiens
acauuuuuuugcug

SEQ ID NO: 2226509 - RNA, 18 nt, Homo sapiens
agcgguugcuucuggcuc

SEQ ID NO: 2226510 - RNA, 18 nt, Homo sapiens
cauagaaaccacuagaaa

SEQ ID NO: 2226511 - RNA, 18 nt, Homo sapiens
gucuagagagaaccaaua

SEQ ID NO: 2226512 - RNA, 19 nt, Homo sapiens
cagcagugccuaaaaccca

SEQ ID NO: 2226513 - RNA, 21 nt, Homo sapiens
agcuagcaacauuuguuuuag

SEQ ID NO: 2226514 - RNA, 15 nt, Homo sapiens
caugauuugggguga

SEQ ID NO: 2226515 - RNA, 19 nt, Homo sapiens
aaauucaaauaaaaauccu

SEQ ID NO: 2226516 - RNA, 14 nt, Homo sapiens
gccaaagauuugag

SEQ ID NO: 2226517 - RNA, 21 nt, Homo sapiens
ggaacagcagcagugccauag

SEQ ID NO: 2226518 - RNA, 19 nt, Homo sapiens
guaaguaaacggucucuca

SEQ ID NO: 2226519 - RNA, 21 nt, Homo sapiens
augauagaacuuuucuuacua

SEQ ID NO: 2226520 - RNA, 16 nt, Homo sapiens
ucugcagucaagcccu

SEQ ID NO: 2226521 - RNA, 23 nt, Homo sapiens
uacugggagaggggccucaaaug

SEQ ID NO: 2226522 - RNA, 16 nt, Homo sapiens
caaagcacaguuugaa

SEQ ID NO: 2226523 - RNA, 17 nt, Homo sapiens
uagguuacagaccucag

SEQ ID NO: 2226524 - RNA, 13 nt, Homo sapiens
auaaugaaugaga

SEQ ID NO: 2226525 - RNA, 16 nt, Homo sapiens
auuuuuuauuuccaca

SEQ ID NO: 2226526 - RNA, 14 nt, Homo sapiens
agaggcaggggcuu

SEQ ID NO: 2226527 - RNA, 20 nt, Homo sapiens
augcacacacuugcauacau

SEQ ID NO: 2226528 - RNA, 22 nt, Homo sapiens
uagauacucucuucuucucaua

SEQ ID NO: 2226529 - RNA, 17 nt, Homo sapiens
ccaacuugaugugaaaa

SEQ ID NO: 2226530 - RNA, 18 nt, Homo sapiens
ccugaggcuccugugcua

SEQ ID NO: 2226531 - RNA, 22 nt, Homo sapiens
accugguuuccugggauucaaa

SEQ ID NO: 2226532 - RNA, 17 nt, Homo sapiens
aaagauauuucuuuaaa

SEQ ID NO: 2226533 - RNA, 18 nt, Homo sapiens
ucugucacguucuccaca

SEQ ID NO: 2226534 - RNA, 15 nt, Homo sapiens
ugugguuaccgagua

SEQ ID NO: 2226535 - RNA, 21 nt, Homo sapiens
agagccugaguguugccuaau

SEQ ID NO: 2226536 - RNA, 12 nt, Homo sapiens
cauuuagcacaa

SEQ ID NO: 2226537 - RNA, 21 nt, Homo sapiens
uccacuugggacuagaucaca

SEQ ID NO: 2226538 - RNA, 14 nt, Homo sapiens
uggaauuagagggc

SEQ ID NO: 2226539 - RNA, 16 nt, Homo sapiens
augaaaagagugguga

SEQ ID NO: 2226540 - RNA, 11 nt, Homo sapiens
gcacucucuuu

SEQ ID NO: 2226541 - RNA, 20 nt, Homo sapiens
ccucguugggccgcucugau

SEQ ID NO: 2226542 - RNA, 17 nt, Homo sapiens
agaucugcacucaccuc

SEQ ID NO: 2226543 - RNA, 14 nt, Homo sapiens
uuguugucuuuaug

SEQ ID NO: 2226544 - RNA, 17 nt, Homo sapiens
aaaaguuguuuuaucca

SEQ ID NO: 2226545 - RNA, 14 nt, Homo sapiens
gaugcgucuaccca

SEQ ID NO: 2226546 - RNA, 19 nt, Homo sapiens
agccccaucugugcauucu

SEQ ID NO: 2226547 - RNA, 19 nt, Homo sapiens
gaacugaggagcggacuca

SEQ ID NO: 2226548 - RNA, 22 nt, Homo sapiens
cauccugcuugacuguaacaaa

SEQ ID NO: 2226549 - RNA, 16 nt, Homo sapiens
caaacacuuacagaau

SEQ ID NO: 2226550 - RNA, 14 nt, Homo sapiens
gcccuuuccagggc

SEQ ID NO: 2226551 - RNA, 13 nt, Homo sapiens
agcuugaugccuc

SEQ ID NO: 2226552 - RNA, 16 nt, Homo sapiens
ucauuuucacuuuuaa

SEQ ID NO: 2226553 - RNA, 14 nt, Homo sapiens
accuaguuugcacu

SEQ ID NO: 2226554 - RNA, 21 nt, Homo sapiens
cuugaguaguuuuuaucugaa

SEQ ID NO: 2226555 - RNA, 14 nt, Homo sapiens
aaccaacaauguga

SEQ ID NO: 2226556 - RNA, 13 nt, Homo sapiens
aauauaaaugcau

SEQ ID NO: 2226557 - RNA, 13 nt, Homo sapiens
aacuaaaauguua

SEQ ID NO: 2226558 - RNA, 21 nt, Homo sapiens
ucccucccaggacucugaccc

SEQ ID NO: 2226559 - RNA, 20 nt, Homo sapiens
agccuuggaggacacuaaga

SEQ ID NO: 2226560 - RNA, 15 nt, Homo sapiens
accacugcucugaug

SEQ ID NO: 2226561 - RNA, 18 nt, Homo sapiens
aacaucaguucaugccug

SEQ ID NO: 2226562 - RNA, 20 nt, Homo sapiens
acuaauagaauuaauggaau

SEQ ID NO: 2226563 - RNA, 17 nt, Homo sapiens
cauaaacacccaugaau

SEQ ID NO: 2226564 - RNA, 15 nt, Homo sapiens
caugaagaggaugcu

SEQ ID NO: 2226565 - RNA, 23 nt, Homo sapiens
uucaaggcauuucuaucacauau

SEQ ID NO: 2226566 - RNA, 19 nt, Homo sapiens
acauccuucucacugccau

SEQ ID NO: 2226567 - RNA, 15 nt, Homo sapiens
acaugaaucauagcc

SEQ ID NO: 2226568 - RNA, 12 nt, Homo sapiens
gagaugucuucu

SEQ ID NO: 2226569 - RNA, 17 nt, Homo sapiens
gugcuguuuuuaaucca

SEQ ID NO: 2226570 - RNA, 21 nt, Homo sapiens
caguggugcaaucacagcuca

SEQ ID NO: 2226571 - RNA, 12 nt, Homo sapiens
ugguggcagcuc

SEQ ID NO: 2226572 - RNA, 16 nt, Homo sapiens
ugcuuaccugaucuca

SEQ ID NO: 2226573 - RNA, 17 nt, Homo sapiens
ucgggccccauccucau

SEQ ID NO: 2226574 - RNA, 14 nt, Homo sapiens
cgauuucacugaca

SEQ ID NO: 2226575 - RNA, 22 nt, Homo sapiens
gacucaagaagugaagaaugca

SEQ ID NO: 2226576 - RNA, 17 nt, Homo sapiens
gcauucucugaauuuau

SEQ ID NO: 2226577 - RNA, 17 nt, Homo sapiens
acuuugaucucugcuua

SEQ ID NO: 2226578 - RNA, 13 nt, Homo sapiens
gauuccacuuuua

SEQ ID NO: 2226579 - RNA, 14 nt, Homo sapiens
ugcaaauaccuccu

SEQ ID NO: 2226580 - RNA, 22 nt, Homo sapiens
gguguuaaucauuucauuuuua

SEQ ID NO: 2226581 - RNA, 19 nt, Homo sapiens
caacacagugaaacuccau

SEQ ID NO: 2226582 - RNA, 17 nt, Homo sapiens
aggaacaaauaaacuca

SEQ ID NO: 2226583 - RNA, 22 nt, Homo sapiens
aauggaggaacuuuccaaacac

SEQ ID NO: 2226584 - RNA, 14 nt, Homo sapiens
ucaucagaacagcu

SEQ ID NO: 2226585 - RNA, 14 nt, Homo sapiens
uuuggugaauuuga

SEQ ID NO: 2226586 - RNA, 14 nt, Homo sapiens
uuaguauagcuuua

SEQ ID NO: 2226587 - RNA, 14 nt, Homo sapiens
uggaguucucucau

SEQ ID NO: 2226588 - RNA, 12 nt, Homo sapiens
uugaaaacacua

SEQ ID NO: 2226589 - RNA, 21 nt, Homo sapiens
ccuuuucuauuccuucuggcc

SEQ ID NO: 2226590 - RNA, 14 nt, Homo sapiens
cccacccagucuca

SEQ ID NO: 2226591 - RNA, 22 nt, Homo sapiens
ugggugugaccugacaccugcc

SEQ ID NO: 2226592 - RNA, 19 nt, Homo sapiens
gccacucagggucugggau

SEQ ID NO: 2226593 - RNA, 19 nt, Homo sapiens
uugcaagauuuaacacuaa

SEQ ID NO: 2226594 - RNA, 16 nt, Homo sapiens
uccaaccuaaccccuu

SEQ ID NO: 2226595 - RNA, 20 nt, Homo sapiens
cucugcaacugcucagcucu

SEQ ID NO: 2226596 - RNA, 21 nt, Homo sapiens
guauuauucuguuuugcacag

SEQ ID NO: 2226597 - RNA, 22 nt, Homo sapiens
auuaucaaaagugaucagcaau

SEQ ID NO: 2226598 - RNA, 22 nt, Homo sapiens
aacuaugaaaucaacugacaag

SEQ ID NO: 2226599 - RNA, 18 nt, Homo sapiens
aaaguguacuauuugaua

SEQ ID NO: 2226600 - RNA, 16 nt, Homo sapiens
uggacuaugcacacuu

SEQ ID NO: 2226601 - RNA, 16 nt, Homo sapiens
cuggccuguggcacag

SEQ ID NO: 2226602 - RNA, 15 nt, Homo sapiens
gcagcugagauucca

SEQ ID NO: 2226603 - RNA, 16 nt, Homo sapiens
caaugguaacugcacc

SEQ ID NO: 2226604 - RNA, 17 nt, Homo sapiens
ccucuaaauagcacuuu

SEQ ID NO: 2226605 - RNA, 22 nt, Homo sapiens
caauaaagugacccugcucuca

SEQ ID NO: 2226606 - RNA, 18 nt, Homo sapiens
uaauuuauacaggucaua

SEQ ID NO: 2226607 - RNA, 22 nt, Homo sapiens
auuauuuugggaagaaaaccug

SEQ ID NO: 2226608 - RNA, 14 nt, Homo sapiens
augauaagauuuac

SEQ ID NO: 2226609 - RNA, 15 nt, Homo sapiens
ugagacuccgucuca

SEQ ID NO: 2226610 - RNA, 14 nt, Homo sapiens
gugacuccagggug

SEQ ID NO: 2226611 - RNA, 23 nt, Homo sapiens
uauggagugccugcuguggaccc

SEQ ID NO: 2226612 - RNA, 15 nt, Homo sapiens
cuaaaugaucugauu

SEQ ID NO: 2226613 - RNA, 12 nt, Homo sapiens
accucacagcua

SEQ ID NO: 2226614 - RNA, 21 nt, Homo sapiens
aguugcuagcaacaacuuacu

SEQ ID NO: 2226615 - RNA, 18 nt, Homo sapiens
ugacaacaaccuaugcac

SEQ ID NO: 2226616 - RNA, 14 nt, Homo sapiens
gggccacccagcca

SEQ ID NO: 2226617 - RNA, 15 nt, Homo sapiens
ccuggagaguaucug

SEQ ID NO: 2226618 - RNA, 13 nt, Homo sapiens
aucuagcauuuau

SEQ ID NO: 2226619 - RNA, 13 nt, Homo sapiens
auuuagcauucau

SEQ ID NO: 2226620 - RNA, 13 nt, Homo sapiens
agaaccuugccug

SEQ ID NO: 2226621 - RNA, 19 nt, Homo sapiens
aguauggugcuaauguguc

SEQ ID NO: 2226622 - RNA, 22 nt, Homo sapiens
gcccaagcagagugauucaggg

SEQ ID NO: 2226623 - RNA, 16 nt, Homo sapiens
aacucaggaugccaag

SEQ ID NO: 2226624 - RNA, 23 nt, Homo sapiens
cauuuuuaaaggacaaacaguga

SEQ ID NO: 2226625 - RNA, 21 nt, Homo sapiens
aggagacuuuacauggaugcc

SEQ ID NO: 2226626 - RNA, 15 nt, Homo sapiens
auugucuauuccuga

SEQ ID NO: 2226627 - RNA, 17 nt, Homo sapiens
ugaaaagaguaguacuu

SEQ ID NO: 2226628 - RNA, 15 nt, Homo sapiens
agugcccugauccca

SEQ ID NO: 2226629 - RNA, 14 nt, Homo sapiens
aauaaaguccugac

SEQ ID NO: 2226630 - RNA, 12 nt, Homo sapiens
gagucagcaccc

SEQ ID NO: 2226631 - RNA, 19 nt, Homo sapiens
agaccacucccuuccccca

SEQ ID NO: 2226632 - RNA, 16 nt, Homo sapiens
uagucauuaacccauc

SEQ ID NO: 2226633 - RNA, 20 nt, Homo sapiens
aucagaccaaggaacaagac

SEQ ID NO: 2226634 - RNA, 13 nt, Homo sapiens
gaacacacugagu

SEQ ID NO: 2226635 - RNA, 15 nt, Homo sapiens
uucccgccuaauaaa

SEQ ID NO: 2226636 - RNA, 18 nt, Homo sapiens
ugcuggccuggaucuccc

SEQ ID NO: 2226637 - RNA, 14 nt, Homo sapiens
acuugauguguaga

SEQ ID NO: 2226638 - RNA, 15 nt, Homo sapiens
uugaaauauaaugca

SEQ ID NO: 2226639 - RNA, 23 nt, Homo sapiens
agcuaagagaagauaaggucuga

SEQ ID NO: 2226640 - RNA, 21 nt, Homo sapiens
ccuuacacaaaugucuuacuc

SEQ ID NO: 2226641 - RNA, 20 nt, Homo sapiens
ccggaggggccuaagugcca

SEQ ID NO: 2226642 - RNA, 13 nt, Homo sapiens
auuaauaucacag

SEQ ID NO: 2226643 - RNA, 16 nt, Homo sapiens
gccuuuagucgcugag

SEQ ID NO: 2226644 - RNA, 16 nt, Homo sapiens
aaaucuuauaguucua

SEQ ID NO: 2226645 - RNA, 15 nt, Homo sapiens
gaaacggaagcucau

SEQ ID NO: 2226646 - RNA, 19 nt, Homo sapiens
uaccucaaaacacuuuccc

SEQ ID NO: 2226647 - RNA, 24 nt, Homo sapiens
uagagacuucuaaaucauaaucau

SEQ ID NO: 2226648 - RNA, 19 nt, Homo sapiens
cauauaaccaaaauccaga

SEQ ID NO: 2226649 - RNA, 20 nt, Homo sapiens
acaauuucaaaaugcaugug

SEQ ID NO: 2226650 - RNA, 20 nt, Homo sapiens
ccaaaguaaauguccugcua

SEQ ID NO: 2226651 - RNA, 13 nt, Homo sapiens
gcccagugccauc

SEQ ID NO: 2226652 - RNA, 21 nt, Homo sapiens
augugagcaugaaacuaugca

SEQ ID NO: 2226653 - RNA, 14 nt, Homo sapiens
caugacauagcacu

SEQ ID NO: 2226654 - RNA, 17 nt, Homo sapiens
auuaucugugauggaug

SEQ ID NO: 2226655 - RNA, 15 nt, Homo sapiens
ucauagcucacugca

SEQ ID NO: 2226656 - RNA, 15 nt, Homo sapiens
uauuguaaacaugug

SEQ ID NO: 2226657 - RNA, 13 nt, Homo sapiens
cuggcuguuaaaa

SEQ ID NO: 2226658 - RNA, 22 nt, Homo sapiens
ucaaggcccucagagaugauca

SEQ ID NO: 2226659 - RNA, 19 nt, Homo sapiens
cuguauuuuacaagucaaa

SEQ ID NO: 2226660 - RNA, 16 nt, Homo sapiens
aaaaugaaucuucaca

SEQ ID NO: 2226661 - RNA, 19 nt, Homo sapiens
uauucuguuugcguacuug

SEQ ID NO: 2226662 - RNA, 20 nt, Homo sapiens
aguccaucucaagugccaua

SEQ ID NO: 2226663 - RNA, 16 nt, Homo sapiens
guguauucauucucau

SEQ ID NO: 2226664 - RNA, 17 nt, Homo sapiens
gcugaaaacuacacaaa

SEQ ID NO: 2226665 - RNA, 20 nt, Homo sapiens
aaacaucuuuccaguccuug

SEQ ID NO: 2226666 - RNA, 20 nt, Homo sapiens
aaaacauugugccaugucaa

SEQ ID NO: 2226667 - RNA, 23 nt, Homo sapiens
uugacuuucugauuggugauuca

SEQ ID NO: 2226668 - RNA, 22 nt, Homo sapiens
cagccguguguucaaauguaca

SEQ ID NO: 2226669 - RNA, 15 nt, Homo sapiens
uuuaacugauuacug

SEQ ID NO: 2226670 - RNA, 18 nt, Homo sapiens
agcaccgccggcuuucag

SEQ ID NO: 2226671 - RNA, 12 nt, Homo sapiens
uuccuagcugug

SEQ ID NO: 2226672 - RNA, 21 nt, Homo sapiens
ucccaggagaaucacuugaac

SEQ ID NO: 2226673 - RNA, 19 nt, Homo sapiens
cugcacuccagaauccaca

SEQ ID NO: 2226674 - RNA, 20 nt, Homo sapiens
acauacauuaaacacacuua

SEQ ID NO: 2226675 - RNA, 21 nt, Homo sapiens
aagagaggaaugccuguguga

SEQ ID NO: 2226676 - RNA, 15 nt, Homo sapiens
cuuguuagcuguuuc

SEQ ID NO: 2226677 - RNA, 21 nt, Homo sapiens
cagaguucuauaauguaaaca

SEQ ID NO: 2226678 - RNA, 22 nt, Homo sapiens
uaugaauuuuacuugcaccuua

SEQ ID NO: 2226679 - RNA, 17 nt, Homo sapiens
agccccggacucaggcc

SEQ ID NO: 2226680 - RNA, 11 nt, Homo sapiens
ggacauguguu

SEQ ID NO: 2226681 - RNA, 13 nt, Homo sapiens
uaauagagaacuu

SEQ ID NO: 2226682 - RNA, 22 nt, Homo sapiens
cuuuuaaacugauuacguuuac

SEQ ID NO: 2226683 - RNA, 13 nt, Homo sapiens
acaagagaagcuu

SEQ ID NO: 2226684 - RNA, 16 nt, Homo sapiens
uuacucaugacuccuu

SEQ ID NO: 2226685 - RNA, 15 nt, Homo sapiens
acauuuacuguggau

SEQ ID NO: 2226686 - RNA, 14 nt, Homo sapiens
aaaauggugaauga

SEQ ID NO: 2226687 - RNA, 18 nt, Homo sapiens
cuggagcgggugggaacc

SEQ ID NO: 2226688 - RNA, 17 nt, Homo sapiens
uucaauuguagaugaac

SEQ ID NO: 2226689 - RNA, 17 nt, Homo sapiens
uccugcuauuacuaagg

SEQ ID NO: 2226690 - RNA, 17 nt, Homo sapiens
ccagacaggcucagguu

SEQ ID NO: 2226691 - RNA, 18 nt, Homo sapiens
acccuucccuugagcccu

SEQ ID NO: 2226692 - RNA, 20 nt, Homo sapiens
aauaaguggcuugucugcag

SEQ ID NO: 2226693 - RNA, 21 nt, Homo sapiens
auccaaagaacuugauuugca

SEQ ID NO: 2226694 - RNA, 18 nt, Homo sapiens
auucaggcuugcauuaaa

SEQ ID NO: 2226695 - RNA, 20 nt, Homo sapiens
ucaccuuaaaauuagcaucu

SEQ ID NO: 2226696 - RNA, 19 nt, Homo sapiens
cuuuuagaauuuaccucuu

SEQ ID NO: 2226697 - RNA, 18 nt, Homo sapiens
cauuaaugacacuugucc

SEQ ID NO: 2226698 - RNA, 20 nt, Homo sapiens
cugcucauaacaucuuugaa

SEQ ID NO: 2226699 - RNA, 17 nt, Homo sapiens
aacugacuucuuugugg

SEQ ID NO: 2226700 - RNA, 20 nt, Homo sapiens
agaggccaguugaucugcuc

SEQ ID NO: 2226701 - RNA, 14 nt, Homo sapiens
aguagaauccuaaa

SEQ ID NO: 2226702 - RNA, 16 nt, Homo sapiens
augagugcaccugccu

SEQ ID NO: 2226703 - RNA, 16 nt, Homo sapiens
uccaccagcccauggc

SEQ ID NO: 2226704 - RNA, 16 nt, Homo sapiens
aguauguucauugcca

SEQ ID NO: 2226705 - RNA, 16 nt, Homo sapiens
agcuucuucacaggca

SEQ ID NO: 2226706 - RNA, 21 nt, Homo sapiens
auuugagcucuggaagccucu

SEQ ID NO: 2226707 - RNA, 18 nt, Homo sapiens
ugagcagagauguacugc

SEQ ID NO: 2226708 - RNA, 14 nt, Homo sapiens
ggaucuguuccuug

SEQ ID NO: 2226709 - RNA, 12 nt, Homo sapiens
auaaagcuuuau

SEQ ID NO: 2226710 - RNA, 20 nt, Homo sapiens
cucacacuuuuggaaccaug

SEQ ID NO: 2226711 - RNA, 22 nt, Homo sapiens
cacaggagacacugugcuauaa

SEQ ID NO: 2226712 - RNA, 13 nt, Homo sapiens
uuuaguaagcaaa

SEQ ID NO: 2226713 - RNA, 16 nt, Homo sapiens
auuuguccucauguga

SEQ ID NO: 2226714 - RNA, 15 nt, Homo sapiens
uaugcuuuacugcga

SEQ ID NO: 2226715 - RNA, 19 nt, Homo sapiens
guugguucuuagaccucaa

SEQ ID NO: 2226716 - RNA, 15 nt, Homo sapiens
agcuaguuaauguca

SEQ ID NO: 2226717 - RNA, 20 nt, Homo sapiens
auaaacacacccucugugcu

SEQ ID NO: 2226718 - RNA, 16 nt, Homo sapiens
uguugaagcacuguug

SEQ ID NO: 2226719 - RNA, 16 nt, Homo sapiens
ucaguucuacuuuuau

SEQ ID NO: 2226720 - RNA, 20 nt, Homo sapiens
agagccagucucaccuucaa

SEQ ID NO: 2226721 - RNA, 20 nt, Homo sapiens
uaguugccguggcaacugug

SEQ ID NO: 2226722 - RNA, 15 nt, Homo sapiens
ucgguacccaccaca

SEQ ID NO: 2226723 - RNA, 16 nt, Homo sapiens
uaggaggaaacaguuc

SEQ ID NO: 2226724 - RNA, 21 nt, Homo sapiens
gacauuucaaauaacugcaga

SEQ ID NO: 2226725 - RNA, 19 nt, Homo sapiens
gcugaugaacuguggugcc

SEQ ID NO: 2226726 - RNA, 22 nt, Homo sapiens
uuaccauuuguaauaaaguaua

SEQ ID NO: 2226727 - RNA, 11 nt, Homo sapiens
guaacuguccu

SEQ ID NO: 2226728 - RNA, 13 nt, Homo sapiens
auauauaugucaa

SEQ ID NO: 2226729 - RNA, 14 nt, Homo sapiens
agccucgacacccc

SEQ ID NO: 2226730 - RNA, 14 nt, Homo sapiens
uggguaaaaugaag

SEQ ID NO: 2226731 - RNA, 19 nt, Homo sapiens
uguagaaaaaaaaauucac

SEQ ID NO: 2226732 - RNA, 14 nt, Homo sapiens
caggauggcacugu

SEQ ID NO: 2226733 - RNA, 17 nt, Homo sapiens
caaagcuugggacaguu

SEQ ID NO: 2226734 - RNA, 22 nt, Homo sapiens
gcaagccuugcuagacagccag

SEQ ID NO: 2226735 - RNA, 16 nt, Homo sapiens
uacaaaagcaaaguga

SEQ ID NO: 2226736 - RNA, 19 nt, Homo sapiens
cgucacugcccaccaaagg

SEQ ID NO: 2226737 - RNA, 23 nt, Homo sapiens
aaucacacucucuucuuacugua

SEQ ID NO: 2226738 - RNA, 14 nt, Homo sapiens
cugagagaucugcu

SEQ ID NO: 2226739 - RNA, 17 nt, Homo sapiens
uaaagucaacaaccaug

SEQ ID NO: 2226740 - RNA, 14 nt, Homo sapiens
cagggugucccagg

SEQ ID NO: 2226741 - RNA, 18 nt, Homo sapiens
cuagaugcaucacugggu

SEQ ID NO: 2226742 - RNA, 17 nt, Homo sapiens
gcuucaguacuugugaa

SEQ ID NO: 2226743 - RNA, 12 nt, Homo sapiens
caauuuuuccau

SEQ ID NO: 2226744 - RNA, 16 nt, Homo sapiens
guaucuauuuuccucu

SEQ ID NO: 2226745 - RNA, 19 nt, Homo sapiens
ucaugccccggcugcacac

SEQ ID NO: 2226746 - RNA, 12 nt, Homo sapiens
acgucagaagaa

SEQ ID NO: 2226747 - RNA, 12 nt, Homo sapiens
uuauuguuccaa

SEQ ID NO: 2226748 - RNA, 16 nt, Homo sapiens
ccaucagugcucugua

SEQ ID NO: 2226749 - RNA, 19 nt, Homo sapiens
aauguguuuuguacaugaa

SEQ ID NO: 2226750 - RNA, 20 nt, Homo sapiens
ggggaagcggcccuaaggga

SEQ ID NO: 2226751 - RNA, 13 nt, Homo sapiens
ccuaaaagcaaaa

SEQ ID NO: 2226752 - RNA, 13 nt, Homo sapiens
gccuuccaauccu

SEQ ID NO: 2226753 - RNA, 13 nt, Homo sapiens
cuccccuuugccu

SEQ ID NO: 2226754 - RNA, 19 nt, Homo sapiens
aacauuuugcugauuuugu

SEQ ID NO: 2226755 - RNA, 22 nt, Homo sapiens
gcugaaauaaaaugauaaacaa

SEQ ID NO: 2226756 - RNA, 15 nt, Homo sapiens
cacugcuaugccauu

SEQ ID NO: 2226757 - RNA, 20 nt, Homo sapiens
agaugcagaaaauugccuaa

SEQ ID NO: 2226758 - RNA, 12 nt, Homo sapiens
uacagacauaca

SEQ ID NO: 2226759 - RNA, 20 nt, Homo sapiens
auuaaaacaauaaugcaauu

SEQ ID NO: 2226760 - RNA, 12 nt, Homo sapiens
gccaagaacucu

SEQ ID NO: 2226761 - RNA, 14 nt, Homo sapiens
auucacagaaccua

SEQ ID NO: 2226762 - RNA, 20 nt, Homo sapiens
agggcuugugugcacauauc

SEQ ID NO: 2226763 - RNA, 22 nt, Homo sapiens
ucccacugcccccuccacugga

SEQ ID NO: 2226764 - RNA, 23 nt, Homo sapiens
caaaauguccugauuacaaugcu

SEQ ID NO: 2226765 - RNA, 15 nt, Homo sapiens
acaacuaccuccuca

SEQ ID NO: 2226766 - RNA, 17 nt, Homo sapiens
acugcacacaugcacac

SEQ ID NO: 2226767 - RNA, 14 nt, Homo sapiens
cugugaacaugccu

SEQ ID NO: 2226768 - RNA, 13 nt, Homo sapiens
uuucgaacauucu

SEQ ID NO: 2226769 - RNA, 11 nt, Homo sapiens
uagugaguaua

SEQ ID NO: 2226770 - RNA, 16 nt, Homo sapiens
caccuccccacuccag

SEQ ID NO: 2226771 - RNA, 13 nt, Homo sapiens
gauaguuuugcca

SEQ ID NO: 2226772 - RNA, 19 nt, Homo sapiens
guacaaaaaaaaaguuuua

SEQ ID NO: 2226773 - RNA, 21 nt, Homo sapiens
aagugaugauuguaaguccca

SEQ ID NO: 2226774 - RNA, 22 nt, Homo sapiens
uaaggcauccacuucacaguuc

SEQ ID NO: 2226775 - RNA, 17 nt, Homo sapiens
uuuaguuauauucacug

SEQ ID NO: 2226776 - RNA, 22 nt, Homo sapiens
cuccccucccgaacacugagaa

SEQ ID NO: 2226777 - RNA, 17 nt, Homo sapiens
cacagacccacagaagg

SEQ ID NO: 2226778 - RNA, 23 nt, Homo sapiens
gagcccuccgccuucacauuccc

SEQ ID NO: 2226779 - RNA, 12 nt, Homo sapiens
cacuuuugagga

SEQ ID NO: 2226780 - RNA, 22 nt, Homo sapiens
agccauggugacacacagcagc

SEQ ID NO: 2226781 - RNA, 21 nt, Homo sapiens
caaacuagauucauggcuuua

SEQ ID NO: 2226782 - RNA, 15 nt, Homo sapiens
ggaaaugauguuuca

SEQ ID NO: 2226783 - RNA, 16 nt, Homo sapiens
aauguuggagcagcag

SEQ ID NO: 2226784 - RNA, 20 nt, Homo sapiens
cagaugccaaaaaagaugcc

SEQ ID NO: 2226785 - RNA, 16 nt, Homo sapiens
agugcagaagcacaug

SEQ ID NO: 2226786 - RNA, 16 nt, Homo sapiens
augaugcagcagaugu

SEQ ID NO: 2226787 - RNA, 16 nt, Homo sapiens
ucacuugaacucggga

SEQ ID NO: 2226788 - RNA, 16 nt, Homo sapiens
uacucacuuucccaaa

SEQ ID NO: 2226789 - RNA, 13 nt, Homo sapiens
ucaacauaugaau

SEQ ID NO: 2226790 - RNA, 13 nt, Homo sapiens
uaacuaucaauau

SEQ ID NO: 2226791 - RNA, 18 nt, Homo sapiens
auagagggccacggggag

SEQ ID NO: 2226792 - RNA, 12 nt, Homo sapiens
ccgccauccacc

SEQ ID NO: 2226793 - RNA, 12 nt, Homo sapiens
uagucaucuccu

SEQ ID NO: 2226794 - RNA, 15 nt, Homo sapiens
acauggaugccaacc

SEQ ID NO: 2226795 - RNA, 15 nt, Homo sapiens
uaguggaaagugauu

SEQ ID NO: 2226796 - RNA, 18 nt, Homo sapiens
cugcucuccccacccaga

SEQ ID NO: 2226797 - RNA, 22 nt, Homo sapiens
ugccccuccccuccccguguaa

SEQ ID NO: 2226798 - RNA, 17 nt, Homo sapiens
acaccagcaaugaagga

SEQ ID NO: 2226799 - RNA, 16 nt, Homo sapiens
ucaauguaccugugug

SEQ ID NO: 2226800 - RNA, 18 nt, Homo sapiens
gguguucugguaaacuga

SEQ ID NO: 2226801 - RNA, 16 nt, Homo sapiens
aucuaaauauuuccau

SEQ ID NO: 2226802 - RNA, 22 nt, Homo sapiens
ugauaguucacccccugagauc

SEQ ID NO: 2226803 - RNA, 12 nt, Homo sapiens
auugaaugaaac

SEQ ID NO: 2226804 - RNA, 21 nt, Homo sapiens
cccaagacaugaagacaucuu

SEQ ID NO: 2226805 - RNA, 17 nt, Homo sapiens
augggucucucuugccc

SEQ ID NO: 2226806 - RNA, 12 nt, Homo sapiens
agagggcccaaa

SEQ ID NO: 2226807 - RNA, 15 nt, Homo sapiens
ucauguaacacgaca

SEQ ID NO: 2226808 - RNA, 21 nt, Homo sapiens
gcuaugcucaggggcccugga

SEQ ID NO: 2226809 - RNA, 14 nt, Homo sapiens
gaacauuuugauua

SEQ ID NO: 2226810 - RNA, 18 nt, Homo sapiens
gagaaauuccuugauuca

SEQ ID NO: 2226811 - RNA, 19 nt, Homo sapiens
caaccuccgccucccaggu

SEQ ID NO: 2226812 - RNA, 22 nt, Homo sapiens
cccuuuuguauucucuuccuca

SEQ ID NO: 2226813 - RNA, 17 nt, Homo sapiens
aguggucucuacugugg

SEQ ID NO: 2226814 - RNA, 21 nt, Homo sapiens
aaguuuuacuaaauacuuuaa

SEQ ID NO: 2226815 - RNA, 20 nt, Homo sapiens
gcaucaggauacucaaagug

SEQ ID NO: 2226816 - RNA, 17 nt, Homo sapiens
uaguauuuuugccaaaa

SEQ ID NO: 2226817 - RNA, 13 nt, Homo sapiens
cccauugcugcca

SEQ ID NO: 2226818 - RNA, 15 nt, Homo sapiens
caccacaugccuuca

SEQ ID NO: 2226819 - RNA, 14 nt, Homo sapiens
caauagaacagaga

SEQ ID NO: 2226820 - RNA, 19 nt, Homo sapiens
accggcccuuucuuuguga

SEQ ID NO: 2226821 - RNA, 23 nt, Homo sapiens
agugcuugcagaucaucugggga

SEQ ID NO: 2226822 - RNA, 14 nt, Homo sapiens
caaaccuguuuaaa

SEQ ID NO: 2226823 - RNA, 17 nt, Homo sapiens
guccuguccuuuaccaa

SEQ ID NO: 2226824 - RNA, 21 nt, Homo sapiens
aaaugcccaucuaugucccuu

SEQ ID NO: 2226825 - RNA, 13 nt, Homo sapiens
cagccugccuuua

SEQ ID NO: 2226826 - RNA, 19 nt, Homo sapiens
cucagguuccaaauucagu

SEQ ID NO: 2226827 - RNA, 19 nt, Homo sapiens
cagaugauccauuugaaca

SEQ ID NO: 2226828 - RNA, 15 nt, Homo sapiens
uggggcuggccugca

SEQ ID NO: 2226829 - RNA, 17 nt, Homo sapiens
ccuaaauugaacugcca

SEQ ID NO: 2226830 - RNA, 17 nt, Homo sapiens
cccuggagcaagaccug

SEQ ID NO: 2226831 - RNA, 14 nt, Homo sapiens
ucucuggaguauuc

SEQ ID NO: 2226832 - RNA, 18 nt, Homo sapiens
caguggguggagccaauc

SEQ ID NO: 2226833 - RNA, 13 nt, Homo sapiens
ugcacccuggaag

SEQ ID NO: 2226834 - RNA, 16 nt, Homo sapiens
aacuuguuacaccaca

SEQ ID NO: 2226835 - RNA, 22 nt, Homo sapiens
uccauuuauugcacucagcuuu

SEQ ID NO: 2226836 - RNA, 14 nt, Homo sapiens
uuguaaaauggugu

SEQ ID NO: 2226837 - RNA, 22 nt, Homo sapiens
agcaugugugugucucuaucuu

SEQ ID NO: 2226838 - RNA, 14 nt, Homo sapiens
uugaccaccaguua

SEQ ID NO: 2226839 - RNA, 14 nt, Homo sapiens
cauuucacuuuaca

SEQ ID NO: 2226840 - RNA, 20 nt, Homo sapiens
aaagcauuuuuuaaaagcau

SEQ ID NO: 2226841 - RNA, 15 nt, Homo sapiens
ccaggcugagccaug

SEQ ID NO: 2226842 - RNA, 16 nt, Homo sapiens
aguagcaucaccaucu

SEQ ID NO: 2226843 - RNA, 20 nt, Homo sapiens
aaagauuauugugacuucac

SEQ ID NO: 2226844 - RNA, 15 nt, Homo sapiens
uuugacagcauuucc

SEQ ID NO: 2226845 - RNA, 14 nt, Homo sapiens
gggcuacagugucu

SEQ ID NO: 2226846 - RNA, 20 nt, Homo sapiens
cccagagguuaucugccugg

SEQ ID NO: 2226847 - RNA, 15 nt, Homo sapiens
aagguuuucauuugc

SEQ ID NO: 2226848 - RNA, 15 nt, Homo sapiens
cauucaggucuuucu

SEQ ID NO: 2226849 - RNA, 23 nt, Homo sapiens
accugugucuuauagguuuccac

SEQ ID NO: 2226850 - RNA, 21 nt, Homo sapiens
cauggacaugcuucagugcug

SEQ ID NO: 2226851 - RNA, 21 nt, Homo sapiens
ugaacuguggugccacaugac

SEQ ID NO: 2226852 - RNA, 21 nt, Homo sapiens
aguaaucuuuggcuguaaggc

SEQ ID NO: 2226853 - RNA, 17 nt, Homo sapiens
caaugaaagacacuguu

SEQ ID NO: 2226854 - RNA, 15 nt, Homo sapiens
uacugugagaacugu

SEQ ID NO: 2226855 - RNA, 22 nt, Homo sapiens
cugccuguauacuuuaguauga

SEQ ID NO: 2226856 - RNA, 23 nt, Homo sapiens
ugaauuaacacaguguuucaauu

SEQ ID NO: 2226857 - RNA, 18 nt, Homo sapiens
caaucuaagggagucauu

SEQ ID NO: 2226858 - RNA, 15 nt, Homo sapiens
uuauucuucuuuaug

SEQ ID NO: 2226859 - RNA, 16 nt, Homo sapiens
uaacaugaacucuuga

SEQ ID NO: 2226860 - RNA, 15 nt, Homo sapiens
ugaugugaguugcac

SEQ ID NO: 2226861 - RNA, 17 nt, Homo sapiens
uaugaaaccccaaugcu

SEQ ID NO: 2226862 - RNA, 14 nt, Homo sapiens
gaguuucaaauccc

SEQ ID NO: 2226863 - RNA, 14 nt, Homo sapiens
acaaaguauuugcu

SEQ ID NO: 2226864 - RNA, 15 nt, Homo sapiens
guugggaaccagaga

SEQ ID NO: 2226865 - RNA, 21 nt, Homo sapiens
cauuuucagaccaugaaugaa

SEQ ID NO: 2226866 - RNA, 15 nt, Homo sapiens
uggaauuacaaccau

SEQ ID NO: 2226867 - RNA, 11 nt, Homo sapiens
accaaagggaa

SEQ ID NO: 2226868 - RNA, 22 nt, Homo sapiens
caggaggcugggacgcucugcu

SEQ ID NO: 2226869 - RNA, 20 nt, Homo sapiens
ggaggauggcuugcgcucag

SEQ ID NO: 2226870 - RNA, 14 nt, Homo sapiens
gaaaaggugaagcu

SEQ ID NO: 2226871 - RNA, 18 nt, Homo sapiens
caugagcaaccagugcca

SEQ ID NO: 2226872 - RNA, 16 nt, Homo sapiens
uggaagagauaagcua

SEQ ID NO: 2226873 - RNA, 19 nt, Homo sapiens
ugcuuccucccaacaagca

SEQ ID NO: 2226874 - RNA, 13 nt, Homo sapiens
ugguuccaaagac

SEQ ID NO: 2226875 - RNA, 15 nt, Homo sapiens
acccugccgucacca

SEQ ID NO: 2226876 - RNA, 17 nt, Homo sapiens
ugugauggauggacaca

SEQ ID NO: 2226877 - RNA, 17 nt, Homo sapiens
agcuagacugugucuga

SEQ ID NO: 2226878 - RNA, 13 nt, Homo sapiens
aaaauaucaauau

SEQ ID NO: 2226879 - RNA, 14 nt, Homo sapiens
uccacucugagguc

SEQ ID NO: 2226880 - RNA, 20 nt, Homo sapiens
guuggggacccccucaggau

SEQ ID NO: 2226881 - RNA, 15 nt, Homo sapiens
uaaugcuugcugcug

SEQ ID NO: 2226882 - RNA, 21 nt, Homo sapiens
aaauuuauuuccuaguucugu

SEQ ID NO: 2226883 - RNA, 15 nt, Homo sapiens
cucuuccaccacaga

SEQ ID NO: 2226884 - RNA, 21 nt, Homo sapiens
cucaaauacaugcacagucau

SEQ ID NO: 2226885 - RNA, 16 nt, Homo sapiens
aucccaaucaagguau

SEQ ID NO: 2226886 - RNA, 20 nt, Homo sapiens
ggcuggagccuggggugucc

SEQ ID NO: 2226887 - RNA, 15 nt, Homo sapiens
ccucagguuugccug

SEQ ID NO: 2226888 - RNA, 17 nt, Homo sapiens
acaguuuuuccuggaau

SEQ ID NO: 2226889 - RNA, 21 nt, Homo sapiens
auaccugaguacccaugggaa

SEQ ID NO: 2226890 - RNA, 11 nt, Homo sapiens
aaagacuguag

SEQ ID NO: 2226891 - RNA, 14 nt, Homo sapiens
uggcaggaccagga

SEQ ID NO: 2226892 - RNA, 15 nt, Homo sapiens
auuaacacagaggac

SEQ ID NO: 2226893 - RNA, 20 nt, Homo sapiens
aagauuuugccacauuugau

SEQ ID NO: 2226894 - RNA, 21 nt, Homo sapiens
aaggugaggccugucugugac

SEQ ID NO: 2226895 - RNA, 20 nt, Homo sapiens
ucaggacccagggaaugcca

SEQ ID NO: 2226896 - RNA, 15 nt, Homo sapiens
gaacauuuucuggga

SEQ ID NO: 2226897 - RNA, 20 nt, Homo sapiens
auuuuguaugccaaucuuaa

SEQ ID NO: 2226898 - RNA, 17 nt, Homo sapiens
cuuggguagggcagaca

SEQ ID NO: 2226899 - RNA, 21 nt, Homo sapiens
aaucucaauauuucagauaau

SEQ ID NO: 2226900 - RNA, 16 nt, Homo sapiens
agaaugaagggccagg

SEQ ID NO: 2226901 - RNA, 20 nt, Homo sapiens
aaucuccacccaaugaauga

SEQ ID NO: 2226902 - RNA, 13 nt, Homo sapiens
caguugcucugac

SEQ ID NO: 2226903 - RNA, 16 nt, Homo sapiens
acugaucgauuugcac

SEQ ID NO: 2226904 - RNA, 22 nt, Homo sapiens
aagcuuguauuuaacugaauaa

SEQ ID NO: 2226905 - RNA, 21 nt, Homo sapiens
aguaauaguaaacacagggaa

SEQ ID NO: 2226906 - RNA, 15 nt, Homo sapiens
aacuaaccagcauuc

SEQ ID NO: 2226907 - RNA, 17 nt, Homo sapiens
uugauuuguagcacuga

SEQ ID NO: 2226908 - RNA, 13 nt, Homo sapiens
aaauuuauugcuu

SEQ ID NO: 2226909 - RNA, 20 nt, Homo sapiens
aucaagaauggggaucacag

SEQ ID NO: 2226910 - RNA, 16 nt, Homo sapiens
augauugugaccucca

SEQ ID NO: 2226911 - RNA, 20 nt, Homo sapiens
agcucaagaugacagcucuu

SEQ ID NO: 2226912 - RNA, 17 nt, Homo sapiens
augucauuucauuuccu

SEQ ID NO: 2226913 - RNA, 13 nt, Homo sapiens
uuccagccuucua

SEQ ID NO: 2226914 - RNA, 17 nt, Homo sapiens
gaugaaucuugaaacac

SEQ ID NO: 2226915 - RNA, 12 nt, Homo sapiens
gcugccuaauaa

SEQ ID NO: 2226916 - RNA, 13 nt, Homo sapiens
ucucaaaaauccu

SEQ ID NO: 2226917 - RNA, 15 nt, Homo sapiens
ucucuacagacucca

SEQ ID NO: 2226918 - RNA, 16 nt, Homo sapiens
aaaucaacucucuccu

SEQ ID NO: 2226919 - RNA, 17 nt, Homo sapiens
gcugcuuggagugcccc

SEQ ID NO: 2226920 - RNA, 20 nt, Homo sapiens
agccgacaccuuuuuucaac

SEQ ID NO: 2226921 - RNA, 15 nt, Homo sapiens
auugcgcccauuuag

SEQ ID NO: 2226922 - RNA, 16 nt, Homo sapiens
aaauggguuggugcuu

SEQ ID NO: 2226923 - RNA, 22 nt, Homo sapiens
ugccugaaacccauuuacuuag

SEQ ID NO: 2226924 - RNA, 14 nt, Homo sapiens
cuaaaggacuaaca

SEQ ID NO: 2226925 - RNA, 12 nt, Homo sapiens
ugggucaacucc

SEQ ID NO: 2226926 - RNA, 18 nt, Homo sapiens
gaggcugagguggcagaa

SEQ ID NO: 2226927 - RNA, 16 nt, Homo sapiens
uuuguugagucucuga

SEQ ID NO: 2226928 - RNA, 16 nt, Homo sapiens
uacuuuaugaugcuau

SEQ ID NO: 2226929 - RNA, 15 nt, Homo sapiens
uuaucuccugggauu

SEQ ID NO: 2226930 - RNA, 22 nt, Homo sapiens
cucguucaguuuaguaagcaaa

SEQ ID NO: 2226931 - RNA, 15 nt, Homo sapiens
auuucacucagggug

SEQ ID NO: 2226932 - RNA, 21 nt, Homo sapiens
ugcugcaugggucacagcggc

SEQ ID NO: 2226933 - RNA, 17 nt, Homo sapiens
agauguacgacuugcau

SEQ ID NO: 2226934 - RNA, 18 nt, Homo sapiens
cacuaagagaauacagga

SEQ ID NO: 2226935 - RNA, 21 nt, Homo sapiens
auuuaaagaaaauaaacacca

SEQ ID NO: 2226936 - RNA, 15 nt, Homo sapiens
aauaauauaugcuca

SEQ ID NO: 2226937 - RNA, 15 nt, Homo sapiens
aagggcaggagcuca

SEQ ID NO: 2226938 - RNA, 17 nt, Homo sapiens
agguagcacagcacuuu

SEQ ID NO: 2226939 - RNA, 15 nt, Homo sapiens
cagcugugcacuuuc

SEQ ID NO: 2226940 - RNA, 23 nt, Homo sapiens
agucacuucggccagagcugaag

SEQ ID NO: 2226941 - RNA, 22 nt, Homo sapiens
cacuacucgagcccacccagca

SEQ ID NO: 2226942 - RNA, 10 nt, Homo sapiens
ggcugugagc

SEQ ID NO: 2226943 - RNA, 15 nt, Homo sapiens
cuguuuuuauaugca

SEQ ID NO: 2226944 - RNA, 22 nt, Homo sapiens
uuuuacucauuguccugguuuc

SEQ ID NO: 2226945 - RNA, 11 nt, Homo sapiens
ggaguccaggc

SEQ ID NO: 2226946 - RNA, 17 nt, Homo sapiens
uuaaauaaaucuuucag

SEQ ID NO: 2226947 - RNA, 17 nt, Homo sapiens
ugccucgaaagugucau

SEQ ID NO: 2226948 - RNA, 19 nt, Homo sapiens
ugcacgggagaauauacaa

SEQ ID NO: 2226949 - RNA, 22 nt, Homo sapiens
gugggcgcuugcaccacuuccg

SEQ ID NO: 2226950 - RNA, 14 nt, Homo sapiens
gugagccacagacc

SEQ ID NO: 2226951 - RNA, 14 nt, Homo sapiens
guaagacacaaaca

SEQ ID NO: 2226952 - RNA, 21 nt, Homo sapiens
ucgagcauguuguuuuuucau

SEQ ID NO: 2226953 - RNA, 13 nt, Homo sapiens
uccagucucucca

SEQ ID NO: 2226954 - RNA, 21 nt, Homo sapiens
cugauaaacauuaaacacugu

SEQ ID NO: 2226955 - RNA, 12 nt, Homo sapiens
gagcucuuggcc

SEQ ID NO: 2226956 - RNA, 15 nt, Homo sapiens
cuccacugaccuggu

SEQ ID NO: 2226957 - RNA, 20 nt, Homo sapiens
ggagguggagguugcaguga

SEQ ID NO: 2226958 - RNA, 19 nt, Homo sapiens
aauguaguaaguaaauuaa

SEQ ID NO: 2226959 - RNA, 15 nt, Homo sapiens
ugcuuaagugcaugc

SEQ ID NO: 2226960 - RNA, 20 nt, Homo sapiens
uuguauuaguauugugaaua

SEQ ID NO: 2226961 - RNA, 19 nt, Homo sapiens
acugcccauggacaggcug

SEQ ID NO: 2226962 - RNA, 16 nt, Homo sapiens
uuccuuuuguuuucca

SEQ ID NO: 2226963 - RNA, 13 nt, Homo sapiens
acuccagaaucca

SEQ ID NO: 2226964 - RNA, 14 nt, Homo sapiens
auacaucauuccac

SEQ ID NO: 2226965 - RNA, 23 nt, Homo sapiens
cuuugggcccugcauguagugug

SEQ ID NO: 2226966 - RNA, 14 nt, Homo sapiens
acauaugugugugu

SEQ ID NO: 2226967 - RNA, 14 nt, Homo sapiens
cuuacaugauucau

SEQ ID NO: 2226968 - RNA, 16 nt, Homo sapiens
uuuucaggguuuuaaa

SEQ ID NO: 2226969 - RNA, 18 nt, Homo sapiens
aagauuuaacaaauacau

SEQ ID NO: 2226970 - RNA, 19 nt, Homo sapiens
agcacccccagccugccuu

SEQ ID NO: 2226971 - RNA, 17 nt, Homo sapiens
cugccuggagagcuccu

SEQ ID NO: 2226972 - RNA, 17 nt, Homo sapiens
cuuccccaucccggagu

SEQ ID NO: 2226973 - RNA, 14 nt, Homo sapiens
aaugaaauacugag

SEQ ID NO: 2226974 - RNA, 14 nt, Homo sapiens
acagaaauaaagag

SEQ ID NO: 2226975 - RNA, 18 nt, Homo sapiens
ggcacuuuaagucaguga

SEQ ID NO: 2226976 - RNA, 21 nt, Homo sapiens
aucaaaaucuuucagcacuca

SEQ ID NO: 2226977 - RNA, 22 nt, Homo sapiens
ugagcuaguuaaggcaaaucag

SEQ ID NO: 2226978 - RNA, 18 nt, Homo sapiens
ugacauccagcaguccaa

SEQ ID NO: 2226979 - RNA, 14 nt, Homo sapiens
agccccaccaugca

SEQ ID NO: 2226980 - RNA, 18 nt, Homo sapiens
acaugggugaacacucaa

SEQ ID NO: 2226981 - RNA, 17 nt, Homo sapiens
ucuuucugucaggggcu

SEQ ID NO: 2226982 - RNA, 18 nt, Homo sapiens
aauccuuggggagcacuu

SEQ ID NO: 2226983 - RNA, 20 nt, Homo sapiens
cuuugucccccaaugccugc

SEQ ID NO: 2226984 - RNA, 12 nt, Homo sapiens
ccuaauaucauu

SEQ ID NO: 2226985 - RNA, 16 nt, Homo sapiens
aaugguggucuucucc

SEQ ID NO: 2226986 - RNA, 15 nt, Homo sapiens
ucgugaccuacaggg

SEQ ID NO: 2226987 - RNA, 23 nt, Homo sapiens
ugcccccagauuuaaccauucca

SEQ ID NO: 2226988 - RNA, 21 nt, Homo sapiens
auuaguaggcucauuuacugu

SEQ ID NO: 2226989 - RNA, 17 nt, Homo sapiens
cuccaccacugugcacu

SEQ ID NO: 2226990 - RNA, 21 nt, Homo sapiens
aacaauguauaaagauuguac

SEQ ID NO: 2226991 - RNA, 13 nt, Homo sapiens
guaaguuuuugca

SEQ ID NO: 2226992 - RNA, 19 nt, Homo sapiens
uuuggagaaaugcuuagaa

SEQ ID NO: 2226993 - RNA, 20 nt, Homo sapiens
ucaaaguuuugaaaagcuau

SEQ ID NO: 2226994 - RNA, 20 nt, Homo sapiens
cauaaaaauaaaucaguuca

SEQ ID NO: 2226995 - RNA, 20 nt, Homo sapiens
uguaaauaugaaucugcuca

SEQ ID NO: 2226996 - RNA, 12 nt, Homo sapiens
acaaucauguaa

SEQ ID NO: 2226997 - RNA, 14 nt, Homo sapiens
gaaugcggcaagaa

SEQ ID NO: 2226998 - RNA, 19 nt, Homo sapiens
uuccaccaucaaaugcugu

SEQ ID NO: 2226999 - RNA, 14 nt, Homo sapiens
gagcuggaccucac

SEQ ID NO: 2227000 - RNA, 17 nt, Homo sapiens
aagcaccucaagugcaa

SEQ ID NO: 2227001 - RNA, 20 nt, Homo sapiens
gccagcugaugacucaagau

SEQ ID NO: 2227002 - RNA, 17 nt, Homo sapiens
uagaaaacaaucugccc

SEQ ID NO: 2227003 - RNA, 17 nt, Homo sapiens
cucuucaggaaaccaga

SEQ ID NO: 2227004 - RNA, 20 nt, Homo sapiens
cauucuuugcaauacugcuu

SEQ ID NO: 2227005 - RNA, 12 nt, Homo sapiens
ucagacaugaaa

SEQ ID NO: 2227006 - RNA, 18 nt, Homo sapiens
uugucagggucuccuucc

SEQ ID NO: 2227007 - RNA, 21 nt, Homo sapiens
gaccuggugcucuaaugccaa

SEQ ID NO: 2227008 - RNA, 13 nt, Homo sapiens
guucccuuccuca

SEQ ID NO: 2227009 - RNA, 23 nt, Homo sapiens
cuucacggaaagugccugcaaaa

SEQ ID NO: 2227010 - RNA, 20 nt, Homo sapiens
guacuguuuuguuuguuaau

SEQ ID NO: 2227011 - RNA, 12 nt, Homo sapiens
aagaaguggcau

SEQ ID NO: 2227012 - RNA, 18 nt, Homo sapiens
ugugauuguuccauaaua

SEQ ID NO: 2227013 - RNA, 15 nt, Homo sapiens
cuucaagugccaaac

SEQ ID NO: 2227014 - RNA, 14 nt, Homo sapiens
gaaaaacauuauuu

SEQ ID NO: 2227015 - RNA, 19 nt, Homo sapiens
ucccauaacaaccugggca

SEQ ID NO: 2227016 - RNA, 17 nt, Homo sapiens
uuccuccugacacccca

SEQ ID NO: 2227017 - RNA, 19 nt, Homo sapiens
aggcagcacagugugugaa

SEQ ID NO: 2227018 - RNA, 15 nt, Homo sapiens
aaagacuguacuggc

SEQ ID NO: 2227019 - RNA, 18 nt, Homo sapiens
uacuaauuaaucacaaau

SEQ ID NO: 2227020 - RNA, 20 nt, Homo sapiens
uuguuacuguucuugcugcu

SEQ ID NO: 2227021 - RNA, 15 nt, Homo sapiens
caaggccuucccugu

SEQ ID NO: 2227022 - RNA, 22 nt, Homo sapiens
guuuuucagguauauaccucca

SEQ ID NO: 2227023 - RNA, 20 nt, Homo sapiens
ucccaaagugcugagauuau

SEQ ID NO: 2227024 - RNA, 18 nt, Homo sapiens
auuaggaacaguaaaauc

SEQ ID NO: 2227025 - RNA, 15 nt, Homo sapiens
ggauggguccucacg

SEQ ID NO: 2227026 - RNA, 15 nt, Homo sapiens
ggcugucucaucccc

SEQ ID NO: 2227027 - RNA, 15 nt, Homo sapiens
cuugaaugcagggac

SEQ ID NO: 2227028 - RNA, 19 nt, Homo sapiens
ccuaacauaacacuaaaug

SEQ ID NO: 2227029 - RNA, 23 nt, Homo sapiens
aucagagaacagucauguaugca

SEQ ID NO: 2227030 - RNA, 12 nt, Homo sapiens
gugauuccauca

SEQ ID NO: 2227031 - RNA, 18 nt, Homo sapiens
aguaaguacaaauauucc

SEQ ID NO: 2227032 - RNA, 23 nt, Homo sapiens
aaugaagacccaguguaaagaau

SEQ ID NO: 2227033 - RNA, 15 nt, Homo sapiens
uaggagcaaagccug

SEQ ID NO: 2227034 - RNA, 15 nt, Homo sapiens
uuauacaacagugcu

SEQ ID NO: 2227035 - RNA, 20 nt, Homo sapiens
accauguugacuuuccucau

SEQ ID NO: 2227036 - RNA, 14 nt, Homo sapiens
ugucauuccagagu

SEQ ID NO: 2227037 - RNA, 23 nt, Homo sapiens
ucagggagaaacuccaaagucca

SEQ ID NO: 2227038 - RNA, 18 nt, Homo sapiens
agggagaugaguugcagu

SEQ ID NO: 2227039 - RNA, 17 nt, Homo sapiens
ccuggccaaaaugcaga

SEQ ID NO: 2227040 - RNA, 22 nt, Homo sapiens
agcuuaaaguaucuaccuggaa

SEQ ID NO: 2227041 - RNA, 19 nt, Homo sapiens
aguagcugggacuacaggc

SEQ ID NO: 2227042 - RNA, 20 nt, Homo sapiens
ugauauuuuuuauacaguga

SEQ ID NO: 2227043 - RNA, 16 nt, Homo sapiens
ccaagacacagaucac

SEQ ID NO: 2227044 - RNA, 15 nt, Homo sapiens
ucagagcacucccua

SEQ ID NO: 2227045 - RNA, 15 nt, Homo sapiens
gcuaggccaucacca

SEQ ID NO: 2227046 - RNA, 12 nt, Homo sapiens
ccucccacuccu

SEQ ID NO: 2227047 - RNA, 17 nt, Homo sapiens
cggccuugugacauuca

SEQ ID NO: 2227048 - RNA, 17 nt, Homo sapiens
uagaauggaaaacugcc

SEQ ID NO: 2227049 - RNA, 14 nt, Homo sapiens
agaaggcacuggga

SEQ ID NO: 2227050 - RNA, 21 nt, Homo sapiens
cucuaaaaaaauaaaaauaga

SEQ ID NO: 2227051 - RNA, 14 nt, Homo sapiens
ccuccucuagcugu

SEQ ID NO: 2227052 - RNA, 23 nt, Homo sapiens
auaaguacuagaugcaucacugg

SEQ ID NO: 2227053 - RNA, 15 nt, Homo sapiens
ccagcccguuaaaug

SEQ ID NO: 2227054 - RNA, 16 nt, Homo sapiens
auguucuuccagugag

SEQ ID NO: 2227055 - RNA, 19 nt, Homo sapiens
acauaccuaagaaguacau

SEQ ID NO: 2227056 - RNA, 17 nt, Homo sapiens
ucugcagggugacgccu

SEQ ID NO: 2227057 - RNA, 16 nt, Homo sapiens
uuccuuggccaugcag

SEQ ID NO: 2227058 - RNA, 16 nt, Homo sapiens
cuaaaugcagugaauu

SEQ ID NO: 2227059 - RNA, 20 nt, Homo sapiens
aggggcagccacaccacugc

SEQ ID NO: 2227060 - RNA, 13 nt, Homo sapiens
gagggcacuggag

SEQ ID NO: 2227061 - RNA, 20 nt, Homo sapiens
gagcgaggaaaaacaacaaa

SEQ ID NO: 2227062 - RNA, 23 nt, Homo sapiens
gacccccagggcauuguguucac

SEQ ID NO: 2227063 - RNA, 14 nt, Homo sapiens
caacuccaaggcaa

SEQ ID NO: 2227064 - RNA, 14 nt, Homo sapiens
cucaggaugccaag

SEQ ID NO: 2227065 - RNA, 23 nt, Homo sapiens
cuuguucuuugcuggaccaucaa

SEQ ID NO: 2227066 - RNA, 19 nt, Homo sapiens
ggauauguuuucacuguau

SEQ ID NO: 2227067 - RNA, 22 nt, Homo sapiens
gcaauaaaggcaccucccccaa

SEQ ID NO: 2227068 - RNA, 16 nt, Homo sapiens
ucuugguugcuggaau

SEQ ID NO: 2227069 - RNA, 19 nt, Homo sapiens
ggacaauuuaccacaggau

SEQ ID NO: 2227070 - RNA, 22 nt, Homo sapiens
acuguggaauuuaaaucacuca

SEQ ID NO: 2227071 - RNA, 23 nt, Homo sapiens
caguuuuguuuugagggcuauua

SEQ ID NO: 2227072 - RNA, 22 nt, Homo sapiens
uaaaucaccauagggcugggga

SEQ ID NO: 2227073 - RNA, 17 nt, Homo sapiens
ugucauguaacacgaca

SEQ ID NO: 2227074 - RNA, 17 nt, Homo sapiens
ucaagcaaaacaguucu

SEQ ID NO: 2227075 - RNA, 13 nt, Homo sapiens
auugacucauaca

SEQ ID NO: 2227076 - RNA, 15 nt, Homo sapiens
uucuguaaccaaaaa

SEQ ID NO: 2227077 - RNA, 14 nt, Homo sapiens
caagaucuuuccaa

SEQ ID NO: 2227078 - RNA, 22 nt, Homo sapiens
auauuuggauugucauucuuac

SEQ ID NO: 2227079 - RNA, 22 nt, Homo sapiens
ccauuuacucuugagacuacuu

SEQ ID NO: 2227080 - RNA, 17 nt, Homo sapiens
gaauacaaagaaccaag

SEQ ID NO: 2227081 - RNA, 22 nt, Homo sapiens
uccaaugugugcauggaacaaa

SEQ ID NO: 2227082 - RNA, 22 nt, Homo sapiens
ucaagaccagccuggacagcuu

SEQ ID NO: 2227083 - RNA, 17 nt, Homo sapiens
auguggccuuuagcaaa

SEQ ID NO: 2227084 - RNA, 12 nt, Homo sapiens
cuaaaacauucc

SEQ ID NO: 2227085 - RNA, 17 nt, Homo sapiens
gaagggcguucuaggua

SEQ ID NO: 2227086 - RNA, 16 nt, Homo sapiens
agaaaaaggcugugcu

SEQ ID NO: 2227087 - RNA, 16 nt, Homo sapiens
auuuuucaucaaacau

SEQ ID NO: 2227088 - RNA, 15 nt, Homo sapiens
acccuucccagcccu

SEQ ID NO: 2227089 - RNA, 17 nt, Homo sapiens
gaccuugugaucugccc

SEQ ID NO: 2227090 - RNA, 16 nt, Homo sapiens
ugauaauuacuuucca

SEQ ID NO: 2227091 - RNA, 16 nt, Homo sapiens
aggagcccagccagaa

SEQ ID NO: 2227092 - RNA, 12 nt, Homo sapiens
aaaauuaugcaa

SEQ ID NO: 2227093 - RNA, 15 nt, Homo sapiens
cacgccugugcagug

SEQ ID NO: 2227094 - RNA, 19 nt, Homo sapiens
gacaauccuauuuagcaua

SEQ ID NO: 2227095 - RNA, 18 nt, Homo sapiens
ucuacacauugcuaccuc

SEQ ID NO: 2227096 - RNA, 21 nt, Homo sapiens
aguuuuaauaagaacagauca

SEQ ID NO: 2227097 - RNA, 21 nt, Homo sapiens
uaagguuguuccccuaguucu

SEQ ID NO: 2227098 - RNA, 16 nt, Homo sapiens
aaaggaaaaagcacaa

SEQ ID NO: 2227099 - RNA, 11 nt, Homo sapiens
gaggcaucuga

SEQ ID NO: 2227100 - RNA, 17 nt, Homo sapiens
uaggauuuaccaaauag

SEQ ID NO: 2227101 - RNA, 18 nt, Homo sapiens
augugcgaacacagugac

SEQ ID NO: 2227102 - RNA, 12 nt, Homo sapiens
ucguuacccauu

SEQ ID NO: 2227103 - RNA, 14 nt, Homo sapiens
cauuugagugucuu

SEQ ID NO: 2227104 - RNA, 18 nt, Homo sapiens
cuccaccaucgucuucuu

SEQ ID NO: 2227105 - RNA, 20 nt, Homo sapiens
caguauccaggcuuuguaca

SEQ ID NO: 2227106 - RNA, 19 nt, Homo sapiens
acccgugccacgcgcucug

SEQ ID NO: 2227107 - RNA, 19 nt, Homo sapiens
gcaucuguaacagcauuaa

SEQ ID NO: 2227108 - RNA, 16 nt, Homo sapiens
aguucaacuuccaaag

SEQ ID NO: 2227109 - RNA, 18 nt, Homo sapiens
uccacuguggcaaaugga

SEQ ID NO: 2227110 - RNA, 14 nt, Homo sapiens
uuccccucacuauc

SEQ ID NO: 2227111 - RNA, 19 nt, Homo sapiens
aaguccuucaccucacuga

SEQ ID NO: 2227112 - RNA, 18 nt, Homo sapiens
aaaaggcuuuuucaggga

SEQ ID NO: 2227113 - RNA, 22 nt, Homo sapiens
aaacagccucucucuuuucuac

SEQ ID NO: 2227114 - RNA, 14 nt, Homo sapiens
ccaguccaaagccg

SEQ ID NO: 2227115 - RNA, 18 nt, Homo sapiens
ccauaucuuuaaagugug

SEQ ID NO: 2227116 - RNA, 22 nt, Homo sapiens
gcauugucaccgcaggugcuca

SEQ ID NO: 2227117 - RNA, 20 nt, Homo sapiens
augcaacauuuuaaggcaau

SEQ ID NO: 2227118 - RNA, 22 nt, Homo sapiens
ucaaguuuuuuauacugcacuu

SEQ ID NO: 2227119 - RNA, 16 nt, Homo sapiens
auggaaucugaugaaa

SEQ ID NO: 2227120 - RNA, 19 nt, Homo sapiens
agaugauggaugccaauau

SEQ ID NO: 2227121 - RNA, 16 nt, Homo sapiens
ugcuauuaagaaggca

SEQ ID NO: 2227122 - RNA, 16 nt, Homo sapiens
agaauugcaaucuaua

SEQ ID NO: 2227123 - RNA, 15 nt, Homo sapiens
aacucacugcucaag

SEQ ID NO: 2227124 - RNA, 22 nt, Homo sapiens
cccugggcaaaugaauggcuca

SEQ ID NO: 2227125 - RNA, 18 nt, Homo sapiens
aauugaauaguuuauuuc

SEQ ID NO: 2227126 - RNA, 22 nt, Homo sapiens
ucaugacaaauccuugaauguu

SEQ ID NO: 2227127 - RNA, 22 nt, Homo sapiens
gagccucgcuuuuucauccuuc

SEQ ID NO: 2227128 - RNA, 18 nt, Homo sapiens
ugaaagguaguggcugau

SEQ ID NO: 2227129 - RNA, 22 nt, Homo sapiens
gccacgcgcucugcaugcuccu

SEQ ID NO: 2227130 - RNA, 21 nt, Homo sapiens
uaacauauuugcacaauuuua

SEQ ID NO: 2227131 - RNA, 14 nt, Homo sapiens
cacacacaugcaca

SEQ ID NO: 2227132 - RNA, 14 nt, Homo sapiens
uguauacacauaua

SEQ ID NO: 2227133 - RNA, 17 nt, Homo sapiens
ucugaauuuugcaaugu

SEQ ID NO: 2227134 - RNA, 17 nt, Homo sapiens
cucccaccaccagugag

SEQ ID NO: 2227135 - RNA, 21 nt, Homo sapiens
ucccuguaaugcacuccugcc

SEQ ID NO: 2227136 - RNA, 18 nt, Homo sapiens
ugaaauauaaacugugag

SEQ ID NO: 2227137 - RNA, 21 nt, Homo sapiens
uuacugugcaccuagagcuuu

SEQ ID NO: 2227138 - RNA, 16 nt, Homo sapiens
cucugagaaccaaaag

SEQ ID NO: 2227139 - RNA, 16 nt, Homo sapiens
uuccucgccucuccca

SEQ ID NO: 2227140 - RNA, 15 nt, Homo sapiens
cuuuuccacaaauca

SEQ ID NO: 2227141 - RNA, 12 nt, Homo sapiens
cauggcaucaga

SEQ ID NO: 2227142 - RNA, 23 nt, Homo sapiens
ccugccucccacuucacugcgaa

SEQ ID NO: 2227143 - RNA, 15 nt, Homo sapiens
accacaagcaaaauc

SEQ ID NO: 2227144 - RNA, 21 nt, Homo sapiens
ugugcuguagauucacauaca

SEQ ID NO: 2227145 - RNA, 15 nt, Homo sapiens
cucuuccaaaggcag

SEQ ID NO: 2227146 - RNA, 17 nt, Homo sapiens
aagugaaauaagccaga

SEQ ID NO: 2227147 - RNA, 15 nt, Homo sapiens
caugccuguccugaa

SEQ ID NO: 2227148 - RNA, 14 nt, Homo sapiens
acacuugucuuuac

SEQ ID NO: 2227149 - RNA, 23 nt, Homo sapiens
cuuccacaccuagcaucucauga

SEQ ID NO: 2227150 - RNA, 23 nt, Homo sapiens
auaggaaauauuuuaauguuucu

SEQ ID NO: 2227151 - RNA, 15 nt, Homo sapiens
uuuuguaacugccua

SEQ ID NO: 2227152 - RNA, 12 nt, Homo sapiens
cucguggcuguc

SEQ ID NO: 2227153 - RNA, 20 nt, Homo sapiens
agucacuugugucaaccacu

SEQ ID NO: 2227154 - RNA, 18 nt, Homo sapiens
cauaagagaaaccugcca

SEQ ID NO: 2227155 - RNA, 13 nt, Homo sapiens
auucaugcacugu

SEQ ID NO: 2227156 - RNA, 13 nt, Homo sapiens
auucuugcacuga

SEQ ID NO: 2227157 - RNA, 22 nt, Homo sapiens
ccuggauuuuuuuuuuuaacua

SEQ ID NO: 2227158 - RNA, 18 nt, Homo sapiens
gacugcugcuagagccag

SEQ ID NO: 2227159 - RNA, 15 nt, Homo sapiens
augaaugcaauagua

SEQ ID NO: 2227160 - RNA, 18 nt, Homo sapiens
augcauuuuuuaccacaa

SEQ ID NO: 2227161 - RNA, 23 nt, Homo sapiens
gugccaucccugagagaccagac

SEQ ID NO: 2227162 - RNA, 21 nt, Homo sapiens
cuccucuccuagccccuguca

SEQ ID NO: 2227163 - RNA, 15 nt, Homo sapiens
aagugcauauuuauc

SEQ ID NO: 2227164 - RNA, 23 nt, Homo sapiens
cuagguucuacaggaaauacaga

SEQ ID NO: 2227165 - RNA, 18 nt, Homo sapiens
aacuaugcagugugcucc

SEQ ID NO: 2227166 - RNA, 21 nt, Homo sapiens
ucuaaaacagacucaaugucc

SEQ ID NO: 2227167 - RNA, 15 nt, Homo sapiens
uccuuccauccaucu

SEQ ID NO: 2227168 - RNA, 15 nt, Homo sapiens
cuguugcacugaugu

SEQ ID NO: 2227169 - RNA, 16 nt, Homo sapiens
agauuaaaugaauaua

SEQ ID NO: 2227170 - RNA, 11 nt, Homo sapiens
acucagcagug

SEQ ID NO: 2227171 - RNA, 21 nt, Homo sapiens
uguuuucugacuaauuaggca

SEQ ID NO: 2227172 - RNA, 15 nt, Homo sapiens
aggggacaggccugu

SEQ ID NO: 2227173 - RNA, 14 nt, Homo sapiens
ccgcguagugucag

SEQ ID NO: 2227174 - RNA, 21 nt, Homo sapiens
cccccugucccauucuagauc

SEQ ID NO: 2227175 - RNA, 20 nt, Homo sapiens
uucaacccucagccuugaaa

SEQ ID NO: 2227176 - RNA, 15 nt, Homo sapiens
aauauugguauguaa

SEQ ID NO: 2227177 - RNA, 19 nt, Homo sapiens
gcugucuccaugcuggaua

SEQ ID NO: 2227178 - RNA, 20 nt, Homo sapiens
uccuauuuuaaaaccaugca

SEQ ID NO: 2227179 - RNA, 16 nt, Homo sapiens
ugaaacacacauggac

SEQ ID NO: 2227180 - RNA, 22 nt, Homo sapiens
cagcuccuccgugcuuccucag

SEQ ID NO: 2227181 - RNA, 19 nt, Homo sapiens
auauguauacaugugccau

SEQ ID NO: 2227182 - RNA, 15 nt, Homo sapiens
auuaggucccaucaa

SEQ ID NO: 2227183 - RNA, 18 nt, Homo sapiens
aggaaaaaaggccacaaa

SEQ ID NO: 2227184 - RNA, 15 nt, Homo sapiens
uggcuuggcaucugu

SEQ ID NO: 2227185 - RNA, 22 nt, Homo sapiens
caugcucccuuaauccccaugc

SEQ ID NO: 2227186 - RNA, 14 nt, Homo sapiens
uagagagagacuau

SEQ ID NO: 2227187 - RNA, 11 nt, Homo sapiens
guacauuuuaa

SEQ ID NO: 2227188 - RNA, 18 nt, Homo sapiens
agcugagaucacaccacu

SEQ ID NO: 2227189 - RNA, 17 nt, Homo sapiens
ugaaagaaucagucuug

SEQ ID NO: 2227190 - RNA, 19 nt, Homo sapiens
ggagcucacucccacugga

SEQ ID NO: 2227191 - RNA, 15 nt, Homo sapiens
cucugagaaccaaaa

SEQ ID NO: 2227192 - RNA, 22 nt, Homo sapiens
ugcagcauuuugcugcuuuauc

SEQ ID NO: 2227193 - RNA, 19 nt, Homo sapiens
auuuauucagccuugguca

SEQ ID NO: 2227194 - RNA, 16 nt, Homo sapiens
uuagagagggaccaug

SEQ ID NO: 2227195 - RNA, 15 nt, Homo sapiens
cugucagcucaggug

SEQ ID NO: 2227196 - RNA, 17 nt, Homo sapiens
accugccgucuucacuu

SEQ ID NO: 2227197 - RNA, 23 nt, Homo sapiens
agccuugggcucucuucuguccc

SEQ ID NO: 2227198 - RNA, 21 nt, Homo sapiens
cagggucuaaagagaacaaga

SEQ ID NO: 2227199 - RNA, 22 nt, Homo sapiens
agaucucucgaaugcugagaag

SEQ ID NO: 2227200 - RNA, 21 nt, Homo sapiens
uuugcacaacuuuugagagua

SEQ ID NO: 2227201 - RNA, 15 nt, Homo sapiens
cagcaauacucauca

SEQ ID NO: 2227202 - RNA, 16 nt, Homo sapiens
uuaacuuuuauaccua

SEQ ID NO: 2227203 - RNA, 23 nt, Homo sapiens
uuaaaauuaaaugcauguccuca

SEQ ID NO: 2227204 - RNA, 22 nt, Homo sapiens
cagaaacuagaaaugugaauga

SEQ ID NO: 2227205 - RNA, 12 nt, Homo sapiens
gucuugcugaga

SEQ ID NO: 2227206 - RNA, 17 nt, Homo sapiens
gcauucuagagugcaua

SEQ ID NO: 2227207 - RNA, 18 nt, Homo sapiens
accuuccccagcguccca

SEQ ID NO: 2227208 - RNA, 17 nt, Homo sapiens
ccaguuguuuugucuug

SEQ ID NO: 2227209 - RNA, 13 nt, Homo sapiens
gacuaaaacuaca

SEQ ID NO: 2227210 - RNA, 19 nt, Homo sapiens
uuaauucucuuucaaagcu

SEQ ID NO: 2227211 - RNA, 17 nt, Homo sapiens
cugaauuggccagagga

SEQ ID NO: 2227212 - RNA, 22 nt, Homo sapiens
cugggaaauucuauaugauccu

SEQ ID NO: 2227213 - RNA, 22 nt, Homo sapiens
aauuaacaaaagauucuguaag

SEQ ID NO: 2227214 - RNA, 17 nt, Homo sapiens
uggggcuggcaccagca

SEQ ID NO: 2227215 - RNA, 19 nt, Homo sapiens
agccgugucguaugaccua

SEQ ID NO: 2227216 - RNA, 20 nt, Homo sapiens
gcaguuucauguauguauau

SEQ ID NO: 2227217 - RNA, 23 nt, Homo sapiens
auccaugugcugcuguggcauca

SEQ ID NO: 2227218 - RNA, 18 nt, Homo sapiens
cuaagaaugcuuugccau

SEQ ID NO: 2227219 - RNA, 17 nt, Homo sapiens
ggugcaugaagguuucu

SEQ ID NO: 2227220 - RNA, 15 nt, Homo sapiens
uuucuaaaccuucau

SEQ ID NO: 2227221 - RNA, 13 nt, Homo sapiens
aaaguaaggugca

SEQ ID NO: 2227222 - RNA, 20 nt, Homo sapiens
acaguuucaaaaacuguauu

SEQ ID NO: 2227223 - RNA, 20 nt, Homo sapiens
uguaaucucauaacuuucca

SEQ ID NO: 2227224 - RNA, 13 nt, Homo sapiens
agagaaggggcag

SEQ ID NO: 2227225 - RNA, 22 nt, Homo sapiens
cugcuccuguucacaccagaga

SEQ ID NO: 2227226 - RNA, 22 nt, Homo sapiens
ucaaacucaccuugucucauga

SEQ ID NO: 2227227 - RNA, 16 nt, Homo sapiens
ugcuacgaagaaagac

SEQ ID NO: 2227228 - RNA, 22 nt, Homo sapiens
cacuggaauauaaaacagucau

SEQ ID NO: 2227229 - RNA, 19 nt, Homo sapiens
gcagcuguuuuaguuaaau

SEQ ID NO: 2227230 - RNA, 12 nt, Homo sapiens
ccugggggccag

SEQ ID NO: 2227231 - RNA, 21 nt, Homo sapiens
ucuuacacccgacgcuuacca

SEQ ID NO: 2227232 - RNA, 17 nt, Homo sapiens
ucuccuuugcacugagg

SEQ ID NO: 2227233 - RNA, 19 nt, Homo sapiens
ggagaguagcaacaaaagg

SEQ ID NO: 2227234 - RNA, 22 nt, Homo sapiens
gggagacagggcugcuccccaa

SEQ ID NO: 2227235 - RNA, 18 nt, Homo sapiens
caugcaguugugggaccg

SEQ ID NO: 2227236 - RNA, 15 nt, Homo sapiens
caaauuaucuugaua

SEQ ID NO: 2227237 - RNA, 16 nt, Homo sapiens
auuuagguuacuuuag

SEQ ID NO: 2227238 - RNA, 19 nt, Homo sapiens
gacagauccccguuccuga

SEQ ID NO: 2227239 - RNA, 12 nt, Homo sapiens
ucaaaacagggu

SEQ ID NO: 2227240 - RNA, 12 nt, Homo sapiens
uggaaacagcau

SEQ ID NO: 2227241 - RNA, 22 nt, Homo sapiens
uaaaccaaugagcuguaucugu

SEQ ID NO: 2227242 - RNA, 20 nt, Homo sapiens
ucaccucuccuacucacuua

SEQ ID NO: 2227243 - RNA, 21 nt, Homo sapiens
ugagcucuauuaugaauguga

SEQ ID NO: 2227244 - RNA, 22 nt, Homo sapiens
gcuccugggccugggcuuuagu

SEQ ID NO: 2227245 - RNA, 16 nt, Homo sapiens
caauagccccaucucu

SEQ ID NO: 2227246 - RNA, 21 nt, Homo sapiens
gcccagacacagacuggcaau

SEQ ID NO: 2227247 - RNA, 20 nt, Homo sapiens
acagagcgagauuccgucuc

SEQ ID NO: 2227248 - RNA, 22 nt, Homo sapiens
uucccuacaguugaaaaacagc

SEQ ID NO: 2227249 - RNA, 17 nt, Homo sapiens
ugcuaaauaacuauaua

SEQ ID NO: 2227250 - RNA, 14 nt, Homo sapiens
uggugacauugcac

SEQ ID NO: 2227251 - RNA, 22 nt, Homo sapiens
auguauauauauauaguaacua

SEQ ID NO: 2227252 - RNA, 18 nt, Homo sapiens
augagaucuaggugagga

SEQ ID NO: 2227253 - RNA, 12 nt, Homo sapiens
aggugaaucuag

SEQ ID NO: 2227254 - RNA, 13 nt, Homo sapiens
cuccccagguucu

SEQ ID NO: 2227255 - RNA, 19 nt, Homo sapiens
gcgccagaacccagauuuc

SEQ ID NO: 2227256 - RNA, 20 nt, Homo sapiens
cucgaauaaaggaugggacc

SEQ ID NO: 2227257 - RNA, 19 nt, Homo sapiens
acaauuucaaaaugcaugu

SEQ ID NO: 2227258 - RNA, 18 nt, Homo sapiens
uggaguggggaagugugu

SEQ ID NO: 2227259 - RNA, 16 nt, Homo sapiens
caacauuuuuggugua

SEQ ID NO: 2227260 - RNA, 22 nt, Homo sapiens
gcccagcaagaugaaacagggc

SEQ ID NO: 2227261 - RNA, 14 nt, Homo sapiens
ccuacacugaugca

SEQ ID NO: 2227262 - RNA, 21 nt, Homo sapiens
acaucuacgaagccacaggcc

SEQ ID NO: 2227263 - RNA, 15 nt, Homo sapiens
cagagauaugcacac

SEQ ID NO: 2227264 - RNA, 15 nt, Homo sapiens
uggucacacacugau

SEQ ID NO: 2227265 - RNA, 21 nt, Homo sapiens
acugcucuauaaauaguauuc

SEQ ID NO: 2227266 - RNA, 21 nt, Homo sapiens
ccugaugggguggaaggcaug

SEQ ID NO: 2227267 - RNA, 18 nt, Homo sapiens
cccaggaacccuccagac

SEQ ID NO: 2227268 - RNA, 12 nt, Homo sapiens
ucuguuugaaac

SEQ ID NO: 2227269 - RNA, 20 nt, Homo sapiens
cucuggcuucaaaaagccac

SEQ ID NO: 2227270 - RNA, 23 nt, Homo sapiens
cuuagggcagauuuucaugcaaa

SEQ ID NO: 2227271 - RNA, 12 nt, Homo sapiens
aucuuacuuugu

SEQ ID NO: 2227272 - RNA, 18 nt, Homo sapiens
aaaacuuugacaaauuga

SEQ ID NO: 2227273 - RNA, 23 nt, Homo sapiens
ugguggggagcacagacacagga

SEQ ID NO: 2227274 - RNA, 15 nt, Homo sapiens
aagagcucuuggccc

SEQ ID NO: 2227275 - RNA, 17 nt, Homo sapiens
caaauaauuccauucca

SEQ ID NO: 2227276 - RNA, 20 nt, Homo sapiens
gaauguuauccaacuauuaa

SEQ ID NO: 2227277 - RNA, 19 nt, Homo sapiens
agaaaagaugcacuuugcu

SEQ ID NO: 2227278 - RNA, 21 nt, Homo sapiens
acacccucccucuacugggag

SEQ ID NO: 2227279 - RNA, 20 nt, Homo sapiens
aguacagggcaggagcugcu

SEQ ID NO: 2227280 - RNA, 22 nt, Homo sapiens
uccauuuuacuuccaugauacu

SEQ ID NO: 2227281 - RNA, 17 nt, Homo sapiens
acacugaaguuaacaga

SEQ ID NO: 2227282 - RNA, 12 nt, Homo sapiens
guggaugcugcu

SEQ ID NO: 2227283 - RNA, 20 nt, Homo sapiens
gcccauuggccgagcuccug

SEQ ID NO: 2227284 - RNA, 18 nt, Homo sapiens
aaucacaauguaaauauu

SEQ ID NO: 2227285 - RNA, 20 nt, Homo sapiens
aucugugcucaggacucaga

SEQ ID NO: 2227286 - RNA, 22 nt, Homo sapiens
cacuguaaucuuaaaaguguaa

SEQ ID NO: 2227287 - RNA, 20 nt, Homo sapiens
cuggggugcugagugagcug

SEQ ID NO: 2227288 - RNA, 21 nt, Homo sapiens
aaucaaggaaagaccaguuuc

SEQ ID NO: 2227289 - RNA, 20 nt, Homo sapiens
aauguguauuuuucaaggca

SEQ ID NO: 2227290 - RNA, 17 nt, Homo sapiens
cugucacacacuggacc

SEQ ID NO: 2227291 - RNA, 20 nt, Homo sapiens
uuguuuuuuagcagugcuga

SEQ ID NO: 2227292 - RNA, 14 nt, Homo sapiens
uggaagaccuggac

SEQ ID NO: 2227293 - RNA, 15 nt, Homo sapiens
aagcagggcucugcc

SEQ ID NO: 2227294 - RNA, 18 nt, Homo sapiens
cugcaucuuauagcacuu

SEQ ID NO: 2227295 - RNA, 18 nt, Homo sapiens
gcacagagggaagccaug

SEQ ID NO: 2227296 - RNA, 20 nt, Homo sapiens
cuguugugaucuugcauuca

SEQ ID NO: 2227297 - RNA, 20 nt, Homo sapiens
ccagauuggggcuaguuuaa

SEQ ID NO: 2227298 - RNA, 20 nt, Homo sapiens
auuuucuucucugugaagua

SEQ ID NO: 2227299 - RNA, 17 nt, Homo sapiens
auaaaauuuuuuacuuu

SEQ ID NO: 2227300 - RNA, 20 nt, Homo sapiens
gagaagcuuugguucugcca

SEQ ID NO: 2227301 - RNA, 13 nt, Homo sapiens
aacaagcguuuau

SEQ ID NO: 2227302 - RNA, 21 nt, Homo sapiens
uuaaacauuucuuucugugcc

SEQ ID NO: 2227303 - RNA, 15 nt, Homo sapiens
cuggggauuccagcu

SEQ ID NO: 2227304 - RNA, 20 nt, Homo sapiens
acauuccaaauaauuccaca

SEQ ID NO: 2227305 - RNA, 15 nt, Homo sapiens
gaggugcgcagugga

SEQ ID NO: 2227306 - RNA, 17 nt, Homo sapiens
cugcuugguagcacuuu

SEQ ID NO: 2227307 - RNA, 21 nt, Homo sapiens
auggccagagaugcuggacuu

SEQ ID NO: 2227308 - RNA, 16 nt, Homo sapiens
aucggccuccaugacc

SEQ ID NO: 2227309 - RNA, 16 nt, Homo sapiens
caaauucucugagaug

SEQ ID NO: 2227310 - RNA, 17 nt, Homo sapiens
uguugacauuagucuca

SEQ ID NO: 2227311 - RNA, 20 nt, Homo sapiens
acacacaaaggcuauugacc

SEQ ID NO: 2227312 - RNA, 14 nt, Homo sapiens
gucuccaguggaag

SEQ ID NO: 2227313 - RNA, 15 nt, Homo sapiens
gaaaauauagucaca

SEQ ID NO: 2227314 - RNA, 14 nt, Homo sapiens
cugcauaaucauau

SEQ ID NO: 2227315 - RNA, 19 nt, Homo sapiens
acauccauaacucuguauc

SEQ ID NO: 2227316 - RNA, 19 nt, Homo sapiens
ucaggagccugcuaaggaa

SEQ ID NO: 2227317 - RNA, 12 nt, Homo sapiens
cagagcaccugc

SEQ ID NO: 2227318 - RNA, 16 nt, Homo sapiens
agagcaaaggagacaa

SEQ ID NO: 2227319 - RNA, 20 nt, Homo sapiens
gagaggacugaugaaugaca

SEQ ID NO: 2227320 - RNA, 20 nt, Homo sapiens
ugaaguccacagaagugagc

SEQ ID NO: 2227321 - RNA, 15 nt, Homo sapiens
aaauacaacacugag

SEQ ID NO: 2227322 - RNA, 18 nt, Homo sapiens
ucuccaaccacugugcca

SEQ ID NO: 2227323 - RNA, 17 nt, Homo sapiens
cauuaccuucucccuca

SEQ ID NO: 2227324 - RNA, 23 nt, Homo sapiens
uaccucacagagugcauugugag

SEQ ID NO: 2227325 - RNA, 12 nt, Homo sapiens
guagagcuggug

SEQ ID NO: 2227326 - RNA, 12 nt, Homo sapiens
uguaagcuuuaa

SEQ ID NO: 2227327 - RNA, 14 nt, Homo sapiens
ugaagagcuucauu

SEQ ID NO: 2227328 - RNA, 16 nt, Homo sapiens
cauuaaucaccaaagu

SEQ ID NO: 2227329 - RNA, 18 nt, Homo sapiens
auuuucauuuaacuacaa

SEQ ID NO: 2227330 - RNA, 21 nt, Homo sapiens
accuacacaggagucuucaga

SEQ ID NO: 2227331 - RNA, 18 nt, Homo sapiens
aaagcagggacugugaac

SEQ ID NO: 2227332 - RNA, 14 nt, Homo sapiens
caaaguccaaaagu

SEQ ID NO: 2227333 - RNA, 14 nt, Homo sapiens
caaaaaccaaaaaa

SEQ ID NO: 2227334 - RNA, 21 nt, Homo sapiens
cgcauuuccuuucaguggcuu

SEQ ID NO: 2227335 - RNA, 15 nt, Homo sapiens
gauacuuuuacaggu

SEQ ID NO: 2227336 - RNA, 14 nt, Homo sapiens
ucaauggcugcuga

SEQ ID NO: 2227337 - RNA, 15 nt, Homo sapiens
uuuguuggagccacu

SEQ ID NO: 2227338 - RNA, 17 nt, Homo sapiens
caggguccaaaggccag

SEQ ID NO: 2227339 - RNA, 18 nt, Homo sapiens
auuaaaaaugaaagccaa

SEQ ID NO: 2227340 - RNA, 17 nt, Homo sapiens
agacucaaaugcucaga

SEQ ID NO: 2227341 - RNA, 23 nt, Homo sapiens
uaggaagagccaggacaugaaga

SEQ ID NO: 2227342 - RNA, 24 nt, Homo sapiens
uacuucacugguguacaucguuua

SEQ ID NO: 2227343 - RNA, 23 nt, Homo sapiens
acuauuuaguuuuuuuaaugugu

SEQ ID NO: 2227344 - RNA, 17 nt, Homo sapiens
gacaucaagcacagaag

SEQ ID NO: 2227345 - RNA, 15 nt, Homo sapiens
acauuugcaccacuu

SEQ ID NO: 2227346 - RNA, 19 nt, Homo sapiens
cucccccagccccagagaa

SEQ ID NO: 2227347 - RNA, 21 nt, Homo sapiens
uaugaguuuuugauagcuuua

SEQ ID NO: 2227348 - RNA, 19 nt, Homo sapiens
gccucaaugugaccagggg

SEQ ID NO: 2227349 - RNA, 18 nt, Homo sapiens
gcuccuccgucugacccu

SEQ ID NO: 2227350 - RNA, 13 nt, Homo sapiens
aaaauaccauuua

SEQ ID NO: 2227351 - RNA, 22 nt, Homo sapiens
caaaagcaagggaccuucaugc

SEQ ID NO: 2227352 - RNA, 21 nt, Homo sapiens
caguuuccacaggcagcaucc

SEQ ID NO: 2227353 - RNA, 15 nt, Homo sapiens
uccuugugaacccca

SEQ ID NO: 2227354 - RNA, 20 nt, Homo sapiens
uguguggaaggugaucuggc

SEQ ID NO: 2227355 - RNA, 14 nt, Homo sapiens
aauagaacacugcc

SEQ ID NO: 2227356 - RNA, 16 nt, Homo sapiens
caacuuccgcugaggg

SEQ ID NO: 2227357 - RNA, 18 nt, Homo sapiens
cauaaguaagacuugauu

SEQ ID NO: 2227358 - RNA, 18 nt, Homo sapiens
aaacaucagcugaauuca

SEQ ID NO: 2227359 - RNA, 14 nt, Homo sapiens
gaaccaugaagcug

SEQ ID NO: 2227360 - RNA, 17 nt, Homo sapiens
auggugaagucacauua

SEQ ID NO: 2227361 - RNA, 14 nt, Homo sapiens
ccccgugaacucac

SEQ ID NO: 2227362 - RNA, 15 nt, Homo sapiens
cccccaaaguucaca

SEQ ID NO: 2227363 - RNA, 22 nt, Homo sapiens
aaguagacauuuguaaaucuau

SEQ ID NO: 2227364 - RNA, 15 nt, Homo sapiens
uugccaaguucucca

SEQ ID NO: 2227365 - RNA, 17 nt, Homo sapiens
agauuagagccuguaaa

SEQ ID NO: 2227366 - RNA, 21 nt, Homo sapiens
uuaggauaaccuugugccuug

SEQ ID NO: 2227367 - RNA, 20 nt, Homo sapiens
auggugguggacaccuguaa

SEQ ID NO: 2227368 - RNA, 11 nt, Homo sapiens
aaugcuuuaaa

SEQ ID NO: 2227369 - RNA, 14 nt, Homo sapiens
ugccugucugucca

SEQ ID NO: 2227370 - RNA, 19 nt, Homo sapiens
guggugugucucaggacaa

SEQ ID NO: 2227371 - RNA, 13 nt, Homo sapiens
ugcucagcacaua

SEQ ID NO: 2227372 - RNA, 21 nt, Homo sapiens
aaguugagacagagaagggaa

SEQ ID NO: 2227373 - RNA, 13 nt, Homo sapiens
ccacaccaaaguc

SEQ ID NO: 2227374 - RNA, 13 nt, Homo sapiens
acuggcacaaaaa

SEQ ID NO: 2227375 - RNA, 12 nt, Homo sapiens
ugacagcacuuu

SEQ ID NO: 2227376 - RNA, 21 nt, Homo sapiens
accugcccccagcuucugcca

SEQ ID NO: 2227377 - RNA, 22 nt, Homo sapiens
ccucacaaaccugaauggucug

SEQ ID NO: 2227378 - RNA, 18 nt, Homo sapiens
auaucuggagccugaugu

SEQ ID NO: 2227379 - RNA, 20 nt, Homo sapiens
aucauuucuugguaugauca

SEQ ID NO: 2227380 - RNA, 18 nt, Homo sapiens
gaaggagauagauuugug

SEQ ID NO: 2227381 - RNA, 13 nt, Homo sapiens
gaugugccuaaau

SEQ ID NO: 2227382 - RNA, 16 nt, Homo sapiens
gaaacaaaaucaaaac

SEQ ID NO: 2227383 - RNA, 14 nt, Homo sapiens
ccugcuuuucccca

SEQ ID NO: 2227384 - RNA, 23 nt, Homo sapiens
cuuguuagaaaugcaaauucuca

SEQ ID NO: 2227385 - RNA, 19 nt, Homo sapiens
ugggccugcugcugagaac

SEQ ID NO: 2227386 - RNA, 24 nt, Homo sapiens
gaauaaaagaugauuucucaaaaa

SEQ ID NO: 2227387 - RNA, 12 nt, Homo sapiens
uuuauauauaua

SEQ ID NO: 2227388 - RNA, 14 nt, Homo sapiens
uucucugauggcac

SEQ ID NO: 2227389 - RNA, 14 nt, Homo sapiens
accccagacucaga

SEQ ID NO: 2227390 - RNA, 21 nt, Homo sapiens
ugagcuucagauuuugugaac

SEQ ID NO: 2227391 - RNA, 13 nt, Homo sapiens
uaaucaaaccacu

SEQ ID NO: 2227392 - RNA, 13 nt, Homo sapiens
gccaggugcugcu

SEQ ID NO: 2227393 - RNA, 21 nt, Homo sapiens
aauaaacgucagcuuccuucc

SEQ ID NO: 2227394 - RNA, 16 nt, Homo sapiens
gcucacugcaaccucu

SEQ ID NO: 2227395 - RNA, 14 nt, Homo sapiens
gucaucacuuugac

SEQ ID NO: 2227396 - RNA, 13 nt, Homo sapiens
agugaaccuuuag

SEQ ID NO: 2227397 - RNA, 19 nt, Homo sapiens
aaaccuauuucccuugccu

SEQ ID NO: 2227398 - RNA, 22 nt, Homo sapiens
agaacauaaaaaauaaaguacc

SEQ ID NO: 2227399 - RNA, 23 nt, Homo sapiens
cauuccauggugauuccugggaa

SEQ ID NO: 2227400 - RNA, 20 nt, Homo sapiens
uaaaugaauuaaauauugaa

SEQ ID NO: 2227401 - RNA, 18 nt, Homo sapiens
uguguacaauuuuaguca

SEQ ID NO: 2227402 - RNA, 14 nt, Homo sapiens
agaaagaggcagug

SEQ ID NO: 2227403 - RNA, 13 nt, Homo sapiens
gggaauccagcca

SEQ ID NO: 2227404 - RNA, 18 nt, Homo sapiens
ugcaaccuaguacuuuau

SEQ ID NO: 2227405 - RNA, 19 nt, Homo sapiens
aauuugaaauuugacucau

SEQ ID NO: 2227406 - RNA, 13 nt, Homo sapiens
aauggacugcaua

SEQ ID NO: 2227407 - RNA, 16 nt, Homo sapiens
ccaugaagaagugcuu

SEQ ID NO: 2227408 - RNA, 15 nt, Homo sapiens
aguucacagacauac

SEQ ID NO: 2227409 - RNA, 21 nt, Homo sapiens
uguuuggguauauucauuuca

SEQ ID NO: 2227410 - RNA, 16 nt, Homo sapiens
aagguuuuaacauuga

SEQ ID NO: 2227411 - RNA, 19 nt, Homo sapiens
gcuauauuuuuaaagaagg

SEQ ID NO: 2227412 - RNA, 13 nt, Homo sapiens
gaaggucucucug

SEQ ID NO: 2227413 - RNA, 20 nt, Homo sapiens
ugcauuccuuacuugcacug

SEQ ID NO: 2227414 - RNA, 19 nt, Homo sapiens
gcuaggaggacaaggaccg

SEQ ID NO: 2227415 - RNA, 15 nt, Homo sapiens
ugaaauauaaucaga

SEQ ID NO: 2227416 - RNA, 12 nt, Homo sapiens
ggaacaaccaga

SEQ ID NO: 2227417 - RNA, 15 nt, Homo sapiens
agagcuccuguaaga

SEQ ID NO: 2227418 - RNA, 20 nt, Homo sapiens
uauauugaaguaaguucauc

SEQ ID NO: 2227419 - RNA, 23 nt, Homo sapiens
guacacgaagaccauccauccuc

SEQ ID NO: 2227420 - RNA, 19 nt, Homo sapiens
cugaauucuggaaucacaa

SEQ ID NO: 2227421 - RNA, 17 nt, Homo sapiens
cuuugaguuuuguauuc

SEQ ID NO: 2227422 - RNA, 17 nt, Homo sapiens
ccccaugacauugcauu

SEQ ID NO: 2227423 - RNA, 18 nt, Homo sapiens
ucaugcucgacacuuacc

SEQ ID NO: 2227424 - RNA, 12 nt, Homo sapiens
aagccugagaac

SEQ ID NO: 2227425 - RNA, 20 nt, Homo sapiens
uacacaucacacccauuuaa

SEQ ID NO: 2227426 - RNA, 18 nt, Homo sapiens
guuucucaaacugagcuu

SEQ ID NO: 2227427 - RNA, 21 nt, Homo sapiens
aaaggaacagccccagugcac

SEQ ID NO: 2227428 - RNA, 17 nt, Homo sapiens
cagccuuucugaacuga

SEQ ID NO: 2227429 - RNA, 16 nt, Homo sapiens
uccccgggcaucuuug

SEQ ID NO: 2227430 - RNA, 21 nt, Homo sapiens
cgaggacauucucugaccuac

SEQ ID NO: 2227431 - RNA, 13 nt, Homo sapiens
cccaguguaauaa

SEQ ID NO: 2227432 - RNA, 18 nt, Homo sapiens
acuacugagaauagcaug

SEQ ID NO: 2227433 - RNA, 13 nt, Homo sapiens
aaggcacagugaa

SEQ ID NO: 2227434 - RNA, 16 nt, Homo sapiens
caagccccugcuccag

SEQ ID NO: 2227435 - RNA, 18 nt, Homo sapiens
gccauuggggcagggacc

SEQ ID NO: 2227436 - RNA, 21 nt, Homo sapiens
uaagccacaggccccaguuau

SEQ ID NO: 2227437 - RNA, 20 nt, Homo sapiens
uguauugacaagcaucagga

SEQ ID NO: 2227438 - RNA, 15 nt, Homo sapiens
uuaccucauuugcau

SEQ ID NO: 2227439 - RNA, 11 nt, Homo sapiens
aguugggaugc

SEQ ID NO: 2227440 - RNA, 14 nt, Homo sapiens
gagucugacaggaa

SEQ ID NO: 2227441 - RNA, 20 nt, Homo sapiens
uaaccugcacguugugcaca

SEQ ID NO: 2227442 - RNA, 19 nt, Homo sapiens
cagagaaugcccacugccu

SEQ ID NO: 2227443 - RNA, 13 nt, Homo sapiens
ugcuauagugaca

SEQ ID NO: 2227444 - RNA, 21 nt, Homo sapiens
uguguuuuguccaaaacugua

SEQ ID NO: 2227445 - RNA, 13 nt, Homo sapiens
auuuagcuuuaca

SEQ ID NO: 2227446 - RNA, 22 nt, Homo sapiens
cagggccacucccggcacucca

SEQ ID NO: 2227447 - RNA, 20 nt, Homo sapiens
aacggugcuugugucacuag

SEQ ID NO: 2227448 - RNA, 16 nt, Homo sapiens
uggggccaacuggaac

SEQ ID NO: 2227449 - RNA, 16 nt, Homo sapiens
agccugcccuccuuuc

SEQ ID NO: 2227450 - RNA, 18 nt, Homo sapiens
gccugaugcugacauuca

SEQ ID NO: 2227451 - RNA, 20 nt, Homo sapiens
acucauuugcuuugucuccc

SEQ ID NO: 2227452 - RNA, 20 nt, Homo sapiens
auagcugugugaacguguau

SEQ ID NO: 2227453 - RNA, 16 nt, Homo sapiens
ugaagcaaagugccca

SEQ ID NO: 2227454 - RNA, 13 nt, Homo sapiens
uucuucucuguga

SEQ ID NO: 2227455 - RNA, 16 nt, Homo sapiens
cacacauugcugugaa

SEQ ID NO: 2227456 - RNA, 21 nt, Homo sapiens
ccuguucuuugggcucaaggg

SEQ ID NO: 2227457 - RNA, 21 nt, Homo sapiens
ucucucccagggaauccgaca

SEQ ID NO: 2227458 - RNA, 14 nt, Homo sapiens
guuuucauuaucuc

SEQ ID NO: 2227459 - RNA, 14 nt, Homo sapiens
acaaaggugaaaau

SEQ ID NO: 2227460 - RNA, 20 nt, Homo sapiens
cuagacuauuaggugcaauu

SEQ ID NO: 2227461 - RNA, 15 nt, Homo sapiens
cugcuccccacguca

SEQ ID NO: 2227462 - RNA, 23 nt, Homo sapiens
auucaugaagcggucacagauca

SEQ ID NO: 2227463 - RNA, 16 nt, Homo sapiens
gugcacuccuggugau

SEQ ID NO: 2227464 - RNA, 21 nt, Homo sapiens
ugugguugaaaaccacaguca

SEQ ID NO: 2227465 - RNA, 20 nt, Homo sapiens
acuuuugcugaugcuuuuga

SEQ ID NO: 2227466 - RNA, 19 nt, Homo sapiens
auaacuaaauuugauacuu

SEQ ID NO: 2227467 - RNA, 22 nt, Homo sapiens
gccuuagaaauguaaacugcca

SEQ ID NO: 2227468 - RNA, 20 nt, Homo sapiens
gagggacaacgaacauggca

SEQ ID NO: 2227469 - RNA, 19 nt, Homo sapiens
aaugcugaugaaucacugu

SEQ ID NO: 2227470 - RNA, 20 nt, Homo sapiens
gaaauuaauaaaacuuaucu

SEQ ID NO: 2227471 - RNA, 17 nt, Homo sapiens
guuuuaggguacaguuu

SEQ ID NO: 2227472 - RNA, 21 nt, Homo sapiens
auucuuaacagugguucaaau

SEQ ID NO: 2227473 - RNA, 19 nt, Homo sapiens
uggcauacgccuguagucc

SEQ ID NO: 2227474 - RNA, 22 nt, Homo sapiens
aaaguaugccuuccuguuuaaa

SEQ ID NO: 2227475 - RNA, 18 nt, Homo sapiens
acccagcggcucuagcca

SEQ ID NO: 2227476 - RNA, 18 nt, Homo sapiens
aauagauuguuuugccac

SEQ ID NO: 2227477 - RNA, 17 nt, Homo sapiens
gucuccuccauggugua

SEQ ID NO: 2227478 - RNA, 15 nt, Homo sapiens
cuguauuuauuuuag

SEQ ID NO: 2227479 - RNA, 18 nt, Homo sapiens
gaauccccgaaggugcug

SEQ ID NO: 2227480 - RNA, 13 nt, Homo sapiens
aaguuugcaucuc

SEQ ID NO: 2227481 - RNA, 22 nt, Homo sapiens
aguuuguuguucagaagaaaga

SEQ ID NO: 2227482 - RNA, 11 nt, Homo sapiens
caggcauuugc

SEQ ID NO: 2227483 - RNA, 21 nt, Homo sapiens
agugcugucuuuuugugggua

SEQ ID NO: 2227484 - RNA, 20 nt, Homo sapiens
augcaggauuggaccaugaa

SEQ ID NO: 2227485 - RNA, 20 nt, Homo sapiens
uccuugacccugcuuuuugc

SEQ ID NO: 2227486 - RNA, 21 nt, Homo sapiens
uugcacuaaaagugaugugau

SEQ ID NO: 2227487 - RNA, 20 nt, Homo sapiens
uuaaacugguaggaaacuag

SEQ ID NO: 2227488 - RNA, 13 nt, Homo sapiens
aaucaaucugcag

SEQ ID NO: 2227489 - RNA, 16 nt, Homo sapiens
uugaguuuucaaagau

SEQ ID NO: 2227490 - RNA, 16 nt, Homo sapiens
auaaagauacgaguuu

SEQ ID NO: 2227491 - RNA, 21 nt, Homo sapiens
augugugaguguauguauaca

SEQ ID NO: 2227492 - RNA, 17 nt, Homo sapiens
aacacaauuaaaugacu

SEQ ID NO: 2227493 - RNA, 22 nt, Homo sapiens
augccaccccaugugccuuuag

SEQ ID NO: 2227494 - RNA, 21 nt, Homo sapiens
ccugucucauucgccucugga

SEQ ID NO: 2227495 - RNA, 18 nt, Homo sapiens
gaagugagggcucacuca

SEQ ID NO: 2227496 - RNA, 12 nt, Homo sapiens
ugaaacuaaaau

SEQ ID NO: 2227497 - RNA, 12 nt, Homo sapiens
cagggagacaag

SEQ ID NO: 2227498 - RNA, 15 nt, Homo sapiens
uugcacuauuccaca

SEQ ID NO: 2227499 - RNA, 17 nt, Homo sapiens
aaugccacaaaacugac

SEQ ID NO: 2227500 - RNA, 20 nt, Homo sapiens
cauccccuuuggcuaccuga

SEQ ID NO: 2227501 - RNA, 22 nt, Homo sapiens
cacaaguaaaaggaaaugcucc

SEQ ID NO: 2227502 - RNA, 21 nt, Homo sapiens
uguugaugcaauccuuacaaa

SEQ ID NO: 2227503 - RNA, 15 nt, Homo sapiens
ucuuugaagaaaaga

SEQ ID NO: 2227504 - RNA, 16 nt, Homo sapiens
auuuggcuugcuguuu

SEQ ID NO: 2227505 - RNA, 19 nt, Homo sapiens
accuguggugauguugcca

SEQ ID NO: 2227506 - RNA, 14 nt, Homo sapiens
acaugguccuagca

SEQ ID NO: 2227507 - RNA, 23 nt, Homo sapiens
uuuguuccccuccuccacucucc

SEQ ID NO: 2227508 - RNA, 15 nt, Homo sapiens
gaugaggucugauaa

SEQ ID NO: 2227509 - RNA, 12 nt, Homo sapiens
gaaacaucucaa

SEQ ID NO: 2227510 - RNA, 23 nt, Homo sapiens
uguacugcaaagucgccagucac

SEQ ID NO: 2227511 - RNA, 22 nt, Homo sapiens
accuccuagaggugggcagcug

SEQ ID NO: 2227512 - RNA, 23 nt, Homo sapiens
ucugcauuucgguggcuagucaa

SEQ ID NO: 2227513 - RNA, 16 nt, Homo sapiens
ggcagccaucaaagag

SEQ ID NO: 2227514 - RNA, 16 nt, Homo sapiens
agcaucuaaggacaag

SEQ ID NO: 2227515 - RNA, 22 nt, Homo sapiens
uuugcccauccucccaaucuca

SEQ ID NO: 2227516 - RNA, 15 nt, Homo sapiens
caacuaauacauggu

SEQ ID NO: 2227517 - RNA, 21 nt, Homo sapiens
cuauuaucccagcugccuaga

SEQ ID NO: 2227518 - RNA, 17 nt, Homo sapiens
aaaggcugucauuucau

SEQ ID NO: 2227519 - RNA, 13 nt, Homo sapiens
ucugacaguacca

SEQ ID NO: 2227520 - RNA, 21 nt, Homo sapiens
cacuuucagcgcuuauacuga

SEQ ID NO: 2227521 - RNA, 15 nt, Homo sapiens
auguuugcacuuugu

SEQ ID NO: 2227522 - RNA, 19 nt, Homo sapiens
uaaagaaaauaaacaccau

SEQ ID NO: 2227523 - RNA, 13 nt, Homo sapiens
ugccuaccccagc

SEQ ID NO: 2227524 - RNA, 14 nt, Homo sapiens
caggcagagcucag

SEQ ID NO: 2227525 - RNA, 14 nt, Homo sapiens
gaggacccuggaaa

SEQ ID NO: 2227526 - RNA, 23 nt, Homo sapiens
ggcacaauggcucacaccuguaa

SEQ ID NO: 2227527 - RNA, 19 nt, Homo sapiens
gugucaacugagagucaua

SEQ ID NO: 2227528 - RNA, 14 nt, Homo sapiens
ccaagggagacuga

SEQ ID NO: 2227529 - RNA, 15 nt, Homo sapiens
cgagucacacucaag

SEQ ID NO: 2227530 - RNA, 19 nt, Homo sapiens
cucauuuaauccucccuuc

SEQ ID NO: 2227531 - RNA, 19 nt, Homo sapiens
uauucaagaaagauaucua

SEQ ID NO: 2227532 - RNA, 19 nt, Homo sapiens
ggcuccaggagcagcgugc

SEQ ID NO: 2227533 - RNA, 17 nt, Homo sapiens
agauguguguugauacu

SEQ ID NO: 2227534 - RNA, 14 nt, Homo sapiens
ccauguaaauugca

SEQ ID NO: 2227535 - RNA, 18 nt, Homo sapiens
cucagaauugcacaucua

SEQ ID NO: 2227536 - RNA, 12 nt, Homo sapiens
cuuucucugcaa

SEQ ID NO: 2227537 - RNA, 20 nt, Homo sapiens
ugcucgcuacacuacuccug

SEQ ID NO: 2227538 - RNA, 12 nt, Homo sapiens
ugugugucugua

SEQ ID NO: 2227539 - RNA, 12 nt, Homo sapiens
cugguguccuga

SEQ ID NO: 2227540 - RNA, 18 nt, Homo sapiens
aaggauggaaagggaaug

SEQ ID NO: 2227541 - RNA, 23 nt, Homo sapiens
aaguugcuuuuuuaggcuacagu

SEQ ID NO: 2227542 - RNA, 17 nt, Homo sapiens
guacuuuguacaaagac

SEQ ID NO: 2227543 - RNA, 14 nt, Homo sapiens
uucuguaugcauca

SEQ ID NO: 2227544 - RNA, 14 nt, Homo sapiens
aggaagaagccaga

SEQ ID NO: 2227545 - RNA, 21 nt, Homo sapiens
caggaagggugggaagggaua

SEQ ID NO: 2227546 - RNA, 17 nt, Homo sapiens
ggccugcugaggccuuc

SEQ ID NO: 2227547 - RNA, 15 nt, Homo sapiens
acguuaagugaugaa

SEQ ID NO: 2227548 - RNA, 14 nt, Homo sapiens
aucuucacuuuuau

SEQ ID NO: 2227549 - RNA, 18 nt, Homo sapiens
ccuccaggguggcagcaa

SEQ ID NO: 2227550 - RNA, 22 nt, Homo sapiens
ugaacaaaucaaauugcuuaaa

SEQ ID NO: 2227551 - RNA, 15 nt, Homo sapiens
acuucucuuucuuau

SEQ ID NO: 2227552 - RNA, 16 nt, Homo sapiens
aacuaauacaauacau

SEQ ID NO: 2227553 - RNA, 20 nt, Homo sapiens
guucaggagucccaaggaaa

SEQ ID NO: 2227554 - RNA, 21 nt, Homo sapiens
aaguucaaggccagccuggac

SEQ ID NO: 2227555 - RNA, 12 nt, Homo sapiens
gguuacaaagac

SEQ ID NO: 2227556 - RNA, 19 nt, Homo sapiens
cuacaaaacguaacuugca

SEQ ID NO: 2227557 - RNA, 16 nt, Homo sapiens
aguuaauccacaucuu

SEQ ID NO: 2227558 - RNA, 14 nt, Homo sapiens
acccaugucuacac

SEQ ID NO: 2227559 - RNA, 16 nt, Homo sapiens
uucuaggggcagguga

SEQ ID NO: 2227560 - RNA, 15 nt, Homo sapiens
aaugccaaguaacaa

SEQ ID NO: 2227561 - RNA, 12 nt, Homo sapiens
aaaaucagagag

SEQ ID NO: 2227562 - RNA, 23 nt, Homo sapiens
gaguuuccagcuaagccugauga

SEQ ID NO: 2227563 - RNA, 22 nt, Homo sapiens
gcaaagugaagacacuggcuca

SEQ ID NO: 2227564 - RNA, 23 nt, Homo sapiens
uuuuccauuguuugaaacaaaga

SEQ ID NO: 2227565 - RNA, 22 nt, Homo sapiens
cucuguccagccagcuccugca

SEQ ID NO: 2227566 - RNA, 19 nt, Homo sapiens
acacacgagcaaacccaga

SEQ ID NO: 2227567 - RNA, 21 nt, Homo sapiens
aaauuuuucuucucuuuucaa

SEQ ID NO: 2227568 - RNA, 21 nt, Homo sapiens
aauccuugcuauuaagaauuu

SEQ ID NO: 2227569 - RNA, 12 nt, Homo sapiens
agcacucugaaa

SEQ ID NO: 2227570 - RNA, 15 nt, Homo sapiens
cucagggaaagccuc

SEQ ID NO: 2227571 - RNA, 16 nt, Homo sapiens
caugagcacuuuguaa

SEQ ID NO: 2227572 - RNA, 16 nt, Homo sapiens
gaagaaccaaauaccu

SEQ ID NO: 2227573 - RNA, 16 nt, Homo sapiens
aggccugggagggcaa

SEQ ID NO: 2227574 - RNA, 17 nt, Homo sapiens
caaguuacagugaugcu

SEQ ID NO: 2227575 - RNA, 15 nt, Homo sapiens
cggaggcggcuccag

SEQ ID NO: 2227576 - RNA, 17 nt, Homo sapiens
ugaucaugccacugcac

SEQ ID NO: 2227577 - RNA, 14 nt, Homo sapiens
uugguaaagcacau

SEQ ID NO: 2227578 - RNA, 13 nt, Homo sapiens
cacccggcauucu

SEQ ID NO: 2227579 - RNA, 16 nt, Homo sapiens
cacucuaacuguauau

SEQ ID NO: 2227580 - RNA, 19 nt, Homo sapiens
uucaacgaugugacugcca

SEQ ID NO: 2227581 - RNA, 13 nt, Homo sapiens
agccugugcaaaa

SEQ ID NO: 2227582 - RNA, 17 nt, Homo sapiens
aaacaaagacauugaca

SEQ ID NO: 2227583 - RNA, 18 nt, Homo sapiens
gacaaauaggagugagug

SEQ ID NO: 2227584 - RNA, 19 nt, Homo sapiens
aauaacuuucucugugaaa

SEQ ID NO: 2227585 - RNA, 16 nt, Homo sapiens
cuggggcaggaccacu

SEQ ID NO: 2227586 - RNA, 15 nt, Homo sapiens
cucacuuuucaauuu

SEQ ID NO: 2227587 - RNA, 23 nt, Homo sapiens
aucaauacugcacacugcacauu

SEQ ID NO: 2227588 - RNA, 13 nt, Homo sapiens
uagccugugcacg

SEQ ID NO: 2227589 - RNA, 13 nt, Homo sapiens
uuuauauacuggg

SEQ ID NO: 2227590 - RNA, 13 nt, Homo sapiens
acucauaacucau

SEQ ID NO: 2227591 - RNA, 15 nt, Homo sapiens
aguuaacaucaucac

SEQ ID NO: 2227592 - RNA, 16 nt, Homo sapiens
cuuacuguuucuguca

SEQ ID NO: 2227593 - RNA, 16 nt, Homo sapiens
ugcuuaugguugauca

SEQ ID NO: 2227594 - RNA, 13 nt, Homo sapiens
aggucaggacggc

SEQ ID NO: 2227595 - RNA, 17 nt, Homo sapiens
cccugccacauccagcu

SEQ ID NO: 2227596 - RNA, 20 nt, Homo sapiens
cgauugucugaggaaaggau

SEQ ID NO: 2227597 - RNA, 22 nt, Homo sapiens
cuuuucccaggaggcuccagga

SEQ ID NO: 2227598 - RNA, 18 nt, Homo sapiens
acacuuauguuauacaau

SEQ ID NO: 2227599 - RNA, 13 nt, Homo sapiens
uaaacaaaaagcc

SEQ ID NO: 2227600 - RNA, 17 nt, Homo sapiens
auuauuguagacaugcc

SEQ ID NO: 2227601 - RNA, 20 nt, Homo sapiens
gcaggcuuuuguguucucua

SEQ ID NO: 2227602 - RNA, 16 nt, Homo sapiens
cagcgcccuuccucuc

SEQ ID NO: 2227603 - RNA, 17 nt, Homo sapiens
agaaauugaauacuuug

SEQ ID NO: 2227604 - RNA, 16 nt, Homo sapiens
cugugcuuugacucac

SEQ ID NO: 2227605 - RNA, 18 nt, Homo sapiens
auucagugacaaaauggg

SEQ ID NO: 2227606 - RNA, 20 nt, Homo sapiens
cucugcucuugcauaguaaa

SEQ ID NO: 2227607 - RNA, 16 nt, Homo sapiens
caccccaacucugugg

SEQ ID NO: 2227608 - RNA, 23 nt, Homo sapiens
cuuuguggaaacagcugguacug

SEQ ID NO: 2227609 - RNA, 14 nt, Homo sapiens
acagaguucacuau

SEQ ID NO: 2227610 - RNA, 15 nt, Homo sapiens
aggguagcacuggga

SEQ ID NO: 2227611 - RNA, 20 nt, Homo sapiens
ugggauaacaguaagggaua

SEQ ID NO: 2227612 - RNA, 24 nt, Homo sapiens
cagcuacuucccagcuaaucucca

SEQ ID NO: 2227613 - RNA, 20 nt, Homo sapiens
ccuuucccagguaauuuaaa

SEQ ID NO: 2227614 - RNA, 12 nt, Homo sapiens
cugugaucccag

SEQ ID NO: 2227615 - RNA, 22 nt, Homo sapiens
cucuguauuuuuuaaaacauca

SEQ ID NO: 2227616 - RNA, 18 nt, Homo sapiens
aaguggguggaucacuug

SEQ ID NO: 2227617 - RNA, 18 nt, Homo sapiens
ggccagugagaagcugag

SEQ ID NO: 2227618 - RNA, 17 nt, Homo sapiens
augccccaaggacaagg

SEQ ID NO: 2227619 - RNA, 20 nt, Homo sapiens
ccuuuugaccaaauaaagua

SEQ ID NO: 2227620 - RNA, 23 nt, Homo sapiens
cccgccucggccucccaaagugc

SEQ ID NO: 2227621 - RNA, 19 nt, Homo sapiens
ucgcauggcagaaaggggg

SEQ ID NO: 2227622 - RNA, 15 nt, Homo sapiens
acaugagugcugaug

SEQ ID NO: 2227623 - RNA, 15 nt, Homo sapiens
aagucauaauugcau

SEQ ID NO: 2227624 - RNA, 15 nt, Homo sapiens
cuaaucucagcacuu

SEQ ID NO: 2227625 - RNA, 13 nt, Homo sapiens
gugaacugugcau

SEQ ID NO: 2227626 - RNA, 16 nt, Homo sapiens
auaaaauuccuaucuc

SEQ ID NO: 2227627 - RNA, 15 nt, Homo sapiens
agcagcccagcacau

SEQ ID NO: 2227628 - RNA, 13 nt, Homo sapiens
ugggcuggagcuc

SEQ ID NO: 2227629 - RNA, 13 nt, Homo sapiens
cuuccucuuggcu

SEQ ID NO: 2227630 - RNA, 16 nt, Homo sapiens
gagacacagauggcac

SEQ ID NO: 2227631 - RNA, 21 nt, Homo sapiens
cagcuggaagggucaacaucu

SEQ ID NO: 2227632 - RNA, 18 nt, Homo sapiens
guuugucgagcauuucuu

SEQ ID NO: 2227633 - RNA, 14 nt, Homo sapiens
agggcuucuaccag

SEQ ID NO: 2227634 - RNA, 17 nt, Homo sapiens
aggcuaggaagaacuug

SEQ ID NO: 2227635 - RNA, 16 nt, Homo sapiens
aaagcagcucaagaac

SEQ ID NO: 2227636 - RNA, 23 nt, Homo sapiens
uucucacccaggcaaucuugccu

SEQ ID NO: 2227637 - RNA, 15 nt, Homo sapiens
gccugaacauggcag

SEQ ID NO: 2227638 - RNA, 13 nt, Homo sapiens
ggaaugcauccaa

SEQ ID NO: 2227639 - RNA, 19 nt, Homo sapiens
acucaacaguuuccaguca

SEQ ID NO: 2227640 - RNA, 13 nt, Homo sapiens
ucccuacuccaug

SEQ ID NO: 2227641 - RNA, 18 nt, Homo sapiens
cuuggccuuggggccaga

SEQ ID NO: 2227642 - RNA, 19 nt, Homo sapiens
ggauccucuccacuccaug

SEQ ID NO: 2227643 - RNA, 22 nt, Homo sapiens
aaacuuguuagaucaaccucca

SEQ ID NO: 2227644 - RNA, 17 nt, Homo sapiens
auucuaaguuauuuacu

SEQ ID NO: 2227645 - RNA, 23 nt, Homo sapiens
acaaaaguguguauaaaauguac

SEQ ID NO: 2227646 - RNA, 17 nt, Homo sapiens
gcauuuuccagcacuuu

SEQ ID NO: 2227647 - RNA, 13 nt, Homo sapiens
gcaacaaagugag

SEQ ID NO: 2227648 - RNA, 17 nt, Homo sapiens
gaugaaacccuaucucu

SEQ ID NO: 2227649 - RNA, 21 nt, Homo sapiens
ugcaagcgucugugcauuuau

SEQ ID NO: 2227650 - RNA, 17 nt, Homo sapiens
accaugcccagcucaga

SEQ ID NO: 2227651 - RNA, 11 nt, Homo sapiens
uugacacugaa

SEQ ID NO: 2227652 - RNA, 23 nt, Homo sapiens
cuccauggccaccccgugccacc

SEQ ID NO: 2227653 - RNA, 14 nt, Homo sapiens
accagcacauuucu

SEQ ID NO: 2227654 - RNA, 18 nt, Homo sapiens
caucaaagaacaaacauc

SEQ ID NO: 2227655 - RNA, 19 nt, Homo sapiens
ucuuaauuuggaaacuaau

SEQ ID NO: 2227656 - RNA, 18 nt, Homo sapiens
gucuuuagaacagugccu

SEQ ID NO: 2227657 - RNA, 14 nt, Homo sapiens
ucauaauucugaaa

SEQ ID NO: 2227658 - RNA, 21 nt, Homo sapiens
ccaccuuucucgcuggaauca

SEQ ID NO: 2227659 - RNA, 16 nt, Homo sapiens
augcugaauccaccuc

SEQ ID NO: 2227660 - RNA, 21 nt, Homo sapiens
auuuaaccuguaaaaugucaa

SEQ ID NO: 2227661 - RNA, 19 nt, Homo sapiens
uguuuccaauuauccuuuu

SEQ ID NO: 2227662 - RNA, 20 nt, Homo sapiens
gggggcaucaggagcagggg

SEQ ID NO: 2227663 - RNA, 14 nt, Homo sapiens
cuagcugugggggu

SEQ ID NO: 2227664 - RNA, 16 nt, Homo sapiens
auugacccauguuccc

SEQ ID NO: 2227665 - RNA, 20 nt, Homo sapiens
uguuugcuuaaacaaaguga

SEQ ID NO: 2227666 - RNA, 14 nt, Homo sapiens
uuagccccucucuu

SEQ ID NO: 2227667 - RNA, 13 nt, Homo sapiens
cuuccccauuuca

SEQ ID NO: 2227668 - RNA, 17 nt, Homo sapiens
uuuguuugccaggacau

SEQ ID NO: 2227669 - RNA, 21 nt, Homo sapiens
auuauaaaaaauaaaggcaaa

SEQ ID NO: 2227670 - RNA, 23 nt, Homo sapiens
aaaccaggaaggaaaaugugaac

SEQ ID NO: 2227671 - RNA, 21 nt, Homo sapiens
agagacgggguuucuccaugu

SEQ ID NO: 2227672 - RNA, 19 nt, Homo sapiens
cucauuuggauugccuuac

SEQ ID NO: 2227673 - RNA, 18 nt, Homo sapiens
gcccugcagcccaaaacc

SEQ ID NO: 2227674 - RNA, 20 nt, Homo sapiens
aauuaaugguugaggcagga

SEQ ID NO: 2227675 - RNA, 14 nt, Homo sapiens
cacaguagaacugu

SEQ ID NO: 2227676 - RNA, 21 nt, Homo sapiens
gucuaguguuccugcaccaaa

SEQ ID NO: 2227677 - RNA, 19 nt, Homo sapiens
aucccaagagauuauguaa

SEQ ID NO: 2227678 - RNA, 15 nt, Homo sapiens
gguacccaggcuucc

SEQ ID NO: 2227679 - RNA, 16 nt, Homo sapiens
uuauauuauugauuca

SEQ ID NO: 2227680 - RNA, 18 nt, Homo sapiens
uuaauggugccuucauuu

SEQ ID NO: 2227681 - RNA, 22 nt, Homo sapiens
cagauuuuagaggggggaaauu

SEQ ID NO: 2227682 - RNA, 22 nt, Homo sapiens
aucgcagacuuaagcguacaaa

SEQ ID NO: 2227683 - RNA, 18 nt, Homo sapiens
aauucggguggcauccuc

SEQ ID NO: 2227684 - RNA, 15 nt, Homo sapiens
ucuaguauuuccaca

SEQ ID NO: 2227685 - RNA, 22 nt, Homo sapiens
aagaugcuuuuugaucuaccua

SEQ ID NO: 2227686 - RNA, 21 nt, Homo sapiens
guggaccacugcaugagcuuu

SEQ ID NO: 2227687 - RNA, 16 nt, Homo sapiens
auagugucccacggug

SEQ ID NO: 2227688 - RNA, 22 nt, Homo sapiens
caucuuugggacaccucagaaa

SEQ ID NO: 2227689 - RNA, 14 nt, Homo sapiens
ugaagucacacagu

SEQ ID NO: 2227690 - RNA, 19 nt, Homo sapiens
caccuaagcaaucacuggg

SEQ ID NO: 2227691 - RNA, 12 nt, Homo sapiens
cccaaacuguau

SEQ ID NO: 2227692 - RNA, 18 nt, Homo sapiens
aaguauugcugaguccaa

SEQ ID NO: 2227693 - RNA, 19 nt, Homo sapiens
ccaagcaguuucuuucaaa

SEQ ID NO: 2227694 - RNA, 22 nt, Homo sapiens
augcauucacauaucugcuuau

SEQ ID NO: 2227695 - RNA, 21 nt, Homo sapiens
caaguguccuggaaauucugc

SEQ ID NO: 2227696 - RNA, 17 nt, Homo sapiens
ugggacacaacacagau

SEQ ID NO: 2227697 - RNA, 21 nt, Homo sapiens
agucuuuugugucagugucuu

SEQ ID NO: 2227698 - RNA, 16 nt, Homo sapiens
agggaaaacauuccau

SEQ ID NO: 2227699 - RNA, 21 nt, Homo sapiens
gccagucucauugucaccucu

SEQ ID NO: 2227700 - RNA, 16 nt, Homo sapiens
uaaugggaagaccaaa

SEQ ID NO: 2227701 - RNA, 19 nt, Homo sapiens
augcccuguaccugugcac

SEQ ID NO: 2227702 - RNA, 20 nt, Homo sapiens
cuucugacccagggcugaga

SEQ ID NO: 2227703 - RNA, 19 nt, Homo sapiens
ugauuaugaaaugccagac

SEQ ID NO: 2227704 - RNA, 16 nt, Homo sapiens
ucucgcgcgacugaga

SEQ ID NO: 2227705 - RNA, 15 nt, Homo sapiens
guggcacccaccacu

SEQ ID NO: 2227706 - RNA, 19 nt, Homo sapiens
auugacugaacugcacguu

SEQ ID NO: 2227707 - RNA, 13 nt, Homo sapiens
auugguuuggcaa

SEQ ID NO: 2227708 - RNA, 17 nt, Homo sapiens
cacaauauccaaugaag

SEQ ID NO: 2227709 - RNA, 19 nt, Homo sapiens
uacaucuuuucuaaucaca

SEQ ID NO: 2227710 - RNA, 14 nt, Homo sapiens
acuugcucuugaug

SEQ ID NO: 2227711 - RNA, 14 nt, Homo sapiens
auccucaugcugcu

SEQ ID NO: 2227712 - RNA, 21 nt, Homo sapiens
uaccaauaaagugacccugcu

SEQ ID NO: 2227713 - RNA, 13 nt, Homo sapiens
cagagcacagccc

SEQ ID NO: 2227714 - RNA, 22 nt, Homo sapiens
gagagacgcagcccugggggcc

SEQ ID NO: 2227715 - RNA, 19 nt, Homo sapiens
gugcucgaguauccuugua

SEQ ID NO: 2227716 - RNA, 20 nt, Homo sapiens
cagagaacucccccaccugu

SEQ ID NO: 2227717 - RNA, 19 nt, Homo sapiens
aaggccacuguuugucuca

SEQ ID NO: 2227718 - RNA, 14 nt, Homo sapiens
guuucucaucccau

SEQ ID NO: 2227719 - RNA, 12 nt, Homo sapiens
acugacuugagg

SEQ ID NO: 2227720 - RNA, 20 nt, Homo sapiens
caaaauguccaccaauagaa

SEQ ID NO: 2227721 - RNA, 17 nt, Homo sapiens
ucuacuguucaauuuca

SEQ ID NO: 2227722 - RNA, 15 nt, Homo sapiens
acuauggagucuugu

SEQ ID NO: 2227723 - RNA, 21 nt, Homo sapiens
ucaccugcuggggaccucacc

SEQ ID NO: 2227724 - RNA, 17 nt, Homo sapiens
gugcccagucaugacau

SEQ ID NO: 2227725 - RNA, 21 nt, Homo sapiens
uaaguacaagcacauuuggcu

SEQ ID NO: 2227726 - RNA, 21 nt, Homo sapiens
ucaauauuugauugguauucu

SEQ ID NO: 2227727 - RNA, 12 nt, Homo sapiens
ccuucaucugaa

SEQ ID NO: 2227728 - RNA, 17 nt, Homo sapiens
aauugaucgacuugcca

SEQ ID NO: 2227729 - RNA, 21 nt, Homo sapiens
aaucuguugacagugccaaua

SEQ ID NO: 2227730 - RNA, 13 nt, Homo sapiens
agcuaacaaaaga

SEQ ID NO: 2227731 - RNA, 20 nt, Homo sapiens
cugccuuaaccugggaccaa

SEQ ID NO: 2227732 - RNA, 15 nt, Homo sapiens
agguagagucauuca

SEQ ID NO: 2227733 - RNA, 15 nt, Homo sapiens
uaaguuucugugacc

SEQ ID NO: 2227734 - RNA, 14 nt, Homo sapiens
agagguagcacuac

SEQ ID NO: 2227735 - RNA, 15 nt, Homo sapiens
uucaagaacauucua

SEQ ID NO: 2227736 - RNA, 14 nt, Homo sapiens
ucccacccagucuc

SEQ ID NO: 2227737 - RNA, 17 nt, Homo sapiens
gacguguuaugacucca

SEQ ID NO: 2227738 - RNA, 15 nt, Homo sapiens
gucacggccaggcag

SEQ ID NO: 2227739 - RNA, 16 nt, Homo sapiens
acuaagcacauuaugu

SEQ ID NO: 2227740 - RNA, 14 nt, Homo sapiens
cgaugacaguguuc

SEQ ID NO: 2227741 - RNA, 22 nt, Homo sapiens
caauacauuauuggacuuccau

SEQ ID NO: 2227742 - RNA, 17 nt, Homo sapiens
uccacagagauacacag

SEQ ID NO: 2227743 - RNA, 18 nt, Homo sapiens
ugaguacguugugcauuu

SEQ ID NO: 2227744 - RNA, 18 nt, Homo sapiens
uuaccuaaaacugcugaa

SEQ ID NO: 2227745 - RNA, 11 nt, Homo sapiens
aaguugcccuc

SEQ ID NO: 2227746 - RNA, 22 nt, Homo sapiens
ccagaaggcagagguugcagug

SEQ ID NO: 2227747 - RNA, 18 nt, Homo sapiens
aaggggaaucagaacuca

SEQ ID NO: 2227748 - RNA, 18 nt, Homo sapiens
caacaaacuuaggaauaa

SEQ ID NO: 2227749 - RNA, 19 nt, Homo sapiens
gcuggacccauuugccagg

SEQ ID NO: 2227750 - RNA, 14 nt, Homo sapiens
acccaccuuugcag

SEQ ID NO: 2227751 - RNA, 21 nt, Homo sapiens
ucaauauuuacuauuucaaua

SEQ ID NO: 2227752 - RNA, 14 nt, Homo sapiens
gacagcuuccucac

SEQ ID NO: 2227753 - RNA, 19 nt, Homo sapiens
cccacgcuggagugcagug

SEQ ID NO: 2227754 - RNA, 17 nt, Homo sapiens
gcuucccagguucaagc

SEQ ID NO: 2227755 - RNA, 21 nt, Homo sapiens
aaaaguggcuaauucaauuua

SEQ ID NO: 2227756 - RNA, 19 nt, Homo sapiens
caaugcuauugaaauuacu

SEQ ID NO: 2227757 - RNA, 17 nt, Homo sapiens
caagagugagacuccac

SEQ ID NO: 2227758 - RNA, 13 nt, Homo sapiens
uccaggccagaau

SEQ ID NO: 2227759 - RNA, 23 nt, Homo sapiens
aauacuacugugugugcauugaa

SEQ ID NO: 2227760 - RNA, 20 nt, Homo sapiens
ccuucagcauugccuaggaa

SEQ ID NO: 2227761 - RNA, 12 nt, Homo sapiens
ggccaccggugg

SEQ ID NO: 2227762 - RNA, 16 nt, Homo sapiens
uauucuguuuugcaca

SEQ ID NO: 2227763 - RNA, 14 nt, Homo sapiens
acaaggucagagag

SEQ ID NO: 2227764 - RNA, 16 nt, Homo sapiens
cugguugucaguuaca

SEQ ID NO: 2227765 - RNA, 20 nt, Homo sapiens
agcuuugcuuccgacaccuc

SEQ ID NO: 2227766 - RNA, 16 nt, Homo sapiens
auaagcaucuguguaa

SEQ ID NO: 2227767 - RNA, 14 nt, Homo sapiens
auuaaugauuuagc

SEQ ID NO: 2227768 - RNA, 22 nt, Homo sapiens
ggagaggcggccucgugccaug

SEQ ID NO: 2227769 - RNA, 20 nt, Homo sapiens
aacauaaauuuaucaucucg

SEQ ID NO: 2227770 - RNA, 22 nt, Homo sapiens
aaacaacauuggaugugcauuu

SEQ ID NO: 2227771 - RNA, 13 nt, Homo sapiens
agugaauucacca

SEQ ID NO: 2227772 - RNA, 19 nt, Homo sapiens
cuuccauagccuccaaaca

SEQ ID NO: 2227773 - RNA, 16 nt, Homo sapiens
aucgcuugaaccuggg

SEQ ID NO: 2227774 - RNA, 16 nt, Homo sapiens
cugccuggcaggugug

SEQ ID NO: 2227775 - RNA, 19 nt, Homo sapiens
ugaagaacugcauguggcu

SEQ ID NO: 2227776 - RNA, 23 nt, Homo sapiens
auagaucuuaggcaaaauaccag

SEQ ID NO: 2227777 - RNA, 14 nt, Homo sapiens
agccaagggacaca

SEQ ID NO: 2227778 - RNA, 17 nt, Homo sapiens
ucuucagcugguggaug

SEQ ID NO: 2227779 - RNA, 15 nt, Homo sapiens
ucugaggaguggagu

SEQ ID NO: 2227780 - RNA, 18 nt, Homo sapiens
acccuuuuccuccagaca

SEQ ID NO: 2227781 - RNA, 22 nt, Homo sapiens
ccuuucugcccagccugcucag

SEQ ID NO: 2227782 - RNA, 14 nt, Homo sapiens
uaaugaaaagcaca

SEQ ID NO: 2227783 - RNA, 20 nt, Homo sapiens
caguuucacaaaguuuguuc

SEQ ID NO: 2227784 - RNA, 21 nt, Homo sapiens
aaauggcuguaaaacuaaaca

SEQ ID NO: 2227785 - RNA, 15 nt, Homo sapiens
ucccaucuuuacucc

SEQ ID NO: 2227786 - RNA, 16 nt, Homo sapiens
gacauuccugcaggga

SEQ ID NO: 2227787 - RNA, 17 nt, Homo sapiens
ucagaaaaaacaggccc

SEQ ID NO: 2227788 - RNA, 22 nt, Homo sapiens
cucgugacagccucugacucac

SEQ ID NO: 2227789 - RNA, 18 nt, Homo sapiens
cucuaagcucagugcucu

SEQ ID NO: 2227790 - RNA, 13 nt, Homo sapiens
uuuucuaaaaagu

SEQ ID NO: 2227791 - RNA, 18 nt, Homo sapiens
uaaauaaaccacugugcg

SEQ ID NO: 2227792 - RNA, 22 nt, Homo sapiens
aacuuguuuacauagcauuugu

SEQ ID NO: 2227793 - RNA, 21 nt, Homo sapiens
auggggguggggaggcaagaa

SEQ ID NO: 2227794 - RNA, 14 nt, Homo sapiens
aacaaagacuuuga

SEQ ID NO: 2227795 - RNA, 20 nt, Homo sapiens
auuuaaagacaaaaauacau

SEQ ID NO: 2227796 - RNA, 20 nt, Homo sapiens
agcuuuggacgcacacagcu

SEQ ID NO: 2227797 - RNA, 20 nt, Homo sapiens
agcagaggaauaacaucacc

SEQ ID NO: 2227798 - RNA, 20 nt, Homo sapiens
cugcagcuuggagaacuccg

SEQ ID NO: 2227799 - RNA, 21 nt, Homo sapiens
ugggauucuagaacugugaau

SEQ ID NO: 2227800 - RNA, 19 nt, Homo sapiens
acucuuaacuccuagccca

SEQ ID NO: 2227801 - RNA, 22 nt, Homo sapiens
ugacugcuuuuaaaugaccaaa

SEQ ID NO: 2227802 - RNA, 15 nt, Homo sapiens
guuaaagaagcaauc

SEQ ID NO: 2227803 - RNA, 18 nt, Homo sapiens
agcugacgcgacuaucau

SEQ ID NO: 2227804 - RNA, 14 nt, Homo sapiens
aacacugcacucuu

SEQ ID NO: 2227805 - RNA, 21 nt, Homo sapiens
cuuuuagucaggagagugcag

SEQ ID NO: 2227806 - RNA, 19 nt, Homo sapiens
acacccccaugacauugca

SEQ ID NO: 2227807 - RNA, 19 nt, Homo sapiens
gaacucagcuguccagcug

SEQ ID NO: 2227808 - RNA, 15 nt, Homo sapiens
caauuuuuauacaua

SEQ ID NO: 2227809 - RNA, 17 nt, Homo sapiens
uaaagcuuguugacuca

SEQ ID NO: 2227810 - RNA, 18 nt, Homo sapiens
gauaucaccucucuucag

SEQ ID NO: 2227811 - RNA, 15 nt, Homo sapiens
gcacaaaaagcacaa

SEQ ID NO: 2227812 - RNA, 11 nt, Homo sapiens
aaacucagugc

SEQ ID NO: 2227813 - RNA, 14 nt, Homo sapiens
aucucacagcauuu

SEQ ID NO: 2227814 - RNA, 16 nt, Homo sapiens
uggccacagugucacu

SEQ ID NO: 2227815 - RNA, 22 nt, Homo sapiens
gaaauauugauaguaaggcaau

SEQ ID NO: 2227816 - RNA, 23 nt, Homo sapiens
uuucuugaggaaaauauugcugu

SEQ ID NO: 2227817 - RNA, 15 nt, Homo sapiens
acuauauuaaucacc

SEQ ID NO: 2227818 - RNA, 15 nt, Homo sapiens
ccuuuuacucagcuu

SEQ ID NO: 2227819 - RNA, 20 nt, Homo sapiens
ugugccggcuuucaaguuug

SEQ ID NO: 2227820 - RNA, 22 nt, Homo sapiens
cgaccaccuccaggacucagug

SEQ ID NO: 2227821 - RNA, 13 nt, Homo sapiens
gucaguguucuua

SEQ ID NO: 2227822 - RNA, 12 nt, Homo sapiens
cuaaaaauugau

SEQ ID NO: 2227823 - RNA, 16 nt, Homo sapiens
acucccuaggcccaag

SEQ ID NO: 2227824 - RNA, 23 nt, Homo sapiens
uaccuuuguaacggcucuuagca

SEQ ID NO: 2227825 - RNA, 13 nt, Homo sapiens
cauugagcucucc

SEQ ID NO: 2227826 - RNA, 20 nt, Homo sapiens
agcccucaugaucauucuca

SEQ ID NO: 2227827 - RNA, 19 nt, Homo sapiens
accugcagggugugugcua

SEQ ID NO: 2227828 - RNA, 19 nt, Homo sapiens
ugggaggguaccagcagaa

SEQ ID NO: 2227829 - RNA, 13 nt, Homo sapiens
aauaaaauaauuc

SEQ ID NO: 2227830 - RNA, 18 nt, Homo sapiens
uccucugaggcuggaucc

SEQ ID NO: 2227831 - RNA, 16 nt, Homo sapiens
ucccgaugcugcuaug

SEQ ID NO: 2227832 - RNA, 22 nt, Homo sapiens
ugguacugagguugggcugaga

SEQ ID NO: 2227833 - RNA, 14 nt, Homo sapiens
uuguaauugcauga

SEQ ID NO: 2227834 - RNA, 15 nt, Homo sapiens
aucagucaacaacuu

SEQ ID NO: 2227835 - RNA, 16 nt, Homo sapiens
uggacuuuugaagucc

SEQ ID NO: 2227836 - RNA, 14 nt, Homo sapiens
aauagcuacuggaa

SEQ ID NO: 2227837 - RNA, 22 nt, Homo sapiens
gauguggaucacgcagugcuuu

SEQ ID NO: 2227838 - RNA, 15 nt, Homo sapiens
guagccugaauugcu

SEQ ID NO: 2227839 - RNA, 13 nt, Homo sapiens
gagacccacaggu

SEQ ID NO: 2227840 - RNA, 20 nt, Homo sapiens
uagacaccuucugugcucau

SEQ ID NO: 2227841 - RNA, 21 nt, Homo sapiens
uggaaucagucguuggcaccu

SEQ ID NO: 2227842 - RNA, 19 nt, Homo sapiens
cagcaauuuuuccaaaagc

SEQ ID NO: 2227843 - RNA, 16 nt, Homo sapiens
agaucauccuuuccag

SEQ ID NO: 2227844 - RNA, 15 nt, Homo sapiens
gccaggcugaucuca

SEQ ID NO: 2227845 - RNA, 22 nt, Homo sapiens
gcccacgucaggccuggccuca

SEQ ID NO: 2227846 - RNA, 17 nt, Homo sapiens
auuuacauaaagacugu

SEQ ID NO: 2227847 - RNA, 23 nt, Homo sapiens
uucuacacguugcccaucauccc

SEQ ID NO: 2227848 - RNA, 15 nt, Homo sapiens
agcuugaaacauaga

SEQ ID NO: 2227849 - RNA, 21 nt, Homo sapiens
accuuugguuuuaaaagagaa

SEQ ID NO: 2227850 - RNA, 20 nt, Homo sapiens
gacagaucaauggcgcagug

SEQ ID NO: 2227851 - RNA, 21 nt, Homo sapiens
uacaguaccuuguugcagaug

SEQ ID NO: 2227852 - RNA, 16 nt, Homo sapiens
uuaaguggguuugccc

SEQ ID NO: 2227853 - RNA, 13 nt, Homo sapiens
uugagcacaaaau

SEQ ID NO: 2227854 - RNA, 17 nt, Homo sapiens
aauaaauaauucuuccu

SEQ ID NO: 2227855 - RNA, 21 nt, Homo sapiens
cgugggcugggcccacaaagg

SEQ ID NO: 2227856 - RNA, 18 nt, Homo sapiens
aaaugugucuugcuguca

SEQ ID NO: 2227857 - RNA, 21 nt, Homo sapiens
uucuugccugaacuccugcca

SEQ ID NO: 2227858 - RNA, 22 nt, Homo sapiens
uuccaaguuccugcacuccaga

SEQ ID NO: 2227859 - RNA, 16 nt, Homo sapiens
acaugcgugugucagg

SEQ ID NO: 2227860 - RNA, 15 nt, Homo sapiens
guagcuagccugaga

SEQ ID NO: 2227861 - RNA, 17 nt, Homo sapiens
cuuuaaaccuuucauaa

SEQ ID NO: 2227862 - RNA, 13 nt, Homo sapiens
cuauuaagggaaa

SEQ ID NO: 2227863 - RNA, 14 nt, Homo sapiens
caaagacuguacug

SEQ ID NO: 2227864 - RNA, 16 nt, Homo sapiens
uaucauccccauuuaa

SEQ ID NO: 2227865 - RNA, 16 nt, Homo sapiens
uuguagaugugauuaa

SEQ ID NO: 2227866 - RNA, 20 nt, Homo sapiens
ccaacugccuccuugccagc

SEQ ID NO: 2227867 - RNA, 17 nt, Homo sapiens
ucccaaacugugaugaa

SEQ ID NO: 2227868 - RNA, 19 nt, Homo sapiens
ccuggggcccaaaugcugg

SEQ ID NO: 2227869 - RNA, 15 nt, Homo sapiens
agccuauauuuacag

SEQ ID NO: 2227870 - RNA, 15 nt, Homo sapiens
uuucuagaagcacau

SEQ ID NO: 2227871 - RNA, 20 nt, Homo sapiens
guuccacagaguaagacauu

SEQ ID NO: 2227872 - RNA, 22 nt, Homo sapiens
uaguuuuuugcuucucuuuccc

SEQ ID NO: 2227873 - RNA, 19 nt, Homo sapiens
uccauaaaagguguguuga

SEQ ID NO: 2227874 - RNA, 18 nt, Homo sapiens
guucuguugaccugugca

SEQ ID NO: 2227875 - RNA, 23 nt, Homo sapiens
gagagcugggcuuuccucuguga

SEQ ID NO: 2227876 - RNA, 12 nt, Homo sapiens
gccugcacugga

SEQ ID NO: 2227877 - RNA, 16 nt, Homo sapiens
aagucugagcccauuu

SEQ ID NO: 2227878 - RNA, 20 nt, Homo sapiens
aauggucaguauuaucuaaa

SEQ ID NO: 2227879 - RNA, 20 nt, Homo sapiens
guucucaccuuaacucagcc

SEQ ID NO: 2227880 - RNA, 18 nt, Homo sapiens
accucaaacuuccaguca

SEQ ID NO: 2227881 - RNA, 14 nt, Homo sapiens
aagcaaccaugaac

SEQ ID NO: 2227882 - RNA, 22 nt, Homo sapiens
uccucugacuggagucuaggaa

SEQ ID NO: 2227883 - RNA, 23 nt, Homo sapiens
ugcaaauuuuagcguuaaaguca

SEQ ID NO: 2227884 - RNA, 22 nt, Homo sapiens
aggguggcacagaagcucaucu

SEQ ID NO: 2227885 - RNA, 14 nt, Homo sapiens
aauaaccaucugaa

SEQ ID NO: 2227886 - RNA, 17 nt, Homo sapiens
uccugcgcucugccacu

SEQ ID NO: 2227887 - RNA, 18 nt, Homo sapiens
cuauggcucaugucugaa

SEQ ID NO: 2227888 - RNA, 19 nt, Homo sapiens
uccaaguuuuaauuuuuaa

SEQ ID NO: 2227889 - RNA, 23 nt, Homo sapiens
caucugcuucuggggacaccuca

SEQ ID NO: 2227890 - RNA, 24 nt, Homo sapiens
gucuggaucccgagguauggcaga

SEQ ID NO: 2227891 - RNA, 20 nt, Homo sapiens
cacaucucguauaauauuca

SEQ ID NO: 2227892 - RNA, 12 nt, Homo sapiens
uuugaacuuaaa

SEQ ID NO: 2227893 - RNA, 15 nt, Homo sapiens
uagcucuccugccac

SEQ ID NO: 2227894 - RNA, 18 nt, Homo sapiens
ugugaaagcaccaucauc

SEQ ID NO: 2227895 - RNA, 14 nt, Homo sapiens
uagccuaaacucca

SEQ ID NO: 2227896 - RNA, 16 nt, Homo sapiens
ccucaggaaugggcug

SEQ ID NO: 2227897 - RNA, 18 nt, Homo sapiens
cugccacagccagaggag

SEQ ID NO: 2227898 - RNA, 15 nt, Homo sapiens
augccucgcucaguc

SEQ ID NO: 2227899 - RNA, 15 nt, Homo sapiens
ggcagcuucacucga

SEQ ID NO: 2227900 - RNA, 23 nt, Homo sapiens
gucauuauagaugaguuuugcca

SEQ ID NO: 2227901 - RNA, 13 nt, Homo sapiens
gagugagacugac

SEQ ID NO: 2227902 - RNA, 19 nt, Homo sapiens
aaaaugcuaaaacaugaug

SEQ ID NO: 2227903 - RNA, 20 nt, Homo sapiens
gucagucugggugucucagg

SEQ ID NO: 2227904 - RNA, 14 nt, Homo sapiens
uccccaaggcacuu

SEQ ID NO: 2227905 - RNA, 15 nt, Homo sapiens
ucacgaugaaauuga

SEQ ID NO: 2227906 - RNA, 14 nt, Homo sapiens
cuuuauuauuccua

SEQ ID NO: 2227907 - RNA, 18 nt, Homo sapiens
ggccauaaagaucaaaca

SEQ ID NO: 2227908 - RNA, 17 nt, Homo sapiens
uacccaaugcaguuugg

SEQ ID NO: 2227909 - RNA, 13 nt, Homo sapiens
agaggcucugaga

SEQ ID NO: 2227910 - RNA, 16 nt, Homo sapiens
guaauaugacuccugu

SEQ ID NO: 2227911 - RNA, 21 nt, Homo sapiens
acauucuugcucaaguugaug

SEQ ID NO: 2227912 - RNA, 17 nt, Homo sapiens
guuaccucugcauggaa

SEQ ID NO: 2227913 - RNA, 12 nt, Homo sapiens
uucauacuguaa

SEQ ID NO: 2227914 - RNA, 12 nt, Homo sapiens
uucuuacuguau

SEQ ID NO: 2227915 - RNA, 19 nt, Homo sapiens
ucugauuauacaccauuuu

SEQ ID NO: 2227916 - RNA, 20 nt, Homo sapiens
ccgcugugucuaugaacuag

SEQ ID NO: 2227917 - RNA, 17 nt, Homo sapiens
augauuucagaauuuag

SEQ ID NO: 2227918 - RNA, 20 nt, Homo sapiens
aguaaugaaggcauauuucc

SEQ ID NO: 2227919 - RNA, 22 nt, Homo sapiens
ucaggucaccgcgaggccuauu

SEQ ID NO: 2227920 - RNA, 15 nt, Homo sapiens
caaaccaggugcaau

SEQ ID NO: 2227921 - RNA, 17 nt, Homo sapiens
acugaaccacauucagg

SEQ ID NO: 2227922 - RNA, 19 nt, Homo sapiens
acauucuuuuucuguugaa

SEQ ID NO: 2227923 - RNA, 12 nt, Homo sapiens
guuuuuaaucca

SEQ ID NO: 2227924 - RNA, 17 nt, Homo sapiens
acagaaugaaucccaua

SEQ ID NO: 2227925 - RNA, 14 nt, Homo sapiens
ccuguuuugcaaau

SEQ ID NO: 2227926 - RNA, 16 nt, Homo sapiens
ggaaugccacagugaa

SEQ ID NO: 2227927 - RNA, 17 nt, Homo sapiens
uaauaaaagcaucuuga

SEQ ID NO: 2227928 - RNA, 18 nt, Homo sapiens
gggccuggccaccucucu

SEQ ID NO: 2227929 - RNA, 21 nt, Homo sapiens
agaaggugccacuuuacccac

SEQ ID NO: 2227930 - RNA, 19 nt, Homo sapiens
cuaccuugguccugccucu

SEQ ID NO: 2227931 - RNA, 14 nt, Homo sapiens
ccugcagaagaugu

SEQ ID NO: 2227932 - RNA, 14 nt, Homo sapiens
cuggguaauucacc

SEQ ID NO: 2227933 - RNA, 22 nt, Homo sapiens
guacauaauucuugcuaugaaa

SEQ ID NO: 2227934 - RNA, 16 nt, Homo sapiens
aaagaggccuguucau

SEQ ID NO: 2227935 - RNA, 19 nt, Homo sapiens
cuucucugagucagcugac

SEQ ID NO: 2227936 - RNA, 22 nt, Homo sapiens
cagccacaaaguugagacuucu

SEQ ID NO: 2227937 - RNA, 11 nt, Homo sapiens
ugaacaaagca

SEQ ID NO: 2227938 - RNA, 23 nt, Homo sapiens
auagugagagaggaggccuggac

SEQ ID NO: 2227939 - RNA, 16 nt, Homo sapiens
ggagaggucagccuug

SEQ ID NO: 2227940 - RNA, 19 nt, Homo sapiens
gauuuccuugugcaaaaua

SEQ ID NO: 2227941 - RNA, 16 nt, Homo sapiens
uaauggaugcucauuc

SEQ ID NO: 2227942 - RNA, 16 nt, Homo sapiens
uuugagagugaccucu

SEQ ID NO: 2227943 - RNA, 18 nt, Homo sapiens
ccucuccuuaaaugcuuc

SEQ ID NO: 2227944 - RNA, 15 nt, Homo sapiens
uuggagaaaaugggu

SEQ ID NO: 2227945 - RNA, 12 nt, Homo sapiens
accuugacaaaa

SEQ ID NO: 2227946 - RNA, 17 nt, Homo sapiens
agcaauucuccugccuc

SEQ ID NO: 2227947 - RNA, 19 nt, Homo sapiens
aaaccuuucaguacucuua

SEQ ID NO: 2227948 - RNA, 18 nt, Homo sapiens
cuuugauuauuugcaugu

SEQ ID NO: 2227949 - RNA, 19 nt, Homo sapiens
aaccuugucccagccagug

SEQ ID NO: 2227950 - RNA, 22 nt, Homo sapiens
ccuuuaaaaaugcaccacuuuu

SEQ ID NO: 2227951 - RNA, 18 nt, Homo sapiens
accuguagaagaugaccu

SEQ ID NO: 2227952 - RNA, 20 nt, Homo sapiens
uaucaccccuuccuccuucc

SEQ ID NO: 2227953 - RNA, 23 nt, Homo sapiens
acaaagggaaggcugcuguguag

SEQ ID NO: 2227954 - RNA, 20 nt, Homo sapiens
aaggcuacaguaaccaaaac

SEQ ID NO: 2227955 - RNA, 21 nt, Homo sapiens
caggaagguagcccagcacug

SEQ ID NO: 2227956 - RNA, 21 nt, Homo sapiens
aggagcauaugauugcuccag

SEQ ID NO: 2227957 - RNA, 22 nt, Homo sapiens
gccuggaguaacacaaagugaa

SEQ ID NO: 2227958 - RNA, 20 nt, Homo sapiens
caaguauuuuugacauuuac

SEQ ID NO: 2227959 - RNA, 19 nt, Homo sapiens
uaaacaagggcagugagaa

SEQ ID NO: 2227960 - RNA, 21 nt, Homo sapiens
ggacagaucaauggcgcagug

SEQ ID NO: 2227961 - RNA, 22 nt, Homo sapiens
cugucuauauauauagggagca

SEQ ID NO: 2227962 - RNA, 21 nt, Homo sapiens
uuugcaaaauuuccaguaccu

SEQ ID NO: 2227963 - RNA, 23 nt, Homo sapiens
cuuuauuuuaaaaaacacugaua

SEQ ID NO: 2227964 - RNA, 18 nt, Homo sapiens
uugggacaauuguuuuaa

SEQ ID NO: 2227965 - RNA, 16 nt, Homo sapiens
uccucccuucccagga

SEQ ID NO: 2227966 - RNA, 17 nt, Homo sapiens
cugucccucuccuugcc

SEQ ID NO: 2227967 - RNA, 15 nt, Homo sapiens
auaaaccuggcacua

SEQ ID NO: 2227968 - RNA, 14 nt, Homo sapiens
ccccacaugcaugu

SEQ ID NO: 2227969 - RNA, 21 nt, Homo sapiens
uccagguucucuuagagccau

SEQ ID NO: 2227970 - RNA, 17 nt, Homo sapiens
gaucccagagcuuccca

SEQ ID NO: 2227971 - RNA, 21 nt, Homo sapiens
ugagcuaucuccuaacuuugg

SEQ ID NO: 2227972 - RNA, 14 nt, Homo sapiens
cuccaacagagugg

SEQ ID NO: 2227973 - RNA, 11 nt, Homo sapiens
ucccugcaaaa

SEQ ID NO: 2227974 - RNA, 23 nt, Homo sapiens
gcaccagagggauaaaaacaaua

SEQ ID NO: 2227975 - RNA, 16 nt, Homo sapiens
auugucgucuuuaugu

SEQ ID NO: 2227976 - RNA, 18 nt, Homo sapiens
caggaggaucacuugagg

SEQ ID NO: 2227977 - RNA, 18 nt, Homo sapiens
aacagcaguguucucaca

SEQ ID NO: 2227978 - RNA, 17 nt, Homo sapiens
agcagcccagggcacuu

SEQ ID NO: 2227979 - RNA, 17 nt, Homo sapiens
gaaaugauaagugacaa

SEQ ID NO: 2227980 - RNA, 16 nt, Homo sapiens
gacuucacagugaagu

SEQ ID NO: 2227981 - RNA, 17 nt, Homo sapiens
cugggcucagacaucca

SEQ ID NO: 2227982 - RNA, 15 nt, Homo sapiens
ggauuaaaagccaug

SEQ ID NO: 2227983 - RNA, 15 nt, Homo sapiens
agcgugaguggugga

SEQ ID NO: 2227984 - RNA, 19 nt, Homo sapiens
uaaucauuuugaacaugug

SEQ ID NO: 2227985 - RNA, 16 nt, Homo sapiens
uccuuuauccacuuuu

SEQ ID NO: 2227986 - RNA, 21 nt, Homo sapiens
acuucccccuaaccccuauga

SEQ ID NO: 2227987 - RNA, 20 nt, Homo sapiens
aaauuguuuugcaaauggau

SEQ ID NO: 2227988 - RNA, 16 nt, Homo sapiens
aaagguauauugugaa

SEQ ID NO: 2227989 - RNA, 21 nt, Homo sapiens
ucuuaaguuuauacucuuaua

SEQ ID NO: 2227990 - RNA, 20 nt, Homo sapiens
gcaaaagucauugcugacag

SEQ ID NO: 2227991 - RNA, 23 nt, Homo sapiens
gcaucugagugggcccagcacau

SEQ ID NO: 2227992 - RNA, 14 nt, Homo sapiens
caagagauucuccu

SEQ ID NO: 2227993 - RNA, 14 nt, Homo sapiens
caagcgauucucau

SEQ ID NO: 2227994 - RNA, 13 nt, Homo sapiens
ugaaguacagucc

SEQ ID NO: 2227995 - RNA, 16 nt, Homo sapiens
gugaaguugugcaacg

SEQ ID NO: 2227996 - RNA, 21 nt, Homo sapiens
auaggagagauaccuugaaaa

SEQ ID NO: 2227997 - RNA, 15 nt, Homo sapiens
agaagcugaagaucc

SEQ ID NO: 2227998 - RNA, 16 nt, Homo sapiens
guuauugaaucuuaau

SEQ ID NO: 2227999 - RNA, 22 nt, Homo sapiens
uauaacaugucuuucagcauua

SEQ ID NO: 2228000 - RNA, 18 nt, Homo sapiens
acacugagcuucugagac

SEQ ID NO: 2228001 - RNA, 18 nt, Homo sapiens
cucuggguccuuccugaa

SEQ ID NO: 2228002 - RNA, 16 nt, Homo sapiens
uuguacauaacuuaga

SEQ ID NO: 2228003 - RNA, 18 nt, Homo sapiens
caaggcuuaccugugaua

SEQ ID NO: 2228004 - RNA, 14 nt, Homo sapiens
gcuuucucccucac

SEQ ID NO: 2228005 - RNA, 15 nt, Homo sapiens
augaagaaggucuca

SEQ ID NO: 2228006 - RNA, 15 nt, Homo sapiens
aaacggauaccaagu

SEQ ID NO: 2228007 - RNA, 16 nt, Homo sapiens
uuaccuuaaacugugu

SEQ ID NO: 2228008 - RNA, 17 nt, Homo sapiens
ggaaaugguacugccca

SEQ ID NO: 2228009 - RNA, 21 nt, Homo sapiens
uuaagucccaguauaccucau

SEQ ID NO: 2228010 - RNA, 21 nt, Homo sapiens
gguucggcucuagggccucag

SEQ ID NO: 2228011 - RNA, 22 nt, Homo sapiens
ucaugaacacagccugggacca

SEQ ID NO: 2228012 - RNA, 19 nt, Homo sapiens
auuuuuaaaagacuuugau

SEQ ID NO: 2228013 - RNA, 16 nt, Homo sapiens
gguauguaaacuuucc

SEQ ID NO: 2228014 - RNA, 17 nt, Homo sapiens
aaaccaagauagaucca

SEQ ID NO: 2228015 - RNA, 15 nt, Homo sapiens
ucaacauuccaggga

SEQ ID NO: 2228016 - RNA, 20 nt, Homo sapiens
ccugaaaauaacagaauucu

SEQ ID NO: 2228017 - RNA, 23 nt, Homo sapiens
ccuggugcaucgaaauguauuca

SEQ ID NO: 2228018 - RNA, 17 nt, Homo sapiens
acaacagaauaaugcau

SEQ ID NO: 2228019 - RNA, 11 nt, Homo sapiens
ugacagcaaua

SEQ ID NO: 2228020 - RNA, 14 nt, Homo sapiens
cuaagaagggaaaa

SEQ ID NO: 2228021 - RNA, 17 nt, Homo sapiens
acagauagacagugcug

SEQ ID NO: 2228022 - RNA, 14 nt, Homo sapiens
acauucaauuugcu

SEQ ID NO: 2228023 - RNA, 15 nt, Homo sapiens
acucaguucuuccuc

SEQ ID NO: 2228024 - RNA, 19 nt, Homo sapiens
agcuucauaauuuccauga

SEQ ID NO: 2228025 - RNA, 21 nt, Homo sapiens
uuuccaccuucucacauggaa

SEQ ID NO: 2228026 - RNA, 17 nt, Homo sapiens
caggaugagguggugga

SEQ ID NO: 2228027 - RNA, 15 nt, Homo sapiens
cagggugagugaaug

SEQ ID NO: 2228028 - RNA, 14 nt, Homo sapiens
cccuucacacaacu

SEQ ID NO: 2228029 - RNA, 22 nt, Homo sapiens
ggccgggccuagaccuggugcu

SEQ ID NO: 2228030 - RNA, 23 nt, Homo sapiens
aagaacuuuuucuuuucccucaa

SEQ ID NO: 2228031 - RNA, 21 nt, Homo sapiens
ccuaauaaaaauuggagcuca

SEQ ID NO: 2228032 - RNA, 23 nt, Homo sapiens
augacagggaugccaacaccuuc

SEQ ID NO: 2228033 - RNA, 20 nt, Homo sapiens
agcaugaaaguggacaagga

SEQ ID NO: 2228034 - RNA, 19 nt, Homo sapiens
acuuaccgagucagacuuu

SEQ ID NO: 2228035 - RNA, 17 nt, Homo sapiens
cuuccagcuucaggcac

SEQ ID NO: 2228036 - RNA, 13 nt, Homo sapiens
agagcagggauua

SEQ ID NO: 2228037 - RNA, 16 nt, Homo sapiens
agcaacucuaagacua

SEQ ID NO: 2228038 - RNA, 17 nt, Homo sapiens
agaagaaacugcuuaga

SEQ ID NO: 2228039 - RNA, 13 nt, Homo sapiens
cucacauuucacc

SEQ ID NO: 2228040 - RNA, 20 nt, Homo sapiens
gaagucugcuuaccaaaaca

SEQ ID NO: 2228041 - RNA, 17 nt, Homo sapiens
uuggagguuaaggcaua

SEQ ID NO: 2228042 - RNA, 15 nt, Homo sapiens
cucauccugcaggca

SEQ ID NO: 2228043 - RNA, 23 nt, Homo sapiens
ucuugaaauagguguuaccuucu

SEQ ID NO: 2228044 - RNA, 18 nt, Homo sapiens
agggcucucucuccccac

SEQ ID NO: 2228045 - RNA, 19 nt, Homo sapiens
ugaaagucaugaacacauc

SEQ ID NO: 2228046 - RNA, 12 nt, Homo sapiens
gauuauacagaa

SEQ ID NO: 2228047 - RNA, 14 nt, Homo sapiens
uccuaaaaauacaa

SEQ ID NO: 2228048 - RNA, 17 nt, Homo sapiens
acaucuuaaagcuaaaa

SEQ ID NO: 2228049 - RNA, 21 nt, Homo sapiens
ucucuaagugggcauugccau

SEQ ID NO: 2228050 - RNA, 22 nt, Homo sapiens
ccaggcuacaaucuucauuuaa

SEQ ID NO: 2228051 - RNA, 16 nt, Homo sapiens
agcucaucugcaaaag

SEQ ID NO: 2228052 - RNA, 19 nt, Homo sapiens
auauccacuggacacugug

SEQ ID NO: 2228053 - RNA, 21 nt, Homo sapiens
gcuuccgugugucaucagggu

SEQ ID NO: 2228054 - RNA, 22 nt, Homo sapiens
gagauagccgggcuccagggag

SEQ ID NO: 2228055 - RNA, 21 nt, Homo sapiens
cacaccccuccggacauccag

SEQ ID NO: 2228056 - RNA, 20 nt, Homo sapiens
gcuucauuugggaaauucag

SEQ ID NO: 2228057 - RNA, 19 nt, Homo sapiens
auggugaaacccugucucu

SEQ ID NO: 2228058 - RNA, 16 nt, Homo sapiens
augcaaguauccugcg

SEQ ID NO: 2228059 - RNA, 13 nt, Homo sapiens
agugcucucacug

SEQ ID NO: 2228060 - RNA, 19 nt, Homo sapiens
uaaauaauuuaacuacccu

SEQ ID NO: 2228061 - RNA, 15 nt, Homo sapiens
aaggagaacuaucca

SEQ ID NO: 2228062 - RNA, 21 nt, Homo sapiens
acccagcuacucuguccaggc

SEQ ID NO: 2228063 - RNA, 16 nt, Homo sapiens
acaauauugacuuugu

SEQ ID NO: 2228064 - RNA, 21 nt, Homo sapiens
gaguucccucuucuaacccaa

SEQ ID NO: 2228065 - RNA, 23 nt, Homo sapiens
augaagcccguguccugccuuga

SEQ ID NO: 2228066 - RNA, 12 nt, Homo sapiens
caugucuuuacu

SEQ ID NO: 2228067 - RNA, 18 nt, Homo sapiens
uccuuauugggacuuuuc

SEQ ID NO: 2228068 - RNA, 18 nt, Homo sapiens
ugacucuaguacugugaa

SEQ ID NO: 2228069 - RNA, 18 nt, Homo sapiens
uucaugaaauuauccaug

SEQ ID NO: 2228070 - RNA, 11 nt, Homo sapiens
uaguacuaagc

SEQ ID NO: 2228071 - RNA, 19 nt, Homo sapiens
cuggcugggccccugggga

SEQ ID NO: 2228072 - RNA, 14 nt, Homo sapiens
gccaucaaaccugg

SEQ ID NO: 2228073 - RNA, 22 nt, Homo sapiens
ccccaccugugguuuuaccugc

SEQ ID NO: 2228074 - RNA, 22 nt, Homo sapiens
ucacugagaagauugugaauau

SEQ ID NO: 2228075 - RNA, 13 nt, Homo sapiens
ggaguucucugau

SEQ ID NO: 2228076 - RNA, 18 nt, Homo sapiens
gauguaaaacugaacuuc

SEQ ID NO: 2228077 - RNA, 14 nt, Homo sapiens
gccucuugcaaugc

SEQ ID NO: 2228078 - RNA, 16 nt, Homo sapiens
ugcugauggcuugaca

SEQ ID NO: 2228079 - RNA, 19 nt, Homo sapiens
cugugcauugacaucacag

SEQ ID NO: 2228080 - RNA, 20 nt, Homo sapiens
acagaggacggcuuccccau

SEQ ID NO: 2228081 - RNA, 21 nt, Homo sapiens
auuuuuuuuuuuuuccuguca

SEQ ID NO: 2228082 - RNA, 22 nt, Homo sapiens
agcaucgggagcacccagagca

SEQ ID NO: 2228083 - RNA, 22 nt, Homo sapiens
aagaugcauuguaguuuaacca

SEQ ID NO: 2228084 - RNA, 16 nt, Homo sapiens
gcccucugcuaaagcc

SEQ ID NO: 2228085 - RNA, 20 nt, Homo sapiens
ccgcugcuuccaggcugggc

SEQ ID NO: 2228086 - RNA, 16 nt, Homo sapiens
cucuuguccuagcuug

SEQ ID NO: 2228087 - RNA, 16 nt, Homo sapiens
caaaaaggcauaugca

SEQ ID NO: 2228088 - RNA, 12 nt, Homo sapiens
aaaguauuguaa

SEQ ID NO: 2228089 - RNA, 11 nt, Homo sapiens
cucaugacagc

SEQ ID NO: 2228090 - RNA, 13 nt, Homo sapiens
aggaauccuggac

SEQ ID NO: 2228091 - RNA, 15 nt, Homo sapiens
agaggaaaaggcuug

SEQ ID NO: 2228092 - RNA, 17 nt, Homo sapiens
cugagacuuggcuccac

SEQ ID NO: 2228093 - RNA, 16 nt, Homo sapiens
agaaucccccaaagaa

SEQ ID NO: 2228094 - RNA, 17 nt, Homo sapiens
cuuggagccacugggau

SEQ ID NO: 2228095 - RNA, 13 nt, Homo sapiens
gcugaagccacac

SEQ ID NO: 2228096 - RNA, 23 nt, Homo sapiens
gcaaagugccuugcucauuugaa

SEQ ID NO: 2228097 - RNA, 22 nt, Homo sapiens
uuugcuggguuguuuaccgagc

SEQ ID NO: 2228098 - RNA, 22 nt, Homo sapiens
caacaauuauuugaagauuuaa

SEQ ID NO: 2228099 - RNA, 21 nt, Homo sapiens
accacuaagagaauacaggaa

SEQ ID NO: 2228100 - RNA, 18 nt, Homo sapiens
ugucagaauaaagaacau

SEQ ID NO: 2228101 - RNA, 13 nt, Homo sapiens
aaccaaccucccc

SEQ ID NO: 2228102 - RNA, 21 nt, Homo sapiens
aggacuuccauuugcuuuguc

SEQ ID NO: 2228103 - RNA, 15 nt, Homo sapiens
agguuggacuggaaa

SEQ ID NO: 2228104 - RNA, 14 nt, Homo sapiens
ugaucaaugaauaa

SEQ ID NO: 2228105 - RNA, 22 nt, Homo sapiens
aagcuucgugaggcccucacca

SEQ ID NO: 2228106 - RNA, 20 nt, Homo sapiens
ugccuauuuuaauaaacacu

SEQ ID NO: 2228107 - RNA, 15 nt, Homo sapiens
accguucaccaguug

SEQ ID NO: 2228108 - RNA, 21 nt, Homo sapiens
uggcuguuguauuaccaaagc

SEQ ID NO: 2228109 - RNA, 23 nt, Homo sapiens
uuugucauuuugaaauacuuaau

SEQ ID NO: 2228110 - RNA, 22 nt, Homo sapiens
ugucccaggcagcgccacuguc

SEQ ID NO: 2228111 - RNA, 19 nt, Homo sapiens
aacugauuuccauccaaac

SEQ ID NO: 2228112 - RNA, 18 nt, Homo sapiens
caaccaauuuacacugcc

SEQ ID NO: 2228113 - RNA, 16 nt, Homo sapiens
ugcaaguuacugcagu

SEQ ID NO: 2228114 - RNA, 17 nt, Homo sapiens
guauggaauacaaugua

SEQ ID NO: 2228115 - RNA, 12 nt, Homo sapiens
uucaaagcuaaa

SEQ ID NO: 2228116 - RNA, 20 nt, Homo sapiens
uuauugguuguuguauugau

SEQ ID NO: 2228117 - RNA, 15 nt, Homo sapiens
acauggacagaauuu

SEQ ID NO: 2228118 - RNA, 16 nt, Homo sapiens
gugacacucauuuuag

SEQ ID NO: 2228119 - RNA, 15 nt, Homo sapiens
aguuuaacguauauu

SEQ ID NO: 2228120 - RNA, 15 nt, Homo sapiens
uguuccuucugugaa

SEQ ID NO: 2228121 - RNA, 16 nt, Homo sapiens
cacaugacauccacau

SEQ ID NO: 2228122 - RNA, 20 nt, Homo sapiens
cuguguuucagccacacuga

SEQ ID NO: 2228123 - RNA, 18 nt, Homo sapiens
uacaacagugcauuuaca

SEQ ID NO: 2228124 - RNA, 15 nt, Homo sapiens
uuuaaauccuuccau

SEQ ID NO: 2228125 - RNA, 23 nt, Homo sapiens
gaauccgagauaggguggcacau

SEQ ID NO: 2228126 - RNA, 23 nt, Homo sapiens
ccacuguugguauuauauaauuc

SEQ ID NO: 2228127 - RNA, 13 nt, Homo sapiens
aaaccccgucucu

SEQ ID NO: 2228128 - RNA, 15 nt, Homo sapiens
uaccugccuguucuc

SEQ ID NO: 2228129 - RNA, 16 nt, Homo sapiens
uccugcuuauucauaa

SEQ ID NO: 2228130 - RNA, 23 nt, Homo sapiens
ggaucuucccacaggagggccag

SEQ ID NO: 2228131 - RNA, 13 nt, Homo sapiens
ucauacaugcaua

SEQ ID NO: 2228132 - RNA, 13 nt, Homo sapiens
uaaggcaugaagg

SEQ ID NO: 2228133 - RNA, 14 nt, Homo sapiens
cuuccuuuacuuuc

SEQ ID NO: 2228134 - RNA, 20 nt, Homo sapiens
guaaagaacguggucagagu

SEQ ID NO: 2228135 - RNA, 13 nt, Homo sapiens
uccaaggcuuuaa

SEQ ID NO: 2228136 - RNA, 23 nt, Homo sapiens
cucccaggugagaauucaggcaa

SEQ ID NO: 2228137 - RNA, 13 nt, Homo sapiens
gcaaacaugccag

SEQ ID NO: 2228138 - RNA, 23 nt, Homo sapiens
cuccucaggcccagcugcucccc

SEQ ID NO: 2228139 - RNA, 15 nt, Homo sapiens
cacauugcuaccuca

SEQ ID NO: 2228140 - RNA, 17 nt, Homo sapiens
aaggccaauaauaaaga

SEQ ID NO: 2228141 - RNA, 20 nt, Homo sapiens
cccaagccuggcaagggaau

SEQ ID NO: 2228142 - RNA, 14 nt, Homo sapiens
acuugacaggguuu

SEQ ID NO: 2228143 - RNA, 19 nt, Homo sapiens
uuagaguguaggugaaaug

SEQ ID NO: 2228144 - RNA, 20 nt, Homo sapiens
uggggaggccuauuccugcu

SEQ ID NO: 2228145 - RNA, 17 nt, Homo sapiens
gaaagaaguuauauucu

SEQ ID NO: 2228146 - RNA, 21 nt, Homo sapiens
cuuagccauuuuucaaagcaa

SEQ ID NO: 2228147 - RNA, 12 nt, Homo sapiens
ccuaugccuguc

SEQ ID NO: 2228148 - RNA, 17 nt, Homo sapiens
ugaucccuagcugugac

SEQ ID NO: 2228149 - RNA, 21 nt, Homo sapiens
gaaauuuuaucucuucuuccu

SEQ ID NO: 2228150 - RNA, 15 nt, Homo sapiens
agagaaaacuucaga

SEQ ID NO: 2228151 - RNA, 18 nt, Homo sapiens
acaaacuauauauaauca

SEQ ID NO: 2228152 - RNA, 22 nt, Homo sapiens
augugaauaaauucuauaggaa

SEQ ID NO: 2228153 - RNA, 13 nt, Homo sapiens
gaaauaauguucu

SEQ ID NO: 2228154 - RNA, 23 nt, Homo sapiens
cagaaauaacagcuggggacaac

SEQ ID NO: 2228155 - RNA, 18 nt, Homo sapiens
cacuaggguccaccagga

SEQ ID NO: 2228156 - RNA, 20 nt, Homo sapiens
acuugggacggaaguggccu

SEQ ID NO: 2228157 - RNA, 21 nt, Homo sapiens
gaauccaucaggacuugggaa

SEQ ID NO: 2228158 - RNA, 15 nt, Homo sapiens
gaaagauaauucacu

SEQ ID NO: 2228159 - RNA, 16 nt, Homo sapiens
uuauuaaacguaugca

SEQ ID NO: 2228160 - RNA, 22 nt, Homo sapiens
aacaacccuguugaguauuugc

SEQ ID NO: 2228161 - RNA, 14 nt, Homo sapiens
cugggggaugcaaa

SEQ ID NO: 2228162 - RNA, 17 nt, Homo sapiens
uacacaaugcaucauaa

SEQ ID NO: 2228163 - RNA, 17 nt, Homo sapiens
uugacuuuguucacagc

SEQ ID NO: 2228164 - RNA, 13 nt, Homo sapiens
gcccccagccugu

SEQ ID NO: 2228165 - RNA, 17 nt, Homo sapiens
cuuucuuagauucucuu

SEQ ID NO: 2228166 - RNA, 20 nt, Homo sapiens
acccuggaucaguccuuuga

SEQ ID NO: 2228167 - RNA, 12 nt, Homo sapiens
uccaaaccucaa

SEQ ID NO: 2228168 - RNA, 14 nt, Homo sapiens
uggagcuacuuuaa

SEQ ID NO: 2228169 - RNA, 19 nt, Homo sapiens
aggcucauggcccuguagu

SEQ ID NO: 2228170 - RNA, 21 nt, Homo sapiens
auuucaugggacuaaaugaac

SEQ ID NO: 2228171 - RNA, 15 nt, Homo sapiens
gcaacaguuaucaca

SEQ ID NO: 2228172 - RNA, 17 nt, Homo sapiens
agauucacaugcuggcu

SEQ ID NO: 2228173 - RNA, 13 nt, Homo sapiens
cacgcugaaggcu

SEQ ID NO: 2228174 - RNA, 20 nt, Homo sapiens
augagacaauuuugcuucac

SEQ ID NO: 2228175 - RNA, 20 nt, Homo sapiens
gaaacucaccacaguguuuu

SEQ ID NO: 2228176 - RNA, 19 nt, Homo sapiens
agcuggggaugucucucau

SEQ ID NO: 2228177 - RNA, 19 nt, Homo sapiens
ugcaauugacauaggcaau

SEQ ID NO: 2228178 - RNA, 16 nt, Homo sapiens
aguucuuguucuucag

SEQ ID NO: 2228179 - RNA, 23 nt, Homo sapiens
agauggccgggacaugcagcucu

SEQ ID NO: 2228180 - RNA, 21 nt, Homo sapiens
gguaccugguccccacugcug

SEQ ID NO: 2228181 - RNA, 23 nt, Homo sapiens
ugcaugaauguaaucaacauucc

SEQ ID NO: 2228182 - RNA, 17 nt, Homo sapiens
aaacuuucaccucagau

SEQ ID NO: 2228183 - RNA, 23 nt, Homo sapiens
guuucccuaucugcaaaauggga

SEQ ID NO: 2228184 - RNA, 14 nt, Homo sapiens
aaaucuaccaagaa

SEQ ID NO: 2228185 - RNA, 18 nt, Homo sapiens
acuggcaguaaccuagug

SEQ ID NO: 2228186 - RNA, 15 nt, Homo sapiens
ucuauauguaacuuc

SEQ ID NO: 2228187 - RNA, 16 nt, Homo sapiens
ccaaagagaaugcccu

SEQ ID NO: 2228188 - RNA, 14 nt, Homo sapiens
auagagcccaguga

SEQ ID NO: 2228189 - RNA, 15 nt, Homo sapiens
ccacguuuaacacaa

SEQ ID NO: 2228190 - RNA, 15 nt, Homo sapiens
uaaaaguaaugcaau

SEQ ID NO: 2228191 - RNA, 18 nt, Homo sapiens
gacauuguaugcagggag

SEQ ID NO: 2228192 - RNA, 18 nt, Homo sapiens
auccagugugagauacug

SEQ ID NO: 2228193 - RNA, 15 nt, Homo sapiens
gaucuccugaccucg

SEQ ID NO: 2228194 - RNA, 14 nt, Homo sapiens
ugguuuuauuucaa

SEQ ID NO: 2228195 - RNA, 15 nt, Homo sapiens
cuuuuaucucacaaa

SEQ ID NO: 2228196 - RNA, 17 nt, Homo sapiens
auuaaagguauuccuug

SEQ ID NO: 2228197 - RNA, 15 nt, Homo sapiens
auuugauuugugcuc

SEQ ID NO: 2228198 - RNA, 22 nt, Homo sapiens
aucuugcucucggugcuuccaa

SEQ ID NO: 2228199 - RNA, 14 nt, Homo sapiens
cuuccuaccaaaua

SEQ ID NO: 2228200 - RNA, 17 nt, Homo sapiens
gagacugguuagugaug

SEQ ID NO: 2228201 - RNA, 17 nt, Homo sapiens
ugagucuguuugaaaug

SEQ ID NO: 2228202 - RNA, 13 nt, Homo sapiens
guacucugagucc

SEQ ID NO: 2228203 - RNA, 16 nt, Homo sapiens
cuaccaaauagugauu

SEQ ID NO: 2228204 - RNA, 22 nt, Homo sapiens
agguuggugaauuucacaagcu

SEQ ID NO: 2228205 - RNA, 21 nt, Homo sapiens
ugaggggaauagauuaccuga

SEQ ID NO: 2228206 - RNA, 14 nt, Homo sapiens
caggucuugacuca

SEQ ID NO: 2228207 - RNA, 16 nt, Homo sapiens
uuuucagacugcuuua

SEQ ID NO: 2228208 - RNA, 20 nt, Homo sapiens
cugcaacuacuauccaacuu

SEQ ID NO: 2228209 - RNA, 20 nt, Homo sapiens
aucuggagccugaugucuua

SEQ ID NO: 2228210 - RNA, 14 nt, Homo sapiens
caaaucaucucuca

SEQ ID NO: 2228211 - RNA, 18 nt, Homo sapiens
cccauguguccuggugag

SEQ ID NO: 2228212 - RNA, 18 nt, Homo sapiens
uaaaacccacaagugucu

SEQ ID NO: 2228213 - RNA, 19 nt, Homo sapiens
ugaaacaugaacccaaaaa

SEQ ID NO: 2228214 - RNA, 15 nt, Homo sapiens
ccuuaaaaaucacac

SEQ ID NO: 2228215 - RNA, 16 nt, Homo sapiens
gcaaguuuccaucauc

SEQ ID NO: 2228216 - RNA, 14 nt, Homo sapiens
guuacuugaaauaa

SEQ ID NO: 2228217 - RNA, 15 nt, Homo sapiens
uuuaaaagcaucuca

SEQ ID NO: 2228218 - RNA, 19 nt, Homo sapiens
cauccugaaguuugcauua

SEQ ID NO: 2228219 - RNA, 18 nt, Homo sapiens
cugucuucuccuaauucu

SEQ ID NO: 2228220 - RNA, 21 nt, Homo sapiens
auggugagagauaagaucuau

SEQ ID NO: 2228221 - RNA, 19 nt, Homo sapiens
gaaucuguaaagaaauaua

SEQ ID NO: 2228222 - RNA, 17 nt, Homo sapiens
gcgugaguauguguaug

SEQ ID NO: 2228223 - RNA, 23 nt, Homo sapiens
cucugauggcacuuuugagcucc

SEQ ID NO: 2228224 - RNA, 21 nt, Homo sapiens
uuggucacaugugacaugucu

SEQ ID NO: 2228225 - RNA, 15 nt, Homo sapiens
uccuaggugcuauuu

SEQ ID NO: 2228226 - RNA, 22 nt, Homo sapiens
uguugacucuaguacugugaau

SEQ ID NO: 2228227 - RNA, 21 nt, Homo sapiens
ugacccagggacucuccaaac

SEQ ID NO: 2228228 - RNA, 23 nt, Homo sapiens
aauauaggauuggugaccaauug

SEQ ID NO: 2228229 - RNA, 19 nt, Homo sapiens
ggccaacugccuccuugcc

SEQ ID NO: 2228230 - RNA, 21 nt, Homo sapiens
cagguugccucucacaaugaa

SEQ ID NO: 2228231 - RNA, 17 nt, Homo sapiens
agccucagaugauuucc

SEQ ID NO: 2228232 - RNA, 15 nt, Homo sapiens
gacugccccuugcuu

SEQ ID NO: 2228233 - RNA, 19 nt, Homo sapiens
caugccacccuguuuucag

SEQ ID NO: 2228234 - RNA, 13 nt, Homo sapiens
caaagacucugag

SEQ ID NO: 2228235 - RNA, 14 nt, Homo sapiens
cccuggagcaagac

SEQ ID NO: 2228236 - RNA, 15 nt, Homo sapiens
caguaaaaauaaaua

SEQ ID NO: 2228237 - RNA, 14 nt, Homo sapiens
cauugaucugggau

SEQ ID NO: 2228238 - RNA, 15 nt, Homo sapiens
ucuguuucaauguau

SEQ ID NO: 2228239 - RNA, 20 nt, Homo sapiens
augucacuucccugcuuaaa

SEQ ID NO: 2228240 - RNA, 10 nt, Homo sapiens
gaugccuuga

SEQ ID NO: 2228241 - RNA, 14 nt, Homo sapiens
caucaauacaacca

SEQ ID NO: 2228242 - RNA, 14 nt, Homo sapiens
ccagacuaccugcc

SEQ ID NO: 2228243 - RNA, 20 nt, Homo sapiens
agaacauaaaaaauaaagua

SEQ ID NO: 2228244 - RNA, 22 nt, Homo sapiens
guccuucaaguuagcucaggag

SEQ ID NO: 2228245 - RNA, 19 nt, Homo sapiens
aaauaaggaugacuuuaga

SEQ ID NO: 2228246 - RNA, 17 nt, Homo sapiens
ugucuuaaggcaucuga

SEQ ID NO: 2228247 - RNA, 18 nt, Homo sapiens
gggauugucccuguguug

SEQ ID NO: 2228248 - RNA, 12 nt, Homo sapiens
cuuccaccucac

SEQ ID NO: 2228249 - RNA, 17 nt, Homo sapiens
uuuguaggagacuugcc

SEQ ID NO: 2228250 - RNA, 14 nt, Homo sapiens
guuccuagccaccg

SEQ ID NO: 2228251 - RNA, 17 nt, Homo sapiens
uauccaaagacuguacu

SEQ ID NO: 2228252 - RNA, 20 nt, Homo sapiens
ugauguuuguguauguggga

SEQ ID NO: 2228253 - RNA, 18 nt, Homo sapiens
ucgaaaggugcagcugcg

SEQ ID NO: 2228254 - RNA, 21 nt, Homo sapiens
uuagcaauuuccgccugguga

SEQ ID NO: 2228255 - RNA, 15 nt, Homo sapiens
agcauggcugagaaa

SEQ ID NO: 2228256 - RNA, 16 nt, Homo sapiens
caaaugccugacucag

SEQ ID NO: 2228257 - RNA, 18 nt, Homo sapiens
aggcugccccucucacca

SEQ ID NO: 2228258 - RNA, 15 nt, Homo sapiens
gauuuaacugugaac

SEQ ID NO: 2228259 - RNA, 23 nt, Homo sapiens
acucccuucucguguuugcuuaa

SEQ ID NO: 2228260 - RNA, 11 nt, Homo sapiens
cucuugcuaau

SEQ ID NO: 2228261 - RNA, 21 nt, Homo sapiens
ccagggcccacuagcauccac

SEQ ID NO: 2228262 - RNA, 20 nt, Homo sapiens
acuuucauugccagugucuu

SEQ ID NO: 2228263 - RNA, 19 nt, Homo sapiens
uagaguccagaucuugccu

SEQ ID NO: 2228264 - RNA, 22 nt, Homo sapiens
acuuccuuugacuuucugugua

SEQ ID NO: 2228265 - RNA, 18 nt, Homo sapiens
acucaugaagcauacccc

SEQ ID NO: 2228266 - RNA, 20 nt, Homo sapiens
cacaguggcggcaacauuga

SEQ ID NO: 2228267 - RNA, 23 nt, Homo sapiens
uguaagaucguucucugccucac

SEQ ID NO: 2228268 - RNA, 23 nt, Homo sapiens
ucaguugagagggugcaguccag

SEQ ID NO: 2228269 - RNA, 15 nt, Homo sapiens
auauuagugcagcca

SEQ ID NO: 2228270 - RNA, 23 nt, Homo sapiens
aaccuauuuaaaacagugaauua

SEQ ID NO: 2228271 - RNA, 19 nt, Homo sapiens
cugucuuauuaagacuggc

SEQ ID NO: 2228272 - RNA, 13 nt, Homo sapiens
gacuauuacauau

SEQ ID NO: 2228273 - RNA, 18 nt, Homo sapiens
ugccgggcccccaccgcc

SEQ ID NO: 2228274 - RNA, 19 nt, Homo sapiens
ucaacuaauguuguuuaca

SEQ ID NO: 2228275 - RNA, 17 nt, Homo sapiens
gcuuuaaaucuaucuau

SEQ ID NO: 2228276 - RNA, 17 nt, Homo sapiens
ccauuuguuaacuguac

SEQ ID NO: 2228277 - RNA, 21 nt, Homo sapiens
gaauauaccauuucaaauauu

SEQ ID NO: 2228278 - RNA, 20 nt, Homo sapiens
aagauuccuuuccacuccaa

SEQ ID NO: 2228279 - RNA, 18 nt, Homo sapiens
cagaauuaaagaccuauu

SEQ ID NO: 2228280 - RNA, 13 nt, Homo sapiens
auuauuuguuacg

SEQ ID NO: 2228281 - RNA, 15 nt, Homo sapiens
uaguuagcuauuucu

SEQ ID NO: 2228282 - RNA, 17 nt, Homo sapiens
aacauaacuguaacaua

SEQ ID NO: 2228283 - RNA, 18 nt, Homo sapiens
augaauuugacugguuca

SEQ ID NO: 2228284 - RNA, 14 nt, Homo sapiens
auaguuaagacaug

SEQ ID NO: 2228285 - RNA, 16 nt, Homo sapiens
cugccacuuugcacau

SEQ ID NO: 2228286 - RNA, 21 nt, Homo sapiens
cagaggcugggugacaugugu

SEQ ID NO: 2228287 - RNA, 18 nt, Homo sapiens
uaaaaaacggauuuccuc

SEQ ID NO: 2228288 - RNA, 16 nt, Homo sapiens
ucaggaugagaacaca

SEQ ID NO: 2228289 - RNA, 19 nt, Homo sapiens
uuuaaaaugaaaugcauuu

SEQ ID NO: 2228290 - RNA, 19 nt, Homo sapiens
cuaggagcugggaggaaaa

SEQ ID NO: 2228291 - RNA, 16 nt, Homo sapiens
auucgaaugacacugu

SEQ ID NO: 2228292 - RNA, 23 nt, Homo sapiens
gaccuaacugccgcucagagugu

SEQ ID NO: 2228293 - RNA, 21 nt, Homo sapiens
ugagacuccccaauaccuaau

SEQ ID NO: 2228294 - RNA, 16 nt, Homo sapiens
acccuaaaucuugacu

SEQ ID NO: 2228295 - RNA, 12 nt, Homo sapiens
caccccugaguu

SEQ ID NO: 2228296 - RNA, 18 nt, Homo sapiens
ugagaggggaacagacug

SEQ ID NO: 2228297 - RNA, 17 nt, Homo sapiens
agccgugaugcucaggc

SEQ ID NO: 2228298 - RNA, 14 nt, Homo sapiens
acuuuaucacuuaa

SEQ ID NO: 2228299 - RNA, 18 nt, Homo sapiens
uaccacaaacccugcuga

SEQ ID NO: 2228300 - RNA, 17 nt, Homo sapiens
aaugcaguccagugaga

SEQ ID NO: 2228301 - RNA, 20 nt, Homo sapiens
cagaugcugagccaacugcu

SEQ ID NO: 2228302 - RNA, 18 nt, Homo sapiens
auccauaaauguguuccu

SEQ ID NO: 2228303 - RNA, 16 nt, Homo sapiens
cacccaucuuccugcu

SEQ ID NO: 2228304 - RNA, 21 nt, Homo sapiens
agacgcaaggaucacuugagc

SEQ ID NO: 2228305 - RNA, 18 nt, Homo sapiens
uacaagugcagcugugac

SEQ ID NO: 2228306 - RNA, 19 nt, Homo sapiens
aagcaaaauuauguuugcc

SEQ ID NO: 2228307 - RNA, 12 nt, Homo sapiens
agaaacacucaa

SEQ ID NO: 2228308 - RNA, 23 nt, Homo sapiens
augcuucuagggaccagcaauac

SEQ ID NO: 2228309 - RNA, 13 nt, Homo sapiens
gcccccuugcccu

SEQ ID NO: 2228310 - RNA, 13 nt, Homo sapiens
ccuuucuuccuuc

SEQ ID NO: 2228311 - RNA, 16 nt, Homo sapiens
auauuuuacuuuuaca

SEQ ID NO: 2228312 - RNA, 17 nt, Homo sapiens
caggugaucuaccugcc

SEQ ID NO: 2228313 - RNA, 16 nt, Homo sapiens
aagaaccagacugugu

SEQ ID NO: 2228314 - RNA, 13 nt, Homo sapiens
cugaaaccauccg

SEQ ID NO: 2228315 - RNA, 13 nt, Homo sapiens
agauaaaugugcu

SEQ ID NO: 2228316 - RNA, 13 nt, Homo sapiens
ugcuugcacuuug

SEQ ID NO: 2228317 - RNA, 21 nt, Homo sapiens
cacggacucaaguuucuucaa

SEQ ID NO: 2228318 - RNA, 13 nt, Homo sapiens
agcgucugcucau

SEQ ID NO: 2228319 - RNA, 15 nt, Homo sapiens
aaaccgagugcaaug

SEQ ID NO: 2228320 - RNA, 19 nt, Homo sapiens
accugcucuccucuugcca

SEQ ID NO: 2228321 - RNA, 22 nt, Homo sapiens
uaacaaacaucacucugcugcu

SEQ ID NO: 2228322 - RNA, 23 nt, Homo sapiens
uuggaaugcaugccaguaaugua

SEQ ID NO: 2228323 - RNA, 16 nt, Homo sapiens
cugcgugacauauacu

SEQ ID NO: 2228324 - RNA, 13 nt, Homo sapiens
acugcccuuccag

SEQ ID NO: 2228325 - RNA, 11 nt, Homo sapiens
cugaccaaaac

SEQ ID NO: 2228326 - RNA, 20 nt, Homo sapiens
augaagaaguuucuaaaaac

SEQ ID NO: 2228327 - RNA, 23 nt, Homo sapiens
cucccaucccguaagaccaccuu

SEQ ID NO: 2228328 - RNA, 21 nt, Homo sapiens
agccuucuucccccagggucc

SEQ ID NO: 2228329 - RNA, 20 nt, Homo sapiens
agaugaauguagcagauccc

SEQ ID NO: 2228330 - RNA, 20 nt, Homo sapiens
uagcuuccccaccagcuuua

SEQ ID NO: 2228331 - RNA, 15 nt, Homo sapiens
cuggguggguggugg

SEQ ID NO: 2228332 - RNA, 15 nt, Homo sapiens
acuacugccauuuca

SEQ ID NO: 2228333 - RNA, 15 nt, Homo sapiens
gacacuauguagucu

SEQ ID NO: 2228334 - RNA, 13 nt, Homo sapiens
acugucacuuugc

SEQ ID NO: 2228335 - RNA, 18 nt, Homo sapiens
caaggccucccacaguga

SEQ ID NO: 2228336 - RNA, 18 nt, Homo sapiens
ggggcaggcugggccaug

SEQ ID NO: 2228337 - RNA, 15 nt, Homo sapiens
ccugagaugguccca

SEQ ID NO: 2228338 - RNA, 20 nt, Homo sapiens
ucuuuauauauggacagcuu

SEQ ID NO: 2228339 - RNA, 23 nt, Homo sapiens
auucucaugccucauccucccaa

SEQ ID NO: 2228340 - RNA, 11 nt, Homo sapiens
gucacugucuu

SEQ ID NO: 2228341 - RNA, 19 nt, Homo sapiens
uauuguaacagacauuguu

SEQ ID NO: 2228342 - RNA, 14 nt, Homo sapiens
agucugcugcugug

SEQ ID NO: 2228343 - RNA, 13 nt, Homo sapiens
ccugaggugggag

SEQ ID NO: 2228344 - RNA, 19 nt, Homo sapiens
acugguaggaaacuaggug

SEQ ID NO: 2228345 - RNA, 14 nt, Homo sapiens
cuuagauguuaaau

SEQ ID NO: 2228346 - RNA, 18 nt, Homo sapiens
auuuuuaaaacagauauu

SEQ ID NO: 2228347 - RNA, 13 nt, Homo sapiens
acuucacuuucau

SEQ ID NO: 2228348 - RNA, 13 nt, Homo sapiens
uuaaacacuuuaa

SEQ ID NO: 2228349 - RNA, 13 nt, Homo sapiens
ugagccacugugc

SEQ ID NO: 2228350 - RNA, 13 nt, Homo sapiens
acacacacacuca

SEQ ID NO: 2228351 - RNA, 13 nt, Homo sapiens
ugugacuuuccua

SEQ ID NO: 2228352 - RNA, 17 nt, Homo sapiens
gccaacucacugaacua

SEQ ID NO: 2228353 - RNA, 18 nt, Homo sapiens
aaucuccauuucugcuca

SEQ ID NO: 2228354 - RNA, 20 nt, Homo sapiens
cauauuuugacccaagugga

SEQ ID NO: 2228355 - RNA, 15 nt, Homo sapiens
uggacgcacacagcu

SEQ ID NO: 2228356 - RNA, 22 nt, Homo sapiens
gccugggggcugggcagaggaa

SEQ ID NO: 2228357 - RNA, 15 nt, Homo sapiens
acagcacaucaccuc

SEQ ID NO: 2228358 - RNA, 23 nt, Homo sapiens
guuucugagcauaaugcucccau

SEQ ID NO: 2228359 - RNA, 13 nt, Homo sapiens
aaguaugagggaa

SEQ ID NO: 2228360 - RNA, 22 nt, Homo sapiens
cccgggagaggagaucagggcg

SEQ ID NO: 2228361 - RNA, 23 nt, Homo sapiens
uaacucugggaggggcucgagag

SEQ ID NO: 2228362 - RNA, 18 nt, Homo sapiens
aagaugaguaaaacuggu

SEQ ID NO: 2228363 - RNA, 14 nt, Homo sapiens
auuaguaacauuca

SEQ ID NO: 2228364 - RNA, 14 nt, Homo sapiens
cucuguaaaacaca

SEQ ID NO: 2228365 - RNA, 21 nt, Homo sapiens
uucccaaauacauuaacaagc

SEQ ID NO: 2228366 - RNA, 16 nt, Homo sapiens
ccaccagguacucuuu

SEQ ID NO: 2228367 - RNA, 18 nt, Homo sapiens
cuaaucccaacaagcaag

SEQ ID NO: 2228368 - RNA, 21 nt, Homo sapiens
accaguccgccgcugcacauc

SEQ ID NO: 2228369 - RNA, 18 nt, Homo sapiens
ccucuuuccugugccagg

SEQ ID NO: 2228370 - RNA, 21 nt, Homo sapiens
ucacccaggcuggagugcaau

SEQ ID NO: 2228371 - RNA, 14 nt, Homo sapiens
aggucagccuggaa

SEQ ID NO: 2228372 - RNA, 13 nt, Homo sapiens
cuuggauguauau

SEQ ID NO: 2228373 - RNA, 22 nt, Homo sapiens
aacucugcaacugaauacuuga

SEQ ID NO: 2228374 - RNA, 15 nt, Homo sapiens
ccaugaaaaugcaac

SEQ ID NO: 2228375 - RNA, 18 nt, Homo sapiens
guaugcauucacauuuag

SEQ ID NO: 2228376 - RNA, 15 nt, Homo sapiens
agaaauccaauugga

SEQ ID NO: 2228377 - RNA, 18 nt, Homo sapiens
ucaccagccccacugcca

SEQ ID NO: 2228378 - RNA, 17 nt, Homo sapiens
ugcuuuucacugcugca

SEQ ID NO: 2228379 - RNA, 22 nt, Homo sapiens
acuguauauucaggacuugaaa

SEQ ID NO: 2228380 - RNA, 14 nt, Homo sapiens
auuagugcagccaa

SEQ ID NO: 2228381 - RNA, 18 nt, Homo sapiens
aacccagcucacaggagc

SEQ ID NO: 2228382 - RNA, 23 nt, Homo sapiens
aagaguccuacagauggacugaa

SEQ ID NO: 2228383 - RNA, 13 nt, Homo sapiens
gaaaguacuauga

SEQ ID NO: 2228384 - RNA, 13 nt, Homo sapiens
auuuuuuacuuga

SEQ ID NO: 2228385 - RNA, 22 nt, Homo sapiens
gcauucacaccaccccccaugc

SEQ ID NO: 2228386 - RNA, 22 nt, Homo sapiens
aaagaggacaggcuaccccuuu

SEQ ID NO: 2228387 - RNA, 22 nt, Homo sapiens
auaacauuuaaauuccacagau

SEQ ID NO: 2228388 - RNA, 23 nt, Homo sapiens
uuaaaaaaaaaaaguacaauuca

SEQ ID NO: 2228389 - RNA, 13 nt, Homo sapiens
aauaucauuucau

SEQ ID NO: 2228390 - RNA, 23 nt, Homo sapiens
agcgugaggagcgaucucagcag

SEQ ID NO: 2228391 - RNA, 17 nt, Homo sapiens
auguuacgugugcaaca

SEQ ID NO: 2228392 - RNA, 13 nt, Homo sapiens
cuguaaauuuggc

SEQ ID NO: 2228393 - RNA, 13 nt, Homo sapiens
gaaagugccaaaa

SEQ ID NO: 2228394 - RNA, 15 nt, Homo sapiens
cagaggacacaggca

SEQ ID NO: 2228395 - RNA, 21 nt, Homo sapiens
aagccagucuuaacauuucua

SEQ ID NO: 2228396 - RNA, 22 nt, Homo sapiens
auuuuuauagauuugaccuaca

SEQ ID NO: 2228397 - RNA, 15 nt, Homo sapiens
agaagacaaacuuug

SEQ ID NO: 2228398 - RNA, 14 nt, Homo sapiens
ggcauugacagcug

SEQ ID NO: 2228399 - RNA, 19 nt, Homo sapiens
caccugcccugcugagucc

SEQ ID NO: 2228400 - RNA, 22 nt, Homo sapiens
ucuaauuagagaacuggaggaa

SEQ ID NO: 2228401 - RNA, 13 nt, Homo sapiens
aauccaugguguu

SEQ ID NO: 2228402 - RNA, 14 nt, Homo sapiens
uaaauuaucugaau

SEQ ID NO: 2228403 - RNA, 16 nt, Homo sapiens
aauauuaacuacagaa

SEQ ID NO: 2228404 - RNA, 12 nt, Homo sapiens
gagacugaguca

SEQ ID NO: 2228405 - RNA, 14 nt, Homo sapiens
uuauuuccugagaa

SEQ ID NO: 2228406 - RNA, 19 nt, Homo sapiens
ucaccuugggaugaugccu

SEQ ID NO: 2228407 - RNA, 15 nt, Homo sapiens
agcauaugugagaaa

SEQ ID NO: 2228408 - RNA, 13 nt, Homo sapiens
augaaggggccag

SEQ ID NO: 2228409 - RNA, 23 nt, Homo sapiens
agcuuuuuaauuaaaugaagcca

SEQ ID NO: 2228410 - RNA, 19 nt, Homo sapiens
gccauacuucuguuuccau

SEQ ID NO: 2228411 - RNA, 20 nt, Homo sapiens
uuaauuauaccccaugauac

SEQ ID NO: 2228412 - RNA, 18 nt, Homo sapiens
agggagugcacauaucca

SEQ ID NO: 2228413 - RNA, 21 nt, Homo sapiens
ucugcucaggaguucugugag

SEQ ID NO: 2228414 - RNA, 11 nt, Homo sapiens
aaaaaacugga

SEQ ID NO: 2228415 - RNA, 18 nt, Homo sapiens
cuguguaccacugggaua

SEQ ID NO: 2228416 - RNA, 23 nt, Homo sapiens
aucaaacguguuauauuccauac

SEQ ID NO: 2228417 - RNA, 19 nt, Homo sapiens
acgaggcaggggcucugcu

SEQ ID NO: 2228418 - RNA, 22 nt, Homo sapiens
aauucuggcugcgggucucaga

SEQ ID NO: 2228419 - RNA, 21 nt, Homo sapiens
ucccuuaaagauuuucugcuu

SEQ ID NO: 2228420 - RNA, 14 nt, Homo sapiens
acagagaucagaau

SEQ ID NO: 2228421 - RNA, 20 nt, Homo sapiens
cuagaaggggcuaugcauau

SEQ ID NO: 2228422 - RNA, 14 nt, Homo sapiens
aauucaauccugcc

SEQ ID NO: 2228423 - RNA, 17 nt, Homo sapiens
uuccaccuccaccacau

SEQ ID NO: 2228424 - RNA, 17 nt, Homo sapiens
gcugcucucaugccugc

SEQ ID NO: 2228425 - RNA, 22 nt, Homo sapiens
gaaaauuggacauuaagcauca

SEQ ID NO: 2228426 - RNA, 22 nt, Homo sapiens
uauugaaugcauacucugugca

SEQ ID NO: 2228427 - RNA, 17 nt, Homo sapiens
agggguuaagagcucag

SEQ ID NO: 2228428 - RNA, 20 nt, Homo sapiens
agcauucaagaaacugauga

SEQ ID NO: 2228429 - RNA, 22 nt, Homo sapiens
accgcucccgcgggaagccagc

SEQ ID NO: 2228430 - RNA, 12 nt, Homo sapiens
uuauuaccucuc

SEQ ID NO: 2228431 - RNA, 18 nt, Homo sapiens
cacuugaaugugucacua

SEQ ID NO: 2228432 - RNA, 20 nt, Homo sapiens
ccuugucucuuccucugcag

SEQ ID NO: 2228433 - RNA, 20 nt, Homo sapiens
guaggcugcugcccugcugu

SEQ ID NO: 2228434 - RNA, 23 nt, Homo sapiens
ggccccacccgggagugaugguu

SEQ ID NO: 2228435 - RNA, 13 nt, Homo sapiens
auuucauaugaca

SEQ ID NO: 2228436 - RNA, 12 nt, Homo sapiens
gccagugcucag

SEQ ID NO: 2228437 - RNA, 18 nt, Homo sapiens
aagauagagaaugcccuc

SEQ ID NO: 2228438 - RNA, 15 nt, Homo sapiens
cucgggcuaggaaga

SEQ ID NO: 2228439 - RNA, 17 nt, Homo sapiens
cugagguuugcacuucc

SEQ ID NO: 2228440 - RNA, 22 nt, Homo sapiens
aaacccaguaguggugacugug

SEQ ID NO: 2228441 - RNA, 20 nt, Homo sapiens
aacaugcuaaauaguucuau

SEQ ID NO: 2228442 - RNA, 14 nt, Homo sapiens
cccaauaauucugu

SEQ ID NO: 2228443 - RNA, 16 nt, Homo sapiens
uccugaaccgacugac

SEQ ID NO: 2228444 - RNA, 13 nt, Homo sapiens
acuccggggagcg

SEQ ID NO: 2228445 - RNA, 23 nt, Homo sapiens
cuaaaaauauuaaagccucaugu

SEQ ID NO: 2228446 - RNA, 11 nt, Homo sapiens
uccucucugcu

SEQ ID NO: 2228447 - RNA, 13 nt, Homo sapiens
gucccaccaacuc

SEQ ID NO: 2228448 - RNA, 22 nt, Homo sapiens
gacaaauccuugaauguucucu

SEQ ID NO: 2228449 - RNA, 13 nt, Homo sapiens
aacacugugcacg

SEQ ID NO: 2228450 - RNA, 13 nt, Homo sapiens
aaaccugugccag

SEQ ID NO: 2228451 - RNA, 18 nt, Homo sapiens
ucaaccuuuaguacgugu

SEQ ID NO: 2228452 - RNA, 19 nt, Homo sapiens
ggcagcuucuguuggcaga

SEQ ID NO: 2228453 - RNA, 18 nt, Homo sapiens
gauacuguguucccucau

SEQ ID NO: 2228454 - RNA, 21 nt, Homo sapiens
acagaagugacugauguuccc

SEQ ID NO: 2228455 - RNA, 16 nt, Homo sapiens
cugcugaaugccgcga

SEQ ID NO: 2228456 - RNA, 15 nt, Homo sapiens
aauggaugacaaaga

SEQ ID NO: 2228457 - RNA, 14 nt, Homo sapiens
gcaggaacauugga

SEQ ID NO: 2228458 - RNA, 17 nt, Homo sapiens
caaauauuucugauacu

SEQ ID NO: 2228459 - RNA, 21 nt, Homo sapiens
ggacagauggacgcaggcccu

SEQ ID NO: 2228460 - RNA, 15 nt, Homo sapiens
ugacccagccugaaa

SEQ ID NO: 2228461 - RNA, 23 nt, Homo sapiens
aggauauugacauugauacagug

SEQ ID NO: 2228462 - RNA, 17 nt, Homo sapiens
ucaaaggccacauaccu

SEQ ID NO: 2228463 - RNA, 16 nt, Homo sapiens
acauuuaaaauucaau

SEQ ID NO: 2228464 - RNA, 16 nt, Homo sapiens
auuuuagcauauuaau

SEQ ID NO: 2228465 - RNA, 18 nt, Homo sapiens
gcagaggcggaaaccuug

SEQ ID NO: 2228466 - RNA, 20 nt, Homo sapiens
gggugcugugaggcuugccc

SEQ ID NO: 2228467 - RNA, 11 nt, Homo sapiens
gaucugugaua

SEQ ID NO: 2228468 - RNA, 19 nt, Homo sapiens
uuaucacaauguacuauau

SEQ ID NO: 2228469 - RNA, 12 nt, Homo sapiens
uaauaagacauu

SEQ ID NO: 2228470 - RNA, 22 nt, Homo sapiens
acccucagcuggcggaaccugg

SEQ ID NO: 2228471 - RNA, 15 nt, Homo sapiens
agccaggccuuccuc

SEQ ID NO: 2228472 - RNA, 18 nt, Homo sapiens
augucauauuuugccacu

SEQ ID NO: 2228473 - RNA, 20 nt, Homo sapiens
acuauggucaaaaagugaug

SEQ ID NO: 2228474 - RNA, 15 nt, Homo sapiens
caaguauaugugaaa

SEQ ID NO: 2228475 - RNA, 16 nt, Homo sapiens
ugaaacccccaucucu

SEQ ID NO: 2228476 - RNA, 14 nt, Homo sapiens
gaaacacacaguca

SEQ ID NO: 2228477 - RNA, 14 nt, Homo sapiens
gaaucacacagaca

SEQ ID NO: 2228478 - RNA, 13 nt, Homo sapiens
cagagccaugacu

SEQ ID NO: 2228479 - RNA, 20 nt, Homo sapiens
uguuucgugaacugcaguga

SEQ ID NO: 2228480 - RNA, 22 nt, Homo sapiens
agauucauaggcagcaucucag

SEQ ID NO: 2228481 - RNA, 21 nt, Homo sapiens
auucaacuuugcaaacaacag

SEQ ID NO: 2228482 - RNA, 21 nt, Homo sapiens
caauaaagauauuuccaagaa

SEQ ID NO: 2228483 - RNA, 17 nt, Homo sapiens
auugucauaucagcaca

SEQ ID NO: 2228484 - RNA, 15 nt, Homo sapiens
uuucuauuauggaaa

SEQ ID NO: 2228485 - RNA, 19 nt, Homo sapiens
uggacaaucugcaaaaugg

SEQ ID NO: 2228486 - RNA, 18 nt, Homo sapiens
acuuuauuggucuugccc

SEQ ID NO: 2228487 - RNA, 16 nt, Homo sapiens
gauaucccuuacucca

SEQ ID NO: 2228488 - RNA, 21 nt, Homo sapiens
cugacugagacacgaugccga

SEQ ID NO: 2228489 - RNA, 16 nt, Homo sapiens
agugaggggcccucca

SEQ ID NO: 2228490 - RNA, 17 nt, Homo sapiens
auuagaauauccaugac

SEQ ID NO: 2228491 - RNA, 21 nt, Homo sapiens
auuucccuaaaauacauuuaa

SEQ ID NO: 2228492 - RNA, 15 nt, Homo sapiens
aagcuuuaggaugac

SEQ ID NO: 2228493 - RNA, 15 nt, Homo sapiens
ggguccccuccagca

SEQ ID NO: 2228494 - RNA, 21 nt, Homo sapiens
uuccaaagcuuuauuaccagu

SEQ ID NO: 2228495 - RNA, 13 nt, Homo sapiens
gcccaaacauaaa

SEQ ID NO: 2228496 - RNA, 20 nt, Homo sapiens
caaaaguuaaugaauaugcc

SEQ ID NO: 2228497 - RNA, 15 nt, Homo sapiens
cuuuuguaauaucaa

SEQ ID NO: 2228498 - RNA, 23 nt, Homo sapiens
cucuuacaagacuuaguggaauu

SEQ ID NO: 2228499 - RNA, 23 nt, Homo sapiens
uaugaaaauauagacauucucac

SEQ ID NO: 2228500 - RNA, 15 nt, Homo sapiens
ucacaucugaaucuc

SEQ ID NO: 2228501 - RNA, 15 nt, Homo sapiens
ucucacaugauucca

SEQ ID NO: 2228502 - RNA, 12 nt, Homo sapiens
ugcucacauucc

SEQ ID NO: 2228503 - RNA, 17 nt, Homo sapiens
gaaggcugugagccaag

SEQ ID NO: 2228504 - RNA, 16 nt, Homo sapiens
ucugcugcucugaccu

SEQ ID NO: 2228505 - RNA, 12 nt, Homo sapiens
gcuccacagugu

SEQ ID NO: 2228506 - RNA, 15 nt, Homo sapiens
aacuguaaaugcucc

SEQ ID NO: 2228507 - RNA, 21 nt, Homo sapiens
aaagugucuuguucacugcag

SEQ ID NO: 2228508 - RNA, 16 nt, Homo sapiens
aggccuggcacgucaa

SEQ ID NO: 2228509 - RNA, 21 nt, Homo sapiens
ucaaccccaaauuuuuacgua

SEQ ID NO: 2228510 - RNA, 13 nt, Homo sapiens
uccagaagcugcu

SEQ ID NO: 2228511 - RNA, 13 nt, Homo sapiens
ugcagggccagac

SEQ ID NO: 2228512 - RNA, 23 nt, Homo sapiens
ccugcacucccuccuggagcucu

SEQ ID NO: 2228513 - RNA, 16 nt, Homo sapiens
ggccgaggcagguuga

SEQ ID NO: 2228514 - RNA, 20 nt, Homo sapiens
cacuuguucauucugugacc

SEQ ID NO: 2228515 - RNA, 10 nt, Homo sapiens
aaacagccac

SEQ ID NO: 2228516 - RNA, 15 nt, Homo sapiens
gggaccgacuuucca

SEQ ID NO: 2228517 - RNA, 22 nt, Homo sapiens
uacaaaauguacgaaacuguau

SEQ ID NO: 2228518 - RNA, 17 nt, Homo sapiens
ucagaaaauaacagaug

SEQ ID NO: 2228519 - RNA, 23 nt, Homo sapiens
cauauguaugugugaguguaugu

SEQ ID NO: 2228520 - RNA, 16 nt, Homo sapiens
augcagccgugcagga

SEQ ID NO: 2228521 - RNA, 13 nt, Homo sapiens
ggccuaccccagu

SEQ ID NO: 2228522 - RNA, 16 nt, Homo sapiens
gcaagacucugucuca

SEQ ID NO: 2228523 - RNA, 19 nt, Homo sapiens
caucuacuuagauuuaaca

SEQ ID NO: 2228524 - RNA, 23 nt, Homo sapiens
ugaaucacauuuuuuuaugcucu

SEQ ID NO: 2228525 - RNA, 20 nt, Homo sapiens
agcuugcacaacauccucag

SEQ ID NO: 2228526 - RNA, 19 nt, Homo sapiens
gauuugaagaacaugugag

SEQ ID NO: 2228527 - RNA, 21 nt, Homo sapiens
agagguuucuggcagccagua

SEQ ID NO: 2228528 - RNA, 20 nt, Homo sapiens
aaugagaaggcagccaccag

SEQ ID NO: 2228529 - RNA, 18 nt, Homo sapiens
guuaaggguuaguuuaca

SEQ ID NO: 2228530 - RNA, 12 nt, Homo sapiens
auugauauucaa

SEQ ID NO: 2228531 - RNA, 14 nt, Homo sapiens
uccaagaagccagc

SEQ ID NO: 2228532 - RNA, 15 nt, Homo sapiens
uuaaauuaagacuug

SEQ ID NO: 2228533 - RNA, 15 nt, Homo sapiens
augcuugauggaauu

SEQ ID NO: 2228534 - RNA, 17 nt, Homo sapiens
ugacauaggcaauaaua

SEQ ID NO: 2228535 - RNA, 17 nt, Homo sapiens
gucuagggugaacaauc

SEQ ID NO: 2228536 - RNA, 14 nt, Homo sapiens
auaguaauaucaau

SEQ ID NO: 2228537 - RNA, 17 nt, Homo sapiens
auuuuucgacugugaac

SEQ ID NO: 2228538 - RNA, 16 nt, Homo sapiens
ggugggugacagucau

SEQ ID NO: 2228539 - RNA, 13 nt, Homo sapiens
auagaucuuaggg

SEQ ID NO: 2228540 - RNA, 23 nt, Homo sapiens
cucaaaucuauucagacaagcaa

SEQ ID NO: 2228541 - RNA, 21 nt, Homo sapiens
uauuuguauuaauaaagcauu

SEQ ID NO: 2228542 - RNA, 20 nt, Homo sapiens
cuuuguugaaagcagaagaa

SEQ ID NO: 2228543 - RNA, 22 nt, Homo sapiens
aauuuucauacacguaaaugca

SEQ ID NO: 2228544 - RNA, 21 nt, Homo sapiens
gaaggaaggacuaugacaaau

SEQ ID NO: 2228545 - RNA, 14 nt, Homo sapiens
ugagggcagauuca

SEQ ID NO: 2228546 - RNA, 15 nt, Homo sapiens
ggccugaccaaacag

SEQ ID NO: 2228547 - RNA, 15 nt, Homo sapiens
cuuugauuccuggaa

SEQ ID NO: 2228548 - RNA, 19 nt, Homo sapiens
caauaucccaacauucugc

SEQ ID NO: 2228549 - RNA, 20 nt, Homo sapiens
ccuccccaaggaagaacaaa

SEQ ID NO: 2228550 - RNA, 20 nt, Homo sapiens
gccagguucugacucuuggc

SEQ ID NO: 2228551 - RNA, 15 nt, Homo sapiens
uucuauauccuugac

SEQ ID NO: 2228552 - RNA, 13 nt, Homo sapiens
cauucacauucag

SEQ ID NO: 2228553 - RNA, 23 nt, Homo sapiens
ucuccuaaacugaacacaugacu

SEQ ID NO: 2228554 - RNA, 16 nt, Homo sapiens
aagccucuauugccau

SEQ ID NO: 2228555 - RNA, 18 nt, Homo sapiens
auuuccagcugugcagca

SEQ ID NO: 2228556 - RNA, 13 nt, Homo sapiens
acacuucucagga

SEQ ID NO: 2228557 - RNA, 22 nt, Homo sapiens
caagcauuuagugcacaguggc

SEQ ID NO: 2228558 - RNA, 10 nt, Homo sapiens
ugacuguugc

SEQ ID NO: 2228559 - RNA, 17 nt, Homo sapiens
acguuuacuagacuuug

SEQ ID NO: 2228560 - RNA, 17 nt, Homo sapiens
aaaacuucucauuuaug

SEQ ID NO: 2228561 - RNA, 21 nt, Homo sapiens
aagacacuuuugaugacgauu

SEQ ID NO: 2228562 - RNA, 12 nt, Homo sapiens
cugcaaagccau

SEQ ID NO: 2228563 - RNA, 20 nt, Homo sapiens
cugauaaacauuaaacacug

SEQ ID NO: 2228564 - RNA, 14 nt, Homo sapiens
accuggagcugcca

SEQ ID NO: 2228565 - RNA, 18 nt, Homo sapiens
uaacuuucagaggcaaua

SEQ ID NO: 2228566 - RNA, 17 nt, Homo sapiens
aaaaugcuaaaacauga

SEQ ID NO: 2228567 - RNA, 21 nt, Homo sapiens
cagguaguuggugaacagaga

SEQ ID NO: 2228568 - RNA, 23 nt, Homo sapiens
gguggggaccuuggcagugugga

SEQ ID NO: 2228569 - RNA, 16 nt, Homo sapiens
guagauuucauugaag

SEQ ID NO: 2228570 - RNA, 15 nt, Homo sapiens
uccugucuugcugag

SEQ ID NO: 2228571 - RNA, 19 nt, Homo sapiens
ucacaaaaguauauucaaa

SEQ ID NO: 2228572 - RNA, 22 nt, Homo sapiens
aaaggucauuuacaguuccaaa

SEQ ID NO: 2228573 - RNA, 19 nt, Homo sapiens
aggaccaaagauacaugua

SEQ ID NO: 2228574 - RNA, 18 nt, Homo sapiens
agcucacugguccauuuc

SEQ ID NO: 2228575 - RNA, 15 nt, Homo sapiens
gacuaguagauuucu

SEQ ID NO: 2228576 - RNA, 18 nt, Homo sapiens
uaaauuuuguaugccaau

SEQ ID NO: 2228577 - RNA, 16 nt, Homo sapiens
uguauucacuuauaug

SEQ ID NO: 2228578 - RNA, 22 nt, Homo sapiens
acaguuguguuagccucuugcg

SEQ ID NO: 2228579 - RNA, 21 nt, Homo sapiens
caaacuacuuucuuaauauca

SEQ ID NO: 2228580 - RNA, 15 nt, Homo sapiens
aucacuucauucaca

SEQ ID NO: 2228581 - RNA, 20 nt, Homo sapiens
ugucauagaagaaaauccau

SEQ ID NO: 2228582 - RNA, 15 nt, Homo sapiens
agcacugccagugga

SEQ ID NO: 2228583 - RNA, 14 nt, Homo sapiens
uguucaauccagag

SEQ ID NO: 2228584 - RNA, 14 nt, Homo sapiens
augaugguggauca

SEQ ID NO: 2228585 - RNA, 20 nt, Homo sapiens
uaaaauagacaacucuucca

SEQ ID NO: 2228586 - RNA, 23 nt, Homo sapiens
ccuaauauuuuguucugcaaauu

SEQ ID NO: 2228587 - RNA, 21 nt, Homo sapiens
ccaggaagaccccagcacaga

SEQ ID NO: 2228588 - RNA, 11 nt, Homo sapiens
uuuuccagaac

SEQ ID NO: 2228589 - RNA, 14 nt, Homo sapiens
ugauuccugggaag

SEQ ID NO: 2228590 - RNA, 18 nt, Homo sapiens
ucaaauaguugcauagca

SEQ ID NO: 2228591 - RNA, 16 nt, Homo sapiens
gguaguggcaaagaga

SEQ ID NO: 2228592 - RNA, 15 nt, Homo sapiens
gaaaggaaacuuuga

SEQ ID NO: 2228593 - RNA, 14 nt, Homo sapiens
ugaaaaaauguuca

SEQ ID NO: 2228594 - RNA, 16 nt, Homo sapiens
ugaaaugacauuucac

SEQ ID NO: 2228595 - RNA, 21 nt, Homo sapiens
caagggaacuugagcgugaau

SEQ ID NO: 2228596 - RNA, 12 nt, Homo sapiens
uaaagcucucaa

SEQ ID NO: 2228597 - RNA, 18 nt, Homo sapiens
cuuuuuuuuaaguuacac

SEQ ID NO: 2228598 - RNA, 11 nt, Homo sapiens
agucaucuccc

SEQ ID NO: 2228599 - RNA, 13 nt, Homo sapiens
gugacacauugua

SEQ ID NO: 2228600 - RNA, 16 nt, Homo sapiens
aacucuucagugcaaa

SEQ ID NO: 2228601 - RNA, 18 nt, Homo sapiens
ugcccauggaagucucaa

SEQ ID NO: 2228602 - RNA, 23 nt, Homo sapiens
caaaauguggggaaaaggcauuu

SEQ ID NO: 2228603 - RNA, 14 nt, Homo sapiens
uccguggauuuggc

SEQ ID NO: 2228604 - RNA, 19 nt, Homo sapiens
agcaacccagaauguaaaa

SEQ ID NO: 2228605 - RNA, 13 nt, Homo sapiens
agguugugcaugg

SEQ ID NO: 2228606 - RNA, 23 nt, Homo sapiens
gacuuccuuuauaauauuucagu

SEQ ID NO: 2228607 - RNA, 17 nt, Homo sapiens
ccucccaaauuugaguu

SEQ ID NO: 2228608 - RNA, 18 nt, Homo sapiens
ugcagcaccucucaggau

SEQ ID NO: 2228609 - RNA, 19 nt, Homo sapiens
agcaggagaggagagccag

SEQ ID NO: 2228610 - RNA, 14 nt, Homo sapiens
acacucagugacau

SEQ ID NO: 2228611 - RNA, 13 nt, Homo sapiens
cugauggccaagg

SEQ ID NO: 2228612 - RNA, 13 nt, Homo sapiens
aaagaaucauuug

SEQ ID NO: 2228613 - RNA, 22 nt, Homo sapiens
ggacccugaagaggcauuucag

SEQ ID NO: 2228614 - RNA, 14 nt, Homo sapiens
ccaggaugcaugca

SEQ ID NO: 2228615 - RNA, 13 nt, Homo sapiens
aggacccagcucg

SEQ ID NO: 2228616 - RNA, 22 nt, Homo sapiens
gugccuucccuucucuggucuc

SEQ ID NO: 2228617 - RNA, 19 nt, Homo sapiens
cacgguuuggaaauauuca

SEQ ID NO: 2228618 - RNA, 19 nt, Homo sapiens
ggagaaaaugaacaggaca

SEQ ID NO: 2228619 - RNA, 12 nt, Homo sapiens
cagccauuucaa

SEQ ID NO: 2228620 - RNA, 21 nt, Homo sapiens
auuuguguaauauuacuuuaa

SEQ ID NO: 2228621 - RNA, 16 nt, Homo sapiens
augagaaggaauuuga

SEQ ID NO: 2228622 - RNA, 18 nt, Homo sapiens
ucuggugccaaaugaaga

SEQ ID NO: 2228623 - RNA, 22 nt, Homo sapiens
gcagagaccccggacccaggcc

SEQ ID NO: 2228624 - RNA, 13 nt, Homo sapiens
gacuuauugccaa

SEQ ID NO: 2228625 - RNA, 13 nt, Homo sapiens
guuggagugcagu

SEQ ID NO: 2228626 - RNA, 13 nt, Homo sapiens
uuaaacucgagau

SEQ ID NO: 2228627 - RNA, 14 nt, Homo sapiens
augugcuaugaagc

SEQ ID NO: 2228628 - RNA, 22 nt, Homo sapiens
agaguuggagugagaugaagga

SEQ ID NO: 2228629 - RNA, 13 nt, Homo sapiens
uauugacucuuuc

SEQ ID NO: 2228630 - RNA, 15 nt, Homo sapiens
gagaguucuccagau

SEQ ID NO: 2228631 - RNA, 23 nt, Homo sapiens
uguuugaaugaguuuauauggaa

SEQ ID NO: 2228632 - RNA, 15 nt, Homo sapiens
uaguauaaaaaaugg

SEQ ID NO: 2228633 - RNA, 11 nt, Homo sapiens
ucaucucauga

SEQ ID NO: 2228634 - RNA, 15 nt, Homo sapiens
cgcauuuccuuucag

SEQ ID NO: 2228635 - RNA, 22 nt, Homo sapiens
gcaaaaacuggguaaugcaacu

SEQ ID NO: 2228636 - RNA, 18 nt, Homo sapiens
cucucagcugaacacccu

SEQ ID NO: 2228637 - RNA, 18 nt, Homo sapiens
ccacuaccuucugaccuc

SEQ ID NO: 2228638 - RNA, 13 nt, Homo sapiens
gcuccauguagaa

SEQ ID NO: 2228639 - RNA, 23 nt, Homo sapiens
cugcucccugcacccaugacaau

SEQ ID NO: 2228640 - RNA, 20 nt, Homo sapiens
ccacccccaaugcacagggc

SEQ ID NO: 2228641 - RNA, 20 nt, Homo sapiens
ugccuggaaaguccuccuau

SEQ ID NO: 2228642 - RNA, 21 nt, Homo sapiens
aaaagcaacaggccauuguga

SEQ ID NO: 2228643 - RNA, 13 nt, Homo sapiens
uauggggggccaa

SEQ ID NO: 2228644 - RNA, 11 nt, Homo sapiens
accugggccag

SEQ ID NO: 2228645 - RNA, 17 nt, Homo sapiens
uuaugaaaaguacuaau

SEQ ID NO: 2228646 - RNA, 16 nt, Homo sapiens
uggcaggaugaugcug

SEQ ID NO: 2228647 - RNA, 16 nt, Homo sapiens
ugugucaguggaugcu

SEQ ID NO: 2228648 - RNA, 10 nt, Homo sapiens
cuagcacaaa

SEQ ID NO: 2228649 - RNA, 12 nt, Homo sapiens
uuucuacuuuga

SEQ ID NO: 2228650 - RNA, 12 nt, Homo sapiens
uuuauacuuugc

SEQ ID NO: 2228651 - RNA, 19 nt, Homo sapiens
gucugagauauauuugcua

SEQ ID NO: 2228652 - RNA, 12 nt, Homo sapiens
acaagggagaaa

SEQ ID NO: 2228653 - RNA, 17 nt, Homo sapiens
aggccugacccacgggg

SEQ ID NO: 2228654 - RNA, 16 nt, Homo sapiens
agccaucaaacacaau

SEQ ID NO: 2228655 - RNA, 14 nt, Homo sapiens
ucuuaaaacuuuau

SEQ ID NO: 2228656 - RNA, 14 nt, Homo sapiens
ucaaauaacuaaaa

SEQ ID NO: 2228657 - RNA, 18 nt, Homo sapiens
uuuuagcgguuugcaaac

SEQ ID NO: 2228658 - RNA, 13 nt, Homo sapiens
auaauccuuguca

SEQ ID NO: 2228659 - RNA, 16 nt, Homo sapiens
aagccugaaacagccu

SEQ ID NO: 2228660 - RNA, 18 nt, Homo sapiens
ccuuugacauuuaauuua

SEQ ID NO: 2228661 - RNA, 10 nt, Homo sapiens
aaugccaaga

SEQ ID NO: 2228662 - RNA, 23 nt, Homo sapiens
caauacauuuguauuuugugaug

SEQ ID NO: 2228663 - RNA, 20 nt, Homo sapiens
ggcaaagugacaaagcaauu

SEQ ID NO: 2228664 - RNA, 20 nt, Homo sapiens
cuggcugucugucugcagug

SEQ ID NO: 2228665 - RNA, 20 nt, Homo sapiens
ugcagucaacaguucaaaga

SEQ ID NO: 2228666 - RNA, 17 nt, Homo sapiens
ggugacacauuacaaag

SEQ ID NO: 2228667 - RNA, 21 nt, Homo sapiens
aacauaccguuuauaaugcca

SEQ ID NO: 2228668 - RNA, 13 nt, Homo sapiens
uccugaaagccac

SEQ ID NO: 2228669 - RNA, 13 nt, Homo sapiens
uucccuaccuaag

SEQ ID NO: 2228670 - RNA, 14 nt, Homo sapiens
cugauuugauacca

SEQ ID NO: 2228671 - RNA, 16 nt, Homo sapiens
auuaagagcaaacuuu

SEQ ID NO: 2228672 - RNA, 16 nt, Homo sapiens
uccagagggugcgcuc

SEQ ID NO: 2228673 - RNA, 18 nt, Homo sapiens
gugggauccacacugaga

SEQ ID NO: 2228674 - RNA, 15 nt, Homo sapiens
agugguaccagcuca

SEQ ID NO: 2228675 - RNA, 20 nt, Homo sapiens
ucuacaagauccuccugcug

SEQ ID NO: 2228676 - RNA, 18 nt, Homo sapiens
cauaaaugggaacugaug

SEQ ID NO: 2228677 - RNA, 17 nt, Homo sapiens
cacaugcccaugaugag

SEQ ID NO: 2228678 - RNA, 22 nt, Homo sapiens
ucagcaggaaccuguacugggu

SEQ ID NO: 2228679 - RNA, 11 nt, Homo sapiens
cauuccaugac

SEQ ID NO: 2228680 - RNA, 20 nt, Homo sapiens
ugcgugcucccgaugcugcu

SEQ ID NO: 2228681 - RNA, 18 nt, Homo sapiens
cauuaaaucuugaacuuu

SEQ ID NO: 2228682 - RNA, 18 nt, Homo sapiens
uuaucaauaaagcacuau

SEQ ID NO: 2228683 - RNA, 20 nt, Homo sapiens
ggucaccucacucagcacca

SEQ ID NO: 2228684 - RNA, 19 nt, Homo sapiens
caaaugccugguaccagag

SEQ ID NO: 2228685 - RNA, 15 nt, Homo sapiens
agaggcuggaccaca

SEQ ID NO: 2228686 - RNA, 16 nt, Homo sapiens
cucuggccuugcccca

SEQ ID NO: 2228687 - RNA, 11 nt, Homo sapiens
ugccugggaag

SEQ ID NO: 2228688 - RNA, 22 nt, Homo sapiens
acaccaaggcccugcaucuguc

SEQ ID NO: 2228689 - RNA, 13 nt, Homo sapiens
ccaucuuaaucuu

SEQ ID NO: 2228690 - RNA, 20 nt, Homo sapiens
uguguaugagacuguguuuc

SEQ ID NO: 2228691 - RNA, 15 nt, Homo sapiens
cggaaucagcuucua

SEQ ID NO: 2228692 - RNA, 15 nt, Homo sapiens
uuaauccuucuaguu

SEQ ID NO: 2228693 - RNA, 22 nt, Homo sapiens
acaaauugauagucaauaucaa

SEQ ID NO: 2228694 - RNA, 22 nt, Homo sapiens
auggcuggcaggcaguucuaga

SEQ ID NO: 2228695 - RNA, 14 nt, Homo sapiens
gaagaagagcaaag

SEQ ID NO: 2228696 - RNA, 14 nt, Homo sapiens
acuauggaaaugua

SEQ ID NO: 2228697 - RNA, 21 nt, Homo sapiens
aucucuuuugaauccaugcuu

SEQ ID NO: 2228698 - RNA, 15 nt, Homo sapiens
uuuugaccauaacug

SEQ ID NO: 2228699 - RNA, 19 nt, Homo sapiens
gaagugcuuuguaucagga

SEQ ID NO: 2228700 - RNA, 17 nt, Homo sapiens
accaauugugcugccau

SEQ ID NO: 2228701 - RNA, 22 nt, Homo sapiens
gugccuuucucuggcuccagaa

SEQ ID NO: 2228702 - RNA, 20 nt, Homo sapiens
uaucuggggaaaucaaaaca

SEQ ID NO: 2228703 - RNA, 22 nt, Homo sapiens
aucucaugccccuggcugggac

SEQ ID NO: 2228704 - RNA, 13 nt, Homo sapiens
cagccccuucuca

SEQ ID NO: 2228705 - RNA, 14 nt, Homo sapiens
ucuugcuguccaau

SEQ ID NO: 2228706 - RNA, 24 nt, Homo sapiens
gucaaguucccuccugcagccuga

SEQ ID NO: 2228707 - RNA, 16 nt, Homo sapiens
aaggaaagcacuaaga

SEQ ID NO: 2228708 - RNA, 16 nt, Homo sapiens
caaacuuuuauacucu

SEQ ID NO: 2228709 - RNA, 16 nt, Homo sapiens
caaguguguaugugcg

SEQ ID NO: 2228710 - RNA, 14 nt, Homo sapiens
uguauucucagcac

SEQ ID NO: 2228711 - RNA, 14 nt, Homo sapiens
ggacagucucacca

SEQ ID NO: 2228712 - RNA, 23 nt, Homo sapiens
aacuaugacuggaguaaaccaug

SEQ ID NO: 2228713 - RNA, 21 nt, Homo sapiens
gcccugacuaaacuaccaccu

SEQ ID NO: 2228714 - RNA, 14 nt, Homo sapiens
acucuggacuccac

SEQ ID NO: 2228715 - RNA, 15 nt, Homo sapiens
caugugacaugucug

SEQ ID NO: 2228716 - RNA, 20 nt, Homo sapiens
gagguugucuguggccagaa

SEQ ID NO: 2228717 - RNA, 20 nt, Homo sapiens
cuacucaggaggcugaggca

SEQ ID NO: 2228718 - RNA, 14 nt, Homo sapiens
caucucccaugugu

SEQ ID NO: 2228719 - RNA, 23 nt, Homo sapiens
cauuagcauaauuuuguguugua

SEQ ID NO: 2228720 - RNA, 23 nt, Homo sapiens
guuugacgacagugcauuugccu

SEQ ID NO: 2228721 - RNA, 14 nt, Homo sapiens
uauuuaaacaacag

SEQ ID NO: 2228722 - RNA, 12 nt, Homo sapiens
acacacuguaaa

SEQ ID NO: 2228723 - RNA, 20 nt, Homo sapiens
agacgucuccccuucucugc

SEQ ID NO: 2228724 - RNA, 23 nt, Homo sapiens
cucuugggcccaggacuguugau

SEQ ID NO: 2228725 - RNA, 15 nt, Homo sapiens
ucuccauggcaucuu

SEQ ID NO: 2228726 - RNA, 13 nt, Homo sapiens
uuuauaacuaagg

SEQ ID NO: 2228727 - RNA, 19 nt, Homo sapiens
uuaaaugcuguaugucauu

SEQ ID NO: 2228728 - RNA, 23 nt, Homo sapiens
gaaauauccuaacccccuaagcu

SEQ ID NO: 2228729 - RNA, 19 nt, Homo sapiens
auaaaagaaagaugcugau

SEQ ID NO: 2228730 - RNA, 19 nt, Homo sapiens
agacugacacuacuaaagc

SEQ ID NO: 2228731 - RNA, 15 nt, Homo sapiens
uucccacugcacucc

SEQ ID NO: 2228732 - RNA, 19 nt, Homo sapiens
aucaucguacacacucagu

SEQ ID NO: 2228733 - RNA, 14 nt, Homo sapiens
acggccacaucaaa

SEQ ID NO: 2228734 - RNA, 20 nt, Homo sapiens
uaagucaggaggaugcaauu

SEQ ID NO: 2228735 - RNA, 20 nt, Homo sapiens
agcaaaggagaguccuggga

SEQ ID NO: 2228736 - RNA, 14 nt, Homo sapiens
aaaggaacacugga

SEQ ID NO: 2228737 - RNA, 22 nt, Homo sapiens
uacuauccagcucuaagucuca

SEQ ID NO: 2228738 - RNA, 21 nt, Homo sapiens
cacaauagccgauaucagaau

SEQ ID NO: 2228739 - RNA, 18 nt, Homo sapiens
auguguuuauucauccag

SEQ ID NO: 2228740 - RNA, 18 nt, Homo sapiens
gccauguaccaguguacu

SEQ ID NO: 2228741 - RNA, 15 nt, Homo sapiens
ccucaaacacuaaag

SEQ ID NO: 2228742 - RNA, 18 nt, Homo sapiens
aaaccuggagaugaugau

SEQ ID NO: 2228743 - RNA, 18 nt, Homo sapiens
accucuugcugccagcua

SEQ ID NO: 2228744 - RNA, 18 nt, Homo sapiens
uccucucccagugacaac

SEQ ID NO: 2228745 - RNA, 22 nt, Homo sapiens
gggugccgcuuucucugagggg

SEQ ID NO: 2228746 - RNA, 16 nt, Homo sapiens
auugauguuaacaaga

SEQ ID NO: 2228747 - RNA, 20 nt, Homo sapiens
ggaggacaagacccucucag

SEQ ID NO: 2228748 - RNA, 22 nt, Homo sapiens
aauguacaagacuuuaccauac

SEQ ID NO: 2228749 - RNA, 21 nt, Homo sapiens
gaguguuauuugcacacugca

SEQ ID NO: 2228750 - RNA, 15 nt, Homo sapiens
ggccuccauguccuc

SEQ ID NO: 2228751 - RNA, 23 nt, Homo sapiens
auccuugucuuuugagcuauuca

SEQ ID NO: 2228752 - RNA, 18 nt, Homo sapiens
accuauuuuguaugugua

SEQ ID NO: 2228753 - RNA, 15 nt, Homo sapiens
accuauccucacugc

SEQ ID NO: 2228754 - RNA, 16 nt, Homo sapiens
uaagaguaucauguac

SEQ ID NO: 2228755 - RNA, 17 nt, Homo sapiens
cccuguccccugaaaaa

SEQ ID NO: 2228756 - RNA, 13 nt, Homo sapiens
aaugcucaugucc

SEQ ID NO: 2228757 - RNA, 21 nt, Homo sapiens
uguuugccacuugauggggcc

SEQ ID NO: 2228758 - RNA, 16 nt, Homo sapiens
uuuuaugaacauugua

SEQ ID NO: 2228759 - RNA, 21 nt, Homo sapiens
guuucuucuucaagacucuga

SEQ ID NO: 2228760 - RNA, 16 nt, Homo sapiens
ucacagagaagcuccu

SEQ ID NO: 2228761 - RNA, 21 nt, Homo sapiens
agcccacuguaacaauacugg

SEQ ID NO: 2228762 - RNA, 15 nt, Homo sapiens
acgcacagugcaguu

SEQ ID NO: 2228763 - RNA, 14 nt, Homo sapiens
uuaaaacagcugcg

SEQ ID NO: 2228764 - RNA, 18 nt, Homo sapiens
accuagcagccucaaaac

SEQ ID NO: 2228765 - RNA, 17 nt, Homo sapiens
agcuaaacauugugaug

SEQ ID NO: 2228766 - RNA, 16 nt, Homo sapiens
ccgggagacucaaagg

SEQ ID NO: 2228767 - RNA, 12 nt, Homo sapiens
guuaagugcccc

SEQ ID NO: 2228768 - RNA, 17 nt, Homo sapiens
aauacccuuggcacuga

SEQ ID NO: 2228769 - RNA, 16 nt, Homo sapiens
ucauucaaauacugua

SEQ ID NO: 2228770 - RNA, 20 nt, Homo sapiens
auggucaugaauagucauua

SEQ ID NO: 2228771 - RNA, 16 nt, Homo sapiens
uuucucccacauauuc

SEQ ID NO: 2228772 - RNA, 22 nt, Homo sapiens
agcuuuccuuuccuucuggcuc

SEQ ID NO: 2228773 - RNA, 22 nt, Homo sapiens
aucaauccugggcaaucagaca

SEQ ID NO: 2228774 - RNA, 18 nt, Homo sapiens
agcucccuaggagaccaa

SEQ ID NO: 2228775 - RNA, 22 nt, Homo sapiens
gucacaacaaaaggaagacugg

SEQ ID NO: 2228776 - RNA, 23 nt, Homo sapiens
agcccacccugcugccuucugac

SEQ ID NO: 2228777 - RNA, 12 nt, Homo sapiens
ugagcuuuccag

SEQ ID NO: 2228778 - RNA, 15 nt, Homo sapiens
ggagugaaaaccucu

SEQ ID NO: 2228779 - RNA, 21 nt, Homo sapiens
ccagaguuggagacucagcau

SEQ ID NO: 2228780 - RNA, 20 nt, Homo sapiens
gaacagcuuuuuguccugua

SEQ ID NO: 2228781 - RNA, 23 nt, Homo sapiens
uggcaauaggugugaacagggaa

SEQ ID NO: 2228782 - RNA, 21 nt, Homo sapiens
uuauaauucuugaaugaggca

SEQ ID NO: 2228783 - RNA, 21 nt, Homo sapiens
ucauaaauuacuguuuugcca

SEQ ID NO: 2228784 - RNA, 19 nt, Homo sapiens
guccccgcucagucuuuga

SEQ ID NO: 2228785 - RNA, 16 nt, Homo sapiens
uaugccuaaucuguaa

SEQ ID NO: 2228786 - RNA, 18 nt, Homo sapiens
cccagagggucaggguug

SEQ ID NO: 2228787 - RNA, 23 nt, Homo sapiens
gcucagauuauuuaaaugggaau

SEQ ID NO: 2228788 - RNA, 21 nt, Homo sapiens
gccccauccuccagcagggaa

SEQ ID NO: 2228789 - RNA, 17 nt, Homo sapiens
ugcuacccucauuucac

SEQ ID NO: 2228790 - RNA, 15 nt, Homo sapiens
cacuuaauuuuccca

SEQ ID NO: 2228791 - RNA, 22 nt, Homo sapiens
agcccauuuguguacacaguca

SEQ ID NO: 2228792 - RNA, 17 nt, Homo sapiens
cuuuucagugauacuca

SEQ ID NO: 2228793 - RNA, 13 nt, Homo sapiens
aaccuuaauugac

SEQ ID NO: 2228794 - RNA, 20 nt, Homo sapiens
uuuaucugaucugugauuaa

SEQ ID NO: 2228795 - RNA, 20 nt, Homo sapiens
ccucaagcuaugugagcuca

SEQ ID NO: 2228796 - RNA, 18 nt, Homo sapiens
agacucaagagaauuuau

SEQ ID NO: 2228797 - RNA, 16 nt, Homo sapiens
uggaagcuugcuuuuu

SEQ ID NO: 2228798 - RNA, 14 nt, Homo sapiens
ccuccgcucuguag

SEQ ID NO: 2228799 - RNA, 22 nt, Homo sapiens
agcuuucccuggcucagggauc

SEQ ID NO: 2228800 - RNA, 19 nt, Homo sapiens
aaaagggaaaaaagcaacu

SEQ ID NO: 2228801 - RNA, 15 nt, Homo sapiens
ugguccuagaacuuu

SEQ ID NO: 2228802 - RNA, 20 nt, Homo sapiens
gaacucaaccucuacagggu

SEQ ID NO: 2228803 - RNA, 19 nt, Homo sapiens
ucaucaacacgagaauaca

SEQ ID NO: 2228804 - RNA, 17 nt, Homo sapiens
gaacugcacgguacaaa

SEQ ID NO: 2228805 - RNA, 16 nt, Homo sapiens
auuagguccacuucaa

SEQ ID NO: 2228806 - RNA, 13 nt, Homo sapiens
ucucccugacccu

SEQ ID NO: 2228807 - RNA, 19 nt, Homo sapiens
ccuuuggaugcacuuuaua

SEQ ID NO: 2228808 - RNA, 19 nt, Homo sapiens
acaggauuauuggaaauuu

SEQ ID NO: 2228809 - RNA, 19 nt, Homo sapiens
ccguguuacuguugcacug

SEQ ID NO: 2228810 - RNA, 23 nt, Homo sapiens
cuccugauauagaucacauaaca

SEQ ID NO: 2228811 - RNA, 21 nt, Homo sapiens
ccuguuucuccacaacagccu

SEQ ID NO: 2228812 - RNA, 21 nt, Homo sapiens
cagucccucugagugaagucc

SEQ ID NO: 2228813 - RNA, 15 nt, Homo sapiens
gaauugaagauguaa

SEQ ID NO: 2228814 - RNA, 20 nt, Homo sapiens
cagcugcuggagauauguaa

SEQ ID NO: 2228815 - RNA, 16 nt, Homo sapiens
auuuacuaacaguaac

SEQ ID NO: 2228816 - RNA, 18 nt, Homo sapiens
ucccuugugagucuucac

SEQ ID NO: 2228817 - RNA, 20 nt, Homo sapiens
agugccaccacacucagcua

SEQ ID NO: 2228818 - RNA, 20 nt, Homo sapiens
ccacuaggguccaccaggag

SEQ ID NO: 2228819 - RNA, 15 nt, Homo sapiens
gcagagagguuguga

SEQ ID NO: 2228820 - RNA, 14 nt, Homo sapiens
cccugugaucuaua

SEQ ID NO: 2228821 - RNA, 15 nt, Homo sapiens
ugccgaaacuggaag

SEQ ID NO: 2228822 - RNA, 14 nt, Homo sapiens
ggagauacagugga

SEQ ID NO: 2228823 - RNA, 21 nt, Homo sapiens
cuuuugagcaacuuucuuaca

SEQ ID NO: 2228824 - RNA, 15 nt, Homo sapiens
aaagggacugagaaa

SEQ ID NO: 2228825 - RNA, 19 nt, Homo sapiens
cuggcaguggaacuaagaa

SEQ ID NO: 2228826 - RNA, 14 nt, Homo sapiens
caaaugaaauaaua

SEQ ID NO: 2228827 - RNA, 14 nt, Homo sapiens
auuguaaacaugug

SEQ ID NO: 2228828 - RNA, 16 nt, Homo sapiens
agggacaggugggccu

SEQ ID NO: 2228829 - RNA, 20 nt, Homo sapiens
gccugaggaugagcuggaag

SEQ ID NO: 2228830 - RNA, 19 nt, Homo sapiens
aaugagugaguucucacuc

SEQ ID NO: 2228831 - RNA, 22 nt, Homo sapiens
gaaaagauuuuauuuauggaau

SEQ ID NO: 2228832 - RNA, 14 nt, Homo sapiens
uguuuauaauguua

SEQ ID NO: 2228833 - RNA, 18 nt, Homo sapiens
uaaauaaaguuacuugaa

SEQ ID NO: 2228834 - RNA, 12 nt, Homo sapiens
accccgugccac

SEQ ID NO: 2228835 - RNA, 18 nt, Homo sapiens
gugacuccugaagggaag

SEQ ID NO: 2228836 - RNA, 13 nt, Homo sapiens
gaguaucacuccc

SEQ ID NO: 2228837 - RNA, 21 nt, Homo sapiens
aaaacucucugguuuacuuca

SEQ ID NO: 2228838 - RNA, 16 nt, Homo sapiens
guugggaauugcaugc

SEQ ID NO: 2228839 - RNA, 23 nt, Homo sapiens
ucagggaaacuaauuguauuuag

SEQ ID NO: 2228840 - RNA, 18 nt, Homo sapiens
agaaagccguacugucua

SEQ ID NO: 2228841 - RNA, 17 nt, Homo sapiens
accaaacuucauguaua

SEQ ID NO: 2228842 - RNA, 17 nt, Homo sapiens
aagucuuauuuccucaa

SEQ ID NO: 2228843 - RNA, 13 nt, Homo sapiens
ugaugaagcacau

SEQ ID NO: 2228844 - RNA, 15 nt, Homo sapiens
gugaauuggcuuccu

SEQ ID NO: 2228845 - RNA, 21 nt, Homo sapiens
caaggcauaucaugcuuugaa

SEQ ID NO: 2228846 - RNA, 21 nt, Homo sapiens
cuuuuuaaaauaaacacaaaa

SEQ ID NO: 2228847 - RNA, 11 nt, Homo sapiens
caaauuucaca

SEQ ID NO: 2228848 - RNA, 16 nt, Homo sapiens
aaaaagcucauuucau

SEQ ID NO: 2228849 - RNA, 19 nt, Homo sapiens
aacauggcacauguauaca

SEQ ID NO: 2228850 - RNA, 23 nt, Homo sapiens
acagagccgcaaaucaaccccag

SEQ ID NO: 2228851 - RNA, 16 nt, Homo sapiens
aguuccuuugaucucg

SEQ ID NO: 2228852 - RNA, 21 nt, Homo sapiens
caagaggugguagaaccacuu

SEQ ID NO: 2228853 - RNA, 21 nt, Homo sapiens
ugaugugcaaaggcaucugag

SEQ ID NO: 2228854 - RNA, 16 nt, Homo sapiens
aacgcguaucuaggcu

SEQ ID NO: 2228855 - RNA, 15 nt, Homo sapiens
uucaccauacuucau

SEQ ID NO: 2228856 - RNA, 12 nt, Homo sapiens
ugcuauucuggc

SEQ ID NO: 2228857 - RNA, 20 nt, Homo sapiens
acaaggguccguggaccagg

SEQ ID NO: 2228858 - RNA, 20 nt, Homo sapiens
ccacauaagaaggcaauuuu

SEQ ID NO: 2228859 - RNA, 19 nt, Homo sapiens
uagacugaaaaacuguugg

SEQ ID NO: 2228860 - RNA, 20 nt, Homo sapiens
uaugauuuaagguacuuaaa

SEQ ID NO: 2228861 - RNA, 14 nt, Homo sapiens
ggcggccaccagcg

SEQ ID NO: 2228862 - RNA, 20 nt, Homo sapiens
aguguuguucccucccucaa

SEQ ID NO: 2228863 - RNA, 19 nt, Homo sapiens
acugaauuugggccucuug

SEQ ID NO: 2228864 - RNA, 19 nt, Homo sapiens
uaguuucuccaaguacuuu

SEQ ID NO: 2228865 - RNA, 16 nt, Homo sapiens
cuucauucacauucag

SEQ ID NO: 2228866 - RNA, 22 nt, Homo sapiens
uaaaaagcauuauuauuugcug

SEQ ID NO: 2228867 - RNA, 13 nt, Homo sapiens
uauuucacaagaa

SEQ ID NO: 2228868 - RNA, 13 nt, Homo sapiens
augaacacuuuuu

SEQ ID NO: 2228869 - RNA, 13 nt, Homo sapiens
uuuuuuuguccau

SEQ ID NO: 2228870 - RNA, 20 nt, Homo sapiens
gagguggagguugcauugag

SEQ ID NO: 2228871 - RNA, 19 nt, Homo sapiens
cuuccuguuucuucccaua

SEQ ID NO: 2228872 - RNA, 20 nt, Homo sapiens
aaagcaagacuguugcucaa

SEQ ID NO: 2228873 - RNA, 21 nt, Homo sapiens
agucacaguuagguagcuuua

SEQ ID NO: 2228874 - RNA, 16 nt, Homo sapiens
gugauaauagcauuuu

SEQ ID NO: 2228875 - RNA, 15 nt, Homo sapiens
ccugggcagugcagg

SEQ ID NO: 2228876 - RNA, 12 nt, Homo sapiens
gcucgggacugu

SEQ ID NO: 2228877 - RNA, 15 nt, Homo sapiens
gcuucaaaacagaac

SEQ ID NO: 2228878 - RNA, 20 nt, Homo sapiens
augugaugguacacaguggg

SEQ ID NO: 2228879 - RNA, 14 nt, Homo sapiens
cuucaaaaagccac

SEQ ID NO: 2228880 - RNA, 17 nt, Homo sapiens
acacuuucaugcagugc

SEQ ID NO: 2228881 - RNA, 13 nt, Homo sapiens
caucucuacuaaa

SEQ ID NO: 2228882 - RNA, 15 nt, Homo sapiens
ugcacaaaccaauua

SEQ ID NO: 2228883 - RNA, 22 nt, Homo sapiens
ccugcagcccauggugagcucu

SEQ ID NO: 2228884 - RNA, 18 nt, Homo sapiens
gaguaauacaucaaagag

SEQ ID NO: 2228885 - RNA, 15 nt, Homo sapiens
gagcagaagcuggag

SEQ ID NO: 2228886 - RNA, 18 nt, Homo sapiens
uguuugaagucugcucau

SEQ ID NO: 2228887 - RNA, 17 nt, Homo sapiens
cugggccuggcagcuca

SEQ ID NO: 2228888 - RNA, 18 nt, Homo sapiens
ccaaaugacuuugcaccu

SEQ ID NO: 2228889 - RNA, 16 nt, Homo sapiens
ugucugaacauagaaa

SEQ ID NO: 2228890 - RNA, 15 nt, Homo sapiens
uuuaaucugcauuua

SEQ ID NO: 2228891 - RNA, 16 nt, Homo sapiens
agcuggggauguuuag

SEQ ID NO: 2228892 - RNA, 14 nt, Homo sapiens
uccaagccacugag

SEQ ID NO: 2228893 - RNA, 16 nt, Homo sapiens
cguaugugaaacacac

SEQ ID NO: 2228894 - RNA, 15 nt, Homo sapiens
ccuaaccacuuagca

SEQ ID NO: 2228895 - RNA, 14 nt, Homo sapiens
aauuaucuauagcu

SEQ ID NO: 2228896 - RNA, 15 nt, Homo sapiens
uaauuuaguuucaua

SEQ ID NO: 2228897 - RNA, 15 nt, Homo sapiens
aauuuaagauacaaa

SEQ ID NO: 2228898 - RNA, 13 nt, Homo sapiens
gcccuuugcaucg

SEQ ID NO: 2228899 - RNA, 20 nt, Homo sapiens
cgccugggaaucaggauucc

SEQ ID NO: 2228900 - RNA, 16 nt, Homo sapiens
aucucauggaaacugg

SEQ ID NO: 2228901 - RNA, 13 nt, Homo sapiens
auuaaaauuccaa

SEQ ID NO: 2228902 - RNA, 16 nt, Homo sapiens
cuaaaugaagugcaaa

SEQ ID NO: 2228903 - RNA, 20 nt, Homo sapiens
accauuaaaaaguuggaguu

SEQ ID NO: 2228904 - RNA, 14 nt, Homo sapiens
aauagcaugcaaaa

SEQ ID NO: 2228905 - RNA, 14 nt, Homo sapiens
aauuacaugcauga

SEQ ID NO: 2228906 - RNA, 21 nt, Homo sapiens
ucuuaaugacauuucacugau

SEQ ID NO: 2228907 - RNA, 18 nt, Homo sapiens
cagcugguggcuagguuu

SEQ ID NO: 2228908 - RNA, 15 nt, Homo sapiens
ccugccauguguaag

SEQ ID NO: 2228909 - RNA, 16 nt, Homo sapiens
agcaaugggcacuggu

SEQ ID NO: 2228910 - RNA, 16 nt, Homo sapiens
cauacauauauaucug

SEQ ID NO: 2228911 - RNA, 15 nt, Homo sapiens
ggauaggagggugcc

SEQ ID NO: 2228912 - RNA, 15 nt, Homo sapiens
uaccuucuaccucuu

SEQ ID NO: 2228913 - RNA, 22 nt, Homo sapiens
caaauuuuguauaacuuuugau

SEQ ID NO: 2228914 - RNA, 21 nt, Homo sapiens
agcuaugaucagaagacuuua

SEQ ID NO: 2228915 - RNA, 18 nt, Homo sapiens
ugccacuuggccaccagg

SEQ ID NO: 2228916 - RNA, 17 nt, Homo sapiens
ugcaaucauaugugauc

SEQ ID NO: 2228917 - RNA, 16 nt, Homo sapiens
gccagaagggggccau

SEQ ID NO: 2228918 - RNA, 14 nt, Homo sapiens
uuggccugaggcug

SEQ ID NO: 2228919 - RNA, 17 nt, Homo sapiens
caguagcagcagcaucu

SEQ ID NO: 2228920 - RNA, 13 nt, Homo sapiens
agaauuuccugua

SEQ ID NO: 2228921 - RNA, 16 nt, Homo sapiens
agauccucaagcagac

SEQ ID NO: 2228922 - RNA, 13 nt, Homo sapiens
cacagcccugcuc

SEQ ID NO: 2228923 - RNA, 18 nt, Homo sapiens
cacagagcaggaagccga

SEQ ID NO: 2228924 - RNA, 13 nt, Homo sapiens
uuaacccagugua

SEQ ID NO: 2228925 - RNA, 20 nt, Homo sapiens
caaacuguggguauuguuaa

SEQ ID NO: 2228926 - RNA, 19 nt, Homo sapiens
guuuuuauaccagcuuaau

SEQ ID NO: 2228927 - RNA, 19 nt, Homo sapiens
acgcuugcacacaugcaca

SEQ ID NO: 2228928 - RNA, 21 nt, Homo sapiens
ucugacuuucuuuuuugauau

SEQ ID NO: 2228929 - RNA, 16 nt, Homo sapiens
gcuccuaaaccauuga

SEQ ID NO: 2228930 - RNA, 19 nt, Homo sapiens
cccgcguggcauccuguga

SEQ ID NO: 2228931 - RNA, 17 nt, Homo sapiens
gcacugaaaccugagau

SEQ ID NO: 2228932 - RNA, 23 nt, Homo sapiens
aauccaaucuguaauuucacuuu

SEQ ID NO: 2228933 - RNA, 13 nt, Homo sapiens
augagucagucaa

SEQ ID NO: 2228934 - RNA, 14 nt, Homo sapiens
gacaggaccaggga

SEQ ID NO: 2228935 - RNA, 13 nt, Homo sapiens
gguggguggcacu

SEQ ID NO: 2228936 - RNA, 16 nt, Homo sapiens
cuccauucauacacaa

SEQ ID NO: 2228937 - RNA, 18 nt, Homo sapiens
gaugggaggugugccaga

SEQ ID NO: 2228938 - RNA, 22 nt, Homo sapiens
cauaaucccugucuucuuucca

SEQ ID NO: 2228939 - RNA, 22 nt, Homo sapiens
uccaugccucuggaggccucug

SEQ ID NO: 2228940 - RNA, 24 nt, Homo sapiens
cuaugaacagaaacuacauuucua

SEQ ID NO: 2228941 - RNA, 15 nt, Homo sapiens
caauaauuguggaga

SEQ ID NO: 2228942 - RNA, 17 nt, Homo sapiens
ugacauuauaugcacua

SEQ ID NO: 2228943 - RNA, 21 nt, Homo sapiens
gguguaguggcucaugccugu

SEQ ID NO: 2228944 - RNA, 13 nt, Homo sapiens
uccucuucuacca

SEQ ID NO: 2228945 - RNA, 18 nt, Homo sapiens
cuuugcuuguccugcuca

SEQ ID NO: 2228946 - RNA, 17 nt, Homo sapiens
uagacugccacaaggaa

SEQ ID NO: 2228947 - RNA, 11 nt, Homo sapiens
uucacugcugc

SEQ ID NO: 2228948 - RNA, 21 nt, Homo sapiens
aaaccacuagaacucuccauc

SEQ ID NO: 2228949 - RNA, 12 nt, Homo sapiens
uaaaugaucucu

SEQ ID NO: 2228950 - RNA, 10 nt, Homo sapiens
uagugcuuau

SEQ ID NO: 2228951 - RNA, 19 nt, Homo sapiens
cuguuuaacauuuccucag

SEQ ID NO: 2228952 - RNA, 15 nt, Homo sapiens
agcagucagcccuua

SEQ ID NO: 2228953 - RNA, 15 nt, Homo sapiens
agccuacagccagaa

SEQ ID NO: 2228954 - RNA, 13 nt, Homo sapiens
uauaagacuacua

SEQ ID NO: 2228955 - RNA, 16 nt, Homo sapiens
cacccgcccacagcca

SEQ ID NO: 2228956 - RNA, 21 nt, Homo sapiens
gcaaaaggaucuuuguggcca

SEQ ID NO: 2228957 - RNA, 20 nt, Homo sapiens
ucaaucuuuagaaaaggcau

SEQ ID NO: 2228958 - RNA, 23 nt, Homo sapiens
cagagucgcuuuugccuuuucaa

SEQ ID NO: 2228959 - RNA, 15 nt, Homo sapiens
uaguucaacuguaua

SEQ ID NO: 2228960 - RNA, 21 nt, Homo sapiens
gacaaaaucacauucugcaua

SEQ ID NO: 2228961 - RNA, 22 nt, Homo sapiens
gcuuacccaagcuguggcagcc

SEQ ID NO: 2228962 - RNA, 14 nt, Homo sapiens
ggacucaaacugcc

SEQ ID NO: 2228963 - RNA, 19 nt, Homo sapiens
cccauagaccuaacuguga

SEQ ID NO: 2228964 - RNA, 16 nt, Homo sapiens
accuacauuaucucac

SEQ ID NO: 2228965 - RNA, 11 nt, Homo sapiens
aggaccaccuc

SEQ ID NO: 2228966 - RNA, 22 nt, Homo sapiens
agacugaugagcacaucucucu

SEQ ID NO: 2228967 - RNA, 17 nt, Homo sapiens
gucccagccagcaguuc

SEQ ID NO: 2228968 - RNA, 16 nt, Homo sapiens
ugagucuuuggaugcc

SEQ ID NO: 2228969 - RNA, 22 nt, Homo sapiens
uaaacuuugaagcaacugugaa

SEQ ID NO: 2228970 - RNA, 18 nt, Homo sapiens
uggggacagcauaccuug

SEQ ID NO: 2228971 - RNA, 13 nt, Homo sapiens
aaagaaaaaccac

SEQ ID NO: 2228972 - RNA, 14 nt, Homo sapiens
augcaguccaguga

SEQ ID NO: 2228973 - RNA, 16 nt, Homo sapiens
cggaagccaacuuggc

SEQ ID NO: 2228974 - RNA, 20 nt, Homo sapiens
aguacuuuugugcuaucaau

SEQ ID NO: 2228975 - RNA, 23 nt, Homo sapiens
aauuugauugcuuugcugcacag

SEQ ID NO: 2228976 - RNA, 16 nt, Homo sapiens
uacauucaaauuuguc

SEQ ID NO: 2228977 - RNA, 14 nt, Homo sapiens
cuugccacccaaau

SEQ ID NO: 2228978 - RNA, 16 nt, Homo sapiens
cuuggagccccagugc

SEQ ID NO: 2228979 - RNA, 18 nt, Homo sapiens
ccagcucuucucaagcag

SEQ ID NO: 2228980 - RNA, 18 nt, Homo sapiens
guucagaggaagcacaua

SEQ ID NO: 2228981 - RNA, 14 nt, Homo sapiens
aauugacaacccaa

SEQ ID NO: 2228982 - RNA, 18 nt, Homo sapiens
ccggagagagauggcuca

SEQ ID NO: 2228983 - RNA, 13 nt, Homo sapiens
guggacagcagcu

SEQ ID NO: 2228984 - RNA, 21 nt, Homo sapiens
aagcugugccacccugggcuc

SEQ ID NO: 2228985 - RNA, 15 nt, Homo sapiens
gagcugcacugauca

SEQ ID NO: 2228986 - RNA, 21 nt, Homo sapiens
uagaggaauuuaaagaggaaa

SEQ ID NO: 2228987 - RNA, 17 nt, Homo sapiens
acaaaugagugauucca

SEQ ID NO: 2228988 - RNA, 21 nt, Homo sapiens
ccuggucccucugcagucucu

SEQ ID NO: 2228989 - RNA, 22 nt, Homo sapiens
aaucaugcucauguauauuuag

SEQ ID NO: 2228990 - RNA, 17 nt, Homo sapiens
gggaauguuguuccagg

SEQ ID NO: 2228991 - RNA, 19 nt, Homo sapiens
agcaugguacuuggccuuu

SEQ ID NO: 2228992 - RNA, 22 nt, Homo sapiens
cagagccguggccacccaggaa

SEQ ID NO: 2228993 - RNA, 21 nt, Homo sapiens
aggugcucuuccucaucucau

SEQ ID NO: 2228994 - RNA, 17 nt, Homo sapiens
agaacaguccauugaaa

SEQ ID NO: 2228995 - RNA, 23 nt, Homo sapiens
cucuuuucuuucccucucauggu

SEQ ID NO: 2228996 - RNA, 18 nt, Homo sapiens
aaacauaacuccaucuac

SEQ ID NO: 2228997 - RNA, 14 nt, Homo sapiens
gaacucgcuucucu

SEQ ID NO: 2228998 - RNA, 16 nt, Homo sapiens
ggccuucaguuuccau

SEQ ID NO: 2228999 - RNA, 18 nt, Homo sapiens
cauauaaagcacuauaca

SEQ ID NO: 2229000 - RNA, 12 nt, Homo sapiens
uguugcuuuaac

SEQ ID NO: 2229001 - RNA, 21 nt, Homo sapiens
aaaucugucauaagcauuacu

SEQ ID NO: 2229002 - RNA, 16 nt, Homo sapiens
aacucugcaaaggccu

SEQ ID NO: 2229003 - RNA, 17 nt, Homo sapiens
ucccagccucuucccau

SEQ ID NO: 2229004 - RNA, 12 nt, Homo sapiens
cuugaagucugu

SEQ ID NO: 2229005 - RNA, 20 nt, Homo sapiens
gaaaaccugaagaguucacu

SEQ ID NO: 2229006 - RNA, 22 nt, Homo sapiens
uuccaggaggaguuagccaaac

SEQ ID NO: 2229007 - RNA, 20 nt, Homo sapiens
cuuauacacaccugaauaaa

SEQ ID NO: 2229008 - RNA, 21 nt, Homo sapiens
gcuucugcguccaccaggccu

SEQ ID NO: 2229009 - RNA, 17 nt, Homo sapiens
gcagaaggaaggcuuug

SEQ ID NO: 2229010 - RNA, 22 nt, Homo sapiens
gcuauuuuauuuguauucauga

SEQ ID NO: 2229011 - RNA, 21 nt, Homo sapiens
ucucaucacuaccuuuauagc

SEQ ID NO: 2229012 - RNA, 13 nt, Homo sapiens
ccuucagaagcua

SEQ ID NO: 2229013 - RNA, 14 nt, Homo sapiens
uaguacaugcucug

SEQ ID NO: 2229014 - RNA, 14 nt, Homo sapiens
cagugagacugugg

SEQ ID NO: 2229015 - RNA, 14 nt, Homo sapiens
ggagccugcaacau

SEQ ID NO: 2229016 - RNA, 22 nt, Homo sapiens
cuuagaugagggugacugucaa

SEQ ID NO: 2229017 - RNA, 15 nt, Homo sapiens
uguaacugagaauuu

SEQ ID NO: 2229018 - RNA, 18 nt, Homo sapiens
gcuacuguaaugcugccu

SEQ ID NO: 2229019 - RNA, 14 nt, Homo sapiens
ccaggcaguucucu

SEQ ID NO: 2229020 - RNA, 23 nt, Homo sapiens
cugaccacgcccccagcugugac

SEQ ID NO: 2229021 - RNA, 18 nt, Homo sapiens
uuugaauuggacaauaau

SEQ ID NO: 2229022 - RNA, 15 nt, Homo sapiens
ucauaaucacaaccc

SEQ ID NO: 2229023 - RNA, 13 nt, Homo sapiens
gugcccugcaaau

SEQ ID NO: 2229024 - RNA, 12 nt, Homo sapiens
ccuccaguucau

SEQ ID NO: 2229025 - RNA, 16 nt, Homo sapiens
uacuguugauacaaac

SEQ ID NO: 2229026 - RNA, 14 nt, Homo sapiens
accaggcuuggccu

SEQ ID NO: 2229027 - RNA, 19 nt, Homo sapiens
agguguaaaugggacaaaa

SEQ ID NO: 2229028 - RNA, 13 nt, Homo sapiens
ugcgacccaagac

SEQ ID NO: 2229029 - RNA, 15 nt, Homo sapiens
aggucaucccggggc

SEQ ID NO: 2229030 - RNA, 15 nt, Homo sapiens
uuccaucagcacaaa

SEQ ID NO: 2229031 - RNA, 16 nt, Homo sapiens
cagagguuauguguuc

SEQ ID NO: 2229032 - RNA, 11 nt, Homo sapiens
agcagcugugc

SEQ ID NO: 2229033 - RNA, 14 nt, Homo sapiens
cacacacaguccuc

SEQ ID NO: 2229034 - RNA, 13 nt, Homo sapiens
uccucgucucucu

SEQ ID NO: 2229035 - RNA, 13 nt, Homo sapiens
gaaaagccagcuu

SEQ ID NO: 2229036 - RNA, 13 nt, Homo sapiens
gaaacgucuacgu

SEQ ID NO: 2229037 - RNA, 18 nt, Homo sapiens
ucucucagugaacuguga

SEQ ID NO: 2229038 - RNA, 17 nt, Homo sapiens
uaggguguguguucacc

SEQ ID NO: 2229039 - RNA, 21 nt, Homo sapiens
cagagucuugcucuguugccc

SEQ ID NO: 2229040 - RNA, 21 nt, Homo sapiens
cagccucucccugugucccac

SEQ ID NO: 2229041 - RNA, 12 nt, Homo sapiens
uucuuuggucau

SEQ ID NO: 2229042 - RNA, 18 nt, Homo sapiens
cccuccuggcucuugaua

SEQ ID NO: 2229043 - RNA, 14 nt, Homo sapiens
auuuaccaaagccu

SEQ ID NO: 2229044 - RNA, 22 nt, Homo sapiens
ucaugcaaguauaaauucaauu

SEQ ID NO: 2229045 - RNA, 23 nt, Homo sapiens
acccaccuggcuucauacagaag

SEQ ID NO: 2229046 - RNA, 12 nt, Homo sapiens
ggggcugucuca

SEQ ID NO: 2229047 - RNA, 18 nt, Homo sapiens
aaugcuuucuguggacac

SEQ ID NO: 2229048 - RNA, 23 nt, Homo sapiens
auggcaaaaccccaucuuuacua

SEQ ID NO: 2229049 - RNA, 12 nt, Homo sapiens
agccauccauga

SEQ ID NO: 2229050 - RNA, 14 nt, Homo sapiens
cauggcuaccucag

SEQ ID NO: 2229051 - RNA, 19 nt, Homo sapiens
uguuccuucuccaauuuga

SEQ ID NO: 2229052 - RNA, 23 nt, Homo sapiens
cagucuacucuuucugcuuacaa

SEQ ID NO: 2229053 - RNA, 21 nt, Homo sapiens
acauuuugcucugugaacuau

SEQ ID NO: 2229054 - RNA, 20 nt, Homo sapiens
aggacgacuguuuucccaac

SEQ ID NO: 2229055 - RNA, 17 nt, Homo sapiens
ccuuccuggacuggccc

SEQ ID NO: 2229056 - RNA, 16 nt, Homo sapiens
cccacaaccacaugua

SEQ ID NO: 2229057 - RNA, 16 nt, Homo sapiens
cugaacaucacagcuu

SEQ ID NO: 2229058 - RNA, 19 nt, Homo sapiens
uucucggggugggacagac

SEQ ID NO: 2229059 - RNA, 16 nt, Homo sapiens
gaagaagugguacuag

SEQ ID NO: 2229060 - RNA, 13 nt, Homo sapiens
acuuucuguaauc

SEQ ID NO: 2229061 - RNA, 21 nt, Homo sapiens
aauucuaaguuauuuacuuuu

SEQ ID NO: 2229062 - RNA, 14 nt, Homo sapiens
gucuagccacugau

SEQ ID NO: 2229063 - RNA, 18 nt, Homo sapiens
uuuacagcugagcacauu

SEQ ID NO: 2229064 - RNA, 15 nt, Homo sapiens
uaaagccaggcucag

SEQ ID NO: 2229065 - RNA, 19 nt, Homo sapiens
auucauucugcauugcuag

SEQ ID NO: 2229066 - RNA, 19 nt, Homo sapiens
aagcauggugucaguuuug

SEQ ID NO: 2229067 - RNA, 16 nt, Homo sapiens
ugccaggaagccagca

SEQ ID NO: 2229068 - RNA, 15 nt, Homo sapiens
uguaaaauguucucu

SEQ ID NO: 2229069 - RNA, 17 nt, Homo sapiens
aaagcuagguguuuaau

SEQ ID NO: 2229070 - RNA, 22 nt, Homo sapiens
ucauucccucgggacccuccca

SEQ ID NO: 2229071 - RNA, 14 nt, Homo sapiens
gacaugugacauuu

SEQ ID NO: 2229072 - RNA, 23 nt, Homo sapiens
uucugaauucauaaaaauaacca

SEQ ID NO: 2229073 - RNA, 22 nt, Homo sapiens
cacaucugcaucacucauggaa

SEQ ID NO: 2229074 - RNA, 19 nt, Homo sapiens
aaagucuggcccacugugc

SEQ ID NO: 2229075 - RNA, 14 nt, Homo sapiens
uaaauuaguauuua

SEQ ID NO: 2229076 - RNA, 16 nt, Homo sapiens
guuuuguacacugcug

SEQ ID NO: 2229077 - RNA, 10 nt, Homo sapiens
ccaagcuggu

SEQ ID NO: 2229078 - RNA, 16 nt, Homo sapiens
uguagcauaacuguag

SEQ ID NO: 2229079 - RNA, 16 nt, Homo sapiens
gcuuuccuucugcccu

SEQ ID NO: 2229080 - RNA, 20 nt, Homo sapiens
caauaagcagagguggaaaa

SEQ ID NO: 2229081 - RNA, 13 nt, Homo sapiens
ugucucaccagcu

SEQ ID NO: 2229082 - RNA, 21 nt, Homo sapiens
uuaaguauuacugaguauuaa

SEQ ID NO: 2229083 - RNA, 21 nt, Homo sapiens
uuguugcaguuaauucuugcc

SEQ ID NO: 2229084 - RNA, 13 nt, Homo sapiens
cuguaauuccagc

SEQ ID NO: 2229085 - RNA, 16 nt, Homo sapiens
ucgccacugcacucca

SEQ ID NO: 2229086 - RNA, 15 nt, Homo sapiens
aacucccacccugac

SEQ ID NO: 2229087 - RNA, 14 nt, Homo sapiens
auccucacugggcu

SEQ ID NO: 2229088 - RNA, 22 nt, Homo sapiens
aauaugcuauauauuaggcaag

SEQ ID NO: 2229089 - RNA, 16 nt, Homo sapiens
aacucugaagccacaa

SEQ ID NO: 2229090 - RNA, 19 nt, Homo sapiens
gucugggcucagacaucca

SEQ ID NO: 2229091 - RNA, 19 nt, Homo sapiens
cugucaccacaucuugucu

SEQ ID NO: 2229092 - RNA, 16 nt, Homo sapiens
agccauggcuggcaga

SEQ ID NO: 2229093 - RNA, 18 nt, Homo sapiens
caauaaaaccuggguguc

SEQ ID NO: 2229094 - RNA, 23 nt, Homo sapiens
ucaugccuguaaucccagcacua

SEQ ID NO: 2229095 - RNA, 23 nt, Homo sapiens
uaaacacccaugaaucaaagaca

SEQ ID NO: 2229096 - RNA, 18 nt, Homo sapiens
aucugaaacagcuucaug

SEQ ID NO: 2229097 - RNA, 13 nt, Homo sapiens
cuuaaccccagua

SEQ ID NO: 2229098 - RNA, 15 nt, Homo sapiens
uguacacacacagac

SEQ ID NO: 2229099 - RNA, 14 nt, Homo sapiens
gcuuuauugugauu

SEQ ID NO: 2229100 - RNA, 14 nt, Homo sapiens
augaaauuacuuau

SEQ ID NO: 2229101 - RNA, 18 nt, Homo sapiens
aagcaccucuccugugag

SEQ ID NO: 2229102 - RNA, 22 nt, Homo sapiens
uucaggaagcagcuuuccccau

SEQ ID NO: 2229103 - RNA, 12 nt, Homo sapiens
ccuugccuuaau

SEQ ID NO: 2229104 - RNA, 23 nt, Homo sapiens
uaaacuccuuccuggccugagag

SEQ ID NO: 2229105 - RNA, 14 nt, Homo sapiens
ccucuaaaaaccaa

SEQ ID NO: 2229106 - RNA, 22 nt, Homo sapiens
uggcaggagggcagugguggag

SEQ ID NO: 2229107 - RNA, 20 nt, Homo sapiens
caguacacccaguugccaaa

SEQ ID NO: 2229108 - RNA, 16 nt, Homo sapiens
ugaaauggauacuaca

SEQ ID NO: 2229109 - RNA, 18 nt, Homo sapiens
auugaagccuuugccagc

SEQ ID NO: 2229110 - RNA, 22 nt, Homo sapiens
caccgcgaggccuauuguugaa

SEQ ID NO: 2229111 - RNA, 14 nt, Homo sapiens
ucuguccuggucag

SEQ ID NO: 2229112 - RNA, 15 nt, Homo sapiens
guuugugauugccau

SEQ ID NO: 2229113 - RNA, 14 nt, Homo sapiens
augaauguaaauuu

SEQ ID NO: 2229114 - RNA, 20 nt, Homo sapiens
agccccggcugacaccugga

SEQ ID NO: 2229115 - RNA, 18 nt, Homo sapiens
caggguuggcaugacugu

SEQ ID NO: 2229116 - RNA, 17 nt, Homo sapiens
cacccuccaccgagcca

SEQ ID NO: 2229117 - RNA, 23 nt, Homo sapiens
gacaccacagccuccccuuccca

SEQ ID NO: 2229118 - RNA, 23 nt, Homo sapiens
uaagccaaaauuaagguguuuga

SEQ ID NO: 2229119 - RNA, 16 nt, Homo sapiens
gucaaccuuguuucua

SEQ ID NO: 2229120 - RNA, 15 nt, Homo sapiens
uacaugaauugcauu

SEQ ID NO: 2229121 - RNA, 21 nt, Homo sapiens
gggagccuccucugcuugcau

SEQ ID NO: 2229122 - RNA, 13 nt, Homo sapiens
cuuugaaugacaa

SEQ ID NO: 2229123 - RNA, 22 nt, Homo sapiens
acauccucugucuauuugagac

SEQ ID NO: 2229124 - RNA, 12 nt, Homo sapiens
guugcuugaaua

SEQ ID NO: 2229125 - RNA, 20 nt, Homo sapiens
uacuuccucugugaacugug

SEQ ID NO: 2229126 - RNA, 15 nt, Homo sapiens
acagaaacauuuuca

SEQ ID NO: 2229127 - RNA, 12 nt, Homo sapiens
auagaguggaau

SEQ ID NO: 2229128 - RNA, 23 nt, Homo sapiens
cauaauuuauacaggucauauua

SEQ ID NO: 2229129 - RNA, 21 nt, Homo sapiens
gaauaaggaggaggagggaga

SEQ ID NO: 2229130 - RNA, 16 nt, Homo sapiens
uaguuguccucagguu

SEQ ID NO: 2229131 - RNA, 13 nt, Homo sapiens
auuaagugcaauu

SEQ ID NO: 2229132 - RNA, 13 nt, Homo sapiens
auuuugugcaaaa

SEQ ID NO: 2229133 - RNA, 14 nt, Homo sapiens
gagagcaggacagg

SEQ ID NO: 2229134 - RNA, 18 nt, Homo sapiens
gccuggccggcuccaguu

SEQ ID NO: 2229135 - RNA, 16 nt, Homo sapiens
cuggucccaagacagu

SEQ ID NO: 2229136 - RNA, 21 nt, Homo sapiens
caguuaauuagcauucuggca

SEQ ID NO: 2229137 - RNA, 22 nt, Homo sapiens
acauguuggaggagagagccuu

SEQ ID NO: 2229138 - RNA, 14 nt, Homo sapiens
ugcccuagaucaac

SEQ ID NO: 2229139 - RNA, 16 nt, Homo sapiens
gcaccagaugaugucc

SEQ ID NO: 2229140 - RNA, 18 nt, Homo sapiens
ggcccuccucucccaucc

SEQ ID NO: 2229141 - RNA, 18 nt, Homo sapiens
uaccugaaggacagcuga

SEQ ID NO: 2229142 - RNA, 22 nt, Homo sapiens
aguucuccacuagcuauggugu

SEQ ID NO: 2229143 - RNA, 11 nt, Homo sapiens
ucuauaucuca

SEQ ID NO: 2229144 - RNA, 18 nt, Homo sapiens
aaaaccuaguacauuacu

SEQ ID NO: 2229145 - RNA, 19 nt, Homo sapiens
caguccuuuaaauuuugca

SEQ ID NO: 2229146 - RNA, 13 nt, Homo sapiens
ugcuucugcacac

SEQ ID NO: 2229147 - RNA, 18 nt, Homo sapiens
guaaaaaugcugcucuca

SEQ ID NO: 2229148 - RNA, 22 nt, Homo sapiens
augucuucaucacuucuuccac

SEQ ID NO: 2229149 - RNA, 14 nt, Homo sapiens
gcacugacugggac

SEQ ID NO: 2229150 - RNA, 21 nt, Homo sapiens
uguuuguaauaauaaaaccaa

SEQ ID NO: 2229151 - RNA, 19 nt, Homo sapiens
acuagucacauucuuguuu

SEQ ID NO: 2229152 - RNA, 23 nt, Homo sapiens
uaugcaggggcaaacaccugcug

SEQ ID NO: 2229153 - RNA, 18 nt, Homo sapiens
aauuucaauuucucccuu

SEQ ID NO: 2229154 - RNA, 17 nt, Homo sapiens
aucccuucucacagcac

SEQ ID NO: 2229155 - RNA, 22 nt, Homo sapiens
caggauuauuuugauuauauac

SEQ ID NO: 2229156 - RNA, 23 nt, Homo sapiens
cccucucccuggggauaugcaac

SEQ ID NO: 2229157 - RNA, 22 nt, Homo sapiens
guuucaaagcacauaugugcca

SEQ ID NO: 2229158 - RNA, 15 nt, Homo sapiens
aggguuuuaacuuug

SEQ ID NO: 2229159 - RNA, 22 nt, Homo sapiens
cugaagaacaguaacugccauc

SEQ ID NO: 2229160 - RNA, 19 nt, Homo sapiens
auaugagacguuuuuggaa

SEQ ID NO: 2229161 - RNA, 21 nt, Homo sapiens
gcaaaacagcccucagacugu

SEQ ID NO: 2229162 - RNA, 18 nt, Homo sapiens
ccauauuaacaaauugca

SEQ ID NO: 2229163 - RNA, 13 nt, Homo sapiens
uguugacaugugc

SEQ ID NO: 2229164 - RNA, 12 nt, Homo sapiens
caugcacugacc

SEQ ID NO: 2229165 - RNA, 13 nt, Homo sapiens
ccaccugcugcug

SEQ ID NO: 2229166 - RNA, 13 nt, Homo sapiens
ccaugugcugccc

SEQ ID NO: 2229167 - RNA, 22 nt, Homo sapiens
uacccauauaucuuauguuaaa

SEQ ID NO: 2229168 - RNA, 20 nt, Homo sapiens
uuugcccaguguuugugcaa

SEQ ID NO: 2229169 - RNA, 21 nt, Homo sapiens
ccuaacauacugcauuucacu

SEQ ID NO: 2229170 - RNA, 14 nt, Homo sapiens
cugaaaagccaugu

SEQ ID NO: 2229171 - RNA, 13 nt, Homo sapiens
aauugucuugcaa

SEQ ID NO: 2229172 - RNA, 19 nt, Homo sapiens
acaguuugagacuccaagc

SEQ ID NO: 2229173 - RNA, 15 nt, Homo sapiens
ucugccauguggcag

SEQ ID NO: 2229174 - RNA, 22 nt, Homo sapiens
gcccaggagagagaaagccagg

SEQ ID NO: 2229175 - RNA, 14 nt, Homo sapiens
auuaaucauuccau

SEQ ID NO: 2229176 - RNA, 14 nt, Homo sapiens
uucaaacaauucaa

SEQ ID NO: 2229177 - RNA, 14 nt, Homo sapiens
caaauguuguauaa

SEQ ID NO: 2229178 - RNA, 15 nt, Homo sapiens
gagcuccuaagccau

SEQ ID NO: 2229179 - RNA, 20 nt, Homo sapiens
uacaccugaggcugaggcag

SEQ ID NO: 2229180 - RNA, 18 nt, Homo sapiens
aguuucucucacauuacu

SEQ ID NO: 2229181 - RNA, 21 nt, Homo sapiens
cucuuuuauacaagaguguau

SEQ ID NO: 2229182 - RNA, 20 nt, Homo sapiens
gccagcacaggggccccaga

SEQ ID NO: 2229183 - RNA, 16 nt, Homo sapiens
aaaagcugacuacuug

SEQ ID NO: 2229184 - RNA, 20 nt, Homo sapiens
ccaauccauccugcucagga

SEQ ID NO: 2229185 - RNA, 13 nt, Homo sapiens
aucuaguuuacuu

SEQ ID NO: 2229186 - RNA, 21 nt, Homo sapiens
gccguccuggcgccuggcagu

SEQ ID NO: 2229187 - RNA, 18 nt, Homo sapiens
uuccucacacccaccugc

SEQ ID NO: 2229188 - RNA, 20 nt, Homo sapiens
uaguaaguaauaucaaagca

SEQ ID NO: 2229189 - RNA, 21 nt, Homo sapiens
cuuccucucaggcucuugacu

SEQ ID NO: 2229190 - RNA, 21 nt, Homo sapiens
uaaauaaauguaucuuauuca

SEQ ID NO: 2229191 - RNA, 22 nt, Homo sapiens
aauggucucaguguuaauacug

SEQ ID NO: 2229192 - RNA, 15 nt, Homo sapiens
ggagcccgugcagua

SEQ ID NO: 2229193 - RNA, 16 nt, Homo sapiens
gaaaaucacacugucu

SEQ ID NO: 2229194 - RNA, 18 nt, Homo sapiens
guaacaauuauguuuuca

SEQ ID NO: 2229195 - RNA, 21 nt, Homo sapiens
cuauugguaauaaaccuugau

SEQ ID NO: 2229196 - RNA, 22 nt, Homo sapiens
aucaagcuuuuaaaaacuagag

SEQ ID NO: 2229197 - RNA, 15 nt, Homo sapiens
ugcacagagcuggag

SEQ ID NO: 2229198 - RNA, 21 nt, Homo sapiens
uucuaauggcacuuaucauua

SEQ ID NO: 2229199 - RNA, 16 nt, Homo sapiens
agggaccugcugcuca

SEQ ID NO: 2229200 - RNA, 19 nt, Homo sapiens
aaacacucaacaaacuuag

SEQ ID NO: 2229201 - RNA, 15 nt, Homo sapiens
cugacauuuaguuga

SEQ ID NO: 2229202 - RNA, 23 nt, Homo sapiens
gauccgggcuguuguugaugcau

SEQ ID NO: 2229203 - RNA, 14 nt, Homo sapiens
caaaaagaaccacu

SEQ ID NO: 2229204 - RNA, 20 nt, Homo sapiens
ugcaagugaacaaagugaga

SEQ ID NO: 2229205 - RNA, 15 nt, Homo sapiens
gauuuuaacaauaac

SEQ ID NO: 2229206 - RNA, 23 nt, Homo sapiens
ucugcuccccagugcuaccucuc

SEQ ID NO: 2229207 - RNA, 14 nt, Homo sapiens
gcagcagugccaua

SEQ ID NO: 2229208 - RNA, 23 nt, Homo sapiens
guuuucuccuugauaucauucag

SEQ ID NO: 2229209 - RNA, 11 nt, Homo sapiens
aaaaggguuca

SEQ ID NO: 2229210 - RNA, 14 nt, Homo sapiens
ugcaggugggauga

SEQ ID NO: 2229211 - RNA, 14 nt, Homo sapiens
uccaaguggcauaa

SEQ ID NO: 2229212 - RNA, 17 nt, Homo sapiens
ccuacgcagaugcuguc

SEQ ID NO: 2229213 - RNA, 21 nt, Homo sapiens
uaacagauguagcaacaugag

SEQ ID NO: 2229214 - RNA, 22 nt, Homo sapiens
cugcauucuucugagcacuguu

SEQ ID NO: 2229215 - RNA, 14 nt, Homo sapiens
caucagaaacaucu

SEQ ID NO: 2229216 - RNA, 14 nt, Homo sapiens
ggauauugaugaaa

SEQ ID NO: 2229217 - RNA, 22 nt, Homo sapiens
gaggaccaggugucucugagaa

SEQ ID NO: 2229218 - RNA, 14 nt, Homo sapiens
auuugaaggccagc

SEQ ID NO: 2229219 - RNA, 18 nt, Homo sapiens
guuaccuuugcugucacu

SEQ ID NO: 2229220 - RNA, 23 nt, Homo sapiens
agccucugcagucgcuugccaaa

SEQ ID NO: 2229221 - RNA, 18 nt, Homo sapiens
uauauguauauacauaua

SEQ ID NO: 2229222 - RNA, 14 nt, Homo sapiens
gccgagccccagga

SEQ ID NO: 2229223 - RNA, 14 nt, Homo sapiens
gacccaccugcuag

SEQ ID NO: 2229224 - RNA, 13 nt, Homo sapiens
uacaaaucaucca

SEQ ID NO: 2229225 - RNA, 13 nt, Homo sapiens
aaucaaucuuuaa

SEQ ID NO: 2229226 - RNA, 16 nt, Homo sapiens
agaaugggccacugua

SEQ ID NO: 2229227 - RNA, 18 nt, Homo sapiens
ucccauguuagcuacaca

SEQ ID NO: 2229228 - RNA, 16 nt, Homo sapiens
cagauuuucagaggau

SEQ ID NO: 2229229 - RNA, 19 nt, Homo sapiens
ccauuuacaugcaccuuau

SEQ ID NO: 2229230 - RNA, 20 nt, Homo sapiens
gggagauucuggguuugccc

SEQ ID NO: 2229231 - RNA, 12 nt, Homo sapiens
caggagugccag

SEQ ID NO: 2229232 - RNA, 21 nt, Homo sapiens
ugucucgaugcaaugaacacu

SEQ ID NO: 2229233 - RNA, 23 nt, Homo sapiens
agaaacugaggccauuauuucaa

SEQ ID NO: 2229234 - RNA, 22 nt, Homo sapiens
aaccacacaaggagaacccaau

SEQ ID NO: 2229235 - RNA, 22 nt, Homo sapiens
agaauuucauucauuugugcuu

SEQ ID NO: 2229236 - RNA, 18 nt, Homo sapiens
cuuucuaaaacacauuua

SEQ ID NO: 2229237 - RNA, 18 nt, Homo sapiens
gacccagggaugacaugu

SEQ ID NO: 2229238 - RNA, 12 nt, Homo sapiens
cuauacaaguug

SEQ ID NO: 2229239 - RNA, 18 nt, Homo sapiens
uacuuccagcaaaaucca

SEQ ID NO: 2229240 - RNA, 17 nt, Homo sapiens
gcccucuucauuuagcc

SEQ ID NO: 2229241 - RNA, 18 nt, Homo sapiens
uaccagagaccugaggca

SEQ ID NO: 2229242 - RNA, 19 nt, Homo sapiens
ucauaauuuaaaaagucaa

SEQ ID NO: 2229243 - RNA, 16 nt, Homo sapiens
ugcgggcgaggucuga

SEQ ID NO: 2229244 - RNA, 22 nt, Homo sapiens
gucuguagagccgcauggcacu

SEQ ID NO: 2229245 - RNA, 22 nt, Homo sapiens
ucgccccuccaguguugccucc

SEQ ID NO: 2229246 - RNA, 24 nt, Homo sapiens
cucaaagaauguguaugguaucau

SEQ ID NO: 2229247 - RNA, 15 nt, Homo sapiens
aaaucucaaaacugu

SEQ ID NO: 2229248 - RNA, 18 nt, Homo sapiens
accugggaccaaccugac

SEQ ID NO: 2229249 - RNA, 12 nt, Homo sapiens
auugcuuugcca

SEQ ID NO: 2229250 - RNA, 17 nt, Homo sapiens
gaagcaggguacccuuu

SEQ ID NO: 2229251 - RNA, 22 nt, Homo sapiens
gagauauuucaagcucauguca

SEQ ID NO: 2229252 - RNA, 21 nt, Homo sapiens
aaucuugcugcaggcccuccc

SEQ ID NO: 2229253 - RNA, 14 nt, Homo sapiens
aaacugguuuauaa

SEQ ID NO: 2229254 - RNA, 13 nt, Homo sapiens
gagauccugcaca

SEQ ID NO: 2229255 - RNA, 22 nt, Homo sapiens
gcuccuucucucuuacauugaa

SEQ ID NO: 2229256 - RNA, 16 nt, Homo sapiens
cagccuacagccagaa

SEQ ID NO: 2229257 - RNA, 11 nt, Homo sapiens
aacuccugacu

SEQ ID NO: 2229258 - RNA, 16 nt, Homo sapiens
uagcgccaguguaauc

SEQ ID NO: 2229259 - RNA, 20 nt, Homo sapiens
cuccuggucgcuuugccauc

SEQ ID NO: 2229260 - RNA, 12 nt, Homo sapiens
aggugggagcau

SEQ ID NO: 2229261 - RNA, 21 nt, Homo sapiens
auuucaaacauuugucagaga

SEQ ID NO: 2229262 - RNA, 16 nt, Homo sapiens
uucuaauacaagcaua

SEQ ID NO: 2229263 - RNA, 16 nt, Homo sapiens
uugugaaggccaugau

SEQ ID NO: 2229264 - RNA, 14 nt, Homo sapiens
ugagccuucuacuu

SEQ ID NO: 2229265 - RNA, 22 nt, Homo sapiens
gcauuucauucuucucuagcug

SEQ ID NO: 2229266 - RNA, 17 nt, Homo sapiens
auguagcagauccccag

SEQ ID NO: 2229267 - RNA, 15 nt, Homo sapiens
guaacacaaagugaa

SEQ ID NO: 2229268 - RNA, 19 nt, Homo sapiens
cagaaacuaccagauuuga

SEQ ID NO: 2229269 - RNA, 16 nt, Homo sapiens
agucaaggucacuuaa

SEQ ID NO: 2229270 - RNA, 20 nt, Homo sapiens
caaugggagggggcuccaug

SEQ ID NO: 2229271 - RNA, 18 nt, Homo sapiens
cgagagcucuuaguuuuu

SEQ ID NO: 2229272 - RNA, 19 nt, Homo sapiens
caauuucacccauagcuaa

SEQ ID NO: 2229273 - RNA, 17 nt, Homo sapiens
gacucaucaauuuuguc

SEQ ID NO: 2229274 - RNA, 23 nt, Homo sapiens
acaccuuaauaaucauaggcacu

SEQ ID NO: 2229275 - RNA, 15 nt, Homo sapiens
ccaugucugcauuuc

SEQ ID NO: 2229276 - RNA, 16 nt, Homo sapiens
uuacuuaguauugcaa

SEQ ID NO: 2229277 - RNA, 21 nt, Homo sapiens
uauuuagaaauagaacuacaa

SEQ ID NO: 2229278 - RNA, 19 nt, Homo sapiens
ggccucagagacagcgcga

SEQ ID NO: 2229279 - RNA, 21 nt, Homo sapiens
uccagaguuguuguuugccaa

SEQ ID NO: 2229280 - RNA, 13 nt, Homo sapiens
cuuuuccauuucg

SEQ ID NO: 2229281 - RNA, 13 nt, Homo sapiens
cuuugccauuucu

SEQ ID NO: 2229282 - RNA, 21 nt, Homo sapiens
augcacacacacggaugcaca

SEQ ID NO: 2229283 - RNA, 20 nt, Homo sapiens
uagagaaauuagaacccaua

SEQ ID NO: 2229284 - RNA, 20 nt, Homo sapiens
ccuggguuuucuaacuguaa

SEQ ID NO: 2229285 - RNA, 13 nt, Homo sapiens
cuauuugcacacg

SEQ ID NO: 2229286 - RNA, 18 nt, Homo sapiens
gaauguugguuuacuuuc

SEQ ID NO: 2229287 - RNA, 19 nt, Homo sapiens
cuuggccggauguccucag

SEQ ID NO: 2229288 - RNA, 20 nt, Homo sapiens
aaucaggcuuugucugcucc

SEQ ID NO: 2229289 - RNA, 16 nt, Homo sapiens
caguuccuuaggagau

SEQ ID NO: 2229290 - RNA, 19 nt, Homo sapiens
aaaggagcauccuuaccuc

SEQ ID NO: 2229291 - RNA, 11 nt, Homo sapiens
aggccaggacu

SEQ ID NO: 2229292 - RNA, 20 nt, Homo sapiens
aucccaagucaaacagugug

SEQ ID NO: 2229293 - RNA, 23 nt, Homo sapiens
caggaguccacugccuccaugau

SEQ ID NO: 2229294 - RNA, 19 nt, Homo sapiens
uguuacuuuggcaauuucc

SEQ ID NO: 2229295 - RNA, 16 nt, Homo sapiens
uauauguuuggcugaa

SEQ ID NO: 2229296 - RNA, 18 nt, Homo sapiens
ggccuucuccacagggac

SEQ ID NO: 2229297 - RNA, 21 nt, Homo sapiens
gcauuguugagguggucugaa

SEQ ID NO: 2229298 - RNA, 12 nt, Homo sapiens
aucucuuucuac

SEQ ID NO: 2229299 - RNA, 13 nt, Homo sapiens
uaaaccuaugaau

SEQ ID NO: 2229300 - RNA, 20 nt, Homo sapiens
uggaaugggcagcucaucuc

SEQ ID NO: 2229301 - RNA, 16 nt, Homo sapiens
gaaugaacuugcauaa

SEQ ID NO: 2229302 - RNA, 18 nt, Homo sapiens
cugcaaucccagcuacuu

SEQ ID NO: 2229303 - RNA, 22 nt, Homo sapiens
uaucagcgccuccuuuacuucc

SEQ ID NO: 2229304 - RNA, 22 nt, Homo sapiens
auuucaaaugcaguccagugag

SEQ ID NO: 2229305 - RNA, 20 nt, Homo sapiens
cucuauggguaucaaacagc

SEQ ID NO: 2229306 - RNA, 20 nt, Homo sapiens
accccucaucaggaguucca

SEQ ID NO: 2229307 - RNA, 17 nt, Homo sapiens
gaaaaaugguggucauu

SEQ ID NO: 2229308 - RNA, 16 nt, Homo sapiens
uuccaucugauuccag

SEQ ID NO: 2229309 - RNA, 13 nt, Homo sapiens
ccagcaacuccaa

SEQ ID NO: 2229310 - RNA, 18 nt, Homo sapiens
agugccuugcccacaggu

SEQ ID NO: 2229311 - RNA, 17 nt, Homo sapiens
agauauccacuuaccug

SEQ ID NO: 2229312 - RNA, 23 nt, Homo sapiens
uguauaauuuucuacaaccuaag

SEQ ID NO: 2229313 - RNA, 18 nt, Homo sapiens
gcaacugacacucccacc

SEQ ID NO: 2229314 - RNA, 19 nt, Homo sapiens
ccagggccucugugcagac

SEQ ID NO: 2229315 - RNA, 19 nt, Homo sapiens
uguggcccagggaagccaa

SEQ ID NO: 2229316 - RNA, 22 nt, Homo sapiens
ugaaguucaccauuaaaaggga

SEQ ID NO: 2229317 - RNA, 17 nt, Homo sapiens
caguagugccugugauc

SEQ ID NO: 2229318 - RNA, 23 nt, Homo sapiens
agguuugguuugguuuuggacau

SEQ ID NO: 2229319 - RNA, 24 nt, Homo sapiens
uuccuuuauagagugucucagggu

SEQ ID NO: 2229320 - RNA, 16 nt, Homo sapiens
ccaacaccccacugag

SEQ ID NO: 2229321 - RNA, 15 nt, Homo sapiens
agaugaacaucucug

SEQ ID NO: 2229322 - RNA, 15 nt, Homo sapiens
ggcaaagcuggagau

SEQ ID NO: 2229323 - RNA, 18 nt, Homo sapiens
ccacacggcugaccucau

SEQ ID NO: 2229324 - RNA, 12 nt, Homo sapiens
auguauauguca

SEQ ID NO: 2229325 - RNA, 20 nt, Homo sapiens
ccaugcuucacucaugcaaa

SEQ ID NO: 2229326 - RNA, 15 nt, Homo sapiens
cugugccaggacugu

SEQ ID NO: 2229327 - RNA, 22 nt, Homo sapiens
gaaggcaccugcccccacagcu

SEQ ID NO: 2229328 - RNA, 16 nt, Homo sapiens
ucaccacuccauuccc

SEQ ID NO: 2229329 - RNA, 17 nt, Homo sapiens
auuucagagagcuucuu

SEQ ID NO: 2229330 - RNA, 18 nt, Homo sapiens
ggucgucaaugaugaguc

SEQ ID NO: 2229331 - RNA, 23 nt, Homo sapiens
ccugaaguucuuggauuacuuua

SEQ ID NO: 2229332 - RNA, 16 nt, Homo sapiens
uuacagggugacucac

SEQ ID NO: 2229333 - RNA, 15 nt, Homo sapiens
ugcagcagaaucucu

SEQ ID NO: 2229334 - RNA, 14 nt, Homo sapiens
ggagggcagccacg

SEQ ID NO: 2229335 - RNA, 22 nt, Homo sapiens
caagacuuuaguuaccgagaca

SEQ ID NO: 2229336 - RNA, 20 nt, Homo sapiens
cguaauuaaaggaacagagu

SEQ ID NO: 2229337 - RNA, 18 nt, Homo sapiens
gaaugcuccauuaaucca

SEQ ID NO: 2229338 - RNA, 17 nt, Homo sapiens
uuaugccuucacuuuac

SEQ ID NO: 2229339 - RNA, 18 nt, Homo sapiens
cuugaaauguaggcauca

SEQ ID NO: 2229340 - RNA, 19 nt, Homo sapiens
aacagcaggguaccugaaa

SEQ ID NO: 2229341 - RNA, 13 nt, Homo sapiens
gaucugaggacaa

SEQ ID NO: 2229342 - RNA, 11 nt, Homo sapiens
uccacagcuua

SEQ ID NO: 2229343 - RNA, 18 nt, Homo sapiens
acauuaagagaacaaaga

SEQ ID NO: 2229344 - RNA, 16 nt, Homo sapiens
gcaggaggaucacuuu

SEQ ID NO: 2229345 - RNA, 19 nt, Homo sapiens
agcuccucgagggcaggga

SEQ ID NO: 2229346 - RNA, 17 nt, Homo sapiens
uccuggggaggucugag

SEQ ID NO: 2229347 - RNA, 20 nt, Homo sapiens
ucacacaguggcacuagcau

SEQ ID NO: 2229348 - RNA, 19 nt, Homo sapiens
auaaugugcaaaucugaca

SEQ ID NO: 2229349 - RNA, 14 nt, Homo sapiens
cauucuuuuguuua

SEQ ID NO: 2229350 - RNA, 15 nt, Homo sapiens
ccugauggugcugcu

SEQ ID NO: 2229351 - RNA, 16 nt, Homo sapiens
aaaagcgacccauuca

SEQ ID NO: 2229352 - RNA, 15 nt, Homo sapiens
acauuugucagugau

SEQ ID NO: 2229353 - RNA, 22 nt, Homo sapiens
uaaaaccuguucucuuuaauca

SEQ ID NO: 2229354 - RNA, 16 nt, Homo sapiens
gacaugugaaaccuuu

SEQ ID NO: 2229355 - RNA, 17 nt, Homo sapiens
ugguguggcacugggag

SEQ ID NO: 2229356 - RNA, 23 nt, Homo sapiens
acccagggggcugaaacuugaac

SEQ ID NO: 2229357 - RNA, 17 nt, Homo sapiens
guuaugaaaaacagaag

SEQ ID NO: 2229358 - RNA, 21 nt, Homo sapiens
cguuucccagagucaucugau

SEQ ID NO: 2229359 - RNA, 14 nt, Homo sapiens
caaaugugaagggg

SEQ ID NO: 2229360 - RNA, 22 nt, Homo sapiens
caccguccugucagcuccuuga

SEQ ID NO: 2229361 - RNA, 17 nt, Homo sapiens
uguuaccguucaccagu

SEQ ID NO: 2229362 - RNA, 18 nt, Homo sapiens
acugaaggccuggcccac

SEQ ID NO: 2229363 - RNA, 19 nt, Homo sapiens
gacagucaaggagaugagc

SEQ ID NO: 2229364 - RNA, 15 nt, Homo sapiens
auugcaacaaugcaa

SEQ ID NO: 2229365 - RNA, 15 nt, Homo sapiens
uacagaacuucagaa

SEQ ID NO: 2229366 - RNA, 17 nt, Homo sapiens
accuuuggaugcacuuu

SEQ ID NO: 2229367 - RNA, 19 nt, Homo sapiens
aagaacguacuuucuguua

SEQ ID NO: 2229368 - RNA, 16 nt, Homo sapiens
acagcacuggggaguc

SEQ ID NO: 2229369 - RNA, 15 nt, Homo sapiens
guuuguaaaugccuc

SEQ ID NO: 2229370 - RNA, 22 nt, Homo sapiens
ugcaauaaugacaaaugcccug

SEQ ID NO: 2229371 - RNA, 19 nt, Homo sapiens
cucauaugauugugcacau

SEQ ID NO: 2229372 - RNA, 22 nt, Homo sapiens
ccccaggcacuuugcaucacag

SEQ ID NO: 2229373 - RNA, 20 nt, Homo sapiens
gaacuguccacaucugccuc

SEQ ID NO: 2229374 - RNA, 20 nt, Homo sapiens
auauaccacauuuucuuuau

SEQ ID NO: 2229375 - RNA, 23 nt, Homo sapiens
ccgcaacaguuuuuuaugcuaau

SEQ ID NO: 2229376 - RNA, 19 nt, Homo sapiens
uuuucaucccguaucacag

SEQ ID NO: 2229377 - RNA, 15 nt, Homo sapiens
aagacucuaugcucu

SEQ ID NO: 2229378 - RNA, 20 nt, Homo sapiens
acauaccuacaccuaucuau

SEQ ID NO: 2229379 - RNA, 14 nt, Homo sapiens
ugcacgaucucagu

SEQ ID NO: 2229380 - RNA, 17 nt, Homo sapiens
cccccgaacggcauucu

SEQ ID NO: 2229381 - RNA, 23 nt, Homo sapiens
uggcccccgagcugggggccaug

SEQ ID NO: 2229382 - RNA, 12 nt, Homo sapiens
gaggcuugcuga

SEQ ID NO: 2229383 - RNA, 22 nt, Homo sapiens
accaagauuaugugacuugcaa

SEQ ID NO: 2229384 - RNA, 20 nt, Homo sapiens
gggcucccuucccaccucuc

SEQ ID NO: 2229385 - RNA, 20 nt, Homo sapiens
aauuauaagcauacaacugg

SEQ ID NO: 2229386 - RNA, 21 nt, Homo sapiens
agacagcuggacccauuugcc

SEQ ID NO: 2229387 - RNA, 17 nt, Homo sapiens
accucacugacacaggg

SEQ ID NO: 2229388 - RNA, 17 nt, Homo sapiens
agcaaaggcccaugccc

SEQ ID NO: 2229389 - RNA, 21 nt, Homo sapiens
cuaacguuucccguuagucuc

SEQ ID NO: 2229390 - RNA, 16 nt, Homo sapiens
agaugucuuccuauca

SEQ ID NO: 2229391 - RNA, 21 nt, Homo sapiens
aauguguuguuccaaauacua

SEQ ID NO: 2229392 - RNA, 15 nt, Homo sapiens
ggccuccaagccagg

SEQ ID NO: 2229393 - RNA, 14 nt, Homo sapiens
acuucagaccaucu

SEQ ID NO: 2229394 - RNA, 14 nt, Homo sapiens
aaaauagacauauu

SEQ ID NO: 2229395 - RNA, 16 nt, Homo sapiens
caaaauguguuucaua

SEQ ID NO: 2229396 - RNA, 21 nt, Homo sapiens
cugcucugugcccacccucca

SEQ ID NO: 2229397 - RNA, 22 nt, Homo sapiens
ugccuucugguuauuuaugguu

SEQ ID NO: 2229398 - RNA, 18 nt, Homo sapiens
ucuuaaaacacuuuucaa

SEQ ID NO: 2229399 - RNA, 21 nt, Homo sapiens
ccacggagaggaaaagcagau

SEQ ID NO: 2229400 - RNA, 15 nt, Homo sapiens
acaaucaaaacacac

SEQ ID NO: 2229401 - RNA, 14 nt, Homo sapiens
aguagcugagcuca

SEQ ID NO: 2229402 - RNA, 22 nt, Homo sapiens
cagauucagacuuggacuauga

SEQ ID NO: 2229403 - RNA, 19 nt, Homo sapiens
augcacugaaaacuuagcc

SEQ ID NO: 2229404 - RNA, 18 nt, Homo sapiens
aucaagaagggcugcaug

SEQ ID NO: 2229405 - RNA, 14 nt, Homo sapiens
gcccagaauugcau

SEQ ID NO: 2229406 - RNA, 19 nt, Homo sapiens
agcauccaaggaacuucau

SEQ ID NO: 2229407 - RNA, 17 nt, Homo sapiens
aaaucaaguauuggcaa

SEQ ID NO: 2229408 - RNA, 20 nt, Homo sapiens
gguugauuguuuaagccaga

SEQ ID NO: 2229409 - RNA, 15 nt, Homo sapiens
uccaggccugcauua

SEQ ID NO: 2229410 - RNA, 14 nt, Homo sapiens
agaugucauuacaa

SEQ ID NO: 2229411 - RNA, 13 nt, Homo sapiens
uuuuugguguaua

SEQ ID NO: 2229412 - RNA, 21 nt, Homo sapiens
gggauaaccccaggcacuguu

SEQ ID NO: 2229413 - RNA, 18 nt, Homo sapiens
ccuucggcagcuacucag

SEQ ID NO: 2229414 - RNA, 23 nt, Homo sapiens
guguauuuaaccuugaaggguuc

SEQ ID NO: 2229415 - RNA, 14 nt, Homo sapiens
cucaauaugugauu

SEQ ID NO: 2229416 - RNA, 23 nt, Homo sapiens
auccuagucacuaccuucaugca

SEQ ID NO: 2229417 - RNA, 18 nt, Homo sapiens
gagggcgccaugcagcgg

SEQ ID NO: 2229418 - RNA, 14 nt, Homo sapiens
ggcugucgggguca

SEQ ID NO: 2229419 - RNA, 19 nt, Homo sapiens
uuaaauuauuuuuguucau

SEQ ID NO: 2229420 - RNA, 21 nt, Homo sapiens
aacaaugacuuguacucugaa

SEQ ID NO: 2229421 - RNA, 12 nt, Homo sapiens
ugugaugugcau

SEQ ID NO: 2229422 - RNA, 16 nt, Homo sapiens
acaggccagcaggggc

SEQ ID NO: 2229423 - RNA, 13 nt, Homo sapiens
ugugcaugccaug

SEQ ID NO: 2229424 - RNA, 14 nt, Homo sapiens
caucuaaggacaag

SEQ ID NO: 2229425 - RNA, 18 nt, Homo sapiens
ucuuauaauacucuguug

SEQ ID NO: 2229426 - RNA, 17 nt, Homo sapiens
ucgauugaaauuuugca

SEQ ID NO: 2229427 - RNA, 18 nt, Homo sapiens
uugaucaagaaugcaaua

SEQ ID NO: 2229428 - RNA, 23 nt, Homo sapiens
agagugggcagccccucuaccuc

SEQ ID NO: 2229429 - RNA, 16 nt, Homo sapiens
gauucuagcacaucau

SEQ ID NO: 2229430 - RNA, 15 nt, Homo sapiens
uaagaugacuguguu

SEQ ID NO: 2229431 - RNA, 15 nt, Homo sapiens
acaaaauggauacau

SEQ ID NO: 2229432 - RNA, 18 nt, Homo sapiens
cccuaacacuuaccccau

SEQ ID NO: 2229433 - RNA, 13 nt, Homo sapiens
cccgacagccugg

SEQ ID NO: 2229434 - RNA, 21 nt, Homo sapiens
uuggugaaacuacaucuccaa

SEQ ID NO: 2229435 - RNA, 20 nt, Homo sapiens
uaccccgagggcgccaugca

SEQ ID NO: 2229436 - RNA, 23 nt, Homo sapiens
agaaguuuaaggaauaugggaga

SEQ ID NO: 2229437 - RNA, 15 nt, Homo sapiens
auaaugacucagaau

SEQ ID NO: 2229438 - RNA, 15 nt, Homo sapiens
gucccaggcagggag

SEQ ID NO: 2229439 - RNA, 23 nt, Homo sapiens
aaugcucaguaacacagugcagu

SEQ ID NO: 2229440 - RNA, 16 nt, Homo sapiens
acaugaggccaucuca

SEQ ID NO: 2229441 - RNA, 12 nt, Homo sapiens
ugaauucuacua

SEQ ID NO: 2229442 - RNA, 21 nt, Homo sapiens
auaauguaucccgauaacuuu

SEQ ID NO: 2229443 - RNA, 13 nt, Homo sapiens
gucagaaacugcc

SEQ ID NO: 2229444 - RNA, 18 nt, Homo sapiens
ucagauccuguuacuugc

SEQ ID NO: 2229445 - RNA, 18 nt, Homo sapiens
gagauucuggcuaguguc

SEQ ID NO: 2229446 - RNA, 21 nt, Homo sapiens
ccaaguagcugggaguacagg

SEQ ID NO: 2229447 - RNA, 17 nt, Homo sapiens
uccuccccuccuggcac

SEQ ID NO: 2229448 - RNA, 15 nt, Homo sapiens
auacauuaugcuuga

SEQ ID NO: 2229449 - RNA, 18 nt, Homo sapiens
aggcucuaauguacaaua

SEQ ID NO: 2229450 - RNA, 19 nt, Homo sapiens
aacacauucugcuaugaau

SEQ ID NO: 2229451 - RNA, 16 nt, Homo sapiens
auguggauaacuuuac

SEQ ID NO: 2229452 - RNA, 16 nt, Homo sapiens
ugaagugguugcauuc

SEQ ID NO: 2229453 - RNA, 23 nt, Homo sapiens
caagacacagaauaguuuacaca

SEQ ID NO: 2229454 - RNA, 23 nt, Homo sapiens
cuucuuucagacuugccauguga

SEQ ID NO: 2229455 - RNA, 19 nt, Homo sapiens
aauaauggaaaaugccaug

SEQ ID NO: 2229456 - RNA, 15 nt, Homo sapiens
gacacagacuggcaa

SEQ ID NO: 2229457 - RNA, 23 nt, Homo sapiens
uuuaauguggcaaguuugcagau

SEQ ID NO: 2229458 - RNA, 23 nt, Homo sapiens
ucucaaaggguacuuccacugau

SEQ ID NO: 2229459 - RNA, 16 nt, Homo sapiens
gaaaagccaaauaaaa

SEQ ID NO: 2229460 - RNA, 19 nt, Homo sapiens
acuguggagguacacucuu

SEQ ID NO: 2229461 - RNA, 13 nt, Homo sapiens
aagguccucuucu

SEQ ID NO: 2229462 - RNA, 16 nt, Homo sapiens
cugggcugucugucac

SEQ ID NO: 2229463 - RNA, 16 nt, Homo sapiens
ggaugacaaaauggaa

SEQ ID NO: 2229464 - RNA, 15 nt, Homo sapiens
auuuuucauacuuuu

SEQ ID NO: 2229465 - RNA, 20 nt, Homo sapiens
agaggaaggaaacauagaaa

SEQ ID NO: 2229466 - RNA, 17 nt, Homo sapiens
uuccuaaagcaugggau

SEQ ID NO: 2229467 - RNA, 12 nt, Homo sapiens
auguuagccuca

SEQ ID NO: 2229468 - RNA, 12 nt, Homo sapiens
uucaaugaacau

SEQ ID NO: 2229469 - RNA, 14 nt, Homo sapiens
cguuggagacugaa

SEQ ID NO: 2229470 - RNA, 15 nt, Homo sapiens
cuucuccaguuagaa

SEQ ID NO: 2229471 - RNA, 18 nt, Homo sapiens
ccuggcuugucggagcaa

SEQ ID NO: 2229472 - RNA, 17 nt, Homo sapiens
aagccaugggaccuccu

SEQ ID NO: 2229473 - RNA, 13 nt, Homo sapiens
ugaaauaucauca

SEQ ID NO: 2229474 - RNA, 17 nt, Homo sapiens
auggaauacugaagggc

SEQ ID NO: 2229475 - RNA, 22 nt, Homo sapiens
caggcuuguuaccaccaugcuc

SEQ ID NO: 2229476 - RNA, 23 nt, Homo sapiens
aaguggcucugggguccucacau

SEQ ID NO: 2229477 - RNA, 12 nt, Homo sapiens
cgugugugcaag

SEQ ID NO: 2229478 - RNA, 16 nt, Homo sapiens
uccaacuuucccucca

SEQ ID NO: 2229479 - RNA, 17 nt, Homo sapiens
ugagaaauuugccuugu

SEQ ID NO: 2229480 - RNA, 18 nt, Homo sapiens
cauacauaagcagcauuu

SEQ ID NO: 2229481 - RNA, 18 nt, Homo sapiens
uucacaucagaagcagua

SEQ ID NO: 2229482 - RNA, 12 nt, Homo sapiens
cuuacacugccu

SEQ ID NO: 2229483 - RNA, 17 nt, Homo sapiens
agguggagacccugaga

SEQ ID NO: 2229484 - RNA, 15 nt, Homo sapiens
uggaaaccacaguca

SEQ ID NO: 2229485 - RNA, 18 nt, Homo sapiens
aagacuauuuaguggaac

SEQ ID NO: 2229486 - RNA, 17 nt, Homo sapiens
guuuuccccacauucua

SEQ ID NO: 2229487 - RNA, 21 nt, Homo sapiens
gagcauagcagaggggccagg

SEQ ID NO: 2229488 - RNA, 21 nt, Homo sapiens
caccuuccagcuccuguaaca

SEQ ID NO: 2229489 - RNA, 20 nt, Homo sapiens
caccccaaguagucugcuca

SEQ ID NO: 2229490 - RNA, 22 nt, Homo sapiens
cccuguaaguuacagucacaau

SEQ ID NO: 2229491 - RNA, 23 nt, Homo sapiens
acaccccugcucuacccaugagc

SEQ ID NO: 2229492 - RNA, 20 nt, Homo sapiens
ggaaagcauaugcagccaac

SEQ ID NO: 2229493 - RNA, 17 nt, Homo sapiens
gucugaauucuggaauc

SEQ ID NO: 2229494 - RNA, 16 nt, Homo sapiens
caacauugugauguau

SEQ ID NO: 2229495 - RNA, 13 nt, Homo sapiens
uauugucuaguga

SEQ ID NO: 2229496 - RNA, 11 nt, Homo sapiens
ugccacggugg

SEQ ID NO: 2229497 - RNA, 20 nt, Homo sapiens
caccuacccagggcugccgc

SEQ ID NO: 2229498 - RNA, 19 nt, Homo sapiens
agaacuucugccucuaagc

SEQ ID NO: 2229499 - RNA, 20 nt, Homo sapiens
aggcaacaggggcacaagcc

SEQ ID NO: 2229500 - RNA, 20 nt, Homo sapiens
auguaaaugcuugauggaau

SEQ ID NO: 2229501 - RNA, 11 nt, Homo sapiens
agcugccauuu

SEQ ID NO: 2229502 - RNA, 13 nt, Homo sapiens
ggcugagcugaac

SEQ ID NO: 2229503 - RNA, 14 nt, Homo sapiens
ccugggcaauguga

SEQ ID NO: 2229504 - RNA, 19 nt, Homo sapiens
aaagagacauauacuaaga

SEQ ID NO: 2229505 - RNA, 19 nt, Homo sapiens
agacaugguauugacucaa

SEQ ID NO: 2229506 - RNA, 19 nt, Homo sapiens
ccauuccaauacauugaac

SEQ ID NO: 2229507 - RNA, 20 nt, Homo sapiens
aggaaauuaaagucuuccau

SEQ ID NO: 2229508 - RNA, 15 nt, Homo sapiens
uugcaggcaugcaug

SEQ ID NO: 2229509 - RNA, 12 nt, Homo sapiens
ggaggagcagug

SEQ ID NO: 2229510 - RNA, 14 nt, Homo sapiens
cugugauuaccucu

SEQ ID NO: 2229511 - RNA, 16 nt, Homo sapiens
auguuucacugugcaa

SEQ ID NO: 2229512 - RNA, 23 nt, Homo sapiens
cuucucugcuaucuagaucugaa

SEQ ID NO: 2229513 - RNA, 20 nt, Homo sapiens
agccaagaauucuuaaauau

SEQ ID NO: 2229514 - RNA, 19 nt, Homo sapiens
gucucgccaagcaggacag

SEQ ID NO: 2229515 - RNA, 20 nt, Homo sapiens
uaggccugguguguucaaga

SEQ ID NO: 2229516 - RNA, 15 nt, Homo sapiens
ucuccuggcuuccca

SEQ ID NO: 2229517 - RNA, 12 nt, Homo sapiens
uaccccucauuu

SEQ ID NO: 2229518 - RNA, 14 nt, Homo sapiens
acauuauccugugu

SEQ ID NO: 2229519 - RNA, 16 nt, Homo sapiens
caacuucuaaacacaa

SEQ ID NO: 2229520 - RNA, 20 nt, Homo sapiens
auuuugauuuuuaauggaaa

SEQ ID NO: 2229521 - RNA, 13 nt, Homo sapiens
augucuaaccuga

SEQ ID NO: 2229522 - RNA, 18 nt, Homo sapiens
cccaggccaucaccacag

SEQ ID NO: 2229523 - RNA, 17 nt, Homo sapiens
cacggaggccagacaca

SEQ ID NO: 2229524 - RNA, 17 nt, Homo sapiens
cgugggccugagaccaa

SEQ ID NO: 2229525 - RNA, 21 nt, Homo sapiens
gcuaugugagcucaccagucc

SEQ ID NO: 2229526 - RNA, 14 nt, Homo sapiens
gcuaagccugauga

SEQ ID NO: 2229527 - RNA, 14 nt, Homo sapiens
ucuguugacugggg

SEQ ID NO: 2229528 - RNA, 15 nt, Homo sapiens
cagcucaaaggcaca

SEQ ID NO: 2229529 - RNA, 21 nt, Homo sapiens
auccacacggcugaccucaua

SEQ ID NO: 2229530 - RNA, 20 nt, Homo sapiens
cucugaaagaugcaucaucu

SEQ ID NO: 2229531 - RNA, 14 nt, Homo sapiens
cucccaagcguucc

SEQ ID NO: 2229532 - RNA, 22 nt, Homo sapiens
aucacaugaaggagacagcagc

SEQ ID NO: 2229533 - RNA, 22 nt, Homo sapiens
uucauuuaauggggauuccacu

SEQ ID NO: 2229534 - RNA, 14 nt, Homo sapiens
caaugugcuccuuc

SEQ ID NO: 2229535 - RNA, 21 nt, Homo sapiens
agucuucccucagauuuccau

SEQ ID NO: 2229536 - RNA, 22 nt, Homo sapiens
acucaaguuucagguaugcuua

SEQ ID NO: 2229537 - RNA, 18 nt, Homo sapiens
caaauuucuaaaacucca

SEQ ID NO: 2229538 - RNA, 11 nt, Homo sapiens
cauucaucuca

SEQ ID NO: 2229539 - RNA, 19 nt, Homo sapiens
guaaucucuaggaagucaa

SEQ ID NO: 2229540 - RNA, 14 nt, Homo sapiens
gguucacuugccau

SEQ ID NO: 2229541 - RNA, 19 nt, Homo sapiens
guggugcccaugaggacaa

SEQ ID NO: 2229542 - RNA, 20 nt, Homo sapiens
uucagguuagugacauuuaa

SEQ ID NO: 2229543 - RNA, 13 nt, Homo sapiens
cgcuaucuagcaa

SEQ ID NO: 2229544 - RNA, 14 nt, Homo sapiens
cuuuguacccccca

SEQ ID NO: 2229545 - RNA, 12 nt, Homo sapiens
aagaacauguag

SEQ ID NO: 2229546 - RNA, 12 nt, Homo sapiens
aaaaacaugugg

SEQ ID NO: 2229547 - RNA, 22 nt, Homo sapiens
agagguugaggaugcacuggcc

SEQ ID NO: 2229548 - RNA, 24 nt, Homo sapiens
ugcacucacgcucagcacacaugc

SEQ ID NO: 2229549 - RNA, 19 nt, Homo sapiens
uguguacauuagucauuca

SEQ ID NO: 2229550 - RNA, 18 nt, Homo sapiens
gcccagcucaugcacauc

SEQ ID NO: 2229551 - RNA, 20 nt, Homo sapiens
cacccagggcccccaaagag

SEQ ID NO: 2229552 - RNA, 17 nt, Homo sapiens
ugggauuggcugugaac

SEQ ID NO: 2229553 - RNA, 17 nt, Homo sapiens
ggacugggacacuuuua

SEQ ID NO: 2229554 - RNA, 20 nt, Homo sapiens
augaccagcagcagcuuuca

SEQ ID NO: 2229555 - RNA, 21 nt, Homo sapiens
gacagaaggaacacugcuuga

SEQ ID NO: 2229556 - RNA, 15 nt, Homo sapiens
acauccaacuccagc

SEQ ID NO: 2229557 - RNA, 16 nt, Homo sapiens
uuucucagacuuugga

SEQ ID NO: 2229558 - RNA, 14 nt, Homo sapiens
ucuucaacaugguu

SEQ ID NO: 2229559 - RNA, 19 nt, Homo sapiens
auguacaucuggccuugaa

SEQ ID NO: 2229560 - RNA, 16 nt, Homo sapiens
cugcuuucccaaaggc

SEQ ID NO: 2229561 - RNA, 14 nt, Homo sapiens
cauccgguuuaguc

SEQ ID NO: 2229562 - RNA, 14 nt, Homo sapiens
cuggugggugccua

SEQ ID NO: 2229563 - RNA, 17 nt, Homo sapiens
uuccccacugcucucug

SEQ ID NO: 2229564 - RNA, 11 nt, Homo sapiens
ucggcuggaag

SEQ ID NO: 2229565 - RNA, 11 nt, Homo sapiens
ucagcuggaaa

SEQ ID NO: 2229566 - RNA, 18 nt, Homo sapiens
auaauacauggcuaucau

SEQ ID NO: 2229567 - RNA, 22 nt, Homo sapiens
ggcuggggacucuggcacagug

SEQ ID NO: 2229568 - RNA, 21 nt, Homo sapiens
gcacuuuuguuauuccaucaa

SEQ ID NO: 2229569 - RNA, 14 nt, Homo sapiens
ucaauaugugauuu

SEQ ID NO: 2229570 - RNA, 20 nt, Homo sapiens
aacucaaacgaugugcaaua

SEQ ID NO: 2229571 - RNA, 21 nt, Homo sapiens
accagugcauccuucaucaca

SEQ ID NO: 2229572 - RNA, 20 nt, Homo sapiens
agaggggaacagacuggaag

SEQ ID NO: 2229573 - RNA, 17 nt, Homo sapiens
ucuacuaccacaaggaa

SEQ ID NO: 2229574 - RNA, 18 nt, Homo sapiens
uuaaucuucucucuugau

SEQ ID NO: 2229575 - RNA, 17 nt, Homo sapiens
gucugcuguugauucca

SEQ ID NO: 2229576 - RNA, 14 nt, Homo sapiens
aauguaacuuccuc

SEQ ID NO: 2229577 - RNA, 14 nt, Homo sapiens
uuauuuuucuuguc

SEQ ID NO: 2229578 - RNA, 23 nt, Homo sapiens
caccuuucauaaucuuugcuuua

SEQ ID NO: 2229579 - RNA, 21 nt, Homo sapiens
ccuagcauagguaugagccag

SEQ ID NO: 2229580 - RNA, 22 nt, Homo sapiens
aucuucaaacauguacaaaauc

SEQ ID NO: 2229581 - RNA, 13 nt, Homo sapiens
uccauuagucaau

SEQ ID NO: 2229582 - RNA, 18 nt, Homo sapiens
acccaaacuguguguagu

SEQ ID NO: 2229583 - RNA, 14 nt, Homo sapiens
ugccucuucuacuu

SEQ ID NO: 2229584 - RNA, 18 nt, Homo sapiens
agcuaaccuuauccugca

SEQ ID NO: 2229585 - RNA, 20 nt, Homo sapiens
cugagguaaagguccaugaa

SEQ ID NO: 2229586 - RNA, 19 nt, Homo sapiens
agcaaauaaaugccuucca

SEQ ID NO: 2229587 - RNA, 20 nt, Homo sapiens
acucuggagagacugugcug

SEQ ID NO: 2229588 - RNA, 18 nt, Homo sapiens
accaggcaaagcaaguga

SEQ ID NO: 2229589 - RNA, 13 nt, Homo sapiens
auaucaugucuug

SEQ ID NO: 2229590 - RNA, 18 nt, Homo sapiens
aaauguuuauacuguauu

SEQ ID NO: 2229591 - RNA, 16 nt, Homo sapiens
ggccuucacagugacc

SEQ ID NO: 2229592 - RNA, 17 nt, Homo sapiens
ccgcgcaaggggaagcc

SEQ ID NO: 2229593 - RNA, 16 nt, Homo sapiens
uuuuaauucaguacaa

SEQ ID NO: 2229594 - RNA, 16 nt, Homo sapiens
ugcaguagacugcagu

SEQ ID NO: 2229595 - RNA, 16 nt, Homo sapiens
ggguggggacagacca

SEQ ID NO: 2229596 - RNA, 13 nt, Homo sapiens
gucgucaccuggg

SEQ ID NO: 2229597 - RNA, 22 nt, Homo sapiens
ucaccaauaaauaagugcauuu

SEQ ID NO: 2229598 - RNA, 21 nt, Homo sapiens
gaaguagauuaagagccauau

SEQ ID NO: 2229599 - RNA, 17 nt, Homo sapiens
ugacucagagugcaaga

SEQ ID NO: 2229600 - RNA, 19 nt, Homo sapiens
gauuuuaugaaaugaccuc

SEQ ID NO: 2229601 - RNA, 14 nt, Homo sapiens
cagagccuucacaa

SEQ ID NO: 2229602 - RNA, 17 nt, Homo sapiens
ugaggcggauggcugug

SEQ ID NO: 2229603 - RNA, 16 nt, Homo sapiens
gggaaggaagggacac

SEQ ID NO: 2229604 - RNA, 12 nt, Homo sapiens
caucuuucacau

SEQ ID NO: 2229605 - RNA, 18 nt, Homo sapiens
uaaaaggacagagauuaa

SEQ ID NO: 2229606 - RNA, 19 nt, Homo sapiens
gcaguauugccacaaugcc

SEQ ID NO: 2229607 - RNA, 21 nt, Homo sapiens
cccgggccagggcugccccua

SEQ ID NO: 2229608 - RNA, 19 nt, Homo sapiens
auccuguucucugaagaug

SEQ ID NO: 2229609 - RNA, 16 nt, Homo sapiens
ugacuguaucuugaua

SEQ ID NO: 2229610 - RNA, 16 nt, Homo sapiens
gaagggcagugacucg

SEQ ID NO: 2229611 - RNA, 17 nt, Homo sapiens
agugccugguguucuga

SEQ ID NO: 2229612 - RNA, 17 nt, Homo sapiens
ugugccccguguucccu

SEQ ID NO: 2229613 - RNA, 17 nt, Homo sapiens
guaaguauaaaugaauu

SEQ ID NO: 2229614 - RNA, 14 nt, Homo sapiens
cuuuugcacaagga

SEQ ID NO: 2229615 - RNA, 16 nt, Homo sapiens
uagcgaaucaucucaa

SEQ ID NO: 2229616 - RNA, 13 nt, Homo sapiens
augugauguggug

SEQ ID NO: 2229617 - RNA, 22 nt, Homo sapiens
auuuauaaaugagcaaauggaa

SEQ ID NO: 2229618 - RNA, 19 nt, Homo sapiens
augauccccaaguggugaa

SEQ ID NO: 2229619 - RNA, 20 nt, Homo sapiens
aguauaacuaauuugcucug

SEQ ID NO: 2229620 - RNA, 17 nt, Homo sapiens
cuaauagucuuugccag

SEQ ID NO: 2229621 - RNA, 17 nt, Homo sapiens
auaucuauaguagacac

SEQ ID NO: 2229622 - RNA, 20 nt, Homo sapiens
ccaaagggcaguggguggag

SEQ ID NO: 2229623 - RNA, 20 nt, Homo sapiens
gaaaagaaauugcaugcagu

SEQ ID NO: 2229624 - RNA, 20 nt, Homo sapiens
cgacccccucucccugcaug

SEQ ID NO: 2229625 - RNA, 17 nt, Homo sapiens
ccacaugccaauuucag

SEQ ID NO: 2229626 - RNA, 17 nt, Homo sapiens
uaaaguaugcaugcagu

SEQ ID NO: 2229627 - RNA, 16 nt, Homo sapiens
uugacgcaccuguggu

SEQ ID NO: 2229628 - RNA, 15 nt, Homo sapiens
cuuugcugauuuccc

SEQ ID NO: 2229629 - RNA, 15 nt, Homo sapiens
ugggcuuuggagcug

SEQ ID NO: 2229630 - RNA, 17 nt, Homo sapiens
aacaguugugucauaaa

SEQ ID NO: 2229631 - RNA, 15 nt, Homo sapiens
cacuguagucucgac

SEQ ID NO: 2229632 - RNA, 15 nt, Homo sapiens
ucuuuuguuguccuu

SEQ ID NO: 2229633 - RNA, 18 nt, Homo sapiens
ugggcagggugacccuga

SEQ ID NO: 2229634 - RNA, 21 nt, Homo sapiens
uacaccagcaauuuagacaaa

SEQ ID NO: 2229635 - RNA, 21 nt, Homo sapiens
gaaaggagaacuauccaaaac

SEQ ID NO: 2229636 - RNA, 20 nt, Homo sapiens
gugcagggccguaguaccuc

SEQ ID NO: 2229637 - RNA, 16 nt, Homo sapiens
ggacagaacauugccu

SEQ ID NO: 2229638 - RNA, 16 nt, Homo sapiens
agggaaggugagccag

SEQ ID NO: 2229639 - RNA, 15 nt, Homo sapiens
cucaaccugggacuu

SEQ ID NO: 2229640 - RNA, 19 nt, Homo sapiens
agggccccggggccuguua

SEQ ID NO: 2229641 - RNA, 17 nt, Homo sapiens
cagacccaggucuucca

SEQ ID NO: 2229642 - RNA, 21 nt, Homo sapiens
ggcccguggccuggcaucugu

SEQ ID NO: 2229643 - RNA, 20 nt, Homo sapiens
aaagacaagugcucaagcag

SEQ ID NO: 2229644 - RNA, 17 nt, Homo sapiens
uaccaccagucaauaau

SEQ ID NO: 2229645 - RNA, 18 nt, Homo sapiens
aagaaaggggacccaaga

SEQ ID NO: 2229646 - RNA, 19 nt, Homo sapiens
aagauucaaucacuguaua

SEQ ID NO: 2229647 - RNA, 23 nt, Homo sapiens
ucauuuggccgagucagcacgua

SEQ ID NO: 2229648 - RNA, 16 nt, Homo sapiens
gacaagacucugggga

SEQ ID NO: 2229649 - RNA, 20 nt, Homo sapiens
auugauguuuuacgugcaaa

SEQ ID NO: 2229650 - RNA, 21 nt, Homo sapiens
gugauauuucguguacugcaa

SEQ ID NO: 2229651 - RNA, 14 nt, Homo sapiens
acuagaaacagagg

SEQ ID NO: 2229652 - RNA, 21 nt, Homo sapiens
uuaaaguuguuugcuuauacu

SEQ ID NO: 2229653 - RNA, 21 nt, Homo sapiens
ccaaccacagcaucgggagca

SEQ ID NO: 2229654 - RNA, 18 nt, Homo sapiens
ccugauagucaccugcug

SEQ ID NO: 2229655 - RNA, 17 nt, Homo sapiens
auuaugcccaugaacaa

SEQ ID NO: 2229656 - RNA, 14 nt, Homo sapiens
gauaugcauuugac

SEQ ID NO: 2229657 - RNA, 16 nt, Homo sapiens
acacagcuuuaugaua

SEQ ID NO: 2229658 - RNA, 20 nt, Homo sapiens
aauuuauauuuuggguuuau

SEQ ID NO: 2229659 - RNA, 21 nt, Homo sapiens
auaggguggcacagaagcuca

SEQ ID NO: 2229660 - RNA, 20 nt, Homo sapiens
aaccuguaagcccagcauuu

SEQ ID NO: 2229661 - RNA, 16 nt, Homo sapiens
ugugcuggacacuguc

SEQ ID NO: 2229662 - RNA, 15 nt, Homo sapiens
ugggaacacaucugg

SEQ ID NO: 2229663 - RNA, 19 nt, Homo sapiens
cccuuguuuauaaauagca

SEQ ID NO: 2229664 - RNA, 19 nt, Homo sapiens
aagucugcauuacauuccu

SEQ ID NO: 2229665 - RNA, 21 nt, Homo sapiens
gagggggcucuuguguguucu

SEQ ID NO: 2229666 - RNA, 12 nt, Homo sapiens
gcgauauacuaa

SEQ ID NO: 2229667 - RNA, 20 nt, Homo sapiens
auccccagccacaacugcca

SEQ ID NO: 2229668 - RNA, 20 nt, Homo sapiens
ccacaucaucuuuaucuccu

SEQ ID NO: 2229669 - RNA, 20 nt, Homo sapiens
caucaggaggacauggcacu

SEQ ID NO: 2229670 - RNA, 12 nt, Homo sapiens
guuaacacugcu

SEQ ID NO: 2229671 - RNA, 19 nt, Homo sapiens
cuaagaaauugaauacuuu

SEQ ID NO: 2229672 - RNA, 19 nt, Homo sapiens
aacauaagguacuagcagu

SEQ ID NO: 2229673 - RNA, 19 nt, Homo sapiens
ccaauucaauuacuauuga

SEQ ID NO: 2229674 - RNA, 17 nt, Homo sapiens
accagagugauggauuu

SEQ ID NO: 2229675 - RNA, 18 nt, Homo sapiens
auuagagggaugagacag

SEQ ID NO: 2229676 - RNA, 17 nt, Homo sapiens
aauugggcaacuauuca

SEQ ID NO: 2229677 - RNA, 19 nt, Homo sapiens
gccuaguuggucuuggaga

SEQ ID NO: 2229678 - RNA, 17 nt, Homo sapiens
aucagccagacauggug

SEQ ID NO: 2229679 - RNA, 12 nt, Homo sapiens
uuaagugccauu

SEQ ID NO: 2229680 - RNA, 12 nt, Homo sapiens
auuaauuuccac

SEQ ID NO: 2229681 - RNA, 13 nt, Homo sapiens
gcaggaacccauc

SEQ ID NO: 2229682 - RNA, 18 nt, Homo sapiens
ugugcucuacuguuacua

SEQ ID NO: 2229683 - RNA, 15 nt, Homo sapiens
guuaggguguguguu

SEQ ID NO: 2229684 - RNA, 16 nt, Homo sapiens
auauaauguugccagc

SEQ ID NO: 2229685 - RNA, 15 nt, Homo sapiens
auugcauacuuugua

SEQ ID NO: 2229686 - RNA, 13 nt, Homo sapiens
cccaugcaucuuc

SEQ ID NO: 2229687 - RNA, 22 nt, Homo sapiens
cuuuggcccgaaauagauccag

SEQ ID NO: 2229688 - RNA, 14 nt, Homo sapiens
gcacccuggaaggg

SEQ ID NO: 2229689 - RNA, 14 nt, Homo sapiens
ccugcuggggaccu

SEQ ID NO: 2229690 - RNA, 15 nt, Homo sapiens
acuuuaucauaugcu

SEQ ID NO: 2229691 - RNA, 22 nt, Homo sapiens
cguguuuaauuaaauuucacaa

SEQ ID NO: 2229692 - RNA, 13 nt, Homo sapiens
aaucuuacuccuu

SEQ ID NO: 2229693 - RNA, 22 nt, Homo sapiens
ccucagauuccaccuagagcua

SEQ ID NO: 2229694 - RNA, 22 nt, Homo sapiens
agagaagccaaacagcaagaag

SEQ ID NO: 2229695 - RNA, 14 nt, Homo sapiens
cugucagcugugaa

SEQ ID NO: 2229696 - RNA, 16 nt, Homo sapiens
uaaaagucacucugag

SEQ ID NO: 2229697 - RNA, 12 nt, Homo sapiens
ugacacagcagc

SEQ ID NO: 2229698 - RNA, 21 nt, Homo sapiens
agcaaggcuggguaaugugaa

SEQ ID NO: 2229699 - RNA, 16 nt, Homo sapiens
cuugucauucugcuaa

SEQ ID NO: 2229700 - RNA, 13 nt, Homo sapiens
ugcccaucagggc

SEQ ID NO: 2229701 - RNA, 11 nt, Homo sapiens
uagaauggugc

SEQ ID NO: 2229702 - RNA, 15 nt, Homo sapiens
aucugaauguucaug

SEQ ID NO: 2229703 - RNA, 22 nt, Homo sapiens
caucccaucucucccacuuccu

SEQ ID NO: 2229704 - RNA, 17 nt, Homo sapiens
ucucugccauguggcag

SEQ ID NO: 2229705 - RNA, 14 nt, Homo sapiens
uucagcaguaccua

SEQ ID NO: 2229706 - RNA, 18 nt, Homo sapiens
auccaaauccagccuuug

SEQ ID NO: 2229707 - RNA, 21 nt, Homo sapiens
acaaaggaaauaucaaagugu

SEQ ID NO: 2229708 - RNA, 23 nt, Homo sapiens
cugggcccagggcccuagguuug

SEQ ID NO: 2229709 - RNA, 22 nt, Homo sapiens
acuggaagaagagccccuccuu

SEQ ID NO: 2229710 - RNA, 16 nt, Homo sapiens
ucgcccacaaacugau

SEQ ID NO: 2229711 - RNA, 22 nt, Homo sapiens
gauugguaccagagccuaugga

SEQ ID NO: 2229712 - RNA, 17 nt, Homo sapiens
cugucaaggcugcuuag

SEQ ID NO: 2229713 - RNA, 16 nt, Homo sapiens
uuaauuuccacuaaaa

SEQ ID NO: 2229714 - RNA, 22 nt, Homo sapiens
uuucuagauacaauaaauugcu

SEQ ID NO: 2229715 - RNA, 17 nt, Homo sapiens
uacagcagugucaucag

SEQ ID NO: 2229716 - RNA, 18 nt, Homo sapiens
uugagacggagucuugcu

SEQ ID NO: 2229717 - RNA, 14 nt, Homo sapiens
uccacagugcugcu

SEQ ID NO: 2229718 - RNA, 14 nt, Homo sapiens
guugcuguuucaca

SEQ ID NO: 2229719 - RNA, 14 nt, Homo sapiens
auccccaacuccau

SEQ ID NO: 2229720 - RNA, 14 nt, Homo sapiens
auuuccaacuuuau

SEQ ID NO: 2229721 - RNA, 22 nt, Homo sapiens
ugccaucucucccacucugcca

SEQ ID NO: 2229722 - RNA, 14 nt, Homo sapiens
cagugcacaugaac

SEQ ID NO: 2229723 - RNA, 17 nt, Homo sapiens
uaaaauccuacagugaa

SEQ ID NO: 2229724 - RNA, 23 nt, Homo sapiens
ucaccauuuggcaaugccaucau

SEQ ID NO: 2229725 - RNA, 22 nt, Homo sapiens
guuuuuauggcuuuugugcauu

SEQ ID NO: 2229726 - RNA, 19 nt, Homo sapiens
augcauuuuuuaccacaau

SEQ ID NO: 2229727 - RNA, 17 nt, Homo sapiens
cagaggaggccggugaa

SEQ ID NO: 2229728 - RNA, 19 nt, Homo sapiens
ugcuguuaaaucaguucug

SEQ ID NO: 2229729 - RNA, 17 nt, Homo sapiens
cagcaauucucuuucuu

SEQ ID NO: 2229730 - RNA, 15 nt, Homo sapiens
auaaagcucucugua

SEQ ID NO: 2229731 - RNA, 21 nt, Homo sapiens
gaagcggauuuccagggauau

SEQ ID NO: 2229732 - RNA, 21 nt, Homo sapiens
uaucuuagugaauuuagucau

SEQ ID NO: 2229733 - RNA, 18 nt, Homo sapiens
gcagacugaaccagucca

SEQ ID NO: 2229734 - RNA, 12 nt, Homo sapiens
gaccagcccauu

SEQ ID NO: 2229735 - RNA, 22 nt, Homo sapiens
gagcaggacuaacaacugggaa

SEQ ID NO: 2229736 - RNA, 23 nt, Homo sapiens
acccagcccugaacaaagcaccu

SEQ ID NO: 2229737 - RNA, 17 nt, Homo sapiens
aucagacucuccuucag

SEQ ID NO: 2229738 - RNA, 18 nt, Homo sapiens
gaagauuagagguuuguc

SEQ ID NO: 2229739 - RNA, 15 nt, Homo sapiens
aagagccccaaagau

SEQ ID NO: 2229740 - RNA, 14 nt, Homo sapiens
uuugggugaucuga

SEQ ID NO: 2229741 - RNA, 16 nt, Homo sapiens
uacaucccagccugug

SEQ ID NO: 2229742 - RNA, 22 nt, Homo sapiens
ugcuuaucugaaaugcuugaaa

SEQ ID NO: 2229743 - RNA, 12 nt, Homo sapiens
uauuuaucuuca

SEQ ID NO: 2229744 - RNA, 23 nt, Homo sapiens
auccucuggaaaaggcuuucaug

SEQ ID NO: 2229745 - RNA, 20 nt, Homo sapiens
gucuccaugcucaccaagga

SEQ ID NO: 2229746 - RNA, 19 nt, Homo sapiens
auuacaauccugcauuguu

SEQ ID NO: 2229747 - RNA, 12 nt, Homo sapiens
acugcaagcucc

SEQ ID NO: 2229748 - RNA, 19 nt, Homo sapiens
uacccuccuguaagcaaca

SEQ ID NO: 2229749 - RNA, 23 nt, Homo sapiens
aucugacucacaagaagaccaga

SEQ ID NO: 2229750 - RNA, 15 nt, Homo sapiens
gaaaaacaucccaaa

SEQ ID NO: 2229751 - RNA, 22 nt, Homo sapiens
aauggcccaggucucucaacuu

SEQ ID NO: 2229752 - RNA, 23 nt, Homo sapiens
agcugaaauuuuagaaauauuca

SEQ ID NO: 2229753 - RNA, 15 nt, Homo sapiens
cauggacauucaugc

SEQ ID NO: 2229754 - RNA, 14 nt, Homo sapiens
uaauauaugcucaa

SEQ ID NO: 2229755 - RNA, 13 nt, Homo sapiens
ugacgucugccac

SEQ ID NO: 2229756 - RNA, 21 nt, Homo sapiens
cacuugaugugauguggcagg

SEQ ID NO: 2229757 - RNA, 23 nt, Homo sapiens
ugacagccagagccugucuuuca

SEQ ID NO: 2229758 - RNA, 13 nt, Homo sapiens
ugucugauucuau

SEQ ID NO: 2229759 - RNA, 18 nt, Homo sapiens
ccucccugcgcuuccuga

SEQ ID NO: 2229760 - RNA, 12 nt, Homo sapiens
auuaagcuuaaa

SEQ ID NO: 2229761 - RNA, 22 nt, Homo sapiens
auugcuacguaaucucacuuaa

SEQ ID NO: 2229762 - RNA, 20 nt, Homo sapiens
ugggggaaaaguuagucaau

SEQ ID NO: 2229763 - RNA, 12 nt, Homo sapiens
guuaauugcagu

SEQ ID NO: 2229764 - RNA, 21 nt, Homo sapiens
agauuuuuuuuguaacuucaa

SEQ ID NO: 2229765 - RNA, 14 nt, Homo sapiens
aacaagggcaguga

SEQ ID NO: 2229766 - RNA, 19 nt, Homo sapiens
acuggaaaaauccugagca

SEQ ID NO: 2229767 - RNA, 21 nt, Homo sapiens
agacugugcuguccuuuaaca

SEQ ID NO: 2229768 - RNA, 19 nt, Homo sapiens
uuuaccaguuaauuacuca

SEQ ID NO: 2229769 - RNA, 12 nt, Homo sapiens
auuucacacagu

SEQ ID NO: 2229770 - RNA, 19 nt, Homo sapiens
gcaauaaaugucccaaaua

SEQ ID NO: 2229771 - RNA, 13 nt, Homo sapiens
gauacauaaagac

SEQ ID NO: 2229772 - RNA, 16 nt, Homo sapiens
accccaaaacucugua

SEQ ID NO: 2229773 - RNA, 20 nt, Homo sapiens
cuuaaggaagaagaguauua

SEQ ID NO: 2229774 - RNA, 20 nt, Homo sapiens
uugagauucugaaguaugaa

SEQ ID NO: 2229775 - RNA, 18 nt, Homo sapiens
aguauggugaaacccugu

SEQ ID NO: 2229776 - RNA, 21 nt, Homo sapiens
uauauuuucugaguagcauau

SEQ ID NO: 2229777 - RNA, 14 nt, Homo sapiens
uuaauaguauuuau

SEQ ID NO: 2229778 - RNA, 12 nt, Homo sapiens
ccuuuugagagu

SEQ ID NO: 2229779 - RNA, 15 nt, Homo sapiens
augagagaacuggag

SEQ ID NO: 2229780 - RNA, 14 nt, Homo sapiens
cuaaauuaugacug

SEQ ID NO: 2229781 - RNA, 20 nt, Homo sapiens
aacauuugcugaauaugcaa

SEQ ID NO: 2229782 - RNA, 22 nt, Homo sapiens
uuuuccuuaaauuuuuagccau

SEQ ID NO: 2229783 - RNA, 20 nt, Homo sapiens
auugucuuguuauguacaaa

SEQ ID NO: 2229784 - RNA, 22 nt, Homo sapiens
uagcagcaccguucugugcaca

SEQ ID NO: 2229785 - RNA, 19 nt, Homo sapiens
ugaaucgcaaguuaacuug

SEQ ID NO: 2229786 - RNA, 19 nt, Homo sapiens
ugugacucgccagcucauu

SEQ ID NO: 2229787 - RNA, 17 nt, Homo sapiens
cuguaaucccagcacuu

SEQ ID NO: 2229788 - RNA, 22 nt, Homo sapiens
gacagcuuguggcaagugaauu

SEQ ID NO: 2229789 - RNA, 20 nt, Homo sapiens
cagccuggucucaaacuccc

SEQ ID NO: 2229790 - RNA, 16 nt, Homo sapiens
auuccuaauaaacugc

SEQ ID NO: 2229791 - RNA, 19 nt, Homo sapiens
ccauccauucacagccagg

SEQ ID NO: 2229792 - RNA, 17 nt, Homo sapiens
uuauauaaaauacauaa

SEQ ID NO: 2229793 - RNA, 20 nt, Homo sapiens
aaaccuaggaccgucuugcu

SEQ ID NO: 2229794 - RNA, 16 nt, Homo sapiens
ggagaugaggugcuca

SEQ ID NO: 2229795 - RNA, 23 nt, Homo sapiens
ucuuggagaggagguguggagug

SEQ ID NO: 2229796 - RNA, 20 nt, Homo sapiens
aacucuugguauuacccucc

SEQ ID NO: 2229797 - RNA, 22 nt, Homo sapiens
gcucugcccucccuggccucac

SEQ ID NO: 2229798 - RNA, 23 nt, Homo sapiens
caagaaccuguuuccuggaccag

SEQ ID NO: 2229799 - RNA, 15 nt, Homo sapiens
cugaaauguuuccag

SEQ ID NO: 2229800 - RNA, 22 nt, Homo sapiens
auuuacaacccgguucacucuu

SEQ ID NO: 2229801 - RNA, 18 nt, Homo sapiens
uuaaucacuacuguaugu

SEQ ID NO: 2229802 - RNA, 20 nt, Homo sapiens
gaucucgccacugcacucca

SEQ ID NO: 2229803 - RNA, 19 nt, Homo sapiens
ucauuggaaacacugccuu

SEQ ID NO: 2229804 - RNA, 20 nt, Homo sapiens
ucccaugagggagaugccau

SEQ ID NO: 2229805 - RNA, 13 nt, Homo sapiens
auuuguuccugcu

SEQ ID NO: 2229806 - RNA, 14 nt, Homo sapiens
ugaaaucucaggaa

SEQ ID NO: 2229807 - RNA, 16 nt, Homo sapiens
uuacucauuaauucaa

SEQ ID NO: 2229808 - RNA, 22 nt, Homo sapiens
ccauaggaggccaacccaaaau

SEQ ID NO: 2229809 - RNA, 21 nt, Homo sapiens
acucagaacuucugccucuaa

SEQ ID NO: 2229810 - RNA, 13 nt, Homo sapiens
agcuugaggccaa

SEQ ID NO: 2229811 - RNA, 19 nt, Homo sapiens
agacaaaauugaugaucca

SEQ ID NO: 2229812 - RNA, 17 nt, Homo sapiens
auaaugcaccacuuuua

SEQ ID NO: 2229813 - RNA, 19 nt, Homo sapiens
cucucaacccaggagcauc

SEQ ID NO: 2229814 - RNA, 18 nt, Homo sapiens
ccaucacccaagccacaa

SEQ ID NO: 2229815 - RNA, 14 nt, Homo sapiens
uuugacuugccacu

SEQ ID NO: 2229816 - RNA, 11 nt, Homo sapiens
uaaagcauuuu

SEQ ID NO: 2229817 - RNA, 22 nt, Homo sapiens
gaaccucucguaguccaucacc

SEQ ID NO: 2229818 - RNA, 14 nt, Homo sapiens
gcaaguagguugcu

SEQ ID NO: 2229819 - RNA, 15 nt, Homo sapiens
uacaaguuacauaca

SEQ ID NO: 2229820 - RNA, 23 nt, Homo sapiens
uggacccugacuguauacagaau

SEQ ID NO: 2229821 - RNA, 21 nt, Homo sapiens
uuaaaauaaacacaaaaacac

SEQ ID NO: 2229822 - RNA, 13 nt, Homo sapiens
gacuggacacaaa

SEQ ID NO: 2229823 - RNA, 22 nt, Homo sapiens
guaccuucaggcagccagugug

SEQ ID NO: 2229824 - RNA, 21 nt, Homo sapiens
aguuguccuauggacaacuua

SEQ ID NO: 2229825 - RNA, 13 nt, Homo sapiens
auaauuauuacau

SEQ ID NO: 2229826 - RNA, 17 nt, Homo sapiens
aguacuggcaugguacg

SEQ ID NO: 2229827 - RNA, 21 nt, Homo sapiens
agaaugaaagcuccucgaggg

SEQ ID NO: 2229828 - RNA, 21 nt, Homo sapiens
agucaagucaccaugcugaau

SEQ ID NO: 2229829 - RNA, 14 nt, Homo sapiens
accacaucuugucu

SEQ ID NO: 2229830 - RNA, 12 nt, Homo sapiens
gcuauucuuaug

SEQ ID NO: 2229831 - RNA, 16 nt, Homo sapiens
uuugaauugccuugcu

SEQ ID NO: 2229832 - RNA, 20 nt, Homo sapiens
auggguuuagggaagacauu

SEQ ID NO: 2229833 - RNA, 24 nt, Homo sapiens
aacacaagcauuucacuucuccaa

SEQ ID NO: 2229834 - RNA, 24 nt, Homo sapiens
ugacuguaacauauucuguaugaa

SEQ ID NO: 2229835 - RNA, 17 nt, Homo sapiens
cucccagacuaccugcc

SEQ ID NO: 2229836 - RNA, 13 nt, Homo sapiens
ccuccaaaugcca

SEQ ID NO: 2229837 - RNA, 15 nt, Homo sapiens
agccugggaggcaca

SEQ ID NO: 2229838 - RNA, 15 nt, Homo sapiens
agcaaacuuuagugu

SEQ ID NO: 2229839 - RNA, 20 nt, Homo sapiens
ugcugggggcacagcugucu

SEQ ID NO: 2229840 - RNA, 21 nt, Homo sapiens
acacuccagucugccauauca

SEQ ID NO: 2229841 - RNA, 16 nt, Homo sapiens
uguggagucauucuca

SEQ ID NO: 2229842 - RNA, 20 nt, Homo sapiens
augcauaaaagacaagcacu

SEQ ID NO: 2229843 - RNA, 12 nt, Homo sapiens
cauucacugucc

SEQ ID NO: 2229844 - RNA, 20 nt, Homo sapiens
agguagaccaggauuucuaa

SEQ ID NO: 2229845 - RNA, 20 nt, Homo sapiens
gaagcauguauaaugcaguu

SEQ ID NO: 2229846 - RNA, 14 nt, Homo sapiens
auguggguggagaa

SEQ ID NO: 2229847 - RNA, 21 nt, Homo sapiens
agcaaccuuguaagcuaucug

SEQ ID NO: 2229848 - RNA, 15 nt, Homo sapiens
gaacagaucaggaau

SEQ ID NO: 2229849 - RNA, 14 nt, Homo sapiens
ccuccagugcaguc

SEQ ID NO: 2229850 - RNA, 18 nt, Homo sapiens
accagaggacaaagccuu

SEQ ID NO: 2229851 - RNA, 12 nt, Homo sapiens
uuugucacuucu

SEQ ID NO: 2229852 - RNA, 16 nt, Homo sapiens
uccugagccaaggagg

SEQ ID NO: 2229853 - RNA, 22 nt, Homo sapiens
agacaauggcccaggucucuca

SEQ ID NO: 2229854 - RNA, 14 nt, Homo sapiens
acugcaacucauca

SEQ ID NO: 2229855 - RNA, 16 nt, Homo sapiens
accagcagacacugcc

SEQ ID NO: 2229856 - RNA, 22 nt, Homo sapiens
gaagacaaaauuguaagccaga

SEQ ID NO: 2229857 - RNA, 22 nt, Homo sapiens
acaagcacuguggaacugcuau

SEQ ID NO: 2229858 - RNA, 14 nt, Homo sapiens
agcuuccauguuua

SEQ ID NO: 2229859 - RNA, 17 nt, Homo sapiens
caaccucggcuccugga

SEQ ID NO: 2229860 - RNA, 19 nt, Homo sapiens
augcucagaccagcucuuc

SEQ ID NO: 2229861 - RNA, 22 nt, Homo sapiens
uugcucuggacagagauggaag

SEQ ID NO: 2229862 - RNA, 22 nt, Homo sapiens
cuuccugaagggggacacucca

SEQ ID NO: 2229863 - RNA, 12 nt, Homo sapiens
agggacacucca

SEQ ID NO: 2229864 - RNA, 12 nt, Homo sapiens
aacaugcacggu

SEQ ID NO: 2229865 - RNA, 20 nt, Homo sapiens
augauaaauauaacaucuau

SEQ ID NO: 2229866 - RNA, 22 nt, Homo sapiens
cacuccagcccuguccccugaa

SEQ ID NO: 2229867 - RNA, 15 nt, Homo sapiens
caugcuaauguuacu

SEQ ID NO: 2229868 - RNA, 13 nt, Homo sapiens
auugagacaucug

SEQ ID NO: 2229869 - RNA, 12 nt, Homo sapiens
uacaguguuauu

SEQ ID NO: 2229870 - RNA, 20 nt, Homo sapiens
caauaguguccuaugcaaua

SEQ ID NO: 2229871 - RNA, 22 nt, Homo sapiens
uuuuaaaugaggauucacugac

SEQ ID NO: 2229872 - RNA, 15 nt, Homo sapiens
cucugcuggagguga

SEQ ID NO: 2229873 - RNA, 15 nt, Homo sapiens
gaaugguccaggguu

SEQ ID NO: 2229874 - RNA, 18 nt, Homo sapiens
uacugacugcuuauaaac

SEQ ID NO: 2229875 - RNA, 15 nt, Homo sapiens
cagaccacauuugaa

SEQ ID NO: 2229876 - RNA, 12 nt, Homo sapiens
uccaaaaauggc

SEQ ID NO: 2229877 - RNA, 15 nt, Homo sapiens
uguuugaaagcuuua

SEQ ID NO: 2229878 - RNA, 18 nt, Homo sapiens
aaucaaucuggugcuaau

SEQ ID NO: 2229879 - RNA, 14 nt, Homo sapiens
ugauaagaaugaau

SEQ ID NO: 2229880 - RNA, 19 nt, Homo sapiens
ucaccucagauggcagcuu

SEQ ID NO: 2229881 - RNA, 17 nt, Homo sapiens
agcguucuucaggagau

SEQ ID NO: 2229882 - RNA, 23 nt, Homo sapiens
auggugaaaccccgucucuacua

SEQ ID NO: 2229883 - RNA, 18 nt, Homo sapiens
ugccagacauggaccucc

SEQ ID NO: 2229884 - RNA, 13 nt, Homo sapiens
uuuacaaagcaaa

SEQ ID NO: 2229885 - RNA, 18 nt, Homo sapiens
gacuuuagggaucugggg

SEQ ID NO: 2229886 - RNA, 13 nt, Homo sapiens
guuuugccaguga

SEQ ID NO: 2229887 - RNA, 22 nt, Homo sapiens
ucaauacuuuuguguauucugu

SEQ ID NO: 2229888 - RNA, 18 nt, Homo sapiens
cccugccagcaacgcuca

SEQ ID NO: 2229889 - RNA, 20 nt, Homo sapiens
cagcuccucccuuguucucu

SEQ ID NO: 2229890 - RNA, 22 nt, Homo sapiens
auuguacuuuuuuuuacuuugg

SEQ ID NO: 2229891 - RNA, 18 nt, Homo sapiens
cuuucaccccagggccug

SEQ ID NO: 2229892 - RNA, 22 nt, Homo sapiens
caugacucaauaaauacauguu

SEQ ID NO: 2229893 - RNA, 11 nt, Homo sapiens
aacucauuuga

SEQ ID NO: 2229894 - RNA, 19 nt, Homo sapiens
cuucuugguuuggggagaa

SEQ ID NO: 2229895 - RNA, 15 nt, Homo sapiens
cucuaagugcugcug

SEQ ID NO: 2229896 - RNA, 20 nt, Homo sapiens
cuuguugagauccccguguu

SEQ ID NO: 2229897 - RNA, 20 nt, Homo sapiens
aaagccacuggaaggagcac

SEQ ID NO: 2229898 - RNA, 14 nt, Homo sapiens
uggcuauuauuuga

SEQ ID NO: 2229899 - RNA, 17 nt, Homo sapiens
acugacuagagugauga

SEQ ID NO: 2229900 - RNA, 17 nt, Homo sapiens
cauaugaggggacccag

SEQ ID NO: 2229901 - RNA, 19 nt, Homo sapiens
aagauuuuauuuauggaau

SEQ ID NO: 2229902 - RNA, 20 nt, Homo sapiens
auacaugacugcaacuguau

SEQ ID NO: 2229903 - RNA, 13 nt, Homo sapiens
uaaaauugugcau

SEQ ID NO: 2229904 - RNA, 16 nt, Homo sapiens
caggcuauuagagagu

SEQ ID NO: 2229905 - RNA, 16 nt, Homo sapiens
ucagcucccaucucau

SEQ ID NO: 2229906 - RNA, 12 nt, Homo sapiens
acggagggauug

SEQ ID NO: 2229907 - RNA, 15 nt, Homo sapiens
ugguuuaugucauca

SEQ ID NO: 2229908 - RNA, 16 nt, Homo sapiens
aggcagccacagggaa

SEQ ID NO: 2229909 - RNA, 19 nt, Homo sapiens
ucacuuguucucacugucu

SEQ ID NO: 2229910 - RNA, 22 nt, Homo sapiens
gcuguacucuucugacugcccc

SEQ ID NO: 2229911 - RNA, 23 nt, Homo sapiens
ccaggaggggaugugugugugca

SEQ ID NO: 2229912 - RNA, 18 nt, Homo sapiens
gucaucuauuuaaaccuu

SEQ ID NO: 2229913 - RNA, 22 nt, Homo sapiens
aggggccaauuuuggaugagca

SEQ ID NO: 2229914 - RNA, 15 nt, Homo sapiens
ugggcagcuugagag

SEQ ID NO: 2229915 - RNA, 15 nt, Homo sapiens
accuguaauagccuc

SEQ ID NO: 2229916 - RNA, 11 nt, Homo sapiens
gggauuugccg

SEQ ID NO: 2229917 - RNA, 18 nt, Homo sapiens
acuuugauaggaugugga

SEQ ID NO: 2229918 - RNA, 16 nt, Homo sapiens
gcaucaaggugcugaa

SEQ ID NO: 2229919 - RNA, 21 nt, Homo sapiens
gugucacccauuggugaccug

SEQ ID NO: 2229920 - RNA, 21 nt, Homo sapiens
ggaugcgggcauggcagcccu

SEQ ID NO: 2229921 - RNA, 10 nt, Homo sapiens
uaaaagaagc

SEQ ID NO: 2229922 - RNA, 18 nt, Homo sapiens
auuuaaacaucaguauua

SEQ ID NO: 2229923 - RNA, 19 nt, Homo sapiens
caaggugcucagacaugaa

SEQ ID NO: 2229924 - RNA, 14 nt, Homo sapiens
gcacagaaggcugg

SEQ ID NO: 2229925 - RNA, 16 nt, Homo sapiens
agagacaggguuucac

SEQ ID NO: 2229926 - RNA, 13 nt, Homo sapiens
caucugauuguga

SEQ ID NO: 2229927 - RNA, 23 nt, Homo sapiens
acgaggugaaaaauauucaguaa

SEQ ID NO: 2229928 - RNA, 12 nt, Homo sapiens
uacuuaauacuc

SEQ ID NO: 2229929 - RNA, 16 nt, Homo sapiens
cccaggaacugggcca

SEQ ID NO: 2229930 - RNA, 22 nt, Homo sapiens
ccacugcugggggugagcugua

SEQ ID NO: 2229931 - RNA, 18 nt, Homo sapiens
uaaauaagauucuaacgg

SEQ ID NO: 2229932 - RNA, 12 nt, Homo sapiens
gacuuugaacug

SEQ ID NO: 2229933 - RNA, 15 nt, Homo sapiens
ucaucacugugccuu

SEQ ID NO: 2229934 - RNA, 19 nt, Homo sapiens
gcaaaguagugauauucua

SEQ ID NO: 2229935 - RNA, 16 nt, Homo sapiens
cuugcuuuccugcauc

SEQ ID NO: 2229936 - RNA, 18 nt, Homo sapiens
gcccccuugggugaccuc

SEQ ID NO: 2229937 - RNA, 16 nt, Homo sapiens
ucuugcauuaugcaau

SEQ ID NO: 2229938 - RNA, 13 nt, Homo sapiens
aguuucaccaucu

SEQ ID NO: 2229939 - RNA, 22 nt, Homo sapiens
augcuaccacugguacuuccuu

SEQ ID NO: 2229940 - RNA, 15 nt, Homo sapiens
ucuuugcucaacaga

SEQ ID NO: 2229941 - RNA, 16 nt, Homo sapiens
gagugaaaccaugacu

SEQ ID NO: 2229942 - RNA, 17 nt, Homo sapiens
agagaccugugugaacu

SEQ ID NO: 2229943 - RNA, 15 nt, Homo sapiens
ugccccuuaaauuuc

SEQ ID NO: 2229944 - RNA, 19 nt, Homo sapiens
aagagugaggacugacuca

SEQ ID NO: 2229945 - RNA, 23 nt, Homo sapiens
auacuucauucucucucauuauu

SEQ ID NO: 2229946 - RNA, 18 nt, Homo sapiens
ccuguggcggugcagugg

SEQ ID NO: 2229947 - RNA, 18 nt, Homo sapiens
aaaaugaauuugggauac

SEQ ID NO: 2229948 - RNA, 11 nt, Homo sapiens
aucugaauauc

SEQ ID NO: 2229949 - RNA, 16 nt, Homo sapiens
cagugacacaaucuca

SEQ ID NO: 2229950 - RNA, 16 nt, Homo sapiens
aauuucuaggacugaa

SEQ ID NO: 2229951 - RNA, 14 nt, Homo sapiens
ucaagagcuuccag

SEQ ID NO: 2229952 - RNA, 16 nt, Homo sapiens
gcugggcuccacuuca

SEQ ID NO: 2229953 - RNA, 19 nt, Homo sapiens
uuauauauaagccaaaaaa

SEQ ID NO: 2229954 - RNA, 14 nt, Homo sapiens
auguauggcaugug

SEQ ID NO: 2229955 - RNA, 17 nt, Homo sapiens
uauaaccauuacauguu

SEQ ID NO: 2229956 - RNA, 18 nt, Homo sapiens
auauggagggaacacuga

SEQ ID NO: 2229957 - RNA, 17 nt, Homo sapiens
ugacacuuauagauuga

SEQ ID NO: 2229958 - RNA, 13 nt, Homo sapiens
aaacaaagcuuau

SEQ ID NO: 2229959 - RNA, 15 nt, Homo sapiens
cuuuaaaauucacua

SEQ ID NO: 2229960 - RNA, 15 nt, Homo sapiens
uuacagcuacuauaa

SEQ ID NO: 2229961 - RNA, 15 nt, Homo sapiens
acaauguauaagcua

SEQ ID NO: 2229962 - RNA, 15 nt, Homo sapiens
ccacaugccaagcac

SEQ ID NO: 2229963 - RNA, 19 nt, Homo sapiens
gauaaaguugguaaaccuu

SEQ ID NO: 2229964 - RNA, 15 nt, Homo sapiens
caaauauuccagaga

SEQ ID NO: 2229965 - RNA, 14 nt, Homo sapiens
ccacaugugcacau

SEQ ID NO: 2229966 - RNA, 15 nt, Homo sapiens
augagauguaacuca

SEQ ID NO: 2229967 - RNA, 18 nt, Homo sapiens
cuguagacuagugccgua

SEQ ID NO: 2229968 - RNA, 17 nt, Homo sapiens
ucauaaguggggagaga

SEQ ID NO: 2229969 - RNA, 16 nt, Homo sapiens
cuagcugugugcaguc

SEQ ID NO: 2229970 - RNA, 22 nt, Homo sapiens
cacaucuuuuaagacaaauuca

SEQ ID NO: 2229971 - RNA, 18 nt, Homo sapiens
cagaugaacuauccacag

SEQ ID NO: 2229972 - RNA, 20 nt, Homo sapiens
auaccugguaagcaaaaacu

SEQ ID NO: 2229973 - RNA, 17 nt, Homo sapiens
ugguuuucuuuugccau

SEQ ID NO: 2229974 - RNA, 13 nt, Homo sapiens
ccuugugucacug

SEQ ID NO: 2229975 - RNA, 17 nt, Homo sapiens
cucugacgcuugugaca

SEQ ID NO: 2229976 - RNA, 13 nt, Homo sapiens
uggauccugugug

SEQ ID NO: 2229977 - RNA, 13 nt, Homo sapiens
ugcgguuccucau

SEQ ID NO: 2229978 - RNA, 21 nt, Homo sapiens
aucagagacccuggugcugcc

SEQ ID NO: 2229979 - RNA, 17 nt, Homo sapiens
cacagcucuguguugcc

SEQ ID NO: 2229980 - RNA, 17 nt, Homo sapiens
gacugaaaugugcucag

SEQ ID NO: 2229981 - RNA, 18 nt, Homo sapiens
caugcaugacacuuccaa

SEQ ID NO: 2229982 - RNA, 20 nt, Homo sapiens
aguccaauuccaaagccaga

SEQ ID NO: 2229983 - RNA, 15 nt, Homo sapiens
gaacucacaauucca

SEQ ID NO: 2229984 - RNA, 20 nt, Homo sapiens
uaccccugaucugacauccc

SEQ ID NO: 2229985 - RNA, 11 nt, Homo sapiens
gugauguauau

SEQ ID NO: 2229986 - RNA, 18 nt, Homo sapiens
caggaggcagacaaugac

SEQ ID NO: 2229987 - RNA, 15 nt, Homo sapiens
ggagacugcaucuca

SEQ ID NO: 2229988 - RNA, 17 nt, Homo sapiens
gcgacuccaucucaaaa

SEQ ID NO: 2229989 - RNA, 15 nt, Homo sapiens
ugauuagcacuuaau

SEQ ID NO: 2229990 - RNA, 22 nt, Homo sapiens
guacuuacccuucuacaaaaga

SEQ ID NO: 2229991 - RNA, 22 nt, Homo sapiens
augccagugaaacuucaagcaa

SEQ ID NO: 2229992 - RNA, 17 nt, Homo sapiens
caaagaagaaguuuaaa

SEQ ID NO: 2229993 - RNA, 22 nt, Homo sapiens
auucagccaugaaacugacuca

SEQ ID NO: 2229994 - RNA, 18 nt, Homo sapiens
acacauaguguuuguaac

SEQ ID NO: 2229995 - RNA, 21 nt, Homo sapiens
uggaacagcgggagaccugug

SEQ ID NO: 2229996 - RNA, 20 nt, Homo sapiens
cuuacuuagcaugcacaaag

SEQ ID NO: 2229997 - RNA, 22 nt, Homo sapiens
cugaaggagcauaugauugcuc

SEQ ID NO: 2229998 - RNA, 19 nt, Homo sapiens
ugaugauuguaagucccau

SEQ ID NO: 2229999 - RNA, 20 nt, Homo sapiens
uacauuaaaauaaaccaaau

SEQ ID NO: 2230000 - RNA, 21 nt, Homo sapiens
guugcauauaccaguugugau

SEQ ID NO: 2230001 - RNA, 15 nt, Homo sapiens
aggacagccagcagc

SEQ ID NO: 2230002 - RNA, 20 nt, Homo sapiens
gaagccacuauuacugggac

SEQ ID NO: 2230003 - RNA, 19 nt, Homo sapiens
guucuacccuccaugugag

SEQ ID NO: 2230004 - RNA, 20 nt, Homo sapiens
uacuaccccaggacgcaugc

SEQ ID NO: 2230005 - RNA, 18 nt, Homo sapiens
uauaacagugacuugauu

SEQ ID NO: 2230006 - RNA, 18 nt, Homo sapiens
agucaugcagucugggag

SEQ ID NO: 2230007 - RNA, 22 nt, Homo sapiens
acuugcaauuguuaaucaaaga

SEQ ID NO: 2230008 - RNA, 14 nt, Homo sapiens
aagugcgugaaugu

SEQ ID NO: 2230009 - RNA, 23 nt, Homo sapiens
gcaaaacaaaaguacauugcuua

SEQ ID NO: 2230010 - RNA, 14 nt, Homo sapiens
ccgugagaacauca

SEQ ID NO: 2230011 - RNA, 12 nt, Homo sapiens
aguacaucucua

SEQ ID NO: 2230012 - RNA, 12 nt, Homo sapiens
uccucaucagcu

SEQ ID NO: 2230013 - RNA, 21 nt, Homo sapiens
guacaaccugugaucaagcaa

SEQ ID NO: 2230014 - RNA, 19 nt, Homo sapiens
uacuauaaugugaugauuc

SEQ ID NO: 2230015 - RNA, 17 nt, Homo sapiens
uuccacagagcaugcaa

SEQ ID NO: 2230016 - RNA, 20 nt, Homo sapiens
agccuggggccuggcaggga

SEQ ID NO: 2230017 - RNA, 18 nt, Homo sapiens
cuuuuguguccugcucug

SEQ ID NO: 2230018 - RNA, 17 nt, Homo sapiens
ggugaaauccaggucuc

SEQ ID NO: 2230019 - RNA, 16 nt, Homo sapiens
ucugccaggccuguau

SEQ ID NO: 2230020 - RNA, 16 nt, Homo sapiens
uuaauauaucaauauu

SEQ ID NO: 2230021 - RNA, 17 nt, Homo sapiens
uauuuuggucacagggu

SEQ ID NO: 2230022 - RNA, 16 nt, Homo sapiens
uuaauuggaguaucua

SEQ ID NO: 2230023 - RNA, 16 nt, Homo sapiens
uggguuauuuuugucc

SEQ ID NO: 2230024 - RNA, 21 nt, Homo sapiens
acacaaguagauugaucuaag

SEQ ID NO: 2230025 - RNA, 16 nt, Homo sapiens
aaacuucagaugacaa

SEQ ID NO: 2230026 - RNA, 22 nt, Homo sapiens
uucuugaguugcggcagaacau

SEQ ID NO: 2230027 - RNA, 21 nt, Homo sapiens
aagaaagaaaccaagugcgcu

SEQ ID NO: 2230028 - RNA, 17 nt, Homo sapiens
agccuucauuugcaauu

SEQ ID NO: 2230029 - RNA, 16 nt, Homo sapiens
caauaacacugucucc

SEQ ID NO: 2230030 - RNA, 15 nt, Homo sapiens
uggaacccagacuca

SEQ ID NO: 2230031 - RNA, 12 nt, Homo sapiens
cucuccaaaggc

SEQ ID NO: 2230032 - RNA, 19 nt, Homo sapiens
aggagaagcgggaguggcu

SEQ ID NO: 2230033 - RNA, 15 nt, Homo sapiens
gcaauggaacauuau

SEQ ID NO: 2230034 - RNA, 18 nt, Homo sapiens
auuaaauggugccuccaa

SEQ ID NO: 2230035 - RNA, 19 nt, Homo sapiens
guuauuacagggcauucaa

SEQ ID NO: 2230036 - RNA, 17 nt, Homo sapiens
acaagauacacgucaca

SEQ ID NO: 2230037 - RNA, 17 nt, Homo sapiens
uagugaaucacguaaag

SEQ ID NO: 2230038 - RNA, 15 nt, Homo sapiens
cucagcuagggccac

SEQ ID NO: 2230039 - RNA, 22 nt, Homo sapiens
aaacaguguuuccagugacaca

SEQ ID NO: 2230040 - RNA, 21 nt, Homo sapiens
uaaaucuuuuugcuucuacuu

SEQ ID NO: 2230041 - RNA, 20 nt, Homo sapiens
cugauaugcaaguaagaaau

SEQ ID NO: 2230042 - RNA, 23 nt, Homo sapiens
auaaaguauccaugcaugugcau

SEQ ID NO: 2230043 - RNA, 18 nt, Homo sapiens
agaaucucuugaaccugg

SEQ ID NO: 2230044 - RNA, 20 nt, Homo sapiens
uggauaccugugugucucca

SEQ ID NO: 2230045 - RNA, 17 nt, Homo sapiens
uugaaaaccucuuucca

SEQ ID NO: 2230046 - RNA, 22 nt, Homo sapiens
ggccagacuggaagacacuuca

SEQ ID NO: 2230047 - RNA, 17 nt, Homo sapiens
acgucuccccuucucug

SEQ ID NO: 2230048 - RNA, 17 nt, Homo sapiens
agcauuuagucuugcca

SEQ ID NO: 2230049 - RNA, 19 nt, Homo sapiens
aaaaugaaaaacaaccaag

SEQ ID NO: 2230050 - RNA, 14 nt, Homo sapiens
uuacuaugaucuca

SEQ ID NO: 2230051 - RNA, 16 nt, Homo sapiens
aaaacaagcauucaca

SEQ ID NO: 2230052 - RNA, 12 nt, Homo sapiens
acucaucugcca

SEQ ID NO: 2230053 - RNA, 14 nt, Homo sapiens
caucugaaccacuu

SEQ ID NO: 2230054 - RNA, 12 nt, Homo sapiens
agucugcacuua

SEQ ID NO: 2230055 - RNA, 17 nt, Homo sapiens
ggagugaagaggggcag

SEQ ID NO: 2230056 - RNA, 14 nt, Homo sapiens
uuggcucucugaga

SEQ ID NO: 2230057 - RNA, 14 nt, Homo sapiens
auuuuauucccaag

SEQ ID NO: 2230058 - RNA, 16 nt, Homo sapiens
cuuaucugauacuuau

SEQ ID NO: 2230059 - RNA, 14 nt, Homo sapiens
acuugaacccaggu

SEQ ID NO: 2230060 - RNA, 23 nt, Homo sapiens
cacaauaauauauccacaucuaa

SEQ ID NO: 2230061 - RNA, 15 nt, Homo sapiens
aaauacaguaguaua

SEQ ID NO: 2230062 - RNA, 16 nt, Homo sapiens
aacaauuucugugucc

SEQ ID NO: 2230063 - RNA, 14 nt, Homo sapiens
cagaggaagcacau

SEQ ID NO: 2230064 - RNA, 20 nt, Homo sapiens
cuccauuguucagaugcuuc

SEQ ID NO: 2230065 - RNA, 16 nt, Homo sapiens
ugaaggggaggucaca

SEQ ID NO: 2230066 - RNA, 21 nt, Homo sapiens
uugaccuuugagagauauaau

SEQ ID NO: 2230067 - RNA, 15 nt, Homo sapiens
ugcucauguaugugc

SEQ ID NO: 2230068 - RNA, 21 nt, Homo sapiens
ggaauccuagcacuugucuca

SEQ ID NO: 2230069 - RNA, 20 nt, Homo sapiens
ugaacugagccaaacacacu

SEQ ID NO: 2230070 - RNA, 14 nt, Homo sapiens
agccggucagagga

SEQ ID NO: 2230071 - RNA, 12 nt, Homo sapiens
uucacuugcagu

SEQ ID NO: 2230072 - RNA, 15 nt, Homo sapiens
gacaugacuaggaag

SEQ ID NO: 2230073 - RNA, 21 nt, Homo sapiens
aauugaugugcuauauacuua

SEQ ID NO: 2230074 - RNA, 17 nt, Homo sapiens
aauaauguaauacugua

SEQ ID NO: 2230075 - RNA, 15 nt, Homo sapiens
uaaucacuguguaua

SEQ ID NO: 2230076 - RNA, 18 nt, Homo sapiens
gacuggccacacaggauc

SEQ ID NO: 2230077 - RNA, 21 nt, Homo sapiens
aacagaugaccguguacaaua

SEQ ID NO: 2230078 - RNA, 16 nt, Homo sapiens
aaacaaaucaguuggc

SEQ ID NO: 2230079 - RNA, 13 nt, Homo sapiens
uaaauggauauua

SEQ ID NO: 2230080 - RNA, 15 nt, Homo sapiens
gaaauaccagugaac

SEQ ID NO: 2230081 - RNA, 13 nt, Homo sapiens
agguuuccuucag

SEQ ID NO: 2230082 - RNA, 13 nt, Homo sapiens
cugccuaugucau

SEQ ID NO: 2230083 - RNA, 22 nt, Homo sapiens
gcugggaagacgccugagcuca

SEQ ID NO: 2230084 - RNA, 23 nt, Homo sapiens
ucaucagagcuccucuguccugc

SEQ ID NO: 2230085 - RNA, 15 nt, Homo sapiens
auacauuuccaaaau

SEQ ID NO: 2230086 - RNA, 18 nt, Homo sapiens
cccuucuuuacuagauau

SEQ ID NO: 2230087 - RNA, 14 nt, Homo sapiens
ucuguaugucaugg

SEQ ID NO: 2230088 - RNA, 22 nt, Homo sapiens
auucagcucccuuauaccccca

SEQ ID NO: 2230089 - RNA, 16 nt, Homo sapiens
caguagugcuaucuca

SEQ ID NO: 2230090 - RNA, 21 nt, Homo sapiens
ccacuuuucuauauugcagug

SEQ ID NO: 2230091 - RNA, 18 nt, Homo sapiens
aggccgagaagcaagaaa

SEQ ID NO: 2230092 - RNA, 22 nt, Homo sapiens
ugugcugaauacgcuaagccug

SEQ ID NO: 2230093 - RNA, 13 nt, Homo sapiens
ugcucaccaagga

SEQ ID NO: 2230094 - RNA, 16 nt, Homo sapiens
acagaagucuccucaa

SEQ ID NO: 2230095 - RNA, 23 nt, Homo sapiens
gaucagacagaucuggaauguga

SEQ ID NO: 2230096 - RNA, 23 nt, Homo sapiens
caaacagaugaaaaaaguuaaca

SEQ ID NO: 2230097 - RNA, 17 nt, Homo sapiens
ugguguggccagcacuc

SEQ ID NO: 2230098 - RNA, 17 nt, Homo sapiens
ucugggcucaagcuuuc

SEQ ID NO: 2230099 - RNA, 16 nt, Homo sapiens
uuccaugauguuacau

SEQ ID NO: 2230100 - RNA, 14 nt, Homo sapiens
uccuugcgccucag

SEQ ID NO: 2230101 - RNA, 17 nt, Homo sapiens
acuaaggugugcucuga

SEQ ID NO: 2230102 - RNA, 15 nt, Homo sapiens
ugagcggcacccugg

SEQ ID NO: 2230103 - RNA, 23 nt, Homo sapiens
cugaaugugccccuggaccuucu

SEQ ID NO: 2230104 - RNA, 18 nt, Homo sapiens
caacuugcuccuuuccau

SEQ ID NO: 2230105 - RNA, 20 nt, Homo sapiens
uggaagguggggacagggau

SEQ ID NO: 2230106 - RNA, 20 nt, Homo sapiens
uacacugaauuuuuaugugu

SEQ ID NO: 2230107 - RNA, 21 nt, Homo sapiens
uggaagccggccggcugggau

SEQ ID NO: 2230108 - RNA, 15 nt, Homo sapiens
uguauccgacucuaa

SEQ ID NO: 2230109 - RNA, 22 nt, Homo sapiens
gaacacuauaaaaacagcuccu

SEQ ID NO: 2230110 - RNA, 20 nt, Homo sapiens
auuccaagacucuagagucc

SEQ ID NO: 2230111 - RNA, 19 nt, Homo sapiens
aggcugacacagccacugc

SEQ ID NO: 2230112 - RNA, 19 nt, Homo sapiens
agacauacgaaacacaaac

SEQ ID NO: 2230113 - RNA, 19 nt, Homo sapiens
acaccagagcagaugcaga

SEQ ID NO: 2230114 - RNA, 15 nt, Homo sapiens
agcaaugcugugaau

SEQ ID NO: 2230115 - RNA, 23 nt, Homo sapiens
cucagguucuucagggccagucc

SEQ ID NO: 2230116 - RNA, 15 nt, Homo sapiens
uagaguggugcugcu

SEQ ID NO: 2230117 - RNA, 17 nt, Homo sapiens
agcacuaacacaugcac

SEQ ID NO: 2230118 - RNA, 18 nt, Homo sapiens
aucucugccaagccuauu

SEQ ID NO: 2230119 - RNA, 15 nt, Homo sapiens
aacucuaugaacuua

SEQ ID NO: 2230120 - RNA, 18 nt, Homo sapiens
ucaucuuggccacuuuaa

SEQ ID NO: 2230121 - RNA, 22 nt, Homo sapiens
acccaggagaguggaagagaga

SEQ ID NO: 2230122 - RNA, 16 nt, Homo sapiens
ucuauccuuuugccug

SEQ ID NO: 2230123 - RNA, 13 nt, Homo sapiens
uuaacggugcuaa

SEQ ID NO: 2230124 - RNA, 15 nt, Homo sapiens
uaccaagccugccau

SEQ ID NO: 2230125 - RNA, 23 nt, Homo sapiens
acuuauuguauuccucaugucau

SEQ ID NO: 2230126 - RNA, 16 nt, Homo sapiens
aacaauaauucaucaa

SEQ ID NO: 2230127 - RNA, 20 nt, Homo sapiens
ucggagacagugacuggugc

SEQ ID NO: 2230128 - RNA, 15 nt, Homo sapiens
auaaggaaagcaaua

SEQ ID NO: 2230129 - RNA, 13 nt, Homo sapiens
caccacaccauca

SEQ ID NO: 2230130 - RNA, 13 nt, Homo sapiens
aauaacacaacaa

SEQ ID NO: 2230131 - RNA, 13 nt, Homo sapiens
auuaucacaucau

SEQ ID NO: 2230132 - RNA, 22 nt, Homo sapiens
gauuauugcuucuuuccuugca

SEQ ID NO: 2230133 - RNA, 18 nt, Homo sapiens
gcgccuugccuccucacc

SEQ ID NO: 2230134 - RNA, 12 nt, Homo sapiens
aaccaguucucu

SEQ ID NO: 2230135 - RNA, 21 nt, Homo sapiens
gcaaucccccaucguuaccca

SEQ ID NO: 2230136 - RNA, 20 nt, Homo sapiens
uaagaaaauacaauaaacua

SEQ ID NO: 2230137 - RNA, 20 nt, Homo sapiens
uuagaaacuuaucuuacaaa

SEQ ID NO: 2230138 - RNA, 21 nt, Homo sapiens
gcaaacaggguuugauagcac

SEQ ID NO: 2230139 - RNA, 19 nt, Homo sapiens
gcccacccugggaugggcc

SEQ ID NO: 2230140 - RNA, 15 nt, Homo sapiens
caagcucccugguga

SEQ ID NO: 2230141 - RNA, 19 nt, Homo sapiens
aaaggugccucauagcaua

SEQ ID NO: 2230142 - RNA, 16 nt, Homo sapiens
agcaccuugaauggaa

SEQ ID NO: 2230143 - RNA, 16 nt, Homo sapiens
gacuggcuuuuauuaa

SEQ ID NO: 2230144 - RNA, 19 nt, Homo sapiens
aaaaaugucauuacuuuca

SEQ ID NO: 2230145 - RNA, 20 nt, Homo sapiens
aacuccaccuauuuugcaaa

SEQ ID NO: 2230146 - RNA, 19 nt, Homo sapiens
cccuguauucucagcacuu

SEQ ID NO: 2230147 - RNA, 15 nt, Homo sapiens
gccugacucuucccu

SEQ ID NO: 2230148 - RNA, 15 nt, Homo sapiens
agcacagcuccugcc

SEQ ID NO: 2230149 - RNA, 20 nt, Homo sapiens
guuuggcaaugcuaauucaa

SEQ ID NO: 2230150 - RNA, 14 nt, Homo sapiens
gaagaguccaggaa

SEQ ID NO: 2230151 - RNA, 17 nt, Homo sapiens
acagacuucucaauaau

SEQ ID NO: 2230152 - RNA, 21 nt, Homo sapiens
cccacuuaccuugcaucucac

SEQ ID NO: 2230153 - RNA, 16 nt, Homo sapiens
guaaucccccuugcca

SEQ ID NO: 2230154 - RNA, 16 nt, Homo sapiens
cuuuuggucuucagcc

SEQ ID NO: 2230155 - RNA, 17 nt, Homo sapiens
uguuguuccguuaaccu

SEQ ID NO: 2230156 - RNA, 20 nt, Homo sapiens
aaauuuuaggcaaccuucua

SEQ ID NO: 2230157 - RNA, 22 nt, Homo sapiens
cucuucuucauucuaucaagcc

SEQ ID NO: 2230158 - RNA, 15 nt, Homo sapiens
aaaauaucuacauua

SEQ ID NO: 2230159 - RNA, 23 nt, Homo sapiens
ccauauaccaucuccagcuauuu

SEQ ID NO: 2230160 - RNA, 22 nt, Homo sapiens
ugcacuuuggguuuuuaacuca

SEQ ID NO: 2230161 - RNA, 24 nt, Homo sapiens
aacuauuaaggauguagcuuuuca

SEQ ID NO: 2230162 - RNA, 23 nt, Homo sapiens
uaucucggggagaaaugcaacca

SEQ ID NO: 2230163 - RNA, 18 nt, Homo sapiens
ucacucaaucucugauuc

SEQ ID NO: 2230164 - RNA, 13 nt, Homo sapiens
aagccucauuuga

SEQ ID NO: 2230165 - RNA, 14 nt, Homo sapiens
cacagcccaagagg

SEQ ID NO: 2230166 - RNA, 19 nt, Homo sapiens
guugcugggauuacaggug

SEQ ID NO: 2230167 - RNA, 17 nt, Homo sapiens
cgggguggcccacugag

SEQ ID NO: 2230168 - RNA, 12 nt, Homo sapiens
cuaucucuacug

SEQ ID NO: 2230169 - RNA, 19 nt, Homo sapiens
uggaaaaguguuccuugcu

SEQ ID NO: 2230170 - RNA, 16 nt, Homo sapiens
ggccugacgcauucuc

SEQ ID NO: 2230171 - RNA, 15 nt, Homo sapiens
uccgcauccuagucu

SEQ ID NO: 2230172 - RNA, 15 nt, Homo sapiens
aauaacaacaacuua

SEQ ID NO: 2230173 - RNA, 20 nt, Homo sapiens
uaugauuguaguuucuguaa

SEQ ID NO: 2230174 - RNA, 16 nt, Homo sapiens
uuacuccucacacuua

SEQ ID NO: 2230175 - RNA, 16 nt, Homo sapiens
cuugauucagucacau

SEQ ID NO: 2230176 - RNA, 17 nt, Homo sapiens
caaacacuagcucugua

SEQ ID NO: 2230177 - RNA, 17 nt, Homo sapiens
cucuucuaaaauagcaa

SEQ ID NO: 2230178 - RNA, 13 nt, Homo sapiens
cacagagugaacu

SEQ ID NO: 2230179 - RNA, 18 nt, Homo sapiens
uccaaugaaagacacugu

SEQ ID NO: 2230180 - RNA, 13 nt, Homo sapiens
uaguauugcugaa

SEQ ID NO: 2230181 - RNA, 23 nt, Homo sapiens
cuugccaccccacccucccugga

SEQ ID NO: 2230182 - RNA, 23 nt, Homo sapiens
gcaccgaugggcuuagagcucuc

SEQ ID NO: 2230183 - RNA, 16 nt, Homo sapiens
gcugguacugauguuc

SEQ ID NO: 2230184 - RNA, 17 nt, Homo sapiens
cagggaucauagcugac

SEQ ID NO: 2230185 - RNA, 23 nt, Homo sapiens
cacacagcaggaacugagccaga

SEQ ID NO: 2230186 - RNA, 20 nt, Homo sapiens
gaagcugaggcagaacucac

SEQ ID NO: 2230187 - RNA, 15 nt, Homo sapiens
gccaauaaaccaaug

SEQ ID NO: 2230188 - RNA, 15 nt, Homo sapiens
gauaaggaaauaaga

SEQ ID NO: 2230189 - RNA, 22 nt, Homo sapiens
cagcaaauaacagucugagacu

SEQ ID NO: 2230190 - RNA, 16 nt, Homo sapiens
agugcaugaacagggu

SEQ ID NO: 2230191 - RNA, 23 nt, Homo sapiens
ugccuuccauuuugaagugggau

SEQ ID NO: 2230192 - RNA, 21 nt, Homo sapiens
uuacuuauuuaacugauuaaa

SEQ ID NO: 2230193 - RNA, 15 nt, Homo sapiens
cguggguugcacugg

SEQ ID NO: 2230194 - RNA, 18 nt, Homo sapiens
gcuucuccuggucacugg

SEQ ID NO: 2230195 - RNA, 22 nt, Homo sapiens
ccauuacuuugauaucugauca

SEQ ID NO: 2230196 - RNA, 23 nt, Homo sapiens
cuguuucagcuaaaugcagggaa

SEQ ID NO: 2230197 - RNA, 17 nt, Homo sapiens
ucauccagcucacucau

SEQ ID NO: 2230198 - RNA, 14 nt, Homo sapiens
cauuuauuuauuca

SEQ ID NO: 2230199 - RNA, 16 nt, Homo sapiens
gucauguuccuucaag

SEQ ID NO: 2230200 - RNA, 18 nt, Homo sapiens
uuaucuugaguugcagcu

SEQ ID NO: 2230201 - RNA, 22 nt, Homo sapiens
cuuuucuaaaacagggauuuug

SEQ ID NO: 2230202 - RNA, 16 nt, Homo sapiens
gcucgcucugcaugau

SEQ ID NO: 2230203 - RNA, 13 nt, Homo sapiens
caggacuuaacau

SEQ ID NO: 2230204 - RNA, 17 nt, Homo sapiens
uggacacgucggacagc

SEQ ID NO: 2230205 - RNA, 20 nt, Homo sapiens
gccccccaucuagcaagcac

SEQ ID NO: 2230206 - RNA, 22 nt, Homo sapiens
uccucccccaccuucaagcacc

SEQ ID NO: 2230207 - RNA, 20 nt, Homo sapiens
gacuucuuuacuaacacugg

SEQ ID NO: 2230208 - RNA, 17 nt, Homo sapiens
ugaucucaaauccacug

SEQ ID NO: 2230209 - RNA, 14 nt, Homo sapiens
uccccaacaccugc

SEQ ID NO: 2230210 - RNA, 14 nt, Homo sapiens
uuuugcacauucca

SEQ ID NO: 2230211 - RNA, 11 nt, Homo sapiens
cgggucccugc

SEQ ID NO: 2230212 - RNA, 17 nt, Homo sapiens
uuuuaaugcuauuugaa

SEQ ID NO: 2230213 - RNA, 16 nt, Homo sapiens
cugaaggugcugacaa

SEQ ID NO: 2230214 - RNA, 22 nt, Homo sapiens
accgagcgugugccacuggacc

SEQ ID NO: 2230215 - RNA, 18 nt, Homo sapiens
ucagaggguagccuugau

SEQ ID NO: 2230216 - RNA, 23 nt, Homo sapiens
accauauucuaaguuagacucuu

SEQ ID NO: 2230217 - RNA, 15 nt, Homo sapiens
aauagcuaagcaucu

SEQ ID NO: 2230218 - RNA, 19 nt, Homo sapiens
uccacagacggaaggguaa

SEQ ID NO: 2230219 - RNA, 19 nt, Homo sapiens
guccucugcuaaaacaaca

SEQ ID NO: 2230220 - RNA, 20 nt, Homo sapiens
cucagggguuaagagcucag

SEQ ID NO: 2230221 - RNA, 14 nt, Homo sapiens
ccccgaugggaugg

SEQ ID NO: 2230222 - RNA, 21 nt, Homo sapiens
ugcagcagcaacacaauguua

SEQ ID NO: 2230223 - RNA, 17 nt, Homo sapiens
uccuccauuuuccuccc

SEQ ID NO: 2230224 - RNA, 21 nt, Homo sapiens
gaacagaaauuucuccaggga

SEQ ID NO: 2230225 - RNA, 15 nt, Homo sapiens
caggcggggugggca

SEQ ID NO: 2230226 - RNA, 18 nt, Homo sapiens
uugagccaagaccaaguc

SEQ ID NO: 2230227 - RNA, 23 nt, Homo sapiens
uugauuuuccucucucacaaauc

SEQ ID NO: 2230228 - RNA, 22 nt, Homo sapiens
uagaaaguuggccaauuucacc

SEQ ID NO: 2230229 - RNA, 22 nt, Homo sapiens
ugccccuauacaaaacaccaga

SEQ ID NO: 2230230 - RNA, 22 nt, Homo sapiens
ccgccugaaagccacaaugaga

SEQ ID NO: 2230231 - RNA, 16 nt, Homo sapiens
auguacauuacagauu

SEQ ID NO: 2230232 - RNA, 20 nt, Homo sapiens
gagucagucagcgagugcuu

SEQ ID NO: 2230233 - RNA, 15 nt, Homo sapiens
ugcucagugaucuca

SEQ ID NO: 2230234 - RNA, 15 nt, Homo sapiens
gugcuugucauggaa

SEQ ID NO: 2230235 - RNA, 20 nt, Homo sapiens
auuuuagcaggguacauauu

SEQ ID NO: 2230236 - RNA, 17 nt, Homo sapiens
ugacaucuaauucaaga

SEQ ID NO: 2230237 - RNA, 22 nt, Homo sapiens
agucugcagauagaaagcauua

SEQ ID NO: 2230238 - RNA, 23 nt, Homo sapiens
ucugauguuuuauuugcacuugu

SEQ ID NO: 2230239 - RNA, 22 nt, Homo sapiens
cucccaggcuggagagcacugc

SEQ ID NO: 2230240 - RNA, 13 nt, Homo sapiens
uagacuacauuua

SEQ ID NO: 2230241 - RNA, 15 nt, Homo sapiens
ccaacuaaucucauu

SEQ ID NO: 2230242 - RNA, 17 nt, Homo sapiens
agaucacgccacugcac

SEQ ID NO: 2230243 - RNA, 21 nt, Homo sapiens
uuacuauaaaaaucaugugau

SEQ ID NO: 2230244 - RNA, 17 nt, Homo sapiens
aagaaucagucuaucca

SEQ ID NO: 2230245 - RNA, 19 nt, Homo sapiens
caguuucuuagcuuuuuaa

SEQ ID NO: 2230246 - RNA, 19 nt, Homo sapiens
acuugaggccugaucugcc

SEQ ID NO: 2230247 - RNA, 20 nt, Homo sapiens
uucucaucuaaauauuucca

SEQ ID NO: 2230248 - RNA, 20 nt, Homo sapiens
ugccuccaucagcuaaacac

SEQ ID NO: 2230249 - RNA, 11 nt, Homo sapiens
ggcccaucuca

SEQ ID NO: 2230250 - RNA, 23 nt, Homo sapiens
gagcccaauguauuaugaucucu

SEQ ID NO: 2230251 - RNA, 17 nt, Homo sapiens
uuaguugcaacuuugua

SEQ ID NO: 2230252 - RNA, 17 nt, Homo sapiens
augugcucuacaucucg

SEQ ID NO: 2230253 - RNA, 20 nt, Homo sapiens
ccagaaauagccacuauuaa

SEQ ID NO: 2230254 - RNA, 19 nt, Homo sapiens
aagaaaucuugucuuacca

SEQ ID NO: 2230255 - RNA, 14 nt, Homo sapiens
auaccaaguugaua

SEQ ID NO: 2230256 - RNA, 18 nt, Homo sapiens
gaaucaaaucucuuccac

SEQ ID NO: 2230257 - RNA, 17 nt, Homo sapiens
gagcaguagaagccugc

SEQ ID NO: 2230258 - RNA, 22 nt, Homo sapiens
ccuucaggguuggauguaguuu

SEQ ID NO: 2230259 - RNA, 13 nt, Homo sapiens
agugaccauggca

SEQ ID NO: 2230260 - RNA, 19 nt, Homo sapiens
cuaaaaguaauaaauucca

SEQ ID NO: 2230261 - RNA, 14 nt, Homo sapiens
gggcagaggccaug

SEQ ID NO: 2230262 - RNA, 22 nt, Homo sapiens
aagagcucaggaugagggaaaa

SEQ ID NO: 2230263 - RNA, 12 nt, Homo sapiens
agcuuuucugca

SEQ ID NO: 2230264 - RNA, 15 nt, Homo sapiens
cuuaggccagcacca

SEQ ID NO: 2230265 - RNA, 22 nt, Homo sapiens
cuauuggacaauggacuugcaa

SEQ ID NO: 2230266 - RNA, 22 nt, Homo sapiens
ucucacauaagcccaguucauc

SEQ ID NO: 2230267 - RNA, 16 nt, Homo sapiens
acaccuuggauuugga

SEQ ID NO: 2230268 - RNA, 13 nt, Homo sapiens
aacuucccaaagc

SEQ ID NO: 2230269 - RNA, 18 nt, Homo sapiens
agcuaagaaauaaggcua

SEQ ID NO: 2230270 - RNA, 15 nt, Homo sapiens
gggaucaguugcccc

SEQ ID NO: 2230271 - RNA, 21 nt, Homo sapiens
ggucagugguggucuucaaga

SEQ ID NO: 2230272 - RNA, 12 nt, Homo sapiens
acuagaucuccc

SEQ ID NO: 2230273 - RNA, 16 nt, Homo sapiens
cggaugaccaaaccag

SEQ ID NO: 2230274 - RNA, 22 nt, Homo sapiens
uugcacaaguucccuggagaaa

SEQ ID NO: 2230275 - RNA, 23 nt, Homo sapiens
gaucagcaugggaaugugccucg

SEQ ID NO: 2230276 - RNA, 18 nt, Homo sapiens
gcaaguaaguaugaagga

SEQ ID NO: 2230277 - RNA, 22 nt, Homo sapiens
caccuccauuucucuccaggaa

SEQ ID NO: 2230278 - RNA, 15 nt, Homo sapiens
uccuuuccagguauu

SEQ ID NO: 2230279 - RNA, 16 nt, Homo sapiens
ggcaguccaggccucu

SEQ ID NO: 2230280 - RNA, 13 nt, Homo sapiens
cuaguacuguauu

SEQ ID NO: 2230281 - RNA, 23 nt, Homo sapiens
aaaauccuuuuggcauguuccca

SEQ ID NO: 2230282 - RNA, 13 nt, Homo sapiens
ugcuucucggggu

SEQ ID NO: 2230283 - RNA, 19 nt, Homo sapiens
aaguaacuucugacuuacu

SEQ ID NO: 2230284 - RNA, 20 nt, Homo sapiens
cagacacuggcauggauaua

SEQ ID NO: 2230285 - RNA, 17 nt, Homo sapiens
uagaauuuggcccagag

SEQ ID NO: 2230286 - RNA, 20 nt, Homo sapiens
ugauuauuuuuuauacugua

SEQ ID NO: 2230287 - RNA, 22 nt, Homo sapiens
guuaugaacccuuccugagcuu

SEQ ID NO: 2230288 - RNA, 14 nt, Homo sapiens
aggggucauucaug

SEQ ID NO: 2230289 - RNA, 17 nt, Homo sapiens
uagccaugauuuguccc

SEQ ID NO: 2230290 - RNA, 13 nt, Homo sapiens
cuuuuucuuugaa

SEQ ID NO: 2230291 - RNA, 22 nt, Homo sapiens
cccuuccaggugggugugggac

SEQ ID NO: 2230292 - RNA, 14 nt, Homo sapiens
guggcccaacacaa

SEQ ID NO: 2230293 - RNA, 22 nt, Homo sapiens
cuuuuucguguggaucuugcca

SEQ ID NO: 2230294 - RNA, 16 nt, Homo sapiens
aggauaaaaagccagg

SEQ ID NO: 2230295 - RNA, 17 nt, Homo sapiens
auuuaaugguuaaggga

SEQ ID NO: 2230296 - RNA, 18 nt, Homo sapiens
aagugggcugugacuccc

SEQ ID NO: 2230297 - RNA, 14 nt, Homo sapiens
uuuacaaccugaug

SEQ ID NO: 2230298 - RNA, 17 nt, Homo sapiens
aauaccccucaacucau

SEQ ID NO: 2230299 - RNA, 15 nt, Homo sapiens
cugggagacuuugaa

SEQ ID NO: 2230300 - RNA, 17 nt, Homo sapiens
aguacuguacagggugg

SEQ ID NO: 2230301 - RNA, 22 nt, Homo sapiens
uuaugauucagugcauuuucaa

SEQ ID NO: 2230302 - RNA, 16 nt, Homo sapiens
uugagauugugaaauu

SEQ ID NO: 2230303 - RNA, 18 nt, Homo sapiens
gaagcccugggugcagga

SEQ ID NO: 2230304 - RNA, 19 nt, Homo sapiens
uuuuauguacagguguaua

SEQ ID NO: 2230305 - RNA, 19 nt, Homo sapiens
auuuacacauacaacuuca

SEQ ID NO: 2230306 - RNA, 12 nt, Homo sapiens
uuuguuuaccag

SEQ ID NO: 2230307 - RNA, 12 nt, Homo sapiens
ucaauuuacuua

SEQ ID NO: 2230308 - RNA, 18 nt, Homo sapiens
ugggaggcuggggaccca

SEQ ID NO: 2230309 - RNA, 19 nt, Homo sapiens
uucaacauuuacauguauu

SEQ ID NO: 2230310 - RNA, 19 nt, Homo sapiens
agggcaugggagugaucuc

SEQ ID NO: 2230311 - RNA, 22 nt, Homo sapiens
gacgggguugucgagaucucag

SEQ ID NO: 2230312 - RNA, 16 nt, Homo sapiens
auugauagaacuacuu

SEQ ID NO: 2230313 - RNA, 17 nt, Homo sapiens
cugacauucacugagug

SEQ ID NO: 2230314 - RNA, 15 nt, Homo sapiens
ugagagacacacuga

SEQ ID NO: 2230315 - RNA, 22 nt, Homo sapiens
auaauauagcuuaaaacacuuc

SEQ ID NO: 2230316 - RNA, 20 nt, Homo sapiens
gagccaugucaugugccacg

SEQ ID NO: 2230317 - RNA, 21 nt, Homo sapiens
caucagacccaacccaugaag

SEQ ID NO: 2230318 - RNA, 22 nt, Homo sapiens
ccacaugugacacauaugcacc

SEQ ID NO: 2230319 - RNA, 23 nt, Homo sapiens
ccugcagccaucccaaggcuccu

SEQ ID NO: 2230320 - RNA, 14 nt, Homo sapiens
gaguccauuugaag

SEQ ID NO: 2230321 - RNA, 17 nt, Homo sapiens
cauccugcucauaacau

SEQ ID NO: 2230322 - RNA, 19 nt, Homo sapiens
cuugaauccuuccauucca

SEQ ID NO: 2230323 - RNA, 18 nt, Homo sapiens
gaaaacucaaccagaguc

SEQ ID NO: 2230324 - RNA, 23 nt, Homo sapiens
cagcgcccccaucugucuucagc

SEQ ID NO: 2230325 - RNA, 19 nt, Homo sapiens
auccaaaaagcucugaaaa

SEQ ID NO: 2230326 - RNA, 17 nt, Homo sapiens
caugaaacauguucuca

SEQ ID NO: 2230327 - RNA, 23 nt, Homo sapiens
aagccuuaaguggcagaauauaa

SEQ ID NO: 2230328 - RNA, 12 nt, Homo sapiens
uagcucuauguu

SEQ ID NO: 2230329 - RNA, 22 nt, Homo sapiens
uguccccggcggggugccugcu

SEQ ID NO: 2230330 - RNA, 21 nt, Homo sapiens
acggcccucaucuaugaggaa

SEQ ID NO: 2230331 - RNA, 21 nt, Homo sapiens
uaauuauuauuuaacucuuaa

SEQ ID NO: 2230332 - RNA, 14 nt, Homo sapiens
ucaaaccuacuaau

SEQ ID NO: 2230333 - RNA, 17 nt, Homo sapiens
cuuuagggcuguugcua

SEQ ID NO: 2230334 - RNA, 19 nt, Homo sapiens
aguuguucgccgcguggaa

SEQ ID NO: 2230335 - RNA, 21 nt, Homo sapiens
cauaagucgucacuaauacac

SEQ ID NO: 2230336 - RNA, 20 nt, Homo sapiens
uaaucaucaaguaauacaaa

SEQ ID NO: 2230337 - RNA, 14 nt, Homo sapiens
ucuuuucagaaaga

SEQ ID NO: 2230338 - RNA, 17 nt, Homo sapiens
cuaauuuacaagcacga

SEQ ID NO: 2230339 - RNA, 13 nt, Homo sapiens
gggacuugggagc

SEQ ID NO: 2230340 - RNA, 13 nt, Homo sapiens
ugagguuguggag

SEQ ID NO: 2230341 - RNA, 21 nt, Homo sapiens
auaauguuacauuauuaucaa

SEQ ID NO: 2230342 - RNA, 23 nt, Homo sapiens
caagccuugauugguguugccag

SEQ ID NO: 2230343 - RNA, 13 nt, Homo sapiens
cuggacucuggac

SEQ ID NO: 2230344 - RNA, 18 nt, Homo sapiens
uucuuucuuuugucgcag

SEQ ID NO: 2230345 - RNA, 23 nt, Homo sapiens
ugggccccugucgucaggaccuc

SEQ ID NO: 2230346 - RNA, 23 nt, Homo sapiens
caagagcguucgugcagugcccu

SEQ ID NO: 2230347 - RNA, 16 nt, Homo sapiens
ggaaaaaaaaagggaa

SEQ ID NO: 2230348 - RNA, 20 nt, Homo sapiens
gagcccaggccguuccccuu

SEQ ID NO: 2230349 - RNA, 20 nt, Homo sapiens
uucuccccugccggugcaca

SEQ ID NO: 2230350 - RNA, 12 nt, Homo sapiens
acuuauuugccc

SEQ ID NO: 2230351 - RNA, 22 nt, Homo sapiens
uuucccuguguacccuccaugu

SEQ ID NO: 2230352 - RNA, 19 nt, Homo sapiens
acaggaggggaaggcaaca

SEQ ID NO: 2230353 - RNA, 16 nt, Homo sapiens
uuccugauaacauuau

SEQ ID NO: 2230354 - RNA, 15 nt, Homo sapiens
agacaacauuucuca

SEQ ID NO: 2230355 - RNA, 13 nt, Homo sapiens
cggagggugaccc

SEQ ID NO: 2230356 - RNA, 16 nt, Homo sapiens
uucccaggccagcgag

SEQ ID NO: 2230357 - RNA, 18 nt, Homo sapiens
cauauugcucucauuuca

SEQ ID NO: 2230358 - RNA, 18 nt, Homo sapiens
accauguuagccaggcug

SEQ ID NO: 2230359 - RNA, 13 nt, Homo sapiens
ucuuggcaaaagc

SEQ ID NO: 2230360 - RNA, 22 nt, Homo sapiens
aacuaccuauccuuacauuuca

SEQ ID NO: 2230361 - RNA, 15 nt, Homo sapiens
cuggaugguggugca

SEQ ID NO: 2230362 - RNA, 14 nt, Homo sapiens
agcuccccuagaca

SEQ ID NO: 2230363 - RNA, 13 nt, Homo sapiens
cuuuguccccuca

SEQ ID NO: 2230364 - RNA, 13 nt, Homo sapiens
gacaguggcacua

SEQ ID NO: 2230365 - RNA, 18 nt, Homo sapiens
ucaaaagugaucuguccc

SEQ ID NO: 2230366 - RNA, 19 nt, Homo sapiens
gauuuucaaaagcauuaau

SEQ ID NO: 2230367 - RNA, 20 nt, Homo sapiens
gaggucugauggagcugcgu

SEQ ID NO: 2230368 - RNA, 14 nt, Homo sapiens
uaguuuaccucauc

SEQ ID NO: 2230369 - RNA, 14 nt, Homo sapiens
cccagcagaucuca

SEQ ID NO: 2230370 - RNA, 11 nt, Homo sapiens
ucagugacauc

SEQ ID NO: 2230371 - RNA, 21 nt, Homo sapiens
uguucucauggagaagacuuc

SEQ ID NO: 2230372 - RNA, 15 nt, Homo sapiens
cuauuuaaguuauca

SEQ ID NO: 2230373 - RNA, 17 nt, Homo sapiens
uagcagggaguacccag

SEQ ID NO: 2230374 - RNA, 22 nt, Homo sapiens
caaggcgauauaagcaaaauca

SEQ ID NO: 2230375 - RNA, 18 nt, Homo sapiens
cugaacaccuauugcacu

SEQ ID NO: 2230376 - RNA, 15 nt, Homo sapiens
agguggaccuggcag

SEQ ID NO: 2230377 - RNA, 12 nt, Homo sapiens
gaaaauuccaau

SEQ ID NO: 2230378 - RNA, 18 nt, Homo sapiens
uaaccgauaugcacuuga

SEQ ID NO: 2230379 - RNA, 12 nt, Homo sapiens
cuauaaugugug

SEQ ID NO: 2230380 - RNA, 13 nt, Homo sapiens
acuaagaggcuau

SEQ ID NO: 2230381 - RNA, 22 nt, Homo sapiens
cauuuauaaccccagccugacc

SEQ ID NO: 2230382 - RNA, 21 nt, Homo sapiens
caggaccuuuuggucuucagc

SEQ ID NO: 2230383 - RNA, 18 nt, Homo sapiens
guuguguugagaugauau

SEQ ID NO: 2230384 - RNA, 13 nt, Homo sapiens
uucacuucagagc

SEQ ID NO: 2230385 - RNA, 20 nt, Homo sapiens
acaaaauuugagaauacaua

SEQ ID NO: 2230386 - RNA, 11 nt, Homo sapiens
aguuacuugaa

SEQ ID NO: 2230387 - RNA, 13 nt, Homo sapiens
caucagcacucug

SEQ ID NO: 2230388 - RNA, 12 nt, Homo sapiens
aacugaagccca

SEQ ID NO: 2230389 - RNA, 13 nt, Homo sapiens
ugugaggccacac

SEQ ID NO: 2230390 - RNA, 12 nt, Homo sapiens
uccuaaggcaug

SEQ ID NO: 2230391 - RNA, 17 nt, Homo sapiens
ccucuguaccccaugac

SEQ ID NO: 2230392 - RNA, 20 nt, Homo sapiens
aauauggaacauaugcacag

SEQ ID NO: 2230393 - RNA, 16 nt, Homo sapiens
agaaauuuaaaagaca

SEQ ID NO: 2230394 - RNA, 19 nt, Homo sapiens
cagccccuccccauggugc

SEQ ID NO: 2230395 - RNA, 14 nt, Homo sapiens
caagugauucucau

SEQ ID NO: 2230396 - RNA, 11 nt, Homo sapiens
caucucuacua

SEQ ID NO: 2230397 - RNA, 18 nt, Homo sapiens
cugauuucacauauugca

SEQ ID NO: 2230398 - RNA, 21 nt, Homo sapiens
auguguuuggaagacaacucu

SEQ ID NO: 2230399 - RNA, 21 nt, Homo sapiens
ggaaggaacauggagcuguca

SEQ ID NO: 2230400 - RNA, 20 nt, Homo sapiens
aagauggagcaaaccuagcc

SEQ ID NO: 2230401 - RNA, 21 nt, Homo sapiens
auuaugcauauauaaguuuac

SEQ ID NO: 2230402 - RNA, 12 nt, Homo sapiens
aagccacacaga

SEQ ID NO: 2230403 - RNA, 12 nt, Homo sapiens
caaacacaaaac

SEQ ID NO: 2230404 - RNA, 18 nt, Homo sapiens
gauucucugcgagcaaca

SEQ ID NO: 2230405 - RNA, 13 nt, Homo sapiens
cagguucuucagg

SEQ ID NO: 2230406 - RNA, 19 nt, Homo sapiens
cuccaggggcagggccuug

SEQ ID NO: 2230407 - RNA, 16 nt, Homo sapiens
ccuuuacaaugugaau

SEQ ID NO: 2230408 - RNA, 22 nt, Homo sapiens
ccccauggccggcuuucaggag

SEQ ID NO: 2230409 - RNA, 14 nt, Homo sapiens
gauauguuaagcau

SEQ ID NO: 2230410 - RNA, 17 nt, Homo sapiens
uaaaugaaucuuacucc

SEQ ID NO: 2230411 - RNA, 18 nt, Homo sapiens
uaucacaguaacccagag

SEQ ID NO: 2230412 - RNA, 14 nt, Homo sapiens
ccuuuucaaaaccu

SEQ ID NO: 2230413 - RNA, 20 nt, Homo sapiens
gucuucuuuuugaaacaauu

SEQ ID NO: 2230414 - RNA, 20 nt, Homo sapiens
gccucaccuccucugugauu

SEQ ID NO: 2230415 - RNA, 15 nt, Homo sapiens
uuaaacucaugggaa

SEQ ID NO: 2230416 - RNA, 11 nt, Homo sapiens
aaccauggcau

SEQ ID NO: 2230417 - RNA, 11 nt, Homo sapiens
aacaauccaaa

SEQ ID NO: 2230418 - RNA, 20 nt, Homo sapiens
cucauuauucacaguaauua

SEQ ID NO: 2230419 - RNA, 14 nt, Homo sapiens
ccuccucuugacuu

SEQ ID NO: 2230420 - RNA, 21 nt, Homo sapiens
agccucaccauacccuguuga

SEQ ID NO: 2230421 - RNA, 13 nt, Homo sapiens
aacuaacaauuca

SEQ ID NO: 2230422 - RNA, 13 nt, Homo sapiens
acagguugcugaa

SEQ ID NO: 2230423 - RNA, 22 nt, Homo sapiens
acaauaaaccuccgccaaugca

SEQ ID NO: 2230424 - RNA, 19 nt, Homo sapiens
aaucuguuaccauucugau

SEQ ID NO: 2230425 - RNA, 21 nt, Homo sapiens
uugguacuagauacugaaugu

SEQ ID NO: 2230426 - RNA, 13 nt, Homo sapiens
cguacuguucaca

SEQ ID NO: 2230427 - RNA, 18 nt, Homo sapiens
ucuuucacccacagaaag

SEQ ID NO: 2230428 - RNA, 20 nt, Homo sapiens
uggugcaauuacagcaaaaa

SEQ ID NO: 2230429 - RNA, 23 nt, Homo sapiens
uuuaucgcaauuacuuguaucau

SEQ ID NO: 2230430 - RNA, 16 nt, Homo sapiens
accccguucccagcgc

SEQ ID NO: 2230431 - RNA, 14 nt, Homo sapiens
ccccuacagaauuu

SEQ ID NO: 2230432 - RNA, 19 nt, Homo sapiens
caguguugacauagccuuu

SEQ ID NO: 2230433 - RNA, 19 nt, Homo sapiens
caagauacuugaacacugu

SEQ ID NO: 2230434 - RNA, 11 nt, Homo sapiens
gcucacugcaa

SEQ ID NO: 2230435 - RNA, 23 nt, Homo sapiens
ggcaugcaaaagcaaucauagag

SEQ ID NO: 2230436 - RNA, 19 nt, Homo sapiens
gaagaguuuacagacaaua

SEQ ID NO: 2230437 - RNA, 15 nt, Homo sapiens
uccucaguucaucca

SEQ ID NO: 2230438 - RNA, 13 nt, Homo sapiens
gauugcagacuca

SEQ ID NO: 2230439 - RNA, 21 nt, Homo sapiens
cauccccucaacacccugcuu

SEQ ID NO: 2230440 - RNA, 19 nt, Homo sapiens
cauccacauaacccuguca

SEQ ID NO: 2230441 - RNA, 15 nt, Homo sapiens
auagugucucuucaa

SEQ ID NO: 2230442 - RNA, 18 nt, Homo sapiens
uucacugagcuccccaga

SEQ ID NO: 2230443 - RNA, 19 nt, Homo sapiens
cagaaccauaaagcauaug

SEQ ID NO: 2230444 - RNA, 22 nt, Homo sapiens
acuucuaaguaaaaccacagca

SEQ ID NO: 2230445 - RNA, 17 nt, Homo sapiens
ugcagaagucccaagac

SEQ ID NO: 2230446 - RNA, 23 nt, Homo sapiens
uucuguccugagaagcauguaau

SEQ ID NO: 2230447 - RNA, 19 nt, Homo sapiens
gucaacucuggccaggaac

SEQ ID NO: 2230448 - RNA, 16 nt, Homo sapiens
cagccucauugauguc

SEQ ID NO: 2230449 - RNA, 19 nt, Homo sapiens
acuucauucaaaaagccaa

SEQ ID NO: 2230450 - RNA, 17 nt, Homo sapiens
ucuguuguuauuccuau

SEQ ID NO: 2230451 - RNA, 17 nt, Homo sapiens
ucacuagagcugggaaa

SEQ ID NO: 2230452 - RNA, 16 nt, Homo sapiens
acugcugggcuuggca

SEQ ID NO: 2230453 - RNA, 20 nt, Homo sapiens
cugugauuaaagcaguaaua

SEQ ID NO: 2230454 - RNA, 17 nt, Homo sapiens
cucucugagaugccccu

SEQ ID NO: 2230455 - RNA, 17 nt, Homo sapiens
guacugaugacacacca

SEQ ID NO: 2230456 - RNA, 12 nt, Homo sapiens
gaucaacauucc

SEQ ID NO: 2230457 - RNA, 21 nt, Homo sapiens
aauuuugcagcagaagccaaa

SEQ ID NO: 2230458 - RNA, 17 nt, Homo sapiens
augggagggggcuccau

SEQ ID NO: 2230459 - RNA, 13 nt, Homo sapiens
ccagcucaugcca

SEQ ID NO: 2230460 - RNA, 14 nt, Homo sapiens
auuggaagugcagu

SEQ ID NO: 2230461 - RNA, 13 nt, Homo sapiens
agcauaacuuauu

SEQ ID NO: 2230462 - RNA, 17 nt, Homo sapiens
aucaaguuugaccagug

SEQ ID NO: 2230463 - RNA, 12 nt, Homo sapiens
uuucauucuugu

SEQ ID NO: 2230464 - RNA, 17 nt, Homo sapiens
auccacaguauuguucu

SEQ ID NO: 2230465 - RNA, 17 nt, Homo sapiens
gggcaacagagcaagau

SEQ ID NO: 2230466 - RNA, 13 nt, Homo sapiens
acuccaaccagaa

SEQ ID NO: 2230467 - RNA, 23 nt, Homo sapiens
cagcugauccaggcaaucguucu

SEQ ID NO: 2230468 - RNA, 15 nt, Homo sapiens
aucugucacauaaaa

SEQ ID NO: 2230469 - RNA, 14 nt, Homo sapiens
agagaugauacuga

SEQ ID NO: 2230470 - RNA, 15 nt, Homo sapiens
cagcccugaaggcac

SEQ ID NO: 2230471 - RNA, 17 nt, Homo sapiens
auguucuuucacccuuu

SEQ ID NO: 2230472 - RNA, 16 nt, Homo sapiens
cugacuucauacaucc

SEQ ID NO: 2230473 - RNA, 20 nt, Homo sapiens
uuccuaaaaguucauaacag

SEQ ID NO: 2230474 - RNA, 17 nt, Homo sapiens
uuuccuacuguccucag

SEQ ID NO: 2230475 - RNA, 22 nt, Homo sapiens
ccaccucggcacacacugugcc

SEQ ID NO: 2230476 - RNA, 16 nt, Homo sapiens
ugcuggucuauuuuga

SEQ ID NO: 2230477 - RNA, 22 nt, Homo sapiens
caagacagcauuuguguguuac

SEQ ID NO: 2230478 - RNA, 16 nt, Homo sapiens
agugaggucacagucc

SEQ ID NO: 2230479 - RNA, 18 nt, Homo sapiens
cuaagccuguugagacuu

SEQ ID NO: 2230480 - RNA, 21 nt, Homo sapiens
uagaucagaauuguugacuug

SEQ ID NO: 2230481 - RNA, 19 nt, Homo sapiens
aaauauuaaggagaauuca

SEQ ID NO: 2230482 - RNA, 15 nt, Homo sapiens
gugcucggcuguaaa

SEQ ID NO: 2230483 - RNA, 16 nt, Homo sapiens
cuggcgacugccccug

SEQ ID NO: 2230484 - RNA, 15 nt, Homo sapiens
gauuaaaagcacaag

SEQ ID NO: 2230485 - RNA, 20 nt, Homo sapiens
uuggugcacaaguaacacau

SEQ ID NO: 2230486 - RNA, 20 nt, Homo sapiens
ccaggaggaauaagcuccca

SEQ ID NO: 2230487 - RNA, 23 nt, Homo sapiens
cugcccauuucauauucuuucaa

SEQ ID NO: 2230488 - RNA, 15 nt, Homo sapiens
aguucugacuuugaa

SEQ ID NO: 2230489 - RNA, 17 nt, Homo sapiens
cuuaaauauacaacuuu

SEQ ID NO: 2230490 - RNA, 19 nt, Homo sapiens
aaaauggaagguuggagac

SEQ ID NO: 2230491 - RNA, 20 nt, Homo sapiens
auugcuccuauacuauugaa

SEQ ID NO: 2230492 - RNA, 16 nt, Homo sapiens
uggccacuucauucca

SEQ ID NO: 2230493 - RNA, 19 nt, Homo sapiens
caaaguguuaggauuacag

SEQ ID NO: 2230494 - RNA, 19 nt, Homo sapiens
ggccaggccacccaaagga

SEQ ID NO: 2230495 - RNA, 20 nt, Homo sapiens
ccucagugagauauuuggua

SEQ ID NO: 2230496 - RNA, 14 nt, Homo sapiens
cugugcacgcagug

SEQ ID NO: 2230497 - RNA, 15 nt, Homo sapiens
cugagguuuacauac

SEQ ID NO: 2230498 - RNA, 23 nt, Homo sapiens
guaucuuaaaaaucuaugccuaa

SEQ ID NO: 2230499 - RNA, 19 nt, Homo sapiens
aggcauaggccugggugcu

SEQ ID NO: 2230500 - RNA, 20 nt, Homo sapiens
uggcuccaacacugcugcuc

SEQ ID NO: 2230501 - RNA, 21 nt, Homo sapiens
acugggcuaccgugagaucca

SEQ ID NO: 2230502 - RNA, 21 nt, Homo sapiens
cuuuugaccuguggugcaaaa

SEQ ID NO: 2230503 - RNA, 22 nt, Homo sapiens
gcucccucuuaacgcagcacuu

SEQ ID NO: 2230504 - RNA, 22 nt, Homo sapiens
uaccuuuguguaaagaagggaa

SEQ ID NO: 2230505 - RNA, 13 nt, Homo sapiens
uccaauauuucug

SEQ ID NO: 2230506 - RNA, 20 nt, Homo sapiens
uuugggggugcuaauccagg

SEQ ID NO: 2230507 - RNA, 11 nt, Homo sapiens
aaucaaagcaa

SEQ ID NO: 2230508 - RNA, 19 nt, Homo sapiens
ccuagggccacugaagaua

SEQ ID NO: 2230509 - RNA, 17 nt, Homo sapiens
auauccaguuuaaucuu

SEQ ID NO: 2230510 - RNA, 17 nt, Homo sapiens
caaagagaaugccauuc

SEQ ID NO: 2230511 - RNA, 15 nt, Homo sapiens
cacaugacauagcac

SEQ ID NO: 2230512 - RNA, 19 nt, Homo sapiens
gacuccaggagaggagcgg

SEQ ID NO: 2230513 - RNA, 17 nt, Homo sapiens
agucaagaaucacuugc

SEQ ID NO: 2230514 - RNA, 14 nt, Homo sapiens
ucgucauacaguaa

SEQ ID NO: 2230515 - RNA, 14 nt, Homo sapiens
ucuucuuacauuau

SEQ ID NO: 2230516 - RNA, 21 nt, Homo sapiens
ucagcauucaaaauaguucua

SEQ ID NO: 2230517 - RNA, 21 nt, Homo sapiens
ggagggccccucaugugugcu

SEQ ID NO: 2230518 - RNA, 20 nt, Homo sapiens
cuaggaaagaguugagcaca

SEQ ID NO: 2230519 - RNA, 18 nt, Homo sapiens
aucauguaaaugcucaaa

SEQ ID NO: 2230520 - RNA, 17 nt, Homo sapiens
aagggagcuagccagag

SEQ ID NO: 2230521 - RNA, 18 nt, Homo sapiens
caaaggcacagugaaggc

SEQ ID NO: 2230522 - RNA, 10 nt, Homo sapiens
guuugacaaa

SEQ ID NO: 2230523 - RNA, 21 nt, Homo sapiens
uguugauccauccagcuugcc

SEQ ID NO: 2230524 - RNA, 18 nt, Homo sapiens
ucaucagagaacagucau

SEQ ID NO: 2230525 - RNA, 21 nt, Homo sapiens
ggcucccucuuggucuuccca

SEQ ID NO: 2230526 - RNA, 23 nt, Homo sapiens
ucacacugcugggaaguggcuua

SEQ ID NO: 2230527 - RNA, 22 nt, Homo sapiens
uccuguauucuacagcagauac

SEQ ID NO: 2230528 - RNA, 21 nt, Homo sapiens
guguuaucacaguaacccaga

SEQ ID NO: 2230529 - RNA, 23 nt, Homo sapiens
ccaagcggaugcuccauuucaau

SEQ ID NO: 2230530 - RNA, 17 nt, Homo sapiens
cugacaacagccugaga

SEQ ID NO: 2230531 - RNA, 16 nt, Homo sapiens
cucaguucucuuucaa

SEQ ID NO: 2230532 - RNA, 16 nt, Homo sapiens
uauguuaccuuuucau

SEQ ID NO: 2230533 - RNA, 12 nt, Homo sapiens
uuugaaagcagu

SEQ ID NO: 2230534 - RNA, 14 nt, Homo sapiens
cccaggcacugggc

SEQ ID NO: 2230535 - RNA, 17 nt, Homo sapiens
aaggaaacauaguagca

SEQ ID NO: 2230536 - RNA, 22 nt, Homo sapiens
uaauaugauuuuuuaagucuau

SEQ ID NO: 2230537 - RNA, 19 nt, Homo sapiens
ucagcuuuacuagugccaa

SEQ ID NO: 2230538 - RNA, 17 nt, Homo sapiens
accaucuucuauucaaa

SEQ ID NO: 2230539 - RNA, 16 nt, Homo sapiens
aaagacaucuccacca

SEQ ID NO: 2230540 - RNA, 19 nt, Homo sapiens
guauugauuuuaaauggau

SEQ ID NO: 2230541 - RNA, 18 nt, Homo sapiens
uucaaggaggaaagaaga

SEQ ID NO: 2230542 - RNA, 21 nt, Homo sapiens
caauuccaggcugagccauga

SEQ ID NO: 2230543 - RNA, 16 nt, Homo sapiens
cagagcuucuuccagg

SEQ ID NO: 2230544 - RNA, 12 nt, Homo sapiens
uuuucaaucuca

SEQ ID NO: 2230545 - RNA, 13 nt, Homo sapiens
cucuuguuauuau

SEQ ID NO: 2230546 - RNA, 20 nt, Homo sapiens
ugcagacagugucagaguca

SEQ ID NO: 2230547 - RNA, 19 nt, Homo sapiens
uucuuaacuuugaaccaua

SEQ ID NO: 2230548 - RNA, 16 nt, Homo sapiens
ucuggccuuacaccuc

SEQ ID NO: 2230549 - RNA, 13 nt, Homo sapiens
aagccaggaguug

SEQ ID NO: 2230550 - RNA, 14 nt, Homo sapiens
cauuaagcccucuu

SEQ ID NO: 2230551 - RNA, 24 nt, Homo sapiens
cccaucuuggccucccagaguauu

SEQ ID NO: 2230552 - RNA, 19 nt, Homo sapiens
cagggaaaauuauuugcau

SEQ ID NO: 2230553 - RNA, 22 nt, Homo sapiens
ccuuuggacuugucccgggaca

SEQ ID NO: 2230554 - RNA, 15 nt, Homo sapiens
ccaugagaguuucaa

SEQ ID NO: 2230555 - RNA, 13 nt, Homo sapiens
cucuugagcauca

SEQ ID NO: 2230556 - RNA, 20 nt, Homo sapiens
ccacuggcaaauguaacugu

SEQ ID NO: 2230557 - RNA, 17 nt, Homo sapiens
ugaagucuucuccucca

SEQ ID NO: 2230558 - RNA, 14 nt, Homo sapiens
agaaucuacuaagu

SEQ ID NO: 2230559 - RNA, 11 nt, Homo sapiens
uaccugggaaa

SEQ ID NO: 2230560 - RNA, 15 nt, Homo sapiens
uugggacucaggaua

SEQ ID NO: 2230561 - RNA, 16 nt, Homo sapiens
accugacucaggccag

SEQ ID NO: 2230562 - RNA, 20 nt, Homo sapiens
gcccucauuuucccucagaa

SEQ ID NO: 2230563 - RNA, 21 nt, Homo sapiens
ugccgccucaagggucuucag

SEQ ID NO: 2230564 - RNA, 18 nt, Homo sapiens
agcuaaggaggggaaaaa

SEQ ID NO: 2230565 - RNA, 19 nt, Homo sapiens
auuuuugaaaaaugcacug

SEQ ID NO: 2230566 - RNA, 10 nt, Homo sapiens
ccaguaccau

SEQ ID NO: 2230567 - RNA, 15 nt, Homo sapiens
uaaagaaaauaugca

SEQ ID NO: 2230568 - RNA, 14 nt, Homo sapiens
aaagaacuuggaaa

SEQ ID NO: 2230569 - RNA, 24 nt, Homo sapiens
ccugaagacugaggacaaagugga

SEQ ID NO: 2230570 - RNA, 19 nt, Homo sapiens
uacuacaaacuucaaagag

SEQ ID NO: 2230571 - RNA, 18 nt, Homo sapiens
cuucuuguguccugauga

SEQ ID NO: 2230572 - RNA, 19 nt, Homo sapiens
aaagacccaacauuacuaa

SEQ ID NO: 2230573 - RNA, 15 nt, Homo sapiens
uagucccagcuacuu

SEQ ID NO: 2230574 - RNA, 20 nt, Homo sapiens
auguccccaaugcuguaccu

SEQ ID NO: 2230575 - RNA, 21 nt, Homo sapiens
gcagccuccaggauaccagca

SEQ ID NO: 2230576 - RNA, 14 nt, Homo sapiens
agucugucucagga

SEQ ID NO: 2230577 - RNA, 14 nt, Homo sapiens
acuucaauuuacuu

SEQ ID NO: 2230578 - RNA, 13 nt, Homo sapiens
uuaaucaacagaa

SEQ ID NO: 2230579 - RNA, 16 nt, Homo sapiens
ucuuaaguagggacuu

SEQ ID NO: 2230580 - RNA, 15 nt, Homo sapiens
gccucgaaaguguca

SEQ ID NO: 2230581 - RNA, 21 nt, Homo sapiens
cagguaacgucuguaagcuga

SEQ ID NO: 2230582 - RNA, 16 nt, Homo sapiens
cuagcucucacagaca

SEQ ID NO: 2230583 - RNA, 14 nt, Homo sapiens
augugcacaugcac

SEQ ID NO: 2230584 - RNA, 14 nt, Homo sapiens
auauguacauacau

SEQ ID NO: 2230585 - RNA, 23 nt, Homo sapiens
ugcaggaaagaauagaagugauu

SEQ ID NO: 2230586 - RNA, 14 nt, Homo sapiens
ugaauauccagaaa

SEQ ID NO: 2230587 - RNA, 16 nt, Homo sapiens
ccugcggugcuaucuc

SEQ ID NO: 2230588 - RNA, 20 nt, Homo sapiens
aguugccaaagaaucuagga

SEQ ID NO: 2230589 - RNA, 14 nt, Homo sapiens
ccagccacauuuca

SEQ ID NO: 2230590 - RNA, 21 nt, Homo sapiens
ucccucugagaauuccaagga

SEQ ID NO: 2230591 - RNA, 16 nt, Homo sapiens
ugccuguauucucuau

SEQ ID NO: 2230592 - RNA, 16 nt, Homo sapiens
gugaaagugacucuca

SEQ ID NO: 2230593 - RNA, 14 nt, Homo sapiens
gacccaaucugccu

SEQ ID NO: 2230594 - RNA, 16 nt, Homo sapiens
uuuaaagcucaugcau

SEQ ID NO: 2230595 - RNA, 22 nt, Homo sapiens
aaccguaugagggaacugugua

SEQ ID NO: 2230596 - RNA, 15 nt, Homo sapiens
ccuauacauccacag

SEQ ID NO: 2230597 - RNA, 14 nt, Homo sapiens
ucaccaaacaggaa

SEQ ID NO: 2230598 - RNA, 20 nt, Homo sapiens
aacugcaucccacguucugu

SEQ ID NO: 2230599 - RNA, 17 nt, Homo sapiens
aaaaauacucacauggc

SEQ ID NO: 2230600 - RNA, 19 nt, Homo sapiens
cagccgaggccacagaauc

SEQ ID NO: 2230601 - RNA, 21 nt, Homo sapiens
uuccugguagaccacugccau

SEQ ID NO: 2230602 - RNA, 19 nt, Homo sapiens
ucucccuggaucagaacag

SEQ ID NO: 2230603 - RNA, 14 nt, Homo sapiens
acucucuguuacac

SEQ ID NO: 2230604 - RNA, 15 nt, Homo sapiens
gacgggaaaaccaaa

SEQ ID NO: 2230605 - RNA, 12 nt, Homo sapiens
cacgaagucagu

SEQ ID NO: 2230606 - RNA, 22 nt, Homo sapiens
cuggaaaguccuccuauuccag

SEQ ID NO: 2230607 - RNA, 14 nt, Homo sapiens
accuacccaugacc

SEQ ID NO: 2230608 - RNA, 20 nt, Homo sapiens
agguuuuuauuuuuccuaca

SEQ ID NO: 2230609 - RNA, 15 nt, Homo sapiens
uuuuuaagccuuuga

SEQ ID NO: 2230610 - RNA, 17 nt, Homo sapiens
uuguauuaucaacagca

SEQ ID NO: 2230611 - RNA, 16 nt, Homo sapiens
uguugugcaugcucaa

SEQ ID NO: 2230612 - RNA, 22 nt, Homo sapiens
gaacucacugcgauggggguca

SEQ ID NO: 2230613 - RNA, 15 nt, Homo sapiens
uacauauaucucugu

SEQ ID NO: 2230614 - RNA, 18 nt, Homo sapiens
aggcuucaauuuauugca

SEQ ID NO: 2230615 - RNA, 13 nt, Homo sapiens
aaaauucacauga

SEQ ID NO: 2230616 - RNA, 17 nt, Homo sapiens
cuguugcgccacugaga

SEQ ID NO: 2230617 - RNA, 16 nt, Homo sapiens
acaugcuuaugacaau

SEQ ID NO: 2230618 - RNA, 15 nt, Homo sapiens
caaacucccaggacc

SEQ ID NO: 2230619 - RNA, 14 nt, Homo sapiens
ugcagauuugauau

SEQ ID NO: 2230620 - RNA, 20 nt, Homo sapiens
ccgucaugaauucuucucaa

SEQ ID NO: 2230621 - RNA, 19 nt, Homo sapiens
ugugcuuucagaagugccc

SEQ ID NO: 2230622 - RNA, 18 nt, Homo sapiens
aaugccuauaaaaugccc

SEQ ID NO: 2230623 - RNA, 14 nt, Homo sapiens
guuugcgcuaaaaa

SEQ ID NO: 2230624 - RNA, 18 nt, Homo sapiens
cacugccauggaggcaca

SEQ ID NO: 2230625 - RNA, 22 nt, Homo sapiens
uacugccuuagucccaauuuga

SEQ ID NO: 2230626 - RNA, 16 nt, Homo sapiens
ggaccagcccauuggc

SEQ ID NO: 2230627 - RNA, 15 nt, Homo sapiens
ucuacaucaauauca

SEQ ID NO: 2230628 - RNA, 19 nt, Homo sapiens
caaugacuucccugcucca

SEQ ID NO: 2230629 - RNA, 14 nt, Homo sapiens
cccuaaaccaaaaa

SEQ ID NO: 2230630 - RNA, 19 nt, Homo sapiens
ucuuacaauaauucuauga

SEQ ID NO: 2230631 - RNA, 16 nt, Homo sapiens
aaccuuccaugucucc

SEQ ID NO: 2230632 - RNA, 17 nt, Homo sapiens
ugccguaacaacugugg

SEQ ID NO: 2230633 - RNA, 22 nt, Homo sapiens
caaggguaaucuuggguuucua

SEQ ID NO: 2230634 - RNA, 19 nt, Homo sapiens
accucggccucccacagug

SEQ ID NO: 2230635 - RNA, 13 nt, Homo sapiens
cuggcucugucac

SEQ ID NO: 2230636 - RNA, 16 nt, Homo sapiens
uggaaauacacuguua

SEQ ID NO: 2230637 - RNA, 14 nt, Homo sapiens
uaaaaaggccuuug

SEQ ID NO: 2230638 - RNA, 15 nt, Homo sapiens
cugccugaagucaca

SEQ ID NO: 2230639 - RNA, 17 nt, Homo sapiens
aaauaaacaguuugaca

SEQ ID NO: 2230640 - RNA, 22 nt, Homo sapiens
ugcucaauaaaguacaagagcu

SEQ ID NO: 2230641 - RNA, 21 nt, Homo sapiens
cuuuuaccuagccacuuaaua

SEQ ID NO: 2230642 - RNA, 11 nt, Homo sapiens
agucuuaacaa

SEQ ID NO: 2230643 - RNA, 15 nt, Homo sapiens
uucauuaaaacaaga

SEQ ID NO: 2230644 - RNA, 21 nt, Homo sapiens
ugagcacagauguucccccau

SEQ ID NO: 2230645 - RNA, 19 nt, Homo sapiens
caagguccaguaauagcaa

SEQ ID NO: 2230646 - RNA, 21 nt, Homo sapiens
cuccuguuuuuuucaggcucc

SEQ ID NO: 2230647 - RNA, 16 nt, Homo sapiens
ucagagcaagcacugg

SEQ ID NO: 2230648 - RNA, 15 nt, Homo sapiens
gagcagguagggcuu

SEQ ID NO: 2230649 - RNA, 13 nt, Homo sapiens
agaucggcuuuca

SEQ ID NO: 2230650 - RNA, 20 nt, Homo sapiens
gcucccucuguuagguccau

SEQ ID NO: 2230651 - RNA, 19 nt, Homo sapiens
aaacaagaggacuguguug

SEQ ID NO: 2230652 - RNA, 16 nt, Homo sapiens
uccucucuaucacauc

SEQ ID NO: 2230653 - RNA, 13 nt, Homo sapiens
cauucugccaaag

SEQ ID NO: 2230654 - RNA, 22 nt, Homo sapiens
acauuguuuuguguaacauauu

SEQ ID NO: 2230655 - RNA, 20 nt, Homo sapiens
accgggccuccccuccaugg

SEQ ID NO: 2230656 - RNA, 18 nt, Homo sapiens
ucaguguugagaugggga

SEQ ID NO: 2230657 - RNA, 15 nt, Homo sapiens
ccaaaugcucucucu

SEQ ID NO: 2230658 - RNA, 17 nt, Homo sapiens
cacacugaguuugaaca

SEQ ID NO: 2230659 - RNA, 14 nt, Homo sapiens
aguccuacccugaa

SEQ ID NO: 2230660 - RNA, 22 nt, Homo sapiens
ugcucugagugcuagcuagcca

SEQ ID NO: 2230661 - RNA, 21 nt, Homo sapiens
uguuucuaaaacuaugguucc

SEQ ID NO: 2230662 - RNA, 12 nt, Homo sapiens
uuaauaagcaac

SEQ ID NO: 2230663 - RNA, 12 nt, Homo sapiens
uuucuaagcaua

SEQ ID NO: 2230664 - RNA, 16 nt, Homo sapiens
gcccugcaccugugca

SEQ ID NO: 2230665 - RNA, 18 nt, Homo sapiens
gaaguauuuucuaguucu

SEQ ID NO: 2230666 - RNA, 18 nt, Homo sapiens
ugcugggggcaacuggcc

SEQ ID NO: 2230667 - RNA, 13 nt, Homo sapiens
ucuucgauguacu

SEQ ID NO: 2230668 - RNA, 15 nt, Homo sapiens
aacacaauaaugugu

SEQ ID NO: 2230669 - RNA, 21 nt, Homo sapiens
cuuccauuucguuuagcugaa

SEQ ID NO: 2230670 - RNA, 16 nt, Homo sapiens
aucauuagaaucuuac

SEQ ID NO: 2230671 - RNA, 17 nt, Homo sapiens
gacgaucauugugccca

SEQ ID NO: 2230672 - RNA, 16 nt, Homo sapiens
gcauuuaaaauggacu

SEQ ID NO: 2230673 - RNA, 23 nt, Homo sapiens
gaccuuccugccaccagucacug

SEQ ID NO: 2230674 - RNA, 13 nt, Homo sapiens
auagaacacuuca

SEQ ID NO: 2230675 - RNA, 22 nt, Homo sapiens
cuuuaaacacggggcuugcaac

SEQ ID NO: 2230676 - RNA, 15 nt, Homo sapiens
ccucaacucacuaga

SEQ ID NO: 2230677 - RNA, 17 nt, Homo sapiens
gacuauggcuaccaaaa

SEQ ID NO: 2230678 - RNA, 13 nt, Homo sapiens
uggaauaaaguca

SEQ ID NO: 2230679 - RNA, 15 nt, Homo sapiens
aggacagucagcucu

SEQ ID NO: 2230680 - RNA, 20 nt, Homo sapiens
aguaacucagugaaggccca

SEQ ID NO: 2230681 - RNA, 16 nt, Homo sapiens
auccaguugcaauaaa

SEQ ID NO: 2230682 - RNA, 22 nt, Homo sapiens
cacugccucucccuggcccuca

SEQ ID NO: 2230683 - RNA, 13 nt, Homo sapiens
auucucugagugg

SEQ ID NO: 2230684 - RNA, 22 nt, Homo sapiens
aagaaucuauaguucacugaca

SEQ ID NO: 2230685 - RNA, 15 nt, Homo sapiens
uaaagucugagaaau

SEQ ID NO: 2230686 - RNA, 12 nt, Homo sapiens
aauuuugcugga

SEQ ID NO: 2230687 - RNA, 20 nt, Homo sapiens
uauuaagguuuucaaccgga

SEQ ID NO: 2230688 - RNA, 19 nt, Homo sapiens
aaauguggagaacauucaa

SEQ ID NO: 2230689 - RNA, 23 nt, Homo sapiens
aagggauuugaggugaggguugg

SEQ ID NO: 2230690 - RNA, 17 nt, Homo sapiens
acaugagcgcugaugau

SEQ ID NO: 2230691 - RNA, 18 nt, Homo sapiens
cagggaggcugugcacag

SEQ ID NO: 2230692 - RNA, 17 nt, Homo sapiens
acaaauaaagugcaguu

SEQ ID NO: 2230693 - RNA, 17 nt, Homo sapiens
gaacccagaaauagcca

SEQ ID NO: 2230694 - RNA, 19 nt, Homo sapiens
uguacguggccauguauga

SEQ ID NO: 2230695 - RNA, 15 nt, Homo sapiens
agcccaggucacugu

SEQ ID NO: 2230696 - RNA, 17 nt, Homo sapiens
cacuggggcuggcacaa

SEQ ID NO: 2230697 - RNA, 22 nt, Homo sapiens
cccacauuugugccgacacugu

SEQ ID NO: 2230698 - RNA, 22 nt, Homo sapiens
acgauuuugcacaaauauccac

SEQ ID NO: 2230699 - RNA, 20 nt, Homo sapiens
gaucgugccauugcacucca

SEQ ID NO: 2230700 - RNA, 12 nt, Homo sapiens
ucacuacaggug

SEQ ID NO: 2230701 - RNA, 17 nt, Homo sapiens
aaaagccuuacaguuau

SEQ ID NO: 2230702 - RNA, 14 nt, Homo sapiens
uacauuaacuucag

SEQ ID NO: 2230703 - RNA, 14 nt, Homo sapiens
uuucugaacacaau

SEQ ID NO: 2230704 - RNA, 22 nt, Homo sapiens
agccugguuuuuaaguacucac

SEQ ID NO: 2230705 - RNA, 23 nt, Homo sapiens
gacgguuaaauacuguguggaac

SEQ ID NO: 2230706 - RNA, 13 nt, Homo sapiens
cccaaacuccucu

SEQ ID NO: 2230707 - RNA, 21 nt, Homo sapiens
ucgaagauguauuucaucuca

SEQ ID NO: 2230708 - RNA, 19 nt, Homo sapiens
agugaaagacaagcugcaa

SEQ ID NO: 2230709 - RNA, 20 nt, Homo sapiens
cauuuagacuuauguggaac

SEQ ID NO: 2230710 - RNA, 23 nt, Homo sapiens
uuaaacucugaagccacaaagac

SEQ ID NO: 2230711 - RNA, 15 nt, Homo sapiens
cuuacugugcaccua

SEQ ID NO: 2230712 - RNA, 15 nt, Homo sapiens
agcauuuguguguua

SEQ ID NO: 2230713 - RNA, 23 nt, Homo sapiens
ggagaagucucagcuaagcucac

SEQ ID NO: 2230714 - RNA, 12 nt, Homo sapiens
aauuuuucauag

SEQ ID NO: 2230715 - RNA, 12 nt, Homo sapiens
aagaagaaagca

SEQ ID NO: 2230716 - RNA, 15 nt, Homo sapiens
cuugucauuccagag

SEQ ID NO: 2230717 - RNA, 21 nt, Homo sapiens
uuacuaaacauguauguaaau

SEQ ID NO: 2230718 - RNA, 22 nt, Homo sapiens
accagaggcugcagaaggccaa

SEQ ID NO: 2230719 - RNA, 16 nt, Homo sapiens
gguucuacccaggugc

SEQ ID NO: 2230720 - RNA, 19 nt, Homo sapiens
guaauacaauacaguacuc

SEQ ID NO: 2230721 - RNA, 16 nt, Homo sapiens
ugcuuuagaaguaaca

SEQ ID NO: 2230722 - RNA, 14 nt, Homo sapiens
accuccaacacagu

SEQ ID NO: 2230723 - RNA, 14 nt, Homo sapiens
cacagcaaaccucu

SEQ ID NO: 2230724 - RNA, 21 nt, Homo sapiens
ugugcaagugucugugugcaa

SEQ ID NO: 2230725 - RNA, 14 nt, Homo sapiens
gaaauaauacuuca

SEQ ID NO: 2230726 - RNA, 19 nt, Homo sapiens
auuuuacagaagcauuuua

SEQ ID NO: 2230727 - RNA, 17 nt, Homo sapiens
auguauguacaauacaa

SEQ ID NO: 2230728 - RNA, 15 nt, Homo sapiens
uaaaaaugaauccua

SEQ ID NO: 2230729 - RNA, 20 nt, Homo sapiens
uggcagugugucacacugag

SEQ ID NO: 2230730 - RNA, 15 nt, Homo sapiens
cucuuucccaacccc

SEQ ID NO: 2230731 - RNA, 18 nt, Homo sapiens
ugaauggcuuugucuuga

SEQ ID NO: 2230732 - RNA, 14 nt, Homo sapiens
agugcaucucagcc

SEQ ID NO: 2230733 - RNA, 20 nt, Homo sapiens
cucaggggaaccauggggcu

SEQ ID NO: 2230734 - RNA, 17 nt, Homo sapiens
augugaucagcuuucaa

SEQ ID NO: 2230735 - RNA, 13 nt, Homo sapiens
cagcacuccucau

SEQ ID NO: 2230736 - RNA, 13 nt, Homo sapiens
cuccacuccagau

SEQ ID NO: 2230737 - RNA, 15 nt, Homo sapiens
gcuaguguagcuucu

SEQ ID NO: 2230738 - RNA, 12 nt, Homo sapiens
gugacugugucc

SEQ ID NO: 2230739 - RNA, 15 nt, Homo sapiens
gagaaauagacuuug

SEQ ID NO: 2230740 - RNA, 17 nt, Homo sapiens
gcuggguggcacugcca

SEQ ID NO: 2230741 - RNA, 21 nt, Homo sapiens
ugcaguaggggcuacugugac

SEQ ID NO: 2230742 - RNA, 15 nt, Homo sapiens
caaacugcuucccuu

SEQ ID NO: 2230743 - RNA, 13 nt, Homo sapiens
cucuuauugcaaa

SEQ ID NO: 2230744 - RNA, 23 nt, Homo sapiens
agagcuaagggugggugcucaga

SEQ ID NO: 2230745 - RNA, 16 nt, Homo sapiens
ugcaagugacaucucu

SEQ ID NO: 2230746 - RNA, 11 nt, Homo sapiens
ugacauuuuau

SEQ ID NO: 2230747 - RNA, 20 nt, Homo sapiens
gacucauuaaauauucugua

SEQ ID NO: 2230748 - RNA, 20 nt, Homo sapiens
acuacugcugcaaagugcaa

SEQ ID NO: 2230749 - RNA, 22 nt, Homo sapiens
aaucggcuggggacugcuaccu

SEQ ID NO: 2230750 - RNA, 14 nt, Homo sapiens
ugggacuacaggca

SEQ ID NO: 2230751 - RNA, 20 nt, Homo sapiens
cagcuucaccagagcauuuc

SEQ ID NO: 2230752 - RNA, 23 nt, Homo sapiens
cccuuugagcuacagaacacuuu

SEQ ID NO: 2230753 - RNA, 20 nt, Homo sapiens
ggaugggggagggagggcaa

SEQ ID NO: 2230754 - RNA, 20 nt, Homo sapiens
gguaacucauuuacagucau

SEQ ID NO: 2230755 - RNA, 18 nt, Homo sapiens
cugacaccuuugcaggca

SEQ ID NO: 2230756 - RNA, 16 nt, Homo sapiens
uacuauuugaagcaau

SEQ ID NO: 2230757 - RNA, 17 nt, Homo sapiens
ccagcaaugagaaggcc

SEQ ID NO: 2230758 - RNA, 22 nt, Homo sapiens
gagggauaaccccaggcacugu

SEQ ID NO: 2230759 - RNA, 16 nt, Homo sapiens
guuugcaauuuuucca

SEQ ID NO: 2230760 - RNA, 15 nt, Homo sapiens
gcccgugcacccugg

SEQ ID NO: 2230761 - RNA, 16 nt, Homo sapiens
acagaagguugccagg

SEQ ID NO: 2230762 - RNA, 18 nt, Homo sapiens
ugaagucaccgggaugaa

SEQ ID NO: 2230763 - RNA, 19 nt, Homo sapiens
ggagccugcaauaagggaa

SEQ ID NO: 2230764 - RNA, 20 nt, Homo sapiens
ucuguuuuuuaaaugaucau

SEQ ID NO: 2230765 - RNA, 15 nt, Homo sapiens
ccuggccgaguccaa

SEQ ID NO: 2230766 - RNA, 20 nt, Homo sapiens
uuccagcuagugacccacau

SEQ ID NO: 2230767 - RNA, 15 nt, Homo sapiens
uguauggcacuggca

SEQ ID NO: 2230768 - RNA, 16 nt, Homo sapiens
gcauuaauugugcugu

SEQ ID NO: 2230769 - RNA, 15 nt, Homo sapiens
aaccuggaaccagag

SEQ ID NO: 2230770 - RNA, 15 nt, Homo sapiens
guucccucugccugg

SEQ ID NO: 2230771 - RNA, 22 nt, Homo sapiens
cucaauaaaaguuuccuuucaa

SEQ ID NO: 2230772 - RNA, 21 nt, Homo sapiens
gccuccccaccacugagccau

SEQ ID NO: 2230773 - RNA, 13 nt, Homo sapiens
uuugguuaaucuc

SEQ ID NO: 2230774 - RNA, 10 nt, Homo sapiens
aaaagcuuuu

SEQ ID NO: 2230775 - RNA, 13 nt, Homo sapiens
cuugaacugauuc

SEQ ID NO: 2230776 - RNA, 17 nt, Homo sapiens
ugaugaauaaacacuuu

SEQ ID NO: 2230777 - RNA, 16 nt, Homo sapiens
gaaaauguucauuuua

SEQ ID NO: 2230778 - RNA, 18 nt, Homo sapiens
gagaagagaaugcacaaa

SEQ ID NO: 2230779 - RNA, 22 nt, Homo sapiens
ugcuuuguuuuaauaaacagua

SEQ ID NO: 2230780 - RNA, 21 nt, Homo sapiens
accuauagcaucuucucauuc

SEQ ID NO: 2230781 - RNA, 20 nt, Homo sapiens
aggugccuuguaaacaugaa

SEQ ID NO: 2230782 - RNA, 19 nt, Homo sapiens
ugugaacacaucagcuugc

SEQ ID NO: 2230783 - RNA, 20 nt, Homo sapiens
ugcagaaacuuggaugucac

SEQ ID NO: 2230784 - RNA, 23 nt, Homo sapiens
acaagccuccuguaccucagugg

SEQ ID NO: 2230785 - RNA, 21 nt, Homo sapiens
cuuucuguggagagugagaau

SEQ ID NO: 2230786 - RNA, 14 nt, Homo sapiens
gccugugaugcugg

SEQ ID NO: 2230787 - RNA, 22 nt, Homo sapiens
uauaacccuaggaauuuagaca

SEQ ID NO: 2230788 - RNA, 18 nt, Homo sapiens
aucagauggugucauuua

SEQ ID NO: 2230789 - RNA, 15 nt, Homo sapiens
uuuauucaguaaaca

SEQ ID NO: 2230790 - RNA, 23 nt, Homo sapiens
acucuuugcccaguucaucccaa

SEQ ID NO: 2230791 - RNA, 22 nt, Homo sapiens
cuauaugccgcuacaaaaaggu

SEQ ID NO: 2230792 - RNA, 13 nt, Homo sapiens
aauucucugugga

SEQ ID NO: 2230793 - RNA, 12 nt, Homo sapiens
auguauacacac

SEQ ID NO: 2230794 - RNA, 23 nt, Homo sapiens
ucccaaaucaauaagaagguaga

SEQ ID NO: 2230795 - RNA, 13 nt, Homo sapiens
ggucaaaauuugc

SEQ ID NO: 2230796 - RNA, 23 nt, Homo sapiens
gagucugaauagucuucagagau

SEQ ID NO: 2230797 - RNA, 16 nt, Homo sapiens
cagguggagggcacag

SEQ ID NO: 2230798 - RNA, 14 nt, Homo sapiens
ggaaacgaagcacc

SEQ ID NO: 2230799 - RNA, 20 nt, Homo sapiens
ccgaagaaugaagucuuucc

SEQ ID NO: 2230800 - RNA, 11 nt, Homo sapiens
uuuaugcacau

SEQ ID NO: 2230801 - RNA, 11 nt, Homo sapiens
uauaugcacuu

SEQ ID NO: 2230802 - RNA, 11 nt, Homo sapiens
cauaugcauuu

SEQ ID NO: 2230803 - RNA, 20 nt, Homo sapiens
uggcgggcccuggagcucaa

SEQ ID NO: 2230804 - RNA, 17 nt, Homo sapiens
uggugggugccuguaau

SEQ ID NO: 2230805 - RNA, 15 nt, Homo sapiens
uauaaauauauacag

SEQ ID NO: 2230806 - RNA, 20 nt, Homo sapiens
cccugagcacuccuggugca

SEQ ID NO: 2230807 - RNA, 22 nt, Homo sapiens
cugaaaggguuuuuaaucucca

SEQ ID NO: 2230808 - RNA, 15 nt, Homo sapiens
ugaauuuuugcacau

SEQ ID NO: 2230809 - RNA, 16 nt, Homo sapiens
agauacuggaaaccua

SEQ ID NO: 2230810 - RNA, 14 nt, Homo sapiens
aucuaugauuccag

SEQ ID NO: 2230811 - RNA, 20 nt, Homo sapiens
guuccccacugacagccucc

SEQ ID NO: 2230812 - RNA, 13 nt, Homo sapiens
aguggagaggaaa

SEQ ID NO: 2230813 - RNA, 21 nt, Homo sapiens
cuugaacacaguauuuuccca

SEQ ID NO: 2230814 - RNA, 17 nt, Homo sapiens
aaccacagaaagcacuc

SEQ ID NO: 2230815 - RNA, 23 nt, Homo sapiens
ucauauugguauucacuaaucug

SEQ ID NO: 2230816 - RNA, 21 nt, Homo sapiens
cugguaaaaagauccagggau

SEQ ID NO: 2230817 - RNA, 20 nt, Homo sapiens
uuugcuuuaaagagcuuuua

SEQ ID NO: 2230818 - RNA, 17 nt, Homo sapiens
cagcuccugacacugcu

SEQ ID NO: 2230819 - RNA, 19 nt, Homo sapiens
cacagugguucguuuacca

SEQ ID NO: 2230820 - RNA, 23 nt, Homo sapiens
gaaagccuuuccucggucucccu

SEQ ID NO: 2230821 - RNA, 22 nt, Homo sapiens
cccauguuuauuaagaaucauu

SEQ ID NO: 2230822 - RNA, 21 nt, Homo sapiens
aauuuauaucagguguauaaa

SEQ ID NO: 2230823 - RNA, 13 nt, Homo sapiens
ccuaacaaaagaa

SEQ ID NO: 2230824 - RNA, 14 nt, Homo sapiens
ccccucucuuguca

SEQ ID NO: 2230825 - RNA, 16 nt, Homo sapiens
cagaccccaugccuua

SEQ ID NO: 2230826 - RNA, 17 nt, Homo sapiens
uaauguagcguguuuac

SEQ ID NO: 2230827 - RNA, 18 nt, Homo sapiens
cuaucuuugccacccuca

SEQ ID NO: 2230828 - RNA, 23 nt, Homo sapiens
augcuggaguauuuucuaauaau

SEQ ID NO: 2230829 - RNA, 23 nt, Homo sapiens
uuaguggggacccaaagauucua

SEQ ID NO: 2230830 - RNA, 21 nt, Homo sapiens
accucuuuauuuuuugauuga

SEQ ID NO: 2230831 - RNA, 19 nt, Homo sapiens
uuuaauuucuucaugugau

SEQ ID NO: 2230832 - RNA, 16 nt, Homo sapiens
ugaaacauguucucaa

SEQ ID NO: 2230833 - RNA, 19 nt, Homo sapiens
acacgcgugugcuccucuc

SEQ ID NO: 2230834 - RNA, 17 nt, Homo sapiens
ggaaaaaucauaaccac

SEQ ID NO: 2230835 - RNA, 16 nt, Homo sapiens
cagcaaaagugcagua

SEQ ID NO: 2230836 - RNA, 23 nt, Homo sapiens
uucucugccacagggacuugccu

SEQ ID NO: 2230837 - RNA, 22 nt, Homo sapiens
aaaagcgaaacacacaaaccag

SEQ ID NO: 2230838 - RNA, 18 nt, Homo sapiens
auuaauucauccaauacc

SEQ ID NO: 2230839 - RNA, 23 nt, Homo sapiens
auauuaaggcuuacuaguaucac

SEQ ID NO: 2230840 - RNA, 15 nt, Homo sapiens
acuaacccaaugccu

SEQ ID NO: 2230841 - RNA, 14 nt, Homo sapiens
acuuccuacuguag

SEQ ID NO: 2230842 - RNA, 23 nt, Homo sapiens
auaauacauuaagccucuugucu

SEQ ID NO: 2230843 - RNA, 21 nt, Homo sapiens
acccaauggaaaauauaauga

SEQ ID NO: 2230844 - RNA, 17 nt, Homo sapiens
uauugcaaggugugaug

SEQ ID NO: 2230845 - RNA, 19 nt, Homo sapiens
cauaugaacagcuguucag

SEQ ID NO: 2230846 - RNA, 23 nt, Homo sapiens
ggaaauagcccuguaacaggcuu

SEQ ID NO: 2230847 - RNA, 14 nt, Homo sapiens
gagaacaugcauac

SEQ ID NO: 2230848 - RNA, 14 nt, Homo sapiens
uagaaaauucauaa

SEQ ID NO: 2230849 - RNA, 22 nt, Homo sapiens
uauggaucuguugggaaccaga

SEQ ID NO: 2230850 - RNA, 15 nt, Homo sapiens
aaauuucucuacugu

SEQ ID NO: 2230851 - RNA, 13 nt, Homo sapiens
uuggcuucccuga

SEQ ID NO: 2230852 - RNA, 23 nt, Homo sapiens
caugcauguucuccucuaucuua

SEQ ID NO: 2230853 - RNA, 15 nt, Homo sapiens
gaacuggacccuguu

SEQ ID NO: 2230854 - RNA, 11 nt, Homo sapiens
cugcaccugcg

SEQ ID NO: 2230855 - RNA, 18 nt, Homo sapiens
gcaacuuguuaaauauau

SEQ ID NO: 2230856 - RNA, 23 nt, Homo sapiens
ucagauguucccgugugccucuu

SEQ ID NO: 2230857 - RNA, 16 nt, Homo sapiens
guuuacaggaacccag

SEQ ID NO: 2230858 - RNA, 13 nt, Homo sapiens
acagugccugcau

SEQ ID NO: 2230859 - RNA, 17 nt, Homo sapiens
acucagagcucucucua

SEQ ID NO: 2230860 - RNA, 18 nt, Homo sapiens
ucaaccagagucacccag

SEQ ID NO: 2230861 - RNA, 16 nt, Homo sapiens
caggaaagacuggccc

SEQ ID NO: 2230862 - RNA, 14 nt, Homo sapiens
uaucuaccaucuaa

SEQ ID NO: 2230863 - RNA, 13 nt, Homo sapiens
ucuguguaaccuc

SEQ ID NO: 2230864 - RNA, 14 nt, Homo sapiens
ggcugaagugcaug

SEQ ID NO: 2230865 - RNA, 19 nt, Homo sapiens
uggcucugccccucagggg

SEQ ID NO: 2230866 - RNA, 10 nt, Homo sapiens
gcgcugcuaa

SEQ ID NO: 2230867 - RNA, 13 nt, Homo sapiens
ugaaccucucagg

SEQ ID NO: 2230868 - RNA, 14 nt, Homo sapiens
ggagcuggugagau

SEQ ID NO: 2230869 - RNA, 15 nt, Homo sapiens
ccaauaaaaguguca

SEQ ID NO: 2230870 - RNA, 19 nt, Homo sapiens
gcucuguucuggaucugcc

SEQ ID NO: 2230871 - RNA, 19 nt, Homo sapiens
ucgcuguugucacaucuca

SEQ ID NO: 2230872 - RNA, 20 nt, Homo sapiens
aaguaauguaaaauccaucc

SEQ ID NO: 2230873 - RNA, 13 nt, Homo sapiens
acaacuaccuccu

SEQ ID NO: 2230874 - RNA, 17 nt, Homo sapiens
auagaacugaaugagaa

SEQ ID NO: 2230875 - RNA, 23 nt, Homo sapiens
cagcaucuuugcccuucugguuu

SEQ ID NO: 2230876 - RNA, 20 nt, Homo sapiens
ugaaacauguucaucuggaa

SEQ ID NO: 2230877 - RNA, 15 nt, Homo sapiens
agaauagauggaaga

SEQ ID NO: 2230878 - RNA, 18 nt, Homo sapiens
guuccacauauauuucca

SEQ ID NO: 2230879 - RNA, 22 nt, Homo sapiens
gccaccccacugagagcugcuc

SEQ ID NO: 2230880 - RNA, 15 nt, Homo sapiens
ugcucauuguggcca

SEQ ID NO: 2230881 - RNA, 17 nt, Homo sapiens
gggcugagccaaagcca

SEQ ID NO: 2230882 - RNA, 16 nt, Homo sapiens
uggcuuugugcuuguu

SEQ ID NO: 2230883 - RNA, 17 nt, Homo sapiens
agagggcuuucucagga

SEQ ID NO: 2230884 - RNA, 13 nt, Homo sapiens
ugguaguggcaaa

SEQ ID NO: 2230885 - RNA, 19 nt, Homo sapiens
uugauuauaguuaauccuu

SEQ ID NO: 2230886 - RNA, 11 nt, Homo sapiens
auccugcauuu

SEQ ID NO: 2230887 - RNA, 22 nt, Homo sapiens
uuaaaauauuuaucugauuaag

SEQ ID NO: 2230888 - RNA, 16 nt, Homo sapiens
gccuucuccacaggga

SEQ ID NO: 2230889 - RNA, 17 nt, Homo sapiens
cugcagugucugugauu

SEQ ID NO: 2230890 - RNA, 23 nt, Homo sapiens
agagucuauuuacggaacucaaa

SEQ ID NO: 2230891 - RNA, 17 nt, Homo sapiens
ccuuguccaaaccuggg

SEQ ID NO: 2230892 - RNA, 17 nt, Homo sapiens
gaucucaguauugucag

SEQ ID NO: 2230893 - RNA, 23 nt, Homo sapiens
aaucuggagagcuagaaccugga

SEQ ID NO: 2230894 - RNA, 22 nt, Homo sapiens
aauacuagcuaacuaauucugu

SEQ ID NO: 2230895 - RNA, 23 nt, Homo sapiens
aaauaaggacaagccuaacuuca

SEQ ID NO: 2230896 - RNA, 15 nt, Homo sapiens
caaggacacagauga

SEQ ID NO: 2230897 - RNA, 21 nt, Homo sapiens
acuguucccaauauguagccu

SEQ ID NO: 2230898 - RNA, 16 nt, Homo sapiens
uuaauaaaaguacuga

SEQ ID NO: 2230899 - RNA, 14 nt, Homo sapiens
ccaauaaaacuuua

SEQ ID NO: 2230900 - RNA, 19 nt, Homo sapiens
aaaagaauugugccucucc

SEQ ID NO: 2230901 - RNA, 18 nt, Homo sapiens
auucuguuccacacccaa

SEQ ID NO: 2230902 - RNA, 23 nt, Homo sapiens
ugcugcacagaaauuuucaauuu

SEQ ID NO: 2230903 - RNA, 15 nt, Homo sapiens
gcccugagccacuga

SEQ ID NO: 2230904 - RNA, 15 nt, Homo sapiens
ggcacuacaugaaau

SEQ ID NO: 2230905 - RNA, 21 nt, Homo sapiens
ugauucacaaugaaaugcucu

SEQ ID NO: 2230906 - RNA, 20 nt, Homo sapiens
uagcuaagcaagccaggaga

SEQ ID NO: 2230907 - RNA, 11 nt, Homo sapiens
aaaaagagcca

SEQ ID NO: 2230908 - RNA, 22 nt, Homo sapiens
aacuaucugcauuaucuaugca

SEQ ID NO: 2230909 - RNA, 18 nt, Homo sapiens
ugacuguauacagaauga

SEQ ID NO: 2230910 - RNA, 21 nt, Homo sapiens
uagccaaggauagaagcugca

SEQ ID NO: 2230911 - RNA, 19 nt, Homo sapiens
ggcaguucgaccagccagg

SEQ ID NO: 2230912 - RNA, 18 nt, Homo sapiens
ccucuuaacgcagcacuu

SEQ ID NO: 2230913 - RNA, 20 nt, Homo sapiens
ccaaguugcugcaaaauaca

SEQ ID NO: 2230914 - RNA, 22 nt, Homo sapiens
guuccaguuugaagaccaauca

SEQ ID NO: 2230915 - RNA, 16 nt, Homo sapiens
uacuccaguaacugcu

SEQ ID NO: 2230916 - RNA, 21 nt, Homo sapiens
acacacuuuggucauuucuca

SEQ ID NO: 2230917 - RNA, 17 nt, Homo sapiens
ugaaaauaaaaagagaa

SEQ ID NO: 2230918 - RNA, 12 nt, Homo sapiens
uccugacuguuc

SEQ ID NO: 2230919 - RNA, 17 nt, Homo sapiens
ccucugcuaccaucuca

SEQ ID NO: 2230920 - RNA, 16 nt, Homo sapiens
cagccauggcuggaug

SEQ ID NO: 2230921 - RNA, 14 nt, Homo sapiens
accaaccacugcga

SEQ ID NO: 2230922 - RNA, 12 nt, Homo sapiens
ugcaccuaccca

SEQ ID NO: 2230923 - RNA, 19 nt, Homo sapiens
auggaugcacgcacaugcc

SEQ ID NO: 2230924 - RNA, 17 nt, Homo sapiens
uauuuauuacuuccuca

SEQ ID NO: 2230925 - RNA, 17 nt, Homo sapiens
aacuauuguauaauggg

SEQ ID NO: 2230926 - RNA, 16 nt, Homo sapiens
aggaauuugcauuuag

SEQ ID NO: 2230927 - RNA, 19 nt, Homo sapiens
uuuuuaacuuaaaaaguag

SEQ ID NO: 2230928 - RNA, 13 nt, Homo sapiens
uucauaaaaacca

SEQ ID NO: 2230929 - RNA, 15 nt, Homo sapiens
uauagagagcccaaa

SEQ ID NO: 2230930 - RNA, 17 nt, Homo sapiens
uguaacgaaacacuuca

SEQ ID NO: 2230931 - RNA, 18 nt, Homo sapiens
ugcccugggccaaaacca

SEQ ID NO: 2230932 - RNA, 16 nt, Homo sapiens
ugaggaauauuucaag

SEQ ID NO: 2230933 - RNA, 13 nt, Homo sapiens
acugcaucuuagu

SEQ ID NO: 2230934 - RNA, 21 nt, Homo sapiens
ucggagucuguaaaaccagca

SEQ ID NO: 2230935 - RNA, 15 nt, Homo sapiens
gcaucugaccaucug

SEQ ID NO: 2230936 - RNA, 15 nt, Homo sapiens
gaaaacaacaaaaca

SEQ ID NO: 2230937 - RNA, 18 nt, Homo sapiens
cugaaccaucccugaugu

SEQ ID NO: 2230938 - RNA, 19 nt, Homo sapiens
aggcccagggaggugaccc

SEQ ID NO: 2230939 - RNA, 23 nt, Homo sapiens
accuucauguggcucagugccuu

SEQ ID NO: 2230940 - RNA, 22 nt, Homo sapiens
uccacgcccgggagugggguag

SEQ ID NO: 2230941 - RNA, 14 nt, Homo sapiens
uuccugcccuugaa

SEQ ID NO: 2230942 - RNA, 17 nt, Homo sapiens
ucuaacauaccuuguca

SEQ ID NO: 2230943 - RNA, 19 nt, Homo sapiens
gacaggacagcauggugca

SEQ ID NO: 2230944 - RNA, 20 nt, Homo sapiens
auuuuaguuaaacucugaca

SEQ ID NO: 2230945 - RNA, 15 nt, Homo sapiens
caauaucaugugauu

SEQ ID NO: 2230946 - RNA, 21 nt, Homo sapiens
gaccguuaugaggaaauaucc

SEQ ID NO: 2230947 - RNA, 21 nt, Homo sapiens
uacauguauuaaauuacauuu

SEQ ID NO: 2230948 - RNA, 16 nt, Homo sapiens
aguaaaaucaaaugug

SEQ ID NO: 2230949 - RNA, 23 nt, Homo sapiens
cagacaacuucuguuucuucucu

SEQ ID NO: 2230950 - RNA, 17 nt, Homo sapiens
cuuugcugcagaacuga

SEQ ID NO: 2230951 - RNA, 20 nt, Homo sapiens
aagaagaguuggagugagau

SEQ ID NO: 2230952 - RNA, 20 nt, Homo sapiens
cggagaaacgggugagcuga

SEQ ID NO: 2230953 - RNA, 19 nt, Homo sapiens
uauuuaauagguuuggaca

SEQ ID NO: 2230954 - RNA, 14 nt, Homo sapiens
ggugugugagagag

SEQ ID NO: 2230955 - RNA, 21 nt, Homo sapiens
cguggcaaaaugaacacaucu

SEQ ID NO: 2230956 - RNA, 15 nt, Homo sapiens
gcuggcccagccaaa

SEQ ID NO: 2230957 - RNA, 21 nt, Homo sapiens
uggcuccggccucugccuuug

SEQ ID NO: 2230958 - RNA, 21 nt, Homo sapiens
gagcauugagacggugcucgc

SEQ ID NO: 2230959 - RNA, 13 nt, Homo sapiens
uaagcuuuguaau

SEQ ID NO: 2230960 - RNA, 17 nt, Homo sapiens
ugaaugcuuaauucaau

SEQ ID NO: 2230961 - RNA, 16 nt, Homo sapiens
ucaaaagauggcuuau

SEQ ID NO: 2230962 - RNA, 16 nt, Homo sapiens
agggcagaguagccag

SEQ ID NO: 2230963 - RNA, 11 nt, Homo sapiens
aaugacuguau

SEQ ID NO: 2230964 - RNA, 15 nt, Homo sapiens
cccagcauccagcug

SEQ ID NO: 2230965 - RNA, 15 nt, Homo sapiens
uauuaacaugaugua

SEQ ID NO: 2230966 - RNA, 22 nt, Homo sapiens
aagaaaaguagguuuacauuca

SEQ ID NO: 2230967 - RNA, 20 nt, Homo sapiens
caguuacagagaauuucuaa

SEQ ID NO: 2230968 - RNA, 18 nt, Homo sapiens
uaccuuuauagcucucau

SEQ ID NO: 2230969 - RNA, 21 nt, Homo sapiens
gccaaccuguaauaaauauga

SEQ ID NO: 2230970 - RNA, 16 nt, Homo sapiens
aacuccucaauuccaa

SEQ ID NO: 2230971 - RNA, 18 nt, Homo sapiens
ugacauuagcauuguggu

SEQ ID NO: 2230972 - RNA, 12 nt, Homo sapiens
accagagcaguu

SEQ ID NO: 2230973 - RNA, 22 nt, Homo sapiens
uuuccaacuggcacucuguggg

SEQ ID NO: 2230974 - RNA, 15 nt, Homo sapiens
uuccccaaccaaaga

SEQ ID NO: 2230975 - RNA, 18 nt, Homo sapiens
guggagugcaguggugcg

SEQ ID NO: 2230976 - RNA, 17 nt, Homo sapiens
cucaaccuacaguggag

SEQ ID NO: 2230977 - RNA, 19 nt, Homo sapiens
ccaucaugaagaagcucuu

SEQ ID NO: 2230978 - RNA, 21 nt, Homo sapiens
uucucuauucuuuccaugaca

SEQ ID NO: 2230979 - RNA, 15 nt, Homo sapiens
gaaaaugucuuucuc

SEQ ID NO: 2230980 - RNA, 20 nt, Homo sapiens
ccaaaacauauucaaagcag

SEQ ID NO: 2230981 - RNA, 17 nt, Homo sapiens
uuaaaguuggagacagc

SEQ ID NO: 2230982 - RNA, 22 nt, Homo sapiens
ccucugcuggccgggcacagcu

SEQ ID NO: 2230983 - RNA, 19 nt, Homo sapiens
caaaaugaugcaaccaaaa

SEQ ID NO: 2230984 - RNA, 20 nt, Homo sapiens
uucagaugcuguuaguaccu

SEQ ID NO: 2230985 - RNA, 21 nt, Homo sapiens
agugagaaauggcagucugcc

SEQ ID NO: 2230986 - RNA, 18 nt, Homo sapiens
acauacugcauuucacuc

SEQ ID NO: 2230987 - RNA, 21 nt, Homo sapiens
aguuuccacuaucccaaucaa

SEQ ID NO: 2230988 - RNA, 18 nt, Homo sapiens
cuugccugccacugugug

SEQ ID NO: 2230989 - RNA, 17 nt, Homo sapiens
cuucugccuaagccucu

SEQ ID NO: 2230990 - RNA, 21 nt, Homo sapiens
cugcguccucaugguacugua

SEQ ID NO: 2230991 - RNA, 18 nt, Homo sapiens
uaaugccaauaugacaca

SEQ ID NO: 2230992 - RNA, 23 nt, Homo sapiens
gcaaaauaaagaauaugccguuu

SEQ ID NO: 2230993 - RNA, 19 nt, Homo sapiens
aacuucuugucagacauaa

SEQ ID NO: 2230994 - RNA, 14 nt, Homo sapiens
aaugaaucuucaca

SEQ ID NO: 2230995 - RNA, 18 nt, Homo sapiens
gcacugugaagacccagc

SEQ ID NO: 2230996 - RNA, 17 nt, Homo sapiens
uggccccucaccugggc

SEQ ID NO: 2230997 - RNA, 17 nt, Homo sapiens
aagaguguguccacuga

SEQ ID NO: 2230998 - RNA, 16 nt, Homo sapiens
acuuuaaaaggauuaa

SEQ ID NO: 2230999 - RNA, 14 nt, Homo sapiens
uugaugguuauuag

SEQ ID NO: 2231000 - RNA, 14 nt, Homo sapiens
cucaucacccaguc

SEQ ID NO: 2231001 - RNA, 22 nt, Homo sapiens
agcauguggaugacacaauccc

SEQ ID NO: 2231002 - RNA, 15 nt, Homo sapiens
uaauuuaaguacuug

SEQ ID NO: 2231003 - RNA, 15 nt, Homo sapiens
agggagggcuguggu

SEQ ID NO: 2231004 - RNA, 15 nt, Homo sapiens
cucacacugcugucc

SEQ ID NO: 2231005 - RNA, 12 nt, Homo sapiens
agugagccauga

SEQ ID NO: 2231006 - RNA, 13 nt, Homo sapiens
ccugugacuaugg

SEQ ID NO: 2231007 - RNA, 21 nt, Homo sapiens
cucccucgaacccacacugca

SEQ ID NO: 2231008 - RNA, 18 nt, Homo sapiens
augaguuuauauggaaaa

SEQ ID NO: 2231009 - RNA, 13 nt, Homo sapiens
ccagugacuuuca

SEQ ID NO: 2231010 - RNA, 21 nt, Homo sapiens
uuugcaauggcuauauggcaa

SEQ ID NO: 2231011 - RNA, 17 nt, Homo sapiens
caaguaaguuauagaag

SEQ ID NO: 2231012 - RNA, 18 nt, Homo sapiens
aauaaacgcagcgacgug

SEQ ID NO: 2231013 - RNA, 17 nt, Homo sapiens
gggcuccuccagggugu

SEQ ID NO: 2231014 - RNA, 14 nt, Homo sapiens
uauaugcaaagaaa

SEQ ID NO: 2231015 - RNA, 15 nt, Homo sapiens
cagcauuugaugaua

SEQ ID NO: 2231016 - RNA, 20 nt, Homo sapiens
gccacugagcuggcugacua

SEQ ID NO: 2231017 - RNA, 12 nt, Homo sapiens
cucccauuuccc

SEQ ID NO: 2231018 - RNA, 13 nt, Homo sapiens
gacaaugacugug

SEQ ID NO: 2231019 - RNA, 21 nt, Homo sapiens
auacauuuggcuccacuguaa

SEQ ID NO: 2231020 - RNA, 21 nt, Homo sapiens
augaaauucaagccuaaagac

SEQ ID NO: 2231021 - RNA, 15 nt, Homo sapiens
ucucaaggcaguuaa

SEQ ID NO: 2231022 - RNA, 19 nt, Homo sapiens
gaauauuuccuaguucauu

SEQ ID NO: 2231023 - RNA, 21 nt, Homo sapiens
cacccaaagccugucccagga

SEQ ID NO: 2231024 - RNA, 14 nt, Homo sapiens
gcuccugcacaaau

SEQ ID NO: 2231025 - RNA, 19 nt, Homo sapiens
uguauuuuauauaggcauu

SEQ ID NO: 2231026 - RNA, 18 nt, Homo sapiens
aucaguauuuaauaucug

SEQ ID NO: 2231027 - RNA, 15 nt, Homo sapiens
aaaugaacuacugcu

SEQ ID NO: 2231028 - RNA, 15 nt, Homo sapiens
uucuucauccauaga

SEQ ID NO: 2231029 - RNA, 15 nt, Homo sapiens
uuuaaugccaagauu

SEQ ID NO: 2231030 - RNA, 12 nt, Homo sapiens
aggagcugcuaa

SEQ ID NO: 2231031 - RNA, 13 nt, Homo sapiens
aacugcaagccca

SEQ ID NO: 2231032 - RNA, 19 nt, Homo sapiens
gagagccucuaugugcaag

SEQ ID NO: 2231033 - RNA, 14 nt, Homo sapiens
uagcgauauuuauc

SEQ ID NO: 2231034 - RNA, 16 nt, Homo sapiens
agcccuguguguguca

SEQ ID NO: 2231035 - RNA, 18 nt, Homo sapiens
uaugugacuugcaauaaa

SEQ ID NO: 2231036 - RNA, 15 nt, Homo sapiens
ccuugagcuguccua

SEQ ID NO: 2231037 - RNA, 13 nt, Homo sapiens
cuugucugugauc

SEQ ID NO: 2231038 - RNA, 13 nt, Homo sapiens
cggaaguuuucaa

SEQ ID NO: 2231039 - RNA, 14 nt, Homo sapiens
gguuaauccagcuu

SEQ ID NO: 2231040 - RNA, 12 nt, Homo sapiens
uauauagccaau

SEQ ID NO: 2231041 - RNA, 15 nt, Homo sapiens
aggaagagaaaugca

SEQ ID NO: 2231042 - RNA, 17 nt, Homo sapiens
ccguaacaacugugguc

SEQ ID NO: 2231043 - RNA, 15 nt, Homo sapiens
ggaccaguggugccu

SEQ ID NO: 2231044 - RNA, 20 nt, Homo sapiens
cuauaaauagaugcugugua

SEQ ID NO: 2231045 - RNA, 16 nt, Homo sapiens
uaucugagaguuccag

SEQ ID NO: 2231046 - RNA, 13 nt, Homo sapiens
cagucuuucuuga

SEQ ID NO: 2231047 - RNA, 15 nt, Homo sapiens
gaacucuuucauccc

SEQ ID NO: 2231048 - RNA, 18 nt, Homo sapiens
cugcugcuccagugcagg

SEQ ID NO: 2231049 - RNA, 15 nt, Homo sapiens
aggauuauuugcuca

SEQ ID NO: 2231050 - RNA, 17 nt, Homo sapiens
guugauuagacuuuuga

SEQ ID NO: 2231051 - RNA, 19 nt, Homo sapiens
ugucauggugaugcaaguc

SEQ ID NO: 2231052 - RNA, 21 nt, Homo sapiens
augaaaauaacugaaccaaau

SEQ ID NO: 2231053 - RNA, 22 nt, Homo sapiens
gcuaggacuuaaccuugaaaug

SEQ ID NO: 2231054 - RNA, 20 nt, Homo sapiens
gcugauugucaacacaaacu

SEQ ID NO: 2231055 - RNA, 15 nt, Homo sapiens
aaauuguugugcuua

SEQ ID NO: 2231056 - RNA, 22 nt, Homo sapiens
caauaaucaacugaauugcaaa

SEQ ID NO: 2231057 - RNA, 14 nt, Homo sapiens
acuuuuauuaaaga

SEQ ID NO: 2231058 - RNA, 20 nt, Homo sapiens
cuauguucaaagacugugaa

SEQ ID NO: 2231059 - RNA, 15 nt, Homo sapiens
aaaaggcauauugcu

SEQ ID NO: 2231060 - RNA, 19 nt, Homo sapiens
auguuuaccucacuggugc

SEQ ID NO: 2231061 - RNA, 14 nt, Homo sapiens
cugaagacauucaa

SEQ ID NO: 2231062 - RNA, 23 nt, Homo sapiens
acugguucccaagagcuauucau

SEQ ID NO: 2231063 - RNA, 21 nt, Homo sapiens
ccaagcaaaaacaaaugggaa

SEQ ID NO: 2231064 - RNA, 17 nt, Homo sapiens
guaauuugggaacauaa

SEQ ID NO: 2231065 - RNA, 15 nt, Homo sapiens
gauugugagugccuu

SEQ ID NO: 2231066 - RNA, 22 nt, Homo sapiens
gccuucuccacagggacacagu

SEQ ID NO: 2231067 - RNA, 12 nt, Homo sapiens
caggugagccaa

SEQ ID NO: 2231068 - RNA, 16 nt, Homo sapiens
agccauugagcucucc

SEQ ID NO: 2231069 - RNA, 20 nt, Homo sapiens
cuacuaaguucacauuagaa

SEQ ID NO: 2231070 - RNA, 21 nt, Homo sapiens
cccccauuaaccagggcacca

SEQ ID NO: 2231071 - RNA, 17 nt, Homo sapiens
gagaugcggccaagaua

SEQ ID NO: 2231072 - RNA, 14 nt, Homo sapiens
augguuacauauca

SEQ ID NO: 2231073 - RNA, 22 nt, Homo sapiens
cacugauucccucucccaccca

SEQ ID NO: 2231074 - RNA, 14 nt, Homo sapiens
gccuuagcauguga

SEQ ID NO: 2231075 - RNA, 15 nt, Homo sapiens
auccuccaguaccuu

SEQ ID NO: 2231076 - RNA, 13 nt, Homo sapiens
cuauaacauucug

SEQ ID NO: 2231077 - RNA, 14 nt, Homo sapiens
cgaagacuauuuag

SEQ ID NO: 2231078 - RNA, 14 nt, Homo sapiens
aauaaacuuucuca

SEQ ID NO: 2231079 - RNA, 15 nt, Homo sapiens
ccccgaaugucacug

SEQ ID NO: 2231080 - RNA, 17 nt, Homo sapiens
uucuccucguccaucag

SEQ ID NO: 2231081 - RNA, 22 nt, Homo sapiens
cccaucgucucggccuucacaa

SEQ ID NO: 2231082 - RNA, 23 nt, Homo sapiens
cacgaugauaucuauauauguau

SEQ ID NO: 2231083 - RNA, 21 nt, Homo sapiens
gccuuaaauaaaacugcauug

SEQ ID NO: 2231084 - RNA, 23 nt, Homo sapiens
ccaaccuuguuugaagcuguuau

SEQ ID NO: 2231085 - RNA, 16 nt, Homo sapiens
aagaagcuuuaauauu

SEQ ID NO: 2231086 - RNA, 14 nt, Homo sapiens
caccuucauucucc

SEQ ID NO: 2231087 - RNA, 14 nt, Homo sapiens
cacugucacuuugc

SEQ ID NO: 2231088 - RNA, 14 nt, Homo sapiens
uccuaugugcugua

SEQ ID NO: 2231089 - RNA, 20 nt, Homo sapiens
cuuugauccuucugagcucc

SEQ ID NO: 2231090 - RNA, 21 nt, Homo sapiens
cacagggguucccuucucuca

SEQ ID NO: 2231091 - RNA, 21 nt, Homo sapiens
gaggacauugaaagugaaaua

SEQ ID NO: 2231092 - RNA, 17 nt, Homo sapiens
auacaaacaagcacaga

SEQ ID NO: 2231093 - RNA, 21 nt, Homo sapiens
agucauuugcugagcauguac

SEQ ID NO: 2231094 - RNA, 21 nt, Homo sapiens
uaauaaaucuaggaugugaug

SEQ ID NO: 2231095 - RNA, 13 nt, Homo sapiens
auuaaauucacau

SEQ ID NO: 2231096 - RNA, 12 nt, Homo sapiens
accuucauccau

SEQ ID NO: 2231097 - RNA, 15 nt, Homo sapiens
accucagucucaccu

SEQ ID NO: 2231098 - RNA, 14 nt, Homo sapiens
ggcguguccaggag

SEQ ID NO: 2231099 - RNA, 14 nt, Homo sapiens
aaaggggcacuggu

SEQ ID NO: 2231100 - RNA, 18 nt, Homo sapiens
gguugagggaugcuggaa

SEQ ID NO: 2231101 - RNA, 19 nt, Homo sapiens
acugaagcuuaaccgaaga

SEQ ID NO: 2231102 - RNA, 15 nt, Homo sapiens
cucuggacaguugug

SEQ ID NO: 2231103 - RNA, 19 nt, Homo sapiens
uuuccacucccacugccag

SEQ ID NO: 2231104 - RNA, 15 nt, Homo sapiens
aaugucuuuuucaca

SEQ ID NO: 2231105 - RNA, 23 nt, Homo sapiens
cccagagauaagggugucuuccu

SEQ ID NO: 2231106 - RNA, 21 nt, Homo sapiens
cacgaucucagcucacugcaa

SEQ ID NO: 2231107 - RNA, 21 nt, Homo sapiens
ucccaggccaggcuuuguugc

SEQ ID NO: 2231108 - RNA, 19 nt, Homo sapiens
uucugcagaacuccuccaa

SEQ ID NO: 2231109 - RNA, 18 nt, Homo sapiens
ugacaccggggggcuccc

SEQ ID NO: 2231110 - RNA, 13 nt, Homo sapiens
aggagaacucuuu

SEQ ID NO: 2231111 - RNA, 19 nt, Homo sapiens
uccuuaggagaugucauga

SEQ ID NO: 2231112 - RNA, 22 nt, Homo sapiens
ugcccucuccuuccuuacccaa

SEQ ID NO: 2231113 - RNA, 20 nt, Homo sapiens
gugaaccacuucauucugca

SEQ ID NO: 2231114 - RNA, 14 nt, Homo sapiens
cuggagaccuccag

SEQ ID NO: 2231115 - RNA, 18 nt, Homo sapiens
aauucugguauacauuga

SEQ ID NO: 2231116 - RNA, 21 nt, Homo sapiens
agucuugcaacagugccaugu

SEQ ID NO: 2231117 - RNA, 22 nt, Homo sapiens
ggcaagggcaacccaccaucua

SEQ ID NO: 2231118 - RNA, 13 nt, Homo sapiens
agugcaccugccu

SEQ ID NO: 2231119 - RNA, 15 nt, Homo sapiens
gaaauacguggcauu

SEQ ID NO: 2231120 - RNA, 20 nt, Homo sapiens
uaguaccuuguuuugccaug

SEQ ID NO: 2231121 - RNA, 12 nt, Homo sapiens
cuguagcuuuaa

SEQ ID NO: 2231122 - RNA, 19 nt, Homo sapiens
gcacuggauaaacaaaggu

SEQ ID NO: 2231123 - RNA, 12 nt, Homo sapiens
cccuaaccaagu

SEQ ID NO: 2231124 - RNA, 19 nt, Homo sapiens
uuccuccauggcccaucac

SEQ ID NO: 2231125 - RNA, 21 nt, Homo sapiens
cucaucccccagccacagugg

SEQ ID NO: 2231126 - RNA, 18 nt, Homo sapiens
uuaaagaugugaagacca

SEQ ID NO: 2231127 - RNA, 13 nt, Homo sapiens
cuuauuaggauuc

SEQ ID NO: 2231128 - RNA, 15 nt, Homo sapiens
ucagcacucuguaaa

SEQ ID NO: 2231129 - RNA, 23 nt, Homo sapiens
augaauuauaacuagacaucugc

SEQ ID NO: 2231130 - RNA, 12 nt, Homo sapiens
auuuauuaacua

SEQ ID NO: 2231131 - RNA, 12 nt, Homo sapiens
uuuaauuaucuu

SEQ ID NO: 2231132 - RNA, 21 nt, Homo sapiens
ugaaaacccaguggauggcug

SEQ ID NO: 2231133 - RNA, 23 nt, Homo sapiens
agaaggagcuugggugcauuugc

SEQ ID NO: 2231134 - RNA, 15 nt, Homo sapiens
aguaugugaagauau

SEQ ID NO: 2231135 - RNA, 22 nt, Homo sapiens
ugaugucaugaaacuguacaua

SEQ ID NO: 2231136 - RNA, 23 nt, Homo sapiens
agcagcgagggcaccuugugauc

SEQ ID NO: 2231137 - RNA, 18 nt, Homo sapiens
acuuguuugguugcaaaa

SEQ ID NO: 2231138 - RNA, 12 nt, Homo sapiens
uucaaagcauuu

SEQ ID NO: 2231139 - RNA, 23 nt, Homo sapiens
agcaacugcuggggagacaaauc

SEQ ID NO: 2231140 - RNA, 14 nt, Homo sapiens
ucgcugagucccag

SEQ ID NO: 2231141 - RNA, 23 nt, Homo sapiens
ccuggccaaauuuugauccuaac

SEQ ID NO: 2231142 - RNA, 14 nt, Homo sapiens
uggcucagugccac

SEQ ID NO: 2231143 - RNA, 16 nt, Homo sapiens
aagcaacagcuuugca

SEQ ID NO: 2231144 - RNA, 20 nt, Homo sapiens
uaauauuuuuaaaaguauac

SEQ ID NO: 2231145 - RNA, 19 nt, Homo sapiens
ucacuuuggauaugaucuu

SEQ ID NO: 2231146 - RNA, 12 nt, Homo sapiens
uacuugaacuca

SEQ ID NO: 2231147 - RNA, 16 nt, Homo sapiens
ugucuuaaccuaccug

SEQ ID NO: 2231148 - RNA, 22 nt, Homo sapiens
acucuuucaauaaauguaucau

SEQ ID NO: 2231149 - RNA, 19 nt, Homo sapiens
ccuucaggcagccagugug

SEQ ID NO: 2231150 - RNA, 18 nt, Homo sapiens
gacuuucccugacagcug

SEQ ID NO: 2231151 - RNA, 14 nt, Homo sapiens
ccagaaaaggcauu

SEQ ID NO: 2231152 - RNA, 17 nt, Homo sapiens
caagaggggaugaguug

SEQ ID NO: 2231153 - RNA, 17 nt, Homo sapiens
gaaaagacaaacaguag

SEQ ID NO: 2231154 - RNA, 16 nt, Homo sapiens
aauucaugcaucucaa

SEQ ID NO: 2231155 - RNA, 20 nt, Homo sapiens
cauccuucuuucuaguucag

SEQ ID NO: 2231156 - RNA, 18 nt, Homo sapiens
gaugauggcacugagaaa

SEQ ID NO: 2231157 - RNA, 18 nt, Homo sapiens
aaggcucacaugcuccuu

SEQ ID NO: 2231158 - RNA, 14 nt, Homo sapiens
acuuucucugccau

SEQ ID NO: 2231159 - RNA, 19 nt, Homo sapiens
uuacaaucgagacugcaau

SEQ ID NO: 2231160 - RNA, 22 nt, Homo sapiens
uggagcaauaaaagacaaaugc

SEQ ID NO: 2231161 - RNA, 17 nt, Homo sapiens
cuguuuagaacaccaaa

SEQ ID NO: 2231162 - RNA, 15 nt, Homo sapiens
ccuauugucauuaaa

SEQ ID NO: 2231163 - RNA, 21 nt, Homo sapiens
uucuaauguguggaaugugca

SEQ ID NO: 2231164 - RNA, 12 nt, Homo sapiens
ggagugcucuga

SEQ ID NO: 2231165 - RNA, 19 nt, Homo sapiens
cagcuaguggcucuucuca

SEQ ID NO: 2231166 - RNA, 20 nt, Homo sapiens
caucugaccaucugugacua

SEQ ID NO: 2231167 - RNA, 20 nt, Homo sapiens
aguuuccuuccagcccagaa

SEQ ID NO: 2231168 - RNA, 21 nt, Homo sapiens
ggcuuguaccacuuuugcaaa

SEQ ID NO: 2231169 - RNA, 23 nt, Homo sapiens
auaagaucuuuuauuuugccaag

SEQ ID NO: 2231170 - RNA, 20 nt, Homo sapiens
gauucacaucucauuuuucc

SEQ ID NO: 2231171 - RNA, 17 nt, Homo sapiens
uggacaaccuggaccca

SEQ ID NO: 2231172 - RNA, 21 nt, Homo sapiens
gguggcuauaaauuucuuacu

SEQ ID NO: 2231173 - RNA, 19 nt, Homo sapiens
uagaaagcugaguguuuca

SEQ ID NO: 2231174 - RNA, 22 nt, Homo sapiens
guuucauauugaugugugucua

SEQ ID NO: 2231175 - RNA, 14 nt, Homo sapiens
cugccccacacucc

SEQ ID NO: 2231176 - RNA, 15 nt, Homo sapiens
uaauaacugaugaga

SEQ ID NO: 2231177 - RNA, 12 nt, Homo sapiens
auagauuacuga

SEQ ID NO: 2231178 - RNA, 14 nt, Homo sapiens
ggaggccagugagc

SEQ ID NO: 2231179 - RNA, 22 nt, Homo sapiens
caggauggcaggaggcauccaa

SEQ ID NO: 2231180 - RNA, 13 nt, Homo sapiens
caaaagcaaggga

SEQ ID NO: 2231181 - RNA, 16 nt, Homo sapiens
uccuccacgccugucc

SEQ ID NO: 2231182 - RNA, 19 nt, Homo sapiens
uauggcucuggcaccacua

SEQ ID NO: 2231183 - RNA, 14 nt, Homo sapiens
uucaagaaacugag

SEQ ID NO: 2231184 - RNA, 23 nt, Homo sapiens
ccagcugggucaggcagggugca

SEQ ID NO: 2231185 - RNA, 19 nt, Homo sapiens
agagcugggacucaguucu

SEQ ID NO: 2231186 - RNA, 15 nt, Homo sapiens
agcauggacauuuag

SEQ ID NO: 2231187 - RNA, 20 nt, Homo sapiens
auuaauuagauuuucuugca

SEQ ID NO: 2231188 - RNA, 22 nt, Homo sapiens
gaugcauagccuggacacagag

SEQ ID NO: 2231189 - RNA, 20 nt, Homo sapiens
gagcuugucuuuucugcuga

SEQ ID NO: 2231190 - RNA, 20 nt, Homo sapiens
ucacauggaaucuacaugug

SEQ ID NO: 2231191 - RNA, 18 nt, Homo sapiens
ucacagcuaugcaaaaag

SEQ ID NO: 2231192 - RNA, 15 nt, Homo sapiens
acuuuagauguaucu

SEQ ID NO: 2231193 - RNA, 19 nt, Homo sapiens
cugucauuccuaaaacacc

SEQ ID NO: 2231194 - RNA, 19 nt, Homo sapiens
cugaugugacgcacuguau

SEQ ID NO: 2231195 - RNA, 15 nt, Homo sapiens
uuggagaaaagcacu

SEQ ID NO: 2231196 - RNA, 22 nt, Homo sapiens
cagugugguuggccugaacaaa

SEQ ID NO: 2231197 - RNA, 18 nt, Homo sapiens
aauggggaucacagagac

SEQ ID NO: 2231198 - RNA, 19 nt, Homo sapiens
ccuucugggcaacauggcc

SEQ ID NO: 2231199 - RNA, 19 nt, Homo sapiens
ccucagcaagaccuugaac

SEQ ID NO: 2231200 - RNA, 22 nt, Homo sapiens
cucuguaguuuaugaugcaaau

SEQ ID NO: 2231201 - RNA, 12 nt, Homo sapiens
uaaugggacccc

SEQ ID NO: 2231202 - RNA, 22 nt, Homo sapiens
uaacaugcuuaugacaaugacu

SEQ ID NO: 2231203 - RNA, 11 nt, Homo sapiens
gagaagugccu

SEQ ID NO: 2231204 - RNA, 18 nt, Homo sapiens
uucaagggacccaugagu

SEQ ID NO: 2231205 - RNA, 20 nt, Homo sapiens
ucaucugccaagcuccucaa

SEQ ID NO: 2231206 - RNA, 19 nt, Homo sapiens
aucauaaccaugugaaaag

SEQ ID NO: 2231207 - RNA, 11 nt, Homo sapiens
uaccugucaau

SEQ ID NO: 2231208 - RNA, 19 nt, Homo sapiens
cucuugaaguacuuaacau

SEQ ID NO: 2231209 - RNA, 19 nt, Homo sapiens
ccugggcuguugugucugg

SEQ ID NO: 2231210 - RNA, 21 nt, Homo sapiens
gguaucauuuucugcauuuaa

SEQ ID NO: 2231211 - RNA, 15 nt, Homo sapiens
ucccucagacccagg

SEQ ID NO: 2231212 - RNA, 21 nt, Homo sapiens
acacaugcuuuucuguuacug

SEQ ID NO: 2231213 - RNA, 22 nt, Homo sapiens
ccuagcugggaaggugaccaca

SEQ ID NO: 2231214 - RNA, 17 nt, Homo sapiens
guucccagacagcuuuu

SEQ ID NO: 2231215 - RNA, 11 nt, Homo sapiens
ccaggagcuca

SEQ ID NO: 2231216 - RNA, 13 nt, Homo sapiens
ugcucaaugccau

SEQ ID NO: 2231217 - RNA, 14 nt, Homo sapiens
cuuaaacacuugca

SEQ ID NO: 2231218 - RNA, 14 nt, Homo sapiens
uauaaacauaugca

SEQ ID NO: 2231219 - RNA, 19 nt, Homo sapiens
cauacccccacaugccaau

SEQ ID NO: 2231220 - RNA, 16 nt, Homo sapiens
ugcuaugccaagccau

SEQ ID NO: 2231221 - RNA, 14 nt, Homo sapiens
cuauaacaaucacu

SEQ ID NO: 2231222 - RNA, 20 nt, Homo sapiens
cugggugacccccacugccg

SEQ ID NO: 2231223 - RNA, 19 nt, Homo sapiens
ucaucuacaagcauuugcc

SEQ ID NO: 2231224 - RNA, 20 nt, Homo sapiens
accaaaccgcaaacgugaaa

SEQ ID NO: 2231225 - RNA, 17 nt, Homo sapiens
ccaccuucccuguccug

SEQ ID NO: 2231226 - RNA, 21 nt, Homo sapiens
caaaacguggguauuuccugc

SEQ ID NO: 2231227 - RNA, 20 nt, Homo sapiens
uuuaacuuuaaccacaguga

SEQ ID NO: 2231228 - RNA, 12 nt, Homo sapiens
cacugcacacau

SEQ ID NO: 2231229 - RNA, 18 nt, Homo sapiens
aauacucaauuuacuaau

SEQ ID NO: 2231230 - RNA, 16 nt, Homo sapiens
cccaugaacacacugu

SEQ ID NO: 2231231 - RNA, 16 nt, Homo sapiens
gaugcugagcugugau

SEQ ID NO: 2231232 - RNA, 19 nt, Homo sapiens
uauccaauuaugugacaac

SEQ ID NO: 2231233 - RNA, 19 nt, Homo sapiens
aaaucuucccaugcauucu

SEQ ID NO: 2231234 - RNA, 15 nt, Homo sapiens
cccagauacauggug

SEQ ID NO: 2231235 - RNA, 18 nt, Homo sapiens
gggugaucugcugcugag

SEQ ID NO: 2231236 - RNA, 22 nt, Homo sapiens
gguauugaaucuaaaaccaaau

SEQ ID NO: 2231237 - RNA, 21 nt, Homo sapiens
cauguauucauccagaguucu

SEQ ID NO: 2231238 - RNA, 15 nt, Homo sapiens
ugauacaugcauugc

SEQ ID NO: 2231239 - RNA, 16 nt, Homo sapiens
caacagugaacagcuu

SEQ ID NO: 2231240 - RNA, 20 nt, Homo sapiens
gacuauuauagaauggaacu

SEQ ID NO: 2231241 - RNA, 16 nt, Homo sapiens
gugacaggcagacaca

SEQ ID NO: 2231242 - RNA, 15 nt, Homo sapiens
auaugaaaacacuca

SEQ ID NO: 2231243 - RNA, 18 nt, Homo sapiens
gcuccagucauugcacaa

SEQ ID NO: 2231244 - RNA, 19 nt, Homo sapiens
auuagcaugagcuuuccag

SEQ ID NO: 2231245 - RNA, 17 nt, Homo sapiens
gagucgggacuaaccca

SEQ ID NO: 2231246 - RNA, 20 nt, Homo sapiens
augcaggguagcacugggaa

SEQ ID NO: 2231247 - RNA, 15 nt, Homo sapiens
agggaauaauccaga

SEQ ID NO: 2231248 - RNA, 22 nt, Homo sapiens
agaaguacuaucuuuguguugc

SEQ ID NO: 2231249 - RNA, 18 nt, Homo sapiens
auuuagaaaaacauccca

SEQ ID NO: 2231250 - RNA, 18 nt, Homo sapiens
gucucuccagcaucaauu

SEQ ID NO: 2231251 - RNA, 17 nt, Homo sapiens
uacucugcucuaugcca

SEQ ID NO: 2231252 - RNA, 18 nt, Homo sapiens
uaaacaguugcacagcau

SEQ ID NO: 2231253 - RNA, 14 nt, Homo sapiens
ucucucuguuuauc

SEQ ID NO: 2231254 - RNA, 15 nt, Homo sapiens
auaaauaauguucau

SEQ ID NO: 2231255 - RNA, 14 nt, Homo sapiens
gaaguaaacugcag

SEQ ID NO: 2231256 - RNA, 21 nt, Homo sapiens
ugaugcuggggacacagcauc

SEQ ID NO: 2231257 - RNA, 23 nt, Homo sapiens
gagcugguggggaggagccugga

SEQ ID NO: 2231258 - RNA, 13 nt, Homo sapiens
ucaucaguauugu

SEQ ID NO: 2231259 - RNA, 11 nt, Homo sapiens
auuaaagucag

SEQ ID NO: 2231260 - RNA, 23 nt, Homo sapiens
uccagcugauacacaccugauga

SEQ ID NO: 2231261 - RNA, 22 nt, Homo sapiens
aucccccacuguaaagccaguu

SEQ ID NO: 2231262 - RNA, 16 nt, Homo sapiens
uuauuccucagaacaa

SEQ ID NO: 2231263 - RNA, 15 nt, Homo sapiens
caugugacacauaug

SEQ ID NO: 2231264 - RNA, 21 nt, Homo sapiens
guuucuugcucccagaccaag

SEQ ID NO: 2231265 - RNA, 14 nt, Homo sapiens
gccuuguagcuguu

SEQ ID NO: 2231266 - RNA, 15 nt, Homo sapiens
ugcuggagaaaucau

SEQ ID NO: 2231267 - RNA, 15 nt, Homo sapiens
aaugguuuacugcug

SEQ ID NO: 2231268 - RNA, 15 nt, Homo sapiens
cuuuugguugccuua

SEQ ID NO: 2231269 - RNA, 19 nt, Homo sapiens
gugccacccaccuuugcca

SEQ ID NO: 2231270 - RNA, 21 nt, Homo sapiens
ggaaaccaguuuggugauaua

SEQ ID NO: 2231271 - RNA, 20 nt, Homo sapiens
ugugaaggcaggggaaugua

SEQ ID NO: 2231272 - RNA, 15 nt, Homo sapiens
acucuguuuuucaca

SEQ ID NO: 2231273 - RNA, 16 nt, Homo sapiens
ccuugugccuggcuca

SEQ ID NO: 2231274 - RNA, 16 nt, Homo sapiens
acacagacuggcaaua

SEQ ID NO: 2231275 - RNA, 19 nt, Homo sapiens
ugggauaacugauuucuau

SEQ ID NO: 2231276 - RNA, 15 nt, Homo sapiens
uccucccuccagaua

SEQ ID NO: 2231277 - RNA, 17 nt, Homo sapiens
aauggaaaguaacucau

SEQ ID NO: 2231278 - RNA, 18 nt, Homo sapiens
ucuauuuuuaguuugcua

SEQ ID NO: 2231279 - RNA, 18 nt, Homo sapiens
guguaaagaauaaaugaa

SEQ ID NO: 2231280 - RNA, 17 nt, Homo sapiens
ucccagacuugccuuac

SEQ ID NO: 2231281 - RNA, 12 nt, Homo sapiens
cauagaauugca

SEQ ID NO: 2231282 - RNA, 15 nt, Homo sapiens
auagaaacaauaauc

SEQ ID NO: 2231283 - RNA, 13 nt, Homo sapiens
cucugcuugccau

SEQ ID NO: 2231284 - RNA, 17 nt, Homo sapiens
ugucauguaauacugaa

SEQ ID NO: 2231285 - RNA, 18 nt, Homo sapiens
uuaagcagcgccagugac

SEQ ID NO: 2231286 - RNA, 19 nt, Homo sapiens
cagcccaagcuucccucca

SEQ ID NO: 2231287 - RNA, 22 nt, Homo sapiens
cauaacuaggauuauaaugcug

SEQ ID NO: 2231288 - RNA, 18 nt, Homo sapiens
auccugcuguucuagcac

SEQ ID NO: 2231289 - RNA, 15 nt, Homo sapiens
gucacaugaugaaua

SEQ ID NO: 2231290 - RNA, 15 nt, Homo sapiens
cugaaggucccaccu

SEQ ID NO: 2231291 - RNA, 19 nt, Homo sapiens
cugcucugcagcccacaga

SEQ ID NO: 2231292 - RNA, 23 nt, Homo sapiens
acccuccccauuaguauccuguu

SEQ ID NO: 2231293 - RNA, 15 nt, Homo sapiens
uugguaacucuguaa

SEQ ID NO: 2231294 - RNA, 14 nt, Homo sapiens
cgggaagugcagcg

SEQ ID NO: 2231295 - RNA, 16 nt, Homo sapiens
uguccucccagcuccu

SEQ ID NO: 2231296 - RNA, 17 nt, Homo sapiens
caccuuuuauugacaca

SEQ ID NO: 2231297 - RNA, 23 nt, Homo sapiens
cuaagaccuccucccaagcacuu

SEQ ID NO: 2231298 - RNA, 17 nt, Homo sapiens
accaauauuaccaucuu

SEQ ID NO: 2231299 - RNA, 23 nt, Homo sapiens
ugccacgguccuuugagugucag

SEQ ID NO: 2231300 - RNA, 21 nt, Homo sapiens
auacuacauugaguagacaca

SEQ ID NO: 2231301 - RNA, 19 nt, Homo sapiens
aggcuguauauucaagccu

SEQ ID NO: 2231302 - RNA, 16 nt, Homo sapiens
ucugggcagcuaaaag

SEQ ID NO: 2231303 - RNA, 12 nt, Homo sapiens
agcugggagcac

SEQ ID NO: 2231304 - RNA, 18 nt, Homo sapiens
gguaaauuuuuaggcaaa

SEQ ID NO: 2231305 - RNA, 15 nt, Homo sapiens
uguauucuguuucag

SEQ ID NO: 2231306 - RNA, 18 nt, Homo sapiens
aaucagcugcuacaagaa

SEQ ID NO: 2231307 - RNA, 20 nt, Homo sapiens
auugcugauuuuaauggauu

SEQ ID NO: 2231308 - RNA, 16 nt, Homo sapiens
uuguccccugccugug

SEQ ID NO: 2231309 - RNA, 21 nt, Homo sapiens
guauuuauguaauauuuagaa

SEQ ID NO: 2231310 - RNA, 13 nt, Homo sapiens
cuuuguguagcuc

SEQ ID NO: 2231311 - RNA, 12 nt, Homo sapiens
auagaacaucca

SEQ ID NO: 2231312 - RNA, 16 nt, Homo sapiens
uucaaucuguguaaga

SEQ ID NO: 2231313 - RNA, 16 nt, Homo sapiens
gauggggacauuugaa

SEQ ID NO: 2231314 - RNA, 13 nt, Homo sapiens
aucugauguuaac

SEQ ID NO: 2231315 - RNA, 15 nt, Homo sapiens
acuugaugccagugg

SEQ ID NO: 2231316 - RNA, 18 nt, Homo sapiens
gugccuccaccaccacug

SEQ ID NO: 2231317 - RNA, 17 nt, Homo sapiens
uacuguaucagauguga

SEQ ID NO: 2231318 - RNA, 17 nt, Homo sapiens
auggugggaacccuccc

SEQ ID NO: 2231319 - RNA, 21 nt, Homo sapiens
cauuguuuguuuuauauacca

SEQ ID NO: 2231320 - RNA, 15 nt, Homo sapiens
aauacggaacacugu

SEQ ID NO: 2231321 - RNA, 17 nt, Homo sapiens
gguaauugcugaggugu

SEQ ID NO: 2231322 - RNA, 22 nt, Homo sapiens
aguacacuuuuaugagcuucca

SEQ ID NO: 2231323 - RNA, 14 nt, Homo sapiens
ccuaagaugaagcu

SEQ ID NO: 2231324 - RNA, 18 nt, Homo sapiens
gacaggaguuugugugca

SEQ ID NO: 2231325 - RNA, 17 nt, Homo sapiens
ggcuguuguugaugcau

SEQ ID NO: 2231326 - RNA, 18 nt, Homo sapiens
ucuuacacacugucugua

SEQ ID NO: 2231327 - RNA, 14 nt, Homo sapiens
agcaaaaugugaua

SEQ ID NO: 2231328 - RNA, 21 nt, Homo sapiens
ggaaauaauaccccaacagau

SEQ ID NO: 2231329 - RNA, 20 nt, Homo sapiens
gaagucucaagaacugccau

SEQ ID NO: 2231330 - RNA, 18 nt, Homo sapiens
agcuccuguguucuagac

SEQ ID NO: 2231331 - RNA, 21 nt, Homo sapiens
aguaucagaggugaaugcaca

SEQ ID NO: 2231332 - RNA, 15 nt, Homo sapiens
uagcacaacugauaa

SEQ ID NO: 2231333 - RNA, 14 nt, Homo sapiens
cauuugcuuugucc

SEQ ID NO: 2231334 - RNA, 23 nt, Homo sapiens
uuuccccaccccagcucaugccc

SEQ ID NO: 2231335 - RNA, 22 nt, Homo sapiens
ccucuuaugagcuccauguugc

SEQ ID NO: 2231336 - RNA, 17 nt, Homo sapiens
gacagaaaccaagccau

SEQ ID NO: 2231337 - RNA, 15 nt, Homo sapiens
aauaauguccuuucc

SEQ ID NO: 2231338 - RNA, 18 nt, Homo sapiens
uaaacucagcugaucuga

SEQ ID NO: 2231339 - RNA, 18 nt, Homo sapiens
guuaaacagcagcacuuu

SEQ ID NO: 2231340 - RNA, 12 nt, Homo sapiens
gccaacaggugg

SEQ ID NO: 2231341 - RNA, 21 nt, Homo sapiens
aaauuaguugguuugugugau

SEQ ID NO: 2231342 - RNA, 19 nt, Homo sapiens
uuguagagacagggucuca

SEQ ID NO: 2231343 - RNA, 16 nt, Homo sapiens
uaugcccccaauuuau

SEQ ID NO: 2231344 - RNA, 21 nt, Homo sapiens
cuuugagcugcugacugccaa

SEQ ID NO: 2231345 - RNA, 20 nt, Homo sapiens
cucacaguacaauguuucag

SEQ ID NO: 2231346 - RNA, 23 nt, Homo sapiens
uaaauugcuuuuguugugacuuu

SEQ ID NO: 2231347 - RNA, 13 nt, Homo sapiens
gccugagugguga

SEQ ID NO: 2231348 - RNA, 11 nt, Homo sapiens
gucacagucca

SEQ ID NO: 2231349 - RNA, 20 nt, Homo sapiens
cuaucugauuuccuaauguc

SEQ ID NO: 2231350 - RNA, 14 nt, Homo sapiens
uccaagaccagacu

SEQ ID NO: 2231351 - RNA, 16 nt, Homo sapiens
ugcuaacaagucacca

SEQ ID NO: 2231352 - RNA, 15 nt, Homo sapiens
ucuuaaccucaggga

SEQ ID NO: 2231353 - RNA, 16 nt, Homo sapiens
caucgguuuauacuau

SEQ ID NO: 2231354 - RNA, 16 nt, Homo sapiens
auccacuuacauauau

SEQ ID NO: 2231355 - RNA, 19 nt, Homo sapiens
ggccuggguuuguuccugg

SEQ ID NO: 2231356 - RNA, 19 nt, Homo sapiens
acacauugacuccuuucca

SEQ ID NO: 2231357 - RNA, 22 nt, Homo sapiens
ccccuuugggcccugcauguag

SEQ ID NO: 2231358 - RNA, 21 nt, Homo sapiens
ccugcugggcacugggcacua

SEQ ID NO: 2231359 - RNA, 20 nt, Homo sapiens
cuccugaguagcugggauua

SEQ ID NO: 2231360 - RNA, 21 nt, Homo sapiens
uaaaacauuacuuauuuaacu

SEQ ID NO: 2231361 - RNA, 20 nt, Homo sapiens
cagcacuguauguguugcac

SEQ ID NO: 2231362 - RNA, 12 nt, Homo sapiens
aucacugaacaa

SEQ ID NO: 2231363 - RNA, 23 nt, Homo sapiens
guacaagcauucaagaaacugau

SEQ ID NO: 2231364 - RNA, 22 nt, Homo sapiens
uggacagugaggucacagucca

SEQ ID NO: 2231365 - RNA, 12 nt, Homo sapiens
cuggaugaaguu

SEQ ID NO: 2231366 - RNA, 16 nt, Homo sapiens
gagauuaaccucuugu

SEQ ID NO: 2231367 - RNA, 21 nt, Homo sapiens
aauuuacuuuuuaaacagugu

SEQ ID NO: 2231368 - RNA, 14 nt, Homo sapiens
acuuucagugcuuu

SEQ ID NO: 2231369 - RNA, 11 nt, Homo sapiens
ccaaguguccu

SEQ ID NO: 2231370 - RNA, 22 nt, Homo sapiens
gggugaccagccacucaaagga

SEQ ID NO: 2231371 - RNA, 18 nt, Homo sapiens
cugccccuccccaaaaga

SEQ ID NO: 2231372 - RNA, 21 nt, Homo sapiens
ucuucaagaaagaauuccugc

SEQ ID NO: 2231373 - RNA, 18 nt, Homo sapiens
augcugaaaaauauagcc

SEQ ID NO: 2231374 - RNA, 16 nt, Homo sapiens
ggagcuagaauuugau

SEQ ID NO: 2231375 - RNA, 21 nt, Homo sapiens
cccaggaaccgauuaucuaua

SEQ ID NO: 2231376 - RNA, 23 nt, Homo sapiens
auggauuugaugaaagugcaaag

SEQ ID NO: 2231377 - RNA, 16 nt, Homo sapiens
gccuaccucagccucc

SEQ ID NO: 2231378 - RNA, 18 nt, Homo sapiens
uuuuuguggugucuagca

SEQ ID NO: 2231379 - RNA, 21 nt, Homo sapiens
aguaccaaagaaauuauaaac

SEQ ID NO: 2231380 - RNA, 17 nt, Homo sapiens
aacugucaccagccgca

SEQ ID NO: 2231381 - RNA, 15 nt, Homo sapiens
cucauuuuucauuuc

SEQ ID NO: 2231382 - RNA, 22 nt, Homo sapiens
aacuugaaauauauaauauuca

SEQ ID NO: 2231383 - RNA, 14 nt, Homo sapiens
caccagcccagaag

SEQ ID NO: 2231384 - RNA, 14 nt, Homo sapiens
acacacauauacau

SEQ ID NO: 2231385 - RNA, 14 nt, Homo sapiens
auauauauacauac

SEQ ID NO: 2231386 - RNA, 17 nt, Homo sapiens
guugaguaaaacacaua

SEQ ID NO: 2231387 - RNA, 17 nt, Homo sapiens
cugucuuaaguuuauac

SEQ ID NO: 2231388 - RNA, 12 nt, Homo sapiens
cucauaccucag

SEQ ID NO: 2231389 - RNA, 19 nt, Homo sapiens
aggagggguuaaagcugcc

SEQ ID NO: 2231390 - RNA, 14 nt, Homo sapiens
ugugauacauuucu

SEQ ID NO: 2231391 - RNA, 20 nt, Homo sapiens
cauuaauaauaaauucccug

SEQ ID NO: 2231392 - RNA, 23 nt, Homo sapiens
uuacaauaaaaccuuugccacuu

SEQ ID NO: 2231393 - RNA, 14 nt, Homo sapiens
gcugccagcacagg

SEQ ID NO: 2231394 - RNA, 18 nt, Homo sapiens
acuucucugugugcacac

SEQ ID NO: 2231395 - RNA, 22 nt, Homo sapiens
acuaaagaccugcuguaauaaa

SEQ ID NO: 2231396 - RNA, 23 nt, Homo sapiens
ccugcauuguucuuugccagaga

SEQ ID NO: 2231397 - RNA, 16 nt, Homo sapiens
ccaagaaacacuuuca

SEQ ID NO: 2231398 - RNA, 12 nt, Homo sapiens
gcagccacaggg

SEQ ID NO: 2231399 - RNA, 19 nt, Homo sapiens
aguuuauuggaaguguuca

SEQ ID NO: 2231400 - RNA, 23 nt, Homo sapiens
cuacccuuccagugcccuaggcc

SEQ ID NO: 2231401 - RNA, 15 nt, Homo sapiens
guguguacauauaua

SEQ ID NO: 2231402 - RNA, 20 nt, Homo sapiens
caauguugguuucacugaga

SEQ ID NO: 2231403 - RNA, 16 nt, Homo sapiens
acacccgacuccucaa

SEQ ID NO: 2231404 - RNA, 20 nt, Homo sapiens
aauguucuauuuaacaacug

SEQ ID NO: 2231405 - RNA, 19 nt, Homo sapiens
uguuuaaauaaaguaucau

SEQ ID NO: 2231406 - RNA, 20 nt, Homo sapiens
cacagagagucccacugccu

SEQ ID NO: 2231407 - RNA, 21 nt, Homo sapiens
ugugcaauauucuuaaauacu

SEQ ID NO: 2231408 - RNA, 20 nt, Homo sapiens
ugagggggaauuccuggaac

SEQ ID NO: 2231409 - RNA, 20 nt, Homo sapiens
cacgacugcgggagccagac

SEQ ID NO: 2231410 - RNA, 23 nt, Homo sapiens
agccucaaagugcccgcagagcc

SEQ ID NO: 2231411 - RNA, 22 nt, Homo sapiens
cacuguacuaucagguucacaa

SEQ ID NO: 2231412 - RNA, 20 nt, Homo sapiens
acagcuucucaauuucuaca

SEQ ID NO: 2231413 - RNA, 23 nt, Homo sapiens
gcuggaggcugcuguggggacca

SEQ ID NO: 2231414 - RNA, 20 nt, Homo sapiens
aguaaaggccucaucuccuu

SEQ ID NO: 2231415 - RNA, 12 nt, Homo sapiens
uuugauaccagu

SEQ ID NO: 2231416 - RNA, 17 nt, Homo sapiens
uaaaaaaagaacauaaa

SEQ ID NO: 2231417 - RNA, 23 nt, Homo sapiens
ucuuaacuaaauuugucuuucaa

SEQ ID NO: 2231418 - RNA, 20 nt, Homo sapiens
cagccaugaaacugacucau

SEQ ID NO: 2231419 - RNA, 12 nt, Homo sapiens
cuggcacugaca

SEQ ID NO: 2231420 - RNA, 20 nt, Homo sapiens
uucacaggcuaaugggauaa

SEQ ID NO: 2231421 - RNA, 19 nt, Homo sapiens
cucuuaugggauuacaugu

SEQ ID NO: 2231422 - RNA, 21 nt, Homo sapiens
gaaaagaaaucuaugauucca

SEQ ID NO: 2231423 - RNA, 23 nt, Homo sapiens
agacggagucucgcucugucacc

SEQ ID NO: 2231424 - RNA, 20 nt, Homo sapiens
guugauccuccuauucucuu

SEQ ID NO: 2231425 - RNA, 15 nt, Homo sapiens
aguacccaucuagua

SEQ ID NO: 2231426 - RNA, 16 nt, Homo sapiens
acugagucuggaguga

SEQ ID NO: 2231427 - RNA, 15 nt, Homo sapiens
auuugugucacaaag

SEQ ID NO: 2231428 - RNA, 16 nt, Homo sapiens
gggucauccuugccca

SEQ ID NO: 2231429 - RNA, 18 nt, Homo sapiens
agagcccuucccagggca

SEQ ID NO: 2231430 - RNA, 21 nt, Homo sapiens
aaacccuccccaggucuucca

SEQ ID NO: 2231431 - RNA, 16 nt, Homo sapiens
cucuuccaaucuccau

SEQ ID NO: 2231432 - RNA, 13 nt, Homo sapiens
uuuguguguuuca

SEQ ID NO: 2231433 - RNA, 17 nt, Homo sapiens
gcagguaguuagcuuca

SEQ ID NO: 2231434 - RNA, 16 nt, Homo sapiens
uuuuaaaggaguagaa

SEQ ID NO: 2231435 - RNA, 17 nt, Homo sapiens
agaucuccacggucaga

SEQ ID NO: 2231436 - RNA, 22 nt, Homo sapiens
cuugaacugaaggccacuugag

SEQ ID NO: 2231437 - RNA, 23 nt, Homo sapiens
cauggcgaaaccccucucuacua

SEQ ID NO: 2231438 - RNA, 11 nt, Homo sapiens
caaacagugac

SEQ ID NO: 2231439 - RNA, 11 nt, Homo sapiens
cacacagugaa

SEQ ID NO: 2231440 - RNA, 18 nt, Homo sapiens
auuaauaugcuacaguac

SEQ ID NO: 2231441 - RNA, 19 nt, Homo sapiens
acuguauuuuacaagucaa

SEQ ID NO: 2231442 - RNA, 21 nt, Homo sapiens
uuuaguaauauuuuacuuuga

SEQ ID NO: 2231443 - RNA, 14 nt, Homo sapiens
ggaccacaggcaug

SEQ ID NO: 2231444 - RNA, 16 nt, Homo sapiens
cuauuuagaugagauc

SEQ ID NO: 2231445 - RNA, 17 nt, Homo sapiens
cguaucuuuuaaugauc

SEQ ID NO: 2231446 - RNA, 15 nt, Homo sapiens
auagcauuugccacu

SEQ ID NO: 2231447 - RNA, 15 nt, Homo sapiens
ggagcuggaaauaaa

SEQ ID NO: 2231448 - RNA, 24 nt, Homo sapiens
cugacuugcuaauggauguagcca

SEQ ID NO: 2231449 - RNA, 15 nt, Homo sapiens
gacguuguguaaugu

SEQ ID NO: 2231450 - RNA, 22 nt, Homo sapiens
auacugacagaugguaucugcc

SEQ ID NO: 2231451 - RNA, 18 nt, Homo sapiens
accucugugccucugucu

SEQ ID NO: 2231452 - RNA, 12 nt, Homo sapiens
aauuuaaccuac

SEQ ID NO: 2231453 - RNA, 21 nt, Homo sapiens
acuuuccagccuguuucccca

SEQ ID NO: 2231454 - RNA, 13 nt, Homo sapiens
uaacugugcugua

SEQ ID NO: 2231455 - RNA, 14 nt, Homo sapiens
caagugugugcucu

SEQ ID NO: 2231456 - RNA, 20 nt, Homo sapiens
ccucuucccuucaacaugaa

SEQ ID NO: 2231457 - RNA, 22 nt, Homo sapiens
agcuaggccuggccagaugcac

SEQ ID NO: 2231458 - RNA, 21 nt, Homo sapiens
uuggaacaacugauacuucac

SEQ ID NO: 2231459 - RNA, 14 nt, Homo sapiens
aagccagccugggg

SEQ ID NO: 2231460 - RNA, 23 nt, Homo sapiens
ucaaacuacugccauuucaguga

SEQ ID NO: 2231461 - RNA, 19 nt, Homo sapiens
uucauaauuucuucacuca

SEQ ID NO: 2231462 - RNA, 21 nt, Homo sapiens
uagacuaccggacacucguca

SEQ ID NO: 2231463 - RNA, 21 nt, Homo sapiens
aaggauauuucaaaugauuau

SEQ ID NO: 2231464 - RNA, 21 nt, Homo sapiens
aggaaaaggccccugcaaugu

SEQ ID NO: 2231465 - RNA, 16 nt, Homo sapiens
cuacacuccagccugg

SEQ ID NO: 2231466 - RNA, 14 nt, Homo sapiens
ucuuuucucuauga

SEQ ID NO: 2231467 - RNA, 15 nt, Homo sapiens
gcacgcuaccaaauc

SEQ ID NO: 2231468 - RNA, 17 nt, Homo sapiens
cagacugccugucugcu

SEQ ID NO: 2231469 - RNA, 22 nt, Homo sapiens
cucuuuggcugaaauucuucaa

SEQ ID NO: 2231470 - RNA, 15 nt, Homo sapiens
caaucaacagaaaag

SEQ ID NO: 2231471 - RNA, 22 nt, Homo sapiens
accuuuccuuaggaagacauuu

SEQ ID NO: 2231472 - RNA, 17 nt, Homo sapiens
cuagaggggacaagcca

SEQ ID NO: 2231473 - RNA, 19 nt, Homo sapiens
ugcaccccaccagcaauac

SEQ ID NO: 2231474 - RNA, 18 nt, Homo sapiens
acaagauccuuaaugcag

SEQ ID NO: 2231475 - RNA, 20 nt, Homo sapiens
cugcaacagguuuguucuca

SEQ ID NO: 2231476 - RNA, 23 nt, Homo sapiens
cuggucagucugcccuugucacu

SEQ ID NO: 2231477 - RNA, 21 nt, Homo sapiens
uccacuuaccuagauucuaca

SEQ ID NO: 2231478 - RNA, 13 nt, Homo sapiens
acuuccccuaugg

SEQ ID NO: 2231479 - RNA, 17 nt, Homo sapiens
aggugaaggaucugucc

SEQ ID NO: 2231480 - RNA, 21 nt, Homo sapiens
cccugccucgaggacugauac

SEQ ID NO: 2231481 - RNA, 20 nt, Homo sapiens
uaguaugggacuggccucug

SEQ ID NO: 2231482 - RNA, 22 nt, Homo sapiens
gacaaugcaccuagcugugcaa

SEQ ID NO: 2231483 - RNA, 20 nt, Homo sapiens
uauuuuaaacuacugauuga

SEQ ID NO: 2231484 - RNA, 20 nt, Homo sapiens
ugagugaaaacaucugcaca

SEQ ID NO: 2231485 - RNA, 12 nt, Homo sapiens
uagaacuguuuc

SEQ ID NO: 2231486 - RNA, 12 nt, Homo sapiens
cugcacugcaua

SEQ ID NO: 2231487 - RNA, 22 nt, Homo sapiens
cacauacccucacuuaaacuuu

SEQ ID NO: 2231488 - RNA, 17 nt, Homo sapiens
cucggucucccaaagug

SEQ ID NO: 2231489 - RNA, 14 nt, Homo sapiens
uuacaaggugacaa

SEQ ID NO: 2231490 - RNA, 18 nt, Homo sapiens
guuguugaggcugucaca

SEQ ID NO: 2231491 - RNA, 19 nt, Homo sapiens
ugauauaauaauuacuuaa

SEQ ID NO: 2231492 - RNA, 23 nt, Homo sapiens
aaguagaaguuacuuaauugcca

SEQ ID NO: 2231493 - RNA, 16 nt, Homo sapiens
uuuauauaacuguugu

SEQ ID NO: 2231494 - RNA, 13 nt, Homo sapiens
cucacagcacauu

SEQ ID NO: 2231495 - RNA, 11 nt, Homo sapiens
cuaaugcauua

SEQ ID NO: 2231496 - RNA, 11 nt, Homo sapiens
cugaugcauug

SEQ ID NO: 2231497 - RNA, 15 nt, Homo sapiens
gaggacggcuucccc

SEQ ID NO: 2231498 - RNA, 22 nt, Homo sapiens
cugcaggccccggggaccccag

SEQ ID NO: 2231499 - RNA, 20 nt, Homo sapiens
uauaguccagacacuuaacu

SEQ ID NO: 2231500 - RNA, 23 nt, Homo sapiens
ucuauugcuucaccauggccuua

SEQ ID NO: 2231501 - RNA, 16 nt, Homo sapiens
auaauguauuuacuuu

SEQ ID NO: 2231502 - RNA, 14 nt, Homo sapiens
ucccacauucugau

SEQ ID NO: 2231503 - RNA, 24 nt, Homo sapiens
aaaagguauuuugaauaccauuaa

SEQ ID NO: 2231504 - RNA, 13 nt, Homo sapiens
ucaagcagguuuc

SEQ ID NO: 2231505 - RNA, 20 nt, Homo sapiens
ugucagggguuucuucaaga

SEQ ID NO: 2231506 - RNA, 23 nt, Homo sapiens
aucugcagggccccgcaccaguu

SEQ ID NO: 2231507 - RNA, 13 nt, Homo sapiens
caaccccaggcug

SEQ ID NO: 2231508 - RNA, 19 nt, Homo sapiens
agucaucagcuauucaguu

SEQ ID NO: 2231509 - RNA, 15 nt, Homo sapiens
uauguaccauaugau

SEQ ID NO: 2231510 - RNA, 23 nt, Homo sapiens
ccuuagaugugucuccuguuuca

SEQ ID NO: 2231511 - RNA, 14 nt, Homo sapiens
uguguggggcccaa

SEQ ID NO: 2231512 - RNA, 23 nt, Homo sapiens
gugcuaaaaaauuaaaccaagca

SEQ ID NO: 2231513 - RNA, 15 nt, Homo sapiens
cuacauugugcaauu

SEQ ID NO: 2231514 - RNA, 21 nt, Homo sapiens
aagcaaauaaaugaacugacu

SEQ ID NO: 2231515 - RNA, 20 nt, Homo sapiens
auggugaaaccccaucucua

SEQ ID NO: 2231516 - RNA, 14 nt, Homo sapiens
uaacugaguuauau

SEQ ID NO: 2231517 - RNA, 15 nt, Homo sapiens
aaaucugacccagug

SEQ ID NO: 2231518 - RNA, 19 nt, Homo sapiens
aaauguucagaagguugcu

SEQ ID NO: 2231519 - RNA, 16 nt, Homo sapiens
cucccucaaagaaauc

SEQ ID NO: 2231520 - RNA, 19 nt, Homo sapiens
uauucucuaaaagcuuuaa

SEQ ID NO: 2231521 - RNA, 17 nt, Homo sapiens
ucugaggaccuccaaag

SEQ ID NO: 2231522 - RNA, 21 nt, Homo sapiens
guucuaucaggggugcauucu

SEQ ID NO: 2231523 - RNA, 14 nt, Homo sapiens
acagccuucacuuu

SEQ ID NO: 2231524 - RNA, 14 nt, Homo sapiens
auaaauaauguuca

SEQ ID NO: 2231525 - RNA, 16 nt, Homo sapiens
cagcaugcugcugcuc

SEQ ID NO: 2231526 - RNA, 17 nt, Homo sapiens
gcuccugccuugaugaa

SEQ ID NO: 2231527 - RNA, 13 nt, Homo sapiens
ucaaccacagauu

SEQ ID NO: 2231528 - RNA, 17 nt, Homo sapiens
ugcauuuauugccucua

SEQ ID NO: 2231529 - RNA, 21 nt, Homo sapiens
caaggauuagaacacucauua

SEQ ID NO: 2231530 - RNA, 19 nt, Homo sapiens
ggagcaaaaggcagcucac

SEQ ID NO: 2231531 - RNA, 12 nt, Homo sapiens
guccagcaaacu

SEQ ID NO: 2231532 - RNA, 20 nt, Homo sapiens
aaacaucuuaguugaugcua

SEQ ID NO: 2231533 - RNA, 11 nt, Homo sapiens
ucaacagucuu

SEQ ID NO: 2231534 - RNA, 20 nt, Homo sapiens
ucuggauuucacggagacag

SEQ ID NO: 2231535 - RNA, 21 nt, Homo sapiens
agugucacuuaccuagauuua

SEQ ID NO: 2231536 - RNA, 15 nt, Homo sapiens
aggggaucacacgag

SEQ ID NO: 2231537 - RNA, 15 nt, Homo sapiens
cuacuucuagcugua

SEQ ID NO: 2231538 - RNA, 17 nt, Homo sapiens
uuauagcacaaaaucag

SEQ ID NO: 2231539 - RNA, 18 nt, Homo sapiens
acaggguauaugaacaaa

SEQ ID NO: 2231540 - RNA, 13 nt, Homo sapiens
gagugacagauca

SEQ ID NO: 2231541 - RNA, 19 nt, Homo sapiens
gcuuccucaguuacacaaa

SEQ ID NO: 2231542 - RNA, 19 nt, Homo sapiens
cgaaacgggggaagggagc

SEQ ID NO: 2231543 - RNA, 17 nt, Homo sapiens
uguguguucaccuucaa

SEQ ID NO: 2231544 - RNA, 13 nt, Homo sapiens
agugagagggcau

SEQ ID NO: 2231545 - RNA, 15 nt, Homo sapiens
gcucuguacccauga

SEQ ID NO: 2231546 - RNA, 20 nt, Homo sapiens
cuuuuagcacaucacugaga

SEQ ID NO: 2231547 - RNA, 20 nt, Homo sapiens
aguuuauuuuuauacuuuca

SEQ ID NO: 2231548 - RNA, 20 nt, Homo sapiens
cacauuggccgcuucagaca

SEQ ID NO: 2231549 - RNA, 23 nt, Homo sapiens
uaccacagaaguucaauacucau

SEQ ID NO: 2231550 - RNA, 22 nt, Homo sapiens
caccuggcuuuucuuucuacca

SEQ ID NO: 2231551 - RNA, 15 nt, Homo sapiens
ugugugcguguuugc

SEQ ID NO: 2231552 - RNA, 19 nt, Homo sapiens
auuuuaauagaaagauaca

SEQ ID NO: 2231553 - RNA, 23 nt, Homo sapiens
ccuagagguggaguucuuagcua

SEQ ID NO: 2231554 - RNA, 14 nt, Homo sapiens
aaguaccacacaua

SEQ ID NO: 2231555 - RNA, 19 nt, Homo sapiens
agcccagccuagcgugccc

SEQ ID NO: 2231556 - RNA, 19 nt, Homo sapiens
cuggccaguccugguccug

SEQ ID NO: 2231557 - RNA, 17 nt, Homo sapiens
acacugagacuugaauc

SEQ ID NO: 2231558 - RNA, 13 nt, Homo sapiens
uuuccaaugccaa

SEQ ID NO: 2231559 - RNA, 18 nt, Homo sapiens
gccaggacacagacguac

SEQ ID NO: 2231560 - RNA, 20 nt, Homo sapiens
caauuagacaagaacuugga

SEQ ID NO: 2231561 - RNA, 16 nt, Homo sapiens
ucuccaucagaaugaa

SEQ ID NO: 2231562 - RNA, 12 nt, Homo sapiens
ugaagagcauuu

SEQ ID NO: 2231563 - RNA, 16 nt, Homo sapiens
ugaauaggaugauucc

SEQ ID NO: 2231564 - RNA, 15 nt, Homo sapiens
uccagagauggucac

SEQ ID NO: 2231565 - RNA, 16 nt, Homo sapiens
auguguaccuaaggga

SEQ ID NO: 2231566 - RNA, 22 nt, Homo sapiens
uguugccuugguuuuaccugua

SEQ ID NO: 2231567 - RNA, 18 nt, Homo sapiens
gauauucccccugagcug

SEQ ID NO: 2231568 - RNA, 13 nt, Homo sapiens
aaggaaaacagac

SEQ ID NO: 2231569 - RNA, 13 nt, Homo sapiens
caaaaaaaaaagc

SEQ ID NO: 2231570 - RNA, 14 nt, Homo sapiens
gacuucugcaucuu

SEQ ID NO: 2231571 - RNA, 19 nt, Homo sapiens
cacacagaaaauauacugu

SEQ ID NO: 2231572 - RNA, 23 nt, Homo sapiens
ugccuugggucucagcugcugac

SEQ ID NO: 2231573 - RNA, 13 nt, Homo sapiens
gucccuuaccugg

SEQ ID NO: 2231574 - RNA, 18 nt, Homo sapiens
gcuacgguucccugccua

SEQ ID NO: 2231575 - RNA, 17 nt, Homo sapiens
acccauuuccuugugcu

SEQ ID NO: 2231576 - RNA, 23 nt, Homo sapiens
ucccacugcacuuggugcugcuu

SEQ ID NO: 2231577 - RNA, 19 nt, Homo sapiens
ugucagauagucuauguau

SEQ ID NO: 2231578 - RNA, 15 nt, Homo sapiens
guggaaaaaucagaa

SEQ ID NO: 2231579 - RNA, 13 nt, Homo sapiens
cugagauccugca

SEQ ID NO: 2231580 - RNA, 16 nt, Homo sapiens
ggcccggggaagggaa

SEQ ID NO: 2231581 - RNA, 18 nt, Homo sapiens
agauccuccuuccaggcc

SEQ ID NO: 2231582 - RNA, 15 nt, Homo sapiens
cccaaaggagucaga

SEQ ID NO: 2231583 - RNA, 12 nt, Homo sapiens
gcugcugugcag

SEQ ID NO: 2231584 - RNA, 16 nt, Homo sapiens
auaaguuugcaguugg

SEQ ID NO: 2231585 - RNA, 15 nt, Homo sapiens
cugauuccacuuuua

SEQ ID NO: 2231586 - RNA, 13 nt, Homo sapiens
uaaaaaaacugga

SEQ ID NO: 2231587 - RNA, 19 nt, Homo sapiens
guuccuguucucagcaucc

SEQ ID NO: 2231588 - RNA, 18 nt, Homo sapiens
cugccaagcucacacagc

SEQ ID NO: 2231589 - RNA, 23 nt, Homo sapiens
aaauauagagcauuaacaaagua

SEQ ID NO: 2231590 - RNA, 14 nt, Homo sapiens
ucagcauguucuca

SEQ ID NO: 2231591 - RNA, 17 nt, Homo sapiens
acauagagauaugcaca

SEQ ID NO: 2231592 - RNA, 13 nt, Homo sapiens
ucccucaaccuca

SEQ ID NO: 2231593 - RNA, 18 nt, Homo sapiens
ucuggcugaacccugugc

SEQ ID NO: 2231594 - RNA, 14 nt, Homo sapiens
agaugcaucacugg

SEQ ID NO: 2231595 - RNA, 17 nt, Homo sapiens
aggaccugccaaugauu

SEQ ID NO: 2231596 - RNA, 12 nt, Homo sapiens
ugugauugcaca

SEQ ID NO: 2231597 - RNA, 13 nt, Homo sapiens
cagaccucaggga

SEQ ID NO: 2231598 - RNA, 20 nt, Homo sapiens
uauuuauugauguuuucaca

SEQ ID NO: 2231599 - RNA, 13 nt, Homo sapiens
aggcggugagcaa

SEQ ID NO: 2231600 - RNA, 14 nt, Homo sapiens
acguccugucuguu

SEQ ID NO: 2231601 - RNA, 18 nt, Homo sapiens
cuccaaggaccucucuca

SEQ ID NO: 2231602 - RNA, 18 nt, Homo sapiens
uucucugagaaccaaaag

SEQ ID NO: 2231603 - RNA, 19 nt, Homo sapiens
cggcuaugggacugcagug

SEQ ID NO: 2231604 - RNA, 17 nt, Homo sapiens
cugcuauaucuauccau

SEQ ID NO: 2231605 - RNA, 16 nt, Homo sapiens
aaacuuuggcuuucau

SEQ ID NO: 2231606 - RNA, 21 nt, Homo sapiens
ugcacaguacaauaauguacu

SEQ ID NO: 2231607 - RNA, 19 nt, Homo sapiens
auuccuauuggaaacagag

SEQ ID NO: 2231608 - RNA, 13 nt, Homo sapiens
cagcacucugcca

SEQ ID NO: 2231609 - RNA, 13 nt, Homo sapiens
gaaaaacuuccau

SEQ ID NO: 2231610 - RNA, 12 nt, Homo sapiens
uaaaaucucaaa

SEQ ID NO: 2231611 - RNA, 18 nt, Homo sapiens
acaugauuguuugacaca

SEQ ID NO: 2231612 - RNA, 23 nt, Homo sapiens
ugugaagaacuauuuuauucuaa

SEQ ID NO: 2231613 - RNA, 23 nt, Homo sapiens
acaaauuguuaagaguaucaugu

SEQ ID NO: 2231614 - RNA, 23 nt, Homo sapiens
ccacgcugauguuuauguacugu

SEQ ID NO: 2231615 - RNA, 20 nt, Homo sapiens
guucugugauacagaacucu

SEQ ID NO: 2231616 - RNA, 17 nt, Homo sapiens
aucuccugucuacaguu

SEQ ID NO: 2231617 - RNA, 22 nt, Homo sapiens
ggcacacugggugcccaagcuc

SEQ ID NO: 2231618 - RNA, 22 nt, Homo sapiens
ccuguuugacgacagugcauuu

SEQ ID NO: 2231619 - RNA, 20 nt, Homo sapiens
uauuuguuuuaauaccacag

SEQ ID NO: 2231620 - RNA, 13 nt, Homo sapiens
gcaguugcucagg

SEQ ID NO: 2231621 - RNA, 14 nt, Homo sapiens
agggagcugaguaa

SEQ ID NO: 2231622 - RNA, 18 nt, Homo sapiens
aaacuauucaugaauauu

SEQ ID NO: 2231623 - RNA, 16 nt, Homo sapiens
cccaggccugggaugc

SEQ ID NO: 2231624 - RNA, 13 nt, Homo sapiens
gaaaaaagugcaa

SEQ ID NO: 2231625 - RNA, 14 nt, Homo sapiens
ccucacugcaguag

SEQ ID NO: 2231626 - RNA, 21 nt, Homo sapiens
ccaguaaaugggggugcauuu

SEQ ID NO: 2231627 - RNA, 15 nt, Homo sapiens
uauuaaucagcauua

SEQ ID NO: 2231628 - RNA, 14 nt, Homo sapiens
gucuagauucucug

SEQ ID NO: 2231629 - RNA, 16 nt, Homo sapiens
auucuagucucugauu

SEQ ID NO: 2231630 - RNA, 12 nt, Homo sapiens
cuccucugugaa

SEQ ID NO: 2231631 - RNA, 19 nt, Homo sapiens
agcaagucacuggccagug

SEQ ID NO: 2231632 - RNA, 14 nt, Homo sapiens
aggucuaccccugg

SEQ ID NO: 2231633 - RNA, 21 nt, Homo sapiens
ucugcacaacugggcacugga

SEQ ID NO: 2231634 - RNA, 20 nt, Homo sapiens
guucaagcgauucuugugcc

SEQ ID NO: 2231635 - RNA, 18 nt, Homo sapiens
cugaacugagccuagcua

SEQ ID NO: 2231636 - RNA, 15 nt, Homo sapiens
caagaaauugauuga

SEQ ID NO: 2231637 - RNA, 23 nt, Homo sapiens
accaagccaauaccagccgccau

SEQ ID NO: 2231638 - RNA, 17 nt, Homo sapiens
agggacuuuagagaaua

SEQ ID NO: 2231639 - RNA, 23 nt, Homo sapiens
auagccaccccagaaauggugaa

SEQ ID NO: 2231640 - RNA, 23 nt, Homo sapiens
aaggcuugguugguagauauuca

SEQ ID NO: 2231641 - RNA, 21 nt, Homo sapiens
agcaguuacucccuacacuga

SEQ ID NO: 2231642 - RNA, 22 nt, Homo sapiens
acauggcguauuuuguauuuaa

SEQ ID NO: 2231643 - RNA, 12 nt, Homo sapiens
aacaucaaagau

SEQ ID NO: 2231644 - RNA, 13 nt, Homo sapiens
uggaguucacuuu

SEQ ID NO: 2231645 - RNA, 13 nt, Homo sapiens
agucagaaccacu

SEQ ID NO: 2231646 - RNA, 16 nt, Homo sapiens
caaccaacaacaaugu

SEQ ID NO: 2231647 - RNA, 16 nt, Homo sapiens
agaaaguuaaccccau

SEQ ID NO: 2231648 - RNA, 20 nt, Homo sapiens
aggaacaaagacaaccacug

SEQ ID NO: 2231649 - RNA, 21 nt, Homo sapiens
acuuauuaugaggcuauuaaa

SEQ ID NO: 2231650 - RNA, 14 nt, Homo sapiens
ucuauuuuuguaug

SEQ ID NO: 2231651 - RNA, 13 nt, Homo sapiens
cgggagaaauuua

SEQ ID NO: 2231652 - RNA, 23 nt, Homo sapiens
acucauuuccauaccauugugga

SEQ ID NO: 2231653 - RNA, 16 nt, Homo sapiens
auacgcccucuuucau

SEQ ID NO: 2231654 - RNA, 17 nt, Homo sapiens
cuuccuuucuuccacaa

SEQ ID NO: 2231655 - RNA, 16 nt, Homo sapiens
uguucauuccgaaaaa

SEQ ID NO: 2231656 - RNA, 17 nt, Homo sapiens
agcucaggaguaaggga

SEQ ID NO: 2231657 - RNA, 22 nt, Homo sapiens
ggcuguuggugggacccguggc

SEQ ID NO: 2231658 - RNA, 16 nt, Homo sapiens
gccucucccugcugcu

SEQ ID NO: 2231659 - RNA, 16 nt, Homo sapiens
aaaaaugggagccagg

SEQ ID NO: 2231660 - RNA, 21 nt, Homo sapiens
cgggcacugucaugcccagcu

SEQ ID NO: 2231661 - RNA, 20 nt, Homo sapiens
ugauaucuauaguagacaca

SEQ ID NO: 2231662 - RNA, 14 nt, Homo sapiens
acuuaggcuacccc

SEQ ID NO: 2231663 - RNA, 12 nt, Homo sapiens
gauguggcuuuu

SEQ ID NO: 2231664 - RNA, 22 nt, Homo sapiens
agccugccuggcaggcugucug

SEQ ID NO: 2231665 - RNA, 15 nt, Homo sapiens
auuggaaugcacagg

SEQ ID NO: 2231666 - RNA, 16 nt, Homo sapiens
ccgaccucugacugau

SEQ ID NO: 2231667 - RNA, 19 nt, Homo sapiens
aaaaccagaaucauaauuu

SEQ ID NO: 2231668 - RNA, 19 nt, Homo sapiens
aggcuggagauuuucacau

SEQ ID NO: 2231669 - RNA, 18 nt, Homo sapiens
cuugcuauucugucccua

SEQ ID NO: 2231670 - RNA, 17 nt, Homo sapiens
guacaccacaaggguca

SEQ ID NO: 2231671 - RNA, 19 nt, Homo sapiens
auaugugggugcuccucuu

SEQ ID NO: 2231672 - RNA, 21 nt, Homo sapiens
guuuacaggaaagaugcauuu

SEQ ID NO: 2231673 - RNA, 19 nt, Homo sapiens
ugcaaugccuagacuuccc

SEQ ID NO: 2231674 - RNA, 22 nt, Homo sapiens
acacugaaaauuagacauuuau

SEQ ID NO: 2231675 - RNA, 14 nt, Homo sapiens
cugaaaauuuauca

SEQ ID NO: 2231676 - RNA, 16 nt, Homo sapiens
acucugcauccagaga

SEQ ID NO: 2231677 - RNA, 16 nt, Homo sapiens
ucugggucagacccau

SEQ ID NO: 2231678 - RNA, 12 nt, Homo sapiens
agaacauuuuaa

SEQ ID NO: 2231679 - RNA, 19 nt, Homo sapiens
uccaccccagggucauaag

SEQ ID NO: 2231680 - RNA, 17 nt, Homo sapiens
aauaaaaaguucagagu

SEQ ID NO: 2231681 - RNA, 20 nt, Homo sapiens
cuuuauauacuuagcuauau

SEQ ID NO: 2231682 - RNA, 17 nt, Homo sapiens
agaucuguccucagccu

SEQ ID NO: 2231683 - RNA, 15 nt, Homo sapiens
cugagcgcuguguua

SEQ ID NO: 2231684 - RNA, 18 nt, Homo sapiens
ggagauccuuucucucaa

SEQ ID NO: 2231685 - RNA, 22 nt, Homo sapiens
cccaucccacacccuggaggau

SEQ ID NO: 2231686 - RNA, 18 nt, Homo sapiens
gcacacagagauucugga

SEQ ID NO: 2231687 - RNA, 15 nt, Homo sapiens
ucauggcagugccug

SEQ ID NO: 2231688 - RNA, 17 nt, Homo sapiens
acagcuuaacauuuaca

SEQ ID NO: 2231689 - RNA, 20 nt, Homo sapiens
agcauacagguuaaccugca

SEQ ID NO: 2231690 - RNA, 22 nt, Homo sapiens
gaugcaguucugaagaagaugg

SEQ ID NO: 2231691 - RNA, 16 nt, Homo sapiens
acuucucucaggaucc

SEQ ID NO: 2231692 - RNA, 17 nt, Homo sapiens
uugauuguuguuauuaa

SEQ ID NO: 2231693 - RNA, 23 nt, Homo sapiens
caucaucccuuaauuaaauauca

SEQ ID NO: 2231694 - RNA, 17 nt, Homo sapiens
uaaccauuacauguuua

SEQ ID NO: 2231695 - RNA, 20 nt, Homo sapiens
uccaagcagaguguuuuauu

SEQ ID NO: 2231696 - RNA, 18 nt, Homo sapiens
agcaagaccccaucucaa

SEQ ID NO: 2231697 - RNA, 18 nt, Homo sapiens
agugagacccugucucaa

SEQ ID NO: 2231698 - RNA, 14 nt, Homo sapiens
ugguccuucccuga

SEQ ID NO: 2231699 - RNA, 21 nt, Homo sapiens
cccacuuuuuguuguucauua

SEQ ID NO: 2231700 - RNA, 13 nt, Homo sapiens
cuuuuaacuacaa

SEQ ID NO: 2231701 - RNA, 21 nt, Homo sapiens
gagggaauuccuagcuguaaa

SEQ ID NO: 2231702 - RNA, 15 nt, Homo sapiens
acacccauggccuca

SEQ ID NO: 2231703 - RNA, 17 nt, Homo sapiens
gaaauuaaauguugauu

SEQ ID NO: 2231704 - RNA, 17 nt, Homo sapiens
ggaucaaccaaguuaca

SEQ ID NO: 2231705 - RNA, 15 nt, Homo sapiens
ucccuucucagaaaa

SEQ ID NO: 2231706 - RNA, 13 nt, Homo sapiens
gauaauuacuuuc

SEQ ID NO: 2231707 - RNA, 15 nt, Homo sapiens
cagagcccaaugcau

SEQ ID NO: 2231708 - RNA, 21 nt, Homo sapiens
aaaauacaauuaaagcaaaau

SEQ ID NO: 2231709 - RNA, 17 nt, Homo sapiens
acccaagugccaagaca

SEQ ID NO: 2231710 - RNA, 14 nt, Homo sapiens
aacuuggugccuaa

SEQ ID NO: 2231711 - RNA, 19 nt, Homo sapiens
ggguggccaggggugguga

SEQ ID NO: 2231712 - RNA, 15 nt, Homo sapiens
acacaucuauugcag

SEQ ID NO: 2231713 - RNA, 23 nt, Homo sapiens
agaggcugcccuccugugcucag

SEQ ID NO: 2231714 - RNA, 18 nt, Homo sapiens
gcgaaggggcccuggucc

SEQ ID NO: 2231715 - RNA, 15 nt, Homo sapiens
acuuauuucauaaac

SEQ ID NO: 2231716 - RNA, 19 nt, Homo sapiens
accuccacaucccauguug

SEQ ID NO: 2231717 - RNA, 22 nt, Homo sapiens
aauguagcaguucugcacuuug

SEQ ID NO: 2231718 - RNA, 19 nt, Homo sapiens
augguaggcuacuuuucag

SEQ ID NO: 2231719 - RNA, 16 nt, Homo sapiens
uaagagaugugacuac

SEQ ID NO: 2231720 - RNA, 15 nt, Homo sapiens
ucaaaagugccucaa

SEQ ID NO: 2231721 - RNA, 13 nt, Homo sapiens
acuuuuuggugga

SEQ ID NO: 2231722 - RNA, 23 nt, Homo sapiens
auuuguuuaaacaaucuuucaug

SEQ ID NO: 2231723 - RNA, 16 nt, Homo sapiens
uguuuugagcuuaaaa

SEQ ID NO: 2231724 - RNA, 18 nt, Homo sapiens
ccacguggggcucacuuu

SEQ ID NO: 2231725 - RNA, 13 nt, Homo sapiens
auaagagauuugg

SEQ ID NO: 2231726 - RNA, 14 nt, Homo sapiens
ugucacagcuuugu

SEQ ID NO: 2231727 - RNA, 20 nt, Homo sapiens
aaggcuuuaauaaaggccac

SEQ ID NO: 2231728 - RNA, 13 nt, Homo sapiens
gugucgugucugc

SEQ ID NO: 2231729 - RNA, 22 nt, Homo sapiens
ggcaaagaacugccccaucucc

SEQ ID NO: 2231730 - RNA, 18 nt, Homo sapiens
uaaaauguuggugcaauu

SEQ ID NO: 2231731 - RNA, 13 nt, Homo sapiens
caaaugcuuuaac

SEQ ID NO: 2231732 - RNA, 21 nt, Homo sapiens
uaugaaugacaguagucacac

SEQ ID NO: 2231733 - RNA, 20 nt, Homo sapiens
cuucacugccaugauagcug

SEQ ID NO: 2231734 - RNA, 20 nt, Homo sapiens
gaagauguuuacucauugcc

SEQ ID NO: 2231735 - RNA, 15 nt, Homo sapiens
agugagcaucaugga

SEQ ID NO: 2231736 - RNA, 19 nt, Homo sapiens
cugugugccuucugccaac

SEQ ID NO: 2231737 - RNA, 16 nt, Homo sapiens
uuucugauacugcuga

SEQ ID NO: 2231738 - RNA, 21 nt, Homo sapiens
gucuuuuuuucccuaccauuc

SEQ ID NO: 2231739 - RNA, 22 nt, Homo sapiens
caaaagaucaaauguauucaga

SEQ ID NO: 2231740 - RNA, 13 nt, Homo sapiens
uaacagauuugcu

SEQ ID NO: 2231741 - RNA, 21 nt, Homo sapiens
ugcaugucaucuucuaggcca

SEQ ID NO: 2231742 - RNA, 15 nt, Homo sapiens
auuuccccuuuccaa

SEQ ID NO: 2231743 - RNA, 20 nt, Homo sapiens
ucaucaaagaugacuugaaa

SEQ ID NO: 2231744 - RNA, 15 nt, Homo sapiens
auaauacacacaguu

SEQ ID NO: 2231745 - RNA, 23 nt, Homo sapiens
uggcaucuuugcuauggggacau

SEQ ID NO: 2231746 - RNA, 14 nt, Homo sapiens
agcaaugacaucuc

SEQ ID NO: 2231747 - RNA, 17 nt, Homo sapiens
cuagugaagaaugcaug

SEQ ID NO: 2231748 - RNA, 14 nt, Homo sapiens
aaugaaugccuaaa

SEQ ID NO: 2231749 - RNA, 14 nt, Homo sapiens
agauucagucuugc

SEQ ID NO: 2231750 - RNA, 14 nt, Homo sapiens
cugaugccauguaa

SEQ ID NO: 2231751 - RNA, 23 nt, Homo sapiens
ucuuaugucaaguucuacaucaa

SEQ ID NO: 2231752 - RNA, 19 nt, Homo sapiens
accaccgaaucccuagucc

SEQ ID NO: 2231753 - RNA, 22 nt, Homo sapiens
caaauucuaccuuauuuuacag

SEQ ID NO: 2231754 - RNA, 21 nt, Homo sapiens
acacuuuuuuggggauaugcu

SEQ ID NO: 2231755 - RNA, 19 nt, Homo sapiens
cacaaaaaggcauaugcaa

SEQ ID NO: 2231756 - RNA, 14 nt, Homo sapiens
uuacugaaagggag

SEQ ID NO: 2231757 - RNA, 15 nt, Homo sapiens
gcccagagcacuuua

SEQ ID NO: 2231758 - RNA, 17 nt, Homo sapiens
ugacgcaccacugccaa

SEQ ID NO: 2231759 - RNA, 16 nt, Homo sapiens
uaaccauucuacugug

SEQ ID NO: 2231760 - RNA, 16 nt, Homo sapiens
uaugagggcagauuca

SEQ ID NO: 2231761 - RNA, 12 nt, Homo sapiens
cauguacuugaa

SEQ ID NO: 2231762 - RNA, 20 nt, Homo sapiens
acuguuccugagccuucagc

SEQ ID NO: 2231763 - RNA, 21 nt, Homo sapiens
aacucaccagccccacugcca

SEQ ID NO: 2231764 - RNA, 17 nt, Homo sapiens
cauuuaaaacaggcaaa

SEQ ID NO: 2231765 - RNA, 18 nt, Homo sapiens
cuacugcuggaaaaagcc

SEQ ID NO: 2231766 - RNA, 19 nt, Homo sapiens
uugaccgagcacauaccau

SEQ ID NO: 2231767 - RNA, 19 nt, Homo sapiens
ggauuugcccacguaccca

SEQ ID NO: 2231768 - RNA, 22 nt, Homo sapiens
aaucacauaacugguacaagua

SEQ ID NO: 2231769 - RNA, 19 nt, Homo sapiens
agaguugagauuuugcaau

SEQ ID NO: 2231770 - RNA, 21 nt, Homo sapiens
ucccaccccuaccucuaguaa

SEQ ID NO: 2231771 - RNA, 18 nt, Homo sapiens
caccccaaucccugccac

SEQ ID NO: 2231772 - RNA, 14 nt, Homo sapiens
gagaagaugugauu

SEQ ID NO: 2231773 - RNA, 18 nt, Homo sapiens
cauucuagacccuauaca

SEQ ID NO: 2231774 - RNA, 15 nt, Homo sapiens
gcuucuguccaggac

SEQ ID NO: 2231775 - RNA, 19 nt, Homo sapiens
guacccagggccagcccac

SEQ ID NO: 2231776 - RNA, 20 nt, Homo sapiens
auaaauguaaauauguacac

SEQ ID NO: 2231777 - RNA, 17 nt, Homo sapiens
uauagcuuccagauuac

SEQ ID NO: 2231778 - RNA, 13 nt, Homo sapiens
ucaccuucacuua

SEQ ID NO: 2231779 - RNA, 12 nt, Homo sapiens
ugaggguguaua

SEQ ID NO: 2231780 - RNA, 23 nt, Homo sapiens
guuaaaaucccaaaucuauagca

SEQ ID NO: 2231781 - RNA, 22 nt, Homo sapiens
gcccccacagcaccuccaugug

SEQ ID NO: 2231782 - RNA, 15 nt, Homo sapiens
uggaggaaugacaau

SEQ ID NO: 2231783 - RNA, 13 nt, Homo sapiens
aacucgugacagc

SEQ ID NO: 2231784 - RNA, 13 nt, Homo sapiens
uaggacuuugaau

SEQ ID NO: 2231785 - RNA, 23 nt, Homo sapiens
acaguuuuuccuggaauugccag

SEQ ID NO: 2231786 - RNA, 17 nt, Homo sapiens
cauacccccacaugcca

SEQ ID NO: 2231787 - RNA, 22 nt, Homo sapiens
acugcugcccagccuccaagcu

SEQ ID NO: 2231788 - RNA, 20 nt, Homo sapiens
caugcugaagccaaagccaa

SEQ ID NO: 2231789 - RNA, 12 nt, Homo sapiens
ugacgagcucac

SEQ ID NO: 2231790 - RNA, 21 nt, Homo sapiens
uccagaugauccuugcacaga

SEQ ID NO: 2231791 - RNA, 21 nt, Homo sapiens
cagcaggaaggaacaaagaca

SEQ ID NO: 2231792 - RNA, 19 nt, Homo sapiens
uggcgugcucagacccaac

SEQ ID NO: 2231793 - RNA, 18 nt, Homo sapiens
aguuagaacuagauuuaa

SEQ ID NO: 2231794 - RNA, 15 nt, Homo sapiens
acuuagcagaaccac

SEQ ID NO: 2231795 - RNA, 22 nt, Homo sapiens
agcuguggcuggaggagcuggc

SEQ ID NO: 2231796 - RNA, 23 nt, Homo sapiens
gagaaaggaacuuuuaaacugca

SEQ ID NO: 2231797 - RNA, 20 nt, Homo sapiens
caggaggcggagguugcagu

SEQ ID NO: 2231798 - RNA, 20 nt, Homo sapiens
uaccauaugccccauuccca

SEQ ID NO: 2231799 - RNA, 15 nt, Homo sapiens
agacuugaacauuug

SEQ ID NO: 2231800 - RNA, 15 nt, Homo sapiens
acccuugaaccaaua

SEQ ID NO: 2231801 - RNA, 19 nt, Homo sapiens
agaaagugauaagugcagg

SEQ ID NO: 2231802 - RNA, 18 nt, Homo sapiens
cucaugggaaggggagga

SEQ ID NO: 2231803 - RNA, 20 nt, Homo sapiens
ccaaauaauuguugugugua

SEQ ID NO: 2231804 - RNA, 15 nt, Homo sapiens
gcuugagccugucac

SEQ ID NO: 2231805 - RNA, 20 nt, Homo sapiens
ugaagaaaauucagaaugaa

SEQ ID NO: 2231806 - RNA, 19 nt, Homo sapiens
cagacuggcaauaaacucc

SEQ ID NO: 2231807 - RNA, 22 nt, Homo sapiens
agugagccccuccccagccagc

SEQ ID NO: 2231808 - RNA, 23 nt, Homo sapiens
augguaaccgagccagcagcuga

SEQ ID NO: 2231809 - RNA, 12 nt, Homo sapiens
acacaacugugg

SEQ ID NO: 2231810 - RNA, 19 nt, Homo sapiens
cguuuuuuuaaauuagcaa

SEQ ID NO: 2231811 - RNA, 15 nt, Homo sapiens
aucuuggggugcagc

SEQ ID NO: 2231812 - RNA, 21 nt, Homo sapiens
aggcucugugggaggaugaag

SEQ ID NO: 2231813 - RNA, 24 nt, Homo sapiens
cacgagcuaguuaaacagugccau

SEQ ID NO: 2231814 - RNA, 17 nt, Homo sapiens
aguuucauuaacuggug

SEQ ID NO: 2231815 - RNA, 20 nt, Homo sapiens
aauauugauuaagccuccuc

SEQ ID NO: 2231816 - RNA, 14 nt, Homo sapiens
ugaacgugccugac

SEQ ID NO: 2231817 - RNA, 23 nt, Homo sapiens
aaucugcauccuuuucaaaaccu

SEQ ID NO: 2231818 - RNA, 18 nt, Homo sapiens
cagggccuguaaucccag

SEQ ID NO: 2231819 - RNA, 14 nt, Homo sapiens
uaauuacuucacua

SEQ ID NO: 2231820 - RNA, 12 nt, Homo sapiens
accaacuuuccc

SEQ ID NO: 2231821 - RNA, 16 nt, Homo sapiens
cagugcccauguguau

SEQ ID NO: 2231822 - RNA, 13 nt, Homo sapiens
ugauuaacuuauu

SEQ ID NO: 2231823 - RNA, 13 nt, Homo sapiens
aggagaacaugag

SEQ ID NO: 2231824 - RNA, 20 nt, Homo sapiens
agcaagcgcuguaaacccug

SEQ ID NO: 2231825 - RNA, 19 nt, Homo sapiens
ccuuguguguuuugagagu

SEQ ID NO: 2231826 - RNA, 19 nt, Homo sapiens
uuagaaauaaagcaucuca

SEQ ID NO: 2231827 - RNA, 12 nt, Homo sapiens
ugaucagggauc

SEQ ID NO: 2231828 - RNA, 12 nt, Homo sapiens
cccaggaucucu

SEQ ID NO: 2231829 - RNA, 23 nt, Homo sapiens
auccuccugcccagcuccucaca

SEQ ID NO: 2231830 - RNA, 23 nt, Homo sapiens
guaacuuucugcugaugaacaaa

SEQ ID NO: 2231831 - RNA, 19 nt, Homo sapiens
caaagggcacagcaucugu

SEQ ID NO: 2231832 - RNA, 15 nt, Homo sapiens
caggaccugccaaug

SEQ ID NO: 2231833 - RNA, 21 nt, Homo sapiens
guacauucccaucuacuaaaa

SEQ ID NO: 2231834 - RNA, 19 nt, Homo sapiens
gcugaguuuccccacuuua

SEQ ID NO: 2231835 - RNA, 21 nt, Homo sapiens
uguggggagggcagguccagc

SEQ ID NO: 2231836 - RNA, 23 nt, Homo sapiens
acuuuguuguuuggauuccucac

SEQ ID NO: 2231837 - RNA, 21 nt, Homo sapiens
ccauuuauaauguuaguagaa

SEQ ID NO: 2231838 - RNA, 13 nt, Homo sapiens
aauuguauuccca

SEQ ID NO: 2231839 - RNA, 13 nt, Homo sapiens
aaaccugacuuaa

SEQ ID NO: 2231840 - RNA, 14 nt, Homo sapiens
auaauaaauuugau

SEQ ID NO: 2231841 - RNA, 18 nt, Homo sapiens
gaaugcaacuccauuuac

SEQ ID NO: 2231842 - RNA, 23 nt, Homo sapiens
aguggaacaugcaaggcacugac

SEQ ID NO: 2231843 - RNA, 21 nt, Homo sapiens
gaggcagggacaccuggacaa

SEQ ID NO: 2231844 - RNA, 20 nt, Homo sapiens
acugcugcacaacaagauac

SEQ ID NO: 2231845 - RNA, 19 nt, Homo sapiens
gauacuucgacacuguucu

SEQ ID NO: 2231846 - RNA, 13 nt, Homo sapiens
agaccagauuaaa

SEQ ID NO: 2231847 - RNA, 15 nt, Homo sapiens
cuccccuaaagccag

SEQ ID NO: 2231848 - RNA, 17 nt, Homo sapiens
cuguaaauacaugugug

SEQ ID NO: 2231849 - RNA, 22 nt, Homo sapiens
uacauuugaacuugauggcuaa

SEQ ID NO: 2231850 - RNA, 22 nt, Homo sapiens
cugccagggugggcagacagac

SEQ ID NO: 2231851 - RNA, 13 nt, Homo sapiens
aguucccaucacc

SEQ ID NO: 2231852 - RNA, 21 nt, Homo sapiens
auucaaaguugccuaaaucca

SEQ ID NO: 2231853 - RNA, 17 nt, Homo sapiens
gaccccgcccagcauug

SEQ ID NO: 2231854 - RNA, 10 nt, Homo sapiens
acuguugcau

SEQ ID NO: 2231855 - RNA, 22 nt, Homo sapiens
ugagaugcaggugaugccauua

SEQ ID NO: 2231856 - RNA, 14 nt, Homo sapiens
accacuuuuaacag

SEQ ID NO: 2231857 - RNA, 12 nt, Homo sapiens
uaaaugcuccag

SEQ ID NO: 2231858 - RNA, 15 nt, Homo sapiens
acucugcaaccucca

SEQ ID NO: 2231859 - RNA, 12 nt, Homo sapiens
uguguaccucua

SEQ ID NO: 2231860 - RNA, 17 nt, Homo sapiens
uaaaaugugcuauuugc

SEQ ID NO: 2231861 - RNA, 21 nt, Homo sapiens
auuccacuauuugcagaggcu

SEQ ID NO: 2231862 - RNA, 20 nt, Homo sapiens
gugcgugcgcaucuugccuc

SEQ ID NO: 2231863 - RNA, 22 nt, Homo sapiens
gcccuucagucuuaauacuuua

SEQ ID NO: 2231864 - RNA, 22 nt, Homo sapiens
cucucuaacguccacuagcuua

SEQ ID NO: 2231865 - RNA, 12 nt, Homo sapiens
cuguauucuggc

SEQ ID NO: 2231866 - RNA, 19 nt, Homo sapiens
acugcugcuagagccagca

SEQ ID NO: 2231867 - RNA, 16 nt, Homo sapiens
aggaaagcagugcagu

SEQ ID NO: 2231868 - RNA, 19 nt, Homo sapiens
ugaguguccacagggacac

SEQ ID NO: 2231869 - RNA, 22 nt, Homo sapiens
ugcuuggguggagaagccauug

SEQ ID NO: 2231870 - RNA, 17 nt, Homo sapiens
aaucuguaauugcuuau

SEQ ID NO: 2231871 - RNA, 17 nt, Homo sapiens
uucauugugaucacugu

SEQ ID NO: 2231872 - RNA, 14 nt, Homo sapiens
aaacucucuagggc

SEQ ID NO: 2231873 - RNA, 19 nt, Homo sapiens
aucuugaucaaccaaaaac

SEQ ID NO: 2231874 - RNA, 20 nt, Homo sapiens
gcuggggggauguucugccu

SEQ ID NO: 2231875 - RNA, 17 nt, Homo sapiens
uacuccuaugaucugag

SEQ ID NO: 2231876 - RNA, 20 nt, Homo sapiens
cagaagugagcuuugcugcu

SEQ ID NO: 2231877 - RNA, 15 nt, Homo sapiens
gcuuucuccauugua

SEQ ID NO: 2231878 - RNA, 17 nt, Homo sapiens
uaaaauugcaguuucau

SEQ ID NO: 2231879 - RNA, 15 nt, Homo sapiens
aaaauugacuuagau

SEQ ID NO: 2231880 - RNA, 19 nt, Homo sapiens
cugcugggaauggauuuuu

SEQ ID NO: 2231881 - RNA, 17 nt, Homo sapiens
caaaacugcacugucaa

SEQ ID NO: 2231882 - RNA, 20 nt, Homo sapiens
uccccaucauuacugguaaa

SEQ ID NO: 2231883 - RNA, 12 nt, Homo sapiens
auguauacaaag

SEQ ID NO: 2231884 - RNA, 23 nt, Homo sapiens
aaaauguaucccauuggcuacua

SEQ ID NO: 2231885 - RNA, 13 nt, Homo sapiens
gcaggaugaccuc

SEQ ID NO: 2231886 - RNA, 11 nt, Homo sapiens
ccucagcuaug

SEQ ID NO: 2231887 - RNA, 19 nt, Homo sapiens
gguggagggcacagcccuc

SEQ ID NO: 2231888 - RNA, 20 nt, Homo sapiens
uuaaucuccucagacaguaa

SEQ ID NO: 2231889 - RNA, 15 nt, Homo sapiens
uguuuucuuugcaaa

SEQ ID NO: 2231890 - RNA, 19 nt, Homo sapiens
caguugcaauucauaacua

SEQ ID NO: 2231891 - RNA, 20 nt, Homo sapiens
auuuucuacaucuuuuauac

SEQ ID NO: 2231892 - RNA, 20 nt, Homo sapiens
guauauuuguaaacuacaaa

SEQ ID NO: 2231893 - RNA, 11 nt, Homo sapiens
uccacuaugag

SEQ ID NO: 2231894 - RNA, 17 nt, Homo sapiens
ugggaagucucagcagc

SEQ ID NO: 2231895 - RNA, 23 nt, Homo sapiens
acauggaagguuagagguuuguc

SEQ ID NO: 2231896 - RNA, 23 nt, Homo sapiens
acaucucaauaaagugcuuuaaa

SEQ ID NO: 2231897 - RNA, 15 nt, Homo sapiens
aaaccucuuucccca

SEQ ID NO: 2231898 - RNA, 18 nt, Homo sapiens
caccauccacccugcagg

SEQ ID NO: 2231899 - RNA, 13 nt, Homo sapiens
uugugacgugugu

SEQ ID NO: 2231900 - RNA, 20 nt, Homo sapiens
ccauauuguugaauguuuca

SEQ ID NO: 2231901 - RNA, 23 nt, Homo sapiens
cccaggagacagaccacuugcca

SEQ ID NO: 2231902 - RNA, 17 nt, Homo sapiens
aguccaugaaaauacca

SEQ ID NO: 2231903 - RNA, 21 nt, Homo sapiens
caaucaucaacuaccauucua

SEQ ID NO: 2231904 - RNA, 21 nt, Homo sapiens
agacaaaauuuaauuguguaa

SEQ ID NO: 2231905 - RNA, 15 nt, Homo sapiens
cauaugaacuuucau

SEQ ID NO: 2231906 - RNA, 23 nt, Homo sapiens
gaccucccucccuccccaguguu

SEQ ID NO: 2231907 - RNA, 23 nt, Homo sapiens
aaaacaguuuugucagucuuucu

SEQ ID NO: 2231908 - RNA, 15 nt, Homo sapiens
cugccucaacacuga

SEQ ID NO: 2231909 - RNA, 20 nt, Homo sapiens
ugugccgcaccauugaacug

SEQ ID NO: 2231910 - RNA, 15 nt, Homo sapiens
cuuuuuccuuacugu

SEQ ID NO: 2231911 - RNA, 17 nt, Homo sapiens
aaaguucuguguuuaau

SEQ ID NO: 2231912 - RNA, 19 nt, Homo sapiens
cuucagcuguacauacuca

SEQ ID NO: 2231913 - RNA, 19 nt, Homo sapiens
cuugggacucaggucugua

SEQ ID NO: 2231914 - RNA, 15 nt, Homo sapiens
gcugagcccacucua

SEQ ID NO: 2231915 - RNA, 13 nt, Homo sapiens
aaauaugucccag

SEQ ID NO: 2231916 - RNA, 18 nt, Homo sapiens
uaaugguuuuuaaugucu

SEQ ID NO: 2231917 - RNA, 16 nt, Homo sapiens
uaaugauuagcacuua

SEQ ID NO: 2231918 - RNA, 13 nt, Homo sapiens
aucuccaguggga

SEQ ID NO: 2231919 - RNA, 16 nt, Homo sapiens
aagaugcaucaucucu

SEQ ID NO: 2231920 - RNA, 17 nt, Homo sapiens
acaugcugugcucuuug

SEQ ID NO: 2231921 - RNA, 18 nt, Homo sapiens
ucuuacucuacugcugcu

SEQ ID NO: 2231922 - RNA, 21 nt, Homo sapiens
aacacacucuacaaaaugacu

SEQ ID NO: 2231923 - RNA, 20 nt, Homo sapiens
uugagggcucuaaacaggau

SEQ ID NO: 2231924 - RNA, 14 nt, Homo sapiens
aauaacuaugguaa

SEQ ID NO: 2231925 - RNA, 16 nt, Homo sapiens
guuauuauuuugcacu

SEQ ID NO: 2231926 - RNA, 13 nt, Homo sapiens
caucaaaugucag

SEQ ID NO: 2231927 - RNA, 16 nt, Homo sapiens
gcacuuccaccuccag

SEQ ID NO: 2231928 - RNA, 14 nt, Homo sapiens
aguggcuuugucag

SEQ ID NO: 2231929 - RNA, 22 nt, Homo sapiens
guauauguagauguaugcacac

SEQ ID NO: 2231930 - RNA, 20 nt, Homo sapiens
ugaguuuggaugucuguagc

SEQ ID NO: 2231931 - RNA, 20 nt, Homo sapiens
acacuccuugucaacaaagu

SEQ ID NO: 2231932 - RNA, 15 nt, Homo sapiens
ccaucuaagcugcag

SEQ ID NO: 2231933 - RNA, 15 nt, Homo sapiens
auccugugccuccau

SEQ ID NO: 2231934 - RNA, 22 nt, Homo sapiens
acguuagauuugccguaccaau

SEQ ID NO: 2231935 - RNA, 16 nt, Homo sapiens
aaaggacugauuugau

SEQ ID NO: 2231936 - RNA, 18 nt, Homo sapiens
aggcaggaggaucacuuu

SEQ ID NO: 2231937 - RNA, 21 nt, Homo sapiens
gguugccaccccaacccaaua

SEQ ID NO: 2231938 - RNA, 18 nt, Homo sapiens
guauuuaguaagugcuug

SEQ ID NO: 2231939 - RNA, 12 nt, Homo sapiens
gugaaaugaagc

SEQ ID NO: 2231940 - RNA, 22 nt, Homo sapiens
gccacauggggcugggcagcua

SEQ ID NO: 2231941 - RNA, 21 nt, Homo sapiens
uaauauucuguuuccauagca

SEQ ID NO: 2231942 - RNA, 20 nt, Homo sapiens
cacagauccgcaagaguaaa

SEQ ID NO: 2231943 - RNA, 17 nt, Homo sapiens
auuauacguacauacac

SEQ ID NO: 2231944 - RNA, 17 nt, Homo sapiens
acaaggcuccacaagcg

SEQ ID NO: 2231945 - RNA, 18 nt, Homo sapiens
cugcgcauguuugacuuu

SEQ ID NO: 2231946 - RNA, 14 nt, Homo sapiens
guuacacauaacuu

SEQ ID NO: 2231947 - RNA, 19 nt, Homo sapiens
uucauguaauagcaaugca

SEQ ID NO: 2231948 - RNA, 10 nt, Homo sapiens
aaugacauuc

SEQ ID NO: 2231949 - RNA, 12 nt, Homo sapiens
uauccaauucaa

SEQ ID NO: 2231950 - RNA, 10 nt, Homo sapiens
gcugcaucuc

SEQ ID NO: 2231951 - RNA, 14 nt, Homo sapiens
agagaaaugaauua

SEQ ID NO: 2231952 - RNA, 13 nt, Homo sapiens
aggaaaaugccuc

SEQ ID NO: 2231953 - RNA, 22 nt, Homo sapiens
auggucacaagcacaaagcuca

SEQ ID NO: 2231954 - RNA, 13 nt, Homo sapiens
uugccugcagauu

SEQ ID NO: 2231955 - RNA, 15 nt, Homo sapiens
aauuuauaacuuacu

SEQ ID NO: 2231956 - RNA, 17 nt, Homo sapiens
cacagcaacaaugacuu

SEQ ID NO: 2231957 - RNA, 16 nt, Homo sapiens
augagaaucaccccuc

SEQ ID NO: 2231958 - RNA, 19 nt, Homo sapiens
cuuuaccccucauccaaag

SEQ ID NO: 2231959 - RNA, 13 nt, Homo sapiens
uacccuauauguc

SEQ ID NO: 2231960 - RNA, 17 nt, Homo sapiens
ugguugccucucuugcc

SEQ ID NO: 2231961 - RNA, 18 nt, Homo sapiens
gaacccuggcauuuggcc

SEQ ID NO: 2231962 - RNA, 15 nt, Homo sapiens
augaaggcgugcaag

SEQ ID NO: 2231963 - RNA, 22 nt, Homo sapiens
ggacaaggagugugaccacuga

SEQ ID NO: 2231964 - RNA, 16 nt, Homo sapiens
auuuauugagugccaa

SEQ ID NO: 2231965 - RNA, 13 nt, Homo sapiens
cagcucccauuuc

SEQ ID NO: 2231966 - RNA, 15 nt, Homo sapiens
gaaaaggaaguuaug

SEQ ID NO: 2231967 - RNA, 20 nt, Homo sapiens
agugaaacguaauuguacaa

SEQ ID NO: 2231968 - RNA, 14 nt, Homo sapiens
ugccgucugugcuu

SEQ ID NO: 2231969 - RNA, 13 nt, Homo sapiens
gguccugauccca

SEQ ID NO: 2231970 - RNA, 19 nt, Homo sapiens
cucagaugcacaugagcug

SEQ ID NO: 2231971 - RNA, 17 nt, Homo sapiens
gcccaggagcggcgaug

SEQ ID NO: 2231972 - RNA, 13 nt, Homo sapiens
auauguagcaaaa

SEQ ID NO: 2231973 - RNA, 14 nt, Homo sapiens
ugugauaaucagaa

SEQ ID NO: 2231974 - RNA, 17 nt, Homo sapiens
uguuuuauuguaaucau

SEQ ID NO: 2231975 - RNA, 20 nt, Homo sapiens
caaugcuggaaacauucacu

SEQ ID NO: 2231976 - RNA, 13 nt, Homo sapiens
uucuugguauuau

SEQ ID NO: 2231977 - RNA, 19 nt, Homo sapiens
ggaaagaagaguuggagug

SEQ ID NO: 2231978 - RNA, 13 nt, Homo sapiens
gcuuguugcuguu

SEQ ID NO: 2231979 - RNA, 12 nt, Homo sapiens
aauaaaacaaca

SEQ ID NO: 2231980 - RNA, 18 nt, Homo sapiens
auuaugaugaaaaccuac

SEQ ID NO: 2231981 - RNA, 17 nt, Homo sapiens
aaagcguuugcauuugc

SEQ ID NO: 2231982 - RNA, 18 nt, Homo sapiens
cacccacccuguggcuca

SEQ ID NO: 2231983 - RNA, 12 nt, Homo sapiens
cuucuuugccca

SEQ ID NO: 2231984 - RNA, 19 nt, Homo sapiens
uguggugccggugcuucca

SEQ ID NO: 2231985 - RNA, 13 nt, Homo sapiens
uaguuaauccaaa

SEQ ID NO: 2231986 - RNA, 15 nt, Homo sapiens
aaaauaugaccacac

SEQ ID NO: 2231987 - RNA, 18 nt, Homo sapiens
auucccaagcuuuuggag

SEQ ID NO: 2231988 - RNA, 15 nt, Homo sapiens
uuaccuuuucagggc

SEQ ID NO: 2231989 - RNA, 15 nt, Homo sapiens
ugcgagggaagcaau

SEQ ID NO: 2231990 - RNA, 19 nt, Homo sapiens
gaaccauccaguacuugug

SEQ ID NO: 2231991 - RNA, 12 nt, Homo sapiens
acaucacagggc

SEQ ID NO: 2231992 - RNA, 17 nt, Homo sapiens
gacugcaauuucuccaa

SEQ ID NO: 2231993 - RNA, 15 nt, Homo sapiens
caguugcaaugauca

SEQ ID NO: 2231994 - RNA, 16 nt, Homo sapiens
aagaacuugucccuca

SEQ ID NO: 2231995 - RNA, 13 nt, Homo sapiens
auucagcucuuaa

SEQ ID NO: 2231996 - RNA, 18 nt, Homo sapiens
agcugccuggaggccaga

SEQ ID NO: 2231997 - RNA, 23 nt, Homo sapiens
cacgagcaaagugaagacacugg

SEQ ID NO: 2231998 - RNA, 17 nt, Homo sapiens
acugagccagucuuuga

SEQ ID NO: 2231999 - RNA, 18 nt, Homo sapiens
gacuugaauagacacuuc

SEQ ID NO: 2232000 - RNA, 22 nt, Homo sapiens
cuagucuuauggaaagcaaaua

SEQ ID NO: 2232001 - RNA, 18 nt, Homo sapiens
cuccugcucugcuuccuc

SEQ ID NO: 2232002 - RNA, 23 nt, Homo sapiens
gcagagaaaaaaaaaaacuuaaa

SEQ ID NO: 2232003 - RNA, 23 nt, Homo sapiens
aagcucugcuccucuccccagca

SEQ ID NO: 2232004 - RNA, 20 nt, Homo sapiens
ucaauccugcccccagccau

SEQ ID NO: 2232005 - RNA, 14 nt, Homo sapiens
ccuuggcuugccau

SEQ ID NO: 2232006 - RNA, 14 nt, Homo sapiens
cugugcuacugaaa

SEQ ID NO: 2232007 - RNA, 21 nt, Homo sapiens
ugugcaagguauuacacucug

SEQ ID NO: 2232008 - RNA, 17 nt, Homo sapiens
uuggaauaaucacuugg

SEQ ID NO: 2232009 - RNA, 20 nt, Homo sapiens
ugaauuagagcuacuuugag

SEQ ID NO: 2232010 - RNA, 16 nt, Homo sapiens
ugaauuuuggcugugu

SEQ ID NO: 2232011 - RNA, 19 nt, Homo sapiens
auagagaauuuagaaauga

SEQ ID NO: 2232012 - RNA, 22 nt, Homo sapiens
cacagucuggugcccagacuca

SEQ ID NO: 2232013 - RNA, 18 nt, Homo sapiens
cagaggagaagcaauggg

SEQ ID NO: 2232014 - RNA, 19 nt, Homo sapiens
ggcucugaugcagaacuuu

SEQ ID NO: 2232015 - RNA, 17 nt, Homo sapiens
aucccaguucuuccugc

SEQ ID NO: 2232016 - RNA, 22 nt, Homo sapiens
cuuuccagggucaaaguacaga

SEQ ID NO: 2232017 - RNA, 19 nt, Homo sapiens
acucuggagagacugugcu

SEQ ID NO: 2232018 - RNA, 12 nt, Homo sapiens
aacacucaugaa

SEQ ID NO: 2232019 - RNA, 21 nt, Homo sapiens
aacaugaagaagaccuuuaca

SEQ ID NO: 2232020 - RNA, 15 nt, Homo sapiens
uugaacuguuuaaca

SEQ ID NO: 2232021 - RNA, 17 nt, Homo sapiens
agaugggggaacuguga

SEQ ID NO: 2232022 - RNA, 17 nt, Homo sapiens
cuuucacauagcacaga

SEQ ID NO: 2232023 - RNA, 13 nt, Homo sapiens
cugaugcaagcaa

SEQ ID NO: 2232024 - RNA, 23 nt, Homo sapiens
cagggcacuacauaauugcuguu

SEQ ID NO: 2232025 - RNA, 22 nt, Homo sapiens
cagccucagcugggaacaugug

SEQ ID NO: 2232026 - RNA, 21 nt, Homo sapiens
auuaaacugugaauguuccaa

SEQ ID NO: 2232027 - RNA, 17 nt, Homo sapiens
agccuggggcucccucu

SEQ ID NO: 2232028 - RNA, 14 nt, Homo sapiens
caagugcugucuug

SEQ ID NO: 2232029 - RNA, 22 nt, Homo sapiens
ugaaucacugcaccucuuuguc

SEQ ID NO: 2232030 - RNA, 11 nt, Homo sapiens
uaccacaggaa

SEQ ID NO: 2232031 - RNA, 23 nt, Homo sapiens
ugcaaaucguguaucugacaaaa

SEQ ID NO: 2232032 - RNA, 15 nt, Homo sapiens
uuguugcaguucaga

SEQ ID NO: 2232033 - RNA, 18 nt, Homo sapiens
uaauggaaacaugcugua

SEQ ID NO: 2232034 - RNA, 17 nt, Homo sapiens
uguuaaaccaugggaua

SEQ ID NO: 2232035 - RNA, 16 nt, Homo sapiens
cuuucuagagccagca

SEQ ID NO: 2232036 - RNA, 15 nt, Homo sapiens
uuaaauauuucuuaa

SEQ ID NO: 2232037 - RNA, 20 nt, Homo sapiens
accaauuccugacacuugau

SEQ ID NO: 2232038 - RNA, 16 nt, Homo sapiens
gucauuuccaccagca

SEQ ID NO: 2232039 - RNA, 23 nt, Homo sapiens
aacuccuuguuucagaugauucu

SEQ ID NO: 2232040 - RNA, 20 nt, Homo sapiens
ugaaggaaccagcaaugaga

SEQ ID NO: 2232041 - RNA, 21 nt, Homo sapiens
ugcugcuccuuagcugccaag

SEQ ID NO: 2232042 - RNA, 16 nt, Homo sapiens
aggaaaaaauaauauc

SEQ ID NO: 2232043 - RNA, 22 nt, Homo sapiens
cugcccagacacagacuggcaa

SEQ ID NO: 2232044 - RNA, 16 nt, Homo sapiens
ucagcauuggccucug

SEQ ID NO: 2232045 - RNA, 22 nt, Homo sapiens
uacuugaaauuuggcuaauaac

SEQ ID NO: 2232046 - RNA, 13 nt, Homo sapiens
gucuaauuugcac

SEQ ID NO: 2232047 - RNA, 17 nt, Homo sapiens
ugugggugccuuccaua

SEQ ID NO: 2232048 - RNA, 20 nt, Homo sapiens
cuguucugggggacagagaa

SEQ ID NO: 2232049 - RNA, 16 nt, Homo sapiens
uuggaucuggcauuga

SEQ ID NO: 2232050 - RNA, 20 nt, Homo sapiens
gagugagacuccaccucaaa

SEQ ID NO: 2232051 - RNA, 19 nt, Homo sapiens
acuuaagguugggugcugc

SEQ ID NO: 2232052 - RNA, 21 nt, Homo sapiens
gacugugaacgugaauaggcu

SEQ ID NO: 2232053 - RNA, 17 nt, Homo sapiens
aaauacagauagauaua

SEQ ID NO: 2232054 - RNA, 23 nt, Homo sapiens
ugcuugauauaauaauuacuuaa

SEQ ID NO: 2232055 - RNA, 21 nt, Homo sapiens
cagagaguguacaucauguua

SEQ ID NO: 2232056 - RNA, 15 nt, Homo sapiens
gauguguaaauggag

SEQ ID NO: 2232057 - RNA, 16 nt, Homo sapiens
ccagucauuguacugu

SEQ ID NO: 2232058 - RNA, 17 nt, Homo sapiens
uaacuauaacaaucacu

SEQ ID NO: 2232059 - RNA, 21 nt, Homo sapiens
ggaaauaaauuugaaauguaa

SEQ ID NO: 2232060 - RNA, 22 nt, Homo sapiens
auuguaaaagcaacaucagcuu

SEQ ID NO: 2232061 - RNA, 13 nt, Homo sapiens
uguaugugcauua

SEQ ID NO: 2232062 - RNA, 21 nt, Homo sapiens
acccugucuaggcacaugugg

SEQ ID NO: 2232063 - RNA, 17 nt, Homo sapiens
aaguuuagcucugagaa

SEQ ID NO: 2232064 - RNA, 19 nt, Homo sapiens
aauuaagagauacauuccc

SEQ ID NO: 2232065 - RNA, 21 nt, Homo sapiens
caguuuuaucuuuaaucuccu

SEQ ID NO: 2232066 - RNA, 13 nt, Homo sapiens
uagucaaaggcag

SEQ ID NO: 2232067 - RNA, 15 nt, Homo sapiens
uuucccuaaagggga

SEQ ID NO: 2232068 - RNA, 12 nt, Homo sapiens
cagcuuggcacu

SEQ ID NO: 2232069 - RNA, 22 nt, Homo sapiens
acgggcaugggccucucugggg

SEQ ID NO: 2232070 - RNA, 23 nt, Homo sapiens
uguuaagccauguguuccaaggc

SEQ ID NO: 2232071 - RNA, 23 nt, Homo sapiens
acccuccguuuuucuacuagaua

SEQ ID NO: 2232072 - RNA, 21 nt, Homo sapiens
cucccuaggcugcccacucuc

SEQ ID NO: 2232073 - RNA, 18 nt, Homo sapiens
cacccagaccccaggcug

SEQ ID NO: 2232074 - RNA, 23 nt, Homo sapiens
acuccacagcggaggagaccagc

SEQ ID NO: 2232075 - RNA, 15 nt, Homo sapiens
guacaguuugcugua

SEQ ID NO: 2232076 - RNA, 22 nt, Homo sapiens
aaaaaucuaagauucauguguu

SEQ ID NO: 2232077 - RNA, 18 nt, Homo sapiens
aaaguaauauaaugaugc

SEQ ID NO: 2232078 - RNA, 11 nt, Homo sapiens
ugugauucuau

SEQ ID NO: 2232079 - RNA, 14 nt, Homo sapiens
gugggcacugcuga

SEQ ID NO: 2232080 - RNA, 13 nt, Homo sapiens
ccagggcaucaca

SEQ ID NO: 2232081 - RNA, 13 nt, Homo sapiens
cuucggcauuuga

SEQ ID NO: 2232082 - RNA, 23 nt, Homo sapiens
ccccuuguccucucagagccuca

SEQ ID NO: 2232083 - RNA, 17 nt, Homo sapiens
aucuaauuacagccuua

SEQ ID NO: 2232084 - RNA, 16 nt, Homo sapiens
aauauuuucauuguga

SEQ ID NO: 2232085 - RNA, 14 nt, Homo sapiens
ugagcaaacaaaac

SEQ ID NO: 2232086 - RNA, 12 nt, Homo sapiens
uugaacuuggaa

SEQ ID NO: 2232087 - RNA, 14 nt, Homo sapiens
ggcuguggagcaaa

SEQ ID NO: 2232088 - RNA, 22 nt, Homo sapiens
aauaaagccuugugaucacuuu

SEQ ID NO: 2232089 - RNA, 14 nt, Homo sapiens
cccaucugcuucag

SEQ ID NO: 2232090 - RNA, 11 nt, Homo sapiens
uauauucacag

SEQ ID NO: 2232091 - RNA, 13 nt, Homo sapiens
uggagguugcauu

SEQ ID NO: 2232092 - RNA, 15 nt, Homo sapiens
ugauucauaagacac

SEQ ID NO: 2232093 - RNA, 14 nt, Homo sapiens
gggagugugccuug

SEQ ID NO: 2232094 - RNA, 18 nt, Homo sapiens
auugcaugccaucuccac

SEQ ID NO: 2232095 - RNA, 19 nt, Homo sapiens
ggaaggucuccccaugugc

SEQ ID NO: 2232096 - RNA, 18 nt, Homo sapiens
auggaucccuggggccaa

SEQ ID NO: 2232097 - RNA, 13 nt, Homo sapiens
ucugcaugaagga

SEQ ID NO: 2232098 - RNA, 20 nt, Homo sapiens
cugggagagccuuccagggg

SEQ ID NO: 2232099 - RNA, 13 nt, Homo sapiens
uaaaagcauuuaa

SEQ ID NO: 2232100 - RNA, 13 nt, Homo sapiens
uaagugcauuugu

SEQ ID NO: 2232101 - RNA, 13 nt, Homo sapiens
cauuugcacuauu

SEQ ID NO: 2232102 - RNA, 20 nt, Homo sapiens
auucaagacaagagcuguua

SEQ ID NO: 2232103 - RNA, 18 nt, Homo sapiens
ccccaguucuacugaccu

SEQ ID NO: 2232104 - RNA, 19 nt, Homo sapiens
agcaguuguuauuuaguga

SEQ ID NO: 2232105 - RNA, 19 nt, Homo sapiens
gacauuaaaaauguuagua

SEQ ID NO: 2232106 - RNA, 18 nt, Homo sapiens
cauuaaauucacaaacuu

SEQ ID NO: 2232107 - RNA, 14 nt, Homo sapiens
agcguuaacacaaa

SEQ ID NO: 2232108 - RNA, 16 nt, Homo sapiens
uuuccaggagcauaga

SEQ ID NO: 2232109 - RNA, 15 nt, Homo sapiens
ucaauucaguucuag

SEQ ID NO: 2232110 - RNA, 11 nt, Homo sapiens
cuccccugugu

SEQ ID NO: 2232111 - RNA, 11 nt, Homo sapiens
cuucccugugc

SEQ ID NO: 2232112 - RNA, 17 nt, Homo sapiens
aagcaauaacuccaagc

SEQ ID NO: 2232113 - RNA, 13 nt, Homo sapiens
ccacuauuuccau

SEQ ID NO: 2232114 - RNA, 17 nt, Homo sapiens
aucucuucagucucuau

SEQ ID NO: 2232115 - RNA, 21 nt, Homo sapiens
acccacaaguauugcccuuua

SEQ ID NO: 2232116 - RNA, 22 nt, Homo sapiens
aaaguguauugcaagugaaaua

SEQ ID NO: 2232117 - RNA, 18 nt, Homo sapiens
uuguauuuauuuccagac

SEQ ID NO: 2232118 - RNA, 13 nt, Homo sapiens
ugaagcuuuuugu

SEQ ID NO: 2232119 - RNA, 16 nt, Homo sapiens
uagccaggauggucuc

SEQ ID NO: 2232120 - RNA, 20 nt, Homo sapiens
ccugguuuucgucaucuucc

SEQ ID NO: 2232121 - RNA, 11 nt, Homo sapiens
ucgagaucuca

SEQ ID NO: 2232122 - RNA, 17 nt, Homo sapiens
gaccccaauauauguau

SEQ ID NO: 2232123 - RNA, 17 nt, Homo sapiens
guggaaaauuggcagug

SEQ ID NO: 2232124 - RNA, 23 nt, Homo sapiens
cuacuuugaaauauuuaauuucc

SEQ ID NO: 2232125 - RNA, 13 nt, Homo sapiens
acuagccaucuca

SEQ ID NO: 2232126 - RNA, 12 nt, Homo sapiens
gccuuacuguug

SEQ ID NO: 2232127 - RNA, 17 nt, Homo sapiens
aauuuaaggccugcacu

SEQ ID NO: 2232128 - RNA, 15 nt, Homo sapiens
aacagccccaaaguc

SEQ ID NO: 2232129 - RNA, 16 nt, Homo sapiens
cagugguauccuguga

SEQ ID NO: 2232130 - RNA, 17 nt, Homo sapiens
caaccagagcacuguau

SEQ ID NO: 2232131 - RNA, 17 nt, Homo sapiens
gagaccaggccugagca

SEQ ID NO: 2232132 - RNA, 22 nt, Homo sapiens
cagacucucauuccuuuccucu

SEQ ID NO: 2232133 - RNA, 14 nt, Homo sapiens
aauuccacaaugaa

SEQ ID NO: 2232134 - RNA, 19 nt, Homo sapiens
auuuuaucuaaauuacagu

SEQ ID NO: 2232135 - RNA, 15 nt, Homo sapiens
uguuccccaucaucu

SEQ ID NO: 2232136 - RNA, 14 nt, Homo sapiens
ucaguaacaaguau

SEQ ID NO: 2232137 - RNA, 22 nt, Homo sapiens
ugcauaaauauuagcaaagcau

SEQ ID NO: 2232138 - RNA, 13 nt, Homo sapiens
uuauaacaagugu

SEQ ID NO: 2232139 - RNA, 23 nt, Homo sapiens
ccccagcuuugcccaacaccagc

SEQ ID NO: 2232140 - RNA, 19 nt, Homo sapiens
uacugucaaacaauaaagg

SEQ ID NO: 2232141 - RNA, 19 nt, Homo sapiens
aauuauccuguaguacaag

SEQ ID NO: 2232142 - RNA, 21 nt, Homo sapiens
acaaagcaaagccacauuuug

SEQ ID NO: 2232143 - RNA, 18 nt, Homo sapiens
auucgcagugcccaguga

SEQ ID NO: 2232144 - RNA, 16 nt, Homo sapiens
auucaugauugcccaa

SEQ ID NO: 2232145 - RNA, 15 nt, Homo sapiens
aucucugauuacagu

SEQ ID NO: 2232146 - RNA, 22 nt, Homo sapiens
acagauuugagcucagcccugg

SEQ ID NO: 2232147 - RNA, 19 nt, Homo sapiens
auccuagauuauaucaaag

SEQ ID NO: 2232148 - RNA, 21 nt, Homo sapiens
agcugcguuuuuuuauaguag

SEQ ID NO: 2232149 - RNA, 12 nt, Homo sapiens
cucauagaaacu

SEQ ID NO: 2232150 - RNA, 20 nt, Homo sapiens
uacauucuugcuaauucuca

SEQ ID NO: 2232151 - RNA, 16 nt, Homo sapiens
ugagugcuccugugug

SEQ ID NO: 2232152 - RNA, 13 nt, Homo sapiens
cagugaacacuca

SEQ ID NO: 2232153 - RNA, 12 nt, Homo sapiens
gaagaaacugcu

SEQ ID NO: 2232154 - RNA, 21 nt, Homo sapiens
uggcucaccugaagcaugaaa

SEQ ID NO: 2232155 - RNA, 17 nt, Homo sapiens
gcccucucauucucacu

SEQ ID NO: 2232156 - RNA, 17 nt, Homo sapiens
ggcugucuugguggaug

SEQ ID NO: 2232157 - RNA, 15 nt, Homo sapiens
uaaugcuuuuacuaa

SEQ ID NO: 2232158 - RNA, 21 nt, Homo sapiens
uuaauggcagcuagugccuuu

SEQ ID NO: 2232159 - RNA, 18 nt, Homo sapiens
cuuuaaauccuaccaaag

SEQ ID NO: 2232160 - RNA, 18 nt, Homo sapiens
gaagccccauuugcacag

SEQ ID NO: 2232161 - RNA, 22 nt, Homo sapiens
cacgguggagagaaagugacau

SEQ ID NO: 2232162 - RNA, 12 nt, Homo sapiens
aaguuuaugcau

SEQ ID NO: 2232163 - RNA, 14 nt, Homo sapiens
aucaaacauaauga

SEQ ID NO: 2232164 - RNA, 17 nt, Homo sapiens
gaucagcgacugccaca

SEQ ID NO: 2232165 - RNA, 14 nt, Homo sapiens
aauaugccagugac

SEQ ID NO: 2232166 - RNA, 17 nt, Homo sapiens
agaaccacucauaauuc

SEQ ID NO: 2232167 - RNA, 16 nt, Homo sapiens
gccacuuagacacuuu

SEQ ID NO: 2232168 - RNA, 12 nt, Homo sapiens
agaauggagcug

SEQ ID NO: 2232169 - RNA, 22 nt, Homo sapiens
caggugauccacccaccuuggc

SEQ ID NO: 2232170 - RNA, 14 nt, Homo sapiens
gucuuugaacacac

SEQ ID NO: 2232171 - RNA, 21 nt, Homo sapiens
aaauaauugcuccuauacuau

SEQ ID NO: 2232172 - RNA, 21 nt, Homo sapiens
cagaaaucugggauguacugu

SEQ ID NO: 2232173 - RNA, 19 nt, Homo sapiens
uaguugcuuugcggcaucu

SEQ ID NO: 2232174 - RNA, 14 nt, Homo sapiens
aacacacaugcaca

SEQ ID NO: 2232175 - RNA, 15 nt, Homo sapiens
cuaagggguggggcu

SEQ ID NO: 2232176 - RNA, 21 nt, Homo sapiens
cagauccucugcugacuccau

SEQ ID NO: 2232177 - RNA, 13 nt, Homo sapiens
acccuguccaaac

SEQ ID NO: 2232178 - RNA, 17 nt, Homo sapiens
cucaugcagaagccuga

SEQ ID NO: 2232179 - RNA, 18 nt, Homo sapiens
gaucaacauuuaugaccu

SEQ ID NO: 2232180 - RNA, 13 nt, Homo sapiens
acugaaaccaaaa

SEQ ID NO: 2232181 - RNA, 18 nt, Homo sapiens
uaaaaggaccucggggaa

SEQ ID NO: 2232182 - RNA, 14 nt, Homo sapiens
uggguguacauuuu

SEQ ID NO: 2232183 - RNA, 17 nt, Homo sapiens
ucacagugacacuggac

SEQ ID NO: 2232184 - RNA, 21 nt, Homo sapiens
gaaguuacuguuacuugauaa

SEQ ID NO: 2232185 - RNA, 18 nt, Homo sapiens
agguccuugacuugauga

SEQ ID NO: 2232186 - RNA, 22 nt, Homo sapiens
ccaagaacauaaacccuccaag

SEQ ID NO: 2232187 - RNA, 15 nt, Homo sapiens
acauccaucccucca

SEQ ID NO: 2232188 - RNA, 22 nt, Homo sapiens
cuuggcuuacugcagccuuugc

SEQ ID NO: 2232189 - RNA, 19 nt, Homo sapiens
aauuauuguuauacacagc

SEQ ID NO: 2232190 - RNA, 14 nt, Homo sapiens
gccuucucccucau

SEQ ID NO: 2232191 - RNA, 22 nt, Homo sapiens
ucagagcuuucaaggauaggcu

SEQ ID NO: 2232192 - RNA, 15 nt, Homo sapiens
caagaucaacauucc

SEQ ID NO: 2232193 - RNA, 17 nt, Homo sapiens
agucugucaauguccua

SEQ ID NO: 2232194 - RNA, 18 nt, Homo sapiens
cagggucccugcuguguu

SEQ ID NO: 2232195 - RNA, 19 nt, Homo sapiens
ugucacccuggauaggcaa

SEQ ID NO: 2232196 - RNA, 18 nt, Homo sapiens
cuccaccccgacugcuca

SEQ ID NO: 2232197 - RNA, 18 nt, Homo sapiens
aggagcgcccucuaggga

SEQ ID NO: 2232198 - RNA, 16 nt, Homo sapiens
cuucggacuauuuucc

SEQ ID NO: 2232199 - RNA, 23 nt, Homo sapiens
uucuguugugauauaaaucacag

SEQ ID NO: 2232200 - RNA, 16 nt, Homo sapiens
cccagcucagugccac

SEQ ID NO: 2232201 - RNA, 23 nt, Homo sapiens
cucaguuauuacauguaauuuga

SEQ ID NO: 2232202 - RNA, 23 nt, Homo sapiens
gaagggauuguuguguagucaag

SEQ ID NO: 2232203 - RNA, 14 nt, Homo sapiens
cucuauugcugcuc

SEQ ID NO: 2232204 - RNA, 14 nt, Homo sapiens
cuguauugcuccuc

SEQ ID NO: 2232205 - RNA, 21 nt, Homo sapiens
gaggcagaggguugcagugag

SEQ ID NO: 2232206 - RNA, 23 nt, Homo sapiens
acagauaaugcuuuuacuaagca

SEQ ID NO: 2232207 - RNA, 19 nt, Homo sapiens
gaaacaugacacugaccuu

SEQ ID NO: 2232208 - RNA, 18 nt, Homo sapiens
cacaaucuacacugccuu

SEQ ID NO: 2232209 - RNA, 16 nt, Homo sapiens
gagcacagaaggaaua

SEQ ID NO: 2232210 - RNA, 15 nt, Homo sapiens
cuacccacuucuccc

SEQ ID NO: 2232211 - RNA, 17 nt, Homo sapiens
cguucaaacugcuggaa

SEQ ID NO: 2232212 - RNA, 14 nt, Homo sapiens
ucccauccuugaug

SEQ ID NO: 2232213 - RNA, 14 nt, Homo sapiens
caugaagugcacag

SEQ ID NO: 2232214 - RNA, 17 nt, Homo sapiens
uuuacugagacaaugua

SEQ ID NO: 2232215 - RNA, 15 nt, Homo sapiens
ugucugacuucucag

SEQ ID NO: 2232216 - RNA, 16 nt, Homo sapiens
uguauuuugacacugg

SEQ ID NO: 2232217 - RNA, 15 nt, Homo sapiens
agcuaccucaaccaa

SEQ ID NO: 2232218 - RNA, 11 nt, Homo sapiens
uuuaccugcac

SEQ ID NO: 2232219 - RNA, 21 nt, Homo sapiens
ugggggacaugcuaaauaacu

SEQ ID NO: 2232220 - RNA, 22 nt, Homo sapiens
ugcucacgucaaaugcauacaa

SEQ ID NO: 2232221 - RNA, 14 nt, Homo sapiens
uuuguucaugaaua

SEQ ID NO: 2232222 - RNA, 21 nt, Homo sapiens
acuugucauuucuacuuucag

SEQ ID NO: 2232223 - RNA, 16 nt, Homo sapiens
caguagggaccugccc

SEQ ID NO: 2232224 - RNA, 14 nt, Homo sapiens
ucccaucugcuuua

SEQ ID NO: 2232225 - RNA, 23 nt, Homo sapiens
agccaagggguagaaguggcaua

SEQ ID NO: 2232226 - RNA, 14 nt, Homo sapiens
ugagcauggagcug

SEQ ID NO: 2232227 - RNA, 22 nt, Homo sapiens
uagagaagccggcucuucaaag

SEQ ID NO: 2232228 - RNA, 11 nt, Homo sapiens
agcaacccagg

SEQ ID NO: 2232229 - RNA, 17 nt, Homo sapiens
gauuuggacugcauuua

SEQ ID NO: 2232230 - RNA, 23 nt, Homo sapiens
gaaugaaaauaacugaaccaaau

SEQ ID NO: 2232231 - RNA, 13 nt, Homo sapiens
agguuccccagag

SEQ ID NO: 2232232 - RNA, 13 nt, Homo sapiens
ccacauuggacuu

SEQ ID NO: 2232233 - RNA, 14 nt, Homo sapiens
ccugcccuuggcac

SEQ ID NO: 2232234 - RNA, 18 nt, Homo sapiens
gauguucugguaaacuga

SEQ ID NO: 2232235 - RNA, 16 nt, Homo sapiens
aaaauggucucuaaca

SEQ ID NO: 2232236 - RNA, 17 nt, Homo sapiens
aaguucuggaucuuaua

SEQ ID NO: 2232237 - RNA, 16 nt, Homo sapiens
cuccugcuucaugggc

SEQ ID NO: 2232238 - RNA, 19 nt, Homo sapiens
aguaacagugcaguacuca

SEQ ID NO: 2232239 - RNA, 21 nt, Homo sapiens
caguuuccagaugcuaucaca

SEQ ID NO: 2232240 - RNA, 19 nt, Homo sapiens
acccuccccaggucuucca

SEQ ID NO: 2232241 - RNA, 18 nt, Homo sapiens
cuuccaaaugucccucca

SEQ ID NO: 2232242 - RNA, 16 nt, Homo sapiens
ccuccaagucacaaag

SEQ ID NO: 2232243 - RNA, 17 nt, Homo sapiens
acaaaguguauacaugu

SEQ ID NO: 2232244 - RNA, 17 nt, Homo sapiens
gcugagaggaagcaaga

SEQ ID NO: 2232245 - RNA, 14 nt, Homo sapiens
caccugcccaagaa

SEQ ID NO: 2232246 - RNA, 13 nt, Homo sapiens
aguuuugccaagg

SEQ ID NO: 2232247 - RNA, 23 nt, Homo sapiens
guggaggggcauagccuuucccu

SEQ ID NO: 2232248 - RNA, 13 nt, Homo sapiens
ccuccugugggga

SEQ ID NO: 2232249 - RNA, 17 nt, Homo sapiens
uccaaaucucauguuca

SEQ ID NO: 2232250 - RNA, 17 nt, Homo sapiens
uaaaaauaaacuguuau

SEQ ID NO: 2232251 - RNA, 15 nt, Homo sapiens
caccaagacugagaa

SEQ ID NO: 2232252 - RNA, 18 nt, Homo sapiens
cuuggaccucgugcuuua

SEQ ID NO: 2232253 - RNA, 15 nt, Homo sapiens
acacuauccaaugaa

SEQ ID NO: 2232254 - RNA, 20 nt, Homo sapiens
uuagaaugucaguugaucag

SEQ ID NO: 2232255 - RNA, 15 nt, Homo sapiens
uggacaucuucacga

SEQ ID NO: 2232256 - RNA, 12 nt, Homo sapiens
ucuucuuccaau

SEQ ID NO: 2232257 - RNA, 17 nt, Homo sapiens
acauucagagcuuacuu

SEQ ID NO: 2232258 - RNA, 16 nt, Homo sapiens
agaagaccagauccaa

SEQ ID NO: 2232259 - RNA, 17 nt, Homo sapiens
auacacauacacgguau

SEQ ID NO: 2232260 - RNA, 15 nt, Homo sapiens
gcugucuuggucacu

SEQ ID NO: 2232261 - RNA, 15 nt, Homo sapiens
ggucuggugcugagg

SEQ ID NO: 2232262 - RNA, 17 nt, Homo sapiens
aaguuuagugcccucau

SEQ ID NO: 2232263 - RNA, 17 nt, Homo sapiens
gccggcucuucaaagac

SEQ ID NO: 2232264 - RNA, 13 nt, Homo sapiens
cgucuuccuccaa

SEQ ID NO: 2232265 - RNA, 23 nt, Homo sapiens
uuagguggugguagagaagcaag

SEQ ID NO: 2232266 - RNA, 15 nt, Homo sapiens
aagggggacagugau

SEQ ID NO: 2232267 - RNA, 17 nt, Homo sapiens
uaagaauuucacaagcu

SEQ ID NO: 2232268 - RNA, 18 nt, Homo sapiens
gugcaugugagcacaugc

SEQ ID NO: 2232269 - RNA, 20 nt, Homo sapiens
uaaaaagguuuacagaauuu

SEQ ID NO: 2232270 - RNA, 16 nt, Homo sapiens
cuagaccuggugcuga

SEQ ID NO: 2232271 - RNA, 14 nt, Homo sapiens
aggcuggcagauuu

SEQ ID NO: 2232272 - RNA, 15 nt, Homo sapiens
gauguaguaucucau

SEQ ID NO: 2232273 - RNA, 22 nt, Homo sapiens
acauucuuguuuuaagugccuu

SEQ ID NO: 2232274 - RNA, 12 nt, Homo sapiens
acaauccuccaa

SEQ ID NO: 2232275 - RNA, 20 nt, Homo sapiens
cugauggugaaaccaaacaa

SEQ ID NO: 2232276 - RNA, 21 nt, Homo sapiens
acagaguaugaucucagggca

SEQ ID NO: 2232277 - RNA, 13 nt, Homo sapiens
ggcugugccaaca

SEQ ID NO: 2232278 - RNA, 17 nt, Homo sapiens
cccugacuucuggagau

SEQ ID NO: 2232279 - RNA, 13 nt, Homo sapiens
aggugcucagccc

SEQ ID NO: 2232280 - RNA, 16 nt, Homo sapiens
gaccccgccucaccaa

SEQ ID NO: 2232281 - RNA, 22 nt, Homo sapiens
cuguauugucugaacuugcauu

SEQ ID NO: 2232282 - RNA, 18 nt, Homo sapiens
uauuuuuucaauguuucu

SEQ ID NO: 2232283 - RNA, 16 nt, Homo sapiens
cagucccccugugcau

SEQ ID NO: 2232284 - RNA, 20 nt, Homo sapiens
ugucuucagcacccucauaa

SEQ ID NO: 2232285 - RNA, 16 nt, Homo sapiens
gauuggccuccagggc

SEQ ID NO: 2232286 - RNA, 15 nt, Homo sapiens
uaaagugcugcagua

SEQ ID NO: 2232287 - RNA, 14 nt, Homo sapiens
gccuugaauuggga

SEQ ID NO: 2232288 - RNA, 17 nt, Homo sapiens
cuucuguguagucaaua

SEQ ID NO: 2232289 - RNA, 21 nt, Homo sapiens
uugagaaacaguuccauucaa

SEQ ID NO: 2232290 - RNA, 14 nt, Homo sapiens
ucagcucucugcag

SEQ ID NO: 2232291 - RNA, 23 nt, Homo sapiens
ggaaccgcaggaagcugcuccgu

SEQ ID NO: 2232292 - RNA, 11 nt, Homo sapiens
cugaacaaagc

SEQ ID NO: 2232293 - RNA, 17 nt, Homo sapiens
accagccccucacaggc

SEQ ID NO: 2232294 - RNA, 16 nt, Homo sapiens
ucuggagccaagucca

SEQ ID NO: 2232295 - RNA, 16 nt, Homo sapiens
uaaacacuggugccaa

SEQ ID NO: 2232296 - RNA, 14 nt, Homo sapiens
accaacauggagaa

SEQ ID NO: 2232297 - RNA, 18 nt, Homo sapiens
uucuuaauuuguaacuuu

SEQ ID NO: 2232298 - RNA, 21 nt, Homo sapiens
cacauggccuaugcacauaug

SEQ ID NO: 2232299 - RNA, 13 nt, Homo sapiens
gacuuggggccag

SEQ ID NO: 2232300 - RNA, 17 nt, Homo sapiens
uuaaugagccaucacua

SEQ ID NO: 2232301 - RNA, 22 nt, Homo sapiens
augauccuaggcauuugcugaa

SEQ ID NO: 2232302 - RNA, 16 nt, Homo sapiens
agaggccaacugccca

SEQ ID NO: 2232303 - RNA, 15 nt, Homo sapiens
uggagaucacagccc

SEQ ID NO: 2232304 - RNA, 18 nt, Homo sapiens
ucucuaaaaacauagaaa

SEQ ID NO: 2232305 - RNA, 16 nt, Homo sapiens
caagcgggccgucucc

SEQ ID NO: 2232306 - RNA, 17 nt, Homo sapiens
aagcaaaagacucugua

SEQ ID NO: 2232307 - RNA, 21 nt, Homo sapiens
uaggaucugucaaagaaaacu

SEQ ID NO: 2232308 - RNA, 13 nt, Homo sapiens
uggcagcacggcc

SEQ ID NO: 2232309 - RNA, 15 nt, Homo sapiens
uuaacuuuauuacaa

SEQ ID NO: 2232310 - RNA, 12 nt, Homo sapiens
uucuacuggaaa

SEQ ID NO: 2232311 - RNA, 18 nt, Homo sapiens
cugaaccuugaggggcua

SEQ ID NO: 2232312 - RNA, 15 nt, Homo sapiens
acucccucugggaag

SEQ ID NO: 2232313 - RNA, 13 nt, Homo sapiens
acauuccaggaaa

SEQ ID NO: 2232314 - RNA, 23 nt, Homo sapiens
gcuacauucuuuuuucuauucaa

SEQ ID NO: 2232315 - RNA, 15 nt, Homo sapiens
ugcaaaguacuguaa

SEQ ID NO: 2232316 - RNA, 12 nt, Homo sapiens
agaaggggacaa

SEQ ID NO: 2232317 - RNA, 22 nt, Homo sapiens
agcggccccccgcacagccacc

SEQ ID NO: 2232318 - RNA, 21 nt, Homo sapiens
uggaaacaaaguggaaggaaa

SEQ ID NO: 2232319 - RNA, 20 nt, Homo sapiens
cggcaggaagccaaagagac

SEQ ID NO: 2232320 - RNA, 16 nt, Homo sapiens
gugaaacagagugauu

SEQ ID NO: 2232321 - RNA, 22 nt, Homo sapiens
uggacaggggcgugggauugaa

SEQ ID NO: 2232322 - RNA, 18 nt, Homo sapiens
cacuacgugccaggcacu

SEQ ID NO: 2232323 - RNA, 15 nt, Homo sapiens
caguguugccuccuc

SEQ ID NO: 2232324 - RNA, 21 nt, Homo sapiens
aggcucucgcacaccucugca

SEQ ID NO: 2232325 - RNA, 19 nt, Homo sapiens
agggaaugagcuuccauua

SEQ ID NO: 2232326 - RNA, 18 nt, Homo sapiens
cauuauaacugaaggaga

SEQ ID NO: 2232327 - RNA, 16 nt, Homo sapiens
uaaauaaaaaaagaca

SEQ ID NO: 2232328 - RNA, 11 nt, Homo sapiens
acauaauacug

SEQ ID NO: 2232329 - RNA, 10 nt, Homo sapiens
gggauguuuu

SEQ ID NO: 2232330 - RNA, 16 nt, Homo sapiens
uaaauccaaugacaua

SEQ ID NO: 2232331 - RNA, 19 nt, Homo sapiens
uaguggccaaauagcacau

SEQ ID NO: 2232332 - RNA, 20 nt, Homo sapiens
acagguaauuauaaacccac

SEQ ID NO: 2232333 - RNA, 21 nt, Homo sapiens
auauuucuguaauuauaucua

SEQ ID NO: 2232334 - RNA, 14 nt, Homo sapiens
ucucuccuaucugu

SEQ ID NO: 2232335 - RNA, 15 nt, Homo sapiens
gcccucaagcaauau

SEQ ID NO: 2232336 - RNA, 20 nt, Homo sapiens
cccuguguccaccugugggu

SEQ ID NO: 2232337 - RNA, 20 nt, Homo sapiens
guauguauacacacauauac

SEQ ID NO: 2232338 - RNA, 21 nt, Homo sapiens
auacaacaccaaaaaauaucu

SEQ ID NO: 2232339 - RNA, 14 nt, Homo sapiens
cuugcuaucaagaa

SEQ ID NO: 2232340 - RNA, 17 nt, Homo sapiens
cagugcucggcuguaaa

SEQ ID NO: 2232341 - RNA, 14 nt, Homo sapiens
uggucacugcugag

SEQ ID NO: 2232342 - RNA, 22 nt, Homo sapiens
agcuggggcuuugauguuccuu

SEQ ID NO: 2232343 - RNA, 16 nt, Homo sapiens
cccacuucucaucaca

SEQ ID NO: 2232344 - RNA, 20 nt, Homo sapiens
ucuccacuggaaaacugcua

SEQ ID NO: 2232345 - RNA, 18 nt, Homo sapiens
ccacagaugauacuucca

SEQ ID NO: 2232346 - RNA, 20 nt, Homo sapiens
cagaccgugaccaucuuugu

SEQ ID NO: 2232347 - RNA, 21 nt, Homo sapiens
auuauacagaccuaauaucau

SEQ ID NO: 2232348 - RNA, 16 nt, Homo sapiens
ugcaaaguacauguau

SEQ ID NO: 2232349 - RNA, 19 nt, Homo sapiens
ggugaaaccucaucucuac

SEQ ID NO: 2232350 - RNA, 16 nt, Homo sapiens
gagcuaaucuucauuu

SEQ ID NO: 2232351 - RNA, 13 nt, Homo sapiens
cacugaguucuau

SEQ ID NO: 2232352 - RNA, 12 nt, Homo sapiens
ucuuuccaugaa

SEQ ID NO: 2232353 - RNA, 22 nt, Homo sapiens
cagauguugaaaagaaagcaaa

SEQ ID NO: 2232354 - RNA, 23 nt, Homo sapiens
uagauuaauuugaucuaguucua

SEQ ID NO: 2232355 - RNA, 23 nt, Homo sapiens
caaaccaaccgcacaugcagaug

SEQ ID NO: 2232356 - RNA, 20 nt, Homo sapiens
ggaaauagaaagaagccaua

SEQ ID NO: 2232357 - RNA, 16 nt, Homo sapiens
caugugcagcuauuua

SEQ ID NO: 2232358 - RNA, 14 nt, Homo sapiens
ugguagguguuuga

SEQ ID NO: 2232359 - RNA, 19 nt, Homo sapiens
aaaaauaugaccacacucc

SEQ ID NO: 2232360 - RNA, 23 nt, Homo sapiens
caacgaacauggcaugugaaaag

SEQ ID NO: 2232361 - RNA, 15 nt, Homo sapiens
cagagagcacaguga

SEQ ID NO: 2232362 - RNA, 13 nt, Homo sapiens
aacauuuacaugu

SEQ ID NO: 2232363 - RNA, 14 nt, Homo sapiens
cauccacacccucu

SEQ ID NO: 2232364 - RNA, 19 nt, Homo sapiens
caugggacuaaaugaacua

SEQ ID NO: 2232365 - RNA, 22 nt, Homo sapiens
aagcaaacacuuacagaauuau

SEQ ID NO: 2232366 - RNA, 21 nt, Homo sapiens
aggucaaagcaaguuucauca

SEQ ID NO: 2232367 - RNA, 17 nt, Homo sapiens
ugugcgaacacagugac

SEQ ID NO: 2232368 - RNA, 18 nt, Homo sapiens
aacacccaugaaucaaag

SEQ ID NO: 2232369 - RNA, 15 nt, Homo sapiens
ccccacguggacaag

SEQ ID NO: 2232370 - RNA, 14 nt, Homo sapiens
augauuguuuaaag

SEQ ID NO: 2232371 - RNA, 23 nt, Homo sapiens
gcccauccucucgccaagccauc

SEQ ID NO: 2232372 - RNA, 19 nt, Homo sapiens
cugggcaauuuuuguaucc

SEQ ID NO: 2232373 - RNA, 14 nt, Homo sapiens
gccagcucauucuc

SEQ ID NO: 2232374 - RNA, 17 nt, Homo sapiens
auuccccacacucuccu

SEQ ID NO: 2232375 - RNA, 16 nt, Homo sapiens
gcuggcucccagggug

SEQ ID NO: 2232376 - RNA, 15 nt, Homo sapiens
gcaccuaauccaggc

SEQ ID NO: 2232377 - RNA, 19 nt, Homo sapiens
aaaaucugggaccaaaaca

SEQ ID NO: 2232378 - RNA, 15 nt, Homo sapiens
caccucccugcagcu

SEQ ID NO: 2232379 - RNA, 18 nt, Homo sapiens
gcauuaagugaaaggauu

SEQ ID NO: 2232380 - RNA, 15 nt, Homo sapiens
cacuucccucaucuc

SEQ ID NO: 2232381 - RNA, 14 nt, Homo sapiens
aauuauuacacugu

SEQ ID NO: 2232382 - RNA, 23 nt, Homo sapiens
acuuggauaucaacccucucuac

SEQ ID NO: 2232383 - RNA, 17 nt, Homo sapiens
aaaaugcuucacuguac

SEQ ID NO: 2232384 - RNA, 15 nt, Homo sapiens
uacccugugucagag

SEQ ID NO: 2232385 - RNA, 23 nt, Homo sapiens
ucacagcuguaaucccagcacuu

SEQ ID NO: 2232386 - RNA, 19 nt, Homo sapiens
auaaauagagcaaccagua

SEQ ID NO: 2232387 - RNA, 10 nt, Homo sapiens
caucuuccag

SEQ ID NO: 2232388 - RNA, 17 nt, Homo sapiens
aaguuuugauacuugua

SEQ ID NO: 2232389 - RNA, 23 nt, Homo sapiens
aacucucccucuggucuacucua

SEQ ID NO: 2232390 - RNA, 18 nt, Homo sapiens
aaagcuagauacuggaaa

SEQ ID NO: 2232391 - RNA, 19 nt, Homo sapiens
gagaugacagugaugcugc

SEQ ID NO: 2232392 - RNA, 12 nt, Homo sapiens
auacauugccaa

SEQ ID NO: 2232393 - RNA, 18 nt, Homo sapiens
cuugccugggaccagugg

SEQ ID NO: 2232394 - RNA, 10 nt, Homo sapiens
agaaggguua

SEQ ID NO: 2232395 - RNA, 17 nt, Homo sapiens
gagcugggugcccagua

SEQ ID NO: 2232396 - RNA, 13 nt, Homo sapiens
cucccucucucug

SEQ ID NO: 2232397 - RNA, 15 nt, Homo sapiens
acaaaaaaguuauaa

SEQ ID NO: 2232398 - RNA, 12 nt, Homo sapiens
gaacucugagca

SEQ ID NO: 2232399 - RNA, 16 nt, Homo sapiens
gguaugucagugucac

SEQ ID NO: 2232400 - RNA, 22 nt, Homo sapiens
accuugugacaauacaccuucc

SEQ ID NO: 2232401 - RNA, 23 nt, Homo sapiens
agagcaagaagaagagugacucc

SEQ ID NO: 2232402 - RNA, 20 nt, Homo sapiens
uacaaggcuuuaucucaggg

SEQ ID NO: 2232403 - RNA, 19 nt, Homo sapiens
aguuaacuuuuuguaggau

SEQ ID NO: 2232404 - RNA, 16 nt, Homo sapiens
cuuacaucauguguug

SEQ ID NO: 2232405 - RNA, 20 nt, Homo sapiens
agcuauagccuuuaauuccu

SEQ ID NO: 2232406 - RNA, 23 nt, Homo sapiens
ucuaaauuaugugaauuuugcca

SEQ ID NO: 2232407 - RNA, 20 nt, Homo sapiens
gaugucaaaaacuucaauau

SEQ ID NO: 2232408 - RNA, 18 nt, Homo sapiens
uauacucagguaccucuu

SEQ ID NO: 2232409 - RNA, 12 nt, Homo sapiens
ucaguuugcuaa

SEQ ID NO: 2232410 - RNA, 16 nt, Homo sapiens
ggccaaaaccuuucaa

SEQ ID NO: 2232411 - RNA, 14 nt, Homo sapiens
agaaaauagcuuuu

SEQ ID NO: 2232412 - RNA, 13 nt, Homo sapiens
cacauuccugacc

SEQ ID NO: 2232413 - RNA, 15 nt, Homo sapiens
uacuuaaaacuguaa

SEQ ID NO: 2232414 - RNA, 19 nt, Homo sapiens
gcuauuucuucuacugcua

SEQ ID NO: 2232415 - RNA, 21 nt, Homo sapiens
uaaauguuaaagauguagcaa

SEQ ID NO: 2232416 - RNA, 15 nt, Homo sapiens
cugccaggacacugc

SEQ ID NO: 2232417 - RNA, 13 nt, Homo sapiens
cgaucuccugacc

SEQ ID NO: 2232418 - RNA, 14 nt, Homo sapiens
gccucaaguucaau

SEQ ID NO: 2232419 - RNA, 13 nt, Homo sapiens
uaauagacuucuc

SEQ ID NO: 2232420 - RNA, 20 nt, Homo sapiens
agccauggucccaggcuucc

SEQ ID NO: 2232421 - RNA, 19 nt, Homo sapiens
uucuaauccuuuuccuuau

SEQ ID NO: 2232422 - RNA, 14 nt, Homo sapiens
uauuuuucugcccu

SEQ ID NO: 2232423 - RNA, 19 nt, Homo sapiens
uccaaccccccagcacuga

SEQ ID NO: 2232424 - RNA, 14 nt, Homo sapiens
ggagacaggugagg

SEQ ID NO: 2232425 - RNA, 16 nt, Homo sapiens
uauuuugcuuccacau

SEQ ID NO: 2232426 - RNA, 13 nt, Homo sapiens
uauuucaccaagc

SEQ ID NO: 2232427 - RNA, 15 nt, Homo sapiens
acuaaauaacuguau

SEQ ID NO: 2232428 - RNA, 15 nt, Homo sapiens
ccagugaaccaaaga

SEQ ID NO: 2232429 - RNA, 21 nt, Homo sapiens
cauuuaucaugguccugaaug

SEQ ID NO: 2232430 - RNA, 19 nt, Homo sapiens
uuuuccauccuagugagaa

SEQ ID NO: 2232431 - RNA, 21 nt, Homo sapiens
ucugagauuuugcuugagcag

SEQ ID NO: 2232432 - RNA, 12 nt, Homo sapiens
cuuuaugaucuu

SEQ ID NO: 2232433 - RNA, 14 nt, Homo sapiens
uccuuccuaccucu

SEQ ID NO: 2232434 - RNA, 22 nt, Homo sapiens
cacugggugguggccugguccc

SEQ ID NO: 2232435 - RNA, 11 nt, Homo sapiens
ucgguagcuug

SEQ ID NO: 2232436 - RNA, 14 nt, Homo sapiens
ccaaaccaagcaaa

SEQ ID NO: 2232437 - RNA, 15 nt, Homo sapiens
aaugaacuaguuuaa

SEQ ID NO: 2232438 - RNA, 15 nt, Homo sapiens
gaugagcugguuuga

SEQ ID NO: 2232439 - RNA, 14 nt, Homo sapiens
guuauaguugauau

SEQ ID NO: 2232440 - RNA, 15 nt, Homo sapiens
ccguaaagugccuua

SEQ ID NO: 2232441 - RNA, 15 nt, Homo sapiens
auuagacacuaugug

SEQ ID NO: 2232442 - RNA, 17 nt, Homo sapiens
aacaauaaagcauuuug

SEQ ID NO: 2232443 - RNA, 22 nt, Homo sapiens
gauaaugaucugaaucuguuuc

SEQ ID NO: 2232444 - RNA, 16 nt, Homo sapiens
uuacccaaugggaccg

SEQ ID NO: 2232445 - RNA, 17 nt, Homo sapiens
gccuccccuucuucccg

SEQ ID NO: 2232446 - RNA, 19 nt, Homo sapiens
ggccgccgcugacccuggg

SEQ ID NO: 2232447 - RNA, 13 nt, Homo sapiens
cuguguaucucag

SEQ ID NO: 2232448 - RNA, 13 nt, Homo sapiens
uggauuauugcuu

SEQ ID NO: 2232449 - RNA, 21 nt, Homo sapiens
cuucaggaucaaguccuaguu

SEQ ID NO: 2232450 - RNA, 22 nt, Homo sapiens
uucguaauaggugucauggaua

SEQ ID NO: 2232451 - RNA, 18 nt, Homo sapiens
uaaugccacucauacuca

SEQ ID NO: 2232452 - RNA, 21 nt, Homo sapiens
cuuccaggaguuuugccccua

SEQ ID NO: 2232453 - RNA, 13 nt, Homo sapiens
uguugcuauggcu

SEQ ID NO: 2232454 - RNA, 20 nt, Homo sapiens
agaaugguacacaaugugau

SEQ ID NO: 2232455 - RNA, 16 nt, Homo sapiens
uacccaauagguaauu

SEQ ID NO: 2232456 - RNA, 23 nt, Homo sapiens
caucugacucacaagaagaccag

SEQ ID NO: 2232457 - RNA, 17 nt, Homo sapiens
cugugcagacaguguca

SEQ ID NO: 2232458 - RNA, 15 nt, Homo sapiens
uccaugauuuagcaa

SEQ ID NO: 2232459 - RNA, 15 nt, Homo sapiens
cuauucuaauaacug

SEQ ID NO: 2232460 - RNA, 22 nt, Homo sapiens
aagcuuccauuccaagccugac

SEQ ID NO: 2232461 - RNA, 13 nt, Homo sapiens
guuaucugugguu

SEQ ID NO: 2232462 - RNA, 18 nt, Homo sapiens
ucaugccacugcacucua

SEQ ID NO: 2232463 - RNA, 22 nt, Homo sapiens
accucccccugaacacugugac

SEQ ID NO: 2232464 - RNA, 14 nt, Homo sapiens
aaugcaucaauaug

SEQ ID NO: 2232465 - RNA, 16 nt, Homo sapiens
cugaagccagauccac

SEQ ID NO: 2232466 - RNA, 14 nt, Homo sapiens
uuuggccauguaaa

SEQ ID NO: 2232467 - RNA, 19 nt, Homo sapiens
aguaucucaacaacauguc

SEQ ID NO: 2232468 - RNA, 16 nt, Homo sapiens
caagauugcaccacug

SEQ ID NO: 2232469 - RNA, 14 nt, Homo sapiens
caaagauucugcau

SEQ ID NO: 2232470 - RNA, 14 nt, Homo sapiens
caaggaugucugcc

SEQ ID NO: 2232471 - RNA, 18 nt, Homo sapiens
gcuuugcuucaaauccau

SEQ ID NO: 2232472 - RNA, 16 nt, Homo sapiens
cuuuugacauccagca

SEQ ID NO: 2232473 - RNA, 12 nt, Homo sapiens
acauucagucug

SEQ ID NO: 2232474 - RNA, 22 nt, Homo sapiens
aaugcuuauuauuucuaauuca

SEQ ID NO: 2232475 - RNA, 17 nt, Homo sapiens
aguaauaaaaagccacc

SEQ ID NO: 2232476 - RNA, 19 nt, Homo sapiens
aaguucuuaugccauguua

SEQ ID NO: 2232477 - RNA, 17 nt, Homo sapiens
aaggauccagacucuca

SEQ ID NO: 2232478 - RNA, 18 nt, Homo sapiens
gggcuguguugacugcug

SEQ ID NO: 2232479 - RNA, 12 nt, Homo sapiens
ucggugggaccc

SEQ ID NO: 2232480 - RNA, 23 nt, Homo sapiens
gucuucugcuuuguugugugccu

SEQ ID NO: 2232481 - RNA, 22 nt, Homo sapiens
agucaccuauccacccucugca

SEQ ID NO: 2232482 - RNA, 16 nt, Homo sapiens
cucagaccagcucuuc

SEQ ID NO: 2232483 - RNA, 20 nt, Homo sapiens
ccacucuguccugggaaaug

SEQ ID NO: 2232484 - RNA, 15 nt, Homo sapiens
caguauccaguacuc

SEQ ID NO: 2232485 - RNA, 16 nt, Homo sapiens
aauucucuagggcuag

SEQ ID NO: 2232486 - RNA, 15 nt, Homo sapiens
cugcacaacaagaua

SEQ ID NO: 2232487 - RNA, 16 nt, Homo sapiens
ucucuucuacacgucc

SEQ ID NO: 2232488 - RNA, 21 nt, Homo sapiens
ggauguuuacaggaacccagc

SEQ ID NO: 2232489 - RNA, 12 nt, Homo sapiens
gcugucaugccc

SEQ ID NO: 2232490 - RNA, 15 nt, Homo sapiens
gcagcauuccaugac

SEQ ID NO: 2232491 - RNA, 23 nt, Homo sapiens
uucacgccauucuccugccucag

SEQ ID NO: 2232492 - RNA, 22 nt, Homo sapiens
cggagccauuuuuagcucugau

SEQ ID NO: 2232493 - RNA, 18 nt, Homo sapiens
acauaacuguaacauaua

SEQ ID NO: 2232494 - RNA, 21 nt, Homo sapiens
ugccuacuaucaaacuagcug

SEQ ID NO: 2232495 - RNA, 18 nt, Homo sapiens
ggccagugccagcaccug

SEQ ID NO: 2232496 - RNA, 17 nt, Homo sapiens
uaugauuccaccuacau

SEQ ID NO: 2232497 - RNA, 18 nt, Homo sapiens
uaauuaaguaaacuaaug

SEQ ID NO: 2232498 - RNA, 18 nt, Homo sapiens
aacacaaugaugauuauu

SEQ ID NO: 2232499 - RNA, 18 nt, Homo sapiens
ccgcucuuggggacaugg

SEQ ID NO: 2232500 - RNA, 22 nt, Homo sapiens
cuuggaggcugucuucucaggc

SEQ ID NO: 2232501 - RNA, 22 nt, Homo sapiens
cugcuuaucugaaacuucccaa

SEQ ID NO: 2232502 - RNA, 21 nt, Homo sapiens
aggucagcccagccccuccaa

SEQ ID NO: 2232503 - RNA, 13 nt, Homo sapiens
aggaaacucucca

SEQ ID NO: 2232504 - RNA, 16 nt, Homo sapiens
cugcuccagugcagga

SEQ ID NO: 2232505 - RNA, 20 nt, Homo sapiens
aagugauccuuccaccucag

SEQ ID NO: 2232506 - RNA, 14 nt, Homo sapiens
auuggcaaacuaga

SEQ ID NO: 2232507 - RNA, 22 nt, Homo sapiens
augcagacaaccucaucagcug

SEQ ID NO: 2232508 - RNA, 19 nt, Homo sapiens
gcauuugucuguguuugaa

SEQ ID NO: 2232509 - RNA, 22 nt, Homo sapiens
uccaccuccucuccaccugcug

SEQ ID NO: 2232510 - RNA, 20 nt, Homo sapiens
uucaggugcuagaagccuac

SEQ ID NO: 2232511 - RNA, 20 nt, Homo sapiens
acuguguuaguaaacugugc

SEQ ID NO: 2232512 - RNA, 18 nt, Homo sapiens
caagaaugggagguugau

SEQ ID NO: 2232513 - RNA, 12 nt, Homo sapiens
agcuucuagucu

SEQ ID NO: 2232514 - RNA, 17 nt, Homo sapiens
ucauccagccucagaga

SEQ ID NO: 2232515 - RNA, 12 nt, Homo sapiens
ucacauaaacuu

SEQ ID NO: 2232516 - RNA, 15 nt, Homo sapiens
acuuaggcuaccccc

SEQ ID NO: 2232517 - RNA, 22 nt, Homo sapiens
gaagcucccugaaguaagcaaa

SEQ ID NO: 2232518 - RNA, 18 nt, Homo sapiens
cugagcccauaggucuca

SEQ ID NO: 2232519 - RNA, 18 nt, Homo sapiens
cuaaacuccaggauuuau

SEQ ID NO: 2232520 - RNA, 22 nt, Homo sapiens
ucuucagacuuaaagcacugau

SEQ ID NO: 2232521 - RNA, 20 nt, Homo sapiens
caagggggacugucuuucag

SEQ ID NO: 2232522 - RNA, 22 nt, Homo sapiens
cuucacagcuaagaugccaugu

SEQ ID NO: 2232523 - RNA, 15 nt, Homo sapiens
caaguagcugagauu

SEQ ID NO: 2232524 - RNA, 22 nt, Homo sapiens
ugaacuccugaccucaggugau

SEQ ID NO: 2232525 - RNA, 23 nt, Homo sapiens
agcagcgcggauuucucuuucuc

SEQ ID NO: 2232526 - RNA, 22 nt, Homo sapiens
cacaagugagcccucuugccca

SEQ ID NO: 2232527 - RNA, 15 nt, Homo sapiens
cacuacuuuguauca

SEQ ID NO: 2232528 - RNA, 14 nt, Homo sapiens
aaaaugugaacuga

SEQ ID NO: 2232529 - RNA, 14 nt, Homo sapiens
gagcaucucaggag

SEQ ID NO: 2232530 - RNA, 15 nt, Homo sapiens
ccccagccaugguga

SEQ ID NO: 2232531 - RNA, 21 nt, Homo sapiens
cuaagcauggccuggacugac

SEQ ID NO: 2232532 - RNA, 20 nt, Homo sapiens
gaaaaccagcucagcacugc

SEQ ID NO: 2232533 - RNA, 15 nt, Homo sapiens
uauaucuaccccaga

SEQ ID NO: 2232534 - RNA, 16 nt, Homo sapiens
cuuaacauuccuaaaa

SEQ ID NO: 2232535 - RNA, 16 nt, Homo sapiens
ugcucuuaacuuguua

SEQ ID NO: 2232536 - RNA, 24 nt, Homo sapiens
aucuucucagcucccauuucuacu

SEQ ID NO: 2232537 - RNA, 18 nt, Homo sapiens
uauaaaacacaucaucaa

SEQ ID NO: 2232538 - RNA, 19 nt, Homo sapiens
agcuagaaaacaggcaaau

SEQ ID NO: 2232539 - RNA, 23 nt, Homo sapiens
aggccucgaaaaccaucacauga

SEQ ID NO: 2232540 - RNA, 20 nt, Homo sapiens
aaucaaagcagauauauuaa

SEQ ID NO: 2232541 - RNA, 20 nt, Homo sapiens
acagaaguaucaagccaugu

SEQ ID NO: 2232542 - RNA, 21 nt, Homo sapiens
cucaguugaaauaacaacaga

SEQ ID NO: 2232543 - RNA, 17 nt, Homo sapiens
ugccgucagcuccgacu

SEQ ID NO: 2232544 - RNA, 21 nt, Homo sapiens
uccuguguuugcaccaaaaua

SEQ ID NO: 2232545 - RNA, 19 nt, Homo sapiens
cugaggcuugggcccagua

SEQ ID NO: 2232546 - RNA, 15 nt, Homo sapiens
ucacucacaacacuu

SEQ ID NO: 2232547 - RNA, 23 nt, Homo sapiens
aauccucacuguuccuucuugag

SEQ ID NO: 2232548 - RNA, 22 nt, Homo sapiens
ggucccuggucggagagggaca

SEQ ID NO: 2232549 - RNA, 21 nt, Homo sapiens
cccaacagugaugaugcaugg

SEQ ID NO: 2232550 - RNA, 14 nt, Homo sapiens
cagccggcugcaag

SEQ ID NO: 2232551 - RNA, 17 nt, Homo sapiens
agugcaugggucagggu

SEQ ID NO: 2232552 - RNA, 23 nt, Homo sapiens
cuggccuauuuuggacgugugag

SEQ ID NO: 2232553 - RNA, 16 nt, Homo sapiens
cagauaaauagaacua

SEQ ID NO: 2232554 - RNA, 12 nt, Homo sapiens
caucaguucuuu

SEQ ID NO: 2232555 - RNA, 13 nt, Homo sapiens
ugaaaaucaaaua

SEQ ID NO: 2232556 - RNA, 18 nt, Homo sapiens
ugagcaggacggguacca

SEQ ID NO: 2232557 - RNA, 18 nt, Homo sapiens
uguuuuuaauccaaagaa

SEQ ID NO: 2232558 - RNA, 14 nt, Homo sapiens
gcaauacaccaagg

SEQ ID NO: 2232559 - RNA, 16 nt, Homo sapiens
ucucaugaagcccuua

SEQ ID NO: 2232560 - RNA, 14 nt, Homo sapiens
uguagccagacagu

SEQ ID NO: 2232561 - RNA, 22 nt, Homo sapiens
guaagccaaggucaugccacug

SEQ ID NO: 2232562 - RNA, 12 nt, Homo sapiens
agaaacccaggg

SEQ ID NO: 2232563 - RNA, 15 nt, Homo sapiens
cucagccaccccuca

SEQ ID NO: 2232564 - RNA, 18 nt, Homo sapiens
agcuccacuuucagugaa

SEQ ID NO: 2232565 - RNA, 12 nt, Homo sapiens
aggcaggagcag

SEQ ID NO: 2232566 - RNA, 21 nt, Homo sapiens
accagaggaaagaccaugugg

SEQ ID NO: 2232567 - RNA, 14 nt, Homo sapiens
aaaauggagccaug

SEQ ID NO: 2232568 - RNA, 17 nt, Homo sapiens
agggugcuggacuguau

SEQ ID NO: 2232569 - RNA, 19 nt, Homo sapiens
agaagaaaccuucauccua

SEQ ID NO: 2232570 - RNA, 13 nt, Homo sapiens
uaauaauuuuccu

SEQ ID NO: 2232571 - RNA, 16 nt, Homo sapiens
guggucuccuugcacu

SEQ ID NO: 2232572 - RNA, 21 nt, Homo sapiens
gaaguagacucauucuucaca

SEQ ID NO: 2232573 - RNA, 22 nt, Homo sapiens
ccugaaggguugacuuuaccca

SEQ ID NO: 2232574 - RNA, 19 nt, Homo sapiens
uguccagguuaguuuacuc

SEQ ID NO: 2232575 - RNA, 14 nt, Homo sapiens
ucucaaucauggga

SEQ ID NO: 2232576 - RNA, 19 nt, Homo sapiens
uuucuuguuaagugcuuuu

SEQ ID NO: 2232577 - RNA, 13 nt, Homo sapiens
cucaagacugaaa

SEQ ID NO: 2232578 - RNA, 15 nt, Homo sapiens
aaacagaaauugcaa

SEQ ID NO: 2232579 - RNA, 21 nt, Homo sapiens
cuaggaaccucauuuguccau

SEQ ID NO: 2232580 - RNA, 21 nt, Homo sapiens
auggcuuauugugugaaggua

SEQ ID NO: 2232581 - RNA, 21 nt, Homo sapiens
caggguuucaccauguugccc

SEQ ID NO: 2232582 - RNA, 16 nt, Homo sapiens
ugugugcaaaggugag

SEQ ID NO: 2232583 - RNA, 16 nt, Homo sapiens
aauggacuccacugaa

SEQ ID NO: 2232584 - RNA, 17 nt, Homo sapiens
accuucuuuucaaugca

SEQ ID NO: 2232585 - RNA, 13 nt, Homo sapiens
cacauuaagccuu

SEQ ID NO: 2232586 - RNA, 19 nt, Homo sapiens
uaagccaaaaaaugcuugc

SEQ ID NO: 2232587 - RNA, 13 nt, Homo sapiens
uggagucugucaa

SEQ ID NO: 2232588 - RNA, 19 nt, Homo sapiens
gagaagguggaccuggcag

SEQ ID NO: 2232589 - RNA, 14 nt, Homo sapiens
agaauuaaauugau

SEQ ID NO: 2232590 - RNA, 19 nt, Homo sapiens
agucucauugccaaggcau

SEQ ID NO: 2232591 - RNA, 22 nt, Homo sapiens
ccagcugagucuauguagguga

SEQ ID NO: 2232592 - RNA, 20 nt, Homo sapiens
aggauaaaugucuuuccaaa

SEQ ID NO: 2232593 - RNA, 18 nt, Homo sapiens
auuuauguggauuuugca

SEQ ID NO: 2232594 - RNA, 15 nt, Homo sapiens
gauguucacuguggc

SEQ ID NO: 2232595 - RNA, 18 nt, Homo sapiens
ucagggcaguacaaugug

SEQ ID NO: 2232596 - RNA, 20 nt, Homo sapiens
agccgagauugcaccacugc

SEQ ID NO: 2232597 - RNA, 20 nt, Homo sapiens
agccaagauugcgccacugc

SEQ ID NO: 2232598 - RNA, 15 nt, Homo sapiens
ugagccaccaugccu

SEQ ID NO: 2232599 - RNA, 16 nt, Homo sapiens
cccugugagcacaaag

SEQ ID NO: 2232600 - RNA, 16 nt, Homo sapiens
uuccuuacacauuuua

SEQ ID NO: 2232601 - RNA, 20 nt, Homo sapiens
cucaaaagaaggccacuguu

SEQ ID NO: 2232602 - RNA, 15 nt, Homo sapiens
uauuagaacaggcaa

SEQ ID NO: 2232603 - RNA, 16 nt, Homo sapiens
uaaacaugaagcacaa

SEQ ID NO: 2232604 - RNA, 20 nt, Homo sapiens
uggaucuuuugguggaguca

SEQ ID NO: 2232605 - RNA, 21 nt, Homo sapiens
ccuuccagggccugagcagcu

SEQ ID NO: 2232606 - RNA, 12 nt, Homo sapiens
ucuuuccaaucc

SEQ ID NO: 2232607 - RNA, 18 nt, Homo sapiens
agguggcccuucccggca

SEQ ID NO: 2232608 - RNA, 14 nt, Homo sapiens
uuuguuugggauca

SEQ ID NO: 2232609 - RNA, 20 nt, Homo sapiens
uauaaaaauaaaaaacacug

SEQ ID NO: 2232610 - RNA, 22 nt, Homo sapiens
uggguuuggcaaaacucaggca

SEQ ID NO: 2232611 - RNA, 20 nt, Homo sapiens
auauuacuugccuaucugac

SEQ ID NO: 2232612 - RNA, 21 nt, Homo sapiens
aagcugaggugcccaggagaa

SEQ ID NO: 2232613 - RNA, 18 nt, Homo sapiens
cauaaauuguacuguuga

SEQ ID NO: 2232614 - RNA, 18 nt, Homo sapiens
gaaggggcaccucucuug

SEQ ID NO: 2232615 - RNA, 14 nt, Homo sapiens
ccugaaagauacag

SEQ ID NO: 2232616 - RNA, 17 nt, Homo sapiens
ccagcagcuuaagucca

SEQ ID NO: 2232617 - RNA, 15 nt, Homo sapiens
aucagccagucucag

SEQ ID NO: 2232618 - RNA, 20 nt, Homo sapiens
cagugugugugggugaaaug

SEQ ID NO: 2232619 - RNA, 16 nt, Homo sapiens
cagaugccuuccuguc

SEQ ID NO: 2232620 - RNA, 18 nt, Homo sapiens
guguaaaauacguuugaa

SEQ ID NO: 2232621 - RNA, 13 nt, Homo sapiens
ugacauauuuaau

SEQ ID NO: 2232622 - RNA, 16 nt, Homo sapiens
aagcugauuaccugaa

SEQ ID NO: 2232623 - RNA, 13 nt, Homo sapiens
ugugaaaucuuuc

SEQ ID NO: 2232624 - RNA, 15 nt, Homo sapiens
cccuuuucucaggac

SEQ ID NO: 2232625 - RNA, 16 nt, Homo sapiens
uagaauauuaucuuca

SEQ ID NO: 2232626 - RNA, 12 nt, Homo sapiens
uacuguauauau

SEQ ID NO: 2232627 - RNA, 12 nt, Homo sapiens
aacuguauuuau

SEQ ID NO: 2232628 - RNA, 21 nt, Homo sapiens
aauccuggaccaagcacaaaa

SEQ ID NO: 2232629 - RNA, 21 nt, Homo sapiens
gaguugcagccagggccagug

SEQ ID NO: 2232630 - RNA, 12 nt, Homo sapiens
gcccagggccag

SEQ ID NO: 2232631 - RNA, 14 nt, Homo sapiens
cugugugcucugau

SEQ ID NO: 2232632 - RNA, 20 nt, Homo sapiens
acccugagcuuaaauaacaa

SEQ ID NO: 2232633 - RNA, 20 nt, Homo sapiens
gccaguagcuaaagugcaag

SEQ ID NO: 2232634 - RNA, 16 nt, Homo sapiens
uucugauaaacacaau

SEQ ID NO: 2232635 - RNA, 12 nt, Homo sapiens
agcuccacagaa

SEQ ID NO: 2232636 - RNA, 20 nt, Homo sapiens
caucaaaaaaaaaaauggau

SEQ ID NO: 2232637 - RNA, 20 nt, Homo sapiens
aaggguaagcuagagagaaa

SEQ ID NO: 2232638 - RNA, 21 nt, Homo sapiens
gcagacaccagcagcccuguc

SEQ ID NO: 2232639 - RNA, 18 nt, Homo sapiens
aaagaacguggucagagu

SEQ ID NO: 2232640 - RNA, 20 nt, Homo sapiens
ucuagaggcucauggcccug

SEQ ID NO: 2232641 - RNA, 23 nt, Homo sapiens
augaacgauauguagcagaaagg

SEQ ID NO: 2232642 - RNA, 14 nt, Homo sapiens
uggcugcuaggcca

SEQ ID NO: 2232643 - RNA, 12 nt, Homo sapiens
acaaaaugguca

SEQ ID NO: 2232644 - RNA, 17 nt, Homo sapiens
uagacuuagccccauga

SEQ ID NO: 2232645 - RNA, 18 nt, Homo sapiens
aucuugaagaagcucuuu

SEQ ID NO: 2232646 - RNA, 18 nt, Homo sapiens
acaggagaagaaacagca

SEQ ID NO: 2232647 - RNA, 16 nt, Homo sapiens
auggacagacagccac

SEQ ID NO: 2232648 - RNA, 15 nt, Homo sapiens
ccuuggaucaguggu

SEQ ID NO: 2232649 - RNA, 16 nt, Homo sapiens
ugagguaccagccuug

SEQ ID NO: 2232650 - RNA, 16 nt, Homo sapiens
uccacuaugagcugcu

SEQ ID NO: 2232651 - RNA, 19 nt, Homo sapiens
gaagccaccgggagauuuc

SEQ ID NO: 2232652 - RNA, 22 nt, Homo sapiens
auucuggaaaagcaaaacugua

SEQ ID NO: 2232653 - RNA, 23 nt, Homo sapiens
ucaucccaucuaagcugcagcuu

SEQ ID NO: 2232654 - RNA, 14 nt, Homo sapiens
auuauauucacaga

SEQ ID NO: 2232655 - RNA, 12 nt, Homo sapiens
ucccagugccau

SEQ ID NO: 2232656 - RNA, 19 nt, Homo sapiens
uaagaaaucaaguaaugaa

SEQ ID NO: 2232657 - RNA, 15 nt, Homo sapiens
augucccccauaucu

SEQ ID NO: 2232658 - RNA, 12 nt, Homo sapiens
acaccuaccuga

SEQ ID NO: 2232659 - RNA, 20 nt, Homo sapiens
gcucuaucucacagcacacu

SEQ ID NO: 2232660 - RNA, 21 nt, Homo sapiens
uuacauagcauuuguguaaag

SEQ ID NO: 2232661 - RNA, 15 nt, Homo sapiens
aagauauaugacugc

SEQ ID NO: 2232662 - RNA, 17 nt, Homo sapiens
ucuccuggcaaucuguc

SEQ ID NO: 2232663 - RNA, 15 nt, Homo sapiens
uggaguggacauuca

SEQ ID NO: 2232664 - RNA, 16 nt, Homo sapiens
gccagcguuguguguu

SEQ ID NO: 2232665 - RNA, 17 nt, Homo sapiens
augauguauuguugcuu

SEQ ID NO: 2232666 - RNA, 14 nt, Homo sapiens
gcuauaagugcuca

SEQ ID NO: 2232667 - RNA, 20 nt, Homo sapiens
acuugaugaauaaacacuuu

SEQ ID NO: 2232668 - RNA, 14 nt, Homo sapiens
agguacacauuuau

SEQ ID NO: 2232669 - RNA, 17 nt, Homo sapiens
guccuagaugccaaagg

SEQ ID NO: 2232670 - RNA, 15 nt, Homo sapiens
gcucauacuuaucua

SEQ ID NO: 2232671 - RNA, 17 nt, Homo sapiens
aggcugagaacacugug

SEQ ID NO: 2232672 - RNA, 22 nt, Homo sapiens
cucuuuggcuccccuguaccuu

SEQ ID NO: 2232673 - RNA, 19 nt, Homo sapiens
uuugggcugggucaaggca

SEQ ID NO: 2232674 - RNA, 15 nt, Homo sapiens
ccaaggggaaucaga

SEQ ID NO: 2232675 - RNA, 20 nt, Homo sapiens
acagaacuuguggccuuuau

SEQ ID NO: 2232676 - RNA, 15 nt, Homo sapiens
gaaggaauuauuccc

SEQ ID NO: 2232677 - RNA, 23 nt, Homo sapiens
aaggaagaaaagcugccauuucc

SEQ ID NO: 2232678 - RNA, 16 nt, Homo sapiens
gcaaggcccugcugcc

SEQ ID NO: 2232679 - RNA, 14 nt, Homo sapiens
agacuggcuuuuau

SEQ ID NO: 2232680 - RNA, 20 nt, Homo sapiens
gaauauauuauaaucuucca

SEQ ID NO: 2232681 - RNA, 15 nt, Homo sapiens
cugagugcuaugugu

SEQ ID NO: 2232682 - RNA, 20 nt, Homo sapiens
ucaaaacauucauaggcagu

SEQ ID NO: 2232683 - RNA, 12 nt, Homo sapiens
guuuucaucucu

SEQ ID NO: 2232684 - RNA, 22 nt, Homo sapiens
cuucuguucucaaaugcuaaau

SEQ ID NO: 2232685 - RNA, 14 nt, Homo sapiens
gccauaggguccug

SEQ ID NO: 2232686 - RNA, 15 nt, Homo sapiens
ccaaacauccuacaa

SEQ ID NO: 2232687 - RNA, 14 nt, Homo sapiens
gaaauacuacuccu

SEQ ID NO: 2232688 - RNA, 19 nt, Homo sapiens
acucaucccccaucagaug

SEQ ID NO: 2232689 - RNA, 19 nt, Homo sapiens
acgccaguugccucuugaa

SEQ ID NO: 2232690 - RNA, 22 nt, Homo sapiens
uuggugaccuagggaucagaga

SEQ ID NO: 2232691 - RNA, 21 nt, Homo sapiens
agguaccagcugcgcuugcuu

SEQ ID NO: 2232692 - RNA, 17 nt, Homo sapiens
gcccaaauggcagggau

SEQ ID NO: 2232693 - RNA, 14 nt, Homo sapiens
acaaaaguuaacca

SEQ ID NO: 2232694 - RNA, 21 nt, Homo sapiens
agcaaucucgcaguacauguu

SEQ ID NO: 2232695 - RNA, 13 nt, Homo sapiens
ggacucuuccacc

SEQ ID NO: 2232696 - RNA, 13 nt, Homo sapiens
cgccucuugcccc

SEQ ID NO: 2232697 - RNA, 14 nt, Homo sapiens
uucauucuuugcag

SEQ ID NO: 2232698 - RNA, 22 nt, Homo sapiens
ugagcugauuuggucaccuucc

SEQ ID NO: 2232699 - RNA, 16 nt, Homo sapiens
ucaggaauugucaaau

SEQ ID NO: 2232700 - RNA, 15 nt, Homo sapiens
agagaaaaaccaaug

SEQ ID NO: 2232701 - RNA, 17 nt, Homo sapiens
gcaauggugaacuguca

SEQ ID NO: 2232702 - RNA, 23 nt, Homo sapiens
agaugcagucucugcugaucaca

SEQ ID NO: 2232703 - RNA, 19 nt, Homo sapiens
gugggugaaacagaacaau

SEQ ID NO: 2232704 - RNA, 13 nt, Homo sapiens
agaagucacucac

SEQ ID NO: 2232705 - RNA, 14 nt, Homo sapiens
caaauauauugcaa

SEQ ID NO: 2232706 - RNA, 19 nt, Homo sapiens
guucaccuuuuccuugcug

SEQ ID NO: 2232707 - RNA, 13 nt, Homo sapiens
auuuaucuuucaa

SEQ ID NO: 2232708 - RNA, 15 nt, Homo sapiens
uggauaaauugcaca

SEQ ID NO: 2232709 - RNA, 22 nt, Homo sapiens
aaucucugccuagaaucuuuau

SEQ ID NO: 2232710 - RNA, 20 nt, Homo sapiens
ucuuuaacugacuucugucc

SEQ ID NO: 2232711 - RNA, 13 nt, Homo sapiens
cccacugagauuu

SEQ ID NO: 2232712 - RNA, 19 nt, Homo sapiens
agaaaaauuuguauacuaa

SEQ ID NO: 2232713 - RNA, 20 nt, Homo sapiens
cucuccacauggaagcccaa

SEQ ID NO: 2232714 - RNA, 18 nt, Homo sapiens
aggucagcuugcugcccu

SEQ ID NO: 2232715 - RNA, 14 nt, Homo sapiens
gagccucugcagac

SEQ ID NO: 2232716 - RNA, 16 nt, Homo sapiens
uuaacaaaauuugaau

SEQ ID NO: 2232717 - RNA, 22 nt, Homo sapiens
caguggcaccugggaagccugg

SEQ ID NO: 2232718 - RNA, 18 nt, Homo sapiens
gccauacugccuuugcag

SEQ ID NO: 2232719 - RNA, 17 nt, Homo sapiens
ucaccaccccagugagg

SEQ ID NO: 2232720 - RNA, 22 nt, Homo sapiens
cucaaacuucuggcuucaugca

SEQ ID NO: 2232721 - RNA, 15 nt, Homo sapiens
gacuuggagacuccu

SEQ ID NO: 2232722 - RNA, 15 nt, Homo sapiens
aaccuuccacccagu

SEQ ID NO: 2232723 - RNA, 12 nt, Homo sapiens
gaagccugagca

SEQ ID NO: 2232724 - RNA, 13 nt, Homo sapiens
ucagcaaaccauu

SEQ ID NO: 2232725 - RNA, 17 nt, Homo sapiens
ugugucagggaacauau

SEQ ID NO: 2232726 - RNA, 14 nt, Homo sapiens
cucuucucagccac

SEQ ID NO: 2232727 - RNA, 19 nt, Homo sapiens
acuuuggcuucuccuguga

SEQ ID NO: 2232728 - RNA, 23 nt, Homo sapiens
ugucacccaaguuggagugcagu

SEQ ID NO: 2232729 - RNA, 14 nt, Homo sapiens
gauccacacugaga

SEQ ID NO: 2232730 - RNA, 22 nt, Homo sapiens
cuuaaaugccuccuucucugcc

SEQ ID NO: 2232731 - RNA, 12 nt, Homo sapiens
accuugugagag

SEQ ID NO: 2232732 - RNA, 13 nt, Homo sapiens
ugguucauguguu

SEQ ID NO: 2232733 - RNA, 17 nt, Homo sapiens
cuguguaccacugggau

SEQ ID NO: 2232734 - RNA, 15 nt, Homo sapiens
uccuggccucagagc

SEQ ID NO: 2232735 - RNA, 17 nt, Homo sapiens
ucagaagguaucaguua

SEQ ID NO: 2232736 - RNA, 23 nt, Homo sapiens
cacugagcccuugcacaggccac

SEQ ID NO: 2232737 - RNA, 18 nt, Homo sapiens
cagccugcagacucacug

SEQ ID NO: 2232738 - RNA, 19 nt, Homo sapiens
aaaauguaggccuccaguu

SEQ ID NO: 2232739 - RNA, 20 nt, Homo sapiens
gaccaaagacgauacagcuu

SEQ ID NO: 2232740 - RNA, 17 nt, Homo sapiens
agaagauaggcucucag

SEQ ID NO: 2232741 - RNA, 18 nt, Homo sapiens
ugcacuccggucccaaau

SEQ ID NO: 2232742 - RNA, 18 nt, Homo sapiens
cugcugcugaccugauca

SEQ ID NO: 2232743 - RNA, 18 nt, Homo sapiens
uuuugguugccaugguca

SEQ ID NO: 2232744 - RNA, 23 nt, Homo sapiens
gaugaacucaaugcaugaugacu

SEQ ID NO: 2232745 - RNA, 22 nt, Homo sapiens
caaacuuuauuuuucuaugugu

SEQ ID NO: 2232746 - RNA, 20 nt, Homo sapiens
ugcacagagcaaguccucac

SEQ ID NO: 2232747 - RNA, 23 nt, Homo sapiens
uuuucuggaagggcagcauauaa

SEQ ID NO: 2232748 - RNA, 13 nt, Homo sapiens
aaaggaaacuacu

SEQ ID NO: 2232749 - RNA, 13 nt, Homo sapiens
auuagaaugcaug

SEQ ID NO: 2232750 - RNA, 16 nt, Homo sapiens
uaauuuaaaagcacac

SEQ ID NO: 2232751 - RNA, 16 nt, Homo sapiens
uuacuuucauguacua

SEQ ID NO: 2232752 - RNA, 22 nt, Homo sapiens
gguugcuguauuuguucaguga

SEQ ID NO: 2232753 - RNA, 22 nt, Homo sapiens
acauuaucgggagcagugucuu

SEQ ID NO: 2232754 - RNA, 13 nt, Homo sapiens
uuuaacacuuucu

SEQ ID NO: 2232755 - RNA, 20 nt, Homo sapiens
ucauaauuuccaugauacaa

SEQ ID NO: 2232756 - RNA, 15 nt, Homo sapiens
aacagggcaacugua

SEQ ID NO: 2232757 - RNA, 19 nt, Homo sapiens
aauguucaucaauucccau

SEQ ID NO: 2232758 - RNA, 14 nt, Homo sapiens
ggcagcaggccaga

SEQ ID NO: 2232759 - RNA, 14 nt, Homo sapiens
cgucacagccucaa

SEQ ID NO: 2232760 - RNA, 16 nt, Homo sapiens
aaguuucugucuuccu

SEQ ID NO: 2232761 - RNA, 15 nt, Homo sapiens
auuacaggugugcac

SEQ ID NO: 2232762 - RNA, 17 nt, Homo sapiens
aacaugcucauguguac

SEQ ID NO: 2232763 - RNA, 15 nt, Homo sapiens
ugccccucuguucuc

SEQ ID NO: 2232764 - RNA, 17 nt, Homo sapiens
augggcaugaauggaga

SEQ ID NO: 2232765 - RNA, 13 nt, Homo sapiens
caguucagcuuua

SEQ ID NO: 2232766 - RNA, 17 nt, Homo sapiens
cucggacaccaagcaga

SEQ ID NO: 2232767 - RNA, 19 nt, Homo sapiens
auguaucaaauguaacuua

SEQ ID NO: 2232768 - RNA, 18 nt, Homo sapiens
aggaggcaaagguucuau

SEQ ID NO: 2232769 - RNA, 15 nt, Homo sapiens
ugccauuucucaggg

SEQ ID NO: 2232770 - RNA, 12 nt, Homo sapiens
cuagaugccaau

SEQ ID NO: 2232771 - RNA, 16 nt, Homo sapiens
cuucagagaagucagu

SEQ ID NO: 2232772 - RNA, 13 nt, Homo sapiens
acgucagccaaau

SEQ ID NO: 2232773 - RNA, 14 nt, Homo sapiens
acaaaccacaccac

SEQ ID NO: 2232774 - RNA, 14 nt, Homo sapiens
cacagccaacacgc

SEQ ID NO: 2232775 - RNA, 16 nt, Homo sapiens
aggcacauacaccucg

SEQ ID NO: 2232776 - RNA, 16 nt, Homo sapiens
cuagccuuuauuauua

SEQ ID NO: 2232777 - RNA, 18 nt, Homo sapiens
ugauaugcacuauauuca

SEQ ID NO: 2232778 - RNA, 22 nt, Homo sapiens
uugaacuucugacuacuuguug

SEQ ID NO: 2232779 - RNA, 21 nt, Homo sapiens
ugaauccucucucuguguuac

SEQ ID NO: 2232780 - RNA, 17 nt, Homo sapiens
auacuaagagauuugcu

SEQ ID NO: 2232781 - RNA, 20 nt, Homo sapiens
ugcaggacauuuggcuguga

SEQ ID NO: 2232782 - RNA, 20 nt, Homo sapiens
caccuggagaguacauuugc

SEQ ID NO: 2232783 - RNA, 12 nt, Homo sapiens
accauacaaaaa

SEQ ID NO: 2232784 - RNA, 13 nt, Homo sapiens
uucacauuccuga

SEQ ID NO: 2232785 - RNA, 18 nt, Homo sapiens
uggcugguaaauugccau

SEQ ID NO: 2232786 - RNA, 16 nt, Homo sapiens
ggccucuucucucaga

SEQ ID NO: 2232787 - RNA, 22 nt, Homo sapiens
ccugacucccccauuguguuaa

SEQ ID NO: 2232788 - RNA, 14 nt, Homo sapiens
aaaaguugugcaug

SEQ ID NO: 2232789 - RNA, 21 nt, Homo sapiens
caaugaaucaaugugcuccuu

SEQ ID NO: 2232790 - RNA, 19 nt, Homo sapiens
cuuguguaauggaaugcaa

SEQ ID NO: 2232791 - RNA, 20 nt, Homo sapiens
guaacacacacacacauaca

SEQ ID NO: 2232792 - RNA, 20 nt, Homo sapiens
gccccuccccaacuccuucc

SEQ ID NO: 2232793 - RNA, 12 nt, Homo sapiens
ucaguaccaaag

SEQ ID NO: 2232794 - RNA, 12 nt, Homo sapiens
aaccuaccuccc

SEQ ID NO: 2232795 - RNA, 17 nt, Homo sapiens
cuucuaaguaaauacaa

SEQ ID NO: 2232796 - RNA, 12 nt, Homo sapiens
aaaaaaagccaa

SEQ ID NO: 2232797 - RNA, 15 nt, Homo sapiens
ccccucauugcauuu

SEQ ID NO: 2232798 - RNA, 22 nt, Homo sapiens
cccaguuaauacuccagagaca

SEQ ID NO: 2232799 - RNA, 15 nt, Homo sapiens
acagacuucuuggua

SEQ ID NO: 2232800 - RNA, 21 nt, Homo sapiens
uuuauugugaauuacaguuga

SEQ ID NO: 2232801 - RNA, 15 nt, Homo sapiens
ugucccaucugcccu

SEQ ID NO: 2232802 - RNA, 13 nt, Homo sapiens
gaagcugugucuu

SEQ ID NO: 2232803 - RNA, 19 nt, Homo sapiens
cacggugggagaccugcug

SEQ ID NO: 2232804 - RNA, 21 nt, Homo sapiens
aaauaaauugccucccuuccu

SEQ ID NO: 2232805 - RNA, 12 nt, Homo sapiens
uucauauugcau

SEQ ID NO: 2232806 - RNA, 20 nt, Homo sapiens
cccaggaggcagcucaggau

SEQ ID NO: 2232807 - RNA, 19 nt, Homo sapiens
auaauaaggggaagacuuu

SEQ ID NO: 2232808 - RNA, 13 nt, Homo sapiens
uagaaucuuuuaa

SEQ ID NO: 2232809 - RNA, 16 nt, Homo sapiens
ggucaagggccaguca

SEQ ID NO: 2232810 - RNA, 19 nt, Homo sapiens
uucaaacuaccuauauucc

SEQ ID NO: 2232811 - RNA, 13 nt, Homo sapiens
ucccagcauuugu

SEQ ID NO: 2232812 - RNA, 19 nt, Homo sapiens
uggaucaacuaauguuguu

SEQ ID NO: 2232813 - RNA, 18 nt, Homo sapiens
ccuauaaccauguucuau

SEQ ID NO: 2232814 - RNA, 22 nt, Homo sapiens
uaugauuagagggaugagacag

SEQ ID NO: 2232815 - RNA, 22 nt, Homo sapiens
caguaaaaauggaaacuauauu

SEQ ID NO: 2232816 - RNA, 18 nt, Homo sapiens
uccuuaguacaugcucug

SEQ ID NO: 2232817 - RNA, 22 nt, Homo sapiens
cccaggcaggggcuucccacag

SEQ ID NO: 2232818 - RNA, 21 nt, Homo sapiens
augaaacacuuucaggaccuu

SEQ ID NO: 2232819 - RNA, 20 nt, Homo sapiens
gacuggguuuugugauugcc

SEQ ID NO: 2232820 - RNA, 15 nt, Homo sapiens
uuguacuaugcuguu

SEQ ID NO: 2232821 - RNA, 16 nt, Homo sapiens
ugaugucuccccugga

SEQ ID NO: 2232822 - RNA, 17 nt, Homo sapiens
uuguuauguaccauaau

SEQ ID NO: 2232823 - RNA, 16 nt, Homo sapiens
caaagcuuccauucca

SEQ ID NO: 2232824 - RNA, 12 nt, Homo sapiens
cugaugaucaaa

SEQ ID NO: 2232825 - RNA, 16 nt, Homo sapiens
aggcacuuaaagccuu

SEQ ID NO: 2232826 - RNA, 21 nt, Homo sapiens
agaaaggccaaggugcuggac

SEQ ID NO: 2232827 - RNA, 20 nt, Homo sapiens
ugaaggcauccccaggcccu

SEQ ID NO: 2232828 - RNA, 18 nt, Homo sapiens
acaagagcgaaacuccau

SEQ ID NO: 2232829 - RNA, 18 nt, Homo sapiens
ggcauuuaguacauccag

SEQ ID NO: 2232830 - RNA, 19 nt, Homo sapiens
ugcaaaagguggcccuuca

SEQ ID NO: 2232831 - RNA, 19 nt, Homo sapiens
aagaccaguuuccauuuau

SEQ ID NO: 2232832 - RNA, 15 nt, Homo sapiens
cugaaaaaggacuuu

SEQ ID NO: 2232833 - RNA, 19 nt, Homo sapiens
cuuguuuuaaguugcuuua

SEQ ID NO: 2232834 - RNA, 15 nt, Homo sapiens
aaaugaauacugaau

SEQ ID NO: 2232835 - RNA, 18 nt, Homo sapiens
cuccucuucacuuggcca

SEQ ID NO: 2232836 - RNA, 20 nt, Homo sapiens
uucaucugaaacccacagau

SEQ ID NO: 2232837 - RNA, 15 nt, Homo sapiens
uaucgcuccuauuga

SEQ ID NO: 2232838 - RNA, 12 nt, Homo sapiens
ucauuucacugu

SEQ ID NO: 2232839 - RNA, 19 nt, Homo sapiens
cccaccuagugcuuccacu

SEQ ID NO: 2232840 - RNA, 12 nt, Homo sapiens
gucuucaucugu

SEQ ID NO: 2232841 - RNA, 18 nt, Homo sapiens
cagcacccccagugcagc

SEQ ID NO: 2232842 - RNA, 17 nt, Homo sapiens
ugucgauuuaugccuca

SEQ ID NO: 2232843 - RNA, 16 nt, Homo sapiens
guuuugguugcuuuaa

SEQ ID NO: 2232844 - RNA, 15 nt, Homo sapiens
ugcaagagugacagu

SEQ ID NO: 2232845 - RNA, 13 nt, Homo sapiens
uuguuuguuuauu

SEQ ID NO: 2232846 - RNA, 13 nt, Homo sapiens
guguguguguaug

SEQ ID NO: 2232847 - RNA, 13 nt, Homo sapiens
aaauuuguaaguu

SEQ ID NO: 2232848 - RNA, 14 nt, Homo sapiens
cacaccauugcacu

SEQ ID NO: 2232849 - RNA, 16 nt, Homo sapiens
ccuuuagaaccuuaaa

SEQ ID NO: 2232850 - RNA, 12 nt, Homo sapiens
cucucaccucau

SEQ ID NO: 2232851 - RNA, 16 nt, Homo sapiens
caggaggucaagauca

SEQ ID NO: 2232852 - RNA, 14 nt, Homo sapiens
cauuuuauuacacu

SEQ ID NO: 2232853 - RNA, 22 nt, Homo sapiens
ugcagguguccugagcaccaca

SEQ ID NO: 2232854 - RNA, 13 nt, Homo sapiens
cugccuucuuggg

SEQ ID NO: 2232855 - RNA, 23 nt, Homo sapiens
ugggcauggugcgggcaccugua

SEQ ID NO: 2232856 - RNA, 15 nt, Homo sapiens
uaaauaacagugugu

SEQ ID NO: 2232857 - RNA, 12 nt, Homo sapiens
auacaucaaaga

SEQ ID NO: 2232858 - RNA, 12 nt, Homo sapiens
cugaaucacaac

SEQ ID NO: 2232859 - RNA, 12 nt, Homo sapiens
caacaucacuga

SEQ ID NO: 2232860 - RNA, 18 nt, Homo sapiens
acagugacuucugagauc

SEQ ID NO: 2232861 - RNA, 14 nt, Homo sapiens
uaaaguaagacauc

SEQ ID NO: 2232862 - RNA, 13 nt, Homo sapiens
uaagaugaucauc

SEQ ID NO: 2232863 - RNA, 16 nt, Homo sapiens
aagcugaaaggaugau

SEQ ID NO: 2232864 - RNA, 13 nt, Homo sapiens
ugcuguuucuaca

SEQ ID NO: 2232865 - RNA, 17 nt, Homo sapiens
ggagcucacacuccagu

SEQ ID NO: 2232866 - RNA, 15 nt, Homo sapiens
ugguggcccagcuau

SEQ ID NO: 2232867 - RNA, 21 nt, Homo sapiens
uguucccuaggggacacuucc

SEQ ID NO: 2232868 - RNA, 17 nt, Homo sapiens
ugaggcuugacagaguc

SEQ ID NO: 2232869 - RNA, 16 nt, Homo sapiens
cucccaggaagcccag

SEQ ID NO: 2232870 - RNA, 17 nt, Homo sapiens
ucagauucaggagcuca

SEQ ID NO: 2232871 - RNA, 21 nt, Homo sapiens
cgcaaacacaccgaugcacac

SEQ ID NO: 2232872 - RNA, 17 nt, Homo sapiens
augagggugacugucaa

SEQ ID NO: 2232873 - RNA, 19 nt, Homo sapiens
ugcacaacauuacagggaa

SEQ ID NO: 2232874 - RNA, 19 nt, Homo sapiens
ggacagucagcauuucuag

SEQ ID NO: 2232875 - RNA, 22 nt, Homo sapiens
aaccuuuuuucuugcuacugaa

SEQ ID NO: 2232876 - RNA, 23 nt, Homo sapiens
gccccugcccugaggagggcccu

SEQ ID NO: 2232877 - RNA, 15 nt, Homo sapiens
gggaaccuccuuacc

SEQ ID NO: 2232878 - RNA, 15 nt, Homo sapiens
acugaaacuuaccug

SEQ ID NO: 2232879 - RNA, 14 nt, Homo sapiens
uuauaagcauuugu

SEQ ID NO: 2232880 - RNA, 14 nt, Homo sapiens
ucaaagaaguacuu

SEQ ID NO: 2232881 - RNA, 15 nt, Homo sapiens
ccugggauguccaca

SEQ ID NO: 2232882 - RNA, 20 nt, Homo sapiens
aucacuucugaagucccugc

SEQ ID NO: 2232883 - RNA, 12 nt, Homo sapiens
ccaacauguauc

SEQ ID NO: 2232884 - RNA, 23 nt, Homo sapiens
aggaccucugggcuuugauucca

SEQ ID NO: 2232885 - RNA, 20 nt, Homo sapiens
gcaguauuguuagacauuuu

SEQ ID NO: 2232886 - RNA, 12 nt, Homo sapiens
aaauacauuccu

SEQ ID NO: 2232887 - RNA, 20 nt, Homo sapiens
agagccagggcagggcgagc

SEQ ID NO: 2232888 - RNA, 15 nt, Homo sapiens
cauuacacaguucag

SEQ ID NO: 2232889 - RNA, 20 nt, Homo sapiens
aucuucaucccaacagccca

SEQ ID NO: 2232890 - RNA, 15 nt, Homo sapiens
ugcuccaagauucua

SEQ ID NO: 2232891 - RNA, 22 nt, Homo sapiens
cugucccggagcucaggcccug

SEQ ID NO: 2232892 - RNA, 14 nt, Homo sapiens
acgggcucagcaaa

SEQ ID NO: 2232893 - RNA, 14 nt, Homo sapiens
aggaguaacuugca

SEQ ID NO: 2232894 - RNA, 14 nt, Homo sapiens
cauugcugcugcua

SEQ ID NO: 2232895 - RNA, 14 nt, Homo sapiens
agccucaaauuuga

SEQ ID NO: 2232896 - RNA, 14 nt, Homo sapiens
uaacaucugaccug

SEQ ID NO: 2232897 - RNA, 14 nt, Homo sapiens
ucccagcugcacuu

SEQ ID NO: 2232898 - RNA, 11 nt, Homo sapiens
cugcuucucac

SEQ ID NO: 2232899 - RNA, 13 nt, Homo sapiens
cuaaugccucuuc

SEQ ID NO: 2232900 - RNA, 18 nt, Homo sapiens
aguguauuaucacugucu

SEQ ID NO: 2232901 - RNA, 19 nt, Homo sapiens
agugguuucuugugcacug

SEQ ID NO: 2232902 - RNA, 23 nt, Homo sapiens
uucccaaugcuuuguccaugaug

SEQ ID NO: 2232903 - RNA, 21 nt, Homo sapiens
uucaaaagcacuuugugcugu

SEQ ID NO: 2232904 - RNA, 23 nt, Homo sapiens
uguuacuguucuugcugcuagaa

SEQ ID NO: 2232905 - RNA, 18 nt, Homo sapiens
agagggcccaguggugcc

SEQ ID NO: 2232906 - RNA, 22 nt, Homo sapiens
cacuggggaagagaaaagccca

SEQ ID NO: 2232907 - RNA, 15 nt, Homo sapiens
aauucagacagagac

SEQ ID NO: 2232908 - RNA, 21 nt, Homo sapiens
gggcaccaagaccccaaaggg

SEQ ID NO: 2232909 - RNA, 23 nt, Homo sapiens
ugacauggacacaucaggaaguu

SEQ ID NO: 2232910 - RNA, 20 nt, Homo sapiens
uaaagugagaaaacugugac

SEQ ID NO: 2232911 - RNA, 20 nt, Homo sapiens
gaggugggauccucccucau

SEQ ID NO: 2232912 - RNA, 18 nt, Homo sapiens
cgaggaguaacaauacaa

SEQ ID NO: 2232913 - RNA, 16 nt, Homo sapiens
uaguuucagugcauua

SEQ ID NO: 2232914 - RNA, 13 nt, Homo sapiens
acuaggcucauac

SEQ ID NO: 2232915 - RNA, 17 nt, Homo sapiens
cucuuguuccugaaaug

SEQ ID NO: 2232916 - RNA, 19 nt, Homo sapiens
gcuuccgagggcacuaccg

SEQ ID NO: 2232917 - RNA, 15 nt, Homo sapiens
ggccugagagucagc

SEQ ID NO: 2232918 - RNA, 14 nt, Homo sapiens
aucuacacugccuu

SEQ ID NO: 2232919 - RNA, 23 nt, Homo sapiens
ggcggaauaaugggcauugagau

SEQ ID NO: 2232920 - RNA, 19 nt, Homo sapiens
agcaacuucuagcauauag

SEQ ID NO: 2232921 - RNA, 19 nt, Homo sapiens
cuaggguccaccaggaguu

SEQ ID NO: 2232922 - RNA, 22 nt, Homo sapiens
aauaguucccuuugccaacaga

SEQ ID NO: 2232923 - RNA, 15 nt, Homo sapiens
acuaagaucuguuaa

SEQ ID NO: 2232924 - RNA, 20 nt, Homo sapiens
guauuuuuucuugcauugac

SEQ ID NO: 2232925 - RNA, 19 nt, Homo sapiens
ucuuacauuuucucugaug

SEQ ID NO: 2232926 - RNA, 17 nt, Homo sapiens
gccccaucugugcauuc

SEQ ID NO: 2232927 - RNA, 15 nt, Homo sapiens
cuuacuaaauaucau

SEQ ID NO: 2232928 - RNA, 19 nt, Homo sapiens
aauuugagugguguuguca

SEQ ID NO: 2232929 - RNA, 21 nt, Homo sapiens
uaauugauuauucugauucca

SEQ ID NO: 2232930 - RNA, 18 nt, Homo sapiens
auccagagagcagugugg

SEQ ID NO: 2232931 - RNA, 14 nt, Homo sapiens
aaaagugaucucug

SEQ ID NO: 2232932 - RNA, 21 nt, Homo sapiens
caugaucgagccacugcacuc

SEQ ID NO: 2232933 - RNA, 18 nt, Homo sapiens
cagagaaaggcaagggag

SEQ ID NO: 2232934 - RNA, 19 nt, Homo sapiens
caugaauauuucauaucua

SEQ ID NO: 2232935 - RNA, 17 nt, Homo sapiens
agaccuuucuuugggac

SEQ ID NO: 2232936 - RNA, 16 nt, Homo sapiens
cauagcuugauugcuc

SEQ ID NO: 2232937 - RNA, 21 nt, Homo sapiens
auuuugaaaaauuaccuguau

SEQ ID NO: 2232938 - RNA, 23 nt, Homo sapiens
gacuaagaugaaaugcacuguau

SEQ ID NO: 2232939 - RNA, 17 nt, Homo sapiens
gagaugaaucaaaacca

SEQ ID NO: 2232940 - RNA, 16 nt, Homo sapiens
ugccgagccuaaugaa

SEQ ID NO: 2232941 - RNA, 18 nt, Homo sapiens
uccuguguguggaaggca

SEQ ID NO: 2232942 - RNA, 19 nt, Homo sapiens
aauccucugggagcuucuu

SEQ ID NO: 2232943 - RNA, 19 nt, Homo sapiens
cuuggacaggagucagugu

SEQ ID NO: 2232944 - RNA, 14 nt, Homo sapiens
aggccguggcugcc

SEQ ID NO: 2232945 - RNA, 16 nt, Homo sapiens
cuuucagaaaacggga

SEQ ID NO: 2232946 - RNA, 19 nt, Homo sapiens
uacucaguaacagugcagu

SEQ ID NO: 2232947 - RNA, 12 nt, Homo sapiens
aagcacugugga

SEQ ID NO: 2232948 - RNA, 16 nt, Homo sapiens
cuguuaaucugaugua

SEQ ID NO: 2232949 - RNA, 18 nt, Homo sapiens
ugaacauuacauugccau

SEQ ID NO: 2232950 - RNA, 15 nt, Homo sapiens
auagagugugaugua

SEQ ID NO: 2232951 - RNA, 19 nt, Homo sapiens
gaagugaggcauugcacag

SEQ ID NO: 2232952 - RNA, 22 nt, Homo sapiens
agacccaacuuucucacugcug

SEQ ID NO: 2232953 - RNA, 21 nt, Homo sapiens
augaggcugcuuuccaaagcc

SEQ ID NO: 2232954 - RNA, 20 nt, Homo sapiens
auguucaauagaacaugcaa

SEQ ID NO: 2232955 - RNA, 21 nt, Homo sapiens
aacuaguauuguccauaucag

SEQ ID NO: 2232956 - RNA, 14 nt, Homo sapiens
aggaagcuuaggga

SEQ ID NO: 2232957 - RNA, 13 nt, Homo sapiens
gcgcaacauuucu

SEQ ID NO: 2232958 - RNA, 13 nt, Homo sapiens
uagcccaaaacaa

SEQ ID NO: 2232959 - RNA, 23 nt, Homo sapiens
acccccagaccauacugacucaa

SEQ ID NO: 2232960 - RNA, 21 nt, Homo sapiens
ugugacuauaaagcuguuauu

SEQ ID NO: 2232961 - RNA, 20 nt, Homo sapiens
acagagcaggggcuccagca

SEQ ID NO: 2232962 - RNA, 15 nt, Homo sapiens
gcagacucauugcag

SEQ ID NO: 2232963 - RNA, 21 nt, Homo sapiens
ucagucaugcacucacaaaga

SEQ ID NO: 2232964 - RNA, 18 nt, Homo sapiens
uuuugaaacccacaguuu

SEQ ID NO: 2232965 - RNA, 15 nt, Homo sapiens
aacuguacugggcca

SEQ ID NO: 2232966 - RNA, 23 nt, Homo sapiens
ugcagauaaacagaaaugcucug

SEQ ID NO: 2232967 - RNA, 13 nt, Homo sapiens
ugggacccacaga

SEQ ID NO: 2232968 - RNA, 11 nt, Homo sapiens
cccuguugcuu

SEQ ID NO: 2232969 - RNA, 11 nt, Homo sapiens
cuuuguugccc

SEQ ID NO: 2232970 - RNA, 16 nt, Homo sapiens
aaaugcacucaucaca

SEQ ID NO: 2232971 - RNA, 11 nt, Homo sapiens
ucuuguuguuc

SEQ ID NO: 2232972 - RNA, 20 nt, Homo sapiens
aauggacauaagacagacag

SEQ ID NO: 2232973 - RNA, 23 nt, Homo sapiens
cuugcaauccaggcuguucucag

SEQ ID NO: 2232974 - RNA, 14 nt, Homo sapiens
ggaagucagacuuu

SEQ ID NO: 2232975 - RNA, 13 nt, Homo sapiens
acaacagcacaca

SEQ ID NO: 2232976 - RNA, 23 nt, Homo sapiens
ccuuaggucgcgcucuugcacac

SEQ ID NO: 2232977 - RNA, 21 nt, Homo sapiens
aauccacgcucaaucucaggu

SEQ ID NO: 2232978 - RNA, 15 nt, Homo sapiens
ccaaggcaguucugu

SEQ ID NO: 2232979 - RNA, 14 nt, Homo sapiens
cagcuaugcaaauc

SEQ ID NO: 2232980 - RNA, 23 nt, Homo sapiens
cccaugucagauugaauguauuu

SEQ ID NO: 2232981 - RNA, 22 nt, Homo sapiens
agucaguuucuaucauucugcu

SEQ ID NO: 2232982 - RNA, 15 nt, Homo sapiens
caugaguaucaucag

SEQ ID NO: 2232983 - RNA, 20 nt, Homo sapiens
ucuuuccuucuugccuucag

SEQ ID NO: 2232984 - RNA, 18 nt, Homo sapiens
uggagucuuguacacuua

SEQ ID NO: 2232985 - RNA, 20 nt, Homo sapiens
ccaaguuggagugcaauggu

SEQ ID NO: 2232986 - RNA, 17 nt, Homo sapiens
gaaucaagagcugcccu

SEQ ID NO: 2232987 - RNA, 21 nt, Homo sapiens
cugaauauuuauuuuaagggu

SEQ ID NO: 2232988 - RNA, 19 nt, Homo sapiens
ugccuccugguaacagcua

SEQ ID NO: 2232989 - RNA, 20 nt, Homo sapiens
gagccuuggcuguuggcagu

SEQ ID NO: 2232990 - RNA, 14 nt, Homo sapiens
cccuggcucaggga

SEQ ID NO: 2232991 - RNA, 20 nt, Homo sapiens
uugggacgcacagugcaguu

SEQ ID NO: 2232992 - RNA, 17 nt, Homo sapiens
ugggagacacugaugua

SEQ ID NO: 2232993 - RNA, 24 nt, Homo sapiens
agaagaaaauuauggcauauauua

SEQ ID NO: 2232994 - RNA, 16 nt, Homo sapiens
aauaaaagaucuugaa

SEQ ID NO: 2232995 - RNA, 16 nt, Homo sapiens
cuguguccaagaacuc

SEQ ID NO: 2232996 - RNA, 21 nt, Homo sapiens
augugcuggugaacacuguga

SEQ ID NO: 2232997 - RNA, 18 nt, Homo sapiens
agcugcuguuuuuagacu

SEQ ID NO: 2232998 - RNA, 13 nt, Homo sapiens
uucauaucuauaa

SEQ ID NO: 2232999 - RNA, 21 nt, Homo sapiens
ugcccuuuaacaagacuucaa

SEQ ID NO: 2233000 - RNA, 22 nt, Homo sapiens
agucauugucgcucagcaauag

SEQ ID NO: 2233001 - RNA, 17 nt, Homo sapiens
gagcaagucccaucuca

SEQ ID NO: 2233002 - RNA, 21 nt, Homo sapiens
ugccucugccaugcccagaga

SEQ ID NO: 2233003 - RNA, 16 nt, Homo sapiens
cuucgugcaacuguag

SEQ ID NO: 2233004 - RNA, 19 nt, Homo sapiens
agcaaugcauucuggagac

SEQ ID NO: 2233005 - RNA, 18 nt, Homo sapiens
aacuugauucuugugauu

SEQ ID NO: 2233006 - RNA, 22 nt, Homo sapiens
ugaaaagggaugaugugguuuu

SEQ ID NO: 2233007 - RNA, 17 nt, Homo sapiens
ccagcagcagagaacca

SEQ ID NO: 2233008 - RNA, 21 nt, Homo sapiens
uuuuuucauuuugccaaaaag

SEQ ID NO: 2233009 - RNA, 17 nt, Homo sapiens
uccugaaagcauuauuu

SEQ ID NO: 2233010 - RNA, 17 nt, Homo sapiens
agccacugguuucucag

SEQ ID NO: 2233011 - RNA, 12 nt, Homo sapiens
agcugcucaggc

SEQ ID NO: 2233012 - RNA, 17 nt, Homo sapiens
gacaacugcacaugaaa

SEQ ID NO: 2233013 - RNA, 14 nt, Homo sapiens
acacuuacugcaaa

SEQ ID NO: 2233014 - RNA, 14 nt, Homo sapiens
uccuuugauuccaa

SEQ ID NO: 2233015 - RNA, 20 nt, Homo sapiens
augauuugcuguuaccaaau

SEQ ID NO: 2233016 - RNA, 21 nt, Homo sapiens
cuuuaaauaaaagagguccau

SEQ ID NO: 2233017 - RNA, 14 nt, Homo sapiens
auuauccacugcaa

SEQ ID NO: 2233018 - RNA, 20 nt, Homo sapiens
aggccggaugcgguggcuca

SEQ ID NO: 2233019 - RNA, 21 nt, Homo sapiens
cugcugagccagauuccccag

SEQ ID NO: 2233020 - RNA, 20 nt, Homo sapiens
gagggccggugcgacccagu

SEQ ID NO: 2233021 - RNA, 19 nt, Homo sapiens
aaacacccuccuggcacaa

SEQ ID NO: 2233022 - RNA, 14 nt, Homo sapiens
uucaaaaaaucagc

SEQ ID NO: 2233023 - RNA, 14 nt, Homo sapiens
aaaaacaauaaaga

SEQ ID NO: 2233024 - RNA, 23 nt, Homo sapiens
uggagaaccagggcucuucucag

SEQ ID NO: 2233025 - RNA, 13 nt, Homo sapiens
uuccuccucagcc

SEQ ID NO: 2233026 - RNA, 15 nt, Homo sapiens
aaugccaucacugga

SEQ ID NO: 2233027 - RNA, 14 nt, Homo sapiens
ugggauuacaggga

SEQ ID NO: 2233028 - RNA, 20 nt, Homo sapiens
ugaugaggaaggacuugacu

SEQ ID NO: 2233029 - RNA, 16 nt, Homo sapiens
uaauccagucuaucau

SEQ ID NO: 2233030 - RNA, 15 nt, Homo sapiens
augcucauuccauga

SEQ ID NO: 2233031 - RNA, 15 nt, Homo sapiens
guaugaauagcugug

SEQ ID NO: 2233032 - RNA, 15 nt, Homo sapiens
aguuguaucacuuaa

SEQ ID NO: 2233033 - RNA, 18 nt, Homo sapiens
aguauggcaugaacaucu

SEQ ID NO: 2233034 - RNA, 13 nt, Homo sapiens
gaccuccggccag

SEQ ID NO: 2233035 - RNA, 22 nt, Homo sapiens
ugaccacucuuccugaguucag

SEQ ID NO: 2233036 - RNA, 22 nt, Homo sapiens
aacccuuuauuugaacaaugaa

SEQ ID NO: 2233037 - RNA, 13 nt, Homo sapiens
ccuuuauugugau

SEQ ID NO: 2233038 - RNA, 14 nt, Homo sapiens
gcuccugugcucac

SEQ ID NO: 2233039 - RNA, 18 nt, Homo sapiens
uuucccugcauucaccug

SEQ ID NO: 2233040 - RNA, 19 nt, Homo sapiens
accaguaugaaugacaauu

SEQ ID NO: 2233041 - RNA, 15 nt, Homo sapiens
uagauauacauauca

SEQ ID NO: 2233042 - RNA, 20 nt, Homo sapiens
caggggcuggggaguggaca

SEQ ID NO: 2233043 - RNA, 20 nt, Homo sapiens
uauaagcauacaacuggacu

SEQ ID NO: 2233044 - RNA, 19 nt, Homo sapiens
gaaagaaaaaaaaauacuu

SEQ ID NO: 2233045 - RNA, 19 nt, Homo sapiens
cuuaaaauguaagauuaua

SEQ ID NO: 2233046 - RNA, 18 nt, Homo sapiens
uuuauuggggugccuauu

SEQ ID NO: 2233047 - RNA, 13 nt, Homo sapiens
gugcaagaugggg

SEQ ID NO: 2233048 - RNA, 21 nt, Homo sapiens
cgggaugguucuucuccaguu

SEQ ID NO: 2233049 - RNA, 14 nt, Homo sapiens
uauguuaacugaca

SEQ ID NO: 2233050 - RNA, 19 nt, Homo sapiens
accucccaaacccagccuc

SEQ ID NO: 2233051 - RNA, 12 nt, Homo sapiens
gcguuguucaua

SEQ ID NO: 2233052 - RNA, 17 nt, Homo sapiens
gcaguggcaucaucuca

SEQ ID NO: 2233053 - RNA, 17 nt, Homo sapiens
ccagggcucuguauucu

SEQ ID NO: 2233054 - RNA, 20 nt, Homo sapiens
ugcacuucuuacgacuuuuu

SEQ ID NO: 2233055 - RNA, 18 nt, Homo sapiens
cgaggcaaugacugugag

SEQ ID NO: 2233056 - RNA, 13 nt, Homo sapiens
aggaaauggcugu

SEQ ID NO: 2233057 - RNA, 19 nt, Homo sapiens
ccgcucugcagacugcugc

SEQ ID NO: 2233058 - RNA, 22 nt, Homo sapiens
aguccugaagaucaagccaguu

SEQ ID NO: 2233059 - RNA, 20 nt, Homo sapiens
uguuuguacacaacaccuaa

SEQ ID NO: 2233060 - RNA, 15 nt, Homo sapiens
cagccuggggugacc

SEQ ID NO: 2233061 - RNA, 20 nt, Homo sapiens
caccugucgcacccacugug

SEQ ID NO: 2233062 - RNA, 21 nt, Homo sapiens
gugcacugcaaugccaggugg

SEQ ID NO: 2233063 - RNA, 16 nt, Homo sapiens
guuauucaauaacuau

SEQ ID NO: 2233064 - RNA, 14 nt, Homo sapiens
accaauaacuucag

SEQ ID NO: 2233065 - RNA, 19 nt, Homo sapiens
auaaaacaaaaccaacuca

SEQ ID NO: 2233066 - RNA, 23 nt, Homo sapiens
cacacacagaugcacacacagau

SEQ ID NO: 2233067 - RNA, 23 nt, Homo sapiens
aagaucaauucccucucucagca

SEQ ID NO: 2233068 - RNA, 20 nt, Homo sapiens
cacugaggcagcgaccucaa

SEQ ID NO: 2233069 - RNA, 16 nt, Homo sapiens
uaacgcugacugcaaa

SEQ ID NO: 2233070 - RNA, 19 nt, Homo sapiens
accccugccuuuucauugc

SEQ ID NO: 2233071 - RNA, 22 nt, Homo sapiens
aaauuauugacgcuuaaccuuu

SEQ ID NO: 2233072 - RNA, 19 nt, Homo sapiens
gcagaaauuuaaacucuga

SEQ ID NO: 2233073 - RNA, 22 nt, Homo sapiens
aucauguaaauguauuggcaca

SEQ ID NO: 2233074 - RNA, 13 nt, Homo sapiens
cagauuguucuca

SEQ ID NO: 2233075 - RNA, 21 nt, Homo sapiens
agcccuccccaccugcucacc

SEQ ID NO: 2233076 - RNA, 20 nt, Homo sapiens
uuaaaacaaaggaaguucuc

SEQ ID NO: 2233077 - RNA, 22 nt, Homo sapiens
agcugauggccuuguuucaaaa

SEQ ID NO: 2233078 - RNA, 18 nt, Homo sapiens
gccguuuguuccccaaga

SEQ ID NO: 2233079 - RNA, 20 nt, Homo sapiens
aacuguaaauugagauuuaa

SEQ ID NO: 2233080 - RNA, 11 nt, Homo sapiens
cauuugugccc

SEQ ID NO: 2233081 - RNA, 11 nt, Homo sapiens
cccuugugcau

SEQ ID NO: 2233082 - RNA, 13 nt, Homo sapiens
uguuaacauuagc

SEQ ID NO: 2233083 - RNA, 23 nt, Homo sapiens
gcccaccuuauagagagcccaaa

SEQ ID NO: 2233084 - RNA, 14 nt, Homo sapiens
cuugaauguucucu

SEQ ID NO: 2233085 - RNA, 17 nt, Homo sapiens
agccagaggacugugau

SEQ ID NO: 2233086 - RNA, 16 nt, Homo sapiens
uucauuguuucaacuc

SEQ ID NO: 2233087 - RNA, 15 nt, Homo sapiens
cugugugcucuccaa

SEQ ID NO: 2233088 - RNA, 16 nt, Homo sapiens
aagucucacagguagu

SEQ ID NO: 2233089 - RNA, 14 nt, Homo sapiens
ucuccucugcagcu

SEQ ID NO: 2233090 - RNA, 21 nt, Homo sapiens
agguauggcagaggugcaaga

SEQ ID NO: 2233091 - RNA, 12 nt, Homo sapiens
cuuucaaagugu

SEQ ID NO: 2233092 - RNA, 20 nt, Homo sapiens
ugcucuggaggaaguucucc

SEQ ID NO: 2233093 - RNA, 21 nt, Homo sapiens
ggccuuugcuuuacagcacug

SEQ ID NO: 2233094 - RNA, 14 nt, Homo sapiens
gugcagauugcagu

SEQ ID NO: 2233095 - RNA, 16 nt, Homo sapiens
cugcaaguccacuggg

SEQ ID NO: 2233096 - RNA, 22 nt, Homo sapiens
uuuucuaaacguaagcacuguu

SEQ ID NO: 2233097 - RNA, 18 nt, Homo sapiens
caaagccuugugucuaca

SEQ ID NO: 2233098 - RNA, 13 nt, Homo sapiens
guuacccauuucu

SEQ ID NO: 2233099 - RNA, 13 nt, Homo sapiens
ggccuccaugcac

SEQ ID NO: 2233100 - RNA, 15 nt, Homo sapiens
uaccguguguuauau

SEQ ID NO: 2233101 - RNA, 17 nt, Homo sapiens
uuuagugcuuugugaua

SEQ ID NO: 2233102 - RNA, 17 nt, Homo sapiens
gcccuguguacauauaa

SEQ ID NO: 2233103 - RNA, 15 nt, Homo sapiens
auuucuggcaaauau

SEQ ID NO: 2233104 - RNA, 19 nt, Homo sapiens
aaguuaccauuaaccaagg

SEQ ID NO: 2233105 - RNA, 13 nt, Homo sapiens
acauagugaaagu

SEQ ID NO: 2233106 - RNA, 14 nt, Homo sapiens
aagaggaaagggag

SEQ ID NO: 2233107 - RNA, 13 nt, Homo sapiens
uuguaugguucca

SEQ ID NO: 2233108 - RNA, 16 nt, Homo sapiens
auaaaaauaagaaaua

SEQ ID NO: 2233109 - RNA, 22 nt, Homo sapiens
ccaaagacuacauauugucacu

SEQ ID NO: 2233110 - RNA, 22 nt, Homo sapiens
cauacuccuuuuaagcagugag

SEQ ID NO: 2233111 - RNA, 22 nt, Homo sapiens
acuaucucauuuccaagcaagu

SEQ ID NO: 2233112 - RNA, 20 nt, Homo sapiens
gguuguccucacugcugauu

SEQ ID NO: 2233113 - RNA, 22 nt, Homo sapiens
aagcccaggagccucacugggg

SEQ ID NO: 2233114 - RNA, 16 nt, Homo sapiens
ugcauaguaguuuuaa

SEQ ID NO: 2233115 - RNA, 12 nt, Homo sapiens
auagcugugacu

SEQ ID NO: 2233116 - RNA, 20 nt, Homo sapiens
auuuccuuuuugacacugaa

SEQ ID NO: 2233117 - RNA, 21 nt, Homo sapiens
ugccuccuccugagagcuguu

SEQ ID NO: 2233118 - RNA, 15 nt, Homo sapiens
aagacuguugcucaa

SEQ ID NO: 2233119 - RNA, 21 nt, Homo sapiens
ucacagcaguacuugcucaau

SEQ ID NO: 2233120 - RNA, 11 nt, Homo sapiens
gucacacuggu

SEQ ID NO: 2233121 - RNA, 13 nt, Homo sapiens
cgauguccuccuc

SEQ ID NO: 2233122 - RNA, 16 nt, Homo sapiens
gccucucuuccuaucc

SEQ ID NO: 2233123 - RNA, 21 nt, Homo sapiens
uguggaacauaaaaaggacau

SEQ ID NO: 2233124 - RNA, 16 nt, Homo sapiens
augcugugcagcacuu

SEQ ID NO: 2233125 - RNA, 13 nt, Homo sapiens
gggaacucaccug

SEQ ID NO: 2233126 - RNA, 21 nt, Homo sapiens
aucauuuguuuacauuugaug

SEQ ID NO: 2233127 - RNA, 18 nt, Homo sapiens
cuugaagacaauggcuua

SEQ ID NO: 2233128 - RNA, 16 nt, Homo sapiens
aacaacaauaauaaag

SEQ ID NO: 2233129 - RNA, 17 nt, Homo sapiens
gccuccagcuucaggca

SEQ ID NO: 2233130 - RNA, 16 nt, Homo sapiens
gaacaaauacaauuca

SEQ ID NO: 2233131 - RNA, 22 nt, Homo sapiens
accugccccugccugacagccu

SEQ ID NO: 2233132 - RNA, 15 nt, Homo sapiens
caagcguguucucag

SEQ ID NO: 2233133 - RNA, 19 nt, Homo sapiens
ggcugccagguguggaaca

SEQ ID NO: 2233134 - RNA, 22 nt, Homo sapiens
cagaaauugaaaaugaccaaaa

SEQ ID NO: 2233135 - RNA, 13 nt, Homo sapiens
acuguaaugcugc

SEQ ID NO: 2233136 - RNA, 18 nt, Homo sapiens
uaucacuuccacugcacc

SEQ ID NO: 2233137 - RNA, 13 nt, Homo sapiens
uguagacucuugc

SEQ ID NO: 2233138 - RNA, 12 nt, Homo sapiens
uucuaugagcau

SEQ ID NO: 2233139 - RNA, 20 nt, Homo sapiens
uacuucauucaaaaagccaa

SEQ ID NO: 2233140 - RNA, 12 nt, Homo sapiens
cagccucagaau

SEQ ID NO: 2233141 - RNA, 14 nt, Homo sapiens
ccagcuuuccucau

SEQ ID NO: 2233142 - RNA, 16 nt, Homo sapiens
agccaggugcugugac

SEQ ID NO: 2233143 - RNA, 20 nt, Homo sapiens
uggggcaggcagugaugcug

SEQ ID NO: 2233144 - RNA, 21 nt, Homo sapiens
cagccuggccaucauggugaa

SEQ ID NO: 2233145 - RNA, 21 nt, Homo sapiens
agcagucccaguauucucaga

SEQ ID NO: 2233146 - RNA, 23 nt, Homo sapiens
cugccaggggcuucccacuuugg

SEQ ID NO: 2233147 - RNA, 13 nt, Homo sapiens
aaaccaccuuccc

SEQ ID NO: 2233148 - RNA, 13 nt, Homo sapiens
auccuaccuaacu

SEQ ID NO: 2233149 - RNA, 14 nt, Homo sapiens
aagaguaguuauua

SEQ ID NO: 2233150 - RNA, 20 nt, Homo sapiens
agagaauccauccaaaguuc

SEQ ID NO: 2233151 - RNA, 15 nt, Homo sapiens
ugguuaacaucucag

SEQ ID NO: 2233152 - RNA, 17 nt, Homo sapiens
accaaacauaacauuau

SEQ ID NO: 2233153 - RNA, 20 nt, Homo sapiens
uugacccagggcugucuccc

SEQ ID NO: 2233154 - RNA, 16 nt, Homo sapiens
uggauggggcuuccag

SEQ ID NO: 2233155 - RNA, 20 nt, Homo sapiens
gugucaggcagguuugccag

SEQ ID NO: 2233156 - RNA, 14 nt, Homo sapiens
gagcauuuguuuaa

SEQ ID NO: 2233157 - RNA, 16 nt, Homo sapiens
ucucagauugaccuua

SEQ ID NO: 2233158 - RNA, 18 nt, Homo sapiens
aaauccaagaugcuggca

SEQ ID NO: 2233159 - RNA, 19 nt, Homo sapiens
augcagcuucaggugagcc

SEQ ID NO: 2233160 - RNA, 17 nt, Homo sapiens
uaagaaaaaugagcaua

SEQ ID NO: 2233161 - RNA, 12 nt, Homo sapiens
ucauucugggaa

SEQ ID NO: 2233162 - RNA, 12 nt, Homo sapiens
ugcaucuggccu

SEQ ID NO: 2233163 - RNA, 16 nt, Homo sapiens
gcagucaccaccccag

SEQ ID NO: 2233164 - RNA, 19 nt, Homo sapiens
cacucgccuucugcuucca

SEQ ID NO: 2233165 - RNA, 16 nt, Homo sapiens
cucccuagggccuuca

SEQ ID NO: 2233166 - RNA, 19 nt, Homo sapiens
ucaccauuucuuggcauug

SEQ ID NO: 2233167 - RNA, 13 nt, Homo sapiens
gucagcacuguaa

SEQ ID NO: 2233168 - RNA, 18 nt, Homo sapiens
ccaacugaacugaacuaa

SEQ ID NO: 2233169 - RNA, 15 nt, Homo sapiens
cacacuucauuguaa

SEQ ID NO: 2233170 - RNA, 12 nt, Homo sapiens
uuacuacugugg

SEQ ID NO: 2233171 - RNA, 19 nt, Homo sapiens
caggacuuguuuacaaaga

SEQ ID NO: 2233172 - RNA, 17 nt, Homo sapiens
ucugccauugauccagc

SEQ ID NO: 2233173 - RNA, 18 nt, Homo sapiens
gaauugcuggaugcauuu

SEQ ID NO: 2233174 - RNA, 23 nt, Homo sapiens
aggagacuuuacauggaugccaa

SEQ ID NO: 2233175 - RNA, 15 nt, Homo sapiens
cuuccacaauggucu

SEQ ID NO: 2233176 - RNA, 21 nt, Homo sapiens
aagauccaagaaggccuucau

SEQ ID NO: 2233177 - RNA, 17 nt, Homo sapiens
cuaagccacucuuccaa

SEQ ID NO: 2233178 - RNA, 14 nt, Homo sapiens
agaugcgcaaagag

SEQ ID NO: 2233179 - RNA, 21 nt, Homo sapiens
caggucucuuccuuugcucug

SEQ ID NO: 2233180 - RNA, 13 nt, Homo sapiens
uuguuuuuugcca

SEQ ID NO: 2233181 - RNA, 12 nt, Homo sapiens
gccaauuuacuu

SEQ ID NO: 2233182 - RNA, 13 nt, Homo sapiens
uucuguaaggugg

SEQ ID NO: 2233183 - RNA, 13 nt, Homo sapiens
gguaaauguggug

SEQ ID NO: 2233184 - RNA, 23 nt, Homo sapiens
uagcugugucauguauauaccuu

SEQ ID NO: 2233185 - RNA, 15 nt, Homo sapiens
acaggugugagccac

SEQ ID NO: 2233186 - RNA, 15 nt, Homo sapiens
uauuggucagggugu

SEQ ID NO: 2233187 - RNA, 21 nt, Homo sapiens
uuauuauuuuagagcaucuca

SEQ ID NO: 2233188 - RNA, 17 nt, Homo sapiens
ucaucaaaaagaacaac

SEQ ID NO: 2233189 - RNA, 21 nt, Homo sapiens
gaucaaguccuaguuguucag

SEQ ID NO: 2233190 - RNA, 15 nt, Homo sapiens
ugaacccucuugcca

SEQ ID NO: 2233191 - RNA, 15 nt, Homo sapiens
acaauuaacugcccu

SEQ ID NO: 2233192 - RNA, 22 nt, Homo sapiens
ucagggaacugacccucaggca

SEQ ID NO: 2233193 - RNA, 16 nt, Homo sapiens
accuuuauagcucuca

SEQ ID NO: 2233194 - RNA, 17 nt, Homo sapiens
acugaacuuacacugua

SEQ ID NO: 2233195 - RNA, 17 nt, Homo sapiens
ucugaacaaacacugaa

SEQ ID NO: 2233196 - RNA, 19 nt, Homo sapiens
acuuucagucucucugaaa

SEQ ID NO: 2233197 - RNA, 17 nt, Homo sapiens
cucagauucuucacugg

SEQ ID NO: 2233198 - RNA, 13 nt, Homo sapiens
uucaguauacugu

SEQ ID NO: 2233199 - RNA, 21 nt, Homo sapiens
uucugaucucagagcauuuca

SEQ ID NO: 2233200 - RNA, 16 nt, Homo sapiens
ggcuagaacuggagag

SEQ ID NO: 2233201 - RNA, 22 nt, Homo sapiens
auuuucuuaccucucaguuguu

SEQ ID NO: 2233202 - RNA, 17 nt, Homo sapiens
gagaugggguuucacca

SEQ ID NO: 2233203 - RNA, 12 nt, Homo sapiens
acuaaucuuucu

SEQ ID NO: 2233204 - RNA, 22 nt, Homo sapiens
aggagcccgaagucugcugcug

SEQ ID NO: 2233205 - RNA, 13 nt, Homo sapiens
guuuagaucccau

SEQ ID NO: 2233206 - RNA, 18 nt, Homo sapiens
aaaugcagcuucagguga

SEQ ID NO: 2233207 - RNA, 13 nt, Homo sapiens
ccacauaauucau

SEQ ID NO: 2233208 - RNA, 16 nt, Homo sapiens
ccuucauacacuguac

SEQ ID NO: 2233209 - RNA, 22 nt, Homo sapiens
gggaggacccacacugcuacac

SEQ ID NO: 2233210 - RNA, 21 nt, Homo sapiens
aaaggagccaauugauuucaa

SEQ ID NO: 2233211 - RNA, 21 nt, Homo sapiens
aggugcccugugggagagcaa

SEQ ID NO: 2233212 - RNA, 15 nt, Homo sapiens
gagaggggcgagaag

SEQ ID NO: 2233213 - RNA, 15 nt, Homo sapiens
agaaguccagcucuu

SEQ ID NO: 2233214 - RNA, 15 nt, Homo sapiens
uucucucuuguccaa

SEQ ID NO: 2233215 - RNA, 14 nt, Homo sapiens
accucuuagcugag

SEQ ID NO: 2233216 - RNA, 18 nt, Homo sapiens
accucagccccacugaca

SEQ ID NO: 2233217 - RNA, 22 nt, Homo sapiens
uggaggaacacagagaaauccu

SEQ ID NO: 2233218 - RNA, 13 nt, Homo sapiens
guggcucaugccu

SEQ ID NO: 2233219 - RNA, 18 nt, Homo sapiens
guauuaugcaaaguacca

SEQ ID NO: 2233220 - RNA, 23 nt, Homo sapiens
aaguuccccaucccugucauuuu

SEQ ID NO: 2233221 - RNA, 19 nt, Homo sapiens
aagucuguuuuaaugacaa

SEQ ID NO: 2233222 - RNA, 14 nt, Homo sapiens
cugggcuauauucc

SEQ ID NO: 2233223 - RNA, 16 nt, Homo sapiens
aguuauuuuaauaccu

SEQ ID NO: 2233224 - RNA, 17 nt, Homo sapiens
agggccuugauuuccag

SEQ ID NO: 2233225 - RNA, 15 nt, Homo sapiens
gcguuggagacauac

SEQ ID NO: 2233226 - RNA, 19 nt, Homo sapiens
aguaugcacuaaucaauac

SEQ ID NO: 2233227 - RNA, 12 nt, Homo sapiens
aaucaauguuca

SEQ ID NO: 2233228 - RNA, 18 nt, Homo sapiens
gcuaggagcaaagccugu

SEQ ID NO: 2233229 - RNA, 16 nt, Homo sapiens
uauccuaagacuaaca

SEQ ID NO: 2233230 - RNA, 21 nt, Homo sapiens
cguggucccaacuacucagcc

SEQ ID NO: 2233231 - RNA, 15 nt, Homo sapiens
ggccccuaccagcca

SEQ ID NO: 2233232 - RNA, 12 nt, Homo sapiens
gucccagucucu

SEQ ID NO: 2233233 - RNA, 22 nt, Homo sapiens
ucuuuaaccacuuuucaauguc

SEQ ID NO: 2233234 - RNA, 12 nt, Homo sapiens
aacguggcccag

SEQ ID NO: 2233235 - RNA, 16 nt, Homo sapiens
agacagugcacaugaa

SEQ ID NO: 2233236 - RNA, 20 nt, Homo sapiens
acagugcauuugccuuguca

SEQ ID NO: 2233237 - RNA, 18 nt, Homo sapiens
cuauaagagacaaaguuu

SEQ ID NO: 2233238 - RNA, 15 nt, Homo sapiens
cuuccugcuuuccau

SEQ ID NO: 2233239 - RNA, 19 nt, Homo sapiens
auauacaguaacuuuaugu

SEQ ID NO: 2233240 - RNA, 22 nt, Homo sapiens
agcacaagccacaagucuucca

SEQ ID NO: 2233241 - RNA, 18 nt, Homo sapiens
ucaaccaggaacauguaa

SEQ ID NO: 2233242 - RNA, 17 nt, Homo sapiens
acaucuuuaucauuaaa

SEQ ID NO: 2233243 - RNA, 22 nt, Homo sapiens
cagcauuugauauacaugcuca

SEQ ID NO: 2233244 - RNA, 20 nt, Homo sapiens
aaaauaaacaaagugaagua

SEQ ID NO: 2233245 - RNA, 14 nt, Homo sapiens
aagaccuugcugau

SEQ ID NO: 2233246 - RNA, 21 nt, Homo sapiens
auuagaggaagaaaaccagcg

SEQ ID NO: 2233247 - RNA, 15 nt, Homo sapiens
agaagccaagacagu

SEQ ID NO: 2233248 - RNA, 12 nt, Homo sapiens
agaacuuugcau

SEQ ID NO: 2233249 - RNA, 18 nt, Homo sapiens
cucucccuguacacagug

SEQ ID NO: 2233250 - RNA, 17 nt, Homo sapiens
ugugcaagggcagugaa

SEQ ID NO: 2233251 - RNA, 20 nt, Homo sapiens
gaagaaaagaaaaaacaacu

SEQ ID NO: 2233252 - RNA, 21 nt, Homo sapiens
uccagcuguacuagugccauu

SEQ ID NO: 2233253 - RNA, 13 nt, Homo sapiens
acggacccugugu

SEQ ID NO: 2233254 - RNA, 21 nt, Homo sapiens
agcagaugagaaacucuugag

SEQ ID NO: 2233255 - RNA, 16 nt, Homo sapiens
aggcuggccaaggugu

SEQ ID NO: 2233256 - RNA, 22 nt, Homo sapiens
acauuucuuaauugcaacuuuu

SEQ ID NO: 2233257 - RNA, 17 nt, Homo sapiens
accucggggagugccac

SEQ ID NO: 2233258 - RNA, 18 nt, Homo sapiens
ugacauauaucuauuaca

SEQ ID NO: 2233259 - RNA, 15 nt, Homo sapiens
agcugagauguggac

SEQ ID NO: 2233260 - RNA, 14 nt, Homo sapiens
ucaccaugcuugug

SEQ ID NO: 2233261 - RNA, 21 nt, Homo sapiens
aggaauguccagacugugggu

SEQ ID NO: 2233262 - RNA, 14 nt, Homo sapiens
aucaccuauuacau

SEQ ID NO: 2233263 - RNA, 14 nt, Homo sapiens
caagcuaggugcua

SEQ ID NO: 2233264 - RNA, 16 nt, Homo sapiens
cacauacugcaugcuc

SEQ ID NO: 2233265 - RNA, 22 nt, Homo sapiens
gaaaugggaauugcgcucaggg

SEQ ID NO: 2233266 - RNA, 14 nt, Homo sapiens
agggcaggcccaaa

SEQ ID NO: 2233267 - RNA, 16 nt, Homo sapiens
cgaauugucuuuggug

SEQ ID NO: 2233268 - RNA, 21 nt, Homo sapiens
ggugggggucagguggacucu

SEQ ID NO: 2233269 - RNA, 18 nt, Homo sapiens
aggcugcccacucugggg

SEQ ID NO: 2233270 - RNA, 17 nt, Homo sapiens
cuuugaaucucuguaua

SEQ ID NO: 2233271 - RNA, 13 nt, Homo sapiens
uggauggucucca

SEQ ID NO: 2233272 - RNA, 16 nt, Homo sapiens
cauaauuguucuuagu

SEQ ID NO: 2233273 - RNA, 17 nt, Homo sapiens
guacgcacagacagguu

SEQ ID NO: 2233274 - RNA, 23 nt, Homo sapiens
auagaagccacaucguugagaca

SEQ ID NO: 2233275 - RNA, 18 nt, Homo sapiens
ggugacuuuucaccuuaa

SEQ ID NO: 2233276 - RNA, 23 nt, Homo sapiens
agcccagcagacaucaagcucaa

SEQ ID NO: 2233277 - RNA, 15 nt, Homo sapiens
cuauuucccuugccu

SEQ ID NO: 2233278 - RNA, 16 nt, Homo sapiens
aaauggcagugguggc

SEQ ID NO: 2233279 - RNA, 17 nt, Homo sapiens
ccagaucacugccacac

SEQ ID NO: 2233280 - RNA, 17 nt, Homo sapiens
uccaguauccacuuugc

SEQ ID NO: 2233281 - RNA, 21 nt, Homo sapiens
gggccacugcuugaagaagaa

SEQ ID NO: 2233282 - RNA, 17 nt, Homo sapiens
ggccagccuuggcacga

SEQ ID NO: 2233283 - RNA, 17 nt, Homo sapiens
guggagggugcccagca

SEQ ID NO: 2233284 - RNA, 21 nt, Homo sapiens
gcagugagccaagaucgugcc

SEQ ID NO: 2233285 - RNA, 15 nt, Homo sapiens
gggccuguaauccca

SEQ ID NO: 2233286 - RNA, 22 nt, Homo sapiens
uucaaccaguuugaaccaagaa

SEQ ID NO: 2233287 - RNA, 22 nt, Homo sapiens
gcccugcagggcuggucagggu

SEQ ID NO: 2233288 - RNA, 22 nt, Homo sapiens
ucuguauauaaauaugugaaau

SEQ ID NO: 2233289 - RNA, 10 nt, Homo sapiens
gggccagcug

SEQ ID NO: 2233290 - RNA, 16 nt, Homo sapiens
auguaagaauucagaa

SEQ ID NO: 2233291 - RNA, 23 nt, Homo sapiens
cacaggcauauucccugcacaca

SEQ ID NO: 2233292 - RNA, 18 nt, Homo sapiens
uggaacagaagacagcug

SEQ ID NO: 2233293 - RNA, 15 nt, Homo sapiens
uccaucaucugcugc

SEQ ID NO: 2233294 - RNA, 15 nt, Homo sapiens
cucagcucacugcaa

SEQ ID NO: 2233295 - RNA, 13 nt, Homo sapiens
ucagccucccaca

SEQ ID NO: 2233296 - RNA, 13 nt, Homo sapiens
auuugauauaugu

SEQ ID NO: 2233297 - RNA, 16 nt, Homo sapiens
agcacaaggccuuaau

SEQ ID NO: 2233298 - RNA, 14 nt, Homo sapiens
ugucugacaaccuc

SEQ ID NO: 2233299 - RNA, 16 nt, Homo sapiens
aacccggcacugcccu

SEQ ID NO: 2233300 - RNA, 20 nt, Homo sapiens
ccagagagccuggugcugcu

SEQ ID NO: 2233301 - RNA, 16 nt, Homo sapiens
aaacuaaaaauuuaca

SEQ ID NO: 2233302 - RNA, 18 nt, Homo sapiens
cgugaucaguguugcaac

SEQ ID NO: 2233303 - RNA, 14 nt, Homo sapiens
guaagcaacacuuu

SEQ ID NO: 2233304 - RNA, 20 nt, Homo sapiens
caagccugcguucuugugac

SEQ ID NO: 2233305 - RNA, 19 nt, Homo sapiens
cucuaccagucuauuucca

SEQ ID NO: 2233306 - RNA, 17 nt, Homo sapiens
uguuguagcucugguau

SEQ ID NO: 2233307 - RNA, 15 nt, Homo sapiens
ucacccacugucagc

SEQ ID NO: 2233308 - RNA, 13 nt, Homo sapiens
uacauuaccauau

SEQ ID NO: 2233309 - RNA, 21 nt, Homo sapiens
cacccaccuuuggaaagcucu

SEQ ID NO: 2233310 - RNA, 13 nt, Homo sapiens
cuuucccuuccag

SEQ ID NO: 2233311 - RNA, 13 nt, Homo sapiens
gugaaacuaacag

SEQ ID NO: 2233312 - RNA, 17 nt, Homo sapiens
aaaauuccuauugugau

SEQ ID NO: 2233313 - RNA, 16 nt, Homo sapiens
accauuaaauaaugca

SEQ ID NO: 2233314 - RNA, 15 nt, Homo sapiens
ccucuuggcucugag

SEQ ID NO: 2233315 - RNA, 11 nt, Homo sapiens
augugcaauau

SEQ ID NO: 2233316 - RNA, 21 nt, Homo sapiens
uauaguuauugcacaaguuca

SEQ ID NO: 2233317 - RNA, 22 nt, Homo sapiens
agacaagcccugcuugcuggaa

SEQ ID NO: 2233318 - RNA, 19 nt, Homo sapiens
gucauggucaggggugaga

SEQ ID NO: 2233319 - RNA, 17 nt, Homo sapiens
aaaauaaauauacuaau

SEQ ID NO: 2233320 - RNA, 22 nt, Homo sapiens
agaguccuggagcuggcucuau

SEQ ID NO: 2233321 - RNA, 18 nt, Homo sapiens
agaaaauggguuuauuca

SEQ ID NO: 2233322 - RNA, 23 nt, Homo sapiens
uccuccuguucugaaaccuuagu

SEQ ID NO: 2233323 - RNA, 14 nt, Homo sapiens
auuucaagcuauaa

SEQ ID NO: 2233324 - RNA, 18 nt, Homo sapiens
gccuuaaccuagaggguc

SEQ ID NO: 2233325 - RNA, 14 nt, Homo sapiens
accagagcugccac

SEQ ID NO: 2233326 - RNA, 11 nt, Homo sapiens
guaacugugcu

SEQ ID NO: 2233327 - RNA, 14 nt, Homo sapiens
cuuuggagcacugu

SEQ ID NO: 2233328 - RNA, 21 nt, Homo sapiens
aucuacauacaaacaaugcaa

SEQ ID NO: 2233329 - RNA, 11 nt, Homo sapiens
uuuaugguucu

SEQ ID NO: 2233330 - RNA, 18 nt, Homo sapiens
ugagacagugcacaugaa

SEQ ID NO: 2233331 - RNA, 17 nt, Homo sapiens
cuguaaucccagcaugc

SEQ ID NO: 2233332 - RNA, 16 nt, Homo sapiens
ccugcaucaucuugaa

SEQ ID NO: 2233333 - RNA, 14 nt, Homo sapiens
augacucuucuuau

SEQ ID NO: 2233334 - RNA, 12 nt, Homo sapiens
uauaagccauag

SEQ ID NO: 2233335 - RNA, 22 nt, Homo sapiens
ccucauugcagcuagaggcauc

SEQ ID NO: 2233336 - RNA, 12 nt, Homo sapiens
caugaacuguac

SEQ ID NO: 2233337 - RNA, 22 nt, Homo sapiens
agcucuuuggaucagucuuugu

SEQ ID NO: 2233338 - RNA, 22 nt, Homo sapiens
acugccauggaggcacacagcu

SEQ ID NO: 2233339 - RNA, 19 nt, Homo sapiens
uguuaacauuccaagacuc

SEQ ID NO: 2233340 - RNA, 21 nt, Homo sapiens
aauacugcuuuugcaaacaga

SEQ ID NO: 2233341 - RNA, 18 nt, Homo sapiens
aaacuaauuuuaacaaac

SEQ ID NO: 2233342 - RNA, 21 nt, Homo sapiens
agaugaaacagggcaccccag

SEQ ID NO: 2233343 - RNA, 21 nt, Homo sapiens
gaccuggauaauuauaucaga

SEQ ID NO: 2233344 - RNA, 13 nt, Homo sapiens
agugcugcuguaa

SEQ ID NO: 2233345 - RNA, 23 nt, Homo sapiens
acauguuaagagaaugcuuugaa

SEQ ID NO: 2233346 - RNA, 18 nt, Homo sapiens
uuuuuccucccagugaga

SEQ ID NO: 2233347 - RNA, 18 nt, Homo sapiens
ggaaaaaaaacacaaaac

SEQ ID NO: 2233348 - RNA, 16 nt, Homo sapiens
gcaaaagcagaacaca

SEQ ID NO: 2233349 - RNA, 15 nt, Homo sapiens
ucccucuacuguguu

SEQ ID NO: 2233350 - RNA, 14 nt, Homo sapiens
ggccauccauguga

SEQ ID NO: 2233351 - RNA, 12 nt, Homo sapiens
aaccugucucac

SEQ ID NO: 2233352 - RNA, 22 nt, Homo sapiens
gcauuuaggaaagcagugcagu

SEQ ID NO: 2233353 - RNA, 23 nt, Homo sapiens
ccucuuccugccaagccaccuuc

SEQ ID NO: 2233354 - RNA, 16 nt, Homo sapiens
aaaauagcaauuagca

SEQ ID NO: 2233355 - RNA, 18 nt, Homo sapiens
augagcauuacuauucac

SEQ ID NO: 2233356 - RNA, 17 nt, Homo sapiens
ccugggaggcagaugga

SEQ ID NO: 2233357 - RNA, 11 nt, Homo sapiens
aaauucauccu

SEQ ID NO: 2233358 - RNA, 13 nt, Homo sapiens
gcuccagugccag

SEQ ID NO: 2233359 - RNA, 15 nt, Homo sapiens
gcccugcagccagcu

SEQ ID NO: 2233360 - RNA, 13 nt, Homo sapiens
acucagugcaaac

SEQ ID NO: 2233361 - RNA, 17 nt, Homo sapiens
aucuuuuaauuacagaa

SEQ ID NO: 2233362 - RNA, 14 nt, Homo sapiens
gugugugcccgugu

SEQ ID NO: 2233363 - RNA, 17 nt, Homo sapiens
cauagcaagauugcuua

SEQ ID NO: 2233364 - RNA, 23 nt, Homo sapiens
caauuuagauuuuucucaucucc

SEQ ID NO: 2233365 - RNA, 16 nt, Homo sapiens
gggcccaggaccagcu

SEQ ID NO: 2233366 - RNA, 21 nt, Homo sapiens
cucagaauauuaagcacauua

SEQ ID NO: 2233367 - RNA, 22 nt, Homo sapiens
acaggaaaaaaaauuaggccgu

SEQ ID NO: 2233368 - RNA, 20 nt, Homo sapiens
aguccugcuggaucuugccu

SEQ ID NO: 2233369 - RNA, 23 nt, Homo sapiens
ggucccaggaugucucccaggac

SEQ ID NO: 2233370 - RNA, 19 nt, Homo sapiens
ggccuuuuucauaaacuga

SEQ ID NO: 2233371 - RNA, 23 nt, Homo sapiens
gaaaaguguguaucuagcuucuu

SEQ ID NO: 2233372 - RNA, 22 nt, Homo sapiens
caggagguggaggcugcaguga

SEQ ID NO: 2233373 - RNA, 17 nt, Homo sapiens
aagcaaaccugauacaa

SEQ ID NO: 2233374 - RNA, 21 nt, Homo sapiens
auauaauuguaccaaccucau

SEQ ID NO: 2233375 - RNA, 18 nt, Homo sapiens
aguccucauuuacuggau

SEQ ID NO: 2233376 - RNA, 23 nt, Homo sapiens
ugaacacacauugcuauucccau

SEQ ID NO: 2233377 - RNA, 20 nt, Homo sapiens
caggggcagcagcaucucag

SEQ ID NO: 2233378 - RNA, 20 nt, Homo sapiens
cagagaagguaaggugugaa

SEQ ID NO: 2233379 - RNA, 14 nt, Homo sapiens
gggcccucuugcca

SEQ ID NO: 2233380 - RNA, 18 nt, Homo sapiens
auuugccaggggcaucca

SEQ ID NO: 2233381 - RNA, 22 nt, Homo sapiens
ggccucccaaagugcugggauu

SEQ ID NO: 2233382 - RNA, 18 nt, Homo sapiens
caacauggcacauguaua

SEQ ID NO: 2233383 - RNA, 17 nt, Homo sapiens
uccucuucucauuacca

SEQ ID NO: 2233384 - RNA, 20 nt, Homo sapiens
gaaaaagguuugcauucuca

SEQ ID NO: 2233385 - RNA, 23 nt, Homo sapiens
gccaucuuuaucaugaagcacau

SEQ ID NO: 2233386 - RNA, 14 nt, Homo sapiens
ucaucagagcagcu

SEQ ID NO: 2233387 - RNA, 14 nt, Homo sapiens
ucucuauaaagggu

SEQ ID NO: 2233388 - RNA, 15 nt, Homo sapiens
agacaaaccacugua

SEQ ID NO: 2233389 - RNA, 22 nt, Homo sapiens
gaacaugguuugacucaucuua

SEQ ID NO: 2233390 - RNA, 20 nt, Homo sapiens
uuuguuuggguuacaguaug

SEQ ID NO: 2233391 - RNA, 14 nt, Homo sapiens
gagcaagacccugu

SEQ ID NO: 2233392 - RNA, 14 nt, Homo sapiens
augcagaacuuccc

SEQ ID NO: 2233393 - RNA, 16 nt, Homo sapiens
uacccuugagcugugu

SEQ ID NO: 2233394 - RNA, 18 nt, Homo sapiens
uaacugaugacauuccac

SEQ ID NO: 2233395 - RNA, 13 nt, Homo sapiens
cuaaucauaacau

SEQ ID NO: 2233396 - RNA, 17 nt, Homo sapiens
acauuuaauacagauaa

SEQ ID NO: 2233397 - RNA, 20 nt, Homo sapiens
uguacuuagcuguacuauaa

SEQ ID NO: 2233398 - RNA, 15 nt, Homo sapiens
aaauuagcugggcau

SEQ ID NO: 2233399 - RNA, 14 nt, Homo sapiens
cuauuuaacaacug

SEQ ID NO: 2233400 - RNA, 14 nt, Homo sapiens
uauuagaauuucau

SEQ ID NO: 2233401 - RNA, 14 nt, Homo sapiens
ugccagggagacag

SEQ ID NO: 2233402 - RNA, 17 nt, Homo sapiens
uuaaauauauaauguug

SEQ ID NO: 2233403 - RNA, 17 nt, Homo sapiens
uaugugaaaaugauuag

SEQ ID NO: 2233404 - RNA, 17 nt, Homo sapiens
ccaccacgcccggcuaa

SEQ ID NO: 2233405 - RNA, 19 nt, Homo sapiens
auaauuucaaaccacacau

SEQ ID NO: 2233406 - RNA, 17 nt, Homo sapiens
aagcggcuguuuacugc

SEQ ID NO: 2233407 - RNA, 20 nt, Homo sapiens
uuccugaauguguucuuggu

SEQ ID NO: 2233408 - RNA, 16 nt, Homo sapiens
cgcaaaccacacugga

SEQ ID NO: 2233409 - RNA, 22 nt, Homo sapiens
cuuugagauagaagaacugcaa

SEQ ID NO: 2233410 - RNA, 19 nt, Homo sapiens
cugcagccaggccacuggc

SEQ ID NO: 2233411 - RNA, 20 nt, Homo sapiens
gccaccacgccuagccucac

SEQ ID NO: 2233412 - RNA, 21 nt, Homo sapiens
cuggaaagugugaaugcugaa

SEQ ID NO: 2233413 - RNA, 21 nt, Homo sapiens
ucuggaccccaucugugaaua

SEQ ID NO: 2233414 - RNA, 19 nt, Homo sapiens
augaagggaugcugcaaug

SEQ ID NO: 2233415 - RNA, 11 nt, Homo sapiens
uuaaaacucau

SEQ ID NO: 2233416 - RNA, 18 nt, Homo sapiens
aguuaaagagacaaauag

SEQ ID NO: 2233417 - RNA, 21 nt, Homo sapiens
gguccccccgagucuccggga

SEQ ID NO: 2233418 - RNA, 20 nt, Homo sapiens
auaaacuagucuguuggcaa

SEQ ID NO: 2233419 - RNA, 13 nt, Homo sapiens
uuggagcauuuau

SEQ ID NO: 2233420 - RNA, 19 nt, Homo sapiens
uuuagaagaaaaaaccacc

SEQ ID NO: 2233421 - RNA, 17 nt, Homo sapiens
aaacugccaaacuauuu

SEQ ID NO: 2233422 - RNA, 21 nt, Homo sapiens
ucucaaauccuugagcacuca

SEQ ID NO: 2233423 - RNA, 15 nt, Homo sapiens
ccacacacacuccuu

SEQ ID NO: 2233424 - RNA, 22 nt, Homo sapiens
ccauuccaggaaaacugggaca

SEQ ID NO: 2233425 - RNA, 17 nt, Homo sapiens
aggggauccagcucaag

SEQ ID NO: 2233426 - RNA, 22 nt, Homo sapiens
uucagaaucucucuacucagau

SEQ ID NO: 2233427 - RNA, 14 nt, Homo sapiens
agacuaacauguca

SEQ ID NO: 2233428 - RNA, 15 nt, Homo sapiens
ucauaagaauucugu

SEQ ID NO: 2233429 - RNA, 21 nt, Homo sapiens
uuugaaaacaccagcuguaua

SEQ ID NO: 2233430 - RNA, 16 nt, Homo sapiens
accugucaacauuugg

SEQ ID NO: 2233431 - RNA, 17 nt, Homo sapiens
gcaaauauuuugucacu

SEQ ID NO: 2233432 - RNA, 20 nt, Homo sapiens
caaacaguagacuuauagua

SEQ ID NO: 2233433 - RNA, 13 nt, Homo sapiens
ucgauagccugag

SEQ ID NO: 2233434 - RNA, 16 nt, Homo sapiens
uuuauguaugcauuga

SEQ ID NO: 2233435 - RNA, 19 nt, Homo sapiens
cgaagccaucgcgcuccuu

SEQ ID NO: 2233436 - RNA, 17 nt, Homo sapiens
auauuuuuaaacaaaga

SEQ ID NO: 2233437 - RNA, 16 nt, Homo sapiens
gagcugccucugagau

SEQ ID NO: 2233438 - RNA, 15 nt, Homo sapiens
guaaaggugaugaau

SEQ ID NO: 2233439 - RNA, 15 nt, Homo sapiens
cucugagaaguacuu

SEQ ID NO: 2233440 - RNA, 19 nt, Homo sapiens
ugcucaggagcagcacucu

SEQ ID NO: 2233441 - RNA, 16 nt, Homo sapiens
accccaucuuccagcc

SEQ ID NO: 2233442 - RNA, 18 nt, Homo sapiens
aacagcaaauuaaugugu

SEQ ID NO: 2233443 - RNA, 17 nt, Homo sapiens
auaauagagcucagaca

SEQ ID NO: 2233444 - RNA, 10 nt, Homo sapiens
uuauaugcac

SEQ ID NO: 2233445 - RNA, 12 nt, Homo sapiens
gcucacagggau

SEQ ID NO: 2233446 - RNA, 14 nt, Homo sapiens
caauuuucacuuuu

SEQ ID NO: 2233447 - RNA, 14 nt, Homo sapiens
acaaugcagaauuu

SEQ ID NO: 2233448 - RNA, 17 nt, Homo sapiens
uguaucacucacugcca

SEQ ID NO: 2233449 - RNA, 18 nt, Homo sapiens
ucagcacuuuguuucaua

SEQ ID NO: 2233450 - RNA, 17 nt, Homo sapiens
uauuucaccaagccaau

SEQ ID NO: 2233451 - RNA, 21 nt, Homo sapiens
cacugugacaaaagccagcau

SEQ ID NO: 2233452 - RNA, 18 nt, Homo sapiens
agcagugaucucagggca

SEQ ID NO: 2233453 - RNA, 18 nt, Homo sapiens
gaggucagcauuugaucu

SEQ ID NO: 2233454 - RNA, 20 nt, Homo sapiens
caacuauuucuuucaucaga

SEQ ID NO: 2233455 - RNA, 20 nt, Homo sapiens
uaaaaaucuagcacacucuu

SEQ ID NO: 2233456 - RNA, 16 nt, Homo sapiens
cugagaggaagccuga

SEQ ID NO: 2233457 - RNA, 16 nt, Homo sapiens
ggaaacuuuccuuuaa

SEQ ID NO: 2233458 - RNA, 16 nt, Homo sapiens
uccagcaagaccaaau

SEQ ID NO: 2233459 - RNA, 16 nt, Homo sapiens
aaucuaacuacaagga

SEQ ID NO: 2233460 - RNA, 12 nt, Homo sapiens
gggcaugccacc

SEQ ID NO: 2233461 - RNA, 15 nt, Homo sapiens
ccacacgcacugcac

SEQ ID NO: 2233462 - RNA, 14 nt, Homo sapiens
uaucaacagcauuu

SEQ ID NO: 2233463 - RNA, 23 nt, Homo sapiens
uccuugggcuauaaaagauuccu

SEQ ID NO: 2233464 - RNA, 20 nt, Homo sapiens
acauccugaccuugcacaaa

SEQ ID NO: 2233465 - RNA, 17 nt, Homo sapiens
gaugucccugggccagg

SEQ ID NO: 2233466 - RNA, 21 nt, Homo sapiens
gcacugguggccguggugggg

SEQ ID NO: 2233467 - RNA, 23 nt, Homo sapiens
auccaaggguugagagccagugg

SEQ ID NO: 2233468 - RNA, 16 nt, Homo sapiens
ugaauaaagugcugcg

SEQ ID NO: 2233469 - RNA, 20 nt, Homo sapiens
cccagaauccccuggggaga

SEQ ID NO: 2233470 - RNA, 14 nt, Homo sapiens
caggccacugggga

SEQ ID NO: 2233471 - RNA, 14 nt, Homo sapiens
ugacaacuaaacaa

SEQ ID NO: 2233472 - RNA, 14 nt, Homo sapiens
uggggacuaaggga

SEQ ID NO: 2233473 - RNA, 22 nt, Homo sapiens
uaacucugcccacccuccugua

SEQ ID NO: 2233474 - RNA, 21 nt, Homo sapiens
caaacauggguuuaguuuuca

SEQ ID NO: 2233475 - RNA, 13 nt, Homo sapiens
uuaaaacaaaaga

SEQ ID NO: 2233476 - RNA, 13 nt, Homo sapiens
aaugaacauuuaa

SEQ ID NO: 2233477 - RNA, 17 nt, Homo sapiens
aauaaaaggaaaaccag

SEQ ID NO: 2233478 - RNA, 21 nt, Homo sapiens
uacaaccaauggaaugugaug

SEQ ID NO: 2233479 - RNA, 19 nt, Homo sapiens
guaaaacuuagcaacuugg

SEQ ID NO: 2233480 - RNA, 12 nt, Homo sapiens
uccuuaaguauu

SEQ ID NO: 2233481 - RNA, 13 nt, Homo sapiens
aaacaccaugaag

SEQ ID NO: 2233482 - RNA, 13 nt, Homo sapiens
caauaucaugucu

SEQ ID NO: 2233483 - RNA, 15 nt, Homo sapiens
uggucauucauauca

SEQ ID NO: 2233484 - RNA, 17 nt, Homo sapiens
caggagaaucacuugaa

SEQ ID NO: 2233485 - RNA, 13 nt, Homo sapiens
uugaucagacuga

SEQ ID NO: 2233486 - RNA, 22 nt, Homo sapiens
cugaaaccucuguucucaugaa

SEQ ID NO: 2233487 - RNA, 13 nt, Homo sapiens
gauaccugugagg

SEQ ID NO: 2233488 - RNA, 12 nt, Homo sapiens
auagucaauaug

SEQ ID NO: 2233489 - RNA, 22 nt, Homo sapiens
uaugugcuauauaaauauguca

SEQ ID NO: 2233490 - RNA, 20 nt, Homo sapiens
gagccugguucagacacagc

SEQ ID NO: 2233491 - RNA, 16 nt, Homo sapiens
gaauauguugaucauu

SEQ ID NO: 2233492 - RNA, 22 nt, Homo sapiens
aauagauaaauuuugacuugaa

SEQ ID NO: 2233493 - RNA, 21 nt, Homo sapiens
guggguggccagcgcgaugaa

SEQ ID NO: 2233494 - RNA, 19 nt, Homo sapiens
cagagagaacaacaggcag

SEQ ID NO: 2233495 - RNA, 23 nt, Homo sapiens
aggagacuuucaugcagccuaaa

SEQ ID NO: 2233496 - RNA, 19 nt, Homo sapiens
aucacaggagcaaucacag

SEQ ID NO: 2233497 - RNA, 21 nt, Homo sapiens
agauuggaucauuuaacaaua

SEQ ID NO: 2233498 - RNA, 16 nt, Homo sapiens
agaaucaguguguuac

SEQ ID NO: 2233499 - RNA, 20 nt, Homo sapiens
auguuuguuauuuacacugg

SEQ ID NO: 2233500 - RNA, 10 nt, Homo sapiens
uuaccaucug

SEQ ID NO: 2233501 - RNA, 15 nt, Homo sapiens
cauuaaauaaugcau

SEQ ID NO: 2233502 - RNA, 15 nt, Homo sapiens
uuacccuugaucuua

SEQ ID NO: 2233503 - RNA, 17 nt, Homo sapiens
gaaagccauucuggaca

SEQ ID NO: 2233504 - RNA, 11 nt, Homo sapiens
auaacuaccuu

SEQ ID NO: 2233505 - RNA, 11 nt, Homo sapiens
augcaacauca

SEQ ID NO: 2233506 - RNA, 16 nt, Homo sapiens
cugcuuguauuuucca

SEQ ID NO: 2233507 - RNA, 21 nt, Homo sapiens
auacuggguucggauugugaa

SEQ ID NO: 2233508 - RNA, 14 nt, Homo sapiens
uagaaaaugaggaa

SEQ ID NO: 2233509 - RNA, 23 nt, Homo sapiens
ggauuuuuuuguuuucugaugac

SEQ ID NO: 2233510 - RNA, 17 nt, Homo sapiens
aaugacgugccuaccuc

SEQ ID NO: 2233511 - RNA, 16 nt, Homo sapiens
gcuguguuacuugaag

SEQ ID NO: 2233512 - RNA, 18 nt, Homo sapiens
gacuccaucucaaaaaau

SEQ ID NO: 2233513 - RNA, 17 nt, Homo sapiens
gucaaguuggauuugaa

SEQ ID NO: 2233514 - RNA, 13 nt, Homo sapiens
ccaucacuuucau

SEQ ID NO: 2233515 - RNA, 21 nt, Homo sapiens
acuucugggaaccguaauuga

SEQ ID NO: 2233516 - RNA, 23 nt, Homo sapiens
aaaucugaggaaggugcuugccu

SEQ ID NO: 2233517 - RNA, 16 nt, Homo sapiens
ugacuugugucccaug

SEQ ID NO: 2233518 - RNA, 11 nt, Homo sapiens
ucucucugagc

SEQ ID NO: 2233519 - RNA, 14 nt, Homo sapiens
uucucguacuuuca

SEQ ID NO: 2233520 - RNA, 17 nt, Homo sapiens
cugugguuaacaucuca

SEQ ID NO: 2233521 - RNA, 14 nt, Homo sapiens
auaaaguacugcaa

SEQ ID NO: 2233522 - RNA, 14 nt, Homo sapiens
acaaacuucaaaga

SEQ ID NO: 2233523 - RNA, 20 nt, Homo sapiens
gacaugggugugccaggcua

SEQ ID NO: 2233524 - RNA, 17 nt, Homo sapiens
uauaaauacaugcacac

SEQ ID NO: 2233525 - RNA, 17 nt, Homo sapiens
aguaaguagaugccugu

SEQ ID NO: 2233526 - RNA, 21 nt, Homo sapiens
cuugcuguuucuugaugcuca

SEQ ID NO: 2233527 - RNA, 21 nt, Homo sapiens
gcacccccggcccagugcccc

SEQ ID NO: 2233528 - RNA, 13 nt, Homo sapiens
agagagcaauuug

SEQ ID NO: 2233529 - RNA, 22 nt, Homo sapiens
acuacuuucuuaauaucacuuu

SEQ ID NO: 2233530 - RNA, 22 nt, Homo sapiens
cuacgccugcauguaaacacgc

SEQ ID NO: 2233531 - RNA, 16 nt, Homo sapiens
auaccauuguccccaa

SEQ ID NO: 2233532 - RNA, 13 nt, Homo sapiens
aacgaugcacuuu

SEQ ID NO: 2233533 - RNA, 19 nt, Homo sapiens
gacugagcgaggaaaaaca

SEQ ID NO: 2233534 - RNA, 16 nt, Homo sapiens
auaaaugaggucacua

SEQ ID NO: 2233535 - RNA, 17 nt, Homo sapiens
cagagcuggaucucuca

SEQ ID NO: 2233536 - RNA, 17 nt, Homo sapiens
aaggaagcuguguugaa

SEQ ID NO: 2233537 - RNA, 14 nt, Homo sapiens
acugucuuccucaa

SEQ ID NO: 2233538 - RNA, 19 nt, Homo sapiens
ggauacccuggagcaagac

SEQ ID NO: 2233539 - RNA, 20 nt, Homo sapiens
guuuucgcuggggauggaau

SEQ ID NO: 2233540 - RNA, 15 nt, Homo sapiens
gggcacaguccagga

SEQ ID NO: 2233541 - RNA, 17 nt, Homo sapiens
agcaaacaagcuugauu

SEQ ID NO: 2233542 - RNA, 17 nt, Homo sapiens
caguugggcccccaucc

SEQ ID NO: 2233543 - RNA, 23 nt, Homo sapiens
gcagacaucaagcucaaggcaau

SEQ ID NO: 2233544 - RNA, 13 nt, Homo sapiens
agaauggugcugu

SEQ ID NO: 2233545 - RNA, 20 nt, Homo sapiens
auuuucugcaucuccacuug

SEQ ID NO: 2233546 - RNA, 21 nt, Homo sapiens
agcucaccccuggaggacggc

SEQ ID NO: 2233547 - RNA, 17 nt, Homo sapiens
augugguacuacuguaa

SEQ ID NO: 2233548 - RNA, 18 nt, Homo sapiens
guccagccccuccucccu

SEQ ID NO: 2233549 - RNA, 18 nt, Homo sapiens
gcuuaggccucucugccu

SEQ ID NO: 2233550 - RNA, 16 nt, Homo sapiens
uaaugaugaacuuaua

SEQ ID NO: 2233551 - RNA, 12 nt, Homo sapiens
uaauucaaacac

SEQ ID NO: 2233552 - RNA, 22 nt, Homo sapiens
caccacgcccacgucaacguga

SEQ ID NO: 2233553 - RNA, 23 nt, Homo sapiens
cagaaauggugcucaccaugcuu

SEQ ID NO: 2233554 - RNA, 18 nt, Homo sapiens
auaaaaauugacaaugau

SEQ ID NO: 2233555 - RNA, 15 nt, Homo sapiens
aaugaaacacuuuca

SEQ ID NO: 2233556 - RNA, 19 nt, Homo sapiens
caauauucugggaacccag

SEQ ID NO: 2233557 - RNA, 16 nt, Homo sapiens
aaauguauuaaugcua

SEQ ID NO: 2233558 - RNA, 15 nt, Homo sapiens
uggguaaaucaggga

SEQ ID NO: 2233559 - RNA, 14 nt, Homo sapiens
aauaauucaaacac

SEQ ID NO: 2233560 - RNA, 15 nt, Homo sapiens
caacagcuucuugcu

SEQ ID NO: 2233561 - RNA, 18 nt, Homo sapiens
ugauuucuacaacuggag

SEQ ID NO: 2233562 - RNA, 21 nt, Homo sapiens
cagauucuguccucuucucug

SEQ ID NO: 2233563 - RNA, 18 nt, Homo sapiens
ugaugcccagaugcucua

SEQ ID NO: 2233564 - RNA, 16 nt, Homo sapiens
ccaccuugaccaaaau

SEQ ID NO: 2233565 - RNA, 19 nt, Homo sapiens
gagauguaugcccaaagac

SEQ ID NO: 2233566 - RNA, 18 nt, Homo sapiens
uaguggucucuacugugg

SEQ ID NO: 2233567 - RNA, 17 nt, Homo sapiens
aaagccaccacauuuag

SEQ ID NO: 2233568 - RNA, 14 nt, Homo sapiens
uugcaaggugugau

SEQ ID NO: 2233569 - RNA, 21 nt, Homo sapiens
gaaagaaaacuuuuaugcaag

SEQ ID NO: 2233570 - RNA, 19 nt, Homo sapiens
aauguguauuuuauaugau

SEQ ID NO: 2233571 - RNA, 19 nt, Homo sapiens
cccaaggggacuugugcca

SEQ ID NO: 2233572 - RNA, 16 nt, Homo sapiens
uggaagacaacucugc

SEQ ID NO: 2233573 - RNA, 15 nt, Homo sapiens
uauggggacauucca

SEQ ID NO: 2233574 - RNA, 22 nt, Homo sapiens
ccugacagaaggugccacuuua

SEQ ID NO: 2233575 - RNA, 14 nt, Homo sapiens
uagguugcacacuu

SEQ ID NO: 2233576 - RNA, 20 nt, Homo sapiens
agaacugaaggcauaugcac

SEQ ID NO: 2233577 - RNA, 19 nt, Homo sapiens
aacacuguauaacauuuaa

SEQ ID NO: 2233578 - RNA, 21 nt, Homo sapiens
uaaaccuuugguaaucuucaa

SEQ ID NO: 2233579 - RNA, 14 nt, Homo sapiens
uaugaacaacagua

SEQ ID NO: 2233580 - RNA, 18 nt, Homo sapiens
ucauauaguaaacacuca

SEQ ID NO: 2233581 - RNA, 13 nt, Homo sapiens
uguuuaauugaca

SEQ ID NO: 2233582 - RNA, 17 nt, Homo sapiens
gagucucugaacauccu

SEQ ID NO: 2233583 - RNA, 14 nt, Homo sapiens
uaccugauggaccu

SEQ ID NO: 2233584 - RNA, 15 nt, Homo sapiens
cuauuacgugcaaua

SEQ ID NO: 2233585 - RNA, 16 nt, Homo sapiens
ucgccaaucaucauua

SEQ ID NO: 2233586 - RNA, 14 nt, Homo sapiens
ucccaacguuuuac

SEQ ID NO: 2233587 - RNA, 18 nt, Homo sapiens
ugagcaagggggcccaaa

SEQ ID NO: 2233588 - RNA, 22 nt, Homo sapiens
acgccuacuuaagagugcugug

SEQ ID NO: 2233589 - RNA, 20 nt, Homo sapiens
ccaggcuggagugcaguggu

SEQ ID NO: 2233590 - RNA, 20 nt, Homo sapiens
ccaggcuagagugcaauggu

SEQ ID NO: 2233591 - RNA, 21 nt, Homo sapiens
gcauugucacagcuaccaaag

SEQ ID NO: 2233592 - RNA, 19 nt, Homo sapiens
ugaaucuauuuaucuucau

SEQ ID NO: 2233593 - RNA, 17 nt, Homo sapiens
auauacgaaaagccagc

SEQ ID NO: 2233594 - RNA, 14 nt, Homo sapiens
uggaauaguauccu

SEQ ID NO: 2233595 - RNA, 13 nt, Homo sapiens
uguacaaagauac

SEQ ID NO: 2233596 - RNA, 20 nt, Homo sapiens
cccccaaauaagaagggaug

SEQ ID NO: 2233597 - RNA, 14 nt, Homo sapiens
ccgcaaacgugaaa

SEQ ID NO: 2233598 - RNA, 13 nt, Homo sapiens
cagacgugugaga

SEQ ID NO: 2233599 - RNA, 21 nt, Homo sapiens
uucacaccuagcgucaguauu

SEQ ID NO: 2233600 - RNA, 21 nt, Homo sapiens
agcaaugggcacugguauuug

SEQ ID NO: 2233601 - RNA, 13 nt, Homo sapiens
uuuuuauacagga

SEQ ID NO: 2233602 - RNA, 22 nt, Homo sapiens
cugauuguggaucuuuucauuc

SEQ ID NO: 2233603 - RNA, 13 nt, Homo sapiens
ucauucucaguga

SEQ ID NO: 2233604 - RNA, 14 nt, Homo sapiens
uugcuuuaaaguac

SEQ ID NO: 2233605 - RNA, 14 nt, Homo sapiens
cuacagugagaaag

SEQ ID NO: 2233606 - RNA, 20 nt, Homo sapiens
ucuccacccacucacauucc

SEQ ID NO: 2233607 - RNA, 15 nt, Homo sapiens
cagggaguccagggu

SEQ ID NO: 2233608 - RNA, 13 nt, Homo sapiens
ccgaaaucagaag

SEQ ID NO: 2233609 - RNA, 13 nt, Homo sapiens
auaauuguuucau

SEQ ID NO: 2233610 - RNA, 12 nt, Homo sapiens
gcagcugggauu

SEQ ID NO: 2233611 - RNA, 18 nt, Homo sapiens
uuaauaggaaaaacggaa

SEQ ID NO: 2233612 - RNA, 23 nt, Homo sapiens
ugagcuucaauauaagaagcaau

SEQ ID NO: 2233613 - RNA, 21 nt, Homo sapiens
cauaugcacaauuccaugaau

SEQ ID NO: 2233614 - RNA, 15 nt, Homo sapiens
ucuacuuugcagaug

SEQ ID NO: 2233615 - RNA, 23 nt, Homo sapiens
ugccccucuucuucuuugccuuc

SEQ ID NO: 2233616 - RNA, 17 nt, Homo sapiens
aacaguuuuagaauaca

SEQ ID NO: 2233617 - RNA, 22 nt, Homo sapiens
caccaguaccugaaagcacugu

SEQ ID NO: 2233618 - RNA, 16 nt, Homo sapiens
uacuaaaaauacaaaa

SEQ ID NO: 2233619 - RNA, 22 nt, Homo sapiens
cugauuuagaccaaaagauuca

SEQ ID NO: 2233620 - RNA, 13 nt, Homo sapiens
ccugcaccugcug

SEQ ID NO: 2233621 - RNA, 17 nt, Homo sapiens
aggcuuuauguacaaac

SEQ ID NO: 2233622 - RNA, 18 nt, Homo sapiens
guugaacaaaacugaccu

SEQ ID NO: 2233623 - RNA, 19 nt, Homo sapiens
uaaacuggaauccuuucac

SEQ ID NO: 2233624 - RNA, 14 nt, Homo sapiens
acuccugcucugcu

SEQ ID NO: 2233625 - RNA, 21 nt, Homo sapiens
uaagcacucaauaaaugcuca

SEQ ID NO: 2233626 - RNA, 14 nt, Homo sapiens
uugaugcaugcacu

SEQ ID NO: 2233627 - RNA, 15 nt, Homo sapiens
ucucugccuugguau

SEQ ID NO: 2233628 - RNA, 14 nt, Homo sapiens
ucugaagaagggaa

SEQ ID NO: 2233629 - RNA, 17 nt, Homo sapiens
gcauauauucaguuaua

SEQ ID NO: 2233630 - RNA, 19 nt, Homo sapiens
cccagccuccccgugccaa

SEQ ID NO: 2233631 - RNA, 17 nt, Homo sapiens
auagaguauugucuuua

SEQ ID NO: 2233632 - RNA, 16 nt, Homo sapiens
ggggauuuuuaugucu

SEQ ID NO: 2233633 - RNA, 19 nt, Homo sapiens
ugagugggagaguaccugu

SEQ ID NO: 2233634 - RNA, 21 nt, Homo sapiens
caacuuccagagaagccaugg

SEQ ID NO: 2233635 - RNA, 16 nt, Homo sapiens
ccugggauggggcaug

SEQ ID NO: 2233636 - RNA, 14 nt, Homo sapiens
gcucucguccugcc

SEQ ID NO: 2233637 - RNA, 15 nt, Homo sapiens
gcaaauuuucuucca

SEQ ID NO: 2233638 - RNA, 14 nt, Homo sapiens
acucucuaccagau

SEQ ID NO: 2233639 - RNA, 23 nt, Homo sapiens
aguaccaugggcuacagugucug

SEQ ID NO: 2233640 - RNA, 15 nt, Homo sapiens
cuauuuuaagccauc

SEQ ID NO: 2233641 - RNA, 19 nt, Homo sapiens
uggagaaacuguagucuca

SEQ ID NO: 2233642 - RNA, 16 nt, Homo sapiens
guucucuucauccauu

SEQ ID NO: 2233643 - RNA, 20 nt, Homo sapiens
ucaaaagacaaacaugcaag

SEQ ID NO: 2233644 - RNA, 13 nt, Homo sapiens
aacaaagacauuu

SEQ ID NO: 2233645 - RNA, 22 nt, Homo sapiens
agccccagggcccugcucaggc

SEQ ID NO: 2233646 - RNA, 23 nt, Homo sapiens
uaauaauacaccuauuucacuaa

SEQ ID NO: 2233647 - RNA, 20 nt, Homo sapiens
cugcuugagucagguuugag

SEQ ID NO: 2233648 - RNA, 15 nt, Homo sapiens
uugauccaucucagu

SEQ ID NO: 2233649 - RNA, 15 nt, Homo sapiens
agcuuuugccaguau

SEQ ID NO: 2233650 - RNA, 17 nt, Homo sapiens
aucauggucucagucau

SEQ ID NO: 2233651 - RNA, 15 nt, Homo sapiens
gccugaaccuuccau

SEQ ID NO: 2233652 - RNA, 18 nt, Homo sapiens
ugcaucaauuuaccuacu

SEQ ID NO: 2233653 - RNA, 16 nt, Homo sapiens
cuuaauaaacucacaa

SEQ ID NO: 2233654 - RNA, 17 nt, Homo sapiens
ugcauuacugcaugcac

SEQ ID NO: 2233655 - RNA, 16 nt, Homo sapiens
uguguuucaggacagc

SEQ ID NO: 2233656 - RNA, 23 nt, Homo sapiens
agauaaaaaaauuuuaauuccuu

SEQ ID NO: 2233657 - RNA, 15 nt, Homo sapiens
uccugaccaaguaga

SEQ ID NO: 2233658 - RNA, 14 nt, Homo sapiens
cuuauacauuugau

SEQ ID NO: 2233659 - RNA, 18 nt, Homo sapiens
aaaauuuuuuacuuuuaa

SEQ ID NO: 2233660 - RNA, 15 nt, Homo sapiens
aguuuguacuuuuau

SEQ ID NO: 2233661 - RNA, 19 nt, Homo sapiens
gcucagcggggacagcucc

SEQ ID NO: 2233662 - RNA, 16 nt, Homo sapiens
agaaggugaacuguua

SEQ ID NO: 2233663 - RNA, 12 nt, Homo sapiens
uuguacugugac

SEQ ID NO: 2233664 - RNA, 17 nt, Homo sapiens
aucucuugaccucguga

SEQ ID NO: 2233665 - RNA, 12 nt, Homo sapiens
ugauacuguugc

SEQ ID NO: 2233666 - RNA, 12 nt, Homo sapiens
auguacugagac

SEQ ID NO: 2233667 - RNA, 17 nt, Homo sapiens
uccuagccccucacuuc

SEQ ID NO: 2233668 - RNA, 19 nt, Homo sapiens
guuggggucuguucuugaa

SEQ ID NO: 2233669 - RNA, 11 nt, Homo sapiens
auagcauguau

SEQ ID NO: 2233670 - RNA, 23 nt, Homo sapiens
cugagguugggaaggcaccugcu

SEQ ID NO: 2233671 - RNA, 13 nt, Homo sapiens
guagaugacaaau

SEQ ID NO: 2233672 - RNA, 21 nt, Homo sapiens
gccucccaaagugcugggauu

SEQ ID NO: 2233673 - RNA, 21 nt, Homo sapiens
ucuguaucauugauucaucaa

SEQ ID NO: 2233674 - RNA, 14 nt, Homo sapiens
uggcaggugccugu

SEQ ID NO: 2233675 - RNA, 14 nt, Homo sapiens
cccagccccuccaa

SEQ ID NO: 2233676 - RNA, 20 nt, Homo sapiens
cccuagggauuuaaagggac

SEQ ID NO: 2233677 - RNA, 15 nt, Homo sapiens
acacuccagugccag

SEQ ID NO: 2233678 - RNA, 16 nt, Homo sapiens
acuuaugcacauuugu

SEQ ID NO: 2233679 - RNA, 22 nt, Homo sapiens
acucuuuuccaaacacaggcaa

SEQ ID NO: 2233680 - RNA, 18 nt, Homo sapiens
cuguucuuuaagacuuuu

SEQ ID NO: 2233681 - RNA, 22 nt, Homo sapiens
cagagauggcuccuugggauga

SEQ ID NO: 2233682 - RNA, 16 nt, Homo sapiens
auuuucuacuagccau

SEQ ID NO: 2233683 - RNA, 19 nt, Homo sapiens
uauucuuaaauucauuuua

SEQ ID NO: 2233684 - RNA, 22 nt, Homo sapiens
augcaacgcaggaggagaaaag

SEQ ID NO: 2233685 - RNA, 20 nt, Homo sapiens
aagcucaggaggcgaauaaa

SEQ ID NO: 2233686 - RNA, 13 nt, Homo sapiens
aaagacugagcag

SEQ ID NO: 2233687 - RNA, 21 nt, Homo sapiens
uaguaggagcugagcuuucca

SEQ ID NO: 2233688 - RNA, 22 nt, Homo sapiens
agauuauaauaugugccuuaag

SEQ ID NO: 2233689 - RNA, 15 nt, Homo sapiens
auuugucugacaaac

SEQ ID NO: 2233690 - RNA, 18 nt, Homo sapiens
acuggcucucuaauucca

SEQ ID NO: 2233691 - RNA, 20 nt, Homo sapiens
aggcgauucuccugccucag

SEQ ID NO: 2233692 - RNA, 16 nt, Homo sapiens
uaaaauugugaugcuc

SEQ ID NO: 2233693 - RNA, 22 nt, Homo sapiens
auauuuaaauguaaagacaaaa

SEQ ID NO: 2233694 - RNA, 21 nt, Homo sapiens
caggcaacuucaguccuggga

SEQ ID NO: 2233695 - RNA, 20 nt, Homo sapiens
acuauugcagaccugucacc

SEQ ID NO: 2233696 - RNA, 15 nt, Homo sapiens
aaccucauuccccaa

SEQ ID NO: 2233697 - RNA, 15 nt, Homo sapiens
aauauauuaaucagc

SEQ ID NO: 2233698 - RNA, 14 nt, Homo sapiens
gacaaagugacauu

SEQ ID NO: 2233699 - RNA, 14 nt, Homo sapiens
uggaauguuggaua

SEQ ID NO: 2233700 - RNA, 16 nt, Homo sapiens
ugacagcaaacagauc

SEQ ID NO: 2233701 - RNA, 16 nt, Homo sapiens
cacaaaaucacuuuaa

SEQ ID NO: 2233702 - RNA, 21 nt, Homo sapiens
ccugagcggaccuucccagcu

SEQ ID NO: 2233703 - RNA, 18 nt, Homo sapiens
gcuuaauaagucacugac

SEQ ID NO: 2233704 - RNA, 15 nt, Homo sapiens
agucuacacugccuu

SEQ ID NO: 2233705 - RNA, 17 nt, Homo sapiens
caaugaagaauuaugua

SEQ ID NO: 2233706 - RNA, 15 nt, Homo sapiens
gcacccuuuaccuuc

SEQ ID NO: 2233707 - RNA, 21 nt, Homo sapiens
auguuacuaaauuuucuaauu

SEQ ID NO: 2233708 - RNA, 15 nt, Homo sapiens
agcccacagugcuca

SEQ ID NO: 2233709 - RNA, 19 nt, Homo sapiens
uccaauuucgggagccuug

SEQ ID NO: 2233710 - RNA, 19 nt, Homo sapiens
auucuagaaagagccuuaa

SEQ ID NO: 2233711 - RNA, 15 nt, Homo sapiens
auuuaaaagacaaac

SEQ ID NO: 2233712 - RNA, 20 nt, Homo sapiens
cagcagaugaagagcuucau

SEQ ID NO: 2233713 - RNA, 19 nt, Homo sapiens
uccagccuggcuacagggc

SEQ ID NO: 2233714 - RNA, 17 nt, Homo sapiens
uggcaggaggcauccaa

SEQ ID NO: 2233715 - RNA, 21 nt, Homo sapiens
uguuggcaagcugcagguuug

SEQ ID NO: 2233716 - RNA, 14 nt, Homo sapiens
gcagcuucagggga

SEQ ID NO: 2233717 - RNA, 12 nt, Homo sapiens
ccagccuaagaa

SEQ ID NO: 2233718 - RNA, 20 nt, Homo sapiens
cacacaacagccaacagcua

SEQ ID NO: 2233719 - RNA, 23 nt, Homo sapiens
agcuugagaaggucacuacugca

SEQ ID NO: 2233720 - RNA, 15 nt, Homo sapiens
uggcucacaccugua

SEQ ID NO: 2233721 - RNA, 16 nt, Homo sapiens
uguuucuucucuacac

SEQ ID NO: 2233722 - RNA, 19 nt, Homo sapiens
ggcacuauuuauuuacaaa

SEQ ID NO: 2233723 - RNA, 11 nt, Homo sapiens
uuaccaaaaaa

SEQ ID NO: 2233724 - RNA, 20 nt, Homo sapiens
gcaggugcugagcaaaggga

SEQ ID NO: 2233725 - RNA, 18 nt, Homo sapiens
aguuccagaaacuuuaag

SEQ ID NO: 2233726 - RNA, 20 nt, Homo sapiens
cacuuuagauauacauauca

SEQ ID NO: 2233727 - RNA, 19 nt, Homo sapiens
ugaucacuuuugcacauuc

SEQ ID NO: 2233728 - RNA, 14 nt, Homo sapiens
augauucuaugucu

SEQ ID NO: 2233729 - RNA, 17 nt, Homo sapiens
gcaaaaaagguaacuaa

SEQ ID NO: 2233730 - RNA, 14 nt, Homo sapiens
ggcuauagcacaca

SEQ ID NO: 2233731 - RNA, 20 nt, Homo sapiens
ccagcaggcaacucaaagag

SEQ ID NO: 2233732 - RNA, 13 nt, Homo sapiens
aaaugaaucuuac

SEQ ID NO: 2233733 - RNA, 17 nt, Homo sapiens
ggaugaacaauguauac

SEQ ID NO: 2233734 - RNA, 19 nt, Homo sapiens
aaacuuuugggaacucucc

SEQ ID NO: 2233735 - RNA, 16 nt, Homo sapiens
cagaaccagccucaaa

SEQ ID NO: 2233736 - RNA, 17 nt, Homo sapiens
uacuuuuuauacuccau

SEQ ID NO: 2233737 - RNA, 15 nt, Homo sapiens
aaggagauaagaaag

SEQ ID NO: 2233738 - RNA, 15 nt, Homo sapiens
cugagggucugggaa

SEQ ID NO: 2233739 - RNA, 23 nt, Homo sapiens
gugacaagaauaauuuuggaaua

SEQ ID NO: 2233740 - RNA, 14 nt, Homo sapiens
ugccaguccugcaa

SEQ ID NO: 2233741 - RNA, 17 nt, Homo sapiens
gcacuguauccaaguua

SEQ ID NO: 2233742 - RNA, 19 nt, Homo sapiens
auaaaccgaaaguguuaca

SEQ ID NO: 2233743 - RNA, 15 nt, Homo sapiens
caacaccccacugag

SEQ ID NO: 2233744 - RNA, 18 nt, Homo sapiens
aaggugaugaauuuacca

SEQ ID NO: 2233745 - RNA, 11 nt, Homo sapiens
auuucaucucu

SEQ ID NO: 2233746 - RNA, 14 nt, Homo sapiens
agcagaaaugccuu

SEQ ID NO: 2233747 - RNA, 19 nt, Homo sapiens
aguuaucaugcauguuaug

SEQ ID NO: 2233748 - RNA, 23 nt, Homo sapiens
auguuuaugauaauaaaggcacc

SEQ ID NO: 2233749 - RNA, 15 nt, Homo sapiens
uggcauuuucacuuu

SEQ ID NO: 2233750 - RNA, 14 nt, Homo sapiens
uuccagugaggcuc

SEQ ID NO: 2233751 - RNA, 19 nt, Homo sapiens
uauauuacuugccuaucug

SEQ ID NO: 2233752 - RNA, 15 nt, Homo sapiens
uaccucaagacucac

SEQ ID NO: 2233753 - RNA, 12 nt, Homo sapiens
guucaacauuuu

SEQ ID NO: 2233754 - RNA, 15 nt, Homo sapiens
ggcuaggccggccag

SEQ ID NO: 2233755 - RNA, 20 nt, Homo sapiens
cgcagcccuggcagggggca

SEQ ID NO: 2233756 - RNA, 17 nt, Homo sapiens
ucuuucccaaucuucuu

SEQ ID NO: 2233757 - RNA, 22 nt, Homo sapiens
ccuugagucuguguuguguccu

SEQ ID NO: 2233758 - RNA, 19 nt, Homo sapiens
aaagugagacuccgucaca

SEQ ID NO: 2233759 - RNA, 23 nt, Homo sapiens
gaauagacacuucaccaaagagc

SEQ ID NO: 2233760 - RNA, 14 nt, Homo sapiens
gggaacagaccagu

SEQ ID NO: 2233761 - RNA, 18 nt, Homo sapiens
gcagggguagaagcaaag

SEQ ID NO: 2233762 - RNA, 19 nt, Homo sapiens
uugggcucagagaguacac

SEQ ID NO: 2233763 - RNA, 20 nt, Homo sapiens
cauuugaaugcuuaauucaa

SEQ ID NO: 2233764 - RNA, 19 nt, Homo sapiens
gggaccucaccccugagca

SEQ ID NO: 2233765 - RNA, 23 nt, Homo sapiens
aaaacacauggggaaaaaaauca

SEQ ID NO: 2233766 - RNA, 18 nt, Homo sapiens
ucaacagauuauuuugga

SEQ ID NO: 2233767 - RNA, 16 nt, Homo sapiens
cucuucagcaugcccc

SEQ ID NO: 2233768 - RNA, 14 nt, Homo sapiens
cuucugacaagcaa

SEQ ID NO: 2233769 - RNA, 19 nt, Homo sapiens
ugguagaaaggcaguucag

SEQ ID NO: 2233770 - RNA, 21 nt, Homo sapiens
augaagguuucugaaaauuaa

SEQ ID NO: 2233771 - RNA, 17 nt, Homo sapiens
caaucacuguauagaau

SEQ ID NO: 2233772 - RNA, 23 nt, Homo sapiens
ucaccucucagcugcuggaugac

SEQ ID NO: 2233773 - RNA, 14 nt, Homo sapiens
uccuccugcugcag

SEQ ID NO: 2233774 - RNA, 13 nt, Homo sapiens
uguuaauaaaggu

SEQ ID NO: 2233775 - RNA, 14 nt, Homo sapiens
aggccacaccggcc

SEQ ID NO: 2233776 - RNA, 14 nt, Homo sapiens
uuuguauauacuuu

SEQ ID NO: 2233777 - RNA, 17 nt, Homo sapiens
accacagugaauccaga

SEQ ID NO: 2233778 - RNA, 23 nt, Homo sapiens
ugaggaaaaguccacaagaacaa

SEQ ID NO: 2233779 - RNA, 15 nt, Homo sapiens
acuggccgagcugcu

SEQ ID NO: 2233780 - RNA, 19 nt, Homo sapiens
cuuuacuaauaaacugugu

SEQ ID NO: 2233781 - RNA, 16 nt, Homo sapiens
aaaauuuauuuuccag

SEQ ID NO: 2233782 - RNA, 22 nt, Homo sapiens
gccaguuucagcucacuuccuc

SEQ ID NO: 2233783 - RNA, 17 nt, Homo sapiens
uaaauuuuucauagaag

SEQ ID NO: 2233784 - RNA, 16 nt, Homo sapiens
uguacaaugauguaaa

SEQ ID NO: 2233785 - RNA, 18 nt, Homo sapiens
uagcaaauuccaauacau

SEQ ID NO: 2233786 - RNA, 17 nt, Homo sapiens
uccagccccuuuccaaa

SEQ ID NO: 2233787 - RNA, 21 nt, Homo sapiens
cauuaaacucuaaagauuagg

SEQ ID NO: 2233788 - RNA, 16 nt, Homo sapiens
uuugaacccaggagag

SEQ ID NO: 2233789 - RNA, 17 nt, Homo sapiens
ggagcaacaggccaagg

SEQ ID NO: 2233790 - RNA, 19 nt, Homo sapiens
ugugggaggcuggggaccc

SEQ ID NO: 2233791 - RNA, 18 nt, Homo sapiens
ggccuccaagccaggugc

SEQ ID NO: 2233792 - RNA, 15 nt, Homo sapiens
uggcaaggagccagg

SEQ ID NO: 2233793 - RNA, 20 nt, Homo sapiens
cauguagaaaacaaaaugga

SEQ ID NO: 2233794 - RNA, 15 nt, Homo sapiens
aggaagagugcaaaa

SEQ ID NO: 2233795 - RNA, 17 nt, Homo sapiens
ucagcugccuccccagc

SEQ ID NO: 2233796 - RNA, 17 nt, Homo sapiens
augucuagauaacauuc

SEQ ID NO: 2233797 - RNA, 16 nt, Homo sapiens
agauuccauacaguga

SEQ ID NO: 2233798 - RNA, 15 nt, Homo sapiens
uuuguccucauguga

SEQ ID NO: 2233799 - RNA, 18 nt, Homo sapiens
gaaaaugcaaguguuuga

SEQ ID NO: 2233800 - RNA, 23 nt, Homo sapiens
aaaaccguaugagggaacugugu

SEQ ID NO: 2233801 - RNA, 22 nt, Homo sapiens
cagugcaguuucuuuucacauu

SEQ ID NO: 2233802 - RNA, 19 nt, Homo sapiens
cccagcuucggcauuugau

SEQ ID NO: 2233803 - RNA, 23 nt, Homo sapiens
cuuguaaauagcucagguguccc

SEQ ID NO: 2233804 - RNA, 20 nt, Homo sapiens
gccuggggauguaaccaagc

SEQ ID NO: 2233805 - RNA, 17 nt, Homo sapiens
aaugccaaucucuucua

SEQ ID NO: 2233806 - RNA, 19 nt, Homo sapiens
aauggcacgcuccugccua

SEQ ID NO: 2233807 - RNA, 21 nt, Homo sapiens
cagauucuuccacuggcucca

SEQ ID NO: 2233808 - RNA, 15 nt, Homo sapiens
agacucaguagccau

SEQ ID NO: 2233809 - RNA, 19 nt, Homo sapiens
cucugcuuuuaacuuuaua

SEQ ID NO: 2233810 - RNA, 22 nt, Homo sapiens
acagcuacuuuaaccuaugaua

SEQ ID NO: 2233811 - RNA, 23 nt, Homo sapiens
ugccuggguggccauccuaccca

SEQ ID NO: 2233812 - RNA, 14 nt, Homo sapiens
ugggggcuagggga

SEQ ID NO: 2233813 - RNA, 14 nt, Homo sapiens
ucucaacuacucag

SEQ ID NO: 2233814 - RNA, 15 nt, Homo sapiens
ggaacaucaguggau

SEQ ID NO: 2233815 - RNA, 14 nt, Homo sapiens
acacucaugaagca

SEQ ID NO: 2233816 - RNA, 18 nt, Homo sapiens
aucguaaagcuguucaaa

SEQ ID NO: 2233817 - RNA, 15 nt, Homo sapiens
ucuuuguacagacaa

SEQ ID NO: 2233818 - RNA, 22 nt, Homo sapiens
uguguacauuagucauucaaua

SEQ ID NO: 2233819 - RNA, 20 nt, Homo sapiens
gucacccuuggacaagacaa

SEQ ID NO: 2233820 - RNA, 21 nt, Homo sapiens
aacccucacugggacuuugua

SEQ ID NO: 2233821 - RNA, 11 nt, Homo sapiens
aucuucaauga

SEQ ID NO: 2233822 - RNA, 13 nt, Homo sapiens
uggagugauucuc

SEQ ID NO: 2233823 - RNA, 13 nt, Homo sapiens
aaagcaucaccuc

SEQ ID NO: 2233824 - RNA, 23 nt, Homo sapiens
gagacauacuugaagggccagag

SEQ ID NO: 2233825 - RNA, 12 nt, Homo sapiens
uggcucccaagu

SEQ ID NO: 2233826 - RNA, 21 nt, Homo sapiens
uuauaugacaauccugaagaa

SEQ ID NO: 2233827 - RNA, 15 nt, Homo sapiens
aguuggugagcagag

SEQ ID NO: 2233828 - RNA, 20 nt, Homo sapiens
gggucuugcuauguugccca

SEQ ID NO: 2233829 - RNA, 13 nt, Homo sapiens
cgaugcugcuaug

SEQ ID NO: 2233830 - RNA, 15 nt, Homo sapiens
ugcaugagcugcaag

SEQ ID NO: 2233831 - RNA, 19 nt, Homo sapiens
cuguggugguucauuccac

SEQ ID NO: 2233832 - RNA, 19 nt, Homo sapiens
acaaaauagacaauuugca

SEQ ID NO: 2233833 - RNA, 14 nt, Homo sapiens
aaagagcagcauuu

SEQ ID NO: 2233834 - RNA, 16 nt, Homo sapiens
auugaaugacaagcau

SEQ ID NO: 2233835 - RNA, 17 nt, Homo sapiens
cacucagggagcauuua

SEQ ID NO: 2233836 - RNA, 16 nt, Homo sapiens
cagaacgcaugcaggg

SEQ ID NO: 2233837 - RNA, 17 nt, Homo sapiens
uaccugucauuuugcac

SEQ ID NO: 2233838 - RNA, 19 nt, Homo sapiens
gguuagggaaaacauucca

SEQ ID NO: 2233839 - RNA, 15 nt, Homo sapiens
uggacaucuugucau

SEQ ID NO: 2233840 - RNA, 16 nt, Homo sapiens
ucugaggggugggggu

SEQ ID NO: 2233841 - RNA, 16 nt, Homo sapiens
acaucuuggcacauuu

SEQ ID NO: 2233842 - RNA, 15 nt, Homo sapiens
ugauauauuucagcu

SEQ ID NO: 2233843 - RNA, 17 nt, Homo sapiens
auccaauggauugugca

SEQ ID NO: 2233844 - RNA, 16 nt, Homo sapiens
caaggcugacuucucu

SEQ ID NO: 2233845 - RNA, 19 nt, Homo sapiens
cagccagacgcauccugcc

SEQ ID NO: 2233846 - RNA, 23 nt, Homo sapiens
aaauuaacaaauucaguggacau

SEQ ID NO: 2233847 - RNA, 17 nt, Homo sapiens
aagcucagggugcuccc

SEQ ID NO: 2233848 - RNA, 15 nt, Homo sapiens
aaggaagcacaaaag

SEQ ID NO: 2233849 - RNA, 20 nt, Homo sapiens
ggucagggccccucuaccca

SEQ ID NO: 2233850 - RNA, 20 nt, Homo sapiens
auauaugauguggacauaug

SEQ ID NO: 2233851 - RNA, 19 nt, Homo sapiens
ccugguggauacuguagaa

SEQ ID NO: 2233852 - RNA, 19 nt, Homo sapiens
uggaaaagcaacauucaua

SEQ ID NO: 2233853 - RNA, 19 nt, Homo sapiens
gcagauaggagcugcaggg

SEQ ID NO: 2233854 - RNA, 22 nt, Homo sapiens
gaccaagcaggaagaacauuga

SEQ ID NO: 2233855 - RNA, 23 nt, Homo sapiens
acacccacugccccgugugaaug

SEQ ID NO: 2233856 - RNA, 20 nt, Homo sapiens
cuggaaaucuggauuuucag

SEQ ID NO: 2233857 - RNA, 17 nt, Homo sapiens
acucaaucuccagggcu

SEQ ID NO: 2233858 - RNA, 23 nt, Homo sapiens
uccaugguggaaguuaaagggca

SEQ ID NO: 2233859 - RNA, 20 nt, Homo sapiens
cgccaccccuccuuccuuga

SEQ ID NO: 2233860 - RNA, 21 nt, Homo sapiens
aucuccugcucaccaccugcc

SEQ ID NO: 2233861 - RNA, 19 nt, Homo sapiens
ucaaugcuuuccacauuuc

SEQ ID NO: 2233862 - RNA, 19 nt, Homo sapiens
aucugucuugucauuccag

SEQ ID NO: 2233863 - RNA, 20 nt, Homo sapiens
agcuugcuggagaguggcau

SEQ ID NO: 2233864 - RNA, 14 nt, Homo sapiens
ugaggaacauucaa

SEQ ID NO: 2233865 - RNA, 18 nt, Homo sapiens
aucaucaaaaagaacaac

SEQ ID NO: 2233866 - RNA, 13 nt, Homo sapiens
ugugaauauuccu

SEQ ID NO: 2233867 - RNA, 20 nt, Homo sapiens
gcucuguguguaccuggucc

SEQ ID NO: 2233868 - RNA, 12 nt, Homo sapiens
cuauaaugugcc

SEQ ID NO: 2233869 - RNA, 18 nt, Homo sapiens
cuacagcgagcugcauua

SEQ ID NO: 2233870 - RNA, 16 nt, Homo sapiens
caugaauuaguucucc

SEQ ID NO: 2233871 - RNA, 16 nt, Homo sapiens
ggcauggguccagggc

SEQ ID NO: 2233872 - RNA, 15 nt, Homo sapiens
cuccagcaacacagc

SEQ ID NO: 2233873 - RNA, 21 nt, Homo sapiens
cugcccacgcugcagugugag

SEQ ID NO: 2233874 - RNA, 21 nt, Homo sapiens
uggcacuugcaagucccauga

SEQ ID NO: 2233875 - RNA, 13 nt, Homo sapiens
cucucugcuccuu

SEQ ID NO: 2233876 - RNA, 22 nt, Homo sapiens
cuuguuucccugcuggccaaag

SEQ ID NO: 2233877 - RNA, 16 nt, Homo sapiens
auagaggaacuugaaa

SEQ ID NO: 2233878 - RNA, 15 nt, Homo sapiens
uguuuggccucucua

SEQ ID NO: 2233879 - RNA, 14 nt, Homo sapiens
gccucucuauucau

SEQ ID NO: 2233880 - RNA, 20 nt, Homo sapiens
cauaaagccuuuaaaaccag

SEQ ID NO: 2233881 - RNA, 14 nt, Homo sapiens
auagaugguguaug

SEQ ID NO: 2233882 - RNA, 13 nt, Homo sapiens
aggggugcugccu

SEQ ID NO: 2233883 - RNA, 13 nt, Homo sapiens
acuagcauccacu

SEQ ID NO: 2233884 - RNA, 13 nt, Homo sapiens
uggacucuuccac

SEQ ID NO: 2233885 - RNA, 13 nt, Homo sapiens
ucgcuucuugccu

SEQ ID NO: 2233886 - RNA, 18 nt, Homo sapiens
uugcuugugccacacccu

SEQ ID NO: 2233887 - RNA, 21 nt, Homo sapiens
aaaugccgggcacaggccagg

SEQ ID NO: 2233888 - RNA, 16 nt, Homo sapiens
gaagcucuucuuccca

SEQ ID NO: 2233889 - RNA, 15 nt, Homo sapiens
cugcgcaccaaggaa

SEQ ID NO: 2233890 - RNA, 22 nt, Homo sapiens
ugaaaaaggagagacauggaaa

SEQ ID NO: 2233891 - RNA, 23 nt, Homo sapiens
uucccaauagcaaggcugugcau

SEQ ID NO: 2233892 - RNA, 21 nt, Homo sapiens
aggugguucagacaagacaga

SEQ ID NO: 2233893 - RNA, 19 nt, Homo sapiens
uauauaaucaaaugauuca

SEQ ID NO: 2233894 - RNA, 16 nt, Homo sapiens
gaaauaaacugugcaa

SEQ ID NO: 2233895 - RNA, 13 nt, Homo sapiens
aauaaacacugug

SEQ ID NO: 2233896 - RNA, 20 nt, Homo sapiens
cuuugcauccuaaggacgaa

SEQ ID NO: 2233897 - RNA, 17 nt, Homo sapiens
auacaguucuaugcaga

SEQ ID NO: 2233898 - RNA, 19 nt, Homo sapiens
gccucccgcguugggcaac

SEQ ID NO: 2233899 - RNA, 13 nt, Homo sapiens
ugacaaacauauc

SEQ ID NO: 2233900 - RNA, 19 nt, Homo sapiens
cuagaacaugguuaccaug

SEQ ID NO: 2233901 - RNA, 21 nt, Homo sapiens
cuuuacuccaucauggcugcu

SEQ ID NO: 2233902 - RNA, 18 nt, Homo sapiens
caccguacaucugcaaua

SEQ ID NO: 2233903 - RNA, 19 nt, Homo sapiens
aagaguuugagaccugaau

SEQ ID NO: 2233904 - RNA, 21 nt, Homo sapiens
agucucauccucccauugccc

SEQ ID NO: 2233905 - RNA, 13 nt, Homo sapiens
gugauguggugcg

SEQ ID NO: 2233906 - RNA, 15 nt, Homo sapiens
uguucuguggcauag

SEQ ID NO: 2233907 - RNA, 16 nt, Homo sapiens
caugucuuguucagaa

SEQ ID NO: 2233908 - RNA, 16 nt, Homo sapiens
ccagccacacccagag

SEQ ID NO: 2233909 - RNA, 13 nt, Homo sapiens
agcaugugcaaua

SEQ ID NO: 2233910 - RNA, 15 nt, Homo sapiens
ucagaucugugagca

SEQ ID NO: 2233911 - RNA, 21 nt, Homo sapiens
uuccauuuuaaaaugcaucau

SEQ ID NO: 2233912 - RNA, 19 nt, Homo sapiens
ccacugucaaggcagggaa

SEQ ID NO: 2233913 - RNA, 18 nt, Homo sapiens
uuacaggugacugccacc

SEQ ID NO: 2233914 - RNA, 21 nt, Homo sapiens
ucucaggauugcuaggagcuc

SEQ ID NO: 2233915 - RNA, 15 nt, Homo sapiens
ccgggccacuccuuc

SEQ ID NO: 2233916 - RNA, 18 nt, Homo sapiens
gugccacuugacauuccu

SEQ ID NO: 2233917 - RNA, 16 nt, Homo sapiens
cucccuccccagugca

SEQ ID NO: 2233918 - RNA, 18 nt, Homo sapiens
caggaagacuuccagcuu

SEQ ID NO: 2233919 - RNA, 19 nt, Homo sapiens
aacaaugguugaaugaaua

SEQ ID NO: 2233920 - RNA, 17 nt, Homo sapiens
ccaccagcaaggggacc

SEQ ID NO: 2233921 - RNA, 17 nt, Homo sapiens
caaaguaaugguucuca

SEQ ID NO: 2233922 - RNA, 15 nt, Homo sapiens
ccuccugucccucau

SEQ ID NO: 2233923 - RNA, 16 nt, Homo sapiens
cagcuggccuguaauc

SEQ ID NO: 2233924 - RNA, 16 nt, Homo sapiens
gaguuguugugcaagu

SEQ ID NO: 2233925 - RNA, 20 nt, Homo sapiens
uaagccacugccucucccuc

SEQ ID NO: 2233926 - RNA, 23 nt, Homo sapiens
agccuccagcaccuucccucuca

SEQ ID NO: 2233927 - RNA, 14 nt, Homo sapiens
auugacaguugaac

SEQ ID NO: 2233928 - RNA, 22 nt, Homo sapiens
auccuccaaagucacacagagu

SEQ ID NO: 2233929 - RNA, 13 nt, Homo sapiens
caggcuguucuca

SEQ ID NO: 2233930 - RNA, 20 nt, Homo sapiens
uaaguauuuuccuguuguca

SEQ ID NO: 2233931 - RNA, 13 nt, Homo sapiens
gcagguuugcaau

SEQ ID NO: 2233932 - RNA, 19 nt, Homo sapiens
ugacucacucauaaagguu

SEQ ID NO: 2233933 - RNA, 21 nt, Homo sapiens
uguauuuuccuaugugcugua

SEQ ID NO: 2233934 - RNA, 16 nt, Homo sapiens
aauaaaaauaagaaau

SEQ ID NO: 2233935 - RNA, 23 nt, Homo sapiens
uucagugcaguuucuuuucacau

SEQ ID NO: 2233936 - RNA, 22 nt, Homo sapiens
ggccggggcugccgcaucugcc

SEQ ID NO: 2233937 - RNA, 16 nt, Homo sapiens
ucguagaaacaagaca

SEQ ID NO: 2233938 - RNA, 21 nt, Homo sapiens
uugggacagcaugacugugca

SEQ ID NO: 2233939 - RNA, 19 nt, Homo sapiens
caagagauaagucuuucau

SEQ ID NO: 2233940 - RNA, 23 nt, Homo sapiens
cauguuauucucucacaguguac

SEQ ID NO: 2233941 - RNA, 14 nt, Homo sapiens
uggcaccucugccc

SEQ ID NO: 2233942 - RNA, 14 nt, Homo sapiens
gaauaacugguaca

SEQ ID NO: 2233943 - RNA, 22 nt, Homo sapiens
aauaggaucccccuucuugccc

SEQ ID NO: 2233944 - RNA, 19 nt, Homo sapiens
agagagcaccuggugauca

SEQ ID NO: 2233945 - RNA, 20 nt, Homo sapiens
uuucaaaaauuacacuacaa

SEQ ID NO: 2233946 - RNA, 16 nt, Homo sapiens
acccaccaaaaccaag

SEQ ID NO: 2233947 - RNA, 20 nt, Homo sapiens
auugaucagagcauugugca

SEQ ID NO: 2233948 - RNA, 23 nt, Homo sapiens
cucugcaagcccacuggccagcu

SEQ ID NO: 2233949 - RNA, 19 nt, Homo sapiens
ugagcagccuccacugugu

SEQ ID NO: 2233950 - RNA, 19 nt, Homo sapiens
uaccugagauggaggaguc

SEQ ID NO: 2233951 - RNA, 15 nt, Homo sapiens
ugugacuucacugua

SEQ ID NO: 2233952 - RNA, 14 nt, Homo sapiens
caaauacaugccuu

SEQ ID NO: 2233953 - RNA, 20 nt, Homo sapiens
ccuaaagggaagcccugaca

SEQ ID NO: 2233954 - RNA, 19 nt, Homo sapiens
acagacgucucaagacuga

SEQ ID NO: 2233955 - RNA, 13 nt, Homo sapiens
caauauaagcaua

SEQ ID NO: 2233956 - RNA, 15 nt, Homo sapiens
uguagcgcuuugaau

SEQ ID NO: 2233957 - RNA, 21 nt, Homo sapiens
caaaugccuccaagccauuca

SEQ ID NO: 2233958 - RNA, 14 nt, Homo sapiens
cacuacauuguaca

SEQ ID NO: 2233959 - RNA, 16 nt, Homo sapiens
ucaaggaaagggcagu

SEQ ID NO: 2233960 - RNA, 22 nt, Homo sapiens
ucccugggaggcuggggccccu

SEQ ID NO: 2233961 - RNA, 21 nt, Homo sapiens
agaggaaggaaaaggaggaaa

SEQ ID NO: 2233962 - RNA, 15 nt, Homo sapiens
uaaugcugucuuugu

SEQ ID NO: 2233963 - RNA, 22 nt, Homo sapiens
agaaucuguuaccagaggacaa

SEQ ID NO: 2233964 - RNA, 21 nt, Homo sapiens
acaaacauuuaaaaggauuug

SEQ ID NO: 2233965 - RNA, 21 nt, Homo sapiens
auuuucaagaucaaacuucca

SEQ ID NO: 2233966 - RNA, 22 nt, Homo sapiens
uucuguuuuuaaugcuauuuga

SEQ ID NO: 2233967 - RNA, 22 nt, Homo sapiens
guacuaugucugaacauagaaa

SEQ ID NO: 2233968 - RNA, 21 nt, Homo sapiens
uucucaaaguuaauucaccua

SEQ ID NO: 2233969 - RNA, 16 nt, Homo sapiens
auuuaauuuccagggu

SEQ ID NO: 2233970 - RNA, 12 nt, Homo sapiens
ggcucacaaaga

SEQ ID NO: 2233971 - RNA, 18 nt, Homo sapiens
uucaaggcucaaugcuau

SEQ ID NO: 2233972 - RNA, 17 nt, Homo sapiens
agcccccugcacccacc

SEQ ID NO: 2233973 - RNA, 17 nt, Homo sapiens
aaaaaccacagccacua

SEQ ID NO: 2233974 - RNA, 14 nt, Homo sapiens
caaggagacugccu

SEQ ID NO: 2233975 - RNA, 18 nt, Homo sapiens
uuuacagucaaucuauga

SEQ ID NO: 2233976 - RNA, 20 nt, Homo sapiens
uucugaaaagaugguaucau

SEQ ID NO: 2233977 - RNA, 12 nt, Homo sapiens
accucaguuuua

SEQ ID NO: 2233978 - RNA, 20 nt, Homo sapiens
agugaaacaggucuuugcca

SEQ ID NO: 2233979 - RNA, 16 nt, Homo sapiens
agagucaggaucucac

SEQ ID NO: 2233980 - RNA, 19 nt, Homo sapiens
cuuuaaugauuccuauaaa

SEQ ID NO: 2233981 - RNA, 21 nt, Homo sapiens
gaccucaaaggugauugugcc

SEQ ID NO: 2233982 - RNA, 16 nt, Homo sapiens
auacuccagcaccugu

SEQ ID NO: 2233983 - RNA, 16 nt, Homo sapiens
caaagccaagcaaaau

SEQ ID NO: 2233984 - RNA, 21 nt, Homo sapiens
uagugggcaccccacugcaau

SEQ ID NO: 2233985 - RNA, 14 nt, Homo sapiens
agcaaugauuacuc

SEQ ID NO: 2233986 - RNA, 18 nt, Homo sapiens
ccuaccugcagaguuacu

SEQ ID NO: 2233987 - RNA, 16 nt, Homo sapiens
cuuuucucccaccucc

SEQ ID NO: 2233988 - RNA, 20 nt, Homo sapiens
gaauacccuuuucugaccaa

SEQ ID NO: 2233989 - RNA, 13 nt, Homo sapiens
aaaguuacauugu

SEQ ID NO: 2233990 - RNA, 18 nt, Homo sapiens
ucugcaggaacaugaccc

SEQ ID NO: 2233991 - RNA, 18 nt, Homo sapiens
uuuccagcugccaagugc

SEQ ID NO: 2233992 - RNA, 17 nt, Homo sapiens
auuuuuaagagccuuca

SEQ ID NO: 2233993 - RNA, 18 nt, Homo sapiens
ucuaagcuguuucuugau

SEQ ID NO: 2233994 - RNA, 20 nt, Homo sapiens
cggggaagagauccaaagac

SEQ ID NO: 2233995 - RNA, 23 nt, Homo sapiens
auuuaaaugugaauuucaacuuu

SEQ ID NO: 2233996 - RNA, 16 nt, Homo sapiens
uccugauuucucugaa

SEQ ID NO: 2233997 - RNA, 20 nt, Homo sapiens
auaaauaaaagauagcaaua

SEQ ID NO: 2233998 - RNA, 18 nt, Homo sapiens
gagacucuaggguccagu

SEQ ID NO: 2233999 - RNA, 22 nt, Homo sapiens
ucaaaacuguuuguuaucucuu

SEQ ID NO: 2234000 - RNA, 11 nt, Homo sapiens
auaauuuugcc

SEQ ID NO: 2234001 - RNA, 13 nt, Homo sapiens
caccaguguccuc

SEQ ID NO: 2234002 - RNA, 20 nt, Homo sapiens
gagcagagcuuccacaagac

SEQ ID NO: 2234003 - RNA, 21 nt, Homo sapiens
aaacgauuagugauguccuua

SEQ ID NO: 2234004 - RNA, 14 nt, Homo sapiens
cacaauaggucuuu

SEQ ID NO: 2234005 - RNA, 22 nt, Homo sapiens
cuagaaacagaccugcauucaa

SEQ ID NO: 2234006 - RNA, 21 nt, Homo sapiens
agccaccccuccucuagcucu

SEQ ID NO: 2234007 - RNA, 21 nt, Homo sapiens
cagcauggaugugucucaggc

SEQ ID NO: 2234008 - RNA, 17 nt, Homo sapiens
aacuuauaggugaauga

SEQ ID NO: 2234009 - RNA, 16 nt, Homo sapiens
ccauguaccagcagcu

SEQ ID NO: 2234010 - RNA, 18 nt, Homo sapiens
agaagauucaaucacugu

SEQ ID NO: 2234011 - RNA, 18 nt, Homo sapiens
cuucucuccacaguguug

SEQ ID NO: 2234012 - RNA, 17 nt, Homo sapiens
gguauaaagcucucaaa

SEQ ID NO: 2234013 - RNA, 16 nt, Homo sapiens
ugucauuaauguguug

SEQ ID NO: 2234014 - RNA, 21 nt, Homo sapiens
ggaugggcagcuaagcagucu

SEQ ID NO: 2234015 - RNA, 12 nt, Homo sapiens
uaaaugaacuca

SEQ ID NO: 2234016 - RNA, 15 nt, Homo sapiens
ggaaccuaaauugaa

SEQ ID NO: 2234017 - RNA, 20 nt, Homo sapiens
agacaaugaaacaacagaga

SEQ ID NO: 2234018 - RNA, 18 nt, Homo sapiens
cuaaguggaauagccucc

SEQ ID NO: 2234019 - RNA, 21 nt, Homo sapiens
acagacuccaaaaggcccuuu

SEQ ID NO: 2234020 - RNA, 13 nt, Homo sapiens
aggaacaugaccc

SEQ ID NO: 2234021 - RNA, 20 nt, Homo sapiens
gggccuagaccuggugcuga

SEQ ID NO: 2234022 - RNA, 13 nt, Homo sapiens
gaauuccuaacuu

SEQ ID NO: 2234023 - RNA, 16 nt, Homo sapiens
cuguggagcgggcaug

SEQ ID NO: 2234024 - RNA, 14 nt, Homo sapiens
uuagaaaaauuccu

SEQ ID NO: 2234025 - RNA, 15 nt, Homo sapiens
ucccuaauucugccu

SEQ ID NO: 2234026 - RNA, 17 nt, Homo sapiens
uaagaugaaucauuuaa

SEQ ID NO: 2234027 - RNA, 15 nt, Homo sapiens
agccucuauugccau

SEQ ID NO: 2234028 - RNA, 14 nt, Homo sapiens
uuuauagauuugac

SEQ ID NO: 2234029 - RNA, 19 nt, Homo sapiens
cacacccccuuugcauguu

SEQ ID NO: 2234030 - RNA, 21 nt, Homo sapiens
ucugcugugauuuaucugcug

SEQ ID NO: 2234031 - RNA, 23 nt, Homo sapiens
acccugggcaaugcagugcagca

SEQ ID NO: 2234032 - RNA, 15 nt, Homo sapiens
cagaugguacugcug

SEQ ID NO: 2234033 - RNA, 18 nt, Homo sapiens
caagaaacugaugaauga

SEQ ID NO: 2234034 - RNA, 15 nt, Homo sapiens
cuguccuccacacaa

SEQ ID NO: 2234035 - RNA, 20 nt, Homo sapiens
caugaggccaccaguaaaag

SEQ ID NO: 2234036 - RNA, 20 nt, Homo sapiens
gaaaaguuuauaaaagugaa

SEQ ID NO: 2234037 - RNA, 15 nt, Homo sapiens
ucaguaggcuucugg

SEQ ID NO: 2234038 - RNA, 18 nt, Homo sapiens
gauuuugagaauguacua

SEQ ID NO: 2234039 - RNA, 11 nt, Homo sapiens
ugacacacagu

SEQ ID NO: 2234040 - RNA, 17 nt, Homo sapiens
acuacccaugcaauuaa

SEQ ID NO: 2234041 - RNA, 17 nt, Homo sapiens
uugguaaucucugugaa

SEQ ID NO: 2234042 - RNA, 16 nt, Homo sapiens
ugcugugggugcagcu

SEQ ID NO: 2234043 - RNA, 15 nt, Homo sapiens
ugaagucuucccuca

SEQ ID NO: 2234044 - RNA, 22 nt, Homo sapiens
guuggagaguacggcuaccugg

SEQ ID NO: 2234045 - RNA, 14 nt, Homo sapiens
gugggguuguucac

SEQ ID NO: 2234046 - RNA, 17 nt, Homo sapiens
gcgcgaucucggcucac

SEQ ID NO: 2234047 - RNA, 16 nt, Homo sapiens
ggugucugugacauuu

SEQ ID NO: 2234048 - RNA, 13 nt, Homo sapiens
uauguugaucauu

SEQ ID NO: 2234049 - RNA, 15 nt, Homo sapiens
cugagaaccaaaaga

SEQ ID NO: 2234050 - RNA, 18 nt, Homo sapiens
ucaggcaaagugcugcug

SEQ ID NO: 2234051 - RNA, 18 nt, Homo sapiens
ugucccucacagcacuag

SEQ ID NO: 2234052 - RNA, 16 nt, Homo sapiens
cacuauucuugaauua

SEQ ID NO: 2234053 - RNA, 19 nt, Homo sapiens
gcaccagccccacccaagc

SEQ ID NO: 2234054 - RNA, 18 nt, Homo sapiens
cugaaauaaaaugauuaa

SEQ ID NO: 2234055 - RNA, 16 nt, Homo sapiens
ccuuccuggcacucuc

SEQ ID NO: 2234056 - RNA, 22 nt, Homo sapiens
ucuguuguguuugucaaaaagu

SEQ ID NO: 2234057 - RNA, 17 nt, Homo sapiens
auuaaauuguuccauuu

SEQ ID NO: 2234058 - RNA, 23 nt, Homo sapiens
uuguucacacacacucugaagaa

SEQ ID NO: 2234059 - RNA, 13 nt, Homo sapiens
uccaucaccagcc

SEQ ID NO: 2234060 - RNA, 16 nt, Homo sapiens
uuuccccaucugccac

SEQ ID NO: 2234061 - RNA, 21 nt, Homo sapiens
agcugcuugacuaucacauac

SEQ ID NO: 2234062 - RNA, 23 nt, Homo sapiens
cuuccgucucccccguguucccc

SEQ ID NO: 2234063 - RNA, 11 nt, Homo sapiens
ugcucucagga

SEQ ID NO: 2234064 - RNA, 20 nt, Homo sapiens
aaaucauaccaguuguucau

SEQ ID NO: 2234065 - RNA, 15 nt, Homo sapiens
auuucaucuuuccaa

SEQ ID NO: 2234066 - RNA, 17 nt, Homo sapiens
uaaagaaaagacgaaua

SEQ ID NO: 2234067 - RNA, 14 nt, Homo sapiens
aaguuguugauguu

SEQ ID NO: 2234068 - RNA, 21 nt, Homo sapiens
ucuucuuuugggaggauuuga

SEQ ID NO: 2234069 - RNA, 11 nt, Homo sapiens
ugacagccaca

SEQ ID NO: 2234070 - RNA, 12 nt, Homo sapiens
gcccagaacggg

SEQ ID NO: 2234071 - RNA, 15 nt, Homo sapiens
caggaacuaaaggaa

SEQ ID NO: 2234072 - RNA, 12 nt, Homo sapiens
uaaauagcucag

SEQ ID NO: 2234073 - RNA, 13 nt, Homo sapiens
uugagacagaguc

SEQ ID NO: 2234074 - RNA, 13 nt, Homo sapiens
caguagucccugc

SEQ ID NO: 2234075 - RNA, 18 nt, Homo sapiens
uggggaugucucucauga

SEQ ID NO: 2234076 - RNA, 16 nt, Homo sapiens
ugcagaaccagugaca

SEQ ID NO: 2234077 - RNA, 22 nt, Homo sapiens
ggagacaauaacuccagugaug

SEQ ID NO: 2234078 - RNA, 23 nt, Homo sapiens
ccgucaagagugaauucccucac

SEQ ID NO: 2234079 - RNA, 18 nt, Homo sapiens
uuaaagaagagaacugcc

SEQ ID NO: 2234080 - RNA, 18 nt, Homo sapiens
cagccagaggcaccucaa

SEQ ID NO: 2234081 - RNA, 20 nt, Homo sapiens
gggucauacuacauacaagc

SEQ ID NO: 2234082 - RNA, 17 nt, Homo sapiens
ugaacaaagcaccucaa

SEQ ID NO: 2234083 - RNA, 11 nt, Homo sapiens
ggaagauaucu

SEQ ID NO: 2234084 - RNA, 21 nt, Homo sapiens
cacucuuuugagcaguaaaug

SEQ ID NO: 2234085 - RNA, 22 nt, Homo sapiens
cagcccuacagggacugggcaa

SEQ ID NO: 2234086 - RNA, 15 nt, Homo sapiens
uguuggagaugcagc

SEQ ID NO: 2234087 - RNA, 18 nt, Homo sapiens
acagauucuucacugugu

SEQ ID NO: 2234088 - RNA, 18 nt, Homo sapiens
gcaugggggccucagggc

SEQ ID NO: 2234089 - RNA, 17 nt, Homo sapiens
aaaauugccaacauaag

SEQ ID NO: 2234090 - RNA, 15 nt, Homo sapiens
ugggggagaagcaag

SEQ ID NO: 2234091 - RNA, 11 nt, Homo sapiens
uuuuauuaguu

SEQ ID NO: 2234092 - RNA, 17 nt, Homo sapiens
ccagaaagcucaucuca

SEQ ID NO: 2234093 - RNA, 22 nt, Homo sapiens
ugugggacugacauuucucaau

SEQ ID NO: 2234094 - RNA, 18 nt, Homo sapiens
gauaauucaaacugacaa

SEQ ID NO: 2234095 - RNA, 21 nt, Homo sapiens
ccaugugacuaaaaaugcauc

SEQ ID NO: 2234096 - RNA, 20 nt, Homo sapiens
uacacuguuaucuucacuuu

SEQ ID NO: 2234097 - RNA, 15 nt, Homo sapiens
uuuuacacuugcauc

SEQ ID NO: 2234098 - RNA, 22 nt, Homo sapiens
uauggugcuaauguacuuucac

SEQ ID NO: 2234099 - RNA, 19 nt, Homo sapiens
ugcuucagcucuucuugac

SEQ ID NO: 2234100 - RNA, 22 nt, Homo sapiens
agagucggauuaccaaaacacu

SEQ ID NO: 2234101 - RNA, 16 nt, Homo sapiens
gauuucauuaccaagu

SEQ ID NO: 2234102 - RNA, 16 nt, Homo sapiens
aaaaauugucugcauu

SEQ ID NO: 2234103 - RNA, 23 nt, Homo sapiens
acugccauuuuuugucugugaua

SEQ ID NO: 2234104 - RNA, 16 nt, Homo sapiens
cugagacuuggauuaa

SEQ ID NO: 2234105 - RNA, 12 nt, Homo sapiens
aaccaugacugu

SEQ ID NO: 2234106 - RNA, 18 nt, Homo sapiens
cugcacuuugcuguggca

SEQ ID NO: 2234107 - RNA, 15 nt, Homo sapiens
uggucuguacuccuu

SEQ ID NO: 2234108 - RNA, 15 nt, Homo sapiens
cgccagcccuaggcu

SEQ ID NO: 2234109 - RNA, 20 nt, Homo sapiens
cuacuguguagacucagcuu

SEQ ID NO: 2234110 - RNA, 20 nt, Homo sapiens
ugucacagaagcagcuaaac

SEQ ID NO: 2234111 - RNA, 18 nt, Homo sapiens
acuucaaugggcucuucc

SEQ ID NO: 2234112 - RNA, 23 nt, Homo sapiens
uaaauagugucauauaaacucau

SEQ ID NO: 2234113 - RNA, 12 nt, Homo sapiens
aucuuaauguau

SEQ ID NO: 2234114 - RNA, 12 nt, Homo sapiens
aacauaaugaaa

SEQ ID NO: 2234115 - RNA, 21 nt, Homo sapiens
gauauacuugguucucuccac

SEQ ID NO: 2234116 - RNA, 17 nt, Homo sapiens
accccacuuaugcugcu

SEQ ID NO: 2234117 - RNA, 16 nt, Homo sapiens
auuuguuuaguuuuga

SEQ ID NO: 2234118 - RNA, 19 nt, Homo sapiens
uauuuugugcaacauaaca

SEQ ID NO: 2234119 - RNA, 19 nt, Homo sapiens
gacuacuauacaaacuaca

SEQ ID NO: 2234120 - RNA, 18 nt, Homo sapiens
ccaggaguuugagaccag

SEQ ID NO: 2234121 - RNA, 16 nt, Homo sapiens
uaaguggcugugauua

SEQ ID NO: 2234122 - RNA, 22 nt, Homo sapiens
uagaagcacggcuguggguggu

SEQ ID NO: 2234123 - RNA, 18 nt, Homo sapiens
aaaccuuuccccagacac

SEQ ID NO: 2234124 - RNA, 23 nt, Homo sapiens
ucagccccaccccagguccugca

SEQ ID NO: 2234125 - RNA, 17 nt, Homo sapiens
cccagccgucgucuccc

SEQ ID NO: 2234126 - RNA, 22 nt, Homo sapiens
cauuaaaagaacauaaguuauc

SEQ ID NO: 2234127 - RNA, 23 nt, Homo sapiens
ccaggagaguacauggcauugag

SEQ ID NO: 2234128 - RNA, 21 nt, Homo sapiens
ccugagugcaccacccuuuga

SEQ ID NO: 2234129 - RNA, 18 nt, Homo sapiens
uguccuggaggcacuggg

SEQ ID NO: 2234130 - RNA, 15 nt, Homo sapiens
cuccguuugauguga

SEQ ID NO: 2234131 - RNA, 18 nt, Homo sapiens
ucuccuuugcacugaggg

SEQ ID NO: 2234132 - RNA, 17 nt, Homo sapiens
ugccuagaaucuuuauu

SEQ ID NO: 2234133 - RNA, 21 nt, Homo sapiens
ugaugcucaaaaucuuuccaa

SEQ ID NO: 2234134 - RNA, 16 nt, Homo sapiens
gccuguagcaaacacc

SEQ ID NO: 2234135 - RNA, 19 nt, Homo sapiens
cacuggaucccaucaaaga

SEQ ID NO: 2234136 - RNA, 22 nt, Homo sapiens
cccagccuucagucacaugcua

SEQ ID NO: 2234137 - RNA, 23 nt, Homo sapiens
uggagcgggugggaaccaaacac

SEQ ID NO: 2234138 - RNA, 17 nt, Homo sapiens
uaguaaauuaagagcau

SEQ ID NO: 2234139 - RNA, 21 nt, Homo sapiens
cuuucuuguugcugcaucucc

SEQ ID NO: 2234140 - RNA, 16 nt, Homo sapiens
accggguggaagggau

SEQ ID NO: 2234141 - RNA, 21 nt, Homo sapiens
ggucucuggcccuucuugccu

SEQ ID NO: 2234142 - RNA, 17 nt, Homo sapiens
cagguaaccacaauuuu

SEQ ID NO: 2234143 - RNA, 14 nt, Homo sapiens
ucauuuauauugca

SEQ ID NO: 2234144 - RNA, 15 nt, Homo sapiens
ucauguaagauggca

SEQ ID NO: 2234145 - RNA, 11 nt, Homo sapiens
gagggcccaac

SEQ ID NO: 2234146 - RNA, 17 nt, Homo sapiens
agccacuggcuuggaac

SEQ ID NO: 2234147 - RNA, 15 nt, Homo sapiens
ucagcauguccaaca

SEQ ID NO: 2234148 - RNA, 20 nt, Homo sapiens
ccaaugagaucauugugaag

SEQ ID NO: 2234149 - RNA, 19 nt, Homo sapiens
gugcaggauauuugcacua

SEQ ID NO: 2234150 - RNA, 23 nt, Homo sapiens
gacccaggauaucugaaaauauu

SEQ ID NO: 2234151 - RNA, 20 nt, Homo sapiens
aaccaccgcgcccagccuuu

SEQ ID NO: 2234152 - RNA, 23 nt, Homo sapiens
auuuuggucagaccgguugcucu

SEQ ID NO: 2234153 - RNA, 20 nt, Homo sapiens
auaaauaagaucagacucug

SEQ ID NO: 2234154 - RNA, 12 nt, Homo sapiens
uagagcacugcc

SEQ ID NO: 2234155 - RNA, 20 nt, Homo sapiens
uacgugauccucucaccuca

SEQ ID NO: 2234156 - RNA, 14 nt, Homo sapiens
ggaccuauguuugc

SEQ ID NO: 2234157 - RNA, 20 nt, Homo sapiens
aaguuacuagguaacuucau

SEQ ID NO: 2234158 - RNA, 17 nt, Homo sapiens
aaacauaauaaaaggag

SEQ ID NO: 2234159 - RNA, 21 nt, Homo sapiens
cacauucuuaaauauuuccau

SEQ ID NO: 2234160 - RNA, 16 nt, Homo sapiens
acauaguuuauuucaa

SEQ ID NO: 2234161 - RNA, 21 nt, Homo sapiens
ccagcuguguucacacuguaa

SEQ ID NO: 2234162 - RNA, 14 nt, Homo sapiens
cugccucagcaauu

SEQ ID NO: 2234163 - RNA, 23 nt, Homo sapiens
ccaggcuggagugcaguggcacg

SEQ ID NO: 2234164 - RNA, 21 nt, Homo sapiens
ccaguauggcaaaaguaggca

SEQ ID NO: 2234165 - RNA, 20 nt, Homo sapiens
accucggcuccuggacucau

SEQ ID NO: 2234166 - RNA, 18 nt, Homo sapiens
acagagcgagacugucuc

SEQ ID NO: 2234167 - RNA, 22 nt, Homo sapiens
aaauucaugguuuuaaagcuaa

SEQ ID NO: 2234168 - RNA, 22 nt, Homo sapiens
gaaggccuugcugucaugugaa

SEQ ID NO: 2234169 - RNA, 15 nt, Homo sapiens
aaaaauagacacucc

SEQ ID NO: 2234170 - RNA, 13 nt, Homo sapiens
aaacuccccagcu

SEQ ID NO: 2234171 - RNA, 14 nt, Homo sapiens
gggccucagacgag

SEQ ID NO: 2234172 - RNA, 19 nt, Homo sapiens
ucaucaaugugacauuuac

SEQ ID NO: 2234173 - RNA, 14 nt, Homo sapiens
ggcagcaugacuca

SEQ ID NO: 2234174 - RNA, 21 nt, Homo sapiens
cuguuugagaaccauuuacuu

SEQ ID NO: 2234175 - RNA, 14 nt, Homo sapiens
aacacuuuggccac

SEQ ID NO: 2234176 - RNA, 15 nt, Homo sapiens
aacuccaaaguccac

SEQ ID NO: 2234177 - RNA, 17 nt, Homo sapiens
uacugaauaaauacaaa

SEQ ID NO: 2234178 - RNA, 20 nt, Homo sapiens
gguucuuaaaaaggaacaaa

SEQ ID NO: 2234179 - RNA, 14 nt, Homo sapiens
gcagucagugucaa

SEQ ID NO: 2234180 - RNA, 14 nt, Homo sapiens
aggccagugccagc

SEQ ID NO: 2234181 - RNA, 14 nt, Homo sapiens
cuguucuguggaaa

SEQ ID NO: 2234182 - RNA, 22 nt, Homo sapiens
ugaauucguuucugacauaccu

SEQ ID NO: 2234183 - RNA, 18 nt, Homo sapiens
cuuaucaaucccaaccau

SEQ ID NO: 2234184 - RNA, 19 nt, Homo sapiens
agaagguugugaugaagaa

SEQ ID NO: 2234185 - RNA, 15 nt, Homo sapiens
agacaccaaacugcc

SEQ ID NO: 2234186 - RNA, 15 nt, Homo sapiens
aaaugaaaagccaaa

SEQ ID NO: 2234187 - RNA, 15 nt, Homo sapiens
caccaaaacgaugaa

SEQ ID NO: 2234188 - RNA, 17 nt, Homo sapiens
gucgaugaucaccaagc

SEQ ID NO: 2234189 - RNA, 18 nt, Homo sapiens
agugagucugaaugucac

SEQ ID NO: 2234190 - RNA, 22 nt, Homo sapiens
agcauuggccuggccagaccag

SEQ ID NO: 2234191 - RNA, 18 nt, Homo sapiens
cuuccucuucucaaaaug

SEQ ID NO: 2234192 - RNA, 12 nt, Homo sapiens
uccaaacagugu

SEQ ID NO: 2234193 - RNA, 18 nt, Homo sapiens
cugugcccagaauacuga

SEQ ID NO: 2234194 - RNA, 13 nt, Homo sapiens
cuggacaaccaga

SEQ ID NO: 2234195 - RNA, 13 nt, Homo sapiens
gugaacaagcaaa

SEQ ID NO: 2234196 - RNA, 22 nt, Homo sapiens
cuccaacuccuuucagccacau

SEQ ID NO: 2234197 - RNA, 20 nt, Homo sapiens
agucacacacacauacaaaa

SEQ ID NO: 2234198 - RNA, 20 nt, Homo sapiens
aguuguuuuccugcuuuaca

SEQ ID NO: 2234199 - RNA, 15 nt, Homo sapiens
aggugaccccagggc

SEQ ID NO: 2234200 - RNA, 23 nt, Homo sapiens
caaacuguaaaacuuaaaacuga

SEQ ID NO: 2234201 - RNA, 18 nt, Homo sapiens
auaaauggaaacaccacu

SEQ ID NO: 2234202 - RNA, 14 nt, Homo sapiens
cugagauagcuuag

SEQ ID NO: 2234203 - RNA, 19 nt, Homo sapiens
gagcuuaagugacuuccuc

SEQ ID NO: 2234204 - RNA, 16 nt, Homo sapiens
cagaaaacacagccug

SEQ ID NO: 2234205 - RNA, 20 nt, Homo sapiens
uuucuuaaugcuauuugcca

SEQ ID NO: 2234206 - RNA, 17 nt, Homo sapiens
cagauucuucacugugu

SEQ ID NO: 2234207 - RNA, 16 nt, Homo sapiens
agaaaagcaguggcuc

SEQ ID NO: 2234208 - RNA, 19 nt, Homo sapiens
guguuaaggcaacauuccu

SEQ ID NO: 2234209 - RNA, 15 nt, Homo sapiens
aggagggcaggcauc

SEQ ID NO: 2234210 - RNA, 19 nt, Homo sapiens
gaaucuagcuuauuuugag

SEQ ID NO: 2234211 - RNA, 18 nt, Homo sapiens
uggucccucugugucugc

SEQ ID NO: 2234212 - RNA, 18 nt, Homo sapiens
ucuuguaaacauugccug

SEQ ID NO: 2234213 - RNA, 13 nt, Homo sapiens
aauaaagcccuug

SEQ ID NO: 2234214 - RNA, 13 nt, Homo sapiens
uuuugugauucua

SEQ ID NO: 2234215 - RNA, 19 nt, Homo sapiens
ucuuuagccagaaucucau

SEQ ID NO: 2234216 - RNA, 12 nt, Homo sapiens
ucccagcccagc

SEQ ID NO: 2234217 - RNA, 12 nt, Homo sapiens
uagaacuugcag

SEQ ID NO: 2234218 - RNA, 22 nt, Homo sapiens
aggccuuuggaaagacuugaau

SEQ ID NO: 2234219 - RNA, 16 nt, Homo sapiens
aggcgccugccaucau

SEQ ID NO: 2234220 - RNA, 20 nt, Homo sapiens
ccucucgcacaaugcaugug

SEQ ID NO: 2234221 - RNA, 13 nt, Homo sapiens
acugccaaaaagg

SEQ ID NO: 2234222 - RNA, 17 nt, Homo sapiens
uccuucccucucugaug

SEQ ID NO: 2234223 - RNA, 13 nt, Homo sapiens
acucauugcugag

SEQ ID NO: 2234224 - RNA, 17 nt, Homo sapiens
ugccuccugaggcuguu

SEQ ID NO: 2234225 - RNA, 11 nt, Homo sapiens
gagucucugau

SEQ ID NO: 2234226 - RNA, 15 nt, Homo sapiens
aauaaguacugugua

SEQ ID NO: 2234227 - RNA, 20 nt, Homo sapiens
cugggcuccucauuuuuacg

SEQ ID NO: 2234228 - RNA, 13 nt, Homo sapiens
augccugcugcug

SEQ ID NO: 2234229 - RNA, 13 nt, Homo sapiens
auuaacugaacuu

SEQ ID NO: 2234230 - RNA, 13 nt, Homo sapiens
uuaagaguugaaa

SEQ ID NO: 2234231 - RNA, 22 nt, Homo sapiens
gccugcuauuugaaguguaauu

SEQ ID NO: 2234232 - RNA, 22 nt, Homo sapiens
acagacuguguuuaacugcugc

SEQ ID NO: 2234233 - RNA, 14 nt, Homo sapiens
cucacauaagccca

SEQ ID NO: 2234234 - RNA, 18 nt, Homo sapiens
gaccuuccagcuccugug

SEQ ID NO: 2234235 - RNA, 19 nt, Homo sapiens
gaauaaaggaugggaccaa

SEQ ID NO: 2234236 - RNA, 16 nt, Homo sapiens
ucagucccuacugagu

SEQ ID NO: 2234237 - RNA, 16 nt, Homo sapiens
uacuuucgaaauuuca

SEQ ID NO: 2234238 - RNA, 15 nt, Homo sapiens
gacaauaaaauggaa

SEQ ID NO: 2234239 - RNA, 16 nt, Homo sapiens
agauuaucagaccucu

SEQ ID NO: 2234240 - RNA, 16 nt, Homo sapiens
ugaauuaugcuuccac

SEQ ID NO: 2234241 - RNA, 21 nt, Homo sapiens
auaaaggucuaguauccaaaa

SEQ ID NO: 2234242 - RNA, 13 nt, Homo sapiens
gccuugucagugu

SEQ ID NO: 2234243 - RNA, 22 nt, Homo sapiens
ccuggcugggaguggcauguau

SEQ ID NO: 2234244 - RNA, 15 nt, Homo sapiens
gcucccauccucacc

SEQ ID NO: 2234245 - RNA, 15 nt, Homo sapiens
aggggccagaccacg

SEQ ID NO: 2234246 - RNA, 19 nt, Homo sapiens
guaaucacauuuuaauugc

SEQ ID NO: 2234247 - RNA, 23 nt, Homo sapiens
uauccugacaaguuccuaggaaa

SEQ ID NO: 2234248 - RNA, 20 nt, Homo sapiens
gagggggcacggcaggcgug

SEQ ID NO: 2234249 - RNA, 11 nt, Homo sapiens
guccuugcccc

SEQ ID NO: 2234250 - RNA, 23 nt, Homo sapiens
cucaaguuuuucagaaagcauua

SEQ ID NO: 2234251 - RNA, 18 nt, Homo sapiens
ugaucaagcauggaacaa

SEQ ID NO: 2234252 - RNA, 20 nt, Homo sapiens
caagauggauggaaagggag

SEQ ID NO: 2234253 - RNA, 20 nt, Homo sapiens
uagccaaccaggcuacaguu

SEQ ID NO: 2234254 - RNA, 17 nt, Homo sapiens
cccauucccaaagggca

SEQ ID NO: 2234255 - RNA, 17 nt, Homo sapiens
gcauugcugacugugua

SEQ ID NO: 2234256 - RNA, 20 nt, Homo sapiens
ccucauugcuaccacagacu

SEQ ID NO: 2234257 - RNA, 17 nt, Homo sapiens
caaacucacugcucaag

SEQ ID NO: 2234258 - RNA, 16 nt, Homo sapiens
uuacuguauauaacua

SEQ ID NO: 2234259 - RNA, 20 nt, Homo sapiens
cuggucccuaugucaugucu

SEQ ID NO: 2234260 - RNA, 14 nt, Homo sapiens
uuucuuuucacaua

SEQ ID NO: 2234261 - RNA, 17 nt, Homo sapiens
uuugaccccagcagcuu

SEQ ID NO: 2234262 - RNA, 16 nt, Homo sapiens
aguuauggugaaccca

SEQ ID NO: 2234263 - RNA, 14 nt, Homo sapiens
acacuuauguauug

SEQ ID NO: 2234264 - RNA, 17 nt, Homo sapiens
auaagcucgagugaauu

SEQ ID NO: 2234265 - RNA, 19 nt, Homo sapiens
uccacauuguuaggugcug

SEQ ID NO: 2234266 - RNA, 16 nt, Homo sapiens
guacagauugcugcuu

SEQ ID NO: 2234267 - RNA, 21 nt, Homo sapiens
cuccccaauccaacccaugca

SEQ ID NO: 2234268 - RNA, 13 nt, Homo sapiens
aggacaguauucc

SEQ ID NO: 2234269 - RNA, 14 nt, Homo sapiens
uggaaaacuguuaa

SEQ ID NO: 2234270 - RNA, 23 nt, Homo sapiens
cagggcaaaagggcagcugugau

SEQ ID NO: 2234271 - RNA, 20 nt, Homo sapiens
uauaaaucguaaccuaugaa

SEQ ID NO: 2234272 - RNA, 17 nt, Homo sapiens
uuaccauucaacugaac

SEQ ID NO: 2234273 - RNA, 14 nt, Homo sapiens
gggcugaugcaguu

SEQ ID NO: 2234274 - RNA, 15 nt, Homo sapiens
cuggcucuguuugau

SEQ ID NO: 2234275 - RNA, 17 nt, Homo sapiens
aaucauuggaauuccuu

SEQ ID NO: 2234276 - RNA, 12 nt, Homo sapiens
cccuucucugua

SEQ ID NO: 2234277 - RNA, 17 nt, Homo sapiens
gagccuccugacccugu

SEQ ID NO: 2234278 - RNA, 23 nt, Homo sapiens
ucaggacccucccaggagaguac

SEQ ID NO: 2234279 - RNA, 16 nt, Homo sapiens
cacacugaagccacag

SEQ ID NO: 2234280 - RNA, 21 nt, Homo sapiens
gaugggcauaugugucagugg

SEQ ID NO: 2234281 - RNA, 20 nt, Homo sapiens
uccugccucagccuccugag

SEQ ID NO: 2234282 - RNA, 13 nt, Homo sapiens
auaaaaaaugaca

SEQ ID NO: 2234283 - RNA, 21 nt, Homo sapiens
uggacuuuucguuaacauuga

SEQ ID NO: 2234284 - RNA, 21 nt, Homo sapiens
guccuuaucaccagccucaca

SEQ ID NO: 2234285 - RNA, 16 nt, Homo sapiens
uugccacaacccuguu

SEQ ID NO: 2234286 - RNA, 20 nt, Homo sapiens
aguguccccagagacaugca

SEQ ID NO: 2234287 - RNA, 21 nt, Homo sapiens
cacuacucccucaaagcacac

SEQ ID NO: 2234288 - RNA, 14 nt, Homo sapiens
gcuucgacuacugc

SEQ ID NO: 2234289 - RNA, 17 nt, Homo sapiens
auguuuuugcugcuacu

SEQ ID NO: 2234290 - RNA, 23 nt, Homo sapiens
uuuaagccgaagggcaauaucua

SEQ ID NO: 2234291 - RNA, 19 nt, Homo sapiens
gugcuggaauuacaggcgu

SEQ ID NO: 2234292 - RNA, 22 nt, Homo sapiens
aggcucugggcacagugcugcc

SEQ ID NO: 2234293 - RNA, 12 nt, Homo sapiens
uuugccauuugc

SEQ ID NO: 2234294 - RNA, 15 nt, Homo sapiens
agggggcugcugcuc

SEQ ID NO: 2234295 - RNA, 21 nt, Homo sapiens
acucuccuagagacagaagca

SEQ ID NO: 2234296 - RNA, 23 nt, Homo sapiens
ggcaaacccaaaaccucaugaca

SEQ ID NO: 2234297 - RNA, 13 nt, Homo sapiens
ucccuuuugcauc

SEQ ID NO: 2234298 - RNA, 23 nt, Homo sapiens
acuguguguuuuaaaacaacaac

SEQ ID NO: 2234299 - RNA, 13 nt, Homo sapiens
cagcccuauggau

SEQ ID NO: 2234300 - RNA, 17 nt, Homo sapiens
gaagccucggcaggacc

SEQ ID NO: 2234301 - RNA, 13 nt, Homo sapiens
cuugaaccccuua

SEQ ID NO: 2234302 - RNA, 19 nt, Homo sapiens
gaaacugcuugagcaucag

SEQ ID NO: 2234303 - RNA, 15 nt, Homo sapiens
uggaauccagugugg

SEQ ID NO: 2234304 - RNA, 23 nt, Homo sapiens
ccggacagaggugggcagggugg

SEQ ID NO: 2234305 - RNA, 17 nt, Homo sapiens
ggccaguaccuuuccau

SEQ ID NO: 2234306 - RNA, 19 nt, Homo sapiens
uaacauguauucuguucuu

SEQ ID NO: 2234307 - RNA, 17 nt, Homo sapiens
auuuaagaacugaggaa

SEQ ID NO: 2234308 - RNA, 13 nt, Homo sapiens
auaccaccaacaa

SEQ ID NO: 2234309 - RNA, 15 nt, Homo sapiens
aaguguaccugugua

SEQ ID NO: 2234310 - RNA, 14 nt, Homo sapiens
uaaguacuuugcug

SEQ ID NO: 2234311 - RNA, 13 nt, Homo sapiens
uguagucuugucu

SEQ ID NO: 2234312 - RNA, 18 nt, Homo sapiens
uaggauaaauuacauuaa

SEQ ID NO: 2234313 - RNA, 16 nt, Homo sapiens
auucauuccuugccau

SEQ ID NO: 2234314 - RNA, 16 nt, Homo sapiens
aagugcuugaggccaa

SEQ ID NO: 2234315 - RNA, 11 nt, Homo sapiens
aaagacacaaa

SEQ ID NO: 2234316 - RNA, 11 nt, Homo sapiens
uuggacacuug

SEQ ID NO: 2234317 - RNA, 18 nt, Homo sapiens
cuccagaauauggaaaca

SEQ ID NO: 2234318 - RNA, 13 nt, Homo sapiens
agagcugccagug

SEQ ID NO: 2234319 - RNA, 21 nt, Homo sapiens
cauaacaaccugggcauuccu

SEQ ID NO: 2234320 - RNA, 15 nt, Homo sapiens
accugcuucauucaa

SEQ ID NO: 2234321 - RNA, 18 nt, Homo sapiens
gacagucuggaaagugau

SEQ ID NO: 2234322 - RNA, 19 nt, Homo sapiens
ccuccagugcaguccauuu

SEQ ID NO: 2234323 - RNA, 23 nt, Homo sapiens
uggcuucucgcugcgcagccucc

SEQ ID NO: 2234324 - RNA, 22 nt, Homo sapiens
ucucaaaacaauauuacuuugu

SEQ ID NO: 2234325 - RNA, 18 nt, Homo sapiens
gcgccuccgacuggcugg

SEQ ID NO: 2234326 - RNA, 14 nt, Homo sapiens
auuccuuacuugca

SEQ ID NO: 2234327 - RNA, 18 nt, Homo sapiens
ggcuccaagccucaaagu

SEQ ID NO: 2234328 - RNA, 20 nt, Homo sapiens
cuguaaucccagcacuuugg

SEQ ID NO: 2234329 - RNA, 15 nt, Homo sapiens
ucaauaaauguugcu

SEQ ID NO: 2234330 - RNA, 22 nt, Homo sapiens
acacacacucuacccuauacaa

SEQ ID NO: 2234331 - RNA, 15 nt, Homo sapiens
aagcuggagugcagu

SEQ ID NO: 2234332 - RNA, 22 nt, Homo sapiens
cauauuauuuuaguguguaaaa

SEQ ID NO: 2234333 - RNA, 14 nt, Homo sapiens
ccauucucucugcc

SEQ ID NO: 2234334 - RNA, 20 nt, Homo sapiens
ucuugaugguguuucuuucc

SEQ ID NO: 2234335 - RNA, 17 nt, Homo sapiens
gccaccuugccacccau

SEQ ID NO: 2234336 - RNA, 12 nt, Homo sapiens
uaugcucuguga

SEQ ID NO: 2234337 - RNA, 17 nt, Homo sapiens
uccaucuuuccauccau

SEQ ID NO: 2234338 - RNA, 21 nt, Homo sapiens
ccaauaaagcgaauggaccau

SEQ ID NO: 2234339 - RNA, 22 nt, Homo sapiens
ucugccuguuauaacucugcac

SEQ ID NO: 2234340 - RNA, 22 nt, Homo sapiens
uucucaguaaauauuaaccuga

SEQ ID NO: 2234341 - RNA, 23 nt, Homo sapiens
cuuuguuuacaugaguucaaaua

SEQ ID NO: 2234342 - RNA, 13 nt, Homo sapiens
augcauggcaaau

SEQ ID NO: 2234343 - RNA, 19 nt, Homo sapiens
cuuugagcugagugcugaa

SEQ ID NO: 2234344 - RNA, 21 nt, Homo sapiens
uuaugaauugucuaaaguuac

SEQ ID NO: 2234345 - RNA, 17 nt, Homo sapiens
acucaucacuguggcug

SEQ ID NO: 2234346 - RNA, 21 nt, Homo sapiens
ccaugagggcagggacaucau

SEQ ID NO: 2234347 - RNA, 19 nt, Homo sapiens
augugcuggccaccugcug

SEQ ID NO: 2234348 - RNA, 13 nt, Homo sapiens
ugcacagcaacug

SEQ ID NO: 2234349 - RNA, 15 nt, Homo sapiens
cugguggaaccugca

SEQ ID NO: 2234350 - RNA, 21 nt, Homo sapiens
caacugaguggggaaaacaga

SEQ ID NO: 2234351 - RNA, 13 nt, Homo sapiens
ggcuguguguccu

SEQ ID NO: 2234352 - RNA, 13 nt, Homo sapiens
agcagcuguaauu

SEQ ID NO: 2234353 - RNA, 19 nt, Homo sapiens
gguggccgucacgcuuuca

SEQ ID NO: 2234354 - RNA, 16 nt, Homo sapiens
aagaaauuaacaccca

SEQ ID NO: 2234355 - RNA, 12 nt, Homo sapiens
uugaaugucaca

SEQ ID NO: 2234356 - RNA, 14 nt, Homo sapiens
aauagaagggcaaa

SEQ ID NO: 2234357 - RNA, 19 nt, Homo sapiens
ggaauuuauccuugaccaa

SEQ ID NO: 2234358 - RNA, 14 nt, Homo sapiens
ugcgugcgcaucuu

SEQ ID NO: 2234359 - RNA, 16 nt, Homo sapiens
ugcaaccucacuaugg

SEQ ID NO: 2234360 - RNA, 22 nt, Homo sapiens
gaauuugcacuguuuaaucaua

SEQ ID NO: 2234361 - RNA, 15 nt, Homo sapiens
aaacagauucuccac

SEQ ID NO: 2234362 - RNA, 12 nt, Homo sapiens
uccuuagcuuaa

SEQ ID NO: 2234363 - RNA, 16 nt, Homo sapiens
caaauauuguugacaa

SEQ ID NO: 2234364 - RNA, 16 nt, Homo sapiens
ccccaccaugccuccu

SEQ ID NO: 2234365 - RNA, 17 nt, Homo sapiens
uuaagguauugugcauc

SEQ ID NO: 2234366 - RNA, 15 nt, Homo sapiens
cuagcugugaccucu

SEQ ID NO: 2234367 - RNA, 15 nt, Homo sapiens
guaacugucaaguca

SEQ ID NO: 2234368 - RNA, 14 nt, Homo sapiens
aaauucaggucugu

SEQ ID NO: 2234369 - RNA, 17 nt, Homo sapiens
aguggaugccugcugca

SEQ ID NO: 2234370 - RNA, 17 nt, Homo sapiens
cuucagauacaaacugc

SEQ ID NO: 2234371 - RNA, 12 nt, Homo sapiens
augaagcaagaa

SEQ ID NO: 2234372 - RNA, 16 nt, Homo sapiens
ccugagccacagaaag

SEQ ID NO: 2234373 - RNA, 14 nt, Homo sapiens
ucuuuucaaugugu

SEQ ID NO: 2234374 - RNA, 19 nt, Homo sapiens
aaauaccagugaaccaaag

SEQ ID NO: 2234375 - RNA, 14 nt, Homo sapiens
agggggcccggcug

SEQ ID NO: 2234376 - RNA, 22 nt, Homo sapiens
aagcacucaauaaaucuuugau

SEQ ID NO: 2234377 - RNA, 12 nt, Homo sapiens
augguucaagua

SEQ ID NO: 2234378 - RNA, 19 nt, Homo sapiens
gugcacccucuaucccaau

SEQ ID NO: 2234379 - RNA, 11 nt, Homo sapiens
uucuaacucau

SEQ ID NO: 2234380 - RNA, 13 nt, Homo sapiens
uugaauguucucu

SEQ ID NO: 2234381 - RNA, 17 nt, Homo sapiens
augacucagagaaccag

SEQ ID NO: 2234382 - RNA, 15 nt, Homo sapiens
guagagaagcaagua

SEQ ID NO: 2234383 - RNA, 14 nt, Homo sapiens
uacucauaaaggga

SEQ ID NO: 2234384 - RNA, 15 nt, Homo sapiens
ggccgccagacucga

SEQ ID NO: 2234385 - RNA, 12 nt, Homo sapiens
cuauuaguuuca

SEQ ID NO: 2234386 - RNA, 23 nt, Homo sapiens
acaaaugaaguauuucauguaau

SEQ ID NO: 2234387 - RNA, 13 nt, Homo sapiens
auaggucuuguga

SEQ ID NO: 2234388 - RNA, 12 nt, Homo sapiens
aacugccagcaa

SEQ ID NO: 2234389 - RNA, 13 nt, Homo sapiens
ccucaaacacugc

SEQ ID NO: 2234390 - RNA, 16 nt, Homo sapiens
agccucauucacuguc

SEQ ID NO: 2234391 - RNA, 23 nt, Homo sapiens
guacuauucugauuacacaaaac

SEQ ID NO: 2234392 - RNA, 15 nt, Homo sapiens
gcaugugcagcuauu

SEQ ID NO: 2234393 - RNA, 20 nt, Homo sapiens
cuaaaaaaccaacaauguga

SEQ ID NO: 2234394 - RNA, 12 nt, Homo sapiens
cauuuguagcuu

SEQ ID NO: 2234395 - RNA, 17 nt, Homo sapiens
caauaaagauacaugau

SEQ ID NO: 2234396 - RNA, 23 nt, Homo sapiens
cagagagguaaaauggaggccag

SEQ ID NO: 2234397 - RNA, 14 nt, Homo sapiens
auuauuuaucacau

SEQ ID NO: 2234398 - RNA, 20 nt, Homo sapiens
aguccugcgaaaacccccaa

SEQ ID NO: 2234399 - RNA, 22 nt, Homo sapiens
ucuauucaggcuguuguuggcu

SEQ ID NO: 2234400 - RNA, 23 nt, Homo sapiens
agaaaguuuccccaccagugaau

SEQ ID NO: 2234401 - RNA, 15 nt, Homo sapiens
aaacugaagcaucaa

SEQ ID NO: 2234402 - RNA, 20 nt, Homo sapiens
gcaaacacugggggcaccuu

SEQ ID NO: 2234403 - RNA, 13 nt, Homo sapiens
aauuacuguuuaa

SEQ ID NO: 2234404 - RNA, 23 nt, Homo sapiens
caaagacagagaagaccaaagca

SEQ ID NO: 2234405 - RNA, 18 nt, Homo sapiens
uguaucaaaaucacuauc

SEQ ID NO: 2234406 - RNA, 11 nt, Homo sapiens
aaucaguuugc

SEQ ID NO: 2234407 - RNA, 11 nt, Homo sapiens
gucauaugcac

SEQ ID NO: 2234408 - RNA, 16 nt, Homo sapiens
agcucaggcacacuuc

SEQ ID NO: 2234409 - RNA, 21 nt, Homo sapiens
aguuucucagcucccaaggcu

SEQ ID NO: 2234410 - RNA, 18 nt, Homo sapiens
auguaccauguugcccag

SEQ ID NO: 2234411 - RNA, 20 nt, Homo sapiens
uaggcaaaggcccuugggca

SEQ ID NO: 2234412 - RNA, 18 nt, Homo sapiens
gcacuaucacgagccuuu

SEQ ID NO: 2234413 - RNA, 14 nt, Homo sapiens
gaggccuaccugcu

SEQ ID NO: 2234414 - RNA, 17 nt, Homo sapiens
aggcuggauccuagccu

SEQ ID NO: 2234415 - RNA, 23 nt, Homo sapiens
uuccugggcuggguaaaagcagc

SEQ ID NO: 2234416 - RNA, 15 nt, Homo sapiens
uuguacaauacuugc

SEQ ID NO: 2234417 - RNA, 13 nt, Homo sapiens
aaaagucuucacu

SEQ ID NO: 2234418 - RNA, 20 nt, Homo sapiens
acaguaacacaccccugcuu

SEQ ID NO: 2234419 - RNA, 17 nt, Homo sapiens
ucuccuuuugaccaaau

SEQ ID NO: 2234420 - RNA, 16 nt, Homo sapiens
acuuucaauugucacu

SEQ ID NO: 2234421 - RNA, 19 nt, Homo sapiens
acagauaggaauuccuuau

SEQ ID NO: 2234422 - RNA, 13 nt, Homo sapiens
ucuuagacacugu

SEQ ID NO: 2234423 - RNA, 16 nt, Homo sapiens
ucuuuggcaguugcau

SEQ ID NO: 2234424 - RNA, 22 nt, Homo sapiens
gcuacaagagggcaaagcugau

SEQ ID NO: 2234425 - RNA, 23 nt, Homo sapiens
caugaaaaaauacucaacauuau

SEQ ID NO: 2234426 - RNA, 15 nt, Homo sapiens
uggaaaaaaaccaca

SEQ ID NO: 2234427 - RNA, 14 nt, Homo sapiens
agucccccaugaca

SEQ ID NO: 2234428 - RNA, 18 nt, Homo sapiens
aggucuagaaaaccagcu

SEQ ID NO: 2234429 - RNA, 17 nt, Homo sapiens
cuuccugccuacugccc

SEQ ID NO: 2234430 - RNA, 20 nt, Homo sapiens
cucagcuccagaauaccuuc

SEQ ID NO: 2234431 - RNA, 20 nt, Homo sapiens
acccuucccgccucccucuc

SEQ ID NO: 2234432 - RNA, 16 nt, Homo sapiens
aacuguacauuucaca

SEQ ID NO: 2234433 - RNA, 13 nt, Homo sapiens
gcgagguguaaag

SEQ ID NO: 2234434 - RNA, 21 nt, Homo sapiens
agaacuaagaugaucaucucc

SEQ ID NO: 2234435 - RNA, 18 nt, Homo sapiens
agggaccaucugcugcag

SEQ ID NO: 2234436 - RNA, 22 nt, Homo sapiens
agagagaacuuuucgacauauu

SEQ ID NO: 2234437 - RNA, 23 nt, Homo sapiens
caguacucuguaaguuucuguga

SEQ ID NO: 2234438 - RNA, 20 nt, Homo sapiens
cuggccaggacacacugaaa

SEQ ID NO: 2234439 - RNA, 18 nt, Homo sapiens
acucucuucuuacuguau

SEQ ID NO: 2234440 - RNA, 21 nt, Homo sapiens
guugauauaauccuaccagaa

SEQ ID NO: 2234441 - RNA, 19 nt, Homo sapiens
ggcugccugcaucuauucu

SEQ ID NO: 2234442 - RNA, 14 nt, Homo sapiens
agcacccccagugc

SEQ ID NO: 2234443 - RNA, 17 nt, Homo sapiens
agcugggguugugcaag

SEQ ID NO: 2234444 - RNA, 21 nt, Homo sapiens
ucauugaaguauuuuccucca

SEQ ID NO: 2234445 - RNA, 17 nt, Homo sapiens
caguggucaugcucagc

SEQ ID NO: 2234446 - RNA, 22 nt, Homo sapiens
cuugaacugucuacccuguugc

SEQ ID NO: 2234447 - RNA, 15 nt, Homo sapiens
ccugaccugagccag

SEQ ID NO: 2234448 - RNA, 15 nt, Homo sapiens
gcagugcuaaagccu

SEQ ID NO: 2234449 - RNA, 22 nt, Homo sapiens
cagugacugaggggccuggcuc

SEQ ID NO: 2234450 - RNA, 19 nt, Homo sapiens
acuguccuguuuucuaauc

SEQ ID NO: 2234451 - RNA, 19 nt, Homo sapiens
cuguaucaguggauuuccc

SEQ ID NO: 2234452 - RNA, 14 nt, Homo sapiens
acccugcacuuucc

SEQ ID NO: 2234453 - RNA, 13 nt, Homo sapiens
uguggacaugcac

SEQ ID NO: 2234454 - RNA, 23 nt, Homo sapiens
gccuagauaugaagaaucugcuc

SEQ ID NO: 2234455 - RNA, 16 nt, Homo sapiens
ucuaaaauucuauuau

SEQ ID NO: 2234456 - RNA, 23 nt, Homo sapiens
cugccuugaagccuccugaauua

SEQ ID NO: 2234457 - RNA, 21 nt, Homo sapiens
agcuaacagucccuauggaaa

SEQ ID NO: 2234458 - RNA, 15 nt, Homo sapiens
ggcccugaggaauaa

SEQ ID NO: 2234459 - RNA, 21 nt, Homo sapiens
agccuuauuucuagaagcaca

SEQ ID NO: 2234460 - RNA, 13 nt, Homo sapiens
uauaaaaguacua

SEQ ID NO: 2234461 - RNA, 15 nt, Homo sapiens
uaugcuauauucaaa

SEQ ID NO: 2234462 - RNA, 10 nt, Homo sapiens
gaagcuuuag

SEQ ID NO: 2234463 - RNA, 19 nt, Homo sapiens
cagugagcugagauugugc

SEQ ID NO: 2234464 - RNA, 13 nt, Homo sapiens
cagauuugcacug

SEQ ID NO: 2234465 - RNA, 16 nt, Homo sapiens
aggaaagucauuggcu

SEQ ID NO: 2234466 - RNA, 19 nt, Homo sapiens
gcaaauggcagaaccaaag

SEQ ID NO: 2234467 - RNA, 20 nt, Homo sapiens
gauuuaauuuuuuaaacugu

SEQ ID NO: 2234468 - RNA, 13 nt, Homo sapiens
uuggcaucugcaa

SEQ ID NO: 2234469 - RNA, 15 nt, Homo sapiens
uucucuucuacacgu

SEQ ID NO: 2234470 - RNA, 20 nt, Homo sapiens
uagaaaaagaacaugcaguu

SEQ ID NO: 2234471 - RNA, 19 nt, Homo sapiens
cuccagaugccacaaugga

SEQ ID NO: 2234472 - RNA, 20 nt, Homo sapiens
cuuuacacaauagaauuaua

SEQ ID NO: 2234473 - RNA, 16 nt, Homo sapiens
gugcagggacaaagag

SEQ ID NO: 2234474 - RNA, 16 nt, Homo sapiens
agcuuccuggggacca

SEQ ID NO: 2234475 - RNA, 20 nt, Homo sapiens
ccagggcuugugugcacaua

SEQ ID NO: 2234476 - RNA, 21 nt, Homo sapiens
guuccauccaccaccuugcca

SEQ ID NO: 2234477 - RNA, 14 nt, Homo sapiens
cggcuucaccugcg

SEQ ID NO: 2234478 - RNA, 13 nt, Homo sapiens
ggaacacaaugac

SEQ ID NO: 2234479 - RNA, 19 nt, Homo sapiens
aaagcacuuuacagaugag

SEQ ID NO: 2234480 - RNA, 15 nt, Homo sapiens
ccaaagaaacucaga

SEQ ID NO: 2234481 - RNA, 20 nt, Homo sapiens
gugucucgcgcgacugagaa

SEQ ID NO: 2234482 - RNA, 13 nt, Homo sapiens
uuucuucuugggc

SEQ ID NO: 2234483 - RNA, 19 nt, Homo sapiens
uuuuaguucaauacaguga

SEQ ID NO: 2234484 - RNA, 12 nt, Homo sapiens
gaugucauuuga

SEQ ID NO: 2234485 - RNA, 14 nt, Homo sapiens
cuggcuugugaucu

SEQ ID NO: 2234486 - RNA, 13 nt, Homo sapiens
cacagcggcugcc

SEQ ID NO: 2234487 - RNA, 13 nt, Homo sapiens
acagcaaacagau

SEQ ID NO: 2234488 - RNA, 23 nt, Homo sapiens
gacauaaccaacauuaaaacuca

SEQ ID NO: 2234489 - RNA, 14 nt, Homo sapiens
uuugccugccauuu

SEQ ID NO: 2234490 - RNA, 18 nt, Homo sapiens
gggggucuauacauuccu

SEQ ID NO: 2234491 - RNA, 22 nt, Homo sapiens
uauaaaacacaucaucaauaaa

SEQ ID NO: 2234492 - RNA, 14 nt, Homo sapiens
agauguugggaaca

SEQ ID NO: 2234493 - RNA, 23 nt, Homo sapiens
cagaaggacaggucucugagaca

SEQ ID NO: 2234494 - RNA, 15 nt, Homo sapiens
uguauuuagugauua

SEQ ID NO: 2234495 - RNA, 16 nt, Homo sapiens
cugccaugauagcugg

SEQ ID NO: 2234496 - RNA, 20 nt, Homo sapiens
uuacguccuuccacuuccaa

SEQ ID NO: 2234497 - RNA, 11 nt, Homo sapiens
gguaacaaagg

SEQ ID NO: 2234498 - RNA, 16 nt, Homo sapiens
acaucaaaacuaacca

SEQ ID NO: 2234499 - RNA, 22 nt, Homo sapiens
aaggucguuuuuuucauuccau

SEQ ID NO: 2234500 - RNA, 18 nt, Homo sapiens
cgccccccggccugaugg

SEQ ID NO: 2234501 - RNA, 14 nt, Homo sapiens
aaucagaucauuuc

SEQ ID NO: 2234502 - RNA, 16 nt, Homo sapiens
aggagcucccaggagg

SEQ ID NO: 2234503 - RNA, 19 nt, Homo sapiens
uauuuggaaauaaagucag

SEQ ID NO: 2234504 - RNA, 20 nt, Homo sapiens
auggaaguuuuccuacacuu

SEQ ID NO: 2234505 - RNA, 13 nt, Homo sapiens
ugguaugugccag

SEQ ID NO: 2234506 - RNA, 22 nt, Homo sapiens
aaccaguaagguuauaacugug

SEQ ID NO: 2234507 - RNA, 16 nt, Homo sapiens
gggcucauuuugcuca

SEQ ID NO: 2234508 - RNA, 19 nt, Homo sapiens
auuugcaaaggcgacaaua

SEQ ID NO: 2234509 - RNA, 20 nt, Homo sapiens
cauaucuuaaagaaacagcu

SEQ ID NO: 2234510 - RNA, 23 nt, Homo sapiens
ccaggagcaggaccuacuaggag

SEQ ID NO: 2234511 - RNA, 18 nt, Homo sapiens
gacucgacaaaggccaca

SEQ ID NO: 2234512 - RNA, 16 nt, Homo sapiens
agcaucccagccucag

SEQ ID NO: 2234513 - RNA, 23 nt, Homo sapiens
uauacaauaaagucuuaccucag

SEQ ID NO: 2234514 - RNA, 22 nt, Homo sapiens
ugaucuguuuuacaggaaacaa

SEQ ID NO: 2234515 - RNA, 23 nt, Homo sapiens
cccuucaaggccuccccaaucca

SEQ ID NO: 2234516 - RNA, 22 nt, Homo sapiens
acccaggccucccugcagacuc

SEQ ID NO: 2234517 - RNA, 15 nt, Homo sapiens
uccagacauacgaaa

SEQ ID NO: 2234518 - RNA, 22 nt, Homo sapiens
gguaguuuguuuuaacuuccaa

SEQ ID NO: 2234519 - RNA, 13 nt, Homo sapiens
aggagaguggcag

SEQ ID NO: 2234520 - RNA, 23 nt, Homo sapiens
acagucaugguggccacggccac

SEQ ID NO: 2234521 - RNA, 19 nt, Homo sapiens
uguguauauguagcaaaau

SEQ ID NO: 2234522 - RNA, 14 nt, Homo sapiens
guaaaaauccaaaa

SEQ ID NO: 2234523 - RNA, 22 nt, Homo sapiens
agcugagacuacaggcacacac

SEQ ID NO: 2234524 - RNA, 14 nt, Homo sapiens
aggcaaauguguac

SEQ ID NO: 2234525 - RNA, 20 nt, Homo sapiens
ccugcaggcugagugcauuu

SEQ ID NO: 2234526 - RNA, 15 nt, Homo sapiens
ggauuucauggugau

SEQ ID NO: 2234527 - RNA, 18 nt, Homo sapiens
aaacgugaggacucagga

SEQ ID NO: 2234528 - RNA, 12 nt, Homo sapiens
ucuggcucucau

SEQ ID NO: 2234529 - RNA, 16 nt, Homo sapiens
acuuauggaacaggga

SEQ ID NO: 2234530 - RNA, 19 nt, Homo sapiens
cuucggggcgaugcucccu

SEQ ID NO: 2234531 - RNA, 15 nt, Homo sapiens
agggaggcccuggga

SEQ ID NO: 2234532 - RNA, 16 nt, Homo sapiens
ccuacaguggcuguca

SEQ ID NO: 2234533 - RNA, 19 nt, Homo sapiens
uggccacgcagccaggaca

SEQ ID NO: 2234534 - RNA, 13 nt, Homo sapiens
acgauaaagggau

SEQ ID NO: 2234535 - RNA, 13 nt, Homo sapiens
agcagaaagccag

SEQ ID NO: 2234536 - RNA, 13 nt, Homo sapiens
accucaaaggcuc

SEQ ID NO: 2234537 - RNA, 17 nt, Homo sapiens
uuaaaagaaaacaugag

SEQ ID NO: 2234538 - RNA, 17 nt, Homo sapiens
gugaaauuaagcauuuu

SEQ ID NO: 2234539 - RNA, 15 nt, Homo sapiens
aagucaccuccuuaa

SEQ ID NO: 2234540 - RNA, 17 nt, Homo sapiens
aacccuuggucacaugu

SEQ ID NO: 2234541 - RNA, 19 nt, Homo sapiens
cuagagaaaauaaauucca

SEQ ID NO: 2234542 - RNA, 18 nt, Homo sapiens
uccccgaaggugcuggag

SEQ ID NO: 2234543 - RNA, 22 nt, Homo sapiens
agccagagagugagagacauua

SEQ ID NO: 2234544 - RNA, 13 nt, Homo sapiens
cacagcuaugaag

SEQ ID NO: 2234545 - RNA, 21 nt, Homo sapiens
gcaauugcgaccuuaauuuaa

SEQ ID NO: 2234546 - RNA, 15 nt, Homo sapiens
auucauacauuaucu

SEQ ID NO: 2234547 - RNA, 17 nt, Homo sapiens
agucagagcuugaagaa

SEQ ID NO: 2234548 - RNA, 17 nt, Homo sapiens
uuuaaagagcauaauaa

SEQ ID NO: 2234549 - RNA, 21 nt, Homo sapiens
ugucugcgucgucaccaaauc

SEQ ID NO: 2234550 - RNA, 18 nt, Homo sapiens
cucucuauaaguguucag

SEQ ID NO: 2234551 - RNA, 22 nt, Homo sapiens
ucgccccaccuccaccugugag

SEQ ID NO: 2234552 - RNA, 17 nt, Homo sapiens
gauugcuccauacucua

SEQ ID NO: 2234553 - RNA, 19 nt, Homo sapiens
guuucuagagaacaguuga

SEQ ID NO: 2234554 - RNA, 18 nt, Homo sapiens
gaagauuaguuaccauug

SEQ ID NO: 2234555 - RNA, 14 nt, Homo sapiens
uauuuucacuggag

SEQ ID NO: 2234556 - RNA, 22 nt, Homo sapiens
cccagcuccauccuugcaucac

SEQ ID NO: 2234557 - RNA, 22 nt, Homo sapiens
gggcaccacccgcuuucuugcu

SEQ ID NO: 2234558 - RNA, 19 nt, Homo sapiens
acagcucuacguggcaaau

SEQ ID NO: 2234559 - RNA, 15 nt, Homo sapiens
gaacuggccacuccc

SEQ ID NO: 2234560 - RNA, 15 nt, Homo sapiens
cauuacuugcacaag

SEQ ID NO: 2234561 - RNA, 14 nt, Homo sapiens
cagcuacaacagcc

SEQ ID NO: 2234562 - RNA, 13 nt, Homo sapiens
ucucugccuuuga

SEQ ID NO: 2234563 - RNA, 12 nt, Homo sapiens
cugccacuucca

SEQ ID NO: 2234564 - RNA, 19 nt, Homo sapiens
auccccagggaaacccauc

SEQ ID NO: 2234565 - RNA, 22 nt, Homo sapiens
ccccaacccucagacagacuua

SEQ ID NO: 2234566 - RNA, 19 nt, Homo sapiens
agggaauugaggucugcuc

SEQ ID NO: 2234567 - RNA, 13 nt, Homo sapiens
caaacacuugagg

SEQ ID NO: 2234568 - RNA, 23 nt, Homo sapiens
gaaacauuucagaagguaucagu

SEQ ID NO: 2234569 - RNA, 10 nt, Homo sapiens
cauccaaagg

SEQ ID NO: 2234570 - RNA, 20 nt, Homo sapiens
gucauuaagguuaugcacug

SEQ ID NO: 2234571 - RNA, 18 nt, Homo sapiens
cucguguuugcuacaaau

SEQ ID NO: 2234572 - RNA, 18 nt, Homo sapiens
aagcuuaauuaaguacaa

SEQ ID NO: 2234573 - RNA, 13 nt, Homo sapiens
caaacuccaagac

SEQ ID NO: 2234574 - RNA, 13 nt, Homo sapiens
cuauauccaugua

SEQ ID NO: 2234575 - RNA, 14 nt, Homo sapiens
ugagucagugccau

SEQ ID NO: 2234576 - RNA, 13 nt, Homo sapiens
uagcuuagcuguc

SEQ ID NO: 2234577 - RNA, 13 nt, Homo sapiens
caaugccaaaagg

SEQ ID NO: 2234578 - RNA, 14 nt, Homo sapiens
accuggucauuuca

SEQ ID NO: 2234579 - RNA, 16 nt, Homo sapiens
gguucuaaaugcaaua

SEQ ID NO: 2234580 - RNA, 13 nt, Homo sapiens
uuuauauauaucc

SEQ ID NO: 2234581 - RNA, 14 nt, Homo sapiens
aaaucagagacaaa

SEQ ID NO: 2234582 - RNA, 18 nt, Homo sapiens
caugauggcaacagaucu

SEQ ID NO: 2234583 - RNA, 15 nt, Homo sapiens
gccucgaauaucuua

SEQ ID NO: 2234584 - RNA, 16 nt, Homo sapiens
cagagauguacugcaa

SEQ ID NO: 2234585 - RNA, 16 nt, Homo sapiens
cucuuaaguugaucua

SEQ ID NO: 2234586 - RNA, 15 nt, Homo sapiens
uugcacuagagaaaa

SEQ ID NO: 2234587 - RNA, 21 nt, Homo sapiens
aguaugguaauuaaauguacu

SEQ ID NO: 2234588 - RNA, 17 nt, Homo sapiens
uguguaaucuaaguaua

SEQ ID NO: 2234589 - RNA, 16 nt, Homo sapiens
gagaacccuugcacua

SEQ ID NO: 2234590 - RNA, 19 nt, Homo sapiens
uuuacguggcaaaaugaac

SEQ ID NO: 2234591 - RNA, 15 nt, Homo sapiens
gcuccuggggcaaug

SEQ ID NO: 2234592 - RNA, 21 nt, Homo sapiens
ugaccuuugucuucuauaaua

SEQ ID NO: 2234593 - RNA, 20 nt, Homo sapiens
uguguaccugugacuaaaca

SEQ ID NO: 2234594 - RNA, 14 nt, Homo sapiens
auuucucuacuugu

SEQ ID NO: 2234595 - RNA, 12 nt, Homo sapiens
ugccucagggau

SEQ ID NO: 2234596 - RNA, 22 nt, Homo sapiens
cagcccggaggggacugguccc

SEQ ID NO: 2234597 - RNA, 20 nt, Homo sapiens
cgugggggcucaugccugua

SEQ ID NO: 2234598 - RNA, 22 nt, Homo sapiens
cugcacaaaagcagauacuuga

SEQ ID NO: 2234599 - RNA, 18 nt, Homo sapiens
agauauucuuauuucacu

SEQ ID NO: 2234600 - RNA, 14 nt, Homo sapiens
caugagaaugucau

SEQ ID NO: 2234601 - RNA, 17 nt, Homo sapiens
ugugcugugaagugauc

SEQ ID NO: 2234602 - RNA, 15 nt, Homo sapiens
cugauccauccccag

SEQ ID NO: 2234603 - RNA, 23 nt, Homo sapiens
uauaacccuaggaauuuagacaa

SEQ ID NO: 2234604 - RNA, 17 nt, Homo sapiens
gagaucuuucuuuccaa

SEQ ID NO: 2234605 - RNA, 12 nt, Homo sapiens
cuguugcuauuu

SEQ ID NO: 2234606 - RNA, 22 nt, Homo sapiens
uagcuuuugaugucuccaagua

SEQ ID NO: 2234607 - RNA, 14 nt, Homo sapiens
agagcccagucauu

SEQ ID NO: 2234608 - RNA, 19 nt, Homo sapiens
ccaccacauuuagaacuuu

SEQ ID NO: 2234609 - RNA, 16 nt, Homo sapiens
aucgaaucuacuaauu

SEQ ID NO: 2234610 - RNA, 14 nt, Homo sapiens
uaauucaaaagcac

SEQ ID NO: 2234611 - RNA, 13 nt, Homo sapiens
aucaucuguagau

SEQ ID NO: 2234612 - RNA, 13 nt, Homo sapiens
aagcacuguucca

SEQ ID NO: 2234613 - RNA, 13 nt, Homo sapiens
aaugcacuuggaa

SEQ ID NO: 2234614 - RNA, 19 nt, Homo sapiens
ggagucggaucuagccaug

SEQ ID NO: 2234615 - RNA, 18 nt, Homo sapiens
aaguauguaccaaaacau

SEQ ID NO: 2234616 - RNA, 22 nt, Homo sapiens
ccuaugugggugggaccacaga

SEQ ID NO: 2234617 - RNA, 23 nt, Homo sapiens
acucuucuuaucacacuugcaaa

SEQ ID NO: 2234618 - RNA, 20 nt, Homo sapiens
gcccaagugcaaaagaaaaa

SEQ ID NO: 2234619 - RNA, 22 nt, Homo sapiens
ugaagcuuggaggucacagcug

SEQ ID NO: 2234620 - RNA, 23 nt, Homo sapiens
guguuugaaacacucgugugcau

SEQ ID NO: 2234621 - RNA, 17 nt, Homo sapiens
uccagcacaaaguuuac

SEQ ID NO: 2234622 - RNA, 16 nt, Homo sapiens
uuuuauuagacauucu

SEQ ID NO: 2234623 - RNA, 22 nt, Homo sapiens
uuuauagaugggcaacuggcug

SEQ ID NO: 2234624 - RNA, 17 nt, Homo sapiens
acauauccuuucaagac

SEQ ID NO: 2234625 - RNA, 23 nt, Homo sapiens
cccagauguuuuacgucugggag

SEQ ID NO: 2234626 - RNA, 20 nt, Homo sapiens
cuccucugccuuugugcucu

SEQ ID NO: 2234627 - RNA, 19 nt, Homo sapiens
gcaaagcacauagagccag

SEQ ID NO: 2234628 - RNA, 18 nt, Homo sapiens
uuuuuggcauuccaccuc

SEQ ID NO: 2234629 - RNA, 15 nt, Homo sapiens
aguggauuggcuuug

SEQ ID NO: 2234630 - RNA, 21 nt, Homo sapiens
gaacucuucaaucucuugcac

SEQ ID NO: 2234631 - RNA, 16 nt, Homo sapiens
ccgccuuccaaaaccu

SEQ ID NO: 2234632 - RNA, 12 nt, Homo sapiens
uuugcacugagg

SEQ ID NO: 2234633 - RNA, 17 nt, Homo sapiens
auaugagaauauaccuu

SEQ ID NO: 2234634 - RNA, 18 nt, Homo sapiens
gccugugguuaacaucuc

SEQ ID NO: 2234635 - RNA, 20 nt, Homo sapiens
ccaacugaguguuauuugca

SEQ ID NO: 2234636 - RNA, 14 nt, Homo sapiens
uaauuuacuuuaag

SEQ ID NO: 2234637 - RNA, 15 nt, Homo sapiens
agagcuaaguggcuu

SEQ ID NO: 2234638 - RNA, 17 nt, Homo sapiens
guacaauuuucauccca

SEQ ID NO: 2234639 - RNA, 19 nt, Homo sapiens
ucuaguugccaaaucuggc

SEQ ID NO: 2234640 - RNA, 17 nt, Homo sapiens
uaaaacauuaguaguuu

SEQ ID NO: 2234641 - RNA, 17 nt, Homo sapiens
uagacuggaaguucaua

SEQ ID NO: 2234642 - RNA, 14 nt, Homo sapiens
auaaguuuacugaa

SEQ ID NO: 2234643 - RNA, 15 nt, Homo sapiens
agaauagacuaaguu

SEQ ID NO: 2234644 - RNA, 13 nt, Homo sapiens
aaugacccaaaga

SEQ ID NO: 2234645 - RNA, 20 nt, Homo sapiens
uccuggccacauucaccaac

SEQ ID NO: 2234646 - RNA, 14 nt, Homo sapiens
acuuggagcuaaaa

SEQ ID NO: 2234647 - RNA, 17 nt, Homo sapiens
ccccccaacuccaggaa

SEQ ID NO: 2234648 - RNA, 13 nt, Homo sapiens
ccccuaaaccaaa

SEQ ID NO: 2234649 - RNA, 15 nt, Homo sapiens
uguauaggacucuca

SEQ ID NO: 2234650 - RNA, 15 nt, Homo sapiens
aguagcugggaccac

SEQ ID NO: 2234651 - RNA, 21 nt, Homo sapiens
acaaaauuuuauuuugugcuc

SEQ ID NO: 2234652 - RNA, 17 nt, Homo sapiens
gugcucagacaugaaau

SEQ ID NO: 2234653 - RNA, 22 nt, Homo sapiens
gccaaacaaaacugaaccacaa

SEQ ID NO: 2234654 - RNA, 20 nt, Homo sapiens
caagaucgcgccacugcacu

SEQ ID NO: 2234655 - RNA, 12 nt, Homo sapiens
ucaaacauauau

SEQ ID NO: 2234656 - RNA, 23 nt, Homo sapiens
gaaccuaaugggaaucauuccac

SEQ ID NO: 2234657 - RNA, 22 nt, Homo sapiens
aaacacaaauagaacauuccau

SEQ ID NO: 2234658 - RNA, 22 nt, Homo sapiens
ugaagcccacccugcaccucau

SEQ ID NO: 2234659 - RNA, 14 nt, Homo sapiens
uugcucuuacuuga

SEQ ID NO: 2234660 - RNA, 23 nt, Homo sapiens
gcgguaggucauucuuuugccac

SEQ ID NO: 2234661 - RNA, 17 nt, Homo sapiens
ucccaaucagcacugaa

SEQ ID NO: 2234662 - RNA, 22 nt, Homo sapiens
augcauggcauuuguuccacag

SEQ ID NO: 2234663 - RNA, 12 nt, Homo sapiens
acuaaauaucau

SEQ ID NO: 2234664 - RNA, 19 nt, Homo sapiens
gcuucugcaauauuauuuc

SEQ ID NO: 2234665 - RNA, 22 nt, Homo sapiens
ucuuacucuacugcugcugaca

SEQ ID NO: 2234666 - RNA, 14 nt, Homo sapiens
gcugccaucagucu

SEQ ID NO: 2234667 - RNA, 16 nt, Homo sapiens
gaaugauaugcauuug

SEQ ID NO: 2234668 - RNA, 19 nt, Homo sapiens
guagccucugggaucugcc

SEQ ID NO: 2234669 - RNA, 19 nt, Homo sapiens
ucaaaacuguaaaaaucau

SEQ ID NO: 2234670 - RNA, 20 nt, Homo sapiens
cagaaccggagagccagcua

SEQ ID NO: 2234671 - RNA, 17 nt, Homo sapiens
ggaccccuguccaggau

SEQ ID NO: 2234672 - RNA, 14 nt, Homo sapiens
uguuugugcuucua

SEQ ID NO: 2234673 - RNA, 17 nt, Homo sapiens
ugugcauuuuucugacg

SEQ ID NO: 2234674 - RNA, 14 nt, Homo sapiens
agacaggcacaaaa

SEQ ID NO: 2234675 - RNA, 9 nt, Homo sapiens
ucucucuuu

SEQ ID NO: 2234676 - RNA, 12 nt, Homo sapiens
acaggcacucca

SEQ ID NO: 2234677 - RNA, 12 nt, Homo sapiens
aaaaaucuucca

SEQ ID NO: 2234678 - RNA, 12 nt, Homo sapiens
aaccaucuucac

SEQ ID NO: 2234679 - RNA, 12 nt, Homo sapiens
aaauaucuuccu

SEQ ID NO: 2234680 - RNA, 13 nt, Homo sapiens
gguuagcucacag

SEQ ID NO: 2234681 - RNA, 23 nt, Homo sapiens
agacugcuagcuuucuccuuacc

SEQ ID NO: 2234682 - RNA, 21 nt, Homo sapiens
uggagauggguguggcagugu

SEQ ID NO: 2234683 - RNA, 23 nt, Homo sapiens
ggaauugcuuuuaaaauacauuu

SEQ ID NO: 2234684 - RNA, 18 nt, Homo sapiens
gggucuucuaccucagac

SEQ ID NO: 2234685 - RNA, 11 nt, Homo sapiens
agauaugauau

SEQ ID NO: 2234686 - RNA, 17 nt, Homo sapiens
agugugacagggccagu

SEQ ID NO: 2234687 - RNA, 17 nt, Homo sapiens
agcaaaacuaaauacuu

SEQ ID NO: 2234688 - RNA, 21 nt, Homo sapiens
caucuauugccugagagcaca

SEQ ID NO: 2234689 - RNA, 22 nt, Homo sapiens
aaaaguuaacauucaguacuuu

SEQ ID NO: 2234690 - RNA, 14 nt, Homo sapiens
uauaauacuguauu

SEQ ID NO: 2234691 - RNA, 12 nt, Homo sapiens
uuaucaguccaa

SEQ ID NO: 2234692 - RNA, 20 nt, Homo sapiens
ucuaaaugaaugagccaaaa

SEQ ID NO: 2234693 - RNA, 22 nt, Homo sapiens
accccaggaucccagagcuucc

SEQ ID NO: 2234694 - RNA, 15 nt, Homo sapiens
aacucaccauuucau

SEQ ID NO: 2234695 - RNA, 16 nt, Homo sapiens
uacaacuaucauaccu

SEQ ID NO: 2234696 - RNA, 17 nt, Homo sapiens
acuagagccugugcuaa

SEQ ID NO: 2234697 - RNA, 20 nt, Homo sapiens
gaaaacagcagcaaugcaau

SEQ ID NO: 2234698 - RNA, 13 nt, Homo sapiens
ucuagccagugaa

SEQ ID NO: 2234699 - RNA, 15 nt, Homo sapiens
acuuuuaccacuugc

SEQ ID NO: 2234700 - RNA, 16 nt, Homo sapiens
uauuuaaacaacagcu

SEQ ID NO: 2234701 - RNA, 16 nt, Homo sapiens
cauauaucuauuacac

SEQ ID NO: 2234702 - RNA, 17 nt, Homo sapiens
accucacgcucuggaca

SEQ ID NO: 2234703 - RNA, 14 nt, Homo sapiens
cagcugguggagca

SEQ ID NO: 2234704 - RNA, 19 nt, Homo sapiens
ccaggcaagugggaccagg

SEQ ID NO: 2234705 - RNA, 22 nt, Homo sapiens
accgaggugcaaauucauuuca

SEQ ID NO: 2234706 - RNA, 12 nt, Homo sapiens
ccaguguaauaa

SEQ ID NO: 2234707 - RNA, 23 nt, Homo sapiens
gauuacagguguaagccaucaca

SEQ ID NO: 2234708 - RNA, 18 nt, Homo sapiens
cauucuuguucagauuaa

SEQ ID NO: 2234709 - RNA, 17 nt, Homo sapiens
ucuaguaagaugcacug

SEQ ID NO: 2234710 - RNA, 17 nt, Homo sapiens
agaauacuuugcuucau

SEQ ID NO: 2234711 - RNA, 18 nt, Homo sapiens
aaaauggcagugaugaau

SEQ ID NO: 2234712 - RNA, 18 nt, Homo sapiens
agcauggaaucugaugaa

SEQ ID NO: 2234713 - RNA, 21 nt, Homo sapiens
gaggcugagccuacagaugaa

SEQ ID NO: 2234714 - RNA, 20 nt, Homo sapiens
ccagauuugaagacaaaaau

SEQ ID NO: 2234715 - RNA, 21 nt, Homo sapiens
ccuuauucucacagcaagccc

SEQ ID NO: 2234716 - RNA, 14 nt, Homo sapiens
acucaccaaaauau

SEQ ID NO: 2234717 - RNA, 17 nt, Homo sapiens
gaauagccuggccacca

SEQ ID NO: 2234718 - RNA, 22 nt, Homo sapiens
cuggcaaugcccuaccugccug

SEQ ID NO: 2234719 - RNA, 19 nt, Homo sapiens
agucagggcaugcuuuauu

SEQ ID NO: 2234720 - RNA, 13 nt, Homo sapiens
accacagugucug

SEQ ID NO: 2234721 - RNA, 22 nt, Homo sapiens
ugccugcucugcagcccacaga

SEQ ID NO: 2234722 - RNA, 16 nt, Homo sapiens
ugggcucccacauaag

SEQ ID NO: 2234723 - RNA, 17 nt, Homo sapiens
caccuucaauacuucau

SEQ ID NO: 2234724 - RNA, 21 nt, Homo sapiens
ucuuuugcucucucauuccca

SEQ ID NO: 2234725 - RNA, 22 nt, Homo sapiens
agagaugcgaaccacccaaaac

SEQ ID NO: 2234726 - RNA, 24 nt, Homo sapiens
cagggagaaguagcuaguagcaau

SEQ ID NO: 2234727 - RNA, 16 nt, Homo sapiens
aaaaugacaagugagu

SEQ ID NO: 2234728 - RNA, 14 nt, Homo sapiens
auacaacacauuga

SEQ ID NO: 2234729 - RNA, 22 nt, Homo sapiens
auguuaaugucauuagugacaa

SEQ ID NO: 2234730 - RNA, 19 nt, Homo sapiens
agacacccaggacuuauuu

SEQ ID NO: 2234731 - RNA, 22 nt, Homo sapiens
uggagaggcccggccucucaca

SEQ ID NO: 2234732 - RNA, 16 nt, Homo sapiens
uugcauguaugacuua

SEQ ID NO: 2234733 - RNA, 19 nt, Homo sapiens
ccccauuccaccaccccag

SEQ ID NO: 2234734 - RNA, 20 nt, Homo sapiens
gccccgcaggguccaaaggc

SEQ ID NO: 2234735 - RNA, 19 nt, Homo sapiens
acagaaacgagauuugcca

SEQ ID NO: 2234736 - RNA, 22 nt, Homo sapiens
auaaagaaaaaaauaguuuuac

SEQ ID NO: 2234737 - RNA, 21 nt, Homo sapiens
gaucaguuuuccuagucuuug

SEQ ID NO: 2234738 - RNA, 17 nt, Homo sapiens
cuccucgacaucacugu

SEQ ID NO: 2234739 - RNA, 22 nt, Homo sapiens
ucagcucccaucucauuuccag

SEQ ID NO: 2234740 - RNA, 23 nt, Homo sapiens
ucuuuuaggaggcacaacaguuc

SEQ ID NO: 2234741 - RNA, 23 nt, Homo sapiens
auuaauuuuuaaggauguugcca

SEQ ID NO: 2234742 - RNA, 17 nt, Homo sapiens
uuuuaaaaagugugcuu

SEQ ID NO: 2234743 - RNA, 18 nt, Homo sapiens
aguuacagccauaugcag

SEQ ID NO: 2234744 - RNA, 22 nt, Homo sapiens
gcuacuuuuguuccacauucuc

SEQ ID NO: 2234745 - RNA, 19 nt, Homo sapiens
guacagucagaauaguuau

SEQ ID NO: 2234746 - RNA, 22 nt, Homo sapiens
agggggcuaagcuauggcccau

SEQ ID NO: 2234747 - RNA, 21 nt, Homo sapiens
ucaugaagaauguuucuggaa

SEQ ID NO: 2234748 - RNA, 21 nt, Homo sapiens
aggauauccucccuccagaua

SEQ ID NO: 2234749 - RNA, 12 nt, Homo sapiens
aaauucuaccuc

SEQ ID NO: 2234750 - RNA, 14 nt, Homo sapiens
auuugcauauguau

SEQ ID NO: 2234751 - RNA, 12 nt, Homo sapiens
auucccaugugg

SEQ ID NO: 2234752 - RNA, 14 nt, Homo sapiens
cuccuguacacuga

SEQ ID NO: 2234753 - RNA, 14 nt, Homo sapiens
uuauccagcaguau

SEQ ID NO: 2234754 - RNA, 21 nt, Homo sapiens
uaauuuauacaggucauauua

SEQ ID NO: 2234755 - RNA, 20 nt, Homo sapiens
gccuguuauaacucugcacu

SEQ ID NO: 2234756 - RNA, 16 nt, Homo sapiens
uaaccucuucaccuua

SEQ ID NO: 2234757 - RNA, 22 nt, Homo sapiens
uuaguugggcauaguggcacuu

SEQ ID NO: 2234758 - RNA, 22 nt, Homo sapiens
uggagcaccugggccccacugg

SEQ ID NO: 2234759 - RNA, 14 nt, Homo sapiens
aaggcuugguccca

SEQ ID NO: 2234760 - RNA, 16 nt, Homo sapiens
uugaaucaaagugauu

SEQ ID NO: 2234761 - RNA, 20 nt, Homo sapiens
guguccaggguccucuagcc

SEQ ID NO: 2234762 - RNA, 17 nt, Homo sapiens
caaaucaggaacuguau

SEQ ID NO: 2234763 - RNA, 20 nt, Homo sapiens
uuuuaguguguaaaauuaau

SEQ ID NO: 2234764 - RNA, 21 nt, Homo sapiens
ggagaaacuguagucucagga

SEQ ID NO: 2234765 - RNA, 21 nt, Homo sapiens
ccuuuucaaaaccuaaaaaca

SEQ ID NO: 2234766 - RNA, 16 nt, Homo sapiens
ccaccuggcuucauac

SEQ ID NO: 2234767 - RNA, 16 nt, Homo sapiens
aaaucacgcagaccca

SEQ ID NO: 2234768 - RNA, 14 nt, Homo sapiens
caucuuuguaauac

SEQ ID NO: 2234769 - RNA, 16 nt, Homo sapiens
ugucuuaguuguacaa

SEQ ID NO: 2234770 - RNA, 20 nt, Homo sapiens
cuuagaaaucauuguagaaa

SEQ ID NO: 2234771 - RNA, 10 nt, Homo sapiens
gcaugcaguu

SEQ ID NO: 2234772 - RNA, 19 nt, Homo sapiens
auggaaacagacucauacc

SEQ ID NO: 2234773 - RNA, 15 nt, Homo sapiens
uaaaguauaugugca

SEQ ID NO: 2234774 - RNA, 15 nt, Homo sapiens
uacacauuuuguaaa

SEQ ID NO: 2234775 - RNA, 20 nt, Homo sapiens
ucaggagcuugggcagugcc

SEQ ID NO: 2234776 - RNA, 15 nt, Homo sapiens
caugguuccagugag

SEQ ID NO: 2234777 - RNA, 21 nt, Homo sapiens
cauagagucuuuauguccaua

SEQ ID NO: 2234778 - RNA, 19 nt, Homo sapiens
auuaaugaguuuuauccaa

SEQ ID NO: 2234779 - RNA, 13 nt, Homo sapiens
auacuuucccugc

SEQ ID NO: 2234780 - RNA, 14 nt, Homo sapiens
ggaaacacagcuga

SEQ ID NO: 2234781 - RNA, 14 nt, Homo sapiens
acccagugauccca

SEQ ID NO: 2234782 - RNA, 16 nt, Homo sapiens
ugcauuuuuagaccau

SEQ ID NO: 2234783 - RNA, 15 nt, Homo sapiens
uacuucaguaauaau

SEQ ID NO: 2234784 - RNA, 20 nt, Homo sapiens
cauggcuggggacuucucac

SEQ ID NO: 2234785 - RNA, 15 nt, Homo sapiens
cagagaccaucccug

SEQ ID NO: 2234786 - RNA, 22 nt, Homo sapiens
uccauuugugugugugcaagug

SEQ ID NO: 2234787 - RNA, 13 nt, Homo sapiens
ccggccacacugg

SEQ ID NO: 2234788 - RNA, 14 nt, Homo sapiens
ccuugcagccacau

SEQ ID NO: 2234789 - RNA, 23 nt, Homo sapiens
aggcugccaggcaccaucugcca

SEQ ID NO: 2234790 - RNA, 15 nt, Homo sapiens
guucugucugugucu

SEQ ID NO: 2234791 - RNA, 20 nt, Homo sapiens
cuaagaauaaacuccauuua

SEQ ID NO: 2234792 - RNA, 19 nt, Homo sapiens
aaucaagagcuuccagaaa

SEQ ID NO: 2234793 - RNA, 19 nt, Homo sapiens
caaccugggggcuuuaggg

SEQ ID NO: 2234794 - RNA, 23 nt, Homo sapiens
ugcagcaacucccacgacuguug

SEQ ID NO: 2234795 - RNA, 15 nt, Homo sapiens
ggcugcaagggccag

SEQ ID NO: 2234796 - RNA, 23 nt, Homo sapiens
cacugccuuugucuuacuggcaa

SEQ ID NO: 2234797 - RNA, 21 nt, Homo sapiens
aagaagccauauaugaccaga

SEQ ID NO: 2234798 - RNA, 20 nt, Homo sapiens
gcaugaauaaaggcuacagg

SEQ ID NO: 2234799 - RNA, 19 nt, Homo sapiens
caauuaaaccgcaugugau

SEQ ID NO: 2234800 - RNA, 15 nt, Homo sapiens
cugcauuucauauua

SEQ ID NO: 2234801 - RNA, 21 nt, Homo sapiens
gaauauugcuuuggucauaug

SEQ ID NO: 2234802 - RNA, 19 nt, Homo sapiens
uuauauauuuuucugagau

SEQ ID NO: 2234803 - RNA, 12 nt, Homo sapiens
accugugugcug

SEQ ID NO: 2234804 - RNA, 16 nt, Homo sapiens
cauguucaaaguguga

SEQ ID NO: 2234805 - RNA, 16 nt, Homo sapiens
gcgaacacagugacac

SEQ ID NO: 2234806 - RNA, 18 nt, Homo sapiens
gguguaugcacagggugu

SEQ ID NO: 2234807 - RNA, 18 nt, Homo sapiens
aaauguauuuuucacaaa

SEQ ID NO: 2234808 - RNA, 16 nt, Homo sapiens
cuugcuaccugugagc

SEQ ID NO: 2234809 - RNA, 16 nt, Homo sapiens
cccuacuggcuguaaa

SEQ ID NO: 2234810 - RNA, 19 nt, Homo sapiens
aaugguguaaccugagaug

SEQ ID NO: 2234811 - RNA, 14 nt, Homo sapiens
gcaguucugauuca

SEQ ID NO: 2234812 - RNA, 16 nt, Homo sapiens
cuaucauggugaaaag

SEQ ID NO: 2234813 - RNA, 15 nt, Homo sapiens
gaccgugugugaaau

SEQ ID NO: 2234814 - RNA, 16 nt, Homo sapiens
gccuccucgauugcuc

SEQ ID NO: 2234815 - RNA, 13 nt, Homo sapiens
agccucuccaagg

SEQ ID NO: 2234816 - RNA, 17 nt, Homo sapiens
guguaagcucacaucca

SEQ ID NO: 2234817 - RNA, 19 nt, Homo sapiens
gagcucccgggcacaucca

SEQ ID NO: 2234818 - RNA, 17 nt, Homo sapiens
gguuuaauuauauuugc

SEQ ID NO: 2234819 - RNA, 20 nt, Homo sapiens
uccauuuuacuuccaugaua

SEQ ID NO: 2234820 - RNA, 21 nt, Homo sapiens
cuguuuccagagugcuuauaa

SEQ ID NO: 2234821 - RNA, 20 nt, Homo sapiens
cccacaagugccacugcccg

SEQ ID NO: 2234822 - RNA, 13 nt, Homo sapiens
ggugggaauaaaa

SEQ ID NO: 2234823 - RNA, 20 nt, Homo sapiens
uugaaaaaaaacccuugauu

SEQ ID NO: 2234824 - RNA, 18 nt, Homo sapiens
uagagauuugguguacaa

SEQ ID NO: 2234825 - RNA, 20 nt, Homo sapiens
gcuacaccacucuggcagcc

SEQ ID NO: 2234826 - RNA, 13 nt, Homo sapiens
augugcccgccuc

SEQ ID NO: 2234827 - RNA, 14 nt, Homo sapiens
cacuuuaaauauga

SEQ ID NO: 2234828 - RNA, 20 nt, Homo sapiens
cugggggcauaucucaguca

SEQ ID NO: 2234829 - RNA, 20 nt, Homo sapiens
aacauuuuguucuuacacau

SEQ ID NO: 2234830 - RNA, 12 nt, Homo sapiens
cacucccaaagc

SEQ ID NO: 2234831 - RNA, 19 nt, Homo sapiens
guaaugucuugagcucuau

SEQ ID NO: 2234832 - RNA, 23 nt, Homo sapiens
acaggggguccccuucuguuacc

SEQ ID NO: 2234833 - RNA, 16 nt, Homo sapiens
ccguagcuucuagucu

SEQ ID NO: 2234834 - RNA, 21 nt, Homo sapiens
cugucacaaagggacuuugga

SEQ ID NO: 2234835 - RNA, 20 nt, Homo sapiens
acugcauaaaaagugccugu

SEQ ID NO: 2234836 - RNA, 14 nt, Homo sapiens
cauuuagcacaaaa

SEQ ID NO: 2234837 - RNA, 16 nt, Homo sapiens
aggccgagaagcaaga

SEQ ID NO: 2234838 - RNA, 17 nt, Homo sapiens
ccugggagaccagggac

SEQ ID NO: 2234839 - RNA, 20 nt, Homo sapiens
uaauccaauauuuugccuuu

SEQ ID NO: 2234840 - RNA, 14 nt, Homo sapiens
gacugaaacuggaa

SEQ ID NO: 2234841 - RNA, 17 nt, Homo sapiens
gaaaggcugaacauaaa

SEQ ID NO: 2234842 - RNA, 17 nt, Homo sapiens
uaucucuucagucucua

SEQ ID NO: 2234843 - RNA, 22 nt, Homo sapiens
ccugccagcagcugccugggaa

SEQ ID NO: 2234844 - RNA, 17 nt, Homo sapiens
cuaaacaacuaccuccu

SEQ ID NO: 2234845 - RNA, 16 nt, Homo sapiens
cccuggccuaggcagu

SEQ ID NO: 2234846 - RNA, 18 nt, Homo sapiens
uaaguuuuguguguauau

SEQ ID NO: 2234847 - RNA, 12 nt, Homo sapiens
uuaagcacugua

SEQ ID NO: 2234848 - RNA, 12 nt, Homo sapiens
uguagcacuuaa

SEQ ID NO: 2234849 - RNA, 22 nt, Homo sapiens
ucauguacuuuggcaucuuuug

SEQ ID NO: 2234850 - RNA, 23 nt, Homo sapiens
aaacugagucuguggacacugug

SEQ ID NO: 2234851 - RNA, 16 nt, Homo sapiens
aguucaccugcacuua

SEQ ID NO: 2234852 - RNA, 14 nt, Homo sapiens
auaugauacucuca

SEQ ID NO: 2234853 - RNA, 20 nt, Homo sapiens
gcuaagaauaaacuccauuu

SEQ ID NO: 2234854 - RNA, 19 nt, Homo sapiens
uaguucaaucuggauucau

SEQ ID NO: 2234855 - RNA, 17 nt, Homo sapiens
gaagggaauugcucaga

SEQ ID NO: 2234856 - RNA, 21 nt, Homo sapiens
ucaggguaccuggggccaaac

SEQ ID NO: 2234857 - RNA, 14 nt, Homo sapiens
caugaaauaaaaua

SEQ ID NO: 2234858 - RNA, 16 nt, Homo sapiens
cauuuaauccucucaa

SEQ ID NO: 2234859 - RNA, 13 nt, Homo sapiens
auguuuuugacuc

SEQ ID NO: 2234860 - RNA, 23 nt, Homo sapiens
uaucuuuucucccaccuccuucc

SEQ ID NO: 2234861 - RNA, 13 nt, Homo sapiens
ggccaucuuccag

SEQ ID NO: 2234862 - RNA, 13 nt, Homo sapiens
aacaaaacuggau

SEQ ID NO: 2234863 - RNA, 21 nt, Homo sapiens
gugcuccucucgcacaaugca

SEQ ID NO: 2234864 - RNA, 21 nt, Homo sapiens
cuggcucuccugucucugcag

SEQ ID NO: 2234865 - RNA, 22 nt, Homo sapiens
ugauguacgcugcgugccauga

SEQ ID NO: 2234866 - RNA, 22 nt, Homo sapiens
augggaaacuauugugcacaag

SEQ ID NO: 2234867 - RNA, 18 nt, Homo sapiens
auggaauaagcagaaacu

SEQ ID NO: 2234868 - RNA, 15 nt, Homo sapiens
ugcauugccaagugc

SEQ ID NO: 2234869 - RNA, 14 nt, Homo sapiens
agcugcaccugcca

SEQ ID NO: 2234870 - RNA, 22 nt, Homo sapiens
ucccgaacacgcacagaaggaa

SEQ ID NO: 2234871 - RNA, 21 nt, Homo sapiens
auggauuuaacagcaugacaa

SEQ ID NO: 2234872 - RNA, 14 nt, Homo sapiens
gguggggccauaaa

SEQ ID NO: 2234873 - RNA, 21 nt, Homo sapiens
uagagaaaccccuggggacca

SEQ ID NO: 2234874 - RNA, 22 nt, Homo sapiens
aaagguuuuaaccgcacaugca

SEQ ID NO: 2234875 - RNA, 18 nt, Homo sapiens
aucaaagaacagaugggg

SEQ ID NO: 2234876 - RNA, 17 nt, Homo sapiens
uggcgcgcgccaccacg

SEQ ID NO: 2234877 - RNA, 17 nt, Homo sapiens
cauggaaucgaaguguu

SEQ ID NO: 2234878 - RNA, 19 nt, Homo sapiens
gaaagcuuuuauuccuuug

SEQ ID NO: 2234879 - RNA, 21 nt, Homo sapiens
ucccucacugaaaccaggugg

SEQ ID NO: 2234880 - RNA, 19 nt, Homo sapiens
gccccuugcaaaguaauag

SEQ ID NO: 2234881 - RNA, 23 nt, Homo sapiens
aggcuguggugcaguaaccauuu

SEQ ID NO: 2234882 - RNA, 16 nt, Homo sapiens
aaauacuauugccuca

SEQ ID NO: 2234883 - RNA, 23 nt, Homo sapiens
cuacuaaaaauacaauuagccag

SEQ ID NO: 2234884 - RNA, 15 nt, Homo sapiens
ucagcaaagaacaag

SEQ ID NO: 2234885 - RNA, 16 nt, Homo sapiens
uaugucugacagucuu

SEQ ID NO: 2234886 - RNA, 22 nt, Homo sapiens
uuaaaaugcuuacauuugaacu

SEQ ID NO: 2234887 - RNA, 20 nt, Homo sapiens
uccuucucagccuugguucc

SEQ ID NO: 2234888 - RNA, 21 nt, Homo sapiens
agaaucccuguguuaauuuaa

SEQ ID NO: 2234889 - RNA, 14 nt, Homo sapiens
caacucaucuucac

SEQ ID NO: 2234890 - RNA, 21 nt, Homo sapiens
accacaacugacacaggaaac

SEQ ID NO: 2234891 - RNA, 22 nt, Homo sapiens
cagggaccacaggccuuaggga

SEQ ID NO: 2234892 - RNA, 23 nt, Homo sapiens
gaaugaugcucaaaaucuuucca

SEQ ID NO: 2234893 - RNA, 21 nt, Homo sapiens
gcuccagcugcucugucuucu

SEQ ID NO: 2234894 - RNA, 17 nt, Homo sapiens
ucaaaucccaaaccauu

SEQ ID NO: 2234895 - RNA, 20 nt, Homo sapiens
ugaagaaguuggucaguauu

SEQ ID NO: 2234896 - RNA, 14 nt, Homo sapiens
uagagaagccauaa

SEQ ID NO: 2234897 - RNA, 19 nt, Homo sapiens
caccugagcugcugcauga

SEQ ID NO: 2234898 - RNA, 18 nt, Homo sapiens
ucccauuuacucuugaga

SEQ ID NO: 2234899 - RNA, 18 nt, Homo sapiens
ugcuagugagccuuccca

SEQ ID NO: 2234900 - RNA, 18 nt, Homo sapiens
ugccagcaaugacaucuc

SEQ ID NO: 2234901 - RNA, 19 nt, Homo sapiens
aaccagguuuagacaguau

SEQ ID NO: 2234902 - RNA, 17 nt, Homo sapiens
ggaguccuguucucaga

SEQ ID NO: 2234903 - RNA, 22 nt, Homo sapiens
ggcggcccggccagcgggcaca

SEQ ID NO: 2234904 - RNA, 14 nt, Homo sapiens
acccuuaggccagc

SEQ ID NO: 2234905 - RNA, 19 nt, Homo sapiens
uuaagcguacaaagugauc

SEQ ID NO: 2234906 - RNA, 16 nt, Homo sapiens
aagcuugaggccaaga

SEQ ID NO: 2234907 - RNA, 22 nt, Homo sapiens
aacaugcuugaauaacugagcu

SEQ ID NO: 2234908 - RNA, 17 nt, Homo sapiens
cauguaagcucuuugag

SEQ ID NO: 2234909 - RNA, 17 nt, Homo sapiens
uuucuguuucaaagcac

SEQ ID NO: 2234910 - RNA, 19 nt, Homo sapiens
ccacuucuccccucaagaa

SEQ ID NO: 2234911 - RNA, 19 nt, Homo sapiens
cacccuguuccugcugcug

SEQ ID NO: 2234912 - RNA, 20 nt, Homo sapiens
cuaaauguguaauaauguaa

SEQ ID NO: 2234913 - RNA, 15 nt, Homo sapiens
uuaacuuugaaaguu

SEQ ID NO: 2234914 - RNA, 14 nt, Homo sapiens
ucaaaugaguuuaa

SEQ ID NO: 2234915 - RNA, 17 nt, Homo sapiens
ccucuuuuuagggcuaa

SEQ ID NO: 2234916 - RNA, 22 nt, Homo sapiens
aacauuuuuuauuugagaauuu

SEQ ID NO: 2234917 - RNA, 11 nt, Homo sapiens
aguaacugugc

SEQ ID NO: 2234918 - RNA, 19 nt, Homo sapiens
aguaauaaacgucuugcca

SEQ ID NO: 2234919 - RNA, 15 nt, Homo sapiens
aagucuuccaugacc

SEQ ID NO: 2234920 - RNA, 22 nt, Homo sapiens
gaccuuuauaucugucuuuuau

SEQ ID NO: 2234921 - RNA, 20 nt, Homo sapiens
accaaaauaauacaacaauc

SEQ ID NO: 2234922 - RNA, 16 nt, Homo sapiens
cauaguggaucacuca

SEQ ID NO: 2234923 - RNA, 12 nt, Homo sapiens
ugaggucaggga

SEQ ID NO: 2234924 - RNA, 12 nt, Homo sapiens
ccuaauggcaaa

SEQ ID NO: 2234925 - RNA, 15 nt, Homo sapiens
uccaacaaaccacac

SEQ ID NO: 2234926 - RNA, 17 nt, Homo sapiens
acccuugacaccugcug

SEQ ID NO: 2234927 - RNA, 19 nt, Homo sapiens
ugucucaccuacccaugac

SEQ ID NO: 2234928 - RNA, 22 nt, Homo sapiens
acccuuuccucuuaauucccaa

SEQ ID NO: 2234929 - RNA, 12 nt, Homo sapiens
gauaaagcaccc

SEQ ID NO: 2234930 - RNA, 19 nt, Homo sapiens
ucuaucggagaacaugaau

SEQ ID NO: 2234931 - RNA, 20 nt, Homo sapiens
cauguguugcagcugucacc

SEQ ID NO: 2234932 - RNA, 18 nt, Homo sapiens
uacacugcuguacccaga

SEQ ID NO: 2234933 - RNA, 23 nt, Homo sapiens
cugacagccuccaccuugagcac

SEQ ID NO: 2234934 - RNA, 16 nt, Homo sapiens
cauuuuugccaaaaua

SEQ ID NO: 2234935 - RNA, 17 nt, Homo sapiens
aguuuauugacaauaau

SEQ ID NO: 2234936 - RNA, 21 nt, Homo sapiens
ccgagcuacaaagcaugggaa

SEQ ID NO: 2234937 - RNA, 19 nt, Homo sapiens
ugaaaacauguacuacagc

SEQ ID NO: 2234938 - RNA, 13 nt, Homo sapiens
auuaaagugccau

SEQ ID NO: 2234939 - RNA, 13 nt, Homo sapiens
acuaaagugucau

SEQ ID NO: 2234940 - RNA, 19 nt, Homo sapiens
auagcuuuauacucucucc

SEQ ID NO: 2234941 - RNA, 22 nt, Homo sapiens
aggagguuuggggucugccacc

SEQ ID NO: 2234942 - RNA, 16 nt, Homo sapiens
ugacagagaauaacuc

SEQ ID NO: 2234943 - RNA, 19 nt, Homo sapiens
agcuucucuugcucucgac

SEQ ID NO: 2234944 - RNA, 21 nt, Homo sapiens
gacaagcaagggcugugcuga

SEQ ID NO: 2234945 - RNA, 22 nt, Homo sapiens
cugaauagugucaccaauucca

SEQ ID NO: 2234946 - RNA, 17 nt, Homo sapiens
ugagaaagagcacuuaa

SEQ ID NO: 2234947 - RNA, 16 nt, Homo sapiens
cacacacacacacaaa

SEQ ID NO: 2234948 - RNA, 16 nt, Homo sapiens
agaucacgagaucaag

SEQ ID NO: 2234949 - RNA, 16 nt, Homo sapiens
ucuuuccuucuuucau

SEQ ID NO: 2234950 - RNA, 16 nt, Homo sapiens
uauacacauauacaaa

SEQ ID NO: 2234951 - RNA, 21 nt, Homo sapiens
augcuuugccccugagacaaa

SEQ ID NO: 2234952 - RNA, 20 nt, Homo sapiens
accauaaacuguacaaauga

SEQ ID NO: 2234953 - RNA, 16 nt, Homo sapiens
ugauuuugacaugggg

SEQ ID NO: 2234954 - RNA, 13 nt, Homo sapiens
auuuuacuuccau

SEQ ID NO: 2234955 - RNA, 18 nt, Homo sapiens
gaauccugaccugagcca

SEQ ID NO: 2234956 - RNA, 16 nt, Homo sapiens
ccacgcacagccagac

SEQ ID NO: 2234957 - RNA, 15 nt, Homo sapiens
acagauuugcuccua

SEQ ID NO: 2234958 - RNA, 16 nt, Homo sapiens
cuuugguaaucuucaa

SEQ ID NO: 2234959 - RNA, 21 nt, Homo sapiens
uccugcccaaacagcuguauu

SEQ ID NO: 2234960 - RNA, 18 nt, Homo sapiens
uguauauagaguggaauc

SEQ ID NO: 2234961 - RNA, 17 nt, Homo sapiens
uucuuauuuugcuacug

SEQ ID NO: 2234962 - RNA, 23 nt, Homo sapiens
uggaguuccucaucagugucauu

SEQ ID NO: 2234963 - RNA, 22 nt, Homo sapiens
ccuaacauccuuggacugagaa

SEQ ID NO: 2234964 - RNA, 20 nt, Homo sapiens
gcaccaggucacucugaccu

SEQ ID NO: 2234965 - RNA, 15 nt, Homo sapiens
aacaugaauuauuuc

SEQ ID NO: 2234966 - RNA, 16 nt, Homo sapiens
acuucucugaagggag

SEQ ID NO: 2234967 - RNA, 21 nt, Homo sapiens
aaacgcuuauguuacagguua

SEQ ID NO: 2234968 - RNA, 18 nt, Homo sapiens
ccaauuaaaaacaugaau

SEQ ID NO: 2234969 - RNA, 22 nt, Homo sapiens
guuuauuuucauucugccaaag

SEQ ID NO: 2234970 - RNA, 21 nt, Homo sapiens
cagucacauugauguaaggac

SEQ ID NO: 2234971 - RNA, 16 nt, Homo sapiens
aaaacaccuagcuuua

SEQ ID NO: 2234972 - RNA, 13 nt, Homo sapiens
uaaaauucuguca

SEQ ID NO: 2234973 - RNA, 13 nt, Homo sapiens
ugucauacauccu

SEQ ID NO: 2234974 - RNA, 17 nt, Homo sapiens
uucauuucuauaggcaa

SEQ ID NO: 2234975 - RNA, 19 nt, Homo sapiens
ccaccuguacucuggagag

SEQ ID NO: 2234976 - RNA, 19 nt, Homo sapiens
agucccccuauccuuggca

SEQ ID NO: 2234977 - RNA, 17 nt, Homo sapiens
cugucaauggacugcac

SEQ ID NO: 2234978 - RNA, 22 nt, Homo sapiens
ucuguuauuuaucccucauuca

SEQ ID NO: 2234979 - RNA, 23 nt, Homo sapiens
caccuuagacggaggugccugag

SEQ ID NO: 2234980 - RNA, 16 nt, Homo sapiens
accuuauauuuacaau

SEQ ID NO: 2234981 - RNA, 14 nt, Homo sapiens
uucacugauuggaa

SEQ ID NO: 2234982 - RNA, 14 nt, Homo sapiens
uuaaaacaaaagag

SEQ ID NO: 2234983 - RNA, 22 nt, Homo sapiens
uggcccgcgugauuguggcauu

SEQ ID NO: 2234984 - RNA, 15 nt, Homo sapiens
gcaugaaaacugaga

SEQ ID NO: 2234985 - RNA, 19 nt, Homo sapiens
aaucacauuuuaauugcca

SEQ ID NO: 2234986 - RNA, 16 nt, Homo sapiens
acuaaaaggugaccaa

SEQ ID NO: 2234987 - RNA, 13 nt, Homo sapiens
caggagucccugc

SEQ ID NO: 2234988 - RNA, 21 nt, Homo sapiens
agaaaaaaggguuuaugcuua

SEQ ID NO: 2234989 - RNA, 13 nt, Homo sapiens
auguauguacaau

SEQ ID NO: 2234990 - RNA, 20 nt, Homo sapiens
uccacuccuccuacuguauu

SEQ ID NO: 2234991 - RNA, 13 nt, Homo sapiens
ugucauaucuucu

SEQ ID NO: 2234992 - RNA, 18 nt, Homo sapiens
gaucccacucuucuugca

SEQ ID NO: 2234993 - RNA, 12 nt, Homo sapiens
uuacaacuaagu

SEQ ID NO: 2234994 - RNA, 13 nt, Homo sapiens
caguucaaucaaa

SEQ ID NO: 2234995 - RNA, 14 nt, Homo sapiens
ccaguuguugccaa

SEQ ID NO: 2234996 - RNA, 22 nt, Homo sapiens
gaauaaacuagauuacauucag

SEQ ID NO: 2234997 - RNA, 20 nt, Homo sapiens
uuccaggccugaucuugccu

SEQ ID NO: 2234998 - RNA, 19 nt, Homo sapiens
gaggaugaugccaguuacu

SEQ ID NO: 2234999 - RNA, 15 nt, Homo sapiens
auacaggaauuauua

SEQ ID NO: 2235000 - RNA, 14 nt, Homo sapiens
caccagacccaccu

SEQ ID NO: 2235001 - RNA, 12 nt, Homo sapiens
uaacagugcagu

SEQ ID NO: 2235002 - RNA, 16 nt, Homo sapiens
cugcuacugaccaucu

SEQ ID NO: 2235003 - RNA, 16 nt, Homo sapiens
gagguugaagaaugag

SEQ ID NO: 2235004 - RNA, 18 nt, Homo sapiens
ccacaaguuaguagcaaa

SEQ ID NO: 2235005 - RNA, 19 nt, Homo sapiens
caccuacgcgagucuuacu

SEQ ID NO: 2235006 - RNA, 20 nt, Homo sapiens
agggagcccccagaggacuu

SEQ ID NO: 2235007 - RNA, 22 nt, Homo sapiens
caugcccagcuuggagugccac

SEQ ID NO: 2235008 - RNA, 20 nt, Homo sapiens
guggagaaauuccuugauuc

SEQ ID NO: 2235009 - RNA, 20 nt, Homo sapiens
gaagagggagaagcaugaaa

SEQ ID NO: 2235010 - RNA, 18 nt, Homo sapiens
uuuccaggggccucccaa

SEQ ID NO: 2235011 - RNA, 17 nt, Homo sapiens
ucauccaggacugagau

SEQ ID NO: 2235012 - RNA, 15 nt, Homo sapiens
uagcaagaccugaaa

SEQ ID NO: 2235013 - RNA, 13 nt, Homo sapiens
uucagcucuuaaa

SEQ ID NO: 2235014 - RNA, 22 nt, Homo sapiens
ugaaauuuuuaaaucauuucau

SEQ ID NO: 2235015 - RNA, 21 nt, Homo sapiens
auauguguaaauguuaugacu

SEQ ID NO: 2235016 - RNA, 21 nt, Homo sapiens
acgccacccagccucuuguuu

SEQ ID NO: 2235017 - RNA, 18 nt, Homo sapiens
aguaugguauuacaaaac

SEQ ID NO: 2235018 - RNA, 17 nt, Homo sapiens
uauuuauuuuuaggaca

SEQ ID NO: 2235019 - RNA, 16 nt, Homo sapiens
caugggaaacuuccaa

SEQ ID NO: 2235020 - RNA, 14 nt, Homo sapiens
cagucacuguggug

SEQ ID NO: 2235021 - RNA, 19 nt, Homo sapiens
ucugcagggugaagcacca

SEQ ID NO: 2235022 - RNA, 19 nt, Homo sapiens
ggccuucagaaaagacacu

SEQ ID NO: 2235023 - RNA, 14 nt, Homo sapiens
cccggggucuccac

SEQ ID NO: 2235024 - RNA, 19 nt, Homo sapiens
augaugaaaaccuacauau

SEQ ID NO: 2235025 - RNA, 16 nt, Homo sapiens
auuguuuugugacuuu

SEQ ID NO: 2235026 - RNA, 21 nt, Homo sapiens
aaauacuguuucacuaauacu

SEQ ID NO: 2235027 - RNA, 21 nt, Homo sapiens
aagcccucucagaucacccca

SEQ ID NO: 2235028 - RNA, 23 nt, Homo sapiens
uucugauggguucaugucucuga

SEQ ID NO: 2235029 - RNA, 22 nt, Homo sapiens
uagaccuccacacccgugagaa

SEQ ID NO: 2235030 - RNA, 11 nt, Homo sapiens
ccagacugugg

SEQ ID NO: 2235031 - RNA, 18 nt, Homo sapiens
auguguguauauggacaa

SEQ ID NO: 2235032 - RNA, 21 nt, Homo sapiens
ggcagggcugaggccucucau

SEQ ID NO: 2235033 - RNA, 18 nt, Homo sapiens
acuuuacaggggagaaaa

SEQ ID NO: 2235034 - RNA, 15 nt, Homo sapiens
gaguggccuagagca

SEQ ID NO: 2235035 - RNA, 16 nt, Homo sapiens
ucauaaaggacacugg

SEQ ID NO: 2235036 - RNA, 20 nt, Homo sapiens
ggauuacaggugacugccac

SEQ ID NO: 2235037 - RNA, 13 nt, Homo sapiens
auuucaucaugau

SEQ ID NO: 2235038 - RNA, 22 nt, Homo sapiens
cuagaauguggauuugauucau

SEQ ID NO: 2235039 - RNA, 21 nt, Homo sapiens
agcagaugguccuccauuuca

SEQ ID NO: 2235040 - RNA, 12 nt, Homo sapiens
ugggaagccaua

SEQ ID NO: 2235041 - RNA, 12 nt, Homo sapiens
caugaagcugga

SEQ ID NO: 2235042 - RNA, 13 nt, Homo sapiens
cuaguuaauguca

SEQ ID NO: 2235043 - RNA, 22 nt, Homo sapiens
aaggucauaaguuucugagaug

SEQ ID NO: 2235044 - RNA, 18 nt, Homo sapiens
ccccuggcagugcugagg

SEQ ID NO: 2235045 - RNA, 15 nt, Homo sapiens
gugcagcuugcaguc

SEQ ID NO: 2235046 - RNA, 22 nt, Homo sapiens
auccauagcaccuccacauacc

SEQ ID NO: 2235047 - RNA, 21 nt, Homo sapiens
guauaguuaaccacuaccgaa

SEQ ID NO: 2235048 - RNA, 15 nt, Homo sapiens
uccccuucucucauc

SEQ ID NO: 2235049 - RNA, 16 nt, Homo sapiens
caucacguuagcuguc

SEQ ID NO: 2235050 - RNA, 20 nt, Homo sapiens
ugggacugugccuggcuccc

SEQ ID NO: 2235051 - RNA, 15 nt, Homo sapiens
ccuggccuaggcagu

SEQ ID NO: 2235052 - RNA, 16 nt, Homo sapiens
ugcaaagguugcagug

SEQ ID NO: 2235053 - RNA, 22 nt, Homo sapiens
uagccauaaaagaaaaucuuua

SEQ ID NO: 2235054 - RNA, 23 nt, Homo sapiens
uucuaauccuaucuggggagcuc

SEQ ID NO: 2235055 - RNA, 17 nt, Homo sapiens
cgcacacccucacucug

SEQ ID NO: 2235056 - RNA, 16 nt, Homo sapiens
gaugcagcucuuggga

SEQ ID NO: 2235057 - RNA, 21 nt, Homo sapiens
gagaaguuucgagggguccuc

SEQ ID NO: 2235058 - RNA, 21 nt, Homo sapiens
uauucaacagcucaccaacua

SEQ ID NO: 2235059 - RNA, 11 nt, Homo sapiens
augcuggccag

SEQ ID NO: 2235060 - RNA, 17 nt, Homo sapiens
uagaaacgaguuggugu

SEQ ID NO: 2235061 - RNA, 19 nt, Homo sapiens
agccacacagagaugucca

SEQ ID NO: 2235062 - RNA, 14 nt, Homo sapiens
cccugggacaucag

SEQ ID NO: 2235063 - RNA, 21 nt, Homo sapiens
uguucagaguggcucacuggc

SEQ ID NO: 2235064 - RNA, 21 nt, Homo sapiens
uggagagaacacagugcuauu

SEQ ID NO: 2235065 - RNA, 13 nt, Homo sapiens
caguauuuugaca

SEQ ID NO: 2235066 - RNA, 23 nt, Homo sapiens
auguaauuggaaucuucaccuca

SEQ ID NO: 2235067 - RNA, 17 nt, Homo sapiens
cugcagccugaccccag

SEQ ID NO: 2235068 - RNA, 22 nt, Homo sapiens
aaugucuggagugguaacagcu

SEQ ID NO: 2235069 - RNA, 22 nt, Homo sapiens
aagagcucccgaggaagcacag

SEQ ID NO: 2235070 - RNA, 18 nt, Homo sapiens
gagugaaaccaugacugu

SEQ ID NO: 2235071 - RNA, 13 nt, Homo sapiens
gguauggacaaaa

SEQ ID NO: 2235072 - RNA, 15 nt, Homo sapiens
uuauucugcuaaaga

SEQ ID NO: 2235073 - RNA, 19 nt, Homo sapiens
aucuaagaaaauuauguau

SEQ ID NO: 2235074 - RNA, 18 nt, Homo sapiens
cucagaaaaucaaagagg

SEQ ID NO: 2235075 - RNA, 20 nt, Homo sapiens
agaagagggguauaggacaa

SEQ ID NO: 2235076 - RNA, 19 nt, Homo sapiens
aggauguggcacugcuuga

SEQ ID NO: 2235077 - RNA, 23 nt, Homo sapiens
gacuugggaaacccaaccaguag

SEQ ID NO: 2235078 - RNA, 14 nt, Homo sapiens
cauauuguuauuau

SEQ ID NO: 2235079 - RNA, 23 nt, Homo sapiens
acuucacccgaguuccucugggu

SEQ ID NO: 2235080 - RNA, 17 nt, Homo sapiens
uuugaccaaauaaagua

SEQ ID NO: 2235081 - RNA, 16 nt, Homo sapiens
ucuuggaaugaaugac

SEQ ID NO: 2235082 - RNA, 18 nt, Homo sapiens
ggacuuagcugggagaaa

SEQ ID NO: 2235083 - RNA, 14 nt, Homo sapiens
acacuacugcuaaa

SEQ ID NO: 2235084 - RNA, 13 nt, Homo sapiens
cacaaauuuguau

SEQ ID NO: 2235085 - RNA, 17 nt, Homo sapiens
auuauagcgccuguaua

SEQ ID NO: 2235086 - RNA, 15 nt, Homo sapiens
uaauagaauucuguu

SEQ ID NO: 2235087 - RNA, 14 nt, Homo sapiens
caaugugaguccca

SEQ ID NO: 2235088 - RNA, 20 nt, Homo sapiens
uggaaaugaauccaucauac

SEQ ID NO: 2235089 - RNA, 14 nt, Homo sapiens
acccaacucugggc

SEQ ID NO: 2235090 - RNA, 16 nt, Homo sapiens
ggaugggaaacugcuc

SEQ ID NO: 2235091 - RNA, 16 nt, Homo sapiens
aaacauuuaacauaau

SEQ ID NO: 2235092 - RNA, 18 nt, Homo sapiens
cauuauuuccccuucaaa

SEQ ID NO: 2235093 - RNA, 18 nt, Homo sapiens
auucuaagagaaggccuu

SEQ ID NO: 2235094 - RNA, 22 nt, Homo sapiens
gauagagugggacaguuccuga

SEQ ID NO: 2235095 - RNA, 23 nt, Homo sapiens
ugggccauauuccgcacugggca

SEQ ID NO: 2235096 - RNA, 12 nt, Homo sapiens
cacuaugcacag

SEQ ID NO: 2235097 - RNA, 17 nt, Homo sapiens
agugcuaugccaagcca

SEQ ID NO: 2235098 - RNA, 20 nt, Homo sapiens
ugccauuuuaaggaaaacua

SEQ ID NO: 2235099 - RNA, 16 nt, Homo sapiens
ugcgaaccuaugucua

SEQ ID NO: 2235100 - RNA, 12 nt, Homo sapiens
aggucucaugga

SEQ ID NO: 2235101 - RNA, 15 nt, Homo sapiens
gaguccucacuccca

SEQ ID NO: 2235102 - RNA, 15 nt, Homo sapiens
ucgaacuucacaacu

SEQ ID NO: 2235103 - RNA, 16 nt, Homo sapiens
agagggugcaguccag

SEQ ID NO: 2235104 - RNA, 19 nt, Homo sapiens
gaagugcuggcaaccacua

SEQ ID NO: 2235105 - RNA, 19 nt, Homo sapiens
uucugggugcagcugagaa

SEQ ID NO: 2235106 - RNA, 22 nt, Homo sapiens
gcacuguccugcuccacagugu

SEQ ID NO: 2235107 - RNA, 21 nt, Homo sapiens
ccaucaggcaguguuaccugu

SEQ ID NO: 2235108 - RNA, 18 nt, Homo sapiens
uuagaucaaggcaaaaau

SEQ ID NO: 2235109 - RNA, 21 nt, Homo sapiens
caauauuuuuauaucaugcaa

SEQ ID NO: 2235110 - RNA, 20 nt, Homo sapiens
uaagguauuucgaaacugcc

SEQ ID NO: 2235111 - RNA, 17 nt, Homo sapiens
cugccaugaacuggagg

SEQ ID NO: 2235112 - RNA, 21 nt, Homo sapiens
gagaccuccccauguacauaa

SEQ ID NO: 2235113 - RNA, 21 nt, Homo sapiens
ccacuugcuuuuaaaauccac

SEQ ID NO: 2235114 - RNA, 12 nt, Homo sapiens
agggaucacugg

SEQ ID NO: 2235115 - RNA, 12 nt, Homo sapiens
aucgaugugcuc

SEQ ID NO: 2235116 - RNA, 16 nt, Homo sapiens
auaccuguguccgaug

SEQ ID NO: 2235117 - RNA, 15 nt, Homo sapiens
aaaugcucucucuuc

SEQ ID NO: 2235118 - RNA, 22 nt, Homo sapiens
acccaccucggccucccaaaau

SEQ ID NO: 2235119 - RNA, 21 nt, Homo sapiens
agucaaacgacuaaccuaucu

SEQ ID NO: 2235120 - RNA, 13 nt, Homo sapiens
uauaggcucuugu

SEQ ID NO: 2235121 - RNA, 21 nt, Homo sapiens
uggaagugugugccaagagcu

SEQ ID NO: 2235122 - RNA, 15 nt, Homo sapiens
gagaccuuccagaaa

SEQ ID NO: 2235123 - RNA, 12 nt, Homo sapiens
auacagcaaacc

SEQ ID NO: 2235124 - RNA, 18 nt, Homo sapiens
accaacuauagaauguau

SEQ ID NO: 2235125 - RNA, 14 nt, Homo sapiens
guccacugucaggg

SEQ ID NO: 2235126 - RNA, 20 nt, Homo sapiens
cucaauagcuccaagcuguu

SEQ ID NO: 2235127 - RNA, 13 nt, Homo sapiens
gacacaaaccugc

SEQ ID NO: 2235128 - RNA, 17 nt, Homo sapiens
gauguagaacuucaaga

SEQ ID NO: 2235129 - RNA, 21 nt, Homo sapiens
aggucuauggcucaugucuga

SEQ ID NO: 2235130 - RNA, 14 nt, Homo sapiens
aauacuaguauuaa

SEQ ID NO: 2235131 - RNA, 19 nt, Homo sapiens
gagauacugaacauuuugc

SEQ ID NO: 2235132 - RNA, 18 nt, Homo sapiens
cauucugcaaugagccau

SEQ ID NO: 2235133 - RNA, 12 nt, Homo sapiens
agggacaagcca

SEQ ID NO: 2235134 - RNA, 23 nt, Homo sapiens
aguaggcucauuuacuguuuuag

SEQ ID NO: 2235135 - RNA, 15 nt, Homo sapiens
gagcccccauuccac

SEQ ID NO: 2235136 - RNA, 22 nt, Homo sapiens
aagagaauuguagauaauacug

SEQ ID NO: 2235137 - RNA, 19 nt, Homo sapiens
gacuaauagagacacagag

SEQ ID NO: 2235138 - RNA, 12 nt, Homo sapiens
cuuggaccucag

SEQ ID NO: 2235139 - RNA, 15 nt, Homo sapiens
gugcuuuguacugcu

SEQ ID NO: 2235140 - RNA, 17 nt, Homo sapiens
augagccuccucgucac

SEQ ID NO: 2235141 - RNA, 19 nt, Homo sapiens
cagaaauaaagagcuguua

SEQ ID NO: 2235142 - RNA, 20 nt, Homo sapiens
auuggaugcauuucuaucaa

SEQ ID NO: 2235143 - RNA, 11 nt, Homo sapiens
aggcugucacc

SEQ ID NO: 2235144 - RNA, 21 nt, Homo sapiens
gcauucuuaacaaacucuuca

SEQ ID NO: 2235145 - RNA, 13 nt, Homo sapiens
uuaagcagcucac

SEQ ID NO: 2235146 - RNA, 23 nt, Homo sapiens
uucuuggcagcuuaacauugacu

SEQ ID NO: 2235147 - RNA, 15 nt, Homo sapiens
guuucuugacaagcu

SEQ ID NO: 2235148 - RNA, 12 nt, Homo sapiens
cucaguaauucc

SEQ ID NO: 2235149 - RNA, 18 nt, Homo sapiens
ugcucaauuaaacauuac

SEQ ID NO: 2235150 - RNA, 18 nt, Homo sapiens
acuuaacaaauacauuca

SEQ ID NO: 2235151 - RNA, 17 nt, Homo sapiens
aggagaagaagguuucu

SEQ ID NO: 2235152 - RNA, 15 nt, Homo sapiens
guaguccguuaacac

SEQ ID NO: 2235153 - RNA, 14 nt, Homo sapiens
guuugagugucugc

SEQ ID NO: 2235154 - RNA, 21 nt, Homo sapiens
cugcacuugggggcucagcaa

SEQ ID NO: 2235155 - RNA, 18 nt, Homo sapiens
ccagcuuuggcugcugaa

SEQ ID NO: 2235156 - RNA, 21 nt, Homo sapiens
ccuggcagggcucacacuccu

SEQ ID NO: 2235157 - RNA, 23 nt, Homo sapiens
uuuuuaggcuguuccuuguacuc

SEQ ID NO: 2235158 - RNA, 18 nt, Homo sapiens
ugucuaguuugcauacuu

SEQ ID NO: 2235159 - RNA, 18 nt, Homo sapiens
auuguaacuuggauguag

SEQ ID NO: 2235160 - RNA, 17 nt, Homo sapiens
auuuaugaugcaguuuc

SEQ ID NO: 2235161 - RNA, 19 nt, Homo sapiens
accaaagcugcugcacagc

SEQ ID NO: 2235162 - RNA, 15 nt, Homo sapiens
cuaaaauucagguau

SEQ ID NO: 2235163 - RNA, 19 nt, Homo sapiens
ggaggugggguacauuucu

SEQ ID NO: 2235164 - RNA, 11 nt, Homo sapiens
aggaucucagg

SEQ ID NO: 2235165 - RNA, 11 nt, Homo sapiens
cauaucuccau

SEQ ID NO: 2235166 - RNA, 22 nt, Homo sapiens
uauaagcucaauuuaauuuugc

SEQ ID NO: 2235167 - RNA, 16 nt, Homo sapiens
agacuuguauauucua

SEQ ID NO: 2235168 - RNA, 16 nt, Homo sapiens
ucacaagaaugugcag

SEQ ID NO: 2235169 - RNA, 16 nt, Homo sapiens
cuucagaauagaaacu

SEQ ID NO: 2235170 - RNA, 21 nt, Homo sapiens
ucuaacuuuaugaacucccuc

SEQ ID NO: 2235171 - RNA, 18 nt, Homo sapiens
auccaacuggaaauucca

SEQ ID NO: 2235172 - RNA, 14 nt, Homo sapiens
aguggcuucaucug

SEQ ID NO: 2235173 - RNA, 14 nt, Homo sapiens
gucucuggcgugug

SEQ ID NO: 2235174 - RNA, 23 nt, Homo sapiens
ucugugaaagucuccuguaucau

SEQ ID NO: 2235175 - RNA, 22 nt, Homo sapiens
uguacgaaucgaauacaaauca

SEQ ID NO: 2235176 - RNA, 19 nt, Homo sapiens
uccauagcaccauuccuca

SEQ ID NO: 2235177 - RNA, 17 nt, Homo sapiens
acuucuaccuacauauu

SEQ ID NO: 2235178 - RNA, 23 nt, Homo sapiens
cuuggggagaccucuacugccuu

SEQ ID NO: 2235179 - RNA, 21 nt, Homo sapiens
ccugucuuaauuuucuuucac

SEQ ID NO: 2235180 - RNA, 14 nt, Homo sapiens
ugcccucucugagu

SEQ ID NO: 2235181 - RNA, 12 nt, Homo sapiens
ccaugacugugu

SEQ ID NO: 2235182 - RNA, 12 nt, Homo sapiens
ccaggacugugg

SEQ ID NO: 2235183 - RNA, 18 nt, Homo sapiens
guccucuuccaccacaga

SEQ ID NO: 2235184 - RNA, 22 nt, Homo sapiens
ugcugaggagaguggaacagaa

SEQ ID NO: 2235185 - RNA, 13 nt, Homo sapiens
acuaugaucacag

SEQ ID NO: 2235186 - RNA, 19 nt, Homo sapiens
uagcaaauggcagaaccaa

SEQ ID NO: 2235187 - RNA, 15 nt, Homo sapiens
ucaagcagaucugcu

SEQ ID NO: 2235188 - RNA, 15 nt, Homo sapiens
aauaaagcaucucau

SEQ ID NO: 2235189 - RNA, 22 nt, Homo sapiens
ccaaggcuuuugcaaagauaug

SEQ ID NO: 2235190 - RNA, 13 nt, Homo sapiens
agccuccagcugc

SEQ ID NO: 2235191 - RNA, 15 nt, Homo sapiens
ucauauucauaugca

SEQ ID NO: 2235192 - RNA, 18 nt, Homo sapiens
ggccuucggccuccaucc

SEQ ID NO: 2235193 - RNA, 14 nt, Homo sapiens
ucagcacuccucau

SEQ ID NO: 2235194 - RNA, 20 nt, Homo sapiens
acacucgccuucugcuucca

SEQ ID NO: 2235195 - RNA, 17 nt, Homo sapiens
ccagccaugucugcauu

SEQ ID NO: 2235196 - RNA, 16 nt, Homo sapiens
uacccggcccagagac

SEQ ID NO: 2235197 - RNA, 20 nt, Homo sapiens
ucuagguggagguugugcau

SEQ ID NO: 2235198 - RNA, 19 nt, Homo sapiens
gccuuccuuucuccaggac

SEQ ID NO: 2235199 - RNA, 16 nt, Homo sapiens
agggaggucacuggaa

SEQ ID NO: 2235200 - RNA, 16 nt, Homo sapiens
uggcauucacacagcc

SEQ ID NO: 2235201 - RNA, 19 nt, Homo sapiens
agugaccaccaacauucug

SEQ ID NO: 2235202 - RNA, 12 nt, Homo sapiens
gaagcauaguga

SEQ ID NO: 2235203 - RNA, 18 nt, Homo sapiens
acugcacagugcaucuca

SEQ ID NO: 2235204 - RNA, 17 nt, Homo sapiens
gcacaguaaaaauggaa

SEQ ID NO: 2235205 - RNA, 22 nt, Homo sapiens
uuacaaauagaagcuucuugcu

SEQ ID NO: 2235206 - RNA, 15 nt, Homo sapiens
augugucucaggcac

SEQ ID NO: 2235207 - RNA, 18 nt, Homo sapiens
aggugggcggaucacuug

SEQ ID NO: 2235208 - RNA, 14 nt, Homo sapiens
aaugaauguuccac

SEQ ID NO: 2235209 - RNA, 10 nt, Homo sapiens
guacucagua

SEQ ID NO: 2235210 - RNA, 21 nt, Homo sapiens
ucgcccaggcuggagugcaau

SEQ ID NO: 2235211 - RNA, 17 nt, Homo sapiens
aggaggccccuggccca

SEQ ID NO: 2235212 - RNA, 22 nt, Homo sapiens
cuaugcaacagcucucaccuac

SEQ ID NO: 2235213 - RNA, 14 nt, Homo sapiens
aguuugaccucaca

SEQ ID NO: 2235214 - RNA, 15 nt, Homo sapiens
aggugugguggcuca

SEQ ID NO: 2235215 - RNA, 17 nt, Homo sapiens
acaugugcccucugcca

SEQ ID NO: 2235216 - RNA, 15 nt, Homo sapiens
augacgucaucauca

SEQ ID NO: 2235217 - RNA, 14 nt, Homo sapiens
ugaugcccagcuca

SEQ ID NO: 2235218 - RNA, 14 nt, Homo sapiens
gcauaacaaaaaga

SEQ ID NO: 2235219 - RNA, 16 nt, Homo sapiens
acagaacacacugaga

SEQ ID NO: 2235220 - RNA, 22 nt, Homo sapiens
auacugggucugcgaugcagcg

SEQ ID NO: 2235221 - RNA, 21 nt, Homo sapiens
ggcucuaauguacaauaaagc

SEQ ID NO: 2235222 - RNA, 17 nt, Homo sapiens
auaaucuacuguacaca

SEQ ID NO: 2235223 - RNA, 14 nt, Homo sapiens
uuguaaacacuuuu

SEQ ID NO: 2235224 - RNA, 13 nt, Homo sapiens
gaaagaccaggcc

SEQ ID NO: 2235225 - RNA, 11 nt, Homo sapiens
agagaccucca

SEQ ID NO: 2235226 - RNA, 12 nt, Homo sapiens
gugaagggaugg

SEQ ID NO: 2235227 - RNA, 15 nt, Homo sapiens
cauccuaacaugaca

SEQ ID NO: 2235228 - RNA, 18 nt, Homo sapiens
cagcucuguguugccaug

SEQ ID NO: 2235229 - RNA, 20 nt, Homo sapiens
accccuucgacaugcugcca

SEQ ID NO: 2235230 - RNA, 23 nt, Homo sapiens
cuguguaauaucaaacacaauua

SEQ ID NO: 2235231 - RNA, 14 nt, Homo sapiens
aggacccugugagc

SEQ ID NO: 2235232 - RNA, 15 nt, Homo sapiens
accaacauggugaaa

SEQ ID NO: 2235233 - RNA, 16 nt, Homo sapiens
gauacgcugcucucau

SEQ ID NO: 2235234 - RNA, 16 nt, Homo sapiens
gucuuacaacugacug

SEQ ID NO: 2235235 - RNA, 15 nt, Homo sapiens
acuuccaugauacuu

SEQ ID NO: 2235236 - RNA, 19 nt, Homo sapiens
ugguaccacuggaaucgau

SEQ ID NO: 2235237 - RNA, 22 nt, Homo sapiens
cagaugauauaauuuaacugug

SEQ ID NO: 2235238 - RNA, 17 nt, Homo sapiens
gucaagcugaaaacaaa

SEQ ID NO: 2235239 - RNA, 17 nt, Homo sapiens
ugauuagagcugcauaa

SEQ ID NO: 2235240 - RNA, 16 nt, Homo sapiens
ugaaaccuuccucuug

SEQ ID NO: 2235241 - RNA, 17 nt, Homo sapiens
aucguuguuuacagugu

SEQ ID NO: 2235242 - RNA, 21 nt, Homo sapiens
cccucuccugcccaagcacuu

SEQ ID NO: 2235243 - RNA, 16 nt, Homo sapiens
gagaguaaaccuugaa

SEQ ID NO: 2235244 - RNA, 20 nt, Homo sapiens
uuucagcaacaaccaucuca

SEQ ID NO: 2235245 - RNA, 13 nt, Homo sapiens
uucagugcaguga

SEQ ID NO: 2235246 - RNA, 16 nt, Homo sapiens
gacccagcacugccca

SEQ ID NO: 2235247 - RNA, 16 nt, Homo sapiens
uuagccagauuugucu

SEQ ID NO: 2235248 - RNA, 15 nt, Homo sapiens
gugaagucucugggu

SEQ ID NO: 2235249 - RNA, 22 nt, Homo sapiens
cagcauggaugugucucaggca

SEQ ID NO: 2235250 - RNA, 14 nt, Homo sapiens
guuuaaugcaaaug

SEQ ID NO: 2235251 - RNA, 20 nt, Homo sapiens
cuuaacaacagcuucuugcu

SEQ ID NO: 2235252 - RNA, 22 nt, Homo sapiens
acuauuguuacauuauguggaa

SEQ ID NO: 2235253 - RNA, 17 nt, Homo sapiens
uaugagcuucuaacuca

SEQ ID NO: 2235254 - RNA, 20 nt, Homo sapiens
aacuccgcugccuuccuuag

SEQ ID NO: 2235255 - RNA, 13 nt, Homo sapiens
uauguacuuuuau

SEQ ID NO: 2235256 - RNA, 13 nt, Homo sapiens
cuuacaacccagg

SEQ ID NO: 2235257 - RNA, 18 nt, Homo sapiens
aucuacuucaacacuuca

SEQ ID NO: 2235258 - RNA, 18 nt, Homo sapiens
ggcaacaucagcaucacu

SEQ ID NO: 2235259 - RNA, 19 nt, Homo sapiens
cuaagcaagugaacucauc

SEQ ID NO: 2235260 - RNA, 20 nt, Homo sapiens
aacuucuaaacacaaauaaa

SEQ ID NO: 2235261 - RNA, 12 nt, Homo sapiens
uuggaacccaag

SEQ ID NO: 2235262 - RNA, 16 nt, Homo sapiens
caucagaaguuugcau

SEQ ID NO: 2235263 - RNA, 16 nt, Homo sapiens
aauuucagaguuuuua

SEQ ID NO: 2235264 - RNA, 22 nt, Homo sapiens
uuucagugcauuaucuacuugu

SEQ ID NO: 2235265 - RNA, 20 nt, Homo sapiens
accugccuuauccuguucua

SEQ ID NO: 2235266 - RNA, 15 nt, Homo sapiens
ucuuugcaccaaaga

SEQ ID NO: 2235267 - RNA, 17 nt, Homo sapiens
uuacaucacuuugugaa

SEQ ID NO: 2235268 - RNA, 13 nt, Homo sapiens
accccauuccugu

SEQ ID NO: 2235269 - RNA, 17 nt, Homo sapiens
ugaauugggaucugauu

SEQ ID NO: 2235270 - RNA, 23 nt, Homo sapiens
ggucaaccugcucacuguucuau

SEQ ID NO: 2235271 - RNA, 18 nt, Homo sapiens
uaaaugauuauauucaca

SEQ ID NO: 2235272 - RNA, 18 nt, Homo sapiens
gcacagaagcucaucuca

SEQ ID NO: 2235273 - RNA, 20 nt, Homo sapiens
cucccugccuggauccagcu

SEQ ID NO: 2235274 - RNA, 16 nt, Homo sapiens
gaugagccgcugugag

SEQ ID NO: 2235275 - RNA, 19 nt, Homo sapiens
acaggcuggagugcagugg

SEQ ID NO: 2235276 - RNA, 15 nt, Homo sapiens
ucugagccaagggag

SEQ ID NO: 2235277 - RNA, 15 nt, Homo sapiens
ugagcagauguaaua

SEQ ID NO: 2235278 - RNA, 20 nt, Homo sapiens
cuaauucuguaggacuuuga

SEQ ID NO: 2235279 - RNA, 18 nt, Homo sapiens
gaaguuaacagucucauu

SEQ ID NO: 2235280 - RNA, 23 nt, Homo sapiens
gcuucuguccucuucugugaguc

SEQ ID NO: 2235281 - RNA, 18 nt, Homo sapiens
accuuggacugacuacca

SEQ ID NO: 2235282 - RNA, 22 nt, Homo sapiens
uaacaucucuuucaucuagcuc

SEQ ID NO: 2235283 - RNA, 15 nt, Homo sapiens
aaaacaaaaaaccac

SEQ ID NO: 2235284 - RNA, 15 nt, Homo sapiens
ccaggggagugugaa

SEQ ID NO: 2235285 - RNA, 19 nt, Homo sapiens
accacauguguuucugucu

SEQ ID NO: 2235286 - RNA, 21 nt, Homo sapiens
uaaguucaagaagacuauggu

SEQ ID NO: 2235287 - RNA, 13 nt, Homo sapiens
gugcuccuggaaa

SEQ ID NO: 2235288 - RNA, 14 nt, Homo sapiens
ucagucuacacuca

SEQ ID NO: 2235289 - RNA, 22 nt, Homo sapiens
ggcacagcugucugccaggcac

SEQ ID NO: 2235290 - RNA, 22 nt, Homo sapiens
gaaaauguguaauucaaaagau

SEQ ID NO: 2235291 - RNA, 23 nt, Homo sapiens
gcuuagaaaauucaagcauuuag

SEQ ID NO: 2235292 - RNA, 22 nt, Homo sapiens
auguuuagauuuuuuuauuuga

SEQ ID NO: 2235293 - RNA, 23 nt, Homo sapiens
uuucacuaauuuaaguacuugag

SEQ ID NO: 2235294 - RNA, 13 nt, Homo sapiens
aaacauaagccac

SEQ ID NO: 2235295 - RNA, 14 nt, Homo sapiens
cugucuuuaauucu

SEQ ID NO: 2235296 - RNA, 14 nt, Homo sapiens
uggccacacuguca

SEQ ID NO: 2235297 - RNA, 17 nt, Homo sapiens
aucuuuuaagcuaucua

SEQ ID NO: 2235298 - RNA, 18 nt, Homo sapiens
uaccuccugucuuuacaa

SEQ ID NO: 2235299 - RNA, 21 nt, Homo sapiens
caacaggcuguucugcacuga

SEQ ID NO: 2235300 - RNA, 14 nt, Homo sapiens
uccuugucacuuua

SEQ ID NO: 2235301 - RNA, 20 nt, Homo sapiens
agcaacuucuucuccauccc

SEQ ID NO: 2235302 - RNA, 18 nt, Homo sapiens
cuucaagccugugcaaug

SEQ ID NO: 2235303 - RNA, 22 nt, Homo sapiens
accccaagaguuuugggaguug

SEQ ID NO: 2235304 - RNA, 18 nt, Homo sapiens
cuacacccuggcccagcu

SEQ ID NO: 2235305 - RNA, 22 nt, Homo sapiens
ugcuuaguaaugcuacguguga

SEQ ID NO: 2235306 - RNA, 23 nt, Homo sapiens
ugcuacuuguggaccucaccaga

SEQ ID NO: 2235307 - RNA, 18 nt, Homo sapiens
accaaguuaucaucucac

SEQ ID NO: 2235308 - RNA, 20 nt, Homo sapiens
agcugguauggccuuaccuu

SEQ ID NO: 2235309 - RNA, 19 nt, Homo sapiens
cuuuaaucuccuuuacuag

SEQ ID NO: 2235310 - RNA, 23 nt, Homo sapiens
ugaugaucuagccuccaucauga

SEQ ID NO: 2235311 - RNA, 17 nt, Homo sapiens
cucgcagccucucagug

SEQ ID NO: 2235312 - RNA, 22 nt, Homo sapiens
acgaccggggccagcaccacuu

SEQ ID NO: 2235313 - RNA, 20 nt, Homo sapiens
cacuugaaagugaacaauca

SEQ ID NO: 2235314 - RNA, 16 nt, Homo sapiens
gaauggucucugucaa

SEQ ID NO: 2235315 - RNA, 23 nt, Homo sapiens
aaagaccugcuguaauaaaugua

SEQ ID NO: 2235316 - RNA, 19 nt, Homo sapiens
agugcugaaggaauggaag

SEQ ID NO: 2235317 - RNA, 19 nt, Homo sapiens
agcuucagauaccaugcaa

SEQ ID NO: 2235318 - RNA, 19 nt, Homo sapiens
accuccuucuuccuagcca

SEQ ID NO: 2235319 - RNA, 15 nt, Homo sapiens
aaggaagauggagcu

SEQ ID NO: 2235320 - RNA, 20 nt, Homo sapiens
agaguauauuccucugcuga

SEQ ID NO: 2235321 - RNA, 22 nt, Homo sapiens
gauucucccuuuaugaagcugc

SEQ ID NO: 2235322 - RNA, 20 nt, Homo sapiens
agugggcuucggagugaaug

SEQ ID NO: 2235323 - RNA, 15 nt, Homo sapiens
gucauaauguuuauu

SEQ ID NO: 2235324 - RNA, 22 nt, Homo sapiens
agcaugaaauguccucuugaag

SEQ ID NO: 2235325 - RNA, 18 nt, Homo sapiens
ugugcauugaauacucug

SEQ ID NO: 2235326 - RNA, 21 nt, Homo sapiens
cugcacaugauuucacaaaua

SEQ ID NO: 2235327 - RNA, 23 nt, Homo sapiens
gauuuccuccucccagugccuuc

SEQ ID NO: 2235328 - RNA, 18 nt, Homo sapiens
ucauuaguagagcaguau

SEQ ID NO: 2235329 - RNA, 13 nt, Homo sapiens
ccggacggcgggu

SEQ ID NO: 2235330 - RNA, 16 nt, Homo sapiens
cguuugugauugccau

SEQ ID NO: 2235331 - RNA, 20 nt, Homo sapiens
guagugcaccaucucacugc

SEQ ID NO: 2235332 - RNA, 20 nt, Homo sapiens
ccuggagaugcugccuggug

SEQ ID NO: 2235333 - RNA, 14 nt, Homo sapiens
gggaucugccauug

SEQ ID NO: 2235334 - RNA, 19 nt, Homo sapiens
aggccuuuccccagugugg

SEQ ID NO: 2235335 - RNA, 15 nt, Homo sapiens
acaucucaacaggcc

SEQ ID NO: 2235336 - RNA, 15 nt, Homo sapiens
ugcaaaggacagauc

SEQ ID NO: 2235337 - RNA, 23 nt, Homo sapiens
cuauugaguuacaggggauuuua

SEQ ID NO: 2235338 - RNA, 22 nt, Homo sapiens
gacggucaguccaugucucgga

SEQ ID NO: 2235339 - RNA, 15 nt, Homo sapiens
caguauaagccuuuu

SEQ ID NO: 2235340 - RNA, 13 nt, Homo sapiens
gauaauaguuuac

SEQ ID NO: 2235341 - RNA, 21 nt, Homo sapiens
aaagaaaauuccuauaaggaa

SEQ ID NO: 2235342 - RNA, 15 nt, Homo sapiens
uauauguacuagcau

SEQ ID NO: 2235343 - RNA, 12 nt, Homo sapiens
uguuugcaaugu

SEQ ID NO: 2235344 - RNA, 12 nt, Homo sapiens
agucugcauugc

SEQ ID NO: 2235345 - RNA, 14 nt, Homo sapiens
uuguugacugugau

SEQ ID NO: 2235346 - RNA, 21 nt, Homo sapiens
aguuaaaacucaucacauaaa

SEQ ID NO: 2235347 - RNA, 12 nt, Homo sapiens
ugagcaacucuu

SEQ ID NO: 2235348 - RNA, 13 nt, Homo sapiens
uaauuuaugcaag

SEQ ID NO: 2235349 - RNA, 23 nt, Homo sapiens
gccggucccccaugccaccaccc

SEQ ID NO: 2235350 - RNA, 15 nt, Homo sapiens
auggugccugggcug

SEQ ID NO: 2235351 - RNA, 22 nt, Homo sapiens
auguccaugauggaauauuccc

SEQ ID NO: 2235352 - RNA, 16 nt, Homo sapiens
augcacccaccucagc

SEQ ID NO: 2235353 - RNA, 13 nt, Homo sapiens
caaaucucucaua

SEQ ID NO: 2235354 - RNA, 16 nt, Homo sapiens
ccuggucccaagacag

SEQ ID NO: 2235355 - RNA, 17 nt, Homo sapiens
ccaaacaaagcaaaaaa

SEQ ID NO: 2235356 - RNA, 16 nt, Homo sapiens
ugcgcuguaguaggca

SEQ ID NO: 2235357 - RNA, 19 nt, Homo sapiens
gagugucaugaagugcaca

SEQ ID NO: 2235358 - RNA, 19 nt, Homo sapiens
ucacagaugaagacaucag

SEQ ID NO: 2235359 - RNA, 13 nt, Homo sapiens
gauauuaaaggag

SEQ ID NO: 2235360 - RNA, 18 nt, Homo sapiens
gugucuccagccuggcuc

SEQ ID NO: 2235361 - RNA, 14 nt, Homo sapiens
uaccuuuucagggc

SEQ ID NO: 2235362 - RNA, 17 nt, Homo sapiens
auaaauucagauauauu

SEQ ID NO: 2235363 - RNA, 17 nt, Homo sapiens
cuccaagacagauuuuc

SEQ ID NO: 2235364 - RNA, 22 nt, Homo sapiens
ggcuccucuaggcccugugagc

SEQ ID NO: 2235365 - RNA, 13 nt, Homo sapiens
cccccugugccca

SEQ ID NO: 2235366 - RNA, 18 nt, Homo sapiens
gagcuuuguccugaagga

SEQ ID NO: 2235367 - RNA, 15 nt, Homo sapiens
gaagucauaaacagc

SEQ ID NO: 2235368 - RNA, 16 nt, Homo sapiens
accacuguguauuuaa

SEQ ID NO: 2235369 - RNA, 20 nt, Homo sapiens
guaauguuaguaaauccaug

SEQ ID NO: 2235370 - RNA, 16 nt, Homo sapiens
gccuaacuaacuggca

SEQ ID NO: 2235371 - RNA, 19 nt, Homo sapiens
uacaguuugucacaugaaa

SEQ ID NO: 2235372 - RNA, 20 nt, Homo sapiens
uuccacagaauacaagccac

SEQ ID NO: 2235373 - RNA, 15 nt, Homo sapiens
cagaugcacacacag

SEQ ID NO: 2235374 - RNA, 23 nt, Homo sapiens
uagugccaggaaacuaauuuccu

SEQ ID NO: 2235375 - RNA, 21 nt, Homo sapiens
aguuuuuauucaaagcagcug

SEQ ID NO: 2235376 - RNA, 18 nt, Homo sapiens
aaauaucaaagucauuaa

SEQ ID NO: 2235377 - RNA, 17 nt, Homo sapiens
cuaagccaguucuuaag

SEQ ID NO: 2235378 - RNA, 21 nt, Homo sapiens
agcaaggaguuuaaaugagac

SEQ ID NO: 2235379 - RNA, 17 nt, Homo sapiens
cuaaaguauaucuuuaa

SEQ ID NO: 2235380 - RNA, 15 nt, Homo sapiens
agcgcggacaucccc

SEQ ID NO: 2235381 - RNA, 19 nt, Homo sapiens
acugcuucuaccaacugga

SEQ ID NO: 2235382 - RNA, 17 nt, Homo sapiens
cugucuucaacagcucc

SEQ ID NO: 2235383 - RNA, 14 nt, Homo sapiens
caucaaggucuuug

SEQ ID NO: 2235384 - RNA, 23 nt, Homo sapiens
gucuauuguauauauaaucuaua

SEQ ID NO: 2235385 - RNA, 18 nt, Homo sapiens
ucuugcaagcaacaagcu

SEQ ID NO: 2235386 - RNA, 12 nt, Homo sapiens
uaauuacauucc

SEQ ID NO: 2235387 - RNA, 15 nt, Homo sapiens
caugaaaaguuuuca

SEQ ID NO: 2235388 - RNA, 14 nt, Homo sapiens
auggaggccuccuu

SEQ ID NO: 2235389 - RNA, 20 nt, Homo sapiens
aguccagagcuggaucucuc

SEQ ID NO: 2235390 - RNA, 23 nt, Homo sapiens
uccugcucucccacugcacacag

SEQ ID NO: 2235391 - RNA, 18 nt, Homo sapiens
gaagauguaagaagcuaa

SEQ ID NO: 2235392 - RNA, 18 nt, Homo sapiens
auuuaaacaccuccucau

SEQ ID NO: 2235393 - RNA, 13 nt, Homo sapiens
aaugaguaaugca

SEQ ID NO: 2235394 - RNA, 17 nt, Homo sapiens
guauuaugacacuccca

SEQ ID NO: 2235395 - RNA, 18 nt, Homo sapiens
auuucagcaacaaccauc

SEQ ID NO: 2235396 - RNA, 18 nt, Homo sapiens
gugacgugguagucacuu

SEQ ID NO: 2235397 - RNA, 20 nt, Homo sapiens
cuuucaagcuucuugccagu

SEQ ID NO: 2235398 - RNA, 11 nt, Homo sapiens
cuuccuuucau

SEQ ID NO: 2235399 - RNA, 19 nt, Homo sapiens
gccauuccacuccacucag

SEQ ID NO: 2235400 - RNA, 21 nt, Homo sapiens
uucaaagcacauaugugccaa

SEQ ID NO: 2235401 - RNA, 16 nt, Homo sapiens
caguuuuuaacauaau

SEQ ID NO: 2235402 - RNA, 16 nt, Homo sapiens
accaucacugccauca

SEQ ID NO: 2235403 - RNA, 13 nt, Homo sapiens
acuuauccugaca

SEQ ID NO: 2235404 - RNA, 15 nt, Homo sapiens
gaugugccuagacac

SEQ ID NO: 2235405 - RNA, 21 nt, Homo sapiens
aauguucucaugaacuacccc

SEQ ID NO: 2235406 - RNA, 18 nt, Homo sapiens
agacucugguauggccaa

SEQ ID NO: 2235407 - RNA, 14 nt, Homo sapiens
cagcuggugcucca

SEQ ID NO: 2235408 - RNA, 22 nt, Homo sapiens
ucucaaaugcuggcaaauccag

SEQ ID NO: 2235409 - RNA, 17 nt, Homo sapiens
uucuggggugggaauca

SEQ ID NO: 2235410 - RNA, 18 nt, Homo sapiens
ugaagagcaaaaauaucc

SEQ ID NO: 2235411 - RNA, 13 nt, Homo sapiens
ccccucuccuccg

SEQ ID NO: 2235412 - RNA, 19 nt, Homo sapiens
acacucgggcccaugggau

SEQ ID NO: 2235413 - RNA, 14 nt, Homo sapiens
gguucugccucucc

SEQ ID NO: 2235414 - RNA, 21 nt, Homo sapiens
uugguguacuguaaugugaau

SEQ ID NO: 2235415 - RNA, 14 nt, Homo sapiens
cuguggucacuuau

SEQ ID NO: 2235416 - RNA, 18 nt, Homo sapiens
uugccaaaauaccagagc

SEQ ID NO: 2235417 - RNA, 14 nt, Homo sapiens
uuucucuacuuuaa

SEQ ID NO: 2235418 - RNA, 14 nt, Homo sapiens
uuucuauacuuuac

SEQ ID NO: 2235419 - RNA, 15 nt, Homo sapiens
gccuuagugggccag

SEQ ID NO: 2235420 - RNA, 12 nt, Homo sapiens
cugaucugugau

SEQ ID NO: 2235421 - RNA, 20 nt, Homo sapiens
ugcugccaaccauaccuucc

SEQ ID NO: 2235422 - RNA, 15 nt, Homo sapiens
uccauguugcugcca

SEQ ID NO: 2235423 - RNA, 23 nt, Homo sapiens
gccaggcauucaauccucagguc

SEQ ID NO: 2235424 - RNA, 16 nt, Homo sapiens
aagcauagcuacaauu

SEQ ID NO: 2235425 - RNA, 21 nt, Homo sapiens
cuguccuggaaccugucucca

SEQ ID NO: 2235426 - RNA, 15 nt, Homo sapiens
cuugcuuuccccggg

SEQ ID NO: 2235427 - RNA, 13 nt, Homo sapiens
acuguuucuugcu

SEQ ID NO: 2235428 - RNA, 18 nt, Homo sapiens
cugcagucacaucacaau

SEQ ID NO: 2235429 - RNA, 15 nt, Homo sapiens
ucucucuacugcugg

SEQ ID NO: 2235430 - RNA, 17 nt, Homo sapiens
cgcacccuggcuggaau

SEQ ID NO: 2235431 - RNA, 13 nt, Homo sapiens
augcacacaaaac

SEQ ID NO: 2235432 - RNA, 21 nt, Homo sapiens
gaacaguaaagaaagcagaau

SEQ ID NO: 2235433 - RNA, 21 nt, Homo sapiens
uuucaucccagaaacuccaga

SEQ ID NO: 2235434 - RNA, 15 nt, Homo sapiens
uaaagugcucuuaua

SEQ ID NO: 2235435 - RNA, 18 nt, Homo sapiens
gugucauaacuucauaga

SEQ ID NO: 2235436 - RNA, 15 nt, Homo sapiens
agacagaauguaucu

SEQ ID NO: 2235437 - RNA, 13 nt, Homo sapiens
guugaugaggcag

SEQ ID NO: 2235438 - RNA, 19 nt, Homo sapiens
agggcccacccaugucacc

SEQ ID NO: 2235439 - RNA, 13 nt, Homo sapiens
cugaaaaaguguu

SEQ ID NO: 2235440 - RNA, 16 nt, Homo sapiens
ccaucccuauccauag

SEQ ID NO: 2235441 - RNA, 14 nt, Homo sapiens
uuccucugcugcau

SEQ ID NO: 2235442 - RNA, 16 nt, Homo sapiens
uacgucauuugugcaa

SEQ ID NO: 2235443 - RNA, 23 nt, Homo sapiens
ucuucuaaaaugcuuuuaauuaa

SEQ ID NO: 2235444 - RNA, 15 nt, Homo sapiens
cuaugaugugaaaca

SEQ ID NO: 2235445 - RNA, 21 nt, Homo sapiens
acugccaagccauacuuauua

SEQ ID NO: 2235446 - RNA, 16 nt, Homo sapiens
cuucugggaacuuccu

SEQ ID NO: 2235447 - RNA, 15 nt, Homo sapiens
ucuguauguguucaa

SEQ ID NO: 2235448 - RNA, 18 nt, Homo sapiens
aauaacgugcaugcuuua

SEQ ID NO: 2235449 - RNA, 14 nt, Homo sapiens
cagccucccugaag

SEQ ID NO: 2235450 - RNA, 13 nt, Homo sapiens
uucaaaccuaaaa

SEQ ID NO: 2235451 - RNA, 17 nt, Homo sapiens
uagaauuauaucacuuc

SEQ ID NO: 2235452 - RNA, 18 nt, Homo sapiens
ggcuguauuuaauggcau

SEQ ID NO: 2235453 - RNA, 18 nt, Homo sapiens
ugaguccaucuaacauca

SEQ ID NO: 2235454 - RNA, 12 nt, Homo sapiens
gcccucugcucu

SEQ ID NO: 2235455 - RNA, 13 nt, Homo sapiens
aaauuguguauga

SEQ ID NO: 2235456 - RNA, 15 nt, Homo sapiens
cauucuucagauaua

SEQ ID NO: 2235457 - RNA, 15 nt, Homo sapiens
caagaaucagugcaa

SEQ ID NO: 2235458 - RNA, 18 nt, Homo sapiens
uaaguugcaccaacuuug

SEQ ID NO: 2235459 - RNA, 14 nt, Homo sapiens
gcagacaguagaca

SEQ ID NO: 2235460 - RNA, 15 nt, Homo sapiens
gaagaauuggaauaa

SEQ ID NO: 2235461 - RNA, 20 nt, Homo sapiens
aacgguuaagaaagcacuua

SEQ ID NO: 2235462 - RNA, 19 nt, Homo sapiens
uacugguaggaacuugaga

SEQ ID NO: 2235463 - RNA, 22 nt, Homo sapiens
cucuggagcaagcccugaccca

SEQ ID NO: 2235464 - RNA, 16 nt, Homo sapiens
uacugcuuacuguugc

SEQ ID NO: 2235465 - RNA, 20 nt, Homo sapiens
guugguggcaagcugcaaag

SEQ ID NO: 2235466 - RNA, 19 nt, Homo sapiens
ccucaagguguucucugua

SEQ ID NO: 2235467 - RNA, 16 nt, Homo sapiens
cagaaaaucuaccaag

SEQ ID NO: 2235468 - RNA, 23 nt, Homo sapiens
uugcuaccaaguuucauaccaaa

SEQ ID NO: 2235469 - RNA, 14 nt, Homo sapiens
cucauggugaaauc

SEQ ID NO: 2235470 - RNA, 22 nt, Homo sapiens
uacagcuaaucagcauucucac

SEQ ID NO: 2235471 - RNA, 13 nt, Homo sapiens
auucaaaaagcca

SEQ ID NO: 2235472 - RNA, 21 nt, Homo sapiens
gaaaauucuguagguucugug

SEQ ID NO: 2235473 - RNA, 14 nt, Homo sapiens
uugauuucuaauga

SEQ ID NO: 2235474 - RNA, 15 nt, Homo sapiens
cacuuuccuuucaau

SEQ ID NO: 2235475 - RNA, 16 nt, Homo sapiens
cuagcaccuccccaga

SEQ ID NO: 2235476 - RNA, 23 nt, Homo sapiens
uggaauacauuucuccuuugaua

SEQ ID NO: 2235477 - RNA, 20 nt, Homo sapiens
agcaacuguuuaaccuguuu

SEQ ID NO: 2235478 - RNA, 21 nt, Homo sapiens
cuagaaacacacauuucuuug

SEQ ID NO: 2235479 - RNA, 12 nt, Homo sapiens
cauucauuccau

SEQ ID NO: 2235480 - RNA, 13 nt, Homo sapiens
ugagcuacaguag

SEQ ID NO: 2235481 - RNA, 19 nt, Homo sapiens
uguggacuguggcacuugc

SEQ ID NO: 2235482 - RNA, 19 nt, Homo sapiens
cagacagugucagagucau

SEQ ID NO: 2235483 - RNA, 13 nt, Homo sapiens
aaccaacugcccc

SEQ ID NO: 2235484 - RNA, 13 nt, Homo sapiens
aacucacugccua

SEQ ID NO: 2235485 - RNA, 13 nt, Homo sapiens
aauuaacugcuuc

SEQ ID NO: 2235486 - RNA, 13 nt, Homo sapiens
gaagaacuacagc

SEQ ID NO: 2235487 - RNA, 12 nt, Homo sapiens
aguuaagacaug

SEQ ID NO: 2235488 - RNA, 18 nt, Homo sapiens
acccagcaacacagagcu

SEQ ID NO: 2235489 - RNA, 15 nt, Homo sapiens
uaugauugugcacau

SEQ ID NO: 2235490 - RNA, 23 nt, Homo sapiens
gacugcugcuucuuaaccccagu

SEQ ID NO: 2235491 - RNA, 14 nt, Homo sapiens
aaauaggugagaua

SEQ ID NO: 2235492 - RNA, 19 nt, Homo sapiens
cuuccuugaagaacugcag

SEQ ID NO: 2235493 - RNA, 15 nt, Homo sapiens
gaacccuucucagac

SEQ ID NO: 2235494 - RNA, 19 nt, Homo sapiens
ugugauguggugcguguga

SEQ ID NO: 2235495 - RNA, 19 nt, Homo sapiens
aaggugggcggaucaccug

SEQ ID NO: 2235496 - RNA, 21 nt, Homo sapiens
cccacagcuucucuacagacu

SEQ ID NO: 2235497 - RNA, 21 nt, Homo sapiens
augugaaaauguaucugagua

SEQ ID NO: 2235498 - RNA, 14 nt, Homo sapiens
aacaguuacaugaa

SEQ ID NO: 2235499 - RNA, 13 nt, Homo sapiens
ugcgcuuaccuuc

SEQ ID NO: 2235500 - RNA, 15 nt, Homo sapiens
ucaguguacauggaa

SEQ ID NO: 2235501 - RNA, 23 nt, Homo sapiens
aaaugcugguuuuucaguuuuca

SEQ ID NO: 2235502 - RNA, 19 nt, Homo sapiens
gucagugcccaacuguuau

SEQ ID NO: 2235503 - RNA, 17 nt, Homo sapiens
uguggcccggagcgucu

SEQ ID NO: 2235504 - RNA, 22 nt, Homo sapiens
ugaggggcgagaaacaagacaa

SEQ ID NO: 2235505 - RNA, 12 nt, Homo sapiens
guacagguguau

SEQ ID NO: 2235506 - RNA, 18 nt, Homo sapiens
uauauuuguugauauuaa

SEQ ID NO: 2235507 - RNA, 19 nt, Homo sapiens
auuuugauaccagugagca

SEQ ID NO: 2235508 - RNA, 17 nt, Homo sapiens
ccacaggaucaucauuu

SEQ ID NO: 2235509 - RNA, 13 nt, Homo sapiens
uacagauacauau

SEQ ID NO: 2235510 - RNA, 21 nt, Homo sapiens
ugauggucucaagcuaugauc

SEQ ID NO: 2235511 - RNA, 12 nt, Homo sapiens
ccuccaccucaa

SEQ ID NO: 2235512 - RNA, 15 nt, Homo sapiens
ugaaacugcugugaa

SEQ ID NO: 2235513 - RNA, 22 nt, Homo sapiens
ugcuaauaugacauaugacaau

SEQ ID NO: 2235514 - RNA, 18 nt, Homo sapiens
aaaugaauccaucauaca

SEQ ID NO: 2235515 - RNA, 17 nt, Homo sapiens
aaagcauggcugagaaa

SEQ ID NO: 2235516 - RNA, 18 nt, Homo sapiens
ucuacugccuuggacaac

SEQ ID NO: 2235517 - RNA, 14 nt, Homo sapiens
uauucaguucccag

SEQ ID NO: 2235518 - RNA, 14 nt, Homo sapiens
aauguuccugaaaa

SEQ ID NO: 2235519 - RNA, 17 nt, Homo sapiens
caagauccucuugccac

SEQ ID NO: 2235520 - RNA, 14 nt, Homo sapiens
uucucaccccagga

SEQ ID NO: 2235521 - RNA, 19 nt, Homo sapiens
agcagcuaucucucaguga

SEQ ID NO: 2235522 - RNA, 14 nt, Homo sapiens
guccugagacuuuu

SEQ ID NO: 2235523 - RNA, 12 nt, Homo sapiens
aucauuuccaug

SEQ ID NO: 2235524 - RNA, 23 nt, Homo sapiens
ccacagccaagguagggucacua

SEQ ID NO: 2235525 - RNA, 15 nt, Homo sapiens
acuucugaagacuga

SEQ ID NO: 2235526 - RNA, 15 nt, Homo sapiens
auguaaaagcacaug

SEQ ID NO: 2235527 - RNA, 21 nt, Homo sapiens
ugaauguuaaacuacucuuga

SEQ ID NO: 2235528 - RNA, 20 nt, Homo sapiens
cugcccaggaaggacugugc

SEQ ID NO: 2235529 - RNA, 14 nt, Homo sapiens
agggagagccagcu

SEQ ID NO: 2235530 - RNA, 16 nt, Homo sapiens
cuuguugaaugucaau

SEQ ID NO: 2235531 - RNA, 22 nt, Homo sapiens
cauguuuauuuauuuccagugg

SEQ ID NO: 2235532 - RNA, 22 nt, Homo sapiens
cuaacaaugacauuuauaucac

SEQ ID NO: 2235533 - RNA, 18 nt, Homo sapiens
cugcuuguuaugcaucau

SEQ ID NO: 2235534 - RNA, 15 nt, Homo sapiens
ucuaugaauugcuaa

SEQ ID NO: 2235535 - RNA, 19 nt, Homo sapiens
gaaaacuagcauuacauua

SEQ ID NO: 2235536 - RNA, 14 nt, Homo sapiens
cuacucuccagcuu

SEQ ID NO: 2235537 - RNA, 13 nt, Homo sapiens
ggccuaccugggg

SEQ ID NO: 2235538 - RNA, 18 nt, Homo sapiens
guuggucaggcgcagugg

SEQ ID NO: 2235539 - RNA, 17 nt, Homo sapiens
gcagguaacuagcugag

SEQ ID NO: 2235540 - RNA, 15 nt, Homo sapiens
uaacuguuaguauua

SEQ ID NO: 2235541 - RNA, 22 nt, Homo sapiens
ucaagcagacauagaagagcca

SEQ ID NO: 2235542 - RNA, 17 nt, Homo sapiens
caagucagcucuucucc

SEQ ID NO: 2235543 - RNA, 13 nt, Homo sapiens
accaauuggauga

SEQ ID NO: 2235544 - RNA, 14 nt, Homo sapiens
gaggccacacuaca

SEQ ID NO: 2235545 - RNA, 20 nt, Homo sapiens
auaaaugaaguauuucucac

SEQ ID NO: 2235546 - RNA, 14 nt, Homo sapiens
ccacuggucaugcc

SEQ ID NO: 2235547 - RNA, 22 nt, Homo sapiens
acuguaauagaucagcauccaa

SEQ ID NO: 2235548 - RNA, 22 nt, Homo sapiens
caaaagaaguaacaagagugau

SEQ ID NO: 2235549 - RNA, 15 nt, Homo sapiens
cacaauacaguacuc

SEQ ID NO: 2235550 - RNA, 15 nt, Homo sapiens
acgguguuuugccau

SEQ ID NO: 2235551 - RNA, 21 nt, Homo sapiens
gaaacucuuaucucagucaug

SEQ ID NO: 2235552 - RNA, 16 nt, Homo sapiens
ccuuugagacuauuga

SEQ ID NO: 2235553 - RNA, 19 nt, Homo sapiens
uaugaaacaaacuacugug

SEQ ID NO: 2235554 - RNA, 18 nt, Homo sapiens
ugcaccgguuucauagac

SEQ ID NO: 2235555 - RNA, 19 nt, Homo sapiens
agcuuauugucuagugaaa

SEQ ID NO: 2235556 - RNA, 20 nt, Homo sapiens
aacacagcaacaaugacuua

SEQ ID NO: 2235557 - RNA, 20 nt, Homo sapiens
ugccucagggcccaccggaa

SEQ ID NO: 2235558 - RNA, 18 nt, Homo sapiens
uguacuugccuuauuaga

SEQ ID NO: 2235559 - RNA, 16 nt, Homo sapiens
gcauucuuuugcacac

SEQ ID NO: 2235560 - RNA, 20 nt, Homo sapiens
cagugaggaauuaaucuugc

SEQ ID NO: 2235561 - RNA, 20 nt, Homo sapiens
cuagaauugguggugagaua

SEQ ID NO: 2235562 - RNA, 21 nt, Homo sapiens
ucagcccucucuugccaaaaa

SEQ ID NO: 2235563 - RNA, 19 nt, Homo sapiens
uccaaguugccacauugcu

SEQ ID NO: 2235564 - RNA, 13 nt, Homo sapiens
cacagcacccaug

SEQ ID NO: 2235565 - RNA, 20 nt, Homo sapiens
ugcccaggcuggaguggagu

SEQ ID NO: 2235566 - RNA, 20 nt, Homo sapiens
agcaggaaggccccucugug

SEQ ID NO: 2235567 - RNA, 17 nt, Homo sapiens
cccacacuucccauuua

SEQ ID NO: 2235568 - RNA, 13 nt, Homo sapiens
aaaggcagcugcc

SEQ ID NO: 2235569 - RNA, 15 nt, Homo sapiens
uugugaugaugcugu

SEQ ID NO: 2235570 - RNA, 20 nt, Homo sapiens
uaaaacaugcuggugaacca

SEQ ID NO: 2235571 - RNA, 14 nt, Homo sapiens
auuuagagucaauu

SEQ ID NO: 2235572 - RNA, 20 nt, Homo sapiens
aucucuggccauauccugcc

SEQ ID NO: 2235573 - RNA, 15 nt, Homo sapiens
aacuuuaaugaacua

SEQ ID NO: 2235574 - RNA, 13 nt, Homo sapiens
uucaaauuauucu

SEQ ID NO: 2235575 - RNA, 18 nt, Homo sapiens
augucaugccucacuuuc

SEQ ID NO: 2235576 - RNA, 22 nt, Homo sapiens
ucccaccaacucugcacuccau

SEQ ID NO: 2235577 - RNA, 18 nt, Homo sapiens
cuguguaucucagcauuu

SEQ ID NO: 2235578 - RNA, 20 nt, Homo sapiens
cccaccuuuggaaagcucug

SEQ ID NO: 2235579 - RNA, 16 nt, Homo sapiens
uauaaaauguaucaac

SEQ ID NO: 2235580 - RNA, 18 nt, Homo sapiens
acccacuucugcacuugc

SEQ ID NO: 2235581 - RNA, 24 nt, Homo sapiens
gagaccuucacagagacacguggc

SEQ ID NO: 2235582 - RNA, 20 nt, Homo sapiens
uccuuggagggacaugacua

SEQ ID NO: 2235583 - RNA, 16 nt, Homo sapiens
uaagguguagccacac

SEQ ID NO: 2235584 - RNA, 20 nt, Homo sapiens
gcuuguuuacagcacuacuc

SEQ ID NO: 2235585 - RNA, 23 nt, Homo sapiens
agaagacccagacggucugugug

SEQ ID NO: 2235586 - RNA, 16 nt, Homo sapiens
gauaauuguacuuuga

SEQ ID NO: 2235587 - RNA, 18 nt, Homo sapiens
gaacacuaguauggccag

SEQ ID NO: 2235588 - RNA, 15 nt, Homo sapiens
agagauuuuccugag

SEQ ID NO: 2235589 - RNA, 13 nt, Homo sapiens
cagugcuacugaa

SEQ ID NO: 2235590 - RNA, 20 nt, Homo sapiens
cuucauugcaguuauuuaga

SEQ ID NO: 2235591 - RNA, 24 nt, Homo sapiens
gagaaugcugaccugacuugccuc

SEQ ID NO: 2235592 - RNA, 11 nt, Homo sapiens
aggucaugccu

SEQ ID NO: 2235593 - RNA, 20 nt, Homo sapiens
ugugguuaacaucucagaaa

SEQ ID NO: 2235594 - RNA, 15 nt, Homo sapiens
agccacaucacuaca

SEQ ID NO: 2235595 - RNA, 19 nt, Homo sapiens
uguaauccuagcacuuugg

SEQ ID NO: 2235596 - RNA, 16 nt, Homo sapiens
ugagaccaaaucuugc

SEQ ID NO: 2235597 - RNA, 19 nt, Homo sapiens
ccaaugggguuguuagcuu

SEQ ID NO: 2235598 - RNA, 23 nt, Homo sapiens
uccccaaacauuaaucaccaaag

SEQ ID NO: 2235599 - RNA, 23 nt, Homo sapiens
gaggccuuauuuugaacugccuc

SEQ ID NO: 2235600 - RNA, 13 nt, Homo sapiens
agaacucuggucu

SEQ ID NO: 2235601 - RNA, 18 nt, Homo sapiens
gggcucuucuuggcagag

SEQ ID NO: 2235602 - RNA, 14 nt, Homo sapiens
cagcuuggggccau

SEQ ID NO: 2235603 - RNA, 15 nt, Homo sapiens
gagacccaacagcag

SEQ ID NO: 2235604 - RNA, 13 nt, Homo sapiens
agucuugugccaa

SEQ ID NO: 2235605 - RNA, 18 nt, Homo sapiens
cugcacacacaugcauac

SEQ ID NO: 2235606 - RNA, 17 nt, Homo sapiens
agaaacaaugacuaauu

SEQ ID NO: 2235607 - RNA, 22 nt, Homo sapiens
uuugcucuuagcugucugcuca

SEQ ID NO: 2235608 - RNA, 19 nt, Homo sapiens
cauuccggaggcuaaauaa

SEQ ID NO: 2235609 - RNA, 23 nt, Homo sapiens
auuucaauacacucaagugccau

SEQ ID NO: 2235610 - RNA, 11 nt, Homo sapiens
cacugcuguua

SEQ ID NO: 2235611 - RNA, 21 nt, Homo sapiens
cuguuuuaaaaaauacaguau

SEQ ID NO: 2235612 - RNA, 19 nt, Homo sapiens
ucaauuccuguccuucaca

SEQ ID NO: 2235613 - RNA, 17 nt, Homo sapiens
agacccaacaggugcug

SEQ ID NO: 2235614 - RNA, 19 nt, Homo sapiens
aguuauuuuaauaccuuua

SEQ ID NO: 2235615 - RNA, 23 nt, Homo sapiens
aaugaagccaagugggauuugca

SEQ ID NO: 2235616 - RNA, 20 nt, Homo sapiens
auugucuguuuggaagacca

SEQ ID NO: 2235617 - RNA, 13 nt, Homo sapiens
agguugugaaaac

SEQ ID NO: 2235618 - RNA, 14 nt, Homo sapiens
cuaauguacuguac

SEQ ID NO: 2235619 - RNA, 16 nt, Homo sapiens
cagccaccaccuggau

SEQ ID NO: 2235620 - RNA, 22 nt, Homo sapiens
ucuuaagcuuccgccgucucaa

SEQ ID NO: 2235621 - RNA, 16 nt, Homo sapiens
ugccucuaugugcaac

SEQ ID NO: 2235622 - RNA, 15 nt, Homo sapiens
cuugguguaaaccau

SEQ ID NO: 2235623 - RNA, 19 nt, Homo sapiens
caggaauugcccauuguuu

SEQ ID NO: 2235624 - RNA, 19 nt, Homo sapiens
auucaagggacccaugagu

SEQ ID NO: 2235625 - RNA, 15 nt, Homo sapiens
ccuugaaaagacauc

SEQ ID NO: 2235626 - RNA, 16 nt, Homo sapiens
aagaaagauugcuaua

SEQ ID NO: 2235627 - RNA, 13 nt, Homo sapiens
uacucugcugcaa

SEQ ID NO: 2235628 - RNA, 23 nt, Homo sapiens
agcacccuugcccggcugugauu

SEQ ID NO: 2235629 - RNA, 21 nt, Homo sapiens
uuuguaaaacaaugccaugaa

SEQ ID NO: 2235630 - RNA, 19 nt, Homo sapiens
uuuuuccuuugaacuuuga

SEQ ID NO: 2235631 - RNA, 15 nt, Homo sapiens
ggaggccuaccucuc

SEQ ID NO: 2235632 - RNA, 15 nt, Homo sapiens
guucuaggcauacuu

SEQ ID NO: 2235633 - RNA, 20 nt, Homo sapiens
ugacucagcuaaugucacaa

SEQ ID NO: 2235634 - RNA, 16 nt, Homo sapiens
ggcuacacagggaugu

SEQ ID NO: 2235635 - RNA, 19 nt, Homo sapiens
aauaauuuucaagcaaagu

SEQ ID NO: 2235636 - RNA, 13 nt, Homo sapiens
cuaaucuugucaa

SEQ ID NO: 2235637 - RNA, 23 nt, Homo sapiens
aaagccauauggacacugugaca

SEQ ID NO: 2235638 - RNA, 23 nt, Homo sapiens
cggacgcaccugggacccugcac

SEQ ID NO: 2235639 - RNA, 22 nt, Homo sapiens
uacuuaaguugucgaacaguag

SEQ ID NO: 2235640 - RNA, 17 nt, Homo sapiens
cuguacuaaaaauacaa

SEQ ID NO: 2235641 - RNA, 14 nt, Homo sapiens
uagcaucccuggaa

SEQ ID NO: 2235642 - RNA, 16 nt, Homo sapiens
auuucuaaaagucuga

SEQ ID NO: 2235643 - RNA, 13 nt, Homo sapiens
cuguaccaugugc

SEQ ID NO: 2235644 - RNA, 18 nt, Homo sapiens
guccaugaagcacugagc

SEQ ID NO: 2235645 - RNA, 22 nt, Homo sapiens
gcuuugauguuccuuccagugu

SEQ ID NO: 2235646 - RNA, 20 nt, Homo sapiens
ccaguacucuguaaguuucu

SEQ ID NO: 2235647 - RNA, 18 nt, Homo sapiens
agcccauugcugccaagg

SEQ ID NO: 2235648 - RNA, 18 nt, Homo sapiens
acagcacccucuccagau

SEQ ID NO: 2235649 - RNA, 13 nt, Homo sapiens
augucuaccucug

SEQ ID NO: 2235650 - RNA, 20 nt, Homo sapiens
uguuacaaguuugcuaaaag

SEQ ID NO: 2235651 - RNA, 13 nt, Homo sapiens
caggcuuuguaca

SEQ ID NO: 2235652 - RNA, 14 nt, Homo sapiens
uuugucaacuucag

SEQ ID NO: 2235653 - RNA, 22 nt, Homo sapiens
gccaaaaacaacaaauagccac

SEQ ID NO: 2235654 - RNA, 14 nt, Homo sapiens
caaaauaaauggac

SEQ ID NO: 2235655 - RNA, 10 nt, Homo sapiens
ugaaaaccua

SEQ ID NO: 2235656 - RNA, 22 nt, Homo sapiens
accucaugggaagcauguggau

SEQ ID NO: 2235657 - RNA, 15 nt, Homo sapiens
gccuuggccuugcag

SEQ ID NO: 2235658 - RNA, 15 nt, Homo sapiens
cuuugucacagggug

SEQ ID NO: 2235659 - RNA, 20 nt, Homo sapiens
ucuucuagagaguugcugac

SEQ ID NO: 2235660 - RNA, 18 nt, Homo sapiens
auggauuuaugacauuac

SEQ ID NO: 2235661 - RNA, 17 nt, Homo sapiens
gucuccaugcucaccaa

SEQ ID NO: 2235662 - RNA, 17 nt, Homo sapiens
gcauccaacuccaggau

SEQ ID NO: 2235663 - RNA, 20 nt, Homo sapiens
uaaaaugaaaugcauuuugc

SEQ ID NO: 2235664 - RNA, 16 nt, Homo sapiens
aaagccuuacggucau

SEQ ID NO: 2235665 - RNA, 21 nt, Homo sapiens
accugggagggugggaccaau

SEQ ID NO: 2235666 - RNA, 16 nt, Homo sapiens
aggggugauggaugau

SEQ ID NO: 2235667 - RNA, 15 nt, Homo sapiens
caggguucugaggca

SEQ ID NO: 2235668 - RNA, 14 nt, Homo sapiens
acaagaucuuucca

SEQ ID NO: 2235669 - RNA, 23 nt, Homo sapiens
ccauaaaauuagacauaccucuc

SEQ ID NO: 2235670 - RNA, 20 nt, Homo sapiens
acaugauaccucugaucaag

SEQ ID NO: 2235671 - RNA, 18 nt, Homo sapiens
aaacccuaaaccucuuca

SEQ ID NO: 2235672 - RNA, 19 nt, Homo sapiens
uuugauagggaacugggga

SEQ ID NO: 2235673 - RNA, 13 nt, Homo sapiens
ucguugcagcacu

SEQ ID NO: 2235674 - RNA, 23 nt, Homo sapiens
uauguuuuaauuccaaguguuuc

SEQ ID NO: 2235675 - RNA, 15 nt, Homo sapiens
uauuuuacacagaaa

SEQ ID NO: 2235676 - RNA, 17 nt, Homo sapiens
acuuggacucuugcucu

SEQ ID NO: 2235677 - RNA, 15 nt, Homo sapiens
ucaagcauauuggaa

SEQ ID NO: 2235678 - RNA, 18 nt, Homo sapiens
ccuuagagugcugugaga

SEQ ID NO: 2235679 - RNA, 21 nt, Homo sapiens
cucacucccuucccauaagcu

SEQ ID NO: 2235680 - RNA, 16 nt, Homo sapiens
cagcugcagcugggag

SEQ ID NO: 2235681 - RNA, 14 nt, Homo sapiens
uuacauacuauucu

SEQ ID NO: 2235682 - RNA, 23 nt, Homo sapiens
agcaggucuuugggaagcuccca

SEQ ID NO: 2235683 - RNA, 22 nt, Homo sapiens
agccucacuggggcagacaaua

SEQ ID NO: 2235684 - RNA, 17 nt, Homo sapiens
aacuggguucaaaaaga

SEQ ID NO: 2235685 - RNA, 21 nt, Homo sapiens
uagacauggagguucuaaggc

SEQ ID NO: 2235686 - RNA, 23 nt, Homo sapiens
uguccaggagaaaccucacaaac

SEQ ID NO: 2235687 - RNA, 19 nt, Homo sapiens
cagcaucuaagaaguuuug

SEQ ID NO: 2235688 - RNA, 14 nt, Homo sapiens
aucaaccaaaugga

SEQ ID NO: 2235689 - RNA, 16 nt, Homo sapiens
agccuggaugccaucc

SEQ ID NO: 2235690 - RNA, 14 nt, Homo sapiens
uauagaguggaauc

SEQ ID NO: 2235691 - RNA, 19 nt, Homo sapiens
cauggacuuucuugcauga

SEQ ID NO: 2235692 - RNA, 14 nt, Homo sapiens
auuguugcauuaaa

SEQ ID NO: 2235693 - RNA, 16 nt, Homo sapiens
auguguggcauuuuca

SEQ ID NO: 2235694 - RNA, 20 nt, Homo sapiens
acagagagcggcuuccccau

SEQ ID NO: 2235695 - RNA, 20 nt, Homo sapiens
agucucuguguaaucaucug

SEQ ID NO: 2235696 - RNA, 22 nt, Homo sapiens
uuaucaaauaaaaagcaugaga

SEQ ID NO: 2235697 - RNA, 14 nt, Homo sapiens
gcgcaggggcugcc

SEQ ID NO: 2235698 - RNA, 15 nt, Homo sapiens
uccuaccuauauuac

SEQ ID NO: 2235699 - RNA, 14 nt, Homo sapiens
aaacagaucuccug

SEQ ID NO: 2235700 - RNA, 18 nt, Homo sapiens
caggugccccucuuccaa

SEQ ID NO: 2235701 - RNA, 13 nt, Homo sapiens
cauuaccaucucu

SEQ ID NO: 2235702 - RNA, 15 nt, Homo sapiens
guaauccucaagaaa

SEQ ID NO: 2235703 - RNA, 14 nt, Homo sapiens
cuccaggugcucau

SEQ ID NO: 2235704 - RNA, 22 nt, Homo sapiens
gaccaggggcaccggcugccca

SEQ ID NO: 2235705 - RNA, 18 nt, Homo sapiens
aaccuguuaugccaaaca

SEQ ID NO: 2235706 - RNA, 18 nt, Homo sapiens
ccaaaucucaaaauaucc

SEQ ID NO: 2235707 - RNA, 19 nt, Homo sapiens
ccaauccuuaaacugccaa

SEQ ID NO: 2235708 - RNA, 22 nt, Homo sapiens
ggagaguaacccugucuaauga

SEQ ID NO: 2235709 - RNA, 17 nt, Homo sapiens
gcauccugugugcugac

SEQ ID NO: 2235710 - RNA, 17 nt, Homo sapiens
agcaacaggaaucucag

SEQ ID NO: 2235711 - RNA, 15 nt, Homo sapiens
uacaacugauugcaa

SEQ ID NO: 2235712 - RNA, 19 nt, Homo sapiens
auccuccuuuagaguugca

SEQ ID NO: 2235713 - RNA, 13 nt, Homo sapiens
augagacuugccu

SEQ ID NO: 2235714 - RNA, 21 nt, Homo sapiens
uagaguuggauuaaauucugg

SEQ ID NO: 2235715 - RNA, 16 nt, Homo sapiens
ugaaaggcacacuuug

SEQ ID NO: 2235716 - RNA, 23 nt, Homo sapiens
guuuuaccaucugcauccagccu

SEQ ID NO: 2235717 - RNA, 18 nt, Homo sapiens
uuaaaaacaacgaaagaa

SEQ ID NO: 2235718 - RNA, 23 nt, Homo sapiens
agcgcaugugugcaugugcugug

SEQ ID NO: 2235719 - RNA, 15 nt, Homo sapiens
ucaacuggagucuau

SEQ ID NO: 2235720 - RNA, 19 nt, Homo sapiens
uuuacagcacuacucugug

SEQ ID NO: 2235721 - RNA, 17 nt, Homo sapiens
uuagaauuccuucaggg

SEQ ID NO: 2235722 - RNA, 13 nt, Homo sapiens
uagccugcucugc

SEQ ID NO: 2235723 - RNA, 21 nt, Homo sapiens
cuugggguacucuugauguga

SEQ ID NO: 2235724 - RNA, 14 nt, Homo sapiens
cauuugcaauaugg

SEQ ID NO: 2235725 - RNA, 18 nt, Homo sapiens
aaauuaaugguuuauucu

SEQ ID NO: 2235726 - RNA, 15 nt, Homo sapiens
gugucuuaggguaga

SEQ ID NO: 2235727 - RNA, 17 nt, Homo sapiens
cccuucuugggucugcc

SEQ ID NO: 2235728 - RNA, 23 nt, Homo sapiens
cucugaggggugggggugccgcu

SEQ ID NO: 2235729 - RNA, 16 nt, Homo sapiens
augcaauaaugugcaa

SEQ ID NO: 2235730 - RNA, 16 nt, Homo sapiens
cagugaagcagcacug

SEQ ID NO: 2235731 - RNA, 17 nt, Homo sapiens
uguugaugcugucuaag

SEQ ID NO: 2235732 - RNA, 15 nt, Homo sapiens
aggaaacugcuuuau

SEQ ID NO: 2235733 - RNA, 11 nt, Homo sapiens
gcucaccuguu

SEQ ID NO: 2235734 - RNA, 17 nt, Homo sapiens
gaauauaaacacuauau

SEQ ID NO: 2235735 - RNA, 22 nt, Homo sapiens
aaguugcagucucagaaagccu

SEQ ID NO: 2235736 - RNA, 18 nt, Homo sapiens
cauaaagacugugcugag

SEQ ID NO: 2235737 - RNA, 19 nt, Homo sapiens
cugcugguugacaucagac

SEQ ID NO: 2235738 - RNA, 14 nt, Homo sapiens
caucucaguuaucu

SEQ ID NO: 2235739 - RNA, 21 nt, Homo sapiens
aaagcagacauuuuccucaca

SEQ ID NO: 2235740 - RNA, 22 nt, Homo sapiens
auccaucaaguugcacacucac

SEQ ID NO: 2235741 - RNA, 23 nt, Homo sapiens
guuagucaauccugucauauaau

SEQ ID NO: 2235742 - RNA, 21 nt, Homo sapiens
cacugaaaaugucacauucua

SEQ ID NO: 2235743 - RNA, 20 nt, Homo sapiens
uggaggccagagucucccag

SEQ ID NO: 2235744 - RNA, 20 nt, Homo sapiens
aauuuccuggcucauuucau

SEQ ID NO: 2235745 - RNA, 22 nt, Homo sapiens
ugacacaggaugaaggcaaugc

SEQ ID NO: 2235746 - RNA, 13 nt, Homo sapiens
agucucauaucag

SEQ ID NO: 2235747 - RNA, 16 nt, Homo sapiens
uacggagggugggcuc

SEQ ID NO: 2235748 - RNA, 19 nt, Homo sapiens
gaccugagcccgcagccca

SEQ ID NO: 2235749 - RNA, 17 nt, Homo sapiens
ugugacuaccgugccag

SEQ ID NO: 2235750 - RNA, 20 nt, Homo sapiens
uggccacgcagccaggacac

SEQ ID NO: 2235751 - RNA, 15 nt, Homo sapiens
ucugccugaaccugg

SEQ ID NO: 2235752 - RNA, 16 nt, Homo sapiens
gaccucuugaucugcc

SEQ ID NO: 2235753 - RNA, 10 nt, Homo sapiens
gucuaccuga

SEQ ID NO: 2235754 - RNA, 18 nt, Homo sapiens
guaacaucuguuaucaaa

SEQ ID NO: 2235755 - RNA, 23 nt, Homo sapiens
uggacaaaauuaauacauucuau

SEQ ID NO: 2235756 - RNA, 17 nt, Homo sapiens
aaguuccugcacuccag

SEQ ID NO: 2235757 - RNA, 18 nt, Homo sapiens
cuguugccuugagcucuu

SEQ ID NO: 2235758 - RNA, 14 nt, Homo sapiens
cccaggaaccaaaa

SEQ ID NO: 2235759 - RNA, 23 nt, Homo sapiens
cuacucucuccuuuuugcuuccu

SEQ ID NO: 2235760 - RNA, 17 nt, Homo sapiens
caauuaaagguccugcc

SEQ ID NO: 2235761 - RNA, 13 nt, Homo sapiens
auuaagacuuuaa

SEQ ID NO: 2235762 - RNA, 13 nt, Homo sapiens
acagagacucaga

SEQ ID NO: 2235763 - RNA, 15 nt, Homo sapiens
aauccuuaacauauu

SEQ ID NO: 2235764 - RNA, 18 nt, Homo sapiens
gauagcaccuaaacuuac

SEQ ID NO: 2235765 - RNA, 14 nt, Homo sapiens
cuauauguauucac

SEQ ID NO: 2235766 - RNA, 21 nt, Homo sapiens
uugaccccugcccaccucucc

SEQ ID NO: 2235767 - RNA, 13 nt, Homo sapiens
ucuguugaucuca

SEQ ID NO: 2235768 - RNA, 14 nt, Homo sapiens
gaaagaagugacua

SEQ ID NO: 2235769 - RNA, 16 nt, Homo sapiens
aauuguacuaaagcca

SEQ ID NO: 2235770 - RNA, 17 nt, Homo sapiens
uuccacuuguuugcacu

SEQ ID NO: 2235771 - RNA, 15 nt, Homo sapiens
aggaccugagccugc

SEQ ID NO: 2235772 - RNA, 17 nt, Homo sapiens
uuauccuccuucacucc

SEQ ID NO: 2235773 - RNA, 15 nt, Homo sapiens
ucuaacuuaagaaau

SEQ ID NO: 2235774 - RNA, 17 nt, Homo sapiens
uaaugucgaacucugaa

SEQ ID NO: 2235775 - RNA, 21 nt, Homo sapiens
aaacauucauuuuuaccuugu

SEQ ID NO: 2235776 - RNA, 15 nt, Homo sapiens
gccuagucagccaca

SEQ ID NO: 2235777 - RNA, 16 nt, Homo sapiens
cagugucuccaccuac

SEQ ID NO: 2235778 - RNA, 18 nt, Homo sapiens
ugggguauacagcauuga

SEQ ID NO: 2235779 - RNA, 15 nt, Homo sapiens
uauauggacaaaaca

SEQ ID NO: 2235780 - RNA, 21 nt, Homo sapiens
agcagaugcuggucauguguu

SEQ ID NO: 2235781 - RNA, 20 nt, Homo sapiens
ggcaucucacuuuaugauag

SEQ ID NO: 2235782 - RNA, 20 nt, Homo sapiens
aaauuguuaguaaacauagg

SEQ ID NO: 2235783 - RNA, 20 nt, Homo sapiens
auuagcaugaaagcaguuua

SEQ ID NO: 2235784 - RNA, 22 nt, Homo sapiens
guaaugaaacaaagaguucaag

SEQ ID NO: 2235785 - RNA, 17 nt, Homo sapiens
caugaccaguucuggcc

SEQ ID NO: 2235786 - RNA, 13 nt, Homo sapiens
uagaugugucuua

SEQ ID NO: 2235787 - RNA, 18 nt, Homo sapiens
cuguuaugcaagcacaaa

SEQ ID NO: 2235788 - RNA, 17 nt, Homo sapiens
gaagagagaauucuguu

SEQ ID NO: 2235789 - RNA, 19 nt, Homo sapiens
ucaauucugugugguauau

SEQ ID NO: 2235790 - RNA, 21 nt, Homo sapiens
uagucccauugauguacuuua

SEQ ID NO: 2235791 - RNA, 21 nt, Homo sapiens
cuggcauggacaucagcauca

SEQ ID NO: 2235792 - RNA, 22 nt, Homo sapiens
gaggaaggggcgauuugaggga

SEQ ID NO: 2235793 - RNA, 16 nt, Homo sapiens
ccacuaccccugauga

SEQ ID NO: 2235794 - RNA, 17 nt, Homo sapiens
cacuagucucaccagcc

SEQ ID NO: 2235795 - RNA, 17 nt, Homo sapiens
aauucugaaugcaauuu

SEQ ID NO: 2235796 - RNA, 20 nt, Homo sapiens
uccuuugcaccgauccccac

SEQ ID NO: 2235797 - RNA, 20 nt, Homo sapiens
uaauuauaauaaaggucaca

SEQ ID NO: 2235798 - RNA, 13 nt, Homo sapiens
aauaaaagcacuu

SEQ ID NO: 2235799 - RNA, 14 nt, Homo sapiens
aagaggaggcagga

SEQ ID NO: 2235800 - RNA, 15 nt, Homo sapiens
cucuguaguggaaua

SEQ ID NO: 2235801 - RNA, 20 nt, Homo sapiens
uaaagacccaacuugccaaa

SEQ ID NO: 2235802 - RNA, 17 nt, Homo sapiens
ugcucacugccagugca

SEQ ID NO: 2235803 - RNA, 19 nt, Homo sapiens
uacaaguggcucaucauca

SEQ ID NO: 2235804 - RNA, 20 nt, Homo sapiens
caguguccuccccucaagga

SEQ ID NO: 2235805 - RNA, 22 nt, Homo sapiens
gaaaucaccacauucugucucu

SEQ ID NO: 2235806 - RNA, 12 nt, Homo sapiens
gaccuuacaaaa

SEQ ID NO: 2235807 - RNA, 23 nt, Homo sapiens
uucuaaacuaucaauaauacaaa

SEQ ID NO: 2235808 - RNA, 13 nt, Homo sapiens
caugauacuuuaa

SEQ ID NO: 2235809 - RNA, 22 nt, Homo sapiens
cuugccaucuauaggggccaaa

SEQ ID NO: 2235810 - RNA, 13 nt, Homo sapiens
agauaacuaaggu

SEQ ID NO: 2235811 - RNA, 16 nt, Homo sapiens
guuagcacuguugaug

SEQ ID NO: 2235812 - RNA, 18 nt, Homo sapiens
gcugucaugagugaugcc

SEQ ID NO: 2235813 - RNA, 15 nt, Homo sapiens
gggcacagugucagu

SEQ ID NO: 2235814 - RNA, 16 nt, Homo sapiens
gcacugugagcaccug

SEQ ID NO: 2235815 - RNA, 23 nt, Homo sapiens
guguuuccuggcacugcuuccag

SEQ ID NO: 2235816 - RNA, 23 nt, Homo sapiens
cucgcgauucaggacguccuucc

SEQ ID NO: 2235817 - RNA, 21 nt, Homo sapiens
uggcaguggaacuaagaaagc

SEQ ID NO: 2235818 - RNA, 22 nt, Homo sapiens
uuuaaacucagggacagagcca

SEQ ID NO: 2235819 - RNA, 15 nt, Homo sapiens
gaaucucguucccaa

SEQ ID NO: 2235820 - RNA, 18 nt, Homo sapiens
gcucuuucucugccagug

SEQ ID NO: 2235821 - RNA, 11 nt, Homo sapiens
acuucaaagag

SEQ ID NO: 2235822 - RNA, 21 nt, Homo sapiens
cacaaguaaaggcauugucca

SEQ ID NO: 2235823 - RNA, 16 nt, Homo sapiens
ucuuccuuagacuuac

SEQ ID NO: 2235824 - RNA, 16 nt, Homo sapiens
agcuccugaccaaaga

SEQ ID NO: 2235825 - RNA, 12 nt, Homo sapiens
aaaaaaguggaa

SEQ ID NO: 2235826 - RNA, 20 nt, Homo sapiens
ccuugcccaaccaaugcaca

SEQ ID NO: 2235827 - RNA, 23 nt, Homo sapiens
guggugagccgagauugcaccau

SEQ ID NO: 2235828 - RNA, 19 nt, Homo sapiens
ggacgaccuccagcucuca

SEQ ID NO: 2235829 - RNA, 19 nt, Homo sapiens
gcccaucagccauuugcca

SEQ ID NO: 2235830 - RNA, 20 nt, Homo sapiens
cuuggccuccccugcugaag

SEQ ID NO: 2235831 - RNA, 17 nt, Homo sapiens
uagaucagaauuguuga

SEQ ID NO: 2235832 - RNA, 13 nt, Homo sapiens
uccuggaaccaau

SEQ ID NO: 2235833 - RNA, 15 nt, Homo sapiens
cucagagacaucagc

SEQ ID NO: 2235834 - RNA, 20 nt, Homo sapiens
gaaacuugcauacagagaca

SEQ ID NO: 2235835 - RNA, 14 nt, Homo sapiens
ucaaauccuuccaa

SEQ ID NO: 2235836 - RNA, 17 nt, Homo sapiens
ucaucugagaaugaaca

SEQ ID NO: 2235837 - RNA, 17 nt, Homo sapiens
cauauguaccauguaca

SEQ ID NO: 2235838 - RNA, 14 nt, Homo sapiens
ugaguuaaaguaua

SEQ ID NO: 2235839 - RNA, 23 nt, Homo sapiens
cauguagaucaagugugcauaua

SEQ ID NO: 2235840 - RNA, 20 nt, Homo sapiens
ucuaaguuaugacugugaaa

SEQ ID NO: 2235841 - RNA, 19 nt, Homo sapiens
aggcuucugcaguucucau

SEQ ID NO: 2235842 - RNA, 14 nt, Homo sapiens
cgacugagccaugc

SEQ ID NO: 2235843 - RNA, 22 nt, Homo sapiens
aguuugccaggaggaacaaaga

SEQ ID NO: 2235844 - RNA, 17 nt, Homo sapiens
cacaauccuauuacucu

SEQ ID NO: 2235845 - RNA, 21 nt, Homo sapiens
ucuaaauuuugugauucuaua

SEQ ID NO: 2235846 - RNA, 13 nt, Homo sapiens
cccagcaauagag

SEQ ID NO: 2235847 - RNA, 19 nt, Homo sapiens
cagcccccuaaaagcacuc

SEQ ID NO: 2235848 - RNA, 16 nt, Homo sapiens
uucugauuucagaaau

SEQ ID NO: 2235849 - RNA, 14 nt, Homo sapiens
ugcugcuucuccau

SEQ ID NO: 2235850 - RNA, 15 nt, Homo sapiens
agucuuaaagcauuu

SEQ ID NO: 2235851 - RNA, 22 nt, Homo sapiens
uucugauugucuuagacacugu

SEQ ID NO: 2235852 - RNA, 13 nt, Homo sapiens
gucaccucagaga

SEQ ID NO: 2235853 - RNA, 21 nt, Homo sapiens
ugguuucauuucuacugugac

SEQ ID NO: 2235854 - RNA, 21 nt, Homo sapiens
agacggggucuggcuguguug

SEQ ID NO: 2235855 - RNA, 21 nt, Homo sapiens
ccugauuuguuccuucugggg

SEQ ID NO: 2235856 - RNA, 23 nt, Homo sapiens
aggacagaaaggagaguggccau

SEQ ID NO: 2235857 - RNA, 17 nt, Homo sapiens
acuucuaagagcauaga

SEQ ID NO: 2235858 - RNA, 15 nt, Homo sapiens
aaccauauaaauucu

SEQ ID NO: 2235859 - RNA, 22 nt, Homo sapiens
uugaucucugcuuaccguucaa

SEQ ID NO: 2235860 - RNA, 20 nt, Homo sapiens
cagcauuagugggaaaaagu

SEQ ID NO: 2235861 - RNA, 20 nt, Homo sapiens
ugguuuucagauaugcuuaa

SEQ ID NO: 2235862 - RNA, 22 nt, Homo sapiens
acuugauguuuguuugcaugau

SEQ ID NO: 2235863 - RNA, 24 nt, Homo sapiens
ucaucuuuuauagauguaaucuga

SEQ ID NO: 2235864 - RNA, 17 nt, Homo sapiens
ggcucucuguaggcaca

SEQ ID NO: 2235865 - RNA, 22 nt, Homo sapiens
ugugacccccaaguccuauccu

SEQ ID NO: 2235866 - RNA, 20 nt, Homo sapiens
ucaagacauaaguaaaugag

SEQ ID NO: 2235867 - RNA, 20 nt, Homo sapiens
gagggagcuuggagaacuca

SEQ ID NO: 2235868 - RNA, 20 nt, Homo sapiens
aacacucucacuaugcugcu

SEQ ID NO: 2235869 - RNA, 16 nt, Homo sapiens
gagacaggcccaagag

SEQ ID NO: 2235870 - RNA, 20 nt, Homo sapiens
aucaacuuauuauaugacua

SEQ ID NO: 2235871 - RNA, 18 nt, Homo sapiens
uguugaaucugagcugca

SEQ ID NO: 2235872 - RNA, 16 nt, Homo sapiens
auucuuaaacugagaa

SEQ ID NO: 2235873 - RNA, 23 nt, Homo sapiens
aacacaguguuuuuguaaagugu

SEQ ID NO: 2235874 - RNA, 12 nt, Homo sapiens
cauaaccaaaga

SEQ ID NO: 2235875 - RNA, 22 nt, Homo sapiens
cgccaugggggucuuugaacac

SEQ ID NO: 2235876 - RNA, 13 nt, Homo sapiens
ugguuuuaccugu

SEQ ID NO: 2235877 - RNA, 17 nt, Homo sapiens
cuacuugggagcuauga

SEQ ID NO: 2235878 - RNA, 16 nt, Homo sapiens
cuccagugucuaccuu

SEQ ID NO: 2235879 - RNA, 16 nt, Homo sapiens
cugacccuucucucac

SEQ ID NO: 2235880 - RNA, 13 nt, Homo sapiens
guaacagcuccuu

SEQ ID NO: 2235881 - RNA, 12 nt, Homo sapiens
uuggaggcaauc

SEQ ID NO: 2235882 - RNA, 19 nt, Homo sapiens
acuccuuucuugcacuauu

SEQ ID NO: 2235883 - RNA, 18 nt, Homo sapiens
gauaguccauaauguucu

SEQ ID NO: 2235884 - RNA, 12 nt, Homo sapiens
uuaaacugugua

SEQ ID NO: 2235885 - RNA, 23 nt, Homo sapiens
cuuugcugugaggcuguccugua

SEQ ID NO: 2235886 - RNA, 16 nt, Homo sapiens
acagaugcacacacag

SEQ ID NO: 2235887 - RNA, 20 nt, Homo sapiens
ugcuaauuuugaaaaacugc

SEQ ID NO: 2235888 - RNA, 13 nt, Homo sapiens
gcugguuugccca

SEQ ID NO: 2235889 - RNA, 15 nt, Homo sapiens
gucugugaaugcuaa

SEQ ID NO: 2235890 - RNA, 21 nt, Homo sapiens
caucuuugcugaaugucauua

SEQ ID NO: 2235891 - RNA, 14 nt, Homo sapiens
acgaaaacagucaa

SEQ ID NO: 2235892 - RNA, 20 nt, Homo sapiens
aauaucagaaguauaucugu

SEQ ID NO: 2235893 - RNA, 14 nt, Homo sapiens
caauagguauuucu

SEQ ID NO: 2235894 - RNA, 18 nt, Homo sapiens
gugcuuuccuucaucucc

SEQ ID NO: 2235895 - RNA, 23 nt, Homo sapiens
auuauguguugccaaaaccaaac

SEQ ID NO: 2235896 - RNA, 15 nt, Homo sapiens
auuggucucugggua

SEQ ID NO: 2235897 - RNA, 18 nt, Homo sapiens
cuaccaaguuucauacca

SEQ ID NO: 2235898 - RNA, 15 nt, Homo sapiens
gggucaggugccacu

SEQ ID NO: 2235899 - RNA, 14 nt, Homo sapiens
gggaucuacuuucc

SEQ ID NO: 2235900 - RNA, 21 nt, Homo sapiens
gucuuuuuacauugugaaugc

SEQ ID NO: 2235901 - RNA, 17 nt, Homo sapiens
auguuauagaacuucau

SEQ ID NO: 2235902 - RNA, 15 nt, Homo sapiens
gcucccgcuugcucu

SEQ ID NO: 2235903 - RNA, 22 nt, Homo sapiens
auaaauguuauguuugcuaaaa

SEQ ID NO: 2235904 - RNA, 22 nt, Homo sapiens
gcuacuauaugcauaaacaaca

SEQ ID NO: 2235905 - RNA, 14 nt, Homo sapiens
ucucugaggggugg

SEQ ID NO: 2235906 - RNA, 21 nt, Homo sapiens
auaugauaaauuugacuguua

SEQ ID NO: 2235907 - RNA, 13 nt, Homo sapiens
uuuggcauguaaa

SEQ ID NO: 2235908 - RNA, 22 nt, Homo sapiens
uagaaguagcaaaaaguauuga

SEQ ID NO: 2235909 - RNA, 12 nt, Homo sapiens
ugaaaacucuau

SEQ ID NO: 2235910 - RNA, 19 nt, Homo sapiens
uucccggcgucccuaccuc

SEQ ID NO: 2235911 - RNA, 14 nt, Homo sapiens
uaauaguaccuaaa

SEQ ID NO: 2235912 - RNA, 21 nt, Homo sapiens
caaagaugaccauaaccacug

SEQ ID NO: 2235913 - RNA, 12 nt, Homo sapiens
caucuucuuuca

SEQ ID NO: 2235914 - RNA, 21 nt, Homo sapiens
cugcuguggggaccacacuga

SEQ ID NO: 2235915 - RNA, 18 nt, Homo sapiens
uuaauaaaugaaugauuu

SEQ ID NO: 2235916 - RNA, 18 nt, Homo sapiens
caucugcaugucuacuca

SEQ ID NO: 2235917 - RNA, 23 nt, Homo sapiens
acccugguucccaccauucccug

SEQ ID NO: 2235918 - RNA, 22 nt, Homo sapiens
ccguaucuucuaaauuugaaau

SEQ ID NO: 2235919 - RNA, 13 nt, Homo sapiens
agucugaugguga

SEQ ID NO: 2235920 - RNA, 15 nt, Homo sapiens
aguuaaacagucagu

SEQ ID NO: 2235921 - RNA, 12 nt, Homo sapiens
ggaugcacacac

SEQ ID NO: 2235922 - RNA, 15 nt, Homo sapiens
gauuccaaccuuccu

SEQ ID NO: 2235923 - RNA, 21 nt, Homo sapiens
uguauauugauguaacugugu

SEQ ID NO: 2235924 - RNA, 17 nt, Homo sapiens
gguauguaguuacagaa

SEQ ID NO: 2235925 - RNA, 21 nt, Homo sapiens
acauuuuuuucuaugcauaaa

SEQ ID NO: 2235926 - RNA, 15 nt, Homo sapiens
gaaagcagugcagua

SEQ ID NO: 2235927 - RNA, 15 nt, Homo sapiens
uggacauaacauuuu

SEQ ID NO: 2235928 - RNA, 18 nt, Homo sapiens
ccaaucucuuggugggga

SEQ ID NO: 2235929 - RNA, 17 nt, Homo sapiens
auucucuuaaucacuac

SEQ ID NO: 2235930 - RNA, 17 nt, Homo sapiens
cagauuaaaugaauaua

SEQ ID NO: 2235931 - RNA, 22 nt, Homo sapiens
uugcuaguauucgcuguguuca

SEQ ID NO: 2235932 - RNA, 23 nt, Homo sapiens
ucaugucugaaacagagaaccaa

SEQ ID NO: 2235933 - RNA, 15 nt, Homo sapiens
caccccucaucagga

SEQ ID NO: 2235934 - RNA, 16 nt, Homo sapiens
uuugauauacauugug

SEQ ID NO: 2235935 - RNA, 21 nt, Homo sapiens
gauaaaccugucuaagcaaua

SEQ ID NO: 2235936 - RNA, 16 nt, Homo sapiens
acacggucagggucag

SEQ ID NO: 2235937 - RNA, 17 nt, Homo sapiens
agcauccagugugagau

SEQ ID NO: 2235938 - RNA, 19 nt, Homo sapiens
aaucucagaugcaguuugg

SEQ ID NO: 2235939 - RNA, 12 nt, Homo sapiens
ccucacugggug

SEQ ID NO: 2235940 - RNA, 21 nt, Homo sapiens
ugagaauguucaucucuccag

SEQ ID NO: 2235941 - RNA, 22 nt, Homo sapiens
aauucucugaaaguuucuuccu

SEQ ID NO: 2235942 - RNA, 15 nt, Homo sapiens
cagaggaugcugaag

SEQ ID NO: 2235943 - RNA, 16 nt, Homo sapiens
agagaaaccagcaaaa

SEQ ID NO: 2235944 - RNA, 17 nt, Homo sapiens
uaaaaucccucacauuu

SEQ ID NO: 2235945 - RNA, 15 nt, Homo sapiens
gccuguauacuuuag

SEQ ID NO: 2235946 - RNA, 19 nt, Homo sapiens
uuaaugucugacuguuaau

SEQ ID NO: 2235947 - RNA, 12 nt, Homo sapiens
augacagugcua

SEQ ID NO: 2235948 - RNA, 12 nt, Homo sapiens
acuucagugugu

SEQ ID NO: 2235949 - RNA, 23 nt, Homo sapiens
aggaaaauguauccagaggaauu

SEQ ID NO: 2235950 - RNA, 16 nt, Homo sapiens
acauuccucaaaaugg

SEQ ID NO: 2235951 - RNA, 13 nt, Homo sapiens
cucccucaugagc

SEQ ID NO: 2235952 - RNA, 21 nt, Homo sapiens
aaauuuauuuuacacauguca

SEQ ID NO: 2235953 - RNA, 13 nt, Homo sapiens
cauuucuugaugu

SEQ ID NO: 2235954 - RNA, 15 nt, Homo sapiens
cccuccguggcauca

SEQ ID NO: 2235955 - RNA, 17 nt, Homo sapiens
agcaagacauacuuaau

SEQ ID NO: 2235956 - RNA, 14 nt, Homo sapiens
agaucuuuacucuu

SEQ ID NO: 2235957 - RNA, 13 nt, Homo sapiens
cuauguauauaca

SEQ ID NO: 2235958 - RNA, 21 nt, Homo sapiens
aauggcaucaaaugucagucc

SEQ ID NO: 2235959 - RNA, 22 nt, Homo sapiens
guccccacagcuucucuacaga

SEQ ID NO: 2235960 - RNA, 15 nt, Homo sapiens
uggcggcagggccag

SEQ ID NO: 2235961 - RNA, 18 nt, Homo sapiens
cccaguuuaauauuccaa

SEQ ID NO: 2235962 - RNA, 20 nt, Homo sapiens
uuagcacagagagggacaca

SEQ ID NO: 2235963 - RNA, 20 nt, Homo sapiens
cacacuuuguaauuugcaaa

SEQ ID NO: 2235964 - RNA, 12 nt, Homo sapiens
ugagaaaugggg

SEQ ID NO: 2235965 - RNA, 20 nt, Homo sapiens
guuuccccucucaucugacc

SEQ ID NO: 2235966 - RNA, 16 nt, Homo sapiens
aaauacacuuccugcu

SEQ ID NO: 2235967 - RNA, 17 nt, Homo sapiens
augucagucuacaggcc

SEQ ID NO: 2235968 - RNA, 22 nt, Homo sapiens
aggacauucuggaaaagcaaaa

SEQ ID NO: 2235969 - RNA, 17 nt, Homo sapiens
cagccugcucuaguggg

SEQ ID NO: 2235970 - RNA, 23 nt, Homo sapiens
aagcaaggcacaagucauaccua

SEQ ID NO: 2235971 - RNA, 15 nt, Homo sapiens
ggagaccuggcacug

SEQ ID NO: 2235972 - RNA, 13 nt, Homo sapiens
aaugcaaucagga

SEQ ID NO: 2235973 - RNA, 21 nt, Homo sapiens
aauuugcaaagaaaaguuuca

SEQ ID NO: 2235974 - RNA, 14 nt, Homo sapiens
gaggguggcaucag

SEQ ID NO: 2235975 - RNA, 15 nt, Homo sapiens
cuaauaagugcuuuc

SEQ ID NO: 2235976 - RNA, 16 nt, Homo sapiens
ccuuuugguuccucac

SEQ ID NO: 2235977 - RNA, 14 nt, Homo sapiens
gaaguuaaagggca

SEQ ID NO: 2235978 - RNA, 20 nt, Homo sapiens
caacuaauacaugguuuaaa

SEQ ID NO: 2235979 - RNA, 15 nt, Homo sapiens
acugugcauuugaga

SEQ ID NO: 2235980 - RNA, 18 nt, Homo sapiens
cugucugauccuguccau

SEQ ID NO: 2235981 - RNA, 23 nt, Homo sapiens
gaccauggccaccccagagccau

SEQ ID NO: 2235982 - RNA, 19 nt, Homo sapiens
gaguuucuauggauucacu

SEQ ID NO: 2235983 - RNA, 13 nt, Homo sapiens
guagggaugccuu

SEQ ID NO: 2235984 - RNA, 20 nt, Homo sapiens
ccaagucucgcuacauuucc

SEQ ID NO: 2235985 - RNA, 16 nt, Homo sapiens
cugauuucacauauug

SEQ ID NO: 2235986 - RNA, 11 nt, Homo sapiens
cacucugucac

SEQ ID NO: 2235987 - RNA, 16 nt, Homo sapiens
auaagcugauguccag

SEQ ID NO: 2235988 - RNA, 12 nt, Homo sapiens
uuaguaagcaaa

SEQ ID NO: 2235989 - RNA, 14 nt, Homo sapiens
agggagauuugcuc

SEQ ID NO: 2235990 - RNA, 18 nt, Homo sapiens
uuuuccucgccuaggccu

SEQ ID NO: 2235991 - RNA, 19 nt, Homo sapiens
caugacuuuguccauuaaa

SEQ ID NO: 2235992 - RNA, 14 nt, Homo sapiens
guacaaaguauuaa

SEQ ID NO: 2235993 - RNA, 22 nt, Homo sapiens
acaccugggucuuuaugcauga

SEQ ID NO: 2235994 - RNA, 21 nt, Homo sapiens
aguccagaguacaaauccaag

SEQ ID NO: 2235995 - RNA, 22 nt, Homo sapiens
cacccuggugugacucuaguga

SEQ ID NO: 2235996 - RNA, 14 nt, Homo sapiens
accuuaaaauguaa

SEQ ID NO: 2235997 - RNA, 13 nt, Homo sapiens
gccucuggccaga

SEQ ID NO: 2235998 - RNA, 19 nt, Homo sapiens
acuuaguaaguaauaucaa

SEQ ID NO: 2235999 - RNA, 23 nt, Homo sapiens
aaaaucuuucagaauacaauuca

SEQ ID NO: 2236000 - RNA, 22 nt, Homo sapiens
augccucccugggccaccuccu

SEQ ID NO: 2236001 - RNA, 14 nt, Homo sapiens
cagggaacccacag

SEQ ID NO: 2236002 - RNA, 16 nt, Homo sapiens
gcacuaacacaugcac

SEQ ID NO: 2236003 - RNA, 16 nt, Homo sapiens
guuuuauuacucucac

SEQ ID NO: 2236004 - RNA, 19 nt, Homo sapiens
acuauuuaguggaaccuug

SEQ ID NO: 2236005 - RNA, 18 nt, Homo sapiens
uugauuaaaauucaggaa

SEQ ID NO: 2236006 - RNA, 14 nt, Homo sapiens
ccugcacuguaaaa

SEQ ID NO: 2236007 - RNA, 19 nt, Homo sapiens
ugccaggcccccaccacac

SEQ ID NO: 2236008 - RNA, 20 nt, Homo sapiens
ugccaaccagagcagcucac

SEQ ID NO: 2236009 - RNA, 15 nt, Homo sapiens
uucaaaagcacaaac

SEQ ID NO: 2236010 - RNA, 16 nt, Homo sapiens
accaagguauacaucu

SEQ ID NO: 2236011 - RNA, 22 nt, Homo sapiens
ccagacagcucccucugccuga

SEQ ID NO: 2236012 - RNA, 19 nt, Homo sapiens
cuacuuuuuuuugacauaa

SEQ ID NO: 2236013 - RNA, 23 nt, Homo sapiens
cguaacaccugauuaacugaggc

SEQ ID NO: 2236014 - RNA, 14 nt, Homo sapiens
cuaccaacuggaag

SEQ ID NO: 2236015 - RNA, 13 nt, Homo sapiens
auucuaaacagau

SEQ ID NO: 2236016 - RNA, 22 nt, Homo sapiens
cuuuacaacuaaauaacacaga

SEQ ID NO: 2236017 - RNA, 14 nt, Homo sapiens
auaacuauacuuga

SEQ ID NO: 2236018 - RNA, 19 nt, Homo sapiens
ugagacgaggcaggggcuc

SEQ ID NO: 2236019 - RNA, 20 nt, Homo sapiens
aauaucuggcacuguuaaua

SEQ ID NO: 2236020 - RNA, 17 nt, Homo sapiens
gucuuucgcacauucuc

SEQ ID NO: 2236021 - RNA, 22 nt, Homo sapiens
gggcaaaugaauuucaugugaa

SEQ ID NO: 2236022 - RNA, 18 nt, Homo sapiens
gacaugauuuccuugaau

SEQ ID NO: 2236023 - RNA, 22 nt, Homo sapiens
uuucuccuuuuuuaugaugaca

SEQ ID NO: 2236024 - RNA, 19 nt, Homo sapiens
aaacaucuuaguugaugcu

SEQ ID NO: 2236025 - RNA, 18 nt, Homo sapiens
auggcuucggacaaaaua

SEQ ID NO: 2236026 - RNA, 15 nt, Homo sapiens
agggauaaccugcac

SEQ ID NO: 2236027 - RNA, 13 nt, Homo sapiens
agcaguugacuca

SEQ ID NO: 2236028 - RNA, 14 nt, Homo sapiens
accccaugccaaag

SEQ ID NO: 2236029 - RNA, 19 nt, Homo sapiens
ugacuggccacacaggauc

SEQ ID NO: 2236030 - RNA, 10 nt, Homo sapiens
aagcccaguu

SEQ ID NO: 2236031 - RNA, 13 nt, Homo sapiens
cuuucuggcuuug

SEQ ID NO: 2236032 - RNA, 22 nt, Homo sapiens
cauaugaaaaggcuaagcuuca

SEQ ID NO: 2236033 - RNA, 21 nt, Homo sapiens
aaggaagcaaguuuucuucca

SEQ ID NO: 2236034 - RNA, 15 nt, Homo sapiens
acucaagauacugga

SEQ ID NO: 2236035 - RNA, 17 nt, Homo sapiens
ccuguguuccuggagaa

SEQ ID NO: 2236036 - RNA, 21 nt, Homo sapiens
uaaauaggcggggcuugccuu

SEQ ID NO: 2236037 - RNA, 17 nt, Homo sapiens
auagcacacacauacac

SEQ ID NO: 2236038 - RNA, 16 nt, Homo sapiens
uuauuaaucauuccau

SEQ ID NO: 2236039 - RNA, 16 nt, Homo sapiens
ggcgccagcagcucca

SEQ ID NO: 2236040 - RNA, 20 nt, Homo sapiens
gggagguggagcuugcaaug

SEQ ID NO: 2236041 - RNA, 12 nt, Homo sapiens
cuuagcuacuug

SEQ ID NO: 2236042 - RNA, 15 nt, Homo sapiens
ggcagguccacagag

SEQ ID NO: 2236043 - RNA, 13 nt, Homo sapiens
caggcuucaucaa

SEQ ID NO: 2236044 - RNA, 13 nt, Homo sapiens
cuuggagcugucc

SEQ ID NO: 2236045 - RNA, 17 nt, Homo sapiens
gacaacagccugagaaa

SEQ ID NO: 2236046 - RNA, 15 nt, Homo sapiens
ucuuaacucuuuaaa

SEQ ID NO: 2236047 - RNA, 20 nt, Homo sapiens
gagguaggagaauugcuuga

SEQ ID NO: 2236048 - RNA, 18 nt, Homo sapiens
ugggaaaucaguguuuua

SEQ ID NO: 2236049 - RNA, 15 nt, Homo sapiens
agguuuccacguaag

SEQ ID NO: 2236050 - RNA, 14 nt, Homo sapiens
aaacugaugacuua

SEQ ID NO: 2236051 - RNA, 12 nt, Homo sapiens
uuucuuugaacu

SEQ ID NO: 2236052 - RNA, 21 nt, Homo sapiens
cuaacacagccaucaagggaa

SEQ ID NO: 2236053 - RNA, 21 nt, Homo sapiens
ucuugaagggcaggugcuuca

SEQ ID NO: 2236054 - RNA, 14 nt, Homo sapiens
aggaacuugaauac

SEQ ID NO: 2236055 - RNA, 21 nt, Homo sapiens
agaacauuuuauaaaacauac

SEQ ID NO: 2236056 - RNA, 21 nt, Homo sapiens
ugcuaauuauuuuaaacacuu

SEQ ID NO: 2236057 - RNA, 16 nt, Homo sapiens
agagaaauacuuucag

SEQ ID NO: 2236058 - RNA, 20 nt, Homo sapiens
gcaaaaaagaaaaauaauca

SEQ ID NO: 2236059 - RNA, 12 nt, Homo sapiens
caacaaggacaa

SEQ ID NO: 2236060 - RNA, 14 nt, Homo sapiens
gagaagcugaucca

SEQ ID NO: 2236061 - RNA, 23 nt, Homo sapiens
ucucugauggcacuuuugagcuc

SEQ ID NO: 2236062 - RNA, 22 nt, Homo sapiens
gucccaucaauucuuagaauau

SEQ ID NO: 2236063 - RNA, 13 nt, Homo sapiens
cucaaaacuuaac

SEQ ID NO: 2236064 - RNA, 15 nt, Homo sapiens
cugacagcuagacac

SEQ ID NO: 2236065 - RNA, 15 nt, Homo sapiens
cuugaaccuaugaag

SEQ ID NO: 2236066 - RNA, 21 nt, Homo sapiens
gccuagugugccaagaaugcc

SEQ ID NO: 2236067 - RNA, 20 nt, Homo sapiens
gauugcacguggccucuuga

SEQ ID NO: 2236068 - RNA, 19 nt, Homo sapiens
acucaagagcccuuccagg

SEQ ID NO: 2236069 - RNA, 18 nt, Homo sapiens
ugaccuguaguguaccau

SEQ ID NO: 2236070 - RNA, 14 nt, Homo sapiens
ugcuacuuccugcc

SEQ ID NO: 2236071 - RNA, 19 nt, Homo sapiens
uaccuaccaagauauaccu

SEQ ID NO: 2236072 - RNA, 21 nt, Homo sapiens
ccucuugacccugcacccucc

SEQ ID NO: 2236073 - RNA, 14 nt, Homo sapiens
ggugccaucaucuc

SEQ ID NO: 2236074 - RNA, 19 nt, Homo sapiens
gauacuugugaacaugccu

SEQ ID NO: 2236075 - RNA, 18 nt, Homo sapiens
uguccucacucucgccau

SEQ ID NO: 2236076 - RNA, 12 nt, Homo sapiens
caucuccagugg

SEQ ID NO: 2236077 - RNA, 15 nt, Homo sapiens
auguugaugaaaaau

SEQ ID NO: 2236078 - RNA, 16 nt, Homo sapiens
cucccagggccaugaa

SEQ ID NO: 2236079 - RNA, 18 nt, Homo sapiens
aagcaaguuuucuuccau

SEQ ID NO: 2236080 - RNA, 23 nt, Homo sapiens
gaaaaaugcaccuaaaaucuaau

SEQ ID NO: 2236081 - RNA, 14 nt, Homo sapiens
cagugcugugagca

SEQ ID NO: 2236082 - RNA, 14 nt, Homo sapiens
acacacuccgucca

SEQ ID NO: 2236083 - RNA, 13 nt, Homo sapiens
auaauugcauuca

SEQ ID NO: 2236084 - RNA, 12 nt, Homo sapiens
auccugauccca

SEQ ID NO: 2236085 - RNA, 13 nt, Homo sapiens
acuaauaacuuuu

SEQ ID NO: 2236086 - RNA, 19 nt, Homo sapiens
aaaucugggaccaaaacau

SEQ ID NO: 2236087 - RNA, 14 nt, Homo sapiens
cucuucauugucua

SEQ ID NO: 2236088 - RNA, 16 nt, Homo sapiens
uugauugggcacauca

SEQ ID NO: 2236089 - RNA, 16 nt, Homo sapiens
aacgcugacugcaaaa

SEQ ID NO: 2236090 - RNA, 13 nt, Homo sapiens
gccccuacugugg

SEQ ID NO: 2236091 - RNA, 21 nt, Homo sapiens
uguagaugaaaaagcauguac

SEQ ID NO: 2236092 - RNA, 21 nt, Homo sapiens
aaugauuguuugucaauauaa

SEQ ID NO: 2236093 - RNA, 12 nt, Homo sapiens
auguagacauaa

SEQ ID NO: 2236094 - RNA, 17 nt, Homo sapiens
uucauacuucaugaaau

SEQ ID NO: 2236095 - RNA, 16 nt, Homo sapiens
aaguguguacaagcau

SEQ ID NO: 2236096 - RNA, 12 nt, Homo sapiens
ucacuucuggga

SEQ ID NO: 2236097 - RNA, 22 nt, Homo sapiens
ccuuugcaggcccagcagacuu

SEQ ID NO: 2236098 - RNA, 20 nt, Homo sapiens
ggccacuugccucaccugcu

SEQ ID NO: 2236099 - RNA, 15 nt, Homo sapiens
aaauuccaugcacuc

SEQ ID NO: 2236100 - RNA, 14 nt, Homo sapiens
agggacccaugagu

SEQ ID NO: 2236101 - RNA, 19 nt, Homo sapiens
gcagaacugaaaaauuacu

SEQ ID NO: 2236102 - RNA, 22 nt, Homo sapiens
augccuuagaaauguaaacugc

SEQ ID NO: 2236103 - RNA, 13 nt, Homo sapiens
cauguaagcucuu

SEQ ID NO: 2236104 - RNA, 20 nt, Homo sapiens
cuuuuuuuuuuucugccuga

SEQ ID NO: 2236105 - RNA, 15 nt, Homo sapiens
aauuauaagucacaa

SEQ ID NO: 2236106 - RNA, 17 nt, Homo sapiens
uacaaaugcaauuucau

SEQ ID NO: 2236107 - RNA, 23 nt, Homo sapiens
auucaaaagcacuuugugcugug

SEQ ID NO: 2236108 - RNA, 17 nt, Homo sapiens
auucauguaacucucca

SEQ ID NO: 2236109 - RNA, 22 nt, Homo sapiens
gaccaaguuaucaucucaccac

SEQ ID NO: 2236110 - RNA, 13 nt, Homo sapiens
gucugcauaucca

SEQ ID NO: 2236111 - RNA, 18 nt, Homo sapiens
caggguuuuuaccuguca

SEQ ID NO: 2236112 - RNA, 17 nt, Homo sapiens
augguguaaugcacaau

SEQ ID NO: 2236113 - RNA, 22 nt, Homo sapiens
caggaaagaagaguuggaguga

SEQ ID NO: 2236114 - RNA, 20 nt, Homo sapiens
ccagacucguucuucuggga

SEQ ID NO: 2236115 - RNA, 14 nt, Homo sapiens
guggccgugccuga

SEQ ID NO: 2236116 - RNA, 16 nt, Homo sapiens
guacaacguguccuca

SEQ ID NO: 2236117 - RNA, 22 nt, Homo sapiens
uucaagcugagaaaaguauucu

SEQ ID NO: 2236118 - RNA, 19 nt, Homo sapiens
uuuucaauauuuguuucuu

SEQ ID NO: 2236119 - RNA, 13 nt, Homo sapiens
gaggcuacaguga

SEQ ID NO: 2236120 - RNA, 15 nt, Homo sapiens
acacuaucauggacu

SEQ ID NO: 2236121 - RNA, 21 nt, Homo sapiens
gguaucauugucuuuccugaa

SEQ ID NO: 2236122 - RNA, 20 nt, Homo sapiens
aaaagucugcauuacauucc

SEQ ID NO: 2236123 - RNA, 17 nt, Homo sapiens
gauuaguacuggauuau

SEQ ID NO: 2236124 - RNA, 23 nt, Homo sapiens
gccugcugugaugugcaaaggca

SEQ ID NO: 2236125 - RNA, 16 nt, Homo sapiens
acagacugauguguau

SEQ ID NO: 2236126 - RNA, 17 nt, Homo sapiens
uccaucuguccguccag

SEQ ID NO: 2236127 - RNA, 13 nt, Homo sapiens
uagagucauugcu

SEQ ID NO: 2236128 - RNA, 15 nt, Homo sapiens
cuuaauuauuauaaa

SEQ ID NO: 2236129 - RNA, 22 nt, Homo sapiens
aagagguucucagcaaguguac

SEQ ID NO: 2236130 - RNA, 17 nt, Homo sapiens
aacugccacagauagcu

SEQ ID NO: 2236131 - RNA, 19 nt, Homo sapiens
cuggccgcuccucccucag

SEQ ID NO: 2236132 - RNA, 16 nt, Homo sapiens
ccagacaaccaaaaca

SEQ ID NO: 2236133 - RNA, 21 nt, Homo sapiens
accugcaggcuuagguccuca

SEQ ID NO: 2236134 - RNA, 16 nt, Homo sapiens
gauugcuuaucaguag

SEQ ID NO: 2236135 - RNA, 19 nt, Homo sapiens
ugugaauuaggcuguaacu

SEQ ID NO: 2236136 - RNA, 14 nt, Homo sapiens
uguuuuaaagcacu

SEQ ID NO: 2236137 - RNA, 12 nt, Homo sapiens
uccuacacuuga

SEQ ID NO: 2236138 - RNA, 12 nt, Homo sapiens
cuguacacccca

SEQ ID NO: 2236139 - RNA, 23 nt, Homo sapiens
cacggcagcugcuggcugugaca

SEQ ID NO: 2236140 - RNA, 13 nt, Homo sapiens
uuuaauauuccug

SEQ ID NO: 2236141 - RNA, 16 nt, Homo sapiens
ugauaaguuccaaaua

SEQ ID NO: 2236142 - RNA, 13 nt, Homo sapiens
ucuguauuugcca

SEQ ID NO: 2236143 - RNA, 20 nt, Homo sapiens
agccucuggggcuguugaag

SEQ ID NO: 2236144 - RNA, 23 nt, Homo sapiens
accugccuccggccugcacuccc

SEQ ID NO: 2236145 - RNA, 13 nt, Homo sapiens
acuggggccucag

SEQ ID NO: 2236146 - RNA, 18 nt, Homo sapiens
aggcaaccucccauccca

SEQ ID NO: 2236147 - RNA, 23 nt, Homo sapiens
acaaaauuuuauuuugugcucau

SEQ ID NO: 2236148 - RNA, 18 nt, Homo sapiens
cauauaagcuauaucaua

SEQ ID NO: 2236149 - RNA, 12 nt, Homo sapiens
cuguuccaagug

SEQ ID NO: 2236150 - RNA, 14 nt, Homo sapiens
cgggauuaguacac

SEQ ID NO: 2236151 - RNA, 20 nt, Homo sapiens
caucuuauuucugucaacuu

SEQ ID NO: 2236152 - RNA, 17 nt, Homo sapiens
guuuuccaguucaucga

SEQ ID NO: 2236153 - RNA, 11 nt, Homo sapiens
gauaaaacacc

SEQ ID NO: 2236154 - RNA, 19 nt, Homo sapiens
augguaagcauuagcacau

SEQ ID NO: 2236155 - RNA, 21 nt, Homo sapiens
uuaauuuugcgauacacugca

SEQ ID NO: 2236156 - RNA, 17 nt, Homo sapiens
acagucauguaugcaag

SEQ ID NO: 2236157 - RNA, 14 nt, Homo sapiens
agucaugugugcau

SEQ ID NO: 2236158 - RNA, 20 nt, Homo sapiens
guguguaugucuauguguau

SEQ ID NO: 2236159 - RNA, 23 nt, Homo sapiens
agcucagauuauuuaaaugggaa

SEQ ID NO: 2236160 - RNA, 18 nt, Homo sapiens
ugaaagauuccacagaga

SEQ ID NO: 2236161 - RNA, 21 nt, Homo sapiens
cacaggucaggggugacacag

SEQ ID NO: 2236162 - RNA, 16 nt, Homo sapiens
gaauuugaaacacuuu

SEQ ID NO: 2236163 - RNA, 11 nt, Homo sapiens
agccuccucag

SEQ ID NO: 2236164 - RNA, 19 nt, Homo sapiens
cuaguacugccccccauga

SEQ ID NO: 2236165 - RNA, 18 nt, Homo sapiens
ucauuguuuggcauugaa

SEQ ID NO: 2236166 - RNA, 13 nt, Homo sapiens
agccuuuccauaa

SEQ ID NO: 2236167 - RNA, 15 nt, Homo sapiens
ggagugcugcagcuu

SEQ ID NO: 2236168 - RNA, 22 nt, Homo sapiens
gcacggugggccuugcugggga

SEQ ID NO: 2236169 - RNA, 16 nt, Homo sapiens
gaggaguacaggugaa

SEQ ID NO: 2236170 - RNA, 15 nt, Homo sapiens
uuuugccaaucucaa

SEQ ID NO: 2236171 - RNA, 13 nt, Homo sapiens
auuaucaucugaa

SEQ ID NO: 2236172 - RNA, 18 nt, Homo sapiens
ccauucagaaagcauuua

SEQ ID NO: 2236173 - RNA, 15 nt, Homo sapiens
ggcguggagcugccu

SEQ ID NO: 2236174 - RNA, 19 nt, Homo sapiens
cauggaccaagaaugagcu

SEQ ID NO: 2236175 - RNA, 15 nt, Homo sapiens
cucucuguagacuga

SEQ ID NO: 2236176 - RNA, 17 nt, Homo sapiens
ucaacuaaguucaggga

SEQ ID NO: 2236177 - RNA, 23 nt, Homo sapiens
uuccucuuaauucccaaucccau

SEQ ID NO: 2236178 - RNA, 17 nt, Homo sapiens
agcuucauccacugaau

SEQ ID NO: 2236179 - RNA, 20 nt, Homo sapiens
ugaaaggguuuuuaaucucc

SEQ ID NO: 2236180 - RNA, 17 nt, Homo sapiens
cucuggaggcugagaua

SEQ ID NO: 2236181 - RNA, 23 nt, Homo sapiens
cucccauggcuuugugcugcuga

SEQ ID NO: 2236182 - RNA, 12 nt, Homo sapiens
uggccuuagccc

SEQ ID NO: 2236183 - RNA, 24 nt, Homo sapiens
uaacgugugugucuuacauugcca

SEQ ID NO: 2236184 - RNA, 21 nt, Homo sapiens
cgaauauuuucaguaauguua

SEQ ID NO: 2236185 - RNA, 10 nt, Homo sapiens
ugugccucaa

SEQ ID NO: 2236186 - RNA, 22 nt, Homo sapiens
gacuguuuccagagugcuuaua

SEQ ID NO: 2236187 - RNA, 19 nt, Homo sapiens
aaacugagguauggccaug

SEQ ID NO: 2236188 - RNA, 14 nt, Homo sapiens
gccaauauccugua

SEQ ID NO: 2236189 - RNA, 14 nt, Homo sapiens
ccuguuaugccaaa

SEQ ID NO: 2236190 - RNA, 18 nt, Homo sapiens
ucuuuuuucaauguacug

SEQ ID NO: 2236191 - RNA, 18 nt, Homo sapiens
gcauauaguuaaacugag

SEQ ID NO: 2236192 - RNA, 16 nt, Homo sapiens
auaaucagugugucua

SEQ ID NO: 2236193 - RNA, 15 nt, Homo sapiens
ucucagguguugcca

SEQ ID NO: 2236194 - RNA, 16 nt, Homo sapiens
aaacaaaguugauuaa

SEQ ID NO: 2236195 - RNA, 16 nt, Homo sapiens
cacuuugccuccugug

SEQ ID NO: 2236196 - RNA, 19 nt, Homo sapiens
uuugaaaaauaaugacucu

SEQ ID NO: 2236197 - RNA, 14 nt, Homo sapiens
cuuagaaauuguaa

SEQ ID NO: 2236198 - RNA, 23 nt, Homo sapiens
cugaaaggauguagaaacaauau

SEQ ID NO: 2236199 - RNA, 20 nt, Homo sapiens
aaaauaguugagccagcaga

SEQ ID NO: 2236200 - RNA, 20 nt, Homo sapiens
guucugggcucuuuccucug

SEQ ID NO: 2236201 - RNA, 19 nt, Homo sapiens
gauuaugcagacaaccuca

SEQ ID NO: 2236202 - RNA, 15 nt, Homo sapiens
augaaauggagucau

SEQ ID NO: 2236203 - RNA, 13 nt, Homo sapiens
uccagcagucagu

SEQ ID NO: 2236204 - RNA, 16 nt, Homo sapiens
aaacucuccuagucaa

SEQ ID NO: 2236205 - RNA, 20 nt, Homo sapiens
cuuauaugagggcagauuca

SEQ ID NO: 2236206 - RNA, 14 nt, Homo sapiens
aacugacuuuaucc

SEQ ID NO: 2236207 - RNA, 13 nt, Homo sapiens
aguuagcuuuauu

SEQ ID NO: 2236208 - RNA, 21 nt, Homo sapiens
aaagauaguugauucuugccu

SEQ ID NO: 2236209 - RNA, 12 nt, Homo sapiens
uguucacuuuau

SEQ ID NO: 2236210 - RNA, 17 nt, Homo sapiens
acccuauaucuccgugu

SEQ ID NO: 2236211 - RNA, 19 nt, Homo sapiens
ucccagugacaaccaaaag

SEQ ID NO: 2236212 - RNA, 22 nt, Homo sapiens
auggaggaaauccggucagcca

SEQ ID NO: 2236213 - RNA, 16 nt, Homo sapiens
aucauaagacaaugga

SEQ ID NO: 2236214 - RNA, 19 nt, Homo sapiens
acagagaagguucugagcu

SEQ ID NO: 2236215 - RNA, 14 nt, Homo sapiens
gcuccggccugucc

SEQ ID NO: 2236216 - RNA, 15 nt, Homo sapiens
ucuauuacaccuuua

SEQ ID NO: 2236217 - RNA, 23 nt, Homo sapiens
caacauuuauauagacuguugaa

SEQ ID NO: 2236218 - RNA, 15 nt, Homo sapiens
uucccauguugucaa

SEQ ID NO: 2236219 - RNA, 17 nt, Homo sapiens
caggugauuaaaaagcu

SEQ ID NO: 2236220 - RNA, 22 nt, Homo sapiens
agcacauaacuggauuuugaac

SEQ ID NO: 2236221 - RNA, 15 nt, Homo sapiens
auguuacagaaucua

SEQ ID NO: 2236222 - RNA, 22 nt, Homo sapiens
agcucugucugcucaaugccau

SEQ ID NO: 2236223 - RNA, 14 nt, Homo sapiens
uccaguuuaaucuu

SEQ ID NO: 2236224 - RNA, 18 nt, Homo sapiens
caggguggagugcagugg

SEQ ID NO: 2236225 - RNA, 13 nt, Homo sapiens
acucuccuugcag

SEQ ID NO: 2236226 - RNA, 20 nt, Homo sapiens
aucuuacaagguugcaagag

SEQ ID NO: 2236227 - RNA, 14 nt, Homo sapiens
gaaucuagcuuauu

SEQ ID NO: 2236228 - RNA, 15 nt, Homo sapiens
aauaguacuauuacu

SEQ ID NO: 2236229 - RNA, 20 nt, Homo sapiens
guggauuggcuuugugcuug

SEQ ID NO: 2236230 - RNA, 16 nt, Homo sapiens
gcuaaacugaugacuu

SEQ ID NO: 2236231 - RNA, 17 nt, Homo sapiens
cugggacaggcuuugau

SEQ ID NO: 2236232 - RNA, 12 nt, Homo sapiens
aacaagcuuucg

SEQ ID NO: 2236233 - RNA, 22 nt, Homo sapiens
ugggaaguaugauuuguuccuu

SEQ ID NO: 2236234 - RNA, 16 nt, Homo sapiens
uaaugaagaacacugu

SEQ ID NO: 2236235 - RNA, 16 nt, Homo sapiens
acuaaaccauugugca

SEQ ID NO: 2236236 - RNA, 17 nt, Homo sapiens
auaauuacuuaaugugg

SEQ ID NO: 2236237 - RNA, 22 nt, Homo sapiens
aagaaaugaaacauccuaugaa

SEQ ID NO: 2236238 - RNA, 21 nt, Homo sapiens
accaaugugugaaguaugcac

SEQ ID NO: 2236239 - RNA, 19 nt, Homo sapiens
cagaaguaacucccacucc

SEQ ID NO: 2236240 - RNA, 18 nt, Homo sapiens
ccugacacaaucccuaca

SEQ ID NO: 2236241 - RNA, 16 nt, Homo sapiens
aggaaacaacaaagga

SEQ ID NO: 2236242 - RNA, 14 nt, Homo sapiens
uuaaaacacuuuca

SEQ ID NO: 2236243 - RNA, 19 nt, Homo sapiens
aaccaagucuacuucacua

SEQ ID NO: 2236244 - RNA, 16 nt, Homo sapiens
gcauagagguuuugua

SEQ ID NO: 2236245 - RNA, 15 nt, Homo sapiens
auuucuuuucaggga

SEQ ID NO: 2236246 - RNA, 14 nt, Homo sapiens
ugcauaguauucca

SEQ ID NO: 2236247 - RNA, 21 nt, Homo sapiens
guaaauaaccccauucuuugc

SEQ ID NO: 2236248 - RNA, 17 nt, Homo sapiens
cuuauauucagucugug

SEQ ID NO: 2236249 - RNA, 15 nt, Homo sapiens
uagcacaugauuuuc

SEQ ID NO: 2236250 - RNA, 19 nt, Homo sapiens
uaguuacuuacugccuuag

SEQ ID NO: 2236251 - RNA, 21 nt, Homo sapiens
aaaguguugggauuacaggcg

SEQ ID NO: 2236252 - RNA, 16 nt, Homo sapiens
agaaacuuugugcuac

SEQ ID NO: 2236253 - RNA, 23 nt, Homo sapiens
gacccucccaugcgggugcacac

SEQ ID NO: 2236254 - RNA, 18 nt, Homo sapiens
uucccuuugcuugucuuc

SEQ ID NO: 2236255 - RNA, 19 nt, Homo sapiens
gcuugacaccugucuugaa

SEQ ID NO: 2236256 - RNA, 19 nt, Homo sapiens
auuuguuaacuguacugaa

SEQ ID NO: 2236257 - RNA, 12 nt, Homo sapiens
gaggguacuuga

SEQ ID NO: 2236258 - RNA, 21 nt, Homo sapiens
cuugaugaagccugugccacc

SEQ ID NO: 2236259 - RNA, 19 nt, Homo sapiens
ccagauauucaagucaccu

SEQ ID NO: 2236260 - RNA, 18 nt, Homo sapiens
gcagcucaggcacacuuc

SEQ ID NO: 2236261 - RNA, 23 nt, Homo sapiens
cuaauuccacuuguucauucugu

SEQ ID NO: 2236262 - RNA, 21 nt, Homo sapiens
cucuaauuccuauaaauacga

SEQ ID NO: 2236263 - RNA, 16 nt, Homo sapiens
uauguacuaagcagua

SEQ ID NO: 2236264 - RNA, 15 nt, Homo sapiens
guuaagcacaagaca

SEQ ID NO: 2236265 - RNA, 21 nt, Homo sapiens
ucacuuagaauccgaagggaa

SEQ ID NO: 2236266 - RNA, 22 nt, Homo sapiens
aagacaaaugggccugccaaac

SEQ ID NO: 2236267 - RNA, 20 nt, Homo sapiens
aggugcugacuucaucuccc

SEQ ID NO: 2236268 - RNA, 12 nt, Homo sapiens
accuugucucau

SEQ ID NO: 2236269 - RNA, 23 nt, Homo sapiens
cuuugccaucaagaaacauucag

SEQ ID NO: 2236270 - RNA, 16 nt, Homo sapiens
gacggguaccaugcug

SEQ ID NO: 2236271 - RNA, 21 nt, Homo sapiens
gcuccccugcgccuccauggc

SEQ ID NO: 2236272 - RNA, 14 nt, Homo sapiens
uaaagaaaggcaga

SEQ ID NO: 2236273 - RNA, 17 nt, Homo sapiens
aucugauccccaugccu

SEQ ID NO: 2236274 - RNA, 15 nt, Homo sapiens
uuccaaaugagccac

SEQ ID NO: 2236275 - RNA, 17 nt, Homo sapiens
gaaaacucauguugaaa

SEQ ID NO: 2236276 - RNA, 17 nt, Homo sapiens
gacucuuccugcaaagg

SEQ ID NO: 2236277 - RNA, 13 nt, Homo sapiens
uggagaagccauu

SEQ ID NO: 2236278 - RNA, 15 nt, Homo sapiens
agcugggaguagcau

SEQ ID NO: 2236279 - RNA, 12 nt, Homo sapiens
gacaggagcacu

SEQ ID NO: 2236280 - RNA, 17 nt, Homo sapiens
uacuccuggcucaagcc

SEQ ID NO: 2236281 - RNA, 14 nt, Homo sapiens
uaaaaucuugucau

SEQ ID NO: 2236282 - RNA, 15 nt, Homo sapiens
gagccaccgugccug

SEQ ID NO: 2236283 - RNA, 13 nt, Homo sapiens
uuuugcacauucu

SEQ ID NO: 2236284 - RNA, 14 nt, Homo sapiens
aaauucaaacugcc

SEQ ID NO: 2236285 - RNA, 21 nt, Homo sapiens
aacucagccaaccuuacuuac

SEQ ID NO: 2236286 - RNA, 14 nt, Homo sapiens
auuacuauaugcaa

SEQ ID NO: 2236287 - RNA, 18 nt, Homo sapiens
uuggcugauguugcagcc

SEQ ID NO: 2236288 - RNA, 15 nt, Homo sapiens
cuaccucagaauuaa

SEQ ID NO: 2236289 - RNA, 22 nt, Homo sapiens
cucagagaguacacugugucuc

SEQ ID NO: 2236290 - RNA, 21 nt, Homo sapiens
acugugcaaauauaucugcua

SEQ ID NO: 2236291 - RNA, 13 nt, Homo sapiens
ugcugggguuauc

SEQ ID NO: 2236292 - RNA, 19 nt, Homo sapiens
auuuuuguagagccagggu

SEQ ID NO: 2236293 - RNA, 15 nt, Homo sapiens
auccugacauauuca

SEQ ID NO: 2236294 - RNA, 17 nt, Homo sapiens
acuggccuagagccuca

SEQ ID NO: 2236295 - RNA, 19 nt, Homo sapiens
uaagaaaaggcaucacuuu

SEQ ID NO: 2236296 - RNA, 12 nt, Homo sapiens
cgcccucaagaa

SEQ ID NO: 2236297 - RNA, 20 nt, Homo sapiens
auaaauauuuagucugcauu

SEQ ID NO: 2236298 - RNA, 11 nt, Homo sapiens
acacuguccau

SEQ ID NO: 2236299 - RNA, 16 nt, Homo sapiens
gagauggguccagggg

SEQ ID NO: 2236300 - RNA, 19 nt, Homo sapiens
uguuucccuucccuuccac

SEQ ID NO: 2236301 - RNA, 14 nt, Homo sapiens
acaccccacugagc

SEQ ID NO: 2236302 - RNA, 14 nt, Homo sapiens
cccucuuucaucuc

SEQ ID NO: 2236303 - RNA, 19 nt, Homo sapiens
uuuaugagaacugguucuu

SEQ ID NO: 2236304 - RNA, 17 nt, Homo sapiens
cgaccccaccacagucc

SEQ ID NO: 2236305 - RNA, 17 nt, Homo sapiens
gguggccccagcuguga

SEQ ID NO: 2236306 - RNA, 23 nt, Homo sapiens
gcacauuagagggacagccaaaa

SEQ ID NO: 2236307 - RNA, 20 nt, Homo sapiens
auacaaggcccagauguggu

SEQ ID NO: 2236308 - RNA, 16 nt, Homo sapiens
ggcugcagaugaucag

SEQ ID NO: 2236309 - RNA, 19 nt, Homo sapiens
ugcuccaaccaguccucag

SEQ ID NO: 2236310 - RNA, 12 nt, Homo sapiens
uguaaacuugua

SEQ ID NO: 2236311 - RNA, 12 nt, Homo sapiens
uuaaaacuuuaa

SEQ ID NO: 2236312 - RNA, 19 nt, Homo sapiens
agcuggacucccucaagcc

SEQ ID NO: 2236313 - RNA, 15 nt, Homo sapiens
gacucuccacugacc

SEQ ID NO: 2236314 - RNA, 16 nt, Homo sapiens
acucagggagcauuua

SEQ ID NO: 2236315 - RNA, 13 nt, Homo sapiens
gaucuugagggac

SEQ ID NO: 2236316 - RNA, 18 nt, Homo sapiens
uaucuagcauagcacaaa

SEQ ID NO: 2236317 - RNA, 16 nt, Homo sapiens
uggauugggggggcca

SEQ ID NO: 2236318 - RNA, 23 nt, Homo sapiens
uugaacaguuuaugcagugcugc

SEQ ID NO: 2236319 - RNA, 17 nt, Homo sapiens
ggccauaaguuccaaaa

SEQ ID NO: 2236320 - RNA, 16 nt, Homo sapiens
aaauauacuggggcuu

SEQ ID NO: 2236321 - RNA, 16 nt, Homo sapiens
ucaucugauuuacucu

SEQ ID NO: 2236322 - RNA, 18 nt, Homo sapiens
cagauuuuuuccucugca

SEQ ID NO: 2236323 - RNA, 18 nt, Homo sapiens
cugugagaggcagcuauc

SEQ ID NO: 2236324 - RNA, 20 nt, Homo sapiens
ucacuuguucucacugucug

SEQ ID NO: 2236325 - RNA, 13 nt, Homo sapiens
aaugucucuguga

SEQ ID NO: 2236326 - RNA, 19 nt, Homo sapiens
guguguauauauguguaua

SEQ ID NO: 2236327 - RNA, 19 nt, Homo sapiens
gugcaaaguucccuacuuc

SEQ ID NO: 2236328 - RNA, 19 nt, Homo sapiens
ccugggcucuuggccgugg

SEQ ID NO: 2236329 - RNA, 19 nt, Homo sapiens
ugcugauaccaccagacag

SEQ ID NO: 2236330 - RNA, 13 nt, Homo sapiens
ucucuacucccuc

SEQ ID NO: 2236331 - RNA, 20 nt, Homo sapiens
gucucuuuauauggccucaa

SEQ ID NO: 2236332 - RNA, 16 nt, Homo sapiens
ucuacuccaauucaua

SEQ ID NO: 2236333 - RNA, 21 nt, Homo sapiens
ccaacugauuuuguauguaaa

SEQ ID NO: 2236334 - RNA, 16 nt, Homo sapiens
gccugccucggggaca

SEQ ID NO: 2236335 - RNA, 23 nt, Homo sapiens
ggcacaaaugcaccucccaguuu

SEQ ID NO: 2236336 - RNA, 20 nt, Homo sapiens
ucuagagcuuaaugcuacau

SEQ ID NO: 2236337 - RNA, 20 nt, Homo sapiens
cccuuugggcggccucuggg

SEQ ID NO: 2236338 - RNA, 16 nt, Homo sapiens
cugcugaagacuugcc

SEQ ID NO: 2236339 - RNA, 19 nt, Homo sapiens
gucuuuugugucagugucu

SEQ ID NO: 2236340 - RNA, 17 nt, Homo sapiens
cuguguuucuugccuca

SEQ ID NO: 2236341 - RNA, 21 nt, Homo sapiens
cacucacgaauauuaugccca

SEQ ID NO: 2236342 - RNA, 22 nt, Homo sapiens
acuaccuguauuuaaaaauaga

SEQ ID NO: 2236343 - RNA, 13 nt, Homo sapiens
uuccuauuacacg

SEQ ID NO: 2236344 - RNA, 15 nt, Homo sapiens
aaaucuuaagagaau

SEQ ID NO: 2236345 - RNA, 17 nt, Homo sapiens
cuccuggcuuccagggg

SEQ ID NO: 2236346 - RNA, 18 nt, Homo sapiens
gagacacauucacaaaga

SEQ ID NO: 2236347 - RNA, 15 nt, Homo sapiens
agagagaaagccagg

SEQ ID NO: 2236348 - RNA, 16 nt, Homo sapiens
ccugggugcaucaaac

SEQ ID NO: 2236349 - RNA, 20 nt, Homo sapiens
auagacugccaugcuagaca

SEQ ID NO: 2236350 - RNA, 15 nt, Homo sapiens
cauucuggcacuuua

SEQ ID NO: 2236351 - RNA, 11 nt, Homo sapiens
uguuaugccaa

SEQ ID NO: 2236352 - RNA, 12 nt, Homo sapiens
uaaacaaaccag

SEQ ID NO: 2236353 - RNA, 18 nt, Homo sapiens
gcuuaaaagcuguucuca

SEQ ID NO: 2236354 - RNA, 22 nt, Homo sapiens
aagaaccagagaggcucugaga

SEQ ID NO: 2236355 - RNA, 21 nt, Homo sapiens
acugugcagguucccacuuaa

SEQ ID NO: 2236356 - RNA, 19 nt, Homo sapiens
uacauuuggccucugcccu

SEQ ID NO: 2236357 - RNA, 12 nt, Homo sapiens
ucucuuugauaa

SEQ ID NO: 2236358 - RNA, 12 nt, Homo sapiens
agacuugcacug

SEQ ID NO: 2236359 - RNA, 22 nt, Homo sapiens
acagaaauuaucugucauuuga

SEQ ID NO: 2236360 - RNA, 20 nt, Homo sapiens
auucaauagcauaucacaga

SEQ ID NO: 2236361 - RNA, 23 nt, Homo sapiens
gaagucucucuauuacacuggag

SEQ ID NO: 2236362 - RNA, 23 nt, Homo sapiens
aauguauaaggacuauagugauu

SEQ ID NO: 2236363 - RNA, 13 nt, Homo sapiens
agguuacuaccua

SEQ ID NO: 2236364 - RNA, 18 nt, Homo sapiens
cugggagauccugcauuu

SEQ ID NO: 2236365 - RNA, 18 nt, Homo sapiens
ugaagacucacuucucag

SEQ ID NO: 2236366 - RNA, 19 nt, Homo sapiens
uacaagguauuuacacaua

SEQ ID NO: 2236367 - RNA, 18 nt, Homo sapiens
ugcuagggaaacuucccg

SEQ ID NO: 2236368 - RNA, 20 nt, Homo sapiens
acuucgugcggaaucagcuu

SEQ ID NO: 2236369 - RNA, 22 nt, Homo sapiens
gaaaaccauucuaaaacacaac

SEQ ID NO: 2236370 - RNA, 19 nt, Homo sapiens
acacugcacacaugcacac

SEQ ID NO: 2236371 - RNA, 19 nt, Homo sapiens
gccuuucuccgcaacagcc

SEQ ID NO: 2236372 - RNA, 16 nt, Homo sapiens
accggggccugggcag

SEQ ID NO: 2236373 - RNA, 22 nt, Homo sapiens
acucccauuuuggugugcaucu

SEQ ID NO: 2236374 - RNA, 15 nt, Homo sapiens
acccaaugauucagc

SEQ ID NO: 2236375 - RNA, 22 nt, Homo sapiens
caauguacaguugaaauaacug

SEQ ID NO: 2236376 - RNA, 21 nt, Homo sapiens
guuugggguggggaagggaag

SEQ ID NO: 2236377 - RNA, 21 nt, Homo sapiens
gcucaggaaggggugugcuga

SEQ ID NO: 2236378 - RNA, 12 nt, Homo sapiens
guccaacuaaaa

SEQ ID NO: 2236379 - RNA, 11 nt, Homo sapiens
cugcuuuccac

SEQ ID NO: 2236380 - RNA, 17 nt, Homo sapiens
agaguaucaguugcagg

SEQ ID NO: 2236381 - RNA, 14 nt, Homo sapiens
ucauuccuugccau

SEQ ID NO: 2236382 - RNA, 17 nt, Homo sapiens
guaggcacaagaccaag

SEQ ID NO: 2236383 - RNA, 22 nt, Homo sapiens
gaggccaauuuuuccagcauuu

SEQ ID NO: 2236384 - RNA, 20 nt, Homo sapiens
caggaguguggccacguggg

SEQ ID NO: 2236385 - RNA, 14 nt, Homo sapiens
aaacauuucuggac

SEQ ID NO: 2236386 - RNA, 13 nt, Homo sapiens
auuuaaaugggaa

SEQ ID NO: 2236387 - RNA, 13 nt, Homo sapiens
cauauauauguau

SEQ ID NO: 2236388 - RNA, 15 nt, Homo sapiens
uuagcugucugcuca

SEQ ID NO: 2236389 - RNA, 15 nt, Homo sapiens
uaauaaaggucacau

SEQ ID NO: 2236390 - RNA, 23 nt, Homo sapiens
uccaucuggcugccuuugcuuaa

SEQ ID NO: 2236391 - RNA, 16 nt, Homo sapiens
agccacacaggaagaa

SEQ ID NO: 2236392 - RNA, 14 nt, Homo sapiens
cuucuccacuggau

SEQ ID NO: 2236393 - RNA, 17 nt, Homo sapiens
uccaaaaagcucugaaa

SEQ ID NO: 2236394 - RNA, 21 nt, Homo sapiens
ugcaaccuccacaucccaugu

SEQ ID NO: 2236395 - RNA, 22 nt, Homo sapiens
agggucucgcucuguugcccag

SEQ ID NO: 2236396 - RNA, 16 nt, Homo sapiens
ugcaugcuguagcugc

SEQ ID NO: 2236397 - RNA, 16 nt, Homo sapiens
cuuucuacaggccagc

SEQ ID NO: 2236398 - RNA, 17 nt, Homo sapiens
gaccuguggugcaaaag

SEQ ID NO: 2236399 - RNA, 15 nt, Homo sapiens
agaucucccuuaaua

SEQ ID NO: 2236400 - RNA, 16 nt, Homo sapiens
gcagcauuucauugca

SEQ ID NO: 2236401 - RNA, 22 nt, Homo sapiens
ugagucugcuuucacugugacu

SEQ ID NO: 2236402 - RNA, 16 nt, Homo sapiens
aacuacccaaaacaag

SEQ ID NO: 2236403 - RNA, 23 nt, Homo sapiens
uggugaaagaaaauucuuggaau

SEQ ID NO: 2236404 - RNA, 16 nt, Homo sapiens
uccccauaacucaaug

SEQ ID NO: 2236405 - RNA, 19 nt, Homo sapiens
uaauuuaaauagcauuauc

SEQ ID NO: 2236406 - RNA, 16 nt, Homo sapiens
ucuccuguccaaccua

SEQ ID NO: 2236407 - RNA, 23 nt, Homo sapiens
uccauccccuagaaauccuggga

SEQ ID NO: 2236408 - RNA, 16 nt, Homo sapiens
aacauucucaaucaug

SEQ ID NO: 2236409 - RNA, 13 nt, Homo sapiens
gaacaaacaauga

SEQ ID NO: 2236410 - RNA, 23 nt, Homo sapiens
agccacagcugugcaugcucagc

SEQ ID NO: 2236411 - RNA, 23 nt, Homo sapiens
cagagagggcagagggguaggca

SEQ ID NO: 2236412 - RNA, 13 nt, Homo sapiens
aagccuucagcuc

SEQ ID NO: 2236413 - RNA, 11 nt, Homo sapiens
uguguauauau

SEQ ID NO: 2236414 - RNA, 15 nt, Homo sapiens
uaguagacacacuau

SEQ ID NO: 2236415 - RNA, 15 nt, Homo sapiens
accugccacaguuca

SEQ ID NO: 2236416 - RNA, 15 nt, Homo sapiens
aacuuguagcuguaa

SEQ ID NO: 2236417 - RNA, 13 nt, Homo sapiens
accuguagcuuug

SEQ ID NO: 2236418 - RNA, 18 nt, Homo sapiens
uucaauuguaaauugaau

SEQ ID NO: 2236419 - RNA, 13 nt, Homo sapiens
ugaaaaaauaaca

SEQ ID NO: 2236420 - RNA, 16 nt, Homo sapiens
auucauauaaccacaa

SEQ ID NO: 2236421 - RNA, 13 nt, Homo sapiens
ucuaguauuucca

SEQ ID NO: 2236422 - RNA, 13 nt, Homo sapiens
cuucagcagucaa

SEQ ID NO: 2236423 - RNA, 14 nt, Homo sapiens
ugcgaguggcuuag

SEQ ID NO: 2236424 - RNA, 10 nt, Homo sapiens
cacuguguaa

SEQ ID NO: 2236425 - RNA, 18 nt, Homo sapiens
acugaggaaucagcucaa

SEQ ID NO: 2236426 - RNA, 14 nt, Homo sapiens
uauggagaguucag

SEQ ID NO: 2236427 - RNA, 17 nt, Homo sapiens
acauucauguaacucuc

SEQ ID NO: 2236428 - RNA, 22 nt, Homo sapiens
agucugagaaugcccaacucuu

SEQ ID NO: 2236429 - RNA, 12 nt, Homo sapiens
ucggcaggcagu

SEQ ID NO: 2236430 - RNA, 13 nt, Homo sapiens
ucuuaauguucac

SEQ ID NO: 2236431 - RNA, 20 nt, Homo sapiens
auuuacauccagcuucucau

SEQ ID NO: 2236432 - RNA, 20 nt, Homo sapiens
acagugccgacagcucucca

SEQ ID NO: 2236433 - RNA, 18 nt, Homo sapiens
aagacuucuggugcugcu

SEQ ID NO: 2236434 - RNA, 20 nt, Homo sapiens
guccccaaaaugugaugcuu

SEQ ID NO: 2236435 - RNA, 17 nt, Homo sapiens
guaggcacgaagcaauu

SEQ ID NO: 2236436 - RNA, 12 nt, Homo sapiens
aaaacugugaca

SEQ ID NO: 2236437 - RNA, 17 nt, Homo sapiens
gccaacccugugacuga

SEQ ID NO: 2236438 - RNA, 16 nt, Homo sapiens
guugcaagaugugaau

SEQ ID NO: 2236439 - RNA, 20 nt, Homo sapiens
cuugcgugcugggacagcua

SEQ ID NO: 2236440 - RNA, 17 nt, Homo sapiens
guggcaugaggaggucc

SEQ ID NO: 2236441 - RNA, 22 nt, Homo sapiens
ucaaccuucuagguuucucuug

SEQ ID NO: 2236442 - RNA, 19 nt, Homo sapiens
cuggaguugcccugccauc

SEQ ID NO: 2236443 - RNA, 16 nt, Homo sapiens
guucucuauuuugccu

SEQ ID NO: 2236444 - RNA, 18 nt, Homo sapiens
agguuucuugaugaucaa

SEQ ID NO: 2236445 - RNA, 19 nt, Homo sapiens
gggcucucucaugauagaa

SEQ ID NO: 2236446 - RNA, 22 nt, Homo sapiens
aggugguuggguucugccuuua

SEQ ID NO: 2236447 - RNA, 20 nt, Homo sapiens
ugcaauacacaguguuauuc

SEQ ID NO: 2236448 - RNA, 21 nt, Homo sapiens
uagcaccuuuucuccucuuug

SEQ ID NO: 2236449 - RNA, 19 nt, Homo sapiens
agaagaauaaaaaauggga

SEQ ID NO: 2236450 - RNA, 18 nt, Homo sapiens
ggcugcggccuagggguc

SEQ ID NO: 2236451 - RNA, 23 nt, Homo sapiens
uucaggaaccucgaguacugugg

SEQ ID NO: 2236452 - RNA, 19 nt, Homo sapiens
uacuucuaagguagcugca

SEQ ID NO: 2236453 - RNA, 15 nt, Homo sapiens
agaccaugaucucaa

SEQ ID NO: 2236454 - RNA, 15 nt, Homo sapiens
aagccaugugcagcc

SEQ ID NO: 2236455 - RNA, 17 nt, Homo sapiens
cggaggccccacugaug

SEQ ID NO: 2236456 - RNA, 20 nt, Homo sapiens
uuccaucacaucacauuuaa

SEQ ID NO: 2236457 - RNA, 22 nt, Homo sapiens
aagugcacagaccacacacagc

SEQ ID NO: 2236458 - RNA, 17 nt, Homo sapiens
ucacacaccccucaaaa

SEQ ID NO: 2236459 - RNA, 16 nt, Homo sapiens
cuagaggacauauuca

SEQ ID NO: 2236460 - RNA, 12 nt, Homo sapiens
uaaacaugugag

SEQ ID NO: 2236461 - RNA, 15 nt, Homo sapiens
cucucggugaccucc

SEQ ID NO: 2236462 - RNA, 21 nt, Homo sapiens
acacuuggagcccgugcagua

SEQ ID NO: 2236463 - RNA, 18 nt, Homo sapiens
acauacacaagugcacag

SEQ ID NO: 2236464 - RNA, 15 nt, Homo sapiens
aauugacaguuucaa

SEQ ID NO: 2236465 - RNA, 15 nt, Homo sapiens
agcguccucuuggcu

SEQ ID NO: 2236466 - RNA, 14 nt, Homo sapiens
uauuaauucauuaa

SEQ ID NO: 2236467 - RNA, 14 nt, Homo sapiens
uaaguauucaagua

SEQ ID NO: 2236468 - RNA, 15 nt, Homo sapiens
aaauaagagcucagg

SEQ ID NO: 2236469 - RNA, 18 nt, Homo sapiens
auuagcuuguuaguaaug

SEQ ID NO: 2236470 - RNA, 19 nt, Homo sapiens
ucuugacuacagucaggaa

SEQ ID NO: 2236471 - RNA, 17 nt, Homo sapiens
auaauaugaaaaucucc

SEQ ID NO: 2236472 - RNA, 13 nt, Homo sapiens
acaugacuaggaa

SEQ ID NO: 2236473 - RNA, 14 nt, Homo sapiens
cugcagacucacug

SEQ ID NO: 2236474 - RNA, 15 nt, Homo sapiens
gaacuagagaaggac

SEQ ID NO: 2236475 - RNA, 20 nt, Homo sapiens
uggcagaccgugaccaucuu

SEQ ID NO: 2236476 - RNA, 20 nt, Homo sapiens
ggcucuccucgcagguguuc

SEQ ID NO: 2236477 - RNA, 15 nt, Homo sapiens
uccuguucacucugu

SEQ ID NO: 2236478 - RNA, 17 nt, Homo sapiens
caggugugguugcucac

SEQ ID NO: 2236479 - RNA, 15 nt, Homo sapiens
agaagccugagcuca

SEQ ID NO: 2236480 - RNA, 20 nt, Homo sapiens
aaaaacaacugaccaguugu

SEQ ID NO: 2236481 - RNA, 16 nt, Homo sapiens
uuuuuacagcacacac

SEQ ID NO: 2236482 - RNA, 18 nt, Homo sapiens
guguugcaaguuggucca

SEQ ID NO: 2236483 - RNA, 17 nt, Homo sapiens
cccaaguuguggugcug

SEQ ID NO: 2236484 - RNA, 20 nt, Homo sapiens
gaaauuguguuugacauucu

SEQ ID NO: 2236485 - RNA, 18 nt, Homo sapiens
ucuuauuugaaggccagc

SEQ ID NO: 2236486 - RNA, 21 nt, Homo sapiens
uugucuuuuuuuucauccuuu

SEQ ID NO: 2236487 - RNA, 20 nt, Homo sapiens
ccaaagcccuuauguuuaau

SEQ ID NO: 2236488 - RNA, 23 nt, Homo sapiens
ucugucaguaggggcaugguaua

SEQ ID NO: 2236489 - RNA, 16 nt, Homo sapiens
agucacgcaugcagug

SEQ ID NO: 2236490 - RNA, 12 nt, Homo sapiens
cucauuagacug

SEQ ID NO: 2236491 - RNA, 16 nt, Homo sapiens
ccuaacacggugcuca

SEQ ID NO: 2236492 - RNA, 21 nt, Homo sapiens
ugaaaacagcagcaaugcaau

SEQ ID NO: 2236493 - RNA, 12 nt, Homo sapiens
gaguaagcacgu

SEQ ID NO: 2236494 - RNA, 15 nt, Homo sapiens
caaucucuugcauuu

SEQ ID NO: 2236495 - RNA, 21 nt, Homo sapiens
cucauuucaaguuaugauuca

SEQ ID NO: 2236496 - RNA, 12 nt, Homo sapiens
cauuacuacaaa

SEQ ID NO: 2236497 - RNA, 21 nt, Homo sapiens
aauucagugaugugccuaaau

SEQ ID NO: 2236498 - RNA, 19 nt, Homo sapiens
uuggacauagcgaauacaa

SEQ ID NO: 2236499 - RNA, 15 nt, Homo sapiens
gaacaacauaucuca

SEQ ID NO: 2236500 - RNA, 17 nt, Homo sapiens
uauaauuuauguaugca

SEQ ID NO: 2236501 - RNA, 22 nt, Homo sapiens
aaggguaccuugaacacugggg

SEQ ID NO: 2236502 - RNA, 20 nt, Homo sapiens
guagaccucuuuuucuuacc

SEQ ID NO: 2236503 - RNA, 20 nt, Homo sapiens
caugucuuuccuauuugcac

SEQ ID NO: 2236504 - RNA, 15 nt, Homo sapiens
acccugccagugcca

SEQ ID NO: 2236505 - RNA, 18 nt, Homo sapiens
ggcacuuuaaagcauuaa

SEQ ID NO: 2236506 - RNA, 15 nt, Homo sapiens
agauguugggaacag

SEQ ID NO: 2236507 - RNA, 20 nt, Homo sapiens
agcucagcauuguguacaaa

SEQ ID NO: 2236508 - RNA, 22 nt, Homo sapiens
aagcaaagacaaaagaaacuua

SEQ ID NO: 2236509 - RNA, 21 nt, Homo sapiens
cuucuuagcuauugcucugag

SEQ ID NO: 2236510 - RNA, 14 nt, Homo sapiens
cuugacaacaucug

SEQ ID NO: 2236511 - RNA, 21 nt, Homo sapiens
aggugcucagcccaggcacaa

SEQ ID NO: 2236512 - RNA, 16 nt, Homo sapiens
auaaacugugucuguc

SEQ ID NO: 2236513 - RNA, 17 nt, Homo sapiens
gaugggcccuaugucuc

SEQ ID NO: 2236514 - RNA, 14 nt, Homo sapiens
uaccuucuaccucu

SEQ ID NO: 2236515 - RNA, 22 nt, Homo sapiens
gcugaaaaaucacauccuggcc

SEQ ID NO: 2236516 - RNA, 17 nt, Homo sapiens
ucccaauucauccucac

SEQ ID NO: 2236517 - RNA, 18 nt, Homo sapiens
gagauggaggcgggaaaa

SEQ ID NO: 2236518 - RNA, 16 nt, Homo sapiens
agcaucugcucugaga

SEQ ID NO: 2236519 - RNA, 12 nt, Homo sapiens
ccagauaccagc

SEQ ID NO: 2236520 - RNA, 17 nt, Homo sapiens
aagaaaaagguuugcau

SEQ ID NO: 2236521 - RNA, 21 nt, Homo sapiens
aacaaaaucacagcacccacu

SEQ ID NO: 2236522 - RNA, 23 nt, Homo sapiens
uucugcuguuuuuuuugcugcua

SEQ ID NO: 2236523 - RNA, 17 nt, Homo sapiens
ccuucccaauccagugg

SEQ ID NO: 2236524 - RNA, 14 nt, Homo sapiens
agucacugcacagu

SEQ ID NO: 2236525 - RNA, 18 nt, Homo sapiens
gaugucaugacaacacua

SEQ ID NO: 2236526 - RNA, 19 nt, Homo sapiens
ugaaggugauucaccaaaa

SEQ ID NO: 2236527 - RNA, 16 nt, Homo sapiens
ugagacucagugcaga

SEQ ID NO: 2236528 - RNA, 18 nt, Homo sapiens
aauugccuguaacacaua

SEQ ID NO: 2236529 - RNA, 15 nt, Homo sapiens
aauguucauggacua

SEQ ID NO: 2236530 - RNA, 14 nt, Homo sapiens
cucuaaccauucaa

SEQ ID NO: 2236531 - RNA, 16 nt, Homo sapiens
uuaaaucaaaagggag

SEQ ID NO: 2236532 - RNA, 15 nt, Homo sapiens
guucuuucaucuccc

SEQ ID NO: 2236533 - RNA, 12 nt, Homo sapiens
agccucauuuga

SEQ ID NO: 2236534 - RNA, 22 nt, Homo sapiens
aaauuggacuggugaaaacaga

SEQ ID NO: 2236535 - RNA, 20 nt, Homo sapiens
gagugcaccacuucaaguga

SEQ ID NO: 2236536 - RNA, 18 nt, Homo sapiens
aggaaaagcaaauugaug

SEQ ID NO: 2236537 - RNA, 16 nt, Homo sapiens
uagaugggacuacagg

SEQ ID NO: 2236538 - RNA, 19 nt, Homo sapiens
ugaaaguccagcacuggaa

SEQ ID NO: 2236539 - RNA, 18 nt, Homo sapiens
uagcaucaguagauuucu

SEQ ID NO: 2236540 - RNA, 18 nt, Homo sapiens
accucaccccauugauug

SEQ ID NO: 2236541 - RNA, 14 nt, Homo sapiens
aaguuugcuguacc

SEQ ID NO: 2236542 - RNA, 17 nt, Homo sapiens
ugucagaagcugggaac

SEQ ID NO: 2236543 - RNA, 19 nt, Homo sapiens
ugcuggugaaaacaauuuu

SEQ ID NO: 2236544 - RNA, 15 nt, Homo sapiens
acuucuggcacugug

SEQ ID NO: 2236545 - RNA, 17 nt, Homo sapiens
uucagaaauauaugcag

SEQ ID NO: 2236546 - RNA, 16 nt, Homo sapiens
accaguguuaguggga

SEQ ID NO: 2236547 - RNA, 14 nt, Homo sapiens
gccaguaaucccag

SEQ ID NO: 2236548 - RNA, 21 nt, Homo sapiens
gcagucggugguaccugagau

SEQ ID NO: 2236549 - RNA, 12 nt, Homo sapiens
agcugcacugca

SEQ ID NO: 2236550 - RNA, 12 nt, Homo sapiens
agaugcacugaa

SEQ ID NO: 2236551 - RNA, 20 nt, Homo sapiens
cugcggcucagccuugcaca

SEQ ID NO: 2236552 - RNA, 21 nt, Homo sapiens
guaaguaguaaugauucucaa

SEQ ID NO: 2236553 - RNA, 20 nt, Homo sapiens
ccauaauaagagaauguucc

SEQ ID NO: 2236554 - RNA, 14 nt, Homo sapiens
ucccaaagugaacu

SEQ ID NO: 2236555 - RNA, 14 nt, Homo sapiens
ucaccaagugcaau

SEQ ID NO: 2236556 - RNA, 17 nt, Homo sapiens
acaggguguugucagca

SEQ ID NO: 2236557 - RNA, 23 nt, Homo sapiens
ggaagacaaauacacauacauau

SEQ ID NO: 2236558 - RNA, 17 nt, Homo sapiens
ucauugcuucacaaccc

SEQ ID NO: 2236559 - RNA, 17 nt, Homo sapiens
ugaaugagccaaagaac

SEQ ID NO: 2236560 - RNA, 16 nt, Homo sapiens
uaguauuaugauugca

SEQ ID NO: 2236561 - RNA, 15 nt, Homo sapiens
aagacagagauacca

SEQ ID NO: 2236562 - RNA, 23 nt, Homo sapiens
uucauuaagcccucuuccaucau

SEQ ID NO: 2236563 - RNA, 23 nt, Homo sapiens
gccagaaagaaguuaacuacagu

SEQ ID NO: 2236564 - RNA, 16 nt, Homo sapiens
aauugaagaaugggaa

SEQ ID NO: 2236565 - RNA, 18 nt, Homo sapiens
aguaaauacauuauugaa

SEQ ID NO: 2236566 - RNA, 20 nt, Homo sapiens
cauuaaaacugaagucugaa

SEQ ID NO: 2236567 - RNA, 20 nt, Homo sapiens
guauuuuuucuaaugugcau

SEQ ID NO: 2236568 - RNA, 20 nt, Homo sapiens
auuaugggaacaaguguaca

SEQ ID NO: 2236569 - RNA, 22 nt, Homo sapiens
uguaguaaaccaggccucccag

SEQ ID NO: 2236570 - RNA, 13 nt, Homo sapiens
acagugucacugg

SEQ ID NO: 2236571 - RNA, 14 nt, Homo sapiens
agcaagcuauucaa

SEQ ID NO: 2236572 - RNA, 20 nt, Homo sapiens
ccacuggacacugugaaaua

SEQ ID NO: 2236573 - RNA, 23 nt, Homo sapiens
ugccuuuuuauuuauauguacug

SEQ ID NO: 2236574 - RNA, 16 nt, Homo sapiens
gcuugggccacugccc

SEQ ID NO: 2236575 - RNA, 16 nt, Homo sapiens
aaguauguaaguauca

SEQ ID NO: 2236576 - RNA, 19 nt, Homo sapiens
cuuagagugcccagcagag

SEQ ID NO: 2236577 - RNA, 20 nt, Homo sapiens
ugagucugaguccugucucu

SEQ ID NO: 2236578 - RNA, 15 nt, Homo sapiens
caggggcaaaaguca

SEQ ID NO: 2236579 - RNA, 15 nt, Homo sapiens
uacccucccuuugaa

SEQ ID NO: 2236580 - RNA, 18 nt, Homo sapiens
acaaagaauuccaaagca

SEQ ID NO: 2236581 - RNA, 23 nt, Homo sapiens
gcagaggcuuugcugcugugaau

SEQ ID NO: 2236582 - RNA, 16 nt, Homo sapiens
ucuuacccuguacaua

SEQ ID NO: 2236583 - RNA, 14 nt, Homo sapiens
uugauacaaaguac

SEQ ID NO: 2236584 - RNA, 12 nt, Homo sapiens
caugauaccugg

SEQ ID NO: 2236585 - RNA, 16 nt, Homo sapiens
ugcaauguagucaaua

SEQ ID NO: 2236586 - RNA, 18 nt, Homo sapiens
ugcacagaccacacagca

SEQ ID NO: 2236587 - RNA, 23 nt, Homo sapiens
ccauuuugaagugggauguuaau

SEQ ID NO: 2236588 - RNA, 21 nt, Homo sapiens
gcagaaaaugaacugcuuugg

SEQ ID NO: 2236589 - RNA, 16 nt, Homo sapiens
cacccugggaguuucc

SEQ ID NO: 2236590 - RNA, 17 nt, Homo sapiens
guuucugggcggccagu

SEQ ID NO: 2236591 - RNA, 15 nt, Homo sapiens
aaaauugaguuucag

SEQ ID NO: 2236592 - RNA, 23 nt, Homo sapiens
ucacaaugccuagacuguguaug

SEQ ID NO: 2236593 - RNA, 15 nt, Homo sapiens
agugaaaacaucugc

SEQ ID NO: 2236594 - RNA, 21 nt, Homo sapiens
guagucauuuucaagacugaa

SEQ ID NO: 2236595 - RNA, 15 nt, Homo sapiens
augggauugaagggg

SEQ ID NO: 2236596 - RNA, 22 nt, Homo sapiens
cagaaacagugggagcccugac

SEQ ID NO: 2236597 - RNA, 17 nt, Homo sapiens
aaagcaagcugauuaaa

SEQ ID NO: 2236598 - RNA, 14 nt, Homo sapiens
uccuuccucccacc

SEQ ID NO: 2236599 - RNA, 17 nt, Homo sapiens
ccccugagcugaauaaa

SEQ ID NO: 2236600 - RNA, 19 nt, Homo sapiens
uguacugccuuaaauguac

SEQ ID NO: 2236601 - RNA, 22 nt, Homo sapiens
ucccagggccuuaaaagccauc

SEQ ID NO: 2236602 - RNA, 17 nt, Homo sapiens
ugaagucccucuauguc

SEQ ID NO: 2236603 - RNA, 23 nt, Homo sapiens
aaagauuuucuaaggaaugcaca

SEQ ID NO: 2236604 - RNA, 15 nt, Homo sapiens
gaggcuuuacagugu

SEQ ID NO: 2236605 - RNA, 15 nt, Homo sapiens
uguccaauaugaaaa

SEQ ID NO: 2236606 - RNA, 17 nt, Homo sapiens
cuacuggggaucagagu

SEQ ID NO: 2236607 - RNA, 15 nt, Homo sapiens
caaaaaugauccuca

SEQ ID NO: 2236608 - RNA, 13 nt, Homo sapiens
ugaaugaagucaa

SEQ ID NO: 2236609 - RNA, 18 nt, Homo sapiens
uggcuucugcuugucauc

SEQ ID NO: 2236610 - RNA, 17 nt, Homo sapiens
cucaaagaaauuuccac

SEQ ID NO: 2236611 - RNA, 22 nt, Homo sapiens
ucauuuggguuaauauggcucu

SEQ ID NO: 2236612 - RNA, 20 nt, Homo sapiens
agccaaaggccgugccuggu

SEQ ID NO: 2236613 - RNA, 17 nt, Homo sapiens
agaccaucccugaaggc

SEQ ID NO: 2236614 - RNA, 12 nt, Homo sapiens
aggacacuucaa

SEQ ID NO: 2236615 - RNA, 12 nt, Homo sapiens
agggcacuucag

SEQ ID NO: 2236616 - RNA, 22 nt, Homo sapiens
auccaagaccuuacaaccacau

SEQ ID NO: 2236617 - RNA, 17 nt, Homo sapiens
cucuggaccauauacca

SEQ ID NO: 2236618 - RNA, 24 nt, Homo sapiens
aaggagccaauugauuucaacaga

SEQ ID NO: 2236619 - RNA, 20 nt, Homo sapiens
gaaaaaaaguugcaaucugu

SEQ ID NO: 2236620 - RNA, 16 nt, Homo sapiens
uaugccuccauuucag

SEQ ID NO: 2236621 - RNA, 19 nt, Homo sapiens
acauucaagagagcucguu

SEQ ID NO: 2236622 - RNA, 14 nt, Homo sapiens
ugugcccucagauu

SEQ ID NO: 2236623 - RNA, 13 nt, Homo sapiens
gcgaagaggaccc

SEQ ID NO: 2236624 - RNA, 13 nt, Homo sapiens
cagcagagcccac

SEQ ID NO: 2236625 - RNA, 19 nt, Homo sapiens
accaugggcucagggccag

SEQ ID NO: 2236626 - RNA, 17 nt, Homo sapiens
cauggcaaguacaguac

SEQ ID NO: 2236627 - RNA, 15 nt, Homo sapiens
ugaaaaaacacuuua

SEQ ID NO: 2236628 - RNA, 20 nt, Homo sapiens
ugucaggaaucaugaucuga

SEQ ID NO: 2236629 - RNA, 22 nt, Homo sapiens
auuuuguuacaaaaagacaaaa

SEQ ID NO: 2236630 - RNA, 14 nt, Homo sapiens
auuuuuuugcaagu

SEQ ID NO: 2236631 - RNA, 19 nt, Homo sapiens
ucugccauuaaaacauuac

SEQ ID NO: 2236632 - RNA, 19 nt, Homo sapiens
uacaaauuuaugcauuuca

SEQ ID NO: 2236633 - RNA, 13 nt, Homo sapiens
uugugaugcauuu

SEQ ID NO: 2236634 - RNA, 11 nt, Homo sapiens
gacagugaaag

SEQ ID NO: 2236635 - RNA, 17 nt, Homo sapiens
ucaucccuuaauuuaag

SEQ ID NO: 2236636 - RNA, 17 nt, Homo sapiens
aaauucaugcaucucaa

SEQ ID NO: 2236637 - RNA, 21 nt, Homo sapiens
acuuggucuuuuuucuggguc

SEQ ID NO: 2236638 - RNA, 23 nt, Homo sapiens
uguacacaaaucccuauguugcu

SEQ ID NO: 2236639 - RNA, 22 nt, Homo sapiens
aaugcauucaaaguaauauauc

SEQ ID NO: 2236640 - RNA, 23 nt, Homo sapiens
aauuaugaguuugcccucuuucc

SEQ ID NO: 2236641 - RNA, 12 nt, Homo sapiens
ugaacacugggg

SEQ ID NO: 2236642 - RNA, 15 nt, Homo sapiens
aaucuccugcugauu

SEQ ID NO: 2236643 - RNA, 23 nt, Homo sapiens
gccaaggugggguauuuaccaca

SEQ ID NO: 2236644 - RNA, 22 nt, Homo sapiens
auaacuauugauauaauuucca

SEQ ID NO: 2236645 - RNA, 15 nt, Homo sapiens
uguacuacaguauac

SEQ ID NO: 2236646 - RNA, 12 nt, Homo sapiens
ucccugacagca

SEQ ID NO: 2236647 - RNA, 22 nt, Homo sapiens
uuuguccaucuugagaugguga

SEQ ID NO: 2236648 - RNA, 16 nt, Homo sapiens
gaaucuuuccuuccuc

SEQ ID NO: 2236649 - RNA, 16 nt, Homo sapiens
cuucaagagcugagaa

SEQ ID NO: 2236650 - RNA, 23 nt, Homo sapiens
cuccauuuugaauagggguugag

SEQ ID NO: 2236651 - RNA, 22 nt, Homo sapiens
agucuuccaaaccaccuucccu

SEQ ID NO: 2236652 - RNA, 15 nt, Homo sapiens
auguguucucuaggc

SEQ ID NO: 2236653 - RNA, 14 nt, Homo sapiens
ucacagaguacaaa

SEQ ID NO: 2236654 - RNA, 22 nt, Homo sapiens
gaacugcaccaccgaccaacuc

SEQ ID NO: 2236655 - RNA, 17 nt, Homo sapiens
caacaucacagcccagc

SEQ ID NO: 2236656 - RNA, 20 nt, Homo sapiens
caagaucgccccacugcacu

SEQ ID NO: 2236657 - RNA, 22 nt, Homo sapiens
cacucacucucccccuccucuu

SEQ ID NO: 2236658 - RNA, 22 nt, Homo sapiens
ucuccccacugcucauuuggau

SEQ ID NO: 2236659 - RNA, 20 nt, Homo sapiens
agaugagauuggcauggcuu

SEQ ID NO: 2236660 - RNA, 15 nt, Homo sapiens
cuccuggugagauua

SEQ ID NO: 2236661 - RNA, 21 nt, Homo sapiens
agaugguguaugcuguaucca

SEQ ID NO: 2236662 - RNA, 16 nt, Homo sapiens
agcugaauuauuagua

SEQ ID NO: 2236663 - RNA, 11 nt, Homo sapiens
aagacuugaau

SEQ ID NO: 2236664 - RNA, 21 nt, Homo sapiens
caccaacacugcucacagccu

SEQ ID NO: 2236665 - RNA, 15 nt, Homo sapiens
cuuggcagcccugau

SEQ ID NO: 2236666 - RNA, 23 nt, Homo sapiens
gacucacuguguggccucagaga

SEQ ID NO: 2236667 - RNA, 15 nt, Homo sapiens
ucuucccgcacaaau

SEQ ID NO: 2236668 - RNA, 16 nt, Homo sapiens
uauuuugaaacuuugc

SEQ ID NO: 2236669 - RNA, 14 nt, Homo sapiens
acaauuaaaucucu

SEQ ID NO: 2236670 - RNA, 13 nt, Homo sapiens
aagcacaucugca

SEQ ID NO: 2236671 - RNA, 16 nt, Homo sapiens
uaagauuaauuuucuc

SEQ ID NO: 2236672 - RNA, 19 nt, Homo sapiens
cuauguguguuguuuccau

SEQ ID NO: 2236673 - RNA, 21 nt, Homo sapiens
gccaggaggggaaacaucaca

SEQ ID NO: 2236674 - RNA, 21 nt, Homo sapiens
guaacuacccucucaaaugga

SEQ ID NO: 2236675 - RNA, 18 nt, Homo sapiens
aucuguaggguugacaaa

SEQ ID NO: 2236676 - RNA, 23 nt, Homo sapiens
ggucaguggaagccccaacggga

SEQ ID NO: 2236677 - RNA, 14 nt, Homo sapiens
uuuaaccuaugaua

SEQ ID NO: 2236678 - RNA, 20 nt, Homo sapiens
uaucauucagaaugugcaaa

SEQ ID NO: 2236679 - RNA, 20 nt, Homo sapiens
agcccugggcaaggaagcuu

SEQ ID NO: 2236680 - RNA, 19 nt, Homo sapiens
uuggagcagugcuuuucac

SEQ ID NO: 2236681 - RNA, 14 nt, Homo sapiens
ugauuacuaaggaa

SEQ ID NO: 2236682 - RNA, 21 nt, Homo sapiens
gacuuugagcugagugcugaa

SEQ ID NO: 2236683 - RNA, 14 nt, Homo sapiens
aaccuuccaucucg

SEQ ID NO: 2236684 - RNA, 18 nt, Homo sapiens
ucacagucucaguucucu

SEQ ID NO: 2236685 - RNA, 16 nt, Homo sapiens
uaguguaaccauuuag

SEQ ID NO: 2236686 - RNA, 15 nt, Homo sapiens
agccugaauuucuca

SEQ ID NO: 2236687 - RNA, 14 nt, Homo sapiens
uugcuguguaucug

SEQ ID NO: 2236688 - RNA, 23 nt, Homo sapiens
agacuagaaaauuagacugugau

SEQ ID NO: 2236689 - RNA, 23 nt, Homo sapiens
gagggaagaaugaacacucccca

SEQ ID NO: 2236690 - RNA, 18 nt, Homo sapiens
accucagaaagauuugau

SEQ ID NO: 2236691 - RNA, 13 nt, Homo sapiens
gcacuccaugagu

SEQ ID NO: 2236692 - RNA, 18 nt, Homo sapiens
uugcccucuuauguauuu

SEQ ID NO: 2236693 - RNA, 19 nt, Homo sapiens
uaauaaagaaauauuuacc

SEQ ID NO: 2236694 - RNA, 15 nt, Homo sapiens
cacugauaagacugu

SEQ ID NO: 2236695 - RNA, 14 nt, Homo sapiens
gacccacagacugg

SEQ ID NO: 2236696 - RNA, 14 nt, Homo sapiens
cuguggcacugcca

SEQ ID NO: 2236697 - RNA, 21 nt, Homo sapiens
ugaaguagaggacuaaccaug

SEQ ID NO: 2236698 - RNA, 16 nt, Homo sapiens
acaguauuacaguguc

SEQ ID NO: 2236699 - RNA, 19 nt, Homo sapiens
acuuucugagauggcuuuu

SEQ ID NO: 2236700 - RNA, 16 nt, Homo sapiens
acagcaggaacugagc

SEQ ID NO: 2236701 - RNA, 12 nt, Homo sapiens
cauugcugccaa

SEQ ID NO: 2236702 - RNA, 21 nt, Homo sapiens
gacucagagaaccagugcaga

SEQ ID NO: 2236703 - RNA, 12 nt, Homo sapiens
agcuggugcugc

SEQ ID NO: 2236704 - RNA, 15 nt, Homo sapiens
ugugugaacguguau

SEQ ID NO: 2236705 - RNA, 15 nt, Homo sapiens
ugacugagaauauaa

SEQ ID NO: 2236706 - RNA, 15 nt, Homo sapiens
ccuacucacacuuca

SEQ ID NO: 2236707 - RNA, 16 nt, Homo sapiens
gauaugcugcuuuaaa

SEQ ID NO: 2236708 - RNA, 10 nt, Homo sapiens
cgaguccuca

SEQ ID NO: 2236709 - RNA, 14 nt, Homo sapiens
aacacaugccuuaa

SEQ ID NO: 2236710 - RNA, 17 nt, Homo sapiens
ggccuggguuuguacuu

SEQ ID NO: 2236711 - RNA, 13 nt, Homo sapiens
uguagccagcaga

SEQ ID NO: 2236712 - RNA, 14 nt, Homo sapiens
aucaucccagggga

SEQ ID NO: 2236713 - RNA, 14 nt, Homo sapiens
uugguauauuucca

SEQ ID NO: 2236714 - RNA, 11 nt, Homo sapiens
uuuccauuugc

SEQ ID NO: 2236715 - RNA, 14 nt, Homo sapiens
aguucaauaaucca

SEQ ID NO: 2236716 - RNA, 18 nt, Homo sapiens
ugcccucucugaaccuca

SEQ ID NO: 2236717 - RNA, 18 nt, Homo sapiens
aggaucaaagaacugaaa

SEQ ID NO: 2236718 - RNA, 20 nt, Homo sapiens
acaagcuuguauauacauau

SEQ ID NO: 2236719 - RNA, 12 nt, Homo sapiens
accccaucccuu

SEQ ID NO: 2236720 - RNA, 16 nt, Homo sapiens
ucagcugccagugucc

SEQ ID NO: 2236721 - RNA, 20 nt, Homo sapiens
cguggggguggccacuccug

SEQ ID NO: 2236722 - RNA, 15 nt, Homo sapiens
ggaaaccacacuucu

SEQ ID NO: 2236723 - RNA, 22 nt, Homo sapiens
uguguuauuauuuugcacuguu

SEQ ID NO: 2236724 - RNA, 14 nt, Homo sapiens
gguguuuuaugggc

SEQ ID NO: 2236725 - RNA, 13 nt, Homo sapiens
aacacaaagugaa

SEQ ID NO: 2236726 - RNA, 20 nt, Homo sapiens
uagacuggccaugcaagugg

SEQ ID NO: 2236727 - RNA, 16 nt, Homo sapiens
aauggugcucauuuca

SEQ ID NO: 2236728 - RNA, 13 nt, Homo sapiens
gaacauagggaca

SEQ ID NO: 2236729 - RNA, 19 nt, Homo sapiens
cucagaugggcagcagcuu

SEQ ID NO: 2236730 - RNA, 13 nt, Homo sapiens
caugcugcaaagg

SEQ ID NO: 2236731 - RNA, 16 nt, Homo sapiens
ucgggagccaugucau

SEQ ID NO: 2236732 - RNA, 20 nt, Homo sapiens
uauaaauacaaaucuguaua

SEQ ID NO: 2236733 - RNA, 18 nt, Homo sapiens
cucuuuguggucauguga

SEQ ID NO: 2236734 - RNA, 14 nt, Homo sapiens
aggauuccuuggca

SEQ ID NO: 2236735 - RNA, 20 nt, Homo sapiens
uuguuuuauauguaguacua

SEQ ID NO: 2236736 - RNA, 12 nt, Homo sapiens
ccugcaaaaaga

SEQ ID NO: 2236737 - RNA, 13 nt, Homo sapiens
cuggccugacucc

SEQ ID NO: 2236738 - RNA, 19 nt, Homo sapiens
ccugggagaaccucaggcu

SEQ ID NO: 2236739 - RNA, 20 nt, Homo sapiens
aucccuuuuuuuacauuuca

SEQ ID NO: 2236740 - RNA, 19 nt, Homo sapiens
ugucuuccaaccccagcug

SEQ ID NO: 2236741 - RNA, 20 nt, Homo sapiens
uuuaaaaaaaaauugaacaa

SEQ ID NO: 2236742 - RNA, 17 nt, Homo sapiens
caauuuuugguugaaua

SEQ ID NO: 2236743 - RNA, 13 nt, Homo sapiens
caccaucuguaua

SEQ ID NO: 2236744 - RNA, 15 nt, Homo sapiens
auguccucagcauuu

SEQ ID NO: 2236745 - RNA, 15 nt, Homo sapiens
aauccacaagccauu

SEQ ID NO: 2236746 - RNA, 11 nt, Homo sapiens
cuuugcaguau

SEQ ID NO: 2236747 - RNA, 17 nt, Homo sapiens
uguuuugugacuuuuag

SEQ ID NO: 2236748 - RNA, 14 nt, Homo sapiens
cccuccacuucucc

SEQ ID NO: 2236749 - RNA, 16 nt, Homo sapiens
augcaagcgacaggaa

SEQ ID NO: 2236750 - RNA, 17 nt, Homo sapiens
ugccaaauugacuguca

SEQ ID NO: 2236751 - RNA, 23 nt, Homo sapiens
ggcccuaagagguuuuuccucuu

SEQ ID NO: 2236752 - RNA, 22 nt, Homo sapiens
aaauuccacaucaaguguucca

SEQ ID NO: 2236753 - RNA, 16 nt, Homo sapiens
aaccccaucucuacua

SEQ ID NO: 2236754 - RNA, 15 nt, Homo sapiens
cgcuaugugcacuga

SEQ ID NO: 2236755 - RNA, 13 nt, Homo sapiens
gaauguugguuuu

SEQ ID NO: 2236756 - RNA, 17 nt, Homo sapiens
agaacacuacugcuaaa

SEQ ID NO: 2236757 - RNA, 16 nt, Homo sapiens
ucccaggucacaugca

SEQ ID NO: 2236758 - RNA, 18 nt, Homo sapiens
aaagacaagacucugggg

SEQ ID NO: 2236759 - RNA, 19 nt, Homo sapiens
accuccuuauguauucuca

SEQ ID NO: 2236760 - RNA, 17 nt, Homo sapiens
ucaauaaaaaucugcuc

SEQ ID NO: 2236761 - RNA, 16 nt, Homo sapiens
uaaaaaacuucaugua

SEQ ID NO: 2236762 - RNA, 22 nt, Homo sapiens
gagcaaaacuccgucucaaaaa

SEQ ID NO: 2236763 - RNA, 21 nt, Homo sapiens
cauaugugagugaaaguacuu

SEQ ID NO: 2236764 - RNA, 17 nt, Homo sapiens
cuucucccaaagugucc

SEQ ID NO: 2236765 - RNA, 15 nt, Homo sapiens
aacuuuguuucucau

SEQ ID NO: 2236766 - RNA, 16 nt, Homo sapiens
gcaaugacucaaaguc

SEQ ID NO: 2236767 - RNA, 16 nt, Homo sapiens
gcccagugucccugag

SEQ ID NO: 2236768 - RNA, 17 nt, Homo sapiens
cuuugaacaagguuuca

SEQ ID NO: 2236769 - RNA, 19 nt, Homo sapiens
acuucaugaaauccugggu

SEQ ID NO: 2236770 - RNA, 14 nt, Homo sapiens
ugcuugaccaaaga

SEQ ID NO: 2236771 - RNA, 14 nt, Homo sapiens
aaggacuuuaucug

SEQ ID NO: 2236772 - RNA, 22 nt, Homo sapiens
aagcugcccuugaagacuuccc

SEQ ID NO: 2236773 - RNA, 21 nt, Homo sapiens
uaugccaaaccuuggcauuuu

SEQ ID NO: 2236774 - RNA, 12 nt, Homo sapiens
cccuuagcuuuu

SEQ ID NO: 2236775 - RNA, 18 nt, Homo sapiens
cacagaauucacuuuaug

SEQ ID NO: 2236776 - RNA, 22 nt, Homo sapiens
uacuuuuuucuuauuuaacuua

SEQ ID NO: 2236777 - RNA, 17 nt, Homo sapiens
agugauagcuacuguag

SEQ ID NO: 2236778 - RNA, 23 nt, Homo sapiens
uccuacacguuagauuugccgua

SEQ ID NO: 2236779 - RNA, 12 nt, Homo sapiens
agauaguaucuu

SEQ ID NO: 2236780 - RNA, 13 nt, Homo sapiens
ccuugugggccug

SEQ ID NO: 2236781 - RNA, 16 nt, Homo sapiens
cuuuugugugugucua

SEQ ID NO: 2236782 - RNA, 18 nt, Homo sapiens
aggaccaauugacucuca

SEQ ID NO: 2236783 - RNA, 17 nt, Homo sapiens
ucaguagauacuaaagc

SEQ ID NO: 2236784 - RNA, 22 nt, Homo sapiens
gacccuuugccuuucuucugcc

SEQ ID NO: 2236785 - RNA, 16 nt, Homo sapiens
uaggauagacacugga

SEQ ID NO: 2236786 - RNA, 17 nt, Homo sapiens
aauguaagagaaauuaa

SEQ ID NO: 2236787 - RNA, 18 nt, Homo sapiens
auuauggaaacagaugaa

SEQ ID NO: 2236788 - RNA, 21 nt, Homo sapiens
auuguuccaaaugaauguugu

SEQ ID NO: 2236789 - RNA, 18 nt, Homo sapiens
agauucuccaaaugauuu

SEQ ID NO: 2236790 - RNA, 21 nt, Homo sapiens
cuucauguggcucagugccuu

SEQ ID NO: 2236791 - RNA, 20 nt, Homo sapiens
ggguuucaccauauugccca

SEQ ID NO: 2236792 - RNA, 17 nt, Homo sapiens
gaaugugcuaugaagcu

SEQ ID NO: 2236793 - RNA, 20 nt, Homo sapiens
uuccgcacugggcacaggcc

SEQ ID NO: 2236794 - RNA, 15 nt, Homo sapiens
uaaaucacauccuua

SEQ ID NO: 2236795 - RNA, 17 nt, Homo sapiens
gaugagaaagaugggca

SEQ ID NO: 2236796 - RNA, 23 nt, Homo sapiens
ccugucgguggcugccuuugauc

SEQ ID NO: 2236797 - RNA, 17 nt, Homo sapiens
aauugugcuuuguauca

SEQ ID NO: 2236798 - RNA, 17 nt, Homo sapiens
cucuaggaaaagggaua

SEQ ID NO: 2236799 - RNA, 17 nt, Homo sapiens
ggcugugcacauucucc

SEQ ID NO: 2236800 - RNA, 23 nt, Homo sapiens
aaguuaguuuuuaaucucuccac

SEQ ID NO: 2236801 - RNA, 18 nt, Homo sapiens
ugaaaaugcaucacauga

SEQ ID NO: 2236802 - RNA, 16 nt, Homo sapiens
cuugacaaggacccuc

SEQ ID NO: 2236803 - RNA, 22 nt, Homo sapiens
aaucauccauccuugccaauag

SEQ ID NO: 2236804 - RNA, 22 nt, Homo sapiens
acuccuuuccugcaaacccauu

SEQ ID NO: 2236805 - RNA, 22 nt, Homo sapiens
uuucuacugugugaucaggaug

SEQ ID NO: 2236806 - RNA, 19 nt, Homo sapiens
cauguuggugcugccuugc

SEQ ID NO: 2236807 - RNA, 17 nt, Homo sapiens
gggaacucagauccagg

SEQ ID NO: 2236808 - RNA, 21 nt, Homo sapiens
auauuuuaggaaacucuccau

SEQ ID NO: 2236809 - RNA, 15 nt, Homo sapiens
auaauccuuucugcc

SEQ ID NO: 2236810 - RNA, 20 nt, Homo sapiens
uggccuggacaguaucccac

SEQ ID NO: 2236811 - RNA, 12 nt, Homo sapiens
uaaacauugccu

SEQ ID NO: 2236812 - RNA, 20 nt, Homo sapiens
acacgccuucaugccagugc

SEQ ID NO: 2236813 - RNA, 17 nt, Homo sapiens
uugcccccagacuuccu

SEQ ID NO: 2236814 - RNA, 18 nt, Homo sapiens
agcuuuccuggaggaaaa

SEQ ID NO: 2236815 - RNA, 23 nt, Homo sapiens
aaacucucaagcagacgugagug

SEQ ID NO: 2236816 - RNA, 21 nt, Homo sapiens
cagccauagcuugauugcuca

SEQ ID NO: 2236817 - RNA, 17 nt, Homo sapiens
ugcgaauaagcuuuuaa

SEQ ID NO: 2236818 - RNA, 20 nt, Homo sapiens
gacagagguuaucuguccca

SEQ ID NO: 2236819 - RNA, 20 nt, Homo sapiens
augaugguuuuaaacuuuca

SEQ ID NO: 2236820 - RNA, 14 nt, Homo sapiens
ggaggccaaggugg

SEQ ID NO: 2236821 - RNA, 16 nt, Homo sapiens
agcuuuccugacaaua

SEQ ID NO: 2236822 - RNA, 19 nt, Homo sapiens
uccuuuacuacgaaguaua

SEQ ID NO: 2236823 - RNA, 15 nt, Homo sapiens
uaacugggugguuug

SEQ ID NO: 2236824 - RNA, 24 nt, Homo sapiens
auuauacgcuggcaacacagaggc

SEQ ID NO: 2236825 - RNA, 19 nt, Homo sapiens
cuguauuuugccagacuua

SEQ ID NO: 2236826 - RNA, 18 nt, Homo sapiens
caaauucuuugacacuca

SEQ ID NO: 2236827 - RNA, 17 nt, Homo sapiens
aaaacuugcugccugaa

SEQ ID NO: 2236828 - RNA, 19 nt, Homo sapiens
ccagcugccaaggaaaccc

SEQ ID NO: 2236829 - RNA, 14 nt, Homo sapiens
auucaacaauuuca

SEQ ID NO: 2236830 - RNA, 14 nt, Homo sapiens
aguguguuugcuaa

SEQ ID NO: 2236831 - RNA, 16 nt, Homo sapiens
auaccuaaguacugua

SEQ ID NO: 2236832 - RNA, 14 nt, Homo sapiens
uccucuucagagga

SEQ ID NO: 2236833 - RNA, 13 nt, Homo sapiens
caaccucauccag

SEQ ID NO: 2236834 - RNA, 16 nt, Homo sapiens
guccagcucagucuca

SEQ ID NO: 2236835 - RNA, 16 nt, Homo sapiens
uuuacauggguucaau

SEQ ID NO: 2236836 - RNA, 22 nt, Homo sapiens
ugagacagcuucgguuucuaac

SEQ ID NO: 2236837 - RNA, 14 nt, Homo sapiens
gaaguugugcuaaa

SEQ ID NO: 2236838 - RNA, 22 nt, Homo sapiens
uuaaauguagaaagugauccau

SEQ ID NO: 2236839 - RNA, 23 nt, Homo sapiens
ggaaugccgcugucucugagggg

SEQ ID NO: 2236840 - RNA, 19 nt, Homo sapiens
cuggaacuugcucucauuu

SEQ ID NO: 2236841 - RNA, 17 nt, Homo sapiens
uaugcaagggucccuua

SEQ ID NO: 2236842 - RNA, 18 nt, Homo sapiens
uugcagugaaagcuuuca

SEQ ID NO: 2236843 - RNA, 20 nt, Homo sapiens
uauaaccaagugugcucuuu

SEQ ID NO: 2236844 - RNA, 15 nt, Homo sapiens
uacagcuuucacagu

SEQ ID NO: 2236845 - RNA, 18 nt, Homo sapiens
acgacuggccagggccac

SEQ ID NO: 2236846 - RNA, 22 nt, Homo sapiens
auaagcugauuugauaccaugg

SEQ ID NO: 2236847 - RNA, 15 nt, Homo sapiens
agucuucacaacuuu

SEQ ID NO: 2236848 - RNA, 17 nt, Homo sapiens
agguggaaaaacugaga

SEQ ID NO: 2236849 - RNA, 14 nt, Homo sapiens
uaaauguccauucu

SEQ ID NO: 2236850 - RNA, 21 nt, Homo sapiens
ugggcaccaggagugccuuca

SEQ ID NO: 2236851 - RNA, 23 nt, Homo sapiens
augcauccagcaguacaauaaaa

SEQ ID NO: 2236852 - RNA, 16 nt, Homo sapiens
auggaaaaaucuugga

SEQ ID NO: 2236853 - RNA, 21 nt, Homo sapiens
gcugcuuguggcggauuccuc

SEQ ID NO: 2236854 - RNA, 18 nt, Homo sapiens
caaucugccuguaucucu

SEQ ID NO: 2236855 - RNA, 22 nt, Homo sapiens
augaauccccaauaauugcaga

SEQ ID NO: 2236856 - RNA, 16 nt, Homo sapiens
agaacuucucuuccca

SEQ ID NO: 2236857 - RNA, 23 nt, Homo sapiens
aucaauaguugaauuagugagua

SEQ ID NO: 2236858 - RNA, 17 nt, Homo sapiens
cgcccaucagugccagc

SEQ ID NO: 2236859 - RNA, 17 nt, Homo sapiens
uauuaacuaugaucauc

SEQ ID NO: 2236860 - RNA, 13 nt, Homo sapiens
aacuuuauuccaa

SEQ ID NO: 2236861 - RNA, 17 nt, Homo sapiens
cguguacuacaauuuaa

SEQ ID NO: 2236862 - RNA, 16 nt, Homo sapiens
cuuggucauuugccaa

SEQ ID NO: 2236863 - RNA, 14 nt, Homo sapiens
ccaagauuauucaa

SEQ ID NO: 2236864 - RNA, 19 nt, Homo sapiens
agagacucagaugaggaca

SEQ ID NO: 2236865 - RNA, 22 nt, Homo sapiens
guucaucauuggcccucauucc

SEQ ID NO: 2236866 - RNA, 22 nt, Homo sapiens
auugacgaacuggcuacaguac

SEQ ID NO: 2236867 - RNA, 21 nt, Homo sapiens
cuuacuuccagcaaaauccaa

SEQ ID NO: 2236868 - RNA, 17 nt, Homo sapiens
gcccagagaguccagcu

SEQ ID NO: 2236869 - RNA, 14 nt, Homo sapiens
gauuuaugugcacu

SEQ ID NO: 2236870 - RNA, 16 nt, Homo sapiens
uagcaaagcgacguua

SEQ ID NO: 2236871 - RNA, 15 nt, Homo sapiens
gucaaauccaugugu

SEQ ID NO: 2236872 - RNA, 22 nt, Homo sapiens
gucacuucuucaccucuuccac

SEQ ID NO: 2236873 - RNA, 15 nt, Homo sapiens
agucucacauguccc

SEQ ID NO: 2236874 - RNA, 18 nt, Homo sapiens
caaugcccucauacccau

SEQ ID NO: 2236875 - RNA, 14 nt, Homo sapiens
acaaacacauuguu

SEQ ID NO: 2236876 - RNA, 20 nt, Homo sapiens
caguggaauuccaacuugaa

SEQ ID NO: 2236877 - RNA, 15 nt, Homo sapiens
guuuaaaugucaaau

SEQ ID NO: 2236878 - RNA, 22 nt, Homo sapiens
uucuagucuccuuugcacugag

SEQ ID NO: 2236879 - RNA, 18 nt, Homo sapiens
cuggagcaagugcucagc

SEQ ID NO: 2236880 - RNA, 16 nt, Homo sapiens
cugcauuuagcacaaa

SEQ ID NO: 2236881 - RNA, 23 nt, Homo sapiens
uggcuggaucuuuugguggaguc

SEQ ID NO: 2236882 - RNA, 17 nt, Homo sapiens
gugauaagaaaagccag

SEQ ID NO: 2236883 - RNA, 20 nt, Homo sapiens
uuaauuuuuuuuacuauaaa

SEQ ID NO: 2236884 - RNA, 14 nt, Homo sapiens
agugaugaaccaga

SEQ ID NO: 2236885 - RNA, 21 nt, Homo sapiens
uucuccaccuagacuguaaac

SEQ ID NO: 2236886 - RNA, 22 nt, Homo sapiens
uggaucaaaaaugaaucacuuc

SEQ ID NO: 2236887 - RNA, 18 nt, Homo sapiens
uggcuggcuccuagggga

SEQ ID NO: 2236888 - RNA, 21 nt, Homo sapiens
cuagaaagagaucacccacuc

SEQ ID NO: 2236889 - RNA, 20 nt, Homo sapiens
ugaccuggccagagccaaga

SEQ ID NO: 2236890 - RNA, 18 nt, Homo sapiens
uuauaaaauaauguacug

SEQ ID NO: 2236891 - RNA, 16 nt, Homo sapiens
auauuugaauaucauu

SEQ ID NO: 2236892 - RNA, 22 nt, Homo sapiens
agucugagacuccucauaccuc

SEQ ID NO: 2236893 - RNA, 14 nt, Homo sapiens
aucuguauaucagc

SEQ ID NO: 2236894 - RNA, 21 nt, Homo sapiens
augaauguaaucaacauucca

SEQ ID NO: 2236895 - RNA, 16 nt, Homo sapiens
ugaauaaauacaaagc

SEQ ID NO: 2236896 - RNA, 15 nt, Homo sapiens
cacauccaacauuuc

SEQ ID NO: 2236897 - RNA, 22 nt, Homo sapiens
auguuuuuucugauuccauccu

SEQ ID NO: 2236898 - RNA, 13 nt, Homo sapiens
cagccccaugugu

SEQ ID NO: 2236899 - RNA, 14 nt, Homo sapiens
ugcaccaugcugcu

SEQ ID NO: 2236900 - RNA, 22 nt, Homo sapiens
ucucaacaaccugaauguccca

SEQ ID NO: 2236901 - RNA, 16 nt, Homo sapiens
gaaacaacaaauaagu

SEQ ID NO: 2236902 - RNA, 19 nt, Homo sapiens
cauaaucuguacaaugaac

SEQ ID NO: 2236903 - RNA, 14 nt, Homo sapiens
gcaguguugcucag

SEQ ID NO: 2236904 - RNA, 14 nt, Homo sapiens
uccacuucuuccuu

SEQ ID NO: 2236905 - RNA, 12 nt, Homo sapiens
caagcauuucau

SEQ ID NO: 2236906 - RNA, 16 nt, Homo sapiens
aggggacuugaaucuu

SEQ ID NO: 2236907 - RNA, 18 nt, Homo sapiens
uuuucaggcacuuuagaa

SEQ ID NO: 2236908 - RNA, 18 nt, Homo sapiens
accccagcgccugugcug

SEQ ID NO: 2236909 - RNA, 15 nt, Homo sapiens
ugucugugugcuacu

SEQ ID NO: 2236910 - RNA, 20 nt, Homo sapiens
ugagcaggucaggacucaga

SEQ ID NO: 2236911 - RNA, 18 nt, Homo sapiens
ggcuuggguucacagugc

SEQ ID NO: 2236912 - RNA, 13 nt, Homo sapiens
uacauugaucaag

SEQ ID NO: 2236913 - RNA, 15 nt, Homo sapiens
guaaaacugugacau

SEQ ID NO: 2236914 - RNA, 18 nt, Homo sapiens
uagaaaggaagacagauu

SEQ ID NO: 2236915 - RNA, 14 nt, Homo sapiens
gcauacaaaauauu

SEQ ID NO: 2236916 - RNA, 20 nt, Homo sapiens
ggaagugggacuggcacuau

SEQ ID NO: 2236917 - RNA, 23 nt, Homo sapiens
ucggcaucgggccaucucagaua

SEQ ID NO: 2236918 - RNA, 21 nt, Homo sapiens
ucacaaaccagagaccaaaug

SEQ ID NO: 2236919 - RNA, 15 nt, Homo sapiens
uagaacacaguuugu

SEQ ID NO: 2236920 - RNA, 19 nt, Homo sapiens
ccaagcucggaucacauga

SEQ ID NO: 2236921 - RNA, 13 nt, Homo sapiens
auuguuucuggaa

SEQ ID NO: 2236922 - RNA, 16 nt, Homo sapiens
cugcucaacuugcaaa

SEQ ID NO: 2236923 - RNA, 18 nt, Homo sapiens
agggugcugccccaugaa

SEQ ID NO: 2236924 - RNA, 13 nt, Homo sapiens
augugggacaccu

SEQ ID NO: 2236925 - RNA, 23 nt, Homo sapiens
aagaaauugauugaacguucuca

SEQ ID NO: 2236926 - RNA, 22 nt, Homo sapiens
gugcuucuccuaacucaaggac

SEQ ID NO: 2236927 - RNA, 14 nt, Homo sapiens
cacagaaaaugcac

SEQ ID NO: 2236928 - RNA, 19 nt, Homo sapiens
agaaacaguugguaacuuu

SEQ ID NO: 2236929 - RNA, 17 nt, Homo sapiens
ucaauaaaggacaggcu

SEQ ID NO: 2236930 - RNA, 22 nt, Homo sapiens
acuauuuaaguaaauacaguag

SEQ ID NO: 2236931 - RNA, 15 nt, Homo sapiens
guuuuaaugcaauga

SEQ ID NO: 2236932 - RNA, 15 nt, Homo sapiens
aaaugaacagugaua

SEQ ID NO: 2236933 - RNA, 14 nt, Homo sapiens
guaacaucaaagau

SEQ ID NO: 2236934 - RNA, 18 nt, Homo sapiens
acucuucaggcaccugaa

SEQ ID NO: 2236935 - RNA, 13 nt, Homo sapiens
ugcagagagccau

SEQ ID NO: 2236936 - RNA, 16 nt, Homo sapiens
cggguggguaucccac

SEQ ID NO: 2236937 - RNA, 23 nt, Homo sapiens
acauauucccaugguagacugug

SEQ ID NO: 2236938 - RNA, 22 nt, Homo sapiens
gaagugcgugguauaaucucca

SEQ ID NO: 2236939 - RNA, 13 nt, Homo sapiens
ugccuucaaacaa

SEQ ID NO: 2236940 - RNA, 21 nt, Homo sapiens
agacaucuuauccauccucac

SEQ ID NO: 2236941 - RNA, 14 nt, Homo sapiens
gggccccauccuca

SEQ ID NO: 2236942 - RNA, 13 nt, Homo sapiens
auugacacauaca

SEQ ID NO: 2236943 - RNA, 18 nt, Homo sapiens
ggaaaagauuucugucca

SEQ ID NO: 2236944 - RNA, 21 nt, Homo sapiens
agacuuuuguuaugaggagcu

SEQ ID NO: 2236945 - RNA, 18 nt, Homo sapiens
ccaggccgggguggagca

SEQ ID NO: 2236946 - RNA, 16 nt, Homo sapiens
acagaaaaaccagagg

SEQ ID NO: 2236947 - RNA, 13 nt, Homo sapiens
aggcugugagcag

SEQ ID NO: 2236948 - RNA, 14 nt, Homo sapiens
caggggaggggugc

SEQ ID NO: 2236949 - RNA, 23 nt, Homo sapiens
acaugguggaaaacgaagcucau

SEQ ID NO: 2236950 - RNA, 12 nt, Homo sapiens
ugccagcuuuau

SEQ ID NO: 2236951 - RNA, 17 nt, Homo sapiens
ugggagggaaaagggaa

SEQ ID NO: 2236952 - RNA, 17 nt, Homo sapiens
cuaguacuaugucaaag

SEQ ID NO: 2236953 - RNA, 19 nt, Homo sapiens
cuuggaagcacaccaaucu

SEQ ID NO: 2236954 - RNA, 23 nt, Homo sapiens
ggauccuggccccucaaccuccu

SEQ ID NO: 2236955 - RNA, 20 nt, Homo sapiens
ggucacucaggacagcccag

SEQ ID NO: 2236956 - RNA, 13 nt, Homo sapiens
ugaggggaggcac

SEQ ID NO: 2236957 - RNA, 14 nt, Homo sapiens
uacuucuccacugu

SEQ ID NO: 2236958 - RNA, 14 nt, Homo sapiens
cggaucucuggagu

SEQ ID NO: 2236959 - RNA, 13 nt, Homo sapiens
aggcuguagccag

SEQ ID NO: 2236960 - RNA, 23 nt, Homo sapiens
auaccagagccuucaagugccaa

SEQ ID NO: 2236961 - RNA, 14 nt, Homo sapiens
uagcauacaccaaa

SEQ ID NO: 2236962 - RNA, 13 nt, Homo sapiens
caguaacagugca

SEQ ID NO: 2236963 - RNA, 23 nt, Homo sapiens
cuguaagaauuucccagugaaau

SEQ ID NO: 2236964 - RNA, 14 nt, Homo sapiens
cugcuagucuguca

SEQ ID NO: 2236965 - RNA, 15 nt, Homo sapiens
ccaugggcacagugg

SEQ ID NO: 2236966 - RNA, 20 nt, Homo sapiens
cauuugggauuuucuuugcc

SEQ ID NO: 2236967 - RNA, 20 nt, Homo sapiens
auucagaaaagaugugcaga

SEQ ID NO: 2236968 - RNA, 24 nt, Homo sapiens
accuguucuuagaguguagcugua

SEQ ID NO: 2236969 - RNA, 18 nt, Homo sapiens
uggggaagagguuuuauu

SEQ ID NO: 2236970 - RNA, 21 nt, Homo sapiens
guaauucccaucugcuuuauu

SEQ ID NO: 2236971 - RNA, 23 nt, Homo sapiens
aagcugaccugcaccccugaugu

SEQ ID NO: 2236972 - RNA, 15 nt, Homo sapiens
ucuagggaaucugga

SEQ ID NO: 2236973 - RNA, 22 nt, Homo sapiens
gauucuacucuugucauuuuua

SEQ ID NO: 2236974 - RNA, 19 nt, Homo sapiens
acuucaacacucuuuauga

SEQ ID NO: 2236975 - RNA, 20 nt, Homo sapiens
acgcugcccugcaugcugcc

SEQ ID NO: 2236976 - RNA, 14 nt, Homo sapiens
cauagcagcagugc

SEQ ID NO: 2236977 - RNA, 15 nt, Homo sapiens
ccccuggcagugcug

SEQ ID NO: 2236978 - RNA, 19 nt, Homo sapiens
gagcccgcagcccagaccc

SEQ ID NO: 2236979 - RNA, 20 nt, Homo sapiens
cuagcccuuacguccuucca

SEQ ID NO: 2236980 - RNA, 17 nt, Homo sapiens
uagaaaagaagcaguaa

SEQ ID NO: 2236981 - RNA, 13 nt, Homo sapiens
uauccauccaugg

SEQ ID NO: 2236982 - RNA, 17 nt, Homo sapiens
uaaaagugggcuugauu

SEQ ID NO: 2236983 - RNA, 23 nt, Homo sapiens
ggcaagaaaagaguuaaggcaaa

SEQ ID NO: 2236984 - RNA, 16 nt, Homo sapiens
gacauagacugcaaaa

SEQ ID NO: 2236985 - RNA, 19 nt, Homo sapiens
aaaccccaucucuacuaaa

SEQ ID NO: 2236986 - RNA, 16 nt, Homo sapiens
gcaagacccaucucaa

SEQ ID NO: 2236987 - RNA, 13 nt, Homo sapiens
aaaguugccuuua

SEQ ID NO: 2236988 - RNA, 14 nt, Homo sapiens
aaagggcuuucuca

SEQ ID NO: 2236989 - RNA, 17 nt, Homo sapiens
acaauaaaugaaugaau

SEQ ID NO: 2236990 - RNA, 16 nt, Homo sapiens
gccgagcggggagcca

SEQ ID NO: 2236991 - RNA, 19 nt, Homo sapiens
uguugucacaucucaggga

SEQ ID NO: 2236992 - RNA, 13 nt, Homo sapiens
ccccccauccuac

SEQ ID NO: 2236993 - RNA, 21 nt, Homo sapiens
aucuuggaaucaugcaaaaaa

SEQ ID NO: 2236994 - RNA, 21 nt, Homo sapiens
aaaaaucugaaaaugugaaua

SEQ ID NO: 2236995 - RNA, 18 nt, Homo sapiens
augagucccuguccccac

SEQ ID NO: 2236996 - RNA, 15 nt, Homo sapiens
aucuaauuucauuca

SEQ ID NO: 2236997 - RNA, 12 nt, Homo sapiens
gaaaauaaguga

SEQ ID NO: 2236998 - RNA, 18 nt, Homo sapiens
ugcugcaaaaguucucaa

SEQ ID NO: 2236999 - RNA, 13 nt, Homo sapiens
gcccucacucagg

SEQ ID NO: 2237000 - RNA, 18 nt, Homo sapiens
gaaccugcccugcuccca

SEQ ID NO: 2237001 - RNA, 20 nt, Homo sapiens
cacacucaauagucacggaa

SEQ ID NO: 2237002 - RNA, 20 nt, Homo sapiens
ccuagauuuuguugaccuca

SEQ ID NO: 2237003 - RNA, 22 nt, Homo sapiens
guacauaucacgcgcacagccu

SEQ ID NO: 2237004 - RNA, 20 nt, Homo sapiens
ucaaguugugcuuguuuaca

SEQ ID NO: 2237005 - RNA, 18 nt, Homo sapiens
aaaagaugaagcugagau

SEQ ID NO: 2237006 - RNA, 22 nt, Homo sapiens
aauuacguucuuacaagcuuaa

SEQ ID NO: 2237007 - RNA, 13 nt, Homo sapiens
cagaguccacugu

SEQ ID NO: 2237008 - RNA, 17 nt, Homo sapiens
gaagaagugaccaagga

SEQ ID NO: 2237009 - RNA, 18 nt, Homo sapiens
cuucccuggugauggucu

SEQ ID NO: 2237010 - RNA, 13 nt, Homo sapiens
caguaggcuuuau

SEQ ID NO: 2237011 - RNA, 13 nt, Homo sapiens
cagaaggcuuuuu

SEQ ID NO: 2237012 - RNA, 15 nt, Homo sapiens
uugcccuuggagcug

SEQ ID NO: 2237013 - RNA, 16 nt, Homo sapiens
ucuucacaauauccaa

SEQ ID NO: 2237014 - RNA, 16 nt, Homo sapiens
ucugcacuauagccau

SEQ ID NO: 2237015 - RNA, 19 nt, Homo sapiens
ugcagccaggccucgccug

SEQ ID NO: 2237016 - RNA, 16 nt, Homo sapiens
gcucuggaguccugcu

SEQ ID NO: 2237017 - RNA, 18 nt, Homo sapiens
gcaacuguuuaaccuguu

SEQ ID NO: 2237018 - RNA, 21 nt, Homo sapiens
cuagcauuacuagauauuaaa

SEQ ID NO: 2237019 - RNA, 20 nt, Homo sapiens
cacacgaggucacgugugga

SEQ ID NO: 2237020 - RNA, 12 nt, Homo sapiens
auguacaggaug

SEQ ID NO: 2237021 - RNA, 22 nt, Homo sapiens
gagugcaacccagucacacugu

SEQ ID NO: 2237022 - RNA, 22 nt, Homo sapiens
gccugaaugucuuacugugauc

SEQ ID NO: 2237023 - RNA, 14 nt, Homo sapiens
uuaaguaauugcca

SEQ ID NO: 2237024 - RNA, 20 nt, Homo sapiens
augcccucauacccaugcac

SEQ ID NO: 2237025 - RNA, 15 nt, Homo sapiens
uaacuauguaucagu

SEQ ID NO: 2237026 - RNA, 14 nt, Homo sapiens
aucucacugcagua

SEQ ID NO: 2237027 - RNA, 13 nt, Homo sapiens
aaagugugugauu

SEQ ID NO: 2237028 - RNA, 17 nt, Homo sapiens
aaauuauucacccauuu

SEQ ID NO: 2237029 - RNA, 12 nt, Homo sapiens
caauaugcauuu

SEQ ID NO: 2237030 - RNA, 12 nt, Homo sapiens
cuaaaugcaaua

SEQ ID NO: 2237031 - RNA, 12 nt, Homo sapiens
cuuuaugcaaau

SEQ ID NO: 2237032 - RNA, 20 nt, Homo sapiens
cagacagguguauggaguca

SEQ ID NO: 2237033 - RNA, 13 nt, Homo sapiens
aagggaaacuauu

SEQ ID NO: 2237034 - RNA, 19 nt, Homo sapiens
gaaaagaccaguccaugag

SEQ ID NO: 2237035 - RNA, 16 nt, Homo sapiens
auauuuaaauauuacc

SEQ ID NO: 2237036 - RNA, 15 nt, Homo sapiens
cuaaacucuuucauc

SEQ ID NO: 2237037 - RNA, 13 nt, Homo sapiens
guaaacugugcac

SEQ ID NO: 2237038 - RNA, 18 nt, Homo sapiens
gucuucauuucauuguau

SEQ ID NO: 2237039 - RNA, 15 nt, Homo sapiens
acagagggauuuauu

SEQ ID NO: 2237040 - RNA, 14 nt, Homo sapiens
uagcuuuaguccuu

SEQ ID NO: 2237041 - RNA, 22 nt, Homo sapiens
guggcuucaucagcugugugca

SEQ ID NO: 2237042 - RNA, 19 nt, Homo sapiens
accgcaggugcucaugcug

SEQ ID NO: 2237043 - RNA, 15 nt, Homo sapiens
ugacauguagcuucu

SEQ ID NO: 2237044 - RNA, 17 nt, Homo sapiens
cucacagaaaugagauc

SEQ ID NO: 2237045 - RNA, 17 nt, Homo sapiens
cuguucucugcccucca

SEQ ID NO: 2237046 - RNA, 22 nt, Homo sapiens
cucucaaaccugugcugaccaa

SEQ ID NO: 2237047 - RNA, 16 nt, Homo sapiens
aggccaaacggugcaa

SEQ ID NO: 2237048 - RNA, 17 nt, Homo sapiens
aaaaugaauuugacugg

SEQ ID NO: 2237049 - RNA, 19 nt, Homo sapiens
cccuugauaaccauauaaa

SEQ ID NO: 2237050 - RNA, 23 nt, Homo sapiens
uguuaaugcuuuucccacucuca

SEQ ID NO: 2237051 - RNA, 15 nt, Homo sapiens
gaccauuucucugca

SEQ ID NO: 2237052 - RNA, 19 nt, Homo sapiens
uucccucacagcaaagcaa

SEQ ID NO: 2237053 - RNA, 22 nt, Homo sapiens
cuggaggcccaguucacccuga

SEQ ID NO: 2237054 - RNA, 21 nt, Homo sapiens
cucauaguucucuuuaagcca

SEQ ID NO: 2237055 - RNA, 22 nt, Homo sapiens
gguuuuaucaguagaaguguca

SEQ ID NO: 2237056 - RNA, 17 nt, Homo sapiens
cuacuugcucagguacu

SEQ ID NO: 2237057 - RNA, 14 nt, Homo sapiens
uugacucauggcag

SEQ ID NO: 2237058 - RNA, 18 nt, Homo sapiens
cugucauuucauugcacu

SEQ ID NO: 2237059 - RNA, 13 nt, Homo sapiens
cacccugcugcac

SEQ ID NO: 2237060 - RNA, 16 nt, Homo sapiens
cacaucuacacguggc

SEQ ID NO: 2237061 - RNA, 23 nt, Homo sapiens
ucugggauuaagggcaaaucuau

SEQ ID NO: 2237062 - RNA, 21 nt, Homo sapiens
ccaaagguuggcagugauccu

SEQ ID NO: 2237063 - RNA, 16 nt, Homo sapiens
cagaacccagauuucc

SEQ ID NO: 2237064 - RNA, 15 nt, Homo sapiens
auuuguguguucacu

SEQ ID NO: 2237065 - RNA, 18 nt, Homo sapiens
acauaauaaagacagauc

SEQ ID NO: 2237066 - RNA, 15 nt, Homo sapiens
gacacugauaugggu

SEQ ID NO: 2237067 - RNA, 15 nt, Homo sapiens
agcgaggucagagga

SEQ ID NO: 2237068 - RNA, 18 nt, Homo sapiens
uccaagagaaaccagcaa

SEQ ID NO: 2237069 - RNA, 22 nt, Homo sapiens
acuugaaacagauucaggccag

SEQ ID NO: 2237070 - RNA, 15 nt, Homo sapiens
auuucaguuacuuac

SEQ ID NO: 2237071 - RNA, 14 nt, Homo sapiens
agagagauggcuca

SEQ ID NO: 2237072 - RNA, 15 nt, Homo sapiens
gcauugccugugacu

SEQ ID NO: 2237073 - RNA, 16 nt, Homo sapiens
ugucuuggucacugcu

SEQ ID NO: 2237074 - RNA, 20 nt, Homo sapiens
gagaagucacucacacuggc

SEQ ID NO: 2237075 - RNA, 17 nt, Homo sapiens
gccucccaaagugcugg

SEQ ID NO: 2237076 - RNA, 19 nt, Homo sapiens
ccacaggcauuuccugcuu

SEQ ID NO: 2237077 - RNA, 14 nt, Homo sapiens
agccagugggagau

SEQ ID NO: 2237078 - RNA, 15 nt, Homo sapiens
gaaauaagcugugau

SEQ ID NO: 2237079 - RNA, 17 nt, Homo sapiens
uguauauuuucucuaua

SEQ ID NO: 2237080 - RNA, 21 nt, Homo sapiens
auuuguaugguuccaaagaca

SEQ ID NO: 2237081 - RNA, 22 nt, Homo sapiens
guccauuugcugaguuucccuu

SEQ ID NO: 2237082 - RNA, 14 nt, Homo sapiens
uuucucuuaugcuu

SEQ ID NO: 2237083 - RNA, 15 nt, Homo sapiens
aggcagccagggcuu

SEQ ID NO: 2237084 - RNA, 16 nt, Homo sapiens
ucagaagcaagccaga

SEQ ID NO: 2237085 - RNA, 20 nt, Homo sapiens
cuuugcagagaaccucagau

SEQ ID NO: 2237086 - RNA, 17 nt, Homo sapiens
caguguaaaucacggaa

SEQ ID NO: 2237087 - RNA, 18 nt, Homo sapiens
auuaaauucaguguaguu

SEQ ID NO: 2237088 - RNA, 21 nt, Homo sapiens
gcuucuuuccagaaaccaaac

SEQ ID NO: 2237089 - RNA, 16 nt, Homo sapiens
ucucugcaucacccac

SEQ ID NO: 2237090 - RNA, 11 nt, Homo sapiens
uagaaguaguu

SEQ ID NO: 2237091 - RNA, 14 nt, Homo sapiens
uuauauugccuuau

SEQ ID NO: 2237092 - RNA, 21 nt, Homo sapiens
cugcuuuggauagucuccuac

SEQ ID NO: 2237093 - RNA, 14 nt, Homo sapiens
guguuuccaaugau

SEQ ID NO: 2237094 - RNA, 22 nt, Homo sapiens
gccagugcacauuuggaauuga

SEQ ID NO: 2237095 - RNA, 17 nt, Homo sapiens
gaagacccgcucuccau

SEQ ID NO: 2237096 - RNA, 15 nt, Homo sapiens
aagugcacugugucc

SEQ ID NO: 2237097 - RNA, 14 nt, Homo sapiens
agauaaaaccagag

SEQ ID NO: 2237098 - RNA, 21 nt, Homo sapiens
cugcugcacacacucaccucu

SEQ ID NO: 2237099 - RNA, 19 nt, Homo sapiens
acuagguuaccgcuuauca

SEQ ID NO: 2237100 - RNA, 13 nt, Homo sapiens
gagaaacaaugac

SEQ ID NO: 2237101 - RNA, 16 nt, Homo sapiens
ugccuggcaggugugc

SEQ ID NO: 2237102 - RNA, 18 nt, Homo sapiens
agcccugauguguccuca

SEQ ID NO: 2237103 - RNA, 18 nt, Homo sapiens
uccccaaauggcugcuuu

SEQ ID NO: 2237104 - RNA, 23 nt, Homo sapiens
guccacgcaauggaacauuauua

SEQ ID NO: 2237105 - RNA, 13 nt, Homo sapiens
cuacaucagccuu

SEQ ID NO: 2237106 - RNA, 20 nt, Homo sapiens
aagcaucuauucccaaagaa

SEQ ID NO: 2237107 - RNA, 15 nt, Homo sapiens
auuaaauaaaucauu

SEQ ID NO: 2237108 - RNA, 15 nt, Homo sapiens
auuaaaaaaaucaua

SEQ ID NO: 2237109 - RNA, 15 nt, Homo sapiens
uuaaaaaauaacaua

SEQ ID NO: 2237110 - RNA, 22 nt, Homo sapiens
uacuuugugucuuuuguucucu

SEQ ID NO: 2237111 - RNA, 14 nt, Homo sapiens
ugaagaauuauuca

SEQ ID NO: 2237112 - RNA, 21 nt, Homo sapiens
ucuaaauguggagaaacugua

SEQ ID NO: 2237113 - RNA, 12 nt, Homo sapiens
uuuuacugcuuu

SEQ ID NO: 2237114 - RNA, 23 nt, Homo sapiens
uagucuagacuaaaagauugaga

SEQ ID NO: 2237115 - RNA, 19 nt, Homo sapiens
agcuccccagaucucccac

SEQ ID NO: 2237116 - RNA, 22 nt, Homo sapiens
ugcagucucagagacuauuuag

SEQ ID NO: 2237117 - RNA, 17 nt, Homo sapiens
ggucccugcuaugcaga

SEQ ID NO: 2237118 - RNA, 20 nt, Homo sapiens
caagaaguagcagugucugu

SEQ ID NO: 2237119 - RNA, 23 nt, Homo sapiens
ucuuaaguacugaaauacauaug

SEQ ID NO: 2237120 - RNA, 15 nt, Homo sapiens
ucaaaucugagggag

SEQ ID NO: 2237121 - RNA, 15 nt, Homo sapiens
aguagaggcauuuag

SEQ ID NO: 2237122 - RNA, 18 nt, Homo sapiens
gaacuguacacagaauug

SEQ ID NO: 2237123 - RNA, 14 nt, Homo sapiens
gcuuucaccagcca

SEQ ID NO: 2237124 - RNA, 18 nt, Homo sapiens
ccauuucguuuagcugaa

SEQ ID NO: 2237125 - RNA, 20 nt, Homo sapiens
aaaugcacccaucagcacuc

SEQ ID NO: 2237126 - RNA, 13 nt, Homo sapiens
aaugcugcgcuua

SEQ ID NO: 2237127 - RNA, 18 nt, Homo sapiens
acuugcaccucugaccua

SEQ ID NO: 2237128 - RNA, 19 nt, Homo sapiens
acuagcauuauaccaagag

SEQ ID NO: 2237129 - RNA, 20 nt, Homo sapiens
uaaauugauagcagauauca

SEQ ID NO: 2237130 - RNA, 19 nt, Homo sapiens
ugugcucgggugcugccag

SEQ ID NO: 2237131 - RNA, 14 nt, Homo sapiens
uugacaaucaaaga

SEQ ID NO: 2237132 - RNA, 21 nt, Homo sapiens
auuuaaguauggaauauucau

SEQ ID NO: 2237133 - RNA, 22 nt, Homo sapiens
uaaaaauaaaaaacauauacaa

SEQ ID NO: 2237134 - RNA, 19 nt, Homo sapiens
uguuguaaaauguaaaggu

SEQ ID NO: 2237135 - RNA, 13 nt, Homo sapiens
agccccacugcca

SEQ ID NO: 2237136 - RNA, 13 nt, Homo sapiens
agagacacugagc

SEQ ID NO: 2237137 - RNA, 20 nt, Homo sapiens
aaugcuuggcuucucauacg

SEQ ID NO: 2237138 - RNA, 15 nt, Homo sapiens
ccagaucaccaccug

SEQ ID NO: 2237139 - RNA, 14 nt, Homo sapiens
agucuugugccaaa

SEQ ID NO: 2237140 - RNA, 17 nt, Homo sapiens
cuucagcccaccacccu

SEQ ID NO: 2237141 - RNA, 17 nt, Homo sapiens
uuuaacaaaacaagaaa

SEQ ID NO: 2237142 - RNA, 13 nt, Homo sapiens
guuuuauauguua

SEQ ID NO: 2237143 - RNA, 15 nt, Homo sapiens
ccaaauggacauaag

SEQ ID NO: 2237144 - RNA, 15 nt, Homo sapiens
accauaguaccauuu

SEQ ID NO: 2237145 - RNA, 21 nt, Homo sapiens
gcuugacaccugucuugaaua

SEQ ID NO: 2237146 - RNA, 22 nt, Homo sapiens
aguggugcgaucucggcucagu

SEQ ID NO: 2237147 - RNA, 15 nt, Homo sapiens
aaauuguguauagca

SEQ ID NO: 2237148 - RNA, 14 nt, Homo sapiens
aguuggagugcagu

SEQ ID NO: 2237149 - RNA, 21 nt, Homo sapiens
ucaagccauucugccucagcc

SEQ ID NO: 2237150 - RNA, 21 nt, Homo sapiens
uuacacuugggauugucuuac

SEQ ID NO: 2237151 - RNA, 12 nt, Homo sapiens
gaagagucauuu

SEQ ID NO: 2237152 - RNA, 19 nt, Homo sapiens
aauuaaagucuacacugcc

SEQ ID NO: 2237153 - RNA, 13 nt, Homo sapiens
acagccaggggag

SEQ ID NO: 2237154 - RNA, 13 nt, Homo sapiens
ugaacagaacuau

SEQ ID NO: 2237155 - RNA, 12 nt, Homo sapiens
cuguugagaaaa

SEQ ID NO: 2237156 - RNA, 20 nt, Homo sapiens
gcgcugcucuuaugccauuu

SEQ ID NO: 2237157 - RNA, 19 nt, Homo sapiens
gcuuuuagaguugcaacuu

SEQ ID NO: 2237158 - RNA, 21 nt, Homo sapiens
ugcauaaauaugcagugauau

SEQ ID NO: 2237159 - RNA, 15 nt, Homo sapiens
cuggaaauugaaaua

SEQ ID NO: 2237160 - RNA, 16 nt, Homo sapiens
uuacccauuuguucau

SEQ ID NO: 2237161 - RNA, 20 nt, Homo sapiens
cucccacccuucucagggac

SEQ ID NO: 2237162 - RNA, 14 nt, Homo sapiens
aacuaggaccucau

SEQ ID NO: 2237163 - RNA, 20 nt, Homo sapiens
cagagaggccuuuuguuuaa

SEQ ID NO: 2237164 - RNA, 18 nt, Homo sapiens
ugagcccggaugcuucuc

SEQ ID NO: 2237165 - RNA, 11 nt, Homo sapiens
uuccuggaccg

SEQ ID NO: 2237166 - RNA, 21 nt, Homo sapiens
ccaaugcuucuguugaucuca

SEQ ID NO: 2237167 - RNA, 14 nt, Homo sapiens
cugacucugacuca

SEQ ID NO: 2237168 - RNA, 11 nt, Homo sapiens
gcuaacaucuu

SEQ ID NO: 2237169 - RNA, 20 nt, Homo sapiens
aaauuaaaccggaccaucuc

SEQ ID NO: 2237170 - RNA, 19 nt, Homo sapiens
gccuuccugccuacugccc

SEQ ID NO: 2237171 - RNA, 19 nt, Homo sapiens
acucugaccuucacaggga

SEQ ID NO: 2237172 - RNA, 18 nt, Homo sapiens
uaaugugguguuacugua

SEQ ID NO: 2237173 - RNA, 15 nt, Homo sapiens
uuaggcaaagauaau

SEQ ID NO: 2237174 - RNA, 17 nt, Homo sapiens
cucaucccgagcaccuc

SEQ ID NO: 2237175 - RNA, 18 nt, Homo sapiens
uuucacaguacaggaucu

SEQ ID NO: 2237176 - RNA, 19 nt, Homo sapiens
augcgguucuuacagcaca

SEQ ID NO: 2237177 - RNA, 16 nt, Homo sapiens
guucaagugcucuuca

SEQ ID NO: 2237178 - RNA, 20 nt, Homo sapiens
gacuagcgccucuccccggg

SEQ ID NO: 2237179 - RNA, 18 nt, Homo sapiens
aagugauugcugguuuua

SEQ ID NO: 2237180 - RNA, 14 nt, Homo sapiens
cauuaccucccuau

SEQ ID NO: 2237181 - RNA, 22 nt, Homo sapiens
aaccacuaagaauucaaacugg

SEQ ID NO: 2237182 - RNA, 19 nt, Homo sapiens
cauguaacauacauauucc

SEQ ID NO: 2237183 - RNA, 16 nt, Homo sapiens
gaccaguuuaccugaa

SEQ ID NO: 2237184 - RNA, 18 nt, Homo sapiens
aguagagacggguuucac

SEQ ID NO: 2237185 - RNA, 15 nt, Homo sapiens
cugcaguuuuuccca

SEQ ID NO: 2237186 - RNA, 19 nt, Homo sapiens
uccagcuguuaccugagau

SEQ ID NO: 2237187 - RNA, 15 nt, Homo sapiens
agacgcuucauccca

SEQ ID NO: 2237188 - RNA, 22 nt, Homo sapiens
cccaagggccuggccugagcug

SEQ ID NO: 2237189 - RNA, 17 nt, Homo sapiens
acgcagguguaccuccc

SEQ ID NO: 2237190 - RNA, 15 nt, Homo sapiens
uuggaaugcuguauu

SEQ ID NO: 2237191 - RNA, 21 nt, Homo sapiens
ucgagccacaaccgaccagau

SEQ ID NO: 2237192 - RNA, 24 nt, Homo sapiens
auugucaugguuacaaacuacaga

SEQ ID NO: 2237193 - RNA, 15 nt, Homo sapiens
augaaauaaugcacu

SEQ ID NO: 2237194 - RNA, 14 nt, Homo sapiens
uuaguaugugucaa

SEQ ID NO: 2237195 - RNA, 15 nt, Homo sapiens
aagaaaaaaagcaca

SEQ ID NO: 2237196 - RNA, 15 nt, Homo sapiens
uguaaauaugucacu

SEQ ID NO: 2237197 - RNA, 15 nt, Homo sapiens
aacaaaaaaaccaca

SEQ ID NO: 2237198 - RNA, 14 nt, Homo sapiens
uucacuaucuguaa

SEQ ID NO: 2237199 - RNA, 20 nt, Homo sapiens
cuuaugaaaugggcuuuaac

SEQ ID NO: 2237200 - RNA, 13 nt, Homo sapiens
aaaggcauuccac

SEQ ID NO: 2237201 - RNA, 21 nt, Homo sapiens
ggagugaaaccuuuagggcag

SEQ ID NO: 2237202 - RNA, 18 nt, Homo sapiens
aaaugucuagguccccac

SEQ ID NO: 2237203 - RNA, 13 nt, Homo sapiens
aguacaggugaag

SEQ ID NO: 2237204 - RNA, 13 nt, Homo sapiens
accugagaaccuu

SEQ ID NO: 2237205 - RNA, 18 nt, Homo sapiens
gggagugauuuuggccac

SEQ ID NO: 2237206 - RNA, 13 nt, Homo sapiens
uagcacuaccauu

SEQ ID NO: 2237207 - RNA, 16 nt, Homo sapiens
gccacaagucuuccag

SEQ ID NO: 2237208 - RNA, 20 nt, Homo sapiens
auuucacuaggacucagaaa

SEQ ID NO: 2237209 - RNA, 17 nt, Homo sapiens
ggcccuuguaaugccac

SEQ ID NO: 2237210 - RNA, 13 nt, Homo sapiens
ucagaaggccuuu

SEQ ID NO: 2237211 - RNA, 21 nt, Homo sapiens
gcaaauccuugauacugcuca

SEQ ID NO: 2237212 - RNA, 17 nt, Homo sapiens
uugucucugcaucucau

SEQ ID NO: 2237213 - RNA, 21 nt, Homo sapiens
cauaguuacuguguaaacuca

SEQ ID NO: 2237214 - RNA, 13 nt, Homo sapiens
auuauguccugug

SEQ ID NO: 2237215 - RNA, 19 nt, Homo sapiens
aauaaacacuggugccaac

SEQ ID NO: 2237216 - RNA, 19 nt, Homo sapiens
caagcucaacggcuccauc

SEQ ID NO: 2237217 - RNA, 13 nt, Homo sapiens
aaaaccuucccca

SEQ ID NO: 2237218 - RNA, 16 nt, Homo sapiens
uuugcccccuugcccu

SEQ ID NO: 2237219 - RNA, 19 nt, Homo sapiens
cuucuaggcccauuguccu

SEQ ID NO: 2237220 - RNA, 16 nt, Homo sapiens
cagaauggcauuugca

SEQ ID NO: 2237221 - RNA, 21 nt, Homo sapiens
agggccugaggucuggcugcu

SEQ ID NO: 2237222 - RNA, 19 nt, Homo sapiens
gcagaacagcaucauguca

SEQ ID NO: 2237223 - RNA, 22 nt, Homo sapiens
cccuaugaaaaauguguuccau

SEQ ID NO: 2237224 - RNA, 19 nt, Homo sapiens
ccuuggacaacuuuucuca

SEQ ID NO: 2237225 - RNA, 13 nt, Homo sapiens
guuggugacaauu

SEQ ID NO: 2237226 - RNA, 21 nt, Homo sapiens
uuggacaaguccuugaccucu

SEQ ID NO: 2237227 - RNA, 19 nt, Homo sapiens
gcgcuguguaaaugcucca

SEQ ID NO: 2237228 - RNA, 15 nt, Homo sapiens
uuacgcugcucuccu

SEQ ID NO: 2237229 - RNA, 12 nt, Homo sapiens
auauauugauuc

SEQ ID NO: 2237230 - RNA, 19 nt, Homo sapiens
agugguugaauaugauuaa

SEQ ID NO: 2237231 - RNA, 17 nt, Homo sapiens
ucacagacuucuggccu

SEQ ID NO: 2237232 - RNA, 18 nt, Homo sapiens
ucuuguguaagguuuugg

SEQ ID NO: 2237233 - RNA, 21 nt, Homo sapiens
cuguaauaguucaguagaauu

SEQ ID NO: 2237234 - RNA, 23 nt, Homo sapiens
cuuuuaccuacccgugccugaga

SEQ ID NO: 2237235 - RNA, 17 nt, Homo sapiens
uugaaauuguaagugaa

SEQ ID NO: 2237236 - RNA, 19 nt, Homo sapiens
aguugaauaaaagugcaca

SEQ ID NO: 2237237 - RNA, 17 nt, Homo sapiens
uagccucgcucuuggca

SEQ ID NO: 2237238 - RNA, 17 nt, Homo sapiens
uaccuggaggaaugauu

SEQ ID NO: 2237239 - RNA, 15 nt, Homo sapiens
uagcaucucaugagu

SEQ ID NO: 2237240 - RNA, 17 nt, Homo sapiens
caucucaaaaagaaaag

SEQ ID NO: 2237241 - RNA, 19 nt, Homo sapiens
gcccuggcuuggagugggu

SEQ ID NO: 2237242 - RNA, 19 nt, Homo sapiens
auucuuaaauauuuccauc

SEQ ID NO: 2237243 - RNA, 18 nt, Homo sapiens
auaccaucucacaccagu

SEQ ID NO: 2237244 - RNA, 10 nt, Homo sapiens
aagucauuuu

SEQ ID NO: 2237245 - RNA, 14 nt, Homo sapiens
cuuucucuuugcca

SEQ ID NO: 2237246 - RNA, 12 nt, Homo sapiens
auuauuguugca

SEQ ID NO: 2237247 - RNA, 17 nt, Homo sapiens
uacuggggaaagugcau

SEQ ID NO: 2237248 - RNA, 22 nt, Homo sapiens
gaccucugccuuuguggugaau

SEQ ID NO: 2237249 - RNA, 16 nt, Homo sapiens
cucacagaacuaugua

SEQ ID NO: 2237250 - RNA, 23 nt, Homo sapiens
uccuuguggcagaggaugucuca

SEQ ID NO: 2237251 - RNA, 15 nt, Homo sapiens
ugaccuucugggaca

SEQ ID NO: 2237252 - RNA, 14 nt, Homo sapiens
aauccucucuuccu

SEQ ID NO: 2237253 - RNA, 14 nt, Homo sapiens
caucagcuauucag

SEQ ID NO: 2237254 - RNA, 19 nt, Homo sapiens
uaagaaccuugccugaaca

SEQ ID NO: 2237255 - RNA, 16 nt, Homo sapiens
aacuuguagcuguaaa

SEQ ID NO: 2237256 - RNA, 15 nt, Homo sapiens
uuugagaaaugcaua

SEQ ID NO: 2237257 - RNA, 17 nt, Homo sapiens
gagggccacaugggagg

SEQ ID NO: 2237258 - RNA, 21 nt, Homo sapiens
auucaacucuccaauguucua

SEQ ID NO: 2237259 - RNA, 13 nt, Homo sapiens
aaagccaaaaggu

SEQ ID NO: 2237260 - RNA, 23 nt, Homo sapiens
aauccuauuuaucagacucugua

SEQ ID NO: 2237261 - RNA, 20 nt, Homo sapiens
auaugcaauguauagugucu

SEQ ID NO: 2237262 - RNA, 19 nt, Homo sapiens
uacagucucuuucuuccuu

SEQ ID NO: 2237263 - RNA, 20 nt, Homo sapiens
auauauucuuuccaugcagu

SEQ ID NO: 2237264 - RNA, 14 nt, Homo sapiens
aauaaaauaucaua

SEQ ID NO: 2237265 - RNA, 23 nt, Homo sapiens
gacagccacuuuuagcuacugcu

SEQ ID NO: 2237266 - RNA, 15 nt, Homo sapiens
uugucuaauuuucac

SEQ ID NO: 2237267 - RNA, 13 nt, Homo sapiens
aaaguaguuugau

SEQ ID NO: 2237268 - RNA, 19 nt, Homo sapiens
ccaaaucacccaaucccag

SEQ ID NO: 2237269 - RNA, 14 nt, Homo sapiens
aauuaauacagagu

SEQ ID NO: 2237270 - RNA, 15 nt, Homo sapiens
cacaaaauaaugcag

SEQ ID NO: 2237271 - RNA, 15 nt, Homo sapiens
ucggggaagccagac

SEQ ID NO: 2237272 - RNA, 13 nt, Homo sapiens
ucuaaucaaaagg

SEQ ID NO: 2237273 - RNA, 21 nt, Homo sapiens
aucagcuagggacuacuuaau

SEQ ID NO: 2237274 - RNA, 14 nt, Homo sapiens
cuccucuuccugua

SEQ ID NO: 2237275 - RNA, 22 nt, Homo sapiens
guuccacuggggcaagcuccuc

SEQ ID NO: 2237276 - RNA, 14 nt, Homo sapiens
ccuuaucuaguguu

SEQ ID NO: 2237277 - RNA, 18 nt, Homo sapiens
uuuuguucugcaaauuaa

SEQ ID NO: 2237278 - RNA, 22 nt, Homo sapiens
ccuagguauaauucacauugua

SEQ ID NO: 2237279 - RNA, 20 nt, Homo sapiens
acaaauacugccuaguguau

SEQ ID NO: 2237280 - RNA, 23 nt, Homo sapiens
uuaaaaacuaaaaagccaucuga

SEQ ID NO: 2237281 - RNA, 16 nt, Homo sapiens
ucccuuaaucugccag

SEQ ID NO: 2237282 - RNA, 22 nt, Homo sapiens
aggugacaaaaggcagaaggag

SEQ ID NO: 2237283 - RNA, 16 nt, Homo sapiens
agacggcaagacucca

SEQ ID NO: 2237284 - RNA, 20 nt, Homo sapiens
agacaugccuuggugccggu

SEQ ID NO: 2237285 - RNA, 14 nt, Homo sapiens
uaggggcaggugaa

SEQ ID NO: 2237286 - RNA, 17 nt, Homo sapiens
gaauauauacauucuau

SEQ ID NO: 2237287 - RNA, 20 nt, Homo sapiens
acaggggcuggugggcacca

SEQ ID NO: 2237288 - RNA, 17 nt, Homo sapiens
aucuuuaacaaccucug

SEQ ID NO: 2237289 - RNA, 16 nt, Homo sapiens
caccugaaagccuguc

SEQ ID NO: 2237290 - RNA, 15 nt, Homo sapiens
agcaugggggcugcc

SEQ ID NO: 2237291 - RNA, 17 nt, Homo sapiens
uguagccucaaccuccc

SEQ ID NO: 2237292 - RNA, 16 nt, Homo sapiens
uaugacgcugauacau

SEQ ID NO: 2237293 - RNA, 14 nt, Homo sapiens
acuacagaauauua

SEQ ID NO: 2237294 - RNA, 22 nt, Homo sapiens
cacgccacuggaguccacacuu

SEQ ID NO: 2237295 - RNA, 17 nt, Homo sapiens
cuguuugcguacuugua

SEQ ID NO: 2237296 - RNA, 15 nt, Homo sapiens
cccguggcauuucaa

SEQ ID NO: 2237297 - RNA, 21 nt, Homo sapiens
cagaaucccuuaacaguugua

SEQ ID NO: 2237298 - RNA, 21 nt, Homo sapiens
acugcagcagaaaacaaacac

SEQ ID NO: 2237299 - RNA, 15 nt, Homo sapiens
uucagauuugccuua

SEQ ID NO: 2237300 - RNA, 22 nt, Homo sapiens
gauccacuuuggcaggagcccu

SEQ ID NO: 2237301 - RNA, 17 nt, Homo sapiens
gugccuugagcugccug

SEQ ID NO: 2237302 - RNA, 17 nt, Homo sapiens
gugcaguccauuuccua

SEQ ID NO: 2237303 - RNA, 14 nt, Homo sapiens
gucuuaaugcaaau

SEQ ID NO: 2237304 - RNA, 14 nt, Homo sapiens
ucucaaagcacugu

SEQ ID NO: 2237305 - RNA, 13 nt, Homo sapiens
ucugaauccuuuu

SEQ ID NO: 2237306 - RNA, 18 nt, Homo sapiens
cucacugucugcuggcaa

SEQ ID NO: 2237307 - RNA, 22 nt, Homo sapiens
gcaguggugugaaacacacaau

SEQ ID NO: 2237308 - RNA, 17 nt, Homo sapiens
uacuuccccagaugccu

SEQ ID NO: 2237309 - RNA, 18 nt, Homo sapiens
auuaacaugauaaaagac

SEQ ID NO: 2237310 - RNA, 22 nt, Homo sapiens
guuuauuuuagaggaacucuca

SEQ ID NO: 2237311 - RNA, 23 nt, Homo sapiens
uucccaggagauggguccagggg

SEQ ID NO: 2237312 - RNA, 17 nt, Homo sapiens
aggaauccacauugcca

SEQ ID NO: 2237313 - RNA, 21 nt, Homo sapiens
cucuucaauaaaccacaagca

SEQ ID NO: 2237314 - RNA, 19 nt, Homo sapiens
accuguucaaaauuccauu

SEQ ID NO: 2237315 - RNA, 18 nt, Homo sapiens
uggcaacguagugacuca

SEQ ID NO: 2237316 - RNA, 17 nt, Homo sapiens
caggggagaagcugaag

SEQ ID NO: 2237317 - RNA, 13 nt, Homo sapiens
gcauaggugacag

SEQ ID NO: 2237318 - RNA, 12 nt, Homo sapiens
ucuuggugccuc

SEQ ID NO: 2237319 - RNA, 17 nt, Homo sapiens
uccuuuccccucccuca

SEQ ID NO: 2237320 - RNA, 15 nt, Homo sapiens
gcacaaucaguuuau

SEQ ID NO: 2237321 - RNA, 12 nt, Homo sapiens
ugcaugcucaaa

SEQ ID NO: 2237322 - RNA, 9 nt, Homo sapiens
ucucagcuc

SEQ ID NO: 2237323 - RNA, 17 nt, Homo sapiens
guucucggaguccaaag

SEQ ID NO: 2237324 - RNA, 10 nt, Homo sapiens
ugcaaaucag

SEQ ID NO: 2237325 - RNA, 11 nt, Homo sapiens
acacacuggcc

SEQ ID NO: 2237326 - RNA, 15 nt, Homo sapiens
uuaucucugaggcua

SEQ ID NO: 2237327 - RNA, 11 nt, Homo sapiens
caugcuuucuc

SEQ ID NO: 2237328 - RNA, 15 nt, Homo sapiens
ccgguucccagcugc

SEQ ID NO: 2237329 - RNA, 15 nt, Homo sapiens
gaacaaagugcuaga

SEQ ID NO: 2237330 - RNA, 19 nt, Homo sapiens
acuuucucuuugccauuuc

SEQ ID NO: 2237331 - RNA, 14 nt, Homo sapiens
auacauauuaucuc

SEQ ID NO: 2237332 - RNA, 15 nt, Homo sapiens
uuaaaaaaauaacau

SEQ ID NO: 2237333 - RNA, 15 nt, Homo sapiens
cuaaaugcacaguca

SEQ ID NO: 2237334 - RNA, 18 nt, Homo sapiens
cauaaauuuuaauucaag

SEQ ID NO: 2237335 - RNA, 16 nt, Homo sapiens
uuuccugauguugaua

SEQ ID NO: 2237336 - RNA, 15 nt, Homo sapiens
uaacaagaagcaaug

SEQ ID NO: 2237337 - RNA, 21 nt, Homo sapiens
aguccccaaggccucucucug

SEQ ID NO: 2237338 - RNA, 21 nt, Homo sapiens
gcccgggguggggugcacucg

SEQ ID NO: 2237339 - RNA, 22 nt, Homo sapiens
cagccuucugacaagcaagggc

SEQ ID NO: 2237340 - RNA, 14 nt, Homo sapiens
uuuguccuccuggg

SEQ ID NO: 2237341 - RNA, 11 nt, Homo sapiens
uuggcacugug

SEQ ID NO: 2237342 - RNA, 21 nt, Homo sapiens
cccaaccuucuugucauugaa

SEQ ID NO: 2237343 - RNA, 20 nt, Homo sapiens
uggguccuaauuaccagucu

SEQ ID NO: 2237344 - RNA, 17 nt, Homo sapiens
uuuaauuuacugauucc

SEQ ID NO: 2237345 - RNA, 13 nt, Homo sapiens
aagggacuugaag

SEQ ID NO: 2237346 - RNA, 12 nt, Homo sapiens
acaaugccucuc

SEQ ID NO: 2237347 - RNA, 18 nt, Homo sapiens
agccucccuguaacucca

SEQ ID NO: 2237348 - RNA, 15 nt, Homo sapiens
gacaugugaaaccuu

SEQ ID NO: 2237349 - RNA, 16 nt, Homo sapiens
aauuaauuuacuagaa

SEQ ID NO: 2237350 - RNA, 22 nt, Homo sapiens
gaccaucaguucuuuugucuua

SEQ ID NO: 2237351 - RNA, 14 nt, Homo sapiens
caaggaaaaggagg

SEQ ID NO: 2237352 - RNA, 14 nt, Homo sapiens
augauaaacaaguc

SEQ ID NO: 2237353 - RNA, 18 nt, Homo sapiens
ugaaagagucugggaccc

SEQ ID NO: 2237354 - RNA, 16 nt, Homo sapiens
aucauugucagccuug

SEQ ID NO: 2237355 - RNA, 15 nt, Homo sapiens
auuuagaugcacuuu

SEQ ID NO: 2237356 - RNA, 13 nt, Homo sapiens
acacaguccaacu

SEQ ID NO: 2237357 - RNA, 19 nt, Homo sapiens
aaugugucugcaacaugga

SEQ ID NO: 2237358 - RNA, 17 nt, Homo sapiens
ugcucagaauugcacau

SEQ ID NO: 2237359 - RNA, 15 nt, Homo sapiens
gcuuggcccuauuaa

SEQ ID NO: 2237360 - RNA, 12 nt, Homo sapiens
ggccagcacuuc

SEQ ID NO: 2237361 - RNA, 15 nt, Homo sapiens
aaugucuccacuuca

SEQ ID NO: 2237362 - RNA, 16 nt, Homo sapiens
gggcugagaacccugc

SEQ ID NO: 2237363 - RNA, 17 nt, Homo sapiens
ggagagucgggggacca

SEQ ID NO: 2237364 - RNA, 14 nt, Homo sapiens
uguaaagacugagc

SEQ ID NO: 2237365 - RNA, 12 nt, Homo sapiens
aggaagucugug

SEQ ID NO: 2237366 - RNA, 21 nt, Homo sapiens
uauuuucuucuccagugguca

SEQ ID NO: 2237367 - RNA, 14 nt, Homo sapiens
aucuuuaagaauag

SEQ ID NO: 2237368 - RNA, 22 nt, Homo sapiens
ggauggaaauaacggguggcau

SEQ ID NO: 2237369 - RNA, 16 nt, Homo sapiens
ucugucuucuuucacu

SEQ ID NO: 2237370 - RNA, 22 nt, Homo sapiens
cucagaauaaaagaugauuucu

SEQ ID NO: 2237371 - RNA, 14 nt, Homo sapiens
cagacuggugggau

SEQ ID NO: 2237372 - RNA, 17 nt, Homo sapiens
uugguuuuaauacuuga

SEQ ID NO: 2237373 - RNA, 21 nt, Homo sapiens
gccugccagcuucugccuuca

SEQ ID NO: 2237374 - RNA, 14 nt, Homo sapiens
cuugcacugugcuu

SEQ ID NO: 2237375 - RNA, 14 nt, Homo sapiens
uaaugguguuuuaa

SEQ ID NO: 2237376 - RNA, 20 nt, Homo sapiens
uucauaauaucaugugcacu

SEQ ID NO: 2237377 - RNA, 13 nt, Homo sapiens
uggagucacugua

SEQ ID NO: 2237378 - RNA, 14 nt, Homo sapiens
gccacuucaccaag

SEQ ID NO: 2237379 - RNA, 17 nt, Homo sapiens
aagauggauguuuguca

SEQ ID NO: 2237380 - RNA, 16 nt, Homo sapiens
cucuggucuccacaga

SEQ ID NO: 2237381 - RNA, 12 nt, Homo sapiens
cucugaacacau

SEQ ID NO: 2237382 - RNA, 13 nt, Homo sapiens
gcacccucuccag

SEQ ID NO: 2237383 - RNA, 22 nt, Homo sapiens
ucuucacacgauugaccugucc

SEQ ID NO: 2237384 - RNA, 18 nt, Homo sapiens
cacauacaggugcucaau

SEQ ID NO: 2237385 - RNA, 17 nt, Homo sapiens
cagucauucagauauga

SEQ ID NO: 2237386 - RNA, 20 nt, Homo sapiens
cucccuugcugaacacacac

SEQ ID NO: 2237387 - RNA, 16 nt, Homo sapiens
cuuacuccuggcuuua

SEQ ID NO: 2237388 - RNA, 17 nt, Homo sapiens
uaccuaaaacugcugaa

SEQ ID NO: 2237389 - RNA, 18 nt, Homo sapiens
cuugaggaaaacaagcau

SEQ ID NO: 2237390 - RNA, 20 nt, Homo sapiens
cuauuaaauguauaugucau

SEQ ID NO: 2237391 - RNA, 13 nt, Homo sapiens
cacucuacccuau

SEQ ID NO: 2237392 - RNA, 18 nt, Homo sapiens
cagacagcuuacaggagc

SEQ ID NO: 2237393 - RNA, 19 nt, Homo sapiens
guccucauguguugaugua

SEQ ID NO: 2237394 - RNA, 17 nt, Homo sapiens
augcauggaaauucccu

SEQ ID NO: 2237395 - RNA, 15 nt, Homo sapiens
cauuacgugcauuua

SEQ ID NO: 2237396 - RNA, 21 nt, Homo sapiens
agucaguucucauuauucaca

SEQ ID NO: 2237397 - RNA, 13 nt, Homo sapiens
aacaugaccaaaa

SEQ ID NO: 2237398 - RNA, 13 nt, Homo sapiens
ccagugacaccga

SEQ ID NO: 2237399 - RNA, 17 nt, Homo sapiens
uaguauggcacuugaug

SEQ ID NO: 2237400 - RNA, 23 nt, Homo sapiens
acaagcugaaaccccaucuccac

SEQ ID NO: 2237401 - RNA, 20 nt, Homo sapiens
ccagagaccuucugaucucc

SEQ ID NO: 2237402 - RNA, 22 nt, Homo sapiens
ugacguuggccuaacacugggc

SEQ ID NO: 2237403 - RNA, 17 nt, Homo sapiens
uggagaaaguauuuuca

SEQ ID NO: 2237404 - RNA, 14 nt, Homo sapiens
uuuaaguaguccuc

SEQ ID NO: 2237405 - RNA, 17 nt, Homo sapiens
uuaaaaccaggcuuucu

SEQ ID NO: 2237406 - RNA, 17 nt, Homo sapiens
augaccauuugacuguu

SEQ ID NO: 2237407 - RNA, 15 nt, Homo sapiens
accagagcaggaaag

SEQ ID NO: 2237408 - RNA, 17 nt, Homo sapiens
uuccaugguuccacaga

SEQ ID NO: 2237409 - RNA, 18 nt, Homo sapiens
gaaacauuuccuuugaac

SEQ ID NO: 2237410 - RNA, 18 nt, Homo sapiens
cauuaucauaugaacuug

SEQ ID NO: 2237411 - RNA, 18 nt, Homo sapiens
gaccucuugcugccagcu

SEQ ID NO: 2237412 - RNA, 23 nt, Homo sapiens
acagaacugcuaaauacuguaca

SEQ ID NO: 2237413 - RNA, 21 nt, Homo sapiens
uccucagaagucaguugcaaa

SEQ ID NO: 2237414 - RNA, 14 nt, Homo sapiens
aguuguacaugaua

SEQ ID NO: 2237415 - RNA, 20 nt, Homo sapiens
auaaugauucauaagacacu

SEQ ID NO: 2237416 - RNA, 14 nt, Homo sapiens
aucccaagucaaac

SEQ ID NO: 2237417 - RNA, 19 nt, Homo sapiens
uugugaccccuuucacuua

SEQ ID NO: 2237418 - RNA, 19 nt, Homo sapiens
acugaagggaacagccuga

SEQ ID NO: 2237419 - RNA, 18 nt, Homo sapiens
ccacauaauucuguuacu

SEQ ID NO: 2237420 - RNA, 14 nt, Homo sapiens
aauuugugauaucu

SEQ ID NO: 2237421 - RNA, 15 nt, Homo sapiens
uacccucuggagaua

SEQ ID NO: 2237422 - RNA, 20 nt, Homo sapiens
augcugcaacaaaauguaga

SEQ ID NO: 2237423 - RNA, 15 nt, Homo sapiens
ggcccagagaagcaa

SEQ ID NO: 2237424 - RNA, 22 nt, Homo sapiens
ugacaaugggcacugauuugau

SEQ ID NO: 2237425 - RNA, 20 nt, Homo sapiens
uccauuuuuuucuuuacuua

SEQ ID NO: 2237426 - RNA, 18 nt, Homo sapiens
uggaugcuuucacccuca

SEQ ID NO: 2237427 - RNA, 14 nt, Homo sapiens
aaugucaguccuug

SEQ ID NO: 2237428 - RNA, 20 nt, Homo sapiens
agcaguugaucagacugaaa

SEQ ID NO: 2237429 - RNA, 15 nt, Homo sapiens
gcaggcccugcagug

SEQ ID NO: 2237430 - RNA, 22 nt, Homo sapiens
cagcaaucaacugagguuucuu

SEQ ID NO: 2237431 - RNA, 17 nt, Homo sapiens
agccuguccugccugug

SEQ ID NO: 2237432 - RNA, 16 nt, Homo sapiens
cacucuugauucuaca

SEQ ID NO: 2237433 - RNA, 18 nt, Homo sapiens
gcuucuggaauagaaaca

SEQ ID NO: 2237434 - RNA, 22 nt, Homo sapiens
agaggaaaaguaaggugcaguu

SEQ ID NO: 2237435 - RNA, 14 nt, Homo sapiens
aagccuguccucac

SEQ ID NO: 2237436 - RNA, 14 nt, Homo sapiens
cagagaccuaugua

SEQ ID NO: 2237437 - RNA, 19 nt, Homo sapiens
uguauccaacugcauccag

SEQ ID NO: 2237438 - RNA, 19 nt, Homo sapiens
ucucccagggcucucugga

SEQ ID NO: 2237439 - RNA, 20 nt, Homo sapiens
aaagauugauuaaugaacua

SEQ ID NO: 2237440 - RNA, 21 nt, Homo sapiens
uuccgucaccacgacuggcca

SEQ ID NO: 2237441 - RNA, 21 nt, Homo sapiens
aagauuuaaaugccauagaaa

SEQ ID NO: 2237442 - RNA, 17 nt, Homo sapiens
cacucugggcuguaacg

SEQ ID NO: 2237443 - RNA, 12 nt, Homo sapiens
uauagauuuagc

SEQ ID NO: 2237444 - RNA, 23 nt, Homo sapiens
uuauucacauggaaauguacacc

SEQ ID NO: 2237445 - RNA, 19 nt, Homo sapiens
uuggcagugauccugcaag

SEQ ID NO: 2237446 - RNA, 23 nt, Homo sapiens
agaaugaccucgcaagacccuua

SEQ ID NO: 2237447 - RNA, 20 nt, Homo sapiens
aacuacuuucuuaauaucac

SEQ ID NO: 2237448 - RNA, 17 nt, Homo sapiens
ucaacauggcagaacca

SEQ ID NO: 2237449 - RNA, 17 nt, Homo sapiens
cccucccacacuuccca

SEQ ID NO: 2237450 - RNA, 19 nt, Homo sapiens
ccuugagccccagaggcag

SEQ ID NO: 2237451 - RNA, 17 nt, Homo sapiens
aaaaccaucuugugucu

SEQ ID NO: 2237452 - RNA, 22 nt, Homo sapiens
gauucuggguuugcccaguccu

SEQ ID NO: 2237453 - RNA, 15 nt, Homo sapiens
accccacacccaugu

SEQ ID NO: 2237454 - RNA, 15 nt, Homo sapiens
uuucuagagcacugc

SEQ ID NO: 2237455 - RNA, 21 nt, Homo sapiens
acaagaugcugcaaugugagu

SEQ ID NO: 2237456 - RNA, 19 nt, Homo sapiens
ucuggcucuugaggcauuu

SEQ ID NO: 2237457 - RNA, 19 nt, Homo sapiens
aauucaacuaguaccacag

SEQ ID NO: 2237458 - RNA, 17 nt, Homo sapiens
gaucuucauuaccaaua

SEQ ID NO: 2237459 - RNA, 19 nt, Homo sapiens
cuagacuucccagggcaag

SEQ ID NO: 2237460 - RNA, 16 nt, Homo sapiens
ugggcgaagcuaaaag

SEQ ID NO: 2237461 - RNA, 16 nt, Homo sapiens
aaugguuuccucugga

SEQ ID NO: 2237462 - RNA, 16 nt, Homo sapiens
ccaaggcucugagcaa

SEQ ID NO: 2237463 - RNA, 23 nt, Homo sapiens
aauugcacacagaugugaaauga

SEQ ID NO: 2237464 - RNA, 15 nt, Homo sapiens
ucugucauaugcaga

SEQ ID NO: 2237465 - RNA, 19 nt, Homo sapiens
guaucuagcucuaguucaa

SEQ ID NO: 2237466 - RNA, 20 nt, Homo sapiens
ucuaagauaagaguugagau

SEQ ID NO: 2237467 - RNA, 22 nt, Homo sapiens
ucagugacagaguucacuauaa

SEQ ID NO: 2237468 - RNA, 22 nt, Homo sapiens
cuuuugcccacugucugcuacc

SEQ ID NO: 2237469 - RNA, 16 nt, Homo sapiens
caucaaaaacacucuc

SEQ ID NO: 2237470 - RNA, 19 nt, Homo sapiens
cauagaaagccaugugcua

SEQ ID NO: 2237471 - RNA, 21 nt, Homo sapiens
caccuauccugaagaugugau

SEQ ID NO: 2237472 - RNA, 22 nt, Homo sapiens
cauuucaaaauuaauagcuuuu

SEQ ID NO: 2237473 - RNA, 11 nt, Homo sapiens
ccaacaugacu

SEQ ID NO: 2237474 - RNA, 14 nt, Homo sapiens
aauuuuauaucauu

SEQ ID NO: 2237475 - RNA, 18 nt, Homo sapiens
gagauccaaaguccugug

SEQ ID NO: 2237476 - RNA, 18 nt, Homo sapiens
acgcaggagaucaucuga

SEQ ID NO: 2237477 - RNA, 15 nt, Homo sapiens
agucucauagguuaa

SEQ ID NO: 2237478 - RNA, 17 nt, Homo sapiens
aggguaccgucuucucc

SEQ ID NO: 2237479 - RNA, 14 nt, Homo sapiens
guucagaugcuucu

SEQ ID NO: 2237480 - RNA, 17 nt, Homo sapiens
cccgaaacuaagccagg

SEQ ID NO: 2237481 - RNA, 22 nt, Homo sapiens
ugacguuguugucauuguccag

SEQ ID NO: 2237482 - RNA, 13 nt, Homo sapiens
aauucagugaaga

SEQ ID NO: 2237483 - RNA, 20 nt, Homo sapiens
cgucucucccucccuugcca

SEQ ID NO: 2237484 - RNA, 17 nt, Homo sapiens
gaggccacccgcacaaa

SEQ ID NO: 2237485 - RNA, 15 nt, Homo sapiens
ugaaugccucccuca

SEQ ID NO: 2237486 - RNA, 21 nt, Homo sapiens
agcagaaauauagugcaauag

SEQ ID NO: 2237487 - RNA, 15 nt, Homo sapiens
uaaugaucuuuccau

SEQ ID NO: 2237488 - RNA, 17 nt, Homo sapiens
aacauugguucuuucau

SEQ ID NO: 2237489 - RNA, 13 nt, Homo sapiens
cuuucugccaaug

SEQ ID NO: 2237490 - RNA, 22 nt, Homo sapiens
cuucauccauagacacaguauu

SEQ ID NO: 2237491 - RNA, 11 nt, Homo sapiens
ugacauaaaaa

SEQ ID NO: 2237492 - RNA, 15 nt, Homo sapiens
auuauuugcacagaa

SEQ ID NO: 2237493 - RNA, 18 nt, Homo sapiens
aucugauuugcauauuca

SEQ ID NO: 2237494 - RNA, 16 nt, Homo sapiens
aauguccagcuucucu

SEQ ID NO: 2237495 - RNA, 17 nt, Homo sapiens
uugggggucaucuugga

SEQ ID NO: 2237496 - RNA, 15 nt, Homo sapiens
agccuaacaucucca

SEQ ID NO: 2237497 - RNA, 14 nt, Homo sapiens
cccccugcugcuca

SEQ ID NO: 2237498 - RNA, 22 nt, Homo sapiens
uguucuccuuuggaauggugua

SEQ ID NO: 2237499 - RNA, 23 nt, Homo sapiens
gaaaacucaaccagagucaccca

SEQ ID NO: 2237500 - RNA, 16 nt, Homo sapiens
acaauugaacugcuua

SEQ ID NO: 2237501 - RNA, 13 nt, Homo sapiens
agggcaagccacc

SEQ ID NO: 2237502 - RNA, 22 nt, Homo sapiens
uaugacugcugaaucaucauau

SEQ ID NO: 2237503 - RNA, 16 nt, Homo sapiens
acucaugucuuucuca

SEQ ID NO: 2237504 - RNA, 11 nt, Homo sapiens
auagucuuuca

SEQ ID NO: 2237505 - RNA, 11 nt, Homo sapiens
guaggggccac

SEQ ID NO: 2237506 - RNA, 11 nt, Homo sapiens
gcccuuuucag

SEQ ID NO: 2237507 - RNA, 23 nt, Homo sapiens
ucauaaagagguaaaaaacuguc

SEQ ID NO: 2237508 - RNA, 19 nt, Homo sapiens
uaaaagagaucugggcauu

SEQ ID NO: 2237509 - RNA, 16 nt, Homo sapiens
uugauacaaaguacag

SEQ ID NO: 2237510 - RNA, 15 nt, Homo sapiens
gugcagugauguggu

SEQ ID NO: 2237511 - RNA, 18 nt, Homo sapiens
gagggcauuuggcuuccu

SEQ ID NO: 2237512 - RNA, 22 nt, Homo sapiens
cccucuuaacgcagcacuuaga

SEQ ID NO: 2237513 - RNA, 21 nt, Homo sapiens
ucugagcguuuaaaguacuga

SEQ ID NO: 2237514 - RNA, 16 nt, Homo sapiens
acauuccuccuacuuc

SEQ ID NO: 2237515 - RNA, 18 nt, Homo sapiens
accugggccccacuggac

SEQ ID NO: 2237516 - RNA, 22 nt, Homo sapiens
caaacugggaugaaacuaaagc

SEQ ID NO: 2237517 - RNA, 24 nt, Homo sapiens
auugccuguucugcuucgaaguau

SEQ ID NO: 2237518 - RNA, 21 nt, Homo sapiens
cagccaggcagguccacagag

SEQ ID NO: 2237519 - RNA, 16 nt, Homo sapiens
ugcuccugugugcugg

SEQ ID NO: 2237520 - RNA, 12 nt, Homo sapiens
cuggaggaccag

SEQ ID NO: 2237521 - RNA, 22 nt, Homo sapiens
aaggugaccuggccagagccaa

SEQ ID NO: 2237522 - RNA, 13 nt, Homo sapiens
ucuuuccaaaagu

SEQ ID NO: 2237523 - RNA, 11 nt, Homo sapiens
cugaauucugg

SEQ ID NO: 2237524 - RNA, 20 nt, Homo sapiens
auagguaacaguuauaucaa

SEQ ID NO: 2237525 - RNA, 17 nt, Homo sapiens
cccucagggaucuugca

SEQ ID NO: 2237526 - RNA, 14 nt, Homo sapiens
gcuccagcagcaca

SEQ ID NO: 2237527 - RNA, 19 nt, Homo sapiens
cuucucccacucuccuagg

SEQ ID NO: 2237528 - RNA, 17 nt, Homo sapiens
uagguagcaacaacaga

SEQ ID NO: 2237529 - RNA, 19 nt, Homo sapiens
augugcuuccuugcucagu

SEQ ID NO: 2237530 - RNA, 15 nt, Homo sapiens
gaauagaugcugacu

SEQ ID NO: 2237531 - RNA, 23 nt, Homo sapiens
uaaguguuuagaaaucauagaag

SEQ ID NO: 2237532 - RNA, 14 nt, Homo sapiens
uaaaguuaucuuac

SEQ ID NO: 2237533 - RNA, 21 nt, Homo sapiens
uguuuuaacgaggauuucccu

SEQ ID NO: 2237534 - RNA, 20 nt, Homo sapiens
caaaauuugaugccaggaca

SEQ ID NO: 2237535 - RNA, 22 nt, Homo sapiens
caaguggggugcucuggucuga

SEQ ID NO: 2237536 - RNA, 22 nt, Homo sapiens
gaggcgcaggagccugugccca

SEQ ID NO: 2237537 - RNA, 13 nt, Homo sapiens
ucugcaagcaaua

SEQ ID NO: 2237538 - RNA, 20 nt, Homo sapiens
uccccagccccuuggaugug

SEQ ID NO: 2237539 - RNA, 15 nt, Homo sapiens
guccucgaauucuca

SEQ ID NO: 2237540 - RNA, 16 nt, Homo sapiens
aaaaugagacuuucua

SEQ ID NO: 2237541 - RNA, 19 nt, Homo sapiens
caaugaaagucaaauuuac

SEQ ID NO: 2237542 - RNA, 13 nt, Homo sapiens
cuuucauaccuug

SEQ ID NO: 2237543 - RNA, 13 nt, Homo sapiens
aagguuaaaccca

SEQ ID NO: 2237544 - RNA, 19 nt, Homo sapiens
uuguauaggccaucuguaa

SEQ ID NO: 2237545 - RNA, 14 nt, Homo sapiens
cgauuuaucuugcu

SEQ ID NO: 2237546 - RNA, 13 nt, Homo sapiens
agauccucuugcc

SEQ ID NO: 2237547 - RNA, 23 nt, Homo sapiens
auccagggacugaagccaaaguu

SEQ ID NO: 2237548 - RNA, 23 nt, Homo sapiens
agacuugcuuuucuaacuaagag

SEQ ID NO: 2237549 - RNA, 19 nt, Homo sapiens
ugccacaaauaacaucuca

SEQ ID NO: 2237550 - RNA, 18 nt, Homo sapiens
ggauaaugcccaugguac

SEQ ID NO: 2237551 - RNA, 20 nt, Homo sapiens
cgagaccgggcccuggguuc

SEQ ID NO: 2237552 - RNA, 17 nt, Homo sapiens
uaaagaucuacaugaau

SEQ ID NO: 2237553 - RNA, 15 nt, Homo sapiens
cauggcagaagucaa

SEQ ID NO: 2237554 - RNA, 17 nt, Homo sapiens
agcccagauugugccac

SEQ ID NO: 2237555 - RNA, 18 nt, Homo sapiens
ugugaaauacucuuccaa

SEQ ID NO: 2237556 - RNA, 23 nt, Homo sapiens
caccuauugagggugacagccac

SEQ ID NO: 2237557 - RNA, 16 nt, Homo sapiens
cucaccccuccaagcu

SEQ ID NO: 2237558 - RNA, 18 nt, Homo sapiens
uagccacccaacuuuguc

SEQ ID NO: 2237559 - RNA, 16 nt, Homo sapiens
uuggaacuaugcagug

SEQ ID NO: 2237560 - RNA, 23 nt, Homo sapiens
aucacccuuaccaugugccugau

SEQ ID NO: 2237561 - RNA, 20 nt, Homo sapiens
uccugauauaucaaacugaa

SEQ ID NO: 2237562 - RNA, 15 nt, Homo sapiens
agcuauggugcuugc

SEQ ID NO: 2237563 - RNA, 14 nt, Homo sapiens
ucucccacacaaga

SEQ ID NO: 2237564 - RNA, 18 nt, Homo sapiens
cuuacaggccuugcucac

SEQ ID NO: 2237565 - RNA, 16 nt, Homo sapiens
uugcacuguagauuua

SEQ ID NO: 2237566 - RNA, 13 nt, Homo sapiens
ucguucccagugu

SEQ ID NO: 2237567 - RNA, 17 nt, Homo sapiens
uuuaccugcugggaccu

SEQ ID NO: 2237568 - RNA, 15 nt, Homo sapiens
gauacaugagccagu

SEQ ID NO: 2237569 - RNA, 14 nt, Homo sapiens
uucuggaauguaau

SEQ ID NO: 2237570 - RNA, 13 nt, Homo sapiens
ccacucguccaag

SEQ ID NO: 2237571 - RNA, 14 nt, Homo sapiens
gacaucucaggggc

SEQ ID NO: 2237572 - RNA, 14 nt, Homo sapiens
gagcgucaggguug

SEQ ID NO: 2237573 - RNA, 21 nt, Homo sapiens
gguauauacuuugccacugcu

SEQ ID NO: 2237574 - RNA, 17 nt, Homo sapiens
gacuauuaggugcaauu

SEQ ID NO: 2237575 - RNA, 15 nt, Homo sapiens
cugguaaaaagaucc

SEQ ID NO: 2237576 - RNA, 18 nt, Homo sapiens
gccccaucagcuccagcu

SEQ ID NO: 2237577 - RNA, 20 nt, Homo sapiens
caauguucaguuuuccuuag

SEQ ID NO: 2237578 - RNA, 12 nt, Homo sapiens
agcccuuuccag

SEQ ID NO: 2237579 - RNA, 21 nt, Homo sapiens
gcauggcuggggacuucucac

SEQ ID NO: 2237580 - RNA, 20 nt, Homo sapiens
ccuaggauuucaugauuuca

SEQ ID NO: 2237581 - RNA, 21 nt, Homo sapiens
cugcugcagggacagcccuga

SEQ ID NO: 2237582 - RNA, 23 nt, Homo sapiens
caggcacugccaggcuugcaguc

SEQ ID NO: 2237583 - RNA, 18 nt, Homo sapiens
cauaggcucacucuuucc

SEQ ID NO: 2237584 - RNA, 22 nt, Homo sapiens
aauagcacauccuccaacguua

SEQ ID NO: 2237585 - RNA, 19 nt, Homo sapiens
acaucuugcucugcauuua

SEQ ID NO: 2237586 - RNA, 13 nt, Homo sapiens
agcgggaguggcu

SEQ ID NO: 2237587 - RNA, 17 nt, Homo sapiens
gcuggagucaugugccu

SEQ ID NO: 2237588 - RNA, 22 nt, Homo sapiens
uucuacuuucaucuauucuuuc

SEQ ID NO: 2237589 - RNA, 16 nt, Homo sapiens
gauauuagucuugggg

SEQ ID NO: 2237590 - RNA, 22 nt, Homo sapiens
acauuacagguuaugcuuugag

SEQ ID NO: 2237591 - RNA, 22 nt, Homo sapiens
acuuguaaacuugaaagcaaga

SEQ ID NO: 2237592 - RNA, 18 nt, Homo sapiens
gauacaggaaaagcugcu

SEQ ID NO: 2237593 - RNA, 17 nt, Homo sapiens
acacauugaaacuguau

SEQ ID NO: 2237594 - RNA, 20 nt, Homo sapiens
gaugcucugaacccugagca

SEQ ID NO: 2237595 - RNA, 22 nt, Homo sapiens
cuccuaacccuuaucaccagcu

SEQ ID NO: 2237596 - RNA, 17 nt, Homo sapiens
gaaccagagagaaucaa

SEQ ID NO: 2237597 - RNA, 21 nt, Homo sapiens
uaaauauguguugaaugaaga

SEQ ID NO: 2237598 - RNA, 21 nt, Homo sapiens
agccacucggggcaggccagc

SEQ ID NO: 2237599 - RNA, 13 nt, Homo sapiens
uuuuucauuguau

SEQ ID NO: 2237600 - RNA, 18 nt, Homo sapiens
ccaagggcccucacucag

SEQ ID NO: 2237601 - RNA, 13 nt, Homo sapiens
ggcugcugcucac

SEQ ID NO: 2237602 - RNA, 23 nt, Homo sapiens
caaucaguaauuaacauaucaag

SEQ ID NO: 2237603 - RNA, 19 nt, Homo sapiens
cuuucaguaaaaauaaaua

SEQ ID NO: 2237604 - RNA, 22 nt, Homo sapiens
ucagauacccaguggaauucca

SEQ ID NO: 2237605 - RNA, 15 nt, Homo sapiens
uacugcgacuaaacu

SEQ ID NO: 2237606 - RNA, 19 nt, Homo sapiens
ccucaguuuuuccuaguca

SEQ ID NO: 2237607 - RNA, 13 nt, Homo sapiens
acaaaacccacug

SEQ ID NO: 2237608 - RNA, 19 nt, Homo sapiens
ucacagaauuuaagcaaga

SEQ ID NO: 2237609 - RNA, 13 nt, Homo sapiens
ucuccugccucag

SEQ ID NO: 2237610 - RNA, 23 nt, Homo sapiens
ugcucagccccagcuuaucuccu

SEQ ID NO: 2237611 - RNA, 23 nt, Homo sapiens
ugucugaaaaaugccugcugcug

SEQ ID NO: 2237612 - RNA, 17 nt, Homo sapiens
cauugcuggacuagcaa

SEQ ID NO: 2237613 - RNA, 20 nt, Homo sapiens
cuuggcaguguggcagugac

SEQ ID NO: 2237614 - RNA, 20 nt, Homo sapiens
gcguguguccaugugugugc

SEQ ID NO: 2237615 - RNA, 11 nt, Homo sapiens
uagcuaccugc

SEQ ID NO: 2237616 - RNA, 21 nt, Homo sapiens
guacugaguauugauaaacuu

SEQ ID NO: 2237617 - RNA, 17 nt, Homo sapiens
cuguaaaauaguuuugc

SEQ ID NO: 2237618 - RNA, 15 nt, Homo sapiens
ugaaaugccaaagga

SEQ ID NO: 2237619 - RNA, 23 nt, Homo sapiens
auuuguuaauuucuugcaauuug

SEQ ID NO: 2237620 - RNA, 16 nt, Homo sapiens
cucuaguacugugaau

SEQ ID NO: 2237621 - RNA, 15 nt, Homo sapiens
guuuacagugaauaa

SEQ ID NO: 2237622 - RNA, 16 nt, Homo sapiens
aaauguuauuauguca

SEQ ID NO: 2237623 - RNA, 16 nt, Homo sapiens
ccaaugucuuuugaca

SEQ ID NO: 2237624 - RNA, 21 nt, Homo sapiens
uaggccacucgagcaucagag

SEQ ID NO: 2237625 - RNA, 14 nt, Homo sapiens
acuuguuaccuuaa

SEQ ID NO: 2237626 - RNA, 15 nt, Homo sapiens
aacauguugugccug

SEQ ID NO: 2237627 - RNA, 22 nt, Homo sapiens
ucaaauugcuacauaguccaaa

SEQ ID NO: 2237628 - RNA, 16 nt, Homo sapiens
ugaacgacuguauauu

SEQ ID NO: 2237629 - RNA, 22 nt, Homo sapiens
ucauggcacccaggcaguccac

SEQ ID NO: 2237630 - RNA, 21 nt, Homo sapiens
caucagguuccaguugcuuga

SEQ ID NO: 2237631 - RNA, 18 nt, Homo sapiens
ggacaguggcacaaucau

SEQ ID NO: 2237632 - RNA, 17 nt, Homo sapiens
ccuuucgacuugcauuu

SEQ ID NO: 2237633 - RNA, 17 nt, Homo sapiens
gcucacggaagggaugc

SEQ ID NO: 2237634 - RNA, 15 nt, Homo sapiens
accauuugacuguuc

SEQ ID NO: 2237635 - RNA, 23 nt, Homo sapiens
guauaaaaugguguuuucaugua

SEQ ID NO: 2237636 - RNA, 17 nt, Homo sapiens
uacccucuugaauauaa

SEQ ID NO: 2237637 - RNA, 19 nt, Homo sapiens
cgugguuuuuacauucaau

SEQ ID NO: 2237638 - RNA, 16 nt, Homo sapiens
gcauaaguuucuggga

SEQ ID NO: 2237639 - RNA, 19 nt, Homo sapiens
cagugaagucuagaaucau

SEQ ID NO: 2237640 - RNA, 20 nt, Homo sapiens
gguuacuaagaugaaauugc

SEQ ID NO: 2237641 - RNA, 17 nt, Homo sapiens
cuucacagucuggugcu

SEQ ID NO: 2237642 - RNA, 19 nt, Homo sapiens
cuguauuuuuaaauugcca

SEQ ID NO: 2237643 - RNA, 22 nt, Homo sapiens
aaugacaggacauuugacauga

SEQ ID NO: 2237644 - RNA, 18 nt, Homo sapiens
cucugugggucucuggaa

SEQ ID NO: 2237645 - RNA, 17 nt, Homo sapiens
uccagcccuggaucucc

SEQ ID NO: 2237646 - RNA, 23 nt, Homo sapiens
uggagcccaggaguuugaggcug

SEQ ID NO: 2237647 - RNA, 13 nt, Homo sapiens
ugcucucccaggu

SEQ ID NO: 2237648 - RNA, 15 nt, Homo sapiens
aauacaaacaagcac

SEQ ID NO: 2237649 - RNA, 17 nt, Homo sapiens
acggggaggaaccacug

SEQ ID NO: 2237650 - RNA, 16 nt, Homo sapiens
gacacgaagccuuauu

SEQ ID NO: 2237651 - RNA, 22 nt, Homo sapiens
agcucaccccagguucucaccu

SEQ ID NO: 2237652 - RNA, 13 nt, Homo sapiens
ccuaaaauacuua

SEQ ID NO: 2237653 - RNA, 17 nt, Homo sapiens
uuuccuggucccucacc

SEQ ID NO: 2237654 - RNA, 13 nt, Homo sapiens
augugcauuucac

SEQ ID NO: 2237655 - RNA, 20 nt, Homo sapiens
ugaauuguuuaacccuggau

SEQ ID NO: 2237656 - RNA, 15 nt, Homo sapiens
auaucgccacugcac

SEQ ID NO: 2237657 - RNA, 17 nt, Homo sapiens
uucuaggccaagcauuu

SEQ ID NO: 2237658 - RNA, 20 nt, Homo sapiens
caaaaacgcacugcaagaag

SEQ ID NO: 2237659 - RNA, 13 nt, Homo sapiens
cugucucaaaaaa

SEQ ID NO: 2237660 - RNA, 19 nt, Homo sapiens
agccuucgggcgucugugu

SEQ ID NO: 2237661 - RNA, 20 nt, Homo sapiens
guucucauggguggcacuca

SEQ ID NO: 2237662 - RNA, 18 nt, Homo sapiens
ugcuauugugaugccaau

SEQ ID NO: 2237663 - RNA, 15 nt, Homo sapiens
uagcagaaugcacau

SEQ ID NO: 2237664 - RNA, 22 nt, Homo sapiens
gagaccaggggaccagagggau

SEQ ID NO: 2237665 - RNA, 20 nt, Homo sapiens
ucuuguuuaacauauauauu

SEQ ID NO: 2237666 - RNA, 13 nt, Homo sapiens
agcccacaaagcc

SEQ ID NO: 2237667 - RNA, 18 nt, Homo sapiens
uaaagugaguacuguuaa

SEQ ID NO: 2237668 - RNA, 16 nt, Homo sapiens
caugguuuuacaguga

SEQ ID NO: 2237669 - RNA, 15 nt, Homo sapiens
acggaaaaggggugg

SEQ ID NO: 2237670 - RNA, 20 nt, Homo sapiens
auucuugugacuuacagugc

SEQ ID NO: 2237671 - RNA, 16 nt, Homo sapiens
gaaacccauuaggcau

SEQ ID NO: 2237672 - RNA, 14 nt, Homo sapiens
guugccacauuuag

SEQ ID NO: 2237673 - RNA, 17 nt, Homo sapiens
uguguuugguucaauuu

SEQ ID NO: 2237674 - RNA, 22 nt, Homo sapiens
caaauaacuacagggugcccau

SEQ ID NO: 2237675 - RNA, 12 nt, Homo sapiens
uguuuacaugag

SEQ ID NO: 2237676 - RNA, 16 nt, Homo sapiens
uauugugccucuggcu

SEQ ID NO: 2237677 - RNA, 13 nt, Homo sapiens
auaagaagugcca

SEQ ID NO: 2237678 - RNA, 23 nt, Homo sapiens
auacuuccuuaugcuucuuucaa

SEQ ID NO: 2237679 - RNA, 19 nt, Homo sapiens
cugccuagcugccuagcaa

SEQ ID NO: 2237680 - RNA, 20 nt, Homo sapiens
augucuuggacacuguacaa

SEQ ID NO: 2237681 - RNA, 15 nt, Homo sapiens
ccugaaggcuucaau

SEQ ID NO: 2237682 - RNA, 13 nt, Homo sapiens
agacaagucugug

SEQ ID NO: 2237683 - RNA, 22 nt, Homo sapiens
cauuguuauaaagacacaugca

SEQ ID NO: 2237684 - RNA, 18 nt, Homo sapiens
cuaaaucugccuuuucau

SEQ ID NO: 2237685 - RNA, 17 nt, Homo sapiens
cagagcucuggagccac

SEQ ID NO: 2237686 - RNA, 19 nt, Homo sapiens
ccuuuccaaaaacuguuaa

SEQ ID NO: 2237687 - RNA, 18 nt, Homo sapiens
uaguuuugcuuuguugaa

SEQ ID NO: 2237688 - RNA, 21 nt, Homo sapiens
uuaauucuuaaaacuauaaca

SEQ ID NO: 2237689 - RNA, 13 nt, Homo sapiens
guuugucaaaaag

SEQ ID NO: 2237690 - RNA, 15 nt, Homo sapiens
uuacuaguacuauua

SEQ ID NO: 2237691 - RNA, 13 nt, Homo sapiens
gccguggcccuug

SEQ ID NO: 2237692 - RNA, 17 nt, Homo sapiens
gcaaucugcccauucau

SEQ ID NO: 2237693 - RNA, 19 nt, Homo sapiens
ugggcuuguuucuggcaga

SEQ ID NO: 2237694 - RNA, 18 nt, Homo sapiens
uauaacucugcacuacuc

SEQ ID NO: 2237695 - RNA, 16 nt, Homo sapiens
agauacuguuguuacu

SEQ ID NO: 2237696 - RNA, 15 nt, Homo sapiens
aggccucaagaacaa

SEQ ID NO: 2237697 - RNA, 22 nt, Homo sapiens
uuugaauuguguggagaagugu

SEQ ID NO: 2237698 - RNA, 23 nt, Homo sapiens
gaaauggcuuauuaaacuuugaa

SEQ ID NO: 2237699 - RNA, 16 nt, Homo sapiens
gcccuucccccugcaa

SEQ ID NO: 2237700 - RNA, 19 nt, Homo sapiens
uauauguauaucuuugcac

SEQ ID NO: 2237701 - RNA, 13 nt, Homo sapiens
gcacccucccuag

SEQ ID NO: 2237702 - RNA, 20 nt, Homo sapiens
uacaauaggugcuuauucuc

SEQ ID NO: 2237703 - RNA, 22 nt, Homo sapiens
agagggggaaaaacacauaaag

SEQ ID NO: 2237704 - RNA, 17 nt, Homo sapiens
cagugguauccugugac

SEQ ID NO: 2237705 - RNA, 19 nt, Homo sapiens
cacaagcucagguccugcu

SEQ ID NO: 2237706 - RNA, 15 nt, Homo sapiens
acucucuugauuaag

SEQ ID NO: 2237707 - RNA, 17 nt, Homo sapiens
cugagaugacuauucag

SEQ ID NO: 2237708 - RNA, 22 nt, Homo sapiens
aaauucauaacugguagcuaua

SEQ ID NO: 2237709 - RNA, 20 nt, Homo sapiens
cuagagacaacaaaaaugcu

SEQ ID NO: 2237710 - RNA, 22 nt, Homo sapiens
gcgguggcucacgccuguaauc

SEQ ID NO: 2237711 - RNA, 15 nt, Homo sapiens
cucuuucaaugcagc

SEQ ID NO: 2237712 - RNA, 12 nt, Homo sapiens
cugcucugcuau

SEQ ID NO: 2237713 - RNA, 18 nt, Homo sapiens
caaaucagaaacuuguga

SEQ ID NO: 2237714 - RNA, 19 nt, Homo sapiens
gugcccugcaucccucucc

SEQ ID NO: 2237715 - RNA, 19 nt, Homo sapiens
gaaagaagaguuggaguga

SEQ ID NO: 2237716 - RNA, 17 nt, Homo sapiens
uggcuggacaaacugca

SEQ ID NO: 2237717 - RNA, 16 nt, Homo sapiens
aaugaucauaagucua

SEQ ID NO: 2237718 - RNA, 18 nt, Homo sapiens
uaacaguaacugccauuu

SEQ ID NO: 2237719 - RNA, 19 nt, Homo sapiens
ucuaauauauccacacauu

SEQ ID NO: 2237720 - RNA, 22 nt, Homo sapiens
gccucaguuuuccuucuguuaa

SEQ ID NO: 2237721 - RNA, 15 nt, Homo sapiens
agcuaaguagcaucg

SEQ ID NO: 2237722 - RNA, 20 nt, Homo sapiens
gugugguggggacaacagca

SEQ ID NO: 2237723 - RNA, 16 nt, Homo sapiens
ugcuggugagugccac

SEQ ID NO: 2237724 - RNA, 14 nt, Homo sapiens
uguacccuuccuac

SEQ ID NO: 2237725 - RNA, 19 nt, Homo sapiens
aaggagugcgugccugcua

SEQ ID NO: 2237726 - RNA, 22 nt, Homo sapiens
acauggaugcgaggaccacuuu

SEQ ID NO: 2237727 - RNA, 14 nt, Homo sapiens
cuccuaagcaaaag

SEQ ID NO: 2237728 - RNA, 22 nt, Homo sapiens
cuuaaaguucugggcagcuaaa

SEQ ID NO: 2237729 - RNA, 13 nt, Homo sapiens
gacucaggccagu

SEQ ID NO: 2237730 - RNA, 11 nt, Homo sapiens
agccaugggcc

SEQ ID NO: 2237731 - RNA, 18 nt, Homo sapiens
aauaguuugacacuugaa

SEQ ID NO: 2237732 - RNA, 20 nt, Homo sapiens
ccuugagcacaaaauuuggu

SEQ ID NO: 2237733 - RNA, 18 nt, Homo sapiens
cagacuucagacuuucaa

SEQ ID NO: 2237734 - RNA, 18 nt, Homo sapiens
uggcggcaucugcuucug

SEQ ID NO: 2237735 - RNA, 15 nt, Homo sapiens
aauguauauacacau

SEQ ID NO: 2237736 - RNA, 11 nt, Homo sapiens
uguguguauau

SEQ ID NO: 2237737 - RNA, 14 nt, Homo sapiens
caaauagcagcaca

SEQ ID NO: 2237738 - RNA, 23 nt, Homo sapiens
ggauggaacacggccacaucaaa

SEQ ID NO: 2237739 - RNA, 16 nt, Homo sapiens
uggccccacuuugaag

SEQ ID NO: 2237740 - RNA, 12 nt, Homo sapiens
agacaguaugca

SEQ ID NO: 2237741 - RNA, 21 nt, Homo sapiens
uggugcauccgugaaugcgcu

SEQ ID NO: 2237742 - RNA, 15 nt, Homo sapiens
ugguacuuaagcucc

SEQ ID NO: 2237743 - RNA, 16 nt, Homo sapiens
agaggauuuaacugug

SEQ ID NO: 2237744 - RNA, 21 nt, Homo sapiens
aaaggagccuugauaauacuu

SEQ ID NO: 2237745 - RNA, 23 nt, Homo sapiens
ccaacaggcuguucugcacugaa

SEQ ID NO: 2237746 - RNA, 17 nt, Homo sapiens
aaucaaguauuggcaaa

SEQ ID NO: 2237747 - RNA, 19 nt, Homo sapiens
uauugcuguugcuuaucau

SEQ ID NO: 2237748 - RNA, 22 nt, Homo sapiens
aaauacgaacccaaucugcaca

SEQ ID NO: 2237749 - RNA, 14 nt, Homo sapiens
gcuaaaaagcaaca

SEQ ID NO: 2237750 - RNA, 16 nt, Homo sapiens
acaacaggcauuccag

SEQ ID NO: 2237751 - RNA, 14 nt, Homo sapiens
ugaaggucaauaaa

SEQ ID NO: 2237752 - RNA, 14 nt, Homo sapiens
uagugucagccaug

SEQ ID NO: 2237753 - RNA, 22 nt, Homo sapiens
uuuggaacauuucuuucuugcu

SEQ ID NO: 2237754 - RNA, 21 nt, Homo sapiens
uuagaauagaaccaacccaaa

SEQ ID NO: 2237755 - RNA, 24 nt, Homo sapiens
uguucauggguuuaccacuaacuc

SEQ ID NO: 2237756 - RNA, 19 nt, Homo sapiens
uccccacccauaccacagc

SEQ ID NO: 2237757 - RNA, 21 nt, Homo sapiens
aaaaucccaaauucacuuuau

SEQ ID NO: 2237758 - RNA, 16 nt, Homo sapiens
uuaugaauaagcacuu

SEQ ID NO: 2237759 - RNA, 14 nt, Homo sapiens
gcuaaagcaguguu

SEQ ID NO: 2237760 - RNA, 11 nt, Homo sapiens
gagaguacucu

SEQ ID NO: 2237761 - RNA, 16 nt, Homo sapiens
ccccagcugauuagug

SEQ ID NO: 2237762 - RNA, 20 nt, Homo sapiens
cuuugaaaacugaaugucag

SEQ ID NO: 2237763 - RNA, 17 nt, Homo sapiens
cuuagaccuauacugaa

SEQ ID NO: 2237764 - RNA, 22 nt, Homo sapiens
uauggaaggguaaauacuggua

SEQ ID NO: 2237765 - RNA, 20 nt, Homo sapiens
uccugggagcccccaccaca

SEQ ID NO: 2237766 - RNA, 12 nt, Homo sapiens
gugauucuugcu

SEQ ID NO: 2237767 - RNA, 14 nt, Homo sapiens
caagcaguagacaa

SEQ ID NO: 2237768 - RNA, 23 nt, Homo sapiens
agccagcccuccuugacccagaa

SEQ ID NO: 2237769 - RNA, 21 nt, Homo sapiens
gcacugacaaugggcacacag

SEQ ID NO: 2237770 - RNA, 21 nt, Homo sapiens
ucagacucuaaacacacaagu

SEQ ID NO: 2237771 - RNA, 13 nt, Homo sapiens
uuugagcgguuga

SEQ ID NO: 2237772 - RNA, 18 nt, Homo sapiens
uuuccgccagaccucaac

SEQ ID NO: 2237773 - RNA, 12 nt, Homo sapiens
gugucacuggcu

SEQ ID NO: 2237774 - RNA, 22 nt, Homo sapiens
ucaccaggggcaggcacagcac

SEQ ID NO: 2237775 - RNA, 20 nt, Homo sapiens
ucucugugugcacacccaug

SEQ ID NO: 2237776 - RNA, 20 nt, Homo sapiens
uuacaaguuuuuuaggauuc

SEQ ID NO: 2237777 - RNA, 22 nt, Homo sapiens
gccugaguuggcguugugggca

SEQ ID NO: 2237778 - RNA, 15 nt, Homo sapiens
agaaaacaauuccuu

SEQ ID NO: 2237779 - RNA, 17 nt, Homo sapiens
caaaccuuacuauggaa

SEQ ID NO: 2237780 - RNA, 13 nt, Homo sapiens
caggaggccaaua

SEQ ID NO: 2237781 - RNA, 20 nt, Homo sapiens
ucuuucaauugcagaugcca

SEQ ID NO: 2237782 - RNA, 14 nt, Homo sapiens
cgcccccaccucca

SEQ ID NO: 2237783 - RNA, 20 nt, Homo sapiens
uacacauggaugcacgcaca

SEQ ID NO: 2237784 - RNA, 17 nt, Homo sapiens
ggcaggaggguggcacu

SEQ ID NO: 2237785 - RNA, 17 nt, Homo sapiens
gugcaaggaccaaaggg

SEQ ID NO: 2237786 - RNA, 20 nt, Homo sapiens
cugagcccggaaacuccaca

SEQ ID NO: 2237787 - RNA, 17 nt, Homo sapiens
agaaagacucugagaug

SEQ ID NO: 2237788 - RNA, 17 nt, Homo sapiens
cucuuuaacacauucuu

SEQ ID NO: 2237789 - RNA, 23 nt, Homo sapiens
gcaucuccagcauucucagccac

SEQ ID NO: 2237790 - RNA, 14 nt, Homo sapiens
cucugccgcugcca

SEQ ID NO: 2237791 - RNA, 18 nt, Homo sapiens
agcccugacggacuucau

SEQ ID NO: 2237792 - RNA, 14 nt, Homo sapiens
cccuauugcugcua

SEQ ID NO: 2237793 - RNA, 16 nt, Homo sapiens
ucagauugcaugugac

SEQ ID NO: 2237794 - RNA, 20 nt, Homo sapiens
aggccagagggagugacaga

SEQ ID NO: 2237795 - RNA, 18 nt, Homo sapiens
ugugacaccaccacugug

SEQ ID NO: 2237796 - RNA, 14 nt, Homo sapiens
aaucaggaaacuca

SEQ ID NO: 2237797 - RNA, 14 nt, Homo sapiens
acuuaaugugcugc

SEQ ID NO: 2237798 - RNA, 17 nt, Homo sapiens
gcauaugauagaugaca

SEQ ID NO: 2237799 - RNA, 19 nt, Homo sapiens
ggggccacaccaaccuucu

SEQ ID NO: 2237800 - RNA, 20 nt, Homo sapiens
cuugaguuggaguacuauau

SEQ ID NO: 2237801 - RNA, 17 nt, Homo sapiens
uaugugcgucucucuuu

SEQ ID NO: 2237802 - RNA, 17 nt, Homo sapiens
uuagccauuugacuaau

SEQ ID NO: 2237803 - RNA, 19 nt, Homo sapiens
gacauaaacaaagacauug

SEQ ID NO: 2237804 - RNA, 16 nt, Homo sapiens
uacuuuuuauacucca

SEQ ID NO: 2237805 - RNA, 21 nt, Homo sapiens
gaaauaugaugagauucacuu

SEQ ID NO: 2237806 - RNA, 18 nt, Homo sapiens
auagguucaaaagcaauc

SEQ ID NO: 2237807 - RNA, 16 nt, Homo sapiens
uuccgguuguugauau

SEQ ID NO: 2237808 - RNA, 21 nt, Homo sapiens
uaucaaacccuagccuugcuu

SEQ ID NO: 2237809 - RNA, 20 nt, Homo sapiens
acacaaaaugucacaauccu

SEQ ID NO: 2237810 - RNA, 20 nt, Homo sapiens
ccacugccccugcaccugcu

SEQ ID NO: 2237811 - RNA, 16 nt, Homo sapiens
ucuaauccaugugcug

SEQ ID NO: 2237812 - RNA, 15 nt, Homo sapiens
aucuuucuuguuuca

SEQ ID NO: 2237813 - RNA, 21 nt, Homo sapiens
cuacaugacgacaaagcugcu

SEQ ID NO: 2237814 - RNA, 20 nt, Homo sapiens
ugccucggccucccaaagug

SEQ ID NO: 2237815 - RNA, 14 nt, Homo sapiens
cgcacguggagcug

SEQ ID NO: 2237816 - RNA, 13 nt, Homo sapiens
ucauuccaugacu

SEQ ID NO: 2237817 - RNA, 20 nt, Homo sapiens
aucugcuagggaauaucaau

SEQ ID NO: 2237818 - RNA, 13 nt, Homo sapiens
gcccuccaggcuu

SEQ ID NO: 2237819 - RNA, 18 nt, Homo sapiens
cuugccugcuccaucuca

SEQ ID NO: 2237820 - RNA, 21 nt, Homo sapiens
gcuuccugucccacuacugua

SEQ ID NO: 2237821 - RNA, 14 nt, Homo sapiens
uguggccaucugcu

SEQ ID NO: 2237822 - RNA, 20 nt, Homo sapiens
guaaaauauagcuguacaaa

SEQ ID NO: 2237823 - RNA, 22 nt, Homo sapiens
ucugcuugcaucacuugggguc

SEQ ID NO: 2237824 - RNA, 12 nt, Homo sapiens
uucauugccucu

SEQ ID NO: 2237825 - RNA, 15 nt, Homo sapiens
auaauugcuuugcca

SEQ ID NO: 2237826 - RNA, 13 nt, Homo sapiens
ugcccuuaggcca

SEQ ID NO: 2237827 - RNA, 23 nt, Homo sapiens
auggcugcaagcgcacuugaugg

SEQ ID NO: 2237828 - RNA, 21 nt, Homo sapiens
uugacagucugcucaacacga

SEQ ID NO: 2237829 - RNA, 17 nt, Homo sapiens
uacaggcgugagccauc

SEQ ID NO: 2237830 - RNA, 14 nt, Homo sapiens
agaauuucaauauc

SEQ ID NO: 2237831 - RNA, 17 nt, Homo sapiens
uagagauggaguuugcu

SEQ ID NO: 2237832 - RNA, 17 nt, Homo sapiens
cuugcaagacccaggga

SEQ ID NO: 2237833 - RNA, 22 nt, Homo sapiens
cauacuuucucuucaaauuuag

SEQ ID NO: 2237834 - RNA, 22 nt, Homo sapiens
agggguugcgggggagcuggaa

SEQ ID NO: 2237835 - RNA, 23 nt, Homo sapiens
ggagcuuuagcuucucugccaag

SEQ ID NO: 2237836 - RNA, 19 nt, Homo sapiens
cauuagcauugaguuuuga

SEQ ID NO: 2237837 - RNA, 20 nt, Homo sapiens
ggcaguauggcggaggccau

SEQ ID NO: 2237838 - RNA, 19 nt, Homo sapiens
acccaaaugguggccauug

SEQ ID NO: 2237839 - RNA, 20 nt, Homo sapiens
cuggauggccaaacccaaga

SEQ ID NO: 2237840 - RNA, 17 nt, Homo sapiens
aaacuuaggcaugcaca

SEQ ID NO: 2237841 - RNA, 19 nt, Homo sapiens
ucacuauguugcccaggcu

SEQ ID NO: 2237842 - RNA, 16 nt, Homo sapiens
ugagaucauugcaaac

SEQ ID NO: 2237843 - RNA, 15 nt, Homo sapiens
aaaucccaugugccc

SEQ ID NO: 2237844 - RNA, 12 nt, Homo sapiens
uguacaauguga

SEQ ID NO: 2237845 - RNA, 13 nt, Homo sapiens
ucugcaugucuca

SEQ ID NO: 2237846 - RNA, 12 nt, Homo sapiens
aaauacuauauu

SEQ ID NO: 2237847 - RNA, 17 nt, Homo sapiens
uccagcacagauuugcu

SEQ ID NO: 2237848 - RNA, 23 nt, Homo sapiens
aacugaggcucaggccacauaau

SEQ ID NO: 2237849 - RNA, 14 nt, Homo sapiens
gcuagaacauucca

SEQ ID NO: 2237850 - RNA, 11 nt, Homo sapiens
uggcuuuccag

SEQ ID NO: 2237851 - RNA, 15 nt, Homo sapiens
gaaguggcagugaaa

SEQ ID NO: 2237852 - RNA, 17 nt, Homo sapiens
agacaaaguaauuccuc

SEQ ID NO: 2237853 - RNA, 16 nt, Homo sapiens
gccaggagaagcucag

SEQ ID NO: 2237854 - RNA, 17 nt, Homo sapiens
aggucauuaaaauuaca

SEQ ID NO: 2237855 - RNA, 22 nt, Homo sapiens
uuaaaaaaaugugguacauaca

SEQ ID NO: 2237856 - RNA, 16 nt, Homo sapiens
uuccugucuuauccuc

SEQ ID NO: 2237857 - RNA, 13 nt, Homo sapiens
agcaauacuugga

SEQ ID NO: 2237858 - RNA, 19 nt, Homo sapiens
cagucaaggaguggcuuac

SEQ ID NO: 2237859 - RNA, 12 nt, Homo sapiens
cacagagugccu

SEQ ID NO: 2237860 - RNA, 20 nt, Homo sapiens
cugaugguguggccuguggc

SEQ ID NO: 2237861 - RNA, 14 nt, Homo sapiens
cagggugaccugcu

SEQ ID NO: 2237862 - RNA, 13 nt, Homo sapiens
ggcaacuucccac

SEQ ID NO: 2237863 - RNA, 13 nt, Homo sapiens
agauccuccauuu

SEQ ID NO: 2237864 - RNA, 22 nt, Homo sapiens
auucaaauuuguacaggacugu

SEQ ID NO: 2237865 - RNA, 22 nt, Homo sapiens
ggcagccucugggggguggcca

SEQ ID NO: 2237866 - RNA, 21 nt, Homo sapiens
aucacgccacugcacuccagc

SEQ ID NO: 2237867 - RNA, 18 nt, Homo sapiens
guacaguuaucauuauca

SEQ ID NO: 2237868 - RNA, 17 nt, Homo sapiens
ugaucaauaaaauguga

SEQ ID NO: 2237869 - RNA, 18 nt, Homo sapiens
aaagagagucgcaucuca

SEQ ID NO: 2237870 - RNA, 23 nt, Homo sapiens
auucagugcagcauauacaauaa

SEQ ID NO: 2237871 - RNA, 13 nt, Homo sapiens
caucaccaggugc

SEQ ID NO: 2237872 - RNA, 22 nt, Homo sapiens
aguugugcaacggccaggguug

SEQ ID NO: 2237873 - RNA, 15 nt, Homo sapiens
aagaaaaugauugcu

SEQ ID NO: 2237874 - RNA, 13 nt, Homo sapiens
gucauacauaccu

SEQ ID NO: 2237875 - RNA, 20 nt, Homo sapiens
ccagaguggccuggccagga

SEQ ID NO: 2237876 - RNA, 15 nt, Homo sapiens
uucgaauccagagag

SEQ ID NO: 2237877 - RNA, 15 nt, Homo sapiens
uaggaagccucagau

SEQ ID NO: 2237878 - RNA, 23 nt, Homo sapiens
uaugaugguggaucaagacauaa

SEQ ID NO: 2237879 - RNA, 20 nt, Homo sapiens
gugcaguggcacgaucucga

SEQ ID NO: 2237880 - RNA, 15 nt, Homo sapiens
aggugcagcuccuca

SEQ ID NO: 2237881 - RNA, 15 nt, Homo sapiens
aucugagcaaugacu

SEQ ID NO: 2237882 - RNA, 12 nt, Homo sapiens
ccucaggugccu

SEQ ID NO: 2237883 - RNA, 17 nt, Homo sapiens
uuauaugccugauucau

SEQ ID NO: 2237884 - RNA, 13 nt, Homo sapiens
aaaacuuccuuaa

SEQ ID NO: 2237885 - RNA, 17 nt, Homo sapiens
uuagucaggaauggcug

SEQ ID NO: 2237886 - RNA, 13 nt, Homo sapiens
gucucaaucugau

SEQ ID NO: 2237887 - RNA, 23 nt, Homo sapiens
uccucugcaguuuugacauuuag

SEQ ID NO: 2237888 - RNA, 13 nt, Homo sapiens
cagcaaaguuaug

SEQ ID NO: 2237889 - RNA, 20 nt, Homo sapiens
uggcugccugcaccccagga

SEQ ID NO: 2237890 - RNA, 15 nt, Homo sapiens
ccaagugcaaaagaa

SEQ ID NO: 2237891 - RNA, 15 nt, Homo sapiens
uucaauacuuacaua

SEQ ID NO: 2237892 - RNA, 14 nt, Homo sapiens
gaaacacuccuugc

SEQ ID NO: 2237893 - RNA, 22 nt, Homo sapiens
ggaaucauuguuuggcauugaa

SEQ ID NO: 2237894 - RNA, 13 nt, Homo sapiens
uccuuccauucca

SEQ ID NO: 2237895 - RNA, 15 nt, Homo sapiens
uuuggaauauuaaaa

SEQ ID NO: 2237896 - RNA, 21 nt, Homo sapiens
aucuuaaaaaucuaugccuaa

SEQ ID NO: 2237897 - RNA, 13 nt, Homo sapiens
uuaacauuuucca

SEQ ID NO: 2237898 - RNA, 17 nt, Homo sapiens
cauguauuaugauuaaa

SEQ ID NO: 2237899 - RNA, 22 nt, Homo sapiens
gagccuaaaaauaaagcacaaa

SEQ ID NO: 2237900 - RNA, 22 nt, Homo sapiens
uucuauaaaugaaugugcugaa

SEQ ID NO: 2237901 - RNA, 17 nt, Homo sapiens
agagagauguauguguc

SEQ ID NO: 2237902 - RNA, 16 nt, Homo sapiens
uggcccugcuuucuac

SEQ ID NO: 2237903 - RNA, 13 nt, Homo sapiens
cagggcacuacau

SEQ ID NO: 2237904 - RNA, 20 nt, Homo sapiens
cucaaggauccagacucuca

SEQ ID NO: 2237905 - RNA, 21 nt, Homo sapiens
uacaaggguaaaauguuacca

SEQ ID NO: 2237906 - RNA, 13 nt, Homo sapiens
caggccaauguca

SEQ ID NO: 2237907 - RNA, 17 nt, Homo sapiens
uaauaguucaguguaug

SEQ ID NO: 2237908 - RNA, 20 nt, Homo sapiens
aauugucuuuguucugugau

SEQ ID NO: 2237909 - RNA, 15 nt, Homo sapiens
uggcaagcagggaaa

SEQ ID NO: 2237910 - RNA, 17 nt, Homo sapiens
cagauguuuuggucaag

SEQ ID NO: 2237911 - RNA, 15 nt, Homo sapiens
ucuucaucugcuaca

SEQ ID NO: 2237912 - RNA, 13 nt, Homo sapiens
uccuuacugucuc

SEQ ID NO: 2237913 - RNA, 18 nt, Homo sapiens
cuacaggcucaugccauc

SEQ ID NO: 2237914 - RNA, 22 nt, Homo sapiens
cagugccuuuguagccuauguc

SEQ ID NO: 2237915 - RNA, 21 nt, Homo sapiens
ucaaauuuuggcgaaucucaa

SEQ ID NO: 2237916 - RNA, 20 nt, Homo sapiens
ugguaccucucauuugggca

SEQ ID NO: 2237917 - RNA, 16 nt, Homo sapiens
gcauccucuaccucuc

SEQ ID NO: 2237918 - RNA, 20 nt, Homo sapiens
gucaacaugcauauuacauu

SEQ ID NO: 2237919 - RNA, 22 nt, Homo sapiens
auacugugugcuaaaacaagca

SEQ ID NO: 2237920 - RNA, 17 nt, Homo sapiens
accuauagcaucuucuc

SEQ ID NO: 2237921 - RNA, 13 nt, Homo sapiens
gggaaaaugugaa

SEQ ID NO: 2237922 - RNA, 22 nt, Homo sapiens
ccaaauacgaagcccucuugca

SEQ ID NO: 2237923 - RNA, 18 nt, Homo sapiens
gucccaacccagacaaug

SEQ ID NO: 2237924 - RNA, 20 nt, Homo sapiens
cccugcacacacaugcauac

SEQ ID NO: 2237925 - RNA, 14 nt, Homo sapiens
aacaaacguuucuu

SEQ ID NO: 2237926 - RNA, 18 nt, Homo sapiens
cccuaccagcgcccgcug

SEQ ID NO: 2237927 - RNA, 21 nt, Homo sapiens
uaauuaaaaaguuaaucuuca

SEQ ID NO: 2237928 - RNA, 18 nt, Homo sapiens
uauuuaaccuaguucaau

SEQ ID NO: 2237929 - RNA, 18 nt, Homo sapiens
cccuguaguugacaauuc

SEQ ID NO: 2237930 - RNA, 15 nt, Homo sapiens
accagagacgcccag

SEQ ID NO: 2237931 - RNA, 23 nt, Homo sapiens
gaauggaauccuucccuggugau

SEQ ID NO: 2237932 - RNA, 20 nt, Homo sapiens
gacauaaagccucugacuca

SEQ ID NO: 2237933 - RNA, 22 nt, Homo sapiens
ggacaucuaguaggugcuugac

SEQ ID NO: 2237934 - RNA, 12 nt, Homo sapiens
uaauguguuucu

SEQ ID NO: 2237935 - RNA, 12 nt, Homo sapiens
gugcccagugau

SEQ ID NO: 2237936 - RNA, 17 nt, Homo sapiens
gccuggucccugguccu

SEQ ID NO: 2237937 - RNA, 22 nt, Homo sapiens
aggugacagaggcgaaggcaga

SEQ ID NO: 2237938 - RNA, 19 nt, Homo sapiens
cacauguucaacuauuaau

SEQ ID NO: 2237939 - RNA, 14 nt, Homo sapiens
aacgugacagggaa

SEQ ID NO: 2237940 - RNA, 20 nt, Homo sapiens
guugccacaccaaucagaga

SEQ ID NO: 2237941 - RNA, 14 nt, Homo sapiens
aacgcaccaaucag

SEQ ID NO: 2237942 - RNA, 17 nt, Homo sapiens
uugaauggucuucugcc

SEQ ID NO: 2237943 - RNA, 12 nt, Homo sapiens
auuaaaagucau

SEQ ID NO: 2237944 - RNA, 13 nt, Homo sapiens
ccugaaaauccaa

SEQ ID NO: 2237945 - RNA, 18 nt, Homo sapiens
gugauccucccaccucag

SEQ ID NO: 2237946 - RNA, 14 nt, Homo sapiens
aagcaacacagagc

SEQ ID NO: 2237947 - RNA, 12 nt, Homo sapiens
cuccaguaccau

SEQ ID NO: 2237948 - RNA, 20 nt, Homo sapiens
uuugauuucagguuuguaug

SEQ ID NO: 2237949 - RNA, 17 nt, Homo sapiens
uuauaaaugaagaugca

SEQ ID NO: 2237950 - RNA, 14 nt, Homo sapiens
guggaugaagcaga

SEQ ID NO: 2237951 - RNA, 14 nt, Homo sapiens
ggguuaagucuccu

SEQ ID NO: 2237952 - RNA, 20 nt, Homo sapiens
aagaugcuucucacugccau

SEQ ID NO: 2237953 - RNA, 16 nt, Homo sapiens
cuaccaaccucugaag

SEQ ID NO: 2237954 - RNA, 16 nt, Homo sapiens
gagugacuaguacaaa

SEQ ID NO: 2237955 - RNA, 18 nt, Homo sapiens
acuaaacagacuauuuaa

SEQ ID NO: 2237956 - RNA, 22 nt, Homo sapiens
gcccagcuuuuagaaaaugcag

SEQ ID NO: 2237957 - RNA, 18 nt, Homo sapiens
ccuuugaccccagcagcu

SEQ ID NO: 2237958 - RNA, 23 nt, Homo sapiens
auucaaaaguauugaaagccaac

SEQ ID NO: 2237959 - RNA, 15 nt, Homo sapiens
caaggccuugcucac

SEQ ID NO: 2237960 - RNA, 18 nt, Homo sapiens
cuauggugagaugcagcu

SEQ ID NO: 2237961 - RNA, 17 nt, Homo sapiens
agagccugagucacugg

SEQ ID NO: 2237962 - RNA, 14 nt, Homo sapiens
uagaaaaagauucu

SEQ ID NO: 2237963 - RNA, 17 nt, Homo sapiens
auauccuuggcacaucc

SEQ ID NO: 2237964 - RNA, 19 nt, Homo sapiens
cuacugccccugcccugag

SEQ ID NO: 2237965 - RNA, 20 nt, Homo sapiens
cagcugguccuccacuuugc

SEQ ID NO: 2237966 - RNA, 15 nt, Homo sapiens
ugauagauguagucu

SEQ ID NO: 2237967 - RNA, 20 nt, Homo sapiens
cauucuucagacaucaguca

SEQ ID NO: 2237968 - RNA, 15 nt, Homo sapiens
uuauauuaaagaagu

SEQ ID NO: 2237969 - RNA, 14 nt, Homo sapiens
cuccgcaggcugcc

SEQ ID NO: 2237970 - RNA, 22 nt, Homo sapiens
agauauugggacacacaucaaa

SEQ ID NO: 2237971 - RNA, 23 nt, Homo sapiens
gggauuucuucgcugcucuagcu

SEQ ID NO: 2237972 - RNA, 15 nt, Homo sapiens
guuuaaaaaccaaau

SEQ ID NO: 2237973 - RNA, 16 nt, Homo sapiens
uaaaaugcuggugaaa

SEQ ID NO: 2237974 - RNA, 18 nt, Homo sapiens
aauacuauuauuugcuac

SEQ ID NO: 2237975 - RNA, 17 nt, Homo sapiens
cccucaaagugagggga

SEQ ID NO: 2237976 - RNA, 23 nt, Homo sapiens
cugucacaucagcuccacuuuca

SEQ ID NO: 2237977 - RNA, 15 nt, Homo sapiens
cuugcuggcucugag

SEQ ID NO: 2237978 - RNA, 20 nt, Homo sapiens
ugugauuuuaauuugauaca

SEQ ID NO: 2237979 - RNA, 20 nt, Homo sapiens
cgggcagggccccugacccu

SEQ ID NO: 2237980 - RNA, 12 nt, Homo sapiens
agcccagacuuu

SEQ ID NO: 2237981 - RNA, 23 nt, Homo sapiens
ucaaguccauguuauucucucac

SEQ ID NO: 2237982 - RNA, 20 nt, Homo sapiens
acccuccuugggacugaagg

SEQ ID NO: 2237983 - RNA, 20 nt, Homo sapiens
accaugacgcacugcucaag

SEQ ID NO: 2237984 - RNA, 22 nt, Homo sapiens
aagggauggacaucuugucauu

SEQ ID NO: 2237985 - RNA, 18 nt, Homo sapiens
agcucuuggacaacagcu

SEQ ID NO: 2237986 - RNA, 23 nt, Homo sapiens
aucuuguguaagguuuugguuau

SEQ ID NO: 2237987 - RNA, 22 nt, Homo sapiens
uugcuuaggaaauugcucauaa

SEQ ID NO: 2237988 - RNA, 22 nt, Homo sapiens
uggaguggcugccauggaagga

SEQ ID NO: 2237989 - RNA, 19 nt, Homo sapiens
acucacuucaaugugucau

SEQ ID NO: 2237990 - RNA, 11 nt, Homo sapiens
agaugucuguu

SEQ ID NO: 2237991 - RNA, 19 nt, Homo sapiens
cugggaugaugcaguuuga

SEQ ID NO: 2237992 - RNA, 23 nt, Homo sapiens
auagaaucaauauuuguaggcca

SEQ ID NO: 2237993 - RNA, 14 nt, Homo sapiens
uucuucagaacaau

SEQ ID NO: 2237994 - RNA, 14 nt, Homo sapiens
auuuucaguauaau

SEQ ID NO: 2237995 - RNA, 18 nt, Homo sapiens
ggggaggagccucuggcu

SEQ ID NO: 2237996 - RNA, 18 nt, Homo sapiens
aagccacgaggugcagua

SEQ ID NO: 2237997 - RNA, 16 nt, Homo sapiens
cuguagcgucuguaua

SEQ ID NO: 2237998 - RNA, 15 nt, Homo sapiens
ucuuaucuaccaguu

SEQ ID NO: 2237999 - RNA, 17 nt, Homo sapiens
uccaccaucaccucucu

SEQ ID NO: 2238000 - RNA, 20 nt, Homo sapiens
cuuucaacuccaguacucug

SEQ ID NO: 2238001 - RNA, 20 nt, Homo sapiens
uggacaaacaccaaucucuc

SEQ ID NO: 2238002 - RNA, 16 nt, Homo sapiens
uaaaagaaaacacugu

SEQ ID NO: 2238003 - RNA, 17 nt, Homo sapiens
ugaagaagauaugugaa

SEQ ID NO: 2238004 - RNA, 14 nt, Homo sapiens
auuucauagccaaa

SEQ ID NO: 2238005 - RNA, 16 nt, Homo sapiens
auccagugcuuccaca

SEQ ID NO: 2238006 - RNA, 23 nt, Homo sapiens
caagaggaggacagaauucuccc

SEQ ID NO: 2238007 - RNA, 19 nt, Homo sapiens
cuuuugcaugucgcacaau

SEQ ID NO: 2238008 - RNA, 13 nt, Homo sapiens
ucugucaacauca

SEQ ID NO: 2238009 - RNA, 16 nt, Homo sapiens
aucuaagcaguggcau

SEQ ID NO: 2238010 - RNA, 22 nt, Homo sapiens
cccauaucccugguugccucau

SEQ ID NO: 2238011 - RNA, 21 nt, Homo sapiens
gugagauaaaugcacauuuca

SEQ ID NO: 2238012 - RNA, 17 nt, Homo sapiens
cauaauuacucuacuuc

SEQ ID NO: 2238013 - RNA, 13 nt, Homo sapiens
aaaucaaauauuc

SEQ ID NO: 2238014 - RNA, 20 nt, Homo sapiens
uuaaaaaggccuuugggauu

SEQ ID NO: 2238015 - RNA, 20 nt, Homo sapiens
cacacagauuugagcucagc

SEQ ID NO: 2238016 - RNA, 14 nt, Homo sapiens
aacuuucuacucau

SEQ ID NO: 2238017 - RNA, 21 nt, Homo sapiens
ggaaaguaucucuacuuuccu

SEQ ID NO: 2238018 - RNA, 14 nt, Homo sapiens
aauugaaaaaccau

SEQ ID NO: 2238019 - RNA, 21 nt, Homo sapiens
acaucacugagacaaucaugu

SEQ ID NO: 2238020 - RNA, 17 nt, Homo sapiens
caugugagccaccgcug

SEQ ID NO: 2238021 - RNA, 22 nt, Homo sapiens
auagaaggaaacuagcuuacau

SEQ ID NO: 2238022 - RNA, 14 nt, Homo sapiens
uccuuccuuaucac

SEQ ID NO: 2238023 - RNA, 13 nt, Homo sapiens
uugauuauuguau

SEQ ID NO: 2238024 - RNA, 20 nt, Homo sapiens
ugcucugaugcaauagugga

SEQ ID NO: 2238025 - RNA, 16 nt, Homo sapiens
cuaacaugaguaucau

SEQ ID NO: 2238026 - RNA, 16 nt, Homo sapiens
acugcuccaagggaca

SEQ ID NO: 2238027 - RNA, 22 nt, Homo sapiens
cauagagggagaggaagcacac

SEQ ID NO: 2238028 - RNA, 23 nt, Homo sapiens
cacacuccuuugcuuagcccaca

SEQ ID NO: 2238029 - RNA, 21 nt, Homo sapiens
uagaauacucagggaaagcau

SEQ ID NO: 2238030 - RNA, 12 nt, Homo sapiens
gaaccagcccca

SEQ ID NO: 2238031 - RNA, 20 nt, Homo sapiens
ccugguuaauucagcuugag

SEQ ID NO: 2238032 - RNA, 22 nt, Homo sapiens
cuguaaaguucaauugugaaaa

SEQ ID NO: 2238033 - RNA, 23 nt, Homo sapiens
auggcucuucaccugggcgccaa

SEQ ID NO: 2238034 - RNA, 21 nt, Homo sapiens
ucagcaacuguuuaaccuguu

SEQ ID NO: 2238035 - RNA, 20 nt, Homo sapiens
uuuuggauauagguuuccaa

SEQ ID NO: 2238036 - RNA, 22 nt, Homo sapiens
aacaacaauuuaggaaugcuca

SEQ ID NO: 2238037 - RNA, 16 nt, Homo sapiens
aguguguccaagugug

SEQ ID NO: 2238038 - RNA, 20 nt, Homo sapiens
caucauaagcugauuugaua

SEQ ID NO: 2238039 - RNA, 17 nt, Homo sapiens
cuuacuuuggaauacau

SEQ ID NO: 2238040 - RNA, 15 nt, Homo sapiens
uggccuguggcuaau

SEQ ID NO: 2238041 - RNA, 20 nt, Homo sapiens
cacuuuugaagcaauaucag

SEQ ID NO: 2238042 - RNA, 16 nt, Homo sapiens
uauuuaaguugugauu

SEQ ID NO: 2238043 - RNA, 20 nt, Homo sapiens
ucggaagacuugccacuuuu

SEQ ID NO: 2238044 - RNA, 21 nt, Homo sapiens
auuugguaauucuguguaaca

SEQ ID NO: 2238045 - RNA, 21 nt, Homo sapiens
cuucugacacuaaaacaccuc

SEQ ID NO: 2238046 - RNA, 20 nt, Homo sapiens
auuauauuaucauaucucuc

SEQ ID NO: 2238047 - RNA, 20 nt, Homo sapiens
ucacucauuccuucacucau

SEQ ID NO: 2238048 - RNA, 22 nt, Homo sapiens
acaaaaggguguauaguguuca

SEQ ID NO: 2238049 - RNA, 20 nt, Homo sapiens
aucauacaccagaagacaaa

SEQ ID NO: 2238050 - RNA, 16 nt, Homo sapiens
acaaaaggaagacugg

SEQ ID NO: 2238051 - RNA, 14 nt, Homo sapiens
aauaaauuugcaaa

SEQ ID NO: 2238052 - RNA, 14 nt, Homo sapiens
agagaagagaccaa

SEQ ID NO: 2238053 - RNA, 17 nt, Homo sapiens
agauaugcacacacaga

SEQ ID NO: 2238054 - RNA, 20 nt, Homo sapiens
accuuuucuauuuaccuccu

SEQ ID NO: 2238055 - RNA, 11 nt, Homo sapiens
aucagugaugg

SEQ ID NO: 2238056 - RNA, 17 nt, Homo sapiens
acacacagagauaugca

SEQ ID NO: 2238057 - RNA, 23 nt, Homo sapiens
aaguuucccuucucccaguccaa

SEQ ID NO: 2238058 - RNA, 18 nt, Homo sapiens
ccuuucuuauuaauuuca

SEQ ID NO: 2238059 - RNA, 14 nt, Homo sapiens
acgucuucugagaa

SEQ ID NO: 2238060 - RNA, 15 nt, Homo sapiens
aucucucugggaugc

SEQ ID NO: 2238061 - RNA, 16 nt, Homo sapiens
cacaucuaaagcuuua

SEQ ID NO: 2238062 - RNA, 13 nt, Homo sapiens
uuuaaauugugcc

SEQ ID NO: 2238063 - RNA, 16 nt, Homo sapiens
cuauaaguguucagug

SEQ ID NO: 2238064 - RNA, 16 nt, Homo sapiens
aaaaucuguguaacug

SEQ ID NO: 2238065 - RNA, 15 nt, Homo sapiens
gaggccacacccaga

SEQ ID NO: 2238066 - RNA, 20 nt, Homo sapiens
gccuucaugaaucuuucaua

SEQ ID NO: 2238067 - RNA, 23 nt, Homo sapiens
gcagucaucuugaccaagcagga

SEQ ID NO: 2238068 - RNA, 17 nt, Homo sapiens
agaguccuuuuagcaca

SEQ ID NO: 2238069 - RNA, 21 nt, Homo sapiens
auggcucuuagaaacucagga

SEQ ID NO: 2238070 - RNA, 22 nt, Homo sapiens
gaugcuaucucgcuagccauau

SEQ ID NO: 2238071 - RNA, 17 nt, Homo sapiens
ugcaaccucuuccuccu

SEQ ID NO: 2238072 - RNA, 13 nt, Homo sapiens
cauaccagucacc

SEQ ID NO: 2238073 - RNA, 22 nt, Homo sapiens
gccuggagaaggguucagccca

SEQ ID NO: 2238074 - RNA, 16 nt, Homo sapiens
aaaauuaauguaauaa

SEQ ID NO: 2238075 - RNA, 16 nt, Homo sapiens
agcugcucauuucacu

SEQ ID NO: 2238076 - RNA, 19 nt, Homo sapiens
caaaauugcaaaucuugaa

SEQ ID NO: 2238077 - RNA, 22 nt, Homo sapiens
ugcuaucuggaggccuuccagc

SEQ ID NO: 2238078 - RNA, 14 nt, Homo sapiens
cuuuaaugaauaaa

SEQ ID NO: 2238079 - RNA, 22 nt, Homo sapiens
gaugaacaauuaugaacaucca

SEQ ID NO: 2238080 - RNA, 16 nt, Homo sapiens
cagcuguugcagugag

SEQ ID NO: 2238081 - RNA, 16 nt, Homo sapiens
ugaggcucagauuaaa

SEQ ID NO: 2238082 - RNA, 23 nt, Homo sapiens
gcaucccugcuucuggcgcccca

SEQ ID NO: 2238083 - RNA, 17 nt, Homo sapiens
gcccaaagaaagagcua

SEQ ID NO: 2238084 - RNA, 22 nt, Homo sapiens
ucuauaagugugaccaguuuug

SEQ ID NO: 2238085 - RNA, 18 nt, Homo sapiens
cagcauugugaucaaaga

SEQ ID NO: 2238086 - RNA, 21 nt, Homo sapiens
agugaccaggcucacaacugu

SEQ ID NO: 2238087 - RNA, 17 nt, Homo sapiens
agcccccaaaacagccu

SEQ ID NO: 2238088 - RNA, 16 nt, Homo sapiens
caucacagcagccucc

SEQ ID NO: 2238089 - RNA, 13 nt, Homo sapiens
caacaaugcuuug

SEQ ID NO: 2238090 - RNA, 13 nt, Homo sapiens
cugggcuagggga

SEQ ID NO: 2238091 - RNA, 19 nt, Homo sapiens
uggccuuauaucauuucau

SEQ ID NO: 2238092 - RNA, 13 nt, Homo sapiens
aucuaugucauau

SEQ ID NO: 2238093 - RNA, 13 nt, Homo sapiens
uauugcaagcauu

SEQ ID NO: 2238094 - RNA, 11 nt, Homo sapiens
uguugcaugga

SEQ ID NO: 2238095 - RNA, 22 nt, Homo sapiens
gauccagaaagaaaacuuguau

SEQ ID NO: 2238096 - RNA, 22 nt, Homo sapiens
uucuggucaaccccacaagcac

SEQ ID NO: 2238097 - RNA, 16 nt, Homo sapiens
agguaugccaccaaca

SEQ ID NO: 2238098 - RNA, 20 nt, Homo sapiens
uguuacaaaaagacaaaaau

SEQ ID NO: 2238099 - RNA, 20 nt, Homo sapiens
accauguggauuuggucaca

SEQ ID NO: 2238100 - RNA, 13 nt, Homo sapiens
uuuuagcuguaga

SEQ ID NO: 2238101 - RNA, 15 nt, Homo sapiens
ccccccagugugcaa

SEQ ID NO: 2238102 - RNA, 12 nt, Homo sapiens
acgauggucucc

SEQ ID NO: 2238103 - RNA, 16 nt, Homo sapiens
cagugaagacuugauu

SEQ ID NO: 2238104 - RNA, 21 nt, Homo sapiens
aacacuaccaauuucccauuu

SEQ ID NO: 2238105 - RNA, 16 nt, Homo sapiens
acuuugggaucaaaua

SEQ ID NO: 2238106 - RNA, 22 nt, Homo sapiens
cuucauacagggaugguguuca

SEQ ID NO: 2238107 - RNA, 16 nt, Homo sapiens
auaaguauuuauugca

SEQ ID NO: 2238108 - RNA, 15 nt, Homo sapiens
cagcugcauggcaca

SEQ ID NO: 2238109 - RNA, 19 nt, Homo sapiens
cacugucuugccagauuac

SEQ ID NO: 2238110 - RNA, 19 nt, Homo sapiens
ucaccuuaggaauaaucuc

SEQ ID NO: 2238111 - RNA, 17 nt, Homo sapiens
uuaggaguaacuuucaa

SEQ ID NO: 2238112 - RNA, 22 nt, Homo sapiens
gcccagagaagcaaguggcuuu

SEQ ID NO: 2238113 - RNA, 19 nt, Homo sapiens
cucuucagaaaacccuuuu

SEQ ID NO: 2238114 - RNA, 15 nt, Homo sapiens
cccugggccaacaga

SEQ ID NO: 2238115 - RNA, 14 nt, Homo sapiens
ccaggggaggugua

SEQ ID NO: 2238116 - RNA, 17 nt, Homo sapiens
cauagugguauuuuaac

SEQ ID NO: 2238117 - RNA, 23 nt, Homo sapiens
auuccacacccucacugcuguag

SEQ ID NO: 2238118 - RNA, 16 nt, Homo sapiens
uggacggacaagacag

SEQ ID NO: 2238119 - RNA, 16 nt, Homo sapiens
ccauggucuucagcag

SEQ ID NO: 2238120 - RNA, 23 nt, Homo sapiens
cacauuaacucccuccaccagcc

SEQ ID NO: 2238121 - RNA, 22 nt, Homo sapiens
aaagucaccauucugcauuuag

SEQ ID NO: 2238122 - RNA, 21 nt, Homo sapiens
uucacugaguuuuguuucacu

SEQ ID NO: 2238123 - RNA, 20 nt, Homo sapiens
gugagccacagggcuagaag

SEQ ID NO: 2238124 - RNA, 17 nt, Homo sapiens
aaugcuucauaugagga

SEQ ID NO: 2238125 - RNA, 23 nt, Homo sapiens
cccaguuuaggugauggccaguc

SEQ ID NO: 2238126 - RNA, 14 nt, Homo sapiens
uguauaaaauguac

SEQ ID NO: 2238127 - RNA, 20 nt, Homo sapiens
uauuucuaagcuuauuucua

SEQ ID NO: 2238128 - RNA, 21 nt, Homo sapiens
auugguuuugguuuugacuca

SEQ ID NO: 2238129 - RNA, 12 nt, Homo sapiens
ugcaagugugca

SEQ ID NO: 2238130 - RNA, 23 nt, Homo sapiens
uaggaacucuucaugagcacuuu

SEQ ID NO: 2238131 - RNA, 14 nt, Homo sapiens
caauaucuugccag

SEQ ID NO: 2238132 - RNA, 18 nt, Homo sapiens
agccaggauucaacccug

SEQ ID NO: 2238133 - RNA, 23 nt, Homo sapiens
cugaauucaguugcuuugcccaa

SEQ ID NO: 2238134 - RNA, 12 nt, Homo sapiens
uaaauacuguuu

SEQ ID NO: 2238135 - RNA, 12 nt, Homo sapiens
cagaagugcaga

SEQ ID NO: 2238136 - RNA, 12 nt, Homo sapiens
gaucgcugugaa

SEQ ID NO: 2238137 - RNA, 20 nt, Homo sapiens
uaugauaaauauaacaucua

SEQ ID NO: 2238138 - RNA, 11 nt, Homo sapiens
auuucaccucu

SEQ ID NO: 2238139 - RNA, 14 nt, Homo sapiens
agugugagacccca

SEQ ID NO: 2238140 - RNA, 17 nt, Homo sapiens
guucccuuugccuuaaa

SEQ ID NO: 2238141 - RNA, 22 nt, Homo sapiens
gcaggagcauguaugucugcag

SEQ ID NO: 2238142 - RNA, 12 nt, Homo sapiens
gagaauccuccc

SEQ ID NO: 2238143 - RNA, 19 nt, Homo sapiens
agaaaugaauagacuaucu

SEQ ID NO: 2238144 - RNA, 12 nt, Homo sapiens
gcccagacuuua

SEQ ID NO: 2238145 - RNA, 12 nt, Homo sapiens
uagccucucuuu

SEQ ID NO: 2238146 - RNA, 14 nt, Homo sapiens
gugaacugugcaua

SEQ ID NO: 2238147 - RNA, 13 nt, Homo sapiens
aggaacuuuguca

SEQ ID NO: 2238148 - RNA, 17 nt, Homo sapiens
ucauaauucagcacuua

SEQ ID NO: 2238149 - RNA, 18 nt, Homo sapiens
ccucaucugagaggcucu

SEQ ID NO: 2238150 - RNA, 22 nt, Homo sapiens
gugccacugcacuccaggcugg

SEQ ID NO: 2238151 - RNA, 16 nt, Homo sapiens
aggcaaauuuguauau

SEQ ID NO: 2238152 - RNA, 22 nt, Homo sapiens
accucaguuuuaucauuuucaa

SEQ ID NO: 2238153 - RNA, 15 nt, Homo sapiens
auuuugucacugucu

SEQ ID NO: 2238154 - RNA, 14 nt, Homo sapiens
uccccccauguugu

SEQ ID NO: 2238155 - RNA, 20 nt, Homo sapiens
gcaaggacaccauaguguca

SEQ ID NO: 2238156 - RNA, 19 nt, Homo sapiens
aaggauaagugaacaccca

SEQ ID NO: 2238157 - RNA, 23 nt, Homo sapiens
cuuucuaggagggagacacuggc

SEQ ID NO: 2238158 - RNA, 18 nt, Homo sapiens
uugcaccaaagacaucag

SEQ ID NO: 2238159 - RNA, 12 nt, Homo sapiens
gaccaggccuca

SEQ ID NO: 2238160 - RNA, 18 nt, Homo sapiens
acccagcagugucacucu

SEQ ID NO: 2238161 - RNA, 15 nt, Homo sapiens
augaccguguacaau

SEQ ID NO: 2238162 - RNA, 17 nt, Homo sapiens
cgaggaaaaacaaaaca

SEQ ID NO: 2238163 - RNA, 14 nt, Homo sapiens
aacaacuuggcauu

SEQ ID NO: 2238164 - RNA, 19 nt, Homo sapiens
ucauguaaaaagugcagua

SEQ ID NO: 2238165 - RNA, 20 nt, Homo sapiens
guggaacaagcagcuaagca

SEQ ID NO: 2238166 - RNA, 13 nt, Homo sapiens
ucaucaugauaag

SEQ ID NO: 2238167 - RNA, 17 nt, Homo sapiens
ucacccagaugaugucc

SEQ ID NO: 2238168 - RNA, 14 nt, Homo sapiens
ugguuuuacaguga

SEQ ID NO: 2238169 - RNA, 21 nt, Homo sapiens
uagcccagucauauguucuca

SEQ ID NO: 2238170 - RNA, 21 nt, Homo sapiens
ggaagcuuccaugaugcacag

SEQ ID NO: 2238171 - RNA, 16 nt, Homo sapiens
uccccaaccacuucau

SEQ ID NO: 2238172 - RNA, 14 nt, Homo sapiens
uuuuauguucuugg

SEQ ID NO: 2238173 - RNA, 18 nt, Homo sapiens
gcuggguccucugcagug

SEQ ID NO: 2238174 - RNA, 21 nt, Homo sapiens
ccuccaguaguggacaacagg

SEQ ID NO: 2238175 - RNA, 24 nt, Homo sapiens
uuuaaaauuaaaugcauguccuca

SEQ ID NO: 2238176 - RNA, 13 nt, Homo sapiens
aguuucagugaag

SEQ ID NO: 2238177 - RNA, 15 nt, Homo sapiens
agugcaguggcucaa

SEQ ID NO: 2238178 - RNA, 18 nt, Homo sapiens
gaccucauuuacaaagca

SEQ ID NO: 2238179 - RNA, 19 nt, Homo sapiens
cccugagcaggaaaguuua

SEQ ID NO: 2238180 - RNA, 14 nt, Homo sapiens
ugauaccauuuccu

SEQ ID NO: 2238181 - RNA, 23 nt, Homo sapiens
aaggauggagccagcucugcauu

SEQ ID NO: 2238182 - RNA, 15 nt, Homo sapiens
cagucccucaccucc

SEQ ID NO: 2238183 - RNA, 15 nt, Homo sapiens
gacauauacuaagau

SEQ ID NO: 2238184 - RNA, 20 nt, Homo sapiens
agaacaucauaacccaugaa

SEQ ID NO: 2238185 - RNA, 22 nt, Homo sapiens
gcuguccugaaccgacugaccc

SEQ ID NO: 2238186 - RNA, 18 nt, Homo sapiens
cagggcucugcaggccac

SEQ ID NO: 2238187 - RNA, 19 nt, Homo sapiens
uugaaagagucugggaccc

SEQ ID NO: 2238188 - RNA, 20 nt, Homo sapiens
uacauauuugucuauuguca

SEQ ID NO: 2238189 - RNA, 18 nt, Homo sapiens
aauguagacagauauuuc

SEQ ID NO: 2238190 - RNA, 23 nt, Homo sapiens
acaguuuccuucuggaguuccaa

SEQ ID NO: 2238191 - RNA, 21 nt, Homo sapiens
aauaaaccaagauagauccau

SEQ ID NO: 2238192 - RNA, 19 nt, Homo sapiens
aaucagcuuaaaauccaaa

SEQ ID NO: 2238193 - RNA, 23 nt, Homo sapiens
ucaaccugaauuaaagucuacac

SEQ ID NO: 2238194 - RNA, 12 nt, Homo sapiens
agcuuuucccaa

SEQ ID NO: 2238195 - RNA, 12 nt, Homo sapiens
auggauucacuu

SEQ ID NO: 2238196 - RNA, 11 nt, Homo sapiens
gggccucaguc

SEQ ID NO: 2238197 - RNA, 16 nt, Homo sapiens
gcuucucuccacugaa

SEQ ID NO: 2238198 - RNA, 22 nt, Homo sapiens
cacaaucccuggggcugugcau

SEQ ID NO: 2238199 - RNA, 18 nt, Homo sapiens
ucacauuccucugcccuu

SEQ ID NO: 2238200 - RNA, 18 nt, Homo sapiens
guccuaaauguaaucacg

SEQ ID NO: 2238201 - RNA, 11 nt, Homo sapiens
agcaagccaug

SEQ ID NO: 2238202 - RNA, 15 nt, Homo sapiens
uucuucauguacaga

SEQ ID NO: 2238203 - RNA, 12 nt, Homo sapiens
aaggcaaguccu

SEQ ID NO: 2238204 - RNA, 12 nt, Homo sapiens
uccuguaggggg

SEQ ID NO: 2238205 - RNA, 13 nt, Homo sapiens
agacuccaucuca

SEQ ID NO: 2238206 - RNA, 13 nt, Homo sapiens
cuucauccacuga

SEQ ID NO: 2238207 - RNA, 21 nt, Homo sapiens
cugccggcucuuuccuugcuc

SEQ ID NO: 2238208 - RNA, 19 nt, Homo sapiens
gucaaaaggaagucucuag

SEQ ID NO: 2238209 - RNA, 14 nt, Homo sapiens
cucacuguccuguu

SEQ ID NO: 2238210 - RNA, 14 nt, Homo sapiens
uauagauuguccuu

SEQ ID NO: 2238211 - RNA, 18 nt, Homo sapiens
caagauauaauggauaau

SEQ ID NO: 2238212 - RNA, 13 nt, Homo sapiens
caaacaccuucca

SEQ ID NO: 2238213 - RNA, 22 nt, Homo sapiens
gcugggcuucacggcugccagg

SEQ ID NO: 2238214 - RNA, 15 nt, Homo sapiens
ugccagguguggaac

SEQ ID NO: 2238215 - RNA, 17 nt, Homo sapiens
guuggcaaggagccagg

SEQ ID NO: 2238216 - RNA, 13 nt, Homo sapiens
agaaaggccugag

SEQ ID NO: 2238217 - RNA, 21 nt, Homo sapiens
agggaccccugcccuuguccc

SEQ ID NO: 2238218 - RNA, 21 nt, Homo sapiens
cauucuaccaagcugucacag

SEQ ID NO: 2238219 - RNA, 22 nt, Homo sapiens
aucuucaguauuuucuccacuu

SEQ ID NO: 2238220 - RNA, 23 nt, Homo sapiens
cuuggauuuggacugauucucca

SEQ ID NO: 2238221 - RNA, 15 nt, Homo sapiens
agaagguugccaggu

SEQ ID NO: 2238222 - RNA, 23 nt, Homo sapiens
ggcaccacucuccuuucacagag

SEQ ID NO: 2238223 - RNA, 15 nt, Homo sapiens
aagaggcugcugcag

SEQ ID NO: 2238224 - RNA, 21 nt, Homo sapiens
gaauuucccaaagcagugcau

SEQ ID NO: 2238225 - RNA, 20 nt, Homo sapiens
uaaauuauuaguuuacauca

SEQ ID NO: 2238226 - RNA, 21 nt, Homo sapiens
uuggucucuauugauauuuca

SEQ ID NO: 2238227 - RNA, 11 nt, Homo sapiens
gguugaagguc

SEQ ID NO: 2238228 - RNA, 15 nt, Homo sapiens
uuucaaaugugcugu

SEQ ID NO: 2238229 - RNA, 20 nt, Homo sapiens
auaaccccagcucccuagga

SEQ ID NO: 2238230 - RNA, 23 nt, Homo sapiens
gcugggaaaaaaguuuugaugaa

SEQ ID NO: 2238231 - RNA, 23 nt, Homo sapiens
ucccugaagaucuagugaacauu

SEQ ID NO: 2238232 - RNA, 21 nt, Homo sapiens
uaucuuaaugcagacaaacaa

SEQ ID NO: 2238233 - RNA, 16 nt, Homo sapiens
uccacauaaaugcucc

SEQ ID NO: 2238234 - RNA, 20 nt, Homo sapiens
agacaguaugucuacuccuc

SEQ ID NO: 2238235 - RNA, 21 nt, Homo sapiens
gcugauggaccaggaagcccu

SEQ ID NO: 2238236 - RNA, 18 nt, Homo sapiens
accggcuggcagggcugg

SEQ ID NO: 2238237 - RNA, 18 nt, Homo sapiens
ucagauaaacaacaaaua

SEQ ID NO: 2238238 - RNA, 20 nt, Homo sapiens
agguucucagcaaguguaca

SEQ ID NO: 2238239 - RNA, 19 nt, Homo sapiens
uuacuaugacugcucccca

SEQ ID NO: 2238240 - RNA, 15 nt, Homo sapiens
aaauuuggccuuaag

SEQ ID NO: 2238241 - RNA, 13 nt, Homo sapiens
acaaauaugcaga

SEQ ID NO: 2238242 - RNA, 14 nt, Homo sapiens
uaaacacuauguaa

SEQ ID NO: 2238243 - RNA, 19 nt, Homo sapiens
gggccuuucccucuucccu

SEQ ID NO: 2238244 - RNA, 22 nt, Homo sapiens
acaugaagaagaccuuuacagu

SEQ ID NO: 2238245 - RNA, 19 nt, Homo sapiens
uaucuuggccuuacuguau

SEQ ID NO: 2238246 - RNA, 22 nt, Homo sapiens
ggaaggaaaucccaucagugaa

SEQ ID NO: 2238247 - RNA, 12 nt, Homo sapiens
augaaggaaaug

SEQ ID NO: 2238248 - RNA, 17 nt, Homo sapiens
uucuguucuuacaaaug

SEQ ID NO: 2238249 - RNA, 23 nt, Homo sapiens
ccagaaggagggcagagccaugg

SEQ ID NO: 2238250 - RNA, 23 nt, Homo sapiens
gacauacauucccucuaauuuga

SEQ ID NO: 2238251 - RNA, 20 nt, Homo sapiens
ggaacccugcuugcacuuug

SEQ ID NO: 2238252 - RNA, 17 nt, Homo sapiens
ccucacacccaccugcu

SEQ ID NO: 2238253 - RNA, 19 nt, Homo sapiens
augaaaggcagggcaagaa

SEQ ID NO: 2238254 - RNA, 23 nt, Homo sapiens
uuugaagaauauuuguaguuauc

SEQ ID NO: 2238255 - RNA, 14 nt, Homo sapiens
cucaaggauccaga

SEQ ID NO: 2238256 - RNA, 22 nt, Homo sapiens
cgaacaaccuuuucucuggaca

SEQ ID NO: 2238257 - RNA, 15 nt, Homo sapiens
cuucugucagcagua

SEQ ID NO: 2238258 - RNA, 22 nt, Homo sapiens
cuuuaaucauggagcaagagaa

SEQ ID NO: 2238259 - RNA, 19 nt, Homo sapiens
ccugggcaucagaccuuaa

SEQ ID NO: 2238260 - RNA, 19 nt, Homo sapiens
aaugcugcacaccaguuac

SEQ ID NO: 2238261 - RNA, 13 nt, Homo sapiens
agcuccucacuca

SEQ ID NO: 2238262 - RNA, 17 nt, Homo sapiens
ucauuauuggaauuaac

SEQ ID NO: 2238263 - RNA, 17 nt, Homo sapiens
ccuucaugcuuacuauu

SEQ ID NO: 2238264 - RNA, 22 nt, Homo sapiens
ccagaggggccugccaccugga

SEQ ID NO: 2238265 - RNA, 22 nt, Homo sapiens
uacagcuugugaggaagugagc

SEQ ID NO: 2238266 - RNA, 21 nt, Homo sapiens
ugaauaacauuuaaauuccac

SEQ ID NO: 2238267 - RNA, 21 nt, Homo sapiens
ccaggaaucucaaacucccuu

SEQ ID NO: 2238268 - RNA, 19 nt, Homo sapiens
ucuucagaggcucaucuaa

SEQ ID NO: 2238269 - RNA, 20 nt, Homo sapiens
acugugucaggaaacauauu

SEQ ID NO: 2238270 - RNA, 14 nt, Homo sapiens
agggcccugcccug

SEQ ID NO: 2238271 - RNA, 20 nt, Homo sapiens
ucaugauuucuuuguagcau

SEQ ID NO: 2238272 - RNA, 17 nt, Homo sapiens
aucccugcucacugcag

SEQ ID NO: 2238273 - RNA, 14 nt, Homo sapiens
ccaggacucaguga

SEQ ID NO: 2238274 - RNA, 18 nt, Homo sapiens
cagggccugcuauugcag

SEQ ID NO: 2238275 - RNA, 16 nt, Homo sapiens
gacagcugugcucuca

SEQ ID NO: 2238276 - RNA, 12 nt, Homo sapiens
uuccaugguggu

SEQ ID NO: 2238277 - RNA, 14 nt, Homo sapiens
gaguuucugcaguu

SEQ ID NO: 2238278 - RNA, 20 nt, Homo sapiens
caucuucuaggccaagcauu

SEQ ID NO: 2238279 - RNA, 19 nt, Homo sapiens
agccaggcuugguggcaca

SEQ ID NO: 2238280 - RNA, 22 nt, Homo sapiens
uaauuaugggaacaaguguaca

SEQ ID NO: 2238281 - RNA, 13 nt, Homo sapiens
uggcaccucucaa

SEQ ID NO: 2238282 - RNA, 16 nt, Homo sapiens
cuucuaggaauggagg

SEQ ID NO: 2238283 - RNA, 17 nt, Homo sapiens
acugaaaacaagccaug

SEQ ID NO: 2238284 - RNA, 18 nt, Homo sapiens
agaagauagaugcacuua

SEQ ID NO: 2238285 - RNA, 15 nt, Homo sapiens
aaagaggcuauguga

SEQ ID NO: 2238286 - RNA, 16 nt, Homo sapiens
ggcauaggccugggug

SEQ ID NO: 2238287 - RNA, 21 nt, Homo sapiens
acagccuccaaaaauggcagu

SEQ ID NO: 2238288 - RNA, 17 nt, Homo sapiens
uagucgucuaaacauaa

SEQ ID NO: 2238289 - RNA, 16 nt, Homo sapiens
ucauguaaauacuguu

SEQ ID NO: 2238290 - RNA, 18 nt, Homo sapiens
gaaaacacccaauaccuu

SEQ ID NO: 2238291 - RNA, 23 nt, Homo sapiens
uuuucuauuucacuggagcacaa

SEQ ID NO: 2238292 - RNA, 17 nt, Homo sapiens
acauggugaaacccugu

SEQ ID NO: 2238293 - RNA, 12 nt, Homo sapiens
uaacaauguuua

SEQ ID NO: 2238294 - RNA, 16 nt, Homo sapiens
ugucacugcuguaaag

SEQ ID NO: 2238295 - RNA, 16 nt, Homo sapiens
ucuggugaucacuuua

SEQ ID NO: 2238296 - RNA, 14 nt, Homo sapiens
aauauguguaucuc

SEQ ID NO: 2238297 - RNA, 22 nt, Homo sapiens
aauaauuacccacaaaugccac

SEQ ID NO: 2238298 - RNA, 18 nt, Homo sapiens
ggccagucaggcugcaga

SEQ ID NO: 2238299 - RNA, 13 nt, Homo sapiens
guuaauaaucuca

SEQ ID NO: 2238300 - RNA, 14 nt, Homo sapiens
ggcacccaucugca

SEQ ID NO: 2238301 - RNA, 22 nt, Homo sapiens
ccagcagacauugucagcaaau

SEQ ID NO: 2238302 - RNA, 15 nt, Homo sapiens
ucaucacaacuuguu

SEQ ID NO: 2238303 - RNA, 19 nt, Homo sapiens
gaagaacaacaaagacaug

SEQ ID NO: 2238304 - RNA, 18 nt, Homo sapiens
caaaggcccccaucacac

SEQ ID NO: 2238305 - RNA, 14 nt, Homo sapiens
cauaagaacgucau

SEQ ID NO: 2238306 - RNA, 15 nt, Homo sapiens
uaaggucaaugccag

SEQ ID NO: 2238307 - RNA, 22 nt, Homo sapiens
uuauaauguguguugugugagc

SEQ ID NO: 2238308 - RNA, 13 nt, Homo sapiens
agauguacaugug

SEQ ID NO: 2238309 - RNA, 23 nt, Homo sapiens
cauuagagcaggcguucagcuca

SEQ ID NO: 2238310 - RNA, 18 nt, Homo sapiens
gguuauucuaagcccuuu

SEQ ID NO: 2238311 - RNA, 16 nt, Homo sapiens
uacaguuagggcuccu

SEQ ID NO: 2238312 - RNA, 13 nt, Homo sapiens
cucacacuauggc

SEQ ID NO: 2238313 - RNA, 16 nt, Homo sapiens
augucuccauuguuaa

SEQ ID NO: 2238314 - RNA, 20 nt, Homo sapiens
cuuuguuuccauucuugucc

SEQ ID NO: 2238315 - RNA, 16 nt, Homo sapiens
uagaauaccucccuca

SEQ ID NO: 2238316 - RNA, 15 nt, Homo sapiens
cggccggccuggggc

SEQ ID NO: 2238317 - RNA, 17 nt, Homo sapiens
ugaacauccuuccuucc

SEQ ID NO: 2238318 - RNA, 16 nt, Homo sapiens
ggaagagcagugcugu

SEQ ID NO: 2238319 - RNA, 18 nt, Homo sapiens
cugaggcagcgaccucaa

SEQ ID NO: 2238320 - RNA, 17 nt, Homo sapiens
aaauuuuuuacaagagu

SEQ ID NO: 2238321 - RNA, 14 nt, Homo sapiens
agaaacuaaacuaa

SEQ ID NO: 2238322 - RNA, 19 nt, Homo sapiens
gccagaguuggauaagcca

SEQ ID NO: 2238323 - RNA, 18 nt, Homo sapiens
cucccaccagagacuggg

SEQ ID NO: 2238324 - RNA, 12 nt, Homo sapiens
cucucuucucaa

SEQ ID NO: 2238325 - RNA, 10 nt, Homo sapiens
caucugaguu

SEQ ID NO: 2238326 - RNA, 19 nt, Homo sapiens
agagaucugguuuugcuau

SEQ ID NO: 2238327 - RNA, 17 nt, Homo sapiens
uauuuguuugcaauuuu

SEQ ID NO: 2238328 - RNA, 20 nt, Homo sapiens
gccauauuuguaaaaugaca

SEQ ID NO: 2238329 - RNA, 13 nt, Homo sapiens
ucugaccauuuca

SEQ ID NO: 2238330 - RNA, 20 nt, Homo sapiens
acccuacuucuuuugcucuu

SEQ ID NO: 2238331 - RNA, 21 nt, Homo sapiens
gaaacaaaaucaaaacagaga

SEQ ID NO: 2238332 - RNA, 20 nt, Homo sapiens
caaaaucaugccauugcacu

SEQ ID NO: 2238333 - RNA, 15 nt, Homo sapiens
acacacgaugcauuu

SEQ ID NO: 2238334 - RNA, 16 nt, Homo sapiens
uauuucuuacccuguc

SEQ ID NO: 2238335 - RNA, 13 nt, Homo sapiens
uaauguacaauuu

SEQ ID NO: 2238336 - RNA, 15 nt, Homo sapiens
uaacaauugugaagu

SEQ ID NO: 2238337 - RNA, 13 nt, Homo sapiens
agaccagaaccag

SEQ ID NO: 2238338 - RNA, 20 nt, Homo sapiens
gcacuugcagauacauucau

SEQ ID NO: 2238339 - RNA, 14 nt, Homo sapiens
uguaaaaaaaccac

SEQ ID NO: 2238340 - RNA, 21 nt, Homo sapiens
acaguaauaagaauggaaaag

SEQ ID NO: 2238341 - RNA, 23 nt, Homo sapiens
ucuugaauguaguauucaaugau

SEQ ID NO: 2238342 - RNA, 17 nt, Homo sapiens
ccuggcucugcaauggg

SEQ ID NO: 2238343 - RNA, 16 nt, Homo sapiens
uuacgcaaugcuucua

SEQ ID NO: 2238344 - RNA, 21 nt, Homo sapiens
aaucugcagugaugcaauaac

SEQ ID NO: 2238345 - RNA, 16 nt, Homo sapiens
guucaaggaccaacaa

SEQ ID NO: 2238346 - RNA, 22 nt, Homo sapiens
cacacuccccugcacuggaguc

SEQ ID NO: 2238347 - RNA, 17 nt, Homo sapiens
cagcccacauccauucc

SEQ ID NO: 2238348 - RNA, 23 nt, Homo sapiens
aucauugagaaauaaagcacauu

SEQ ID NO: 2238349 - RNA, 17 nt, Homo sapiens
cucuuuuagcugaugaa

SEQ ID NO: 2238350 - RNA, 11 nt, Homo sapiens
uuuacauauag

SEQ ID NO: 2238351 - RNA, 16 nt, Homo sapiens
aaguuugucacuaaac

SEQ ID NO: 2238352 - RNA, 11 nt, Homo sapiens
acacacuguuu

SEQ ID NO: 2238353 - RNA, 11 nt, Homo sapiens
uuucacugaca

SEQ ID NO: 2238354 - RNA, 13 nt, Homo sapiens
acuuaaacccagc

SEQ ID NO: 2238355 - RNA, 13 nt, Homo sapiens
ccuuuuucauaau

SEQ ID NO: 2238356 - RNA, 14 nt, Homo sapiens
aggaacccuggaga

SEQ ID NO: 2238357 - RNA, 17 nt, Homo sapiens
acuuaacugugugaaga

SEQ ID NO: 2238358 - RNA, 21 nt, Homo sapiens
gagcugguguggccaagcaca

SEQ ID NO: 2238359 - RNA, 19 nt, Homo sapiens
caggauucaggaguuuuaa

SEQ ID NO: 2238360 - RNA, 20 nt, Homo sapiens
aaaagggagaacauggccaa

SEQ ID NO: 2238361 - RNA, 19 nt, Homo sapiens
gccauaucuucaggccaug

SEQ ID NO: 2238362 - RNA, 13 nt, Homo sapiens
gcuaaaugcaauu

SEQ ID NO: 2238363 - RNA, 18 nt, Homo sapiens
gaucccacuucacuguga

SEQ ID NO: 2238364 - RNA, 21 nt, Homo sapiens
uggaucagggaauccagcucc

SEQ ID NO: 2238365 - RNA, 19 nt, Homo sapiens
cgcccacccgccuugugag

SEQ ID NO: 2238366 - RNA, 19 nt, Homo sapiens
aggcugggcuggccagcca

SEQ ID NO: 2238367 - RNA, 15 nt, Homo sapiens
uaagguaugugcuau

SEQ ID NO: 2238368 - RNA, 11 nt, Homo sapiens
cugagaaggaa

SEQ ID NO: 2238369 - RNA, 20 nt, Homo sapiens
guguacagugaaaagucucc

SEQ ID NO: 2238370 - RNA, 17 nt, Homo sapiens
aacuguauauauuccca

SEQ ID NO: 2238371 - RNA, 14 nt, Homo sapiens
cuacacacauaccu

SEQ ID NO: 2238372 - RNA, 17 nt, Homo sapiens
auuguauacuaccauag

SEQ ID NO: 2238373 - RNA, 22 nt, Homo sapiens
gaaauagcuucaggauacugua

SEQ ID NO: 2238374 - RNA, 16 nt, Homo sapiens
agaaaguaauacaaua

SEQ ID NO: 2238375 - RNA, 14 nt, Homo sapiens
aaguucuugacaga

SEQ ID NO: 2238376 - RNA, 13 nt, Homo sapiens
cagucuuggaaua

SEQ ID NO: 2238377 - RNA, 21 nt, Homo sapiens
aaagaauucuuuuuacaucua

SEQ ID NO: 2238378 - RNA, 17 nt, Homo sapiens
acaggccacacgcugcc

SEQ ID NO: 2238379 - RNA, 20 nt, Homo sapiens
cuuuaauaaaggccacagga

SEQ ID NO: 2238380 - RNA, 17 nt, Homo sapiens
gacauuccucuaggacu

SEQ ID NO: 2238381 - RNA, 16 nt, Homo sapiens
agaauauaauacugua

SEQ ID NO: 2238382 - RNA, 14 nt, Homo sapiens
ugccucucuugccc

SEQ ID NO: 2238383 - RNA, 19 nt, Homo sapiens
gaaaaaugaggaauccaaa

SEQ ID NO: 2238384 - RNA, 16 nt, Homo sapiens
auuauauuagucuguu

SEQ ID NO: 2238385 - RNA, 14 nt, Homo sapiens
acacacaugcauac

SEQ ID NO: 2238386 - RNA, 18 nt, Homo sapiens
augcccacguaugugaaa

SEQ ID NO: 2238387 - RNA, 15 nt, Homo sapiens
agcaccggccucggg

SEQ ID NO: 2238388 - RNA, 16 nt, Homo sapiens
cagagaaagaaguccu

SEQ ID NO: 2238389 - RNA, 22 nt, Homo sapiens
aacguaugugguuaucugugaa

SEQ ID NO: 2238390 - RNA, 16 nt, Homo sapiens
ucuacacauacagaaa

SEQ ID NO: 2238391 - RNA, 16 nt, Homo sapiens
auaaaagugcuuugca

SEQ ID NO: 2238392 - RNA, 13 nt, Homo sapiens
cuuucacaguccu

SEQ ID NO: 2238393 - RNA, 16 nt, Homo sapiens
ugaaagcuaugaaugu

SEQ ID NO: 2238394 - RNA, 15 nt, Homo sapiens
auuuggaaugaagga

SEQ ID NO: 2238395 - RNA, 16 nt, Homo sapiens
uagagcaaagacuuaa

SEQ ID NO: 2238396 - RNA, 23 nt, Homo sapiens
uccuucccucggggccauacuuc

SEQ ID NO: 2238397 - RNA, 19 nt, Homo sapiens
cucccucagccccuucuca

SEQ ID NO: 2238398 - RNA, 15 nt, Homo sapiens
ccuaggcuagggugg

SEQ ID NO: 2238399 - RNA, 13 nt, Homo sapiens
ugagagucacuug

SEQ ID NO: 2238400 - RNA, 19 nt, Homo sapiens
uuaaguggguuuuuaugaa

SEQ ID NO: 2238401 - RNA, 21 nt, Homo sapiens
aagacucauucccuagaucuu

SEQ ID NO: 2238402 - RNA, 14 nt, Homo sapiens
ucuuucugugcuuc

SEQ ID NO: 2238403 - RNA, 22 nt, Homo sapiens
uggcuaggaaagggaagccuga

SEQ ID NO: 2238404 - RNA, 20 nt, Homo sapiens
auauuccuuuuucuaugaaa

SEQ ID NO: 2238405 - RNA, 14 nt, Homo sapiens
augagaagccaaag

SEQ ID NO: 2238406 - RNA, 17 nt, Homo sapiens
guaaucuaguugucaau

SEQ ID NO: 2238407 - RNA, 22 nt, Homo sapiens
cuguaaaaugcaccaaucagca

SEQ ID NO: 2238408 - RNA, 15 nt, Homo sapiens
gugaaugguugcaaa

SEQ ID NO: 2238409 - RNA, 17 nt, Homo sapiens
auuaacaaaugugcugc

SEQ ID NO: 2238410 - RNA, 15 nt, Homo sapiens
cgaccccaucccuau

SEQ ID NO: 2238411 - RNA, 12 nt, Homo sapiens
guuucuugacuc

SEQ ID NO: 2238412 - RNA, 13 nt, Homo sapiens
gaauagcuuguac

SEQ ID NO: 2238413 - RNA, 18 nt, Homo sapiens
aggggcaacuguaugaaa

SEQ ID NO: 2238414 - RNA, 22 nt, Homo sapiens
caaacaguaaaggccaugugaa

SEQ ID NO: 2238415 - RNA, 13 nt, Homo sapiens
cugucuccagggc

SEQ ID NO: 2238416 - RNA, 13 nt, Homo sapiens
aggucagcaguau

SEQ ID NO: 2238417 - RNA, 15 nt, Homo sapiens
aggguggcacuggga

SEQ ID NO: 2238418 - RNA, 23 nt, Homo sapiens
agauuguuccugcuuuuccccaa

SEQ ID NO: 2238419 - RNA, 16 nt, Homo sapiens
aauauaaaaguaaaua

SEQ ID NO: 2238420 - RNA, 22 nt, Homo sapiens
cuagauguguagggcugagggc

SEQ ID NO: 2238421 - RNA, 15 nt, Homo sapiens
auaaauagauuuagu

SEQ ID NO: 2238422 - RNA, 15 nt, Homo sapiens
uauguaaaugacucu

SEQ ID NO: 2238423 - RNA, 16 nt, Homo sapiens
augccagcuguacuga

SEQ ID NO: 2238424 - RNA, 16 nt, Homo sapiens
agggccaggacugagc

SEQ ID NO: 2238425 - RNA, 21 nt, Homo sapiens
cccuugagaaggugcuuugua

SEQ ID NO: 2238426 - RNA, 17 nt, Homo sapiens
guauuagccaagcuggu

SEQ ID NO: 2238427 - RNA, 19 nt, Homo sapiens
accuaaaucgcaucaugcc

SEQ ID NO: 2238428 - RNA, 15 nt, Homo sapiens
acagcuauuucccuu

SEQ ID NO: 2238429 - RNA, 22 nt, Homo sapiens
cuuuuucuugaauauuugccac

SEQ ID NO: 2238430 - RNA, 14 nt, Homo sapiens
guggcuuugcauag

SEQ ID NO: 2238431 - RNA, 18 nt, Homo sapiens
uacaaaacuuccaggcua

SEQ ID NO: 2238432 - RNA, 14 nt, Homo sapiens
ggacccucccagga

SEQ ID NO: 2238433 - RNA, 15 nt, Homo sapiens
guuccagcaccacac

SEQ ID NO: 2238434 - RNA, 13 nt, Homo sapiens
gaaauugcuauuu

SEQ ID NO: 2238435 - RNA, 23 nt, Homo sapiens
acaaucaacucuaauagugcuua

SEQ ID NO: 2238436 - RNA, 21 nt, Homo sapiens
agaccacgcccguccugccug

SEQ ID NO: 2238437 - RNA, 16 nt, Homo sapiens
aaagaaaguacagaac

SEQ ID NO: 2238438 - RNA, 22 nt, Homo sapiens
aaggugcuuuguaauauucucc

SEQ ID NO: 2238439 - RNA, 18 nt, Homo sapiens
cacgaauuccaucuugua

SEQ ID NO: 2238440 - RNA, 17 nt, Homo sapiens
ugugagguauacauauu

SEQ ID NO: 2238441 - RNA, 18 nt, Homo sapiens
aauauuuaggcaagagaa

SEQ ID NO: 2238442 - RNA, 17 nt, Homo sapiens
acagcauggugcaugcc

SEQ ID NO: 2238443 - RNA, 15 nt, Homo sapiens
cagacaaccaaaaca

SEQ ID NO: 2238444 - RNA, 14 nt, Homo sapiens
aaucucuugcacuc

SEQ ID NO: 2238445 - RNA, 18 nt, Homo sapiens
cauauuuuuguagcacug

SEQ ID NO: 2238446 - RNA, 20 nt, Homo sapiens
agacaaauuagccauuucac

SEQ ID NO: 2238447 - RNA, 23 nt, Homo sapiens
uucccugcauaugcuucugaugg

SEQ ID NO: 2238448 - RNA, 18 nt, Homo sapiens
cuaagccuuugccgugag

SEQ ID NO: 2238449 - RNA, 21 nt, Homo sapiens
gagggagaacccaaagagaca

SEQ ID NO: 2238450 - RNA, 13 nt, Homo sapiens
cagccaucccagc

SEQ ID NO: 2238451 - RNA, 17 nt, Homo sapiens
ugagccccauacagggc

SEQ ID NO: 2238452 - RNA, 18 nt, Homo sapiens
aguuucagaaauucucaa

SEQ ID NO: 2238453 - RNA, 19 nt, Homo sapiens
cuuugguccucugauuuca

SEQ ID NO: 2238454 - RNA, 21 nt, Homo sapiens
acucaggaggcugaggcagga

SEQ ID NO: 2238455 - RNA, 22 nt, Homo sapiens
cgcucugaauuggauccagggg

SEQ ID NO: 2238456 - RNA, 15 nt, Homo sapiens
uguagcaucugcauu

SEQ ID NO: 2238457 - RNA, 15 nt, Homo sapiens
gagcugcagguuccu

SEQ ID NO: 2238458 - RNA, 19 nt, Homo sapiens
aaugucacaaccucucuga

SEQ ID NO: 2238459 - RNA, 16 nt, Homo sapiens
uguccucucugugucc

SEQ ID NO: 2238460 - RNA, 20 nt, Homo sapiens
acccacucaugacugcauga

SEQ ID NO: 2238461 - RNA, 15 nt, Homo sapiens
uggacagccagugac

SEQ ID NO: 2238462 - RNA, 13 nt, Homo sapiens
aaucccagcacuu

SEQ ID NO: 2238463 - RNA, 20 nt, Homo sapiens
ccugguggaggcuucuugcc

SEQ ID NO: 2238464 - RNA, 19 nt, Homo sapiens
cuuugugcagauucuuuac

SEQ ID NO: 2238465 - RNA, 22 nt, Homo sapiens
ugagggcaguucugaguguuua

SEQ ID NO: 2238466 - RNA, 13 nt, Homo sapiens
aguuucaccacuc

SEQ ID NO: 2238467 - RNA, 14 nt, Homo sapiens
ccauggaguugcca

SEQ ID NO: 2238468 - RNA, 16 nt, Homo sapiens
aacuuuuccaaugaca

SEQ ID NO: 2238469 - RNA, 13 nt, Homo sapiens
uguacaacacugg

SEQ ID NO: 2238470 - RNA, 19 nt, Homo sapiens
agaagagaugacaaaccau

SEQ ID NO: 2238471 - RNA, 12 nt, Homo sapiens
augaucuuggca

SEQ ID NO: 2238472 - RNA, 12 nt, Homo sapiens
auguucuuggcu

SEQ ID NO: 2238473 - RNA, 12 nt, Homo sapiens
ggucacaugaug

SEQ ID NO: 2238474 - RNA, 22 nt, Homo sapiens
aaaucgaaacaacaacgagaua

SEQ ID NO: 2238475 - RNA, 12 nt, Homo sapiens
uucuacuuugaa

SEQ ID NO: 2238476 - RNA, 14 nt, Homo sapiens
guggcuucugucug

SEQ ID NO: 2238477 - RNA, 17 nt, Homo sapiens
uaucauguauggugaua

SEQ ID NO: 2238478 - RNA, 10 nt, Homo sapiens
agaaagccug

SEQ ID NO: 2238479 - RNA, 12 nt, Homo sapiens
cugauaugucag

SEQ ID NO: 2238480 - RNA, 16 nt, Homo sapiens
auucacuaaggacuua

SEQ ID NO: 2238481 - RNA, 14 nt, Homo sapiens
cacacaauguggac

SEQ ID NO: 2238482 - RNA, 20 nt, Homo sapiens
cuuaugaugaaaauuuacaa

SEQ ID NO: 2238483 - RNA, 17 nt, Homo sapiens
aagcuaugugagcucac

SEQ ID NO: 2238484 - RNA, 21 nt, Homo sapiens
ucacaguuugaaauaagcuau

SEQ ID NO: 2238485 - RNA, 11 nt, Homo sapiens
guaguuugugc

SEQ ID NO: 2238486 - RNA, 14 nt, Homo sapiens
ccacauuucucugc

SEQ ID NO: 2238487 - RNA, 15 nt, Homo sapiens
auguaaccacugcac

SEQ ID NO: 2238488 - RNA, 13 nt, Homo sapiens
agaaguuugcacu

SEQ ID NO: 2238489 - RNA, 14 nt, Homo sapiens
caccacuuaaucuu

SEQ ID NO: 2238490 - RNA, 15 nt, Homo sapiens
ugaaggugcugccac

SEQ ID NO: 2238491 - RNA, 20 nt, Homo sapiens
uaaauuacuaauuaucuuau

SEQ ID NO: 2238492 - RNA, 16 nt, Homo sapiens
uauucauuccucacaa

SEQ ID NO: 2238493 - RNA, 15 nt, Homo sapiens
ugagaugguucccaa

SEQ ID NO: 2238494 - RNA, 18 nt, Homo sapiens
caugucuuguacaugugu

SEQ ID NO: 2238495 - RNA, 21 nt, Homo sapiens
ccucucagcugaacacccucc

SEQ ID NO: 2238496 - RNA, 16 nt, Homo sapiens
ucccacguucuguuaa

SEQ ID NO: 2238497 - RNA, 19 nt, Homo sapiens
agaucugagauugaauauu

SEQ ID NO: 2238498 - RNA, 13 nt, Homo sapiens
uggauguauuugu

SEQ ID NO: 2238499 - RNA, 16 nt, Homo sapiens
aagucuuccauugcau

SEQ ID NO: 2238500 - RNA, 18 nt, Homo sapiens
cacgccugcgauggugcu

SEQ ID NO: 2238501 - RNA, 20 nt, Homo sapiens
uuuaguuuuagcagcugaaa

SEQ ID NO: 2238502 - RNA, 13 nt, Homo sapiens
ugggcuggcugcu

SEQ ID NO: 2238503 - RNA, 15 nt, Homo sapiens
cuuagccccagacuc

SEQ ID NO: 2238504 - RNA, 15 nt, Homo sapiens
cuaacucccuaggcc

SEQ ID NO: 2238505 - RNA, 21 nt, Homo sapiens
cuccauguguaagaacaaugc

SEQ ID NO: 2238506 - RNA, 20 nt, Homo sapiens
ccuaaggacaagacacugag

SEQ ID NO: 2238507 - RNA, 20 nt, Homo sapiens
gaacaucucugcuuucacuc

SEQ ID NO: 2238508 - RNA, 18 nt, Homo sapiens
aggggccauccuguccca

SEQ ID NO: 2238509 - RNA, 21 nt, Homo sapiens
cuauccaaguguuauaccaac

SEQ ID NO: 2238510 - RNA, 21 nt, Homo sapiens
gcaaacacaagaaaucaaaau

SEQ ID NO: 2238511 - RNA, 16 nt, Homo sapiens
gacuucagucuugccu

SEQ ID NO: 2238512 - RNA, 16 nt, Homo sapiens
aauuggaaacugacau

SEQ ID NO: 2238513 - RNA, 20 nt, Homo sapiens
guaaacugugcuagugcuga

SEQ ID NO: 2238514 - RNA, 15 nt, Homo sapiens
cagcgauggugcugc

SEQ ID NO: 2238515 - RNA, 19 nt, Homo sapiens
uaacccaagacaugacauu

SEQ ID NO: 2238516 - RNA, 16 nt, Homo sapiens
agugcuuugugauagu

SEQ ID NO: 2238517 - RNA, 20 nt, Homo sapiens
ccucugcugagugcugggca

SEQ ID NO: 2238518 - RNA, 15 nt, Homo sapiens
ccugaaaauugcaau

SEQ ID NO: 2238519 - RNA, 18 nt, Homo sapiens
aagcaagacguccuggaa

SEQ ID NO: 2238520 - RNA, 16 nt, Homo sapiens
cauucaauauugacau

SEQ ID NO: 2238521 - RNA, 15 nt, Homo sapiens
uuccuaaacuuucaa

SEQ ID NO: 2238522 - RNA, 13 nt, Homo sapiens
cuguugcuuacaa

SEQ ID NO: 2238523 - RNA, 13 nt, Homo sapiens
ugagguguugcua

SEQ ID NO: 2238524 - RNA, 17 nt, Homo sapiens
cugcauuugauagcaau

SEQ ID NO: 2238525 - RNA, 21 nt, Homo sapiens
aaugcuuccuccuuggaagag

SEQ ID NO: 2238526 - RNA, 17 nt, Homo sapiens
ucuugaauauuugccac

SEQ ID NO: 2238527 - RNA, 20 nt, Homo sapiens
gcaaaaugaaaaugucaaua

SEQ ID NO: 2238528 - RNA, 12 nt, Homo sapiens
caacaugcacau

SEQ ID NO: 2238529 - RNA, 23 nt, Homo sapiens
cuaaaaguuuucuaauuugcacu

SEQ ID NO: 2238530 - RNA, 14 nt, Homo sapiens
uuugugguuguaga

SEQ ID NO: 2238531 - RNA, 21 nt, Homo sapiens
acugagagugagcaaccagcu

SEQ ID NO: 2238532 - RNA, 21 nt, Homo sapiens
uggagaagucuuagacuugaa

SEQ ID NO: 2238533 - RNA, 16 nt, Homo sapiens
aucuaccaguuuauuc

SEQ ID NO: 2238534 - RNA, 20 nt, Homo sapiens
ggagcugggcagaaggccaa

SEQ ID NO: 2238535 - RNA, 15 nt, Homo sapiens
cacuguugucaaaaa

SEQ ID NO: 2238536 - RNA, 23 nt, Homo sapiens
ggggaaguuaggaacuggugucu

SEQ ID NO: 2238537 - RNA, 14 nt, Homo sapiens
caugaugaugauga

SEQ ID NO: 2238538 - RNA, 21 nt, Homo sapiens
aaucugugcuacacuggauaa

SEQ ID NO: 2238539 - RNA, 17 nt, Homo sapiens
uugaaucaaagcaguua

SEQ ID NO: 2238540 - RNA, 21 nt, Homo sapiens
gcugucccaggcaugcagcug

SEQ ID NO: 2238541 - RNA, 15 nt, Homo sapiens
gaauaauauuguguc

SEQ ID NO: 2238542 - RNA, 12 nt, Homo sapiens
aacuacugauaa

SEQ ID NO: 2238543 - RNA, 12 nt, Homo sapiens
cucuacugcaaa

SEQ ID NO: 2238544 - RNA, 16 nt, Homo sapiens
cagucacguguaaaca

SEQ ID NO: 2238545 - RNA, 12 nt, Homo sapiens
auacauguugua

SEQ ID NO: 2238546 - RNA, 22 nt, Homo sapiens
uaggacacauuuagaugcacua

SEQ ID NO: 2238547 - RNA, 15 nt, Homo sapiens
cugugggaagcuccc

SEQ ID NO: 2238548 - RNA, 17 nt, Homo sapiens
caggcacgggucccugc

SEQ ID NO: 2238549 - RNA, 22 nt, Homo sapiens
aguaaaagaucagguuauacuu

SEQ ID NO: 2238550 - RNA, 14 nt, Homo sapiens
caagaucacgccau

SEQ ID NO: 2238551 - RNA, 13 nt, Homo sapiens
ugcaaaauuucca

SEQ ID NO: 2238552 - RNA, 13 nt, Homo sapiens
aguaaaauauuca

SEQ ID NO: 2238553 - RNA, 18 nt, Homo sapiens
gcucaauaaauguguguu

SEQ ID NO: 2238554 - RNA, 18 nt, Homo sapiens
uuuguauaaauaagcacu

SEQ ID NO: 2238555 - RNA, 21 nt, Homo sapiens
aguagauucuuacaaggcccu

SEQ ID NO: 2238556 - RNA, 21 nt, Homo sapiens
agaacaaaugcuggggucaua

SEQ ID NO: 2238557 - RNA, 21 nt, Homo sapiens
gagcauuggccccugagccca

SEQ ID NO: 2238558 - RNA, 16 nt, Homo sapiens
ucuuucauacauuaua

SEQ ID NO: 2238559 - RNA, 19 nt, Homo sapiens
cuuuuuguaucacacagua

SEQ ID NO: 2238560 - RNA, 19 nt, Homo sapiens
gccagcagagcuuagcuuc

SEQ ID NO: 2238561 - RNA, 18 nt, Homo sapiens
aucugggggaguggaaua

SEQ ID NO: 2238562 - RNA, 23 nt, Homo sapiens
aagccuuauuucuagaagcacau

SEQ ID NO: 2238563 - RNA, 22 nt, Homo sapiens
ggcugcuaacaagucaccaaaa

SEQ ID NO: 2238564 - RNA, 13 nt, Homo sapiens
agggcugugcuga

SEQ ID NO: 2238565 - RNA, 13 nt, Homo sapiens
agcaucuaaugaa

SEQ ID NO: 2238566 - RNA, 12 nt, Homo sapiens
guugacugcugg

SEQ ID NO: 2238567 - RNA, 12 nt, Homo sapiens
guuuacugcugu

SEQ ID NO: 2238568 - RNA, 19 nt, Homo sapiens
uuagauaugauaccaaaga

SEQ ID NO: 2238569 - RNA, 13 nt, Homo sapiens
agaggcuggccaa

SEQ ID NO: 2238570 - RNA, 17 nt, Homo sapiens
ucucaggugcuccugaa

SEQ ID NO: 2238571 - RNA, 21 nt, Homo sapiens
uuuugaguaaagcuccuaucu

SEQ ID NO: 2238572 - RNA, 17 nt, Homo sapiens
cuaccuagggcacuuua

SEQ ID NO: 2238573 - RNA, 15 nt, Homo sapiens
gacagugaggcugca

SEQ ID NO: 2238574 - RNA, 15 nt, Homo sapiens
ccugccauggaucuc

SEQ ID NO: 2238575 - RNA, 14 nt, Homo sapiens
agaaauguacuuag

SEQ ID NO: 2238576 - RNA, 19 nt, Homo sapiens
ggggaccaggaugacaccu

SEQ ID NO: 2238577 - RNA, 14 nt, Homo sapiens
gacauguauuccca

SEQ ID NO: 2238578 - RNA, 23 nt, Homo sapiens
augugugugugucuccaugcaca

SEQ ID NO: 2238579 - RNA, 14 nt, Homo sapiens
uuucuugcuucaaa

SEQ ID NO: 2238580 - RNA, 23 nt, Homo sapiens
guccccugaaaaacugaucaaaa

SEQ ID NO: 2238581 - RNA, 14 nt, Homo sapiens
guagucuguagcuu

SEQ ID NO: 2238582 - RNA, 17 nt, Homo sapiens
auauuuguguaugugua

SEQ ID NO: 2238583 - RNA, 20 nt, Homo sapiens
caaaaacaauugcaacagaa

SEQ ID NO: 2238584 - RNA, 15 nt, Homo sapiens
uguccagaaguggcc

SEQ ID NO: 2238585 - RNA, 16 nt, Homo sapiens
uuuaggacaucuuaaa

SEQ ID NO: 2238586 - RNA, 15 nt, Homo sapiens
agcuuuuuguugccu

SEQ ID NO: 2238587 - RNA, 23 nt, Homo sapiens
auguaucuuaaaggacauaaaau

SEQ ID NO: 2238588 - RNA, 15 nt, Homo sapiens
caaaaagacauggaa

SEQ ID NO: 2238589 - RNA, 13 nt, Homo sapiens
uuguagagcacag

SEQ ID NO: 2238590 - RNA, 17 nt, Homo sapiens
uccagagguccuccgua

SEQ ID NO: 2238591 - RNA, 18 nt, Homo sapiens
aaggcccugcugcccaau

SEQ ID NO: 2238592 - RNA, 23 nt, Homo sapiens
ggucagcgacuggaugcucgcca

SEQ ID NO: 2238593 - RNA, 17 nt, Homo sapiens
cacucagaaucuccuuc

SEQ ID NO: 2238594 - RNA, 13 nt, Homo sapiens
aggaaaaaaccau

SEQ ID NO: 2238595 - RNA, 22 nt, Homo sapiens
aggacccucagccccaggagaa

SEQ ID NO: 2238596 - RNA, 16 nt, Homo sapiens
uggcacugcugugcug

SEQ ID NO: 2238597 - RNA, 16 nt, Homo sapiens
ccagcggaugcugcca

SEQ ID NO: 2238598 - RNA, 16 nt, Homo sapiens
agucacagaggagcug

SEQ ID NO: 2238599 - RNA, 19 nt, Homo sapiens
aaggaagcaagcaucuccg

SEQ ID NO: 2238600 - RNA, 15 nt, Homo sapiens
caccucuuccuugau

SEQ ID NO: 2238601 - RNA, 13 nt, Homo sapiens
gaaucaagcuaga

SEQ ID NO: 2238602 - RNA, 13 nt, Homo sapiens
cucguggucccca

SEQ ID NO: 2238603 - RNA, 19 nt, Homo sapiens
agugugacuccuuaucucu

SEQ ID NO: 2238604 - RNA, 17 nt, Homo sapiens
acuggguggcacugcug

SEQ ID NO: 2238605 - RNA, 20 nt, Homo sapiens
gccuccaagucaugggagaa

SEQ ID NO: 2238606 - RNA, 21 nt, Homo sapiens
ugaaggguuuugcuauuucca

SEQ ID NO: 2238607 - RNA, 21 nt, Homo sapiens
cuaacucccuccucacacucc

SEQ ID NO: 2238608 - RNA, 11 nt, Homo sapiens
caaacagugaa

SEQ ID NO: 2238609 - RNA, 11 nt, Homo sapiens
cauacagugau

SEQ ID NO: 2238610 - RNA, 15 nt, Homo sapiens
aacuguuuucaagga

SEQ ID NO: 2238611 - RNA, 23 nt, Homo sapiens
auuauuuacuauuacgugcuauu

SEQ ID NO: 2238612 - RNA, 18 nt, Homo sapiens
uaucaaacuacugccauu

SEQ ID NO: 2238613 - RNA, 18 nt, Homo sapiens
caacugucuauuucugcu

SEQ ID NO: 2238614 - RNA, 21 nt, Homo sapiens
auucaaagcauggacauuuag

SEQ ID NO: 2238615 - RNA, 12 nt, Homo sapiens
aagugagcagaa

SEQ ID NO: 2238616 - RNA, 14 nt, Homo sapiens
uguauguauacaca

SEQ ID NO: 2238617 - RNA, 13 nt, Homo sapiens
acaugcacacggg

SEQ ID NO: 2238618 - RNA, 13 nt, Homo sapiens
accucuauauguu

SEQ ID NO: 2238619 - RNA, 17 nt, Homo sapiens
uagccuuagaagucaca

SEQ ID NO: 2238620 - RNA, 19 nt, Homo sapiens
guguucuucauuaccucag

SEQ ID NO: 2238621 - RNA, 20 nt, Homo sapiens
agcucccaccccacucaggg

SEQ ID NO: 2238622 - RNA, 17 nt, Homo sapiens
caagcagacuccagccc

SEQ ID NO: 2238623 - RNA, 16 nt, Homo sapiens
uauuuaagcaaauacu

SEQ ID NO: 2238624 - RNA, 21 nt, Homo sapiens
caggaggaaccccuucucugg

SEQ ID NO: 2238625 - RNA, 16 nt, Homo sapiens
uaaaauuuuggauuaa

SEQ ID NO: 2238626 - RNA, 20 nt, Homo sapiens
acuaacgugugugucuuaca

SEQ ID NO: 2238627 - RNA, 13 nt, Homo sapiens
ucuugugucuacu

SEQ ID NO: 2238628 - RNA, 17 nt, Homo sapiens
auuauuuuaagcacuug

SEQ ID NO: 2238629 - RNA, 24 nt, Homo sapiens
agaaagaaauugagcgccauaagc

SEQ ID NO: 2238630 - RNA, 17 nt, Homo sapiens
cagagcagaucagucuu

SEQ ID NO: 2238631 - RNA, 13 nt, Homo sapiens
aaagaaccagaga

SEQ ID NO: 2238632 - RNA, 17 nt, Homo sapiens
uagaaaacgauuuugaa

SEQ ID NO: 2238633 - RNA, 19 nt, Homo sapiens
gccaugugaaacucaucuc

SEQ ID NO: 2238634 - RNA, 21 nt, Homo sapiens
aggaaaccaacacccaaagca

SEQ ID NO: 2238635 - RNA, 21 nt, Homo sapiens
auguguguguacaacacuggu

SEQ ID NO: 2238636 - RNA, 20 nt, Homo sapiens
guuuuccucccuucugcuac

SEQ ID NO: 2238637 - RNA, 16 nt, Homo sapiens
uagcgcuggcucagga

SEQ ID NO: 2238638 - RNA, 19 nt, Homo sapiens
gacuguuccaaagccagug

SEQ ID NO: 2238639 - RNA, 16 nt, Homo sapiens
uccuugcucagugcaa

SEQ ID NO: 2238640 - RNA, 18 nt, Homo sapiens
augacaaaagauacaaaa

SEQ ID NO: 2238641 - RNA, 22 nt, Homo sapiens
caugaauucacaaacaaauggc

SEQ ID NO: 2238642 - RNA, 16 nt, Homo sapiens
uuucacauaucuagua

SEQ ID NO: 2238643 - RNA, 16 nt, Homo sapiens
ccaaagaacaggugua

SEQ ID NO: 2238644 - RNA, 15 nt, Homo sapiens
ucaggauaacagaga

SEQ ID NO: 2238645 - RNA, 11 nt, Homo sapiens
ggaacauuucu

SEQ ID NO: 2238646 - RNA, 18 nt, Homo sapiens
cugcuccccuaaagccag

SEQ ID NO: 2238647 - RNA, 12 nt, Homo sapiens
accucuuuccaa

SEQ ID NO: 2238648 - RNA, 17 nt, Homo sapiens
aaccauccagugacaaa

SEQ ID NO: 2238649 - RNA, 13 nt, Homo sapiens
gguuaucuuguua

SEQ ID NO: 2238650 - RNA, 16 nt, Homo sapiens
gagccucgguggccau

SEQ ID NO: 2238651 - RNA, 19 nt, Homo sapiens
gaggcacaacgcaccagac

SEQ ID NO: 2238652 - RNA, 22 nt, Homo sapiens
caaagcuucccacggccuuucu

SEQ ID NO: 2238653 - RNA, 14 nt, Homo sapiens
cugugugcuacuaa

SEQ ID NO: 2238654 - RNA, 13 nt, Homo sapiens
gcaagagacuuug

SEQ ID NO: 2238655 - RNA, 23 nt, Homo sapiens
uguuuuaauuccaauaugaugac

SEQ ID NO: 2238656 - RNA, 18 nt, Homo sapiens
aaccauucuacuguguca

SEQ ID NO: 2238657 - RNA, 14 nt, Homo sapiens
gcuggucucuaggc

SEQ ID NO: 2238658 - RNA, 16 nt, Homo sapiens
auguguuuuuuuacau

SEQ ID NO: 2238659 - RNA, 18 nt, Homo sapiens
uaaauaucacaucacuua

SEQ ID NO: 2238660 - RNA, 21 nt, Homo sapiens
ucagaaggaauaagcauuccu

SEQ ID NO: 2238661 - RNA, 16 nt, Homo sapiens
gauucagaaccaagac

SEQ ID NO: 2238662 - RNA, 13 nt, Homo sapiens
gaacgacauguua

SEQ ID NO: 2238663 - RNA, 17 nt, Homo sapiens
ccuuccauuuucauucu

SEQ ID NO: 2238664 - RNA, 21 nt, Homo sapiens
auagaugcacuuaugcaguaa

SEQ ID NO: 2238665 - RNA, 18 nt, Homo sapiens
ccucccaaaugagccaug

SEQ ID NO: 2238666 - RNA, 16 nt, Homo sapiens
uguacuguaugugaug

SEQ ID NO: 2238667 - RNA, 14 nt, Homo sapiens
cccagagaccccuu

SEQ ID NO: 2238668 - RNA, 17 nt, Homo sapiens
ugggaggggaaauggga

SEQ ID NO: 2238669 - RNA, 15 nt, Homo sapiens
cugccugcugaccau

SEQ ID NO: 2238670 - RNA, 23 nt, Homo sapiens
cauaucugcuuaucagugugcaa

SEQ ID NO: 2238671 - RNA, 15 nt, Homo sapiens
cugcacuucuguucc

SEQ ID NO: 2238672 - RNA, 21 nt, Homo sapiens
acuuaaccacgucagaggaag

SEQ ID NO: 2238673 - RNA, 20 nt, Homo sapiens
aaagacucuuaaugcagacu

SEQ ID NO: 2238674 - RNA, 17 nt, Homo sapiens
uuugacuugccacugcc

SEQ ID NO: 2238675 - RNA, 16 nt, Homo sapiens
ggccacagucauggug

SEQ ID NO: 2238676 - RNA, 14 nt, Homo sapiens
auaaugucuauaua

SEQ ID NO: 2238677 - RNA, 15 nt, Homo sapiens
agaagaaacuuguaa

SEQ ID NO: 2238678 - RNA, 19 nt, Homo sapiens
acuguccugcuccacagug

SEQ ID NO: 2238679 - RNA, 13 nt, Homo sapiens
agaacaugcaguu

SEQ ID NO: 2238680 - RNA, 16 nt, Homo sapiens
uggcuguaaacuauaa

SEQ ID NO: 2238681 - RNA, 17 nt, Homo sapiens
cuaauuggcaugaaggu

SEQ ID NO: 2238682 - RNA, 12 nt, Homo sapiens
ccuccacucugc

SEQ ID NO: 2238683 - RNA, 19 nt, Homo sapiens
acagaccuggugcucuaau

SEQ ID NO: 2238684 - RNA, 22 nt, Homo sapiens
auguaaucucucugcagcugcc

SEQ ID NO: 2238685 - RNA, 19 nt, Homo sapiens
cuguuuuccccccaaggga

SEQ ID NO: 2238686 - RNA, 17 nt, Homo sapiens
agcuggaagucuaccug

SEQ ID NO: 2238687 - RNA, 16 nt, Homo sapiens
aaccagggccugagcc

SEQ ID NO: 2238688 - RNA, 21 nt, Homo sapiens
ugggcaaaacccacagaagac

SEQ ID NO: 2238689 - RNA, 18 nt, Homo sapiens
ggucuacauuacaaaaga

SEQ ID NO: 2238690 - RNA, 18 nt, Homo sapiens
gcacaauaguaaccuggg

SEQ ID NO: 2238691 - RNA, 16 nt, Homo sapiens
aaaugauccuuccuac

SEQ ID NO: 2238692 - RNA, 15 nt, Homo sapiens
aauaugggggccuuu

SEQ ID NO: 2238693 - RNA, 14 nt, Homo sapiens
aucagaggugaaug

SEQ ID NO: 2238694 - RNA, 20 nt, Homo sapiens
cuuuaguugauuuaaacucu

SEQ ID NO: 2238695 - RNA, 22 nt, Homo sapiens
gaggaaacuggcgaucucccag

SEQ ID NO: 2238696 - RNA, 23 nt, Homo sapiens
agcaucuaucucaucuaucucaa

SEQ ID NO: 2238697 - RNA, 21 nt, Homo sapiens
auugugugcgcugccuggcca

SEQ ID NO: 2238698 - RNA, 17 nt, Homo sapiens
aauccaucagcaaugcu

SEQ ID NO: 2238699 - RNA, 12 nt, Homo sapiens
cagggccagugc

SEQ ID NO: 2238700 - RNA, 13 nt, Homo sapiens
ccaaaaugcauuu

SEQ ID NO: 2238701 - RNA, 19 nt, Homo sapiens
gagacagugacuggugcca

SEQ ID NO: 2238702 - RNA, 19 nt, Homo sapiens
ugagauccggcaacaucaa

SEQ ID NO: 2238703 - RNA, 20 nt, Homo sapiens
cagacaaaauuugagaauac

SEQ ID NO: 2238704 - RNA, 23 nt, Homo sapiens
accauguuggccaggauggucuc

SEQ ID NO: 2238705 - RNA, 16 nt, Homo sapiens
agagauuuggggcuaa

SEQ ID NO: 2238706 - RNA, 17 nt, Homo sapiens
auucuuuuuucuauuca

SEQ ID NO: 2238707 - RNA, 18 nt, Homo sapiens
auucuccuuugcacuguu

SEQ ID NO: 2238708 - RNA, 19 nt, Homo sapiens
aaagcaaaaggcugagaag

SEQ ID NO: 2238709 - RNA, 22 nt, Homo sapiens
ucaugcagccgugaucaaggga

SEQ ID NO: 2238710 - RNA, 18 nt, Homo sapiens
acuguccaccaccaccug

SEQ ID NO: 2238711 - RNA, 20 nt, Homo sapiens
aaaauucuauguuaauuaca

SEQ ID NO: 2238712 - RNA, 17 nt, Homo sapiens
gaauguugauggugcua

SEQ ID NO: 2238713 - RNA, 15 nt, Homo sapiens
aagccuccaccugca

SEQ ID NO: 2238714 - RNA, 15 nt, Homo sapiens
agccaucauaucccc

SEQ ID NO: 2238715 - RNA, 12 nt, Homo sapiens
auuaaaagcccu

SEQ ID NO: 2238716 - RNA, 21 nt, Homo sapiens
agugccacuuaauguauguua

SEQ ID NO: 2238717 - RNA, 14 nt, Homo sapiens
ucuaaauacaggaa

SEQ ID NO: 2238718 - RNA, 16 nt, Homo sapiens
uauucuaaaaccauuc

SEQ ID NO: 2238719 - RNA, 13 nt, Homo sapiens
uugagacuaggau

SEQ ID NO: 2238720 - RNA, 21 nt, Homo sapiens
acuuggccaguuucagcucac

SEQ ID NO: 2238721 - RNA, 13 nt, Homo sapiens
aagacauucacca

SEQ ID NO: 2238722 - RNA, 13 nt, Homo sapiens
aaucuugaacuuu

SEQ ID NO: 2238723 - RNA, 16 nt, Homo sapiens
aggcauuaacacaaag

SEQ ID NO: 2238724 - RNA, 19 nt, Homo sapiens
ugagacugggcaucucuga

SEQ ID NO: 2238725 - RNA, 19 nt, Homo sapiens
cagauaacagugugcucau

SEQ ID NO: 2238726 - RNA, 20 nt, Homo sapiens
gaucuggugccuccagacau

SEQ ID NO: 2238727 - RNA, 20 nt, Homo sapiens
caauaaagugcuuuaaaaag

SEQ ID NO: 2238728 - RNA, 22 nt, Homo sapiens
aaucucccuuguccuccuucaa

SEQ ID NO: 2238729 - RNA, 17 nt, Homo sapiens
cucccuuuuuaaacaaa

SEQ ID NO: 2238730 - RNA, 22 nt, Homo sapiens
caagcaagaggugguagaacca

SEQ ID NO: 2238731 - RNA, 12 nt, Homo sapiens
aaucccaaacaa

SEQ ID NO: 2238732 - RNA, 16 nt, Homo sapiens
ccgugugguaccuuca

SEQ ID NO: 2238733 - RNA, 19 nt, Homo sapiens
cccauaacuuccaguauca

SEQ ID NO: 2238734 - RNA, 16 nt, Homo sapiens
ucuuuaucauugcuaa

SEQ ID NO: 2238735 - RNA, 20 nt, Homo sapiens
auucuguguccccucugcau

SEQ ID NO: 2238736 - RNA, 10 nt, Homo sapiens
guacuacucu

SEQ ID NO: 2238737 - RNA, 19 nt, Homo sapiens
uagaagauauuagucuugg

SEQ ID NO: 2238738 - RNA, 17 nt, Homo sapiens
acacugccuuagccucu

SEQ ID NO: 2238739 - RNA, 22 nt, Homo sapiens
uuacaaugaucaccgacugaaa

SEQ ID NO: 2238740 - RNA, 11 nt, Homo sapiens
ggacacuccaa

SEQ ID NO: 2238741 - RNA, 22 nt, Homo sapiens
ugcaucuuucucuucccaugca

SEQ ID NO: 2238742 - RNA, 13 nt, Homo sapiens
uucacaccacagg

SEQ ID NO: 2238743 - RNA, 18 nt, Homo sapiens
auggagaguuacauguua

SEQ ID NO: 2238744 - RNA, 13 nt, Homo sapiens
aaauuacagucau

SEQ ID NO: 2238745 - RNA, 16 nt, Homo sapiens
ucagcuucacccugag

SEQ ID NO: 2238746 - RNA, 16 nt, Homo sapiens
caagacucccaugagg

SEQ ID NO: 2238747 - RNA, 19 nt, Homo sapiens
agccuacacuauucuagca

SEQ ID NO: 2238748 - RNA, 16 nt, Homo sapiens
auugguguuuuaucuc

SEQ ID NO: 2238749 - RNA, 16 nt, Homo sapiens
gauauauacacaggau

SEQ ID NO: 2238750 - RNA, 18 nt, Homo sapiens
cugguggaaacucauggc

SEQ ID NO: 2238751 - RNA, 21 nt, Homo sapiens
caccucugugggcacuggugg

SEQ ID NO: 2238752 - RNA, 19 nt, Homo sapiens
guuaacugugaaauaccac

SEQ ID NO: 2238753 - RNA, 14 nt, Homo sapiens
auauauacuggaag

SEQ ID NO: 2238754 - RNA, 14 nt, Homo sapiens
gccaccaggccuca

SEQ ID NO: 2238755 - RNA, 20 nt, Homo sapiens
augucaguggaagaagcaga

SEQ ID NO: 2238756 - RNA, 17 nt, Homo sapiens
ugaagacccuaucuccc

SEQ ID NO: 2238757 - RNA, 22 nt, Homo sapiens
guuucucccccuuuccaaaaac

SEQ ID NO: 2238758 - RNA, 18 nt, Homo sapiens
acguaaugaaacuuggau

SEQ ID NO: 2238759 - RNA, 21 nt, Homo sapiens
cuuugcugccagccacuucau

SEQ ID NO: 2238760 - RNA, 20 nt, Homo sapiens
aaguaccacacauauugcac

SEQ ID NO: 2238761 - RNA, 14 nt, Homo sapiens
uuauugaaugugau

SEQ ID NO: 2238762 - RNA, 15 nt, Homo sapiens
cauccaacacuggau

SEQ ID NO: 2238763 - RNA, 10 nt, Homo sapiens
uuuacuguua

SEQ ID NO: 2238764 - RNA, 22 nt, Homo sapiens
gcagcaugcuugggcugaccca

SEQ ID NO: 2238765 - RNA, 15 nt, Homo sapiens
uauacaauacagauc

SEQ ID NO: 2238766 - RNA, 16 nt, Homo sapiens
ccuuaaaaccaaagag

SEQ ID NO: 2238767 - RNA, 18 nt, Homo sapiens
aucuacaaaaaacaacaa

SEQ ID NO: 2238768 - RNA, 18 nt, Homo sapiens
cagagaucaggaucagcu

SEQ ID NO: 2238769 - RNA, 14 nt, Homo sapiens
guuauagaagguca

SEQ ID NO: 2238770 - RNA, 17 nt, Homo sapiens
cugggcauagaugcagg

SEQ ID NO: 2238771 - RNA, 14 nt, Homo sapiens
gaaguuauuuucca

SEQ ID NO: 2238772 - RNA, 19 nt, Homo sapiens
ucaucaaauggaagacaca

SEQ ID NO: 2238773 - RNA, 16 nt, Homo sapiens
auuuaugcgaaccuau

SEQ ID NO: 2238774 - RNA, 20 nt, Homo sapiens
uggccuuccccuuuugccug

SEQ ID NO: 2238775 - RNA, 20 nt, Homo sapiens
gacuacccuaguucaaaaca

SEQ ID NO: 2238776 - RNA, 19 nt, Homo sapiens
cugagugaaugaacaaaug

SEQ ID NO: 2238777 - RNA, 21 nt, Homo sapiens
gucaauaguauuaacuauuag

SEQ ID NO: 2238778 - RNA, 21 nt, Homo sapiens
augucucuuugugcucuaaaa

SEQ ID NO: 2238779 - RNA, 17 nt, Homo sapiens
gagacugguuaggacaa

SEQ ID NO: 2238780 - RNA, 15 nt, Homo sapiens
gcauugcagucacuu

SEQ ID NO: 2238781 - RNA, 14 nt, Homo sapiens
cacacccaccugcu

SEQ ID NO: 2238782 - RNA, 22 nt, Homo sapiens
acuauguaaaugacucuacuaa

SEQ ID NO: 2238783 - RNA, 12 nt, Homo sapiens
ugagugguggag

SEQ ID NO: 2238784 - RNA, 19 nt, Homo sapiens
agggcuggcagaaagggaa

SEQ ID NO: 2238785 - RNA, 20 nt, Homo sapiens
ucagcagguuccagugccug

SEQ ID NO: 2238786 - RNA, 16 nt, Homo sapiens
agagcaaucguguaua

SEQ ID NO: 2238787 - RNA, 16 nt, Homo sapiens
gcucacacccuaauaa

SEQ ID NO: 2238788 - RNA, 14 nt, Homo sapiens
aaagcccaugcccu

SEQ ID NO: 2238789 - RNA, 12 nt, Homo sapiens
aucaugaauauu

SEQ ID NO: 2238790 - RNA, 12 nt, Homo sapiens
aauuugaauuca

SEQ ID NO: 2238791 - RNA, 21 nt, Homo sapiens
aagauuucagauuugugacca

SEQ ID NO: 2238792 - RNA, 17 nt, Homo sapiens
ggaugugucacuguugg

SEQ ID NO: 2238793 - RNA, 15 nt, Homo sapiens
gggcccccaucucau

SEQ ID NO: 2238794 - RNA, 15 nt, Homo sapiens
uuuauuuaacuauuc

SEQ ID NO: 2238795 - RNA, 12 nt, Homo sapiens
ccaaugccugug

SEQ ID NO: 2238796 - RNA, 18 nt, Homo sapiens
cacucucugccauucugu

SEQ ID NO: 2238797 - RNA, 21 nt, Homo sapiens
ggcuccucgagaucccaacac

SEQ ID NO: 2238798 - RNA, 20 nt, Homo sapiens
agacuuuuaaagacuugcac

SEQ ID NO: 2238799 - RNA, 14 nt, Homo sapiens
uguuuauucuucca

SEQ ID NO: 2238800 - RNA, 23 nt, Homo sapiens
uuguaaucauguuaccauuacaa

SEQ ID NO: 2238801 - RNA, 19 nt, Homo sapiens
aggaaucuagccagugaac

SEQ ID NO: 2238802 - RNA, 18 nt, Homo sapiens
agaccuacugcacugagu

SEQ ID NO: 2238803 - RNA, 23 nt, Homo sapiens
aguuccaguugaaguuaguggaa

SEQ ID NO: 2238804 - RNA, 22 nt, Homo sapiens
gacccccgcccccugcccuccc

SEQ ID NO: 2238805 - RNA, 16 nt, Homo sapiens
agggcuagaagcacag

SEQ ID NO: 2238806 - RNA, 22 nt, Homo sapiens
acgcaauuuuaccuaguuugca

SEQ ID NO: 2238807 - RNA, 19 nt, Homo sapiens
cugcaggguuacacaaaaa

SEQ ID NO: 2238808 - RNA, 18 nt, Homo sapiens
auuguuauuuucagugau

SEQ ID NO: 2238809 - RNA, 17 nt, Homo sapiens
gagucugugcauuugug

SEQ ID NO: 2238810 - RNA, 13 nt, Homo sapiens
uggcaggugcaga

SEQ ID NO: 2238811 - RNA, 18 nt, Homo sapiens
guaucccacauccaacuc

SEQ ID NO: 2238812 - RNA, 19 nt, Homo sapiens
guauaaguggaggcacuuu

SEQ ID NO: 2238813 - RNA, 18 nt, Homo sapiens
gcaaagugccuugcucau

SEQ ID NO: 2238814 - RNA, 16 nt, Homo sapiens
ucaaauaaacugaagg

SEQ ID NO: 2238815 - RNA, 19 nt, Homo sapiens
uaacuguucuuugcaguga

SEQ ID NO: 2238816 - RNA, 15 nt, Homo sapiens
gccugugccuaucac

SEQ ID NO: 2238817 - RNA, 15 nt, Homo sapiens
cagccccagcccagc

SEQ ID NO: 2238818 - RNA, 16 nt, Homo sapiens
uggaaaauaauaucca

SEQ ID NO: 2238819 - RNA, 21 nt, Homo sapiens
ccuguugaagcucuggugaca

SEQ ID NO: 2238820 - RNA, 13 nt, Homo sapiens
cuuuaugcacauu

SEQ ID NO: 2238821 - RNA, 15 nt, Homo sapiens
ucccuguccucauga

SEQ ID NO: 2238822 - RNA, 20 nt, Homo sapiens
accuaauggucucuaccuaa

SEQ ID NO: 2238823 - RNA, 20 nt, Homo sapiens
aagugggcagcauaaaguca

SEQ ID NO: 2238824 - RNA, 16 nt, Homo sapiens
gcacuuauacccauga

SEQ ID NO: 2238825 - RNA, 15 nt, Homo sapiens
uguagcguguuuaca

SEQ ID NO: 2238826 - RNA, 18 nt, Homo sapiens
uauucccauuagaccaag

SEQ ID NO: 2238827 - RNA, 17 nt, Homo sapiens
ucugcuggagaaagcca

SEQ ID NO: 2238828 - RNA, 13 nt, Homo sapiens
ugaggagcccagg

SEQ ID NO: 2238829 - RNA, 15 nt, Homo sapiens
uagcagagggaucaa

SEQ ID NO: 2238830 - RNA, 16 nt, Homo sapiens
caacuucccaaagcac

SEQ ID NO: 2238831 - RNA, 19 nt, Homo sapiens
ugccacugcuuucauugaa

SEQ ID NO: 2238832 - RNA, 17 nt, Homo sapiens
aaagaaacaaccugcca

SEQ ID NO: 2238833 - RNA, 21 nt, Homo sapiens
ggacgaagcggagagagccaa

SEQ ID NO: 2238834 - RNA, 19 nt, Homo sapiens
cuacuuauuuaaugauaaa

SEQ ID NO: 2238835 - RNA, 23 nt, Homo sapiens
acccuaguucaaaacaaccacuu

SEQ ID NO: 2238836 - RNA, 22 nt, Homo sapiens
gagccucccaaggagaacaaau

SEQ ID NO: 2238837 - RNA, 20 nt, Homo sapiens
ccuccagaccucccagagag

SEQ ID NO: 2238838 - RNA, 16 nt, Homo sapiens
aagucuacuucacuaa

SEQ ID NO: 2238839 - RNA, 16 nt, Homo sapiens
guggcaccgagaccaa

SEQ ID NO: 2238840 - RNA, 12 nt, Homo sapiens
cuaccucugacu

SEQ ID NO: 2238841 - RNA, 16 nt, Homo sapiens
cacccacauaccuggc

SEQ ID NO: 2238842 - RNA, 22 nt, Homo sapiens
cagcagauguaguuucagacuu

SEQ ID NO: 2238843 - RNA, 14 nt, Homo sapiens
cucaccugccccuc

SEQ ID NO: 2238844 - RNA, 21 nt, Homo sapiens
acauacugcauuucacucugg

SEQ ID NO: 2238845 - RNA, 19 nt, Homo sapiens
ccacaaggcuguugcaugg

SEQ ID NO: 2238846 - RNA, 21 nt, Homo sapiens
cuguauuuugaugauugcuau

SEQ ID NO: 2238847 - RNA, 19 nt, Homo sapiens
ucuuagcccucaccacagc

SEQ ID NO: 2238848 - RNA, 17 nt, Homo sapiens
aguuaauuuuauuccag

SEQ ID NO: 2238849 - RNA, 21 nt, Homo sapiens
auguugugauguauucuagcu

SEQ ID NO: 2238850 - RNA, 17 nt, Homo sapiens
ccagggacauguggaaa

SEQ ID NO: 2238851 - RNA, 22 nt, Homo sapiens
ugcuaucuuggcucacugcaaa

SEQ ID NO: 2238852 - RNA, 16 nt, Homo sapiens
ugaaaaacuaugucag

SEQ ID NO: 2238853 - RNA, 16 nt, Homo sapiens
guuuucaauaacaaag

SEQ ID NO: 2238854 - RNA, 15 nt, Homo sapiens
aggauagacacugga

SEQ ID NO: 2238855 - RNA, 23 nt, Homo sapiens
ucuuuaccaaaaaccauguugcg

SEQ ID NO: 2238856 - RNA, 14 nt, Homo sapiens
caugaucaguguau

SEQ ID NO: 2238857 - RNA, 23 nt, Homo sapiens
augcauguuuccugcucuucccu

SEQ ID NO: 2238858 - RNA, 14 nt, Homo sapiens
uuacucagguuuga

SEQ ID NO: 2238859 - RNA, 16 nt, Homo sapiens
auaguauucauuuucc

SEQ ID NO: 2238860 - RNA, 14 nt, Homo sapiens
cucccagugccaaa

SEQ ID NO: 2238861 - RNA, 19 nt, Homo sapiens
cuaauucagugucacauga

SEQ ID NO: 2238862 - RNA, 22 nt, Homo sapiens
aagcaauaaaaauacuaugaaa

SEQ ID NO: 2238863 - RNA, 22 nt, Homo sapiens
ugauagggaaggcuacuaccua

SEQ ID NO: 2238864 - RNA, 14 nt, Homo sapiens
aggaguuuugagaa

SEQ ID NO: 2238865 - RNA, 13 nt, Homo sapiens
acacacuuuccau

SEQ ID NO: 2238866 - RNA, 17 nt, Homo sapiens
agaugaaguuuuauaca

SEQ ID NO: 2238867 - RNA, 20 nt, Homo sapiens
ccugcuuuccugcagcaguc

SEQ ID NO: 2238868 - RNA, 14 nt, Homo sapiens
ccugaggccaagaa

SEQ ID NO: 2238869 - RNA, 14 nt, Homo sapiens
aauaaggcacaaaa

SEQ ID NO: 2238870 - RNA, 23 nt, Homo sapiens
uguacucacauauaacaugcaaa

SEQ ID NO: 2238871 - RNA, 17 nt, Homo sapiens
cagcucccucugccuga

SEQ ID NO: 2238872 - RNA, 13 nt, Homo sapiens
gcucaaacccugu

SEQ ID NO: 2238873 - RNA, 16 nt, Homo sapiens
cugacuuucucuccag

SEQ ID NO: 2238874 - RNA, 14 nt, Homo sapiens
agcuuaaacacauu

SEQ ID NO: 2238875 - RNA, 14 nt, Homo sapiens
agauuuaacaaaua

SEQ ID NO: 2238876 - RNA, 14 nt, Homo sapiens
uaagaugcacugaa

SEQ ID NO: 2238877 - RNA, 16 nt, Homo sapiens
uuaccagagaaaaagg

SEQ ID NO: 2238878 - RNA, 22 nt, Homo sapiens
caggauccuauucucaccagga

SEQ ID NO: 2238879 - RNA, 16 nt, Homo sapiens
ucugcuuuccuuuucu

SEQ ID NO: 2238880 - RNA, 16 nt, Homo sapiens
uacuuaauauacucag

SEQ ID NO: 2238881 - RNA, 15 nt, Homo sapiens
uuagggacacuuuca

SEQ ID NO: 2238882 - RNA, 13 nt, Homo sapiens
auauguauauaug

SEQ ID NO: 2238883 - RNA, 11 nt, Homo sapiens
aaguugugauu

SEQ ID NO: 2238884 - RNA, 13 nt, Homo sapiens
ucccgaccucagg

SEQ ID NO: 2238885 - RNA, 13 nt, Homo sapiens
ccugggugggugg

SEQ ID NO: 2238886 - RNA, 17 nt, Homo sapiens
uacuucuuacuugucug

SEQ ID NO: 2238887 - RNA, 19 nt, Homo sapiens
augacacccacccugugcc

SEQ ID NO: 2238888 - RNA, 21 nt, Homo sapiens
caggaccuugcuuccuucuca

SEQ ID NO: 2238889 - RNA, 21 nt, Homo sapiens
cagggugggcuuguggggccu

SEQ ID NO: 2238890 - RNA, 13 nt, Homo sapiens
aagaauaugcauc

SEQ ID NO: 2238891 - RNA, 19 nt, Homo sapiens
ugauuugauaccauggcac

SEQ ID NO: 2238892 - RNA, 18 nt, Homo sapiens
aucuacaaaaauuuauua

SEQ ID NO: 2238893 - RNA, 14 nt, Homo sapiens
gagcuagucuuuca

SEQ ID NO: 2238894 - RNA, 13 nt, Homo sapiens
ccagagaugacua

SEQ ID NO: 2238895 - RNA, 14 nt, Homo sapiens
agguagaugaacua

SEQ ID NO: 2238896 - RNA, 16 nt, Homo sapiens
aaacuuauucuacuga

SEQ ID NO: 2238897 - RNA, 15 nt, Homo sapiens
ugucuuaaccuaccu

SEQ ID NO: 2238898 - RNA, 14 nt, Homo sapiens
auggaaucaauuca

SEQ ID NO: 2238899 - RNA, 15 nt, Homo sapiens
uaccaaaugcuucua

SEQ ID NO: 2238900 - RNA, 15 nt, Homo sapiens
gacucuauucucaaa

SEQ ID NO: 2238901 - RNA, 10 nt, Homo sapiens
ccaaccucag

SEQ ID NO: 2238902 - RNA, 20 nt, Homo sapiens
auagccaggagcgcaucuca

SEQ ID NO: 2238903 - RNA, 20 nt, Homo sapiens
aauuugggugagcugcaccu

SEQ ID NO: 2238904 - RNA, 16 nt, Homo sapiens
aaggacuuuaaggaag

SEQ ID NO: 2238905 - RNA, 14 nt, Homo sapiens
uccagaccccagaa

SEQ ID NO: 2238906 - RNA, 13 nt, Homo sapiens
ucucucaggugaa

SEQ ID NO: 2238907 - RNA, 18 nt, Homo sapiens
ucccgucagcuggaaaag

SEQ ID NO: 2238908 - RNA, 19 nt, Homo sapiens
acugaaugaaacccccaca

SEQ ID NO: 2238909 - RNA, 21 nt, Homo sapiens
uucguucugauaugugaauuu

SEQ ID NO: 2238910 - RNA, 14 nt, Homo sapiens
ugguccccacugcu

SEQ ID NO: 2238911 - RNA, 16 nt, Homo sapiens
aaaaacacguggagau

SEQ ID NO: 2238912 - RNA, 23 nt, Homo sapiens
gacuguucuauagcagucaucau

SEQ ID NO: 2238913 - RNA, 17 nt, Homo sapiens
gacugguuaggacaaaa

SEQ ID NO: 2238914 - RNA, 11 nt, Homo sapiens
guuguuugcaa

SEQ ID NO: 2238915 - RNA, 20 nt, Homo sapiens
agccaacuguuucccugcug

SEQ ID NO: 2238916 - RNA, 20 nt, Homo sapiens
gcugagaucacgccacugca

SEQ ID NO: 2238917 - RNA, 18 nt, Homo sapiens
cguuuguucccccaugaa

SEQ ID NO: 2238918 - RNA, 12 nt, Homo sapiens
ccccguagcucc

SEQ ID NO: 2238919 - RNA, 16 nt, Homo sapiens
gcaacuaggccuucag

SEQ ID NO: 2238920 - RNA, 21 nt, Homo sapiens
ugcaccucccacgguggucac

SEQ ID NO: 2238921 - RNA, 20 nt, Homo sapiens
caaggagcaaacacugaaau

SEQ ID NO: 2238922 - RNA, 14 nt, Homo sapiens
cugucugcccugaa

SEQ ID NO: 2238923 - RNA, 15 nt, Homo sapiens
uugcucccugcaaga

SEQ ID NO: 2238924 - RNA, 15 nt, Homo sapiens
cuagaauucauguga

SEQ ID NO: 2238925 - RNA, 12 nt, Homo sapiens
ccccggggacuc

SEQ ID NO: 2238926 - RNA, 19 nt, Homo sapiens
agggaccugcugcucagua

SEQ ID NO: 2238927 - RNA, 13 nt, Homo sapiens
ggaacugcugcca

SEQ ID NO: 2238928 - RNA, 13 nt, Homo sapiens
ucuaacgcuuuaa

SEQ ID NO: 2238929 - RNA, 17 nt, Homo sapiens
uuauugcaugcugauaa

SEQ ID NO: 2238930 - RNA, 17 nt, Homo sapiens
aaucgagagaagcugcc

SEQ ID NO: 2238931 - RNA, 17 nt, Homo sapiens
aauuucauuuccauuua

SEQ ID NO: 2238932 - RNA, 13 nt, Homo sapiens
cagcucagugcca

SEQ ID NO: 2238933 - RNA, 24 nt, Homo sapiens
auugaucauaaacugacuaucaua

SEQ ID NO: 2238934 - RNA, 15 nt, Homo sapiens
acuacauacaagcau

SEQ ID NO: 2238935 - RNA, 13 nt, Homo sapiens
cuccucugagcag

SEQ ID NO: 2238936 - RNA, 17 nt, Homo sapiens
caaacgcuguauuccaa

SEQ ID NO: 2238937 - RNA, 18 nt, Homo sapiens
ggcccagccacugcagca

SEQ ID NO: 2238938 - RNA, 22 nt, Homo sapiens
cauuguaugauguguugugaua

SEQ ID NO: 2238939 - RNA, 21 nt, Homo sapiens
uuaaaucaagagcuuacauaa

SEQ ID NO: 2238940 - RNA, 12 nt, Homo sapiens
uauuugaaugau

SEQ ID NO: 2238941 - RNA, 21 nt, Homo sapiens
cuaacuggggauauaauacua

SEQ ID NO: 2238942 - RNA, 19 nt, Homo sapiens
cagucaaaacccaccaaaa

SEQ ID NO: 2238943 - RNA, 20 nt, Homo sapiens
uagucucaugccuugagauc

SEQ ID NO: 2238944 - RNA, 18 nt, Homo sapiens
uguuauagaacuucaugg

SEQ ID NO: 2238945 - RNA, 20 nt, Homo sapiens
uaugucaucucagugcugua

SEQ ID NO: 2238946 - RNA, 15 nt, Homo sapiens
uaagucacauaucag

SEQ ID NO: 2238947 - RNA, 23 nt, Homo sapiens
ucugagaccacuugggcgcuguu

SEQ ID NO: 2238948 - RNA, 15 nt, Homo sapiens
ccauaagauuugcaa

SEQ ID NO: 2238949 - RNA, 15 nt, Homo sapiens
cucugaggauguaua

SEQ ID NO: 2238950 - RNA, 13 nt, Homo sapiens
uuuaagcuaugaa

SEQ ID NO: 2238951 - RNA, 17 nt, Homo sapiens
acuguccuacaauauca

SEQ ID NO: 2238952 - RNA, 17 nt, Homo sapiens
auucaaagaaucaccua

SEQ ID NO: 2238953 - RNA, 14 nt, Homo sapiens
uuucaaagucucac

SEQ ID NO: 2238954 - RNA, 14 nt, Homo sapiens
cuauacagccauaa

SEQ ID NO: 2238955 - RNA, 15 nt, Homo sapiens
aguucccuacgugaa

SEQ ID NO: 2238956 - RNA, 15 nt, Homo sapiens
accccauuucuacua

SEQ ID NO: 2238957 - RNA, 23 nt, Homo sapiens
cuucccagagggauugcugugaa

SEQ ID NO: 2238958 - RNA, 20 nt, Homo sapiens
ccuguuucuaccuauaugca

SEQ ID NO: 2238959 - RNA, 14 nt, Homo sapiens
cuuccaaccccuuu

SEQ ID NO: 2238960 - RNA, 16 nt, Homo sapiens
cauggcaaguacagua

SEQ ID NO: 2238961 - RNA, 15 nt, Homo sapiens
guuucccucuguaua

SEQ ID NO: 2238962 - RNA, 15 nt, Homo sapiens
cuucguucuguaaua

SEQ ID NO: 2238963 - RNA, 14 nt, Homo sapiens
gcaauuccccuaca

SEQ ID NO: 2238964 - RNA, 15 nt, Homo sapiens
gauuucuuaguucau

SEQ ID NO: 2238965 - RNA, 13 nt, Homo sapiens
gucacugccaacg

SEQ ID NO: 2238966 - RNA, 23 nt, Homo sapiens
aacuccacugcuuaccuacuuuc

SEQ ID NO: 2238967 - RNA, 17 nt, Homo sapiens
acacaaaacauucaugu

SEQ ID NO: 2238968 - RNA, 23 nt, Homo sapiens
gccagcgucggucugugccccuu

SEQ ID NO: 2238969 - RNA, 18 nt, Homo sapiens
agcauaguacuggcacaa

SEQ ID NO: 2238970 - RNA, 23 nt, Homo sapiens
gguagcugaugaggaucagagcg

SEQ ID NO: 2238971 - RNA, 16 nt, Homo sapiens
cuacucucaccgacuu

SEQ ID NO: 2238972 - RNA, 21 nt, Homo sapiens
guucuggauaccauuauaugu

SEQ ID NO: 2238973 - RNA, 23 nt, Homo sapiens
agaucugcuuucuguucaucucu

SEQ ID NO: 2238974 - RNA, 13 nt, Homo sapiens
ugucauauauuac

SEQ ID NO: 2238975 - RNA, 13 nt, Homo sapiens
cuuuauagcuuug

SEQ ID NO: 2238976 - RNA, 15 nt, Homo sapiens
gcccccuuccucacc

SEQ ID NO: 2238977 - RNA, 15 nt, Homo sapiens
cuuuaaaaugcacac

SEQ ID NO: 2238978 - RNA, 17 nt, Homo sapiens
gugagacagcucugcau

SEQ ID NO: 2238979 - RNA, 13 nt, Homo sapiens
accagcugcugug

SEQ ID NO: 2238980 - RNA, 22 nt, Homo sapiens
guugauggaaauacacuguuau

SEQ ID NO: 2238981 - RNA, 19 nt, Homo sapiens
caacaggcuuaugaauaua

SEQ ID NO: 2238982 - RNA, 22 nt, Homo sapiens
guccuccucugugaaacuggga

SEQ ID NO: 2238983 - RNA, 19 nt, Homo sapiens
caaaaaaugaacagugaua

SEQ ID NO: 2238984 - RNA, 20 nt, Homo sapiens
uggcaacucaaggcugcuuc

SEQ ID NO: 2238985 - RNA, 16 nt, Homo sapiens
aaaucucaauucuucc

SEQ ID NO: 2238986 - RNA, 17 nt, Homo sapiens
cuaagcuucacuguaaa

SEQ ID NO: 2238987 - RNA, 15 nt, Homo sapiens
ccuuccacucuggaa

SEQ ID NO: 2238988 - RNA, 15 nt, Homo sapiens
uaucuaacagacaag

SEQ ID NO: 2238989 - RNA, 21 nt, Homo sapiens
ugggcucugaugcagaacuuu

SEQ ID NO: 2238990 - RNA, 15 nt, Homo sapiens
cacauccaucagcac

SEQ ID NO: 2238991 - RNA, 21 nt, Homo sapiens
cugguaggucuggauuuucaa

SEQ ID NO: 2238992 - RNA, 16 nt, Homo sapiens
aagugugcagccauag

SEQ ID NO: 2238993 - RNA, 18 nt, Homo sapiens
ccucacugggacuuugua

SEQ ID NO: 2238994 - RNA, 23 nt, Homo sapiens
aagaugagauuugccagcacagg

SEQ ID NO: 2238995 - RNA, 12 nt, Homo sapiens
agcgaacaaaug

SEQ ID NO: 2238996 - RNA, 12 nt, Homo sapiens
agcaaacaaaua

SEQ ID NO: 2238997 - RNA, 15 nt, Homo sapiens
aguugagcucagguu

SEQ ID NO: 2238998 - RNA, 17 nt, Homo sapiens
cuguucuugcuccaaag

SEQ ID NO: 2238999 - RNA, 12 nt, Homo sapiens
aguggggugcug

SEQ ID NO: 2239000 - RNA, 20 nt, Homo sapiens
auccuuugagaaugugauuc

SEQ ID NO: 2239001 - RNA, 17 nt, Homo sapiens
gccccaaggcuugccaa

SEQ ID NO: 2239002 - RNA, 20 nt, Homo sapiens
agccaagagucaugucaaau

SEQ ID NO: 2239003 - RNA, 18 nt, Homo sapiens
cacaacugacacaggaaa

SEQ ID NO: 2239004 - RNA, 19 nt, Homo sapiens
gcaauguggggagacccca

SEQ ID NO: 2239005 - RNA, 22 nt, Homo sapiens
cucagcacaccggcauccccac

SEQ ID NO: 2239006 - RNA, 13 nt, Homo sapiens
aacauuccaagac

SEQ ID NO: 2239007 - RNA, 22 nt, Homo sapiens
caacaccucugcacaagcugca

SEQ ID NO: 2239008 - RNA, 15 nt, Homo sapiens
gugcuaaaccauuca

SEQ ID NO: 2239009 - RNA, 17 nt, Homo sapiens
caugcugcuuugccaag

SEQ ID NO: 2239010 - RNA, 20 nt, Homo sapiens
gacucaccuguucucacucc

SEQ ID NO: 2239011 - RNA, 15 nt, Homo sapiens
cuucuuugcacuuuu

SEQ ID NO: 2239012 - RNA, 16 nt, Homo sapiens
aacuaagacauaugca

SEQ ID NO: 2239013 - RNA, 20 nt, Homo sapiens
acuuacccuaaaacaugugu

SEQ ID NO: 2239014 - RNA, 18 nt, Homo sapiens
cugaaccgugugcuccuc

SEQ ID NO: 2239015 - RNA, 18 nt, Homo sapiens
uugugugaccaacugugu

SEQ ID NO: 2239016 - RNA, 22 nt, Homo sapiens
cccagcucaugcacaucagcug

SEQ ID NO: 2239017 - RNA, 15 nt, Homo sapiens
ccaaagccaccaaga

SEQ ID NO: 2239018 - RNA, 21 nt, Homo sapiens
uuguaucaaccuaaaugaguc

SEQ ID NO: 2239019 - RNA, 22 nt, Homo sapiens
aggaaagcuaagucuugucuca

SEQ ID NO: 2239020 - RNA, 14 nt, Homo sapiens
ugaaauugucaaag

SEQ ID NO: 2239021 - RNA, 19 nt, Homo sapiens
uaacuaaggaaauauuuca

SEQ ID NO: 2239022 - RNA, 22 nt, Homo sapiens
accuucaaaggccaagagaauu

SEQ ID NO: 2239023 - RNA, 12 nt, Homo sapiens
agaaaaugcauu

SEQ ID NO: 2239024 - RNA, 12 nt, Homo sapiens
agugguguuguc

SEQ ID NO: 2239025 - RNA, 19 nt, Homo sapiens
aaaacagagggcugcauuc

SEQ ID NO: 2239026 - RNA, 20 nt, Homo sapiens
uuuccuguagucccauugau

SEQ ID NO: 2239027 - RNA, 21 nt, Homo sapiens
ucuuaaagugcaguucuuagc

SEQ ID NO: 2239028 - RNA, 17 nt, Homo sapiens
cucugaacuugccuuaa

SEQ ID NO: 2239029 - RNA, 11 nt, Homo sapiens
uuccuacuggu

SEQ ID NO: 2239030 - RNA, 15 nt, Homo sapiens
ggcccucuucuuauu

SEQ ID NO: 2239031 - RNA, 15 nt, Homo sapiens
gcauuuuccucuugu

SEQ ID NO: 2239032 - RNA, 14 nt, Homo sapiens
ccagauguuaugcu

SEQ ID NO: 2239033 - RNA, 14 nt, Homo sapiens
uuuuuaacugguga

SEQ ID NO: 2239034 - RNA, 17 nt, Homo sapiens
ucuugcucugcauuuau

SEQ ID NO: 2239035 - RNA, 20 nt, Homo sapiens
aacagaacauagacagaaga

SEQ ID NO: 2239036 - RNA, 22 nt, Homo sapiens
cacagcuucucuacagacucca

SEQ ID NO: 2239037 - RNA, 16 nt, Homo sapiens
ggggaccuuggucuga

SEQ ID NO: 2239038 - RNA, 23 nt, Homo sapiens
ggaggggugguacuuggcaccaa

SEQ ID NO: 2239039 - RNA, 15 nt, Homo sapiens
gaagaguccaggaag

SEQ ID NO: 2239040 - RNA, 17 nt, Homo sapiens
ugcauggauaugugcca

SEQ ID NO: 2239041 - RNA, 20 nt, Homo sapiens
cacauagcgccgugcuguaa

SEQ ID NO: 2239042 - RNA, 18 nt, Homo sapiens
cucuugucucacaugcua

SEQ ID NO: 2239043 - RNA, 17 nt, Homo sapiens
uccccauuugcuuacuu

SEQ ID NO: 2239044 - RNA, 14 nt, Homo sapiens
guaaguucuguggu

SEQ ID NO: 2239045 - RNA, 18 nt, Homo sapiens
uuaacauuaucuaguuca

SEQ ID NO: 2239046 - RNA, 13 nt, Homo sapiens
gacuacuauacaa

SEQ ID NO: 2239047 - RNA, 18 nt, Homo sapiens
aacaugaagaaugcauuc

SEQ ID NO: 2239048 - RNA, 14 nt, Homo sapiens
augauuauauucac

SEQ ID NO: 2239049 - RNA, 19 nt, Homo sapiens
ugagccagcagacauuguc

SEQ ID NO: 2239050 - RNA, 14 nt, Homo sapiens
caucuuggucacau

SEQ ID NO: 2239051 - RNA, 12 nt, Homo sapiens
gagccaaaaacu

SEQ ID NO: 2239052 - RNA, 21 nt, Homo sapiens
ucaagccuagcaucucgggga

SEQ ID NO: 2239053 - RNA, 14 nt, Homo sapiens
auaaaauggucaug

SEQ ID NO: 2239054 - RNA, 23 nt, Homo sapiens
ccugacggcuggggacccaccca

SEQ ID NO: 2239055 - RNA, 21 nt, Homo sapiens
gccucuagaacagccagaccc

SEQ ID NO: 2239056 - RNA, 14 nt, Homo sapiens
ugugugugcaagaa

SEQ ID NO: 2239057 - RNA, 19 nt, Homo sapiens
aaccagagaacaacauggg

SEQ ID NO: 2239058 - RNA, 11 nt, Homo sapiens
ccuaaauaacc

SEQ ID NO: 2239059 - RNA, 18 nt, Homo sapiens
aaacuucaucuuccccaa

SEQ ID NO: 2239060 - RNA, 20 nt, Homo sapiens
aauucacaugaugcacuuca

SEQ ID NO: 2239061 - RNA, 14 nt, Homo sapiens
cagaaaaucugaau

SEQ ID NO: 2239062 - RNA, 22 nt, Homo sapiens
gcuggaaaaggccuguggccca

SEQ ID NO: 2239063 - RNA, 12 nt, Homo sapiens
cugcaaaccuuc

SEQ ID NO: 2239064 - RNA, 20 nt, Homo sapiens
gcucaaagauguacugagag

SEQ ID NO: 2239065 - RNA, 15 nt, Homo sapiens
ucaaguugugugcua

SEQ ID NO: 2239066 - RNA, 16 nt, Homo sapiens
gcccuccuuucugugc

SEQ ID NO: 2239067 - RNA, 15 nt, Homo sapiens
augguaagacuguaa

SEQ ID NO: 2239068 - RNA, 22 nt, Homo sapiens
ucacucaagaguucagugcuca

SEQ ID NO: 2239069 - RNA, 19 nt, Homo sapiens
uguccguggcuacaauuca

SEQ ID NO: 2239070 - RNA, 20 nt, Homo sapiens
gcugcuauggacgaccucca

SEQ ID NO: 2239071 - RNA, 22 nt, Homo sapiens
aucauaauucagcacuuaacua

SEQ ID NO: 2239072 - RNA, 15 nt, Homo sapiens
auccuggagugauau

SEQ ID NO: 2239073 - RNA, 23 nt, Homo sapiens
ucaguaacacagugcaguacuca

SEQ ID NO: 2239074 - RNA, 14 nt, Homo sapiens
gaaugacaaaguau

SEQ ID NO: 2239075 - RNA, 20 nt, Homo sapiens
acucccugaucccaguuucu

SEQ ID NO: 2239076 - RNA, 19 nt, Homo sapiens
uucauucacucaacaaaca

SEQ ID NO: 2239077 - RNA, 12 nt, Homo sapiens
gauaaaccaaaa

SEQ ID NO: 2239078 - RNA, 12 nt, Homo sapiens
gcucaaccacac

SEQ ID NO: 2239079 - RNA, 17 nt, Homo sapiens
acuuuguguucauuuca

SEQ ID NO: 2239080 - RNA, 20 nt, Homo sapiens
ccucagagcauuuaaggaaa

SEQ ID NO: 2239081 - RNA, 22 nt, Homo sapiens
guacaguggaaccguugccaac

SEQ ID NO: 2239082 - RNA, 21 nt, Homo sapiens
ccacguugcagaaaaagagcu

SEQ ID NO: 2239083 - RNA, 22 nt, Homo sapiens
gacuacaggcgugagccaccau

SEQ ID NO: 2239084 - RNA, 14 nt, Homo sapiens
ccuauccugguuag

SEQ ID NO: 2239085 - RNA, 19 nt, Homo sapiens
gaaaugugcaaccacugcu

SEQ ID NO: 2239086 - RNA, 18 nt, Homo sapiens
cuaaccuugaaugcugcc

SEQ ID NO: 2239087 - RNA, 17 nt, Homo sapiens
acgagaccaugaugcau

SEQ ID NO: 2239088 - RNA, 23 nt, Homo sapiens
cgaaggggaaaacccgcucucuc

SEQ ID NO: 2239089 - RNA, 14 nt, Homo sapiens
aaguaugugcauau

SEQ ID NO: 2239090 - RNA, 14 nt, Homo sapiens
cugggaaaugcaga

SEQ ID NO: 2239091 - RNA, 14 nt, Homo sapiens
ccaugaguggaguu

SEQ ID NO: 2239092 - RNA, 13 nt, Homo sapiens
agguuucuauucg

SEQ ID NO: 2239093 - RNA, 18 nt, Homo sapiens
acucacauggacccaaga

SEQ ID NO: 2239094 - RNA, 15 nt, Homo sapiens
uuaaaauagucucau

SEQ ID NO: 2239095 - RNA, 16 nt, Homo sapiens
ucgaaagaaaaugggc

SEQ ID NO: 2239096 - RNA, 19 nt, Homo sapiens
uaccaaaugaaaugccaaa

SEQ ID NO: 2239097 - RNA, 12 nt, Homo sapiens
ggaccauuccag

SEQ ID NO: 2239098 - RNA, 20 nt, Homo sapiens
uggcagcagccagggacccc

SEQ ID NO: 2239099 - RNA, 21 nt, Homo sapiens
cuauaugaaaagagcaaaaac

SEQ ID NO: 2239100 - RNA, 14 nt, Homo sapiens
cccucccuuugaaa

SEQ ID NO: 2239101 - RNA, 15 nt, Homo sapiens
agugccaugguagaa

SEQ ID NO: 2239102 - RNA, 21 nt, Homo sapiens
uugcaugugcugcagguguaa

SEQ ID NO: 2239103 - RNA, 12 nt, Homo sapiens
agugcauaugca

SEQ ID NO: 2239104 - RNA, 16 nt, Homo sapiens
guguaugcucauacuu

SEQ ID NO: 2239105 - RNA, 17 nt, Homo sapiens
ugcagcggugguuguca

SEQ ID NO: 2239106 - RNA, 10 nt, Homo sapiens
ccuuccucac

SEQ ID NO: 2239107 - RNA, 22 nt, Homo sapiens
gcaucuggcuguuuagcagaac

SEQ ID NO: 2239108 - RNA, 10 nt, Homo sapiens
cuuuccucau

SEQ ID NO: 2239109 - RNA, 14 nt, Homo sapiens
ucuccuuugagcaa

SEQ ID NO: 2239110 - RNA, 12 nt, Homo sapiens
aguguucaucuc

SEQ ID NO: 2239111 - RNA, 15 nt, Homo sapiens
cagcagaaagguuag

SEQ ID NO: 2239112 - RNA, 18 nt, Homo sapiens
aauaauauuguuguauaa

SEQ ID NO: 2239113 - RNA, 13 nt, Homo sapiens
cuuccucuugacc

SEQ ID NO: 2239114 - RNA, 21 nt, Homo sapiens
ugauauugggcucuucaggaa

SEQ ID NO: 2239115 - RNA, 18 nt, Homo sapiens
ccacagcagcaauaugcu

SEQ ID NO: 2239116 - RNA, 14 nt, Homo sapiens
gaaaauaaaccaag

SEQ ID NO: 2239117 - RNA, 18 nt, Homo sapiens
cggggacuaacaaagaca

SEQ ID NO: 2239118 - RNA, 16 nt, Homo sapiens
caugggucgcccauga

SEQ ID NO: 2239119 - RNA, 23 nt, Homo sapiens
cccucuuccagcuucuuuugcca

SEQ ID NO: 2239120 - RNA, 22 nt, Homo sapiens
caaaggaggggaaacaaugaaa

SEQ ID NO: 2239121 - RNA, 13 nt, Homo sapiens
gguccaccuggag

SEQ ID NO: 2239122 - RNA, 18 nt, Homo sapiens
gcugguuuuucauuucca

SEQ ID NO: 2239123 - RNA, 24 nt, Homo sapiens
gauacaaacuuuguaauucuaaua

SEQ ID NO: 2239124 - RNA, 20 nt, Homo sapiens
aguugucagcuuugacuuua

SEQ ID NO: 2239125 - RNA, 21 nt, Homo sapiens
cagauguuuuucuucauuaac

SEQ ID NO: 2239126 - RNA, 22 nt, Homo sapiens
uuguaccuuccacaagacucag

SEQ ID NO: 2239127 - RNA, 13 nt, Homo sapiens
cuuacccuaaaga

SEQ ID NO: 2239128 - RNA, 20 nt, Homo sapiens
uaaccuccaacacagugcau

SEQ ID NO: 2239129 - RNA, 23 nt, Homo sapiens
ucaaacguggcuuuuagacagau

SEQ ID NO: 2239130 - RNA, 20 nt, Homo sapiens
auucuggcccagccaaucua

SEQ ID NO: 2239131 - RNA, 15 nt, Homo sapiens
gguacuacaaccaau

SEQ ID NO: 2239132 - RNA, 20 nt, Homo sapiens
uggcaggccccagcccugca

SEQ ID NO: 2239133 - RNA, 23 nt, Homo sapiens
cccaguuaaauuuucauuucaga

SEQ ID NO: 2239134 - RNA, 16 nt, Homo sapiens
auagaaccaacccaaa

SEQ ID NO: 2239135 - RNA, 21 nt, Homo sapiens
aggccgccccagccucugagc

SEQ ID NO: 2239136 - RNA, 19 nt, Homo sapiens
caaaaucuugaucaguuaa

SEQ ID NO: 2239137 - RNA, 23 nt, Homo sapiens
caucagucaucacucucaaauau

SEQ ID NO: 2239138 - RNA, 12 nt, Homo sapiens
agauugucuguu

SEQ ID NO: 2239139 - RNA, 16 nt, Homo sapiens
cacccaugccagagag

SEQ ID NO: 2239140 - RNA, 14 nt, Homo sapiens
auagccaacugcug

SEQ ID NO: 2239141 - RNA, 21 nt, Homo sapiens
uacaaaugaaguauuucaugu

SEQ ID NO: 2239142 - RNA, 12 nt, Homo sapiens
auagaaaugcca

SEQ ID NO: 2239143 - RNA, 19 nt, Homo sapiens
aauuuuugcuaugcuguaa

SEQ ID NO: 2239144 - RNA, 20 nt, Homo sapiens
aaugaacuaauaauagcauu

SEQ ID NO: 2239145 - RNA, 22 nt, Homo sapiens
uggauagauaauuuuauuugaa

SEQ ID NO: 2239146 - RNA, 13 nt, Homo sapiens
ugacacauucucu

SEQ ID NO: 2239147 - RNA, 19 nt, Homo sapiens
auaaccuuuuuguauauca

SEQ ID NO: 2239148 - RNA, 15 nt, Homo sapiens
gacauguacugagac

SEQ ID NO: 2239149 - RNA, 16 nt, Homo sapiens
ggcccacccccagugg

SEQ ID NO: 2239150 - RNA, 13 nt, Homo sapiens
acucccacuuccc

SEQ ID NO: 2239151 - RNA, 15 nt, Homo sapiens
ugucguaucugggag

SEQ ID NO: 2239152 - RNA, 14 nt, Homo sapiens
ugaauaauuuccaa

SEQ ID NO: 2239153 - RNA, 14 nt, Homo sapiens
uucucuccauuuca

SEQ ID NO: 2239154 - RNA, 14 nt, Homo sapiens
agucauccugccaa

SEQ ID NO: 2239155 - RNA, 14 nt, Homo sapiens
acugcuguguaaug

SEQ ID NO: 2239156 - RNA, 15 nt, Homo sapiens
gcgccuccauccauc

SEQ ID NO: 2239157 - RNA, 16 nt, Homo sapiens
cugccgcugcaccacg

SEQ ID NO: 2239158 - RNA, 15 nt, Homo sapiens
aaacacaaaacauuc

SEQ ID NO: 2239159 - RNA, 18 nt, Homo sapiens
acacucagccacugucac

SEQ ID NO: 2239160 - RNA, 14 nt, Homo sapiens
ugaccucugcaaga

SEQ ID NO: 2239161 - RNA, 17 nt, Homo sapiens
aaacaagugaccccagg

SEQ ID NO: 2239162 - RNA, 19 nt, Homo sapiens
cuuucccuggagcugaggu

SEQ ID NO: 2239163 - RNA, 23 nt, Homo sapiens
uugcacugaaauggaauucccau

SEQ ID NO: 2239164 - RNA, 19 nt, Homo sapiens
gccuggggugggacaggga

SEQ ID NO: 2239165 - RNA, 18 nt, Homo sapiens
augauauugcauaugcau

SEQ ID NO: 2239166 - RNA, 16 nt, Homo sapiens
cuuuguuuugcacuga

SEQ ID NO: 2239167 - RNA, 16 nt, Homo sapiens
cucuguuauguacugu

SEQ ID NO: 2239168 - RNA, 23 nt, Homo sapiens
auccuaaaugaguaaacccagcu

SEQ ID NO: 2239169 - RNA, 19 nt, Homo sapiens
uauccaauaggcauuugau

SEQ ID NO: 2239170 - RNA, 11 nt, Homo sapiens
aaaaugaagga

SEQ ID NO: 2239171 - RNA, 14 nt, Homo sapiens
aaucugcaaaaugg

SEQ ID NO: 2239172 - RNA, 15 nt, Homo sapiens
gagagaggugccaca

SEQ ID NO: 2239173 - RNA, 15 nt, Homo sapiens
gggauccagcucaag

SEQ ID NO: 2239174 - RNA, 16 nt, Homo sapiens
aauugcuaauguugcu

SEQ ID NO: 2239175 - RNA, 23 nt, Homo sapiens
ucaguagucacaaacugaucuaa

SEQ ID NO: 2239176 - RNA, 19 nt, Homo sapiens
cacagcugggguggggacc

SEQ ID NO: 2239177 - RNA, 18 nt, Homo sapiens
agcccuggcccgguccca

SEQ ID NO: 2239178 - RNA, 18 nt, Homo sapiens
acccuauacaacuggaca

SEQ ID NO: 2239179 - RNA, 21 nt, Homo sapiens
ccuuaggagacgcugcacuug

SEQ ID NO: 2239180 - RNA, 18 nt, Homo sapiens
aauaaaugugacucagca

SEQ ID NO: 2239181 - RNA, 13 nt, Homo sapiens
gaauaugcacaaa

SEQ ID NO: 2239182 - RNA, 13 nt, Homo sapiens
ccccucaaacugc

SEQ ID NO: 2239183 - RNA, 13 nt, Homo sapiens
gugucaucaggag

SEQ ID NO: 2239184 - RNA, 16 nt, Homo sapiens
uacaguauauucuugu

SEQ ID NO: 2239185 - RNA, 16 nt, Homo sapiens
ucacacccaccugcug

SEQ ID NO: 2239186 - RNA, 23 nt, Homo sapiens
acucagaagggagcuagccagag

SEQ ID NO: 2239187 - RNA, 20 nt, Homo sapiens
acuuguugcugauucaagaa

SEQ ID NO: 2239188 - RNA, 21 nt, Homo sapiens
acagaugguguccugcaugua

SEQ ID NO: 2239189 - RNA, 23 nt, Homo sapiens
uauaacuggauugcagacuguuc

SEQ ID NO: 2239190 - RNA, 19 nt, Homo sapiens
gugaggcggcccugaccaa

SEQ ID NO: 2239191 - RNA, 18 nt, Homo sapiens
uucuuuagcuguacugua

SEQ ID NO: 2239192 - RNA, 19 nt, Homo sapiens
agucuggagcacccugaga

SEQ ID NO: 2239193 - RNA, 22 nt, Homo sapiens
uccauagccuaaucccugggca

SEQ ID NO: 2239194 - RNA, 15 nt, Homo sapiens
ccaaauaugagaugc

SEQ ID NO: 2239195 - RNA, 16 nt, Homo sapiens
uugcauaugcauccca

SEQ ID NO: 2239196 - RNA, 16 nt, Homo sapiens
acucuuugguggcuuu

SEQ ID NO: 2239197 - RNA, 20 nt, Homo sapiens
uguugcuuuucacaaaucau

SEQ ID NO: 2239198 - RNA, 16 nt, Homo sapiens
ugaugcuaaucuuguc

SEQ ID NO: 2239199 - RNA, 21 nt, Homo sapiens
gcacccggcucguguauuuau

SEQ ID NO: 2239200 - RNA, 19 nt, Homo sapiens
accuacacaggagucuuca

SEQ ID NO: 2239201 - RNA, 12 nt, Homo sapiens
agcaaacccaga

SEQ ID NO: 2239202 - RNA, 20 nt, Homo sapiens
uaaagugaauaaccacuuaa

SEQ ID NO: 2239203 - RNA, 17 nt, Homo sapiens
auuuaaagaaaaccaca

SEQ ID NO: 2239204 - RNA, 18 nt, Homo sapiens
ucaauauuaagucauugu

SEQ ID NO: 2239205 - RNA, 18 nt, Homo sapiens
gggcagaggcaaggaugg

SEQ ID NO: 2239206 - RNA, 19 nt, Homo sapiens
ccaagaaaauggccaguga

SEQ ID NO: 2239207 - RNA, 20 nt, Homo sapiens
gagacagacagagaaggcag

SEQ ID NO: 2239208 - RNA, 22 nt, Homo sapiens
ucaccuugcccuagcaaaacua

SEQ ID NO: 2239209 - RNA, 21 nt, Homo sapiens
auuuggcuccuuaccaauauu

SEQ ID NO: 2239210 - RNA, 13 nt, Homo sapiens
cugaaaaucugga

SEQ ID NO: 2239211 - RNA, 23 nt, Homo sapiens
uacacaauuaauucaucccuuaa

SEQ ID NO: 2239212 - RNA, 18 nt, Homo sapiens
auacugcagugacugccg

SEQ ID NO: 2239213 - RNA, 15 nt, Homo sapiens
auguuggccagggug

SEQ ID NO: 2239214 - RNA, 12 nt, Homo sapiens
ucagagugccac

SEQ ID NO: 2239215 - RNA, 16 nt, Homo sapiens
accugggcauuguuga

SEQ ID NO: 2239216 - RNA, 20 nt, Homo sapiens
uuuuaaugaaacuucaaaua

SEQ ID NO: 2239217 - RNA, 13 nt, Homo sapiens
cugauuccagaac

SEQ ID NO: 2239218 - RNA, 18 nt, Homo sapiens
uaaaaaauagcagcuuua

SEQ ID NO: 2239219 - RNA, 23 nt, Homo sapiens
aggcagcgcugcaguugcucagg

SEQ ID NO: 2239220 - RNA, 17 nt, Homo sapiens
gaacagaaauuggguga

SEQ ID NO: 2239221 - RNA, 21 nt, Homo sapiens
uuuacacaauuaauucauccc

SEQ ID NO: 2239222 - RNA, 15 nt, Homo sapiens
cuaagcgcacauuca

SEQ ID NO: 2239223 - RNA, 13 nt, Homo sapiens
cacaucauuggaa

SEQ ID NO: 2239224 - RNA, 15 nt, Homo sapiens
gcacuucaaauucaa

SEQ ID NO: 2239225 - RNA, 23 nt, Homo sapiens
cuuuuguaguguguuuucauaac

SEQ ID NO: 2239226 - RNA, 13 nt, Homo sapiens
cuggcucuaggac

SEQ ID NO: 2239227 - RNA, 20 nt, Homo sapiens
ccaguguccccaggggcaca

SEQ ID NO: 2239228 - RNA, 13 nt, Homo sapiens
augggacagggag

SEQ ID NO: 2239229 - RNA, 15 nt, Homo sapiens
cgugauccaccugcc

SEQ ID NO: 2239230 - RNA, 18 nt, Homo sapiens
guauccaauuaugugaca

SEQ ID NO: 2239231 - RNA, 20 nt, Homo sapiens
gaaguggagcccggcacagg

SEQ ID NO: 2239232 - RNA, 14 nt, Homo sapiens
aacuucugaacuug

SEQ ID NO: 2239233 - RNA, 21 nt, Homo sapiens
gaaauaaugcauuucugugga

SEQ ID NO: 2239234 - RNA, 22 nt, Homo sapiens
cuucucucuguucccuuccuca

SEQ ID NO: 2239235 - RNA, 15 nt, Homo sapiens
gcccucuccaaaggc

SEQ ID NO: 2239236 - RNA, 14 nt, Homo sapiens
ccuggccauuucca

SEQ ID NO: 2239237 - RNA, 15 nt, Homo sapiens
cugugccccaccacg

SEQ ID NO: 2239238 - RNA, 15 nt, Homo sapiens
cccacgcauggugca

SEQ ID NO: 2239239 - RNA, 19 nt, Homo sapiens
aaaguccaauuccaaagcc

SEQ ID NO: 2239240 - RNA, 16 nt, Homo sapiens
aguugcuuuuauugca

SEQ ID NO: 2239241 - RNA, 16 nt, Homo sapiens
acagaucuaguucucu

SEQ ID NO: 2239242 - RNA, 18 nt, Homo sapiens
aauuucacgucgucuucu

SEQ ID NO: 2239243 - RNA, 18 nt, Homo sapiens
cacuacaugaugacucaa

SEQ ID NO: 2239244 - RNA, 19 nt, Homo sapiens
uacaaaccugcaugguguu

SEQ ID NO: 2239245 - RNA, 22 nt, Homo sapiens
auaauagguuugaaaguacucc

SEQ ID NO: 2239246 - RNA, 16 nt, Homo sapiens
aaaugauaaacaaguc

SEQ ID NO: 2239247 - RNA, 14 nt, Homo sapiens
agcaaccucuguau

SEQ ID NO: 2239248 - RNA, 14 nt, Homo sapiens
aaggggcuagaagu

SEQ ID NO: 2239249 - RNA, 18 nt, Homo sapiens
augaacucuucucaacuc

SEQ ID NO: 2239250 - RNA, 22 nt, Homo sapiens
ggcagcuguagcucccgagcua

SEQ ID NO: 2239251 - RNA, 15 nt, Homo sapiens
uaacaugugaaaaga

SEQ ID NO: 2239252 - RNA, 14 nt, Homo sapiens
ccuugaccaagaag

SEQ ID NO: 2239253 - RNA, 21 nt, Homo sapiens
ggugucuagacugccagggag

SEQ ID NO: 2239254 - RNA, 14 nt, Homo sapiens
ucuuuuuacuguug

SEQ ID NO: 2239255 - RNA, 15 nt, Homo sapiens
caauauuaaguaaaa

SEQ ID NO: 2239256 - RNA, 22 nt, Homo sapiens
uaacguauauuaaaccuguuga

SEQ ID NO: 2239257 - RNA, 23 nt, Homo sapiens
gcccuggcagaagccagaacaca

SEQ ID NO: 2239258 - RNA, 17 nt, Homo sapiens
caaauauuaccagagca

SEQ ID NO: 2239259 - RNA, 21 nt, Homo sapiens
aacucaaccaaaugguacaaa

SEQ ID NO: 2239260 - RNA, 21 nt, Homo sapiens
cuaaauuuacccucuugaaua

SEQ ID NO: 2239261 - RNA, 14 nt, Homo sapiens
ccagggacaagcag

SEQ ID NO: 2239262 - RNA, 15 nt, Homo sapiens
gcuccaggacucccu

SEQ ID NO: 2239263 - RNA, 14 nt, Homo sapiens
agucaucucagccc

SEQ ID NO: 2239264 - RNA, 22 nt, Homo sapiens
ucuuucagauggaggugccaua

SEQ ID NO: 2239265 - RNA, 20 nt, Homo sapiens
aacccuuugugugcucucca

SEQ ID NO: 2239266 - RNA, 19 nt, Homo sapiens
gcacagggcuguaaaugca

SEQ ID NO: 2239267 - RNA, 22 nt, Homo sapiens
auuacuaguacuaguacuauga

SEQ ID NO: 2239268 - RNA, 22 nt, Homo sapiens
ucaggagagagcuuccuguuuc

SEQ ID NO: 2239269 - RNA, 14 nt, Homo sapiens
cuuauuguaccucu

SEQ ID NO: 2239270 - RNA, 18 nt, Homo sapiens
gaugcuuggcuggaguca

SEQ ID NO: 2239271 - RNA, 15 nt, Homo sapiens
cauaagcuacugaug

SEQ ID NO: 2239272 - RNA, 18 nt, Homo sapiens
ucagauuuugguugcuaa

SEQ ID NO: 2239273 - RNA, 21 nt, Homo sapiens
aggaacguuuagcugacaaaa

SEQ ID NO: 2239274 - RNA, 12 nt, Homo sapiens
ucugagcuucua

SEQ ID NO: 2239275 - RNA, 12 nt, Homo sapiens
caggagcucaga

SEQ ID NO: 2239276 - RNA, 19 nt, Homo sapiens
auuuguagauuaggauuaa

SEQ ID NO: 2239277 - RNA, 14 nt, Homo sapiens
auaaaggcaccucc

SEQ ID NO: 2239278 - RNA, 19 nt, Homo sapiens
agacaucacuugccaaugu

SEQ ID NO: 2239279 - RNA, 19 nt, Homo sapiens
uccaaugaaggaaacauca

SEQ ID NO: 2239280 - RNA, 21 nt, Homo sapiens
ccaacagcacccucuccagau

SEQ ID NO: 2239281 - RNA, 17 nt, Homo sapiens
cagcagcgguaccccag

SEQ ID NO: 2239282 - RNA, 20 nt, Homo sapiens
uuuuuacuaaucuuucugca

SEQ ID NO: 2239283 - RNA, 87 nt, Homo sapiens
aacuccuuuguagucacagugaccuugucugacuuugcaaauucuggggucauuuuaugaucacuguggauugacuacaggugaguu

SEQ ID NO: 2239284 - RNA, 79 nt, Homo sapiens
uagccuccaauuuuuucaccauggucaguuuaguuauaagcccacuggcaauggcagaaauaguugugguaggaggcug

SEQ ID NO: 2239285 - RNA, 58 nt, Homo sapiens
ucauuggaugagaccccuguccugcccuaacagucaggacaagggucuaauccaauga

SEQ ID NO: 2239286 - RNA, 72 nt, Homo sapiens
auauuaucuguuuucugcaaacuagacuugaggaacuuccuugagucaaguuuuuucagagaauaaaaauau

SEQ ID NO: 2239287 - RNA, 82 nt, Homo sapiens
gagacccuuuauuucugucagucaugaaccacuaggcuuaaauggcuuuggacuucuaacugacauggacaaaagaugucuc

SEQ ID NO: 2239288 - RNA, 75 nt, Homo sapiens
ucugugcuaggaugucuuuaaagcuucucggaacuaacuacuuuccuuuaguuaauaaagacaagcucacauagg

SEQ ID NO: 2239289 - RNA, 75 nt, Homo sapiens
uuuugacuuugacagacacaauugauccaugaaauuauaugucuuugaggguuuguuuguuuguuugagacagga

SEQ ID NO: 2239290 - RNA, 58 nt, Homo sapiens
cuauugcaacagaagaaagaguccggcaugaccuggacucaccuucaucugugcagag

SEQ ID NO: 2239291 - RNA, 79 nt, Homo sapiens
aagauggacaauggauggauagaaggaugauggauggaugugugcauaaaugcuuagaucuguauauaugucuaugcuu

SEQ ID NO: 2239292 - RNA, 102 nt, Homo sapiens
cuggauauuuucauuuagauagauaaaugcaaagcaaauaucugauauuugcaaggcgauuuuugcauuaucagauguuugcuuugcaaauauucuucccag

SEQ ID NO: 2239293 - RNA, 130 nt, Homo sapiens
ggauuauuaaguauguuguuuuauuuugaaguguuugcagauuguuuuguuaaugauuucuaguuuaauaccauugugauuggagaacaaacugcauaugauuucauuucuuuuaaauuuguuaagauuu

SEQ ID NO: 2239294 - RNA, 118 nt, Homo sapiens
ccugccccuguucucccccauuccccuagagcuacagcccucacugucccgugaggggaaaaggcauggugacaaugggggcuguagcccuaggagaacgggggagaagaugggcagg

SEQ ID NO: 2239295 - RNA, 73 nt, Homo sapiens
gccugagucacuggacauguugaagcuuuucucaugggcgagaggcuuucuuugugcuccagguggacuaggu

SEQ ID NO: 2239296 - RNA, 89 nt, Homo sapiens
ggagaaucgcuugaacccagguggcagacguugcagugagcugagauugcaccauugcacuccagccugggcaacaaaagugaagcucc

SEQ ID NO: 2239297 - RNA, 61 nt, Homo sapiens
guuagaugaagaccaagggcaaauucacaccucuggggcuugcucugguguuuuauuuaac

SEQ ID NO: 2239298 - RNA, 82 nt, Homo sapiens
aguucuaggguacaugugcacaaugugcagguuuguuacauauguauacacgugccauguuggugugcugcacccauuaacu

SEQ ID NO: 2239299 - RNA, 66 nt, Homo sapiens
aagauccugccauugccccuggcuuccaggaacugaacuggauucugagcaucauggcagaaucuu

SEQ ID NO: 2239300 - RNA, 59 nt, Homo sapiens
acagacugaaugugggugugugaggaaaaagaacacucaggcaagacuuuuagguuugu

SEQ ID NO: 2239301 - RNA, 64 nt, Homo sapiens
ugagguggcuggaaaguuacaaaguaucuggaagugcuuuguguggacauuucaggcagccuca

SEQ ID NO: 2239302 - RNA, 77 nt, Homo sapiens
gaguuauuuauuuuggucuuuuauuuaaagcagcccuaauuuuuagauuguuugaauaacagacaaauuagaagcuc

SEQ ID NO: 2239303 - RNA, 89 nt, Homo sapiens
ugaguaagaaugagugauuagaggaaugguagauuaugguaauauagaagcuagugauuuauaggcuauuagguauucaaaaaagcuca

SEQ ID NO: 2239304 - RNA, 72 nt, Homo sapiens
ggccccauuguccuuucuucuaagccacauugugcucucaaauguccuuggucauggaagagacaggggguc

SEQ ID NO: 2239305 - RNA, 83 nt, Homo sapiens
gcaucuuguagcauuuugggcacuuugcuucugguuucaauuauuugcugcaguagcaugccucagaaugaggcagcagaugc

SEQ ID NO: 2239306 - RNA, 65 nt, Homo sapiens
acuuuguugaaaugaauuaaguguagagucuuguaccacuucaccuucauucauucagcugaagu

SEQ ID NO: 2239307 - RNA, 91 nt, Homo sapiens
uuaccuuuacaccuuuaugccagugauuauaagggccugaaaggaugaauugugccuuuauggcaucuggcaaaauuaagguuggcgguga

SEQ ID NO: 2239308 - RNA, 78 nt, Homo sapiens
agguucaauaacauccuuugguuccaaaacaaggucucuugagccucccuuuguugcaagggaaaagucacugaaccu

SEQ ID NO: 2239309 - RNA, 85 nt, Homo sapiens
gggauggauuuggaguugauaaaaugauaucuucuuuaugaaauagaaguaaggaguaucuguuuucucacccaaguauaguccc

SEQ ID NO: 2239310 - RNA, 74 nt, Homo sapiens
cagaaugagacuaagugacauugugcccauuugagcuuacaccuuaagaggccuugugugcauuuucucuuuug

SEQ ID NO: 2239311 - RNA, 67 nt, Homo sapiens
guuuugguuauauggaucaguucuuuaaugcugauuucugagauucugaugcacccauaaccagagc

SEQ ID NO: 2239312 - RNA, 73 nt, Homo sapiens
gcacuaacguucuuuccuuugaggccaaaaguauuuaaacagaugcuuuugcaggaaaggaagaauguagugc

SEQ ID NO: 2239313 - RNA, 58 nt, Homo sapiens
agcuucauucugaauagguugacuaaacacacauauucaacaaguuacaggaggagcu

SEQ ID NO: 2239314 - RNA, 68 nt, Homo sapiens
cuuuagguucauuuccagcucagcauuuccauuguacggaugagcaaagagaugagacccuguuagag

SEQ ID NO: 2239315 - RNA, 66 nt, Homo sapiens
uagaaugccugguguuggccagaaaucucucccauuagagugacuggcaccauccaggugucucua

SEQ ID NO: 2239316 - RNA, 67 nt, Homo sapiens
gcaaggauagcagccauucuuuuuauuuguuaaaugucuuuuaagugggagaauaucugcuaugugc

SEQ ID NO: 2239317 - RNA, 81 nt, Homo sapiens
ucccaggagaaauggcuguuuaagaguuucauuucauugaguauguaguuagagcacucaauaugccaucauucuguggga

SEQ ID NO: 2239318 - RNA, 91 nt, Homo sapiens
caaaauaaaagacaucacaggcaaaauuccuucucucucucccucuuuuuaacuagggaaggaaaucuugcuugugagcagcugaauuuug

SEQ ID NO: 2239319 - RNA, 67 nt, Homo sapiens
gugagaacugugucuuauaaacguugcugucuuagaauuaaugacgaggccgggcacaguugcucac

SEQ ID NO: 2239320 - RNA, 126 nt, Homo sapiens
uguuacaguccccaacauuauucaguagaauacugaauauaguuaacaguauauuacaguacuacuggcuguacuauacuguaacuguauucaguauucugcugaauacuguaggcaauuauaaca

SEQ ID NO: 2239321 - RNA, 68 nt, Homo sapiens
aaacaagaguuuauauuggcaauccuggggacuuacguuuguggcauuguccaauaaaauuuuuguuu

SEQ ID NO: 2239322 - RNA, 114 nt, Homo sapiens
acaaaguucccucaguguguggguuuuucugugagcgguaaaggucuugggggaggcugugguguccaggucucaguacuugcacagaagaacuugcuauacugcagauuuugu

SEQ ID NO: 2239323 - RNA, 63 nt, Homo sapiens
cuauguguccauguguucucaugauuuagcuuccacuuauaagugagaacaugugguauuugg

SEQ ID NO: 2239324 - RNA, 76 nt, Homo sapiens
gguggcaagaacgaaauguaggguaauagaugaaagaaaagaucuuuaaaauaucuugguuucuuucuugucaacc

SEQ ID NO: 2239325 - RNA, 59 nt, Homo sapiens
gugauugcuuuuacugggagcuuugaaaaaaaguucaaggguuccuaauggucaaucau

SEQ ID NO: 2239326 - RNA, 67 nt, Homo sapiens
gugacuggacucugaagaaaauugaaggccugagcuccgaacagcugccauuuucucucuccaucac

SEQ ID NO: 2239327 - RNA, 69 nt, Homo sapiens
uuccgggucuggcacagggaaaguacaagauaagcucuggugcaucuuauugugccacaaaauaaggaa

SEQ ID NO: 2239328 - RNA, 72 nt, Homo sapiens
uggcagaagaggccugacaauaccuaaggcuauaagaaugccucuaaaugcugcuuuggccucuucucacca

SEQ ID NO: 2239329 - RNA, 57 nt, Homo sapiens
agagcuaguauuuacggagcauggacucugggccaugcagccauagcauuuaguucu

SEQ ID NO: 2239330 - RNA, 56 nt, Homo sapiens
uuugaaugaauggaaagaaggguagauguguuagccuucucugcuauuugaucaaa

SEQ ID NO: 2239331 - RNA, 64 nt, Homo sapiens
uuccucuagacugucgguuucucagacuuuccuuguuuuugauggccuugacaguuuggaggag

SEQ ID NO: 2239332 - RNA, 56 nt, Homo sapiens
uuacccaccuugcucaauggcuaaaacaagcagugccuuuugggcaagguagguga

SEQ ID NO: 2239333 - RNA, 78 nt, Homo sapiens
gcaugauuccaccuauguuauguccagcucacuuugcacgucuucaagguccauugguauuauagcauggauccaugc

SEQ ID NO: 2239334 - RNA, 59 nt, Homo sapiens
agacaucauuugauggugggagcugcuaucugauuugcccugccuccaucagugagucu

SEQ ID NO: 2239335 - RNA, 67 nt, Homo sapiens
uugaagagaguaguggaucuuccauaacggaguuugagaucugagaauggaaagacugccucuucaa

SEQ ID NO: 2239336 - RNA, 71 nt, Homo sapiens
gagcuagugugauucuuugggguuguugaaacacuucauuuuuuauacuaccagaguucuuacacugguuc

SEQ ID NO: 2239337 - RNA, 59 nt, Homo sapiens
ugaaacacaccuccucuccauccuuagugaccccuucauggugaugucgguguguuuua

SEQ ID NO: 2239338 - RNA, 99 nt, Homo sapiens
agcuaucuucuaagcuaagcuaagaagauagcuaagcuucuucuaagcuaagcuaagaagauagcuaagcuucuucuaagcuaagcuaagaagauagcu

SEQ ID NO: 2239339 - RNA, 104 nt, Homo sapiens
augaagagaaaaagaauguuuaucaaucuagggaaacuccaaaaagggaguuuuacuuaauuuggggauugccuauuaguaaaucaauucuaaaucuugguuau

SEQ ID NO: 2239340 - RNA, 89 nt, Homo sapiens
ucugugcaauaggucugaguccucagguuucaucaaagaagauguacaacaaugaggcacucuagacuuauucaagaguagagcacaga

SEQ ID NO: 2239341 - RNA, 60 nt, Homo sapiens
uuuaaaguuagaaggaaagggcuuuuacuucccuuauggccuuccucugaccauuuuaaa

SEQ ID NO: 2239342 - RNA, 68 nt, Homo sapiens
gcaggcagaagaauguggaaaggcuagauugguuuugucuucuggccuacaucauuuuuccgugcugc

SEQ ID NO: 2239343 - RNA, 86 nt, Homo sapiens
guguacaaggcucuaacauugcuggacuaccugcucaagacgggcuccgagcggguggcccaccagugccgcgagaaccucuacac

SEQ ID NO: 2239344 - RNA, 79 nt, Homo sapiens
aggcugaagugcaguggcaagaucuuggcucacugaaaccgccaucucccagguucaagcaauucuucugccucagccu

SEQ ID NO: 2239345 - RNA, 61 nt, Homo sapiens
ucagagcuucuaucaacaauaaguagagucgaucuuuccugcucuuugguacgugcuuuga

SEQ ID NO: 2239346 - RNA, 57 nt, Homo sapiens
gggugcuaugauguaagucuuuggucacuuuagccauauuugcauuauggagcaccc

SEQ ID NO: 2239347 - RNA, 68 nt, Homo sapiens
ggguacaggugcacaacaugcagguuuguuacaaauguauacaugugccauguugguaugcugcaccc

SEQ ID NO: 2239348 - RNA, 84 nt, Homo sapiens
cuugugggcauuuagugcuauaaauuucccucuacacacugcuuugaaugugucacagagauuuugguauguugcaaacacaag

SEQ ID NO: 2239349 - RNA, 58 nt, Homo sapiens
uauugcacuccucaugcauuuggugauccuugacugugugcauuuuugaguugcaaug

SEQ ID NO: 2239350 - RNA, 64 nt, Homo sapiens
gcuugagcuggagaggcagagguugcaguaagccaaaaccguaccauugcacuccagcccgggc

SEQ ID NO: 2239351 - RNA, 60 nt, Homo sapiens
agcugggccccagccagcuaugugauuuugcccaggucauacaguauggagggcccagcu

SEQ ID NO: 2239352 - RNA, 67 nt, Homo sapiens
acagaauucauugcuuauuuguugguggagaaaauccuccacacauuuggucgcagaugucuucugu

SEQ ID NO: 2239353 - RNA, 66 nt, Homo sapiens
gccaauuuuuuaaaucucuggaacagguuaaaugcuuccugauuuaugguuuucugggagauuggc

SEQ ID NO: 2239354 - RNA, 61 nt, Homo sapiens
cuggaagguaauugucagcucauagcuuaagcugugggacuguucauuugccuugacccag

SEQ ID NO: 2239355 - RNA, 78 nt, Homo sapiens
gcuuacucugugcuaggcaaugugguagauauuugaaauacaaacgugaaccaggcacauuuccuacacauggcaagc

SEQ ID NO: 2239356 - RNA, 130 nt, Homo sapiens
aauuuaauuauauaauacuuguuuauucaucagcaauauuuaagauguaugugagcuagaaaaauuuaauuauggaucuuugauuagacugauggauaauauuuucuuuuuuuuuauuauacuuuaaauu

SEQ ID NO: 2239357 - RNA, 129 nt, Homo sapiens
ucuuccauggcggcgacaagagaaaaugagguagaaguaaaaguggaaacccaggauaaacccuugagauuuaucugggguuuccacuuuuacuucuaccucauuuccucuugcugcugccauguaaga

SEQ ID NO: 2239358 - RNA, 130 nt, Homo sapiens
agggacguuuaagucugcagaagcucucugcugccuuuuguucagauaugccuugcccccagagguggaaucuagagaggcaguaggccuuacgaagcugcugugggcuccaccuaguuugagcuucccu

SEQ ID NO: 2239359 - RNA, 57 nt, Homo sapiens
auggcacuguguauuuuucuguuggguaucaguuuccaguaaaauacacaaugucau

SEQ ID NO: 2239360 - RNA, 79 nt, Homo sapiens
uggccauuuucauuuuucccuggacagccuugccugggguacugccugcugccggugaggguugcuaggaaaccggcca

SEQ ID NO: 2239361 - RNA, 68 nt, Homo sapiens
aacuuuaccugucacugucaacucugaguaugccucuggcugagacuugacaguugggcagggaaguu

SEQ ID NO: 2239362 - RNA, 104 nt, Homo sapiens
uugaggcaggagaaucgcuugaacccgggaggcggagguugcagugagccgagaucgugccauugcacuccagccuagccaacaagagcgaaacuccgucucaa

SEQ ID NO: 2239363 - RNA, 129 nt, Homo sapiens
ccaccaacugucagauccguggcagcauuagauucucauaggagugugaacccuguuuugaacugugcaugcggggcaucuagguugcaugcuccuuaugagaaucuaaugccugaugaucugaggugg

SEQ ID NO: 2239364 - RNA, 60 nt, Homo sapiens
ccugaagccaugccucggacuggccccguccugggcuuggucccguguucuggcuuuagg

SEQ ID NO: 2239365 - RNA, 82 nt, Homo sapiens
aucaccugagaucuuauuagaaaugcagaaucgcagacuuguggaaucagaaucugcacuacuaacaagguccucagcugau

SEQ ID NO: 2239366 - RNA, 106 nt, Homo sapiens
ucuuuugccuccccucuuuaaaugaaagcacacuuggauaggauucagauauauggauuguguuugauaaguccauaguuguucuuuuuuaaacagugguuaagga

SEQ ID NO: 2239367 - RNA, 58 nt, Homo sapiens
gugcacaacaugcagguuuguuacauauguauacaugugacauguugguguucugcac

SEQ ID NO: 2239368 - RNA, 77 nt, Homo sapiens
cguuagccuuccucugauuuacauucaacucugaucccugggccuuagguuugacauggagguggaggaagauagcg

SEQ ID NO: 2239369 - RNA, 92 nt, Homo sapiens
uuugucacccagacuggaguguagcggcaccuauuagucuuccaucucccuuuugcuaauaguaacugguugcucuucuuguuggucacaga

SEQ ID NO: 2239370 - RNA, 74 nt, Homo sapiens
gaacucacucuuaagaccucugggggccucaguguucucuuuuguaaaaugaggagguguugagaugaaaguuc

SEQ ID NO: 2239371 - RNA, 69 nt, Homo sapiens
gcuaagauuucagcuugauguuauuaguuaucauguuaaugauaacagauaaugucaguuaucaugggc

SEQ ID NO: 2239372 - RNA, 62 nt, Homo sapiens
uauuccuauguguuuccuauaggcuaguggaagaauugcccuacuguuuauacauaggaaug

SEQ ID NO: 2239373 - RNA, 62 nt, Homo sapiens
uaucucagggauauucugcuaugaacggaauguaguugugaaugguacugucucuggagaua

SEQ ID NO: 2239374 - RNA, 118 nt, Homo sapiens
cucugugauauuaggaguuauaucucccuaggauauuacaaaucauaucacaggguguacacccacugugguauuagguguaguaucucccuaggauauaacaaauaauaucacaggg

SEQ ID NO: 2239375 - RNA, 69 nt, Homo sapiens
uuuuuucugagguuauauucucucaaguguaucaacuuacuuggccaguaauauguaccuaagggaaag

SEQ ID NO: 2239376 - RNA, 67 nt, Homo sapiens
uugaggaggcagucuucccauucucagaucuccagcugcguacugggagaaccacugcucucuucaa

SEQ ID NO: 2239377 - RNA, 72 nt, Homo sapiens
uaggaaggacuuagucuuacaacuugggugucggcuccaccacaguagaauagagcacuaggucgaauccua

SEQ ID NO: 2239378 - RNA, 88 nt, Homo sapiens
ggcuguauggaaauaguaguguaaaucaaucuguugucuuaguuuuugaggugacaagguggauuuacuuauaacacuuucuccagcc

SEQ ID NO: 2239379 - RNA, 62 nt, Homo sapiens
gucugacacagugauuaguaaauuaauucaacaaauuauugagcaucuacuguguuccagac

SEQ ID NO: 2239380 - RNA, 74 nt, Homo sapiens
aaugccacuuuauuucuucauguuggauuuguuucacuggaacacuguuuuguggagaauguagaugagguguu

SEQ ID NO: 2239381 - RNA, 72 nt, Homo sapiens
agggggccaagugcuuaaaauuucauuuuggagcuuacccgauuguaaauuagaaagcauugucaucucccu

SEQ ID NO: 2239382 - RNA, 108 nt, Homo sapiens
acuuccacuggacuugagccauuguccuccuggggcuauuuaucauagcaguuuagucuagaauaaucccagaggauagauagccagcaaguauuuuuagugggaagu

SEQ ID NO: 2239383 - RNA, 101 nt, Homo sapiens
aguuuuaaaaucauguauuucacaguaaauccagaagaaauuaugcacuuaauuuuucugggugaauuguguuauagagguaauagaggauuauuaaaauu

SEQ ID NO: 2239384 - RNA, 76 nt, Homo sapiens
uugcuugaacccaggagauggagguuguggugagccaagaucacgcuacugcacuccagccugggugaagaagcaa

SEQ ID NO: 2239385 - RNA, 129 nt, Homo sapiens
cauuguugacauuuugagcugggggugggagggcuguccugugcauuguaggguaauuaacaguguccugggauuguacccacuagaugccaguggcacccccuuccccaguuucaacaaccaaaaaug

SEQ ID NO: 2239386 - RNA, 82 nt, Homo sapiens
guuguuguuguuguuguugagacagggucuuacucugucacccaugcuggagugucccaaucucagcucagcucacugcagc

SEQ ID NO: 2239387 - RNA, 60 nt, Homo sapiens
ucuaaucuugauuuugcuaugcaaaucaggauuagauuugcauagcaaaauaggauuaga

SEQ ID NO: 2239388 - RNA, 106 nt, Homo sapiens
uaugcguauacacacacgugcauguaugcguauacacacacgugcauguaugcguauacacacacgugcauguaugcguauacacacacgugcauguaugcguaua

SEQ ID NO: 2239389 - RNA, 58 nt, Homo sapiens
gucacuggcugucuuguaugauuuaacugacaguucuuuauccaugcaguacagugac

SEQ ID NO: 2239390 - RNA, 76 nt, Homo sapiens
guccucguuaugccuuugaccauuuugugacguggaaauaugauucucaucagauggcaauggcauguucuuggac

SEQ ID NO: 2239391 - RNA, 69 nt, Homo sapiens
ugcuucagacugcagauuuugaugaauguggaaaaauuuucuuggagcucuuagggucguuuuggagca

SEQ ID NO: 2239392 - RNA, 94 nt, Homo sapiens
agagagucgcuugaacccgggaggcugagaggucgcagugggccaagauugcaucacugcgcuucagccugggugacagagcaagacuucaucu

SEQ ID NO: 2239393 - RNA, 60 nt, Homo sapiens
ucuaggggcuuaaauaacugucuauaaguauucuugaggaaguaauuuuaggccuguaga

SEQ ID NO: 2239394 - RNA, 75 nt, Homo sapiens
ggaagcagagcagauggucuucauaaguuuuaagcaaaggugcuaagaaaacacaaaguuuacuuuucuacuucc

SEQ ID NO: 2239395 - RNA, 72 nt, Homo sapiens
gggagaggagaaaggcaauuuguugugaggauuuucauccugaaagccuuuaaugaauuguucuuugcuccc

SEQ ID NO: 2239396 - RNA, 73 nt, Homo sapiens
cgaagcuggauuuaguguggagcaaaauuucauauacaugcuugcacugcugcacacuauguuuacuguuuug

SEQ ID NO: 2239397 - RNA, 69 nt, Homo sapiens
cugugaacauuuuguauauauuauucugcaauuccauuaauagguaaaaugugcaaacauguucuauag

SEQ ID NO: 2239398 - RNA, 60 nt, Homo sapiens
gucacugagaagguuaguuugucuuucacagcagggcuauuaguaaaaauucucagugau

SEQ ID NO: 2239399 - RNA, 117 nt, Homo sapiens
ucaguuuccauguaauugagcgguuuuaagugaguuucuuaauccugaguucuaguuugauugcacuguggucugagagacaguuuguuaaaauuucuguucuuuuacauuugcuga

SEQ ID NO: 2239400 - RNA, 94 nt, Homo sapiens
uugugcuugcgauaguuuacugagaaugaugauuuccaauuucauccaugucccuacaaaggacaugaacucaucauuuuuuauggcugcauag

SEQ ID NO: 2239401 - RNA, 89 nt, Homo sapiens
auagacacacuuugaucuuugacauuguccuacuaggguuccagugauuuuccauugucugccacugaggacagccagagcaugucugu

SEQ ID NO: 2239402 - RNA, 70 nt, Homo sapiens
agacaaauggacugugauauuuacauguacacaguacagggaaacauguaacuaucugagccaugggucu

SEQ ID NO: 2239403 - RNA, 86 nt, Homo sapiens
gguguuggccacagaagugcuuauauauauauaucucauauauauaugagauauauauauuugagacagagucuggcugugucacc

SEQ ID NO: 2239404 - RNA, 96 nt, Homo sapiens
gaccauaaauacuuaagcaaagguaacaugagaacaaugagaacaaaccacaugaaccuuuucgaaaguugcuuuugucacucaguauuauguguu

SEQ ID NO: 2239405 - RNA, 93 nt, Homo sapiens
guguucuaccaccuuucuuuuucuugcaugcuuggguaggaaaaaaaucauuggcuaaguuaaucaaggagaucugaaaaccaagguaaauau

SEQ ID NO: 2239406 - RNA, 74 nt, Homo sapiens
ggaagaugguaaaguagaaaaagacuaccuuugauguauguuaauuaguugaaagucugcuuuucuuuucuuuc

SEQ ID NO: 2239407 - RNA, 64 nt, Homo sapiens
auagaauagcauuacuuggugucuauggacauuuucugcccccagcaccagugcaugcuacuau

SEQ ID NO: 2239408 - RNA, 67 nt, Homo sapiens
ucaucuuaucccaguaaaaauggcuucuauccaaaagauaggaaauaacaaaugcuggugaggauga

SEQ ID NO: 2239409 - RNA, 68 nt, Homo sapiens
cuuuggaaugcaacagaaggauaauggcuguuucugcuauuacccagaaguaauguuguauuauaaag

SEQ ID NO: 2239410 - RNA, 91 nt, Homo sapiens
aaucuauccuggagaaucuucuaugugcaguuaugaagaaugcauagucuauagcuguugaauggaauauucuguaaccaucucuuagguu

SEQ ID NO: 2239411 - RNA, 89 nt, Homo sapiens
caggcucccuggucugaauguuuauauuggccaaaagggauguucagaguucuuauuguccaauaggauguuccugcagauggugccug

SEQ ID NO: 2239412 - RNA, 104 nt, Homo sapiens
ggcaggucuuugcugcacuguucuugugguagugaaugagucucaugaggucugaugguuuuaaaaaugggaguuucucugcacaaaaucuugcuuugccugcc

SEQ ID NO: 2239413 - RNA, 63 nt, Homo sapiens
gcccugcaucuguuacuaggaaggggaggguguggaggagcucuucuuggggcagggcagggu

SEQ ID NO: 2239414 - RNA, 85 nt, Homo sapiens
ccgcgcccagccggacucugggauuuaaagauaaccaagugaaaauagguucauccucuuugacucacagccuggcugccugugg

SEQ ID NO: 2239415 - RNA, 85 nt, Homo sapiens
cuuaucuuuggcauguuuaguagaauguggugaucauuuugaauugaucugagccccgugcuucuaguaaacaguaacagguaag

SEQ ID NO: 2239416 - RNA, 55 nt, Homo sapiens
acucuaacagccaagacaugaaaauauucuaauuuucuuugcucaguguuagagu

SEQ ID NO: 2239417 - RNA, 60 nt, Homo sapiens
ggcccugaaguguauaagcuaaaaugccuaugcuaauuagcaccacacacuuuagaggcu

SEQ ID NO: 2239418 - RNA, 129 nt, Homo sapiens
uuaaaguaaauguggcagaaugaaaguuaagcauagaaucuguuagguuaaggaauggcaaaaaccgcaauuacuuuuguuccaaccuaauagaugauggguauagcauuuuuugaacaauucuuuugg

SEQ ID NO: 2239419 - RNA, 77 nt, Homo sapiens
uuucaaagguguuuuacaacugucuuacugguuauuggaaacaauucuucaaugacuuagaucauuuguaauugaaa

SEQ ID NO: 2239420 - RNA, 100 nt, Homo sapiens
gaggcaggagaaucgcuuuaacccuggaggcggagguugcagugagcugagaucaugcuauuguacuccagccuaggcaacaagagugaaacucugucuc

SEQ ID NO: 2239421 - RNA, 64 nt, Homo sapiens
uucaguuugccaguauuuuauugaggauuuuugcaucaauguucaucagggauauuggccugaa

SEQ ID NO: 2239422 - RNA, 68 nt, Homo sapiens
accucucuuuggaugccuuaggguuagaggaugccccuaacuuugggcagcaucccaaaguuagaggu

SEQ ID NO: 2239423 - RNA, 79 nt, Homo sapiens
gcugagaagagcugcugcagcuccaggccuauccuguuagguuagcaacaucagcagcaggaaaaugcuuuucucaagc

SEQ ID NO: 2239424 - RNA, 65 nt, Homo sapiens
ggggaccggcagggaguaaggguuaggugcuuguagucuugcuacccuucgucucucugguucuc

SEQ ID NO: 2239425 - RNA, 93 nt, Homo sapiens
gaugugaggcuugcuggugagaacauggagaaccccccaauacccaugaguacugggaauguuggccauguuuugaacuaguuucuuuucauc

SEQ ID NO: 2239426 - RNA, 97 nt, Homo sapiens
gaggaggagaaucgcuugaacccgggaggcggagguugcagugagccgagaucgcgccacugcacuccagucugacgacagagcgagacucggucuc

SEQ ID NO: 2239427 - RNA, 64 nt, Homo sapiens
gcucaggaucacagccagcucccagaagugccucagcaauuucuggcugguuggugaucacagc

SEQ ID NO: 2239428 - RNA, 81 nt, Homo sapiens
guucaucacucuuuauugcugaguaguauuucauuguauggcuauaccauauuuuguuuaucugcucaccaguugaugaac

SEQ ID NO: 2239429 - RNA, 83 nt, Homo sapiens
auaauaucacagggagugugcacacaugguauacagucccugcgacaugguguacacaugguguacacucccugugauauugu

SEQ ID NO: 2239430 - RNA, 88 nt, Homo sapiens
gaaauuuuccugucuuagaauuucccucauguuuauugacaauggaaugggauuggaaauuuugcagaucugacuaaggaugaguuuu

SEQ ID NO: 2239431 - RNA, 60 nt, Homo sapiens
guggguauucguuguagccauuuucuuuuccuagucaagguuuggacagugauuauccau

SEQ ID NO: 2239432 - RNA, 93 nt, Homo sapiens
cuuguuaaaaaugcauauuccugggccucacucuaaaucuguugaaccuagaguuccugggagauggggacuaggaaucugcaauuuaacaag

SEQ ID NO: 2239433 - RNA, 64 nt, Homo sapiens
auugugaauagugcugcaauaaacauacguguguaugugucuuuaaagcagcauaauuuauaau

SEQ ID NO: 2239434 - RNA, 59 nt, Homo sapiens
gugagcaaacuuaccuaagguuguauuaauaguaagugguagagcuugaguuuguucac

SEQ ID NO: 2239435 - RNA, 63 nt, Homo sapiens
auguugaaccagccuuguauuccuggaaugaauccuaccuggaaugaaaccugguuaugauau

SEQ ID NO: 2239436 - RNA, 63 nt, Homo sapiens
cuggauucaccaccugcugauuguagagcccuugggccuagggugaacauaggugguaaccag

SEQ ID NO: 2239437 - RNA, 70 nt, Homo sapiens
uaugcaccaauucuauaauuuauccucacucucugucgguaggguaguaggcuugggauugguccgcgua

SEQ ID NO: 2239438 - RNA, 65 nt, Homo sapiens
ugagaauguaucauagucacuuccaguuugggcuaucacaaaugaaacugcuaugaacauucuca

SEQ ID NO: 2239439 - RNA, 64 nt, Homo sapiens
uguguguguguggacaggcaggguggggagggauaaacacauuaaaaauguccaaauaaauaca

SEQ ID NO: 2239440 - RNA, 59 nt, Homo sapiens
cagcugugggauaggugagugagaguacuugcccuucaacauucaucaguccucagcug

SEQ ID NO: 2239441 - RNA, 78 nt, Homo sapiens
guucucuuuguucccuuuuuauaaugaagcaagaugauaaugaucacugggucaaaguagaaaacuaacaaacagaau

SEQ ID NO: 2239442 - RNA, 85 nt, Homo sapiens
gggaaggugguuucuaugucacuggacauaaguucugagagucaauuugagaacucauucgugaacgugcuuugcucccucuccc

SEQ ID NO: 2239443 - RNA, 100 nt, Homo sapiens
ucccuaaaaacagaaugugucaacuauguuaauaaguuucauuauuuaugguaacaaugacccugauuggcaaguugcaccucggacuguggacuagggg

SEQ ID NO: 2239444 - RNA, 81 nt, Homo sapiens
gugucaguagaaaagacaguuuuuucaacaaauggugcuggaacaacuggcaugcacaugugaaaaaaugaaucuagacac

SEQ ID NO: 2239445 - RNA, 61 nt, Homo sapiens
uagaaucacaguggucagguauagauugaaguagcaguuuacugaacugauuguggcuuua

SEQ ID NO: 2239446 - RNA, 71 nt, Homo sapiens
gccaggcaacauuuaccucaaucuugcugaagagcccuugggcuuaaagcgaauauuggugguauccuggc

SEQ ID NO: 2239447 - RNA, 60 nt, Homo sapiens
uucaauaaaugucacuuuuugcuaguguucuugucugguaggcaagguguuauuauugaa

SEQ ID NO: 2239448 - RNA, 55 nt, Homo sapiens
uggcgcaaggccugugacacuguauugucagcagcugucauuaagcacugugcca

SEQ ID NO: 2239449 - RNA, 64 nt, Homo sapiens
auuuagcuacaucaaauauugucauguaucacauuauaauuacaguauguggauguggcuaagu

SEQ ID NO: 2239450 - RNA, 65 nt, Homo sapiens
uccuuugccauuuucccgucgcuugaagcugauugaggcaucagugaacgaggaggaggguggga

SEQ ID NO: 2239451 - RNA, 116 nt, Homo sapiens
ucugaauacuuaauaggcucaauuggaagcuagugaaguuuuaaucaguuguccauuuaggaccccucaucagcaccaguucauagggccugucugaaauauucuuagguagcaga

SEQ ID NO: 2239452 - RNA, 69 nt, Homo sapiens
uauguguuacaaauauuuugucccauucuguggcuugucuuuucaugguacaguauguuuggaugcaua

SEQ ID NO: 2239453 - RNA, 84 nt, Homo sapiens
uauuagguugguggaaaaguaguugcgguuuuugccauuaaaaguaaugaccaaaaucgcaauuauuuuugcaccaacuuaaua

SEQ ID NO: 2239454 - RNA, 60 nt, Homo sapiens
uugugaauagugccacaauaaacaugugugcaugugucuuuauaguggcaugauuuauaa

SEQ ID NO: 2239455 - RNA, 76 nt, Homo sapiens
cuggggagggucugugguuccuaugucaccuucugugcuuaggaugugcaucugaccaugguacccacucccccag

SEQ ID NO: 2239456 - RNA, 85 nt, Homo sapiens
cagggacuuuaaagcacuggagucaucaucuagugaugcugcuuugagcuguuagaaacgaugcuagaguuuuauuaagucucug

SEQ ID NO: 2239457 - RNA, 86 nt, Homo sapiens
uucucagcugcuuuuuuguuguuguuguuuguuuguuuguaaaagaaaauaaucuggacauuaacugcaagauagaugccugagaa

SEQ ID NO: 2239458 - RNA, 86 nt, Homo sapiens
uuccauauaguauucuuauaauuacaaaauaaaaccagagagcaacuuagugguuuuguacuugaagaaucuuuauguugauggaa

SEQ ID NO: 2239459 - RNA, 87 nt, Homo sapiens
ccagcaccguggagcgagacgggguauuucuaauggagcaaugccucacugucuuuggagacaaccccagucucgcuuaggaguugg

SEQ ID NO: 2239460 - RNA, 62 nt, Homo sapiens
gucugggaggacauggcucggggaaguggcuucugaauguaagagcugguguacugccgggc

SEQ ID NO: 2239461 - RNA, 59 nt, Homo sapiens
caguguuuuuacaagcacucugggugauucugauaaauccagaaauuugagaaccacug

SEQ ID NO: 2239462 - RNA, 55 nt, Homo sapiens
accauuaugcuguuugugcugugcagaagucuuaguacaguaccuggcaugaggu

SEQ ID NO: 2239463 - RNA, 74 nt, Homo sapiens
uguauaaucuuaguuuagauuagcaauucgggaucucuuuuucccugaauucuaaccauuaagccaagcaagca

SEQ ID NO: 2239464 - RNA, 91 nt, Homo sapiens
cugcuguuuucuucugaaauguaaguugucuagucuuccguucacagggcuuuaagaaagcacagcuuagguuucaaugauuuucaguuag

SEQ ID NO: 2239465 - RNA, 71 nt, Homo sapiens
ggggucuuuugguacuagcugaucgcagagauuccuuccccaucucuugagcccucgcuaguccauucucc

SEQ ID NO: 2239466 - RNA, 93 nt, Homo sapiens
guccuagcugugcugcccuuuuuccaucuguaaauuuuuggcuauugaaaacaugucucaagaugguagaugggaauagguuuucagaaggau

SEQ ID NO: 2239467 - RNA, 59 nt, Homo sapiens
gcuacuuggaauacuuguuaaaguccagaauucuggcacccucgagauucuaauuuagc

SEQ ID NO: 2239468 - RNA, 117 nt, Homo sapiens
cauaaaggacaugaucucauugcuuuuuaucagugcauaguauuuaaugauguauauguaucauauuuucuuuauccagucugucacugaugggcauuccauguauuugcuauugug

SEQ ID NO: 2239469 - RNA, 60 nt, Homo sapiens
ccuugucacugaguggaaugaaacaagcauuaaaaacuguuuaauuuucucagugugagg

SEQ ID NO: 2239470 - RNA, 73 nt, Homo sapiens
uuucuucaggccacaaaaauggucaaggcaauaacaagaccgcuguguacaacuauuaauguggcugaagaga

SEQ ID NO: 2239471 - RNA, 56 nt, Homo sapiens
uccauguuguugcaaaugauguugacuguugugaauagugcugcaauaaccauggg

SEQ ID NO: 2239472 - RNA, 111 nt, Homo sapiens
auauaauuuuguuuaaauugguaauucagugucugcauucuuauuguuagguaacugucuucacagcuaagccauguaagauacaguuuacuaagggaaauaguuuugugu

SEQ ID NO: 2239473 - RNA, 76 nt, Homo sapiens
uaguacuaauauaauagcaguguuacuaggacugauaccauuaguuauaguacuaguacugcuugcaguaguacua

SEQ ID NO: 2239474 - RNA, 122 nt, Homo sapiens
aaagacaaauguuguauuauuccacuuuucuaaggcaccuagagucaucaaaucuauagagacagacuggacaaugguggcuaccagguccuggggaggguggugauuggggaguuguuuuu

SEQ ID NO: 2239475 - RNA, 82 nt, Homo sapiens
uacugguuugaguucuuuguagauucuguguauuaguccuuugucagaugcagacuuugcaaagauuuucuccugcucugug

SEQ ID NO: 2239476 - RNA, 58 nt, Homo sapiens
uacaguggaauguaggguuugagguggggaaauccguugugauccucccuucccugua

SEQ ID NO: 2239477 - RNA, 80 nt, Homo sapiens
gugacggucucaaguaguaacaguaguaacuguugaaaugacagucucaaguaguaacuaacugugacagcuugccacac

SEQ ID NO: 2239478 - RNA, 55 nt, Homo sapiens
uugagacggagucucgcucucuagcccaggcuggagugcaguggcuccaucucag

SEQ ID NO: 2239479 - RNA, 57 nt, Homo sapiens
ccaggaggucgagguugcggugagcugagauggugccacugcacuucagccugcugg

SEQ ID NO: 2239480 - RNA, 58 nt, Homo sapiens
cuggaaagcaaagggugcauugggacacagccuacucauguuccuuuugccuuucuag

SEQ ID NO: 2239481 - RNA, 92 nt, Homo sapiens
gcauugguuagagauaggcugguacugagaaauuuauaacauugcuaguuaauuuauacuggcaaauucuuguaugccuacuuaauauuugc

SEQ ID NO: 2239482 - RNA, 105 nt, Homo sapiens
ugauuuuuguacauuaauuuuguaaccugaaacuuuacugaagucaguuaucagauucaggagcccuuugguggagucuuuagguuccuuuuagguauagaauca

SEQ ID NO: 2239483 - RNA, 57 nt, Homo sapiens
cuauggcuguagucccuguguaagaugaugguggcuuggacagggugucagccaugg

SEQ ID NO: 2239484 - RNA, 88 nt, Homo sapiens
ggaggguacuguucuauaugcauugugggguacugaguauuauccuuugucuccacucacuacuuaccaguagcauaacucucucucc

SEQ ID NO: 2239485 - RNA, 75 nt, Homo sapiens
uaaagccaggauauaucuugggcuuuuaaggcuaauaaauucccuccuuaggcuaguugauauaguuuggcuuug

SEQ ID NO: 2239486 - RNA, 74 nt, Homo sapiens
ugguagcuauuagguuguugccauugaaaguaauggcaaaaccgcaauuacuuuuucaccaaccuaauauacca

SEQ ID NO: 2239487 - RNA, 119 nt, Homo sapiens
auuucaugcuugacuagaacucccacugcaaugucgaauagagaugauaagagugggccucuuuaucuuauuccugaucuugaaggaaaguuucagucuuucacuauugaguaugaaau

SEQ ID NO: 2239488 - RNA, 66 nt, Homo sapiens
cugacaagauucaucacucaguuuucugggacaacugaaauuggaauggaguauggauuuggucag

SEQ ID NO: 2239489 - RNA, 78 nt, Homo sapiens
gucacuucauuggauguuacacugugugacugcauuaccgaaaaugacugcacacaucguguagauccaaggauuggc

SEQ ID NO: 2239490 - RNA, 63 nt, Homo sapiens
cauuaccaacacauggucucagacuucuggccuccagaacugugagauaauauguuucugaug

SEQ ID NO: 2239491 - RNA, 72 nt, Homo sapiens
uuaucucacaugaauugucuuguuccagagggcuauugccuguggaugcaguggacauuuuauuuuagauga

SEQ ID NO: 2239492 - RNA, 65 nt, Homo sapiens
ugaggaggcagccuaucccuuagcagagcucaagcacugugcuaggugauccacugcucucuuca

SEQ ID NO: 2239493 - RNA, 101 nt, Homo sapiens
ugaggcaugagaaccacuugaacccaggaggagaaugcugcaaugagcugagaucacgccauugcacuccagccugggugacagagugagacucugucuca

SEQ ID NO: 2239494 - RNA, 62 nt, Homo sapiens
guuugcauaagugcauucugugauguucacacgaugaaaucacgugaugcauuugucagaac

SEQ ID NO: 2239495 - RNA, 55 nt, Homo sapiens
cagcuggugcugcaccagugggauccugcccacuccacugcugcugcuccagcug

SEQ ID NO: 2239496 - RNA, 99 nt, Homo sapiens
gaggcaggaguaucgcuugaaccuggaggcggagguugcaaugggcugagaucacgccauuguacuccagccugggcaaaaagagcaaaacucugucuc

SEQ ID NO: 2239497 - RNA, 64 nt, Homo sapiens
aaaccaugccuggcuucauguagauacacugagauguaggugucaugaaggcaggugugaguuu

SEQ ID NO: 2239498 - RNA, 70 nt, Homo sapiens
ggcuggagugcaguggcucaaaaugccucccagagugcugaaauucaggcaugagccgcugcacccgguc

SEQ ID NO: 2239499 - RNA, 65 nt, Homo sapiens
acaaugaacacacaaggaauucucguccagacaaagaugaauggauucaucuguuuguucgcugu

SEQ ID NO: 2239500 - RNA, 70 nt, Homo sapiens
uuagcggguuuuagauuucuccuguguaaugucaaacagcccaaaauaagagaauccaaaacaccguuga

SEQ ID NO: 2239501 - RNA, 95 nt, Homo sapiens
gucaagcauuagauucucauaaggaacgcacaaccuagucccucacaugugcaguucacaauaggguuugugcuccuaugagaaucuaauguggc

SEQ ID NO: 2239502 - RNA, 108 nt, Homo sapiens
ccagcuuuccaucucugcugugacugcagggcauauuugucacauucuucucugcuuauuuuguguuuuacagcaagauucucugcagucauugccauggggagcugg

SEQ ID NO: 2239503 - RNA, 77 nt, Homo sapiens
ggcuguauuacugagugugacaaauacgucggaagggccccgcucuggaugauuguucucacucaagagagaaagcc

SEQ ID NO: 2239504 - RNA, 86 nt, Homo sapiens
ugcaugugggguuuaaaaccuagaugacugguugaugggugcagcaaaccaccauggcacauauauaucuagguaacaaacaugca

SEQ ID NO: 2239505 - RNA, 64 nt, Homo sapiens
uguguugcauaauaagagggauacguucuaagaaaugcgucuuugucauugugcaaacaucaca

SEQ ID NO: 2239506 - RNA, 65 nt, Homo sapiens
ugugcccuuugugucuggcugggguggaaagccaugcugccauccacagucagaacgggccuaca

SEQ ID NO: 2239507 - RNA, 67 nt, Homo sapiens
uugaggaggcagucugcccauucucauaucuucagcuguguguugggagaaccacugcucucuucaa

SEQ ID NO: 2239508 - RNA, 58 nt, Homo sapiens
aggugcuugagggaagaaauuaugcaucuuauucaucuucauuuucccuucagcaccu

SEQ ID NO: 2239509 - RNA, 67 nt, Homo sapiens
agguaagaguugauguugcagucuugaggagaauuccuucuccuucagaaaaccucagucuuugccu

SEQ ID NO: 2239510 - RNA, 80 nt, Homo sapiens
cucugcuagggcagugcagaagggaaaugugggguuggagccuccauacagagucccuacuggggcacugccuaguggag

SEQ ID NO: 2239511 - RNA, 82 nt, Homo sapiens
agaugaucugucuaguaaggaugagcugcacuuugccuuuuuuucaagcaaggauaauucacuucuuuuaggcagggaauuu

SEQ ID NO: 2239512 - RNA, 90 nt, Homo sapiens
uccauggcaguugucacuuuggcuuuuacugucaugauguugagguucaugagguaguagaaagucaggugaagcacacugucaucugga

SEQ ID NO: 2239513 - RNA, 73 nt, Homo sapiens
aggcuggagugcaguggugcgaucuuggcucacugcaaguucugccuccuggguucgcgccauucuccugccu

SEQ ID NO: 2239514 - RNA, 97 nt, Homo sapiens
guuaucaugauugacugagauucuucaauauuuauucucgagguggaauaaaccuugagaugggauaaagggggaucuccuuugaugaaugcauagc

SEQ ID NO: 2239515 - RNA, 77 nt, Homo sapiens
cuugcucuaucaccagguuggagugcaguggugagaucuuggucggcucacugcaaccuccgccucccggguucaag

SEQ ID NO: 2239516 - RNA, 129 nt, Homo sapiens
gacacuauuuuaaauauaguagccaugaaaagugauggcuacugauuaaauauaguagcugaugaccuacugauuaaauauaguagccguggaaaaugauggcuauuuaacugauuuaaauaugguauc

SEQ ID NO: 2239517 - RNA, 60 nt, Homo sapiens
cccuucauucaaggguugugagucuguaaacuggcucaagccugggaauugauugaaggg

SEQ ID NO: 2239518 - RNA, 83 nt, Homo sapiens
auuuuuaguagagauggggcacaugccaccacaccuggcuaaugccaccaccccuggcuaauguuuguauuuuuaguagagau

SEQ ID NO: 2239519 - RNA, 82 nt, Homo sapiens
aagagggugagguuuucauugguacaaauagacagcaucauguauaugagauguuuguuucagugccuuaaaucacuuuuuu

SEQ ID NO: 2239520 - RNA, 95 nt, Homo sapiens
aaauuuuuguagaucuuucuuauuugauugacuuuagcaggaccauuuagguuccuuuauuagugcaagucaaaucuagaggcauuuaagaauuu

SEQ ID NO: 2239521 - RNA, 115 nt, Homo sapiens
acagaguucugcaucaauucuauuucuacuuuucauuuuuguagaugcaagcacagaaaagccuuguuugaagacuacugggagugaaagaaguuuaauuacggcaguuuuaugu

SEQ ID NO: 2239522 - RNA, 56 nt, Homo sapiens
uugcauuguacuugguacggcugagggaagucuguugcccagcucuugcaaugcag

SEQ ID NO: 2239523 - RNA, 88 nt, Homo sapiens
ggccuuuacaugcacaaggaugcugggacagagcugcugucugugguguuuccaguucucugucacugaaucccugucacucagggcc

SEQ ID NO: 2239524 - RNA, 58 nt, Homo sapiens
uuagcaugucuacuaauuugcuguuugugugccagacaugguaaaugauacaugcuga

SEQ ID NO: 2239525 - RNA, 106 nt, Homo sapiens
aggauugagaagacugcagaugugaaggagaaaaaaauucaacuucaucugaacugaauuguuucauucuuuacauuacagccaucaacauuaucaacuuuauccu

SEQ ID NO: 2239526 - RNA, 57 nt, Homo sapiens
gggggugguucuaaguccuauauggucacugcaugaggcuaagaugacuccaccccc

SEQ ID NO: 2239527 - RNA, 129 nt, Homo sapiens
ugaaaucaugcuaggaggaaguugugaagcaaaaggcuauaugugggugccucauaaaucaucuggugggugccuuauaacacccacauauagucuuuugcaucacaacuuccucuuagcaugauuuca

SEQ ID NO: 2239528 - RNA, 58 nt, Homo sapiens
cuauuugcugggguucaugaucaucuccuagaggaugucacagguccuagccaagugg

SEQ ID NO: 2239529 - RNA, 74 nt, Homo sapiens
agugggauauguagauuuuuaucuugaaccaauuuuuaaagcuuuauuaagguauaauuuacauguuauaaacu

SEQ ID NO: 2239530 - RNA, 67 nt, Homo sapiens
guagaagcacagggccuguauuucuaauaucaccaguguuaccauucugcuggcccaugaauucuac

SEQ ID NO: 2239531 - RNA, 128 nt, Homo sapiens
cacguguguauguguacauauguguauaugugugcaugagcaugucugugcaugucuauauacauguauaugaacgugugcauauaagcagguguaugugugugcauguguguuuauauguguaugug

SEQ ID NO: 2239532 - RNA, 71 nt, Homo sapiens
uuguuuugagauggaguuucgcucuuguugcccaggcuggagugcaauggugcgauuucaacucacugcga

SEQ ID NO: 2239533 - RNA, 66 nt, Homo sapiens
uauugugaauagugcugugaugaacauacaugugcguguaucuuuaugccagcauucuuaacagug

SEQ ID NO: 2239534 - RNA, 77 nt, Homo sapiens
ucggaaguuaggaggcuuaaaaucucagucuuguuucaacaaugcauugauugagcaaggucuccuaguauuucuga

SEQ ID NO: 2239535 - RNA, 77 nt, Homo sapiens
cacaacuccuucacacggugaugauuccuagagauucaugaauauuuggagauuccuacucugugcuaggcacugug

SEQ ID NO: 2239536 - RNA, 106 nt, Homo sapiens
ucaaacaugucauucuuucccucuauggcuuaagacaaccuuucauguaaucuugggagacaggaaagguugucuuagccacagagggaaagaaugacacguuuga

SEQ ID NO: 2239537 - RNA, 71 nt, Homo sapiens
ggagaagagaugacugauggcugauuauuaaugcucuuucacaggugauaugaaucaaucacucuucaucu

SEQ ID NO: 2239538 - RNA, 55 nt, Homo sapiens
uuuugcaaauuccaguggccauaugacagcauugccauauauuggaaaugcaaga

SEQ ID NO: 2239539 - RNA, 88 nt, Homo sapiens
ggagucucucccuguugccuaggcuggagugcaguggcgcgaucucggcucacugcaaccuccaccucccggguucaagugauucucc

SEQ ID NO: 2239540 - RNA, 62 nt, Homo sapiens
ggagaaugaugauuuccaauuucauccaugucccuacaaaggacaugaacucaucauuuuuu

SEQ ID NO: 2239541 - RNA, 95 nt, Homo sapiens
ugcuggguucucaggguuagguagggacucugccauuucuuacugucaaaaucucuccuguggagaugguguuccacugccagucuagcucagca

SEQ ID NO: 2239542 - RNA, 77 nt, Homo sapiens
auuuggggcaugagagagaagauuaaaauauaguuuacuugucuccauauuugagucauuuccuuaugcuacuaaau

SEQ ID NO: 2239543 - RNA, 90 nt, Homo sapiens
ugggcucucacaguuccuggcccaguugcgggugguaccguacauaaguacaguagauaugacugcagcuggaaggaacaagugcgucca

SEQ ID NO: 2239544 - RNA, 67 nt, Homo sapiens
cuacaucaccacugauugcuaaggagggacaaaugagagaggcuuuuuacaguugguugugaggugg

SEQ ID NO: 2239545 - RNA, 65 nt, Homo sapiens
augaaaucuuuggcagaucuuauguacagaaugguacuuccuagguuauuguccaggguuuuuau

SEQ ID NO: 2239546 - RNA, 93 nt, Homo sapiens
uguguuguauucuugaaaacugcuuuaaagacuuuuuuugaaugggcaaaacauucacgugguucauaaggcagaaaggagaauacaaauaca

SEQ ID NO: 2239547 - RNA, 63 nt, Homo sapiens
gguccaugaauuccuuggcaaaacacccaaguugaaaaccucacuugacuguccagguggacc

SEQ ID NO: 2239548 - RNA, 61 nt, Homo sapiens
aacuggcauaugaacuuguucuucuuguauacagcucugagcaaagcaccauauggcaguu

SEQ ID NO: 2239549 - RNA, 95 nt, Homo sapiens
gggccuuucggguuugguucaguauugcaccuggaguccuacaggaaaugaaagaguaauggacccagauuugucugaauccagagucgaagccc

SEQ ID NO: 2239550 - RNA, 68 nt, Homo sapiens
ucaaagguccccuguaagaacuggcugauggggcagauaauuuacugguuacagugggaccuuccuga

SEQ ID NO: 2239551 - RNA, 81 nt, Homo sapiens
guuaauuugagauuggagaaaguuauaacauuauuacucaaagugagaaauaguagugucccugacuaucacaguguugac

SEQ ID NO: 2239552 - RNA, 60 nt, Homo sapiens
uguaagcauugggcaugcaguccaccuuuucuuguuggaagcgguucaguauuguuugca

SEQ ID NO: 2239553 - RNA, 120 nt, Homo sapiens
agaggggauaaaggcagggaaaagaagugauuaagaucuggacccaguucaagggaugaacuuuguuuagggcagggacaguucuuccauuucuauuccaauccuuucaucugucucucu

SEQ ID NO: 2239554 - RNA, 91 nt, Homo sapiens
uucuucccacagacauugauugaacaucuguucuuguaucccuccaugaagcuuggcacaaagcagguguccacaauguuugcugaaugaa

SEQ ID NO: 2239555 - RNA, 64 nt, Homo sapiens
guacaauagcaguuuucccuuuaucugccuaaggaaucuacaaguuggaagauuggcuaugugc

SEQ ID NO: 2239556 - RNA, 66 nt, Homo sapiens
gcauacggagcacagugcagcucagcagugauuuuucuaacuuugauaacauucugcauccuaugc

SEQ ID NO: 2239557 - RNA, 55 nt, Homo sapiens
uuccuuucauauauuaguucugucccucuggagagcccugacuaauacaaaggaa

SEQ ID NO: 2239558 - RNA, 91 nt, Homo sapiens
gagauugucacagaaacuguugguuaaauuccaugcaggcguuacuuuacuucucugcuggaagaugccaauuuuguucugauggcuccuc

SEQ ID NO: 2239559 - RNA, 55 nt, Homo sapiens
ugcccuggaugcugcaggugugugccccaauacacccugucagcuggccugggca

SEQ ID NO: 2239560 - RNA, 63 nt, Homo sapiens
ucaaaagcuguuguucauccugaauugaauuuucuuaguuuggguggaacagagucguuuuga

SEQ ID NO: 2239561 - RNA, 55 nt, Homo sapiens
caugacacuggcauguuucuuuagugaugauaaaggcgacaugaucaguggcaug

SEQ ID NO: 2239562 - RNA, 58 nt, Homo sapiens
ggcuacucugcaguaauuccagccccuuaccaaaagaggguggaggcugagaguggcc

SEQ ID NO: 2239563 - RNA, 65 nt, Homo sapiens
ugucuuuaacauuggcuacauacagaacuuuguuaaacaugugcacugcagcaauguaaaagaca

SEQ ID NO: 2239564 - RNA, 98 nt, Homo sapiens
caagaccagcaagggcaacaugaugaaaugccaucucuaccaaaaauacaaaaacuuagucgggugugguggcgugcaucuguggucccagcuacuug

SEQ ID NO: 2239565 - RNA, 73 nt, Homo sapiens
cugucaaggaauuuauccauuucuucuagauuuucuaguuuauuuacauagagguguuuguauucucugaugg

SEQ ID NO: 2239566 - RNA, 58 nt, Homo sapiens
aacuucugccuguauauccaagcauuuccauacaucuugugaaaucuaggcagagguu

SEQ ID NO: 2239567 - RNA, 63 nt, Homo sapiens
ugaggcugaacuaguaguuuacuugaugugcaagugaugucaaguaucacugaguuucccuca

SEQ ID NO: 2239568 - RNA, 77 nt, Homo sapiens
gaggaaaaaaaagguggaaagaagggcuagggacugagaugacacucugguuuuucuuccauuaagacauguuccuu

SEQ ID NO: 2239569 - RNA, 116 nt, Homo sapiens
gagcaucauaaguuaagaugguagacauucuaaaucucuauaaaugucaacacagauuuauuuaugguuaauauaggaaguuaaaaaucuaugcccagucuugacagauggagcuu

SEQ ID NO: 2239570 - RNA, 90 nt, Homo sapiens
caaugcaggcucuuuuuugguuccauaugaacuuuaguuguuuccaauucugugaagaaagucauugguagcuugaaggggauggcauug

SEQ ID NO: 2239571 - RNA, 60 nt, Homo sapiens
gggcucauguccaaccuagcuuuccuuagacccuuagguuauuagguacuggauaugccc

SEQ ID NO: 2239572 - RNA, 60 nt, Homo sapiens
cauuacacuuguaagguuuuucuccaguaugaacucuccaaugccuugcaaguugugaug

SEQ ID NO: 2239573 - RNA, 73 nt, Homo sapiens
gguuuguuaccuagguauacauguugcauggugguuugcugcaccuagcaacccgucaucuagguuuuaagcc

SEQ ID NO: 2239574 - RNA, 96 nt, Homo sapiens
ccucucucucacucuaacacagagguuuauuucucaccacggcuuuaccugugccgggggagagccaccucucguguuaguggcauuugaaagagg

SEQ ID NO: 2239575 - RNA, 99 nt, Homo sapiens
cccugccuucugcuucagggaaaagucacacugggucggcuccaaagagugucccugcugauucacuguggcuuucucugaucauuagccaaaccaggg

SEQ ID NO: 2239576 - RNA, 63 nt, Homo sapiens
guguuuucagggcauuggaguuucugaacacuucagauugucuccuauguccugcaaagauac

SEQ ID NO: 2239577 - RNA, 80 nt, Homo sapiens
guuuacuuuuaaucugucuaugauuuugguacacaauaugaguuauggagccagauuuacaggcagauuacuuaaugaau

SEQ ID NO: 2239578 - RNA, 71 nt, Homo sapiens
ggauuugguuugccaguauuuuacugaggauuuucacuuugauguucaucaggaauauuggccuaaaauuc

SEQ ID NO: 2239579 - RNA, 111 nt, Homo sapiens
guccaaggccuuuucugcaucuauugagauaaucaugugguuuuugucauugguucuguuuaugugauggauuacauuuauugacuugcguauguugaaccagccuuggau

SEQ ID NO: 2239580 - RNA, 64 nt, Homo sapiens
cucugcauuuaagaaagggagggaagagugaaaaggacucugucuugugguuugagugccaggg

SEQ ID NO: 2239581 - RNA, 94 nt, Homo sapiens
uucagaaaugauuguuagaauguagaauggaacugacuauagcugacuuggcucagcugaugggaguucuguguuaaaugacaaagauucugga

SEQ ID NO: 2239582 - RNA, 90 nt, Homo sapiens
uauagcuaccacaaauaacacuguuuccagucaugaucaggaaucacauauuaagacauaacugcaaauugugcuauacuggguacugua

SEQ ID NO: 2239583 - RNA, 127 nt, Homo sapiens
gaggcugaggcaggagaauugcuugaacccgggagguggagguugcagugagcugagaucgcaccacugcacuccggccucgugacagagcgaggcucugucucaaaaacaaacgaaaaacaaccuu

SEQ ID NO: 2239584 - RNA, 62 nt, Homo sapiens
uuuaagguauguggugaaaauucuggaauaggaagacgggaaacacucacauaagcuuuaga

SEQ ID NO: 2239585 - RNA, 87 nt, Homo sapiens
aaaauaguuugcauuuauguagaccuuaucuauauuuaucaagugcuucucuauucaugaggugaggucaguaagguagacuguuuu

SEQ ID NO: 2239586 - RNA, 86 nt, Homo sapiens
gugccugucuuggccucugaaaguguugagauuacaggcaugagccgccaugccuggcuaaguugcuuuucgguuagauacggcau

SEQ ID NO: 2239587 - RNA, 65 nt, Homo sapiens
ugagaugccuggguguucccagagucagugagacaauuaaucugauuuacauccauugcauuuca

SEQ ID NO: 2239588 - RNA, 62 nt, Homo sapiens
ccagucuuggauaugucuuuauuagcagcaugagaauggacuaauacaguuguccaagcugg

SEQ ID NO: 2239589 - RNA, 61 nt, Homo sapiens
cauggcacagaagaugucguuuggcuucuacaaguacagcaacauggaguuugugcgcaug

SEQ ID NO: 2239590 - RNA, 77 nt, Homo sapiens
agaggauguuccaaaaaugauucuucuggcagacucucugucuuugagauaggguuauuuuuguacuuaacaccucu

SEQ ID NO: 2239591 - RNA, 64 nt, Homo sapiens
ggaagagguaagaaagucaguccuucugcggacacuguugagauuggcuuuuuaccuuaauucc

SEQ ID NO: 2239592 - RNA, 56 nt, Homo sapiens
gcugccuugccaggggcagaaacaaauagauggagaaguccccugagcgaugcagu

SEQ ID NO: 2239593 - RNA, 130 nt, Homo sapiens
ugagccauaaucacgccaaugcacuccagccugcgugacagagcaagacccuauuuaaaaaaaauuuuuuagagauggagucuugcucugucacccaggcuggagugcagugaugcuaucauauaccuca

SEQ ID NO: 2239594 - RNA, 75 nt, Homo sapiens
gaggcauaugguaucaguuugguuagguuuguuauuaacuuugaguacuugguuaaggugaugucuuugugccuc

SEQ ID NO: 2239595 - RNA, 56 nt, Homo sapiens
uuuuggcucuugguaggucagaguggccuuuccuucaugccugccaaagcacaaag

SEQ ID NO: 2239596 - RNA, 67 nt, Homo sapiens
uugaggaggcagucuguccauucucagagcucaaaugcugugcugggagaaccacugcucucuucag

SEQ ID NO: 2239597 - RNA, 55 nt, Homo sapiens
ucuccuacacaucaguaagucaaagauaagcaacuuugacacuguuggugggagg

SEQ ID NO: 2239598 - RNA, 62 nt, Homo sapiens
uguucucacuuauuugugggagucaaaaauuaaaacaauugaacucauggagaaggagaaua

SEQ ID NO: 2239599 - RNA, 84 nt, Homo sapiens
ucaucgguuauagggaucauuuuucauccuacagaacuguucuuguacugauggaauuugaggaaugauuauauaugaugguga

SEQ ID NO: 2239600 - RNA, 80 nt, Homo sapiens
ggauuucaaucugucuuuuagggggccacgacuaaaaguacuauaguagccauggccaauuucuugaagacagaaaaucc

SEQ ID NO: 2239601 - RNA, 68 nt, Homo sapiens
gaugccuauugcuaguccuaaaauuuaucaguuaagagaggucuuuuggguuucguaauggcagcauc

SEQ ID NO: 2239602 - RNA, 57 nt, Homo sapiens
uguugcacugguaauguacugaccuuuugaaaaggugggguauacuccagucuaaca

SEQ ID NO: 2239603 - RNA, 86 nt, Homo sapiens
guuucagguaaaugauauuuuauguaaguacaccgcaaauauugcauggauauacuuguacuucaagauuaugguuuaucugaaau

SEQ ID NO: 2239604 - RNA, 55 nt, Homo sapiens
aggucuguuugcuguuuucuccaaugaaaugguucuggguaaacagcagacgccu

SEQ ID NO: 2239605 - RNA, 57 nt, Homo sapiens
uugagauggagucucacgcauugucgcccaggcuggagugccguggugccaucucag

SEQ ID NO: 2239606 - RNA, 85 nt, Homo sapiens
auauuggauaugcguuuuuacugugggguuucuuagaggcuuuuaauuucugaaucucuaaaaauacauauuaaguauucagugu

SEQ ID NO: 2239607 - RNA, 84 nt, Homo sapiens
gucauauucucugaccacuguagccacuuaagauagucucaaauaugaauaauuuucaguggccauaguggagaagaugcugac

SEQ ID NO: 2239608 - RNA, 84 nt, Homo sapiens
ugacauugacacugucauugucaauugacaauugucauugucaauugucaaugacaaugucauugacauugacauugucaguca

SEQ ID NO: 2239609 - RNA, 66 nt, Homo sapiens
gcuuccuggcauauaaaaucuaaaaucauuagugccuccuaagugaugucuuuuugugugcugagu

SEQ ID NO: 2239610 - RNA, 62 nt, Homo sapiens
auugugaauagugccgcaauaaacauacgugugcaugucuuuguagcagcaugauuuauaau

SEQ ID NO: 2239611 - RNA, 70 nt, Homo sapiens
ggauuuggauugccaguauuuuguugagaauuuugcauugauguucuucaaggauauuggccucaaguuu

SEQ ID NO: 2239612 - RNA, 101 nt, Homo sapiens
ggaaaacuugauagagagaugaaaauaucaaaguaggcauauguuuuuaugaaaguuucagaaaaguauguuuauuuugacuuaugucuaaauuagauucc

SEQ ID NO: 2239613 - RNA, 129 nt, Homo sapiens
gaggcugaggcaggagaaucgcuugaaccugaaggcagagcuugcagugagcugagaucucaccauuguacuccagccugggugacacaaguggaacucugucucaaaaaaaaaaaaaaaauggcaauu

SEQ ID NO: 2239614 - RNA, 130 nt, Homo sapiens
ucaggaagcugagguaggagaaucgcuugaaccuaggcggcgagguugcagggagcagagaucgcaccauugcacuccagccugggugacaagagugaaacuccaccucaaaaaaaaaaaaaauuacuga

SEQ ID NO: 2239615 - RNA, 62 nt, Homo sapiens
uaggacacagauggagaaaagcaagaggucauauuccaauguaucuuucuaccuguguucug

SEQ ID NO: 2239616 - RNA, 83 nt, Homo sapiens
ggcaauugagguaauagauaauauuuuugaggaacuuugcuucaaaaaugugauuuauuccccaaaucuuuuguauuuuugcc

SEQ ID NO: 2239617 - RNA, 86 nt, Homo sapiens
ggcauugacuugggcuugagggugcccagucacaccuguuuugugacaugggcuggcagguccaguuaaggggagauugaagugcc

SEQ ID NO: 2239618 - RNA, 80 nt, Homo sapiens
gaauuuagcugugagguaugugggcagacauuuagagucgcuuuugauguugagauccacaugagaacacacaaagauuc

SEQ ID NO: 2239619 - RNA, 107 nt, Homo sapiens
gauaguugagaaaauggaaugucaauguagucuuuaauuaugagugaaauugugcuuuuguuucagguauuuaagggccguuuacauuucauuuucuuuggucuauu

SEQ ID NO: 2239620 - RNA, 61 nt, Homo sapiens
cugcaggaaucuguauguuaggacauuaagguaaaucuugacauguaauucaguccagcag

SEQ ID NO: 2239621 - RNA, 80 nt, Homo sapiens
gugcgaagccugggcaaaacuguacugccaaggcuguggggccuuggaaaggacagauaguucugcuggcugaaagacac

SEQ ID NO: 2239622 - RNA, 60 nt, Homo sapiens
uuacacaauuuuauugaccuaaacucaggaaaucccucacuggucauggagguuguguga

SEQ ID NO: 2239623 - RNA, 60 nt, Homo sapiens
caucagaaugugcauuuuaacaaggaacccagguaauucaaaugcacauuacugcuggug

SEQ ID NO: 2239624 - RNA, 107 nt, Homo sapiens
guagagggauuagaggaauaauucuuuuugucuguuuggugucaugagggggacaggaaguuguucggugucaugagggggacaggaaguuguucagucccauuugc

SEQ ID NO: 2239625 - RNA, 56 nt, Homo sapiens
aaugucacugugguccuccagucagaguaggagcucauggaggucaggugaucauu

SEQ ID NO: 2239626 - RNA, 58 nt, Homo sapiens
acccggaagguggagguugcagggagcugagauagcaccauugcacuccagccugggu

SEQ ID NO: 2239627 - RNA, 63 nt, Homo sapiens
ugauuuaaaguguaugggcagaugugcauaaguuauaugcaaauacuaugccacuuuauauca

SEQ ID NO: 2239628 - RNA, 63 nt, Homo sapiens
acaaggacagcagggaguugugccgauggcugaaucauuguacugccccccuguugcuagugu

SEQ ID NO: 2239629 - RNA, 84 nt, Homo sapiens
gcuuacguggucuguccaaaguuaaagaguuaguaacuuguggaaccaguauucaucuuaagcuuuggcuuaaagaccacaagc

SEQ ID NO: 2239630 - RNA, 101 nt, Homo sapiens
ggauuuacuucaauuuugaaagaaguucuacugggggcaaaauguuaucaaacaucauugcacccuauagagaaauauuucaugaaaagaggagucgaucu

SEQ ID NO: 2239631 - RNA, 103 nt, Homo sapiens
uugagauggaguuuugcucucuugccgaggcuggagugcaguggugcagucuuggcucacugaaaccuccaccucucggguucaagcgauucuccuaccucag

SEQ ID NO: 2239632 - RNA, 78 nt, Homo sapiens
cucaaacucuaaaaauucuuuaaaaaucuaggaaauauucuuuuuaacaugggucuuggcaaagaauuuuuggcugag

SEQ ID NO: 2239633 - RNA, 59 nt, Homo sapiens
uaagacuguguaauuuaugaagaaaagagguuuauuugauucauaguuauacaggcuua

SEQ ID NO: 2239634 - RNA, 72 nt, Homo sapiens
cugggcgugguggugucugccuguaaucccagcuacucaggagguugaggcaggagaauuacuugaacccag

SEQ ID NO: 2239635 - RNA, 56 nt, Homo sapiens
gcuucccuuggcuaggcgagggaguucuccaaccccuugcacuucccaagugaggc

SEQ ID NO: 2239636 - RNA, 64 nt, Homo sapiens
gacaauuucucagaguccauaaaauuaucuuacuuaaagauaagguuagcucugagaaaguguc

SEQ ID NO: 2239637 - RNA, 95 nt, Homo sapiens
gcuuucugggcaggcagugagugaaugagaucccuggcaccuuggagugagaucagagucuagaucacucacuggggcccuguuucccaggaagc

SEQ ID NO: 2239638 - RNA, 56 nt, Homo sapiens
uuggaaugguaggcuaucucauaucgccuaggugugugguaggcuauaccaucuag

SEQ ID NO: 2239639 - RNA, 70 nt, Homo sapiens
guuggaauauggguauuaagaaucaaaaccaaaacugaguuuuauucugugcucauguuauauguacaac

SEQ ID NO: 2239640 - RNA, 124 nt, Homo sapiens
ucuagccugggauauguugcacaccuuagacauuaaugacuuuagguaggugcuuuuuucacagccagugcugucugugaaaguuauaaccuuucugacauuucugacacacguugcagcugga

SEQ ID NO: 2239641 - RNA, 56 nt, Homo sapiens
aaggaauuauacuauacauugggugacugugucaucacccucuaggaugauuucuu

SEQ ID NO: 2239642 - RNA, 96 nt, Homo sapiens
guuguucaguggguuugcacgguggcguguuugucacuaggcgaggucaccgugccuagggacaaaccguccgaccuaauggagucgaggagcaac

SEQ ID NO: 2239643 - RNA, 76 nt, Homo sapiens
uucuauccugggagaggcaaguugagaaggcuagaggcuacagaacccgucucagcagucacuccuaugacaaggg

SEQ ID NO: 2239644 - RNA, 61 nt, Homo sapiens
uuauugagguauacuuugcauaucaugaaaugcaaccauuguuaagugugcaacucaguga

SEQ ID NO: 2239645 - RNA, 113 nt, Homo sapiens
caucuucugccucauggauaagcucauugagaucuauggcuuugccuaauaauuauaauaaagguauucuaagccugcaucuucaaccagaguucuaucuccagcuagaaaug

SEQ ID NO: 2239646 - RNA, 70 nt, Homo sapiens
cuggauguccaggcagaaguuugcugcaagggcagggcccucauggagaaccucugcuagggcaguucag

SEQ ID NO: 2239647 - RNA, 64 nt, Homo sapiens
ccugcuucagggaugauggcacugugucaaaaaugucaugauuugcauuguugcugagagcagg

SEQ ID NO: 2239648 - RNA, 71 nt, Homo sapiens
uccaaguuacuggcuuauagacucuauaagcauaauucauugccuguuaccuuaagccacuaaguuuugga

SEQ ID NO: 2239649 - RNA, 68 nt, Homo sapiens
gaggauucugagcugucuuuguuaguuguccuaguuucuuuugacugauauucaacaaagaaaucuuc

SEQ ID NO: 2239650 - RNA, 129 nt, Homo sapiens
aguaguaauaggaaacuuagucuuauauccaauuugguaccaagauauaugaauagauuuauuacuauuauauaucuagagcggaccaggcuugcuuguagguuaauugcuuaguaccuguguagugcu

SEQ ID NO: 2239651 - RNA, 116 nt, Homo sapiens
aaauugcccagucuuugguaucuuuauuagcagcacaaaagcagacuaauacaguaacuugguacugguagaguggggugcugcuguaaagauacccaaaaauguggaagcaauuu

SEQ ID NO: 2239652 - RNA, 64 nt, Homo sapiens
ugaugauaugagaaaggaucaacaaagcacuacaagcugauguuaugcuuaauuuuaugcauca

SEQ ID NO: 2239653 - RNA, 59 nt, Homo sapiens
cuccccccacaguguucuugccaaugagagaaaugagcaggagcauuguugugguggag

SEQ ID NO: 2239654 - RNA, 85 nt, Homo sapiens
guucaaugauacgauuucagauugcauaccgaaaguagcuuuuaagaaccuacuguuugucaauucugaucuaguaucaaagaau

SEQ ID NO: 2239655 - RNA, 60 nt, Homo sapiens
ugaucaauggagguccuugcuaagagugggaauccccauaagcuaguauuuccaugguua

SEQ ID NO: 2239656 - RNA, 88 nt, Homo sapiens
gccuugcuuauaguaagugaggagguucacuucagacccaaauuccugugugugaucuuucaggcuugaccauagacaauugcaaggc

SEQ ID NO: 2239657 - RNA, 73 nt, Homo sapiens
ggauuugguuugccaguauuuuauugaggauuuucgcaucaaucuucaucagggauauuggccugaaauuucc

SEQ ID NO: 2239658 - RNA, 62 nt, Homo sapiens
ugucuuuuagcaugcuaauuagcauacauaauuauaauuagcuauaauuagcagugaggaca

SEQ ID NO: 2239659 - RNA, 84 nt, Homo sapiens
uggcugcauaaaugucuucuuuugagaagugucuguucauaucuaucacccacuuuuugauggggagaacauuuuugcaaucca

SEQ ID NO: 2239660 - RNA, 81 nt, Homo sapiens
cagccagauaaugucagguaaaaguauaacuuaugacucagucagagcaaugcuuuugcuuugauauaucgauguuggcug

SEQ ID NO: 2239661 - RNA, 60 nt, Homo sapiens
gaauaccucuuuguucaauaauauucccaaggucacagagaugaugaacagagaggauuc

SEQ ID NO: 2239662 - RNA, 59 nt, Homo sapiens
augucugcgaaggcaagggcauguauagcuugaaaaauauccuuugguuuccaugacau

SEQ ID NO: 2239663 - RNA, 90 nt, Homo sapiens
ccuugugugcacugaggcaugauggcuccagaucaugacacuaaaugcugcagguaaugcuggugcugugugcccuggguguacagaagg

SEQ ID NO: 2239664 - RNA, 69 nt, Homo sapiens
ugacuaguuggauaaccuaggagaaaugaacagauuccuaguaacaugcaaguuaccaagacuaaguca

SEQ ID NO: 2239665 - RNA, 95 nt, Homo sapiens
cugcuaacaguauauugaacagugcauuccuguccauauucuagacacuccuaaagcauuggcagggaugcauuacguggcaauaauuauagcag

SEQ ID NO: 2239666 - RNA, 77 nt, Homo sapiens
ggaauagcaacuuuuaauuaugauugggauuugcacggaaauacugguacaccaauuuaaucaaaagcagauguucc

SEQ ID NO: 2239667 - RNA, 78 nt, Homo sapiens
cagcauuuaggagcagagucacagccaaauucaucaagacaaugagcccauggcauuuucucuguucuuagacugcug

SEQ ID NO: 2239668 - RNA, 75 nt, Homo sapiens
accuccuuuugucauauuaccugaguugguuuucugguuucuucucauuuagguagucucugucagagggaaggu

SEQ ID NO: 2239669 - RNA, 109 nt, Homo sapiens
uagagguaacaagcaguauuuuguaagugaagagugcuuuacaguucauagacuuccacugaguucucaugguguccugucucugcgcuuggcucuuguugucccucug

SEQ ID NO: 2239670 - RNA, 60 nt, Homo sapiens
uuucuaccaggagguguuauguuguuucccgaaguacuaauacuugcauccuuggagaga

SEQ ID NO: 2239671 - RNA, 77 nt, Homo sapiens
aggcuggagugcaauggcgugaucuuggcucacagcaaccucugcuucccggccggguucaagccauucuccugccu

SEQ ID NO: 2239672 - RNA, 61 nt, Homo sapiens
cugggucuagccuggucacaugcccauuucuaaaccaaucgcugugacugggccagccuag

SEQ ID NO: 2239673 - RNA, 74 nt, Homo sapiens
gaaucuuuggagugauagugacaaauaucuggaucugauuucaccauuuauuaguuguaugauucccaagcuuc

SEQ ID NO: 2239674 - RNA, 103 nt, Homo sapiens
guaguaaucaaugcauagcuacagcugguugaaggggaccaaauccauugaagaggcgauuugguuccauuuuaccagcucuagcaaagcauuguagugcugc

SEQ ID NO: 2239675 - RNA, 126 nt, Homo sapiens
agcugagucaugaaaagugaaaaguucagucaguugcccagauguauuuauugccaaauaacacaggguacuuggauacaucuggacagccgaaugaacucuuaacuccucgucucuccaacagcu

SEQ ID NO: 2239676 - RNA, 61 nt, Homo sapiens
aagguaguuuucuuuaaugcuggaauuucaggcaauggcagcccaaagagagagcuacuuu

SEQ ID NO: 2239677 - RNA, 84 nt, Homo sapiens
ucauacauagucuucuuuugguuauuuuucuguuauuuauuuuuagccuaauugcacuauaaucggagaguaugauuuguauga

SEQ ID NO: 2239678 - RNA, 55 nt, Homo sapiens
ugcucaguuuaaaacuuuugaguauugaagugaugcucaaacaaaaugcugagua

SEQ ID NO: 2239679 - RNA, 68 nt, Homo sapiens
ucgcaugagccugggaggcagagguuguaguuagccaagaugacaccauugcauuccagccuggguga

SEQ ID NO: 2239680 - RNA, 78 nt, Homo sapiens
gcucuuagcaagcucuguggggucaagggagcuugaggcaguggcagucuuuggcauuagagagacuugcacuggggc

SEQ ID NO: 2239681 - RNA, 61 nt, Homo sapiens
guagguaaguacuucuggugagaaggcaaaaacuuuuaaaaugccuauaaguaaugccuac

SEQ ID NO: 2239682 - RNA, 57 nt, Homo sapiens
acuguuucucuccucagcaagacacacuuccugugucuacccugugagggacacagu

SEQ ID NO: 2239683 - RNA, 61 nt, Homo sapiens
ccaugcucgcuuaggcagcacauauacuaaaacuggaauaauacugggaagaugagcaugg

SEQ ID NO: 2239684 - RNA, 83 nt, Homo sapiens
ugggccccuuguuccagcugggggcaacucugcagggccauccuagcugcagagcugccuguggcugcugcaucauucgccua

SEQ ID NO: 2239685 - RNA, 64 nt, Homo sapiens
ugugagggguggggacugacaggaaccuacuggagauucuaucacagccccacacucucuugca

SEQ ID NO: 2239686 - RNA, 57 nt, Homo sapiens
cucaccuugugauccuccugccucggccucccaaagugcuaggaucacaggcgugag

SEQ ID NO: 2239687 - RNA, 75 nt, Homo sapiens
cuguuuucuggguucccugaugagaguuaguuccuuuuagggacuaauucguccuagggaggacuagauuaauag

SEQ ID NO: 2239688 - RNA, 101 nt, Homo sapiens
ugaggcaggagaaucgcuugaaccagggaggcggagguugcagugagcugagaucaugccauugcacuccagccuaggugacagcgcgagacucucucuca

SEQ ID NO: 2239689 - RNA, 73 nt, Homo sapiens
acauauaagggaucagugacagaauuaauuucugaguaaugcagaauaaacaucaauauugaccuuuguaugu

SEQ ID NO: 2239690 - RNA, 64 nt, Homo sapiens
uuggaacacuugcacauuggugguaagaauguaaaauggugcagccaguguggcaauuuuucaa

SEQ ID NO: 2239691 - RNA, 69 nt, Homo sapiens
cgguguguccaaagcauccaggauguuagauuuguuaaaccaagugaauguccauugauguuuugacug

SEQ ID NO: 2239692 - RNA, 58 nt, Homo sapiens
gugugcucaagauuaauucauguuguaauuuuuuuugacugagagaucuggggcacau

SEQ ID NO: 2239693 - RNA, 125 nt, Homo sapiens
ccaacaauucuuaaauugugguauuaaacuagauaauagugaacuuuuguugguuuacacacacaaaaagaaguaaauggauagaaauguacuguuuucucccauaauuuauuuugaaaccuugg

SEQ ID NO: 2239694 - RNA, 66 nt, Homo sapiens
uacaucuuccuuagaauccggguugaggguuucauauuuguaucucauugauucuggggugaugug

SEQ ID NO: 2239695 - RNA, 68 nt, Homo sapiens
ucaccucucuggcacccuugcuuaggaagaugcuacaccauccuucuaggaaggaugccaacaggugg

SEQ ID NO: 2239696 - RNA, 72 nt, Homo sapiens
ugucauguugagaaacuuggauuucacccuggaggcgcaggaacuaggggggauuuuucagcagcagugaca

SEQ ID NO: 2239697 - RNA, 79 nt, Homo sapiens
accugccuaccucaguucaauaacagauagauaaacagugggugugaauuuaucuguuauuaaaccgagguagacaggu

SEQ ID NO: 2239698 - RNA, 56 nt, Homo sapiens
uugagacugaguuucacucuuguugcccaggcuggaguguaaugacucgaucucgg

SEQ ID NO: 2239699 - RNA, 60 nt, Homo sapiens
ucuaauauguauuuuaacguguaagggcuuggauacaacuacccuagaauacauaguaga

SEQ ID NO: 2239700 - RNA, 74 nt, Homo sapiens
gggcucuuugagaucaucuaaucuggccucuucacucuacacugguggagacuaagauucauaggugauugccc

SEQ ID NO: 2239701 - RNA, 87 nt, Homo sapiens
gauugguuuccugaauagagcacacugaugggucuugacucuuuauccaauuugccagucugugucuuuuauuuggaggauuuaguc

SEQ ID NO: 2239702 - RNA, 56 nt, Homo sapiens
uuugguucuguuuauaugcuggauuauguuuauugauuuucauauguugaaccaga

SEQ ID NO: 2239703 - RNA, 73 nt, Homo sapiens
gaaugaggucacgugcuauuugccuuucugauaccuggccuaugucacuaaagaaaauggcauggacgcauuc

SEQ ID NO: 2239704 - RNA, 68 nt, Homo sapiens
gacaaugggacuauauuuuucaagguaaaaguguagugugaacucugaagauaucuaguaccauuguc

SEQ ID NO: 2239705 - RNA, 82 nt, Homo sapiens
auggucuuccaaaaauaauuauaaguuaagaaaauaacuuucaaaguaguaguuuuguguauaauaauggcuaggaagccau

SEQ ID NO: 2239706 - RNA, 81 nt, Homo sapiens
ggagguggaggaaagcagugugaaaugauuuaagggauuaaaagguauuuccuuauagaacuuaccugccuuucacgcuuc

SEQ ID NO: 2239707 - RNA, 85 nt, Homo sapiens
gauguuggugucucucugagcuuuuauuuccucaucuguaaauuuuugaugauaauaccugccucagagaguugucauaaagauc

SEQ ID NO: 2239708 - RNA, 81 nt, Homo sapiens
ugauuaugugcgugugugguuuuuuucuccaauaggcaauuauuuccagucagagaaggaaaccagugccuggcauucuca

SEQ ID NO: 2239709 - RNA, 56 nt, Homo sapiens
acaaaaccuuuagguuaugggcauccaauuuacccccaucaccuggcaggauuugu

SEQ ID NO: 2239710 - RNA, 55 nt, Homo sapiens
uggcuccuguggcuauuucaguugcuauuaaacaggaaaugggacuacaaagcca

SEQ ID NO: 2239711 - RNA, 69 nt, Homo sapiens
ccuuucaggcaagggugacccugaauaauggucuguuccuccaugccucaguuuccuugucuguaaagg

SEQ ID NO: 2239712 - RNA, 100 nt, Homo sapiens
gccacaaacauaauauucuuugucaguagauucugucaucagcucugacaccacagaguuugauacuagagucuuucugacagcagucacauuuucuggu

SEQ ID NO: 2239713 - RNA, 58 nt, Homo sapiens
guucucacuggacugugaaaauuugauagaauaaggguucaaaggucacaaugaggac

SEQ ID NO: 2239714 - RNA, 73 nt, Homo sapiens
gcagagcccccacuucacuuagaaucauaguagccagggcuaguagguaguaaauugauagaggauucuuugc

SEQ ID NO: 2239715 - RNA, 81 nt, Homo sapiens
uccaggagaguucaguggagaggcugagugguacaauaauugaaugauacuuuugguuugcuucauggaaugcaaguuggg

SEQ ID NO: 2239716 - RNA, 77 nt, Homo sapiens
gguugaauuaauaaaucuggagcuguagaauguuagaauaguguaacuucucaguaauuccagauuuuugaaaagcc

SEQ ID NO: 2239717 - RNA, 55 nt, Homo sapiens
cuaguucuagaucccugaggaaucuccacacugacuuccacagugguugaacuag

SEQ ID NO: 2239718 - RNA, 94 nt, Homo sapiens
gauaaaaggcuuuuaaauuuuaccuauucaguaugauaauagcugugggucuguccuauaugucuuuguuauguugagguauguuccuucuauc

SEQ ID NO: 2239719 - RNA, 105 nt, Homo sapiens
aggagcauguuaaaauguacaucccugagccugacucucagagaaucuaucugauuuggaagaucuggggugaggccuaggaauuuaaauuuucaacaugugccu

SEQ ID NO: 2239720 - RNA, 86 nt, Homo sapiens
auggguaaauugcaugucauguuuaguguacagauuauuuugucacccagguaauaagcauaauaucugacaggcaguuuuuccau

SEQ ID NO: 2239721 - RNA, 73 nt, Homo sapiens
caggggcuuggaagcaugguuauugacguuagacagacaugagugugaaucccacuuccaaccuuugccccug

SEQ ID NO: 2239722 - RNA, 79 nt, Homo sapiens
ccaugaaugguuuacaaguguaaucuuuucuggagaagagacuagguauuagguuacaucuugaggaaucuucccgugg

SEQ ID NO: 2239723 - RNA, 62 nt, Homo sapiens
guacaaccugucauuuugauugccuggugcucugguacccucaagggacugacagaaugugc

SEQ ID NO: 2239724 - RNA, 61 nt, Homo sapiens
caauguggcauuucucauucauuuuuguauagcucuuaaaaguuagugaaaugucauauug

SEQ ID NO: 2239725 - RNA, 122 nt, Homo sapiens
uacgcccaugagcgccugcagcugcuguucuaccagcggaccuuugucuccacgcuacagcgauaucaagagguaugccugggcuggagcagggcuuucaccagagcuccguggauggugua

SEQ ID NO: 2239726 - RNA, 65 nt, Homo sapiens
agacagggucuugaucagagcucacugcaauaucaaacuccuggguucaagugauccuccugucu

SEQ ID NO: 2239727 - RNA, 94 nt, Homo sapiens
cuucauucgggugcaauuguaacagaauuugcuaaacuccgcauuugauuucugaaguggauuuuaauuauucugucauaaacuugcaauggag

SEQ ID NO: 2239728 - RNA, 61 nt, Homo sapiens
accuucaagaggcauuuuccaaauacuucacuuacucuguuuacaauggcuccuugaaggu

SEQ ID NO: 2239729 - RNA, 83 nt, Homo sapiens
gccggaaaaccuacuagaugauuauguuccauuggagggccuggaagagacauaauuuaucuaacaauaaagaauuuucuggu

SEQ ID NO: 2239730 - RNA, 58 nt, Homo sapiens
acccaggaggcgaaaguugcagugagccgagauugcgucauugcacuccugccugggu

SEQ ID NO: 2239731 - RNA, 55 nt, Homo sapiens
uugagauggagucucgcucugucauccaggcuggagugcgguggcuccaucucgg

SEQ ID NO: 2239732 - RNA, 64 nt, Homo sapiens
auagugcugcauaucaugcagaacugcauaucugcaugcauaucugcauaucaugcagaacuau

SEQ ID NO: 2239733 - RNA, 61 nt, Homo sapiens
ggggugggagugccauccuugaugccugcacgcuggccugucauugggugcagcccacccu

SEQ ID NO: 2239734 - RNA, 75 nt, Homo sapiens
cgugaccuucuaggugcaugagccguacaguuuguuacauucacaggcugacugccaguacuuagauuuauuaug

SEQ ID NO: 2239735 - RNA, 92 nt, Homo sapiens
uuuuggaacuaaaauauuugccaaagugauaccuuaucccuaacuuggaccagcuaaggugcucucuuauguagaaauuaauaguuucagaa

SEQ ID NO: 2239736 - RNA, 57 nt, Homo sapiens
cagguguauaaacucagugacuccaagcggcuacacugagcaauguuuacauacuug

SEQ ID NO: 2239737 - RNA, 127 nt, Homo sapiens
guugcuagauuuugaaaaguuaggguuuuucucccuauaaaguuaagacagaauguuaagauugcugguauuaauacugcuuaacuuuaggaaaggaauuauaucacccuccaguucuuucuguaac

SEQ ID NO: 2239738 - RNA, 99 nt, Homo sapiens
gaggcaggagaaugacuugaaccuggaaguuggagguugcagugagucgagcucucaccacugcacucccgcccgggugacagugcaagacuccgucuc

SEQ ID NO: 2239739 - RNA, 91 nt, Homo sapiens
ugguugaaugaaaaauggcuuuucacagaggguucugagcaaaugaauagaacagaauuucccagaauuggccguuuaaaaaauacgauua

SEQ ID NO: 2239740 - RNA, 63 nt, Homo sapiens
ucugauccaaucugugggcugucaguuuacaauuucugcuguauagcacuucacuugguuaga

SEQ ID NO: 2239741 - RNA, 88 nt, Homo sapiens
uggcaugggguauuuaaugagucucucuggccagagagccuccucaagucucuggccagagacauucauuaaaguuacccagauacca

SEQ ID NO: 2239742 - RNA, 59 nt, Homo sapiens
gacauauccuguacuaagguuuucccaacuauuuggguagcccuuaaugcaggcaaguc

SEQ ID NO: 2239743 - RNA, 59 nt, Homo sapiens
uguucucuaguuuaauguguaugcuuuguuuucuucagcuacauaguaaacugagagca

SEQ ID NO: 2239744 - RNA, 63 nt, Homo sapiens
ugugggacacuucugggcuauuuucaugaucacaagugucuauagcucagugguguugccaua

SEQ ID NO: 2239745 - RNA, 61 nt, Homo sapiens
uuuccauguuggugaaaugaggaaaaaucccacccuccccagguuucauuaagauaggaaa

SEQ ID NO: 2239746 - RNA, 74 nt, Homo sapiens
gaauucuguuuugcacuagaaccagagguuuuaacaagugugucaaaccuccuuaauguuguaaaacagaauuc

SEQ ID NO: 2239747 - RNA, 79 nt, Homo sapiens
uaagaaacuuucugaagaacuaggugagaucuagaagcaauguccuuuuguuuauucccaguuuuuuuuaaguaucuug

SEQ ID NO: 2239748 - RNA, 85 nt, Homo sapiens
gucagguugcgcacugcaugaggauacucagucaaugggccaaguguucgcugagaugcuccucuugcaaagccuuuugcuuggc

SEQ ID NO: 2239749 - RNA, 58 nt, Homo sapiens
augaauguacacgcguacuuguucugucucugaaaagcaaguacacauguacguucau

SEQ ID NO: 2239750 - RNA, 76 nt, Homo sapiens
guagcaaauacgugauauugcaguauauaggaaagaaugagcacuuucauuauuguaaacaucuguacauugcuac

SEQ ID NO: 2239751 - RNA, 75 nt, Homo sapiens
auaagcaaauucuuaagaucagugcaaacuggaggugcucaacuggguuugcauugauuuuaagaauuugcuuau

SEQ ID NO: 2239752 - RNA, 55 nt, Homo sapiens
cuucuuguuguggggggugcaacagguugagauuuauccacuugcaacagagaag

SEQ ID NO: 2239753 - RNA, 63 nt, Homo sapiens
guauguggaguguaugugacagagaggaauaagauguuaucucuguccucugcuuuccauagc

SEQ ID NO: 2239754 - RNA, 84 nt, Homo sapiens
aaugugacgucuuuagccagguacuuaauuauuuuuccacauuuuaaggguuaaagagcugagaccugguggaguuaaaacauu

SEQ ID NO: 2239755 - RNA, 60 nt, Homo sapiens
guugcaugucugggaggccagcccugucccccuucccugcucaucucccugacacucaac

SEQ ID NO: 2239756 - RNA, 90 nt, Homo sapiens
gcaauguuuccuuaaggcagauaagaauucagcaagcuuuauucaacaaacuugcagagaaauuucugguuuacuuccaggacacauugu

SEQ ID NO: 2239757 - RNA, 106 nt, Homo sapiens
aggcuggggaugggcuuuuaagguauauuugguagcuauuuugcaguuuuauguuaaaugaaacuaugggauagguauuaaaaauagcaagagcaaugcccugccu

SEQ ID NO: 2239758 - RNA, 100 nt, Homo sapiens
caggguaaaaucuuacugacuugaaguuaccauaugcaacaagaauagauugaucuugauuauuugccuauauggcuuuaacagggaggauuucacuuug

SEQ ID NO: 2239759 - RNA, 81 nt, Homo sapiens
uggaaugcaauaaagagugguucuauauguaauuggcucuacaccaucaccacuacaaaacggaagcacuuuugcagucua

SEQ ID NO: 2239760 - RNA, 61 nt, Homo sapiens
uagugguauuagcgauacuacuaaaguauuauuauguaaaguaguauuagcaaugcuacua

SEQ ID NO: 2239761 - RNA, 77 nt, Homo sapiens
auuuuuaaauauaugcauuaauaaagggcucuacaauucccuggaguauacuuggagugaugcaaaucuuuaaaagu

SEQ ID NO: 2239762 - RNA, 85 nt, Homo sapiens
cauuuuuaaaauauuacaaauuagguauuuucuggacagggcccuagcuauggucucuuccuugaccuauuguaauagaagaaug

SEQ ID NO: 2239763 - RNA, 93 nt, Homo sapiens
gugagcuguaagaauugugcaaauguuaaacuaacuucagauuccagaaaugaguccaaguuggucaugauauuuagcauucuuauaaauugc

SEQ ID NO: 2239764 - RNA, 58 nt, Homo sapiens
ugggaagggucaacagcuggaaauucuuuaugcagaguugcagcacgggcccuuucca

SEQ ID NO: 2239765 - RNA, 82 nt, Homo sapiens
uguuaguuccaguuuauagguagauuuagaauguuuucuagucgacaauggguugaguuuaucuaaagaccugggaucaaua

SEQ ID NO: 2239766 - RNA, 90 nt, Homo sapiens
ugauuuuuuguggaccuguauaauuguacauauuuaugguauacacagugauauuuugauauguguaaacaauguauaauggucaaauca

SEQ ID NO: 2239767 - RNA, 59 nt, Homo sapiens
cuuagugaaugucacuggcuguuggacagcuuguugucuacacagggcaguucaaugag

SEQ ID NO: 2239768 - RNA, 57 nt, Homo sapiens
ggcucagagucagggguacauggguuacacaccagcucuacccuucagcacugggcc

SEQ ID NO: 2239769 - RNA, 75 nt, Homo sapiens
uaggacacagaccuggauggaagaccacccuccaccccacccacaggggcucuuccaaggccaggcucuguccua

SEQ ID NO: 2239770 - RNA, 72 nt, Homo sapiens
uuuuggcucugagguuguucuucucaguggcauaucuacauuugccaugcaauauauauccucaagccaagg

SEQ ID NO: 2239771 - RNA, 65 nt, Homo sapiens
ggagcagaaggagccccugaugcuuuagaugaaagauuccgucugcaaaguggcuaccuugcucc

SEQ ID NO: 2239772 - RNA, 86 nt, Homo sapiens
gggcuccuguuugcuucagaguaguuccuggcagaaagcgcugaguguaauuugcugacucugccauacugccucucagggagccc

SEQ ID NO: 2239773 - RNA, 80 nt, Homo sapiens
agcauguaggguaacuucuggauguagccauggcauuuauaaacagucauggcacuaaugggaguuuacuuuaguaugcu

SEQ ID NO: 2239774 - RNA, 81 nt, Homo sapiens
auaucaguuccuuucauuucaaacauuugcuugacauuuguaguaauuaggugaaugcuggaagaaaugauuaaaugauau

SEQ ID NO: 2239775 - RNA, 99 nt, Homo sapiens
gcuguaaccuuuucagaugaugccgcugaaaaccuuaaaguacuguuguguuuucacagugcuguuguguuuucacguggucacaccucucugugcagc

SEQ ID NO: 2239776 - RNA, 66 nt, Homo sapiens
auagagaggcaggucaaaggugaagcuuauugcucacuacugacacuacugcaaucaucucucugu

SEQ ID NO: 2239777 - RNA, 57 nt, Homo sapiens
ggacauuuugucucaguuucauuaagucuucuuauuugaacacuggacugagugucc

SEQ ID NO: 2239778 - RNA, 88 nt, Homo sapiens
guuuuugacuucccuguucuuuucaguuuaaugccgaguguuuaguagguacucagugacuggguauuaaaucagaggaagcagaaac

SEQ ID NO: 2239779 - RNA, 57 nt, Homo sapiens
aaaaauuggcuauuuggugagugauucacuugaguuccuuuucaguggucaauguuu

SEQ ID NO: 2239780 - RNA, 60 nt, Homo sapiens
uuuugcacuucugagugugacaugcccuagugggcaugcacauucgucgggguggcggga

SEQ ID NO: 2239781 - RNA, 62 nt, Homo sapiens
guaauggugaaagagucauucacgcagagcuggcuguguggaagauggaguuuuaucauuac

SEQ ID NO: 2239782 - RNA, 70 nt, Homo sapiens
ggagauuggcauugcugcaccugagaaagcuuccaacacuuguggacucaugugcaaaaguccaaauucu

SEQ ID NO: 2239783 - RNA, 101 nt, Homo sapiens
uguaauaaucacacgaggguaaauggguauucauuaccucaagcauuuaucauuucuuuguguuaugaacacuccaauuguacuccuuugguuauuuuaca

SEQ ID NO: 2239784 - RNA, 103 nt, Homo sapiens
aggucagcuggucuucagcuugacccuagaauugacucuaggagcagugacccugcugccucccagagccaguuauaggcucaagaucaagaccaacugaccu

SEQ ID NO: 2239785 - RNA, 64 nt, Homo sapiens
aguauggauuuuggaauauguggggauucuggaacccuucccucacauauaccaagggcugacu

SEQ ID NO: 2239786 - RNA, 60 nt, Homo sapiens
ugaauugucucucacuggguuccucccacaacacauggggauuaugagaacuacaauuca

SEQ ID NO: 2239787 - RNA, 68 nt, Homo sapiens
augcagagucccagccccuagcccagaucuacugacucaaucucugggugaggccugggaaucuguau

SEQ ID NO: 2239788 - RNA, 73 nt, Homo sapiens
ggaaagacaccuuacuauguuaauauggguuacuacugggcaaugggauuauacauggcugauggguuuuucu

SEQ ID NO: 2239789 - RNA, 64 nt, Homo sapiens
gaugcugagagauuggagacuaguuucauucuucuguauguggauauccaguuuucccagcauc

SEQ ID NO: 2239790 - RNA, 62 nt, Homo sapiens
ucagugucaucuggguuguuuguuuaaaugcugauucccagaucccccuucagaugaacuga

SEQ ID NO: 2239791 - RNA, 88 nt, Homo sapiens
cacuucaagguguuccuugaaacagucaagagaaguccuuuaugccuccccggguuuucucgacuguuucaagguacaccucagagug

SEQ ID NO: 2239792 - RNA, 63 nt, Homo sapiens
auguggucugugcaagagugaaaggagcuaaagaugacuccaaaagcuguugucagagcacau

SEQ ID NO: 2239793 - RNA, 77 nt, Homo sapiens
ucacuugaaucugggaguuggagguugcagugagccgagaucgcgccauugcacuccagcuugggcaacaagaguga

SEQ ID NO: 2239794 - RNA, 84 nt, Homo sapiens
ugggaguacaggggaagaauauuaggggauuucggagugguaaccagacuaagugaaaaacuaauguuuuucucuguacucuca

SEQ ID NO: 2239795 - RNA, 81 nt, Homo sapiens
ggagugggcuguguggagggagaccaagcaccaaggcccgcccuggccucugaguguccaccccuuucacaggcccauuuc

SEQ ID NO: 2239796 - RNA, 58 nt, Homo sapiens
agaggagacuuggauuuccacuagugccaugaaugacagugggcaaauccuuuccucu

SEQ ID NO: 2239797 - RNA, 64 nt, Homo sapiens
auugugaauagugcugcacuaaacauacaugugcaugugucuuuauagcagcaugauuuauaau

SEQ ID NO: 2239798 - RNA, 69 nt, Homo sapiens
gauggucagggagucucuaucaguggagccaaaccagcuccacugacacaguuaaagacccuugccauc

SEQ ID NO: 2239799 - RNA, 60 nt, Homo sapiens
uaucagagcugucagccuaccuauacagagaaaaaugguacaggcagagacagccuggua

SEQ ID NO: 2239800 - RNA, 78 nt, Homo sapiens
guaugucaguuucacucagcuggaacugugguuccaucuccaagggauucuguuucucugauugaacucugacagugc

SEQ ID NO: 2239801 - RNA, 86 nt, Homo sapiens
accuaguaaccuccuaagaaagagugcauugguggucaggugugguggcucgcauuuguaauuccagcacuuugggaggcugaggu

SEQ ID NO: 2239802 - RNA, 130 nt, Homo sapiens
auuacucccaauaucaacaguggguguacacuccuccugugauauuguuuguuauaucuaagaaagaagaggaugauauuacugucaauaucacagaagguguacagccccuugugauguuguuucuaau

SEQ ID NO: 2239803 - RNA, 86 nt, Homo sapiens
uauggucucagaacugucauaaauugcacuggaaguaacugagcgcaugccagugugcgagaguguaauuggccuugagaacuaug

SEQ ID NO: 2239804 - RNA, 80 nt, Homo sapiens
guaaggguucacuggaacuaagggggcuccagcuaaaaaacaaguuugaaaggcacugaucuuauccaguaucaucuuac

SEQ ID NO: 2239805 - RNA, 74 nt, Homo sapiens
cuggucccuacagcuaugugcaugcaugcugccaguuuugucccugcagcugugcacaugcauguaguuuccag

SEQ ID NO: 2239806 - RNA, 62 nt, Homo sapiens
accauuguuccccggucauuuuuguccucaaaaguaggggaacaaaaauggggaacaauggu

SEQ ID NO: 2239807 - RNA, 61 nt, Homo sapiens
uuagacucguaguaacuggaugucugcccauuuccccuuggcauuuauugcuauaagcuga

SEQ ID NO: 2239808 - RNA, 57 nt, Homo sapiens
uagucuuuccuggaacgaucagucauugugcuuuggcugagaucaggauuaaggcua

SEQ ID NO: 2239809 - RNA, 70 nt, Homo sapiens
guuaucaggugcuggcuggucguuauuuaucuucucacagacgaugugagugacugcagcaucuggaaac

SEQ ID NO: 2239810 - RNA, 69 nt, Homo sapiens
uuguuuaagacagggucucacucugucacucaggcuggagugcaguagugugaucuuggcucacugcaa

SEQ ID NO: 2239811 - RNA, 66 nt, Homo sapiens
ugcuaaacuuuugcuuaaaucuuaaucagaugggcuuuuaucuggagagagauuucagcaugagca

SEQ ID NO: 2239812 - RNA, 83 nt, Homo sapiens
uggaggaauggaguuuaagucuugugcaucugauacaauuggauucuggccauagguguucaagaguuugaacccccucucca

SEQ ID NO: 2239813 - RNA, 89 nt, Homo sapiens
uucaauacgugagccucaaagucuucucauuaugucuuccacauauuaaaguggaaguaaccagaaggcuuuggaaauucaggucugaa

SEQ ID NO: 2239814 - RNA, 62 nt, Homo sapiens
gagugaguuuaggaauuuucucagguguguuuuuuauggcugagugauuucaaacagaauuc

SEQ ID NO: 2239815 - RNA, 129 nt, Homo sapiens
ccuccccaaaugcugggauuacaggugcgaggcacugugacuggccuauaauggcgaauuuuaacauaaaaccugguaaguuaggccaggcgcgguggcucacuccuguaaucccagcacuuugggagg

SEQ ID NO: 2239816 - RNA, 55 nt, Homo sapiens
ggugaugcaugccuguagucucagguauuugggaggcuaaggcacgggaauuacu

SEQ ID NO: 2239817 - RNA, 75 nt, Homo sapiens
ggaaagaacaggggaugagggagccaaagaccuugggcauguggcuuggcuuucuggggcuucuguucuaaugcc

SEQ ID NO: 2239818 - RNA, 79 nt, Homo sapiens
ggaacaguugcacagucuuuccuggacuuacaacguugauacuuuggaagaguccaggcaaguuguuguguagaaugcc

SEQ ID NO: 2239819 - RNA, 70 nt, Homo sapiens
auugaaauaugacucaguacaguugccaugacauacuuaccaaaauguugcaugcuuagucauuuucaau

SEQ ID NO: 2239820 - RNA, 64 nt, Homo sapiens
guauuaguuuucuguggauuacaagcaagucacacauuuugaauguacucaaggaaaacuaugc

SEQ ID NO: 2239821 - RNA, 89 nt, Homo sapiens
ccuaucacagaccugccagauuccucugguaaacugcagguucccucugccucaguuguggccagggauucugaccaggagaugauggg

SEQ ID NO: 2239822 - RNA, 98 nt, Homo sapiens
gguuggugaaaaagcaaucacaguuuuugccauaaaguaauggaguuuuucacugccaugaaguaauggcaaaaagugcgauuacuuuuucaucagcc

SEQ ID NO: 2239823 - RNA, 57 nt, Homo sapiens
ucagaguuuuggaagcuggaagucugacaucagggugccagcaucauuagauucugg

SEQ ID NO: 2239824 - RNA, 102 nt, Homo sapiens
aaauacaugagguugaagcagaugaaauucauguuucggcaagcucaaaaauaucaaauagccgaauacugacuauuucaucugguucgaccuaauauauuu

SEQ ID NO: 2239825 - RNA, 127 nt, Homo sapiens
ucccaaagugcugggauuacaggugugagccaccucgcccagccucuagagcaguuuagaaaauguauuaaaagcauucagagugcugggcacaguggcuuaugccuguaaucccagcacuuuggga

SEQ ID NO: 2239826 - RNA, 111 nt, Homo sapiens
auguugagaugauguaagaguccauguagguaguugugggcuugaauggcaucuccaugaucaucagggacccagacuacuucuaucuucuuucuccacuauucucaacau

SEQ ID NO: 2239827 - RNA, 70 nt, Homo sapiens
ggcuauguaagaacaaagugcuggccgggcgcaguggcucacaccuguaauccuagcacuuugggaggcc

SEQ ID NO: 2239828 - RNA, 76 nt, Homo sapiens
uucuuaaggcugcauucacauaucagagcacuauuuuuacuuggguuguaugguuauuuguggaugguugugagga

SEQ ID NO: 2239829 - RNA, 65 nt, Homo sapiens
cuggguaucagcagcaggggcugcagaacagggaauguuacugaacggcaaauguugcugccugg

SEQ ID NO: 2239830 - RNA, 77 nt, Homo sapiens
uaucuuuuugauauguuguuggauucacuuagcuaguauuuuguuaaggauuuuagcauauauguucaucaaggaua

SEQ ID NO: 2239831 - RNA, 55 nt, Homo sapiens
aggacaagagacugggacacugaacaaaggauguugguggguccucacuuguccu

SEQ ID NO: 2239832 - RNA, 69 nt, Homo sapiens
uuuggaauucucauuugaauuuggccaaguuggguacaguuggucaaaucugaugggagaaacaccaga

SEQ ID NO: 2239833 - RNA, 80 nt, Homo sapiens
ugaugacucccugcugcauguacauuuccaggguuuuccuugcuguuucugacaagugaucacagcagcaaagaguauua

SEQ ID NO: 2239834 - RNA, 67 nt, Homo sapiens
ccaaaguauuuucacugauaucuuguuucuaguuuuuaucacaggauaguaggaauuuuacuauugg

SEQ ID NO: 2239835 - RNA, 74 nt, Homo sapiens
uagguugucuuucaggguuuuuauaguuuuagguuuuacauuuaagacuguaauccaucuugaguuaauuucug

SEQ ID NO: 2239836 - RNA, 71 nt, Homo sapiens
gcagagaccucaacuugucacgucucaagcucagauguacaaacuuugggaucgucaagugaggcucgugu

SEQ ID NO: 2239837 - RNA, 79 nt, Homo sapiens
guacuuuguuauggcaacccuaagaaacuaauauaaucccauuuuugucaagucuugggcaaguuccauuuacaaagac

SEQ ID NO: 2239838 - RNA, 75 nt, Homo sapiens
gguacauagugauucucauugugauuguaacuugcauucccuuaaugaugaacaaugagcaucuuuuuaugugcu

SEQ ID NO: 2239839 - RNA, 70 nt, Homo sapiens
gagucuuugcuauugugaauagugccgcaauaaacauacuugugcauaugucuuuauaguagcaugauuu

SEQ ID NO: 2239840 - RNA, 129 nt, Homo sapiens
uacucuucucaucucaagcugguaacaaauaguuugcuaaucaacacuggccugauuagcagucagaccaguggccagaccagugcugauuagcaaacuauuuguuaccagucugagaugagacuggua

SEQ ID NO: 2239841 - RNA, 91 nt, Homo sapiens
caggaaccggccauuuucacuucuuuugugauucuucaucugcuucaggauguauacgugcaggucacaggggauaugauggcuuagcuug

SEQ ID NO: 2239842 - RNA, 66 nt, Homo sapiens
guggccaagucaagggguaccagggacauuauaccuuagaaccucccauagcucuuguugguccau

SEQ ID NO: 2239843 - RNA, 123 nt, Homo sapiens
ccaaagucgcuuccacauuuucagguaucuguauagcaaugccccacaccugguaccaauuuucuguauuaguccauucucgcauugcuauggguaaugaauaaagaaaagagguuuaauugg

SEQ ID NO: 2239844 - RNA, 58 nt, Homo sapiens
uugaauagacagccagcuuuaauuucugaggaaacacugggguuggcuuucuauuugg

SEQ ID NO: 2239845 - RNA, 85 nt, Homo sapiens
agaaguucuaagcaauuggcuuuggaacuccaaggacuuaacaaauaaaucacugggagaccaaagccaucuugguuaguguucu

SEQ ID NO: 2239846 - RNA, 59 nt, Homo sapiens
cuaguaggcuguuuuaaggacuuuggcuauuuauccaaauguaaugaagaagccacugg

SEQ ID NO: 2239847 - RNA, 115 nt, Homo sapiens
cuuggugaaaauuuuacugcuuggaauccagugauugugaaaacauuaagaagcaccaauguuuucauaaugucacagucaaaacaauucucaggcgaugaguucuaccaccaag

SEQ ID NO: 2239848 - RNA, 93 nt, Homo sapiens
ugaugacagguuuugcauaauuccuugcaccagaaucaaacagagcaagaauuuugaucucuggugcaaggaauuaugcaaaaccugucauua

SEQ ID NO: 2239849 - RNA, 63 nt, Homo sapiens
uugauuuugacauuucaguuugcuaacccaauacaaugguagacugaaguaucugagacucag

SEQ ID NO: 2239850 - RNA, 118 nt, Homo sapiens
uuguguuucgaguagggugugucuggaguccccgggaccaccuccuugugcaaugauuggccaagagugcucgugggacucagcaugcagucacacucauggcuacgauucaucacag

SEQ ID NO: 2239851 - RNA, 82 nt, Homo sapiens
aguucuaggguacaugugcacaauaugcagguuuguuacauauguauacacgugccauguuggugugcugcacccauuaacu

SEQ ID NO: 2239852 - RNA, 71 nt, Homo sapiens
gauaguuuacugagaaugaugauuuccagggacauggaugaaauuggaaaucaucauucucgguauauauu

SEQ ID NO: 2239853 - RNA, 67 nt, Homo sapiens
ccaucugucagggagggauagaugauuaauagcaucuguucuagucauccacucuccuuguggaugg

SEQ ID NO: 2239854 - RNA, 62 nt, Homo sapiens
agugauggagccaggauuuaauuccagacaaugaggcuuugggauccuggagcuccaucacu

SEQ ID NO: 2239855 - RNA, 77 nt, Homo sapiens
ggguauuacauugcacuuuauuagauacaaauaaaacuuuuaugaaaguguuuauaggagugaaugcuggaagaccc

SEQ ID NO: 2239856 - RNA, 81 nt, Homo sapiens
augauucaguuuuugaugugcucaguuuggaaggucgguuagacuuccaugugggcuugucaaguaggcagcuggggucau

SEQ ID NO: 2239857 - RNA, 89 nt, Homo sapiens
guguuuucccuuggauuuagcaauagccugcaucugcagcuuguuugaaggacuguuuggaggacuaugcucaggccauuggagcacac

SEQ ID NO: 2239858 - RNA, 69 nt, Homo sapiens
cucugguguuauucauguaguuuucauugauuuuagggcaauaccauaagcuuuggauaauaccaugag

SEQ ID NO: 2239859 - RNA, 76 nt, Homo sapiens
uuuugcuucuuuuggcuuuuccuugaaucugccugugugcccuuagguuucaucugaaaagcgaaaugaugagaaa

SEQ ID NO: 2239860 - RNA, 92 nt, Homo sapiens
cuagucuuguauuguacaguggguguagucuuccuccugaguuuccuugagaugagggcugcacucaaaaacaaagaggaaaacaaggcugg

SEQ ID NO: 2239861 - RNA, 63 nt, Homo sapiens
ggcauauggguuuauuucuggucucaaugcuacuccauugaucuauauuucuauccauaugcc

SEQ ID NO: 2239862 - RNA, 58 nt, Homo sapiens
uccugagaacauguacccaaggcaguugaguuacaacugguuuuauacaguuuaggga

SEQ ID NO: 2239863 - RNA, 65 nt, Homo sapiens
gagcucaggaguggcuuuggcugcaucuuucucauagugaugaauugucagucacugccuggcuu

SEQ ID NO: 2239864 - RNA, 126 nt, Homo sapiens
acagccaguccccaggccugugaagggaggugagcagcacauggcagaacauauugaagaccaaggagucaguggcccucugugugcugcauacggacugccggaggaaggcuugcuggaggcugu

SEQ ID NO: 2239865 - RNA, 59 nt, Homo sapiens
uucauuguauauuaggguaaggguuuugcauauaauccuguaggcuaguagacagugga

SEQ ID NO: 2239866 - RNA, 82 nt, Homo sapiens
aagauuauugguuuauauggguuuuauauuaggcucuuagauauaaaaaggaguuugacagagcuuauguagccuuaguuuu

SEQ ID NO: 2239867 - RNA, 90 nt, Homo sapiens
uguaagaaagacaugagauuugggaugggccagugcuggaauaauaugguuuggcuuuguguccccacucaaauuacauguugaguugca

SEQ ID NO: 2239868 - RNA, 104 nt, Homo sapiens
cugaggcaggagaauugcuugaaaucaggaggcggagguugcagugagcugagaucaugccauugcacuccagcucugggcgacagggcaagacucagucucgg

SEQ ID NO: 2239869 - RNA, 89 nt, Homo sapiens
caagcaugggcaacauggcgaaaccacaugucuacaaagaauaaaaauuagucaggcaugaugcgcacgccuguagucccagguacuug

SEQ ID NO: 2239870 - RNA, 57 nt, Homo sapiens
caguucagggguaccucuauauaccuguguguguaugugguuuuagguguugaacug

SEQ ID NO: 2239871 - RNA, 56 nt, Homo sapiens
agugcauuugcaucucaauauaaagucacugcaugauauaccaaugcggaugcacu

SEQ ID NO: 2239872 - RNA, 85 nt, Homo sapiens
uuauauauauagguauguauauacacacacaccgauuagugacugcuguguguguguguguauguauauauauaucccaguauaa

SEQ ID NO: 2239873 - RNA, 78 nt, Homo sapiens
cuuuuccuucauucucauuucauagugcuuaauuugauaagaguucuaguugcauuggcugcuaugcugggggaaaag

SEQ ID NO: 2239874 - RNA, 66 nt, Homo sapiens
aagcaauugguuuuaguaaaaugagacuucuucaggagucacuccuuuacuguggacccauugcuu

SEQ ID NO: 2239875 - RNA, 89 nt, Homo sapiens
uuggauguacuugcagagcugggauggcgcugacacagccuccugugucacagcuuccaucucggugcgcgggucagaaugagcaccaa

SEQ ID NO: 2239876 - RNA, 55 nt, Homo sapiens
ccuacggaaauaccacaacugaaaucaaaagauuuggacugugagguuucguggg

SEQ ID NO: 2239877 - RNA, 59 nt, Homo sapiens
ugagacugaguuucucucuuguuacccaggcuggaguacaauggcguuaucucggcuca

SEQ ID NO: 2239878 - RNA, 91 nt, Homo sapiens
uuucugaguucugauuggucaaaacuugcugauuucugagugacugauucaggucaaagucuauuggcuaauucagggacauaaacagaaa

SEQ ID NO: 2239879 - RNA, 72 nt, Homo sapiens
aucagauuccagaggcagcacccagaaucacuauauucuauugccuuuucugggugucugucugaauuugau

SEQ ID NO: 2239880 - RNA, 71 nt, Homo sapiens
acuuagaaauuaccuugcacugagucugaaaaauacaaauuuuucuauaaaaagugcuaggauaacugggu

SEQ ID NO: 2239881 - RNA, 86 nt, Homo sapiens
cuagguuaacuagauuauaugucaucacagacacccucuacaucuuagggggugucugugauggcauauaaccuaguuucuucugg

SEQ ID NO: 2239882 - RNA, 72 nt, Homo sapiens
aggcuguugugaggugguagguucacagcagcccugacccccugggcucaagcuauccucccaccucagccu

SEQ ID NO: 2239883 - RNA, 62 nt, Homo sapiens
auuugugccucuggauauuuaaauuauucaaugacaaucuguuuagaugucuuugcauagau

SEQ ID NO: 2239884 - RNA, 89 nt, Homo sapiens
guuggagguggggccuggugggaggugauugggucacuggggugguuucuaaugguuuugcaccaucccucuagugcuguucucacgac

SEQ ID NO: 2239885 - RNA, 125 nt, Homo sapiens
cccagaaccccugaauggcagaaaccccaggcauggcguggagauauggucagccuugggguuaaagguacaucgcucccuccacgccccccaggguuugcuguguggcucagauaggacuuggg

SEQ ID NO: 2239886 - RNA, 87 nt, Homo sapiens
ugcucuuuugauauguuauugaauuugguuugcuaagaauuccuugaggaguuuugcauccauauucauuagugauauugaacugua

SEQ ID NO: 2239887 - RNA, 122 nt, Homo sapiens
auacacacacauauccauauauauacacacacacacacauauauauacauauguguguauacauacauacauacacuagggaugugguguguguguguguguguguguguguguguguguau

SEQ ID NO: 2239888 - RNA, 56 nt, Homo sapiens
cggugcaauucuccugucucagucucccaaguagcugggacuacaggugugcaccg

SEQ ID NO: 2239889 - RNA, 58 nt, Homo sapiens
ugucucaagaccaguguaccuuaggguccugcaacccagaaaacacuguuuagggaca

SEQ ID NO: 2239890 - RNA, 56 nt, Homo sapiens
uacagaguauccauuugaguucauaacauaaauauguacuuggugaaugcucugua

SEQ ID NO: 2239891 - RNA, 128 nt, Homo sapiens
aauaaucaccuggaaaccuuguuuaaaaguguagauucucugggcccuacucuuagauaauuugauuuaguugaucuggagagaggcccgugaacuuacguuuuuaauaagaaacccagaugauuauu

SEQ ID NO: 2239892 - RNA, 76 nt, Homo sapiens
gcccaaauguuuucccaugggauauguaccggaagguuuaucaccacccugggaaacauaaugcugccccuugggc

SEQ ID NO: 2239893 - RNA, 57 nt, Homo sapiens
uuuggcuuugagaagcaguggagcuggggcaucagaauccagugaggcaaaguggga

SEQ ID NO: 2239894 - RNA, 83 nt, Homo sapiens
aagauuuaagagaaucaagguacguugccucagauugaaaaucugcacagaaauguauuuuaucccaaauucucaugagucuu

SEQ ID NO: 2239895 - RNA, 65 nt, Homo sapiens
uagacuggaugaaaguucccagaugccagagaacauuuagcacugggccacauuuauuuucucua

SEQ ID NO: 2239896 - RNA, 56 nt, Homo sapiens
cuuggcacgugauagguguugagcaaacguuuacugaacaucuaucagaugccagg

SEQ ID NO: 2239897 - RNA, 68 nt, Homo sapiens
uagucauuauucagauguguaugugcacuuuuaccucuggcuaugcucauaugcaacuuauagugcug

SEQ ID NO: 2239898 - RNA, 73 nt, Homo sapiens
gugaauguacuuaacacuggauugugcauuuaaaaaugaagaagguuguaaguuuucuguuuuguacauuuac

SEQ ID NO: 2239899 - RNA, 63 nt, Homo sapiens
ugucucugguuaugucauuaagcaguuuggugaacguuuuguaugaggcauacaucaggcaca

SEQ ID NO: 2239900 - RNA, 55 nt, Homo sapiens
acccgggaggcagagcuugcaguaagccgagauugcaccacugcacugccugggu

SEQ ID NO: 2239901 - RNA, 75 nt, Homo sapiens
uggggaagaaaaaacuagguuuguggccaaaaguaaucauauaauaggccugauaagccuuuucuuucugcccca

SEQ ID NO: 2239902 - RNA, 75 nt, Homo sapiens
ugcuuguagagcaguguuacaauuagucaaauucuguacuagaaauauggccuguaacgcugucucagccaggca

SEQ ID NO: 2239903 - RNA, 75 nt, Homo sapiens
cuguaauaucucaguguuugcaaauuccugcaguuagugucucuguauuaucucaguguuuguaaacaauuacag

SEQ ID NO: 2239904 - RNA, 68 nt, Homo sapiens
aucuauggccuuguauaccuggcaaagaguuugaauuuuguguugagcaguaggaggccacuaaagau

SEQ ID NO: 2239905 - RNA, 89 nt, Homo sapiens
gcuguauacuguaacucagggauucugucagaugagugcaaacauuaccgugcuguaaccauccagagucccagggucacauuggcagc

SEQ ID NO: 2239906 - RNA, 70 nt, Homo sapiens
uaguagauuugaugcuguuauaagacacguuguaagacaucagguaaauauagcacaucagauuuuauua

SEQ ID NO: 2239907 - RNA, 65 nt, Homo sapiens
ggauacugcaggagggugcuggucuuaaucaucugagaaugagaucuuaccuuccugccuuaccc

SEQ ID NO: 2239908 - RNA, 80 nt, Homo sapiens
ucuuaaucucuguuucuguuauaauaggaagacugcagcuuuguuuacuuucugaggagaauagagaacagggagaaaga

SEQ ID NO: 2239909 - RNA, 68 nt, Homo sapiens
gagacaugaggaucucuugagcccagaaguuugagaccagcuugggcaacauagagagaucccgucuc

SEQ ID NO: 2239910 - RNA, 75 nt, Homo sapiens
uggaacuuuucaaggugcuuccagacaggucaaauaaugacaguuuacuuaguauggggcuuuugagaagaucua

SEQ ID NO: 2239911 - RNA, 80 nt, Homo sapiens
gcccaaugucccagacaggaugaccuguaauggacaucgacugugcugccuuccuacauccauccugcugggcagugggc

SEQ ID NO: 2239912 - RNA, 56 nt, Homo sapiens
gucauuuccugucaguuucuacguuucguauucuggagucugaacuggacaaugac

SEQ ID NO: 2239913 - RNA, 61 nt, Homo sapiens
uuauaaauuaauucuaccuucugugugcuagggugcauuaaggaaguaauuugguuuauag

SEQ ID NO: 2239914 - RNA, 70 nt, Homo sapiens
acaagcuugauauguguuuuagucaggguuuuccagagagacacaccccacugaacauauauacaguugu

SEQ ID NO: 2239915 - RNA, 130 nt, Homo sapiens
aguugacaacauuuguuauuacuauguccacugcucaucauuaccagucugauaaacagaaagugguaugcccucuauuugcuguuucuagacuguaaaugaguuugaauaauuuuucacaaauuuagcu

SEQ ID NO: 2239916 - RNA, 79 nt, Homo sapiens
ucaggauuucauuaguuuucacuuacagaauuaauuuuaggucacugggaugcuguaugugagaaauaauaaguuuuga

SEQ ID NO: 2239917 - RNA, 71 nt, Homo sapiens
cugggugugaucaugugugccuuagucccagcuacucaggaggcuggcacaugagaaucgcuugaaccugg

SEQ ID NO: 2239918 - RNA, 65 nt, Homo sapiens
gucccaaguguaucagaugugggucccucauuccugcccugcagcuaugucuguugcucuugggc

SEQ ID NO: 2239919 - RNA, 55 nt, Homo sapiens
guguccauauguucucaucauuuagcucccacuuaaaagugagaacaugugauau

SEQ ID NO: 2239920 - RNA, 66 nt, Homo sapiens
cucuccugcucuuggaucacuuucucuguuugaaagaaucccugugacgagcaucccuauggagag

SEQ ID NO: 2239921 - RNA, 77 nt, Homo sapiens
guuuggaaaccuguagccacagguggcgaggaaauuaaagagugcuuggguggcuugauggcacaagguuucugaac

SEQ ID NO: 2239922 - RNA, 84 nt, Homo sapiens
gcaacugaauagaagaugccuuggagggcuguaaguagaguucccuguucaguaguuccaguggguauuuuuuuguaaaguugu

SEQ ID NO: 2239923 - RNA, 60 nt, Homo sapiens
gaagagguagguugagaugggcaucauagacucugugaagaacuuaagaaccuccucuuc

SEQ ID NO: 2239924 - RNA, 72 nt, Homo sapiens
uaaucagucuaauagcauuuauuggcugcuuaccaaguucuggacacugaucuaagugcuuuauauugauua

SEQ ID NO: 2239925 - RNA, 66 nt, Homo sapiens
uuccuaagcuuucccaguggaacauguagucauuuauaacagugacuauacacuggggaaaaggaa

SEQ ID NO: 2239926 - RNA, 96 nt, Homo sapiens
gugggaggauugcuuaagcccaagagagcaaggcugcagugagccaugaucacaucacugcacuccaguuugggcagcagagcaagacccucucuc

SEQ ID NO: 2239927 - RNA, 82 nt, Homo sapiens
ugcuccgucuuguagcugcccagcacgaaguuggcaucugaaaaaugggccacacggugccugagcagcgcgacuggaagca

SEQ ID NO: 2239928 - RNA, 67 nt, Homo sapiens
uccugauggagcuugcagcuucacuccaugaucuucaaaaauggcugacugugcagcuccaucaggg

SEQ ID NO: 2239929 - RNA, 69 nt, Homo sapiens
cagaguaaacuucagaguucuuccuggcauaaacaagcaagaaggaagacccaucugggguuugcccug

SEQ ID NO: 2239930 - RNA, 79 nt, Homo sapiens
ggaguucggaauuuaugcuacauguguuggaaaaaccaaugaaggguuuucagcuagguaacaugauccgauuuacucc

SEQ ID NO: 2239931 - RNA, 71 nt, Homo sapiens
cuucuaaauacuuugauaucuauugaucauaauuuuacucccuacuucagugagauuaaguuguuuagaag

SEQ ID NO: 2239932 - RNA, 60 nt, Homo sapiens
cuguuauguucuagagggugcaaauaaguuuuccuguccccucugguccuaauauagcag

SEQ ID NO: 2239933 - RNA, 57 nt, Homo sapiens
gaugaggcuagagacauguguagggagcauaccauagacagauuuguaggucuuauu

SEQ ID NO: 2239934 - RNA, 70 nt, Homo sapiens
guaguuguaacaauuaacaguacuaccagccguauaugggagggcucuaguaccauauuguuggcagcac

SEQ ID NO: 2239935 - RNA, 95 nt, Homo sapiens
guggaggcaauuaugaaggacuccaacuaggagagguguggacugagagaacacccugguagcuaugaagucuuuacuuuugauugggcauccau

SEQ ID NO: 2239936 - RNA, 73 nt, Homo sapiens
auuagguuggugcaaauguaauugugguuuuugccuuuaaaaguaauggcaauugcauuugcaccaaccuaau

SEQ ID NO: 2239937 - RNA, 68 nt, Homo sapiens
gcucuauugcccaggcuggagugcaguggcacuaucucagcugacugcaacgccuccuggguucaagc

SEQ ID NO: 2239938 - RNA, 89 nt, Homo sapiens
aaaugucuaggcaggucuaaggaauccugcagaugauuuuggauccauagggauuuugcaguuuauuccuggggcucugcuugacauuu

SEQ ID NO: 2239939 - RNA, 63 nt, Homo sapiens
guacacauucugauugauugguaguggcuguccagagugcuaucauugauuagugauguguac

SEQ ID NO: 2239940 - RNA, 70 nt, Homo sapiens
gggcuuucaccuggagccuucacauucuggggcugccagaagggguggccagugugacuuugaggggccc

SEQ ID NO: 2239941 - RNA, 67 nt, Homo sapiens
ucuuuggagcuguugguuugaaagaauuugucuuuggaacaagcuuuuuaucagucagcuuuaaaga

SEQ ID NO: 2239942 - RNA, 85 nt, Homo sapiens
agcaccuauuguguauuagguuggugcaaaacuuucaguggcaaaaauugcaauuauuuugcaccaaccuaucagguauugugcu

SEQ ID NO: 2239943 - RNA, 99 nt, Homo sapiens
gauggacccuuccuuggacaaaagagcucucuguagcaugugauucugcuuaauagcauuuuaccuacagcagaacuucuuucaaaguuggaguccauc

SEQ ID NO: 2239944 - RNA, 72 nt, Homo sapiens
caccauuauaaauugacuuauuugcuuucaaaucucacuggaaaauagcagagcaguggauuuugugaggug

SEQ ID NO: 2239945 - RNA, 130 nt, Homo sapiens
guagucuuuccuuguguucauaaaugcauguguuucucaaguuuguauuaggaaugagauugcuuggcuauagauaugugaacacuuagcuuugagagaaugccaaauaauuuccgaugugguuggacuc

SEQ ID NO: 2239946 - RNA, 69 nt, Homo sapiens
caugaguugguaagguggaugaugaauaaauggggauuuauuuagcuauuuucuuuaucuuugcuuaug

SEQ ID NO: 2239947 - RNA, 67 nt, Homo sapiens
ucucuagagagccugguguucacgcccaggacaagcccuggggaaaugagagccaagcuccugggga

SEQ ID NO: 2239948 - RNA, 67 nt, Homo sapiens
uuccugugacuguguggcaccccgagucuugccauuacuacucauugaaugucagcaguuucaggaa

SEQ ID NO: 2239949 - RNA, 76 nt, Homo sapiens
guccccgacguuuggcuugaugaaacauuuucuugauauuuuucaacaguuaucagcgugcaaaucuuuggaggac

SEQ ID NO: 2239950 - RNA, 69 nt, Homo sapiens
auaguuucuauuuuauauguacuauauacuguauucuuagaauaaagugagcuggagaaaagaaacugu

SEQ ID NO: 2239951 - RNA, 103 nt, Homo sapiens
aaagugguuagugcaacugagaagcugaauuuuuauuguauuuagauuuauauuuaaaugcucacauaaagguagcagcuacaguauuggacggugcagcuuu

SEQ ID NO: 2239952 - RNA, 83 nt, Homo sapiens
uacaucuguauauguuuucauaaggcuagaaggacuuuaaaauauuaucugauuuauuguuguggauagcaugugcuugagug

SEQ ID NO: 2239953 - RNA, 75 nt, Homo sapiens
gaauuauaugucacagaggcuaagaccccaccagguugacaagcuaggccuggguucugagucuuuugaaaauuc

SEQ ID NO: 2239954 - RNA, 68 nt, Homo sapiens
uugaggucaucacuuucuauuucugugccauagguuucucaaugguaaauaagaguggugagucucaa

SEQ ID NO: 2239955 - RNA, 58 nt, Homo sapiens
ugagccaggaucuuaucacugaacuccagccucggugccacaaugagauccugucuca

SEQ ID NO: 2239956 - RNA, 70 nt, Homo sapiens
acaaacaaaaagggcuugaauacucuuuuuggaauauuagaagcuguauaauuaugcccugagugugugu

SEQ ID NO: 2239957 - RNA, 70 nt, Homo sapiens
ccuauuuuguauuuuacaagccuaauuuuggucauuugacccuaagguagguuccaaaauaccuaacagg

SEQ ID NO: 2239958 - RNA, 69 nt, Homo sapiens
uacuugaaauguuuucccgaccuuggccaaaagcagguugaguuuuccauuggaaaacuuuucuaagua

SEQ ID NO: 2239959 - RNA, 84 nt, Homo sapiens
agaucauccuuucauuccucuagugacaaauuucaugaugcgaaaaaugauguguuucaugagacacacuggaaaggaaaaucu

SEQ ID NO: 2239960 - RNA, 99 nt, Homo sapiens
agcugagccuucucuuuggaaaccuuguagccacagguggcgaggaaauuuaagagugcuuggguggcuugauggcacaagguuucugaacaggcagcu

SEQ ID NO: 2239961 - RNA, 99 nt, Homo sapiens
guuuaagauuuaguaagacagucauugcauguuaauuaaacagcaauggaucauuuaccaaccuguuuaaugagguguaacaacuauugaauauaaaac

SEQ ID NO: 2239962 - RNA, 63 nt, Homo sapiens
cacugagcugauagaauuccaguuagaaagcaaagaaacuuggcauuuuaguuagcuucagug

SEQ ID NO: 2239963 - RNA, 77 nt, Homo sapiens
accuuggauguagaaugacaggcaaaguagcuaaguaaauguugguugaaguagcauuucaugucuacaucacaggu

SEQ ID NO: 2239964 - RNA, 78 nt, Homo sapiens
aacaaaccuccuggggagaacauaaaguguauugagaguuacagaacacuguauccuucuguccuuuuggaaauuguu

SEQ ID NO: 2239965 - RNA, 65 nt, Homo sapiens
gauggcacuaagccauguaggaaggauccaucuccaugauccaauaccuccaacuaagucccauc

SEQ ID NO: 2239966 - RNA, 94 nt, Homo sapiens
cugccagcguuccugagccuuguaucuaguagaagucuguuucuccuaacggccacuuagauuacagguaaaauguagucaggaauuucugcag

SEQ ID NO: 2239967 - RNA, 92 nt, Homo sapiens
ugagauuuuggaggcguggcagucuuuggcaaugacaacuuuuggguuaucaccuugcaguggaugcuauaauguauugccccagacuuuca

SEQ ID NO: 2239968 - RNA, 91 nt, Homo sapiens
cccugucuuguggaaucagaauuacugaauggagcccaggcauuuuuuaaaaaaguucccuugguaauucuguuccuuagcaagucuuggg

SEQ ID NO: 2239969 - RNA, 128 nt, Homo sapiens
auuuccucuuuugauugguuacuuuuauggagagauauuuaugguuuuaauaagauuucccucccaucuguuuugauccuaccguaaaaucaucccauguuugaugggcagccgguuguuagggaaau

SEQ ID NO: 2239970 - RNA, 56 nt, Homo sapiens
uugagauggaguuucacucuugucgcccaggcuggagugcaauggcaccaucucag

SEQ ID NO: 2239971 - RNA, 60 nt, Homo sapiens
ggcgcaguagcggggcccagagcauacaagggauugggcuuuggcuucucugcugcagcc

SEQ ID NO: 2239972 - RNA, 68 nt, Homo sapiens
uugcuugagccugggagguggagguugcagugagcuaagguugcaccacuacaccccaggcugggcaa

SEQ ID NO: 2239973 - RNA, 72 nt, Homo sapiens
cagauaaaguuuauuggcaccaccauguccuccuucccugggcugugaguggacgugaccaauaaacugcug

SEQ ID NO: 2239974 - RNA, 73 nt, Homo sapiens
gcugcugcuguuuaguuucuccuggguuguggguaucuuucccauuccagaagauuugagcagacaggccagc

SEQ ID NO: 2239975 - RNA, 87 nt, Homo sapiens
agcuggcugacuucuuaggugcauggaaguguuuucccuucauugcaaggguuaacacuuucagcgccuacccugugucaggcaguu

SEQ ID NO: 2239976 - RNA, 61 nt, Homo sapiens
ucuucugugauucuucacuagcuucaggccaucuggauguauacgugcagaucacagggga

SEQ ID NO: 2239977 - RNA, 85 nt, Homo sapiens
ggauccuuagagggcccuuuuggucuaucagagaagcaugacuugaugcuccugaauugaaccugagguacccacaugaggaucu

SEQ ID NO: 2239978 - RNA, 58 nt, Homo sapiens
agugugaccuuauugaaaauaauguugcagauguaauaaguugagaugaggucauacu

SEQ ID NO: 2239979 - RNA, 57 nt, Homo sapiens
uuauaacuggggaguuccuugaauggaaauauguucacaguggcugcuuaauuguga

SEQ ID NO: 2239980 - RNA, 79 nt, Homo sapiens
cuucucuucaaguggccuguaacccucucauaggcaaaacucagggcugucugauggcagugguucagguggauagaag

SEQ ID NO: 2239981 - RNA, 65 nt, Homo sapiens
uuucuuuguuguuguagcuggagacaauuagguaacacaaauugucacccuacauaacagggaaa

SEQ ID NO: 2239982 - RNA, 76 nt, Homo sapiens
guguuuccuugagcucuucuagcaauucuagcaaguuauggcuagaauaaccuaaggaaggguugugggaauuuac

SEQ ID NO: 2239983 - RNA, 56 nt, Homo sapiens
ugaauagugcuguauuaaacauacgugugcaugugucuuuauagcagcauuauuua

SEQ ID NO: 2239984 - RNA, 121 nt, Homo sapiens
uuugggggguuguuuuucaucuuguugguaagauuuaucacauugacugauuugcauauguugaagaauccuugcauccauuggauaaaucucacuuugucaugaugaacaaucuuuuaaa

SEQ ID NO: 2239985 - RNA, 69 nt, Homo sapiens
ucuuuauagcagugugagaaugaacuaauacagaaaacugguacugggagugaggcacugcuauaaaga

SEQ ID NO: 2239986 - RNA, 55 nt, Homo sapiens
caggcaccugccccaaaaugcagccuggcugcuuuuugguagagcaggugugcug

SEQ ID NO: 2239987 - RNA, 129 nt, Homo sapiens
ugggaccugcucuggggcucuggucuuugguggcuggggagggagaaguaggcggcauaguggaaaaacaucugcccguaauccucuccccaguacacaggcaggccacguuuuaguagcagcaucuca

SEQ ID NO: 2239988 - RNA, 129 nt, Homo sapiens
ucacauuuuauacacuguuagggcugaacugugucuccugaaaauucacauguugaaacccaaagccauaccucagaaugugacuuauuaggagacacagccuccaaagacgugauuaaguaaaaguga

SEQ ID NO: 2239989 - RNA, 100 nt, Homo sapiens
agaugcuuuucaaaauagaggucaucuucuuggagauuucuucuuaaugguaacuucuaaagauguuaaaagcuaucuccaaggucaucucagggcaucu

SEQ ID NO: 2239990 - RNA, 109 nt, Homo sapiens
uaaaaggauuuuggaaaccuuucuccuucaugcaucaauguauccauggagccaaagaugagauauuuaggaugguggagggcaagagaggaaaggacaucaccuuuua

SEQ ID NO: 2239991 - RNA, 63 nt, Homo sapiens
gcuuugaaaaggaacaacaaagggagcucgcuccaaccugguagcuccacucguucccaaagc

SEQ ID NO: 2239992 - RNA, 123 nt, Homo sapiens
ggcaugcgccaccacgcccagcuaauuuuuuguacuuuuaguagagacgggauuucaccuguugaucaggcacccugucucuacuaaaaauacaaaaauuagcugggugugguggcgcaugcc

SEQ ID NO: 2239993 - RNA, 65 nt, Homo sapiens
guggccuagaaucuaacucgcaugaaaaugucacaaacauucagcggauaguuucuaaaugccac

SEQ ID NO: 2239994 - RNA, 76 nt, Homo sapiens
gggggcuugggcauuguuccuaguuaucugauuccugcaguggggaaagaaguggaggacauugcccaucgcccuu

SEQ ID NO: 2239995 - RNA, 80 nt, Homo sapiens
ugacuauugucuuaagugaggucagucuugugaaggauuguguuuuuaaucacaaagcuuggccugcuucugaauaguca

SEQ ID NO: 2239996 - RNA, 88 nt, Homo sapiens
gaugaauaaaugcuaaccuuuagucagcucuuaggaugcaccaggcagugcuccaagugcaugccagggguuaagucauuuaaucauc

SEQ ID NO: 2239997 - RNA, 64 nt, Homo sapiens
ggcuauugaagcuugugcguauaucacgaaguucucgugcuaugguuuuuagcuccaucagguc

SEQ ID NO: 2239998 - RNA, 77 nt, Homo sapiens
ggcacacuuacauagcccauuuugcacugagaugcuagauccuagccaggacgacgauuggcuuccuauuugaugcu

SEQ ID NO: 2239999 - RNA, 66 nt, Homo sapiens
gcagcauucaccaugagcugacuuaagaacacuugggacuuaagggagcaucagugguaguguugc

SEQ ID NO: 2240000 - RNA, 64 nt, Homo sapiens
cuugccuauugucaaaaaauagaauuuucuaagguuuauucuauguuuuugcuaguaguguaag

SEQ ID NO: 2240001 - RNA, 63 nt, Homo sapiens
gagacuuuaucaugucuguguguaccuaggcaaugccuaguacagauggcaugcuguuuucuu

SEQ ID NO: 2240002 - RNA, 118 nt, Homo sapiens
cagcuuucuauuccuaugugcucacugugccuacugugggagcgucaguugguaggagagaguuccaguuagaggcuuucagcgguaggucccaggaagcaaugaaagagauacguug

SEQ ID NO: 2240003 - RNA, 56 nt, Homo sapiens
gugaggggaggggcgucugccauuacugaauauugaguaggugguuuuccccucac

SEQ ID NO: 2240004 - RNA, 91 nt, Homo sapiens
ucugaacucaguucuugcaguucccaaauucacagcuaucuugggauauguugauuugugggcugcaaaauaugagaaauucuaccucaga

SEQ ID NO: 2240005 - RNA, 120 nt, Homo sapiens
auauauauuugcaauaaauaaaugacuacauguaaugaauauaugcacacgugugcauaugcauauuuauauacgcauauauauauguguguauauagacaugugucuguggauauauau

SEQ ID NO: 2240006 - RNA, 63 nt, Homo sapiens
gauggcagagucuugcaucuuuagaguaugaacuuuuaauucugaaggugaugagaugccauc

SEQ ID NO: 2240007 - RNA, 65 nt, Homo sapiens
uacauauauaagguagaaauagucacaucuguaaugcagugguccugguccccuuuauguaugug

SEQ ID NO: 2240008 - RNA, 76 nt, Homo sapiens
aaggaaaggaaggaaagugcacuuggaagagggccaggcgggcgacguggagggcaagugccucuuuucucuccuu

SEQ ID NO: 2240009 - RNA, 79 nt, Homo sapiens
aaagaaagcagacauguucauuuugaaaggagguacuuuuucacucacuagguucaauaugaacaugucugcuuuuuuu

SEQ ID NO: 2240010 - RNA, 73 nt, Homo sapiens
ucaaucauuuuaaagugcacacgggucaggcgcgguggcucacgccuauaauccuggcacuuugggaggcuga

SEQ ID NO: 2240011 - RNA, 66 nt, Homo sapiens
acccaggcagucuggcucccaagugcauauucuagagagucacuaugcccaggcugcucugaaggu

SEQ ID NO: 2240012 - RNA, 67 nt, Homo sapiens
aaccucauauguaugugcaauuuuguguauauggauacagaauuacacauguauguauggcgggguu

SEQ ID NO: 2240013 - RNA, 93 nt, Homo sapiens
ugcugagucuaaugguaauuauguuuugcauucuuugaaaaauugccacacugcuuuucacagcggucgaacuaauuugcauuuccaccagca

SEQ ID NO: 2240014 - RNA, 57 nt, Homo sapiens
cauaaagauggaggaggccaggcaggguggauuaugccuguaauccagcacuuugug

SEQ ID NO: 2240015 - RNA, 56 nt, Homo sapiens
uauugugcauguugaauaacuaauuagcaaguuugguugaauaaauauguauaaua

SEQ ID NO: 2240016 - RNA, 68 nt, Homo sapiens
gcgagaauuauugagcauguggcuuuagaagcaaagcuucugugguagaaaucucaaauagaacuugc

SEQ ID NO: 2240017 - RNA, 71 nt, Homo sapiens
uucucuaugucuuucauauuuuggggauggugcuuuguccugugaccucaauuuucugaaggauguaagaa

SEQ ID NO: 2240018 - RNA, 64 nt, Homo sapiens
uucaguuugccaguauuuuauugaggauuuuggcaucgauguucaucagggauaguggccugaa

SEQ ID NO: 2240019 - RNA, 86 nt, Homo sapiens
cuccugcugggacccgggaggacaaauaggugcagccccccuagaaugguugagccaaggauugucuuuccugguuccugaaggag

SEQ ID NO: 2240020 - RNA, 87 nt, Homo sapiens
cauugagucaucugaaaauuuuguuguucacauuagcauuuuuuauagugcaguguucuuuagaggaaauauuuugaggaccaaaug

SEQ ID NO: 2240021 - RNA, 71 nt, Homo sapiens
aagccuuuccacauucagcacacauauaggguuuuuccccaguaugaguuuucugauguguggugagguuu

SEQ ID NO: 2240022 - RNA, 61 nt, Homo sapiens
gcuggcaugguuagcugaggguucugaaauccucacauagucccugcuaaucuucuccagu

SEQ ID NO: 2240023 - RNA, 63 nt, Homo sapiens
cuuauaagugcaaugaguguggcaaagccuuuagugggcagucaucacuuauucaucaucaag

SEQ ID NO: 2240024 - RNA, 68 nt, Homo sapiens
uuucaucuccuuugcuugccuuuuaccucuuucuuaagacugcagugaacaagcaaaggcaggaggaa

SEQ ID NO: 2240025 - RNA, 76 nt, Homo sapiens
aaggaaugagugugaccugccaagagauaccggacaguggccuccacuuucucugccuaggucggccagucuccuu

SEQ ID NO: 2240026 - RNA, 71 nt, Homo sapiens
aguggaagugguauaaguaccuccuuucauugacuagaacaggugugggaagcucuuauaccaacaccauu

SEQ ID NO: 2240027 - RNA, 96 nt, Homo sapiens
ugagacagagucuugcuguugccuaggcuggagugcaguggcacaaucucagcucauugcaacugccuccuggguucaagcaauucuccugucuca

SEQ ID NO: 2240028 - RNA, 60 nt, Homo sapiens
uuggucaggcuaaucucgaacguccaacgucaggaauguccggugauucgccugcaucag

SEQ ID NO: 2240029 - RNA, 101 nt, Homo sapiens
aggggaguuggggacagucagcagugagagaccucacccagcucccaugcaguuguugaggucagucucacuucugcagugccccacucagaccauacccu

SEQ ID NO: 2240030 - RNA, 78 nt, Homo sapiens
cugagauaauuucuaggugucauaucauggagggucuuguagauacacucuacuaaggacacuggacuuuuaucuuag

SEQ ID NO: 2240031 - RNA, 77 nt, Homo sapiens
ggagaaguuuugugucuagcucagggauuguaaacgcaccagucagcacccugucaaaauggaccaaucagcucucu

SEQ ID NO: 2240032 - RNA, 80 nt, Homo sapiens
uaaguggugugacucauagcucucaguuuuugguagacagcugaagccagagaacauucagagcuguagacaaacacuua

SEQ ID NO: 2240033 - RNA, 70 nt, Homo sapiens
accauagguuuucacuguagauucuguggacccccagccuauggauucugucagauggcaaaucuauggu

SEQ ID NO: 2240034 - RNA, 81 nt, Homo sapiens
gaucagagcucaaauuucucauugaucaucaccuucucaguuuggggagaaaauucaugugagcaaguugggcucaagauc

SEQ ID NO: 2240035 - RNA, 73 nt, Homo sapiens
gcuuugugauguguaaauacaagugcuugaaauagucugaaguuccauacaaauguauuuucacaaaugaggu

SEQ ID NO: 2240036 - RNA, 64 nt, Homo sapiens
uguguaaagcuuguuccagaaacagugagaaaaccauuuggauuggagcuuaagguuugacaua

SEQ ID NO: 2240037 - RNA, 78 nt, Homo sapiens
cccaguacugccggggacccaacucaagcuaucucaaaccaagugcugagcucagcuaguugaggugucugggggggg

SEQ ID NO: 2240038 - RNA, 65 nt, Homo sapiens
aguaggcuuagcugucaagggcauucccaucaacaaagcccuguugacagaaaauugaguuugcu

SEQ ID NO: 2240039 - RNA, 102 nt, Homo sapiens
ggugugguagcacaugccuguauucucagcuucucgagaggcugaggugggaggaucacuugagcccuggaggcagaggcuacagugagcuaugaucacgcc

SEQ ID NO: 2240040 - RNA, 63 nt, Homo sapiens
uuaugguuuucucucacgcaggaguagaaaggcaggguaccuggagugaggaggagcacauag

SEQ ID NO: 2240041 - RNA, 84 nt, Homo sapiens
cuagggccacauagcuagucaguagugaagccuggauccaaacccagaucugucugucugcacagcucaugggaaaaacccuag

SEQ ID NO: 2240042 - RNA, 70 nt, Homo sapiens
gcuuccuugcacuggguuagaacaugcuccuuuagcuuggaggaguuuguucucacccaccuucugaagc

SEQ ID NO: 2240043 - RNA, 65 nt, Homo sapiens
ucucaugagauuaauaugacugccagggcccaguccuauguggaggaugggugucauucucgaga

SEQ ID NO: 2240044 - RNA, 55 nt, Homo sapiens
guggaauuauagagacaucuugaacuuaagaaaugcuguguaccuaugguuccac

SEQ ID NO: 2240045 - RNA, 56 nt, Homo sapiens
ugaguucuuuuacauuuugaaugcaaugauagacuguggaaaggugaaggaacuca

SEQ ID NO: 2240046 - RNA, 106 nt, Homo sapiens
aggcugaggcagaagaaucgcuugaacccggugggcggagcuugcagugagcugagauagcgccacugcacuccagccuggguggagcgccacugcacucuagccu

SEQ ID NO: 2240047 - RNA, 56 nt, Homo sapiens
uuaggaauuugaaucccaguuaagccauuuacuagcuggguugccagguuacuuaa

SEQ ID NO: 2240048 - RNA, 76 nt, Homo sapiens
uuucauuuaugagcugaaccaugaaacuugcccuuaucuacuauugguuucccagugguacaguuuauauaggaaa

SEQ ID NO: 2240049 - RNA, 116 nt, Homo sapiens
gcugucaguaauuaagucuugucaguuuggggccaguuguuacagaaaugaucauuuaucuuccuggauugucacuggagauagcaaucugguuuccugcaagucugacuuauagc

SEQ ID NO: 2240050 - RNA, 57 nt, Homo sapiens
gaggagugaauuguaugcuguaaagugguacauuuuauggcguaugaauuauaucuc

SEQ ID NO: 2240051 - RNA, 56 nt, Homo sapiens
gaagccuugagggacugugcuaucuggcugagauacuacacuuuucccaagguuuu

SEQ ID NO: 2240052 - RNA, 59 nt, Homo sapiens
uuauagcacuaagaagguaauaauuacucuauguguuaguuaccucuuggcugcuguaa

SEQ ID NO: 2240053 - RNA, 66 nt, Homo sapiens
acguuuuauaacuggaugacacuugagcuauuugugguagucaagugguuucugaguugggggcgu

SEQ ID NO: 2240054 - RNA, 65 nt, Homo sapiens
cucacaaguuaguauugguuuugggaaguugcuuugcuuuugauguugauacuaccuucagugag

SEQ ID NO: 2240055 - RNA, 56 nt, Homo sapiens
auaaugaacagagccuugagaaccugugacaauagguccaacuuuucugucauugu

SEQ ID NO: 2240056 - RNA, 77 nt, Homo sapiens
acacccuuccauggaguugucuacuauguccaaggaacuagacuggaaaauggaagacuccucuuuggguauggugu

SEQ ID NO: 2240057 - RNA, 80 nt, Homo sapiens
cuguauuggaucauuucauagaggacauuacuggagcagucacugaaacuccaauagggcuucuaggugaaucaaaacgg

SEQ ID NO: 2240058 - RNA, 99 nt, Homo sapiens
ucagagaaauuuacccugugagauuaucuguacauaggagcuuauagagguuucugcaacacagagauuucauucaaugaccagaguuuauuucucuga

SEQ ID NO: 2240059 - RNA, 56 nt, Homo sapiens
gagccugggaugaggcaggaaggagccaagggccagagacugccuuauuccagcuc

SEQ ID NO: 2240060 - RNA, 57 nt, Homo sapiens
cuggagacaaagauagaaaagcagccaaggugcuuaacaaaggaucuuuuucucuag

SEQ ID NO: 2240061 - RNA, 87 nt, Homo sapiens
uuuaucugccugucauuuuguuuucauuauccaugauagcaaucucuugcauggcuuaugagaacauaucaagugauugguuuuaaa

SEQ ID NO: 2240062 - RNA, 68 nt, Homo sapiens
gccauucugaggucuuuauuuagugcucaggucauaugaaugggcuguauagaggggacuggaugggc

SEQ ID NO: 2240063 - RNA, 66 nt, Homo sapiens
gaguccucaguggauguucucacagcuguuguuagauggccauccccugagauccacugaagauuc

SEQ ID NO: 2240064 - RNA, 84 nt, Homo sapiens
ugggacucugauaagucuggcacagucuagccaucuguagagaacugagauggcacuuuggacugcuagaugcuguagauccua

SEQ ID NO: 2240065 - RNA, 60 nt, Homo sapiens
ggcuuagagcaaaccagucacaaauuaaagagaaacaaaugugaccucugucucugaguc

SEQ ID NO: 2240066 - RNA, 60 nt, Homo sapiens
acauugcauuuucagguuggucugcaucugugcaggaccaacuguugcagaugccucugu

SEQ ID NO: 2240067 - RNA, 75 nt, Homo sapiens
aacuuaaaauauuagguuggugcaaaaguaauugcgguuucuugccauuacuuuugcaccaaccuaauaaaaguu

SEQ ID NO: 2240068 - RNA, 110 nt, Homo sapiens
uucacugauaucuuuguuacuuugcauuucuguaguacagucaugcauugcuuacugauggggauauguucugagaaaugcauuguuaggcaauuucauuguuacgugaa

SEQ ID NO: 2240069 - RNA, 94 nt, Homo sapiens
uuucuuauagauuagaugcuauucgaccagguuuaugccauggucucugacaaaccacauaaaucuuguugaauagcaccuaacguauaagaaa

SEQ ID NO: 2240070 - RNA, 93 nt, Homo sapiens
auuuaagagggcagaauaaucaccaugaaaaaaucuguuuuucuugcuugauaugcugauguuuucagguaauucugaugcucuaacuugaau

SEQ ID NO: 2240071 - RNA, 57 nt, Homo sapiens
gggggaaucucugcaggcccucugauaacuuuuuauguggugcuugaauauuccucc

SEQ ID NO: 2240072 - RNA, 83 nt, Homo sapiens
aggacagugccuaacauauguaaaggucuuugaguucuucaggaauaaauggcacuuuauaaauguuaaacuacaaguuuccu

SEQ ID NO: 2240073 - RNA, 55 nt, Homo sapiens
uuauaugcuaaacaagggguggauuauucauacuuccccuuuuuagaucauauag

SEQ ID NO: 2240074 - RNA, 68 nt, Homo sapiens
uuuauaauugaaugauaugggacauuuugucuaaugagaaaagaugugcugcuucauacaagcuuaga

SEQ ID NO: 2240075 - RNA, 58 nt, Homo sapiens
aagcacguggcccaaaauuguaggaaaaaaauguauuacaguggcaugucaggugcuu

SEQ ID NO: 2240076 - RNA, 55 nt, Homo sapiens
ugagauggagucuugucgccuaggcuggaguguggagcacaguggcgccaucucg

SEQ ID NO: 2240077 - RNA, 71 nt, Homo sapiens
cugagggugaggccuuuaacuuccaacaucuucuccauuuucugaugauaauuguugagcuuuuccuuuag

SEQ ID NO: 2240078 - RNA, 106 nt, Homo sapiens
acagauuuuuauuugcucuuauuuuauuugacaaugugugcuuguauuuuauuugaaaugcacuggcauuucuauuguucugaaguaagauaucauaucuuucugu

SEQ ID NO: 2240079 - RNA, 86 nt, Homo sapiens
gcaaugacugccagguaaaugugagacucaguuuccucaucuggcaaggggagcuggucugauacuuaccuccccaaacucaaugc

SEQ ID NO: 2240080 - RNA, 81 nt, Homo sapiens
auuuagaugacagagguaagcaagucagcauuaaaaucauuuaugguguuucuaaagcauuguccuguguuuaagcuaaau

SEQ ID NO: 2240081 - RNA, 102 nt, Homo sapiens
agggagcucuggcuuagauucuguauuauuuuguguuauacugauuuuuagaaaauggaauguagcguugacacgagcacaaaucucagcaagggccuaccu

SEQ ID NO: 2240082 - RNA, 129 nt, Homo sapiens
uguuuuuagaccaacuccaaaaucuagugcuuuggauaaaugucaguuuaagcauguugggcuagauuuugauucuuaagauucugcauauacucuagaagcuggauuagaguuccagguaaauagaca

SEQ ID NO: 2240083 - RNA, 107 nt, Homo sapiens
auaguguaguagagcuaggaggagaggguccuggagaagcguggaccgguccggguggguuccggcagguucucacccucucuaggccccauucuccucugcacugu

SEQ ID NO: 2240084 - RNA, 72 nt, Homo sapiens
agggaacacuuuuacacugguggugggaauguaaacuaguacagccuauagaaaacaguguggagauuccuu

SEQ ID NO: 2240085 - RNA, 88 nt, Homo sapiens
ccugugaaaagcagaagucacagaugucucucagaagacgugaaauccaccagagagugacacugucuucugcucuuaaauccacagg

SEQ ID NO: 2240086 - RNA, 66 nt, Homo sapiens
guauuucuaguucuagaucccugaggaaucgccacacagacuuccacagugguugaacuaguuuac

SEQ ID NO: 2240087 - RNA, 88 nt, Homo sapiens
ugaaaagcuucugaauaaagguguuguucaacacaauucuagaaugcuggaccuuuuaugaacagcacguuuauucagaagccucuca

SEQ ID NO: 2240088 - RNA, 58 nt, Homo sapiens
agggugggggcagcagagacaaugcccauucuaggcaccccuuugguccccgcacccu

SEQ ID NO: 2240089 - RNA, 72 nt, Homo sapiens
guuugcccagcaccauuuauugaaaagacagucuuuuccccauuguguuuucuugguggcugugucacagau

SEQ ID NO: 2240090 - RNA, 80 nt, Homo sapiens
cuauucaucaaaauguguauccauuauaaacaauggcuaauucacuauaguuuaucuucuggauggacauugauggauag

SEQ ID NO: 2240091 - RNA, 91 nt, Homo sapiens
uggcauagaugaggagcuuaaagcuagcgcugcuuggaaggauuuuuaaaaaucuacagccagucugguuuguagcaucgguuuagggcca

SEQ ID NO: 2240092 - RNA, 72 nt, Homo sapiens
uauuuuccuuuuauacucgucugaaugauucuuugaaagagaauguuuucaugagaaugaauaggggaaaua

SEQ ID NO: 2240093 - RNA, 88 nt, Homo sapiens
ggagaaucgcuugaacuuaggagguggaaguugcagugagccaagaucacgccauugcaccccagccugggugacagagcgagacucc

SEQ ID NO: 2240094 - RNA, 60 nt, Homo sapiens
ugugaauagugcugcaacaaauauacgugugcaugugucuuuauagcagcaugauuuaua

SEQ ID NO: 2240095 - RNA, 67 nt, Homo sapiens
ucugagugguaguacaggagauaccggggaggguucccuggcuuuuguugguaccaccuuauccaga

SEQ ID NO: 2240096 - RNA, 59 nt, Homo sapiens
uccuagagucucauaacaagucaacugaauguuuauuguguuugaaugaggcuccagga

SEQ ID NO: 2240097 - RNA, 75 nt, Homo sapiens
uauguggcaaauagcaauaggaggguaggugaaauaacuucaaugauaccuuaauuauugauuguucacugugua

SEQ ID NO: 2240098 - RNA, 82 nt, Homo sapiens
acuggagaaugguuggcuaguagcacacuagguuaaaauugacccaaauuaaccaaaaucuacuagucaagucuuuuccagu

SEQ ID NO: 2240099 - RNA, 57 nt, Homo sapiens
aguauccauguguuuucaucauuuagcucccacuuauaagugagaacaugugguauu

SEQ ID NO: 2240100 - RNA, 101 nt, Homo sapiens
auguaguugagcgguuuugagugaguuucuuaauccugaguuguaguuugauugcacuguggucugagagacaguuuguuauaauuucuguucuuuuacau

SEQ ID NO: 2240101 - RNA, 95 nt, Homo sapiens
cucagaugucuaccauaaggggcuuucucugaaagagcauacagauuuggguugugugcucauuuagagagaagcaccuuugguaggcaucugag

SEQ ID NO: 2240102 - RNA, 68 nt, Homo sapiens
ucacgggaaaauuauugccaucauaaucuugucucauaugguuacucaaggcaauacuuucuuguugg

SEQ ID NO: 2240103 - RNA, 63 nt, Homo sapiens
uacauauaaggagacuagggcauagagaagucgaacgacaugcccaaguuuuccuaaugagua

SEQ ID NO: 2240104 - RNA, 58 nt, Homo sapiens
gugaauagugcugcaaugaacauacaugcccaugugucuuaaugguagaauuauuuac

SEQ ID NO: 2240105 - RNA, 66 nt, Homo sapiens
gcugacuuccacagcacguauaguaaaauuggaguuuuuuuuacuauaugugcuguggaagucagc

SEQ ID NO: 2240106 - RNA, 96 nt, Homo sapiens
gccaaaaagcugaguuuuggcucagugaucuguuucuguaaaaggaauagccauugucugcagauacaaucaaaaugagccagaaccacaagaggc

SEQ ID NO: 2240107 - RNA, 57 nt, Homo sapiens
ugagcuaggucuugcucugucacccagacugggaugcaguggcuugaucauagcuca

SEQ ID NO: 2240108 - RNA, 59 nt, Homo sapiens
uugcugaggcggagguugcagugagccacgaucccgccauugcacuccagccugggcga

SEQ ID NO: 2240109 - RNA, 64 nt, Homo sapiens
cagugcacugggauuauaagugugagccaccaugccccucauauuuuauaugucguauguauug

SEQ ID NO: 2240110 - RNA, 93 nt, Homo sapiens
gccuugcauaauucaagagcuuucaagaggagcuucacaaucuugaguggagauucuuggguuguuggcuucuccugcucuagacuggagggc

SEQ ID NO: 2240111 - RNA, 67 nt, Homo sapiens
aggcuggacuguaguuucccgggcuggagugcagcggcaccaucacggcucacugcaagcuccaccu

SEQ ID NO: 2240112 - RNA, 57 nt, Homo sapiens
agaggaugucuggcagguggcagcuuccuuucugcacucuugccccauucauccucu

SEQ ID NO: 2240113 - RNA, 129 nt, Homo sapiens
uuauucccaguagccaaggauuucuggaaacuccuugucucccuucccauuaggaagcuagaaaguuucuccuccauauuuuccuuccuauugcugaaggggaauuguuuucagcuuugacagggacca

SEQ ID NO: 2240114 - RNA, 82 nt, Homo sapiens
uaagagacuuaagcauccguggauuuugguaacugaggguggauccuagaaccaaucccacauggauacuuaucauuucuua

SEQ ID NO: 2240115 - RNA, 59 nt, Homo sapiens
guagaugcauggauuuacuucuggguucucuauuccguuccauuagucugugugucuau

SEQ ID NO: 2240116 - RNA, 55 nt, Homo sapiens
ggaauucucauuuugucccugguuugagaaaagguuagagagauauggggguucc

SEQ ID NO: 2240117 - RNA, 82 nt, Homo sapiens
ccacccagaaucucagaaugugaucuuauuuggucuuugcagauguaauugguuaagauaagaucauacuggauguggaugg

SEQ ID NO: 2240118 - RNA, 85 nt, Homo sapiens
acauuacugcacgugucuuuuggugaacaaauguagcauuuuuguugaauauguuucuaaaagugcaauugcuaauucaugaugu

SEQ ID NO: 2240119 - RNA, 57 nt, Homo sapiens
aaauucaugaaagaagacugccaugguuguauacauggauucaucccucaugaauuu

SEQ ID NO: 2240120 - RNA, 63 nt, Homo sapiens
uuuccauuuccgugucugugauaucuggccuguuaauggcuaaaaugacauaggaaaaggaga

SEQ ID NO: 2240121 - RNA, 67 nt, Homo sapiens
aguugaucucauuggcuacugaggcuuguggauucaucacguaguucucaugccaugguuuucagcu

SEQ ID NO: 2240122 - RNA, 73 nt, Homo sapiens
ggagaggugggauggagagaagguaugagcuaaaaauccccaagcucugccauccucccuccccuacuucucc

SEQ ID NO: 2240123 - RNA, 110 nt, Homo sapiens
guuuugaauuuuuaaauggacauuuugguuaaauagguagcuaauauuguuucacaaugaccuaagaucccauuuaaucaaaugugucaacguuuuaauauuauuaaaau

SEQ ID NO: 2240124 - RNA, 76 nt, Homo sapiens
agugggcauagaauuguucauagaauuccuuuauuauccuuuaaauguccauggaaucuguagcaauguccccgcu

SEQ ID NO: 2240125 - RNA, 81 nt, Homo sapiens
aagcuuggcuggaacucauuuuaguaagauucaaucuauacuugguuugucacucuuccuaggguaggcccucccaggcuu

SEQ ID NO: 2240126 - RNA, 77 nt, Homo sapiens
gcccagauuggaaugcugcagugccguagcuacucacaggaauaaucauugcgcacugcagauuugaacuccugggu

SEQ ID NO: 2240127 - RNA, 56 nt, Homo sapiens
gcagucuaagacuugcaugauaguaagagaauccugcaugcaaugucacaggcugc

SEQ ID NO: 2240128 - RNA, 94 nt, Homo sapiens
agaaagacuuugaaccuaguagaggagaggaaggaauuguucaaacauaacuuuaaccuucauuccuuucccugccaaggucccaggucuuuuu

SEQ ID NO: 2240129 - RNA, 59 nt, Homo sapiens
ccuaggaaguagacccauuacguaguuuccagaaauacugguuggguuaccuuccuggg

SEQ ID NO: 2240130 - RNA, 82 nt, Homo sapiens
uguagccuuguaguauaguuugaagucagguagcgugaugccuccagcuuuguucuuuuggcuuagaauugucuuggcuaua

SEQ ID NO: 2240131 - RNA, 61 nt, Homo sapiens
gcugggauuacaagcgugaaccaccgcacccggccccuuguucacaguuucuaaucccagc

SEQ ID NO: 2240132 - RNA, 100 nt, Homo sapiens
uuccagucacccuccugacucaguguuucagcugcucagaucauacaggcaccuauuuucuucugcagaaaugcugauguaucauggaggguggguggga

SEQ ID NO: 2240133 - RNA, 68 nt, Homo sapiens
uuugccaaucagaggcaucuuggagaggcuuagcaucaaaauguacucgauguccuuagauugguaaa

SEQ ID NO: 2240134 - RNA, 79 nt, Homo sapiens
uuucaauguauuugguuggugcaaaaguaauggcaguuuugccauugaaguuacuucuacaccaaccuaauagaugaaa

SEQ ID NO: 2240135 - RNA, 70 nt, Homo sapiens
uauuuuaauugugcuuuacuuacuaccagaaguugaugcaacuugugauggaacuaaggaacaaaagaua

SEQ ID NO: 2240136 - RNA, 77 nt, Homo sapiens
cagagugggagcucuagaaagauuguugaccaaucaucuuauugacuagaccaucuuucuagaguauaacuauuuug

SEQ ID NO: 2240137 - RNA, 68 nt, Homo sapiens
gcugaagcagauccagguguggcagggcgugacauuuggcccaggucagugucuggauccugcucagu

SEQ ID NO: 2240138 - RNA, 57 nt, Homo sapiens
uauugcuuuugauucaaggcagauuucuguuaucucucuuuggagaaagaugcaaua

SEQ ID NO: 2240139 - RNA, 67 nt, Homo sapiens
auuaugugaucaguuucuggagauacguaacuaugcagauacuauauucaagagacugucacuuaau

SEQ ID NO: 2240140 - RNA, 89 nt, Homo sapiens
ggagaaucacuugaaccccacaggcggagguugcagugagccaagaucgugccauugcacuccagccugggcaacaagagugaaacucc

SEQ ID NO: 2240141 - RNA, 81 nt, Homo sapiens
guugggugauuuuucuguuucagaaaggacaggcuaagucagaguucagguauucuggaacagagaaacugucauaccaac

SEQ ID NO: 2240142 - RNA, 62 nt, Homo sapiens
uuccuuucaucaagcacagaguagauguucaaugaaggucuuuuguauuuaaugagauggaa

SEQ ID NO: 2240143 - RNA, 58 nt, Homo sapiens
guggaggagaugggaagcaaaaucaguuguaugaauccaguucccauguuucuucuac

SEQ ID NO: 2240144 - RNA, 92 nt, Homo sapiens
guaugcaagauggccucagccaucucuuagggauucacuacaguuggauguggaauaaacuagagaggacugagagcccugcuuuggcguau

SEQ ID NO: 2240145 - RNA, 69 nt, Homo sapiens
guguccgugugaagagaccaccaaacaggcuuugugugagcaacauggcuguuuauuucacgugggugc

SEQ ID NO: 2240146 - RNA, 61 nt, Homo sapiens
uagguaucuauguguucucaucauuuagcucucacuuacaagugagaacaugugguauuug

SEQ ID NO: 2240147 - RNA, 68 nt, Homo sapiens
cagacccuguugguggaucagauugggcuugagaugaggugcccagcccuguccagcagagggugcug

SEQ ID NO: 2240148 - RNA, 63 nt, Homo sapiens
uugauuuuacagucucauagguggaagaaacuugccuuuucucagaugagacuuuaaacuugg

SEQ ID NO: 2240149 - RNA, 72 nt, Homo sapiens
agagucugguacuuguuuguaaggggaguguucucacauucacaaaauucuugacaggaaguugccaauucu

SEQ ID NO: 2240150 - RNA, 130 nt, Homo sapiens
auccgcccgccucggccucccaaagugcugggauuacaggcaugagccaccaugccuggcguacaaaaaggccaggcacggugucucaugccuguaaucccagcacuuugggaggccgaggcagguggau

SEQ ID NO: 2240151 - RNA, 109 nt, Homo sapiens
gacagguaacaggugaggaagaaauuugggcuugacugaaguaaugggggaugucugugaagccuugcggcaguacagcccagguaauuugcugagccugauggguguc

SEQ ID NO: 2240152 - RNA, 98 nt, Homo sapiens
uuccagaggucaucccugugucuucuaacugcauuugucugucucaauugaucaguaaaaugagcaauuacagucggagcagcacugggauucuggag

SEQ ID NO: 2240153 - RNA, 60 nt, Homo sapiens
cuagguaggcuugugucuagugggucauugaguguuauccucuagacauagguuuaaugg

SEQ ID NO: 2240154 - RNA, 81 nt, Homo sapiens
uuccuuuccuauauguguauauccuauuaguucuguccuucuggagaacccuaauauagaauguacagagaagaaaaggaa

SEQ ID NO: 2240155 - RNA, 96 nt, Homo sapiens
accccuaacacuccuaucugcuucuagaccuguaacuagacuaaagucccagugggccccuagaggugagguucagagugcgacccaugaggaggu

SEQ ID NO: 2240156 - RNA, 59 nt, Homo sapiens
ugucauuggacuucuuucaugguggcuuagggcuccuagagagaguguuucaagagaca

SEQ ID NO: 2240157 - RNA, 80 nt, Homo sapiens
acagagacaaacccuguuacuucucuggaaugcucguuagcaucuaauauagcacugagaauguaauuccuguuuacugu

SEQ ID NO: 2240158 - RNA, 92 nt, Homo sapiens
guagcaggccucagggcagggaagcgagauuacaagggauaaugaggcagcuaucccuugagccuggcuucucacccauugaccuuaguuac

SEQ ID NO: 2240159 - RNA, 75 nt, Homo sapiens
agcaguagugaaaguagacuuaucucucuuuuuccuaaucuuaaggauaagcauacagucuuucacuauuuuguu

SEQ ID NO: 2240160 - RNA, 61 nt, Homo sapiens
gugaaagguaggaacagggugcaggucaccagacucugaggccaguguucuuccucuuugc

SEQ ID NO: 2240161 - RNA, 109 nt, Homo sapiens
cuuuauaaauaaugaugguguguuacaaugaccucaauguuuuuguucuauguaaugaauaugaauagaguuaauugaguaccauuaaucauauuuuucuuauguaaag

SEQ ID NO: 2240162 - RNA, 76 nt, Homo sapiens
ggaguugauugagguaaagcgaggucuccuacaagaugaugcacauccuacucuuguaaccuaugcugaccauucc

SEQ ID NO: 2240163 - RNA, 90 nt, Homo sapiens
aggagguguucugugcacgucuuaggaggucacggugggacugcaccccgugccccagcagcgacgucaaucgcacagccugcuccuccu

SEQ ID NO: 2240164 - RNA, 75 nt, Homo sapiens
gagaugucauugaaguggaaucauccagucuuugucuuuuugugacuggcuuauuucacuuaauguaauguccuc

SEQ ID NO: 2240165 - RNA, 61 nt, Homo sapiens
gugccugugugugguuuccuagaaauaguuucagcaguccuggaagagugacacaagguau

SEQ ID NO: 2240166 - RNA, 68 nt, Homo sapiens
cccugucucagguauuucuuuauagcaaugcaagaaugaacuaauacagugaauaucuggggcagugg

SEQ ID NO: 2240167 - RNA, 62 nt, Homo sapiens
uugugaauagugcugcaagaaacauacgugugcaugugucuuuauagcagcaugauuuauaa

SEQ ID NO: 2240168 - RNA, 129 nt, Homo sapiens
uaagguuuuucaauaaucuuuuuauuuuugauugcuaaauuguccuucuguuacagaauauagucgcugugauacagacuuugaauuugguaagccuuaauuuauaaccuagauuaugaccaaauuuua

SEQ ID NO: 2240169 - RNA, 60 nt, Homo sapiens
uucaucuagccaagacucagguaucuucuuuacaaauugcacuggguucaggcuugugga

SEQ ID NO: 2240170 - RNA, 65 nt, Homo sapiens
ucccuagcaggcaagauaagauucaagacuauaaauucuaugaggcaucauguuccugcaaggga

SEQ ID NO: 2240171 - RNA, 82 nt, Homo sapiens
uugagcaugcagcaggauuggagccucucugaaccuauucugguuugggggcugcccaauucaugaauuguuuucugcucaa

SEQ ID NO: 2240172 - RNA, 64 nt, Homo sapiens
uggugagaaacuagauauuuuucuccuaagauugaguauaaggcaaggauguuucuucucacca

SEQ ID NO: 2240173 - RNA, 68 nt, Homo sapiens
gugagcacaggugcgcgguuacucacacagauuccaccccugccgaguggccuccaaccaugucucac

SEQ ID NO: 2240174 - RNA, 60 nt, Homo sapiens
uguagaaauaucuuauuggucuggaagugaucacuuguacuaguaagcguguucuuugca

SEQ ID NO: 2240175 - RNA, 64 nt, Homo sapiens
guucuuagguuguuucuggucuuagguauugaugucauccuugaucaccggggucaaccagagc

SEQ ID NO: 2240176 - RNA, 70 nt, Homo sapiens
guuguugagauggaguuucgcucuuucgcccaggcuggagugaaguggcgugaucucugcucauugcaac

SEQ ID NO: 2240177 - RNA, 58 nt, Homo sapiens
uauucaagugaugcagcuguuuuugcuaagggucuugcaaaaggcugacgucagaaua

SEQ ID NO: 2240178 - RNA, 65 nt, Homo sapiens
gugacuaccuggccaaucagagcaccccacauccccugccucggcucagugauugguuuaguuau

SEQ ID NO: 2240179 - RNA, 73 nt, Homo sapiens
uaggccugccuagauguuguagggggugagucuuuuucaaacuggccccacugugauuucuagguauagccug

SEQ ID NO: 2240180 - RNA, 107 nt, Homo sapiens
gggucaggagcucacaucccuuucucuggcuagggggaagggccuauccucuuugaugauaacuuccugccuaguugauaggaagcgguuccugugcuccuugaccc

SEQ ID NO: 2240181 - RNA, 71 nt, Homo sapiens
aggaaacgcuguuggguaauggggcgcaccguguaaagcagguccuugccucauuccaaccagaaagcccu

SEQ ID NO: 2240182 - RNA, 89 nt, Homo sapiens
cagagagaugugggauuuugccaggugccaaguaugucuaugccaguuguacauuuuggcacugggaaaaugaccacggaaugacucug

SEQ ID NO: 2240183 - RNA, 82 nt, Homo sapiens
cccauuggcauaaacccguagauccgaucuuguggugaaguggaccgcacaagcucgcuucuaugggucugugucagugugg

SEQ ID NO: 2240184 - RNA, 98 nt, Homo sapiens
uuuuguguguaugagaacuagagaacaaggugauugaugcuaauucucaucaccauuccuaccucaccuguuuuuauuuaguuuucaugaccagagaa

SEQ ID NO: 2240185 - RNA, 73 nt, Homo sapiens
ccagugauaauucccugguuuugauaacugugcaaugcauggcauguaaguuguugacauuaggggaaucugg

SEQ ID NO: 2240186 - RNA, 76 nt, Homo sapiens
gucaugaauugcuuaaugauggagauaccuucuggaaaauguguccuuagguaauuuuaucauuaugugacaugau

SEQ ID NO: 2240187 - RNA, 71 nt, Homo sapiens
gauacaaacaauacauagggagaagggagauuuaaaaaguaucaacuaccaugcagguguauguuuguguu

SEQ ID NO: 2240188 - RNA, 101 nt, Homo sapiens
gucuagcuacuuugcacauccauguuugacuuuuaggaggaaaaugacaacuaaccaaguugagucaauguccaaucuuaaaaguccgugauguguuggac

SEQ ID NO: 2240189 - RNA, 58 nt, Homo sapiens
cucuugguaucagccagaauagccaauaugaagauucuggcuuugggaugcucaaggg

SEQ ID NO: 2240190 - RNA, 70 nt, Homo sapiens
aagucuuugcuauugugaauagugccgcaauaaacauacgugugcaugugucuucauaguagcaugauuu

SEQ ID NO: 2240191 - RNA, 64 nt, Homo sapiens
cucaaucagcucuucaccuugagggggugcagcauccccuugcagugaccggggcgugggugag

SEQ ID NO: 2240192 - RNA, 98 nt, Homo sapiens
acaugagacuaggguuguuuggccuguaggguauugguaggggcugcuguggucccuuugcucacccuugggccagcugacuccuucauucucuaugu

SEQ ID NO: 2240193 - RNA, 78 nt, Homo sapiens
uguggcagguauuuuuuuaacauuuauuguaggcucagcugucuacuggguguucugagaaaauacaaggaagcuaua

SEQ ID NO: 2240194 - RNA, 82 nt, Homo sapiens
caucuccuagucaaauaguuaaugaucuguuuuaaaaacaacaaugggagaucauuuccuauuugaagggaauuuagaggug

SEQ ID NO: 2240195 - RNA, 73 nt, Homo sapiens
gaaagcaacagagugcauguuuagaugagugaaucaauuucacuuuugaucugugcaauucaguuaacuuuuc

SEQ ID NO: 2240196 - RNA, 62 nt, Homo sapiens
aguguuaaauugaccacugagguagaaaacuaacaagaaauuuuggacuucaauuugacacu

SEQ ID NO: 2240197 - RNA, 58 nt, Homo sapiens
auaucacaggaaaggaagauacacagauaaauuuuggauuuaucuuuuccagugguau

SEQ ID NO: 2240198 - RNA, 55 nt, Homo sapiens
guguucauaaguucucaucauuuagcucucgcuuauaagugagaacaugcagcau

SEQ ID NO: 2240199 - RNA, 77 nt, Homo sapiens
ccagaguaacccuguaggccuaaaguacucaguuuuaagacaaacacuacuucccaugcgggguacuuuccuuaugg

SEQ ID NO: 2240200 - RNA, 58 nt, Homo sapiens
uuuuggcacuuugucugauucucuuccuucauccugaaaguuagcacacgugucaaaa

SEQ ID NO: 2240201 - RNA, 75 nt, Homo sapiens
gucacucguuaguuuucuuguuuauguucugugucuuuggcuagaauguaacucuaugaaggcaggauuuguggc

SEQ ID NO: 2240202 - RNA, 60 nt, Homo sapiens
uacaauucucaggucuacuugaugcucugaacaagagugcuacaggacugagaaucugug

SEQ ID NO: 2240203 - RNA, 130 nt, Homo sapiens
aaauuacccagucucagguaguaucuuuacagcagugugaagauggacuaauauaguaaguacuuauuuaaaugguguauuagucuguuuucauacugcugauagagacauaccccagacugggcaauuu

SEQ ID NO: 2240204 - RNA, 67 nt, Homo sapiens
uggugcuagaagguaagagcuggaugcagcuguugugguagcauuuauggguuaccuuuguuaacca

SEQ ID NO: 2240205 - RNA, 65 nt, Homo sapiens
uuggaauucuuuggaaacaguacuaauucuugauaucaccaggaauuccaauucagaauguccaa

SEQ ID NO: 2240206 - RNA, 76 nt, Homo sapiens
ggucucuucucacaguacagggagcucuguagcuauaauagcuuuucagaguuguccaguguuggaucaagaggcu

SEQ ID NO: 2240207 - RNA, 75 nt, Homo sapiens
uguucugggaucccuguaguaauauucuagcuuucuccaugcaagugaaugcuguacuacagugauuuucaaaca

SEQ ID NO: 2240208 - RNA, 118 nt, Homo sapiens
ucuuauuucuuucaaagccugccauaucugagaacuaaugaagaauuuauuugugcuaaugaauauguauuaguucuuuuaagaugagauaugcauauuuuaguaggaaaugccgaga

SEQ ID NO: 2240209 - RNA, 80 nt, Homo sapiens
aucuauagggcaggggcaaaaugccacgagucucuuugcuaaagcagagcaagagucacuuuugcuccaguucccuagau

SEQ ID NO: 2240210 - RNA, 84 nt, Homo sapiens
aauguacacagucaaaaauuuccaggcacaucugcucucuccucuccuauuugacauugcacuggagauucuggcaaguauauu

SEQ ID NO: 2240211 - RNA, 113 nt, Homo sapiens
auaaaugcaaguuagaacuuuaaggcaugauuuuauaucuauguaacuaguuaacaugguuuauaugagaaaauauaaggucgauaagacuugaagggaacuggacauguuau

SEQ ID NO: 2240212 - RNA, 82 nt, Homo sapiens
uuccccaucugccuuuggugacaggcaugugugggcauuccuuaccucccccaccagccugaucaucaaagcaacaagggaa

SEQ ID NO: 2240213 - RNA, 63 nt, Homo sapiens
ccuuuuaaaauauugguggccaggugugguggcuuacgccuguaauaucagcauuuugggagg

SEQ ID NO: 2240214 - RNA, 70 nt, Homo sapiens
gccucugagauacacuaauagucucuggagauaaacacuguugagaggccuaaugcguguggcuccaggc

SEQ ID NO: 2240215 - RNA, 109 nt, Homo sapiens
aguaggcuuacuuuuuugauccuccaguuuucaagauaaugguuuuauuucuugaagcuguaaucagaugaaaauguccaaaggacuaaagaaacugaguagggcuauu

SEQ ID NO: 2240216 - RNA, 60 nt, Homo sapiens
ugggaggcaagaguaguuaaguuaggaacagcugucuggagcuuuaccucuugcuuuuua

SEQ ID NO: 2240217 - RNA, 70 nt, Homo sapiens
gucacuugagccugggaagcagagguugcaaugagccaagauugcaccauggcacuccaggcugggugac

SEQ ID NO: 2240218 - RNA, 81 nt, Homo sapiens
ugauauuggcuucauugaaugauuuuuagaagauucucuccuccucaauuuuuugaaaccauuucagugggauuaauguca

SEQ ID NO: 2240219 - RNA, 92 nt, Homo sapiens
uaggcaauggaauggucuaugauucccuuggucaacggaugcaacgcucagcucuuugcgucucaccaagugaaauaagcuucuucggccug

SEQ ID NO: 2240220 - RNA, 77 nt, Homo sapiens
cgagcugugaaacccuaagaagaagggagcugaaccagugauugugaaacagcaucauucaucugggguaauacucg

SEQ ID NO: 2240221 - RNA, 56 nt, Homo sapiens
caguuacuaaguacuguggcaauccauuuggucagucacuaguaaaaggugaacug

SEQ ID NO: 2240222 - RNA, 87 nt, Homo sapiens
gagaucuccauaaguggccagcuuuaauuuguaugccucagggguucacaggacuguaaauggaaaugaagggcuggcccuggucuc

SEQ ID NO: 2240223 - RNA, 103 nt, Homo sapiens
aagacagucuaggaggaggaggagguagggugugaaacagccaggcucucuccaaaucccaaguguugacacagccaucuugucccaucccuggaagccucuu

SEQ ID NO: 2240224 - RNA, 90 nt, Homo sapiens
uuuugguuagaauucuuguucacaaugccuuguugaugguauugcggaagcagccaucaaaucagagcauuaaucuuuucuaugccagaa

SEQ ID NO: 2240225 - RNA, 85 nt, Homo sapiens
gcuguggggcuaggacccauggcagugucuagggguguuucagcugaagccccagugggcauguguuacgggguccauaggcagc

SEQ ID NO: 2240226 - RNA, 55 nt, Homo sapiens
guaauccuggcacuuugggaggccaaggcuggccaucaccugaggucaggaguuc

SEQ ID NO: 2240227 - RNA, 122 nt, Homo sapiens
gaugcacucacuaacuauugcagcauaaccaaucacuccacaacuuagcagcuugaaacagcaaacauuuauugucucaguuucuguggguuaggaauuugggcauggcuuuccuguguauc

SEQ ID NO: 2240228 - RNA, 83 nt, Homo sapiens
uagcauuucuuuaaauguuugguaaaauucagcagugaagccauuggguuucaggcuuuuauuuacugauaaacauuuuguua

SEQ ID NO: 2240229 - RNA, 66 nt, Homo sapiens
guugucuaggacagagacugugugccacgcuacuuuuuauuccccacacagugcuuugucagaagc

SEQ ID NO: 2240230 - RNA, 60 nt, Homo sapiens
cuuuggcaagauuguguggcugaaguaauauuaguuuucuuccuauguaucuugcugggg

SEQ ID NO: 2240231 - RNA, 111 nt, Homo sapiens
uucauuucaguucucuucugaugcagaauuauggugcuggcuuccauugaauggcaaaugggaugagaugguacacauacgauucugccucacugaugaauuuggggugga

SEQ ID NO: 2240232 - RNA, 124 nt, Homo sapiens
ccaaagucacauggguugguccccuugguugguaccccugguguacuaauacgaccccaaaacucguguuagcugcuuuggggacccuccaccaggggacauacgaccuccaggugaaucaugg

SEQ ID NO: 2240233 - RNA, 70 nt, Homo sapiens
agcuuuugcaggucaggggcagagaagugagacugauuucugccaggacaccugcgaacagauaccagcu

SEQ ID NO: 2240234 - RNA, 71 nt, Homo sapiens
caccuggagggcuugcuaaaacagauuccugggcccuagcccagauguuuucauucagcaagucuggggug

SEQ ID NO: 2240235 - RNA, 58 nt, Homo sapiens
caggugcaaguaauuccagcuacugaggaggcucaggcaguagaauugcuugaaccug

SEQ ID NO: 2240236 - RNA, 77 nt, Homo sapiens
uaaaauuauugcuuuauguggcugauacucauucuguugggucagugccauugccauaugaguugcuaaauauuuug

SEQ ID NO: 2240237 - RNA, 58 nt, Homo sapiens
uggcuguuguuacuaacaguucccacguaccaaguguugcucucuagugacacaguca

SEQ ID NO: 2240238 - RNA, 62 nt, Homo sapiens
cucugccauaugguuucuuagcaccucacucaauucuuggcagccuaagacacuuggcagag

SEQ ID NO: 2240239 - RNA, 58 nt, Homo sapiens
gacagcuggggagcagaauacauucccuuucuaaagagugugcuugaauucagcuguc

SEQ ID NO: 2240240 - RNA, 60 nt, Homo sapiens
gagguagguuugguuacaaaagagcaacauccuugucgugauggaaccaaacuguaucuu

SEQ ID NO: 2240241 - RNA, 109 nt, Homo sapiens
uuagcaugcugacuugagacugaaacuggccuccuugggaaauuaggcugcuauuucucucgccugauuucuugggaagucagauaacaacucaguguugguuugcuga

SEQ ID NO: 2240242 - RNA, 88 nt, Homo sapiens
caucuuugugagacuaucuaugguaggggcuggaggaagaugaaaacucacuuauuuaguucugccauaguuaucacauuaucugaug

SEQ ID NO: 2240243 - RNA, 67 nt, Homo sapiens
cggugaggcaaugaggcggaccagcagguucccggggaucucugcagccccguugccauaacaaccg

SEQ ID NO: 2240244 - RNA, 92 nt, Homo sapiens
cuccuagaacuugcauucuacuauuggagacaaaugacuauaugauguaggcaaugucagcuaaugauggaaagcaaagcaaguugaaggag

SEQ ID NO: 2240245 - RNA, 59 nt, Homo sapiens
aguuaggcauggcugucauuuccagguggaagcacauaagaacugguguauguuuaacu

SEQ ID NO: 2240246 - RNA, 67 nt, Homo sapiens
gcaugucauguuucuacugaccaaauucugggagucuccccuuuggguaaaaacauaacacucuugc

SEQ ID NO: 2240247 - RNA, 62 nt, Homo sapiens
auaggguuugaucucacaauagccugacaucucuacaaguuagguagaacuuuagacccugu

SEQ ID NO: 2240248 - RNA, 67 nt, Homo sapiens
ugagaccauaguaaguaaggagcuucacugcauucuuggaugugaagacucaauuauuaugaacuua

SEQ ID NO: 2240249 - RNA, 63 nt, Homo sapiens
uauuagguaauauaaucauggcaguuauaucccauaacuucugccauauucuauugcuuagua

SEQ ID NO: 2240250 - RNA, 64 nt, Homo sapiens
guugcaacauguguaccacucuguugcagaauguugauaaugggggaggguauacauguguaac

SEQ ID NO: 2240251 - RNA, 74 nt, Homo sapiens
gucuacaguacacagguaccaagcugccuuuugucuuucuaauucagaaaaagccugaugccugugcuguaagc

SEQ ID NO: 2240252 - RNA, 90 nt, Homo sapiens
uugaauuuuauguauccauaagugcuuguugaauaauagcauuuauugaaugcugucaguaugcuuaagcacuuuuuauguguuauuuaa

SEQ ID NO: 2240253 - RNA, 68 nt, Homo sapiens
uauuuggauagucuggaaaaaaaucagcagaaaaugucacuuugggcuuccuccauuuuguccaaaua

SEQ ID NO: 2240254 - RNA, 77 nt, Homo sapiens
gaucugucuaaugcugagagugguauguuuaagugccauacuauuauaguauuagaauauaucucucucucuagauc

SEQ ID NO: 2240255 - RNA, 85 nt, Homo sapiens
aguagaguauacuugagucguuaccuauaacagaggugucuguuaccuauaaucuauguuauagauaacgacucaaguaucuauu

SEQ ID NO: 2240256 - RNA, 74 nt, Homo sapiens
agacuguuugacuccagagugaguaaauguuagauagauuaaaucuuuacuuuaucuggcuuuagauuuggucu

SEQ ID NO: 2240257 - RNA, 93 nt, Homo sapiens
aagaaaguagagaugcuagcagagaaaugacuuacaagagaaugcuaauagugauuaucucuguggguagugcugaaugauuucuauuuuuuu

SEQ ID NO: 2240258 - RNA, 78 nt, Homo sapiens
ggagacuuauaauggagcugaguggccuugggcaagcccgugcagcuccccacccaccagcauccauuaaacaccucc

SEQ ID NO: 2240259 - RNA, 66 nt, Homo sapiens
cuuugaaacuuacuguuaauuuucugucucguugaucugucuaauguugacaguggguuguuaaag

SEQ ID NO: 2240260 - RNA, 60 nt, Homo sapiens
gagaaugaugauuuccaauuucauccaugucccuacaaaggacaugagcucaucauuuuu

SEQ ID NO: 2240261 - RNA, 61 nt, Homo sapiens
ccagcugacaguagguuuacaguuuauaaucuggccuuuguaaaagcauuugucagccugg

SEQ ID NO: 2240262 - RNA, 122 nt, Homo sapiens
uuuuccucucuuaccugcuuaucguguaacauaagcuguauugacuuuguaucauaguauuuaaguauuguuaccuuucugucauauacuuaagcuacaggaucucaaggugaagaagaaag

SEQ ID NO: 2240263 - RNA, 55 nt, Homo sapiens
uccuuaaugcuacggcucuguguuugucccucagacaaguuggauggcuugagga

SEQ ID NO: 2240264 - RNA, 113 nt, Homo sapiens
cccagccugucuuggggugaggaucgcugcccggaagcggggcacuggggccccaacacaggggguuugcagugucagcuucuguguucaccucuccccuuaucuuaacuggg

SEQ ID NO: 2240265 - RNA, 59 nt, Homo sapiens
uagauucuauguggaauuccaaaggaguaaguguuccuuuggcagaaaacaagaaucug

SEQ ID NO: 2240266 - RNA, 106 nt, Homo sapiens
gggaacuguggucaggugagaggaggcagcuuuuacaaucagacuucauugaauagugugggcugcuguuuccuuguaacaaaaccccauaaugauggcaguuucc

SEQ ID NO: 2240267 - RNA, 59 nt, Homo sapiens
acucaaauagcaacggugagaagcucaggcugccauuaauuucacugugugucuugggu

SEQ ID NO: 2240268 - RNA, 61 nt, Homo sapiens
aagaugguauuucauuaguuuuggauggucccuuccacagagcucagaugcuaugcuucuu

SEQ ID NO: 2240269 - RNA, 105 nt, Homo sapiens
gcacauaaaugcaggguaccuuuccuucccguuauugcccuugggugucuggcugcuuaggaugcccauuugccagauggggagagugaggccuguagaaggugc

SEQ ID NO: 2240270 - RNA, 88 nt, Homo sapiens
aggggaauugcuugaacccaggaggcagagguugcagugagcugagaucaugcuacugcacuccagccugccaacagagcaagacccu

SEQ ID NO: 2240271 - RNA, 74 nt, Homo sapiens
ggcuauugugaauagagcugcaguggacauugguguacaaggaauugagucgcugcuuucuauucuuuuggguc

SEQ ID NO: 2240272 - RNA, 61 nt, Homo sapiens
ggugaugguuaccacaaauuauaagauaggaaaccucucuuuuggguauggagccaucauu

SEQ ID NO: 2240273 - RNA, 58 nt, Homo sapiens
cugcuugaccugcuguucucacauccagcucuguaugugagaacaacaggucaagcag

SEQ ID NO: 2240274 - RNA, 82 nt, Homo sapiens
cucauucauuucuaucauaguuuggacuuucauuucaaaaugucagaaaugaaaguuaaacuagauuaacagaaaaguggag

SEQ ID NO: 2240275 - RNA, 77 nt, Homo sapiens
ggagacguuuugugucuagcucagggauuguaaacacacccaucagcacccugucaaaacggaccaaucagcucucu

SEQ ID NO: 2240276 - RNA, 63 nt, Homo sapiens
acagaaucaaggccauuucgcagacaacuacccuaaaauaucuacagaugguguugcuucugu

SEQ ID NO: 2240277 - RNA, 119 nt, Homo sapiens
uuaacauaguuauuuugaugaauuuuuuaagaagugauuuuccucauucuguacuuucuuccaaagagugaaaaagaaaucgauuuugcugaguuuuuggaauaaaucaaauauguuag

SEQ ID NO: 2240278 - RNA, 63 nt, Homo sapiens
cuauguguccauguguucucgccauuuagcucccacuuauaagugagaacaugugguauuugg

SEQ ID NO: 2240279 - RNA, 106 nt, Homo sapiens
uagaaaaaaugccaaauggauuaagcuguaguugaggauuuuaagacuguuucuaaaaacguauuuaaaaggucuuaauuguaccuagauacaaguauuuauuuua

SEQ ID NO: 2240280 - RNA, 80 nt, Homo sapiens
uuuaucaagaaaagagguuuaauugauucacaguuccaaggagcuggggagacgucaguaaacuuaacaaucaugguaga

SEQ ID NO: 2240281 - RNA, 94 nt, Homo sapiens
auucguuucagugguugccauagugcugccagauaucuaggcaaaugaaacuguggugugcugggaccacgcugggugagcuauugagaugggu

SEQ ID NO: 2240282 - RNA, 55 nt, Homo sapiens
guuauggcuuugcgguguuagcagcucuuuauuguuacagccucaggguuauagc

SEQ ID NO: 2240283 - RNA, 67 nt, Homo sapiens
cacuagcugugccuggggugaguuagcugggacccuuuucaccaagcaccaccccaggucacaagug

SEQ ID NO: 2240284 - RNA, 75 nt, Homo sapiens
ucugucaguguacuguaagaauuacuuccuaacauugcaauaccaggccguaguucaaugaguacagugauuaga

SEQ ID NO: 2240285 - RNA, 61 nt, Homo sapiens
ucuucucuucccuacccugauguuccaugauccugaagaagauaucagggugaagagagga

SEQ ID NO: 2240286 - RNA, 105 nt, Homo sapiens
gcuacuuuuucucaggcagccugauuuuugugagcuuacugauuucaaauucuuugggauagguaaguaauauacagaugaggaaauggagccaugggcuguagc

SEQ ID NO: 2240287 - RNA, 58 nt, Homo sapiens
gcaccaaagaccuaccugguuagguagguuagguaccugguuagguaggucuuugugu

SEQ ID NO: 2240288 - RNA, 61 nt, Homo sapiens
ugaagauugaauggaauaauguguaggaaaugccugcuacauuguagguauucaaacuuua

SEQ ID NO: 2240289 - RNA, 72 nt, Homo sapiens
ugaauuuggaauguaacuugaaacuuuuaucacacauuuugucaaaaguuuauacuacauuuuggggauuca

SEQ ID NO: 2240290 - RNA, 94 nt, Homo sapiens
ugugacauaucucugguaguaucacuuagguuaugccgcucuucuacuuggucccugccaaccuggagagugacauauuucuaggccaggcaca

SEQ ID NO: 2240291 - RNA, 70 nt, Homo sapiens
uuggcagauauuccauuugugcuagaaaagauuguguauucuacuguuguuggguggaaugucaugucaa

SEQ ID NO: 2240292 - RNA, 68 nt, Homo sapiens
ugugccagugcugucuucuccaggguuaucucugcuacuuuuuuuccuggagugcaacacuagguaua

SEQ ID NO: 2240293 - RNA, 82 nt, Homo sapiens
aacucuuucucauuuaucuggggagaggguagaggucaggaugacauuuaagucacuccagguuaaagugaaggacugaguu

SEQ ID NO: 2240294 - RNA, 60 nt, Homo sapiens
uauugcaaauggugaucccaggaggccacuguagcuaauggugucccccaguuugcaaua

SEQ ID NO: 2240295 - RNA, 60 nt, Homo sapiens
ggaagaaagguggacaacagguggccagcagugguccaccugugguuauuuuacucuucc

SEQ ID NO: 2240296 - RNA, 67 nt, Homo sapiens
uccguaaguaguauaagguuuuuugacagaaauuacuaucagaaauuaugccuacuacagugaugga

SEQ ID NO: 2240297 - RNA, 65 nt, Homo sapiens
gaguuugcaguugguuagaacuggauggagagacccagcuucagaucaucccagcuccacuacuc

SEQ ID NO: 2240298 - RNA, 70 nt, Homo sapiens
uuucauccggcuguguauuaugaaguuugcuugauucuucccccuucucuugauuagcuccuggaugaag

SEQ ID NO: 2240299 - RNA, 56 nt, Homo sapiens
accucugccuaguuuucagaggauguauggaaauaccuggaugucgaggcagaggu

SEQ ID NO: 2240300 - RNA, 100 nt, Homo sapiens
gaggcagggagaaucgcuugaaccugggaaguggagguugcagugagccgagauggugccacugcacuccagcuuuggugacagagugagacuccgucuc

SEQ ID NO: 2240301 - RNA, 67 nt, Homo sapiens
uguuccaucuguguacaggcagcaaacaccauaaaugucugaucauuuggccugauaucuuggagca

SEQ ID NO: 2240302 - RNA, 69 nt, Homo sapiens
gcacuaguuuuagucccauuuuacagacaggacauggaaaccuaucuguaaagaucacagagcuggugc

SEQ ID NO: 2240303 - RNA, 89 nt, Homo sapiens
uuagggagauagcaaaauggcagcugguuuuacccuagaagaccucuuacuagauaaauuccagcugugaauauaugauguuuccuuaa

SEQ ID NO: 2240304 - RNA, 59 nt, Homo sapiens
ggcuucuguccagggucucgggaauuuggcuuccaugucagggacgcuugacacaagcc

SEQ ID NO: 2240305 - RNA, 68 nt, Homo sapiens
ugucuaucgaaguucacaauguacuuuccauuuuauucuuauguauuauggaacuuaauugauggaca

SEQ ID NO: 2240306 - RNA, 68 nt, Homo sapiens
ugcagcaucagaaucugcauugugacaagcucucuauguugucuugcacauuacagaucugcauugca

SEQ ID NO: 2240307 - RNA, 69 nt, Homo sapiens
ucuccacacuuuuacaaacauuuguuaucacuugccuuuuugauaauagcuguccuuagaagugugagg

SEQ ID NO: 2240308 - RNA, 57 nt, Homo sapiens
ccuuucuagauagaugaaacccauauggagaggaaauagugacaucauuuagaaagg

SEQ ID NO: 2240309 - RNA, 71 nt, Homo sapiens
gggaauggaugaggagauauuggucaaaggguacaaaguguccaagcacaguggcucccgucuauaauccc

SEQ ID NO: 2240310 - RNA, 61 nt, Homo sapiens
gagaacagagcagguggaggaguauuaucaccgauggcccugcuaccacuuuucuaauuuu

SEQ ID NO: 2240311 - RNA, 90 nt, Homo sapiens
uucauucgaaaauaacuuccuagaauagacagugcugucagcaucuuucugcugaccauagacuacucugggcgguauuuugaaaaugaa

SEQ ID NO: 2240312 - RNA, 56 nt, Homo sapiens
aacagagcuggugacuccagguagccauagcaacugugagguaacgcugcucuguu

SEQ ID NO: 2240313 - RNA, 62 nt, Homo sapiens
ucagugaauauauaacagcgauguuuuguuuucagaaaaucaggcugauaguguuguacuga

SEQ ID NO: 2240314 - RNA, 71 nt, Homo sapiens
uuuauuagccuuaaguguucauuuucagugguuuguuagagacugagaucaagauguuagggacuaauaaa

SEQ ID NO: 2240315 - RNA, 76 nt, Homo sapiens
ucuguaaccuagcagacacuuccagagaguucuccagcaaauuuucugccagugugaugcuaacaguggaagcaga

SEQ ID NO: 2240316 - RNA, 79 nt, Homo sapiens
acagguagcaccagugcucuucucaacauuuguuaucacuaaugauagaagccuuuggaagagcaaaggguuacucugu

SEQ ID NO: 2240317 - RNA, 78 nt, Homo sapiens
uuugauacaucaaucagauggcuaaaacagaagauaugugagucuauuaucuuuugcugucugauaugauaggucaga

SEQ ID NO: 2240318 - RNA, 123 nt, Homo sapiens
agacuaacaaauccuugaaaucacacagcuugcaaauacguacuaaacugcacaagguguguguucuauaugugcaguuuuagcguauuuuaguugcauagguuuccaugguauuuauagucu

SEQ ID NO: 2240319 - RNA, 55 nt, Homo sapiens
caggagauuaaacauugcaaauaagucuauuugcaggauguucaguaauuuccug

SEQ ID NO: 2240320 - RNA, 108 nt, Homo sapiens
gguggaacuuaacucucaugaauguauuuggaaguccucauaccugauucuggccuuaccuuagagucacaugaggcccuucauuaaaacaacauggauccuuccacc

SEQ ID NO: 2240321 - RNA, 61 nt, Homo sapiens
accauugcaguuuuugguguaucucaucaauuugcugagcauacuucucagacguaauggu

SEQ ID NO: 2240322 - RNA, 60 nt, Homo sapiens
auaacguuuuuguuaauggcacaaaacaguucauuauugcuuuugacagaaacuuguugu

SEQ ID NO: 2240323 - RNA, 60 nt, Homo sapiens
uggcgguaucucaggcagagauuaguguuuaauucacuauugcccauaaggauauuguca

SEQ ID NO: 2240324 - RNA, 57 nt, Homo sapiens
ucuucaugguccacugacugaggacaaucaaccccuucacagccuaggaccugaaga

SEQ ID NO: 2240325 - RNA, 67 nt, Homo sapiens
caccaugacugguugagagaggcaggaagaaaggaggaaguguucuguuuuagcacuuguuauggug

SEQ ID NO: 2240326 - RNA, 74 nt, Homo sapiens
gugugcgugcauacuguaugcgugcauaccgugugugugcguacugugugugugcguacugugugugugcguac

SEQ ID NO: 2240327 - RNA, 99 nt, Homo sapiens
uuugggccuaggucuguuacacucuaguguucuuaaucaggcaugacccugccugagccaucugaggacacuggggaccagguagacugugggcugaaa

SEQ ID NO: 2240328 - RNA, 67 nt, Homo sapiens
cauagguuggggaauagaaauugggaaccgcaagaucaaauauccuauccuucuuuuucaaccugug

SEQ ID NO: 2240329 - RNA, 55 nt, Homo sapiens
uacaguuggcccucuguauucgugggucccacauuugcagauucaaccaacugug

SEQ ID NO: 2240330 - RNA, 59 nt, Homo sapiens
ugagacugaguuucgcucuuguugcccaggcuggagugcaauggcgugaucucggcuca

SEQ ID NO: 2240331 - RNA, 56 nt, Homo sapiens
gggagagaugcugauugccaaugucuuauuuccuuuggcaagguagcauuucuucu

SEQ ID NO: 2240332 - RNA, 82 nt, Homo sapiens
cuugaacacauuaugcuaagugaaauaagccagacauaaaaaugacaaauauuguauuauuccacuuacaugagguaucaag

SEQ ID NO: 2240333 - RNA, 69 nt, Homo sapiens
ucaggagcagauggauuuacagcugaauucuaccaaaguacacagagaagcuaguaccacuucuucuga

SEQ ID NO: 2240334 - RNA, 60 nt, Homo sapiens
uguccuacauuuucuuucauuuccccacccucauaaugaaauggcuuugaggguaggaca

SEQ ID NO: 2240335 - RNA, 58 nt, Homo sapiens
aguuucuguuucugguggaaauacagcccacugcugcuguaugcuagagagggaagcu

SEQ ID NO: 2240336 - RNA, 103 nt, Homo sapiens
uauuccuucaauuuuuaauucuuuucugcuugagagaauugcuguuggugucucaauuggugcucagcauuuucuuaauguaggugaguuauuuggaagaaua

SEQ ID NO: 2240337 - RNA, 59 nt, Homo sapiens
ccacugcccuagagcaauggugcuagccuaacuucuacaucacagcaaguagggagugg

SEQ ID NO: 2240338 - RNA, 121 nt, Homo sapiens
gggcuggugcuggccucaugugcccugagaucuauuccucacccuucuccuccccugugcccgugaguguugugguaguggguggguggguggaucaggggucgagguuggcgccgagccc

SEQ ID NO: 2240339 - RNA, 74 nt, Homo sapiens
cucgcucuaacaccacagugugguuuggacguggccacagugccguacaaaccacagugugcugcuggggcggg

SEQ ID NO: 2240340 - RNA, 84 nt, Homo sapiens
gaggaaagcaaacauuguuuuaugaagugccugccucagauauguuuuugugugaucuucauggaaggugaaauugcuuuucuc

SEQ ID NO: 2240341 - RNA, 72 nt, Homo sapiens
ugagcaggcaauggauauaaaagagauaagaacagaugaaccaaucucaguguuaucuaucugccuucuaca

SEQ ID NO: 2240342 - RNA, 88 nt, Homo sapiens
cugcucuuuccauuuuuuagaugauucacuuuacuuccagcuucauagcugaauuagucgggguucucuagagggacagaacuaguag

SEQ ID NO: 2240343 - RNA, 76 nt, Homo sapiens
caucuuuggucagcugcgggucagcuggguggcucuucuguuuggcuguuagcuggcugcagacugguccaggaug

SEQ ID NO: 2240344 - RNA, 58 nt, Homo sapiens
aacagugcuuucaauguucaguauccuuuacaucugcugcucagcuggaaacacuguu

SEQ ID NO: 2240345 - RNA, 56 nt, Homo sapiens
aggcccugauacaaguaaggucuacguuuuccuaagacugacucuuauuauggccu

SEQ ID NO: 2240346 - RNA, 67 nt, Homo sapiens
gcacugguggagggaggggcgucugccauuacugaagcaugaguaggcaguuuuccuuucacagugu

SEQ ID NO: 2240347 - RNA, 56 nt, Homo sapiens
ugacuuagguaugucugugaugaucuaaugaaaugucauggaacaacuuaaaguca

SEQ ID NO: 2240348 - RNA, 96 nt, Homo sapiens
gcuuugccucacugggccuggcuccuucucucuaccagcuggaaggaucccuggagcaagagaagaaggugcgcauggaccuggagcgagcgaagc

SEQ ID NO: 2240349 - RNA, 63 nt, Homo sapiens
aauguagguggauauugcaauuagcuuccuucuuaguacugcuguugcaguauccuauauguu

SEQ ID NO: 2240350 - RNA, 58 nt, Homo sapiens
ucucuucccuuccaaggauaauaugauuguacuucuugguuccuuuugggguaggaga

SEQ ID NO: 2240351 - RNA, 55 nt, Homo sapiens
ugccucaaccucccaagguggcuguaauccuagcacuuuguugggggcugaggca

SEQ ID NO: 2240352 - RNA, 84 nt, Homo sapiens
aaccagugaggaagaaguaggcuuuggggcuugacagucauggguuugagcuacugcacuguccuagaguccuccucauugguu

SEQ ID NO: 2240353 - RNA, 85 nt, Homo sapiens
uaagcccaguagugcuuugguucuuucagacucuuagguaccaccuuguggucauggauaagauccagaaguauucgcugguuua

SEQ ID NO: 2240354 - RNA, 67 nt, Homo sapiens
uugccauuccucguguucaggacaaaaugacauuccaggaauggaaucugaaccaugggaauggugg

SEQ ID NO: 2240355 - RNA, 68 nt, Homo sapiens
guguauauggcauguauguguggcgcacgugugguauguguguguuguguguugcauguggugugugu

SEQ ID NO: 2240356 - RNA, 95 nt, Homo sapiens
aaaucuguauaccuuuuauauucuuuuuugucuuacuguauuagcuaggacuucuaguacacuguuaaaaagaaguggugagaggggacauuuuu

SEQ ID NO: 2240357 - RNA, 57 nt, Homo sapiens
guccaggcagaggucugcuacaggggcaaagcccucauggagaaccucugcuagggc

SEQ ID NO: 2240358 - RNA, 65 nt, Homo sapiens
gaaagaaagccuaaugcaagacagaguauaaccaagucugcuuugucugagacuguuuuacuuuc

SEQ ID NO: 2240359 - RNA, 103 nt, Homo sapiens
uuaauuucauuguuuacccaaaagucuuucaggaacagauaguuuaauuuccacauaauuguaugcuuuugagagauauuuuuggaguugauuucuauuuuaa

SEQ ID NO: 2240360 - RNA, 67 nt, Homo sapiens
cuugacuggaacuuuagugagucuacaacuuucuuaagaagggcucacauuuaguaucacggucaag

SEQ ID NO: 2240361 - RNA, 78 nt, Homo sapiens
gaggaaccuucauacuguuuccauuaugguucugccaauuuacauuuacauuucugccaacaguguguaaguuuccuu

SEQ ID NO: 2240362 - RNA, 61 nt, Homo sapiens
ggcuucagacaucaaacuggaaguuuucugaauuuaggauaucagguagaucuuugagguc

SEQ ID NO: 2240363 - RNA, 87 nt, Homo sapiens
cuguuggaauauaguaaugccauugaguuuuguauguugauuuuguauccugcaauguuacugaauguguuuuaucaguuccaauag

SEQ ID NO: 2240364 - RNA, 79 nt, Homo sapiens
ugugaguugggucuugggaggguguaauagggauggggacucuuccuaucccuguggacuucccaacagcccuugcaca

SEQ ID NO: 2240365 - RNA, 67 nt, Homo sapiens
cauguaacaucccgcuguaggacaucugccauuuacaucuccuuugccugcuguggagauuuacaug

SEQ ID NO: 2240366 - RNA, 64 nt, Homo sapiens
guaaucucagcuacuugggaggcugaggcacaggaaucucaugaacccaggagguggagguugc

SEQ ID NO: 2240367 - RNA, 59 nt, Homo sapiens
gagaucugggguuggcaaaguuuggcccuugggccgagucuggccugcugccaguuuuc

SEQ ID NO: 2240368 - RNA, 85 nt, Homo sapiens
uuggaaagaauaugucauggguaaagugcccuucucaucccagaauaucaagggggauaucauaccuacaugacaucacugacga

SEQ ID NO: 2240369 - RNA, 58 nt, Homo sapiens
aauauggcauucagaacuguauauacuuguguuuaugccauaaguucuaugccguguu

SEQ ID NO: 2240370 - RNA, 74 nt, Homo sapiens
ccugagggucccagcguucggcauggcugagcuuugcccucaagucucagccaucaugugggcgccuccucagg

SEQ ID NO: 2240371 - RNA, 83 nt, Homo sapiens
ugcacccagccugauuuugauaauuauaucacuuguuuuugaaaauacacaaggaaauauguagauaucaagaggcauaugua

SEQ ID NO: 2240372 - RNA, 57 nt, Homo sapiens
acugauggaagcccuucagaauggaugaugggaaaccaacuggaaggcuacuacagu

SEQ ID NO: 2240373 - RNA, 66 nt, Homo sapiens
ccugacucugauuucgcugcauaacucccaggggcauccugcucugaugucaggaagggagucagg

SEQ ID NO: 2240374 - RNA, 85 nt, Homo sapiens
agagugcuuuuaccuuauggcuuagcaaaggcuguuaaguauauucuuuuguauuuacaguuuucuaggcuaccaggaguuuucu

SEQ ID NO: 2240375 - RNA, 72 nt, Homo sapiens
uccaacccugaagaauauuuccugcacuugggauuggugcaaaauuccaguagaauuuuauucaacagugga

SEQ ID NO: 2240376 - RNA, 88 nt, Homo sapiens
ucaagguacacaaugugaugauuugauaaacguauugggaaaugauuaccacaaugaaauuaaucaacacauacaucaguacacuugg

SEQ ID NO: 2240377 - RNA, 77 nt, Homo sapiens
ucgcuugaacccaggaggcagagguugcagugagccgagaucgcgccauuguacuccagccuguggagcaagagcga

SEQ ID NO: 2240378 - RNA, 130 nt, Homo sapiens
cugccucagccucccaaagugcugggauuacaggcaugaggcacugcgcccuacugaggguucuuuauaaauucuaggccaggcacaguggcucaugccuguaguccuagugcuuugggaggcugagcag

SEQ ID NO: 2240379 - RNA, 60 nt, Homo sapiens
caggaaugugaggguucccugccugaaaaguuaguaaggcagaggagaucucauguccug

SEQ ID NO: 2240380 - RNA, 84 nt, Homo sapiens
ggccuacucuggaguaagucugcaagugaaaucaccuuugaugaggugauguuugaguugagacaggaaucacagaaaggagcc

SEQ ID NO: 2240381 - RNA, 57 nt, Homo sapiens
acauucaggccaccaggcuagaagugaaacagagcuuuggccuggaggccugaaugu

SEQ ID NO: 2240382 - RNA, 67 nt, Homo sapiens
ucaaguugggaaacugggggcuuaugggaacccuuucccauacugucaaauagauuuccuggauuga

SEQ ID NO: 2240383 - RNA, 63 nt, Homo sapiens
uugagaagugucuguucaugucuuuugcucacuuuuuaugagguuuuggggggaccuuuucag

SEQ ID NO: 2240384 - RNA, 103 nt, Homo sapiens
gaggugggaggaucgcuugagcccaggagguggagguugcagugaccuauggucgcaccacugcacuccagccuuggccacagagcaagaacucccccgccuc

SEQ ID NO: 2240385 - RNA, 73 nt, Homo sapiens
uuccauaagggucuugacuguuccuugaaaauccaucucuguggaucacauaguuuucgggaccuugguggaa

SEQ ID NO: 2240386 - RNA, 76 nt, Homo sapiens
ucuccugcauuugugaaugucauaagcuccacccugaguuuuagcccuuggauucucuggcguucaucaauggaga

SEQ ID NO: 2240387 - RNA, 74 nt, Homo sapiens
ucagaugaggucaggacauuuuugcuuugugacagauuugggacgcagagaaaagaguucaggcuuuguacuga

SEQ ID NO: 2240388 - RNA, 85 nt, Homo sapiens
gggaagaguaaaguaauggaguuauuuuaugagauuaaaguuuacuuguuaucagcuuaaauagccuauuaaaauuacauuuccu

SEQ ID NO: 2240389 - RNA, 88 nt, Homo sapiens
gccuacuacacagccaggauuuguaguguaccuaauguucuuaggcuacaaaccuauacagcaaguuacugugcugaauacuguaggc

SEQ ID NO: 2240390 - RNA, 84 nt, Homo sapiens
aguucauugauagaauguuccccaauuuagguucaucugcuguuuucuaugacugcauuggguuaugcauuuuuaacaagaauu

SEQ ID NO: 2240391 - RNA, 81 nt, Homo sapiens
caaguauuauggcucuauuuccuugucuagauacugauauaacuguaauuguggauggguugaaaugugagccaaugcuug

SEQ ID NO: 2240392 - RNA, 74 nt, Homo sapiens
cguuuuuaugacugaguagcauuccauuauauuuauauuuauaauggaauaauacucagccauauaaaggaaug

SEQ ID NO: 2240393 - RNA, 58 nt, Homo sapiens
aucacuggccuuuuuaaaugcuuacaacuuuaagggguccaugugaaagggucaugau

SEQ ID NO: 2240394 - RNA, 81 nt, Homo sapiens
ggccucagcaaaucauccuauuugagcaauaaagacagcccaagcugguaccaagcaucgauaggaaauuuguuaaagguc

SEQ ID NO: 2240395 - RNA, 67 nt, Homo sapiens
uugagcacugucugugugcaguaccucuuggaagugcugaggaacaagagaacaagacaguguucaa

SEQ ID NO: 2240396 - RNA, 100 nt, Homo sapiens
gguggcgugugccuguagucucagcuacuugagaggcuuaggugggagguucacuugagccugggagguugagguugcacugagccauguccaugccacc

SEQ ID NO: 2240397 - RNA, 55 nt, Homo sapiens
cuggaucuuguccaagaccauuaaggcaguaccacuaugagucugcaagaaccag

SEQ ID NO: 2240398 - RNA, 72 nt, Homo sapiens
guuacauuucuguuguuguuuuaagagacaaggacucccucugucgcccagguugacaugcagaggugugau

SEQ ID NO: 2240399 - RNA, 72 nt, Homo sapiens
cucuaaguagcagaauaucagauaauuuuaauuuuuuuugagacaggucuuacucuguuacccagguuagag

SEQ ID NO: 2240400 - RNA, 93 nt, Homo sapiens
ggaggagaaucgcuugaacccggaaggaggacacugcagugagccgaaauuaugccacugcacuccagccugcugacagagcgaaauuccuuc

SEQ ID NO: 2240401 - RNA, 74 nt, Homo sapiens
uuaugauuuucccccuuuacaggugaggaaacugaggcccaccuguauaacaagugggaaaucuaaugucacga

SEQ ID NO: 2240402 - RNA, 87 nt, Homo sapiens
ucucaugcugugacucucuggagggaagcacuuucuguugucugaaagaaaacaaagcgcuucucuuuagaguguuacgguuugaga

SEQ ID NO: 2240403 - RNA, 74 nt, Homo sapiens
ugcuugagcucaggaggcagaggcuacaaugagcaaagaucaugccacugcacgccauccugggcgacagagcg

SEQ ID NO: 2240404 - RNA, 58 nt, Homo sapiens
auguauguuuucuacuuguacguuuaauuuuuuucuauguggaaguagaaacauaugu

SEQ ID NO: 2240405 - RNA, 79 nt, Homo sapiens
aauaaaauacaguguacaauagccuuuuaaucaaaacacagcaucguaguuggagguugaaagcuuguagcuguuuguu

SEQ ID NO: 2240406 - RNA, 72 nt, Homo sapiens
gccaagucagauucugcagagaaaaggagcuaggacuuacuuaccucuguggcucucggacuuggacuuggc

SEQ ID NO: 2240407 - RNA, 60 nt, Homo sapiens
auugagcaauuccuaugugcuuggcuuuauuauaagguuuuuacauggcauugucucaau

SEQ ID NO: 2240408 - RNA, 83 nt, Homo sapiens
ggaggugcccacuugguaaagcacaauuucaccuucuuguaaaccacagggcagagugaaaugcuaugaaugugggcacaucc

SEQ ID NO: 2240409 - RNA, 64 nt, Homo sapiens
gccucuaaagucacgauuuguggguauccgagucucucugccucuaaagucaugauuuaugggu

SEQ ID NO: 2240410 - RNA, 79 nt, Homo sapiens
aacccaugagauauuuagaaauguguucuuuaauucacaaauauuuaaggauuuucucgauaucuuagugucauugguu

SEQ ID NO: 2240411 - RNA, 61 nt, Homo sapiens
ggaauugucuaguacucacggccacuaugacucuaaggugauaugaguucauuagacuucc

SEQ ID NO: 2240412 - RNA, 57 nt, Homo sapiens
aaguuucauggaucacagguacaccgcuagggacccuguagaaugucugugauacuu

SEQ ID NO: 2240413 - RNA, 78 nt, Homo sapiens
gucucuaagcuguaagaucugcagcugucauuaaaauaucuacaguucuguagcuuuuauaugcuuagccaaacagac

SEQ ID NO: 2240414 - RNA, 57 nt, Homo sapiens
gcuucauggaggcugggcgcaguggcucacgccuguaaccccagcacuuuaggaggc

SEQ ID NO: 2240415 - RNA, 57 nt, Homo sapiens
ugagaugaguugcgcucugucgcccaggcuggagugcaguggcgcgaucucggcuca

SEQ ID NO: 2240416 - RNA, 122 nt, Homo sapiens
gaaguuuccucagcugggaggggaaggacauggaguguaauauugagagcugcagcuguguguuuggcuagggcuuccacuugcagcuccauaucaacuuuggcugccugugaggaaauuuu

SEQ ID NO: 2240417 - RNA, 71 nt, Homo sapiens
uucaaaucagcaaugaccuaagcaaauaacccccagugcccgggauauuuagcuggagucagugcuuugaa

SEQ ID NO: 2240418 - RNA, 94 nt, Homo sapiens
cagccugggaccacuuaggaaaaacaggaaagaugccacagacuuuucuguuugggaagauucuguguuuuuccacauggaaccccaagaguug

SEQ ID NO: 2240419 - RNA, 64 nt, Homo sapiens
uuuguuguuuguuugugauacgguacauuaguuuuuuauugcugcuguaacaaauuaccacaaa

SEQ ID NO: 2240420 - RNA, 59 nt, Homo sapiens
ucagaacugauacuagaacuuuagauaguucuagugcuuguucuaguaucuaguucugg

SEQ ID NO: 2240421 - RNA, 81 nt, Homo sapiens
ggaugaucgcuugagcuugggaggcugagguugcagugagcugagaucaugccauugcacuacagccuaggcgacaaaucc

SEQ ID NO: 2240422 - RNA, 69 nt, Homo sapiens
aaguaaaagcuagagaagcugcugucaacuuuuuacuuaaaucugacaguauaucucugccuuggacuu

SEQ ID NO: 2240423 - RNA, 130 nt, Homo sapiens
cccaccucagccuccugaagugcuggaauuacaggcauaagccacuguaccugucucuuaaaaauaaauuuaaagguggggaacgguggcucaugccuguaaucccagcacuuugggaggccgagguggg

SEQ ID NO: 2240424 - RNA, 56 nt, Homo sapiens
cccgggaggaaaaaguugcagugagcugagaucaugucauugcacuccugccuggg

SEQ ID NO: 2240425 - RNA, 74 nt, Homo sapiens
uuuuauuacaguagagaucagcaaacuaugucccauggguaaaaucuggucugccaucucuuuuuguaaagaaa

SEQ ID NO: 2240426 - RNA, 69 nt, Homo sapiens
ugggcccggaagagagagauguaauaauaacaccuggcuugguauaacauccuuucuuaucguugucua

SEQ ID NO: 2240427 - RNA, 76 nt, Homo sapiens
gaugaugcuagguguuagggcugcaauaccaaauacuagauuauucacagguucaugaggcucaucuagcaucauu

SEQ ID NO: 2240428 - RNA, 65 nt, Homo sapiens
aggaaaagagacuggaagaaaaucacgccaucuguaggcaaugggugguuuuucucuuccuuccu

SEQ ID NO: 2240429 - RNA, 60 nt, Homo sapiens
uuuauggcauagcggcauuggauacacauuuggguguagcuaaguuguauuugucaugaa

SEQ ID NO: 2240430 - RNA, 63 nt, Homo sapiens
uuuauuguguacuacaguaugccacacuguuaaauauugggcauguagaagugacaugaugaa

SEQ ID NO: 2240431 - RNA, 69 nt, Homo sapiens
uaacuuuuuauugcucuaaaguugccauuaguuugaccaacuaaccaaugaaugagcuguaguggguug

SEQ ID NO: 2240432 - RNA, 67 nt, Homo sapiens
uuagauuauugguguuuugcaaucuccaaugaauuaauggaucuaagcauugggcaucaaugacuga

SEQ ID NO: 2240433 - RNA, 68 nt, Homo sapiens
caaagugcugagaugacacacgggagccaccaggccgggacucaccguguaucauuucauccgcuuug

SEQ ID NO: 2240434 - RNA, 71 nt, Homo sapiens
agugcugguauuucaggugugagccaccauggcugaccacagcuaugucugaugccugauuacuaaucauu

SEQ ID NO: 2240435 - RNA, 56 nt, Homo sapiens
uggauauguuuauuacccugaauguggugacaaugucauggguguaugcauauuua

SEQ ID NO: 2240436 - RNA, 59 nt, Homo sapiens
gagugguuuugauuuauagcuggacauauuaaauguauaaguuaugcuagaagccacuc

SEQ ID NO: 2240437 - RNA, 76 nt, Homo sapiens
uaaugucuguuucuacagugggucuguaguccuugucaugacaaaguccuaccaccuacugugcaaaagagaguua

SEQ ID NO: 2240438 - RNA, 78 nt, Homo sapiens
uuagagcagugauaaauguagggacaaguagagaaaauacuuucuuuaguuaagggacauuuuauaucacagcucuaa

SEQ ID NO: 2240439 - RNA, 83 nt, Homo sapiens
aguugcauggugugauggaaggagaauggucuuugaaagcagacagacauaauuucaaauaccagcuuuuccagaauguaacu

SEQ ID NO: 2240440 - RNA, 59 nt, Homo sapiens
ggagacaaaguuagaagcuggcuaucaguuuaaauuucuagucaguuuauuuucucucu

SEQ ID NO: 2240441 - RNA, 63 nt, Homo sapiens
ggauacugugauuuuuuccuauuccauagauugagaaucuaggcuguagagaaguucaguacc

SEQ ID NO: 2240442 - RNA, 118 nt, Homo sapiens
ccugguacugauguaaauucugguacguaaauucugagugcaucuuuaucuuauagcagaaaaguauaaccuauggaucuacucggguacuugauuuuaaaugcucuuaaaucccagg

SEQ ID NO: 2240443 - RNA, 85 nt, Homo sapiens
ccugguagcuugcaagaaaugcagauucucagguccuacccagaacccuuugaauuggaaucuguauucuagcaagaucccuagg

SEQ ID NO: 2240444 - RNA, 72 nt, Homo sapiens
uucaaagucucaugugccauugucuugucaauguguguaauagcuucagguaauagcacaugauaccuuggg

SEQ ID NO: 2240445 - RNA, 55 nt, Homo sapiens
gggggcauuuuuaacaauuaugucagaaaaacaagcauaaacuagaacugucccc

SEQ ID NO: 2240446 - RNA, 100 nt, Homo sapiens
auguaguugagcaguuuugagugagucucuuaauccucaguucuaguuugauucccuguggucugagagacaguuuguuaaaauuucuguucuuuuauau

SEQ ID NO: 2240447 - RNA, 68 nt, Homo sapiens
cugguauuacaggcaccuggcuaauuuuuguauuuuuaguagagauggaguuuugccauguuggccag

SEQ ID NO: 2240448 - RNA, 125 nt, Homo sapiens
gaaaaaugacuccagaaucuuuaaaucugcucuacuguauagauggaguugauuuuuaaaaguugaaaaauauuauaagaugauuuuauuuacaguaaguugacuuaggauuggacuuauuuuuu

SEQ ID NO: 2240449 - RNA, 99 nt, Homo sapiens
auucagcuuauaauccauuauuaucacuguuuugaugcucggacgcucugagacgauccgggcaucaaaacagugauaguaaugcauuauaagcugaau

SEQ ID NO: 2240450 - RNA, 62 nt, Homo sapiens
guauggcucuuauuauuuugagguauguuccuucaguacccaguuuauugagaguuuuuaac

SEQ ID NO: 2240451 - RNA, 71 nt, Homo sapiens
cacauguaaaagggcuuuguaaacuucaaguuucuguccaaauaugaaucgugauuagaggccugcaugug

SEQ ID NO: 2240452 - RNA, 90 nt, Homo sapiens
ggguuauacguauuuaggaaaucucugaggcucccuuccugcucugcucgagcuggagcgagugcucaaguuuucucacccuaaugaccc

SEQ ID NO: 2240453 - RNA, 76 nt, Homo sapiens
gaugcauuggacuguaagugccuugaguacagggauaugucugcuuugcucacucuauucacagugccagugcauu

SEQ ID NO: 2240454 - RNA, 65 nt, Homo sapiens
auaauguaccuuugcggcaaucacacugcauuuugaaugugcaauggcaacgaggugugcauuau

SEQ ID NO: 2240455 - RNA, 79 nt, Homo sapiens
guagacagcucacugggcugucaugagcaacacaugaauucacacauuuaaagugcuuaugacagugcauggcgcauac

SEQ ID NO: 2240456 - RNA, 56 nt, Homo sapiens
ugaaugcuucaugucugggcuguaagaucuacugugagcccuacaugaugcauuca

SEQ ID NO: 2240457 - RNA, 129 nt, Homo sapiens
uauguauauauguguguguguguguauaguuauaauuauaguuauauauaguuuauauauaguuauauguggaaauguauaugugucuguauuuuuuguauauguagaccuacaaaauuuguauaugug

SEQ ID NO: 2240458 - RNA, 68 nt, Homo sapiens
uccaugucagugauugauuuaaagacgugauuggauaacacuugucuguugauugaauuacugaugga

SEQ ID NO: 2240459 - RNA, 77 nt, Homo sapiens
uuguuaaaaucauauucuuguucuguuccaaaucuugaauaacugaggcuuggaauaucaugagaguuuguuaacaa

SEQ ID NO: 2240460 - RNA, 78 nt, Homo sapiens
cccgaacuugagaaucuuucgaauguucucucaaacauaagcaccaggagaggauaugauagagucucaacaccuggg

SEQ ID NO: 2240461 - RNA, 65 nt, Homo sapiens
uguaugcacacguguccaugugcacccauguccaagucaccucucugcacggcugugugugugca

SEQ ID NO: 2240462 - RNA, 97 nt, Homo sapiens
ugcagcaauacaacugaagaacaaauucuuaccuuccaggugaggacacagaauacacuggagcauugguggauuuguuauuuagucuguuacugca

SEQ ID NO: 2240463 - RNA, 63 nt, Homo sapiens
ugacucugagagguagacagugagaaugugugugaccaggguccugaugaccucugagaguua

SEQ ID NO: 2240464 - RNA, 95 nt, Homo sapiens
ccuuguacuugugugcuguagcuguaauuuuauuugccauuuuauauaacaaaugcagagaaaucuaaaauauggagaugaacaacaggauaagg

SEQ ID NO: 2240465 - RNA, 64 nt, Homo sapiens
uguuugagauguagauauggauuagaccauuuggguuuagcacaucauguacaucuaguaaaua

SEQ ID NO: 2240466 - RNA, 66 nt, Homo sapiens
ugugagaugauagauauguuaauuugcuuuaaaguagcaaugauuuuacugucuguguaucucaua

SEQ ID NO: 2240467 - RNA, 58 nt, Homo sapiens
ugugguguaugugugugcuugaauacaaagagaaacguucagaugcaugcucacuaca

SEQ ID NO: 2240468 - RNA, 76 nt, Homo sapiens
ucagcaguagcaauuguucugauucccugugguucccuaagacagcccacugaguugagagaguuguuauuucuga

SEQ ID NO: 2240469 - RNA, 64 nt, Homo sapiens
acaucucaguucaggcuggccacauuucuucaaguugaaauguggcuaacccaaauugagaugu

SEQ ID NO: 2240470 - RNA, 58 nt, Homo sapiens
gcuugcuagagaugagggaugugugucuucccaccauuuggaccucauucuaguaggu

SEQ ID NO: 2240471 - RNA, 99 nt, Homo sapiens
ccugaauuugaauauuggccugacuugcuagauugggaaguucuggauauccuucagaguguuuuccaacuugguuccguucucccugucacuuucagg

SEQ ID NO: 2240472 - RNA, 56 nt, Homo sapiens
auuugagaaacaccggacgcugccagcauccugggaaguccacgugcuuuccagau

SEQ ID NO: 2240473 - RNA, 61 nt, Homo sapiens
ugaacaucuuuguuaauuuucugucucagugaucuggcuaauauugacauugggguguuca

SEQ ID NO: 2240474 - RNA, 75 nt, Homo sapiens
uuuaagcugauucuaaaucauaauccaucuguugccucccaacauggcuuaugaauuuggagaagaggccuugag

SEQ ID NO: 2240475 - RNA, 68 nt, Homo sapiens
uagaguacucugguaaguucuuugagggcagucauuauauucuucaccaagcuuagcagacugcucug

SEQ ID NO: 2240476 - RNA, 93 nt, Homo sapiens
aacaagaucauauauaaauuuaaggcaaucagucaugguguuacuuuaaaagaggaagacgauuggugcuuugaaauuguguuauaagaaguu

SEQ ID NO: 2240477 - RNA, 60 nt, Homo sapiens
caagugaaugaugugaaguguaaacaaccaucuauguuucauguuacugucauacacuug

SEQ ID NO: 2240478 - RNA, 71 nt, Homo sapiens
gagaaagcuacauuuuauuuaugucaguguguaaaauuauaaccugauaaugaaagaaauacaguuuuuuc

SEQ ID NO: 2240479 - RNA, 67 nt, Homo sapiens
uaacauugucuugcuuaguuuuguauccucuguauuuacuccagggcuuggcaaagggcauguguua

SEQ ID NO: 2240480 - RNA, 78 nt, Homo sapiens
agguuucuuauuggugaggaaauuaugagcagugcaaauucuuuuguauaggcaaauuuccucauggauuaugggcuu

SEQ ID NO: 2240481 - RNA, 99 nt, Homo sapiens
gugguaggacugucacugccugaggcugaugcagcaccucggcagacaucugaagccgcaacucugcucagagccuacagagcugagguccuggaucac

SEQ ID NO: 2240482 - RNA, 65 nt, Homo sapiens
ugaugccauuucaaaauaagauuuaaaaugacucuguaugugagcuuguagugugaaugguauca

SEQ ID NO: 2240483 - RNA, 60 nt, Homo sapiens
gagcuagguuuugaauccagaccauauacucauggccauuaggacuucaaacaucagcuc

SEQ ID NO: 2240484 - RNA, 80 nt, Homo sapiens
uuuuugacccuauagaggcaauaggcacuuccauucuuuuuacuuuuuauguagguucuagauaauuugggggucaaaga

SEQ ID NO: 2240485 - RNA, 67 nt, Homo sapiens
uuaugugccuuuuugccauucauaugucauauuuaagacgauauaugaauggcaaaaaggcacauaa

SEQ ID NO: 2240486 - RNA, 84 nt, Homo sapiens
uuaacuuuagggcguaauuaugguuguuaucuugguucgauaccauuggaauuaguggcaaucauauuguugcuuuauuguuaa

SEQ ID NO: 2240487 - RNA, 81 nt, Homo sapiens
gauuuuugacaaaggugucaacacaguuaaauggggaaagaauaaucuuuuccacaaaugauguugaaacaacuagaaauc

SEQ ID NO: 2240488 - RNA, 59 nt, Homo sapiens
uguccaggcagagguuugcugcaggagugaacuccucauggagaaccucugcuagggca

SEQ ID NO: 2240489 - RNA, 83 nt, Homo sapiens
ugugcauuaccuccauccuugucaccauggccacuuuauugaugagcucauugggugacuggggaaagaggcugacugauaca

SEQ ID NO: 2240490 - RNA, 64 nt, Homo sapiens
ugaggcaaugugcccggcccacaaugguuuucauauagcuauuguguauugcguuauugccuua

SEQ ID NO: 2240491 - RNA, 72 nt, Homo sapiens
uucugucucuauggauuugccuauucuguauuucauauaaauagaagcauaauucagccacaagagauggaa

SEQ ID NO: 2240492 - RNA, 57 nt, Homo sapiens
ucuagaugaaguauaaaguaguucccagugcugguugcacaucuacuucaucucaga

SEQ ID NO: 2240493 - RNA, 59 nt, Homo sapiens
gugauguguuucaacagcuccuuuccuuaaacauuguuaggugcuauuuaacauaucau

SEQ ID NO: 2240494 - RNA, 75 nt, Homo sapiens
gucucuaaugcuaaggauuuguuaaggaaucacuaaacacgguuagugcuuaauagauguccagcaucaugggac

SEQ ID NO: 2240495 - RNA, 99 nt, Homo sapiens
uagaauucuuauaguuugaggucuuacauuuuaauauuuauaucaucuugaguucaguuuuguauguguugaaaaguagggcuccagcuucauuuucug

SEQ ID NO: 2240496 - RNA, 104 nt, Homo sapiens
uucgcagcgucuuccaagucucuguucucuaaggaaauaugucacuugcugagcgaggguaggggaagugugguuucuuuacagaaccgggaagauucuccgag

SEQ ID NO: 2240497 - RNA, 94 nt, Homo sapiens
gugcauguacaugugugcaugcauguguguguguccaugugugugcauguguguguggacauguacauauguguaugugugccugugcaugugu

SEQ ID NO: 2240498 - RNA, 59 nt, Homo sapiens
ggaucccugagaacuuuuaauguuuuuucuaccacuaaaaauauaggugacagggauuc

SEQ ID NO: 2240499 - RNA, 100 nt, Homo sapiens
ugugugaguuagcauaaagggauuuuguuuucauuuaagacuugauuuucaaacucuaggaggucacagucugcgugaugagacagaguuagcacacaua

SEQ ID NO: 2240500 - RNA, 129 nt, Homo sapiens
aauacuuuccuacaggaucauaauguagcucccaaugaugcccccgcuuggcaggauuuuaacaccaauuccaaaaaugucaaggaaugucauugguuugaauuuacauaauugauagaguaggguauu

SEQ ID NO: 2240501 - RNA, 65 nt, Homo sapiens
accacgccuggcuaauuuuuguauucuuaguagagauggaguaucaucuuguuggccaggcuggu

SEQ ID NO: 2240502 - RNA, 83 nt, Homo sapiens
agacuacuggauuuugagaaucuuugcuaaaggaagaggauuaaauauucuuccaaugcccaagauuucuucaauucuauucu

SEQ ID NO: 2240503 - RNA, 79 nt, Homo sapiens
augucacauuuucacaguauucaugaacauggaaugggagccuccaauuucuguaaucaagauauuugagaguugaugu

SEQ ID NO: 2240504 - RNA, 82 nt, Homo sapiens
cccugucagcagucugugccuaguaauguguccagacagacagggcugugggcaugagagcugugguagaacuggggcaggg

SEQ ID NO: 2240505 - RNA, 69 nt, Homo sapiens
cuuguugccuaggcuggagugcagugguacgaucuuggcucacugcaaccuccgccucccagguucaag

SEQ ID NO: 2240506 - RNA, 69 nt, Homo sapiens
uuaggacaccagguuauuuaaaacguauaaaaauacuaaauaauggguaagaauggcucuggguucuaa

SEQ ID NO: 2240507 - RNA, 75 nt, Homo sapiens
ugcuuggagccuuugggagcuuuccuggucaagggagguuuugugccauggaggauuuauagaggcccccaagca

SEQ ID NO: 2240508 - RNA, 95 nt, Homo sapiens
aaacacugcaauauauuucagauguuaauuuuggugcuguuuguuggaaaguaggcauggagacuaaaauuauauuuguguguggugcuauguuu

SEQ ID NO: 2240509 - RNA, 80 nt, Homo sapiens
ggagugaauuauagcuaacaucugugaaaaguuauguaucugaaugcacauuuuccagcaugagcuuuaguaccaacucc

SEQ ID NO: 2240510 - RNA, 74 nt, Homo sapiens
cacuugauuccgaaaugaggcuuuugcagacguaauugaggaugucaagaugagaucauucuggaauuagagug

SEQ ID NO: 2240511 - RNA, 99 nt, Homo sapiens
aggauugacuguugucuguugccuuuuucuggaaugcagugagcauuagauauggucauuucaagccucacugcguuuuguaucaguuuagucuguucu

SEQ ID NO: 2240512 - RNA, 58 nt, Homo sapiens
ccacaaucuaaagggcuguaucucauacccuuaagaguaugcaaacccugcuuugugg

SEQ ID NO: 2240513 - RNA, 85 nt, Homo sapiens
cggcuguccucuccaacaauauccuggugcugagugaugacucaggcgacuccagcaucagugauuuuguugaagagggcagcug

SEQ ID NO: 2240514 - RNA, 87 nt, Homo sapiens
uaucuaucuugauaaguuagugugagaauuuugcgugguuguauaaagggccuggcacauaguaacuucucaauuugugauagcaua

SEQ ID NO: 2240515 - RNA, 63 nt, Homo sapiens
guuagcaguauggagcgaggcccagauccagacuucugucggccuaauuuuauaucuguggac

SEQ ID NO: 2240516 - RNA, 58 nt, Homo sapiens
gcagccgcaguggccacaucuuggagauugacugucagcgcauggucgugcggcaugc

SEQ ID NO: 2240517 - RNA, 69 nt, Homo sapiens
aaauaauuuugcucuucggaagagcuugcuaugaggaugaaagguaagcuagacugagagaaaauauuu

SEQ ID NO: 2240518 - RNA, 97 nt, Homo sapiens
cccuuuauuugaaagaacuagaauguuuucauuauccuaacuguauccugacagauaucagagguauugcaaaagccuagauuccaaguacaaaggg

SEQ ID NO: 2240519 - RNA, 83 nt, Homo sapiens
uguuggcuauggauuuguaguacaugguugauuaacauaaaugcaaaaauugucaccaaaauacuaucaaaccaaauacaaca

SEQ ID NO: 2240520 - RNA, 130 nt, Homo sapiens
aaagguuccuuuuccaauuguggggguuagugagacaaaguguaugaaaagcauaaacgcugaagugccauguugguauugcuuagcaacacuuuguucacacugucacguauugcacugcauuuccuuu

SEQ ID NO: 2240521 - RNA, 84 nt, Homo sapiens
uauuagguuggugcaaauguuauugagguuuuugccauugaaaguaauagcaaaaaucacaauuauuuuugcaccaaccuaaua

SEQ ID NO: 2240522 - RNA, 56 nt, Homo sapiens
ugaguguauagagggcauuuguccugacuggaucaaaaugugcuuuaguacccuca

SEQ ID NO: 2240523 - RNA, 129 nt, Homo sapiens
ucccuccugaaauccgcuuccuguccuucuugggcuccugucugcuucuauggacuauuaauauaucucaugacacuggcaggagcuaaaaagagggguggccagaccaaagaggacacaguugaggga

SEQ ID NO: 2240524 - RNA, 95 nt, Homo sapiens
gaaggaauacucacggcaguggugauaaccacuaucauagcuaccauuaaauuacucguugugacugguugucccacuuuccucagguuuucuuc

SEQ ID NO: 2240525 - RNA, 65 nt, Homo sapiens
agaaagaagcuuuaugagaaacugcuuggugaugugugcauucaucucauagaguuucacuuucu

SEQ ID NO: 2240526 - RNA, 74 nt, Homo sapiens
uccaaaacuuagccgcuuaagacaacuucuacuauuucacuucugugguucaagaauuaaaguggcuuuuuggg

SEQ ID NO: 2240527 - RNA, 107 nt, Homo sapiens
uguccuggagccccugcaccugucuccaaaugguauccgcugugccgccaggacgcgcuucacuggcagcaugggugccuuugugaagauugugaggcgcuaggaua

SEQ ID NO: 2240528 - RNA, 120 nt, Homo sapiens
auugagccuugaagugugaguaggaguucaucaggugagggguaaauguaacacuuacauuuugccagagucuaccucucucccagauugacuuccuuuucauagcuuuaugaaaucagu

SEQ ID NO: 2240529 - RNA, 68 nt, Homo sapiens
aauucuaugagguugguauuacugucucuauuuuaagaucaggggcuuuaagaaacuucccuaggauu

SEQ ID NO: 2240530 - RNA, 129 nt, Homo sapiens
ccuccacuccccuuuccagagggggccaugguuaacaguguguguguucaccuagaccguuuaugcaucuguagacacacacacagugaagugugguuuucgucguuuugguggggagguugguuucug

SEQ ID NO: 2240531 - RNA, 78 nt, Homo sapiens
gauagagggucauuaagcagcuuugcauggccugugagacagucucagcccugccagagcucucaacagccaccuguc

SEQ ID NO: 2240532 - RNA, 86 nt, Homo sapiens
gauuuauuauauacccugcagaucuuggggcuugccagccuccaugaucaugugguuggcaagucccaagaccugcagggugaguc

SEQ ID NO: 2240533 - RNA, 82 nt, Homo sapiens
uccaaaauuaauuguccaaguucaucucucaaaaugaaauaauuucagcuagaaaugagcuguggcacaguaagccuuugga

SEQ ID NO: 2240534 - RNA, 64 nt, Homo sapiens
gugggucucucuaguggcagaagcaaauugccaaauaauaguuugucugagagaggagaucuac

SEQ ID NO: 2240535 - RNA, 60 nt, Homo sapiens
uuaagguuuauguauggagucucaauucuguuccacugauugagcuauauauguccuuga

SEQ ID NO: 2240536 - RNA, 90 nt, Homo sapiens
uacugaauggggacaucuugcacuguuguaagggacuuguucaccagcucaugaaaagccagaccuuagugcaagacacgucccacagug

SEQ ID NO: 2240537 - RNA, 94 nt, Homo sapiens
gccugcuccuagaaaacaaaggaaacggagauacucuauuucaguuaaucucuugcugaaaugaauuauuuucuuuccuguuuuagaaguaggu

SEQ ID NO: 2240538 - RNA, 61 nt, Homo sapiens
cugucagugggaguucaggcuugcuguccccagcuggaaaugcagguggucccgcuggcgg

SEQ ID NO: 2240539 - RNA, 61 nt, Homo sapiens
ugugguacuaucuuugguuucaggcauucaguggguucuuggaacauacauaguccccgca

SEQ ID NO: 2240540 - RNA, 73 nt, Homo sapiens
aaaggcauugcuuguuuaaagcaguuuaaaugauaguaucuuuuaaggcuuuaaguaaacacagcuggccuuu

SEQ ID NO: 2240541 - RNA, 59 nt, Homo sapiens
ggugaucauugucucuaguaugaauuaaacucuucuugcuuaggucaccagugaucacc

SEQ ID NO: 2240542 - RNA, 75 nt, Homo sapiens
uggcgcacaccuguaauuccagcuacuagggaagcugagacacgagaaucucuuggcggaaguugcagugagcca

SEQ ID NO: 2240543 - RNA, 57 nt, Homo sapiens
uuaucccacuuucuguuccuguggucuucuuucucccaugaagcagaaacuggauaa

SEQ ID NO: 2240544 - RNA, 62 nt, Homo sapiens
guguuugaaggauaacucugcuaaacauuauauuuuugguuggcaguuuuugccuucaauac

SEQ ID NO: 2240545 - RNA, 57 nt, Homo sapiens
gggaggggcugaggcucaggucuguggcugcccggcucugagguugggguccuuccc

SEQ ID NO: 2240546 - RNA, 95 nt, Homo sapiens
ucauuucucuugcucucacaauugguguuuauggggaaguaucaacuacuugcagugccauuuccccaucaauuacuagagaguggggaaaguga

SEQ ID NO: 2240547 - RNA, 78 nt, Homo sapiens
uucaguuuccauguaguugagcggcuuugagugagauucuuaauccuuaguucuaguuugauugcacuguggucugag

SEQ ID NO: 2240548 - RNA, 62 nt, Homo sapiens
uuguaugucuucauuugaaaaauguucauguccuuugcucacuuuuagaugagguuauacgg

SEQ ID NO: 2240549 - RNA, 75 nt, Homo sapiens
aaauacggguauaagaagugaaccagacgucuuuaagaaagaguaugucugcuacucuuguuuccaaaaguguuu

SEQ ID NO: 2240550 - RNA, 66 nt, Homo sapiens
uuuugagacauaauuggugggauggaugcuuacuuucauaauucauuucuacuccuguguccagaa

SEQ ID NO: 2240551 - RNA, 73 nt, Homo sapiens
agguacuuagugaauguuggcuauuaauacuauuacuauauaugcaguguuacuaauaauucauucaguacuu

SEQ ID NO: 2240552 - RNA, 68 nt, Homo sapiens
ucagagguugcguucacuugagugucaaaguguguaccaagacaaauucauucagugaauucuuuuga

SEQ ID NO: 2240553 - RNA, 80 nt, Homo sapiens
cagcaagaaugcuuuuaauagcuuuaaaaaaguuuucaaauuucuuuggcaaaugaagucagcuguacaguaucuugcug

SEQ ID NO: 2240554 - RNA, 68 nt, Homo sapiens
aguuugugagggagcuaagaugaguugagauaaaccaguguuacuguucuuguauucugucguggacu

SEQ ID NO: 2240555 - RNA, 59 nt, Homo sapiens
uaacauagucauauacuugcuugaguuuucacauagggcacaggaaaugacucauguua

SEQ ID NO: 2240556 - RNA, 78 nt, Homo sapiens
gaaccaucucuucucaggcuuuucccagagugaugucaacaagacaauucaugugaagggcuugaaucucugugguuc

SEQ ID NO: 2240557 - RNA, 60 nt, Homo sapiens
gcucaaggaauacuggugguugcuauuaauauaauaguaaugauuauuauuuccuagggu

SEQ ID NO: 2240558 - RNA, 64 nt, Homo sapiens
gagagucuccagguauggaucugauuuguaacucggcacuuucagguaggccuagaguauucuu

SEQ ID NO: 2240559 - RNA, 57 nt, Homo sapiens
cuuucacucauggugaaaggcaaaggggaacugugcacaucaccuugugagagagag

SEQ ID NO: 2240560 - RNA, 87 nt, Homo sapiens
gagcauuuggcccauuuacauuuaagguuaguauuguuaugugugaauuugauccuguccuuaugauguuagcugguuauuuugcuc

SEQ ID NO: 2240561 - RNA, 78 nt, Homo sapiens
gauucaauguugagagauugugugauuccaauaauuucucuguuuuguuuggauuuucuaauuucugugcauaggguu

SEQ ID NO: 2240562 - RNA, 97 nt, Homo sapiens
uaguauuuauuauccagaguaaggcgguuauagguuuuauguuaaagauaccuuuugaaaguaaggcuucuggcccuuaacuuuguuuauaauacua

SEQ ID NO: 2240563 - RNA, 95 nt, Homo sapiens
uguaaagacauguuuuggauaaaguuugugagaaaaaaauucaagcugcuucuauuuucauacaagcuacaaucacaaagaguuuugccuuugca

SEQ ID NO: 2240564 - RNA, 88 nt, Homo sapiens
ggaggaucacuugaacccggggggcagagguugcagugagccaagaucgugccauugcacuccagccugggugacagagugagacucc

SEQ ID NO: 2240565 - RNA, 58 nt, Homo sapiens
ugagacggagucucgcucuguuguccagccuggaaugcagcagcgcgaucucugcuca

SEQ ID NO: 2240566 - RNA, 99 nt, Homo sapiens
caggaacaggccauuuucacuucuuuugugauuccucaguuacuucaggccaucuggauguauacgugcaagucacaggggauaugauggcuuagcuug

SEQ ID NO: 2240567 - RNA, 58 nt, Homo sapiens
gaaaggauuugaaaaaguugcaggaaacgaauuuaugccuguaccagcaagucuuuuc

SEQ ID NO: 2240568 - RNA, 70 nt, Homo sapiens
uuuagcauccaagguuaugacugacauuuguacaaggugauacuggucaaguaauccugggugucaugaa

SEQ ID NO: 2240569 - RNA, 55 nt, Homo sapiens
ugaaacacacauugcccuuuaucugagaguucugaaagggcagaggugugucuca

SEQ ID NO: 2240570 - RNA, 92 nt, Homo sapiens
ucuaaauuacugggcuugcauaucacaaacaagucuguacuuguccuccuacucuacaaauauaaauauaguaugugauguaggccuuugga

SEQ ID NO: 2240571 - RNA, 78 nt, Homo sapiens
gacaccuaacaauuauucagugacuuaagagauauacuagucuguuucuuagucauguaauaguccagguuagguguu

SEQ ID NO: 2240572 - RNA, 92 nt, Homo sapiens
cuuucuauuguggaaaauaauaagagagacauaaauugcagugaacuucccauuauuguucuuguguccuuuuccuccacauuauacgagag

SEQ ID NO: 2240573 - RNA, 69 nt, Homo sapiens
uugcuaaugaaguuucaggcaccauugucauugauaacaucuuaucaggagacaggguuuugagagcaa

SEQ ID NO: 2240574 - RNA, 75 nt, Homo sapiens
uaaucaagcuuucaagaaugcagcucucaucugauuagaccccauaagaaugaguucauuuugaaaccuugauug

SEQ ID NO: 2240575 - RNA, 70 nt, Homo sapiens
gauuugccaagagagacuuugcagacuccacagauguuguguacugcagaguauucuguucugcaaaauc

SEQ ID NO: 2240576 - RNA, 59 nt, Homo sapiens
uaggaacauaaaugguaucacuuagggaaaauuguaagguauuuacauuucuguuucua

SEQ ID NO: 2240577 - RNA, 64 nt, Homo sapiens
uuucuucaaagacagcuuggccuggaaucucuagacaagacaggccagaugaucuaugaaggaa

SEQ ID NO: 2240578 - RNA, 81 nt, Homo sapiens
aaugcaauuuuguucuguggauguauugcacagucugaaauccaggcuuuuaguguauccaugacccaaauaaugugcauu

SEQ ID NO: 2240579 - RNA, 95 nt, Homo sapiens
ugaauguuuuuguaugucucugggugcagggggacuugaguuagcauuuacgccuagcaguagaauuccugcaucacaggauauauguauguuca

SEQ ID NO: 2240580 - RNA, 104 nt, Homo sapiens
gaggcugaggcaggaaaaucgcuugaacccaggauggagguugcggugagccgagauugagccauugcacuccagccugggcaacaagagugaaacucaguuuc

SEQ ID NO: 2240581 - RNA, 74 nt, Homo sapiens
ucauauugccucagugacuuugggggaguuuguugaacuuucucucaaccccaaguuuacugggggaagaauga

SEQ ID NO: 2240582 - RNA, 80 nt, Homo sapiens
aaauggaaccugagucucugaggugggggcaaaucuguuucuaagguggagucauaucucagagaaucagauuuacguuu

SEQ ID NO: 2240583 - RNA, 60 nt, Homo sapiens
ccauggccauuuuauuguagagugcauuauuaaguguauagcuugaaggaauggucaugg

SEQ ID NO: 2240584 - RNA, 60 nt, Homo sapiens
uagugcuuauauagcacuuaguaugugucaggcacacuuuuaagugcuuuguaugcacua

SEQ ID NO: 2240585 - RNA, 58 nt, Homo sapiens
ggcuguguuucuguuugacauuugcaauuaauuaccgaaaugcaauggagaugcagcc

SEQ ID NO: 2240586 - RNA, 105 nt, Homo sapiens
uccagaguugagggguagaaggcaaaaugagggaaaucugggcugugcacucaggucacgguggaaucccagaucccucucucacuacccacuuaaacuauuggg

SEQ ID NO: 2240587 - RNA, 56 nt, Homo sapiens
uuuggcuaagaucacgugagaauauuagccaaguuaaauauucucucuuggugaaa

SEQ ID NO: 2240588 - RNA, 71 nt, Homo sapiens
ucacguugggcaguguauuacuuaggguucucuagagggacagaacuaauagguaauauacauguauguga

SEQ ID NO: 2240589 - RNA, 86 nt, Homo sapiens
uugaguguuaaaugaguugguauauguaaaacauguagaagagggcccgcuacauaguaagcacuaugccaauuuugaauauuuga

SEQ ID NO: 2240590 - RNA, 56 nt, Homo sapiens
uugagaugaaguuuugcucuuuuugccaaggcuggagugcaguggcgccaucucaa

SEQ ID NO: 2240591 - RNA, 56 nt, Homo sapiens
cuucccuuucugaaaaucucauucgcacauugagagguuggaaguggagggggagg

SEQ ID NO: 2240592 - RNA, 59 nt, Homo sapiens
guauccugcacauuuggagagcucuaacacauuccucuugaggugaauuugcaggaugc

SEQ ID NO: 2240593 - RNA, 77 nt, Homo sapiens
gaagcuuggcaguggugugugccagccuagguuccagcucccugacccugagcuggcugccacaauugcuggguuuu

SEQ ID NO: 2240594 - RNA, 80 nt, Homo sapiens
uauuacuuaacuucuaugggcuucaguauccucauuuguaaacuggauuaauugcaauuaguccauagaguuuugugaua

SEQ ID NO: 2240595 - RNA, 77 nt, Homo sapiens
ucgcuugaaccugagaggcggagguugcagugagccgagacugcgccauugcacuccagccucggcagcaagagcga

SEQ ID NO: 2240596 - RNA, 65 nt, Homo sapiens
gguauugccacuuuugaacaguugguggcuccaaugcuuugcaacugucuugcaagugugauacc

SEQ ID NO: 2240597 - RNA, 55 nt, Homo sapiens
guguauucaucuggcugagguaaaccuuucuuuuuauucagcuguuuggaaacac

SEQ ID NO: 2240598 - RNA, 58 nt, Homo sapiens
gauucuuggugauuuuaggggggaagacuccguaugaguuccuuaguuauagagaguc

SEQ ID NO: 2240599 - RNA, 70 nt, Homo sapiens
gcugcaucuguggucagcauccgccacucccaaggggcucgcagguggcggguuugaaccacaaagcagc

SEQ ID NO: 2240600 - RNA, 81 nt, Homo sapiens
aggugugaggugauaucucauugugguuuuaauuugcauuucacagaugauuaaugaugaugaguauuucuucauguaccu

SEQ ID NO: 2240601 - RNA, 60 nt, Homo sapiens
uuugacuccucaaaaucuuaacuacuauccuguaaucucaguaguugaguuugagucaag

SEQ ID NO: 2240602 - RNA, 63 nt, Homo sapiens
uuucuucuacaucagagaauucauaaagguggaaaacccuaugaauguaaggaguguaagaaa

SEQ ID NO: 2240603 - RNA, 68 nt, Homo sapiens
ugagaucuuaucagaaauggugucagauuuugucaaauguuuuuucugcaucuauugagaagaucuua

SEQ ID NO: 2240604 - RNA, 58 nt, Homo sapiens
gguuuugacuugcauuucucugaugauuagugacauuuaggaaaugucuauuaagauc

SEQ ID NO: 2240605 - RNA, 56 nt, Homo sapiens
uucaagucaacaagcacuugagaguucucauguuuuuuaagagcuugaaauuugga

SEQ ID NO: 2240606 - RNA, 78 nt, Homo sapiens
ggcucaauaguauuuaauaguuagcucaaaaggacgaauaaaguucuacaugggaagcugcugaacuacagucaggcc

SEQ ID NO: 2240607 - RNA, 72 nt, Homo sapiens
acugacagaauugaagguagaaguucucaauucaacaauaagaguuggagacaccuauacuucacucuuagu

SEQ ID NO: 2240608 - RNA, 124 nt, Homo sapiens
cuauacuuuggagcugagugacuuugggccaguugcuugacuuuugugcuaaauuuucccaucugcaagauuuagguaauauuaaguagcuggcaaggcuguugugaggauuguuaaacuguag

SEQ ID NO: 2240609 - RNA, 55 nt, Homo sapiens
ucuccagguagauaugucaggaaucauuugaaauacuuauaugucugcuggggga

SEQ ID NO: 2240610 - RNA, 73 nt, Homo sapiens
cgguagagccauugagguagcuuugauggaggucaguguacuuguggccuucauaggagcuauuugcugauug

SEQ ID NO: 2240611 - RNA, 66 nt, Homo sapiens
augagauuuggguggagacacagagccaaaccauaucauucugccccuggucccccgcaaucucau

SEQ ID NO: 2240612 - RNA, 57 nt, Homo sapiens
gcagccugggguuaagggagguauggcacaaauauucccuuagcugccucagccugc

SEQ ID NO: 2240613 - RNA, 84 nt, Homo sapiens
cacccaucuauccaaaguuguuuucacugacugcaaauccauugguugggucaauugcuuaugaagauacaugacaaaagggug

SEQ ID NO: 2240614 - RNA, 72 nt, Homo sapiens
ggagaccuuaggaacagccucaaauuaguaucauucuaacugugcaaccuugggcaaaucacuaacgucucc

SEQ ID NO: 2240615 - RNA, 70 nt, Homo sapiens
acucagggugaugguugaaugaauuaugggacauuugucucauggaauacuucacagccacuaaaagagu

SEQ ID NO: 2240616 - RNA, 58 nt, Homo sapiens
gccauauagcaaacugugcauugcugggaaccaagccagcuucacauugcugcauggc

SEQ ID NO: 2240617 - RNA, 128 nt, Homo sapiens
auuuugugccacuucuuaugcuaccauugugggcauauggaaucauccuccugggagcuguaauucguuucaucuuaucuugcaggcaggggacccugauuucauuaccaagguuguaggcacaaaau

SEQ ID NO: 2240618 - RNA, 55 nt, Homo sapiens
gucuccgagccguguggagccgggcucuaguccugagcgccuucugcuuggagau

SEQ ID NO: 2240619 - RNA, 129 nt, Homo sapiens
ucacugugggaccuuagaccagacacuucaccucucugagcuucaguuuccccucuguaaagggagggcaaaauugcaguuaggaugaugguuuaucuguagccugguuucuucccuugcacacugugg

SEQ ID NO: 2240620 - RNA, 129 nt, Homo sapiens
gaagggcgacucaauuagacccaauugggguaagcaucacguagacuuuaccauuucaaagaaucuuuaaaacacggaaaguaguaguugaugugguguggauuuuaaggccagauuuuuugacccuuc

SEQ ID NO: 2240621 - RNA, 64 nt, Homo sapiens
auugugaauagugcugcaauaaacauacgugugcaugugucuuuacagcagcaugauuuauaau

SEQ ID NO: 2240622 - RNA, 83 nt, Homo sapiens
augaagauucuauuuaucacuuggaaaaauauccaucacuuauuaugcuuaugggagcugggugaggaguacagagucuucau

SEQ ID NO: 2240623 - RNA, 70 nt, Homo sapiens
ccccaggaaugaaucuuguuagagaauauggaauuccaccaauccucugagagaguuucauaaacugggg

SEQ ID NO: 2240624 - RNA, 71 nt, Homo sapiens
ucacuucuucugugauucuucaguuacuucaggccaucuggauguauacaugcaggucacaggggauauga

SEQ ID NO: 2240625 - RNA, 57 nt, Homo sapiens
caugguguauaugugccacauuuucuuaauccagucuauggcacauguauacuuaug

SEQ ID NO: 2240626 - RNA, 59 nt, Homo sapiens
cuggaaugcagcuuuaggggcucucuccacacuucccgaaccccagcuucaccuuccag

SEQ ID NO: 2240627 - RNA, 60 nt, Homo sapiens
gaggcugguuuucaguuacugaguuggaggggucccugagacagaacugagaacagucuc

SEQ ID NO: 2240628 - RNA, 107 nt, Homo sapiens
gaggagguugcucaguuuccauguaguugugcaguuuugagugaguuucuuaauccugaguucucauuugauugcauuguggucugagagacuguuaugauuuccuu

SEQ ID NO: 2240629 - RNA, 77 nt, Homo sapiens
gauuaagauuuauuagaugcuuaccugcgccaaugggagauauacuggcccaaguaagcauccaauaaauguugauu

SEQ ID NO: 2240630 - RNA, 71 nt, Homo sapiens
uccccaaauaucacggaguacauguucugugccggcuacucggauggcagcaaggacuccugcaaggggga

SEQ ID NO: 2240631 - RNA, 58 nt, Homo sapiens
gauuccauugcgaauuuucagaucaacuuuucuaccucugaaauaguccauugggauu

SEQ ID NO: 2240632 - RNA, 69 nt, Homo sapiens
acagaaguuugacauguuuagcucuuccaaauauagaguuaaucuagcagcuaaauuggaaauuucugu

SEQ ID NO: 2240633 - RNA, 58 nt, Homo sapiens
uuugcuauugugaauagugccgcaauaaacuuacgugugcauaugucuuuauagcaga

SEQ ID NO: 2240634 - RNA, 73 nt, Homo sapiens
guaaauuuucagucuguguguacguuuauagaugaacuauguuuauuguaaucaacacaucauugggaauugc

SEQ ID NO: 2240635 - RNA, 75 nt, Homo sapiens
ggcaugcuuuuaugaacuaggccuagaaguugaguauuuauucaugcuuuuaugaacuaggccuagaaguuggcc

SEQ ID NO: 2240636 - RNA, 70 nt, Homo sapiens
guggcuuguacaugggacaggaggagagaagcaggucagagcuucucucacugggaauauguucugccac

SEQ ID NO: 2240637 - RNA, 69 nt, Homo sapiens
gagaaugugguuuuaguaaaacuauguuagcaguuaagguuagagcaaaguucaggaaagccauaucuu

SEQ ID NO: 2240638 - RNA, 113 nt, Homo sapiens
gcugcagugcagugcucuggcacggugccgguuacacaguaggucccuaguaaaugguuguuacugagucccuacuguguaccaggcacugcugcaggugcugcgaauacagc

SEQ ID NO: 2240639 - RNA, 64 nt, Homo sapiens
uaaauaacucucguuuaugccuaguguuccauuauuggaaugcuaagcaugugggaauuauuug

SEQ ID NO: 2240640 - RNA, 55 nt, Homo sapiens
aggaagacagagaauaaauguuaaguagaaaacuugcaguguucacuguauuccu

SEQ ID NO: 2240641 - RNA, 55 nt, Homo sapiens
gggugaacacacucuguguguguaugugugaauguauaugcauguguuuucacuu

SEQ ID NO: 2240642 - RNA, 62 nt, Homo sapiens
guuuucagaaaucccagggggguaauggacugccuauaccccugugacggguauuugaggac

SEQ ID NO: 2240643 - RNA, 74 nt, Homo sapiens
uuguuccuucaguuauccagugaaagacaaauggauucagggaucccuguaaaucugguuaauuggauaaauaa

SEQ ID NO: 2240644 - RNA, 66 nt, Homo sapiens
uucuauuggucuuucaugagacuaagccuuccauccuggauugugugucaugcagagacccuggag

SEQ ID NO: 2240645 - RNA, 56 nt, Homo sapiens
uuucuauugcaauaauugcuuauauugauaaaauuugagcauuaguacaguaggga

SEQ ID NO: 2240646 - RNA, 58 nt, Homo sapiens
uagcaguaaagaaugugauguugucagaggaaggaagguguugaauuuuuugcuguug

SEQ ID NO: 2240647 - RNA, 84 nt, Homo sapiens
uucgcccuucuucuugguaaugucacauuuccuguacccucaggcuaucgaggaagccuggcauuaaaaagcaaaaagagugaa

SEQ ID NO: 2240648 - RNA, 55 nt, Homo sapiens
guacgaguacagauuuguuauguaaguaaacuugcgucauggagauguguuguac

SEQ ID NO: 2240649 - RNA, 69 nt, Homo sapiens
ccugagggaugccugguuuguuuucccucaugaauaauaccuuucagaagcacagaccagaucuccagg

SEQ ID NO: 2240650 - RNA, 65 nt, Homo sapiens
ugugauguguuuuguaguucaacucauuucccuuuaggaccucaguagacacuaaauacauuaca

SEQ ID NO: 2240651 - RNA, 80 nt, Homo sapiens
agaugagugagaaguuuaguuccgguuucuuauucuuccgcuguagaguucauauccuggaacugaauuucuuagcauuu

SEQ ID NO: 2240652 - RNA, 68 nt, Homo sapiens
uaacaaaugcaccacucuggugcaggauguugauaguaacaaaugcaccacucuggugcaggauguug

SEQ ID NO: 2240653 - RNA, 59 nt, Homo sapiens
aguauaaugaaaugugucaguagaacuguuucuaaguuauuugacaguuucuuuauauu

SEQ ID NO: 2240654 - RNA, 60 nt, Homo sapiens
aauaaaucccauuuaugccuaguguuccauuacuggaaugcuaagcaugugggaguuauu

SEQ ID NO: 2240655 - RNA, 65 nt, Homo sapiens
agcccuaggucuuuuucauuucaacaccaaacucuacacuggcuuuugagaugaagacagggguu

SEQ ID NO: 2240656 - RNA, 61 nt, Homo sapiens
ucuaaaagacucaccagguaaggaugaaagaauuucuauaucuacuugcugggucucugga

SEQ ID NO: 2240657 - RNA, 116 nt, Homo sapiens
aggagccaccaggugguguguggauucugaaucauggacuuaggucacugcuagggcuuagcagguguggcuuauccugaaacagaagucacaacggcauccuggagccaaguccu

SEQ ID NO: 2240658 - RNA, 55 nt, Homo sapiens
caggguguuguauuuaguauuuaagguauugauuacgugaauggacaaugccuug

SEQ ID NO: 2240659 - RNA, 73 nt, Homo sapiens
uuucauuucagccauuggauagguuuauagugauacuguguuuuccuuugcaccuuccuaguggcugaugaag

SEQ ID NO: 2240660 - RNA, 129 nt, Homo sapiens
auagaacuaagaguuacguuaaugaaucuccacuaccauucccaaacgcuucuaaugaaaauucaucacuucauggaugcauuugagggguugguuugucggggcugaaacugacuaagucaauucuau

SEQ ID NO: 2240661 - RNA, 94 nt, Homo sapiens
augggaauacaauucaagaugagauuuggguggggacacagagccaaaccauaucauuccgcccuuggccccuccaaaucucaugucuucccau

SEQ ID NO: 2240662 - RNA, 76 nt, Homo sapiens
agagggaaauaugucuguuuagucuguaaugaugcauauuuucauacauaaaauaaauaggucaucaaaucucucu

SEQ ID NO: 2240663 - RNA, 56 nt, Homo sapiens
gguggcuuggguggggguucuugagguagagcacaugacccugaccuaagccaauc

SEQ ID NO: 2240664 - RNA, 107 nt, Homo sapiens
gcauuggugguuauagucuguauaacuauagaugauuauuacauucauuguuuauuuauuuauguauguaguagauauuuauggaaaggcuaugacacggcagaugc

SEQ ID NO: 2240665 - RNA, 61 nt, Homo sapiens
ugauggcagugagucucuaguauuagugcacuacaccagaaauacagcccucacuccauca

SEQ ID NO: 2240666 - RNA, 72 nt, Homo sapiens
cucacagagugagacccugucucuguuagaaaaaaaguaaaaaauuaaaggauuucagccuuacucuguggg

SEQ ID NO: 2240667 - RNA, 68 nt, Homo sapiens
uuuguguuuuauuuucugcuguauucauacaauuuacaacagugccuggcaagagaauacaacauaaa

SEQ ID NO: 2240668 - RNA, 102 nt, Homo sapiens
guccaauauguaccucccauuacagcgguguuaggaaggugagggcugccgcugaaaggguccccuucauaaucaucacuagauuugggguauauuauggau

SEQ ID NO: 2240669 - RNA, 62 nt, Homo sapiens
gguauucugcaaaucauccagagggcucauucaauagaucugggaugaugcuugagaauauc

SEQ ID NO: 2240670 - RNA, 74 nt, Homo sapiens
caaagucuucaguugauucugauauauccaguuuuuggacuuacuguuugccuugagagucaauaggggcuuug

SEQ ID NO: 2240671 - RNA, 69 nt, Homo sapiens
cuuaggguugcaauaaaauaucuguacucaauaacuauucauugaaugauggaguaauguaaucuugag

SEQ ID NO: 2240672 - RNA, 76 nt, Homo sapiens
guugaauacacuugcauuucagguaucccuugucuauaggcacaggugccggcacuuaccuaugcaagcuuuuaac

SEQ ID NO: 2240673 - RNA, 84 nt, Homo sapiens
gggaugaaauguuaugcuaucauucaggauuuguuuuaaaaauacugaggcaggccagguaugguagcucaugccuguaauucc

SEQ ID NO: 2240674 - RNA, 62 nt, Homo sapiens
aaaugucuucuuuugagaagugucuguucauaucccucacccacuuuuugaugaggucguuu

SEQ ID NO: 2240675 - RNA, 76 nt, Homo sapiens
gagugugaaauguuaucccgucgugguuuugauuuguauuucccuagugacuaaugacguucagcauuuuucauuu

SEQ ID NO: 2240676 - RNA, 59 nt, Homo sapiens
uuaugucuuugagcaaugcuguguccccugauagaaaggcacucucuauaaagacauga

SEQ ID NO: 2240677 - RNA, 82 nt, Homo sapiens
auucuccuagcugcacuuccugcuacugggaagggugggguugcuuuccuggggagcaguaguaggcaggcagcuggagaau

SEQ ID NO: 2240678 - RNA, 93 nt, Homo sapiens
ugguaauuuauagggcuauaugcagggcaguuuggguugauagcuuaguggaguuaucacccuuucauuguucuucaggucaucaaauuauua

SEQ ID NO: 2240679 - RNA, 62 nt, Homo sapiens
uguuucuaggggagggguauauuaucagcuuccaaaguggaucuaucacuucccuggaaaca

SEQ ID NO: 2240680 - RNA, 86 nt, Homo sapiens
ggccuccaucacugugccaagcuugcgaugugcuguguccauuauccagggcauauugagcaacuggguacaaaagaucacaggcu

SEQ ID NO: 2240681 - RNA, 119 nt, Homo sapiens
cuuuuuuuuugucuucagcuuuggaccauugucaccaauuuugcaguaauagaaguccccuuccgcauucuguuauguuugauggaugaaucaugaaaccagccuaagagaaaggaaag

SEQ ID NO: 2240682 - RNA, 94 nt, Homo sapiens
ugggaggaucgcuugagcccaggaugucgaggcuguagugagccgagaucacauuacugcauuccaaucugggcgacagagucgaauugucuca

SEQ ID NO: 2240683 - RNA, 107 nt, Homo sapiens
aaugaauaguaauguugggcaacuuuucauguguuuguuggacauuuuuauaaucauuuugaagaaauguuuauucaaacccguugcccauuuuuaauugguucauu

SEQ ID NO: 2240684 - RNA, 69 nt, Homo sapiens
gcuauugugaauagugcugcaauaaacauacgugugcaugugucuuuauagcagcaugauuucuaaugc

SEQ ID NO: 2240685 - RNA, 79 nt, Homo sapiens
gacaguuggcaaguucagggcagaaguuuuugaaggcauuguauguuuccacuuuuuccuugugcuccugucacuuguc

SEQ ID NO: 2240686 - RNA, 80 nt, Homo sapiens
uugcacuuucugaaucuacuuugcugcugaauccuacauuuuguaggggcugcuugaguaguaagugguucaccguguaa

SEQ ID NO: 2240687 - RNA, 86 nt, Homo sapiens
cgauggcacagguaagggggcuggggccccacgagcucaccggggugucuccgggugcgucggcgcccuggcccuggucgccgucg

SEQ ID NO: 2240688 - RNA, 78 nt, Homo sapiens
gcaauguauugauuucccuggaacucauuuccaacauuucuucaacccuggagaugacacugggucaaaucucauugc

SEQ ID NO: 2240689 - RNA, 67 nt, Homo sapiens
uuaaucuaggucacaugguaaauaagugggcuuuuauggucuauuugggguaccugugguagauuaa

SEQ ID NO: 2240690 - RNA, 57 nt, Homo sapiens
uugagcaucauguuagcacucauaaaguucccgacuuuggguguuucagauacucaa

SEQ ID NO: 2240691 - RNA, 89 nt, Homo sapiens
ggagaaucacuugaaccccagaggcggagguugcagugagcugagaucgcgccauugcacuccagccugggggacaagagcgagacuuc

SEQ ID NO: 2240692 - RNA, 60 nt, Homo sapiens
auauccuggagcauuuuugcaaaaugaaaugcagcaauuagauggaguguuccaagaugu

SEQ ID NO: 2240693 - RNA, 78 nt, Homo sapiens
ugcugugcaguuuaagauacaucuuuuaccuuuaaggagcuuacggucucuuuggguagauauguagcugcacaagca

SEQ ID NO: 2240694 - RNA, 55 nt, Homo sapiens
cucuguuucucagccuauuuccacuuguauggagcaagugggcuagaaaucaggg

SEQ ID NO: 2240695 - RNA, 88 nt, Homo sapiens
aaaugugacugaccugccaaggcucaguuuaccuuugcaguugaaguccucaaagggcacugugcuuuggcaaguuugcuuugcauuu

SEQ ID NO: 2240696 - RNA, 80 nt, Homo sapiens
cacauuuuugcauaaaccuacauuuucacuucucuuugaagaacaccuagaggugaguuugcugggucauaugauaugug

SEQ ID NO: 2240697 - RNA, 66 nt, Homo sapiens
gcugcguuuccauagugcaguaguuccugaaguucuugaccugaccugcagcacugggaaugcagu

SEQ ID NO: 2240698 - RNA, 70 nt, Homo sapiens
ugagguacaacauggacugaagaggagcauguguuaaaaacgugugaauuauuuauccuguaguaucuua

SEQ ID NO: 2240699 - RNA, 97 nt, Homo sapiens
cauuacagagaccuuaauacugcauuucacuguuaaagaaugaagcaacucuuaggucuugaggauaagugcaguauuuauaggcucuuaucuaaug

SEQ ID NO: 2240700 - RNA, 68 nt, Homo sapiens
gcaucuguuagagugugcaugcgggccguggggccucacagcaugugugugcacaaucuggcaugugc

SEQ ID NO: 2240701 - RNA, 64 nt, Homo sapiens
uugcaaaucauuauugccacugaguaugugacucucaucaugaccagagguaugauguuuguga

SEQ ID NO: 2240702 - RNA, 64 nt, Homo sapiens
cacaaaauuccagguggcgccauucacaugguggccauuaugaauggcaccaccuaggguugug

SEQ ID NO: 2240703 - RNA, 62 nt, Homo sapiens
uuucuugacaguggcuuaaauugguuacgaucuuaaaucagagccaacauugaaucaaggaa

SEQ ID NO: 2240704 - RNA, 93 nt, Homo sapiens
cuuuacaggcauaggcuguuacacugugcacuaaauuugagaauucggaacagcuaucagaaugcauuuuguguagcuaugaugccuguggag

SEQ ID NO: 2240705 - RNA, 130 nt, Homo sapiens
guuagaaagaauuauugaagaaguguccaguuaaagcugaaaugauuaugacaagccuguguuauaacuaugugguaaaugucuagucuuagcucuaauuggucuuauuuuaauguguuuauuguuuaau

SEQ ID NO: 2240706 - RNA, 112 nt, Homo sapiens
ugaggcuucugucaagaugucuuccagggcugcagucaucugaaggcuuaacuggagcugaugauccaccucuaagauggcucacucacagggcuguuggcaggaggccuca

SEQ ID NO: 2240707 - RNA, 75 nt, Homo sapiens
gcucauccaugugaagagaccaccaaacaggcuuugugugagcaacauggcuguuuauuucaccugggugcaggc

SEQ ID NO: 2240708 - RNA, 63 nt, Homo sapiens
caugguuucacagaugugcauauauaugucaagagucaucaaauuguacacuguaaaccugug

SEQ ID NO: 2240709 - RNA, 57 nt, Homo sapiens
agggaccuugagugugguuuacuguccucuuugcagaaaugucuauucagggucccu

SEQ ID NO: 2240710 - RNA, 80 nt, Homo sapiens
cuuggauuaggaggucauggacaaggugugagccauggauggaacuuggagggcaugcuguccaugggcugggguccagg

SEQ ID NO: 2240711 - RNA, 70 nt, Homo sapiens
gugccaucauuaauauuaggcauuauuuuucuuauucuugaaauacaguguuuuauauagugccuggcau

SEQ ID NO: 2240712 - RNA, 63 nt, Homo sapiens
ggcccaggguugcuuuagauucugaagcaacuucaggguuuaaaggcaucccugaaauggguc

SEQ ID NO: 2240713 - RNA, 58 nt, Homo sapiens
guagucacuaaccacauguggcuuuugagcacuugauauaugugguuagcaugacugc

SEQ ID NO: 2240714 - RNA, 85 nt, Homo sapiens
uuucauuuguauuucccugaugacuaaugguuuugaguaucuuuucccgugcuuauuggccauuuguuuaucaucuucaaagaaa

SEQ ID NO: 2240715 - RNA, 68 nt, Homo sapiens
ugagguacgaaauacacuguacuuaaauuuccuguccuggaugugaauauauguguuuuucugcuuca

SEQ ID NO: 2240716 - RNA, 71 nt, Homo sapiens
uccuguuuuccuuuggguagcuguucagaugcaauucaacugacacugauagaacacccaugaggccagga

SEQ ID NO: 2240717 - RNA, 66 nt, Homo sapiens
aagauagcagccaggcauccacccuaaggcuaacauuccagaugguuggaagccuggugcuaucuu

SEQ ID NO: 2240718 - RNA, 76 nt, Homo sapiens
ggugcaaggaugcuuggcccacccugagaggcguaauucgcccaucaacauugcugucaggcaucuuuuuagcacu

SEQ ID NO: 2240719 - RNA, 84 nt, Homo sapiens
gcugggauuacaggcgugagccaccgugcccagucgaaagugaaccuuucacugggugugguggcucacgccuguaaucccagc

SEQ ID NO: 2240720 - RNA, 76 nt, Homo sapiens
gacccacaggugaaugccucuccuucuggccccacccaccucacaggcagaaagagggaggcuucacaaggagguu

SEQ ID NO: 2240721 - RNA, 129 nt, Homo sapiens
ccuaggcuuccuccaacagauuuugccauuugacucugaugaguguuccuuuguccagucuaagacaauaucuacucaauugcagucaccuggccagcaaaaaucuccuagccgaaguaucaccuuuug

SEQ ID NO: 2240722 - RNA, 118 nt, Homo sapiens
cugcacauccuuaaugcuccuugugcagugagaugacgacacaccucagugagaggaccacacgccucagugagaggucucaucucgcaggccgggcucaaagaggauggaccugcgg

SEQ ID NO: 2240723 - RNA, 60 nt, Homo sapiens
uuggaaauauguuaagugucauguugggaauaaccacgagaauaugaaacauauauccag

SEQ ID NO: 2240724 - RNA, 65 nt, Homo sapiens
cugagauuaagauauugggaguugaugguuucuauacauuuuacuuaaaugguucuuuaucucag

SEQ ID NO: 2240725 - RNA, 83 nt, Homo sapiens
gcaacgaauauucccaagcuagauauuaugcuuccagcacaugugggaaagcaaacaucagcuugguuaacaguuuuguuugc

SEQ ID NO: 2240726 - RNA, 74 nt, Homo sapiens
cuaucguaaugcacauauauuuccuuauucugccauaauaaguagaaucaacaggaugugcauuguaaagguag

SEQ ID NO: 2240727 - RNA, 110 nt, Homo sapiens
auuucuugggaaaaaaagggaggcuuauggaauguuauggcuuuaaucuuuuuccuuagggaugucugagaugggcuauauacaugcugucuuucuuugauauaagagau

SEQ ID NO: 2240728 - RNA, 85 nt, Homo sapiens
ucucaagcugugacugcaaagggaagcccuuucuguugucuaaaagaaaagaaagugcuucccuuuggugaauuacgguuugaga

SEQ ID NO: 2240729 - RNA, 61 nt, Homo sapiens
uaguuucaccuuucagaaugcguggacucuaaagucgcuaugacagaggaagggggagcug

SEQ ID NO: 2240730 - RNA, 73 nt, Homo sapiens
aucuauuggugacacccaaauuuuaagcuccacagggcagacuuugggcuagaugcuuuggggucauaaagau

SEQ ID NO: 2240731 - RNA, 59 nt, Homo sapiens
uuucuaauuucauuuccaggaauaaugauauaaaucaguuuggaaaugugaauugggag

SEQ ID NO: 2240732 - RNA, 65 nt, Homo sapiens
guauuuuacaagugcuuuucuguuugaggucauuucacucagaguauagcaacuuaguaaaauau

SEQ ID NO: 2240733 - RNA, 87 nt, Homo sapiens
ugcagggcuuaaaaccuagaugacagguugauaggugcagcaaaccaccauggcacauguacaccuauguaaccugcacuuucugca

SEQ ID NO: 2240734 - RNA, 55 nt, Homo sapiens
acuaguaucauugaaacggcuuguaaaaaguacaacuguuaagacugguacuggu

SEQ ID NO: 2240735 - RNA, 73 nt, Homo sapiens
uugauuucuuucuguuacuuuaaaaacuauuguauuucacucaaaauaugcaugaaguagcauaggaugucaa

SEQ ID NO: 2240736 - RNA, 58 nt, Homo sapiens
uuguaguaagcaccacaagucagaacuggggauuucugcaucaggcugcuuauuacaa

SEQ ID NO: 2240737 - RNA, 56 nt, Homo sapiens
acguguaacuucaaaugggaagaucccuuguccuuccugagaauagaguugcaugu

SEQ ID NO: 2240738 - RNA, 55 nt, Homo sapiens
gagccugcagaucuuuuaaguguuaauguaaaacagacauugcauuuguaggcuu

SEQ ID NO: 2240739 - RNA, 78 nt, Homo sapiens
agucagcgggaguggaaagucagacacacagggccugaaggucaugaaaggacucuggcuuucacuccaagcaagacu

SEQ ID NO: 2240740 - RNA, 69 nt, Homo sapiens
guuugcaacauaguccuauguagugauuuuaaugauaucgcauacuuuacacauggauuuugugcaaac

SEQ ID NO: 2240741 - RNA, 59 nt, Homo sapiens
cucuucacaugguugccuuuugaucuuucagagcucagaguagcugugcugacuuagag

SEQ ID NO: 2240742 - RNA, 75 nt, Homo sapiens
cucccugagguggugguggaggcauagcugacucauccagauuuguucugcuggccucaucacugacuucuggag

SEQ ID NO: 2240743 - RNA, 113 nt, Homo sapiens
gggggaggcgggugcaugaaggagugaacaggcuguggaagcacaggccuccuggaugcccuguguccugggggcucuugguucuacugagcucaccucuaccugccccuccc

SEQ ID NO: 2240744 - RNA, 89 nt, Homo sapiens
ggagaagcccuugaacccgggauuugaagguuguggugagcugagaucccaccauugcacuccagccugggcaacaagagcaaaacucc

SEQ ID NO: 2240745 - RNA, 69 nt, Homo sapiens
uccagaguuaugguuuccuguguaauaacuagugagauuacuggucacauuggacuaucaaguuuugga

SEQ ID NO: 2240746 - RNA, 102 nt, Homo sapiens
ggaggauaggaggaucauuugagcccaggagguugaagcugcagugagccaugaucgugucauugcacuccagccuggacaacagagugagauccugucucc

SEQ ID NO: 2240747 - RNA, 70 nt, Homo sapiens
cuaguuccugauaugaugggugauuuucaauuguaucuugaaaauguuucuauuauaucaugagacucug

SEQ ID NO: 2240748 - RNA, 92 nt, Homo sapiens
gcaauguaagaaagacaugagauuugggaggggccaggguggaacgauaugcuuugaauauuuguccccuuccaaaucucauguugaauugu

SEQ ID NO: 2240749 - RNA, 79 nt, Homo sapiens
auuuuuguauuuuuaguagagguggguuucaccauguuggccaggcuggaccccuucuccuauuaaaauaaccaaaaau

SEQ ID NO: 2240750 - RNA, 83 nt, Homo sapiens
guguuucccagaauauggggcugcauaucaccucagguaaaugagauggcuuuaggugguacacagccccaguuaaagaacac

SEQ ID NO: 2240751 - RNA, 92 nt, Homo sapiens
gcauauaauagcaaaaauaguaauaauaguuguuaauauuuauuuagaacugccaauuguugacaaugcacugugcuaagugcuuuauaugc

SEQ ID NO: 2240752 - RNA, 68 nt, Homo sapiens
uuuuagauaucaagcugcuuguuugaaucuaucuccgauagauucaagaaaaguuaugauuuaugaaa

SEQ ID NO: 2240753 - RNA, 83 nt, Homo sapiens
ggcuccagagaucacaguuggcaaguggcugagcugggacgguauccagcucuaucugguuccaaagucuggucucuaaggcc

SEQ ID NO: 2240754 - RNA, 61 nt, Homo sapiens
caauguaaauuguggcucccaacugugccuuccuccaccguaacaagccaccauuuacuug

SEQ ID NO: 2240755 - RNA, 79 nt, Homo sapiens
guauagaguuuuguauguaauugaaguuaaguuguuuucagcuugaaauauacaauuauaauuauaagaaguuuuaugc

SEQ ID NO: 2240756 - RNA, 63 nt, Homo sapiens
auuguuuccaguaauagcacagcauuguaggugauaguguugauacuguuauuguaagauaau

SEQ ID NO: 2240757 - RNA, 63 nt, Homo sapiens
gaaugggcugacauuaaguaccguuaaacuccuaggacagugacuuucuguggcaguccauuc

SEQ ID NO: 2240758 - RNA, 76 nt, Homo sapiens
gagggauagacagcugguagcacuuccuguguuuggcgauccauggagcaggacaucuacccaguguuucucccuc

SEQ ID NO: 2240759 - RNA, 69 nt, Homo sapiens
gggcaacaugccgaaaccacgucucuacuuaaaauccaaaaaauuagccaggcgugguggugugugccu

SEQ ID NO: 2240760 - RNA, 67 nt, Homo sapiens
aaggcuucuaugagaugauaggcguucuaacaggugaacugacucccuggacaucacucuaagccuu

SEQ ID NO: 2240761 - RNA, 84 nt, Homo sapiens
guagguaaaugcugaguugaaaagauuaacaaauccagagucuucucuggaucuguucuauuuaucugagcuuuauggauuugc

SEQ ID NO: 2240762 - RNA, 85 nt, Homo sapiens
agucuuacugaaaugcucauuuuggauccuugccaaacuuuuugagacagauggcagcuauaauauuuaguauuuuaguaagauu

SEQ ID NO: 2240763 - RNA, 62 nt, Homo sapiens
caagcuauguagucucccugcguccccuuccuguccuuaagaugcagagaugugguagcuug

SEQ ID NO: 2240764 - RNA, 59 nt, Homo sapiens
ggaucucagaucuacagaucuacaguggcaaggaacugagaucuacagaucucagaucu

SEQ ID NO: 2240765 - RNA, 65 nt, Homo sapiens
ugauauugaggaaugugauuucaaauacuucacagugauguauuaauuauuucacucgacuguca

SEQ ID NO: 2240766 - RNA, 89 nt, Homo sapiens
ggagaaucacuugaacccaggagguaaaguuugcagugagucgagaucaugccauugcacuccagccugggcgacaagaccgaaacucc

SEQ ID NO: 2240767 - RNA, 55 nt, Homo sapiens
caaggcacagccccuacuuccugaauuccuggaggucgaguagguccuuguuuug

SEQ ID NO: 2240768 - RNA, 58 nt, Homo sapiens
gucuuuguuuugauuuaccagauuggaaacauccuuuuuguagaaucaacauagggac

SEQ ID NO: 2240769 - RNA, 55 nt, Homo sapiens
uaaguaaaguagggcaggcaccaaaagacaaacuuugcauguccucacuuacuug

SEQ ID NO: 2240770 - RNA, 88 nt, Homo sapiens
cccaggugauuccagugugcaggcaaguuugacagucagugcucuagaagagcuucuuaaacuucaccgugcacagcaguuaccuggg

SEQ ID NO: 2240771 - RNA, 71 nt, Homo sapiens
aacuaauaaggcaaaccuuggcugcaguuagcacacaauuaaagcaacuuaccaaguuuuaccuuaaaguu

SEQ ID NO: 2240772 - RNA, 55 nt, Homo sapiens
ccuucccuagaucucagcgccuucauuuuagaaaugaaaaguucgaucuagaagg

SEQ ID NO: 2240773 - RNA, 80 nt, Homo sapiens
gcugugaaggacuagggaccaugagcaauccauuuuggugacagugcuggaagcaguagucccuaagucccauuuccagc

SEQ ID NO: 2240774 - RNA, 55 nt, Homo sapiens
ucugacccucugucauguauguaacaucuuuugcugaugccacagugaggucaga

SEQ ID NO: 2240775 - RNA, 74 nt, Homo sapiens
ggccacccucugcaggacugaggccuguuuguucucaucaguaaccaaacauugaccucauccuggcacuggcu

SEQ ID NO: 2240776 - RNA, 85 nt, Homo sapiens
aguaaaauauuaaauagaaauguugauagugggcauuguuguucucaaacucaguguuccagauugcauuauuuaauaugauacu

SEQ ID NO: 2240777 - RNA, 82 nt, Homo sapiens
aaaaggguuguccuuagauguggccuccagggauaguuaagcuguaaauggaaggcuucauauguaaagacauuuuccuuuu

SEQ ID NO: 2240778 - RNA, 76 nt, Homo sapiens
uauuuagggguauacuuguuugcauguaauuacuaauuuaaugugauaagugagauagcaagugaacuuccaagug

SEQ ID NO: 2240779 - RNA, 67 nt, Homo sapiens
gcacuugcauucauugaaaacacacagauagaccuucacaucucacagaguuucagaguggaagugu

SEQ ID NO: 2240780 - RNA, 80 nt, Homo sapiens
gaguccuaugauuugucuuggaugaggauuaacagguuguagucuauuugaauaauauguucaggaggaaugaaggacuu

SEQ ID NO: 2240781 - RNA, 75 nt, Homo sapiens
uccuaaauagcagguuggguuuuuugucuucaauauuguucucaauauugacuugagaagggauuagccuuggga

SEQ ID NO: 2240782 - RNA, 64 nt, Homo sapiens
auugugaauagugcugcaauaaacauacauguguaugugucuuuaaaguagcaugauuuauaau

SEQ ID NO: 2240783 - RNA, 56 nt, Homo sapiens
uaagguuuuugauaugcugcuggauuugguuugccaguauuuuauugaggauuuua

SEQ ID NO: 2240784 - RNA, 129 nt, Homo sapiens
uuuauuacuguaaaugguauuguguuuauagcaaagguauuuuucuuuguggauauagaaauacaauuaauuauugcauguugagcaguaccuugcaaauauauuuacuuauucuuauaguuuuuuaaa

SEQ ID NO: 2240785 - RNA, 87 nt, Homo sapiens
agaaaaauagcuucuacuggauaaauacuaauucgaauauuuuuaauguuuggaauuaagagauauuuucuagguugcuauuuaucu

SEQ ID NO: 2240786 - RNA, 90 nt, Homo sapiens
ggagucuugcucccgucgagcaggcuggagugcaguggcgcggaccuuggcucacugcgaccuccaccuccuggguucaagcgauucucc

SEQ ID NO: 2240787 - RNA, 85 nt, Homo sapiens
uuucagguaucuuuauagcaaugccccauucccaguacugauuuucuguauugguucuugcauugcuauaaagaacuaccugaga

SEQ ID NO: 2240788 - RNA, 69 nt, Homo sapiens
gaggcuucucgucaucagugucaggagcccaagcuacugggcagugagcacagcgugugggagagccuc

SEQ ID NO: 2240789 - RNA, 58 nt, Homo sapiens
uaggccuuuuucagauggguagauugcaaacauuuucucccauucuguagguugccug

SEQ ID NO: 2240790 - RNA, 99 nt, Homo sapiens
gagauggggggaucacuugaggccagaagugugaggcuacagugaccuauaauugugccacugcacuccugccugggugacagagugagucccugucuc

SEQ ID NO: 2240791 - RNA, 128 nt, Homo sapiens
uuccaaaguugcucccacauugucagguuaucuuuauagcaguaccccaguauccugguaccaauuuccuguauuagucuguuuucauacugcuaaaaagaacuaccuaagacuggauaauuaaugaa

SEQ ID NO: 2240792 - RNA, 81 nt, Homo sapiens
uuuuuaucagucaagguccuugaggaaacagaugugaccaauagguuacagauggcacacucaaggggugauugaugagaa

SEQ ID NO: 2240793 - RNA, 89 nt, Homo sapiens
gguucuuggcuucuguuucuggucaggccaauaaaucuccuuccucaucccauuuuacugcuuaugacuagagacagaaacuaaaaacc

SEQ ID NO: 2240794 - RNA, 59 nt, Homo sapiens
uccagugccagcuguuaaaguuucaucgucucaucgugaaagacacuguccccacugga

SEQ ID NO: 2240795 - RNA, 128 nt, Homo sapiens
gugacacucugucucaaaaaaaaaaaaggaauagaguggaauauaaagcaucguguaauacagggccguguaauacagggugguauuuuuaaaacuaaaauuuucuuuuuuuugagacggagucucgc

SEQ ID NO: 2240796 - RNA, 78 nt, Homo sapiens
ucagaauacucaugaguaggccccacucuagaaauuguuucagaaagccugggguaggccugguuaugugcauuuuga

SEQ ID NO: 2240797 - RNA, 59 nt, Homo sapiens
gcuaguuuggggcaggaggaaggcaugaaucuagaaccuucuaccuguagguaauuggu

SEQ ID NO: 2240798 - RNA, 72 nt, Homo sapiens
gguggaauuauguuaagggucuugagguagggggaucaccuuggauucuccugguggacccuaaacgccauc

SEQ ID NO: 2240799 - RNA, 128 nt, Homo sapiens
ccaucauaauuugaccccuccuuuauuggaguaugagguuucagguucauuugcugcuauucauaccacugugcaauguagucauuggacagacuucucgcucuuccuauauguuuaucuauguaugg

SEQ ID NO: 2240800 - RNA, 94 nt, Homo sapiens
guggcauaguacacuaaguuuugagguauuuuguuaugcagccuuagcaacugguaagguugcucaaauauuuuacagucuaugaauuguccac

SEQ ID NO: 2240801 - RNA, 63 nt, Homo sapiens
ccauggcaugaucaguuuugcuauuuaaagcaaaaaaugcucuagcuacacugugauucaugg

SEQ ID NO: 2240802 - RNA, 98 nt, Homo sapiens
gauggauauuagagaaugacaguguggauuauuguaagucuaaucagguggagauuucaaugguagcugcuguucuuuucuuuuguugaauggcuauc

SEQ ID NO: 2240803 - RNA, 79 nt, Homo sapiens
ucaagccaguauucaagccaaauucaagccaguauuaauaauauaauggcuuuaaaaugguuugguauuccuggcaugg

SEQ ID NO: 2240804 - RNA, 101 nt, Homo sapiens
gauauauaaauauauguagaaaaagucuagaggaucaugugugguuuucucuaaguagaggcauuauaaaugauugucacuuuauauacauacuuuauauc

SEQ ID NO: 2240805 - RNA, 91 nt, Homo sapiens
uucucuuacuuucaaaggacauugcuauugauugccauuauuuaugaagucacuagacuuagguagucagcagugcuuacaaagaggggaa

SEQ ID NO: 2240806 - RNA, 55 nt, Homo sapiens
gauaccaaagaggaggccaagaagcggacuguggcuuggugaccuguuugguauu

SEQ ID NO: 2240807 - RNA, 58 nt, Homo sapiens
ugcaugagaugccauuugguggauuaauuuguucuuggacuaaaucucauuuuaugca

SEQ ID NO: 2240808 - RNA, 95 nt, Homo sapiens
gguuuuauugaaguagauuguaauaugcagaauggugcaaaaaguaaauguacagcucuauuaauuauuacaaacugaaucuuuauguaaacacc

SEQ ID NO: 2240809 - RNA, 69 nt, Homo sapiens
aacuaggugauugaagguggaaugugaggcagaaaggagaguaaacguugauccucaaguuacugaguu

SEQ ID NO: 2240810 - RNA, 98 nt, Homo sapiens
gaggcaggagaauugcuugaaaucgggaggcggagguugcagugagccgagaucgcgccauugcacuccagccuggugacaaagcaagacuccgucuc

SEQ ID NO: 2240811 - RNA, 62 nt, Homo sapiens
ucuugauaugaaguucaaaccaggugcugucguaacucaccugguuuugguucauauuaggg

SEQ ID NO: 2240812 - RNA, 57 nt, Homo sapiens
augauaucuggcaugaugguuuaucaaucucugaacagauauuaagcuagauauuau

SEQ ID NO: 2240813 - RNA, 58 nt, Homo sapiens
uccuucauuugucaacucuaguuucucccuuaaacauggagauagguaaauagaggga

SEQ ID NO: 2240814 - RNA, 110 nt, Homo sapiens
uuuuguauauggugguguuuggaagaagguauuuguaauauaugucauugaugugaaaauggcagauaggauacaggacuaacuugcagcucccacuuggauggacagaa

SEQ ID NO: 2240815 - RNA, 70 nt, Homo sapiens
cugaacugggaucuccguugaucucagggcaaccuuauuuuugcccugagaccaacagauuccaguucag

SEQ ID NO: 2240816 - RNA, 98 nt, Homo sapiens
gucuuugagaaaacuauggaagacaggcuguauuuuaaaugauugauaaucuuaauguucuuuugaaacauuaccuguauuuccauaaaggucaagac

SEQ ID NO: 2240817 - RNA, 74 nt, Homo sapiens
aacuuuugaugucuugcaggcacgagaugaguucacaagcaaucagugcuggaaggaugugcaaaauaaaaguu

SEQ ID NO: 2240818 - RNA, 129 nt, Homo sapiens
accuuggagcucacagcauugucuugguugggggaccaugugggcggcagguccuggcugugcucgcuccccacccugucauccacauggugcucugucgggggccuggggcaugcugcccuccagggu

SEQ ID NO: 2240819 - RNA, 83 nt, Homo sapiens
ugguuguuuauguguauuugcaugaguauguguuaaguucugugcaauuuuaucacacgugcagauuuauauaaauauaacca

SEQ ID NO: 2240820 - RNA, 60 nt, Homo sapiens
gaaccucugccuagauuucagaggauguauggaaacaucuggaugccuaggcagaaguuu

SEQ ID NO: 2240821 - RNA, 57 nt, Homo sapiens
uucucuguggauugggugagaggcaggagaucagccucagagaaccuaagcggagga

SEQ ID NO: 2240822 - RNA, 58 nt, Homo sapiens
ucuguucuccuggcagguggggcugaagcugcccacccuacccuguauuagagaaaga

SEQ ID NO: 2240823 - RNA, 59 nt, Homo sapiens
ugugacuucauuugguaauugggucuuuaaggaggaaccuaauugaaaaugaugucaua

SEQ ID NO: 2240824 - RNA, 58 nt, Homo sapiens
ggcccacaagccaaauccagaauuaugcaacagagacugcauguggcuuuugaaggcu

SEQ ID NO: 2240825 - RNA, 99 nt, Homo sapiens
gcugccagcauggcugccagaacaucauugggggcuacaggugcagcugcccccagggcuaccuccagcacuaccaguggaaccaguguguuggcaagu

SEQ ID NO: 2240826 - RNA, 82 nt, Homo sapiens
gguguuagucugagugaugacuggauaauggacacacauccuggaaggugguuugcauuguucaguuucuuacauuaauauc

SEQ ID NO: 2240827 - RNA, 58 nt, Homo sapiens
ugagcggcuuucaaaucuggcaucagguaauaacuuguuugccaagaaagucagcuua

SEQ ID NO: 2240828 - RNA, 69 nt, Homo sapiens
gcuaacaccuugcucugucaauaagcuguucuaccaacuucagaauuauucacagauggguguguuggc

SEQ ID NO: 2240829 - RNA, 87 nt, Homo sapiens
gcauuggauuucauaggaguacaaacccuauugggaacugcacaugcaagggaucuagguugugugccucuuaugagaaucuaaugu

SEQ ID NO: 2240830 - RNA, 129 nt, Homo sapiens
uuauuauauagguaaacugugucauggagguuuggacuacagauuacuucaucagccacauaauaagcaaaauacucgagagguaguuuuuuggucaucucccuccugccacacuccacccucaaguag

SEQ ID NO: 2240831 - RNA, 70 nt, Homo sapiens
aggagagggcaagagaccugagugucauucuguuauucaggagacaaaacucugguccuuucuuuuuccu

SEQ ID NO: 2240832 - RNA, 63 nt, Homo sapiens
augcugggaaugacucuggaucugcuggcuauaaacagagaucacuucuguauucuacagugu

SEQ ID NO: 2240833 - RNA, 81 nt, Homo sapiens
gugcagcuagaauaaagccaggagacguaauuggaaagagcagacuuguugagucuucuggcuuucaucauucuccugugc

SEQ ID NO: 2240834 - RNA, 75 nt, Homo sapiens
cagccacugugaaagauuuuaacugggagacuccuauacccggaagucuuucaguucugaaucucggcaggucug

SEQ ID NO: 2240835 - RNA, 91 nt, Homo sapiens
gagcagaaaucaguuaucguacauacuucacagacuuuaaaguuuuuugcacuuuacuccucagugauaugugaacauggugucacugcuc

SEQ ID NO: 2240836 - RNA, 72 nt, Homo sapiens
guuguaauucuguauuguuuagggacuagugacaagaaaaaauagucuguacauguucaguacagaagcaau

SEQ ID NO: 2240837 - RNA, 71 nt, Homo sapiens
gccuacagucuggagaaugggugcucaauugaggauauucuuagaggagauaaauuguccuagauuuaggc

SEQ ID NO: 2240838 - RNA, 95 nt, Homo sapiens
agagaugcaauauaaaauuauuuuuuacuauaggucagggccaagaaguuugaaaaucacugaucuagagacauaguaaagaauaugcauacuuu

SEQ ID NO: 2240839 - RNA, 99 nt, Homo sapiens
gacauaguugaguuugggguccugagauauuauuucccuuucacaguaguauauaguguguggguaguagauuucauuuugcagauuauaauuacuguc

SEQ ID NO: 2240840 - RNA, 58 nt, Homo sapiens
guuggcugugggugugggaguccuccucggagagccuggucugacagccccagucaac

SEQ ID NO: 2240841 - RNA, 77 nt, Homo sapiens
gugcuuaggagacuggauaucucuuuugcagcucuaguuuuauacuaugaaggggguacuuuucgguuccuaggugu

SEQ ID NO: 2240842 - RNA, 57 nt, Homo sapiens
uagcagaauaacuugccagccuuaaugaguaccuacuauaggccagguauugugcua

SEQ ID NO: 2240843 - RNA, 80 nt, Homo sapiens
auaaugucucuaugguuucuccauaucaucagaugugucagaauuuuauuugauuuugugguuagauaauaguccauugu

SEQ ID NO: 2240844 - RNA, 85 nt, Homo sapiens
gugggauucuugcaaggaaaugugacagguagguaauuuuugcucuaaaacagcaacugucugucuuuucuuaagacacucccac

SEQ ID NO: 2240845 - RNA, 126 nt, Homo sapiens
cugcagccaaauucuacuguauagccacaagcuucaugugaguagagaagcaauuguagcagcauguugguaguuucuguaucucacagcuccagguuguguucuggaagucaaccauuccugugg

SEQ ID NO: 2240846 - RNA, 72 nt, Homo sapiens
aggccauauuaauuacacaggaugagaauguuuacaccauuaaguucuacuccaguguuauaauaugcgucu

SEQ ID NO: 2240847 - RNA, 55 nt, Homo sapiens
cuuggcacucuguggaguuaggguaugugccuuggcuuccugauuagaguccaag

SEQ ID NO: 2240848 - RNA, 98 nt, Homo sapiens
cuaaacauaauuaaaugguagagcuuauuuucaaguuuugcuuauuuuuauauguaaagcuuggauuuaggcuaauaaaaaucaggaaauuuguuuag

SEQ ID NO: 2240849 - RNA, 56 nt, Homo sapiens
cagagauaccaauucucuugaggcuguugaguaucacuagagaauagguaguucug

SEQ ID NO: 2240850 - RNA, 61 nt, Homo sapiens
auaauuggcaguaguggcuaacagaacccaggaaaacaguuuacuuacuacugccuauuau

SEQ ID NO: 2240851 - RNA, 61 nt, Homo sapiens
caaggcuccucucgauaaugacuguuggcuucuccccuuccuagucaugugaggacccuug

SEQ ID NO: 2240852 - RNA, 56 nt, Homo sapiens
cugacauuuuauccugaaggcauguugaggaaguaugagcuaggacagaaugucag

SEQ ID NO: 2240853 - RNA, 84 nt, Homo sapiens
uccaagaagcauaggguguucuaguuacuauggcugcaaaucaaaauauaguagcaugaaacagccauuuguuaugcucaugga

SEQ ID NO: 2240854 - RNA, 57 nt, Homo sapiens
caagcagauauuuuagucaagaauuccagagaaggcugcuccuaaaaugucuacuug

SEQ ID NO: 2240855 - RNA, 77 nt, Homo sapiens
cuauucacagucaaaguaaucauagacauguagcuuacuacuaccauuuugucgauuguuuucugauuguuuuguag

SEQ ID NO: 2240856 - RNA, 93 nt, Homo sapiens
caauaugaagaaaaagucaagaaucucagcaucuuuggcucugacaucauagauggaaaaggcuugguucuuugaugacauuuuugaguauug

SEQ ID NO: 2240857 - RNA, 78 nt, Homo sapiens
cuuggguuuugccauauagauaaccagcuaaugcuucugacuuuucugcauagauuguuuaaguggcacacaucaaag

SEQ ID NO: 2240858 - RNA, 60 nt, Homo sapiens
gagcuaagggaggaagcugugcagggugaggucaucccccucacgguccucccugggcuc

SEQ ID NO: 2240859 - RNA, 60 nt, Homo sapiens
ggucuagagagagggguggacuguauccucuagaccagcaguccccaaccuuuuuggacc

SEQ ID NO: 2240860 - RNA, 80 nt, Homo sapiens
cagccaggauuugguguucuggcucaagagucugugcugucaaccacuacaucguugagaaaaggcaccaagcugggcug

SEQ ID NO: 2240861 - RNA, 63 nt, Homo sapiens
ucuuagauauguauauagauuuaagcuaaauauuuguguguauguuuauaugcauguguagga

SEQ ID NO: 2240862 - RNA, 67 nt, Homo sapiens
uggcaguguggcaggugggggcucagagcuggggccaccucgugguuccccacuugcuaacuugccg

SEQ ID NO: 2240863 - RNA, 76 nt, Homo sapiens
uuuaugacuugauacauguuuuugaacagcaacaaccuaaguuaaagugacuuuaaaaaauguacucggucauaga

SEQ ID NO: 2240864 - RNA, 127 nt, Homo sapiens
aggaaguucuuuuguauuaauauuauuaauuuucugagugcuuugauuauaaaaggguguuugauuuugucaagugccuuuuugugugucaauugaaguuauuauguguuuuguuucccuucuuucu

SEQ ID NO: 2240865 - RNA, 79 nt, Homo sapiens
guuguuacaaugaauauguacucauguguugcuuguagaaauucuggagugcaguggcauggucauaacucauagcagc

SEQ ID NO: 2240866 - RNA, 58 nt, Homo sapiens
acccaguaauuggaggcuguggugaacuaugaucacgcuacugcacuccauccugggu

SEQ ID NO: 2240867 - RNA, 64 nt, Homo sapiens
auugugaauagugccgcaauaaacaugcgugugcaugugucuuuauagcagcacgauuuauagu

SEQ ID NO: 2240868 - RNA, 78 nt, Homo sapiens
agcucacaucuauuucugcuaauaacaaucccacugcuaauuaugggaugugguaguuauagugauaagagaggagcu

SEQ ID NO: 2240869 - RNA, 119 nt, Homo sapiens
gauguaaaagauuaaaaaaugauacacuugugacgggcacuuaccaugaauggaacuugcaggacugaaaguugcuuuagguaagucaauggguacugagugugaagcucuuggacauu

SEQ ID NO: 2240870 - RNA, 63 nt, Homo sapiens
uacuugaucaaugugguacuugaucaaugugauacucgaucaaugugguacuugaucaaugug

SEQ ID NO: 2240871 - RNA, 85 nt, Homo sapiens
acauuagaaagaccauuuaucaugacuaaguuguauuuaucccagagaugcaaggaugguuagauauaugcaaaucaaucaaugu

SEQ ID NO: 2240872 - RNA, 125 nt, Homo sapiens
ccucggccucccaaagugcugggauugcaggcaugagccaccgugcccggccccugauuaaaaaauuucaagcagaccagcacaggggcucacgccuguaaucccagcacuuuggaaaaccaagg

SEQ ID NO: 2240873 - RNA, 79 nt, Homo sapiens
gcagggucuugggcauccugugugcugaggacagagcugagcuuauagucacugugcaugaaggaugcugugauucugc

SEQ ID NO: 2240874 - RNA, 64 nt, Homo sapiens
cugugaggaaugucaaugguaguuuaaugaaaauagcauugaauccauacauuucuuuaggcag

SEQ ID NO: 2240875 - RNA, 56 nt, Homo sapiens
uauguagaauugauugcucacuugagauuuggagugagaaucaucauggcugcaua

SEQ ID NO: 2240876 - RNA, 83 nt, Homo sapiens
gugguuaggaugguuuuggugaugagagaugaugaaacuucauuggaauuucauugcugcuuaucuccagagaggucaaccac

SEQ ID NO: 2240877 - RNA, 88 nt, Homo sapiens
uuaugauaguuuacugagaaugaugauuuccaauuucauccaugucccuacaaaggaaaugaacucaucauuuuuuauggcugcauag

SEQ ID NO: 2240878 - RNA, 73 nt, Homo sapiens
gcuggccauggcccugggcugggcgaacaugcucuacuauacgcgggguuuccaguccaugggcauguacagc

SEQ ID NO: 2240879 - RNA, 55 nt, Homo sapiens
uguucucacucauaugagggagcuaaaauaguugaucucauagagguagagaaua

SEQ ID NO: 2240880 - RNA, 67 nt, Homo sapiens
ucugggaugguggaugucaguggacaguuuucuggaacagucgauuccaguggguuuacaucccaga

SEQ ID NO: 2240881 - RNA, 70 nt, Homo sapiens
guggcuccuuggaguauugugaccuaaugcaggccuguauauguguuaaucucaaguacucucagcucac

SEQ ID NO: 2240882 - RNA, 74 nt, Homo sapiens
ucuugguaacaauuucugucucagguuguuugugcugcuauaacagaauaccugagacuaggcauuuuauaaga

SEQ ID NO: 2240883 - RNA, 105 nt, Homo sapiens
auccacauuuuuagguaucuuuauggcaaugccccacuccuacauaccaauuuuuuguguuaguccguucucacguugcuaguaaagaacuaccugagacugggu

SEQ ID NO: 2240884 - RNA, 56 nt, Homo sapiens
gaaaggaguaaguagguaaaucuugcaaaaugugccuaugaucacuugcuucuuuu

SEQ ID NO: 2240885 - RNA, 64 nt, Homo sapiens
uugaaauaucucgucuucuacguuucuuuaagggaagcuuugaaguagaaagacgaaauuuugg

SEQ ID NO: 2240886 - RNA, 85 nt, Homo sapiens
uguuuccuugguugugcuucaacuucuaaaauauguuuuuucuaugaacauuuuaaugagggguuggacauaagacagaaaaaua

SEQ ID NO: 2240887 - RNA, 63 nt, Homo sapiens
uaucugugguuguaugcauauuacaaucaagccuuaagcuaguaaaguauaucaaccuagaug

SEQ ID NO: 2240888 - RNA, 80 nt, Homo sapiens
uuuaaugugaagugaagacucacagaaggccuggacagcugccugguccuuccugagucuuugaagcuuccaucauugaa

SEQ ID NO: 2240889 - RNA, 59 nt, Homo sapiens
gguauugaauuuuuaagcccuuugauagcucuuccaauugggaauaaaauucagugucc

SEQ ID NO: 2240890 - RNA, 89 nt, Homo sapiens
cuugauuugaaaaaaaugcugcccugauuuuacauauauccaggauggauaugucuauuauuagggcagguuaugagggauaagucaag

SEQ ID NO: 2240891 - RNA, 66 nt, Homo sapiens
uggccucccaaaguguugggauuacaagugugagucaccgugccuggucccaugaacuuuagguca

SEQ ID NO: 2240892 - RNA, 105 nt, Homo sapiens
cccaauuguuuguguguauuuaucuaagagguagaagcuugccuucuauucuuccugugagguagaagcuugccuucuauucuuccugugugcauaaauguuggg

SEQ ID NO: 2240893 - RNA, 101 nt, Homo sapiens
gaagaagguggcgccauaacaggggauugauuggaagucucuugaguucaauugcaagauccuacaguccauucuuuguggccaggcaaucaucuuucuuc

SEQ ID NO: 2240894 - RNA, 77 nt, Homo sapiens
uguaaacuugccaggcaccaaaguaugcuuuaggauaucaccaugacuagugcccuuugcugccugccaugguuaca

SEQ ID NO: 2240895 - RNA, 55 nt, Homo sapiens
ugaucuguguauauugaaccagccuugcaucccuggaucaaauuacacuugguca

SEQ ID NO: 2240896 - RNA, 61 nt, Homo sapiens
uggaaucaugugcucuguggcauuuugugacuagcuuccuucacugagcaucaugguuuca

SEQ ID NO: 2240897 - RNA, 97 nt, Homo sapiens
augguuauuaugagguggggguuuuccugcacaagcucucuuuuugccugaugccaaccagguaagaugugacuugguguuccuugccuucugccau

SEQ ID NO: 2240898 - RNA, 74 nt, Homo sapiens
uuuuaaaaauggcaugucguuuuucauaggaucagaguggcuauguuuuaaagaggaaugacauggcacuggaa

SEQ ID NO: 2240899 - RNA, 102 nt, Homo sapiens
uugagacagagucucgcucugucacuaggcuggagugcaguggcgugaucucggcucacugcaaccuccgccuuccggguucaagcgauucuccugucucag

SEQ ID NO: 2240900 - RNA, 92 nt, Homo sapiens
cuaacaggugugaggugagaucucauuaugguuuuaauuugcauuucccugaugauuaguaauaaugagcauuuuuuucauauaucuguuag

SEQ ID NO: 2240901 - RNA, 87 nt, Homo sapiens
uugcacaauuccaggaggcagcauucgcauagacagccuaccugugaucagccugggaugugacuguugcccccaugaguuaugcaa

SEQ ID NO: 2240902 - RNA, 55 nt, Homo sapiens
augauuccacuuucuaagaggggcuacucuagauacuucacagaaguggaaucau

SEQ ID NO: 2240903 - RNA, 64 nt, Homo sapiens
uucgguuugccaguauuuuauugaggauuuuugcaucgauguucaucagggauauuggccugaa

SEQ ID NO: 2240904 - RNA, 69 nt, Homo sapiens
ucagcagugacccaguguugggcagaacuguggagccccaauuucugcugagcacugggccugugcugg

SEQ ID NO: 2240905 - RNA, 87 nt, Homo sapiens
ggagaaucacuugaaaucaggaggcggagguugcagugagcugagaucgcaccacugcacuccagccuguugacacagugagacucc

SEQ ID NO: 2240906 - RNA, 81 nt, Homo sapiens
auucccucuucaccaguuuggcagucucaucuucagagcaaaagauacggugugaggcugaaacuggcgauagagugggau

SEQ ID NO: 2240907 - RNA, 70 nt, Homo sapiens
accuugucacggagauauggauucggauguguucccacggucuccaaucucuaguuccaugauagaaggu

SEQ ID NO: 2240908 - RNA, 86 nt, Homo sapiens
gcuuucuacuucuaguaguuaaagucggucacuugcagauguuuuccauuggugacuauugauuuagacgugcugagagagugagc

SEQ ID NO: 2240909 - RNA, 71 nt, Homo sapiens
augcuugugaaguuuucagaaauugcaucaaaauuaagcaauuaacuguggaaaugacuuuaaacaagcau

SEQ ID NO: 2240910 - RNA, 88 nt, Homo sapiens
ggagaauugcuugaagccaguaggcggagguugcagugagccaagauggcgccauuguacuccagccugggcgacagagcaggacucc

SEQ ID NO: 2240911 - RNA, 87 nt, Homo sapiens
gccacuuuuuugucagguauguuccaaaggcggagcuuuccauccaaagacccacuuagaaaauaccugucauccuaaagagguggc

SEQ ID NO: 2240912 - RNA, 87 nt, Homo sapiens
ugcuguugccuuugauacugguuuuugucauguggaaagagugaugagaaaucuuuuugugaggaaacuguaucuguggccaaggua

SEQ ID NO: 2240913 - RNA, 68 nt, Homo sapiens
ggguacaugugcacaacgugcagguuuguuacauauguauaaaugugccauguuggugugcugcaccc

SEQ ID NO: 2240914 - RNA, 60 nt, Homo sapiens
agauucuuaauugguuuucacccaguugcaauugucacauuggugagaaauuaugggucu

SEQ ID NO: 2240915 - RNA, 76 nt, Homo sapiens
agaggauccuagugcacuacuugugggaauguaaguugguacugucauuacgaaaauuaguguacagguuuccuuu

SEQ ID NO: 2240916 - RNA, 57 nt, Homo sapiens
ugaucuuuugcagucuucaguggggucaauccccaacugagccuuuaaaugacuuca

SEQ ID NO: 2240917 - RNA, 56 nt, Homo sapiens
gugugacagcuauagacaugauauauuuuaaaguuucaucuguaguauugucauau

SEQ ID NO: 2240918 - RNA, 67 nt, Homo sapiens
aagcaauauaagugcaacauaaguguuaaacacaguuuaagcauagauguuguacucuaaaauguuu

SEQ ID NO: 2240919 - RNA, 99 nt, Homo sapiens
ugagacagucucacuguguugccuaggcuggagugcaguggugugauuucggcucacugcaaccuccgccucccagguucaagugauucuccugucuca

SEQ ID NO: 2240920 - RNA, 77 nt, Homo sapiens
ccuuggcucaaaaccuuccaguggcagccgggcaugguggcucauaccucucaucccagcacuuuuggaggccgagg

SEQ ID NO: 2240921 - RNA, 83 nt, Homo sapiens
caucaaugacaacaugaaaagugucacagagcaugccaagcucucguuuuucaucuuuggauacuugauauaguggaaugaug

SEQ ID NO: 2240922 - RNA, 69 nt, Homo sapiens
ucuuuauagcagugcccaacuccuggcaccaauuuacuguguuaguuuguucacacacugcuauaaaga

SEQ ID NO: 2240923 - RNA, 73 nt, Homo sapiens
uuggcauauggcuucuuacucuucugcauguuccgucaugaaacaugcaugagucaaaagagggcagcuccaa

SEQ ID NO: 2240924 - RNA, 65 nt, Homo sapiens
gugucugacucauaguuaaguguucaauaaauauuuauugaguaaaaaauagugaugucauucau

SEQ ID NO: 2240925 - RNA, 60 nt, Homo sapiens
ccaaaugccuaagacccugugggggaguaguaauauaauccccaacagguucuuaguugg

SEQ ID NO: 2240926 - RNA, 128 nt, Homo sapiens
cuuggccucccaaagugcugggauuacaggcuugagcaccaugccuggccauguacauuucaaaaauaauuaccauagccagccacgguggcucaugccuguaaucccagcacuuugggaggaccagg

SEQ ID NO: 2240927 - RNA, 63 nt, Homo sapiens
gauauggucaaagucacaaucucacuuggcugaacucucaagcugugugacauugagcauguc

SEQ ID NO: 2240928 - RNA, 74 nt, Homo sapiens
gucauguguacacguggcuguguaggaguguggcaugugugugacugggacccugugucauguguacacguggc

SEQ ID NO: 2240929 - RNA, 88 nt, Homo sapiens
agucuggagaaacugucugcugccuuuuguucagauacgcccugcccucagagguggaaucuagagaggcaguaggccuugcuaggcu

SEQ ID NO: 2240930 - RNA, 81 nt, Homo sapiens
augguggagagcagagaagggaaauaagcucucuugugacucuuauaagggcacuaaucccauuuaugagggcuccaccau

SEQ ID NO: 2240931 - RNA, 63 nt, Homo sapiens
ccugugguuaaccagcuagauggacagaggaugaccagcaggguguggcuggcuggcuacagg

SEQ ID NO: 2240932 - RNA, 83 nt, Homo sapiens
acacauucacauauauacuuuuaguguaagguuuccaugauuaauuacuaauacacuacuggguauauguguuugacaagugu

SEQ ID NO: 2240933 - RNA, 66 nt, Homo sapiens
cucugcguaauuauuccuaagccaugacauguuuugcuuauguacccuuagagagugaucgaagag

SEQ ID NO: 2240934 - RNA, 62 nt, Homo sapiens
uuacacucaauuuaugugugugagggucuauucaauuuuaucacauguguaaauugguguaa

SEQ ID NO: 2240935 - RNA, 80 nt, Homo sapiens
uucuggcagcaugguauuuaacagucuuucuauuuaaaauguacuuagaaauguaugaguacuucaggcuuuaaccagaa

SEQ ID NO: 2240936 - RNA, 61 nt, Homo sapiens
cuuaaaggacaugauuucaucugaagguaaaugagacuagauggcauuucaguucuuuagg

SEQ ID NO: 2240937 - RNA, 62 nt, Homo sapiens
cugaauguuucacucugaaaugggaguccuuggaggguuuugagcagaggagagacauucag

SEQ ID NO: 2240938 - RNA, 59 nt, Homo sapiens
uauauuucauaacucaauccaggugucaaaauguacuuccuggguagugaugagacaua

SEQ ID NO: 2240939 - RNA, 69 nt, Homo sapiens
agacuugguuaaaacaccaauccuaagaagacuuuguuuugaacuucuuagguagaauugauuaaguuu

SEQ ID NO: 2240940 - RNA, 76 nt, Homo sapiens
ggaagaugggugguccuuacaggaggcuuacucauaggugugaagugaccucauuacggggccugcuccaucuuuc

SEQ ID NO: 2240941 - RNA, 72 nt, Homo sapiens
uuucccugcugaucauaugacaacuaugcauguauauacauacaagcacaaaugcauagauggguagagaga

SEQ ID NO: 2240942 - RNA, 62 nt, Homo sapiens
ucuggaguugagagugugcgagugaaaaccagcuucaucgcauuucccucuguagcuucaga

SEQ ID NO: 2240943 - RNA, 57 nt, Homo sapiens
ccuggcagaaugacugcuuaaauccugagaacagauuuaucccagugucucugcagg

SEQ ID NO: 2240944 - RNA, 88 nt, Homo sapiens
gguuuuccucauguuucuugucauugcaguaagagugggcucuugaaguuucccaagggucuuacuuuccuguagucaugggaaggcu

SEQ ID NO: 2240945 - RNA, 67 nt, Homo sapiens
agcauuaugccucuucauaaaguaugaacuuaaauuuuucaugcguuagagaauugggguuaaugcu

SEQ ID NO: 2240946 - RNA, 72 nt, Homo sapiens
aaggaacacuuuuacacugcuggugggaauguaaacuaguacaaccacuauggaaaaguguaaagauuccuu

SEQ ID NO: 2240947 - RNA, 93 nt, Homo sapiens
gaugccugccacuccugcgccaugcacucgcauuccucagcccuuggguggucgaugggacugggugccguggagcaggggguggcgcucguc

SEQ ID NO: 2240948 - RNA, 66 nt, Homo sapiens
ccugagcaauauagugagaucuugucucuuaaaagaaagaaaaguuguuauacuuuauuguuuagg

SEQ ID NO: 2240949 - RNA, 126 nt, Homo sapiens
gcauaguauuccaugguuguauguaucacauuuucuuuauucaauaugucauuggcaggcauuuagguugauuccaugucuuugcuauugugaagagugcugcaaugaacauucgugugcaugugu

SEQ ID NO: 2240950 - RNA, 111 nt, Homo sapiens
cacugccuggauguuugguagacuugaauagcauguuuagugcauaugaguuuaucuuucagauuuucauguauaugcaugcauucaaaggcuauaaaaauuccuccagug

SEQ ID NO: 2240951 - RNA, 86 nt, Homo sapiens
aggacugaaaauuguacccuuugucaaucaguacuaaccaguaacuuuuugcucauugggggaaugauaaaggaauucuuaguucu

SEQ ID NO: 2240952 - RNA, 75 nt, Homo sapiens
ugccauaauaggguuccuguggaggaacugugaauuuuacagaguguuuuucaugggauacuuuuuauuguggca

SEQ ID NO: 2240953 - RNA, 70 nt, Homo sapiens
cagcuuugugauuuccaugagaacaugccuggcuugcuugcuguaagaugaggcacauggagcagagcug

SEQ ID NO: 2240954 - RNA, 64 nt, Homo sapiens
ucucauugaagggaucuaauaggugaauucucauucaccuguagcaugcccuuggaugcacaga

SEQ ID NO: 2240955 - RNA, 55 nt, Homo sapiens
uugagauggagucucgcucugucacccaggcuagaguagagcggcucgaucucag

SEQ ID NO: 2240956 - RNA, 65 nt, Homo sapiens
uaugagcuguuuggaagacacuugaugguuaaugcaaaucaggguggauccuuaaauaguuuaug

SEQ ID NO: 2240957 - RNA, 76 nt, Homo sapiens
ucagaggcuagcaucauaccaaucugguccuucuuguaugaagccaugagucuuuggcuggugccaguuucucuga

SEQ ID NO: 2240958 - RNA, 89 nt, Homo sapiens
uaauuuuagguagaauccaaguagucauuuuuaagaacuggaagaucuuuguuuuuggguaaugauuaucaauaauucccacaaaauua

SEQ ID NO: 2240959 - RNA, 84 nt, Homo sapiens
uucucagcuugacuuuucccuuuagcuuagugauuuuggggcacucaaggaacacugcagacagaggggcacguuuugugggaa

SEQ ID NO: 2240960 - RNA, 86 nt, Homo sapiens
auuagauuuagcucauuugaugcaucucuacuuuguuccugcuucugggaagagagggacuuauuaaagucuagcauaaaucuggu

SEQ ID NO: 2240961 - RNA, 59 nt, Homo sapiens
uuaauauauuaugugguuucccuauccaaugaacuuggauagggcuuguugauaguuaa

SEQ ID NO: 2240962 - RNA, 82 nt, Homo sapiens
guauguugcccaggcuggagugcaguagugauucacagaugugaucauugcacaucacagccucaaauuccugggcucaagc

SEQ ID NO: 2240963 - RNA, 84 nt, Homo sapiens
cacaaagggccuccuauucuaugauuccgcuuaugugaaauguccagaauaugcaaauccauagagacagaaaggagauuugug

SEQ ID NO: 2240964 - RNA, 63 nt, Homo sapiens
aucauccugucaggagcugugaccaauucucaacccuacaaauggcacagaucucaagaugau

SEQ ID NO: 2240965 - RNA, 62 nt, Homo sapiens
uugugaauagugcugcaauaaacauacguaugcauguaucuuuagaguagcaugauuuauaa

SEQ ID NO: 2240966 - RNA, 58 nt, Homo sapiens
gcauauuguguauauuuugggguuacaugugauauuuugauacauauaugcaaugugu

SEQ ID NO: 2240967 - RNA, 60 nt, Homo sapiens
cccacggucacugugcaguucugugcccgcagguacacaugcuccacuguggccucuggg

SEQ ID NO: 2240968 - RNA, 70 nt, Homo sapiens
ggggguguuggcuaccuggguguauguucaguuugugaaaauucacggagcgccuaagcuaugcacccuc

SEQ ID NO: 2240969 - RNA, 60 nt, Homo sapiens
cuugccuacucacugguuuacuaucaaugaggaugggagaucagacagauuaggaucaag

SEQ ID NO: 2240970 - RNA, 67 nt, Homo sapiens
gcuugcagaggcccuggggagaguaggcgcccccacucugcagccucccccaccuuccucugcgagc

SEQ ID NO: 2240971 - RNA, 79 nt, Homo sapiens
ggggacagguucagauucucagauucuuacagcucugcagauucagcagggugugucuugagagucucgagaaguucuc

SEQ ID NO: 2240972 - RNA, 64 nt, Homo sapiens
ggguugaagucuauuccuuuuuaacugcguguuugucuugcauuuuuggaaugaauuccagccc

SEQ ID NO: 2240973 - RNA, 76 nt, Homo sapiens
ucacucuguugcccaggcuggagugcaguggcaugaucucugcucacugcauccuccaccugccaggcucaaguga

SEQ ID NO: 2240974 - RNA, 77 nt, Homo sapiens
guggcugauguguacuguguaguuagaccucagacgguugcaucugugcugaacauacacggaccuuuucuugucau

SEQ ID NO: 2240975 - RNA, 79 nt, Homo sapiens
uucugaagaagauaauuaugccucuuccugggguuauggggagcuucgcuaggcaagagguaucuuauuuuccccggga

SEQ ID NO: 2240976 - RNA, 83 nt, Homo sapiens
gcuggaucauugggaaggugguauuucaaaguggcagggaaauaacuugaaagcucugaaauccauugugaaugugagccagc

SEQ ID NO: 2240977 - RNA, 62 nt, Homo sapiens
uuccuguuuuggcucaugacacaugaaggaauuuccagugucaugguagcaaggacgaggag

SEQ ID NO: 2240978 - RNA, 102 nt, Homo sapiens
ugaggcaggagaaucacuugaaccccguagguggagguugcagugagcugauaucacgccauugcacuccagccugggcuagaagagcgaaacucugucuca

SEQ ID NO: 2240979 - RNA, 64 nt, Homo sapiens
ugaagugggaaaugaguauuaagcaaauaaauagacacaggcuguauacuuauuuauuauuuca

SEQ ID NO: 2240980 - RNA, 72 nt, Homo sapiens
gcuugagcccaggaauuggaggcugcagugagcuacgaucgugcuauugcacuccagccugagcaaaagagc

SEQ ID NO: 2240981 - RNA, 124 nt, Homo sapiens
ggacuuaguucucauuuuccuccccuguuuucuccggauuguggcuauuguucccugguugcuagaucaaccuggagcacaguaaagcagugucacaaagcuggaaggggucugggaugagucc

SEQ ID NO: 2240982 - RNA, 85 nt, Homo sapiens
cuuugaauugugacuaggagauauguuuucuucagcuuuggcugcaucaaggagaagauacaaauuucuuagaugcggaucaaag

SEQ ID NO: 2240983 - RNA, 130 nt, Homo sapiens
agacaggauacuggcuuugacgucagaaacuugggguagaauagaauugauaucacaggauaaccaugugaugucgagaauucaccucaacucaaaccucuggccuccuugagcccugaccuccuuaucu

SEQ ID NO: 2240984 - RNA, 76 nt, Homo sapiens
caaauggcuagauauccagaguucugagaccaggucugaccugggagcagagaagagcugauguuuaagcuguuug

SEQ ID NO: 2240985 - RNA, 61 nt, Homo sapiens
ucauaggucugagaagaaaauaacuugaccaaauuuggcuuucuuuuuauuaggcuuguga

SEQ ID NO: 2240986 - RNA, 63 nt, Homo sapiens
caugccagagacuggguaauuuaugaagaaaaagagguuucauggacucaauaguuucgcaug

SEQ ID NO: 2240987 - RNA, 64 nt, Homo sapiens
uucaguuugccaguauuuuauugagaauuuuugcauugauguucacaagaaauauuggccugaa

SEQ ID NO: 2240988 - RNA, 92 nt, Homo sapiens
aagaucaaaguauugacaaguuugauuuauuccaaggccuuucuacuuggcuuuuagugauggcagccuuaucacuaucuucaccugaucuu

SEQ ID NO: 2240989 - RNA, 58 nt, Homo sapiens
uucauuguagcaaauguguaaacaaauguguauuuguuuaagaauuugcugcaaugaa

SEQ ID NO: 2240990 - RNA, 130 nt, Homo sapiens
ugaaugaauaagauacuaggaaaaugaugaaguacugugauacuguacugaaguacccauuuaguacagcgauacuaaaguacuaaaguaaguauagugauacagaugaaaucagauaucauuucagaaa

SEQ ID NO: 2240991 - RNA, 62 nt, Homo sapiens
gaaagugcugagacagacugggaagccuuuggcuaccggcuuccacugucccuggcacuuuu

SEQ ID NO: 2240992 - RNA, 90 nt, Homo sapiens
uugacuggaauggacccaaggaauacccucccuuuuugccuauugaagaggcuaagcaggagaugggugcuuuucauguuagccagucaa

SEQ ID NO: 2240993 - RNA, 112 nt, Homo sapiens
ucagaucaauaguagcaaauucucauaggagcacgaacucuagugugaauugugcauauaaagggaucuacacugugugcuccuuaugagaaucugaugccugaugaucuga

SEQ ID NO: 2240994 - RNA, 78 nt, Homo sapiens
guccaaucaacucuguaggauccagguggacccagaaauggaaccagugaccaucuggagacugaccagaggcaggau

SEQ ID NO: 2240995 - RNA, 60 nt, Homo sapiens
aaguugcaagauguucaugggcuguuuugauaauagagagaacacgugcaucugcaauuu

SEQ ID NO: 2240996 - RNA, 76 nt, Homo sapiens
uguaaugaucaaaucagaguaauugagaucuucaucaccucaaagcuuuaucuuuacuuugugugggaacauuaca

SEQ ID NO: 2240997 - RNA, 62 nt, Homo sapiens
gugagggaugugaaaaaggucagucuacuguuuuacaauucuuaccuguuggcaucuuucac

SEQ ID NO: 2240998 - RNA, 90 nt, Homo sapiens
uguucagauuuuaaaauaacuucuacagaauauguuugagguauuuucuuaaugaacuuuauuuuguagagaaguuuuagguucccagca

SEQ ID NO: 2240999 - RNA, 70 nt, Homo sapiens
ggucagacaacugaguaaccaaaugguuucgccuacuuauuugguuauucaguuguucaguuucuugacc

SEQ ID NO: 2241000 - RNA, 77 nt, Homo sapiens
ggaggcugaggugggaugaucaccugaaccugcggaagucgaggcugcaaugaacugugaucaugucacugcacucc

SEQ ID NO: 2241001 - RNA, 78 nt, Homo sapiens
accaagugagcuaguagagugcacccggcuuuccugugucuucugggguguugcuggggcucugcuguuucgucuggu

SEQ ID NO: 2241002 - RNA, 103 nt, Homo sapiens
gggaugcugaggcagaauugcuugaacccgggaggcggagguugcagugagcugagauugcaccacugcacuucagccuguugacagagcgagacuccaucuc

SEQ ID NO: 2241003 - RNA, 67 nt, Homo sapiens
gaaguuaugaaaucuuuccugugaggaucagauacaugucauuuccaucugaaguuuucaggacuuc

SEQ ID NO: 2241004 - RNA, 92 nt, Homo sapiens
aaggacaaggaauaugaaagaagaguaaguagguuacuuaguagggaaguaacuaagcuaauguguuuucucuuaauuguugaccuguucuu

SEQ ID NO: 2241005 - RNA, 62 nt, Homo sapiens
caggaaugcagguguuuugcacugaguugucacagcuacuguaugacugaccuguaaaccug

SEQ ID NO: 2241006 - RNA, 55 nt, Homo sapiens
cugucuguuucaaaagugguuauccuucauugagcaccaaaugugcaacaggcag

SEQ ID NO: 2241007 - RNA, 97 nt, Homo sapiens
ucucauuuuucgccuuuuauugcaagugccguaacuaccaagaucccaauuuuagaagaucuaguccauagcauuugauaacaggccaaagaagaga

SEQ ID NO: 2241008 - RNA, 103 nt, Homo sapiens
ugguuuacagaaauaacauugauuagugauugguauacauuguuaaccuguaggguaugggugauaguguccugugccacauuguuacguuaauuuauaacca

SEQ ID NO: 2241009 - RNA, 73 nt, Homo sapiens
cuacacagagguauggcaauuucagagucauuccuucggccagaaaacucauugcucauaccuuaucuuguag

SEQ ID NO: 2241010 - RNA, 55 nt, Homo sapiens
uuggcauuguccaauuucugcccugaaaauucagguucggaaaugcaauggcuga

SEQ ID NO: 2241011 - RNA, 59 nt, Homo sapiens
cugacugcauuugccccaucgaauaagcucuaagcuaauauucugacuuaugcaguuag

SEQ ID NO: 2241012 - RNA, 58 nt, Homo sapiens
ucaguucuaguuuauugguucuguuugggaguaacgagcccaguguugccagagcuga

SEQ ID NO: 2241013 - RNA, 79 nt, Homo sapiens
uguaacucaggauuccauuuguggcuauuuacuuuagagaaacucaugugcaugggcauaagggaauccauuuauuaca

SEQ ID NO: 2241014 - RNA, 70 nt, Homo sapiens
uagguuugugcaaaaguaauugcgguuuacuuuccauggcaaaagcugcaauuacuuuugcaccaaccua

SEQ ID NO: 2241015 - RNA, 56 nt, Homo sapiens
ugacaagagaccccuccgcaggcgcaguugcuagucuuuaaggggccuuuguguca

SEQ ID NO: 2241016 - RNA, 64 nt, Homo sapiens
gacaggugagcuuucucauccgacuucauacccuuuuguuguugagauagggucucacucuguc

SEQ ID NO: 2241017 - RNA, 58 nt, Homo sapiens
augaauagugcugcaauaaacauacaugugcaugugucuuuacagcagcaugauuuau

SEQ ID NO: 2241018 - RNA, 75 nt, Homo sapiens
uggaaaaaggauuuaagcauuucauaugacaugauuucgugucaaacauuaugaugcucuagauuuggaagucca

SEQ ID NO: 2241019 - RNA, 57 nt, Homo sapiens
ugucaucccuaaaguugaggugauaauuacaguacuugccuuaacauugggaugaua

SEQ ID NO: 2241020 - RNA, 62 nt, Homo sapiens
ucaguuugccaguauuuuauggaggauuuucguauugauguucaucaguuauauuggccuga

SEQ ID NO: 2241021 - RNA, 57 nt, Homo sapiens
auuugggaagggccagggguagaauaauauaguuuggauauuugucccuucccaaau

SEQ ID NO: 2241022 - RNA, 67 nt, Homo sapiens
ggguacaugugcacaaccugcagguuuguuacauauguauacaugugccauguuggugugcgcaccc

SEQ ID NO: 2241023 - RNA, 63 nt, Homo sapiens
ucaacucucugugugacccuuucucugagccucaguuucuucccugggaauauggggaguuga

SEQ ID NO: 2241024 - RNA, 83 nt, Homo sapiens
cacgcaggaggcagugcagugcagugguuaggagccaggcagcuuggguuugcauccuggcucugccacuuacugccugugug

SEQ ID NO: 2241025 - RNA, 70 nt, Homo sapiens
auguaugucuugucuauggcugcuuuuguauuauggcagcuaaaccgaguagcuaucacagagacuacau

SEQ ID NO: 2241026 - RNA, 66 nt, Homo sapiens
ucccaaugagaugagccggggaccucaguuggaaauaacccaccuucuguguugaucucacuggga

SEQ ID NO: 2241027 - RNA, 58 nt, Homo sapiens
gaguaacaugaacuuucaaauauggacuuuucuuaagcccuuuggcuguucaugacuc

SEQ ID NO: 2241028 - RNA, 77 nt, Homo sapiens
ggaagaguaguuuuguuuaaaaauuuugggacagcagaaagauauguaaguucuggcuuauaaacgugacuucuucc

SEQ ID NO: 2241029 - RNA, 77 nt, Homo sapiens
cuauuaggucugugcagcagugauugcgguuuuugucauuacuuuuuacugcaauuacuguuguaccaaccuaauag

SEQ ID NO: 2241030 - RNA, 82 nt, Homo sapiens
uugcugcacugagaugagagaaugcuugccugagauguguaguucugucggggguaucuuuuucucuucaucagccaaguaa

SEQ ID NO: 2241031 - RNA, 110 nt, Homo sapiens
gaagacuuuaucuuauucaaauauguuuuaugggauuucauuaagugucugaauuaucuggaguacuuacauuuuccauuaagcuaaauugaguacuacagauaaucuuu

SEQ ID NO: 2241032 - RNA, 59 nt, Homo sapiens
aaccacauggcucaguggacauacuuauccauuaaguaugcuuauccugaccauugguu

SEQ ID NO: 2241033 - RNA, 94 nt, Homo sapiens
ucagaaaaauuacuagagacuuucucuucacugugugccucacaagcucuuaauauugcuguagcacauuugaagagaagcacuuucuuucuga

SEQ ID NO: 2241034 - RNA, 62 nt, Homo sapiens
ggagauaauccagggagggacucagcugagaacaguucccugccuucucuggaauugccucc

SEQ ID NO: 2241035 - RNA, 108 nt, Homo sapiens
cucacucagauggcuguuggcaagaggugcuguacaccagagaggccucuuuccagggcguucacagcauagcaguggauuucugccagagcaggugaucccagugag

SEQ ID NO: 2241036 - RNA, 86 nt, Homo sapiens
aggauugcuugcaccaaagagguugaggccgcagugagcugugaucaugccacugcacuucagccugggaaacagagcaagauccu

SEQ ID NO: 2241037 - RNA, 128 nt, Homo sapiens
ggcugaugaugaaaucagaaaaguaauggacauaaaaaugaaaguaugcaguguguguguguguauguacguauguauaucacaugcacucauuuucaugauguacauauggaauuucacaaccagcc

SEQ ID NO: 2241038 - RNA, 100 nt, Homo sapiens
gaggcaggagaaucgcuugaacccaggaggcggagguuguggugagcgaagaucgugccauugcacuccagccugggcaacaagagcaaaacucugucuc

SEQ ID NO: 2241039 - RNA, 71 nt, Homo sapiens
accucucugagccugagguuccuacuccauaaaaugagggagggacauuacagguuacagguaauccaggu

SEQ ID NO: 2241040 - RNA, 64 nt, Homo sapiens
agaggacaauugagacagaagcuguaguagaggucccuuuacaagaugucuguccaacacuucu

SEQ ID NO: 2241041 - RNA, 76 nt, Homo sapiens
ccuccccaggucagccugcgauguuuccccuuaguccucaugcguacugagcaucacaugggcugcuugggagagg

SEQ ID NO: 2241042 - RNA, 124 nt, Homo sapiens
aaaggcaauugccucaaguuaaggagauccaugaaagacugaggaauuggaucagauuaccucuuaaauuccuuccaaagcuuagcuuuaacguagacuccuccaaccugggggaauuuucuuu

SEQ ID NO: 2241043 - RNA, 60 nt, Homo sapiens
uguaaauagugcugcaauaaacaugcaugugcaugugucuuuagaguaguaugauuuaua

SEQ ID NO: 2241044 - RNA, 77 nt, Homo sapiens
cggguugaauaccuaggugauggguugauagguacaggaaaccacuauggcacacguuuaccuauguaacaaaccug

SEQ ID NO: 2241045 - RNA, 97 nt, Homo sapiens
gaaaguuauuaaaguagaauguuucaacccagaauguuugacauagauacacacacuaugucaaauucuggguuaaaacacugauucacugauuuuu

SEQ ID NO: 2241046 - RNA, 61 nt, Homo sapiens
aguggugauaaccacuaucauagcuaccauuaaauuauucguugugacugguugucucgcu

SEQ ID NO: 2241047 - RNA, 98 nt, Homo sapiens
ggggcugguuuacucuaauacucuauaagggaagcuguagcagcugcguuacaggagcacgguuuuuauuguauguaauuuaggguuuuuguagccuu

SEQ ID NO: 2241048 - RNA, 69 nt, Homo sapiens
aggcugaagugcaguggcacagucauggcucacugcagccgugaacugcagacaugcaucuuuaugccu

SEQ ID NO: 2241049 - RNA, 74 nt, Homo sapiens
ugagucauggagucagaagcuggcugggaccucuccgcucauuguauccaguguuuuugaauuccaggaacuua

SEQ ID NO: 2241050 - RNA, 82 nt, Homo sapiens
caugguaagagcauguaguggcucuaccuagaacuugcuuuucuuauagaccuacuaugugcuuucuuguaaaccuacuaug

SEQ ID NO: 2241051 - RNA, 58 nt, Homo sapiens
ugauuggauuguaaguuuccugaggccuucccagccauauggaacugugagccaauua

SEQ ID NO: 2241052 - RNA, 98 nt, Homo sapiens
ugacaugguggcacaugcguguaguucagcuaccugggaugcugaagugggaggaucacuugagcccaggaguuugagguugcagugagcuaugauca

SEQ ID NO: 2241053 - RNA, 79 nt, Homo sapiens
uauauacacauaugcauguguguacaugugcacacacacacuguauguggacauguauauauauguguguguguguaua

SEQ ID NO: 2241054 - RNA, 95 nt, Homo sapiens
uuaaggauguagauggaauuaaaguugcuagccggcugacuuuaagauuaucuuagauuauccggcugggacaauguaaugacaaaacuccuuaa

SEQ ID NO: 2241055 - RNA, 65 nt, Homo sapiens
uacacuggacauccuuguaucuguccuuuuguacaccugcacagguacacagaauauccagagug

SEQ ID NO: 2241056 - RNA, 70 nt, Homo sapiens
guuuugcuuuccaucugauuuuugugucugaauuucucaguugguucugaccacagacuggaaagagggc

SEQ ID NO: 2241057 - RNA, 60 nt, Homo sapiens
gcuggcaaguggccuacuuugucuugccuuugcccauuacaaagggagguuacuuuuagc

SEQ ID NO: 2241058 - RNA, 75 nt, Homo sapiens
gccuacuccuaagcaauuuguguugacgcacuguacaaacacaugucauagauugcuuggaaaaaaaucacaggc

SEQ ID NO: 2241059 - RNA, 71 nt, Homo sapiens
auccuaaaccauaucacacuccaaacagaagcugccauaacuggcaaaacggcaagugugagguuuggggu

SEQ ID NO: 2241060 - RNA, 55 nt, Homo sapiens
aagaguaguaguggcacucucuaaccauuagggacaaucuaagacuacuacucuu

SEQ ID NO: 2241061 - RNA, 59 nt, Homo sapiens
agauauuauuuucuauuuaucaacugcauucaggcagugcuaaguagaugacugaugcu

SEQ ID NO: 2241062 - RNA, 62 nt, Homo sapiens
gucauugcaaugggaaacuaugaaaccuuuagaaaacaugguuuuauggaacauuuaaugac

SEQ ID NO: 2241063 - RNA, 75 nt, Homo sapiens
agguggugggcuggauuugcuugcagaucacaguuugcugaugucugcaagucuaaacuagccaugucaauuccu

SEQ ID NO: 2241064 - RNA, 130 nt, Homo sapiens
uucuuccuuuccaguugguaugccuuuuauuucuucuucuugccuuauugaagugacuaagacucccaauacuguguugaauaagaguaguaagggcagauauucuugcuuuguucugaccccuggaaga

SEQ ID NO: 2241065 - RNA, 57 nt, Homo sapiens
cuuccauaguuacacccagggagggugagugcucucccuuucuuugucacaugggag

SEQ ID NO: 2241066 - RNA, 65 nt, Homo sapiens
aacagggacauuuugguucuaaguaccuuucaauauuguauagaacccuuugaaauguguuuguu

SEQ ID NO: 2241067 - RNA, 69 nt, Homo sapiens
uggucaaauuuccuuagagaaagguccuuugguggauacauggaucauauucuugaggaggaugggcua

SEQ ID NO: 2241068 - RNA, 64 nt, Homo sapiens
caagaggcuguguauaaagccauaacugauaaaacggcucgggauguuguaauacagcuucuug

SEQ ID NO: 2241069 - RNA, 127 nt, Homo sapiens
uaccuuuucauuuucuuuuuggcaacauuuuacuuuccagacguggauuagucgcuaucaaaauuuuauuccuaaaauguuuggaaaguggaaauagcuguggaaacugugaauagucaguaaggua

SEQ ID NO: 2241070 - RNA, 61 nt, Homo sapiens
gcuuuggugucucuucaggaacauuuuaucauuauaauguaauguucuggaggacagaagc

SEQ ID NO: 2241071 - RNA, 73 nt, Homo sapiens
gucuauaauggcacccaugcacuuucagucuugaagguucuuucuuuaaugcugcccagucaugggccaagac

SEQ ID NO: 2241072 - RNA, 55 nt, Homo sapiens
uuccacgugaaguauucuaaaggauuccugacccaugggaaauucuuauguggaa

SEQ ID NO: 2241073 - RNA, 71 nt, Homo sapiens
uagaagcagaacaagcuguugugaacuauacaucuaaugcuaauuaguauggcuuuagagcagugcuucua

SEQ ID NO: 2241074 - RNA, 75 nt, Homo sapiens
ugguaaauaucuugcaauguaauugagguuuuugccauugaaaguaauggccaaaaugcaauuacuuuugcacca

SEQ ID NO: 2241075 - RNA, 98 nt, Homo sapiens
gggacuuguucacguagacaugauugaccaucugcugggcugaccuuggucaccagcacuuccagaggucagguugauacugugugguucaaaguccc

SEQ ID NO: 2241076 - RNA, 78 nt, Homo sapiens
auagacuggcaagagugaaccagcugucuaauuuuucucuauacccucagacucuggugaagcuuuuagcuauuuuau

SEQ ID NO: 2241077 - RNA, 73 nt, Homo sapiens
guucacgaugcugguauuuggaccagccugcggguuuauccugggcucuuucuguaccaaaaucuacguggau

SEQ ID NO: 2241078 - RNA, 86 nt, Homo sapiens
uuucuuuuuaauacucuaucacuaaauaaacaccaaaaguagacuuggcucuuugguuagguuuaguugaugauuuaaguuaggga

SEQ ID NO: 2241079 - RNA, 72 nt, Homo sapiens
cuauguaccuggaacuguauuauuugaagaaagauauaucauaagcaagccagaaauaguucuugugcauag

SEQ ID NO: 2241080 - RNA, 83 nt, Homo sapiens
uauuagguuggagcaaaaguaauugcagauuugccauugaaaguaauggcaagaaccacaguuacuuuugcaccaaccuaaua

SEQ ID NO: 2241081 - RNA, 56 nt, Homo sapiens
cacacauauccuuagaagaauaauuuucuccaaauugaacuguaagggucugugug

SEQ ID NO: 2241082 - RNA, 56 nt, Homo sapiens
uuugcacauugauuuuguaucuugagacuuugcugaaguugcuuaucagugucaga

SEQ ID NO: 2241083 - RNA, 57 nt, Homo sapiens
gagaucaugcugguucucucaucuuucaauaguugcuuagauccagucauguauuuc

SEQ ID NO: 2241084 - RNA, 99 nt, Homo sapiens
uuauccauugacuaguaagccuagaaagggguugcuaagugcguauauaauuauccauugacuagcgauccccuuucuaggaacccaugucaaagauaa

SEQ ID NO: 2241085 - RNA, 70 nt, Homo sapiens
gacugguauggcauuuguggauuggccaauuuucccuugaauugcccaaacuucuguguuaauaucaguc

SEQ ID NO: 2241086 - RNA, 64 nt, Homo sapiens
uuuggacgcauuuuguaauggcaaaaacaucuucuaaaaauguaaguugcauaguguauccaaa

SEQ ID NO: 2241087 - RNA, 72 nt, Homo sapiens
accaacugaaauguccaucgacugaugaauggauaaacaaauauuuaucaauauaaugagauauuuucuggu

SEQ ID NO: 2241088 - RNA, 78 nt, Homo sapiens
gaaaggaguccaguuucaauuuucugcauauggcuagccaguucugccagcaccauuuauuaaauagggaauccuuuc

SEQ ID NO: 2241089 - RNA, 55 nt, Homo sapiens
accacccauucucugaccguggggucuguggcccacacugucuucaauggguggu
